United States Patent 7,655,785 (BIOINFORMATICALLY DETECTABLE GROUP OF NOVEL REGULATORY OLIGONUCLEOTIDES AND USES THEREOF) - sequence listing, part 22

SEQ ID NO: 883135 - RNA, 19 nt, Homo sapiens
caaauggacauaagacaga

SEQ ID NO: 883136 - RNA, 20 nt, Homo sapiens
caaauggagaaguucaggaa

SEQ ID NO: 883137 - RNA, 21 nt, Homo sapiens
caaauguaauuaugaggugaa

SEQ ID NO: 883138 - RNA, 15 nt, Homo sapiens
caaauuaaguauguu

SEQ ID NO: 883139 - RNA, 18 nt, Homo sapiens
caaauuagguuuuguaca

SEQ ID NO: 883140 - RNA, 15 nt, Homo sapiens
caaauugcuacauag

SEQ ID NO: 883141 - RNA, 20 nt, Homo sapiens
caaauugcuacauaguccaa

SEQ ID NO: 883142 - RNA, 19 nt, Homo sapiens
caaauugcugggauuacag

SEQ ID NO: 883143 - RNA, 16 nt, Homo sapiens
caaauugcuucuagga

SEQ ID NO: 883144 - RNA, 11 nt, Homo sapiens
caaauuucaca

SEQ ID NO: 883145 - RNA, 17 nt, Homo sapiens
caaauuuuuacugagaa

SEQ ID NO: 883146 - RNA, 22 nt, Homo sapiens
caacaaaaucaauuuuuugcua

SEQ ID NO: 883147 - RNA, 15 nt, Homo sapiens
caacaaacauagaaa

SEQ ID NO: 883148 - RNA, 19 nt, Homo sapiens
caacaaagcgagaucccau

SEQ ID NO: 883149 - RNA, 16 nt, Homo sapiens
caacaacaaaccaaaa

SEQ ID NO: 883150 - RNA, 13 nt, Homo sapiens
caacaacaaggac

SEQ ID NO: 883151 - RNA, 19 nt, Homo sapiens
caacaacauccauguccua

SEQ ID NO: 883152 - RNA, 14 nt, Homo sapiens
caacaagccauagu

SEQ ID NO: 883153 - RNA, 16 nt, Homo sapiens
caacaauaaagacuga

SEQ ID NO: 883154 - RNA, 13 nt, Homo sapiens
caacaauacaugc

SEQ ID NO: 883155 - RNA, 19 nt, Homo sapiens
caacaauacaugcugcuaa

SEQ ID NO: 883156 - RNA, 23 nt, Homo sapiens
caacacaagcuggaagcacaugu

SEQ ID NO: 883157 - RNA, 13 nt, Homo sapiens
caacaccaccucu

SEQ ID NO: 883158 - RNA, 12 nt, Homo sapiens
caacacccaaag

SEQ ID NO: 883159 - RNA, 22 nt, Homo sapiens
caacaccuauauauccaagaag

SEQ ID NO: 883160 - RNA, 18 nt, Homo sapiens
caacagaagcuuccauuc

SEQ ID NO: 883161 - RNA, 12 nt, Homo sapiens
caacagacugaa

SEQ ID NO: 883162 - RNA, 13 nt, Homo sapiens
caacagagcaaga

SEQ ID NO: 883163 - RNA, 16 nt, Homo sapiens
caacaggaacuuggag

SEQ ID NO: 883164 - RNA, 23 nt, Homo sapiens
caacaggcuguucugcacugaaa

SEQ ID NO: 883165 - RNA, 22 nt, Homo sapiens
caacagguggcaggaccaggac

SEQ ID NO: 883166 - RNA, 17 nt, Homo sapiens
caacagugagucuguca

SEQ ID NO: 883167 - RNA, 14 nt, Homo sapiens
caacaguuccuuca

SEQ ID NO: 883168 - RNA, 12 nt, Homo sapiens
caacauaucauu

SEQ ID NO: 883169 - RNA, 16 nt, Homo sapiens
caacaucccacagugg

SEQ ID NO: 883170 - RNA, 12 nt, Homo sapiens
caacaucuucaa

SEQ ID NO: 883171 - RNA, 20 nt, Homo sapiens
caacaucuuuuuccucccuu

SEQ ID NO: 883172 - RNA, 13 nt, Homo sapiens
caacaugacuguu

SEQ ID NO: 883173 - RNA, 23 nt, Homo sapiens
caacauggugaaaccucaucucu

SEQ ID NO: 883174 - RNA, 15 nt, Homo sapiens
caacauguuauuugu

SEQ ID NO: 883175 - RNA, 18 nt, Homo sapiens
cacgucccggaccugugg

SEQ ID NO: 883176 - RNA, 13 nt, Homo sapiens
cacguguccugua

SEQ ID NO: 883177 - RNA, 18 nt, Homo sapiens
cacgugugcagacugugg

SEQ ID NO: 883178 - RNA, 18 nt, Homo sapiens
cacuaauggggcggugag

SEQ ID NO: 883179 - RNA, 22 nt, Homo sapiens
cacuaauuugauguuuacaggu

SEQ ID NO: 883180 - RNA, 16 nt, Homo sapiens
cacuacaguacaguga

SEQ ID NO: 883181 - RNA, 12 nt, Homo sapiens
cacuagccugug

SEQ ID NO: 883182 - RNA, 20 nt, Homo sapiens
cacuaggucaaaacauucag

SEQ ID NO: 883183 - RNA, 19 nt, Homo sapiens
cacuagguucaauucccug

SEQ ID NO: 883184 - RNA, 19 nt, Homo sapiens
cacuauagccuaggugaca

SEQ ID NO: 883185 - RNA, 21 nt, Homo sapiens
cacuauagccuaggugacaga

SEQ ID NO: 883186 - RNA, 22 nt, Homo sapiens
cacuaugaggaauaauuauuua

SEQ ID NO: 883187 - RNA, 12 nt, Homo sapiens
cacuaugcugcu

SEQ ID NO: 883188 - RNA, 14 nt, Homo sapiens
cacuauguccagcu

SEQ ID NO: 883189 - RNA, 19 nt, Homo sapiens
cacuauuuaucugugcaaa

SEQ ID NO: 883190 - RNA, 19 nt, Homo sapiens
cacucagggcugccacuaa

SEQ ID NO: 883191 - RNA, 16 nt, Homo sapiens
cacucaguuguuccua

SEQ ID NO: 883192 - RNA, 20 nt, Homo sapiens
cacucaguuguuccuacuca

SEQ ID NO: 883193 - RNA, 16 nt, Homo sapiens
cacucauuucaucuca

SEQ ID NO: 883194 - RNA, 17 nt, Homo sapiens
cacucauuucaucucau

SEQ ID NO: 883195 - RNA, 23 nt, Homo sapiens
cacuccacccccuccagcuccag

SEQ ID NO: 883196 - RNA, 14 nt, Homo sapiens
cacucuaauauuca

SEQ ID NO: 883197 - RNA, 16 nt, Homo sapiens
cacucucaaauccuga

SEQ ID NO: 883198 - RNA, 23 nt, Homo sapiens
cacucuccccucccucuuccuuc

SEQ ID NO: 883199 - RNA, 15 nt, Homo sapiens
cacucucuagcuuua

SEQ ID NO: 883200 - RNA, 18 nt, Homo sapiens
cacucucuagcuuuaggg

SEQ ID NO: 883201 - RNA, 14 nt, Homo sapiens
cacucugaaacuga

SEQ ID NO: 883202 - RNA, 14 nt, Homo sapiens
cacucugcucugau

SEQ ID NO: 883203 - RNA, 20 nt, Homo sapiens
cacucuuauagaaaguucaa

SEQ ID NO: 883204 - RNA, 18 nt, Homo sapiens
cacucuucauucuuugaa

SEQ ID NO: 883205 - RNA, 18 nt, Homo sapiens
cacugaaaauaccaucag

SEQ ID NO: 883206 - RNA, 23 nt, Homo sapiens
cacugacauuauaucauggcauu

SEQ ID NO: 883207 - RNA, 11 nt, Homo sapiens
cacugaccuca

SEQ ID NO: 883208 - RNA, 13 nt, Homo sapiens
cacugacugggac

SEQ ID NO: 883209 - RNA, 19 nt, Homo sapiens
cacugagcugggcaccaca

SEQ ID NO: 883210 - RNA, 17 nt, Homo sapiens
cacugaggaccagccau

SEQ ID NO: 883211 - RNA, 11 nt, Homo sapiens
cacugaucaau

SEQ ID NO: 883212 - RNA, 21 nt, Homo sapiens
cacugcaccgggccacagaga

SEQ ID NO: 883213 - RNA, 14 nt, Homo sapiens
cacugccucuucca

SEQ ID NO: 883214 - RNA, 23 nt, Homo sapiens
cacuggaaucgaucuguacugua

SEQ ID NO: 883215 - RNA, 17 nt, Homo sapiens
cacuggauauguuguua

SEQ ID NO: 883216 - RNA, 13 nt, Homo sapiens
cacuggcauuaaa

SEQ ID NO: 883217 - RNA, 23 nt, Homo sapiens
cacugggaugagccgcugugagc

SEQ ID NO: 883218 - RNA, 13 nt, Homo sapiens
cacuggguugacu

SEQ ID NO: 883219 - RNA, 18 nt, Homo sapiens
cacuguaagacucauucc

SEQ ID NO: 883220 - RNA, 11 nt, Homo sapiens
cacuguacaag

SEQ ID NO: 883221 - RNA, 15 nt, Homo sapiens
cacuguauguuuacu

SEQ ID NO: 883222 - RNA, 10 nt, Homo sapiens
cacuguccag

SEQ ID NO: 883223 - RNA, 20 nt, Homo sapiens
cacuuacuaaccugguccua

SEQ ID NO: 883224 - RNA, 12 nt, Homo sapiens
cacuuaucugau

SEQ ID NO: 883225 - RNA, 18 nt, Homo sapiens
cacuucuaugcaaaugcc

SEQ ID NO: 883226 - RNA, 17 nt, Homo sapiens
cacuucucuacucugga

SEQ ID NO: 883227 - RNA, 13 nt, Homo sapiens
cacuucucuccag

SEQ ID NO: 883228 - RNA, 22 nt, Homo sapiens
cacuucucuccaggcuguuucu

SEQ ID NO: 883229 - RNA, 15 nt, Homo sapiens
cacuugacauuccuu

SEQ ID NO: 883230 - RNA, 22 nt, Homo sapiens
cacuugguuuuuggcucuuuca

SEQ ID NO: 883231 - RNA, 13 nt, Homo sapiens
cacuuuccuacaa

SEQ ID NO: 883232 - RNA, 20 nt, Homo sapiens
cacuuuggcuucuccuguga

SEQ ID NO: 883233 - RNA, 16 nt, Homo sapiens
cagaaaacaaaagaga

SEQ ID NO: 883234 - RNA, 23 nt, Homo sapiens
cagaaaacaaaucuucaaggugu

SEQ ID NO: 883235 - RNA, 16 nt, Homo sapiens
cagaaaacacagccug

SEQ ID NO: 883236 - RNA, 22 nt, Homo sapiens
cagaaacucaaccaucaaugga

SEQ ID NO: 883237 - RNA, 17 nt, Homo sapiens
cagaaagcauccuaaau

SEQ ID NO: 883238 - RNA, 19 nt, Homo sapiens
cagaaaggagaacuaucca

SEQ ID NO: 883239 - RNA, 17 nt, Homo sapiens
cagaaagguuaguauca

SEQ ID NO: 883240 - RNA, 19 nt, Homo sapiens
cagaaaguggccaugccac

SEQ ID NO: 883241 - RNA, 16 nt, Homo sapiens
cagaacccagauuucc

SEQ ID NO: 883242 - RNA, 16 nt, Homo sapiens
cagaagacacugcaaa

SEQ ID NO: 883243 - RNA, 21 nt, Homo sapiens
cagaagcacauaugaacugga

SEQ ID NO: 883244 - RNA, 23 nt, Homo sapiens
cagaagcaguugagucgucauca

SEQ ID NO: 883245 - RNA, 13 nt, Homo sapiens
cagaaggacucag

SEQ ID NO: 883246 - RNA, 22 nt, Homo sapiens
cagaaggagggcagagccaugg

SEQ ID NO: 883247 - RNA, 12 nt, Homo sapiens
cagaaggggugg

SEQ ID NO: 883248 - RNA, 15 nt, Homo sapiens
cagaagguugcucua

SEQ ID NO: 883249 - RNA, 18 nt, Homo sapiens
cagaagguuugcaccccu

SEQ ID NO: 883250 - RNA, 15 nt, Homo sapiens
cagaagucuugucuc

SEQ ID NO: 883251 - RNA, 16 nt, Homo sapiens
cagaagucuugucuca

SEQ ID NO: 883252 - RNA, 17 nt, Homo sapiens
cagaauaaauaugcuca

SEQ ID NO: 883253 - RNA, 17 nt, Homo sapiens
cagaauauggacaaaga

SEQ ID NO: 883254 - RNA, 14 nt, Homo sapiens
cagaaucccggcug

SEQ ID NO: 883255 - RNA, 19 nt, Homo sapiens
cagaaugcgcaagggcaaa

SEQ ID NO: 883256 - RNA, 18 nt, Homo sapiens
cagaaugcucuacuucuu

SEQ ID NO: 883257 - RNA, 12 nt, Homo sapiens
cagaauugugca

SEQ ID NO: 883258 - RNA, 16 nt, Homo sapiens
cagaauuuuaaagagc

SEQ ID NO: 883259 - RNA, 17 nt, Homo sapiens
cagacaaguaaucacua

SEQ ID NO: 883260 - RNA, 15 nt, Homo sapiens
cagacaggcucaggu

SEQ ID NO: 883261 - RNA, 18 nt, Homo sapiens
cagacauacgaaacacaa

SEQ ID NO: 883262 - RNA, 22 nt, Homo sapiens
cagacauuuucaauaaugugaa

SEQ ID NO: 883263 - RNA, 14 nt, Homo sapiens
cagaccaccugcca

SEQ ID NO: 883264 - RNA, 16 nt, Homo sapiens
cagaccacucccuucc

SEQ ID NO: 883265 - RNA, 13 nt, Homo sapiens
cagaccagugaaa

SEQ ID NO: 883266 - RNA, 18 nt, Homo sapiens
cagaccauugucuuccaa

SEQ ID NO: 883267 - RNA, 14 nt, Homo sapiens
cagaccccaaggcc

SEQ ID NO: 883268 - RNA, 22 nt, Homo sapiens
cagaccccuuggcuuuugcuug

SEQ ID NO: 883269 - RNA, 16 nt, Homo sapiens
cagaccucaggugcua

SEQ ID NO: 883270 - RNA, 15 nt, Homo sapiens
cagaccugacugccu

SEQ ID NO: 883271 - RNA, 18 nt, Homo sapiens
cagaccuucaacuuccaa

SEQ ID NO: 883272 - RNA, 19 nt, Homo sapiens
cagacggcggggggcagca

SEQ ID NO: 883273 - RNA, 18 nt, Homo sapiens
cagacgucucaagacuga

SEQ ID NO: 883274 - RNA, 13 nt, Homo sapiens
cagacucacugug

SEQ ID NO: 883275 - RNA, 14 nt, Homo sapiens
cagacucacugugg

SEQ ID NO: 883276 - RNA, 16 nt, Homo sapiens
cagacucagacuccau

SEQ ID NO: 883277 - RNA, 20 nt, Homo sapiens
cagacucuacagaggccaug

SEQ ID NO: 883278 - RNA, 13 nt, Homo sapiens
cagacuuaaauca

SEQ ID NO: 883279 - RNA, 16 nt, Homo sapiens
cagagaaaagacauaa

SEQ ID NO: 883280 - RNA, 21 nt, Homo sapiens
cagagaaaauaaaagcacuua

SEQ ID NO: 883281 - RNA, 18 nt, Homo sapiens
cagagacaggcccaagag

SEQ ID NO: 883282 - RNA, 22 nt, Homo sapiens
cagagacauacaccuaugucau

SEQ ID NO: 883283 - RNA, 16 nt, Homo sapiens
cagagacgcaagggag

SEQ ID NO: 883284 - RNA, 13 nt, Homo sapiens
cagagacuauuua

SEQ ID NO: 883285 - RNA, 14 nt, Homo sapiens
cagagacucuggaa

SEQ ID NO: 883286 - RNA, 23 nt, Homo sapiens
cagagagggcagagggguaggca

SEQ ID NO: 883287 - RNA, 19 nt, Homo sapiens
cagagaggggcagguugac

SEQ ID NO: 883288 - RNA, 17 nt, Homo sapiens
cagagaguccucuggau

SEQ ID NO: 883289 - RNA, 18 nt, Homo sapiens
cagagauacgcaaacaca

SEQ ID NO: 883290 - RNA, 13 nt, Homo sapiens
cgaguucagcaaa

SEQ ID NO: 883291 - RNA, 23 nt, Homo sapiens
cgauaaagaacacgaauugcuca

SEQ ID NO: 883292 - RNA, 14 nt, Homo sapiens
cgaucgcugugaaa

SEQ ID NO: 883293 - RNA, 22 nt, Homo sapiens
cgaucuuugaauauacuuaccu

SEQ ID NO: 883294 - RNA, 19 nt, Homo sapiens
cgaugcacacgcacauaga

SEQ ID NO: 883295 - RNA, 19 nt, Homo sapiens
cgaugcuggggucaaagac

SEQ ID NO: 883296 - RNA, 15 nt, Homo sapiens
cgcacacacaccgau

SEQ ID NO: 883297 - RNA, 19 nt, Homo sapiens
cgcacacacagauaugcac

SEQ ID NO: 883298 - RNA, 13 nt, Homo sapiens
cgcaccuaucacc

SEQ ID NO: 883299 - RNA, 11 nt, Homo sapiens
cgcaccugccc

SEQ ID NO: 883300 - RNA, 17 nt, Homo sapiens
cgcagcccgaagcccag

SEQ ID NO: 883301 - RNA, 16 nt, Homo sapiens
cgcaucaggccuggca

SEQ ID NO: 883302 - RNA, 13 nt, Homo sapiens
cgccaaugcacac

SEQ ID NO: 883303 - RNA, 20 nt, Homo sapiens
cgccauccgggacgcuucca

SEQ ID NO: 883304 - RNA, 22 nt, Homo sapiens
cgccuguaaucccagcacuuug

SEQ ID NO: 883305 - RNA, 18 nt, Homo sapiens
cgcgggaggcaccagcuc

SEQ ID NO: 883306 - RNA, 18 nt, Homo sapiens
cgcuacccacuucuaaau

SEQ ID NO: 883307 - RNA, 10 nt, Homo sapiens
cgcucuggac

SEQ ID NO: 883308 - RNA, 12 nt, Homo sapiens
cgcuguggcucc

SEQ ID NO: 883309 - RNA, 14 nt, Homo sapiens
cggaaggcaaagag

SEQ ID NO: 883310 - RNA, 11 nt, Homo sapiens
cggacaaauca

SEQ ID NO: 883311 - RNA, 20 nt, Homo sapiens
cggacccugcccauaccccu

SEQ ID NO: 883312 - RNA, 14 nt, Homo sapiens
cggagaguacagug

SEQ ID NO: 883313 - RNA, 19 nt, Homo sapiens
cggaggccggccaccugca

SEQ ID NO: 883314 - RNA, 15 nt, Homo sapiens
cggaggcggcuccag

SEQ ID NO: 883315 - RNA, 19 nt, Homo sapiens
cggagggaggacaucauaa

SEQ ID NO: 883316 - RNA, 18 nt, Homo sapiens
cggaguacagacgucuca

SEQ ID NO: 883317 - RNA, 21 nt, Homo sapiens
cggaucuggggcucugggaua

SEQ ID NO: 883318 - RNA, 16 nt, Homo sapiens
cggaugcacacacaga

SEQ ID NO: 883319 - RNA, 17 nt, Homo sapiens
cggaugcacacacagau

SEQ ID NO: 883320 - RNA, 17 nt, Homo sapiens
cggcaaccccaguucug

SEQ ID NO: 883321 - RNA, 16 nt, Homo sapiens
cggcacauuggcagug

SEQ ID NO: 883322 - RNA, 19 nt, Homo sapiens
cggcagcuugagccuguca

SEQ ID NO: 883323 - RNA, 17 nt, Homo sapiens
cggcaugugaauucugu

SEQ ID NO: 883324 - RNA, 18 nt, Homo sapiens
cggccaagugaaggagcc

SEQ ID NO: 883325 - RNA, 19 nt, Homo sapiens
cggccagccuugcacugug

SEQ ID NO: 883326 - RNA, 14 nt, Homo sapiens
cggcgccaccaucc

SEQ ID NO: 883327 - RNA, 13 nt, Homo sapiens
cgggaacaguguu

SEQ ID NO: 883328 - RNA, 15 nt, Homo sapiens
cgggaggcugagaca

SEQ ID NO: 883329 - RNA, 13 nt, Homo sapiens
cgggcaagcacua

SEQ ID NO: 883330 - RNA, 21 nt, Homo sapiens
cgggcugcccuucgcugccag

SEQ ID NO: 883331 - RNA, 20 nt, Homo sapiens
cgggggaaagcacaccucau

SEQ ID NO: 883332 - RNA, 16 nt, Homo sapiens
cguaagggaucuuccu

SEQ ID NO: 883333 - RNA, 14 nt, Homo sapiens
cguagacuugacaa

SEQ ID NO: 883334 - RNA, 17 nt, Homo sapiens
cgucagccacaccuguc

SEQ ID NO: 883335 - RNA, 22 nt, Homo sapiens
cgucaguaguuugagaccagcc

SEQ ID NO: 883336 - RNA, 20 nt, Homo sapiens
cgucccaaacagagggccac

SEQ ID NO: 883337 - RNA, 12 nt, Homo sapiens
cgucucaagacu

SEQ ID NO: 883338 - RNA, 21 nt, Homo sapiens
cgucuucuccaacaccaccuc

SEQ ID NO: 883339 - RNA, 17 nt, Homo sapiens
cgugaaaccccgucucu

SEQ ID NO: 883340 - RNA, 16 nt, Homo sapiens
cgugaugccaggacca

SEQ ID NO: 883341 - RNA, 13 nt, Homo sapiens
cgugauggucuga

SEQ ID NO: 883342 - RNA, 16 nt, Homo sapiens
cgugcaccaccaugcc

SEQ ID NO: 883343 - RNA, 14 nt, Homo sapiens
cgugccaguguccc

SEQ ID NO: 883344 - RNA, 21 nt, Homo sapiens
cguggaccacccgcccuggca

SEQ ID NO: 883345 - RNA, 18 nt, Homo sapiens
cguggucuccuugcacuu

SEQ ID NO: 883346 - RNA, 13 nt, Homo sapiens
cguguagugucug

SEQ ID NO: 883347 - RNA, 16 nt, Homo sapiens
cgugugcagacugugg

SEQ ID NO: 883348 - RNA, 14 nt, Homo sapiens
cguguggcuuacaa

SEQ ID NO: 883349 - RNA, 21 nt, Homo sapiens
cguuaaggagaugggccuuuu

SEQ ID NO: 883350 - RNA, 17 nt, Homo sapiens
cguugguucugcacuaa

SEQ ID NO: 883351 - RNA, 23 nt, Homo sapiens
cguuuugugugguggcaccuccu

SEQ ID NO: 883352 - RNA, 14 nt, Homo sapiens
cuaaaaaacagagg

SEQ ID NO: 883353 - RNA, 22 nt, Homo sapiens
cuaaaaaacagaggccauggca

SEQ ID NO: 883354 - RNA, 17 nt, Homo sapiens
cuaaaaaauggugggag

SEQ ID NO: 883355 - RNA, 13 nt, Homo sapiens
cuaaaaauacaaa

SEQ ID NO: 883356 - RNA, 15 nt, Homo sapiens
cuaaaauuagaugaa

SEQ ID NO: 883357 - RNA, 18 nt, Homo sapiens
cuaaacaagggcagugag

SEQ ID NO: 883358 - RNA, 20 nt, Homo sapiens
cuaaacagacuauuuaacuu

SEQ ID NO: 883359 - RNA, 14 nt, Homo sapiens
cuaaacccaaauaa

SEQ ID NO: 883360 - RNA, 10 nt, Homo sapiens
cuaaacugua

SEQ ID NO: 883361 - RNA, 21 nt, Homo sapiens
cuaaagaguuauucaaaugaa

SEQ ID NO: 883362 - RNA, 12 nt, Homo sapiens
cuaaagauauca

SEQ ID NO: 883363 - RNA, 19 nt, Homo sapiens
cuaaagggugcccacaaaa

SEQ ID NO: 883364 - RNA, 16 nt, Homo sapiens
cuaaauauuucaugau

SEQ ID NO: 883365 - RNA, 22 nt, Homo sapiens
cuaaaucuuccagcaugcaucc

SEQ ID NO: 883366 - RNA, 11 nt, Homo sapiens
cuaaaugaagu

SEQ ID NO: 883367 - RNA, 16 nt, Homo sapiens
cuaaaugaagugcaaa

SEQ ID NO: 883368 - RNA, 23 nt, Homo sapiens
cuaaaugaccucagcaaauccuc

SEQ ID NO: 883369 - RNA, 16 nt, Homo sapiens
cuaaaugcagugaauu

SEQ ID NO: 883370 - RNA, 15 nt, Homo sapiens
cuaacacagccauca

SEQ ID NO: 883371 - RNA, 21 nt, Homo sapiens
cuaacacagccaucaagggaa

SEQ ID NO: 883372 - RNA, 15 nt, Homo sapiens
cuaacauauguauua

SEQ ID NO: 883373 - RNA, 15 nt, Homo sapiens
cuaacccccagugcc

SEQ ID NO: 883374 - RNA, 19 nt, Homo sapiens
cuaaccucagccaaacaca

SEQ ID NO: 883375 - RNA, 16 nt, Homo sapiens
cuaacuaucaaauaga

SEQ ID NO: 883376 - RNA, 19 nt, Homo sapiens
cuaagaaaauuauguauuu

SEQ ID NO: 883377 - RNA, 14 nt, Homo sapiens
cuaagacaccugca

SEQ ID NO: 883378 - RNA, 14 nt, Homo sapiens
cuaagauggcuuuu

SEQ ID NO: 883379 - RNA, 17 nt, Homo sapiens
cuaagcacguagagaug

SEQ ID NO: 883380 - RNA, 22 nt, Homo sapiens
cuaagcaguaagcuaucuucaa

SEQ ID NO: 883381 - RNA, 15 nt, Homo sapiens
cuaagccaacuuuaa

SEQ ID NO: 883382 - RNA, 13 nt, Homo sapiens
cuaagccacucuu

SEQ ID NO: 883383 - RNA, 17 nt, Homo sapiens
cuaagccacucuuccaa

SEQ ID NO: 883384 - RNA, 21 nt, Homo sapiens
cuaagccacucuuccaaaggc

SEQ ID NO: 883385 - RNA, 22 nt, Homo sapiens
cuaagcgaauguguacaaagug

SEQ ID NO: 883386 - RNA, 22 nt, Homo sapiens
cuaaguaaaaccacagcaguug

SEQ ID NO: 883387 - RNA, 17 nt, Homo sapiens
cuaauaaacauccuuca

SEQ ID NO: 883388 - RNA, 16 nt, Homo sapiens
cuaauaaucaccauau

SEQ ID NO: 883389 - RNA, 18 nt, Homo sapiens
cuaauagaaccaagaauu

SEQ ID NO: 883390 - RNA, 14 nt, Homo sapiens
cuaauauggcaaaa

SEQ ID NO: 883391 - RNA, 22 nt, Homo sapiens
cuaauccucaacaacaaaccaa

SEQ ID NO: 883392 - RNA, 19 nt, Homo sapiens
cuaaugagucgacuuugag

SEQ ID NO: 883393 - RNA, 16 nt, Homo sapiens
cuaaugauuagcacuu

SEQ ID NO: 883394 - RNA, 12 nt, Homo sapiens
cuaaugggacac

SEQ ID NO: 883395 - RNA, 15 nt, Homo sapiens
cuaauguaugcauuc

SEQ ID NO: 883396 - RNA, 17 nt, Homo sapiens
cuaauguaugcauucau

SEQ ID NO: 883397 - RNA, 18 nt, Homo sapiens
cuaauuaaaaucuggaaa

SEQ ID NO: 883398 - RNA, 14 nt, Homo sapiens
cuaauucaacauau

SEQ ID NO: 883399 - RNA, 23 nt, Homo sapiens
cuaauuccuggcaugacacucua

SEQ ID NO: 883400 - RNA, 18 nt, Homo sapiens
cuaauuugauguuuacag

SEQ ID NO: 883401 - RNA, 15 nt, Homo sapiens
cuacaaaaaacaaca

SEQ ID NO: 883402 - RNA, 20 nt, Homo sapiens
cuacaaaaaauaaaaacacu

SEQ ID NO: 883403 - RNA, 13 nt, Homo sapiens
cuacaaaaacaca

SEQ ID NO: 883404 - RNA, 24 nt, Homo sapiens
cuacaaacauaucaaacauaugua

SEQ ID NO: 883405 - RNA, 15 nt, Homo sapiens
cucuggguuucauau

SEQ ID NO: 883406 - RNA, 16 nt, Homo sapiens
cucuguccacucugaa

SEQ ID NO: 883407 - RNA, 13 nt, Homo sapiens
cucugucccucac

SEQ ID NO: 883408 - RNA, 14 nt, Homo sapiens
cucugugaaaucag

SEQ ID NO: 883409 - RNA, 23 nt, Homo sapiens
cucugugguuuuaaucuucucau

SEQ ID NO: 883410 - RNA, 20 nt, Homo sapiens
cucuguguacccacuccuca

SEQ ID NO: 883411 - RNA, 15 nt, Homo sapiens
cucuguucauuuccu

SEQ ID NO: 883412 - RNA, 17 nt, Homo sapiens
cucuuaaucaaauagca

SEQ ID NO: 883413 - RNA, 14 nt, Homo sapiens
cucuuaauguugcu

SEQ ID NO: 883414 - RNA, 18 nt, Homo sapiens
cucuucaacugaccagcc

SEQ ID NO: 883415 - RNA, 20 nt, Homo sapiens
cucuucagccccuagugcua

SEQ ID NO: 883416 - RNA, 19 nt, Homo sapiens
cucuucccccacuccucuu

SEQ ID NO: 883417 - RNA, 13 nt, Homo sapiens
cucuucccgggau

SEQ ID NO: 883418 - RNA, 18 nt, Homo sapiens
cucuucccgggaucacuu

SEQ ID NO: 883419 - RNA, 22 nt, Homo sapiens
cucuuccugauuccccacucaa

SEQ ID NO: 883420 - RNA, 14 nt, Homo sapiens
cucuucuaacucau

SEQ ID NO: 883421 - RNA, 14 nt, Homo sapiens
cucuucuccacugg

SEQ ID NO: 883422 - RNA, 15 nt, Homo sapiens
cucuugcauugcaaa

SEQ ID NO: 883423 - RNA, 15 nt, Homo sapiens
cucuugccucucuca

SEQ ID NO: 883424 - RNA, 21 nt, Homo sapiens
cucuugugcccuucugagccc

SEQ ID NO: 883425 - RNA, 15 nt, Homo sapiens
cucuuuaaugucaca

SEQ ID NO: 883426 - RNA, 19 nt, Homo sapiens
cucuuuauuuuuugauuga

SEQ ID NO: 883427 - RNA, 15 nt, Homo sapiens
cucuuuccuuccuuc

SEQ ID NO: 883428 - RNA, 20 nt, Homo sapiens
cucuuucuuggugucugucc

SEQ ID NO: 883429 - RNA, 17 nt, Homo sapiens
cucuuuucaaaacauuu

SEQ ID NO: 883430 - RNA, 14 nt, Homo sapiens
cugaaaaacugauc

SEQ ID NO: 883431 - RNA, 13 nt, Homo sapiens
cugaaaauucugu

SEQ ID NO: 883432 - RNA, 13 nt, Homo sapiens
cugaaacaaaagu

SEQ ID NO: 883433 - RNA, 20 nt, Homo sapiens
cugaaacauucacacagggc

SEQ ID NO: 883434 - RNA, 12 nt, Homo sapiens
cugaaagacaga

SEQ ID NO: 883435 - RNA, 16 nt, Homo sapiens
cugaaauaaaagccuc

SEQ ID NO: 883436 - RNA, 12 nt, Homo sapiens
cugaaaugccuc

SEQ ID NO: 883437 - RNA, 23 nt, Homo sapiens
cugaaauuuuaauugaacuaaca

SEQ ID NO: 883438 - RNA, 15 nt, Homo sapiens
cugaacccauuuuga

SEQ ID NO: 883439 - RNA, 16 nt, Homo sapiens
cugaaccgacuuuucu

SEQ ID NO: 883440 - RNA, 13 nt, Homo sapiens
cugaagaaaccuu

SEQ ID NO: 883441 - RNA, 22 nt, Homo sapiens
cugaagaacaguaacugccauc

SEQ ID NO: 883442 - RNA, 16 nt, Homo sapiens
cugaagacaaaccacu

SEQ ID NO: 883443 - RNA, 22 nt, Homo sapiens
cugaagacuuacuuauucuucc

SEQ ID NO: 883444 - RNA, 20 nt, Homo sapiens
cugaaggaauagccagagag

SEQ ID NO: 883445 - RNA, 23 nt, Homo sapiens
cugaaggacgcgccaggggaguu

SEQ ID NO: 883446 - RNA, 20 nt, Homo sapiens
cugaagggcuucuucuuaua

SEQ ID NO: 883447 - RNA, 18 nt, Homo sapiens
cugaaggggcacaccacu

SEQ ID NO: 883448 - RNA, 15 nt, Homo sapiens
cugaaggucccaccu

SEQ ID NO: 883449 - RNA, 12 nt, Homo sapiens
cugaaggugcug

SEQ ID NO: 883450 - RNA, 13 nt, Homo sapiens
cugaagucacaca

SEQ ID NO: 883451 - RNA, 18 nt, Homo sapiens
cugaaugauuuccaaaga

SEQ ID NO: 883452 - RNA, 20 nt, Homo sapiens
cugaauguauugaacuugga

SEQ ID NO: 883453 - RNA, 20 nt, Homo sapiens
cugaauuuuaaauguucaca

SEQ ID NO: 883454 - RNA, 14 nt, Homo sapiens
cugacaagcacugc

SEQ ID NO: 883455 - RNA, 16 nt, Homo sapiens
cugacaccaccaucua

SEQ ID NO: 883456 - RNA, 14 nt, Homo sapiens
cugacagaaaugca

SEQ ID NO: 883457 - RNA, 20 nt, Homo sapiens
cugacagaaaugcaaucucc

SEQ ID NO: 883458 - RNA, 15 nt, Homo sapiens
cugacagguucccag

SEQ ID NO: 883459 - RNA, 14 nt, Homo sapiens
cugaccccaaagag

SEQ ID NO: 883460 - RNA, 19 nt, Homo sapiens
cugaccucaagugauccac

SEQ ID NO: 883461 - RNA, 17 nt, Homo sapiens
cugaccucgugauccac

SEQ ID NO: 883462 - RNA, 14 nt, Homo sapiens
cugacgacacugaa

SEQ ID NO: 883463 - RNA, 12 nt, Homo sapiens
cugacuagucau

SEQ ID NO: 883464 - RNA, 21 nt, Homo sapiens
cugacucucugugaccugccc

SEQ ID NO: 883465 - RNA, 15 nt, Homo sapiens
cugacuguguucagu

SEQ ID NO: 883466 - RNA, 18 nt, Homo sapiens
cugacuuugagacggugu

SEQ ID NO: 883467 - RNA, 15 nt, Homo sapiens
cugacuuugugaucc

SEQ ID NO: 883468 - RNA, 19 nt, Homo sapiens
cugagaaacccaccagccu

SEQ ID NO: 883469 - RNA, 12 nt, Homo sapiens
cugagaauucca

SEQ ID NO: 883470 - RNA, 22 nt, Homo sapiens
cugagagacccaaggaggaaaa

SEQ ID NO: 883471 - RNA, 20 nt, Homo sapiens
cugagagcauguuuuaucau

SEQ ID NO: 883472 - RNA, 11 nt, Homo sapiens
cugagaucucc

SEQ ID NO: 883473 - RNA, 13 nt, Homo sapiens
cugagaucucccu

SEQ ID NO: 883474 - RNA, 18 nt, Homo sapiens
cugagaugugaacacauc

SEQ ID NO: 883475 - RNA, 22 nt, Homo sapiens
cugagauugcgccacugcacuc

SEQ ID NO: 883476 - RNA, 17 nt, Homo sapiens
cugagcaccuacuuaca

SEQ ID NO: 883477 - RNA, 21 nt, Homo sapiens
cugagcaccuacuuacaugca

SEQ ID NO: 883478 - RNA, 15 nt, Homo sapiens
cugagccaaacacac

SEQ ID NO: 883479 - RNA, 21 nt, Homo sapiens
cugagccacucgcagucgcag

SEQ ID NO: 883480 - RNA, 11 nt, Homo sapiens
cugagccugac

SEQ ID NO: 883481 - RNA, 13 nt, Homo sapiens
cugagcucacuga

SEQ ID NO: 883482 - RNA, 15 nt, Homo sapiens
cugaggaaggugcuu

SEQ ID NO: 883483 - RNA, 15 nt, Homo sapiens
cugaggacucaaggg

SEQ ID NO: 883484 - RNA, 17 nt, Homo sapiens
cugaggcaaauggcaca

SEQ ID NO: 883485 - RNA, 21 nt, Homo sapiens
cugaggggggccgugcccagg

SEQ ID NO: 883486 - RNA, 21 nt, Homo sapiens
cugagucaggacuugaaccca

SEQ ID NO: 883487 - RNA, 22 nt, Homo sapiens
cugagucaggacuugaacccag

SEQ ID NO: 883488 - RNA, 12 nt, Homo sapiens
cugagugacaug

SEQ ID NO: 883489 - RNA, 19 nt, Homo sapiens
cugaguggaucuccaagga

SEQ ID NO: 883490 - RNA, 15 nt, Homo sapiens
cugauaaacauuaaa

SEQ ID NO: 883491 - RNA, 20 nt, Homo sapiens
cugauaaacauuaaacacug

SEQ ID NO: 883492 - RNA, 12 nt, Homo sapiens
cugauaagcaaa

SEQ ID NO: 883493 - RNA, 13 nt, Homo sapiens
cugauaagcaaau

SEQ ID NO: 883494 - RNA, 15 nt, Homo sapiens
cugauaauaauugau

SEQ ID NO: 883495 - RNA, 17 nt, Homo sapiens
cugauaauaauugauca

SEQ ID NO: 883496 - RNA, 22 nt, Homo sapiens
cugauauaacaaacuacaugua

SEQ ID NO: 883497 - RNA, 19 nt, Homo sapiens
cugauaugggacugagccu

SEQ ID NO: 883498 - RNA, 21 nt, Homo sapiens
cugaucauccacugugccaug

SEQ ID NO: 883499 - RNA, 16 nt, Homo sapiens
cugaucauuacauggc

SEQ ID NO: 883500 - RNA, 17 nt, Homo sapiens
cugaugacaaacccagg

SEQ ID NO: 883501 - RNA, 22 nt, Homo sapiens
cugaugaccuaaccuaagcaaa

SEQ ID NO: 883502 - RNA, 18 nt, Homo sapiens
cugaugagagagugcuga

SEQ ID NO: 883503 - RNA, 22 nt, Homo sapiens
cugaugaugucucuuguagaag

SEQ ID NO: 883504 - RNA, 14 nt, Homo sapiens
cugaugccauguaa

SEQ ID NO: 883505 - RNA, 23 nt, Homo sapiens
cugaugcuuugcuucaaauccau

SEQ ID NO: 883506 - RNA, 15 nt, Homo sapiens
cugaugggacaucaa

SEQ ID NO: 883507 - RNA, 14 nt, Homo sapiens
cugauuaguauuca

SEQ ID NO: 883508 - RNA, 22 nt, Homo sapiens
cugauucagccuggccaucccc

SEQ ID NO: 883509 - RNA, 13 nt, Homo sapiens
cugauucaguggg

SEQ ID NO: 883510 - RNA, 19 nt, Homo sapiens
cugauucccaagcucugcu

SEQ ID NO: 883511 - RNA, 13 nt, Homo sapiens
cugauuucaggga

SEQ ID NO: 883512 - RNA, 14 nt, Homo sapiens
cugauuucagggaa

SEQ ID NO: 883513 - RNA, 17 nt, Homo sapiens
cugauuuccuaauguca

SEQ ID NO: 883514 - RNA, 23 nt, Homo sapiens
cugauuuugucacugucuucaca

SEQ ID NO: 883515 - RNA, 16 nt, Homo sapiens
cugauuuuuagcuuua

SEQ ID NO: 883516 - RNA, 18 nt, Homo sapiens
cugauuuuuuuguuguug

SEQ ID NO: 883517 - RNA, 23 nt, Homo sapiens
cugcaaaaauauaaccauuacau

SEQ ID NO: 883518 - RNA, 23 nt, Homo sapiens
cugcaaauauuagcaaagaagcu

SEQ ID NO: 883519 - RNA, 13 nt, Homo sapiens
cugcaagggccag

SEQ ID NO: 883520 - RNA, 15 nt, Homo sapiens
cuuccacacagggug

SEQ ID NO: 883521 - RNA, 13 nt, Homo sapiens
cuuccacuuugag

SEQ ID NO: 883522 - RNA, 15 nt, Homo sapiens
cuuccagcaugcauc

SEQ ID NO: 883523 - RNA, 14 nt, Homo sapiens
cuuccagguacuga

SEQ ID NO: 883524 - RNA, 12 nt, Homo sapiens
cuuccaugagaa

SEQ ID NO: 883525 - RNA, 15 nt, Homo sapiens
cuuccauuaaaacaa

SEQ ID NO: 883526 - RNA, 21 nt, Homo sapiens
cuucccaaucagcacugaaaa

SEQ ID NO: 883527 - RNA, 20 nt, Homo sapiens
cuucccacagcauuccucca

SEQ ID NO: 883528 - RNA, 13 nt, Homo sapiens
cuucccaccucag

SEQ ID NO: 883529 - RNA, 18 nt, Homo sapiens
cuucccaguagcucuugc

SEQ ID NO: 883530 - RNA, 17 nt, Homo sapiens
cuuccccagacucagcu

SEQ ID NO: 883531 - RNA, 15 nt, Homo sapiens
cuuccccagguccuu

SEQ ID NO: 883532 - RNA, 21 nt, Homo sapiens
cuuccccagguccuuccuuua

SEQ ID NO: 883533 - RNA, 13 nt, Homo sapiens
cuuccccuucucg

SEQ ID NO: 883534 - RNA, 21 nt, Homo sapiens
cuucccuggcuuguaacucca

SEQ ID NO: 883535 - RNA, 22 nt, Homo sapiens
cuuccgugugucaucaggguug

SEQ ID NO: 883536 - RNA, 17 nt, Homo sapiens
cuuccucacuaugacac

SEQ ID NO: 883537 - RNA, 15 nt, Homo sapiens
cuuccuccccagucu

SEQ ID NO: 883538 - RNA, 22 nt, Homo sapiens
cuuccuccugguucaagcgauu

SEQ ID NO: 883539 - RNA, 13 nt, Homo sapiens
cuuccugacccuc

SEQ ID NO: 883540 - RNA, 19 nt, Homo sapiens
cuuccuggaguacaaacac

SEQ ID NO: 883541 - RNA, 20 nt, Homo sapiens
cuuccuuaauucacucccac

SEQ ID NO: 883542 - RNA, 20 nt, Homo sapiens
cuuccuugggaugaucuuga

SEQ ID NO: 883543 - RNA, 14 nt, Homo sapiens
cuucgacucaggau

SEQ ID NO: 883544 - RNA, 16 nt, Homo sapiens
cuucgauggcauccug

SEQ ID NO: 883545 - RNA, 22 nt, Homo sapiens
cuucgguuuguauuuagugucu

SEQ ID NO: 883546 - RNA, 13 nt, Homo sapiens
cuucuagaucugg

SEQ ID NO: 883547 - RNA, 16 nt, Homo sapiens
cuucucacaucugucc

SEQ ID NO: 883548 - RNA, 20 nt, Homo sapiens
cuucucaggacacaggccug

SEQ ID NO: 883549 - RNA, 11 nt, Homo sapiens
cuucucagugu

SEQ ID NO: 883550 - RNA, 20 nt, Homo sapiens
cuucucauccccagucccaa

SEQ ID NO: 883551 - RNA, 16 nt, Homo sapiens
cuucucguuaaggaga

SEQ ID NO: 883552 - RNA, 14 nt, Homo sapiens
cuucucuuugccuc

SEQ ID NO: 883553 - RNA, 21 nt, Homo sapiens
cuucugagaccuuguuucaau

SEQ ID NO: 883554 - RNA, 21 nt, Homo sapiens
cuucugcuguauacuguacug

SEQ ID NO: 883555 - RNA, 19 nt, Homo sapiens
cuucuggagucuccagugg

SEQ ID NO: 883556 - RNA, 17 nt, Homo sapiens
cuucugggaacccugcc

SEQ ID NO: 883557 - RNA, 23 nt, Homo sapiens
cuucugggaagacaacuaggaua

SEQ ID NO: 883558 - RNA, 14 nt, Homo sapiens
cuucuguccaggac

SEQ ID NO: 883559 - RNA, 14 nt, Homo sapiens
cuucuucagaagac

SEQ ID NO: 883560 - RNA, 20 nt, Homo sapiens
cuucuucaucuugacaugua

SEQ ID NO: 883561 - RNA, 18 nt, Homo sapiens
cuucuucuuagcaccaca

SEQ ID NO: 883562 - RNA, 16 nt, Homo sapiens
cuucuuuaucugugau

SEQ ID NO: 883563 - RNA, 16 nt, Homo sapiens
cuucuuuuaaaccauu

SEQ ID NO: 883564 - RNA, 20 nt, Homo sapiens
cuucuuuuaguuguaucucu

SEQ ID NO: 883565 - RNA, 22 nt, Homo sapiens
cuugaaacauagagaucuaugu

SEQ ID NO: 883566 - RNA, 13 nt, Homo sapiens
cuugaaaccaaag

SEQ ID NO: 883567 - RNA, 17 nt, Homo sapiens
cuugaaagcaguuaaac

SEQ ID NO: 883568 - RNA, 16 nt, Homo sapiens
cuugaaauaccaguga

SEQ ID NO: 883569 - RNA, 22 nt, Homo sapiens
cuugaaauaccagugaaccaaa

SEQ ID NO: 883570 - RNA, 12 nt, Homo sapiens
cuugaaaucuga

SEQ ID NO: 883571 - RNA, 14 nt, Homo sapiens
cuugaaaugcauua

SEQ ID NO: 883572 - RNA, 16 nt, Homo sapiens
cuugaaauuauaucug

SEQ ID NO: 883573 - RNA, 15 nt, Homo sapiens
cuugaaggcccaggu

SEQ ID NO: 883574 - RNA, 13 nt, Homo sapiens
cuugaaucaaagc

SEQ ID NO: 883575 - RNA, 15 nt, Homo sapiens
cuugaaugugucacu

SEQ ID NO: 883576 - RNA, 21 nt, Homo sapiens
cuugacaacaucccacagugg

SEQ ID NO: 883577 - RNA, 17 nt, Homo sapiens
cuugacagaacacuguc

SEQ ID NO: 883578 - RNA, 20 nt, Homo sapiens
cuugaccucaggugauccac

SEQ ID NO: 883579 - RNA, 21 nt, Homo sapiens
cuugagagaaaaagugccccu

SEQ ID NO: 883580 - RNA, 20 nt, Homo sapiens
cuugagccaguaauuggucc

SEQ ID NO: 883581 - RNA, 18 nt, Homo sapiens
cuugagcuuggcagcuga

SEQ ID NO: 883582 - RNA, 20 nt, Homo sapiens
cuugaggaggggcaccugcc

SEQ ID NO: 883583 - RNA, 21 nt, Homo sapiens
cuugaggauuuugaguaucuc

SEQ ID NO: 883584 - RNA, 22 nt, Homo sapiens
cuugaggguaauaaacuuagaa

SEQ ID NO: 883585 - RNA, 17 nt, Homo sapiens
cuugagguggugccuuc

SEQ ID NO: 883586 - RNA, 19 nt, Homo sapiens
cuugagguuuucugugcuu

SEQ ID NO: 883587 - RNA, 18 nt, Homo sapiens
cuugaucuguauauacaa

SEQ ID NO: 883588 - RNA, 16 nt, Homo sapiens
cuugauucacaaugaa

SEQ ID NO: 883589 - RNA, 20 nt, Homo sapiens
cuugauugagugcuccugug

SEQ ID NO: 883590 - RNA, 20 nt, Homo sapiens
cuugauuuagcacuauuuac

SEQ ID NO: 883591 - RNA, 21 nt, Homo sapiens
cuugcagugagccgagauugc

SEQ ID NO: 883592 - RNA, 18 nt, Homo sapiens
cuugcauacagagacaga

SEQ ID NO: 883593 - RNA, 13 nt, Homo sapiens
cuugccaggcucc

SEQ ID NO: 883594 - RNA, 16 nt, Homo sapiens
cuugccugaauccauc

SEQ ID NO: 883595 - RNA, 17 nt, Homo sapiens
cuugccuguaaucccag

SEQ ID NO: 883596 - RNA, 13 nt, Homo sapiens
cuugcguacucag

SEQ ID NO: 883597 - RNA, 21 nt, Homo sapiens
cuugcuagacagccagguuag

SEQ ID NO: 883598 - RNA, 20 nt, Homo sapiens
cuugcucugagugcuagcua

SEQ ID NO: 883599 - RNA, 11 nt, Homo sapiens
cuugcucugca

SEQ ID NO: 883600 - RNA, 21 nt, Homo sapiens
cuugcuuaguaugguucucag

SEQ ID NO: 883601 - RNA, 22 nt, Homo sapiens
cuugcuuaugacaucacuugua

SEQ ID NO: 883602 - RNA, 19 nt, Homo sapiens
cuugcuucuaaaugcccag

SEQ ID NO: 883603 - RNA, 15 nt, Homo sapiens
cuugcuuuccccggg

SEQ ID NO: 883604 - RNA, 20 nt, Homo sapiens
cuuggaaaaagaaagaaaca

SEQ ID NO: 883605 - RNA, 17 nt, Homo sapiens
cuuggaaagcugaugau

SEQ ID NO: 883606 - RNA, 19 nt, Homo sapiens
cuuggacuauuauaauuua

SEQ ID NO: 883607 - RNA, 13 nt, Homo sapiens
cuuggacuccucc

SEQ ID NO: 883608 - RNA, 18 nt, Homo sapiens
cuuggacuuguucgugcc

SEQ ID NO: 883609 - RNA, 23 nt, Homo sapiens
cuuggaggagggcuguaggaaga

SEQ ID NO: 883610 - RNA, 19 nt, Homo sapiens
cuuggcaaauuccuaguca

SEQ ID NO: 883611 - RNA, 14 nt, Homo sapiens
cuuggcaguauucc

SEQ ID NO: 883612 - RNA, 17 nt, Homo sapiens
cuuggccgacucaggga

SEQ ID NO: 883613 - RNA, 15 nt, Homo sapiens
cuuggccucccaagg

SEQ ID NO: 883614 - RNA, 15 nt, Homo sapiens
cuugggaacuccacu

SEQ ID NO: 883615 - RNA, 18 nt, Homo sapiens
cuugggagaccuguaauc

SEQ ID NO: 883616 - RNA, 13 nt, Homo sapiens
cuugggagucagg

SEQ ID NO: 883617 - RNA, 14 nt, Homo sapiens
cuugggaugaucuu

SEQ ID NO: 883618 - RNA, 18 nt, Homo sapiens
cuugggcccugcacagau

SEQ ID NO: 883619 - RNA, 20 nt, Homo sapiens
cuuggggagauggaguucuu

SEQ ID NO: 883620 - RNA, 17 nt, Homo sapiens
cuuggucuaagugugcu

SEQ ID NO: 883621 - RNA, 18 nt, Homo sapiens
cuuguaauucuaaaugaa

SEQ ID NO: 883622 - RNA, 18 nt, Homo sapiens
cuuguagcagaaggcaag

SEQ ID NO: 883623 - RNA, 14 nt, Homo sapiens
cuuguauauacaua

SEQ ID NO: 883624 - RNA, 15 nt, Homo sapiens
cuuguccaugugguu

SEQ ID NO: 883625 - RNA, 21 nt, Homo sapiens
cuuguccccgggguauuagca

SEQ ID NO: 883626 - RNA, 15 nt, Homo sapiens
cuugucuccauuugg

SEQ ID NO: 883627 - RNA, 21 nt, Homo sapiens
cuugucuuuaaaucuucaaua

SEQ ID NO: 883628 - RNA, 15 nt, Homo sapiens
cuugugaaaccacag

SEQ ID NO: 883629 - RNA, 16 nt, Homo sapiens
cuugugauucugggau

SEQ ID NO: 883630 - RNA, 16 nt, Homo sapiens
cuuguggauaagggag

SEQ ID NO: 883631 - RNA, 19 nt, Homo sapiens
cuugugguuuaugucauca

SEQ ID NO: 883632 - RNA, 18 nt, Homo sapiens
cuuguguccccaccucag

SEQ ID NO: 883633 - RNA, 15 nt, Homo sapiens
cuuguguccugauga

SEQ ID NO: 883634 - RNA, 13 nt, Homo sapiens
cuuguucuuuaaa

SEQ ID NO: 883635 - RNA, 21 nt, Homo sapiens
gaauucucgaacugcauguau

SEQ ID NO: 883636 - RNA, 15 nt, Homo sapiens
gaauucuuuacaaua

SEQ ID NO: 883637 - RNA, 15 nt, Homo sapiens
gaauugcaugccauc

SEQ ID NO: 883638 - RNA, 17 nt, Homo sapiens
gaauuuggccugcacua

SEQ ID NO: 883639 - RNA, 15 nt, Homo sapiens
gaauuuuaagugcuu

SEQ ID NO: 883640 - RNA, 16 nt, Homo sapiens
gaauuuuuaaacaagu

SEQ ID NO: 883641 - RNA, 15 nt, Homo sapiens
gacaaaacacugugu

SEQ ID NO: 883642 - RNA, 20 nt, Homo sapiens
gacaaaccacuguacauaua

SEQ ID NO: 883643 - RNA, 12 nt, Homo sapiens
gacaaagccaaa

SEQ ID NO: 883644 - RNA, 21 nt, Homo sapiens
gacaaagguuuuccucuucua

SEQ ID NO: 883645 - RNA, 19 nt, Homo sapiens
gacaaaguugaauguaaag

SEQ ID NO: 883646 - RNA, 16 nt, Homo sapiens
gacaacagcauaacua

SEQ ID NO: 883647 - RNA, 12 nt, Homo sapiens
gacaacauuuua

SEQ ID NO: 883648 - RNA, 18 nt, Homo sapiens
gacaagaaggccacuggu

SEQ ID NO: 883649 - RNA, 20 nt, Homo sapiens
gacaagcaagggcugugcug

SEQ ID NO: 883650 - RNA, 22 nt, Homo sapiens
gacaagcaagggcugugcugag

SEQ ID NO: 883651 - RNA, 15 nt, Homo sapiens
gacaagcaugguccc

SEQ ID NO: 883652 - RNA, 16 nt, Homo sapiens
gacaagggcugaccug

SEQ ID NO: 883653 - RNA, 20 nt, Homo sapiens
gacaaggggagggccaggau

SEQ ID NO: 883654 - RNA, 20 nt, Homo sapiens
gacaauaaaacauuccugug

SEQ ID NO: 883655 - RNA, 14 nt, Homo sapiens
gacaauaggccaug

SEQ ID NO: 883656 - RNA, 22 nt, Homo sapiens
gacaauccccacauaccaucug

SEQ ID NO: 883657 - RNA, 23 nt, Homo sapiens
gacaaugaugugaguacccagga

SEQ ID NO: 883658 - RNA, 12 nt, Homo sapiens
gacacacuguaa

SEQ ID NO: 883659 - RNA, 16 nt, Homo sapiens
gacacagagggggccu

SEQ ID NO: 883660 - RNA, 21 nt, Homo sapiens
gacacagcucuucuccaggcu

SEQ ID NO: 883661 - RNA, 12 nt, Homo sapiens
gacacaggccag

SEQ ID NO: 883662 - RNA, 13 nt, Homo sapiens
gacacaggccagc

SEQ ID NO: 883663 - RNA, 13 nt, Homo sapiens
gacacauaugcac

SEQ ID NO: 883664 - RNA, 19 nt, Homo sapiens
gacacauaugcaccuugug

SEQ ID NO: 883665 - RNA, 20 nt, Homo sapiens
gacacauucuccugugcccc

SEQ ID NO: 883666 - RNA, 15 nt, Homo sapiens
gacaccgaguuccac

SEQ ID NO: 883667 - RNA, 18 nt, Homo sapiens
gacaccgucccucaguga

SEQ ID NO: 883668 - RNA, 15 nt, Homo sapiens
gacaccuccauuucu

SEQ ID NO: 883669 - RNA, 17 nt, Homo sapiens
gacaccuugacagggca

SEQ ID NO: 883670 - RNA, 23 nt, Homo sapiens
gacaccuuuuguauuuaaaaccu

SEQ ID NO: 883671 - RNA, 22 nt, Homo sapiens
gacacuucuaaaugaagugcaa

SEQ ID NO: 883672 - RNA, 22 nt, Homo sapiens
gacagaaaaaaaaaaaaaauca

SEQ ID NO: 883673 - RNA, 16 nt, Homo sapiens
gacagaagucuugucu

SEQ ID NO: 883674 - RNA, 14 nt, Homo sapiens
gacagaccuggaca

SEQ ID NO: 883675 - RNA, 12 nt, Homo sapiens
gacagaccuuca

SEQ ID NO: 883676 - RNA, 14 nt, Homo sapiens
gacagagucucacu

SEQ ID NO: 883677 - RNA, 22 nt, Homo sapiens
gacagccagagccugucuuuca

SEQ ID NO: 883678 - RNA, 13 nt, Homo sapiens
gacagccuggcac

SEQ ID NO: 883679 - RNA, 15 nt, Homo sapiens
gacaggaauacuuaa

SEQ ID NO: 883680 - RNA, 19 nt, Homo sapiens
gacaggaggaaucauguca

SEQ ID NO: 883681 - RNA, 18 nt, Homo sapiens
gacaggauaagagggauu

SEQ ID NO: 883682 - RNA, 19 nt, Homo sapiens
gacagggucucacuauguu

SEQ ID NO: 883683 - RNA, 13 nt, Homo sapiens
gacaggguuucac

SEQ ID NO: 883684 - RNA, 15 nt, Homo sapiens
gacaguaguccccuc

SEQ ID NO: 883685 - RNA, 23 nt, Homo sapiens
gacagucccuugcugacauggcu

SEQ ID NO: 883686 - RNA, 12 nt, Homo sapiens
gacagucuugca

SEQ ID NO: 883687 - RNA, 17 nt, Homo sapiens
gacaguguuuucuggga

SEQ ID NO: 883688 - RNA, 13 nt, Homo sapiens
gacauaugcauuu

SEQ ID NO: 883689 - RNA, 16 nt, Homo sapiens
gacaucaaauuugcca

SEQ ID NO: 883690 - RNA, 24 nt, Homo sapiens
gacaucuccucuaucacauuacau

SEQ ID NO: 883691 - RNA, 21 nt, Homo sapiens
gacaugaaaucugaggaaggu

SEQ ID NO: 883692 - RNA, 19 nt, Homo sapiens
gacaugaacagaaacaaua

SEQ ID NO: 883693 - RNA, 15 nt, Homo sapiens
gacaugcacugaccc

SEQ ID NO: 883694 - RNA, 23 nt, Homo sapiens
gacauggguagcaauucuaccca

SEQ ID NO: 883695 - RNA, 16 nt, Homo sapiens
gacaugggugugccag

SEQ ID NO: 883696 - RNA, 20 nt, Homo sapiens
gacaugggugugccaggcua

SEQ ID NO: 883697 - RNA, 18 nt, Homo sapiens
gacaugucuagccacuga

SEQ ID NO: 883698 - RNA, 21 nt, Homo sapiens
gacaugucucacagacgcucc

SEQ ID NO: 883699 - RNA, 15 nt, Homo sapiens
gacauguuucacaac

SEQ ID NO: 883700 - RNA, 22 nt, Homo sapiens
gacauucaaggcauuucuauca

SEQ ID NO: 883701 - RNA, 14 nt, Homo sapiens
gacauuccaaagaa

SEQ ID NO: 883702 - RNA, 20 nt, Homo sapiens
gacauucuggaaaagcaaaa

SEQ ID NO: 883703 - RNA, 20 nt, Homo sapiens
gacauuucccuccugggaga

SEQ ID NO: 883704 - RNA, 18 nt, Homo sapiens
gaccaaauaaaguaccau

SEQ ID NO: 883705 - RNA, 18 nt, Homo sapiens
gaccaacaccccucccac

SEQ ID NO: 883706 - RNA, 22 nt, Homo sapiens
gaccaccucucaauauucaaua

SEQ ID NO: 883707 - RNA, 17 nt, Homo sapiens
gaccacugggcaaugau

SEQ ID NO: 883708 - RNA, 21 nt, Homo sapiens
gaccaggcaccaggcaggguc

SEQ ID NO: 883709 - RNA, 15 nt, Homo sapiens
gaccauaaagggaaa

SEQ ID NO: 883710 - RNA, 22 nt, Homo sapiens
gaccauccuggcuaacacguga

SEQ ID NO: 883711 - RNA, 17 nt, Homo sapiens
gaccauuguaacaauag

SEQ ID NO: 883712 - RNA, 14 nt, Homo sapiens
gaccauugucuucc

SEQ ID NO: 883713 - RNA, 16 nt, Homo sapiens
gaccauugucuuccaa

SEQ ID NO: 883714 - RNA, 23 nt, Homo sapiens
gacccaaguguugaggggaccaa

SEQ ID NO: 883715 - RNA, 19 nt, Homo sapiens
gacccacgaacgcucuuag

SEQ ID NO: 883716 - RNA, 15 nt, Homo sapiens
gacccaggcccucca

SEQ ID NO: 883717 - RNA, 21 nt, Homo sapiens
gaccccaaagagccuggagaa

SEQ ID NO: 883718 - RNA, 24 nt, Homo sapiens
gaccccagggcacaggagcuaccu

SEQ ID NO: 883719 - RNA, 12 nt, Homo sapiens
gaccccaucuca

SEQ ID NO: 883720 - RNA, 18 nt, Homo sapiens
gaccccugaauucaauga

SEQ ID NO: 883721 - RNA, 17 nt, Homo sapiens
gaccccuggccggccca

SEQ ID NO: 883722 - RNA, 23 nt, Homo sapiens
gaccccuuucccccaccccagag

SEQ ID NO: 883723 - RNA, 21 nt, Homo sapiens
gacccuaagaccggcggccau

SEQ ID NO: 883724 - RNA, 20 nt, Homo sapiens
gacccucugaaugguccagg

SEQ ID NO: 883725 - RNA, 22 nt, Homo sapiens
gaccgugcuaacuguguguaca

SEQ ID NO: 883726 - RNA, 17 nt, Homo sapiens
gaccuaaccuaagcaaa

SEQ ID NO: 883727 - RNA, 15 nt, Homo sapiens
gaccuacuaaaaaua

SEQ ID NO: 883728 - RNA, 15 nt, Homo sapiens
gaccuaggauuucau

SEQ ID NO: 883729 - RNA, 13 nt, Homo sapiens
gaccucacaguga

SEQ ID NO: 883730 - RNA, 22 nt, Homo sapiens
gaccucaggugauccacccacc

SEQ ID NO: 883731 - RNA, 14 nt, Homo sapiens
gaccuccacauuaa

SEQ ID NO: 883732 - RNA, 15 nt, Homo sapiens
gaccuccagcuuucc

SEQ ID NO: 883733 - RNA, 19 nt, Homo sapiens
gaccugacaagcacugcua

SEQ ID NO: 883734 - RNA, 23 nt, Homo sapiens
gaccugacaccgucccucaguga

SEQ ID NO: 883735 - RNA, 20 nt, Homo sapiens
gaccugaggcuccugugcua

SEQ ID NO: 883736 - RNA, 17 nt, Homo sapiens
gaccuuccacacagggu

SEQ ID NO: 883737 - RNA, 14 nt, Homo sapiens
gaccuuccugccac

SEQ ID NO: 883738 - RNA, 22 nt, Homo sapiens
gaccuucuaggaagcuccaguu

SEQ ID NO: 883739 - RNA, 22 nt, Homo sapiens
gaccuuucugagugacaugggu

SEQ ID NO: 883740 - RNA, 13 nt, Homo sapiens
gacggaaggcaaa

SEQ ID NO: 883741 - RNA, 15 nt, Homo sapiens
gacggaaggcaaaga

SEQ ID NO: 883742 - RNA, 23 nt, Homo sapiens
gacggacguugguucugcacuaa

SEQ ID NO: 883743 - RNA, 21 nt, Homo sapiens
gacgguuaacuuguauauucc

SEQ ID NO: 883744 - RNA, 21 nt, Homo sapiens
gacuaacauaaaaucugugaa

SEQ ID NO: 883745 - RNA, 19 nt, Homo sapiens
gacuaaccugcccacccac

SEQ ID NO: 883746 - RNA, 13 nt, Homo sapiens
gacuaacuaucaa

SEQ ID NO: 883747 - RNA, 15 nt, Homo sapiens
gacuaaugcaugugg

SEQ ID NO: 883748 - RNA, 15 nt, Homo sapiens
gacuagagcucaggc

SEQ ID NO: 883749 - RNA, 20 nt, Homo sapiens
gguuaucacuuuucuguaac

SEQ ID NO: 883750 - RNA, 16 nt, Homo sapiens
gguucagacugagcuc

SEQ ID NO: 883751 - RNA, 22 nt, Homo sapiens
gguucccaauaaaagugacucu

SEQ ID NO: 883752 - RNA, 18 nt, Homo sapiens
gguuccggugucuggaaa

SEQ ID NO: 883753 - RNA, 22 nt, Homo sapiens
gguucuuuccaugcagacuccu

SEQ ID NO: 883754 - RNA, 18 nt, Homo sapiens
gguugaucacacucuggg

SEQ ID NO: 883755 - RNA, 17 nt, Homo sapiens
gguuucucagaauccaa

SEQ ID NO: 883756 - RNA, 14 nt, Homo sapiens
gguuucucuguaua

SEQ ID NO: 883757 - RNA, 11 nt, Homo sapiens
gguuugcaguu

SEQ ID NO: 883758 - RNA, 14 nt, Homo sapiens
guaaaaacuuguac

SEQ ID NO: 883759 - RNA, 13 nt, Homo sapiens
guaaaauauuuau

SEQ ID NO: 883760 - RNA, 14 nt, Homo sapiens
guaaaaucuuggca

SEQ ID NO: 883761 - RNA, 15 nt, Homo sapiens
guaaacaaaggaauu

SEQ ID NO: 883762 - RNA, 13 nt, Homo sapiens
guaaacauaauuc

SEQ ID NO: 883763 - RNA, 12 nt, Homo sapiens
guaaaccaaaaa

SEQ ID NO: 883764 - RNA, 19 nt, Homo sapiens
guaaacuauaaacuacugu

SEQ ID NO: 883765 - RNA, 15 nt, Homo sapiens
guaaacuguaucaaa

SEQ ID NO: 883766 - RNA, 14 nt, Homo sapiens
guaaagaugucaau

SEQ ID NO: 883767 - RNA, 16 nt, Homo sapiens
guaaaugccacaaaga

SEQ ID NO: 883768 - RNA, 15 nt, Homo sapiens
guaaauguuuagguu

SEQ ID NO: 883769 - RNA, 18 nt, Homo sapiens
guaacaacuguggucaau

SEQ ID NO: 883770 - RNA, 18 nt, Homo sapiens
guaacaugcaauuuugca

SEQ ID NO: 883771 - RNA, 16 nt, Homo sapiens
guaaccaaauguuggc

SEQ ID NO: 883772 - RNA, 20 nt, Homo sapiens
guaacccgcucaucacugga

SEQ ID NO: 883773 - RNA, 21 nt, Homo sapiens
guaacccgcucaucacuggau

SEQ ID NO: 883774 - RNA, 22 nt, Homo sapiens
guaaccuccacaguagcauuuc

SEQ ID NO: 883775 - RNA, 23 nt, Homo sapiens
guaaccuccacaguagcauuucu

SEQ ID NO: 883776 - RNA, 19 nt, Homo sapiens
guaacuccagcucugcucc

SEQ ID NO: 883777 - RNA, 14 nt, Homo sapiens
guaaggaacuggaa

SEQ ID NO: 883778 - RNA, 15 nt, Homo sapiens
guaaggaacuggaac

SEQ ID NO: 883779 - RNA, 15 nt, Homo sapiens
guaagggaaacugcc

SEQ ID NO: 883780 - RNA, 21 nt, Homo sapiens
guaagguaauuucuguguauu

SEQ ID NO: 883781 - RNA, 21 nt, Homo sapiens
guaauaaaacccagcauguac

SEQ ID NO: 883782 - RNA, 18 nt, Homo sapiens
guaauaaacgucuugcca

SEQ ID NO: 883783 - RNA, 18 nt, Homo sapiens
guaauaguccauggacaa

SEQ ID NO: 883784 - RNA, 16 nt, Homo sapiens
guaaucccagcacuuu

SEQ ID NO: 883785 - RNA, 16 nt, Homo sapiens
guaaucccccuugcca

SEQ ID NO: 883786 - RNA, 22 nt, Homo sapiens
guaaugaaacaaagaguucaag

SEQ ID NO: 883787 - RNA, 20 nt, Homo sapiens
guaauuuagcaguccaaaga

SEQ ID NO: 883788 - RNA, 18 nt, Homo sapiens
guaauuugauacugaccu

SEQ ID NO: 883789 - RNA, 22 nt, Homo sapiens
guaauuuguggaggacuuugaa

SEQ ID NO: 883790 - RNA, 20 nt, Homo sapiens
guacaaacacaggauuugua

SEQ ID NO: 883791 - RNA, 15 nt, Homo sapiens
guacaaauuguucau

SEQ ID NO: 883792 - RNA, 16 nt, Homo sapiens
guacacagcaccagaa

SEQ ID NO: 883793 - RNA, 15 nt, Homo sapiens
guacaccauaugcaa

SEQ ID NO: 883794 - RNA, 22 nt, Homo sapiens
guacagaauuuuuaaugacuuu

SEQ ID NO: 883795 - RNA, 16 nt, Homo sapiens
guacaggcaacaauga

SEQ ID NO: 883796 - RNA, 19 nt, Homo sapiens
guacauucccugcauccaa

SEQ ID NO: 883797 - RNA, 21 nt, Homo sapiens
guacauuucccugugcugacg

SEQ ID NO: 883798 - RNA, 21 nt, Homo sapiens
guaccucccccugccuuccaa

SEQ ID NO: 883799 - RNA, 14 nt, Homo sapiens
guaccucucuuaua

SEQ ID NO: 883800 - RNA, 20 nt, Homo sapiens
guacgaugcauccauuucag

SEQ ID NO: 883801 - RNA, 17 nt, Homo sapiens
guacguuuuugcauuau

SEQ ID NO: 883802 - RNA, 21 nt, Homo sapiens
guacuacugcugcaaagugca

SEQ ID NO: 883803 - RNA, 20 nt, Homo sapiens
guacuccagccugggugaca

SEQ ID NO: 883804 - RNA, 20 nt, Homo sapiens
guacucuuaacuccuagccc

SEQ ID NO: 883805 - RNA, 17 nt, Homo sapiens
guacugaaaaaaaaaga

SEQ ID NO: 883806 - RNA, 21 nt, Homo sapiens
guacuucaaguuaaagugaau

SEQ ID NO: 883807 - RNA, 18 nt, Homo sapiens
guacuugugaccauugua

SEQ ID NO: 883808 - RNA, 22 nt, Homo sapiens
guacuuuauuuguauuugccau

SEQ ID NO: 883809 - RNA, 16 nt, Homo sapiens
guagaagucucuucca

SEQ ID NO: 883810 - RNA, 18 nt, Homo sapiens
guagagguuuuguuguuu

SEQ ID NO: 883811 - RNA, 22 nt, Homo sapiens
guagaguuugaaggaggugagg

SEQ ID NO: 883812 - RNA, 19 nt, Homo sapiens
guagaugccggcaggccuu

SEQ ID NO: 883813 - RNA, 16 nt, Homo sapiens
guagauuaccugccac

SEQ ID NO: 883814 - RNA, 15 nt, Homo sapiens
guagcauacauuuau

SEQ ID NO: 883815 - RNA, 14 nt, Homo sapiens
guagcucuguccac

SEQ ID NO: 883816 - RNA, 19 nt, Homo sapiens
guagcucuguccacucuga

SEQ ID NO: 883817 - RNA, 12 nt, Homo sapiens
guagcugaugaa

SEQ ID NO: 883818 - RNA, 19 nt, Homo sapiens
guagcugggacuacaggca

SEQ ID NO: 883819 - RNA, 17 nt, Homo sapiens
guagcuuaccugacaca

SEQ ID NO: 883820 - RNA, 22 nt, Homo sapiens
guaggaaagcaccgcagcaugu

SEQ ID NO: 883821 - RNA, 13 nt, Homo sapiens
guaggcagggaac

SEQ ID NO: 883822 - RNA, 13 nt, Homo sapiens
guagggaugccuu

SEQ ID NO: 883823 - RNA, 22 nt, Homo sapiens
guagguacuucacauugcaaac

SEQ ID NO: 883824 - RNA, 16 nt, Homo sapiens
guagguggaucaccug

SEQ ID NO: 883825 - RNA, 15 nt, Homo sapiens
guaggugucugcacc

SEQ ID NO: 883826 - RNA, 14 nt, Homo sapiens
guagguucuugaua

SEQ ID NO: 883827 - RNA, 20 nt, Homo sapiens
guaguauggccugugucacu

SEQ ID NO: 883828 - RNA, 15 nt, Homo sapiens
guaguccguuaacac

SEQ ID NO: 883829 - RNA, 14 nt, Homo sapiens
guagugggugaaug

SEQ ID NO: 883830 - RNA, 18 nt, Homo sapiens
guaguuguugaguucaag

SEQ ID NO: 883831 - RNA, 18 nt, Homo sapiens
guauaaagugaucaguau

SEQ ID NO: 883832 - RNA, 15 nt, Homo sapiens
guauacacacauaua

SEQ ID NO: 883833 - RNA, 11 nt, Homo sapiens
guauacuguac

SEQ ID NO: 883834 - RNA, 17 nt, Homo sapiens
guauagcugacaucucc

SEQ ID NO: 883835 - RNA, 17 nt, Homo sapiens
guauauacacauauacc

SEQ ID NO: 883836 - RNA, 13 nt, Homo sapiens
guauauacauaug

SEQ ID NO: 883837 - RNA, 15 nt, Homo sapiens
guauauagaagucua

SEQ ID NO: 883838 - RNA, 16 nt, Homo sapiens
guauauagaugugcaa

SEQ ID NO: 883839 - RNA, 20 nt, Homo sapiens
guauauuaugguguaaugca

SEQ ID NO: 883840 - RNA, 20 nt, Homo sapiens
guauauucugguuacugugg

SEQ ID NO: 883841 - RNA, 14 nt, Homo sapiens
guauauuuaucaaa

SEQ ID NO: 883842 - RNA, 12 nt, Homo sapiens
guaucaucagau

SEQ ID NO: 883843 - RNA, 15 nt, Homo sapiens
guauccaauuaugug

SEQ ID NO: 883844 - RNA, 13 nt, Homo sapiens
guaucuaccaucu

SEQ ID NO: 883845 - RNA, 20 nt, Homo sapiens
guaucuaccucacuauucaa

SEQ ID NO: 883846 - RNA, 19 nt, Homo sapiens
guaugaguggcuucuggga

SEQ ID NO: 883847 - RNA, 14 nt, Homo sapiens
guaugcucauacuu

SEQ ID NO: 883848 - RNA, 13 nt, Homo sapiens
guaugcuggccag

SEQ ID NO: 883849 - RNA, 18 nt, Homo sapiens
guaugcuggccagcaccc

SEQ ID NO: 883850 - RNA, 19 nt, Homo sapiens
guauguaaguaauugcauu

SEQ ID NO: 883851 - RNA, 17 nt, Homo sapiens
guauguacuaagcagua

SEQ ID NO: 883852 - RNA, 23 nt, Homo sapiens
guauguaggcaauacauguaucu

SEQ ID NO: 883853 - RNA, 20 nt, Homo sapiens
guauguauacacacauauac

SEQ ID NO: 883854 - RNA, 21 nt, Homo sapiens
guauguauacacacauauaca

SEQ ID NO: 883855 - RNA, 18 nt, Homo sapiens
guaugugcacaugugucu

SEQ ID NO: 883856 - RNA, 21 nt, Homo sapiens
guauguguauuuguauguacu

SEQ ID NO: 883857 - RNA, 16 nt, Homo sapiens
guauuaauaugcuaca

SEQ ID NO: 883858 - RNA, 20 nt, Homo sapiens
guauucuacagcagauacuu

SEQ ID NO: 883859 - RNA, 21 nt, Homo sapiens
guauucuuuacuaaagauauc

SEQ ID NO: 883860 - RNA, 19 nt, Homo sapiens
guauuugaaaacucacaga

SEQ ID NO: 883861 - RNA, 16 nt, Homo sapiens
guauuugccagcuuua

SEQ ID NO: 883862 - RNA, 19 nt, Homo sapiens
guauuuuaaaacauaagaa

SEQ ID NO: 883863 - RNA, 19 nt, Homo sapiens
guauuuuagcaggguacau

SEQ ID NO: 883864 - RNA, 16 nt, Homo sapiens
guuucaggacaugggg

SEQ ID NO: 883865 - RNA, 16 nt, Homo sapiens
guuucaguugacaaaa

SEQ ID NO: 883866 - RNA, 15 nt, Homo sapiens
guuucaucuguucau

SEQ ID NO: 883867 - RNA, 11 nt, Homo sapiens
guuucauucau

SEQ ID NO: 883868 - RNA, 15 nt, Homo sapiens
guuuccaaaaaggaa

SEQ ID NO: 883869 - RNA, 17 nt, Homo sapiens
guuuccacugucuugcc

SEQ ID NO: 883870 - RNA, 20 nt, Homo sapiens
guuucuauucuaaguaauuc

SEQ ID NO: 883871 - RNA, 21 nt, Homo sapiens
guuucuccuuuugaccaaaua

SEQ ID NO: 883872 - RNA, 20 nt, Homo sapiens
guuucugaaccauuacugua

SEQ ID NO: 883873 - RNA, 23 nt, Homo sapiens
guuucugagcauaaugcucccau

SEQ ID NO: 883874 - RNA, 18 nt, Homo sapiens
guuucuggggacaccagc

SEQ ID NO: 883875 - RNA, 17 nt, Homo sapiens
guuucuguuucuauucu

SEQ ID NO: 883876 - RNA, 11 nt, Homo sapiens
guuucuuccaa

SEQ ID NO: 883877 - RNA, 15 nt, Homo sapiens
guuucuuccuuuccu

SEQ ID NO: 883878 - RNA, 14 nt, Homo sapiens
guuucuugcucuga

SEQ ID NO: 883879 - RNA, 15 nt, Homo sapiens
guuucuugggguccc

SEQ ID NO: 883880 - RNA, 15 nt, Homo sapiens
guuucuugugggcua

SEQ ID NO: 883881 - RNA, 20 nt, Homo sapiens
guuugaaggaggugagggau

SEQ ID NO: 883882 - RNA, 13 nt, Homo sapiens
guuugagaccagc

SEQ ID NO: 883883 - RNA, 14 nt, Homo sapiens
guuugagcuuucau

SEQ ID NO: 883884 - RNA, 16 nt, Homo sapiens
guuugcaauuuuucca

SEQ ID NO: 883885 - RNA, 23 nt, Homo sapiens
guuugcaccuuucuaguugaaaa

SEQ ID NO: 883886 - RNA, 23 nt, Homo sapiens
guuugcucuugcauugcaaaaau

SEQ ID NO: 883887 - RNA, 15 nt, Homo sapiens
guuugcuguuugcaa

SEQ ID NO: 883888 - RNA, 13 nt, Homo sapiens
guuugucaaaaag

SEQ ID NO: 883889 - RNA, 11 nt, Homo sapiens
guuugucauau

SEQ ID NO: 883890 - RNA, 23 nt, Homo sapiens
guuugucuauaugucuagcucau

SEQ ID NO: 883891 - RNA, 22 nt, Homo sapiens
guuuuacaaauuuaauuuugca

SEQ ID NO: 883892 - RNA, 18 nt, Homo sapiens
guuuuacuuuugucuucc

SEQ ID NO: 883893 - RNA, 18 nt, Homo sapiens
guuuuauauguaguacua

SEQ ID NO: 883894 - RNA, 17 nt, Homo sapiens
guuuucauggugaaaau

SEQ ID NO: 883895 - RNA, 14 nt, Homo sapiens
guuuucauuaucuc

SEQ ID NO: 883896 - RNA, 15 nt, Homo sapiens
guuuuguaccaacac

SEQ ID NO: 883897 - RNA, 18 nt, Homo sapiens
guuuuuaaaaguuucaau

SEQ ID NO: 883898 - RNA, 12 nt, Homo sapiens
guuuuucuuauc

SEQ ID NO: 883899 - RNA, 22 nt, Homo sapiens
guuuuugaagaagggaaauuca

SEQ ID NO: 883900 - RNA, 21 nt, Homo sapiens
guuuuuggcucuuucagagag

SEQ ID NO: 883901 - RNA, 20 nt, Homo sapiens
uaaaaaaaaaccuagcaucu

SEQ ID NO: 883902 - RNA, 13 nt, Homo sapiens
uaaaaaauggaac

SEQ ID NO: 883903 - RNA, 13 nt, Homo sapiens
uaaaaacauuccc

SEQ ID NO: 883904 - RNA, 23 nt, Homo sapiens
uaaaaacccuguauggcacuuau

SEQ ID NO: 883905 - RNA, 12 nt, Homo sapiens
uaaaaacuaaaa

SEQ ID NO: 883906 - RNA, 13 nt, Homo sapiens
uaaaaacugagug

SEQ ID NO: 883907 - RNA, 18 nt, Homo sapiens
uaaaaagacuaaccugcc

SEQ ID NO: 883908 - RNA, 16 nt, Homo sapiens
uaaaaauacaaaaaau

SEQ ID NO: 883909 - RNA, 19 nt, Homo sapiens
uaaaaaucaugagauccuu

SEQ ID NO: 883910 - RNA, 12 nt, Homo sapiens
uaaaaaugcaua

SEQ ID NO: 883911 - RNA, 12 nt, Homo sapiens
uaaaacacagcu

SEQ ID NO: 883912 - RNA, 16 nt, Homo sapiens
uaaaacccagcaugua

SEQ ID NO: 883913 - RNA, 21 nt, Homo sapiens
uaaaacccagcauguacaaaa

SEQ ID NO: 883914 - RNA, 17 nt, Homo sapiens
uaaaacuacacaucccu

SEQ ID NO: 883915 - RNA, 17 nt, Homo sapiens
uaaaacuauauucucag

SEQ ID NO: 883916 - RNA, 21 nt, Homo sapiens
uaaaacugauuuuuagcuuua

SEQ ID NO: 883917 - RNA, 22 nt, Homo sapiens
uaaaagaauaaaauugcacuuu

SEQ ID NO: 883918 - RNA, 17 nt, Homo sapiens
uaaaagaauuugugaca

SEQ ID NO: 883919 - RNA, 15 nt, Homo sapiens
uaaaagccucuggug

SEQ ID NO: 883920 - RNA, 15 nt, Homo sapiens
uaaaagugacucuca

SEQ ID NO: 883921 - RNA, 22 nt, Homo sapiens
uaaaauaaauaaaugcaauaug

SEQ ID NO: 883922 - RNA, 20 nt, Homo sapiens
uaaaauaaggauaauaauca

SEQ ID NO: 883923 - RNA, 21 nt, Homo sapiens
uaaaauagaaauaagugguua

SEQ ID NO: 883924 - RNA, 22 nt, Homo sapiens
uaaaauaggaaccuaugaaacu

SEQ ID NO: 883925 - RNA, 17 nt, Homo sapiens
uaaaauauaagaucuga

SEQ ID NO: 883926 - RNA, 15 nt, Homo sapiens
uaaaauauacaaaca

SEQ ID NO: 883927 - RNA, 14 nt, Homo sapiens
uaaaauauggcuau

SEQ ID NO: 883928 - RNA, 19 nt, Homo sapiens
uaaaauauuccugcauuug

SEQ ID NO: 883929 - RNA, 20 nt, Homo sapiens
uaaaauauuuuuaugugcaa

SEQ ID NO: 883930 - RNA, 21 nt, Homo sapiens
uaaaaucauaaauauaaucua

SEQ ID NO: 883931 - RNA, 19 nt, Homo sapiens
uaaaaugaaauuacuacaa

SEQ ID NO: 883932 - RNA, 14 nt, Homo sapiens
uaaaauguuauuau

SEQ ID NO: 883933 - RNA, 18 nt, Homo sapiens
uaaaauuaaaugcauguc

SEQ ID NO: 883934 - RNA, 23 nt, Homo sapiens
uaaaauuaaaugcauguccucaa

SEQ ID NO: 883935 - RNA, 18 nt, Homo sapiens
uaaaauuagaaagcaacu

SEQ ID NO: 883936 - RNA, 13 nt, Homo sapiens
uaaaauuagugag

SEQ ID NO: 883937 - RNA, 15 nt, Homo sapiens
uaaaauuaugccaua

SEQ ID NO: 883938 - RNA, 14 nt, Homo sapiens
uaaaauucacuuag

SEQ ID NO: 883939 - RNA, 18 nt, Homo sapiens
uaaaauugaacuacuugg

SEQ ID NO: 883940 - RNA, 18 nt, Homo sapiens
uaaaauuuaccacagacu

SEQ ID NO: 883941 - RNA, 16 nt, Homo sapiens
uaaacaacuaccuccu

SEQ ID NO: 883942 - RNA, 18 nt, Homo sapiens
uaaacacauacauugcca

SEQ ID NO: 883943 - RNA, 14 nt, Homo sapiens
uaaacacccaugaa

SEQ ID NO: 883944 - RNA, 20 nt, Homo sapiens
uaaacagugagccugaauuu

SEQ ID NO: 883945 - RNA, 17 nt, Homo sapiens
uaaacaugagcgcugau

SEQ ID NO: 883946 - RNA, 13 nt, Homo sapiens
uaaacauguguuu

SEQ ID NO: 883947 - RNA, 21 nt, Homo sapiens
uaaacauucaucaagcuguac

SEQ ID NO: 883948 - RNA, 20 nt, Homo sapiens
uaaacauugguauauuucca

SEQ ID NO: 883949 - RNA, 13 nt, Homo sapiens
uaaaccaaaaagg

SEQ ID NO: 883950 - RNA, 22 nt, Homo sapiens
uaaacccaaauaaauguguaaa

SEQ ID NO: 883951 - RNA, 22 nt, Homo sapiens
uaaacccagcucccuucuuccc

SEQ ID NO: 883952 - RNA, 13 nt, Homo sapiens
uaaaccuagggag

SEQ ID NO: 883953 - RNA, 11 nt, Homo sapiens
uaaaccuggag

SEQ ID NO: 883954 - RNA, 15 nt, Homo sapiens
uaaacuaaaagcaua

SEQ ID NO: 883955 - RNA, 15 nt, Homo sapiens
uaaacuacuuguaaa

SEQ ID NO: 883956 - RNA, 17 nt, Homo sapiens
uaaacuaucuuggugaa

SEQ ID NO: 883957 - RNA, 19 nt, Homo sapiens
uaaacugguugucaguuac

SEQ ID NO: 883958 - RNA, 14 nt, Homo sapiens
uaaacuguacaugu

SEQ ID NO: 883959 - RNA, 20 nt, Homo sapiens
uaaacuuaauuuuguaaaac

SEQ ID NO: 883960 - RNA, 21 nt, Homo sapiens
uaaacuuaccugggcauucuu

SEQ ID NO: 883961 - RNA, 13 nt, Homo sapiens
uaaacuuuucaaa

SEQ ID NO: 883962 - RNA, 22 nt, Homo sapiens
uaaagaacacgaauugcucaau

SEQ ID NO: 883963 - RNA, 10 nt, Homo sapiens
uaaagacuua

SEQ ID NO: 883964 - RNA, 22 nt, Homo sapiens
uaaagaugcccuaaguguugaa

SEQ ID NO: 883965 - RNA, 19 nt, Homo sapiens
uaaagcaguagacaauccc

SEQ ID NO: 883966 - RNA, 13 nt, Homo sapiens
uaaagcauugcaa

SEQ ID NO: 883967 - RNA, 19 nt, Homo sapiens
uaaagcucugaacaaaagc

SEQ ID NO: 883968 - RNA, 13 nt, Homo sapiens
uaaagcugcugag

SEQ ID NO: 883969 - RNA, 19 nt, Homo sapiens
uaaaggaaggagauacuca

SEQ ID NO: 883970 - RNA, 16 nt, Homo sapiens
uaaaggggagauacuc

SEQ ID NO: 883971 - RNA, 16 nt, Homo sapiens
uaaaguacccugugcu

SEQ ID NO: 883972 - RNA, 16 nt, Homo sapiens
uaaagucaacaaccau

SEQ ID NO: 883973 - RNA, 20 nt, Homo sapiens
uaaagucaacaaccaugcca

SEQ ID NO: 883974 - RNA, 18 nt, Homo sapiens
uaaagucacuuccagugu

SEQ ID NO: 883975 - RNA, 13 nt, Homo sapiens
uaaagucucugcu

SEQ ID NO: 883976 - RNA, 21 nt, Homo sapiens
uaaagugaauaaccacuuaaa

SEQ ID NO: 883977 - RNA, 18 nt, Homo sapiens
uaaagugccuaccccagc

SEQ ID NO: 883978 - RNA, 17 nt, Homo sapiens
uaaaguguggaagcaga

SEQ ID NO: 883979 - RNA, 16 nt, Homo sapiens
uagacaaaguucaagu

SEQ ID NO: 883980 - RNA, 21 nt, Homo sapiens
uagacaauccccacauaccau

SEQ ID NO: 883981 - RNA, 22 nt, Homo sapiens
uagacaaugaugugaguaccca

SEQ ID NO: 883982 - RNA, 23 nt, Homo sapiens
uagacacccauuuucacauuccc

SEQ ID NO: 883983 - RNA, 16 nt, Homo sapiens
uagacagagucucacu

SEQ ID NO: 883984 - RNA, 13 nt, Homo sapiens
uagaccacugucc

SEQ ID NO: 883985 - RNA, 13 nt, Homo sapiens
uagacuagugcuu

SEQ ID NO: 883986 - RNA, 19 nt, Homo sapiens
uagagaaauuugccaauuu

SEQ ID NO: 883987 - RNA, 13 nt, Homo sapiens
uagagauaugcac

SEQ ID NO: 883988 - RNA, 14 nt, Homo sapiens
uagagauaugcaca

SEQ ID NO: 883989 - RNA, 17 nt, Homo sapiens
uagagauaugcacacac

SEQ ID NO: 883990 - RNA, 17 nt, Homo sapiens
uagaggaagaccaaaaa

SEQ ID NO: 883991 - RNA, 22 nt, Homo sapiens
uagaggcaugaacacacaugga

SEQ ID NO: 883992 - RNA, 20 nt, Homo sapiens
uagaggugcucauucauuua

SEQ ID NO: 883993 - RNA, 22 nt, Homo sapiens
uagagugcccuuaaaauaauga

SEQ ID NO: 883994 - RNA, 23 nt, Homo sapiens
uagauaaccuguacuucaaguua

SEQ ID NO: 883995 - RNA, 18 nt, Homo sapiens
uagauaucacuuacucag

SEQ ID NO: 883996 - RNA, 22 nt, Homo sapiens
uagauccauuuggacaaaaugg

SEQ ID NO: 883997 - RNA, 12 nt, Homo sapiens
uagaucuagaaa

SEQ ID NO: 883998 - RNA, 13 nt, Homo sapiens
uagaucuccugua

SEQ ID NO: 883999 - RNA, 18 nt, Homo sapiens
uagaucugauggugagcu

SEQ ID NO: 884000 - RNA, 17 nt, Homo sapiens
uagaugugacacauucu

SEQ ID NO: 884001 - RNA, 13 nt, Homo sapiens
uagcaaaagaaga

SEQ ID NO: 884002 - RNA, 14 nt, Homo sapiens
uagcaaaauugagg

SEQ ID NO: 884003 - RNA, 19 nt, Homo sapiens
uagcaaagaagcuucaugc

SEQ ID NO: 884004 - RNA, 21 nt, Homo sapiens
uagcaaagauaucucaucucu

SEQ ID NO: 884005 - RNA, 20 nt, Homo sapiens
uagcaaccuucugcauucau

SEQ ID NO: 884006 - RNA, 17 nt, Homo sapiens
uagcaagacacaucccu

SEQ ID NO: 884007 - RNA, 16 nt, Homo sapiens
uagcaauugacuguca

SEQ ID NO: 884008 - RNA, 17 nt, Homo sapiens
uagcacuauuuacauac

SEQ ID NO: 884009 - RNA, 13 nt, Homo sapiens
uagcacugggaac

SEQ ID NO: 884010 - RNA, 14 nt, Homo sapiens
uagcagaaaccaag

SEQ ID NO: 884011 - RNA, 12 nt, Homo sapiens
uagcagaaggca

SEQ ID NO: 884012 - RNA, 22 nt, Homo sapiens
uagcaggcuaugaaguugcaau

SEQ ID NO: 884013 - RNA, 15 nt, Homo sapiens
uagcaucucaugagu

SEQ ID NO: 884014 - RNA, 15 nt, Homo sapiens
uagcaucugagcucc

SEQ ID NO: 884015 - RNA, 23 nt, Homo sapiens
uagccagccggggcgaguggcac

SEQ ID NO: 884016 - RNA, 14 nt, Homo sapiens
uagccagcuguguu

SEQ ID NO: 884017 - RNA, 12 nt, Homo sapiens
uagccauaugca

SEQ ID NO: 884018 - RNA, 17 nt, Homo sapiens
uagccauccuuggccug

SEQ ID NO: 884019 - RNA, 16 nt, Homo sapiens
uagccgaaaugaucuu

SEQ ID NO: 884020 - RNA, 16 nt, Homo sapiens
uagccuaauacaacau

SEQ ID NO: 884021 - RNA, 23 nt, Homo sapiens
uagccucccaaagugcugggauu

SEQ ID NO: 884022 - RNA, 17 nt, Homo sapiens
uagccucgcucuuggca

SEQ ID NO: 884023 - RNA, 17 nt, Homo sapiens
uagccuuagaagucaca

SEQ ID NO: 884024 - RNA, 15 nt, Homo sapiens
uagcgaaucaucuca

SEQ ID NO: 884025 - RNA, 16 nt, Homo sapiens
uagcgcucucuuccag

SEQ ID NO: 884026 - RNA, 20 nt, Homo sapiens
uagcgcugccgcaccccaga

SEQ ID NO: 884027 - RNA, 16 nt, Homo sapiens
uagcgcuggcucagga

SEQ ID NO: 884028 - RNA, 17 nt, Homo sapiens
uagcgcuggcucaggaa

SEQ ID NO: 884029 - RNA, 16 nt, Homo sapiens
uagcggaucucacuca

SEQ ID NO: 884030 - RNA, 13 nt, Homo sapiens
uagcggucaauuu

SEQ ID NO: 884031 - RNA, 16 nt, Homo sapiens
uagcuaaugaaauuga

SEQ ID NO: 884032 - RNA, 18 nt, Homo sapiens
uagcuaccucacuaugcu

SEQ ID NO: 884033 - RNA, 21 nt, Homo sapiens
uagcuaccucacuaugcugcu

SEQ ID NO: 884034 - RNA, 22 nt, Homo sapiens
uagcuaccucacuaugcugcuu

SEQ ID NO: 884035 - RNA, 17 nt, Homo sapiens
uagcuaccuucucuacc

SEQ ID NO: 884036 - RNA, 17 nt, Homo sapiens
uagcuagaagugggcca

SEQ ID NO: 884037 - RNA, 23 nt, Homo sapiens
uagcuagaaugcacaccaaaaaa

SEQ ID NO: 884038 - RNA, 17 nt, Homo sapiens
uagcuagccagcugugu

SEQ ID NO: 884039 - RNA, 11 nt, Homo sapiens
uagcucugauc

SEQ ID NO: 884040 - RNA, 12 nt, Homo sapiens
uagcucuuucag

SEQ ID NO: 884041 - RNA, 14 nt, Homo sapiens
uagcugacaucucc

SEQ ID NO: 884042 - RNA, 19 nt, Homo sapiens
uagcugaguuuaacaugug

SEQ ID NO: 884043 - RNA, 16 nt, Homo sapiens
uagcuggccacaguga

SEQ ID NO: 884044 - RNA, 23 nt, Homo sapiens
uagcuggccacagugagcugaug

SEQ ID NO: 884045 - RNA, 15 nt, Homo sapiens
uagcugggacuacag

SEQ ID NO: 884046 - RNA, 17 nt, Homo sapiens
uagcugggacuacaggc

SEQ ID NO: 884047 - RNA, 19 nt, Homo sapiens
uagcuguaaauacaugugu

SEQ ID NO: 884048 - RNA, 13 nt, Homo sapiens
uagcuuaccugac

SEQ ID NO: 884049 - RNA, 14 nt, Homo sapiens
uagcuuagaccuca

SEQ ID NO: 884050 - RNA, 15 nt, Homo sapiens
uagcuuagaccucag

SEQ ID NO: 884051 - RNA, 16 nt, Homo sapiens
uagcuuagaccucagc

SEQ ID NO: 884052 - RNA, 13 nt, Homo sapiens
uagcuucaugccu

SEQ ID NO: 884053 - RNA, 15 nt, Homo sapiens
uagcuuggaaacugg

SEQ ID NO: 884054 - RNA, 13 nt, Homo sapiens
uagcuuuacaaau

SEQ ID NO: 884055 - RNA, 16 nt, Homo sapiens
uagcuuuagggcaaua

SEQ ID NO: 884056 - RNA, 20 nt, Homo sapiens
uagcuuucccaaauaaacuc

SEQ ID NO: 884057 - RNA, 17 nt, Homo sapiens
uaggaaacccuucuuua

SEQ ID NO: 884058 - RNA, 15 nt, Homo sapiens
uaggaaccuaugaaa

SEQ ID NO: 884059 - RNA, 18 nt, Homo sapiens
uaggaaccuaugaaacua

SEQ ID NO: 884060 - RNA, 22 nt, Homo sapiens
uaggaaggcagcauuccaugac

SEQ ID NO: 884061 - RNA, 16 nt, Homo sapiens
uaggcaauacauguau

SEQ ID NO: 884062 - RNA, 13 nt, Homo sapiens
uaggcaauaucuu

SEQ ID NO: 884063 - RNA, 17 nt, Homo sapiens
uagggaaauucaaagca

SEQ ID NO: 884064 - RNA, 15 nt, Homo sapiens
uagggaugacuguga

SEQ ID NO: 884065 - RNA, 20 nt, Homo sapiens
uagggcuggagggacaggga

SEQ ID NO: 884066 - RNA, 16 nt, Homo sapiens
uaggggaaguaugugu

SEQ ID NO: 884067 - RNA, 22 nt, Homo sapiens
uaggggacuaauucacuggcga

SEQ ID NO: 884068 - RNA, 16 nt, Homo sapiens
uaggggucaggcucca

SEQ ID NO: 884069 - RNA, 21 nt, Homo sapiens
uagggucaggcggggugcugu

SEQ ID NO: 884070 - RNA, 20 nt, Homo sapiens
uaggugacagagugagacuc

SEQ ID NO: 884071 - RNA, 14 nt, Homo sapiens
uagguugugcaaau

SEQ ID NO: 884072 - RNA, 20 nt, Homo sapiens
uagguuuacauucaucucau

SEQ ID NO: 884073 - RNA, 21 nt, Homo sapiens
uagguuuugauuuauaugugu

SEQ ID NO: 884074 - RNA, 16 nt, Homo sapiens
uaguaacauagacaaa

SEQ ID NO: 884075 - RNA, 20 nt, Homo sapiens
uaguaagggaacuauggaaa

SEQ ID NO: 884076 - RNA, 20 nt, Homo sapiens
uaguaaucccccuugccaaa

SEQ ID NO: 884077 - RNA, 21 nt, Homo sapiens
uaguaaucccccuugccaaau

SEQ ID NO: 884078 - RNA, 20 nt, Homo sapiens
uaguaauuguaaguaccccu

SEQ ID NO: 884079 - RNA, 14 nt, Homo sapiens
uaguacaauucuua

SEQ ID NO: 884080 - RNA, 13 nt, Homo sapiens
uaguagugucuuc

SEQ ID NO: 884081 - RNA, 14 nt, Homo sapiens
uaguauaccauaca

SEQ ID NO: 884082 - RNA, 16 nt, Homo sapiens
uaguauauuuauacuc

SEQ ID NO: 884083 - RNA, 17 nt, Homo sapiens
uaguauauuuauacucu

SEQ ID NO: 884084 - RNA, 20 nt, Homo sapiens
uaguauuccagaccugaaga

SEQ ID NO: 884085 - RNA, 14 nt, Homo sapiens
uagucacaccaucu

SEQ ID NO: 884086 - RNA, 12 nt, Homo sapiens
uagucacauggc

SEQ ID NO: 884087 - RNA, 18 nt, Homo sapiens
uagucccagcuacucaga

SEQ ID NO: 884088 - RNA, 18 nt, Homo sapiens
uagucuccuuugcacuga

SEQ ID NO: 884089 - RNA, 19 nt, Homo sapiens
uagugagaaacugauuuau

SEQ ID NO: 884090 - RNA, 17 nt, Homo sapiens
uagugauuucauuacca

SEQ ID NO: 884091 - RNA, 16 nt, Homo sapiens
uagugauuugccucaa

SEQ ID NO: 884092 - RNA, 20 nt, Homo sapiens
uagugcuuuaccuuuauuaa

SEQ ID NO: 884093 - RNA, 19 nt, Homo sapiens
uaguggccaaauagcacau

SEQ ID NO: 884094 - RNA, 15 nt, Homo sapiens
ucacauuuugccuuu

SEQ ID NO: 884095 - RNA, 19 nt, Homo sapiens
ucaccaagcucacaguucc

SEQ ID NO: 884096 - RNA, 22 nt, Homo sapiens
ucaccaauaaauaagugcauuu

SEQ ID NO: 884097 - RNA, 17 nt, Homo sapiens
ucaccacaugugcacau

SEQ ID NO: 884098 - RNA, 15 nt, Homo sapiens
ucaccacuccauucc

SEQ ID NO: 884099 - RNA, 17 nt, Homo sapiens
ucaccagaauugugcaa

SEQ ID NO: 884100 - RNA, 16 nt, Homo sapiens
ucaccagcagacacug

SEQ ID NO: 884101 - RNA, 18 nt, Homo sapiens
ucaccagcagacacugcc

SEQ ID NO: 884102 - RNA, 19 nt, Homo sapiens
ucaccaguguccccuccac

SEQ ID NO: 884103 - RNA, 19 nt, Homo sapiens
ucacccgagcuagagugca

SEQ ID NO: 884104 - RNA, 17 nt, Homo sapiens
ucacccgggacucuccc

SEQ ID NO: 884105 - RNA, 14 nt, Homo sapiens
ucacccuaccugug

SEQ ID NO: 884106 - RNA, 15 nt, Homo sapiens
ucacccuucugggca

SEQ ID NO: 884107 - RNA, 14 nt, Homo sapiens
ucaccgacaacaug

SEQ ID NO: 884108 - RNA, 14 nt, Homo sapiens
ucaccggagcuuuc

SEQ ID NO: 884109 - RNA, 22 nt, Homo sapiens
ucaccggagcuuucaaagaagg

SEQ ID NO: 884110 - RNA, 15 nt, Homo sapiens
ucaccucagcugaua

SEQ ID NO: 884111 - RNA, 20 nt, Homo sapiens
ucaccuccucccagacuuuc

SEQ ID NO: 884112 - RNA, 18 nt, Homo sapiens
ucaccugggccuuuccug

SEQ ID NO: 884113 - RNA, 16 nt, Homo sapiens
ucaccuucaccuucau

SEQ ID NO: 884114 - RNA, 17 nt, Homo sapiens
ucaccuuggagccugaa

SEQ ID NO: 884115 - RNA, 14 nt, Homo sapiens
ucacgccacugcac

SEQ ID NO: 884116 - RNA, 19 nt, Homo sapiens
ucacgccuguaaucccagc

SEQ ID NO: 884117 - RNA, 16 nt, Homo sapiens
ucacggcucacugcag

SEQ ID NO: 884118 - RNA, 23 nt, Homo sapiens
ucacuaaagggugcccacaaaau

SEQ ID NO: 884119 - RNA, 19 nt, Homo sapiens
ucacuaaaguauaucuuua

SEQ ID NO: 884120 - RNA, 17 nt, Homo sapiens
ucacuagagcugggaaa

SEQ ID NO: 884121 - RNA, 22 nt, Homo sapiens
ucacuagccaugauaacugcaa

SEQ ID NO: 884122 - RNA, 23 nt, Homo sapiens
ucacuagccaugauaacugcaau

SEQ ID NO: 884123 - RNA, 15 nt, Homo sapiens
ucacuaugacacuga

SEQ ID NO: 884124 - RNA, 19 nt, Homo sapiens
ucacuauguugcccaggcu

SEQ ID NO: 884125 - RNA, 17 nt, Homo sapiens
ucacucaaaaaggugug

SEQ ID NO: 884126 - RNA, 17 nt, Homo sapiens
ucacucagccacacccc

SEQ ID NO: 884127 - RNA, 16 nt, Homo sapiens
ucacucccauaagcua

SEQ ID NO: 884128 - RNA, 16 nt, Homo sapiens
ucacugcaaccuccac

SEQ ID NO: 884129 - RNA, 14 nt, Homo sapiens
ucacugcucaagaa

SEQ ID NO: 884130 - RNA, 11 nt, Homo sapiens
ucacugggcua

SEQ ID NO: 884131 - RNA, 19 nt, Homo sapiens
ucacugucccucaaaugac

SEQ ID NO: 884132 - RNA, 15 nt, Homo sapiens
ucacuuauaccaaag

SEQ ID NO: 884133 - RNA, 15 nt, Homo sapiens
ucacuucccugggaa

SEQ ID NO: 884134 - RNA, 19 nt, Homo sapiens
ucacuucgaugacuggaua

SEQ ID NO: 884135 - RNA, 15 nt, Homo sapiens
ucacuugaguguaau

SEQ ID NO: 884136 - RNA, 15 nt, Homo sapiens
ucacuuggagccagg

SEQ ID NO: 884137 - RNA, 23 nt, Homo sapiens
ucacuuggagccaggaguuugag

SEQ ID NO: 884138 - RNA, 20 nt, Homo sapiens
ucacuugugcaguguugaca

SEQ ID NO: 884139 - RNA, 14 nt, Homo sapiens
ucacuuguucuuaa

SEQ ID NO: 884140 - RNA, 14 nt, Homo sapiens
ucacuuuguuaaaa

SEQ ID NO: 884141 - RNA, 12 nt, Homo sapiens
ucagaaaccaaa

SEQ ID NO: 884142 - RNA, 22 nt, Homo sapiens
ucagaacagcugaaacauuccg

SEQ ID NO: 884143 - RNA, 17 nt, Homo sapiens
ucagaagccuacuuuga

SEQ ID NO: 884144 - RNA, 20 nt, Homo sapiens
ucagaauggaaagaaacuca

SEQ ID NO: 884145 - RNA, 18 nt, Homo sapiens
ucagacaauccacucuca

SEQ ID NO: 884146 - RNA, 22 nt, Homo sapiens
ucagacaauccacucucaggag

SEQ ID NO: 884147 - RNA, 14 nt, Homo sapiens
ucagacucaucuac

SEQ ID NO: 884148 - RNA, 17 nt, Homo sapiens
ucagacuccugugcaac

SEQ ID NO: 884149 - RNA, 14 nt, Homo sapiens
ucagagaagucagu

SEQ ID NO: 884150 - RNA, 17 nt, Homo sapiens
ucagagaggcaugugau

SEQ ID NO: 884151 - RNA, 15 nt, Homo sapiens
ucagagccagugaag

SEQ ID NO: 884152 - RNA, 14 nt, Homo sapiens
ucagagcugggaaa

SEQ ID NO: 884153 - RNA, 19 nt, Homo sapiens
ucagagcugggaguagcau

SEQ ID NO: 884154 - RNA, 17 nt, Homo sapiens
ucagaggcccaggaauc

SEQ ID NO: 884155 - RNA, 18 nt, Homo sapiens
ucagauaaacaacaaaua

SEQ ID NO: 884156 - RNA, 15 nt, Homo sapiens
ucagauagaaugaca

SEQ ID NO: 884157 - RNA, 13 nt, Homo sapiens
ucagauaugauau

SEQ ID NO: 884158 - RNA, 23 nt, Homo sapiens
ucagauuccacacaaaaugucac

SEQ ID NO: 884159 - RNA, 15 nt, Homo sapiens
ucagcaaaccucagu

SEQ ID NO: 884160 - RNA, 15 nt, Homo sapiens
ucagcaaagaacaag

SEQ ID NO: 884161 - RNA, 22 nt, Homo sapiens
ucagcaagacuucucuuugccu

SEQ ID NO: 884162 - RNA, 21 nt, Homo sapiens
ucagcacugccggcccaguga

SEQ ID NO: 884163 - RNA, 17 nt, Homo sapiens
ucagcagagucuaguag

SEQ ID NO: 884164 - RNA, 15 nt, Homo sapiens
ucagcagcccuccuc

SEQ ID NO: 884165 - RNA, 20 nt, Homo sapiens
ucagcauuauuccuccagga

SEQ ID NO: 884166 - RNA, 12 nt, Homo sapiens
ucagccaugagg

SEQ ID NO: 884167 - RNA, 22 nt, Homo sapiens
ucagccgcagacaaguaaucac

SEQ ID NO: 884168 - RNA, 19 nt, Homo sapiens
ucagccgcuucugacugcu

SEQ ID NO: 884169 - RNA, 20 nt, Homo sapiens
ucagccuagccgaccucagc

SEQ ID NO: 884170 - RNA, 18 nt, Homo sapiens
ucagccucccgaguagcu

SEQ ID NO: 884171 - RNA, 21 nt, Homo sapiens
ucagcggucauucuacacuga

SEQ ID NO: 884172 - RNA, 12 nt, Homo sapiens
ucagcucaggug

SEQ ID NO: 884173 - RNA, 17 nt, Homo sapiens
ucagcucuccugcugca

SEQ ID NO: 884174 - RNA, 16 nt, Homo sapiens
ucagcugcacauuccu

SEQ ID NO: 884175 - RNA, 20 nt, Homo sapiens
ucagcuggguacgguggcac

SEQ ID NO: 884176 - RNA, 22 nt, Homo sapiens
ucaggaaaucaaauaugcaaag

SEQ ID NO: 884177 - RNA, 21 nt, Homo sapiens
ucaggacacuaauacaccagg

SEQ ID NO: 884178 - RNA, 19 nt, Homo sapiens
ucaggagagaguugaaccu

SEQ ID NO: 884179 - RNA, 17 nt, Homo sapiens
ucaggagaucgagacca

SEQ ID NO: 884180 - RNA, 13 nt, Homo sapiens
ucaggaguucaag

SEQ ID NO: 884181 - RNA, 17 nt, Homo sapiens
ucaggaguucgagacca

SEQ ID NO: 884182 - RNA, 17 nt, Homo sapiens
ucaggaguuggagacca

SEQ ID NO: 884183 - RNA, 16 nt, Homo sapiens
ucaggauacucuguca

SEQ ID NO: 884184 - RNA, 23 nt, Homo sapiens
ucaggauuaaugguccugugaug

SEQ ID NO: 884185 - RNA, 18 nt, Homo sapiens
ucaggcaggcaccuagca

SEQ ID NO: 884186 - RNA, 19 nt, Homo sapiens
ucaggcagguuugccagug

SEQ ID NO: 884187 - RNA, 21 nt, Homo sapiens
ucaggcagguuugccagugaa

SEQ ID NO: 884188 - RNA, 17 nt, Homo sapiens
ucaggccaacaagccaa

SEQ ID NO: 884189 - RNA, 20 nt, Homo sapiens
ucaggccaagaccccagcuu

SEQ ID NO: 884190 - RNA, 18 nt, Homo sapiens
ucaggccaggugcagugg

SEQ ID NO: 884191 - RNA, 15 nt, Homo sapiens
ucaggccagugccag

SEQ ID NO: 884192 - RNA, 15 nt, Homo sapiens
ucagggagcauuuau

SEQ ID NO: 884193 - RNA, 16 nt, Homo sapiens
ucagggagccuggaag

SEQ ID NO: 884194 - RNA, 21 nt, Homo sapiens
ucagggcuggaaaagucacac

SEQ ID NO: 884195 - RNA, 21 nt, Homo sapiens
ucaggguccagacccugaaga

SEQ ID NO: 884196 - RNA, 21 nt, Homo sapiens
ucaggguuuuuagauuaaaca

SEQ ID NO: 884197 - RNA, 17 nt, Homo sapiens
ucagguaguacugggaa

SEQ ID NO: 884198 - RNA, 12 nt, Homo sapiens
ucagguauuugu

SEQ ID NO: 884199 - RNA, 19 nt, Homo sapiens
ucagguucuuucugaaauc

SEQ ID NO: 884200 - RNA, 18 nt, Homo sapiens
ucaguaaacaaugaauag

SEQ ID NO: 884201 - RNA, 12 nt, Homo sapiens
ucaguccagaug

SEQ ID NO: 884202 - RNA, 19 nt, Homo sapiens
ucaguccuggucugcucag

SEQ ID NO: 884203 - RNA, 19 nt, Homo sapiens
ucagucugggugggacuua

SEQ ID NO: 884204 - RNA, 21 nt, Homo sapiens
ucagugaagaauacuucucau

SEQ ID NO: 884205 - RNA, 18 nt, Homo sapiens
ucagugcacuguauauag

SEQ ID NO: 884206 - RNA, 21 nt, Homo sapiens
ucagugccacuugacauuccu

SEQ ID NO: 884207 - RNA, 20 nt, Homo sapiens
ucaguggcauucacaucuca

SEQ ID NO: 884208 - RNA, 17 nt, Homo sapiens
ugucuuaaggcaucuga

SEQ ID NO: 884209 - RNA, 17 nt, Homo sapiens
ugucuuagcuguauaca

SEQ ID NO: 884210 - RNA, 19 nt, Homo sapiens
ugucuuggacacuguacaa

SEQ ID NO: 884211 - RNA, 22 nt, Homo sapiens
ugucuugggaauuuucuuccaa

SEQ ID NO: 884212 - RNA, 12 nt, Homo sapiens
ugugaaaccacu

SEQ ID NO: 884213 - RNA, 23 nt, Homo sapiens
ugugaaaggaagcuccacuguca

SEQ ID NO: 884214 - RNA, 23 nt, Homo sapiens
ugugaaauucaaccugugucuua

SEQ ID NO: 884215 - RNA, 15 nt, Homo sapiens
ugugaaccaccacac

SEQ ID NO: 884216 - RNA, 16 nt, Homo sapiens
ugugaacccaggacaa

SEQ ID NO: 884217 - RNA, 20 nt, Homo sapiens
ugugaauaaaaacccuguau

SEQ ID NO: 884218 - RNA, 21 nt, Homo sapiens
ugugacaaccuuuguguaaua

SEQ ID NO: 884219 - RNA, 17 nt, Homo sapiens
ugugacccuacuuccug

SEQ ID NO: 884220 - RNA, 16 nt, Homo sapiens
ugugacuaucuuuaug

SEQ ID NO: 884221 - RNA, 18 nt, Homo sapiens
ugugacuauguuccaaua

SEQ ID NO: 884222 - RNA, 22 nt, Homo sapiens
ugugacuccagccugcccucag

SEQ ID NO: 884223 - RNA, 18 nt, Homo sapiens
ugugaucuaucaauaguc

SEQ ID NO: 884224 - RNA, 18 nt, Homo sapiens
ugugauuuuugaacaaua

SEQ ID NO: 884225 - RNA, 17 nt, Homo sapiens
ugugcaagucuugucag

SEQ ID NO: 884226 - RNA, 16 nt, Homo sapiens
ugugcacaaugggcaa

SEQ ID NO: 884227 - RNA, 14 nt, Homo sapiens
ugugcagacugugg

SEQ ID NO: 884228 - RNA, 21 nt, Homo sapiens
ugugcaguguugacaguucau

SEQ ID NO: 884229 - RNA, 16 nt, Homo sapiens
ugugcaucuguacuca

SEQ ID NO: 884230 - RNA, 12 nt, Homo sapiens
ugugcaugaccu

SEQ ID NO: 884231 - RNA, 17 nt, Homo sapiens
ugugcauguaugucuug

SEQ ID NO: 884232 - RNA, 15 nt, Homo sapiens
ugugcaugugagcac

SEQ ID NO: 884233 - RNA, 20 nt, Homo sapiens
ugugccaccaccccuugacc

SEQ ID NO: 884234 - RNA, 15 nt, Homo sapiens
ugugcccacgugugc

SEQ ID NO: 884235 - RNA, 15 nt, Homo sapiens
ugugccucagccucc

SEQ ID NO: 884236 - RNA, 19 nt, Homo sapiens
ugugccuuaggaaaagcau

SEQ ID NO: 884237 - RNA, 24 nt, Homo sapiens
ugugcucugaucauccacugugcc

SEQ ID NO: 884238 - RNA, 19 nt, Homo sapiens
ugugcugacuaacuauaag

SEQ ID NO: 884239 - RNA, 23 nt, Homo sapiens
uguggaauauaaagauggcugac

SEQ ID NO: 884240 - RNA, 13 nt, Homo sapiens
uguggacacagcu

SEQ ID NO: 884241 - RNA, 18 nt, Homo sapiens
uguggaggagcucaggac

SEQ ID NO: 884242 - RNA, 18 nt, Homo sapiens
uguggaggccugaugcug

SEQ ID NO: 884243 - RNA, 19 nt, Homo sapiens
uguggaguggacauucaaa

SEQ ID NO: 884244 - RNA, 19 nt, Homo sapiens
uguggauguguaaauggcu

SEQ ID NO: 884245 - RNA, 15 nt, Homo sapiens
uguggcccaagacaa

SEQ ID NO: 884246 - RNA, 23 nt, Homo sapiens
uguggcccagggaagccaaaaga

SEQ ID NO: 884247 - RNA, 21 nt, Homo sapiens
uguggcuccugccuugaugaa

SEQ ID NO: 884248 - RNA, 21 nt, Homo sapiens
uguggcugcuagcacuuggag

SEQ ID NO: 884249 - RNA, 17 nt, Homo sapiens
ugugggacugagaugca

SEQ ID NO: 884250 - RNA, 17 nt, Homo sapiens
ugugggagccugcaaac

SEQ ID NO: 884251 - RNA, 13 nt, Homo sapiens
ugugggcugcaga

SEQ ID NO: 884252 - RNA, 17 nt, Homo sapiens
uguggguuuuuucacau

SEQ ID NO: 884253 - RNA, 16 nt, Homo sapiens
ugugguacaagcauuc

SEQ ID NO: 884254 - RNA, 20 nt, Homo sapiens
uguggucaauccgaaguaug

SEQ ID NO: 884255 - RNA, 21 nt, Homo sapiens
uguggugagggaagacgccuu

SEQ ID NO: 884256 - RNA, 16 nt, Homo sapiens
uguguaccugugacua

SEQ ID NO: 884257 - RNA, 16 nt, Homo sapiens
uguguagcucugucca

SEQ ID NO: 884258 - RNA, 13 nt, Homo sapiens
uguguagcuguga

SEQ ID NO: 884259 - RNA, 14 nt, Homo sapiens
uguguauauauaca

SEQ ID NO: 884260 - RNA, 13 nt, Homo sapiens
uguguauguguau

SEQ ID NO: 884261 - RNA, 20 nt, Homo sapiens
ugugucagaguaacaugcca

SEQ ID NO: 884262 - RNA, 16 nt, Homo sapiens
ugugucaguggaugcu

SEQ ID NO: 884263 - RNA, 17 nt, Homo sapiens
ugugucccccccagugc

SEQ ID NO: 884264 - RNA, 13 nt, Homo sapiens
uguguccugauga

SEQ ID NO: 884265 - RNA, 15 nt, Homo sapiens
uguguccuugugugc

SEQ ID NO: 884266 - RNA, 12 nt, Homo sapiens
ugugucuguaca

SEQ ID NO: 884267 - RNA, 13 nt, Homo sapiens
ugugucuguacac

SEQ ID NO: 884268 - RNA, 23 nt, Homo sapiens
ugugugaaaggaagcuccacugu

SEQ ID NO: 884269 - RNA, 21 nt, Homo sapiens
ugugugcauguaugugcacau

SEQ ID NO: 884270 - RNA, 11 nt, Homo sapiens
ugugugcauuu

SEQ ID NO: 884271 - RNA, 18 nt, Homo sapiens
ugugugccgugacagggc

SEQ ID NO: 884272 - RNA, 15 nt, Homo sapiens
uguguggcaguucuc

SEQ ID NO: 884273 - RNA, 12 nt, Homo sapiens
uguguguagcca

SEQ ID NO: 884274 - RNA, 15 nt, Homo sapiens
uguguuaagugcagg

SEQ ID NO: 884275 - RNA, 22 nt, Homo sapiens
uguguuauuauuuugcacuguu

SEQ ID NO: 884276 - RNA, 14 nt, Homo sapiens
uguguucacacugu

SEQ ID NO: 884277 - RNA, 15 nt, Homo sapiens
uguguucaguacaau

SEQ ID NO: 884278 - RNA, 23 nt, Homo sapiens
uguguugggaauugcaugccauc

SEQ ID NO: 884279 - RNA, 19 nt, Homo sapiens
uguguugggaccugugauc

SEQ ID NO: 884280 - RNA, 21 nt, Homo sapiens
uguguuucuggggacaccagc

SEQ ID NO: 884281 - RNA, 18 nt, Homo sapiens
uguuaaagcaucagagau

SEQ ID NO: 884282 - RNA, 21 nt, Homo sapiens
uguuaagcaaaggaaaccaaa

SEQ ID NO: 884283 - RNA, 22 nt, Homo sapiens
uguuaagcaaaggaaaccaaag

SEQ ID NO: 884284 - RNA, 22 nt, Homo sapiens
uguuaaguaacacucaccauca

SEQ ID NO: 884285 - RNA, 20 nt, Homo sapiens
uguuacgcacacguacuuaa

SEQ ID NO: 884286 - RNA, 21 nt, Homo sapiens
uguuacuaaagucacauauaa

SEQ ID NO: 884287 - RNA, 14 nt, Homo sapiens
uguuagauuccucu

SEQ ID NO: 884288 - RNA, 14 nt, Homo sapiens
uguuaucagucaua

SEQ ID NO: 884289 - RNA, 20 nt, Homo sapiens
uguuaucagucauaacuaaa

SEQ ID NO: 884290 - RNA, 15 nt, Homo sapiens
uguuauccacaagca

SEQ ID NO: 884291 - RNA, 20 nt, Homo sapiens
uguuauguauauagaugugc

SEQ ID NO: 884292 - RNA, 18 nt, Homo sapiens
uguuauuuuuuauuucca

SEQ ID NO: 884293 - RNA, 21 nt, Homo sapiens
uguucacaacauaaggagaau

SEQ ID NO: 884294 - RNA, 12 nt, Homo sapiens
uguucacaugca

SEQ ID NO: 884295 - RNA, 15 nt, Homo sapiens
uguucacccacaucu

SEQ ID NO: 884296 - RNA, 18 nt, Homo sapiens
uguucagcuggacaauau

SEQ ID NO: 884297 - RNA, 20 nt, Homo sapiens
uguucauuuuagugacugua

SEQ ID NO: 884298 - RNA, 15 nt, Homo sapiens
uguuccaugccugcu

SEQ ID NO: 884299 - RNA, 16 nt, Homo sapiens
uguucccccgcuggca

SEQ ID NO: 884300 - RNA, 22 nt, Homo sapiens
uguucccuagcugaggaugaca

SEQ ID NO: 884301 - RNA, 20 nt, Homo sapiens
uguucccuccccgaucaucu

SEQ ID NO: 884302 - RNA, 15 nt, Homo sapiens
uguucccuugaccau

SEQ ID NO: 884303 - RNA, 19 nt, Homo sapiens
uguuccuacucagacuguu

SEQ ID NO: 884304 - RNA, 19 nt, Homo sapiens
uguuccuugucacugguag

SEQ ID NO: 884305 - RNA, 19 nt, Homo sapiens
uguucuccggguguggccu

SEQ ID NO: 884306 - RNA, 13 nt, Homo sapiens
uguucugcacuga

SEQ ID NO: 884307 - RNA, 14 nt, Homo sapiens
uguucugcacugaa

SEQ ID NO: 884308 - RNA, 13 nt, Homo sapiens
uguucuggcuuua

SEQ ID NO: 884309 - RNA, 13 nt, Homo sapiens
uguucugggacac

SEQ ID NO: 884310 - RNA, 15 nt, Homo sapiens
uguucuguggcauag

SEQ ID NO: 884311 - RNA, 15 nt, Homo sapiens
uguucuuagcugaac

SEQ ID NO: 884312 - RNA, 17 nt, Homo sapiens
uguugaaaauguucaga

SEQ ID NO: 884313 - RNA, 17 nt, Homo sapiens
uguugaaucaggggcaa

SEQ ID NO: 884314 - RNA, 13 nt, Homo sapiens
uguugagugagau

SEQ ID NO: 884315 - RNA, 18 nt, Homo sapiens
uguugcagggaagucuua

SEQ ID NO: 884316 - RNA, 18 nt, Homo sapiens
uguugccuggaagcacau

SEQ ID NO: 884317 - RNA, 18 nt, Homo sapiens
uguugcuaggacauauac

SEQ ID NO: 884318 - RNA, 17 nt, Homo sapiens
uguuggaaaaugugcaa

SEQ ID NO: 884319 - RNA, 16 nt, Homo sapiens
uguuggggcaguggua

SEQ ID NO: 884320 - RNA, 17 nt, Homo sapiens
uguugguguauuugcca

SEQ ID NO: 884321 - RNA, 18 nt, Homo sapiens
uguugguguauuugccag

SEQ ID NO: 884322 - RNA, 21 nt, Homo sapiens
uguuguggguuuuuucacaua

SEQ ID NO: 884323 - RNA, 21 nt, Homo sapiens
uucuaacuagaaaucugccaa

SEQ ID NO: 884324 - RNA, 18 nt, Homo sapiens
uucuaaguagauagaaag

SEQ ID NO: 884325 - RNA, 21 nt, Homo sapiens
uucuaaguggaaaaaguauua

SEQ ID NO: 884326 - RNA, 18 nt, Homo sapiens
uucuaauguaugcauuca

SEQ ID NO: 884327 - RNA, 15 nt, Homo sapiens
uucuaaugugugaau

SEQ ID NO: 884328 - RNA, 16 nt, Homo sapiens
uucuaauuggcaugaa

SEQ ID NO: 884329 - RNA, 14 nt, Homo sapiens
uucuacacauauau

SEQ ID NO: 884330 - RNA, 12 nt, Homo sapiens
uucuacagccuc

SEQ ID NO: 884331 - RNA, 18 nt, Homo sapiens
uucuacagccucagaaac

SEQ ID NO: 884332 - RNA, 15 nt, Homo sapiens
uucuacugugacuga

SEQ ID NO: 884333 - RNA, 17 nt, Homo sapiens
uucuaugcaaaugccuc

SEQ ID NO: 884334 - RNA, 22 nt, Homo sapiens
uucuaugguugacauuguauau

SEQ ID NO: 884335 - RNA, 21 nt, Homo sapiens
uucuauugaaaaaucaccaca

SEQ ID NO: 884336 - RNA, 16 nt, Homo sapiens
uucuauuuuuguagaa

SEQ ID NO: 884337 - RNA, 23 nt, Homo sapiens
uucucaaaugcacaucucauggc

SEQ ID NO: 884338 - RNA, 19 nt, Homo sapiens
uucucaaucagugcaguga

SEQ ID NO: 884339 - RNA, 20 nt, Homo sapiens
uucucaaucagugcagugau

SEQ ID NO: 884340 - RNA, 22 nt, Homo sapiens
uucucaguaaauauuaaccuga

SEQ ID NO: 884341 - RNA, 20 nt, Homo sapiens
uucucaguguagggcagaga

SEQ ID NO: 884342 - RNA, 14 nt, Homo sapiens
uucucaugugaucc

SEQ ID NO: 884343 - RNA, 23 nt, Homo sapiens
uucucauguugaagccacugccu

SEQ ID NO: 884344 - RNA, 23 nt, Homo sapiens
uucuccagacccaccacaccgca

SEQ ID NO: 884345 - RNA, 23 nt, Homo sapiens
uucuccucccuguuaucugcuag

SEQ ID NO: 884346 - RNA, 19 nt, Homo sapiens
uucuccugacuccagugag

SEQ ID NO: 884347 - RNA, 14 nt, Homo sapiens
uucuccugccucag

SEQ ID NO: 884348 - RNA, 22 nt, Homo sapiens
uucuccuuggaggacaguggga

SEQ ID NO: 884349 - RNA, 15 nt, Homo sapiens
uucuccuuuuugccc

SEQ ID NO: 884350 - RNA, 19 nt, Homo sapiens
uucucgugguagaagccag

SEQ ID NO: 884351 - RNA, 18 nt, Homo sapiens
uucucuaccgggcgaguc

SEQ ID NO: 884352 - RNA, 15 nt, Homo sapiens
uucucuacucuggaa

SEQ ID NO: 884353 - RNA, 19 nt, Homo sapiens
uucucuaucccaagccaac

SEQ ID NO: 884354 - RNA, 23 nt, Homo sapiens
uucucuguaaggcaaaauaaucu

SEQ ID NO: 884355 - RNA, 15 nt, Homo sapiens
uucucuuugccucaa

SEQ ID NO: 884356 - RNA, 17 nt, Homo sapiens
uucucuuugguguuaca

SEQ ID NO: 884357 - RNA, 19 nt, Homo sapiens
uucugaaccauuacuguaa

SEQ ID NO: 884358 - RNA, 14 nt, Homo sapiens
uucugaagaucuca

SEQ ID NO: 884359 - RNA, 13 nt, Homo sapiens
uucugacaucagc

SEQ ID NO: 884360 - RNA, 13 nt, Homo sapiens
uucugagugacau

SEQ ID NO: 884361 - RNA, 11 nt, Homo sapiens
uucugcacuga

SEQ ID NO: 884362 - RNA, 14 nt, Homo sapiens
uucugcacugaaaa

SEQ ID NO: 884363 - RNA, 17 nt, Homo sapiens
uucugccccagcuuuau

SEQ ID NO: 884364 - RNA, 13 nt, Homo sapiens
uucugcucacaua

SEQ ID NO: 884365 - RNA, 16 nt, Homo sapiens
uucuggaaaagcaaaa

SEQ ID NO: 884366 - RNA, 19 nt, Homo sapiens
uucuggacccuccacuuca

SEQ ID NO: 884367 - RNA, 19 nt, Homo sapiens
uucuggcgcaagagaacau

SEQ ID NO: 884368 - RNA, 12 nt, Homo sapiens
uucuggcuuuac

SEQ ID NO: 884369 - RNA, 16 nt, Homo sapiens
uucugggaacuuccuc

SEQ ID NO: 884370 - RNA, 16 nt, Homo sapiens
uucugggacacaguuc

SEQ ID NO: 884371 - RNA, 21 nt, Homo sapiens
uucugggaguucccugaacau

SEQ ID NO: 884372 - RNA, 23 nt, Homo sapiens
uucuggucuucacugccaugccu

SEQ ID NO: 884373 - RNA, 15 nt, Homo sapiens
uucuguucaucuuaa

SEQ ID NO: 884374 - RNA, 22 nt, Homo sapiens
uucuguuucuauucucuccuca

SEQ ID NO: 884375 - RNA, 21 nt, Homo sapiens
uucuuaaaauguuaacuggca

SEQ ID NO: 884376 - RNA, 13 nt, Homo sapiens
uucuuacaaacau

SEQ ID NO: 884377 - RNA, 14 nt, Homo sapiens
uucuuagugucacu

SEQ ID NO: 884378 - RNA, 14 nt, Homo sapiens
uucuuauuugcaau

SEQ ID NO: 884379 - RNA, 17 nt, Homo sapiens
uucuucaugcaaugaca

SEQ ID NO: 884380 - RNA, 13 nt, Homo sapiens
uucuuccaucuga

SEQ ID NO: 884381 - RNA, 14 nt, Homo sapiens
uucuuccaucugau

SEQ ID NO: 884382 - RNA, 21 nt, Homo sapiens
uucuucuaaugagucgacuuu

SEQ ID NO: 884383 - RNA, 23 nt, Homo sapiens
uucuucuaaugagucgacuuuga

SEQ ID NO: 884384 - RNA, 17 nt, Homo sapiens
uucuucucuuaauuuca

SEQ ID NO: 884385 - RNA, 16 nt, Homo sapiens
uucuucuuagcaccac

SEQ ID NO: 884386 - RNA, 13 nt, Homo sapiens
uucuugaaccaau

SEQ ID NO: 884387 - RNA, 16 nt, Homo sapiens
uucuugaaccaauaau

SEQ ID NO: 884388 - RNA, 17 nt, Homo sapiens
uucuugcagucaucaga

SEQ ID NO: 884389 - RNA, 16 nt, Homo sapiens
uucuuggcuucuggga

SEQ ID NO: 884390 - RNA, 13 nt, Homo sapiens
uucuugugccuca

SEQ ID NO: 884391 - RNA, 13 nt, Homo sapiens
uucuuguugcaaa

SEQ ID NO: 884392 - RNA, 18 nt, Homo sapiens
uucuuuaauguuguccag

SEQ ID NO: 884393 - RNA, 15 nt, Homo sapiens
uucuuucucuucccu

SEQ ID NO: 884394 - RNA, 15 nt, Homo sapiens
uucuuuuaaaccauu

SEQ ID NO: 884395 - RNA, 15 nt, Homo sapiens
uucuuuuacuguaau

SEQ ID NO: 884396 - RNA, 19 nt, Homo sapiens
uucuuuucaaaacugcuaa

SEQ ID NO: 884397 - RNA, 15 nt, Homo sapiens
uucuuuuuuuaugac

SEQ ID NO: 884398 - RNA, 17 nt, Homo sapiens
uugaaaagauagggaag

SEQ ID NO: 884399 - RNA, 12 nt, Homo sapiens
uugaaaagcuaa

SEQ ID NO: 884400 - RNA, 21 nt, Homo sapiens
uugaaaaugaaaugacugucu

SEQ ID NO: 884401 - RNA, 13 nt, Homo sapiens
uugaaaccaaaga

SEQ ID NO: 884402 - RNA, 14 nt, Homo sapiens
uugaaauaaacagg

SEQ ID NO: 884403 - RNA, 16 nt, Homo sapiens
uugaaauaccagugaa

SEQ ID NO: 884404 - RNA, 17 nt, Homo sapiens
uugaaauaccagugaac

SEQ ID NO: 884405 - RNA, 23 nt, Homo sapiens
uugaaaugagaaacuuugaucuc

SEQ ID NO: 884406 - RNA, 19 nt, Homo sapiens
uugaaauuauaucuguggu

SEQ ID NO: 884407 - RNA, 16 nt, Homo sapiens
uugaacacaauugaua

SEQ ID NO: 884408 - RNA, 12 nt, Homo sapiens
uugaacaucuca

SEQ ID NO: 884409 - RNA, 21 nt, Homo sapiens
uugaaccuugguaaauuguaa

SEQ ID NO: 884410 - RNA, 21 nt, Homo sapiens
uugaacugccaagaaaaggca

SEQ ID NO: 884411 - RNA, 12 nt, Homo sapiens
uugaacugguuc

SEQ ID NO: 884412 - RNA, 19 nt, Homo sapiens
uugaacuuauuuacacaua

SEQ ID NO: 884413 - RNA, 20 nt, Homo sapiens
uugaagaaaggaacugaggc

SEQ ID NO: 884414 - RNA, 21 nt, Homo sapiens
uugaagagauuucaacauauc

SEQ ID NO: 884415 - RNA, 22 nt, Homo sapiens
uugaagagauuucaacauauca

SEQ ID NO: 884416 - RNA, 21 nt, Homo sapiens
uugaagaucccuauuauggga

SEQ ID NO: 884417 - RNA, 17 nt, Homo sapiens
uugaaucaaagcaguua

SEQ ID NO: 884418 - RNA, 19 nt, Homo sapiens
uugaaucccuuaaacucag

SEQ ID NO: 884419 - RNA, 20 nt, Homo sapiens
uugaaugaguuuauauggaa

SEQ ID NO: 884420 - RNA, 17 nt, Homo sapiens
uugacaaaauauauaau

SEQ ID NO: 884421 - RNA, 15 nt, Homo sapiens
uugacaacagacuga

SEQ ID NO: 884422 - RNA, 17 nt, Homo sapiens
uugacaacaucccacag

SEQ ID NO: 884423 - RNA, 15 nt, Homo sapiens
uugacaauaauuuca

SEQ ID NO: 884424 - RNA, 20 nt, Homo sapiens
uugacacggugaaauccagg

SEQ ID NO: 884425 - RNA, 11 nt, Homo sapiens
uugaccacaga

SEQ ID NO: 884426 - RNA, 12 nt, Homo sapiens
uugaccucaggu

SEQ ID NO: 884427 - RNA, 14 nt, Homo sapiens
uugacgccaccaua

SEQ ID NO: 884428 - RNA, 20 nt, Homo sapiens
uugagaaagaagagaagaag

SEQ ID NO: 884429 - RNA, 23 nt, Homo sapiens
uugagccaagcuucaacccucag

SEQ ID NO: 884430 - RNA, 16 nt, Homo sapiens
uugagcccucccagca

SEQ ID NO: 884431 - RNA, 15 nt, Homo sapiens
uugagcuccccaaaa

SEQ ID NO: 884432 - RNA, 21 nt, Homo sapiens
uugaggacaaccauuccagac

SEQ ID NO: 884433 - RNA, 17 nt, Homo sapiens
uugaggauuuugaucca

SEQ ID NO: 884434 - RNA, 20 nt, Homo sapiens
uugaggccugcccucaggga

SEQ ID NO: 884435 - RNA, 21 nt, Homo sapiens
uugagguggugccuucucaca

SEQ ID NO: 884436 - RNA, 18 nt, Homo sapiens
uugaguaauucuagcuuu

SEQ ID NO: 884437 - RNA, 11 nt, Homo sapiens
uugaguaccaa

SEQ ID NO: 884438 - RNA, 19 nt, Homo sapiens
uuucuaauguaugcauuca

SEQ ID NO: 884439 - RNA, 21 nt, Homo sapiens
uuucuaguuucuugugggcua

SEQ ID NO: 884440 - RNA, 15 nt, Homo sapiens
uuucuauaccugucu

SEQ ID NO: 884441 - RNA, 12 nt, Homo sapiens
uuucuaucauuc

SEQ ID NO: 884442 - RNA, 17 nt, Homo sapiens
uuucuauucucuccuca

SEQ ID NO: 884443 - RNA, 14 nt, Homo sapiens
uuucucaaaugcac

SEQ ID NO: 884444 - RNA, 22 nt, Homo sapiens
uuucuccuuuugaccaaauaaa

SEQ ID NO: 884445 - RNA, 15 nt, Homo sapiens
uuucucgggugcauu

SEQ ID NO: 884446 - RNA, 23 nt, Homo sapiens
uuucucugcuuacccuucaccuu

SEQ ID NO: 884447 - RNA, 15 nt, Homo sapiens
uuucucuguauagua

SEQ ID NO: 884448 - RNA, 19 nt, Homo sapiens
uuucugaaccauuacugua

SEQ ID NO: 884449 - RNA, 22 nt, Homo sapiens
uuucugagaaagacuauucaaa

SEQ ID NO: 884450 - RNA, 22 nt, Homo sapiens
uuucugauaacagaauugccaa

SEQ ID NO: 884451 - RNA, 15 nt, Homo sapiens
uuucuggcucuccca

SEQ ID NO: 884452 - RNA, 17 nt, Homo sapiens
uuucuggggacaccagc

SEQ ID NO: 884453 - RNA, 20 nt, Homo sapiens
uuucuggugaugcccaaaga

SEQ ID NO: 884454 - RNA, 24 nt, Homo sapiens
uuucuggugccuauuuauucauuc

SEQ ID NO: 884455 - RNA, 20 nt, Homo sapiens
uuucuguggagagugagaau

SEQ ID NO: 884456 - RNA, 18 nt, Homo sapiens
uuucuuacccauauaucu

SEQ ID NO: 884457 - RNA, 19 nt, Homo sapiens
uuucuucuacaaccagagc

SEQ ID NO: 884458 - RNA, 17 nt, Homo sapiens
uuucuugaaccaauaau

SEQ ID NO: 884459 - RNA, 16 nt, Homo sapiens
uuucuuuuaucacgau

SEQ ID NO: 884460 - RNA, 17 nt, Homo sapiens
uuucuuuuucugucucu

SEQ ID NO: 884461 - RNA, 15 nt, Homo sapiens
uuugaaacugaaugu

SEQ ID NO: 884462 - RNA, 22 nt, Homo sapiens
uuugaagccugcuaaaugaaga

SEQ ID NO: 884463 - RNA, 19 nt, Homo sapiens
uuugaagguauaaccuuca

SEQ ID NO: 884464 - RNA, 14 nt, Homo sapiens
uuugaauaucauua

SEQ ID NO: 884465 - RNA, 17 nt, Homo sapiens
uuugaccaaauaaagua

SEQ ID NO: 884466 - RNA, 20 nt, Homo sapiens
uuugaccaaauaaaguacca

SEQ ID NO: 884467 - RNA, 18 nt, Homo sapiens
uuugagaauaugaucaug

SEQ ID NO: 884468 - RNA, 21 nt, Homo sapiens
uuugagaauaugaucauguaa

SEQ ID NO: 884469 - RNA, 23 nt, Homo sapiens
uuugagacggcgcaccuaucacc

SEQ ID NO: 884470 - RNA, 19 nt, Homo sapiens
uuugagggacgaucuuuga

SEQ ID NO: 884471 - RNA, 16 nt, Homo sapiens
uuugaggggcugacuu

SEQ ID NO: 884472 - RNA, 13 nt, Homo sapiens
uuugagugauccu

SEQ ID NO: 884473 - RNA, 19 nt, Homo sapiens
uuugauacaagaaagcaau

SEQ ID NO: 884474 - RNA, 14 nt, Homo sapiens
uuugaucacacagc

SEQ ID NO: 884475 - RNA, 20 nt, Homo sapiens
uuugaugugaaaaucaugaa

SEQ ID NO: 884476 - RNA, 21 nt, Homo sapiens
uuugauuauauacuauguaug

SEQ ID NO: 884477 - RNA, 14 nt, Homo sapiens
uuugauucagacag

SEQ ID NO: 884478 - RNA, 18 nt, Homo sapiens
uuugcaacaagacaaagc

SEQ ID NO: 884479 - RNA, 13 nt, Homo sapiens
uuugcacugacaa

SEQ ID NO: 884480 - RNA, 12 nt, Homo sapiens
uuugcacuuugu

SEQ ID NO: 884481 - RNA, 15 nt, Homo sapiens
uuugcauugugugag

SEQ ID NO: 884482 - RNA, 13 nt, Homo sapiens
uuugccaaaguga

SEQ ID NO: 884483 - RNA, 21 nt, Homo sapiens
uuugccaaagugacacagagc

SEQ ID NO: 884484 - RNA, 14 nt, Homo sapiens
uuugcuguacuuua

SEQ ID NO: 884485 - RNA, 21 nt, Homo sapiens
uuuggaaguguucccugagaa

SEQ ID NO: 884486 - RNA, 21 nt, Homo sapiens
uuuggauuuacgacugaagaa

SEQ ID NO: 884487 - RNA, 21 nt, Homo sapiens
uuugggagaaaacuucucaca

SEQ ID NO: 884488 - RNA, 21 nt, Homo sapiens
uuugggaguguucugugggcu

SEQ ID NO: 884489 - RNA, 19 nt, Homo sapiens
uuuggggacuuguagggau

SEQ ID NO: 884490 - RNA, 20 nt, Homo sapiens
uuuggguuugucaggaugga

SEQ ID NO: 884491 - RNA, 20 nt, Homo sapiens
uuuguaaauuaauacuucau

SEQ ID NO: 884492 - RNA, 16 nt, Homo sapiens
uuuguaauaaacucuc

SEQ ID NO: 884493 - RNA, 22 nt, Homo sapiens
uuuguaaugggaacugccucuu

SEQ ID NO: 884494 - RNA, 18 nt, Homo sapiens
uuugucauauggaauuua

SEQ ID NO: 884495 - RNA, 18 nt, Homo sapiens
uuugucauucaagccugu

SEQ ID NO: 884496 - RNA, 16 nt, Homo sapiens
uuugugacuuuccuaa

SEQ ID NO: 884497 - RNA, 12 nt, Homo sapiens
uuugugagccgu

SEQ ID NO: 884498 - RNA, 20 nt, Homo sapiens
uuugugggcccagcuacaag

SEQ ID NO: 884499 - RNA, 21 nt, Homo sapiens
uuuguucuccggguguggccu

SEQ ID NO: 884500 - RNA, 20 nt, Homo sapiens
uuuguuguuuuuaacaacua

SEQ ID NO: 884501 - RNA, 19 nt, Homo sapiens
uuuguuuaaaaaccaaaua

SEQ ID NO: 884502 - RNA, 18 nt, Homo sapiens
uuuguuucuuucauauga

SEQ ID NO: 884503 - RNA, 15 nt, Homo sapiens
uuuguuuugcacuga

SEQ ID NO: 884504 - RNA, 22 nt, Homo sapiens
uuuuaaaaguuucaaugugauu

SEQ ID NO: 884505 - RNA, 23 nt, Homo sapiens
uuuuaaauuugaagaugggaugu

SEQ ID NO: 884506 - RNA, 23 nt, Homo sapiens
uuuuaacacuagaaaacauucca

SEQ ID NO: 884507 - RNA, 13 nt, Homo sapiens
uuuuaacauucca

SEQ ID NO: 884508 - RNA, 14 nt, Homo sapiens
uuuuaaucuucuca

SEQ ID NO: 884509 - RNA, 17 nt, Homo sapiens
uuuuaauggaauguggu

SEQ ID NO: 884510 - RNA, 20 nt, Homo sapiens
uuuuacaaauuuaauuuugc

SEQ ID NO: 884511 - RNA, 13 nt, Homo sapiens
uuuuagacagagu

SEQ ID NO: 884512 - RNA, 22 nt, Homo sapiens
uuuuaguauaaguacauuauug

SEQ ID NO: 884513 - RNA, 16 nt, Homo sapiens
uuuuauacuaccaagu

SEQ ID NO: 884514 - RNA, 18 nt, Homo sapiens
uuuuaucauuaccauuaa

SEQ ID NO: 884515 - RNA, 21 nt, Homo sapiens
uuuuaugccuucacuuuacaa

SEQ ID NO: 884516 - RNA, 20 nt, Homo sapiens
uuuuaugggaauucuuuaca

SEQ ID NO: 884517 - RNA, 14 nt, Homo sapiens
uuuucaacauaacu

SEQ ID NO: 884518 - RNA, 14 nt, Homo sapiens
uuuucaagaugcuu

SEQ ID NO: 884519 - RNA, 17 nt, Homo sapiens
uuuucaugucauuugac

SEQ ID NO: 884520 - RNA, 15 nt, Homo sapiens
uuuuccagauucuuc

SEQ ID NO: 884521 - RNA, 19 nt, Homo sapiens
uuuucccgagcaaagucua

SEQ ID NO: 884522 - RNA, 13 nt, Homo sapiens
uuuucuaaucuug

SEQ ID NO: 884523 - RNA, 15 nt, Homo sapiens
uuuucuagacugucu

SEQ ID NO: 884524 - RNA, 16 nt, Homo sapiens
uuuucuauauggggau

SEQ ID NO: 884525 - RNA, 14 nt, Homo sapiens
uuuucuaugcuuau

SEQ ID NO: 884526 - RNA, 14 nt, Homo sapiens
uuuucuauuauuaa

SEQ ID NO: 884527 - RNA, 23 nt, Homo sapiens
uuuucucuccuaagacaccugca

SEQ ID NO: 884528 - RNA, 15 nt, Homo sapiens
uuuucucugugcuuc

SEQ ID NO: 884529 - RNA, 21 nt, Homo sapiens
uuuucugagcuuuucauggaa

SEQ ID NO: 884530 - RNA, 15 nt, Homo sapiens
uuuucugugcuuuga

SEQ ID NO: 884531 - RNA, 19 nt, Homo sapiens
uuuucuuauuuaacuuaac

SEQ ID NO: 884532 - RNA, 18 nt, Homo sapiens
uuuugacaucagcauuag

SEQ ID NO: 884533 - RNA, 22 nt, Homo sapiens
uuuugcauuugaauaaagccug

SEQ ID NO: 884534 - RNA, 22 nt, Homo sapiens
uuuuggaggguccuccacaaua

SEQ ID NO: 884535 - RNA, 22 nt, Homo sapiens
uuuugggagaaaacuucucaca

SEQ ID NO: 884536 - RNA, 15 nt, Homo sapiens
uuuuguaaacuguau

SEQ ID NO: 884537 - RNA, 15 nt, Homo sapiens
uuuugucauauguau

SEQ ID NO: 884538 - RNA, 19 nt, Homo sapiens
uuuugucuaugggacucaa

SEQ ID NO: 884539 - RNA, 22 nt, Homo sapiens
uuuugucugcuuaguaucucau

SEQ ID NO: 884540 - RNA, 18 nt, Homo sapiens
uuuugugaaguuaccucu

SEQ ID NO: 884541 - RNA, 13 nt, Homo sapiens
uuuuguuaccuuu

SEQ ID NO: 884542 - RNA, 18 nt, Homo sapiens
uuuuguucuacaugagga

SEQ ID NO: 884543 - RNA, 16 nt, Homo sapiens
uuuuuaaaaaaguaag

SEQ ID NO: 884544 - RNA, 14 nt, Homo sapiens
uuuuuauacauauc

SEQ ID NO: 884545 - RNA, 15 nt, Homo sapiens
uuuuucaacuuggaa

SEQ ID NO: 884546 - RNA, 15 nt, Homo sapiens
uuuuuccccaaaguc

SEQ ID NO: 884547 - RNA, 16 nt, Homo sapiens
uuuuugaaaagcuaau

SEQ ID NO: 884548 - RNA, 20 nt, Homo sapiens
uuuuugagguggagucucau

SEQ ID NO: 884549 - RNA, 19 nt, Homo sapiens
gaaaaucugcacugugggc

SEQ ID NO: 884550 - RNA, 21 nt, Homo sapiens
gaaaaugaagcccuauuacuu

SEQ ID NO: 884551 - RNA, 22 nt, Homo sapiens
gaaaaugccagagcuugugaac

SEQ ID NO: 884552 - RNA, 20 nt, Homo sapiens
gaaaaugucagaaaccaguu

SEQ ID NO: 884553 - RNA, 12 nt, Homo sapiens
gaaaaugugcaa

SEQ ID NO: 884554 - RNA, 14 nt, Homo sapiens
gaaaauuaacacug

SEQ ID NO: 884555 - RNA, 23 nt, Homo sapiens
gaaaauuguauguuaaguuacuu

SEQ ID NO: 884556 - RNA, 18 nt, Homo sapiens
gaaacaccgagucucugu

SEQ ID NO: 884557 - RNA, 16 nt, Homo sapiens
gaaacacucaacaaua

SEQ ID NO: 884558 - RNA, 18 nt, Homo sapiens
gaaacacucaacaauaaa

SEQ ID NO: 884559 - RNA, 22 nt, Homo sapiens
gaaacagggagccccuaggaaa

SEQ ID NO: 884560 - RNA, 14 nt, Homo sapiens
gaaacaugacacug

SEQ ID NO: 884561 - RNA, 14 nt, Homo sapiens
gaaaccacucugaa

SEQ ID NO: 884562 - RNA, 22 nt, Homo sapiens
gaaaccagagucaaauuugaaa

SEQ ID NO: 884563 - RNA, 20 nt, Homo sapiens
gaaacccauuaggcaugccu

SEQ ID NO: 884564 - RNA, 17 nt, Homo sapiens
gaaaccuuauuguaccu

SEQ ID NO: 884565 - RNA, 17 nt, Homo sapiens
gaaacuaacacagccau

SEQ ID NO: 884566 - RNA, 18 nt, Homo sapiens
gaaacuguaccauacaca

SEQ ID NO: 884567 - RNA, 16 nt, Homo sapiens
gaaacuuaauuacauc

SEQ ID NO: 884568 - RNA, 20 nt, Homo sapiens
gaaacuugcauacagagaca

SEQ ID NO: 884569 - RNA, 14 nt, Homo sapiens
gaaagaaguaggca

SEQ ID NO: 884570 - RNA, 15 nt, Homo sapiens
gaaagaaucagucuu

SEQ ID NO: 884571 - RNA, 21 nt, Homo sapiens
gaaagacauagccaacugcug

SEQ ID NO: 884572 - RNA, 18 nt, Homo sapiens
gaaagacuauucaaacag

SEQ ID NO: 884573 - RNA, 15 nt, Homo sapiens
gaaagagaguaccau

SEQ ID NO: 884574 - RNA, 19 nt, Homo sapiens
gaaagcauuacauuuccaa

SEQ ID NO: 884575 - RNA, 18 nt, Homo sapiens
gaaagccguacugucuau

SEQ ID NO: 884576 - RNA, 13 nt, Homo sapiens
gaaagccuuccau

SEQ ID NO: 884577 - RNA, 22 nt, Homo sapiens
gaaagcuguggccagcuuguua

SEQ ID NO: 884578 - RNA, 18 nt, Homo sapiens
gaaagcuucaaacugcau

SEQ ID NO: 884579 - RNA, 16 nt, Homo sapiens
gaaaggaaagccaaac

SEQ ID NO: 884580 - RNA, 23 nt, Homo sapiens
gaaaggaaagccaaacacuguuu

SEQ ID NO: 884581 - RNA, 21 nt, Homo sapiens
gaaaggagaacuauccaaaac

SEQ ID NO: 884582 - RNA, 13 nt, Homo sapiens
gaaaggccaauaa

SEQ ID NO: 884583 - RNA, 16 nt, Homo sapiens
gaaagggauaguccaa

SEQ ID NO: 884584 - RNA, 21 nt, Homo sapiens
gaaagggucaacggcccuguu

SEQ ID NO: 884585 - RNA, 16 nt, Homo sapiens
gaaagguuauguuagc

SEQ ID NO: 884586 - RNA, 17 nt, Homo sapiens
gaaaguaagugguagcu

SEQ ID NO: 884587 - RNA, 15 nt, Homo sapiens
gaaaguaugugauau

SEQ ID NO: 884588 - RNA, 12 nt, Homo sapiens
gaaagugauauc

SEQ ID NO: 884589 - RNA, 16 nt, Homo sapiens
gaaaguggcucuucua

SEQ ID NO: 884590 - RNA, 19 nt, Homo sapiens
gaaaguguuuaacuuguca

SEQ ID NO: 884591 - RNA, 17 nt, Homo sapiens
gaaauaaacagguaaua

SEQ ID NO: 884592 - RNA, 13 nt, Homo sapiens
gaaauaaaccugg

SEQ ID NO: 884593 - RNA, 19 nt, Homo sapiens
gaaauaaaguuggugacag

SEQ ID NO: 884594 - RNA, 19 nt, Homo sapiens
gaaauacuuuaucugugac

SEQ ID NO: 884595 - RNA, 16 nt, Homo sapiens
gaaauauuauuggugu

SEQ ID NO: 884596 - RNA, 18 nt, Homo sapiens
gaaaucagucuaccaagg

SEQ ID NO: 884597 - RNA, 15 nt, Homo sapiens
gaaaucauuguagaa

SEQ ID NO: 884598 - RNA, 23 nt, Homo sapiens
gaaaucauuuuacccuuggcuca

SEQ ID NO: 884599 - RNA, 16 nt, Homo sapiens
gaaauccaguuuccca

SEQ ID NO: 884600 - RNA, 20 nt, Homo sapiens
gaaaucugaggaaggugcuu

SEQ ID NO: 884601 - RNA, 12 nt, Homo sapiens
gaaaucugccaa

SEQ ID NO: 884602 - RNA, 14 nt, Homo sapiens
gaaaucuguaauuc

SEQ ID NO: 884603 - RNA, 23 nt, Homo sapiens
gaaaugcccaucuaugucccuug

SEQ ID NO: 884604 - RNA, 21 nt, Homo sapiens
gaaaugcuacaaacauaucaa

SEQ ID NO: 884605 - RNA, 22 nt, Homo sapiens
gaaaugugguagccucacuuuu

SEQ ID NO: 884606 - RNA, 17 nt, Homo sapiens
gaaauuaaagucuucca

SEQ ID NO: 884607 - RNA, 23 nt, Homo sapiens
gaaauuaaagucuuccauugcau

SEQ ID NO: 884608 - RNA, 16 nt, Homo sapiens
gaaauugaugccagug

SEQ ID NO: 884609 - RNA, 19 nt, Homo sapiens
gaaauugcauuuccugaca

SEQ ID NO: 884610 - RNA, 22 nt, Homo sapiens
gaaauuuaaacuauaagcaaga

SEQ ID NO: 884611 - RNA, 13 nt, Homo sapiens
gaacaacaacaac

SEQ ID NO: 884612 - RNA, 14 nt, Homo sapiens
gaacaagcaacaua

SEQ ID NO: 884613 - RNA, 16 nt, Homo sapiens
gaacaagcauuaguuu

SEQ ID NO: 884614 - RNA, 14 nt, Homo sapiens
gaacaaugaaugcu

SEQ ID NO: 884615 - RNA, 19 nt, Homo sapiens
gaacaauggagauaucagu

SEQ ID NO: 884616 - RNA, 20 nt, Homo sapiens
gaacaauuaaacagccaaau

SEQ ID NO: 884617 - RNA, 15 nt, Homo sapiens
gaacacaaggucauu

SEQ ID NO: 884618 - RNA, 20 nt, Homo sapiens
gaacacacauggaugcacac

SEQ ID NO: 884619 - RNA, 19 nt, Homo sapiens
gaacacagccugggaccag

SEQ ID NO: 884620 - RNA, 21 nt, Homo sapiens
gaacacccgacuccucaaaag

SEQ ID NO: 884621 - RNA, 16 nt, Homo sapiens
gaacacgaauugcuca

SEQ ID NO: 884622 - RNA, 18 nt, Homo sapiens
gaacacgaauugcucaau

SEQ ID NO: 884623 - RNA, 14 nt, Homo sapiens
gaacacguggguau

SEQ ID NO: 884624 - RNA, 22 nt, Homo sapiens
gaacacuaaacagacuauuuaa

SEQ ID NO: 884625 - RNA, 20 nt, Homo sapiens
gaacacugggggaggggaca

SEQ ID NO: 884626 - RNA, 17 nt, Homo sapiens
gaacagaaggaugaaug

SEQ ID NO: 884627 - RNA, 16 nt, Homo sapiens
gaacagacaacagaag

SEQ ID NO: 884628 - RNA, 17 nt, Homo sapiens
gaacagaggcauuuaaa

SEQ ID NO: 884629 - RNA, 13 nt, Homo sapiens
gaacaggggccaa

SEQ ID NO: 884630 - RNA, 13 nt, Homo sapiens
gaacauguaccac

SEQ ID NO: 884631 - RNA, 21 nt, Homo sapiens
gaaccaaggcagccuccagag

SEQ ID NO: 884632 - RNA, 12 nt, Homo sapiens
gaaccaauaaug

SEQ ID NO: 884633 - RNA, 14 nt, Homo sapiens
gaaccaauaaugua

SEQ ID NO: 884634 - RNA, 19 nt, Homo sapiens
gaaccaauauuuguagaag

SEQ ID NO: 884635 - RNA, 15 nt, Homo sapiens
gaaccauuacuguaa

SEQ ID NO: 884636 - RNA, 16 nt, Homo sapiens
gaaccauuacuguaau

SEQ ID NO: 884637 - RNA, 12 nt, Homo sapiens
gaacccaggaca

SEQ ID NO: 884638 - RNA, 23 nt, Homo sapiens
gaacccugggacguggcuaguca

SEQ ID NO: 884639 - RNA, 16 nt, Homo sapiens
gaaccgugauaagccu

SEQ ID NO: 884640 - RNA, 17 nt, Homo sapiens
gaaccuagaagggcuag

SEQ ID NO: 884641 - RNA, 11 nt, Homo sapiens
gaaccucaguu

SEQ ID NO: 884642 - RNA, 19 nt, Homo sapiens
gaaccugaaggugcugaca

SEQ ID NO: 884643 - RNA, 21 nt, Homo sapiens
gaaccuuuaaaguaaaggccu

SEQ ID NO: 884644 - RNA, 16 nt, Homo sapiens
gaacgucuaguacaau

SEQ ID NO: 884645 - RNA, 21 nt, Homo sapiens
gaacuacaaagcuucuauccc

SEQ ID NO: 884646 - RNA, 14 nt, Homo sapiens
gaacuauguacuuu

SEQ ID NO: 884647 - RNA, 21 nt, Homo sapiens
gaacuauuagacaugaaaucu

SEQ ID NO: 884648 - RNA, 15 nt, Homo sapiens
gaacuauuucuacac

SEQ ID NO: 884649 - RNA, 20 nt, Homo sapiens
gaacuauuucuacacagugg

SEQ ID NO: 884650 - RNA, 19 nt, Homo sapiens
gaacucagcugucuguggc

SEQ ID NO: 884651 - RNA, 11 nt, Homo sapiens
gaacuccacuc

SEQ ID NO: 884652 - RNA, 19 nt, Homo sapiens
gaacuccaguacucaccca

SEQ ID NO: 884653 - RNA, 18 nt, Homo sapiens
gaacuccggaaugaccag

SEQ ID NO: 884654 - RNA, 16 nt, Homo sapiens
gaacucgaagcccuuc

SEQ ID NO: 884655 - RNA, 22 nt, Homo sapiens
gaacugaauaaacaggaaaaug

SEQ ID NO: 884656 - RNA, 18 nt, Homo sapiens
gaacuugauauauuucau

SEQ ID NO: 884657 - RNA, 20 nt, Homo sapiens
gaacuugcugcugagugcac

SEQ ID NO: 884658 - RNA, 17 nt, Homo sapiens
gaacuuguucacagguu

SEQ ID NO: 884659 - RNA, 15 nt, Homo sapiens
gaacuuucacauagc

SEQ ID NO: 884660 - RNA, 14 nt, Homo sapiens
gaagaaaaaauaca

SEQ ID NO: 884661 - RNA, 15 nt, Homo sapiens
gaagaaaaucaacca

SEQ ID NO: 884662 - RNA, 18 nt, Homo sapiens
gaagaaaccccaagcagc

SEQ ID NO: 884663 - RNA, 17 nt, Homo sapiens
gaagaacauccaaggag

SEQ ID NO: 884664 - RNA, 23 nt, Homo sapiens
gaaugacguguccuacagccuca

SEQ ID NO: 884665 - RNA, 17 nt, Homo sapiens
gaaugagaagaaugacu

SEQ ID NO: 884666 - RNA, 18 nt, Homo sapiens
gaaugaggucccaggcag

SEQ ID NO: 884667 - RNA, 15 nt, Homo sapiens
gaaugauaagcagga

SEQ ID NO: 884668 - RNA, 22 nt, Homo sapiens
gaaugauuuagguacgucaaag

SEQ ID NO: 884669 - RNA, 19 nt, Homo sapiens
gaaugcaaaguagcaauuu

SEQ ID NO: 884670 - RNA, 22 nt, Homo sapiens
gaaugcaaaguagcaauuucca

SEQ ID NO: 884671 - RNA, 16 nt, Homo sapiens
gaaugcagugguauga

SEQ ID NO: 884672 - RNA, 17 nt, Homo sapiens
gaaugccucaaugugac

SEQ ID NO: 884673 - RNA, 15 nt, Homo sapiens
gaaugcuuggcacuc

SEQ ID NO: 884674 - RNA, 16 nt, Homo sapiens
gaauggcagcuggaau

SEQ ID NO: 884675 - RNA, 17 nt, Homo sapiens
gaaugggagcugcaaac

SEQ ID NO: 884676 - RNA, 19 nt, Homo sapiens
gaauggggugcaugaaggu

SEQ ID NO: 884677 - RNA, 16 nt, Homo sapiens
gaauggguuugcuaga

SEQ ID NO: 884678 - RNA, 20 nt, Homo sapiens
gaauguauugaacuuggaaa

SEQ ID NO: 884679 - RNA, 18 nt, Homo sapiens
gaaugucuuacugugauc

SEQ ID NO: 884680 - RNA, 16 nt, Homo sapiens
gaauguuaagacuuga

SEQ ID NO: 884681 - RNA, 20 nt, Homo sapiens
gaauguuagauuccucuugc

SEQ ID NO: 884682 - RNA, 14 nt, Homo sapiens
gaauguuugccucu

SEQ ID NO: 884683 - RNA, 17 nt, Homo sapiens
gaauuaaacaacaaaca

SEQ ID NO: 884684 - RNA, 23 nt, Homo sapiens
gaauuaaguuagggaauggcaca

SEQ ID NO: 884685 - RNA, 19 nt, Homo sapiens
gaauuauuuuuguguuucu

SEQ ID NO: 884686 - RNA, 22 nt, Homo sapiens
gaauucugcuaccucacugggg

SEQ ID NO: 884687 - RNA, 17 nt, Homo sapiens
gaauucuuuacaauaaa

SEQ ID NO: 884688 - RNA, 15 nt, Homo sapiens
gaauugaagauguaa

SEQ ID NO: 884689 - RNA, 22 nt, Homo sapiens
gaauugauucaagauuggacau

SEQ ID NO: 884690 - RNA, 14 nt, Homo sapiens
gaauugcaugccau

SEQ ID NO: 884691 - RNA, 14 nt, Homo sapiens
gaauuuacuacuuu

SEQ ID NO: 884692 - RNA, 18 nt, Homo sapiens
gaauuucaguaaacaaug

SEQ ID NO: 884693 - RNA, 20 nt, Homo sapiens
gaauuucuaaaaaacagagg

SEQ ID NO: 884694 - RNA, 15 nt, Homo sapiens
gaauuucuuugucau

SEQ ID NO: 884695 - RNA, 16 nt, Homo sapiens
gaauuugccuguaaca

SEQ ID NO: 884696 - RNA, 15 nt, Homo sapiens
gaauuugggccucuu

SEQ ID NO: 884697 - RNA, 15 nt, Homo sapiens
gaauuuguaagcaac

SEQ ID NO: 884698 - RNA, 14 nt, Homo sapiens
gaauuuuguauauu

SEQ ID NO: 884699 - RNA, 18 nt, Homo sapiens
gacaaaggagccugugaa

SEQ ID NO: 884700 - RNA, 24 nt, Homo sapiens
gacaaaggcucuacacauacugca

SEQ ID NO: 884701 - RNA, 17 nt, Homo sapiens
gacaaagguuuuccucu

SEQ ID NO: 884702 - RNA, 13 nt, Homo sapiens
gacaacagacuga

SEQ ID NO: 884703 - RNA, 15 nt, Homo sapiens
gacaacagguuuuca

SEQ ID NO: 884704 - RNA, 18 nt, Homo sapiens
gacaacauuucuauagcc

SEQ ID NO: 884705 - RNA, 21 nt, Homo sapiens
gacaacauuucucaaaugcac

SEQ ID NO: 884706 - RNA, 15 nt, Homo sapiens
gacaagauaaaggaa

SEQ ID NO: 884707 - RNA, 23 nt, Homo sapiens
gacaauaugauuuuaaauuugaa

SEQ ID NO: 884708 - RNA, 20 nt, Homo sapiens
gacaauggaaacuguaccau

SEQ ID NO: 884709 - RNA, 20 nt, Homo sapiens
gacaauggcuuacuccagga

SEQ ID NO: 884710 - RNA, 14 nt, Homo sapiens
gacacaauccucaa

SEQ ID NO: 884711 - RNA, 19 nt, Homo sapiens
gacacagagggggccuuca

SEQ ID NO: 884712 - RNA, 22 nt, Homo sapiens
gacacagcgucccuagcaguga

SEQ ID NO: 884713 - RNA, 22 nt, Homo sapiens
gacacagcugaacaguguuaau

SEQ ID NO: 884714 - RNA, 15 nt, Homo sapiens
gacacauaugcaccu

SEQ ID NO: 884715 - RNA, 16 nt, Homo sapiens
gacaccugccuuaaca

SEQ ID NO: 884716 - RNA, 13 nt, Homo sapiens
gacaccugugcac

SEQ ID NO: 884717 - RNA, 20 nt, Homo sapiens
gacacucuagugacuuccug

SEQ ID NO: 884718 - RNA, 18 nt, Homo sapiens
gacacuguaugacucucc

SEQ ID NO: 884719 - RNA, 15 nt, Homo sapiens
gacacuuacccaagg

SEQ ID NO: 884720 - RNA, 15 nt, Homo sapiens
gacagaaaugcaauc

SEQ ID NO: 884721 - RNA, 19 nt, Homo sapiens
gacagaagucuugucucaa

SEQ ID NO: 884722 - RNA, 23 nt, Homo sapiens
gacagagccgcaaaucaacccca

SEQ ID NO: 884723 - RNA, 16 nt, Homo sapiens
gacagagcgagacucc

SEQ ID NO: 884724 - RNA, 22 nt, Homo sapiens
gacagaucccauccaucagcuc

SEQ ID NO: 884725 - RNA, 23 nt, Homo sapiens
gacagcagucuucuucacccgcu

SEQ ID NO: 884726 - RNA, 22 nt, Homo sapiens
gacagccacggccaggccagag

SEQ ID NO: 884727 - RNA, 15 nt, Homo sapiens
gacaggaaaggcccu

SEQ ID NO: 884728 - RNA, 16 nt, Homo sapiens
gacaggaaaggcccuc

SEQ ID NO: 884729 - RNA, 20 nt, Homo sapiens
gacaggaagcccaaggcagu

SEQ ID NO: 884730 - RNA, 16 nt, Homo sapiens
gacaggacuaacacuc

SEQ ID NO: 884731 - RNA, 18 nt, Homo sapiens
gacagguucccagcagcu

SEQ ID NO: 884732 - RNA, 19 nt, Homo sapiens
gacagguucccagcagcug

SEQ ID NO: 884733 - RNA, 23 nt, Homo sapiens
gacaguacucuuaacuccuagcc

SEQ ID NO: 884734 - RNA, 13 nt, Homo sapiens
gacagucuugcau

SEQ ID NO: 884735 - RNA, 21 nt, Homo sapiens
gacaguuacucuucaguuuua

SEQ ID NO: 884736 - RNA, 19 nt, Homo sapiens
gacauaagcaaagacuaug

SEQ ID NO: 884737 - RNA, 18 nt, Homo sapiens
gacauacaccuaugucau

SEQ ID NO: 884738 - RNA, 21 nt, Homo sapiens
gacauagccaacugcuguuca

SEQ ID NO: 884739 - RNA, 22 nt, Homo sapiens
gacauagcuggaaaauuccuau

SEQ ID NO: 884740 - RNA, 17 nt, Homo sapiens
gacauauaccuucucaa

SEQ ID NO: 884741 - RNA, 15 nt, Homo sapiens
gacaugacuaggaag

SEQ ID NO: 884742 - RNA, 14 nt, Homo sapiens
gacaugcacuauga

SEQ ID NO: 884743 - RNA, 21 nt, Homo sapiens
gacaugccacccucuccaugc

SEQ ID NO: 884744 - RNA, 17 nt, Homo sapiens
gacauggaauuaccuua

SEQ ID NO: 884745 - RNA, 16 nt, Homo sapiens
gacaugucucacagac

SEQ ID NO: 884746 - RNA, 21 nt, Homo sapiens
gacauguuucacaacaggcau

SEQ ID NO: 884747 - RNA, 16 nt, Homo sapiens
gacauuaaaagcuauc

SEQ ID NO: 884748 - RNA, 14 nt, Homo sapiens
gacauuaaaccugg

SEQ ID NO: 884749 - RNA, 13 nt, Homo sapiens
gacauuaacucau

SEQ ID NO: 884750 - RNA, 13 nt, Homo sapiens
gacauuaugugug

SEQ ID NO: 884751 - RNA, 21 nt, Homo sapiens
gacauuggauguggagcuccu

SEQ ID NO: 884752 - RNA, 22 nt, Homo sapiens
gaccaacauggugaaacccugu

SEQ ID NO: 884753 - RNA, 22 nt, Homo sapiens
gaccaauaaccaugcccaagaa

SEQ ID NO: 884754 - RNA, 13 nt, Homo sapiens
gaccaauauucaa

SEQ ID NO: 884755 - RNA, 19 nt, Homo sapiens
gaccacaccuaaaacugcc

SEQ ID NO: 884756 - RNA, 20 nt, Homo sapiens
gaccacccgcccuggcaguu

SEQ ID NO: 884757 - RNA, 17 nt, Homo sapiens
gaccagcccagccaaca

SEQ ID NO: 884758 - RNA, 23 nt, Homo sapiens
gaccagccugggcaacaaaguga

SEQ ID NO: 884759 - RNA, 20 nt, Homo sapiens
gaccaguugggagcacugga

SEQ ID NO: 884760 - RNA, 21 nt, Homo sapiens
gacccaagagguggggaccaa

SEQ ID NO: 884761 - RNA, 18 nt, Homo sapiens
gacccagagagcuagggc

SEQ ID NO: 884762 - RNA, 18 nt, Homo sapiens
gacccagggaugacaugu

SEQ ID NO: 884763 - RNA, 18 nt, Homo sapiens
gacccaguguaaagaaua

SEQ ID NO: 884764 - RNA, 12 nt, Homo sapiens
gaccccaaagag

SEQ ID NO: 884765 - RNA, 13 nt, Homo sapiens
gaccccacuggac

SEQ ID NO: 884766 - RNA, 19 nt, Homo sapiens
gacccccaucucuacaaaa

SEQ ID NO: 884767 - RNA, 17 nt, Homo sapiens
gaccccuacccacuucc

SEQ ID NO: 884768 - RNA, 22 nt, Homo sapiens
gaccccuuucccccaccccaga

SEQ ID NO: 884769 - RNA, 23 nt, Homo sapiens
gacccuaaauguggacaucauga

SEQ ID NO: 884770 - RNA, 17 nt, Homo sapiens
gacccucccuaccugag

SEQ ID NO: 884771 - RNA, 15 nt, Homo sapiens
gacccuccuguccag

SEQ ID NO: 884772 - RNA, 16 nt, Homo sapiens
gaccgaaucucacucu

SEQ ID NO: 884773 - RNA, 21 nt, Homo sapiens
gaccgcuucccagaggccagg

SEQ ID NO: 884774 - RNA, 17 nt, Homo sapiens
gaccuaaaugaccucag

SEQ ID NO: 884775 - RNA, 18 nt, Homo sapiens
gaccuagaccugggccaa

SEQ ID NO: 884776 - RNA, 14 nt, Homo sapiens
gaccucagccugug

SEQ ID NO: 884777 - RNA, 11 nt, Homo sapiens
gaccucaggug

SEQ ID NO: 884778 - RNA, 13 nt, Homo sapiens
gaagaagccagac

SEQ ID NO: 884779 - RNA, 14 nt, Homo sapiens
gaagaagcugagga

SEQ ID NO: 884780 - RNA, 19 nt, Homo sapiens
gaagaaggaagaagccaga

SEQ ID NO: 884781 - RNA, 14 nt, Homo sapiens
gaagaaggacauuu

SEQ ID NO: 884782 - RNA, 19 nt, Homo sapiens
gaagaaguuuaaaaaacca

SEQ ID NO: 884783 - RNA, 20 nt, Homo sapiens
gaagaaguuuaaaaaaccau

SEQ ID NO: 884784 - RNA, 17 nt, Homo sapiens
gaagaaucacaauaauu

SEQ ID NO: 884785 - RNA, 19 nt, Homo sapiens
gaagacccacgugcuaggg

SEQ ID NO: 884786 - RNA, 16 nt, Homo sapiens
gaagacccaguguaaa

SEQ ID NO: 884787 - RNA, 23 nt, Homo sapiens
gaagacccaguguaaagaauaaa

SEQ ID NO: 884788 - RNA, 23 nt, Homo sapiens
gaagaccuccacauuaaguggcu

SEQ ID NO: 884789 - RNA, 12 nt, Homo sapiens
gaagacuggaag

SEQ ID NO: 884790 - RNA, 16 nt, Homo sapiens
gaagagaagcugagaa

SEQ ID NO: 884791 - RNA, 14 nt, Homo sapiens
gaagagaagggaag

SEQ ID NO: 884792 - RNA, 13 nt, Homo sapiens
gaagagaccacag

SEQ ID NO: 884793 - RNA, 19 nt, Homo sapiens
gaagagacucucuuaggga

SEQ ID NO: 884794 - RNA, 22 nt, Homo sapiens
gaagagagagagagagguucug

SEQ ID NO: 884795 - RNA, 23 nt, Homo sapiens
gaagagggcgaguucagcaaaga

SEQ ID NO: 884796 - RNA, 15 nt, Homo sapiens
gaagaguuaaaacag

SEQ ID NO: 884797 - RNA, 20 nt, Homo sapiens
gaagauaacuugagcaccgu

SEQ ID NO: 884798 - RNA, 17 nt, Homo sapiens
gaagauagaacaaugcu

SEQ ID NO: 884799 - RNA, 17 nt, Homo sapiens
gaagaucuaauaccauc

SEQ ID NO: 884800 - RNA, 22 nt, Homo sapiens
gaagauucccucuuccugccaa

SEQ ID NO: 884801 - RNA, 18 nt, Homo sapiens
gaagauucuccugugcua

SEQ ID NO: 884802 - RNA, 14 nt, Homo sapiens
gaagauuucagagg

SEQ ID NO: 884803 - RNA, 16 nt, Homo sapiens
gaagcacagagggcua

SEQ ID NO: 884804 - RNA, 20 nt, Homo sapiens
gaagcagccuccuaauuuga

SEQ ID NO: 884805 - RNA, 13 nt, Homo sapiens
gaagcagcugcuu

SEQ ID NO: 884806 - RNA, 19 nt, Homo sapiens
gaagcagugccuuccauaa

SEQ ID NO: 884807 - RNA, 21 nt, Homo sapiens
gaagcaucacauaaaaaugau

SEQ ID NO: 884808 - RNA, 16 nt, Homo sapiens
gaagcaucaccaugca

SEQ ID NO: 884809 - RNA, 12 nt, Homo sapiens
gaagcauuuacu

SEQ ID NO: 884810 - RNA, 10 nt, Homo sapiens
gaagcauuuu

SEQ ID NO: 884811 - RNA, 20 nt, Homo sapiens
gaagccacugaagcugggau

SEQ ID NO: 884812 - RNA, 19 nt, Homo sapiens
gaagccauauucacaccuc

SEQ ID NO: 884813 - RNA, 20 nt, Homo sapiens
gaagccgucugacuccagag

SEQ ID NO: 884814 - RNA, 23 nt, Homo sapiens
gaagccuuuuuuuaguaaauccu

SEQ ID NO: 884815 - RNA, 13 nt, Homo sapiens
gaagcucacccaa

SEQ ID NO: 884816 - RNA, 13 nt, Homo sapiens
gaagcuccacugu

SEQ ID NO: 884817 - RNA, 23 nt, Homo sapiens
gaagcucuggccaaccaaagaca

SEQ ID NO: 884818 - RNA, 15 nt, Homo sapiens
gaagcugggagcuac

SEQ ID NO: 884819 - RNA, 19 nt, Homo sapiens
gaaggaacucuggcuucca

SEQ ID NO: 884820 - RNA, 20 nt, Homo sapiens
gaaggaacucuggcuuccag

SEQ ID NO: 884821 - RNA, 16 nt, Homo sapiens
gaaggaagaagccaga

SEQ ID NO: 884822 - RNA, 16 nt, Homo sapiens
gaaggacaugugcuau

SEQ ID NO: 884823 - RNA, 20 nt, Homo sapiens
gaaggacauuuucucuuuaa

SEQ ID NO: 884824 - RNA, 20 nt, Homo sapiens
gaaggagauacucauguuga

SEQ ID NO: 884825 - RNA, 23 nt, Homo sapiens
gaaggagccacgugaauggcccu

SEQ ID NO: 884826 - RNA, 18 nt, Homo sapiens
gaaggagccagugcccac

SEQ ID NO: 884827 - RNA, 22 nt, Homo sapiens
gaaggaggcuuaggacuuucca

SEQ ID NO: 884828 - RNA, 16 nt, Homo sapiens
gaaggauauauuuggc

SEQ ID NO: 884829 - RNA, 13 nt, Homo sapiens
gaaggaugaauga

SEQ ID NO: 884830 - RNA, 20 nt, Homo sapiens
gaaggcaaagagaccacuca

SEQ ID NO: 884831 - RNA, 23 nt, Homo sapiens
gaaggcaaauauaagcugggaaa

SEQ ID NO: 884832 - RNA, 19 nt, Homo sapiens
gaaggcuccaucuccagug

SEQ ID NO: 884833 - RNA, 19 nt, Homo sapiens
gaaggcucccuaacacaca

SEQ ID NO: 884834 - RNA, 19 nt, Homo sapiens
gaaggcuggggccagugua

SEQ ID NO: 884835 - RNA, 22 nt, Homo sapiens
gaaggggcaaagaaaagccaga

SEQ ID NO: 884836 - RNA, 20 nt, Homo sapiens
gaagggggcggccuaugacu

SEQ ID NO: 884837 - RNA, 19 nt, Homo sapiens
gaagggggucaaaggaaga

SEQ ID NO: 884838 - RNA, 23 nt, Homo sapiens
gaagguagcccagcacugugaag

SEQ ID NO: 884839 - RNA, 21 nt, Homo sapiens
gaaggucuugccugaauccau

SEQ ID NO: 884840 - RNA, 22 nt, Homo sapiens
gaaggucuugccugaauccauc

SEQ ID NO: 884841 - RNA, 16 nt, Homo sapiens
gaaggugcugacaaag

SEQ ID NO: 884842 - RNA, 12 nt, Homo sapiens
gaaggugucaua

SEQ ID NO: 884843 - RNA, 16 nt, Homo sapiens
gaaguaaaagcuaauu

SEQ ID NO: 884844 - RNA, 22 nt, Homo sapiens
gaaguauccaauuaugugacaa

SEQ ID NO: 884845 - RNA, 21 nt, Homo sapiens
gaaguauuuuccuccaggcaa

SEQ ID NO: 884846 - RNA, 14 nt, Homo sapiens
gaagucacacagua

SEQ ID NO: 884847 - RNA, 19 nt, Homo sapiens
gaagucacacaguauuacu

SEQ ID NO: 884848 - RNA, 15 nt, Homo sapiens
gaagucauaaacagc

SEQ ID NO: 884849 - RNA, 16 nt, Homo sapiens
gaagucccuguucuca

SEQ ID NO: 884850 - RNA, 12 nt, Homo sapiens
gaagucuuccau

SEQ ID NO: 884851 - RNA, 15 nt, Homo sapiens
gaaguggcagugaaa

SEQ ID NO: 884852 - RNA, 19 nt, Homo sapiens
gaaguuaggucauuacuaa

SEQ ID NO: 884853 - RNA, 22 nt, Homo sapiens
gaaguuauuaacgggcauguau

SEQ ID NO: 884854 - RNA, 20 nt, Homo sapiens
gaaguugcagugagcugaua

SEQ ID NO: 884855 - RNA, 16 nt, Homo sapiens
gaaguuuaaaaaacca

SEQ ID NO: 884856 - RNA, 20 nt, Homo sapiens
gaaguuuggauaaccuuccu

SEQ ID NO: 884857 - RNA, 14 nt, Homo sapiens
gaauaaaauugcac

SEQ ID NO: 884858 - RNA, 15 nt, Homo sapiens
gaauaaaauugcacu

SEQ ID NO: 884859 - RNA, 17 nt, Homo sapiens
gaauaaaauugcacuuu

SEQ ID NO: 884860 - RNA, 16 nt, Homo sapiens
gaauaaaccauuuuua

SEQ ID NO: 884861 - RNA, 17 nt, Homo sapiens
gaauaaacgugcucccc

SEQ ID NO: 884862 - RNA, 16 nt, Homo sapiens
gaauaaagcccuugaa

SEQ ID NO: 884863 - RNA, 17 nt, Homo sapiens
gaauaaagcccuugaac

SEQ ID NO: 884864 - RNA, 19 nt, Homo sapiens
gaauaaagcccuugaacca

SEQ ID NO: 884865 - RNA, 21 nt, Homo sapiens
gaauaaagcccuugaaccagc

SEQ ID NO: 884866 - RNA, 18 nt, Homo sapiens
gaauaaauaaauguaucu

SEQ ID NO: 884867 - RNA, 14 nt, Homo sapiens
gaauaaaugaaucu

SEQ ID NO: 884868 - RNA, 22 nt, Homo sapiens
gaauaaaugaaucuuacuccuu

SEQ ID NO: 884869 - RNA, 12 nt, Homo sapiens
gaauaaccacuu

SEQ ID NO: 884870 - RNA, 16 nt, Homo sapiens
gaauaaugagucugca

SEQ ID NO: 884871 - RNA, 16 nt, Homo sapiens
gaauaauggaaucuau

SEQ ID NO: 884872 - RNA, 21 nt, Homo sapiens
gaauaauuguguacaaaguag

SEQ ID NO: 884873 - RNA, 19 nt, Homo sapiens
gaauagcuuugaauguggc

SEQ ID NO: 884874 - RNA, 19 nt, Homo sapiens
gaauauaaauuuguguucu

SEQ ID NO: 884875 - RNA, 21 nt, Homo sapiens
gaauauauuauaaucuuccau

SEQ ID NO: 884876 - RNA, 18 nt, Homo sapiens
gaauaugcuagugaugua

SEQ ID NO: 884877 - RNA, 19 nt, Homo sapiens
gaauauggugggcacagaa

SEQ ID NO: 884878 - RNA, 23 nt, Homo sapiens
gaauauggugggcacagaaguag

SEQ ID NO: 884879 - RNA, 13 nt, Homo sapiens
gaaucaaagacau

SEQ ID NO: 884880 - RNA, 13 nt, Homo sapiens
gaaucaagcuaga

SEQ ID NO: 884881 - RNA, 15 nt, Homo sapiens
gaaucacuugcacuc

SEQ ID NO: 884882 - RNA, 23 nt, Homo sapiens
gaaucagugaagaugccagugaa

SEQ ID NO: 884883 - RNA, 12 nt, Homo sapiens
gaaucaucucaa

SEQ ID NO: 884884 - RNA, 14 nt, Homo sapiens
gaaucauuaucuua

SEQ ID NO: 884885 - RNA, 17 nt, Homo sapiens
gaaucgcuuaaaccugg

SEQ ID NO: 884886 - RNA, 19 nt, Homo sapiens
gaaucguuucaaauggacu

SEQ ID NO: 884887 - RNA, 20 nt, Homo sapiens
gaaucugugcagaugagcag

SEQ ID NO: 884888 - RNA, 13 nt, Homo sapiens
gaaugaagcaugu

SEQ ID NO: 884889 - RNA, 15 nt, Homo sapiens
gaaugacaacagaag

SEQ ID NO: 884890 - RNA, 13 nt, Homo sapiens
gaaugacacuguu

SEQ ID NO: 884891 - RNA, 15 nt, Homo sapiens
gaaugacacuguuca

SEQ ID NO: 884892 - RNA, 17 nt, Homo sapiens
auuaacuuaaaagauuc

SEQ ID NO: 884893 - RNA, 23 nt, Homo sapiens
auuaacuuauugucuaggccaga

SEQ ID NO: 884894 - RNA, 16 nt, Homo sapiens
auuaagauacacuccu

SEQ ID NO: 884895 - RNA, 16 nt, Homo sapiens
auuaagguguggcuuu

SEQ ID NO: 884896 - RNA, 17 nt, Homo sapiens
auuaaguaaaccaaaaa

SEQ ID NO: 884897 - RNA, 13 nt, Homo sapiens
auuaagugccuga

SEQ ID NO: 884898 - RNA, 23 nt, Homo sapiens
auuaaguggcuuuuuaacaugaa

SEQ ID NO: 884899 - RNA, 22 nt, Homo sapiens
auuaauaugcuacaguacuaug

SEQ ID NO: 884900 - RNA, 15 nt, Homo sapiens
auuaaucaacuuucc

SEQ ID NO: 884901 - RNA, 13 nt, Homo sapiens
auuaauguuaauu

SEQ ID NO: 884902 - RNA, 24 nt, Homo sapiens
auuaauuaaacaagugcacuugaa

SEQ ID NO: 884903 - RNA, 12 nt, Homo sapiens
auuaauucaccu

SEQ ID NO: 884904 - RNA, 23 nt, Homo sapiens
auuacaagcgugagccacugcac

SEQ ID NO: 884905 - RNA, 13 nt, Homo sapiens
auuacagguguga

SEQ ID NO: 884906 - RNA, 23 nt, Homo sapiens
auuacaggugugaaccaccacac

SEQ ID NO: 884907 - RNA, 16 nt, Homo sapiens
auuacaguagugcauu

SEQ ID NO: 884908 - RNA, 16 nt, Homo sapiens
auuacauggcaguguu

SEQ ID NO: 884909 - RNA, 19 nt, Homo sapiens
auuaccuccuguguggaag

SEQ ID NO: 884910 - RNA, 16 nt, Homo sapiens
auuaccuguuaguauu

SEQ ID NO: 884911 - RNA, 14 nt, Homo sapiens
auuacguuuuacaa

SEQ ID NO: 884912 - RNA, 14 nt, Homo sapiens
auuacuauaugcaa

SEQ ID NO: 884913 - RNA, 23 nt, Homo sapiens
auuacugaaaacaaaauaucuga

SEQ ID NO: 884914 - RNA, 16 nt, Homo sapiens
auuacugcaugcacuu

SEQ ID NO: 884915 - RNA, 21 nt, Homo sapiens
auuagaaacugaaaacuguaa

SEQ ID NO: 884916 - RNA, 14 nt, Homo sapiens
auuagaaugcaugu

SEQ ID NO: 884917 - RNA, 20 nt, Homo sapiens
auuagacaugaaaucugagg

SEQ ID NO: 884918 - RNA, 21 nt, Homo sapiens
auuagagagggcuaaacaagg

SEQ ID NO: 884919 - RNA, 16 nt, Homo sapiens
auuagauguuuuacaa

SEQ ID NO: 884920 - RNA, 19 nt, Homo sapiens
auuagcaauugacugucac

SEQ ID NO: 884921 - RNA, 18 nt, Homo sapiens
auuagccgggcauggugg

SEQ ID NO: 884922 - RNA, 19 nt, Homo sapiens
auuagcugaguguagugac

SEQ ID NO: 884923 - RNA, 12 nt, Homo sapiens
auuagcugugau

SEQ ID NO: 884924 - RNA, 13 nt, Homo sapiens
auuagcugugauu

SEQ ID NO: 884925 - RNA, 16 nt, Homo sapiens
auuaggcaugccuaau

SEQ ID NO: 884926 - RNA, 15 nt, Homo sapiens
auuaguaacugcaca

SEQ ID NO: 884927 - RNA, 16 nt, Homo sapiens
auuaguugagaaagaa

SEQ ID NO: 884928 - RNA, 13 nt, Homo sapiens
auuauacauuuga

SEQ ID NO: 884929 - RNA, 16 nt, Homo sapiens
auuauacucaaaauuc

SEQ ID NO: 884930 - RNA, 16 nt, Homo sapiens
auuauagccacauccc

SEQ ID NO: 884931 - RNA, 20 nt, Homo sapiens
auuauaucugaggcacugau

SEQ ID NO: 884932 - RNA, 22 nt, Homo sapiens
auuauaugacaauccugaagaa

SEQ ID NO: 884933 - RNA, 17 nt, Homo sapiens
auuaucgggaacagugu

SEQ ID NO: 884934 - RNA, 20 nt, Homo sapiens
auuauggcaagugauaucac

SEQ ID NO: 884935 - RNA, 16 nt, Homo sapiens
auuauuagauucucca

SEQ ID NO: 884936 - RNA, 19 nt, Homo sapiens
auuauuccacucaauaugu

SEQ ID NO: 884937 - RNA, 23 nt, Homo sapiens
auuauuccuccaggaaggagcaa

SEQ ID NO: 884938 - RNA, 19 nt, Homo sapiens
auuauuuauucagcuucau

SEQ ID NO: 884939 - RNA, 16 nt, Homo sapiens
auuauuuucacuguag

SEQ ID NO: 884940 - RNA, 19 nt, Homo sapiens
auucaaaagugaacuugau

SEQ ID NO: 884941 - RNA, 16 nt, Homo sapiens
auucaagauuggacau

SEQ ID NO: 884942 - RNA, 15 nt, Homo sapiens
auucaagugccucuu

SEQ ID NO: 884943 - RNA, 21 nt, Homo sapiens
auucaaguugcuucucaugga

SEQ ID NO: 884944 - RNA, 24 nt, Homo sapiens
auucaaugaucuuagaaguacuga

SEQ ID NO: 884945 - RNA, 14 nt, Homo sapiens
auucacaacuagga

SEQ ID NO: 884946 - RNA, 19 nt, Homo sapiens
auucacaacuaggaccuca

SEQ ID NO: 884947 - RNA, 14 nt, Homo sapiens
auucacagagccuu

SEQ ID NO: 884948 - RNA, 21 nt, Homo sapiens
auucacauaacuucucugagu

SEQ ID NO: 884949 - RNA, 16 nt, Homo sapiens
auucacauuugaugua

SEQ ID NO: 884950 - RNA, 19 nt, Homo sapiens
auucacccuucaacauaaa

SEQ ID NO: 884951 - RNA, 15 nt, Homo sapiens
auucacuagaccaga

SEQ ID NO: 884952 - RNA, 20 nt, Homo sapiens
auucacucccacacccaaga

SEQ ID NO: 884953 - RNA, 23 nt, Homo sapiens
auucacuuauggcagaggaauau

SEQ ID NO: 884954 - RNA, 19 nt, Homo sapiens
auucagcauuauuccucca

SEQ ID NO: 884955 - RNA, 18 nt, Homo sapiens
auucaggcagcacugaca

SEQ ID NO: 884956 - RNA, 19 nt, Homo sapiens
auucagguauuuguaauag

SEQ ID NO: 884957 - RNA, 17 nt, Homo sapiens
auucauaauaaacuaga

SEQ ID NO: 884958 - RNA, 20 nt, Homo sapiens
auucaucauuccauaugacu

SEQ ID NO: 884959 - RNA, 14 nt, Homo sapiens
auucauccaacaga

SEQ ID NO: 884960 - RNA, 22 nt, Homo sapiens
auucaugccagggacugacaaa

SEQ ID NO: 884961 - RNA, 15 nt, Homo sapiens
auucauguggaauau

SEQ ID NO: 884962 - RNA, 16 nt, Homo sapiens
auucauuagcugugau

SEQ ID NO: 884963 - RNA, 14 nt, Homo sapiens
auucauuguucaaa

SEQ ID NO: 884964 - RNA, 16 nt, Homo sapiens
auucauuuaacagagc

SEQ ID NO: 884965 - RNA, 23 nt, Homo sapiens
auucauuuuucuuucugauguca

SEQ ID NO: 884966 - RNA, 15 nt, Homo sapiens
auuccaaaacuuuaa

SEQ ID NO: 884967 - RNA, 15 nt, Homo sapiens
auuccaaaguuuuga

SEQ ID NO: 884968 - RNA, 18 nt, Homo sapiens
auuccacuuuuauucauu

SEQ ID NO: 884969 - RNA, 16 nt, Homo sapiens
auuccagcauuugcca

SEQ ID NO: 884970 - RNA, 14 nt, Homo sapiens
auucccaccaaggu

SEQ ID NO: 884971 - RNA, 20 nt, Homo sapiens
auucccagcugucuguguca

SEQ ID NO: 884972 - RNA, 22 nt, Homo sapiens
auucccuaucaaaacauaucaa

SEQ ID NO: 884973 - RNA, 14 nt, Homo sapiens
auucccucuugcua

SEQ ID NO: 884974 - RNA, 19 nt, Homo sapiens
auucccuuggauguagucu

SEQ ID NO: 884975 - RNA, 20 nt, Homo sapiens
auucccuuucccauccauaa

SEQ ID NO: 884976 - RNA, 20 nt, Homo sapiens
auuccuauauaguuuauuga

SEQ ID NO: 884977 - RNA, 15 nt, Homo sapiens
auuccucuugccucu

SEQ ID NO: 884978 - RNA, 22 nt, Homo sapiens
auuccucuugccucucucagga

SEQ ID NO: 884979 - RNA, 16 nt, Homo sapiens
auuccugaagccagau

SEQ ID NO: 884980 - RNA, 13 nt, Homo sapiens
auuccugauaaua

SEQ ID NO: 884981 - RNA, 13 nt, Homo sapiens
auuccugugauuu

SEQ ID NO: 884982 - RNA, 23 nt, Homo sapiens
auuccuugucaccagcaacaucu

SEQ ID NO: 884983 - RNA, 15 nt, Homo sapiens
auucgaaugacacug

SEQ ID NO: 884984 - RNA, 16 nt, Homo sapiens
auucgaaugacacugu

SEQ ID NO: 884985 - RNA, 20 nt, Homo sapiens
auucuaaaugaauguuuaca

SEQ ID NO: 884986 - RNA, 21 nt, Homo sapiens
auucuacacauauauguauau

SEQ ID NO: 884987 - RNA, 13 nt, Homo sapiens
auucuaggcaucc

SEQ ID NO: 884988 - RNA, 13 nt, Homo sapiens
auucucaccagga

SEQ ID NO: 884989 - RNA, 21 nt, Homo sapiens
auucucacuccaccacccaaa

SEQ ID NO: 884990 - RNA, 14 nt, Homo sapiens
auucucacuccuac

SEQ ID NO: 884991 - RNA, 19 nt, Homo sapiens
auucucaguguagggcaga

SEQ ID NO: 884992 - RNA, 21 nt, Homo sapiens
aaaauaguaaaugcuuugugu

SEQ ID NO: 884993 - RNA, 18 nt, Homo sapiens
aaaauaguaagccucccu

SEQ ID NO: 884994 - RNA, 16 nt, Homo sapiens
aaaauauaaccauuac

SEQ ID NO: 884995 - RNA, 22 nt, Homo sapiens
aaaauauuuguaucacaaaucu

SEQ ID NO: 884996 - RNA, 22 nt, Homo sapiens
aaaaucaucuuggccacuuuaa

SEQ ID NO: 884997 - RNA, 22 nt, Homo sapiens
aaaaugaaaauuaggauuucau

SEQ ID NO: 884998 - RNA, 15 nt, Homo sapiens
aaaaugaaagccaaa

SEQ ID NO: 884999 - RNA, 18 nt, Homo sapiens
aaaaugcaacaacaugua

SEQ ID NO: 885000 - RNA, 18 nt, Homo sapiens
aaaaugcauauacuuuaa

SEQ ID NO: 885001 - RNA, 11 nt, Homo sapiens
aaaauggacau

SEQ ID NO: 885002 - RNA, 19 nt, Homo sapiens
aaaauguccaugauggaau

SEQ ID NO: 885003 - RNA, 18 nt, Homo sapiens
aaaauguuauuaugucaa

SEQ ID NO: 885004 - RNA, 16 nt, Homo sapiens
aaaauguuuucuucau

SEQ ID NO: 885005 - RNA, 22 nt, Homo sapiens
aaaauuaaaugcauguccucaa

SEQ ID NO: 885006 - RNA, 23 nt, Homo sapiens
aaaauuaaaugcauguccucaaa

SEQ ID NO: 885007 - RNA, 19 nt, Homo sapiens
aaaauucauuucacauuaa

SEQ ID NO: 885008 - RNA, 18 nt, Homo sapiens
aaaauuugaaauuuagcu

SEQ ID NO: 885009 - RNA, 14 nt, Homo sapiens
aaacaaaucuucaa

SEQ ID NO: 885010 - RNA, 21 nt, Homo sapiens
aaacaacuuguguucuauuaa

SEQ ID NO: 885011 - RNA, 23 nt, Homo sapiens
aaacaagaauuuucuuugcucug

SEQ ID NO: 885012 - RNA, 18 nt, Homo sapiens
aaacaaggggcuguuaca

SEQ ID NO: 885013 - RNA, 15 nt, Homo sapiens
aaacaaucacacuca

SEQ ID NO: 885014 - RNA, 12 nt, Homo sapiens
aaacaaugccau

SEQ ID NO: 885015 - RNA, 15 nt, Homo sapiens
aaacacaaaccacaa

SEQ ID NO: 885016 - RNA, 16 nt, Homo sapiens
aaacacagccugugua

SEQ ID NO: 885017 - RNA, 13 nt, Homo sapiens
aaacacagugcug

SEQ ID NO: 885018 - RNA, 13 nt, Homo sapiens
aaacaccauucau

SEQ ID NO: 885019 - RNA, 20 nt, Homo sapiens
aaacacccuuuccaaagcaa

SEQ ID NO: 885020 - RNA, 21 nt, Homo sapiens
aaacaccggcagaaaacggag

SEQ ID NO: 885021 - RNA, 14 nt, Homo sapiens
aaacacgugucuau

SEQ ID NO: 885022 - RNA, 22 nt, Homo sapiens
aaacacuguuucuaacucaggg

SEQ ID NO: 885023 - RNA, 14 nt, Homo sapiens
aaacagcucugugu

SEQ ID NO: 885024 - RNA, 16 nt, Homo sapiens
aaacaggaccacaaaa

SEQ ID NO: 885025 - RNA, 14 nt, Homo sapiens
aaacauacccagug

SEQ ID NO: 885026 - RNA, 22 nt, Homo sapiens
aaacauacccuuuaucucugua

SEQ ID NO: 885027 - RNA, 19 nt, Homo sapiens
aaacaugaccuuccacaau

SEQ ID NO: 885028 - RNA, 17 nt, Homo sapiens
aaacaugcuaaauaguu

SEQ ID NO: 885029 - RNA, 23 nt, Homo sapiens
aaacaugugguuaaugccaugga

SEQ ID NO: 885030 - RNA, 15 nt, Homo sapiens
aaacauguucacuua

SEQ ID NO: 885031 - RNA, 19 nt, Homo sapiens
aaacauuaaaugucuuaua

SEQ ID NO: 885032 - RNA, 19 nt, Homo sapiens
aaacauuaaucaccaaagu

SEQ ID NO: 885033 - RNA, 14 nt, Homo sapiens
aaagugacauuugu

SEQ ID NO: 885034 - RNA, 14 nt, Homo sapiens
aaagugacuaccag

SEQ ID NO: 885035 - RNA, 19 nt, Homo sapiens
aaagugcuaguauuauggg

SEQ ID NO: 885036 - RNA, 11 nt, Homo sapiens
aaagugcugua

SEQ ID NO: 885037 - RNA, 14 nt, Homo sapiens
aaaguggccaugcc

SEQ ID NO: 885038 - RNA, 18 nt, Homo sapiens
aaaguuguuugugccuuu

SEQ ID NO: 885039 - RNA, 13 nt, Homo sapiens
aaauaaaccugga

SEQ ID NO: 885040 - RNA, 22 nt, Homo sapiens
aaauaaaguauauauagaaucu

SEQ ID NO: 885041 - RNA, 21 nt, Homo sapiens
aaauaaggauaauaaucauuc

SEQ ID NO: 885042 - RNA, 14 nt, Homo sapiens
aaauaaggcuccuu

SEQ ID NO: 885043 - RNA, 13 nt, Homo sapiens
aaauaaugaacug

SEQ ID NO: 885044 - RNA, 16 nt, Homo sapiens
aaauacaaauuggaca

SEQ ID NO: 885045 - RNA, 19 nt, Homo sapiens
aaauacacacucaaaucaa

SEQ ID NO: 885046 - RNA, 16 nt, Homo sapiens
aaauacacuuccugcu

SEQ ID NO: 885047 - RNA, 16 nt, Homo sapiens
aaauaccaaguauuua

SEQ ID NO: 885048 - RNA, 17 nt, Homo sapiens
aaauaccagugaaccaa

SEQ ID NO: 885049 - RNA, 20 nt, Homo sapiens
aaauaccagugaaccaaaga

SEQ ID NO: 885050 - RNA, 17 nt, Homo sapiens
aaauacccacuaacaaa

SEQ ID NO: 885051 - RNA, 20 nt, Homo sapiens
aaauaccuauaugaauauga

SEQ ID NO: 885052 - RNA, 11 nt, Homo sapiens
aaauacuacac

SEQ ID NO: 885053 - RNA, 16 nt, Homo sapiens
aaauacuacacaucca

SEQ ID NO: 885054 - RNA, 13 nt, Homo sapiens
aaauaguuuuaaa

SEQ ID NO: 885055 - RNA, 15 nt, Homo sapiens
aaauauaaacuugug

SEQ ID NO: 885056 - RNA, 18 nt, Homo sapiens
aaauauaaucuaauacac

SEQ ID NO: 885057 - RNA, 23 nt, Homo sapiens
aaauaucuaccugcccucucuca

SEQ ID NO: 885058 - RNA, 18 nt, Homo sapiens
aaauaugcaccaaaucau

SEQ ID NO: 885059 - RNA, 16 nt, Homo sapiens
aaauauuauugguguu

SEQ ID NO: 885060 - RNA, 12 nt, Homo sapiens
aaauauucccug

SEQ ID NO: 885061 - RNA, 11 nt, Homo sapiens
aaauauucucu

SEQ ID NO: 885062 - RNA, 16 nt, Homo sapiens
aaauauugauuucuac

SEQ ID NO: 885063 - RNA, 14 nt, Homo sapiens
aaauauugucauaa

SEQ ID NO: 885064 - RNA, 15 nt, Homo sapiens
aaauauuuaugagaa

SEQ ID NO: 885065 - RNA, 17 nt, Homo sapiens
aaauauuuaugcuuaaa

SEQ ID NO: 885066 - RNA, 18 nt, Homo sapiens
aaauauuuuagccuuaaa

SEQ ID NO: 885067 - RNA, 20 nt, Homo sapiens
aaauauuuuuaugugcaaua

SEQ ID NO: 885068 - RNA, 19 nt, Homo sapiens
aaaucaaauaugcaaagca

SEQ ID NO: 885069 - RNA, 19 nt, Homo sapiens
aaaucagcacauuccuccu

SEQ ID NO: 885070 - RNA, 15 nt, Homo sapiens
aaaucaguuauguca

SEQ ID NO: 885071 - RNA, 20 nt, Homo sapiens
aaaucaucucucaucacuuu

SEQ ID NO: 885072 - RNA, 16 nt, Homo sapiens
aaauccacaagccauu

SEQ ID NO: 885073 - RNA, 20 nt, Homo sapiens
aaauccacagccaacaaaca

SEQ ID NO: 885074 - RNA, 20 nt, Homo sapiens
aaaucccuauuuaauuuucc

SEQ ID NO: 885075 - RNA, 23 nt, Homo sapiens
aaauccucagguaguacugggaa

SEQ ID NO: 885076 - RNA, 16 nt, Homo sapiens
aaauccuguuacuuaa

SEQ ID NO: 885077 - RNA, 15 nt, Homo sapiens
aaauccuuccaugaa

SEQ ID NO: 885078 - RNA, 12 nt, Homo sapiens
aaauccuugaua

SEQ ID NO: 885079 - RNA, 23 nt, Homo sapiens
aaaucggaucuggggcucuggga

SEQ ID NO: 885080 - RNA, 21 nt, Homo sapiens
aaaucgugacaacacuugugu

SEQ ID NO: 885081 - RNA, 13 nt, Homo sapiens
aaaucuagaucaa

SEQ ID NO: 885082 - RNA, 15 nt, Homo sapiens
aaaucuccagugugc

SEQ ID NO: 885083 - RNA, 13 nt, Homo sapiens
aaaucucuaauau

SEQ ID NO: 885084 - RNA, 16 nt, Homo sapiens
aaaucugguuagauaa

SEQ ID NO: 885085 - RNA, 21 nt, Homo sapiens
aaaugaagguuaggauuuaac

SEQ ID NO: 885086 - RNA, 14 nt, Homo sapiens
aaaugaaucuuacu

SEQ ID NO: 885087 - RNA, 12 nt, Homo sapiens
aaaugaccucag

SEQ ID NO: 885088 - RNA, 16 nt, Homo sapiens
aaaugaugccacuucc

SEQ ID NO: 885089 - RNA, 18 nt, Homo sapiens
aaaugcauccauuccuca

SEQ ID NO: 885090 - RNA, 13 nt, Homo sapiens
aaaugcauguccu

SEQ ID NO: 885091 - RNA, 15 nt, Homo sapiens
aaaugccacaaagaa

SEQ ID NO: 885092 - RNA, 23 nt, Homo sapiens
aaauggagaaauaggaccuucca

SEQ ID NO: 885093 - RNA, 19 nt, Homo sapiens
aaauggcuguagguggugu

SEQ ID NO: 885094 - RNA, 16 nt, Homo sapiens
aaaugggcagugccuc

SEQ ID NO: 885095 - RNA, 16 nt, Homo sapiens
aaauggguuggugcuu

SEQ ID NO: 885096 - RNA, 13 nt, Homo sapiens
aaauggugggaac

SEQ ID NO: 885097 - RNA, 13 nt, Homo sapiens
aaauguaacuuga

SEQ ID NO: 885098 - RNA, 16 nt, Homo sapiens
aaauguacauuaauua

SEQ ID NO: 885099 - RNA, 13 nt, Homo sapiens
aaauguauauaca

SEQ ID NO: 885100 - RNA, 21 nt, Homo sapiens
aaaugucucuuuaaugucaca

SEQ ID NO: 885101 - RNA, 19 nt, Homo sapiens
aaaugucuuaaucaugaga

SEQ ID NO: 885102 - RNA, 21 nt, Homo sapiens
aaaugugucuugucuccauuu

SEQ ID NO: 885103 - RNA, 22 nt, Homo sapiens
aaauguuauuuuuuaauuauua

SEQ ID NO: 885104 - RNA, 19 nt, Homo sapiens
aaauguucagaagguugcu

SEQ ID NO: 885105 - RNA, 12 nt, Homo sapiens
aaauguuucuca

SEQ ID NO: 885106 - RNA, 15 nt, Homo sapiens
aaauuaaacccugcc

SEQ ID NO: 885107 - RNA, 23 nt, Homo sapiens
aaauuaaagcccauaaggccaga

SEQ ID NO: 885108 - RNA, 14 nt, Homo sapiens
aaauuaaaguauac

SEQ ID NO: 885109 - RNA, 22 nt, Homo sapiens
caacucuucauuuugagucuca

SEQ ID NO: 885110 - RNA, 20 nt, Homo sapiens
caacugaaaagacucagugu

SEQ ID NO: 885111 - RNA, 20 nt, Homo sapiens
caacuggcuucugugcacua

SEQ ID NO: 885112 - RNA, 16 nt, Homo sapiens
caacuguggucaaucc

SEQ ID NO: 885113 - RNA, 20 nt, Homo sapiens
caacuuauaaagcauugcaa

SEQ ID NO: 885114 - RNA, 17 nt, Homo sapiens
caacuuauuauaugacu

SEQ ID NO: 885115 - RNA, 14 nt, Homo sapiens
caacuugcuucuaa

SEQ ID NO: 885116 - RNA, 13 nt, Homo sapiens
caacuuucuguaa

SEQ ID NO: 885117 - RNA, 12 nt, Homo sapiens
caacuuugacaa

SEQ ID NO: 885118 - RNA, 18 nt, Homo sapiens
caacuuuuccuuugaauc

SEQ ID NO: 885119 - RNA, 23 nt, Homo sapiens
caacuuuucucauguugaagcca

SEQ ID NO: 885120 - RNA, 21 nt, Homo sapiens
caagaaagauccacccucaaa

SEQ ID NO: 885121 - RNA, 19 nt, Homo sapiens
caagaaauaaaaaucaacu

SEQ ID NO: 885122 - RNA, 23 nt, Homo sapiens
caagaacauuaucuuaguggaag

SEQ ID NO: 885123 - RNA, 21 nt, Homo sapiens
caagaaccugcuaaggcugcc

SEQ ID NO: 885124 - RNA, 19 nt, Homo sapiens
caagaagaccagacugugg

SEQ ID NO: 885125 - RNA, 13 nt, Homo sapiens
caagaagggcuag

SEQ ID NO: 885126 - RNA, 14 nt, Homo sapiens
caagaaguacauga

SEQ ID NO: 885127 - RNA, 17 nt, Homo sapiens
caagaagucaaaguaaa

SEQ ID NO: 885128 - RNA, 23 nt, Homo sapiens
caagaauagaugcugacuguacu

SEQ ID NO: 885129 - RNA, 19 nt, Homo sapiens
caagaauauuguauguuaa

SEQ ID NO: 885130 - RNA, 16 nt, Homo sapiens
caagaaucaccucaaa

SEQ ID NO: 885131 - RNA, 13 nt, Homo sapiens
caagaaugaaaca

SEQ ID NO: 885132 - RNA, 21 nt, Homo sapiens
caagacagauuaccaaagaag

SEQ ID NO: 885133 - RNA, 17 nt, Homo sapiens
caagacuugauacugca

SEQ ID NO: 885134 - RNA, 19 nt, Homo sapiens
caagacuugauacugcaau

SEQ ID NO: 885135 - RNA, 20 nt, Homo sapiens
caagagcaucaugccucuga

SEQ ID NO: 885136 - RNA, 17 nt, Homo sapiens
caagagcuggcaaaggu

SEQ ID NO: 885137 - RNA, 20 nt, Homo sapiens
caagagugagacuccgucuc

SEQ ID NO: 885138 - RNA, 20 nt, Homo sapiens
caagagugagugaacaacua

SEQ ID NO: 885139 - RNA, 23 nt, Homo sapiens
caagauaaaggaagucaccaaaa

SEQ ID NO: 885140 - RNA, 20 nt, Homo sapiens
caagaucgcgccacugcacu

SEQ ID NO: 885141 - RNA, 16 nt, Homo sapiens
caagaucuuucaggaa

SEQ ID NO: 885142 - RNA, 12 nt, Homo sapiens
caagaugacagc

SEQ ID NO: 885143 - RNA, 16 nt, Homo sapiens
caagauuuucuacuuu

SEQ ID NO: 885144 - RNA, 22 nt, Homo sapiens
caagcaagaggugguagaacca

SEQ ID NO: 885145 - RNA, 19 nt, Homo sapiens
caagcaagggcugugcuga

SEQ ID NO: 885146 - RNA, 17 nt, Homo sapiens
caagcaauuauugugcc

SEQ ID NO: 885147 - RNA, 18 nt, Homo sapiens
caagcagccgcagcgcag

SEQ ID NO: 885148 - RNA, 18 nt, Homo sapiens
caagccacagaagccagg

SEQ ID NO: 885149 - RNA, 15 nt, Homo sapiens
caagccacuaccuuc

SEQ ID NO: 885150 - RNA, 14 nt, Homo sapiens
caagccauggugac

SEQ ID NO: 885151 - RNA, 15 nt, Homo sapiens
caagccauggugaca

SEQ ID NO: 885152 - RNA, 17 nt, Homo sapiens
caagccauucacuuccc

SEQ ID NO: 885153 - RNA, 16 nt, Homo sapiens
caagccccacuuauuc

SEQ ID NO: 885154 - RNA, 22 nt, Homo sapiens
caagccuguauagacagcacuu

SEQ ID NO: 885155 - RNA, 23 nt, Homo sapiens
caagcgaaaaaaaaaaaugcacu

SEQ ID NO: 885156 - RNA, 13 nt, Homo sapiens
caagcgcagggag

SEQ ID NO: 885157 - RNA, 19 nt, Homo sapiens
caagcuccuggucuugaga

SEQ ID NO: 885158 - RNA, 11 nt, Homo sapiens
caagcucugcu

SEQ ID NO: 885159 - RNA, 16 nt, Homo sapiens
caagcugcuuuggaca

SEQ ID NO: 885160 - RNA, 15 nt, Homo sapiens
caaggaaaauggaca

SEQ ID NO: 885161 - RNA, 20 nt, Homo sapiens
caaggaaagccccagcacua

SEQ ID NO: 885162 - RNA, 15 nt, Homo sapiens
caaggcaacugugag

SEQ ID NO: 885163 - RNA, 19 nt, Homo sapiens
caaggcuuuauauuuuuaa

SEQ ID NO: 885164 - RNA, 19 nt, Homo sapiens
caagggagaagaaauccau

SEQ ID NO: 885165 - RNA, 22 nt, Homo sapiens
caagguguggccugcacugggu

SEQ ID NO: 885166 - RNA, 14 nt, Homo sapiens
caagguguuuccau

SEQ ID NO: 885167 - RNA, 19 nt, Homo sapiens
caagguuuuggagucagua

SEQ ID NO: 885168 - RNA, 21 nt, Homo sapiens
caaguaguagugucuuccuag

SEQ ID NO: 885169 - RNA, 14 nt, Homo sapiens
caaguauugcgaau

SEQ ID NO: 885170 - RNA, 17 nt, Homo sapiens
caagucaacacucuucu

SEQ ID NO: 885171 - RNA, 17 nt, Homo sapiens
caagucaugauggaugg

SEQ ID NO: 885172 - RNA, 12 nt, Homo sapiens
caaguccaagca

SEQ ID NO: 885173 - RNA, 15 nt, Homo sapiens
gaaccucacugaaaa

SEQ ID NO: 885174 - RNA, 16 nt, Homo sapiens
gaaccugaaggugcug

SEQ ID NO: 885175 - RNA, 22 nt, Homo sapiens
gaaccugcuaaggcugccucag

SEQ ID NO: 885176 - RNA, 21 nt, Homo sapiens
gaacgagcacuggccagagag

SEQ ID NO: 885177 - RNA, 22 nt, Homo sapiens
gaacgcacuuuauaaaagcaaa

SEQ ID NO: 885178 - RNA, 13 nt, Homo sapiens
gaacggggagaaa

SEQ ID NO: 885179 - RNA, 17 nt, Homo sapiens
gaacuacauuaguacac

SEQ ID NO: 885180 - RNA, 18 nt, Homo sapiens
gaacuauuuauuucaccc

SEQ ID NO: 885181 - RNA, 15 nt, Homo sapiens
gaacucaaugugcaa

SEQ ID NO: 885182 - RNA, 21 nt, Homo sapiens
gaacucaucccuguuccucaa

SEQ ID NO: 885183 - RNA, 23 nt, Homo sapiens
gaacucgaagcccuuccaguggu

SEQ ID NO: 885184 - RNA, 11 nt, Homo sapiens
gaacucuccau

SEQ ID NO: 885185 - RNA, 15 nt, Homo sapiens
gaacugcauaucgga

SEQ ID NO: 885186 - RNA, 15 nt, Homo sapiens
gaacuggacugugug

SEQ ID NO: 885187 - RNA, 16 nt, Homo sapiens
gaacuggguacuugug

SEQ ID NO: 885188 - RNA, 22 nt, Homo sapiens
gaacugguucaagagacacugc

SEQ ID NO: 885189 - RNA, 22 nt, Homo sapiens
gaacugucagcccacagcagca

SEQ ID NO: 885190 - RNA, 14 nt, Homo sapiens
gaacuuauuuacac

SEQ ID NO: 885191 - RNA, 10 nt, Homo sapiens
gaacuuccuu

SEQ ID NO: 885192 - RNA, 15 nt, Homo sapiens
gaagaaaacaugacu

SEQ ID NO: 885193 - RNA, 15 nt, Homo sapiens
gaagaaauucuguca

SEQ ID NO: 885194 - RNA, 17 nt, Homo sapiens
gaagaacaaaucugggc

SEQ ID NO: 885195 - RNA, 12 nt, Homo sapiens
gaagaacugacu

SEQ ID NO: 885196 - RNA, 12 nt, Homo sapiens
gaagaagcuaaa

SEQ ID NO: 885197 - RNA, 16 nt, Homo sapiens
gaagaaggaaacaccg

SEQ ID NO: 885198 - RNA, 22 nt, Homo sapiens
gaagacaacagcauaacuaaau

SEQ ID NO: 885199 - RNA, 20 nt, Homo sapiens
gaagaccaaagcauugccug

SEQ ID NO: 885200 - RNA, 21 nt, Homo sapiens
gaagaccaagacacagaucac

SEQ ID NO: 885201 - RNA, 16 nt, Homo sapiens
gaagacccacgugcua

SEQ ID NO: 885202 - RNA, 17 nt, Homo sapiens
gaagacccacgugcuag

SEQ ID NO: 885203 - RNA, 21 nt, Homo sapiens
gaagaccuucugaagaucuca

SEQ ID NO: 885204 - RNA, 17 nt, Homo sapiens
gaagacuauauuguaca

SEQ ID NO: 885205 - RNA, 19 nt, Homo sapiens
gaagacuauauuguacaca

SEQ ID NO: 885206 - RNA, 18 nt, Homo sapiens
gaagacuugaagcacaga

SEQ ID NO: 885207 - RNA, 15 nt, Homo sapiens
gaagagacucucuua

SEQ ID NO: 885208 - RNA, 18 nt, Homo sapiens
gaagagcagcuggucaac

SEQ ID NO: 885209 - RNA, 17 nt, Homo sapiens
gaagagccugacugugu

SEQ ID NO: 885210 - RNA, 21 nt, Homo sapiens
gaagaggugagaguaagccuu

SEQ ID NO: 885211 - RNA, 20 nt, Homo sapiens
gaagaguuucuccuuuugac

SEQ ID NO: 885212 - RNA, 15 nt, Homo sapiens
gaagauguaaggaau

SEQ ID NO: 885213 - RNA, 24 nt, Homo sapiens
gaagauuuuaugcugcuguuuaca

SEQ ID NO: 885214 - RNA, 19 nt, Homo sapiens
gaagcacagagggcuaggg

SEQ ID NO: 885215 - RNA, 17 nt, Homo sapiens
gaagcacagcagcaucu

SEQ ID NO: 885216 - RNA, 12 nt, Homo sapiens
gaagcacagcuu

SEQ ID NO: 885217 - RNA, 17 nt, Homo sapiens
gaagcauuuacuuugug

SEQ ID NO: 885218 - RNA, 18 nt, Homo sapiens
gaagcauuugauuuucaa

SEQ ID NO: 885219 - RNA, 14 nt, Homo sapiens
gaagccacugccuu

SEQ ID NO: 885220 - RNA, 13 nt, Homo sapiens
gaagccauauuca

SEQ ID NO: 885221 - RNA, 23 nt, Homo sapiens
gaagcccuugccugaaagcaaga

SEQ ID NO: 885222 - RNA, 19 nt, Homo sapiens
gaagccggccggcugggau

SEQ ID NO: 885223 - RNA, 15 nt, Homo sapiens
cacauguaacauaga

SEQ ID NO: 885224 - RNA, 19 nt, Homo sapiens
cacauguaucuaugcauuu

SEQ ID NO: 885225 - RNA, 16 nt, Homo sapiens
cacaugucuuguacau

SEQ ID NO: 885226 - RNA, 19 nt, Homo sapiens
cacaugucuuguacaugug

SEQ ID NO: 885227 - RNA, 20 nt, Homo sapiens
cacaugucuuguacaugugu

SEQ ID NO: 885228 - RNA, 22 nt, Homo sapiens
cacaugucuuguacauguguag

SEQ ID NO: 885229 - RNA, 17 nt, Homo sapiens
cacaugugcacaugcac

SEQ ID NO: 885230 - RNA, 20 nt, Homo sapiens
cacauguuauccacaagcaa

SEQ ID NO: 885231 - RNA, 16 nt, Homo sapiens
cacauuaauuagauuu

SEQ ID NO: 885232 - RNA, 13 nt, Homo sapiens
cacauuccuccua

SEQ ID NO: 885233 - RNA, 23 nt, Homo sapiens
cacauucuuaaaggaaaagucaa

SEQ ID NO: 885234 - RNA, 20 nt, Homo sapiens
cacauuggaaggcucccuaa

SEQ ID NO: 885235 - RNA, 17 nt, Homo sapiens
cacauuggcaguguguc

SEQ ID NO: 885236 - RNA, 20 nt, Homo sapiens
cacauuuugcauuagacaga

SEQ ID NO: 885237 - RNA, 15 nt, Homo sapiens
caccaaaguauuaau

SEQ ID NO: 885238 - RNA, 15 nt, Homo sapiens
caccaaaucaucucu

SEQ ID NO: 885239 - RNA, 22 nt, Homo sapiens
caccaaaucaucucucaucacu

SEQ ID NO: 885240 - RNA, 14 nt, Homo sapiens
caccaagcccaguu

SEQ ID NO: 885241 - RNA, 21 nt, Homo sapiens
caccaaguucuggaaaccacg

SEQ ID NO: 885242 - RNA, 19 nt, Homo sapiens
caccaauuguacauucccu

SEQ ID NO: 885243 - RNA, 14 nt, Homo sapiens
caccacaugugcac

SEQ ID NO: 885244 - RNA, 16 nt, Homo sapiens
caccaccuucccagcu

SEQ ID NO: 885245 - RNA, 14 nt, Homo sapiens
caccagaauguaua

SEQ ID NO: 885246 - RNA, 22 nt, Homo sapiens
caccaguguccccuccacuguc

SEQ ID NO: 885247 - RNA, 19 nt, Homo sapiens
caccauccuuuacuauuaa

SEQ ID NO: 885248 - RNA, 16 nt, Homo sapiens
caccaugcgcugcuca

SEQ ID NO: 885249 - RNA, 18 nt, Homo sapiens
caccauguaacaaccaga

SEQ ID NO: 885250 - RNA, 20 nt, Homo sapiens
caccauguaacaaccagaga

SEQ ID NO: 885251 - RNA, 20 nt, Homo sapiens
caccauuguuccuuaccuuu

SEQ ID NO: 885252 - RNA, 22 nt, Homo sapiens
caccauuguuccuuaccuuuac

SEQ ID NO: 885253 - RNA, 21 nt, Homo sapiens
cacccaagagggcugcuuccc

SEQ ID NO: 885254 - RNA, 15 nt, Homo sapiens
cacccaggcugcacu

SEQ ID NO: 885255 - RNA, 16 nt, Homo sapiens
cacccagugcugccau

SEQ ID NO: 885256 - RNA, 18 nt, Homo sapiens
cacccaugaaucaaagac

SEQ ID NO: 885257 - RNA, 19 nt, Homo sapiens
cacccaugccauagaaacu

SEQ ID NO: 885258 - RNA, 16 nt, Homo sapiens
cacccaugcccagcug

SEQ ID NO: 885259 - RNA, 19 nt, Homo sapiens
cacccggcucccccugcuu

SEQ ID NO: 885260 - RNA, 16 nt, Homo sapiens
cacccucaaaugucag

SEQ ID NO: 885261 - RNA, 17 nt, Homo sapiens
cacccucaaaugucaga

SEQ ID NO: 885262 - RNA, 18 nt, Homo sapiens
cacccuccaccucuucac

SEQ ID NO: 885263 - RNA, 20 nt, Homo sapiens
cacccugaggagucugaggu

SEQ ID NO: 885264 - RNA, 20 nt, Homo sapiens
cacccuguagguucuugaua

SEQ ID NO: 885265 - RNA, 16 nt, Homo sapiens
cacccuucucauucca

SEQ ID NO: 885266 - RNA, 21 nt, Homo sapiens
caccgauguacacacacagau

SEQ ID NO: 885267 - RNA, 22 nt, Homo sapiens
caccgauugcaggacacaagca

SEQ ID NO: 885268 - RNA, 13 nt, Homo sapiens
caccgcgugccau

SEQ ID NO: 885269 - RNA, 21 nt, Homo sapiens
caccguggaccuuccugccac

SEQ ID NO: 885270 - RNA, 11 nt, Homo sapiens
caccuaccugc

SEQ ID NO: 885271 - RNA, 17 nt, Homo sapiens
caccuacuuacaugcau

SEQ ID NO: 885272 - RNA, 18 nt, Homo sapiens
caccuacuuacaugcauu

SEQ ID NO: 885273 - RNA, 12 nt, Homo sapiens
caccuagccucg

SEQ ID NO: 885274 - RNA, 17 nt, Homo sapiens
caccuaucacccaggcu

SEQ ID NO: 885275 - RNA, 13 nt, Homo sapiens
caccucaccagaa

SEQ ID NO: 885276 - RNA, 21 nt, Homo sapiens
caccucaugagucuaccugag

SEQ ID NO: 885277 - RNA, 14 nt, Homo sapiens
caccucuccagagg

SEQ ID NO: 885278 - RNA, 18 nt, Homo sapiens
caccucugccucaaugug

SEQ ID NO: 885279 - RNA, 13 nt, Homo sapiens
caccucuggaucc

SEQ ID NO: 885280 - RNA, 16 nt, Homo sapiens
caccucuggaucccug

SEQ ID NO: 885281 - RNA, 20 nt, Homo sapiens
caccucuugggcaugcucag

SEQ ID NO: 885282 - RNA, 16 nt, Homo sapiens
caccucuuuuugaaca

SEQ ID NO: 885283 - RNA, 20 nt, Homo sapiens
caccugccagccaucacaag

SEQ ID NO: 885284 - RNA, 16 nt, Homo sapiens
caccugccauuugcac

SEQ ID NO: 885285 - RNA, 23 nt, Homo sapiens
caccugcucuucuaccauuugaa

SEQ ID NO: 885286 - RNA, 22 nt, Homo sapiens
caccugcuggaaaccacacuuc

SEQ ID NO: 885287 - RNA, 18 nt, Homo sapiens
caccuguuaaaauguaca

SEQ ID NO: 885288 - RNA, 15 nt, Homo sapiens
gacguaaucuccaca

SEQ ID NO: 885289 - RNA, 17 nt, Homo sapiens
gacgucucaagacugaa

SEQ ID NO: 885290 - RNA, 20 nt, Homo sapiens
gacgugaccaugguguuguu

SEQ ID NO: 885291 - RNA, 17 nt, Homo sapiens
gacguguccuacagccu

SEQ ID NO: 885292 - RNA, 15 nt, Homo sapiens
gacgugucucaggag

SEQ ID NO: 885293 - RNA, 19 nt, Homo sapiens
gacuacuauacaaacuaca

SEQ ID NO: 885294 - RNA, 14 nt, Homo sapiens
gacuagaaccugga

SEQ ID NO: 885295 - RNA, 21 nt, Homo sapiens
gacuagaauagugcauuguau

SEQ ID NO: 885296 - RNA, 18 nt, Homo sapiens
gacuagagcuuucuuuca

SEQ ID NO: 885297 - RNA, 20 nt, Homo sapiens
gacuagugcuuuaccuuuau

SEQ ID NO: 885298 - RNA, 21 nt, Homo sapiens
gacuauauacauguguguaua

SEQ ID NO: 885299 - RNA, 17 nt, Homo sapiens
gacuauggcuaccaaaa

SEQ ID NO: 885300 - RNA, 22 nt, Homo sapiens
gacuauguuccaauaaaacuuu

SEQ ID NO: 885301 - RNA, 17 nt, Homo sapiens
gacuauuucacuaauaa

SEQ ID NO: 885302 - RNA, 20 nt, Homo sapiens
gacucaaagagggagugcau

SEQ ID NO: 885303 - RNA, 15 nt, Homo sapiens
gacucaauaaaauca

SEQ ID NO: 885304 - RNA, 17 nt, Homo sapiens
gacucaauaaaaucaug

SEQ ID NO: 885305 - RNA, 17 nt, Homo sapiens
gacucacaagaagacca

SEQ ID NO: 885306 - RNA, 13 nt, Homo sapiens
gacucacuguggg

SEQ ID NO: 885307 - RNA, 16 nt, Homo sapiens
gacucagggaccuaag

SEQ ID NO: 885308 - RNA, 19 nt, Homo sapiens
gacucagggccccagcacu

SEQ ID NO: 885309 - RNA, 21 nt, Homo sapiens
gacucagggccccagcacuaa

SEQ ID NO: 885310 - RNA, 13 nt, Homo sapiens
gacucaugaacua

SEQ ID NO: 885311 - RNA, 20 nt, Homo sapiens
gacuccugucuguccuggag

SEQ ID NO: 885312 - RNA, 13 nt, Homo sapiens
gacuccugugcaa

SEQ ID NO: 885313 - RNA, 22 nt, Homo sapiens
gacuccuuagagacaucaaaau

SEQ ID NO: 885314 - RNA, 17 nt, Homo sapiens
gacucuaaauauuucau

SEQ ID NO: 885315 - RNA, 17 nt, Homo sapiens
gacucuacagaggccau

SEQ ID NO: 885316 - RNA, 23 nt, Homo sapiens
gacucugaaaaacauuccaggaa

SEQ ID NO: 885317 - RNA, 15 nt, Homo sapiens
gacucugacuuugag

SEQ ID NO: 885318 - RNA, 10 nt, Homo sapiens
gacucugcac

SEQ ID NO: 885319 - RNA, 14 nt, Homo sapiens
gacucugcacaugu

SEQ ID NO: 885320 - RNA, 15 nt, Homo sapiens
gacucugcacauguc

SEQ ID NO: 885321 - RNA, 18 nt, Homo sapiens
gacugaaggggcacacca

SEQ ID NO: 885322 - RNA, 19 nt, Homo sapiens
gacugaaggggcacaccac

SEQ ID NO: 885323 - RNA, 13 nt, Homo sapiens
gacugacauuuag

SEQ ID NO: 885324 - RNA, 14 nt, Homo sapiens
gacugaggaccaca

SEQ ID NO: 885325 - RNA, 18 nt, Homo sapiens
gacugaugggacaucaaa

SEQ ID NO: 885326 - RNA, 17 nt, Homo sapiens
gacugauguuacaucac

SEQ ID NO: 885327 - RNA, 11 nt, Homo sapiens
gacugauuacc

SEQ ID NO: 885328 - RNA, 21 nt, Homo sapiens
gacugcaacaggaacuuggag

SEQ ID NO: 885329 - RNA, 15 nt, Homo sapiens
gacugcaucucaaaa

SEQ ID NO: 885330 - RNA, 17 nt, Homo sapiens
gacugccaugcuagaca

SEQ ID NO: 885331 - RNA, 19 nt, Homo sapiens
gacuggccucaaagcaagc

SEQ ID NO: 885332 - RNA, 11 nt, Homo sapiens
gacuguguuca

SEQ ID NO: 885333 - RNA, 13 nt, Homo sapiens
gacuguugcucaa

SEQ ID NO: 885334 - RNA, 13 nt, Homo sapiens
gacuucacacugc

SEQ ID NO: 885335 - RNA, 13 nt, Homo sapiens
gacuucaucccaa

SEQ ID NO: 885336 - RNA, 23 nt, Homo sapiens
gacuucuccuccaguggaccuga

SEQ ID NO: 885337 - RNA, 17 nt, Homo sapiens
gacuucucuuugccuca

SEQ ID NO: 885338 - RNA, 16 nt, Homo sapiens
ggagucucauucuguu

SEQ ID NO: 885339 - RNA, 15 nt, Homo sapiens
ggaguguucuguggg

SEQ ID NO: 885340 - RNA, 20 nt, Homo sapiens
ggauaaugcuguugccucau

SEQ ID NO: 885341 - RNA, 20 nt, Homo sapiens
ggauacaauguauaagcuac

SEQ ID NO: 885342 - RNA, 20 nt, Homo sapiens
ggauagcuauuuucuuacag

SEQ ID NO: 885343 - RNA, 20 nt, Homo sapiens
ggauagucagcuguaccaag

SEQ ID NO: 885344 - RNA, 14 nt, Homo sapiens
ggauagucugucca

SEQ ID NO: 885345 - RNA, 13 nt, Homo sapiens
ggauauuuacuac

SEQ ID NO: 885346 - RNA, 15 nt, Homo sapiens
ggauauuuucuucca

SEQ ID NO: 885347 - RNA, 20 nt, Homo sapiens
ggauccccagccuacugccu

SEQ ID NO: 885348 - RNA, 19 nt, Homo sapiens
ggaucuccaaggaccaggu

SEQ ID NO: 885349 - RNA, 21 nt, Homo sapiens
ggaucuguaaggaacuggaac

SEQ ID NO: 885350 - RNA, 12 nt, Homo sapiens
ggaugaauggaa

SEQ ID NO: 885351 - RNA, 14 nt, Homo sapiens
ggaugacugugauu

SEQ ID NO: 885352 - RNA, 16 nt, Homo sapiens
ggaugcacacacagau

SEQ ID NO: 885353 - RNA, 14 nt, Homo sapiens
ggaugcacagagau

SEQ ID NO: 885354 - RNA, 20 nt, Homo sapiens
ggaugcacagagauaugcac

SEQ ID NO: 885355 - RNA, 23 nt, Homo sapiens
ggauggacgaacaggggccaaac

SEQ ID NO: 885356 - RNA, 11 nt, Homo sapiens
ggauggcacuc

SEQ ID NO: 885357 - RNA, 19 nt, Homo sapiens
ggauguaguuuaguuacua

SEQ ID NO: 885358 - RNA, 20 nt, Homo sapiens
ggaugugcccacagggacca

SEQ ID NO: 885359 - RNA, 16 nt, Homo sapiens
ggauguguggggcaug

SEQ ID NO: 885360 - RNA, 20 nt, Homo sapiens
ggauuaaugguccugugaug

SEQ ID NO: 885361 - RNA, 14 nt, Homo sapiens
ggauucaggaaaag

SEQ ID NO: 885362 - RNA, 15 nt, Homo sapiens
ggauuccagcauuug

SEQ ID NO: 885363 - RNA, 22 nt, Homo sapiens
ggauuccuaagcagugcuugua

SEQ ID NO: 885364 - RNA, 17 nt, Homo sapiens
ggauugcuaugaaugau

SEQ ID NO: 885365 - RNA, 19 nt, Homo sapiens
ggauuggcuauaacauguc

SEQ ID NO: 885366 - RNA, 23 nt, Homo sapiens
ggauuugaagcaaagcaccagcu

SEQ ID NO: 885367 - RNA, 16 nt, Homo sapiens
ggcaaaaaaauuaaau

SEQ ID NO: 885368 - RNA, 18 nt, Homo sapiens
ggcaaaaacuuccaucac

SEQ ID NO: 885369 - RNA, 15 nt, Homo sapiens
ggcaaaugacaugca

SEQ ID NO: 885370 - RNA, 21 nt, Homo sapiens
ggcaacaacagcaaaacucca

SEQ ID NO: 885371 - RNA, 16 nt, Homo sapiens
ggcaacccucacugug

SEQ ID NO: 885372 - RNA, 18 nt, Homo sapiens
ggcaacccucacuguguu

SEQ ID NO: 885373 - RNA, 17 nt, Homo sapiens
ggcaacgacgguuucaa

SEQ ID NO: 885374 - RNA, 15 nt, Homo sapiens
ggcaagcacuaccag

SEQ ID NO: 885375 - RNA, 16 nt, Homo sapiens
ggcaaugaaaccaaag

SEQ ID NO: 885376 - RNA, 13 nt, Homo sapiens
ggcaaugcaaaag

SEQ ID NO: 885377 - RNA, 22 nt, Homo sapiens
ggcaauugcggggcccaccuua

SEQ ID NO: 885378 - RNA, 21 nt, Homo sapiens
ggcacacaucaggaguucaau

SEQ ID NO: 885379 - RNA, 18 nt, Homo sapiens
ggcacaggacugauucug

SEQ ID NO: 885380 - RNA, 17 nt, Homo sapiens
ggcacagucauucacau

SEQ ID NO: 885381 - RNA, 16 nt, Homo sapiens
ggcacauggcuggcac

SEQ ID NO: 885382 - RNA, 20 nt, Homo sapiens
ggcacauuggcaguguguca

SEQ ID NO: 885383 - RNA, 18 nt, Homo sapiens
ggcaccagaaugcuaaag

SEQ ID NO: 885384 - RNA, 15 nt, Homo sapiens
ggcaccgcgugccau

SEQ ID NO: 885385 - RNA, 20 nt, Homo sapiens
ggcacucagaagacacugau

SEQ ID NO: 885386 - RNA, 22 nt, Homo sapiens
ggcacugcaggggccgagccau

SEQ ID NO: 885387 - RNA, 12 nt, Homo sapiens
ggcacugccuga

SEQ ID NO: 885388 - RNA, 18 nt, Homo sapiens
ggcagaaaacacagccug

SEQ ID NO: 885389 - RNA, 15 nt, Homo sapiens
ggcagagccaugggc

SEQ ID NO: 885390 - RNA, 21 nt, Homo sapiens
ggcagaugaaauuuauuucca

SEQ ID NO: 885391 - RNA, 21 nt, Homo sapiens
ggcaggaguagcugagcucac

SEQ ID NO: 885392 - RNA, 17 nt, Homo sapiens
ggcaggcagaucacaag

SEQ ID NO: 885393 - RNA, 19 nt, Homo sapiens
ggcagucucugcccaaaca

SEQ ID NO: 885394 - RNA, 20 nt, Homo sapiens
ggcagucugaacccuugugc

SEQ ID NO: 885395 - RNA, 13 nt, Homo sapiens
ggcagugcugauu

SEQ ID NO: 885396 - RNA, 17 nt, Homo sapiens
ggcaguuuaaagcacaa

SEQ ID NO: 885397 - RNA, 11 nt, Homo sapiens
ggcauaugcaa

SEQ ID NO: 885398 - RNA, 22 nt, Homo sapiens
ggcauccacccagugcugccau

SEQ ID NO: 885399 - RNA, 19 nt, Homo sapiens
ggcaugaaggugucauaca

SEQ ID NO: 885400 - RNA, 14 nt, Homo sapiens
ggcaugacacucua

SEQ ID NO: 885401 - RNA, 18 nt, Homo sapiens
ggcauggccagguggcca

SEQ ID NO: 885402 - RNA, 23 nt, Homo sapiens
ggcauguuuugcccaccagauca

SEQ ID NO: 885403 - RNA, 16 nt, Homo sapiens
ggcauuaaagugcugu

SEQ ID NO: 885404 - RNA, 12 nt, Homo sapiens
ggcauugcaaag

SEQ ID NO: 885405 - RNA, 15 nt, Homo sapiens
ggcauuuccugggug

SEQ ID NO: 885406 - RNA, 20 nt, Homo sapiens
cccaggguaggggagggugg

SEQ ID NO: 885407 - RNA, 18 nt, Homo sapiens
cccaggugcaggugcuga

SEQ ID NO: 885408 - RNA, 15 nt, Homo sapiens
cccagguguggcugu

SEQ ID NO: 885409 - RNA, 19 nt, Homo sapiens
cccagguucagacugagcu

SEQ ID NO: 885410 - RNA, 19 nt, Homo sapiens
cccaguaacucaucuguca

SEQ ID NO: 885411 - RNA, 22 nt, Homo sapiens
cccagucgcucgacugcgacgc

SEQ ID NO: 885412 - RNA, 19 nt, Homo sapiens
cccagucuggaaugcagug

SEQ ID NO: 885413 - RNA, 13 nt, Homo sapiens
cccagugaccuga

SEQ ID NO: 885414 - RNA, 14 nt, Homo sapiens
cccagugaccugac

SEQ ID NO: 885415 - RNA, 21 nt, Homo sapiens
cccaguguaaagaauaaauga

SEQ ID NO: 885416 - RNA, 17 nt, Homo sapiens
cccaguuugcuggguuu

SEQ ID NO: 885417 - RNA, 19 nt, Homo sapiens
cccauagugcacacuugua

SEQ ID NO: 885418 - RNA, 13 nt, Homo sapiens
cccaucuuuccuc

SEQ ID NO: 885419 - RNA, 21 nt, Homo sapiens
cccaugaaucaaagacaugga

SEQ ID NO: 885420 - RNA, 22 nt, Homo sapiens
cccaugaguagugcccacuuga

SEQ ID NO: 885421 - RNA, 14 nt, Homo sapiens
cccaugcccagcug

SEQ ID NO: 885422 - RNA, 23 nt, Homo sapiens
cccauguauuuaucucuauuuaa

SEQ ID NO: 885423 - RNA, 22 nt, Homo sapiens
cccauugucaccuaacucugaa

SEQ ID NO: 885424 - RNA, 14 nt, Homo sapiens
cccauuuugcaaaa

SEQ ID NO: 885425 - RNA, 12 nt, Homo sapiens
ccccaaguucug

SEQ ID NO: 885426 - RNA, 14 nt, Homo sapiens
ccccacacgugcuc

SEQ ID NO: 885427 - RNA, 11 nt, Homo sapiens
ccccaccuacu

SEQ ID NO: 885428 - RNA, 21 nt, Homo sapiens
ccccaccugggacccuugaga

SEQ ID NO: 885429 - RNA, 23 nt, Homo sapiens
ccccacgagggucaggacuguga

SEQ ID NO: 885430 - RNA, 13 nt, Homo sapiens
ccccacuccagcc

SEQ ID NO: 885431 - RNA, 18 nt, Homo sapiens
ccccagaacacagugccu

SEQ ID NO: 885432 - RNA, 24 nt, Homo sapiens
ccccagaaccagcugcagauggag

SEQ ID NO: 885433 - RNA, 24 nt, Homo sapiens
ccccagagccacuaccuuugucca

SEQ ID NO: 885434 - RNA, 20 nt, Homo sapiens
ccccagauggccgggacaug

SEQ ID NO: 885435 - RNA, 22 nt, Homo sapiens
ccccagcucuggcuuccagaaa

SEQ ID NO: 885436 - RNA, 10 nt, Homo sapiens
ccccagcugu

SEQ ID NO: 885437 - RNA, 23 nt, Homo sapiens
ccccagugcagggaaccgugaua

SEQ ID NO: 885438 - RNA, 20 nt, Homo sapiens
ccccauaucuuuaaagugug

SEQ ID NO: 885439 - RNA, 18 nt, Homo sapiens
ccccaugaccuccagcuu

SEQ ID NO: 885440 - RNA, 21 nt, Homo sapiens
cccccauaucuuuaaagugug

SEQ ID NO: 885441 - RNA, 16 nt, Homo sapiens
cccccaucucuacaaa

SEQ ID NO: 885442 - RNA, 19 nt, Homo sapiens
cccccuaagaggcagugag

SEQ ID NO: 885443 - RNA, 21 nt, Homo sapiens
cccccucuaacccccagugcc

SEQ ID NO: 885444 - RNA, 16 nt, Homo sapiens
ccccggccucagcacc

SEQ ID NO: 885445 - RNA, 22 nt, Homo sapiens
ccccgugaaugcuuaccuguga

SEQ ID NO: 885446 - RNA, 16 nt, Homo sapiens
ccccucaaaauccaag

SEQ ID NO: 885447 - RNA, 20 nt, Homo sapiens
ccccucauuguuuauuaaca

SEQ ID NO: 885448 - RNA, 15 nt, Homo sapiens
ccccuccacugucac

SEQ ID NO: 885449 - RNA, 19 nt, Homo sapiens
ccccuggaacugucucuca

SEQ ID NO: 885450 - RNA, 17 nt, Homo sapiens
ccccuggacugggaggu

SEQ ID NO: 885451 - RNA, 15 nt, Homo sapiens
ccccuggccuuugag

SEQ ID NO: 885452 - RNA, 16 nt, Homo sapiens
ggugaccaauacuacu

SEQ ID NO: 885453 - RNA, 17 nt, Homo sapiens
ggugaccccagggcaca

SEQ ID NO: 885454 - RNA, 19 nt, Homo sapiens
ggugaucaauuaaauguag

SEQ ID NO: 885455 - RNA, 14 nt, Homo sapiens
ggugcaaaucaaug

SEQ ID NO: 885456 - RNA, 21 nt, Homo sapiens
ggugcaguuuuccaggaauag

SEQ ID NO: 885457 - RNA, 17 nt, Homo sapiens
ggugcaugaagguuucu

SEQ ID NO: 885458 - RNA, 19 nt, Homo sapiens
ggugcaugaagguuucuga

SEQ ID NO: 885459 - RNA, 14 nt, Homo sapiens
ggugggacagggac

SEQ ID NO: 885460 - RNA, 16 nt, Homo sapiens
ggugggugacagucau

SEQ ID NO: 885461 - RNA, 13 nt, Homo sapiens
ggugucacugggc

SEQ ID NO: 885462 - RNA, 20 nt, Homo sapiens
ggugucaggcagguuugcca

SEQ ID NO: 885463 - RNA, 22 nt, Homo sapiens
ggugugcaaacuuguaucugaa

SEQ ID NO: 885464 - RNA, 13 nt, Homo sapiens
gguuaacuuguau

SEQ ID NO: 885465 - RNA, 12 nt, Homo sapiens
gguuaucaacca

SEQ ID NO: 885466 - RNA, 22 nt, Homo sapiens
gguuccuuuuucaacuuggaaa

SEQ ID NO: 885467 - RNA, 11 nt, Homo sapiens
gguugcaguga

SEQ ID NO: 885468 - RNA, 15 nt, Homo sapiens
gguugucaguuacau

SEQ ID NO: 885469 - RNA, 16 nt, Homo sapiens
gguuucggagcacgua

SEQ ID NO: 885470 - RNA, 17 nt, Homo sapiens
gguuuggggucugccac

SEQ ID NO: 885471 - RNA, 18 nt, Homo sapiens
gguuuguugcagccaaag

SEQ ID NO: 885472 - RNA, 16 nt, Homo sapiens
gguuuuaacaauuucc

SEQ ID NO: 885473 - RNA, 16 nt, Homo sapiens
guaaaaccacagcagu

SEQ ID NO: 885474 - RNA, 15 nt, Homo sapiens
guaaaacuauauucu

SEQ ID NO: 885475 - RNA, 17 nt, Homo sapiens
guaaaacuauauucuca

SEQ ID NO: 885476 - RNA, 16 nt, Homo sapiens
guaaaagugugagcag

SEQ ID NO: 885477 - RNA, 13 nt, Homo sapiens
guaaaauaaucca

SEQ ID NO: 885478 - RNA, 13 nt, Homo sapiens
guaaaaugaaauu

SEQ ID NO: 885479 - RNA, 14 nt, Homo sapiens
guaaacauucucuc

SEQ ID NO: 885480 - RNA, 15 nt, Homo sapiens
guaaagaaguuugau

SEQ ID NO: 885481 - RNA, 11 nt, Homo sapiens
guaaaugcucg

SEQ ID NO: 885482 - RNA, 15 nt, Homo sapiens
guaaauucaaccacu

SEQ ID NO: 885483 - RNA, 13 nt, Homo sapiens
guaacaacugugg

SEQ ID NO: 885484 - RNA, 19 nt, Homo sapiens
guaacaacuguggucaauc

SEQ ID NO: 885485 - RNA, 14 nt, Homo sapiens
guaacauagacaaa

SEQ ID NO: 885486 - RNA, 16 nt, Homo sapiens
guaacauuaauucuac

SEQ ID NO: 885487 - RNA, 17 nt, Homo sapiens
guaaccaagaguauucc

SEQ ID NO: 885488 - RNA, 18 nt, Homo sapiens
guaaccaagaguauucca

SEQ ID NO: 885489 - RNA, 19 nt, Homo sapiens
guaacgaaugguacuacaa

SEQ ID NO: 885490 - RNA, 16 nt, Homo sapiens
guaacucaucugucac

SEQ ID NO: 885491 - RNA, 23 nt, Homo sapiens
guaacugcacacaugguuuccaa

SEQ ID NO: 885492 - RNA, 17 nt, Homo sapiens
guaacuucuuaaucuaa

SEQ ID NO: 885493 - RNA, 14 nt, Homo sapiens
guaagcauucugag

SEQ ID NO: 885494 - RNA, 19 nt, Homo sapiens
guaagcugcucuauuguag

SEQ ID NO: 885495 - RNA, 17 nt, Homo sapiens
guaagggaaacugccag

SEQ ID NO: 885496 - RNA, 15 nt, Homo sapiens
guaagguaugggaga

SEQ ID NO: 885497 - RNA, 16 nt, Homo sapiens
guaauaaacucucuag

SEQ ID NO: 885498 - RNA, 14 nt, Homo sapiens
guaauccuauuaaa

SEQ ID NO: 885499 - RNA, 14 nt, Homo sapiens
guaaugaaacaaag

SEQ ID NO: 885500 - RNA, 19 nt, Homo sapiens
guaauuaaguaaaccaaaa

SEQ ID NO: 885501 - RNA, 23 nt, Homo sapiens
guaauugcauuucugcucuucca

SEQ ID NO: 885502 - RNA, 12 nt, Homo sapiens
guacaagcauuu

SEQ ID NO: 885503 - RNA, 18 nt, Homo sapiens
guacaaguuuuguauaaa

SEQ ID NO: 885504 - RNA, 11 nt, Homo sapiens
guacaauaaua

SEQ ID NO: 885505 - RNA, 16 nt, Homo sapiens
guacaauguacauuau

SEQ ID NO: 885506 - RNA, 17 nt, Homo sapiens
guacagaauucugcuac

SEQ ID NO: 885507 - RNA, 22 nt, Homo sapiens
guacagaauucugcuaccucac

SEQ ID NO: 885508 - RNA, 17 nt, Homo sapiens
guacaguuauacauacc

SEQ ID NO: 885509 - RNA, 10 nt, Homo sapiens
guacauguau

SEQ ID NO: 885510 - RNA, 20 nt, Homo sapiens
guacauuccugauacugggu

SEQ ID NO: 885511 - RNA, 17 nt, Homo sapiens
guaccagaacuauuuau

SEQ ID NO: 885512 - RNA, 17 nt, Homo sapiens
guaccaguguacugcuu

SEQ ID NO: 885513 - RNA, 23 nt, Homo sapiens
guacccuuccuacagauagucaa

SEQ ID NO: 885514 - RNA, 18 nt, Homo sapiens
guaccuugaacacugggg

SEQ ID NO: 885515 - RNA, 15 nt, Homo sapiens
guaccuugcagccau

SEQ ID NO: 885516 - RNA, 16 nt, Homo sapiens
guacuagcaguguuuc

SEQ ID NO: 885517 - RNA, 20 nt, Homo sapiens
guacuauuauccccauuucu

SEQ ID NO: 885518 - RNA, 18 nt, Homo sapiens
guacucuccaaaggcccu

SEQ ID NO: 885519 - RNA, 19 nt, Homo sapiens
guacucuggagagacugug

SEQ ID NO: 885520 - RNA, 17 nt, Homo sapiens
guacucuuaacuccuag

SEQ ID NO: 885521 - RNA, 17 nt, Homo sapiens
guacugagacauuacag

SEQ ID NO: 885522 - RNA, 15 nt, Homo sapiens
ccucuauuuugccac

SEQ ID NO: 885523 - RNA, 17 nt, Homo sapiens
ccucucaucaguguccu

SEQ ID NO: 885524 - RNA, 13 nt, Homo sapiens
ccucuccccucau

SEQ ID NO: 885525 - RNA, 17 nt, Homo sapiens
ccucuccuuugugacuu

SEQ ID NO: 885526 - RNA, 12 nt, Homo sapiens
ccucucuccuuc

SEQ ID NO: 885527 - RNA, 12 nt, Homo sapiens
ccucucuugccu

SEQ ID NO: 885528 - RNA, 19 nt, Homo sapiens
ccucugauacccagagcau

SEQ ID NO: 885529 - RNA, 15 nt, Homo sapiens
ccucugcagcacuuu

SEQ ID NO: 885530 - RNA, 12 nt, Homo sapiens
ccucugccucaa

SEQ ID NO: 885531 - RNA, 23 nt, Homo sapiens
ccucuuaaaaaauaaaaacugac

SEQ ID NO: 885532 - RNA, 22 nt, Homo sapiens
ccucuuccagggccucugggag

SEQ ID NO: 885533 - RNA, 18 nt, Homo sapiens
ccucuuccccuugcccuu

SEQ ID NO: 885534 - RNA, 16 nt, Homo sapiens
ccucuucgcugaccuc

SEQ ID NO: 885535 - RNA, 17 nt, Homo sapiens
ccucuucgcugaccucg

SEQ ID NO: 885536 - RNA, 14 nt, Homo sapiens
ccucuucuaacuca

SEQ ID NO: 885537 - RNA, 13 nt, Homo sapiens
ccucuuuccccac

SEQ ID NO: 885538 - RNA, 18 nt, Homo sapiens
ccucuuuucccucucuag

SEQ ID NO: 885539 - RNA, 21 nt, Homo sapiens
ccugaaagucuguguccaauu

SEQ ID NO: 885540 - RNA, 12 nt, Homo sapiens
ccugaagugaug

SEQ ID NO: 885541 - RNA, 18 nt, Homo sapiens
ccugaaugguuccaugcc

SEQ ID NO: 885542 - RNA, 14 nt, Homo sapiens
ccugacagugccca

SEQ ID NO: 885543 - RNA, 19 nt, Homo sapiens
ccugacccacaggaacugg

SEQ ID NO: 885544 - RNA, 17 nt, Homo sapiens
ccugacccuacuucuuu

SEQ ID NO: 885545 - RNA, 20 nt, Homo sapiens
ccugacccuccuccacucca

SEQ ID NO: 885546 - RNA, 13 nt, Homo sapiens
ccugaccgugcua

SEQ ID NO: 885547 - RNA, 18 nt, Homo sapiens
ccugaccgugcuaacugu

SEQ ID NO: 885548 - RNA, 12 nt, Homo sapiens
ccugaccuguca

SEQ ID NO: 885549 - RNA, 19 nt, Homo sapiens
ccugaccugucaccgugag

SEQ ID NO: 885550 - RNA, 18 nt, Homo sapiens
ccugacgaacuccuugau

SEQ ID NO: 885551 - RNA, 18 nt, Homo sapiens
ccugacgacacugaagaa

SEQ ID NO: 885552 - RNA, 16 nt, Homo sapiens
ccugacgucaguaguu

SEQ ID NO: 885553 - RNA, 20 nt, Homo sapiens
ccugagcccaggagguggag

SEQ ID NO: 885554 - RNA, 21 nt, Homo sapiens
ccugaggcuccugugcuacuu

SEQ ID NO: 885555 - RNA, 15 nt, Homo sapiens
ccugaggguccccac

SEQ ID NO: 885556 - RNA, 16 nt, Homo sapiens
ccugauacuggguaca

SEQ ID NO: 885557 - RNA, 14 nt, Homo sapiens
ccugaucaugguca

SEQ ID NO: 885558 - RNA, 22 nt, Homo sapiens
ccugaucauggucagcucacac

SEQ ID NO: 885559 - RNA, 21 nt, Homo sapiens
ccugaugacagagcgagauuc

SEQ ID NO: 885560 - RNA, 23 nt, Homo sapiens
ccugauuagaugacucucagucc

SEQ ID NO: 885561 - RNA, 19 nt, Homo sapiens
ccugauuuagauaugcaaa

SEQ ID NO: 885562 - RNA, 19 nt, Homo sapiens
ccugcaauucuacaguuuc

SEQ ID NO: 885563 - RNA, 23 nt, Homo sapiens
ccugcaccgagagagauggaaua

SEQ ID NO: 885564 - RNA, 13 nt, Homo sapiens
ccugcacuacucu

SEQ ID NO: 885565 - RNA, 12 nt, Homo sapiens
ccugcacuccag

SEQ ID NO: 885566 - RNA, 18 nt, Homo sapiens
ccugcacuccagaaucca

SEQ ID NO: 885567 - RNA, 17 nt, Homo sapiens
ccugcagacucacugug

SEQ ID NO: 885568 - RNA, 23 nt, Homo sapiens
ccuuuauuaaugaacugugacag

SEQ ID NO: 885569 - RNA, 22 nt, Homo sapiens
ccuuucaaauuuuuacugagaa

SEQ ID NO: 885570 - RNA, 18 nt, Homo sapiens
ccuuuccagucauuucaa

SEQ ID NO: 885571 - RNA, 11 nt, Homo sapiens
ccuuuccauaa

SEQ ID NO: 885572 - RNA, 17 nt, Homo sapiens
ccuuucuaaaucugaga

SEQ ID NO: 885573 - RNA, 21 nt, Homo sapiens
ccuuucucagccacaaaauaa

SEQ ID NO: 885574 - RNA, 17 nt, Homo sapiens
ccuuucucuaaaacugc

SEQ ID NO: 885575 - RNA, 13 nt, Homo sapiens
ccuuuguguaaua

SEQ ID NO: 885576 - RNA, 18 nt, Homo sapiens
ccuuuuagguagaauuua

SEQ ID NO: 885577 - RNA, 20 nt, Homo sapiens
ccuuuugaccaaauaaagua

SEQ ID NO: 885578 - RNA, 15 nt, Homo sapiens
ccuuuuguguaauaa

SEQ ID NO: 885579 - RNA, 17 nt, Homo sapiens
cgaaauuggauuaugca

SEQ ID NO: 885580 - RNA, 19 nt, Homo sapiens
cgaaccaucucaauguaag

SEQ ID NO: 885581 - RNA, 12 nt, Homo sapiens
cgaagcccaguu

SEQ ID NO: 885582 - RNA, 16 nt, Homo sapiens
cgaaguggcucucagg

SEQ ID NO: 885583 - RNA, 21 nt, Homo sapiens
cgaauggggcgaucaagucca

SEQ ID NO: 885584 - RNA, 18 nt, Homo sapiens
cgaauguuagauuccucu

SEQ ID NO: 885585 - RNA, 22 nt, Homo sapiens
cgacaaagccaaacucugccag

SEQ ID NO: 885586 - RNA, 20 nt, Homo sapiens
cgacagaagucuugucucaa

SEQ ID NO: 885587 - RNA, 13 nt, Homo sapiens
cgaccagacaccu

SEQ ID NO: 885588 - RNA, 13 nt, Homo sapiens
cgaccccaucuca

SEQ ID NO: 885589 - RNA, 14 nt, Homo sapiens
cgaccccaucucau

SEQ ID NO: 885590 - RNA, 16 nt, Homo sapiens
cgaccccucagugcuc

SEQ ID NO: 885591 - RNA, 23 nt, Homo sapiens
cgacgguuucaaaccaggauuuu

SEQ ID NO: 885592 - RNA, 14 nt, Homo sapiens
cgacuucaucccaa

SEQ ID NO: 885593 - RNA, 17 nt, Homo sapiens
cgagacugagaggcaga

SEQ ID NO: 885594 - RNA, 22 nt, Homo sapiens
cgagagaggcgcgucugcccca

SEQ ID NO: 885595 - RNA, 19 nt, Homo sapiens
cgagaucacgccacugcac

SEQ ID NO: 885596 - RNA, 20 nt, Homo sapiens
cgagauugcaccacugcacu

SEQ ID NO: 885597 - RNA, 19 nt, Homo sapiens
cgagcccagcuacauuccu

SEQ ID NO: 885598 - RNA, 14 nt, Homo sapiens
cgaggacaagugag

SEQ ID NO: 885599 - RNA, 21 nt, Homo sapiens
cgaggagcuuccagugcaugu

SEQ ID NO: 885600 - RNA, 16 nt, Homo sapiens
cgagucaugcacucag

SEQ ID NO: 885601 - RNA, 16 nt, Homo sapiens
cgaguucagcaaagag

SEQ ID NO: 885602 - RNA, 16 nt, Homo sapiens
cgaguuccaccccauc

SEQ ID NO: 885603 - RNA, 17 nt, Homo sapiens
cgaguuguggaaagccu

SEQ ID NO: 885604 - RNA, 20 nt, Homo sapiens
cgaugaauguguugauuuga

SEQ ID NO: 885605 - RNA, 15 nt, Homo sapiens
cgaugcacacgcaca

SEQ ID NO: 885606 - RNA, 15 nt, Homo sapiens
cgauguacacacaca

SEQ ID NO: 885607 - RNA, 15 nt, Homo sapiens
cgauucaaacugcuc

SEQ ID NO: 885608 - RNA, 13 nt, Homo sapiens
cgcaaaaccugca

SEQ ID NO: 885609 - RNA, 20 nt, Homo sapiens
cgcaaagggcugaaagccau

SEQ ID NO: 885610 - RNA, 16 nt, Homo sapiens
cgcaaaucaaccccag

SEQ ID NO: 885611 - RNA, 13 nt, Homo sapiens
cgcaacaguuuuu

SEQ ID NO: 885612 - RNA, 21 nt, Homo sapiens
cgcaagggagaagaaauccau

SEQ ID NO: 885613 - RNA, 17 nt, Homo sapiens
cgcacaaggcugaccaa

SEQ ID NO: 885614 - RNA, 13 nt, Homo sapiens
cgcacacacagau

SEQ ID NO: 885615 - RNA, 19 nt, Homo sapiens
cgcacauagagauaugcac

SEQ ID NO: 885616 - RNA, 22 nt, Homo sapiens
cgcacccccacugcugcugcag

SEQ ID NO: 885617 - RNA, 16 nt, Homo sapiens
cgcaccuugucaugua

SEQ ID NO: 885618 - RNA, 12 nt, Homo sapiens
cgcagauguuac

SEQ ID NO: 885619 - RNA, 12 nt, Homo sapiens
cgcaguggcuca

SEQ ID NO: 885620 - RNA, 14 nt, Homo sapiens
cgcaucauaugcag

SEQ ID NO: 885621 - RNA, 15 nt, Homo sapiens
cgccaaacacuccac

SEQ ID NO: 885622 - RNA, 13 nt, Homo sapiens
cgccagggccaag

SEQ ID NO: 885623 - RNA, 23 nt, Homo sapiens
cgccaucagggcaguggccaaga

SEQ ID NO: 885624 - RNA, 17 nt, Homo sapiens
cgccauuccaagucaac

SEQ ID NO: 885625 - RNA, 21 nt, Homo sapiens
cgccccucauuuaucccucaa

SEQ ID NO: 885626 - RNA, 15 nt, Homo sapiens
cgccuaugaucccag

SEQ ID NO: 885627 - RNA, 21 nt, Homo sapiens
cgccuaugaucccagcacuuu

SEQ ID NO: 885628 - RNA, 21 nt, Homo sapiens
cgccuguaaucccagcacuuu

SEQ ID NO: 885629 - RNA, 13 nt, Homo sapiens
cgcgagacugaga

SEQ ID NO: 885630 - RNA, 18 nt, Homo sapiens
cgcuauagaauaaugcau

SEQ ID NO: 885631 - RNA, 19 nt, Homo sapiens
cgcuccacguuucaggcag

SEQ ID NO: 885632 - RNA, 14 nt, Homo sapiens
cgcucucucaggcg

SEQ ID NO: 885633 - RNA, 13 nt, Homo sapiens
cgcucucuuccag

SEQ ID NO: 885634 - RNA, 13 nt, Homo sapiens
cgcugccuggggc

SEQ ID NO: 885635 - RNA, 14 nt, Homo sapiens
cgcugccuugccau

SEQ ID NO: 885636 - RNA, 16 nt, Homo sapiens
cgcuggaccuugaacu

SEQ ID NO: 885637 - RNA, 20 nt, Homo sapiens
cggaaugaaccacaucuugc

SEQ ID NO: 885638 - RNA, 16 nt, Homo sapiens
gucugaucguucaaag

SEQ ID NO: 885639 - RNA, 16 nt, Homo sapiens
gucugcuagccaggau

SEQ ID NO: 885640 - RNA, 20 nt, Homo sapiens
gucugcuuaguaucucauca

SEQ ID NO: 885641 - RNA, 17 nt, Homo sapiens
gucuggaaaagcacuuu

SEQ ID NO: 885642 - RNA, 15 nt, Homo sapiens
gucuggcuaugcuca

SEQ ID NO: 885643 - RNA, 22 nt, Homo sapiens
gucugggcaaugaaaccaaagc

SEQ ID NO: 885644 - RNA, 14 nt, Homo sapiens
gucugggugucuca

SEQ ID NO: 885645 - RNA, 19 nt, Homo sapiens
gucuguauauacauuucau

SEQ ID NO: 885646 - RNA, 20 nt, Homo sapiens
gucuuaagccuuuugcucac

SEQ ID NO: 885647 - RNA, 22 nt, Homo sapiens
gucuuaauauauauauccagau

SEQ ID NO: 885648 - RNA, 18 nt, Homo sapiens
gucuucauuucauuguau

SEQ ID NO: 885649 - RNA, 16 nt, Homo sapiens
gucuuccagguacuga

SEQ ID NO: 885650 - RNA, 12 nt, Homo sapiens
gucuuccauaau

SEQ ID NO: 885651 - RNA, 18 nt, Homo sapiens
gucuucugccagcccauu

SEQ ID NO: 885652 - RNA, 16 nt, Homo sapiens
gucuucuuaaucugaa

SEQ ID NO: 885653 - RNA, 12 nt, Homo sapiens
gucuugaacucc

SEQ ID NO: 885654 - RNA, 15 nt, Homo sapiens
gucuugccagccaga

SEQ ID NO: 885655 - RNA, 15 nt, Homo sapiens
gucuugucucaagaa

SEQ ID NO: 885656 - RNA, 16 nt, Homo sapiens
gucuuuaucagugaug

SEQ ID NO: 885657 - RNA, 17 nt, Homo sapiens
gucuuuuccacuccuau

SEQ ID NO: 885658 - RNA, 21 nt, Homo sapiens
gugaaacccugucucuacuaa

SEQ ID NO: 885659 - RNA, 17 nt, Homo sapiens
gugaaaccucaucucua

SEQ ID NO: 885660 - RNA, 21 nt, Homo sapiens
gugaaaccucaucucuacuaa

SEQ ID NO: 885661 - RNA, 19 nt, Homo sapiens
gugaaagaugcaagcaccu

SEQ ID NO: 885662 - RNA, 18 nt, Homo sapiens
gugaacccaggacaagca

SEQ ID NO: 885663 - RNA, 18 nt, Homo sapiens
gugaauaaaaacccugua

SEQ ID NO: 885664 - RNA, 14 nt, Homo sapiens
gugaauugacccau

SEQ ID NO: 885665 - RNA, 13 nt, Homo sapiens
gugacaacaugcg

SEQ ID NO: 885666 - RNA, 21 nt, Homo sapiens
gugacccuucccaaucagcac

SEQ ID NO: 885667 - RNA, 12 nt, Homo sapiens
gugacucucuug

SEQ ID NO: 885668 - RNA, 20 nt, Homo sapiens
gugacuuuuuagccagugac

SEQ ID NO: 885669 - RNA, 13 nt, Homo sapiens
gugagaaguucau

SEQ ID NO: 885670 - RNA, 20 nt, Homo sapiens
gugagaaucaaaacucuccu

SEQ ID NO: 885671 - RNA, 15 nt, Homo sapiens
gugagagaaucugcc

SEQ ID NO: 885672 - RNA, 13 nt, Homo sapiens
gugagauguaauu

SEQ ID NO: 885673 - RNA, 14 nt, Homo sapiens
gugagccacagacc

SEQ ID NO: 885674 - RNA, 18 nt, Homo sapiens
gugagccgugucguauga

SEQ ID NO: 885675 - RNA, 13 nt, Homo sapiens
gugagcugucacu

SEQ ID NO: 885676 - RNA, 18 nt, Homo sapiens
gugaguacccaggaugau

SEQ ID NO: 885677 - RNA, 19 nt, Homo sapiens
gugaucaacuguucagggu

SEQ ID NO: 885678 - RNA, 15 nt, Homo sapiens
gugauuucagagagg

SEQ ID NO: 885679 - RNA, 21 nt, Homo sapiens
gugcaacgcuuuuugggagaa

SEQ ID NO: 885680 - RNA, 16 nt, Homo sapiens
gugcaagagacagagc

SEQ ID NO: 885681 - RNA, 13 nt, Homo sapiens
gugcaauauguga

SEQ ID NO: 885682 - RNA, 19 nt, Homo sapiens
gugcaccccuccccauuca

SEQ ID NO: 885683 - RNA, 16 nt, Homo sapiens
ucaaccgcuugccaua

SEQ ID NO: 885684 - RNA, 17 nt, Homo sapiens
ucaaccgcuugccauau

SEQ ID NO: 885685 - RNA, 21 nt, Homo sapiens
ucaaccuccugggcuaaguga

SEQ ID NO: 885686 - RNA, 21 nt, Homo sapiens
ucaaccugguggcaccagaug

SEQ ID NO: 885687 - RNA, 22 nt, Homo sapiens
ucaaccugguggcaccagaugc

SEQ ID NO: 885688 - RNA, 14 nt, Homo sapiens
ucaacuacucagcu

SEQ ID NO: 885689 - RNA, 13 nt, Homo sapiens
ucaacuaugauau

SEQ ID NO: 885690 - RNA, 22 nt, Homo sapiens
ucaacugaaaagacucaguguu

SEQ ID NO: 885691 - RNA, 21 nt, Homo sapiens
ucaacuuaccaggcaccaaaa

SEQ ID NO: 885692 - RNA, 18 nt, Homo sapiens
ucaacuuuuccuuugaau

SEQ ID NO: 885693 - RNA, 16 nt, Homo sapiens
ucaagaacucugggcu

SEQ ID NO: 885694 - RNA, 21 nt, Homo sapiens
ucaagacuugauacugcaaua

SEQ ID NO: 885695 - RNA, 14 nt, Homo sapiens
ucaagagacacugc

SEQ ID NO: 885696 - RNA, 22 nt, Homo sapiens
ucaagauacauuucaucugcug

SEQ ID NO: 885697 - RNA, 19 nt, Homo sapiens
ucaagaugaugaugaucuu

SEQ ID NO: 885698 - RNA, 22 nt, Homo sapiens
ucaagcaauccuccugccucag

SEQ ID NO: 885699 - RNA, 18 nt, Homo sapiens
ucaagcacccuguucccu

SEQ ID NO: 885700 - RNA, 21 nt, Homo sapiens
ucaagcgauucuucugccuca

SEQ ID NO: 885701 - RNA, 20 nt, Homo sapiens
ucaaguaccaaaauguuaau

SEQ ID NO: 885702 - RNA, 20 nt, Homo sapiens
ucaagucuagaaaccaguau

SEQ ID NO: 885703 - RNA, 23 nt, Homo sapiens
ucaagugccucuuguugcagaga

SEQ ID NO: 885704 - RNA, 21 nt, Homo sapiens
ucaauaccccuguuaagcaau

SEQ ID NO: 885705 - RNA, 22 nt, Homo sapiens
ucaauaccccuguuaagcaauu

SEQ ID NO: 885706 - RNA, 14 nt, Homo sapiens
ucaauauuccugaa

SEQ ID NO: 885707 - RNA, 16 nt, Homo sapiens
ucaaucagugcaguga

SEQ ID NO: 885708 - RNA, 18 nt, Homo sapiens
ucaaucagugcagugaua

SEQ ID NO: 885709 - RNA, 16 nt, Homo sapiens
ucaauccgaaguauga

SEQ ID NO: 885710 - RNA, 20 nt, Homo sapiens
ucaauccugcccccagccau

SEQ ID NO: 885711 - RNA, 22 nt, Homo sapiens
ucaauccugcccccagccaugg

SEQ ID NO: 885712 - RNA, 21 nt, Homo sapiens
ucaaugauuauuuucauuaca

SEQ ID NO: 885713 - RNA, 18 nt, Homo sapiens
ucaaugcaucaauuuacc

SEQ ID NO: 885714 - RNA, 20 nt, Homo sapiens
ucaaugugcaaguuguacug

SEQ ID NO: 885715 - RNA, 18 nt, Homo sapiens
ucaauuaaaggcuuucag

SEQ ID NO: 885716 - RNA, 14 nt, Homo sapiens
ucaauuaguacagu

SEQ ID NO: 885717 - RNA, 16 nt, Homo sapiens
ucaauucagugcugua

SEQ ID NO: 885718 - RNA, 20 nt, Homo sapiens
ucaauuccaccugcaaucaa

SEQ ID NO: 885719 - RNA, 18 nt, Homo sapiens
ucaauuuguaauugcuua

SEQ ID NO: 885720 - RNA, 14 nt, Homo sapiens
ucacaacagaucaa

SEQ ID NO: 885721 - RNA, 14 nt, Homo sapiens
ucacaaccagccac

SEQ ID NO: 885722 - RNA, 18 nt, Homo sapiens
ucacaacuaggaccucau

SEQ ID NO: 885723 - RNA, 15 nt, Homo sapiens
ucacaagaagaccag

SEQ ID NO: 885724 - RNA, 18 nt, Homo sapiens
ucacaagaagaccagacu

SEQ ID NO: 885725 - RNA, 18 nt, Homo sapiens
ucacaaggcaacugugag

SEQ ID NO: 885726 - RNA, 21 nt, Homo sapiens
ucacaagggauuggcaauugu

SEQ ID NO: 885727 - RNA, 18 nt, Homo sapiens
ucacaauacucaaaagag

SEQ ID NO: 885728 - RNA, 21 nt, Homo sapiens
ucacaauuccauuuccaguuc

SEQ ID NO: 885729 - RNA, 17 nt, Homo sapiens
ucacacaccccucaaaa

SEQ ID NO: 885730 - RNA, 18 nt, Homo sapiens
ucacacauccgcuucaua

SEQ ID NO: 885731 - RNA, 21 nt, Homo sapiens
ucacacuauggcagccaucca

SEQ ID NO: 885732 - RNA, 12 nt, Homo sapiens
ucacacuguaaa

SEQ ID NO: 885733 - RNA, 17 nt, Homo sapiens
ucacacuguaaacauuc

SEQ ID NO: 885734 - RNA, 19 nt, Homo sapiens
ucacagaacuauguacuuu

SEQ ID NO: 885735 - RNA, 20 nt, Homo sapiens
ucacagcagugcauaggcca

SEQ ID NO: 885736 - RNA, 16 nt, Homo sapiens
ucacagcucuguagaa

SEQ ID NO: 885737 - RNA, 15 nt, Homo sapiens
ucacauccaaugcau

SEQ ID NO: 885738 - RNA, 14 nt, Homo sapiens
ucacaucuguccag

SEQ ID NO: 885739 - RNA, 15 nt, Homo sapiens
ucacaugauaccccu

SEQ ID NO: 885740 - RNA, 21 nt, Homo sapiens
ucacaugcuagcaacauacca

SEQ ID NO: 885741 - RNA, 18 nt, Homo sapiens
ucacauggccuaugcaca

SEQ ID NO: 885742 - RNA, 23 nt, Homo sapiens
ucacauggccuaugcacauaugg

SEQ ID NO: 885743 - RNA, 16 nt, Homo sapiens
ucacauuaucaucuga

SEQ ID NO: 885744 - RNA, 17 nt, Homo sapiens
ucacauuaucaucugaa

SEQ ID NO: 885745 - RNA, 14 nt, Homo sapiens
ucacauucaggaag

SEQ ID NO: 885746 - RNA, 12 nt, Homo sapiens
ucaccaagccca

SEQ ID NO: 885747 - RNA, 15 nt, Homo sapiens
ucaccaagcccaguu

SEQ ID NO: 885748 - RNA, 16 nt, Homo sapiens
ucaccaauaacuucag

SEQ ID NO: 885749 - RNA, 16 nt, Homo sapiens
ucaccacuccauuccc

SEQ ID NO: 885750 - RNA, 18 nt, Homo sapiens
ucaccagcuaucugucau

SEQ ID NO: 885751 - RNA, 12 nt, Homo sapiens
ucaccagugucc

SEQ ID NO: 885752 - RNA, 14 nt, Homo sapiens
ucaccauacuucau

SEQ ID NO: 885753 - RNA, 17 nt, Homo sapiens
ucaccauguaacaacca

SEQ ID NO: 885754 - RNA, 14 nt, Homo sapiens
ucacccacaucuaa

SEQ ID NO: 885755 - RNA, 20 nt, Homo sapiens
ucacccggaucccuccucac

SEQ ID NO: 885756 - RNA, 13 nt, Homo sapiens
cuuugaauguggc

SEQ ID NO: 885757 - RNA, 15 nt, Homo sapiens
cuuugacaaauugaa

SEQ ID NO: 885758 - RNA, 13 nt, Homo sapiens
cuuugaguaccaa

SEQ ID NO: 885759 - RNA, 18 nt, Homo sapiens
cuuugaugucauauggaa

SEQ ID NO: 885760 - RNA, 16 nt, Homo sapiens
cuuugauucaaagcac

SEQ ID NO: 885761 - RNA, 13 nt, Homo sapiens
cuuugcacugagg

SEQ ID NO: 885762 - RNA, 13 nt, Homo sapiens
cuuugcauuccau

SEQ ID NO: 885763 - RNA, 17 nt, Homo sapiens
cuuugccucugaaacuu

SEQ ID NO: 885764 - RNA, 17 nt, Homo sapiens
cuuuggacaacugacaa

SEQ ID NO: 885765 - RNA, 15 nt, Homo sapiens
cuuuggccauuccaa

SEQ ID NO: 885766 - RNA, 19 nt, Homo sapiens
cuuuggggacaguuggcag

SEQ ID NO: 885767 - RNA, 22 nt, Homo sapiens
cuuuggguuggagcuguuccau

SEQ ID NO: 885768 - RNA, 19 nt, Homo sapiens
cuuuguacuuugugcaaaa

SEQ ID NO: 885769 - RNA, 14 nt, Homo sapiens
cuuuguauccauga

SEQ ID NO: 885770 - RNA, 22 nt, Homo sapiens
cuuugucagucugggugucuca

SEQ ID NO: 885771 - RNA, 15 nt, Homo sapiens
cuuugucucugagaa

SEQ ID NO: 885772 - RNA, 22 nt, Homo sapiens
cuuugugcaaaagggucuggcu

SEQ ID NO: 885773 - RNA, 20 nt, Homo sapiens
cuuuguuuccauucuugucc

SEQ ID NO: 885774 - RNA, 16 nt, Homo sapiens
cuuuuaaaugcauaaa

SEQ ID NO: 885775 - RNA, 17 nt, Homo sapiens
cuuuuaaugaacaaaug

SEQ ID NO: 885776 - RNA, 14 nt, Homo sapiens
cuuuuacaccaguu

SEQ ID NO: 885777 - RNA, 17 nt, Homo sapiens
cuuuuacagcucuuggc

SEQ ID NO: 885778 - RNA, 20 nt, Homo sapiens
cuuuuagaccaaaauaugaa

SEQ ID NO: 885779 - RNA, 19 nt, Homo sapiens
cuuuuaucuuggacugaca

SEQ ID NO: 885780 - RNA, 14 nt, Homo sapiens
cuuuuaugccuuca

SEQ ID NO: 885781 - RNA, 18 nt, Homo sapiens
cuuuucaaaacugcuaaa

SEQ ID NO: 885782 - RNA, 16 nt, Homo sapiens
cuuuuccauguaucua

SEQ ID NO: 885783 - RNA, 16 nt, Homo sapiens
cuuuucuaacucuccc

SEQ ID NO: 885784 - RNA, 16 nt, Homo sapiens
cuuuucugugucauac

SEQ ID NO: 885785 - RNA, 13 nt, Homo sapiens
cuuuugaggggcu

SEQ ID NO: 885786 - RNA, 19 nt, Homo sapiens
cuuuuggugguauguuggu

SEQ ID NO: 885787 - RNA, 15 nt, Homo sapiens
cuuuugucuuccuca

SEQ ID NO: 885788 - RNA, 21 nt, Homo sapiens
cuuuuguggauugacaguagu

SEQ ID NO: 885789 - RNA, 18 nt, Homo sapiens
cuuuuuccagauucuucc

SEQ ID NO: 885790 - RNA, 16 nt, Homo sapiens
cuuuuucugagcuuuu

SEQ ID NO: 885791 - RNA, 19 nt, Homo sapiens
cuuuuugggagaaugaugu

SEQ ID NO: 885792 - RNA, 21 nt, Homo sapiens
cuuuuuuccuccuguguacag

SEQ ID NO: 885793 - RNA, 16 nt, Homo sapiens
cuuuuuucuaguuuca

SEQ ID NO: 885794 - RNA, 22 nt, Homo sapiens
cuuuuuuuugagaauacacuau

SEQ ID NO: 885795 - RNA, 19 nt, Homo sapiens
gaaaaaacuagagccugug

SEQ ID NO: 885796 - RNA, 22 nt, Homo sapiens
gaaaaaacuagagccugugcua

SEQ ID NO: 885797 - RNA, 17 nt, Homo sapiens
ucauuccaccuucccau

SEQ ID NO: 885798 - RNA, 15 nt, Homo sapiens
ucauucuuugaagga

SEQ ID NO: 885799 - RNA, 21 nt, Homo sapiens
ucauugaaguauuuuccucca

SEQ ID NO: 885800 - RNA, 14 nt, Homo sapiens
ucauugacuaucaa

SEQ ID NO: 885801 - RNA, 14 nt, Homo sapiens
ucauugauugaaua

SEQ ID NO: 885802 - RNA, 21 nt, Homo sapiens
ucauuguaaauuauuucauac

SEQ ID NO: 885803 - RNA, 14 nt, Homo sapiens
ucauuguguucucu

SEQ ID NO: 885804 - RNA, 17 nt, Homo sapiens
ucauuuaauuugaaauu

SEQ ID NO: 885805 - RNA, 15 nt, Homo sapiens
ucauuuaucccucaa

SEQ ID NO: 885806 - RNA, 17 nt, Homo sapiens
ucauuucagauaaacaa

SEQ ID NO: 885807 - RNA, 13 nt, Homo sapiens
ucauuucaucuca

SEQ ID NO: 885808 - RNA, 13 nt, Homo sapiens
ucauuugaacaac

SEQ ID NO: 885809 - RNA, 14 nt, Homo sapiens
ucauuugaugcuaa

SEQ ID NO: 885810 - RNA, 20 nt, Homo sapiens
ucauuuuaaaaaauggaaca

SEQ ID NO: 885811 - RNA, 17 nt, Homo sapiens
ucauuuuaacaucugag

SEQ ID NO: 885812 - RNA, 22 nt, Homo sapiens
ucauuuucaaugcacauuaguu

SEQ ID NO: 885813 - RNA, 15 nt, Homo sapiens
ucauuuucuauucac

SEQ ID NO: 885814 - RNA, 19 nt, Homo sapiens
ucauuuuguuauagaaacu

SEQ ID NO: 885815 - RNA, 20 nt, Homo sapiens
uccaaaaaggaacacuggaa

SEQ ID NO: 885816 - RNA, 19 nt, Homo sapiens
uccaaaaccuaaagaggaa

SEQ ID NO: 885817 - RNA, 21 nt, Homo sapiens
uccaaagaaauguaagggaaa

SEQ ID NO: 885818 - RNA, 19 nt, Homo sapiens
uccaaaggcauaagacccu

SEQ ID NO: 885819 - RNA, 18 nt, Homo sapiens
uccaaaucuuaauucaac

SEQ ID NO: 885820 - RNA, 16 nt, Homo sapiens
uccaaaugaaugaccu

SEQ ID NO: 885821 - RNA, 15 nt, Homo sapiens
uccaaauggacauaa

SEQ ID NO: 885822 - RNA, 19 nt, Homo sapiens
uccaacagcucaagucuuc

SEQ ID NO: 885823 - RNA, 13 nt, Homo sapiens
uccaacuuaacau

SEQ ID NO: 885824 - RNA, 16 nt, Homo sapiens
uccaacuucccaguuc

SEQ ID NO: 885825 - RNA, 16 nt, Homo sapiens
uccaagaaagauccac

SEQ ID NO: 885826 - RNA, 23 nt, Homo sapiens
uccaaggaggucgggauggggcu

SEQ ID NO: 885827 - RNA, 15 nt, Homo sapiens
uccaaggggcuuugu

SEQ ID NO: 885828 - RNA, 16 nt, Homo sapiens
uccaagucaacacucu

SEQ ID NO: 885829 - RNA, 12 nt, Homo sapiens
uccaagucuuca

SEQ ID NO: 885830 - RNA, 19 nt, Homo sapiens
uccaaguuuuaauuuuuaa

SEQ ID NO: 885831 - RNA, 21 nt, Homo sapiens
uccaauccucaggauuucauu

SEQ ID NO: 885832 - RNA, 19 nt, Homo sapiens
uccaauggaauacugaaaa

SEQ ID NO: 885833 - RNA, 22 nt, Homo sapiens
uccaaugucuuuuuaagcuuau

SEQ ID NO: 885834 - RNA, 19 nt, Homo sapiens
uccacaaaaacaacuuauu

SEQ ID NO: 885835 - RNA, 20 nt, Homo sapiens
uccacaccuagcaucucaug

SEQ ID NO: 885836 - RNA, 16 nt, Homo sapiens
uccacaccuggucuga

SEQ ID NO: 885837 - RNA, 18 nt, Homo sapiens
uccacagaaauacaugaa

SEQ ID NO: 885838 - RNA, 23 nt, Homo sapiens
uccacagccaacaaacauagaaa

SEQ ID NO: 885839 - RNA, 17 nt, Homo sapiens
uccacagucucccauuc

SEQ ID NO: 885840 - RNA, 19 nt, Homo sapiens
uccaccauucacauuugau

SEQ ID NO: 885841 - RNA, 18 nt, Homo sapiens
uccacccucaaaugucag

SEQ ID NO: 885842 - RNA, 14 nt, Homo sapiens
uccacuaaaugagc

SEQ ID NO: 885843 - RNA, 15 nt, Homo sapiens
uccacucacuccagc

SEQ ID NO: 885844 - RNA, 21 nt, Homo sapiens
uccacuuaccuagauucuaca

SEQ ID NO: 885845 - RNA, 22 nt, Homo sapiens
uccacuuaccuagauucuacau

SEQ ID NO: 885846 - RNA, 20 nt, Homo sapiens
uccacuuagaaauugcauuu

SEQ ID NO: 885847 - RNA, 17 nt, Homo sapiens
uccacuuugaguaccaa

SEQ ID NO: 885848 - RNA, 11 nt, Homo sapiens
uccacuuuuau

SEQ ID NO: 885849 - RNA, 19 nt, Homo sapiens
uccagaacugaggucacug

SEQ ID NO: 885850 - RNA, 16 nt, Homo sapiens
uccagaauaugcauaa

SEQ ID NO: 885851 - RNA, 22 nt, Homo sapiens
uccagacccugccugagcccag

SEQ ID NO: 885852 - RNA, 16 nt, Homo sapiens
uccagaucagauucuu

SEQ ID NO: 885853 - RNA, 16 nt, Homo sapiens
uccagauggcaugugu

SEQ ID NO: 885854 - RNA, 21 nt, Homo sapiens
uccagcacucccucccagaga

SEQ ID NO: 885855 - RNA, 13 nt, Homo sapiens
uccagcagcugcg

SEQ ID NO: 885856 - RNA, 11 nt, Homo sapiens
uccagcauuug

SEQ ID NO: 885857 - RNA, 15 nt, Homo sapiens
uccagccaacauuua

SEQ ID NO: 885858 - RNA, 20 nt, Homo sapiens
uccagcuagccaacuccucc

SEQ ID NO: 885859 - RNA, 23 nt, Homo sapiens
uccaggaagguagcccagcacug

SEQ ID NO: 885860 - RNA, 20 nt, Homo sapiens
uccaggaugaguuacuugaa

SEQ ID NO: 885861 - RNA, 14 nt, Homo sapiens
uccaggcaccaucu

SEQ ID NO: 885862 - RNA, 17 nt, Homo sapiens
uccaguauucuugucaa

SEQ ID NO: 885863 - RNA, 18 nt, Homo sapiens
uccagugcauguugccau

SEQ ID NO: 885864 - RNA, 22 nt, Homo sapiens
uccagugggaggugagaccacc

SEQ ID NO: 885865 - RNA, 23 nt, Homo sapiens
uccagugguaccagcucacuccc

SEQ ID NO: 885866 - RNA, 15 nt, Homo sapiens
uccaguuuccaaagg

SEQ ID NO: 885867 - RNA, 19 nt, Homo sapiens
uccaguuucccaccaccuu

SEQ ID NO: 885868 - RNA, 21 nt, Homo sapiens
uccauaaacacccaugaauca

SEQ ID NO: 885869 - RNA, 23 nt, Homo sapiens
uccauaaaguaauuuugugaaag

SEQ ID NO: 885870 - RNA, 13 nt, Homo sapiens
uccauagugcacu

SEQ ID NO: 885871 - RNA, 14 nt, Homo sapiens
uccauagugcacua

SEQ ID NO: 885872 - RNA, 20 nt, Homo sapiens
gaaguauuuuccuccaggca

SEQ ID NO: 885873 - RNA, 22 nt, Homo sapiens
gaaguauuuuccuccaggcaaa

SEQ ID NO: 885874 - RNA, 13 nt, Homo sapiens
gaagucacaucac

SEQ ID NO: 885875 - RNA, 14 nt, Homo sapiens
gaagucaccaaaau

SEQ ID NO: 885876 - RNA, 21 nt, Homo sapiens
gaagucaucuuagcuuuccac

SEQ ID NO: 885877 - RNA, 13 nt, Homo sapiens
gaagucucuucca

SEQ ID NO: 885878 - RNA, 16 nt, Homo sapiens
gaagucucuuccaguu

SEQ ID NO: 885879 - RNA, 16 nt, Homo sapiens
gaagucuuccauagag

SEQ ID NO: 885880 - RNA, 14 nt, Homo sapiens
gaagucuugucuca

SEQ ID NO: 885881 - RNA, 15 nt, Homo sapiens
gaagucuugucucaa

SEQ ID NO: 885882 - RNA, 22 nt, Homo sapiens
gaagucuugucucaagaagaaa

SEQ ID NO: 885883 - RNA, 16 nt, Homo sapiens
gaagugagaaaccagc

SEQ ID NO: 885884 - RNA, 16 nt, Homo sapiens
gaaguuauucuugaca

SEQ ID NO: 885885 - RNA, 19 nt, Homo sapiens
gaaguuccaguguucucuc

SEQ ID NO: 885886 - RNA, 12 nt, Homo sapiens
gaaguuccucaa

SEQ ID NO: 885887 - RNA, 11 nt, Homo sapiens
gaaguuucauc

SEQ ID NO: 885888 - RNA, 13 nt, Homo sapiens
gaaguuuggcaau

SEQ ID NO: 885889 - RNA, 11 nt, Homo sapiens
gaauaaagccu

SEQ ID NO: 885890 - RNA, 22 nt, Homo sapiens
gaauaaauaugcucagccaccc

SEQ ID NO: 885891 - RNA, 17 nt, Homo sapiens
gaauaaaugaaucuuac

SEQ ID NO: 885892 - RNA, 13 nt, Homo sapiens
gaauaagaagcaa

SEQ ID NO: 885893 - RNA, 12 nt, Homo sapiens
gaauaaggccuu

SEQ ID NO: 885894 - RNA, 22 nt, Homo sapiens
gaauacaguaagcugcucuauu

SEQ ID NO: 885895 - RNA, 20 nt, Homo sapiens
gaauacccuuuucugaccaa

SEQ ID NO: 885896 - RNA, 22 nt, Homo sapiens
gaauacuuaacucaauaauucu

SEQ ID NO: 885897 - RNA, 17 nt, Homo sapiens
gaauagccauguacuau

SEQ ID NO: 885898 - RNA, 18 nt, Homo sapiens
gaauagcgaaucaucuca

SEQ ID NO: 885899 - RNA, 22 nt, Homo sapiens
gaauaggucauuuucuauucac

SEQ ID NO: 885900 - RNA, 22 nt, Homo sapiens
gaauaguguuggaaaaugugca

SEQ ID NO: 885901 - RNA, 23 nt, Homo sapiens
gaauaguguuggaaaaugugcaa

SEQ ID NO: 885902 - RNA, 21 nt, Homo sapiens
gaauaugaucauguaaaugau

SEQ ID NO: 885903 - RNA, 20 nt, Homo sapiens
gaauauuaucaguggcugcc

SEQ ID NO: 885904 - RNA, 18 nt, Homo sapiens
gaauauuuauuaccucug

SEQ ID NO: 885905 - RNA, 16 nt, Homo sapiens
gaaucaaaaauugaag

SEQ ID NO: 885906 - RNA, 14 nt, Homo sapiens
gaaucaauuuccca

SEQ ID NO: 885907 - RNA, 12 nt, Homo sapiens
gaaucagacuca

SEQ ID NO: 885908 - RNA, 18 nt, Homo sapiens
gaaucauuaauacaaaga

SEQ ID NO: 885909 - RNA, 20 nt, Homo sapiens
gaauccaaagaucacauauu

SEQ ID NO: 885910 - RNA, 20 nt, Homo sapiens
gaauccaucaggacuuggga

SEQ ID NO: 885911 - RNA, 20 nt, Homo sapiens
gaaucccacccacaugugac

SEQ ID NO: 885912 - RNA, 23 nt, Homo sapiens
uggcggcccccccagcugucauc

SEQ ID NO: 885913 - RNA, 14 nt, Homo sapiens
uggcuaacacguga

SEQ ID NO: 885914 - RNA, 22 nt, Homo sapiens
uggcuacugggaaauuacuuau

SEQ ID NO: 885915 - RNA, 12 nt, Homo sapiens
uggcuagucaua

SEQ ID NO: 885916 - RNA, 16 nt, Homo sapiens
uggcuagucauaaccu

SEQ ID NO: 885917 - RNA, 15 nt, Homo sapiens
uggcuauaaauauau

SEQ ID NO: 885918 - RNA, 21 nt, Homo sapiens
uggcuauaacaugucuuucag

SEQ ID NO: 885919 - RNA, 19 nt, Homo sapiens
uggcuaucugcauuuauaa

SEQ ID NO: 885920 - RNA, 21 nt, Homo sapiens
uggcuccaggacagaccuuca

SEQ ID NO: 885921 - RNA, 18 nt, Homo sapiens
uggcuccuccaggcacgu

SEQ ID NO: 885922 - RNA, 12 nt, Homo sapiens
uggcucugccag

SEQ ID NO: 885923 - RNA, 12 nt, Homo sapiens
uggcucugugaa

SEQ ID NO: 885924 - RNA, 17 nt, Homo sapiens
uggcugaccccaaagag

SEQ ID NO: 885925 - RNA, 15 nt, Homo sapiens
uggcugcuagcacuu

SEQ ID NO: 885926 - RNA, 23 nt, Homo sapiens
uggcugcugacaggauguggcac

SEQ ID NO: 885927 - RNA, 14 nt, Homo sapiens
uggcuggcacugag

SEQ ID NO: 885928 - RNA, 19 nt, Homo sapiens
uggcugggggccucagugc

SEQ ID NO: 885929 - RNA, 18 nt, Homo sapiens
uggcuguuauucuuccac

SEQ ID NO: 885930 - RNA, 18 nt, Homo sapiens
uggcuucuguugcgccac

SEQ ID NO: 885931 - RNA, 13 nt, Homo sapiens
ugggaaaacuggg

SEQ ID NO: 885932 - RNA, 15 nt, Homo sapiens
ugggaacuccacucu

SEQ ID NO: 885933 - RNA, 13 nt, Homo sapiens
ugggaagcuugcu

SEQ ID NO: 885934 - RNA, 13 nt, Homo sapiens
ugggaauugcaug

SEQ ID NO: 885935 - RNA, 17 nt, Homo sapiens
ugggaauuuucuuccaa

SEQ ID NO: 885936 - RNA, 12 nt, Homo sapiens
ugggacacugaa

SEQ ID NO: 885937 - RNA, 16 nt, Homo sapiens
ugggacagcaaccugu

SEQ ID NO: 885938 - RNA, 14 nt, Homo sapiens
ugggacuacaggca

SEQ ID NO: 885939 - RNA, 22 nt, Homo sapiens
ugggacuacaggugugagucac

SEQ ID NO: 885940 - RNA, 13 nt, Homo sapiens
ugggacugagaug

SEQ ID NO: 885941 - RNA, 14 nt, Homo sapiens
ugggagaagagaga

SEQ ID NO: 885942 - RNA, 12 nt, Homo sapiens
ugggagagccag

SEQ ID NO: 885943 - RNA, 15 nt, Homo sapiens
ugggagaucagccac

SEQ ID NO: 885944 - RNA, 16 nt, Homo sapiens
ugggagaucagccacg

SEQ ID NO: 885945 - RNA, 17 nt, Homo sapiens
ugggaggucuccacuga

SEQ ID NO: 885946 - RNA, 16 nt, Homo sapiens
ugggaguagcauggac

SEQ ID NO: 885947 - RNA, 19 nt, Homo sapiens
ugggaucgcaccuuuuaua

SEQ ID NO: 885948 - RNA, 19 nt, Homo sapiens
ugggauuacaggugugaac

SEQ ID NO: 885949 - RNA, 16 nt, Homo sapiens
ugggauugugguacaa

SEQ ID NO: 885950 - RNA, 22 nt, Homo sapiens
ugggcaaagcugugcacuugca

SEQ ID NO: 885951 - RNA, 18 nt, Homo sapiens
ugggcaacagagcaagau

SEQ ID NO: 885952 - RNA, 23 nt, Homo sapiens
ugggcaacauaguaagaccccau

SEQ ID NO: 885953 - RNA, 22 nt, Homo sapiens
ugggcagcugauuuugucacug

SEQ ID NO: 885954 - RNA, 15 nt, Homo sapiens
ugggcagcuugagag

SEQ ID NO: 885955 - RNA, 17 nt, Homo sapiens
ugggcaggaacugcagu

SEQ ID NO: 885956 - RNA, 22 nt, Homo sapiens
ugggcagugccuccugggacca

SEQ ID NO: 885957 - RNA, 14 nt, Homo sapiens
ugggcaugcucagc

SEQ ID NO: 885958 - RNA, 18 nt, Homo sapiens
ugggcauucuuguuucaa

SEQ ID NO: 885959 - RNA, 21 nt, Homo sapiens
ugggccgggcaauccagacag

SEQ ID NO: 885960 - RNA, 23 nt, Homo sapiens
ugggccuagggacagacugcaag

SEQ ID NO: 885961 - RNA, 16 nt, Homo sapiens
ugggcgaagcuaaaag

SEQ ID NO: 885962 - RNA, 19 nt, Homo sapiens
ugggcuuggccuuguguca

SEQ ID NO: 885963 - RNA, 16 nt, Homo sapiens
uggggagaaaguacuu

SEQ ID NO: 885964 - RNA, 15 nt, Homo sapiens
uggggagauggaguu

SEQ ID NO: 885965 - RNA, 13 nt, Homo sapiens
uggggaucugcau

SEQ ID NO: 885966 - RNA, 20 nt, Homo sapiens
uggggcagcuugaggguugg

SEQ ID NO: 885967 - RNA, 23 nt, Homo sapiens
ugggggaaaguguugaccacaga

SEQ ID NO: 885968 - RNA, 19 nt, Homo sapiens
ugggggaggcggcacauug

SEQ ID NO: 885969 - RNA, 15 nt, Homo sapiens
ugggggaugugcacg

SEQ ID NO: 885970 - RNA, 17 nt, Homo sapiens
ugggggucaggggcuag

SEQ ID NO: 885971 - RNA, 21 nt, Homo sapiens
ugggguacccacugcucuggu

SEQ ID NO: 885972 - RNA, 19 nt, Homo sapiens
uggggucuugcuauauugc

SEQ ID NO: 885973 - RNA, 17 nt, Homo sapiens
uggguauccuacuacuu

SEQ ID NO: 885974 - RNA, 15 nt, Homo sapiens
ugggucaaagccggu

SEQ ID NO: 885975 - RNA, 16 nt, Homo sapiens
ugggucucaauccuua

SEQ ID NO: 885976 - RNA, 18 nt, Homo sapiens
ugggucuuuguacauuuu

SEQ ID NO: 885977 - RNA, 15 nt, Homo sapiens
ugggugaauguguga

SEQ ID NO: 885978 - RNA, 11 nt, Homo sapiens
uggguggcucc

SEQ ID NO: 885979 - RNA, 15 nt, Homo sapiens
uggguguuuucaaau

SEQ ID NO: 885980 - RNA, 17 nt, Homo sapiens
uggguuuucuaacugua

SEQ ID NO: 885981 - RNA, 19 nt, Homo sapiens
uggguuuucuaacuguaaa

SEQ ID NO: 885982 - RNA, 15 nt, Homo sapiens
ugguaaaacacagau

SEQ ID NO: 885983 - RNA, 14 nt, Homo sapiens
ugguaaaauacuuc

SEQ ID NO: 885984 - RNA, 17 nt, Homo sapiens
ugguaaauuaguauuua

SEQ ID NO: 885985 - RNA, 16 nt, Homo sapiens
ugguaacugcacacau

SEQ ID NO: 885986 - RNA, 18 nt, Homo sapiens
ugguaauaaaccuugaug

SEQ ID NO: 885987 - RNA, 21 nt, Homo sapiens
ugguaauugaauggaagcaaa

SEQ ID NO: 885988 - RNA, 12 nt, Homo sapiens
ugguacaaggaa

SEQ ID NO: 885989 - RNA, 14 nt, Homo sapiens
ugguaggauuuaua

SEQ ID NO: 885990 - RNA, 17 nt, Homo sapiens
ugguauaucuuuuucca

SEQ ID NO: 885991 - RNA, 19 nt, Homo sapiens
ugguaucuuauuaaugagu

SEQ ID NO: 885992 - RNA, 15 nt, Homo sapiens
uggucaaagcaacug

SEQ ID NO: 885993 - RNA, 21 nt, Homo sapiens
uggucaaccugcucacuguuc

SEQ ID NO: 885994 - RNA, 19 nt, Homo sapiens
uggucaauccgaaguauga

SEQ ID NO: 885995 - RNA, 19 nt, Homo sapiens
ggaccuuccugccaccagu

SEQ ID NO: 885996 - RNA, 21 nt, Homo sapiens
ggacgcgccaggggaguuccu

SEQ ID NO: 885997 - RNA, 16 nt, Homo sapiens
ggacgcuuccagacca

SEQ ID NO: 885998 - RNA, 22 nt, Homo sapiens
ggacguccugcuggcaccucag

SEQ ID NO: 885999 - RNA, 13 nt, Homo sapiens
ggacuacaggcac

SEQ ID NO: 886000 - RNA, 18 nt, Homo sapiens
ggacuagaaaaacuuggg

SEQ ID NO: 886001 - RNA, 20 nt, Homo sapiens
ggacuauggguacauuccac

SEQ ID NO: 886002 - RNA, 12 nt, Homo sapiens
ggacucaaugca

SEQ ID NO: 886003 - RNA, 21 nt, Homo sapiens
ggacuccccaggccaggccac

SEQ ID NO: 886004 - RNA, 20 nt, Homo sapiens
ggacucugccuuuuuucaca

SEQ ID NO: 886005 - RNA, 10 nt, Homo sapiens
ggacugggag

SEQ ID NO: 886006 - RNA, 15 nt, Homo sapiens
ggacuguuuccugag

SEQ ID NO: 886007 - RNA, 15 nt, Homo sapiens
ggacuugaacccagg

SEQ ID NO: 886008 - RNA, 15 nt, Homo sapiens
ggacuuggaagcucc

SEQ ID NO: 886009 - RNA, 13 nt, Homo sapiens
ggacuuguaggga

SEQ ID NO: 886010 - RNA, 17 nt, Homo sapiens
ggagaaaugacuuugaa

SEQ ID NO: 886011 - RNA, 14 nt, Homo sapiens
ggagaacuagagaa

SEQ ID NO: 886012 - RNA, 18 nt, Homo sapiens
ggagaagaaagaggugac

SEQ ID NO: 886013 - RNA, 18 nt, Homo sapiens
ggagaaucacuugcacuc

SEQ ID NO: 886014 - RNA, 17 nt, Homo sapiens
ggagaccagcucagagg

SEQ ID NO: 886015 - RNA, 18 nt, Homo sapiens
ggagacggccaagugaag

SEQ ID NO: 886016 - RNA, 20 nt, Homo sapiens
ggagagaggcucagccacac

SEQ ID NO: 886017 - RNA, 14 nt, Homo sapiens
ggagaggacucugc

SEQ ID NO: 886018 - RNA, 15 nt, Homo sapiens
ggagaggcauggcug

SEQ ID NO: 886019 - RNA, 20 nt, Homo sapiens
ggagaguacagugagccaag

SEQ ID NO: 886020 - RNA, 20 nt, Homo sapiens
ggagauaaaacucugugguu

SEQ ID NO: 886021 - RNA, 15 nt, Homo sapiens
ggagauuucaguuac

SEQ ID NO: 886022 - RNA, 18 nt, Homo sapiens
ggagccaucagcugggug

SEQ ID NO: 886023 - RNA, 17 nt, Homo sapiens
ggagcccagaaaaccuc

SEQ ID NO: 886024 - RNA, 15 nt, Homo sapiens
ggagcccgugcagua

SEQ ID NO: 886025 - RNA, 14 nt, Homo sapiens
ggagccgcugcuga

SEQ ID NO: 886026 - RNA, 21 nt, Homo sapiens
ggagccuccucugcuugcauc

SEQ ID NO: 886027 - RNA, 18 nt, Homo sapiens
ugugcaguuaauacuuaa

SEQ ID NO: 886028 - RNA, 20 nt, Homo sapiens
ugugcaugaaagagaaagac

SEQ ID NO: 886029 - RNA, 14 nt, Homo sapiens
ugugccaugugcca

SEQ ID NO: 886030 - RNA, 23 nt, Homo sapiens
ugugcccuugggguaagccagag

SEQ ID NO: 886031 - RNA, 12 nt, Homo sapiens
ugugccuggaaa

SEQ ID NO: 886032 - RNA, 17 nt, Homo sapiens
ugugcgacuucacaaaa

SEQ ID NO: 886033 - RNA, 21 nt, Homo sapiens
ugugcgacuucacaaaaugca

SEQ ID NO: 886034 - RNA, 14 nt, Homo sapiens
ugugcuacacuugc

SEQ ID NO: 886035 - RNA, 17 nt, Homo sapiens
ugugcuauugaacugag

SEQ ID NO: 886036 - RNA, 14 nt, Homo sapiens
ugugcucacugggg

SEQ ID NO: 886037 - RNA, 16 nt, Homo sapiens
ugugcucuaagugaau

SEQ ID NO: 886038 - RNA, 13 nt, Homo sapiens
ugugcucugugac

SEQ ID NO: 886039 - RNA, 21 nt, Homo sapiens
ugugcugcccugcucugggga

SEQ ID NO: 886040 - RNA, 15 nt, Homo sapiens
ugugcuggacuguuu

SEQ ID NO: 886041 - RNA, 18 nt, Homo sapiens
ugugcuugcccaccacag

SEQ ID NO: 886042 - RNA, 17 nt, Homo sapiens
uguggaggacuuugaau

SEQ ID NO: 886043 - RNA, 18 nt, Homo sapiens
uguggcaguuacagggcc

SEQ ID NO: 886044 - RNA, 14 nt, Homo sapiens
uguggcccaagaca

SEQ ID NO: 886045 - RNA, 19 nt, Homo sapiens
uguggcccagggaagccaa

SEQ ID NO: 886046 - RNA, 16 nt, Homo sapiens
uguggccccaacacaa

SEQ ID NO: 886047 - RNA, 23 nt, Homo sapiens
uguggccuugcccgccagccuca

SEQ ID NO: 886048 - RNA, 18 nt, Homo sapiens
uguggcuucccaugucuu

SEQ ID NO: 886049 - RNA, 14 nt, Homo sapiens
uguggcuuccucag

SEQ ID NO: 886050 - RNA, 13 nt, Homo sapiens
ugugggacugaga

SEQ ID NO: 886051 - RNA, 22 nt, Homo sapiens
ugugggcauagcauuagcugcu

SEQ ID NO: 886052 - RNA, 16 nt, Homo sapiens
ugugguacaaucucaa

SEQ ID NO: 886053 - RNA, 13 nt, Homo sapiens
ugugguagccuca

SEQ ID NO: 886054 - RNA, 13 nt, Homo sapiens
uguggucaauccg

SEQ ID NO: 886055 - RNA, 21 nt, Homo sapiens
uguggucaauccgaaguauga

SEQ ID NO: 886056 - RNA, 19 nt, Homo sapiens
ugugguggugggugccugu

SEQ ID NO: 886057 - RNA, 15 nt, Homo sapiens
ugugguuuaugucau

SEQ ID NO: 886058 - RNA, 20 nt, Homo sapiens
ugugguuuaugucaucauac

SEQ ID NO: 886059 - RNA, 22 nt, Homo sapiens
uguguaaauacaguggaucuca

SEQ ID NO: 886060 - RNA, 23 nt, Homo sapiens
uguguaaauacaguggaucucaa

SEQ ID NO: 886061 - RNA, 22 nt, Homo sapiens
uguguaaauggcuggggggcca

SEQ ID NO: 886062 - RNA, 18 nt, Homo sapiens
uguguaauaagaaaguau

SEQ ID NO: 886063 - RNA, 21 nt, Homo sapiens
uguguacauauauauucuaca

SEQ ID NO: 886064 - RNA, 16 nt, Homo sapiens
uguguacugcaguugg

SEQ ID NO: 886065 - RNA, 15 nt, Homo sapiens
uguguagccugugca

SEQ ID NO: 886066 - RNA, 20 nt, Homo sapiens
uguguagcucuguccacucu

SEQ ID NO: 886067 - RNA, 17 nt, Homo sapiens
uguguauauauguguau

SEQ ID NO: 886068 - RNA, 21 nt, Homo sapiens
uguguccguggaaccaguccu

SEQ ID NO: 886069 - RNA, 22 nt, Homo sapiens
uguguccuuggggcacagucau

SEQ ID NO: 886070 - RNA, 16 nt, Homo sapiens
ugugucuguacacgug

SEQ ID NO: 886071 - RNA, 16 nt, Homo sapiens
ugugugcacguacaca

SEQ ID NO: 886072 - RNA, 18 nt, Homo sapiens
ugugugcauguaugugca

SEQ ID NO: 886073 - RNA, 16 nt, Homo sapiens
ugugugggcugcagau

SEQ ID NO: 886074 - RNA, 14 nt, Homo sapiens
uguguguaccugug

SEQ ID NO: 886075 - RNA, 20 nt, Homo sapiens
uguguguauaagugcacaca

SEQ ID NO: 886076 - RNA, 11 nt, Homo sapiens
uguguguauau

SEQ ID NO: 886077 - RNA, 16 nt, Homo sapiens
uguguguauguauaca

SEQ ID NO: 886078 - RNA, 15 nt, Homo sapiens
ugugugucugaagac

SEQ ID NO: 886079 - RNA, 22 nt, Homo sapiens
ugugugugcauguaugugcaca

SEQ ID NO: 886080 - RNA, 22 nt, Homo sapiens
uguguguuagcagucaaaucua

SEQ ID NO: 886081 - RNA, 19 nt, Homo sapiens
uguguucucuauugcugcu

SEQ ID NO: 886082 - RNA, 21 nt, Homo sapiens
uguguugggaauugcaugcca

SEQ ID NO: 886083 - RNA, 17 nt, Homo sapiens
uguguugggaccuguga

SEQ ID NO: 886084 - RNA, 21 nt, Homo sapiens
uguguuuccuucagugcaucu

SEQ ID NO: 886085 - RNA, 17 nt, Homo sapiens
uguguuucuggggacac

SEQ ID NO: 886086 - RNA, 14 nt, Homo sapiens
uguguuucuuacag

SEQ ID NO: 886087 - RNA, 13 nt, Homo sapiens
uguguuugcugag

SEQ ID NO: 886088 - RNA, 17 nt, Homo sapiens
uguguuuggaagacuau

SEQ ID NO: 886089 - RNA, 15 nt, Homo sapiens
uguuaaaaucaggau

SEQ ID NO: 886090 - RNA, 19 nt, Homo sapiens
uguuaaaauguacacugga

SEQ ID NO: 886091 - RNA, 21 nt, Homo sapiens
uguuaaauauuuacauaugaa

SEQ ID NO: 886092 - RNA, 16 nt, Homo sapiens
uguuaacuaaauaacu

SEQ ID NO: 886093 - RNA, 14 nt, Homo sapiens
uguuaacuauugua

SEQ ID NO: 886094 - RNA, 15 nt, Homo sapiens
uguuaagacuugaca

SEQ ID NO: 886095 - RNA, 13 nt, Homo sapiens
uguuaaugcauca

SEQ ID NO: 886096 - RNA, 18 nt, Homo sapiens
uguuaauucagcacugau

SEQ ID NO: 886097 - RNA, 14 nt, Homo sapiens
uguuacacaugaca

SEQ ID NO: 886098 - RNA, 20 nt, Homo sapiens
uguuacacaugacacucuuc

SEQ ID NO: 886099 - RNA, 20 nt, Homo sapiens
uguuacuugaaauaccagug

SEQ ID NO: 886100 - RNA, 21 nt, Homo sapiens
uguuacuugaaauaccaguga

SEQ ID NO: 886101 - RNA, 19 nt, Homo sapiens
uguuagauuccucuugccu

SEQ ID NO: 886102 - RNA, 16 nt, Homo sapiens
uguuagcccaagguua

SEQ ID NO: 886103 - RNA, 20 nt, Homo sapiens
uguuauccacaagcaaugga

SEQ ID NO: 886104 - RNA, 20 nt, Homo sapiens
uguuaucuguguagcaagcu

SEQ ID NO: 886105 - RNA, 17 nt, Homo sapiens
uguuaugugacuaucuu

SEQ ID NO: 886106 - RNA, 16 nt, Homo sapiens
uguuauguuugcacuu

SEQ ID NO: 886107 - RNA, 17 nt, Homo sapiens
uguuauguuugcacuuu

SEQ ID NO: 886108 - RNA, 18 nt, Homo sapiens
uguuauguuugcacuuug

SEQ ID NO: 886109 - RNA, 18 nt, Homo sapiens
uguuauuauuuugcacug

SEQ ID NO: 886110 - RNA, 16 nt, Homo sapiens
uguuauugcacuauga

SEQ ID NO: 886111 - RNA, 10 nt, Homo sapiens
gggauguuuu

SEQ ID NO: 886112 - RNA, 22 nt, Homo sapiens
gggcaaagcugugcacuugcag

SEQ ID NO: 886113 - RNA, 22 nt, Homo sapiens
gggcaaaugacaugcacugacc

SEQ ID NO: 886114 - RNA, 14 nt, Homo sapiens
gggcaacaaaguga

SEQ ID NO: 886115 - RNA, 12 nt, Homo sapiens
gggcaacagagc

SEQ ID NO: 886116 - RNA, 15 nt, Homo sapiens
gggcaauccagacag

SEQ ID NO: 886117 - RNA, 23 nt, Homo sapiens
gggcacgagagagucuuccaggu

SEQ ID NO: 886118 - RNA, 15 nt, Homo sapiens
gggcagcauagcaag

SEQ ID NO: 886119 - RNA, 15 nt, Homo sapiens
gggcaggaacugcag

SEQ ID NO: 886120 - RNA, 18 nt, Homo sapiens
gggcaggaguagcugagc

SEQ ID NO: 886121 - RNA, 15 nt, Homo sapiens
gggcagggguuccca

SEQ ID NO: 886122 - RNA, 18 nt, Homo sapiens
gggcagucguaaggguug

SEQ ID NO: 886123 - RNA, 22 nt, Homo sapiens
gggcaguucgcagccacccuga

SEQ ID NO: 886124 - RNA, 19 nt, Homo sapiens
gggccacaucccacugcca

SEQ ID NO: 886125 - RNA, 21 nt, Homo sapiens
gggccagcugucgcaucucag

SEQ ID NO: 886126 - RNA, 15 nt, Homo sapiens
gggccccaccaccua

SEQ ID NO: 886127 - RNA, 15 nt, Homo sapiens
gggcccugcacagau

SEQ ID NO: 886128 - RNA, 19 nt, Homo sapiens
gggccuauggagagcccug

SEQ ID NO: 886129 - RNA, 14 nt, Homo sapiens
gggccugcugcuga

SEQ ID NO: 886130 - RNA, 20 nt, Homo sapiens
gggccuggcuggcugagggc

SEQ ID NO: 886131 - RNA, 15 nt, Homo sapiens
gggccuggggcuccu

SEQ ID NO: 886132 - RNA, 12 nt, Homo sapiens
gggcgcgguggc

SEQ ID NO: 886133 - RNA, 21 nt, Homo sapiens
gggcugaccugccucucacac

SEQ ID NO: 886134 - RNA, 22 nt, Homo sapiens
gggcugagcccuggcaggauga

SEQ ID NO: 886135 - RNA, 19 nt, Homo sapiens
gggcuggaaaagucacaca

SEQ ID NO: 886136 - RNA, 19 nt, Homo sapiens
gggcuggcugcuggaagaa

SEQ ID NO: 886137 - RNA, 21 nt, Homo sapiens
gggcuuguagaccacuguccu

SEQ ID NO: 886138 - RNA, 15 nt, Homo sapiens
ggggagcaugggacu

SEQ ID NO: 886139 - RNA, 20 nt, Homo sapiens
ggggaguguuuuuguaucac

SEQ ID NO: 886140 - RNA, 12 nt, Homo sapiens
ggggaugugcac

SEQ ID NO: 886141 - RNA, 22 nt, Homo sapiens
ggggauuugaagaagaguuucu

SEQ ID NO: 886142 - RNA, 20 nt, Homo sapiens
acacuuaugggccaagccca

SEQ ID NO: 886143 - RNA, 14 nt, Homo sapiens
acacuuguauaaau

SEQ ID NO: 886144 - RNA, 18 nt, Homo sapiens
acagaaauauauauacau

SEQ ID NO: 886145 - RNA, 14 nt, Homo sapiens
acagaacacugucu

SEQ ID NO: 886146 - RNA, 18 nt, Homo sapiens
acagaacuauguacuuua

SEQ ID NO: 886147 - RNA, 19 nt, Homo sapiens
acagaaggaaucugugcag

SEQ ID NO: 886148 - RNA, 13 nt, Homo sapiens
acagaaggggugg

SEQ ID NO: 886149 - RNA, 15 nt, Homo sapiens
acagaauacaagcca

SEQ ID NO: 886150 - RNA, 17 nt, Homo sapiens
acagaauacaagccacu

SEQ ID NO: 886151 - RNA, 18 nt, Homo sapiens
acagaauacaagccacua

SEQ ID NO: 886152 - RNA, 21 nt, Homo sapiens
acagacagggccuagcuuuca

SEQ ID NO: 886153 - RNA, 22 nt, Homo sapiens
acagacauuuucaauaauguga

SEQ ID NO: 886154 - RNA, 14 nt, Homo sapiens
acagacgucucaag

SEQ ID NO: 886155 - RNA, 21 nt, Homo sapiens
acagacgucucaagacugaaa

SEQ ID NO: 886156 - RNA, 14 nt, Homo sapiens
acagagaacccugu

SEQ ID NO: 886157 - RNA, 13 nt, Homo sapiens
acagagacagaaa

SEQ ID NO: 886158 - RNA, 22 nt, Homo sapiens
acagagaugcaugcgcaggcuc

SEQ ID NO: 886159 - RNA, 17 nt, Homo sapiens
acagagccaacucacuc

SEQ ID NO: 886160 - RNA, 22 nt, Homo sapiens
acagagcccccaagccucugcc

SEQ ID NO: 886161 - RNA, 23 nt, Homo sapiens
acagagccgcaaaucaaccccag

SEQ ID NO: 886162 - RNA, 14 nt, Homo sapiens
acagaggcauuuaa

SEQ ID NO: 886163 - RNA, 15 nt, Homo sapiens
acagagguggcugcu

SEQ ID NO: 886164 - RNA, 17 nt, Homo sapiens
acagaguauauauguac

SEQ ID NO: 886165 - RNA, 17 nt, Homo sapiens
acagauagacagugcug

SEQ ID NO: 886166 - RNA, 14 nt, Homo sapiens
acagauagucaaac

SEQ ID NO: 886167 - RNA, 12 nt, Homo sapiens
acagaugcacac

SEQ ID NO: 886168 - RNA, 16 nt, Homo sapiens
acagauggucacacag

SEQ ID NO: 886169 - RNA, 15 nt, Homo sapiens
acagauuguuugcaa

SEQ ID NO: 886170 - RNA, 10 nt, Homo sapiens
acagauuugg

SEQ ID NO: 886171 - RNA, 19 nt, Homo sapiens
acagcaacaggaaucucag

SEQ ID NO: 886172 - RNA, 13 nt, Homo sapiens
acagcaaccugua

SEQ ID NO: 886173 - RNA, 20 nt, Homo sapiens
acagcacccaggcuccaugg

SEQ ID NO: 886174 - RNA, 15 nt, Homo sapiens
acagcacuaauucaa

SEQ ID NO: 886175 - RNA, 15 nt, Homo sapiens
acagcacuccaccuu

SEQ ID NO: 886176 - RNA, 16 nt, Homo sapiens
acagcagcaauaugcu

SEQ ID NO: 886177 - RNA, 16 nt, Homo sapiens
acagcagcacugcaga

SEQ ID NO: 886178 - RNA, 17 nt, Homo sapiens
acagcagccccugcaca

SEQ ID NO: 886179 - RNA, 20 nt, Homo sapiens
acagcaucugccucuauuca

SEQ ID NO: 886180 - RNA, 22 nt, Homo sapiens
acagcaucugccucuauucaau

SEQ ID NO: 886181 - RNA, 19 nt, Homo sapiens
acagccaggcggcuggaau

SEQ ID NO: 886182 - RNA, 15 nt, Homo sapiens
acagcccagacuuua

SEQ ID NO: 886183 - RNA, 18 nt, Homo sapiens
acagcgagaggcagagaa

SEQ ID NO: 886184 - RNA, 23 nt, Homo sapiens
acagcgcguccuucccuaaagac

SEQ ID NO: 886185 - RNA, 18 nt, Homo sapiens
acagcuaugcacuguaaa

SEQ ID NO: 886186 - RNA, 16 nt, Homo sapiens
acagcuccuucugucc

SEQ ID NO: 886187 - RNA, 14 nt, Homo sapiens
acagcucuucucca

SEQ ID NO: 886188 - RNA, 13 nt, Homo sapiens
acagcucuuggca

SEQ ID NO: 886189 - RNA, 21 nt, Homo sapiens
acagcucuuggcauuuuccuc

SEQ ID NO: 886190 - RNA, 14 nt, Homo sapiens
acagcugacagaua

SEQ ID NO: 886191 - RNA, 15 nt, Homo sapiens
acagcugucccuguc

SEQ ID NO: 886192 - RNA, 16 nt, Homo sapiens
acagcuuaacauuuac

SEQ ID NO: 886193 - RNA, 17 nt, Homo sapiens
acagcuuaacauuuaca

SEQ ID NO: 886194 - RNA, 18 nt, Homo sapiens
acaggacuuaaaaugaca

SEQ ID NO: 886195 - RNA, 17 nt, Homo sapiens
acaggagacccagagag

SEQ ID NO: 886196 - RNA, 13 nt, Homo sapiens
acaggagcucuua

SEQ ID NO: 886197 - RNA, 14 nt, Homo sapiens
acaggaggggccca

SEQ ID NO: 886198 - RNA, 19 nt, Homo sapiens
acaggauccuauucucacc

SEQ ID NO: 886199 - RNA, 18 nt, Homo sapiens
acaggauuuguaauuccu

SEQ ID NO: 886200 - RNA, 14 nt, Homo sapiens
acaggcauuccaga

SEQ ID NO: 886201 - RNA, 18 nt, Homo sapiens
acaggcauuccagaauua

SEQ ID NO: 886202 - RNA, 23 nt, Homo sapiens
acaggcccggcccagccuaggcc

SEQ ID NO: 886203 - RNA, 23 nt, Homo sapiens
acaggcccuugggguucccccag

SEQ ID NO: 886204 - RNA, 23 nt, Homo sapiens
acaggcugccucaugacccuccu

SEQ ID NO: 886205 - RNA, 16 nt, Homo sapiens
acagggcagugacaag

SEQ ID NO: 886206 - RNA, 19 nt, Homo sapiens
acagggcaugcauuuugca

SEQ ID NO: 886207 - RNA, 19 nt, Homo sapiens
acaggggccccagaucugc

SEQ ID NO: 886208 - RNA, 14 nt, Homo sapiens
acaggucaacuuca

SEQ ID NO: 886209 - RNA, 13 nt, Homo sapiens
acaggugugaacc

SEQ ID NO: 886210 - RNA, 20 nt, Homo sapiens
acagguuuucagcaacucag

SEQ ID NO: 886211 - RNA, 13 nt, Homo sapiens
acaguacagugag

SEQ ID NO: 886212 - RNA, 12 nt, Homo sapiens
acaguagugcau

SEQ ID NO: 886213 - RNA, 16 nt, Homo sapiens
acaguauuuguacaaa

SEQ ID NO: 886214 - RNA, 20 nt, Homo sapiens
acagucucaggaaaucaaau

SEQ ID NO: 886215 - RNA, 16 nt, Homo sapiens
acagugcauccuugaa

SEQ ID NO: 886216 - RNA, 16 nt, Homo sapiens
acagugcccagcauga

SEQ ID NO: 886217 - RNA, 19 nt, Homo sapiens
acagugcccuuuucaucuc

SEQ ID NO: 886218 - RNA, 14 nt, Homo sapiens
acaguggaucucaa

SEQ ID NO: 886219 - RNA, 16 nt, Homo sapiens
acaguuaacuuucaga

SEQ ID NO: 886220 - RNA, 18 nt, Homo sapiens
acaguuauacauaccucu

SEQ ID NO: 886221 - RNA, 20 nt, Homo sapiens
acaguuccuucagcuuccau

SEQ ID NO: 886222 - RNA, 17 nt, Homo sapiens
acaguucuuggugacug

SEQ ID NO: 886223 - RNA, 20 nt, Homo sapiens
acaguugugagauugugccc

SEQ ID NO: 886224 - RNA, 15 nt, Homo sapiens
acaguuuugccuuaa

SEQ ID NO: 886225 - RNA, 15 nt, Homo sapiens
acauaaugaaugcua

SEQ ID NO: 886226 - RNA, 21 nt, Homo sapiens
acauacaccuaugucauuuca

SEQ ID NO: 886227 - RNA, 22 nt, Homo sapiens
acauacaccuaugucauuucau

SEQ ID NO: 886228 - RNA, 19 nt, Homo sapiens
acauacaggccauacuuua

SEQ ID NO: 886229 - RNA, 14 nt, Homo sapiens
acauacauacacau

SEQ ID NO: 886230 - RNA, 16 nt, Homo sapiens
acauacauacauacau

SEQ ID NO: 886231 - RNA, 15 nt, Homo sapiens
acauacauacauaua

SEQ ID NO: 886232 - RNA, 19 nt, Homo sapiens
acauacauauauaucugau

SEQ ID NO: 886233 - RNA, 21 nt, Homo sapiens
acauacauugccaauuuucca

SEQ ID NO: 886234 - RNA, 17 nt, Homo sapiens
acauagagauaugcaca

SEQ ID NO: 886235 - RNA, 12 nt, Homo sapiens
acauagcacaga

SEQ ID NO: 886236 - RNA, 16 nt, Homo sapiens
acauaguuuauuucaa

SEQ ID NO: 886237 - RNA, 19 nt, Homo sapiens
acauauaccuauaaugugu

SEQ ID NO: 886238 - RNA, 20 nt, Homo sapiens
acauauauauucuacauaua

SEQ ID NO: 886239 - RNA, 14 nt, Homo sapiens
acauauauguauau

SEQ ID NO: 886240 - RNA, 14 nt, Homo sapiens
acauaugacauaua

SEQ ID NO: 886241 - RNA, 12 nt, Homo sapiens
acauaugcaccu

SEQ ID NO: 886242 - RNA, 16 nt, Homo sapiens
acauaugcauuaugaa

SEQ ID NO: 886243 - RNA, 15 nt, Homo sapiens
acauauggcacaacu

SEQ ID NO: 886244 - RNA, 18 nt, Homo sapiens
acauauucuuuaaauuuc

SEQ ID NO: 886245 - RNA, 15 nt, Homo sapiens
acauauugagcacuu

SEQ ID NO: 886246 - RNA, 14 nt, Homo sapiens
acaucaacauuccc

SEQ ID NO: 886247 - RNA, 16 nt, Homo sapiens
acaucacaacauuuac

SEQ ID NO: 886248 - RNA, 17 nt, Homo sapiens
acaucacugaaaugcua

SEQ ID NO: 886249 - RNA, 15 nt, Homo sapiens
acaucagagugacau

SEQ ID NO: 886250 - RNA, 20 nt, Homo sapiens
acaucagagugacauccagg

SEQ ID NO: 886251 - RNA, 21 nt, Homo sapiens
acaucagagugacauccagga

SEQ ID NO: 886252 - RNA, 18 nt, Homo sapiens
acaucagcuugcccuguu

SEQ ID NO: 886253 - RNA, 14 nt, Homo sapiens
acaucagugcacac

SEQ ID NO: 886254 - RNA, 14 nt, Homo sapiens
acaucccacugcca

SEQ ID NO: 886255 - RNA, 21 nt, Homo sapiens
acauccguugugcuugccugc

SEQ ID NO: 886256 - RNA, 14 nt, Homo sapiens
acaucuauguaucu

SEQ ID NO: 886257 - RNA, 20 nt, Homo sapiens
acaucuauguaucuaccauc

SEQ ID NO: 886258 - RNA, 19 nt, Homo sapiens
acaucuauuauaaaaccau

SEQ ID NO: 886259 - RNA, 17 nt, Homo sapiens
acaucucuuugauguca

SEQ ID NO: 886260 - RNA, 22 nt, Homo sapiens
acaucugugucucuggaaccca

SEQ ID NO: 886261 - RNA, 15 nt, Homo sapiens
acaucuucucagugu

SEQ ID NO: 886262 - RNA, 15 nt, Homo sapiens
acaugaagagcagcu

SEQ ID NO: 886263 - RNA, 23 nt, Homo sapiens
acaugaaucccacccacauguga

SEQ ID NO: 886264 - RNA, 13 nt, Homo sapiens
acaugaaugcaca

SEQ ID NO: 886265 - RNA, 20 nt, Homo sapiens
acaugaccagaaaacaaauc

SEQ ID NO: 886266 - RNA, 13 nt, Homo sapiens
acaugacuaggaa

SEQ ID NO: 886267 - RNA, 23 nt, Homo sapiens
acaugacuucugccccagcuuua

SEQ ID NO: 886268 - RNA, 17 nt, Homo sapiens
acaugagcgcugaugau

SEQ ID NO: 886269 - RNA, 16 nt, Homo sapiens
acaugauacuauucag

SEQ ID NO: 886270 - RNA, 21 nt, Homo sapiens
acaugauggagcgcaccugcc

SEQ ID NO: 886271 - RNA, 22 nt, Homo sapiens
acaugauggagcgcaccugccc

SEQ ID NO: 886272 - RNA, 16 nt, Homo sapiens
acaugcaauuuugcau

SEQ ID NO: 886273 - RNA, 14 nt, Homo sapiens
acaugcacauuuau

SEQ ID NO: 886274 - RNA, 22 nt, Homo sapiens
acaugcauuacugcaugcacuu

SEQ ID NO: 886275 - RNA, 15 nt, Homo sapiens
acaugcgaccgugac

SEQ ID NO: 886276 - RNA, 17 nt, Homo sapiens
acaugcugugcucuuug

SEQ ID NO: 886277 - RNA, 20 nt, Homo sapiens
acauggaauuaccuuagauu

SEQ ID NO: 886278 - RNA, 19 nt, Homo sapiens
acauggacacaccagagug

SEQ ID NO: 886279 - RNA, 22 nt, Homo sapiens
acauggucuccucugauuauca

SEQ ID NO: 886280 - RNA, 23 nt, Homo sapiens
acauggugaaaccucaucucuac

SEQ ID NO: 886281 - RNA, 21 nt, Homo sapiens
acauguaugcuauuacauaca

SEQ ID NO: 886282 - RNA, 20 nt, Homo sapiens
acaugucuagccacugauca

SEQ ID NO: 886283 - RNA, 16 nt, Homo sapiens
acaugugcacaugcac

SEQ ID NO: 886284 - RNA, 23 nt, Homo sapiens
acauguggugggacagggaccca

SEQ ID NO: 886285 - RNA, 20 nt, Homo sapiens
acauguguagccugugcaug

SEQ ID NO: 886286 - RNA, 22 nt, Homo sapiens
acauguguagccugugcaugua

SEQ ID NO: 886287 - RNA, 14 nt, Homo sapiens
acaugugucugugu

SEQ ID NO: 886288 - RNA, 20 nt, Homo sapiens
acaugugucugugugguaua

SEQ ID NO: 886289 - RNA, 22 nt, Homo sapiens
acauguguguauauauguguau

SEQ ID NO: 886290 - RNA, 23 nt, Homo sapiens
acauguuauccacaagcaaugga

SEQ ID NO: 886291 - RNA, 14 nt, Homo sapiens
acauuaaaagcuau

SEQ ID NO: 886292 - RNA, 19 nt, Homo sapiens
acauuaaauucacaugcag

SEQ ID NO: 886293 - RNA, 16 nt, Homo sapiens
acauuaauucuacuaa

SEQ ID NO: 886294 - RNA, 22 nt, Homo sapiens
acauuaucaucugaaaaucugg

SEQ ID NO: 886295 - RNA, 19 nt, Homo sapiens
acauucacacagggcucuu

SEQ ID NO: 886296 - RNA, 14 nt, Homo sapiens
acauucaucaagcu

SEQ ID NO: 886297 - RNA, 17 nt, Homo sapiens
acauuccaggaaaccau

SEQ ID NO: 886298 - RNA, 16 nt, Homo sapiens
acauucccuaucaaaa

SEQ ID NO: 886299 - RNA, 23 nt, Homo sapiens
acauucccuaucaaaacauauca

SEQ ID NO: 886300 - RNA, 23 nt, Homo sapiens
acauucccuggccuggcucuccu

SEQ ID NO: 886301 - RNA, 20 nt, Homo sapiens
acauuccucugcagcacuuc

SEQ ID NO: 886302 - RNA, 22 nt, Homo sapiens
acauucuuguuuuaagugccuu

SEQ ID NO: 886303 - RNA, 18 nt, Homo sapiens
acauucuuuaucuugaca

SEQ ID NO: 886304 - RNA, 19 nt, Homo sapiens
acauuggaaggcucccuaa

SEQ ID NO: 886305 - RNA, 20 nt, Homo sapiens
acauuggcagugugucacac

SEQ ID NO: 886306 - RNA, 13 nt, Homo sapiens
acauuguauauau

SEQ ID NO: 886307 - RNA, 13 nt, Homo sapiens
acauuuacaauaa

SEQ ID NO: 886308 - RNA, 16 nt, Homo sapiens
acauuuccaaaugaau

SEQ ID NO: 886309 - RNA, 16 nt, Homo sapiens
acauuucccugugcug

SEQ ID NO: 886310 - RNA, 14 nt, Homo sapiens
acauuucucugagc

SEQ ID NO: 886311 - RNA, 15 nt, Homo sapiens
acauuuggagugugu

SEQ ID NO: 886312 - RNA, 15 nt, Homo sapiens
acauuuucucuuuaa

SEQ ID NO: 886313 - RNA, 23 nt, Homo sapiens
acauuuugcauuagacagaugac

SEQ ID NO: 886314 - RNA, 23 nt, Homo sapiens
acauuuuguacaaagauaugcua

SEQ ID NO: 886315 - RNA, 15 nt, Homo sapiens
acauuuuuguacaca

SEQ ID NO: 886316 - RNA, 14 nt, Homo sapiens
accaaaucaucucu

SEQ ID NO: 886317 - RNA, 17 nt, Homo sapiens
accaaaucaucucucau

SEQ ID NO: 886318 - RNA, 18 nt, Homo sapiens
accaaaugaugccacuuc

SEQ ID NO: 886319 - RNA, 17 nt, Homo sapiens
accaacaaacaaugcca

SEQ ID NO: 886320 - RNA, 18 nt, Homo sapiens
accaacaaacaaugccau

SEQ ID NO: 886321 - RNA, 19 nt, Homo sapiens
accaacaguuccuucagcu

SEQ ID NO: 886322 - RNA, 16 nt, Homo sapiens
accuaaaccaccagug

SEQ ID NO: 886323 - RNA, 15 nt, Homo sapiens
accuaaaugaccuca

SEQ ID NO: 886324 - RNA, 12 nt, Homo sapiens
accuaagcaaca

SEQ ID NO: 886325 - RNA, 19 nt, Homo sapiens
accuacaagguugugcccu

SEQ ID NO: 886326 - RNA, 20 nt, Homo sapiens
accuaccaccccuuccuguc

SEQ ID NO: 886327 - RNA, 22 nt, Homo sapiens
accuaccaccuucccucuuucu

SEQ ID NO: 886328 - RNA, 13 nt, Homo sapiens
accuacuagacaa

SEQ ID NO: 886329 - RNA, 16 nt, Homo sapiens
accuacucacacaggc

SEQ ID NO: 886330 - RNA, 14 nt, Homo sapiens
accuacuuacaugc

SEQ ID NO: 886331 - RNA, 15 nt, Homo sapiens
accuacuuacaugca

SEQ ID NO: 886332 - RNA, 19 nt, Homo sapiens
accuacuuuucuuuccuca

SEQ ID NO: 886333 - RNA, 13 nt, Homo sapiens
accuagugcuguu

SEQ ID NO: 886334 - RNA, 22 nt, Homo sapiens
accuagugguuucuacucucac

SEQ ID NO: 886335 - RNA, 23 nt, Homo sapiens
accuauaccuguguuucuugccu

SEQ ID NO: 886336 - RNA, 19 nt, Homo sapiens
accuauuauaaaaucuuac

SEQ ID NO: 886337 - RNA, 17 nt, Homo sapiens
accucacgcucuggaca

SEQ ID NO: 886338 - RNA, 13 nt, Homo sapiens
accucacuauuca

SEQ ID NO: 886339 - RNA, 19 nt, Homo sapiens
accucacugaggaagggag

SEQ ID NO: 886340 - RNA, 19 nt, Homo sapiens
accucagacaauccacucu

SEQ ID NO: 886341 - RNA, 18 nt, Homo sapiens
accucaggcagaggaugu

SEQ ID NO: 886342 - RNA, 19 nt, Homo sapiens
accucagggacaacauuuu

SEQ ID NO: 886343 - RNA, 22 nt, Homo sapiens
accucagugucauuuaugaaaa

SEQ ID NO: 886344 - RNA, 17 nt, Homo sapiens
accucaucuacaagcau

SEQ ID NO: 886345 - RNA, 16 nt, Homo sapiens
accucaucucuacuaa

SEQ ID NO: 886346 - RNA, 18 nt, Homo sapiens
accuccauuucucuccag

SEQ ID NO: 886347 - RNA, 22 nt, Homo sapiens
accucccccaagcagagcuucc

SEQ ID NO: 886348 - RNA, 21 nt, Homo sapiens
accuccuacgucaaacaugaa

SEQ ID NO: 886349 - RNA, 22 nt, Homo sapiens
accuccuagaggugggcagcug

SEQ ID NO: 886350 - RNA, 20 nt, Homo sapiens
accuccuccacucacuccag

SEQ ID NO: 886351 - RNA, 23 nt, Homo sapiens
accuccugaccugucaccgugag

SEQ ID NO: 886352 - RNA, 18 nt, Homo sapiens
accucgacccacucucaa

SEQ ID NO: 886353 - RNA, 13 nt, Homo sapiens
accucuauauguu

SEQ ID NO: 886354 - RNA, 19 nt, Homo sapiens
accucucuaagccacagcu

SEQ ID NO: 886355 - RNA, 12 nt, Homo sapiens
accucugaccaa

SEQ ID NO: 886356 - RNA, 20 nt, Homo sapiens
accucugccugaagucacac

SEQ ID NO: 886357 - RNA, 12 nt, Homo sapiens
accucuuccuuc

SEQ ID NO: 886358 - RNA, 15 nt, Homo sapiens
accucuucuaugcaa

SEQ ID NO: 886359 - RNA, 20 nt, Homo sapiens
accucuucuaugcaagccuu

SEQ ID NO: 886360 - RNA, 18 nt, Homo sapiens
accucuucucuuccugua

SEQ ID NO: 886361 - RNA, 19 nt, Homo sapiens
accucuucucuuccuguaa

SEQ ID NO: 886362 - RNA, 20 nt, Homo sapiens
accucuucugggaacuuccu

SEQ ID NO: 886363 - RNA, 22 nt, Homo sapiens
accucuuuauuuuuugauugaa

SEQ ID NO: 886364 - RNA, 17 nt, Homo sapiens
accucuuugucagucug

SEQ ID NO: 886365 - RNA, 20 nt, Homo sapiens
accugaaaaaaaguuuacaa

SEQ ID NO: 886366 - RNA, 19 nt, Homo sapiens
accugaaccugggaaccau

SEQ ID NO: 886367 - RNA, 20 nt, Homo sapiens
accugaagggugacauccca

SEQ ID NO: 886368 - RNA, 18 nt, Homo sapiens
accugacaauggcagcua

SEQ ID NO: 886369 - RNA, 14 nt, Homo sapiens
accugacacaagag

SEQ ID NO: 886370 - RNA, 13 nt, Homo sapiens
accugagccugcc

SEQ ID NO: 886371 - RNA, 19 nt, Homo sapiens
accugaggcuccugugcua

SEQ ID NO: 886372 - RNA, 20 nt, Homo sapiens
accugaggcuccugugcuac

SEQ ID NO: 886373 - RNA, 16 nt, Homo sapiens
accugaucccacgagg

SEQ ID NO: 886374 - RNA, 13 nt, Homo sapiens
accugcaggccaa

SEQ ID NO: 886375 - RNA, 22 nt, Homo sapiens
accugcauguguuguacaauac

SEQ ID NO: 886376 - RNA, 19 nt, Homo sapiens
accugcccacccacuccuu

SEQ ID NO: 886377 - RNA, 19 nt, Homo sapiens
accugcucuccucuugcca

SEQ ID NO: 886378 - RNA, 18 nt, Homo sapiens
accugcugagcucugaga

SEQ ID NO: 886379 - RNA, 17 nt, Homo sapiens
accuggagaugaugaug

SEQ ID NO: 886380 - RNA, 18 nt, Homo sapiens
accuggagaugaugauga

SEQ ID NO: 886381 - RNA, 21 nt, Homo sapiens
accuggagggcuagaaccuag

SEQ ID NO: 886382 - RNA, 22 nt, Homo sapiens
accuggagggcuagaaccuaga

SEQ ID NO: 886383 - RNA, 16 nt, Homo sapiens
accugggcccuggggc

SEQ ID NO: 886384 - RNA, 14 nt, Homo sapiens
accugugcacccca

SEQ ID NO: 886385 - RNA, 19 nt, Homo sapiens
accuguggugauguugcca

SEQ ID NO: 886386 - RNA, 19 nt, Homo sapiens
accuguguuucuugccuca

SEQ ID NO: 886387 - RNA, 15 nt, Homo sapiens
accuguuacuugaaa

SEQ ID NO: 886388 - RNA, 19 nt, Homo sapiens
accuguuuuuaagcuguuu

SEQ ID NO: 886389 - RNA, 17 nt, Homo sapiens
accuuaaucugccauaa

SEQ ID NO: 886390 - RNA, 23 nt, Homo sapiens
accuuaaucugccauaaagccau

SEQ ID NO: 886391 - RNA, 17 nt, Homo sapiens
accuuauuguaccucuc

SEQ ID NO: 886392 - RNA, 19 nt, Homo sapiens
accuucagauuuguguuau

SEQ ID NO: 886393 - RNA, 16 nt, Homo sapiens
accuucaucagaccac

SEQ ID NO: 886394 - RNA, 12 nt, Homo sapiens
accuucauccau

SEQ ID NO: 886395 - RNA, 14 nt, Homo sapiens
accuucaugucacu

SEQ ID NO: 886396 - RNA, 15 nt, Homo sapiens
accuuccacacaggg

SEQ ID NO: 886397 - RNA, 16 nt, Homo sapiens
accuucccaugcccug

SEQ ID NO: 886398 - RNA, 18 nt, Homo sapiens
accuucccucuuucuaca

SEQ ID NO: 886399 - RNA, 15 nt, Homo sapiens
accuugcuccugugu

SEQ ID NO: 886400 - RNA, 14 nt, Homo sapiens
accuuggagccuga

SEQ ID NO: 886401 - RNA, 17 nt, Homo sapiens
accuugugucuguacac

SEQ ID NO: 886402 - RNA, 21 nt, Homo sapiens
accuuuauuaaugaacuguga

SEQ ID NO: 886403 - RNA, 23 nt, Homo sapiens
accuuuauuaaugaacugugaca

SEQ ID NO: 886404 - RNA, 17 nt, Homo sapiens
accuuucaaauuucaca

SEQ ID NO: 886405 - RNA, 19 nt, Homo sapiens
accuuuggaugcacuuuau

SEQ ID NO: 886406 - RNA, 14 nt, Homo sapiens
accuuuguguaaua

SEQ ID NO: 886407 - RNA, 14 nt, Homo sapiens
accuuuugucucac

SEQ ID NO: 886408 - RNA, 15 nt, Homo sapiens
acgaaacacaaacca

SEQ ID NO: 886409 - RNA, 13 nt, Homo sapiens
acgaaggggcccc

SEQ ID NO: 886410 - RNA, 13 nt, Homo sapiens
acgaauugagaua

SEQ ID NO: 886411 - RNA, 19 nt, Homo sapiens
acgacaaagcaucauugua

SEQ ID NO: 886412 - RNA, 21 nt, Homo sapiens
acgacaaagcaucauuguaaa

SEQ ID NO: 886413 - RNA, 22 nt, Homo sapiens
acgacaagauuuucuacuuuuu

SEQ ID NO: 886414 - RNA, 12 nt, Homo sapiens
acgagcuauauu

SEQ ID NO: 886415 - RNA, 20 nt, Homo sapiens
acgaugaaauugaaccuggu

SEQ ID NO: 886416 - RNA, 22 nt, Homo sapiens
acgauuuugcacaaauauccac

SEQ ID NO: 886417 - RNA, 17 nt, Homo sapiens
acgcacaugccaaugca

SEQ ID NO: 886418 - RNA, 11 nt, Homo sapiens
acgcagaucac

SEQ ID NO: 886419 - RNA, 22 nt, Homo sapiens
acgcagcccugggggccagcug

SEQ ID NO: 886420 - RNA, 23 nt, Homo sapiens
acgcagccugcagacucacugug

SEQ ID NO: 886421 - RNA, 21 nt, Homo sapiens
acgccaaugcacacacacaga

SEQ ID NO: 886422 - RNA, 20 nt, Homo sapiens
acgccacucauuucaucuca

SEQ ID NO: 886423 - RNA, 20 nt, Homo sapiens
acgccccgaaccucaccuga

SEQ ID NO: 886424 - RNA, 22 nt, Homo sapiens
acgccccucccuccucuggccc

SEQ ID NO: 886425 - RNA, 17 nt, Homo sapiens
acgccuguaaucccagc

SEQ ID NO: 886426 - RNA, 14 nt, Homo sapiens
acgcgggcgcugcc

SEQ ID NO: 886427 - RNA, 20 nt, Homo sapiens
acgcucccccgcagucccca

SEQ ID NO: 886428 - RNA, 21 nt, Homo sapiens
acggaaggcaaagagaccacu

SEQ ID NO: 886429 - RNA, 20 nt, Homo sapiens
acggaauaaugaguuagaac

SEQ ID NO: 886430 - RNA, 21 nt, Homo sapiens
acggagcugaagcugggagcu

SEQ ID NO: 886431 - RNA, 12 nt, Homo sapiens
acggaugcacag

SEQ ID NO: 886432 - RNA, 13 nt, Homo sapiens
acggggacugggg

SEQ ID NO: 886433 - RNA, 23 nt, Homo sapiens
acgggguuucaccacauucguca

SEQ ID NO: 886434 - RNA, 14 nt, Homo sapiens
acggugaaauccag

SEQ ID NO: 886435 - RNA, 17 nt, Homo sapiens
acggugaaccgcaugga

SEQ ID NO: 886436 - RNA, 18 nt, Homo sapiens
accaacccuguuuccuga

SEQ ID NO: 886437 - RNA, 15 nt, Homo sapiens
accaagacucugaaa

SEQ ID NO: 886438 - RNA, 23 nt, Homo sapiens
accaagauagauccauuuggaca

SEQ ID NO: 886439 - RNA, 20 nt, Homo sapiens
accaaggggcugcuaguaua

SEQ ID NO: 886440 - RNA, 22 nt, Homo sapiens
accaaguguguugggaauugca

SEQ ID NO: 886441 - RNA, 13 nt, Homo sapiens
accaauauucaaa

SEQ ID NO: 886442 - RNA, 12 nt, Homo sapiens
accaauauuugu

SEQ ID NO: 886443 - RNA, 14 nt, Homo sapiens
accaaucauuuuaa

SEQ ID NO: 886444 - RNA, 21 nt, Homo sapiens
accaaugccaagauaauucac

SEQ ID NO: 886445 - RNA, 15 nt, Homo sapiens
accacaacugacaca

SEQ ID NO: 886446 - RNA, 19 nt, Homo sapiens
accacaacugacacaggaa

SEQ ID NO: 886447 - RNA, 15 nt, Homo sapiens
accacagugucugua

SEQ ID NO: 886448 - RNA, 15 nt, Homo sapiens
accacaugugcacau

SEQ ID NO: 886449 - RNA, 16 nt, Homo sapiens
accaccugccagccau

SEQ ID NO: 886450 - RNA, 22 nt, Homo sapiens
accacgaagcugugaacucaga

SEQ ID NO: 886451 - RNA, 14 nt, Homo sapiens
accacuauucuuaa

SEQ ID NO: 886452 - RNA, 15 nt, Homo sapiens
accacuccauuccca

SEQ ID NO: 886453 - RNA, 17 nt, Homo sapiens
accacuccauucccaac

SEQ ID NO: 886454 - RNA, 18 nt, Homo sapiens
accacugagccugagaug

SEQ ID NO: 886455 - RNA, 13 nt, Homo sapiens
accagaaguggac

SEQ ID NO: 886456 - RNA, 23 nt, Homo sapiens
accagacucguucuucugggaac

SEQ ID NO: 886457 - RNA, 22 nt, Homo sapiens
accagaggcugcagaaggccaa

SEQ ID NO: 886458 - RNA, 13 nt, Homo sapiens
accagauuugcua

SEQ ID NO: 886459 - RNA, 15 nt, Homo sapiens
accagcauauugugu

SEQ ID NO: 886460 - RNA, 14 nt, Homo sapiens
accagcaugucacu

SEQ ID NO: 886461 - RNA, 17 nt, Homo sapiens
accagccuaagaagcuc

SEQ ID NO: 886462 - RNA, 14 nt, Homo sapiens
accagcugccaaaa

SEQ ID NO: 886463 - RNA, 14 nt, Homo sapiens
accagcugcucugc

SEQ ID NO: 886464 - RNA, 21 nt, Homo sapiens
accagcuuguccaacaacucc

SEQ ID NO: 886465 - RNA, 16 nt, Homo sapiens
accaggacuauagccc

SEQ ID NO: 886466 - RNA, 17 nt, Homo sapiens
accaggacuauagccca

SEQ ID NO: 886467 - RNA, 21 nt, Homo sapiens
accaggggugauuucagagag

SEQ ID NO: 886468 - RNA, 22 nt, Homo sapiens
accaggguccgcaccagcugcu

SEQ ID NO: 886469 - RNA, 13 nt, Homo sapiens
accaguccaugag

SEQ ID NO: 886470 - RNA, 23 nt, Homo sapiens
accagugaaccaaagagacugga

SEQ ID NO: 886471 - RNA, 14 nt, Homo sapiens
accaguguacugcu

SEQ ID NO: 886472 - RNA, 23 nt, Homo sapiens
accagugugcuugcccaccacag

SEQ ID NO: 886473 - RNA, 15 nt, Homo sapiens
accaguuaugugaau

SEQ ID NO: 886474 - RNA, 17 nt, Homo sapiens
accaguugggagcacug

SEQ ID NO: 886475 - RNA, 20 nt, Homo sapiens
accauaaaaauccuucucac

SEQ ID NO: 886476 - RNA, 16 nt, Homo sapiens
accauaacaacuucau

SEQ ID NO: 886477 - RNA, 13 nt, Homo sapiens
accauaauguuac

SEQ ID NO: 886478 - RNA, 16 nt, Homo sapiens
accauaugcuguggac

SEQ ID NO: 886479 - RNA, 16 nt, Homo sapiens
accaucaguuacuggu

SEQ ID NO: 886480 - RNA, 22 nt, Homo sapiens
accaucauuauaaacgugauga

SEQ ID NO: 886481 - RNA, 21 nt, Homo sapiens
accauccuggcuaacacguga

SEQ ID NO: 886482 - RNA, 14 nt, Homo sapiens
accaucguccuucc

SEQ ID NO: 886483 - RNA, 13 nt, Homo sapiens
accaucuuggcca

SEQ ID NO: 886484 - RNA, 16 nt, Homo sapiens
accaugaaauauccag

SEQ ID NO: 886485 - RNA, 22 nt, Homo sapiens
accaugaagcuggaagcacugc

SEQ ID NO: 886486 - RNA, 22 nt, Homo sapiens
accaugagaccacuguuaucaa

SEQ ID NO: 886487 - RNA, 14 nt, Homo sapiens
accaugccauuuaa

SEQ ID NO: 886488 - RNA, 15 nt, Homo sapiens
accaugcgcugcuca

SEQ ID NO: 886489 - RNA, 13 nt, Homo sapiens
accauguacauga

SEQ ID NO: 886490 - RNA, 20 nt, Homo sapiens
accauguacaugaagaagcu

SEQ ID NO: 886491 - RNA, 14 nt, Homo sapiens
accauuacuguaau

SEQ ID NO: 886492 - RNA, 14 nt, Homo sapiens
accauuucagagag

SEQ ID NO: 886493 - RNA, 12 nt, Homo sapiens
acccaaagacca

SEQ ID NO: 886494 - RNA, 15 nt, Homo sapiens
acccacaucuaaugu

SEQ ID NO: 886495 - RNA, 17 nt, Homo sapiens
acccacaucuaaugucu

SEQ ID NO: 886496 - RNA, 16 nt, Homo sapiens
acccaccaucaugucu

SEQ ID NO: 886497 - RNA, 21 nt, Homo sapiens
acccacccagugucuuucgag

SEQ ID NO: 886498 - RNA, 12 nt, Homo sapiens
acccaccucagc

SEQ ID NO: 886499 - RNA, 16 nt, Homo sapiens
acccaccuguacucug

SEQ ID NO: 886500 - RNA, 14 nt, Homo sapiens
acccacuaacaaag

SEQ ID NO: 886501 - RNA, 14 nt, Homo sapiens
acccacucacacuu

SEQ ID NO: 886502 - RNA, 14 nt, Homo sapiens
acccagaacuggac

SEQ ID NO: 886503 - RNA, 15 nt, Homo sapiens
acccagauuuccuaa

SEQ ID NO: 886504 - RNA, 13 nt, Homo sapiens
acccagcaaagag

SEQ ID NO: 886505 - RNA, 16 nt, Homo sapiens
acccagcauguacaaa

SEQ ID NO: 886506 - RNA, 15 nt, Homo sapiens
acccagggugcauua

SEQ ID NO: 886507 - RNA, 22 nt, Homo sapiens
acccagguuggcgacugcaaca

SEQ ID NO: 886508 - RNA, 23 nt, Homo sapiens
  misc_feature (7)..(7): n is a, c, g or u
acccagnagggcgucgcuggaca

SEQ ID NO: 886509 - RNA, 15 nt, Homo sapiens
acccaguauaugcua

SEQ ID NO: 886510 - RNA, 19 nt, Homo sapiens
acccagucccagaaccaca

SEQ ID NO: 886511 - RNA, 22 nt, Homo sapiens
acccaguccgccaaacacucca

SEQ ID NO: 886512 - RNA, 23 nt, Homo sapiens
acccauagugcacacuuguauau

SEQ ID NO: 886513 - RNA, 17 nt, Homo sapiens
acccaucagacagguaa

SEQ ID NO: 886514 - RNA, 16 nt, Homo sapiens
acccaugaaucaaaga

SEQ ID NO: 886515 - RNA, 21 nt, Homo sapiens
accccaacacccccaagacag

SEQ ID NO: 886516 - RNA, 13 nt, Homo sapiens
accccaccacuuc

SEQ ID NO: 886517 - RNA, 13 nt, Homo sapiens
accccacccaagu

SEQ ID NO: 886518 - RNA, 13 nt, Homo sapiens
accccaccuugcc

SEQ ID NO: 886519 - RNA, 22 nt, Homo sapiens
accccaggaucccagagcuucc

SEQ ID NO: 886520 - RNA, 18 nt, Homo sapiens
accccaucaccuacucac

SEQ ID NO: 886521 - RNA, 15 nt, Homo sapiens
accccaucucuacua

SEQ ID NO: 886522 - RNA, 17 nt, Homo sapiens
accccauuuguggucac

SEQ ID NO: 886523 - RNA, 13 nt, Homo sapiens
accccuacaugaa

SEQ ID NO: 886524 - RNA, 18 nt, Homo sapiens
accccugauaagcaaauu

SEQ ID NO: 886525 - RNA, 13 nt, Homo sapiens
accccugucucua

SEQ ID NO: 886526 - RNA, 20 nt, Homo sapiens
acccgagcuagagugcagug

SEQ ID NO: 886527 - RNA, 15 nt, Homo sapiens
acccgcucuggacca

SEQ ID NO: 886528 - RNA, 22 nt, Homo sapiens
acccggcaggcuagaaccuggc

SEQ ID NO: 886529 - RNA, 22 nt, Homo sapiens
acccggcucccccugcuucuca

SEQ ID NO: 886530 - RNA, 21 nt, Homo sapiens
acccgguuaccuuggccguga

SEQ ID NO: 886531 - RNA, 15 nt, Homo sapiens
acccuaaauguggac

SEQ ID NO: 886532 - RNA, 19 nt, Homo sapiens
acccuaaugcuaguuucau

SEQ ID NO: 886533 - RNA, 15 nt, Homo sapiens
acccucaaaugucag

SEQ ID NO: 886534 - RNA, 22 nt, Homo sapiens
acccuccuuucaccacaugugc

SEQ ID NO: 886535 - RNA, 14 nt, Homo sapiens
acccucucuucccu

SEQ ID NO: 886536 - RNA, 16 nt, Homo sapiens
acccugcccacuccca

SEQ ID NO: 886537 - RNA, 18 nt, Homo sapiens
acccuggaauucagcacc

SEQ ID NO: 886538 - RNA, 19 nt, Homo sapiens
acccuguagguucuugaua

SEQ ID NO: 886539 - RNA, 19 nt, Homo sapiens
acccugucuaaaaaacaua

SEQ ID NO: 886540 - RNA, 18 nt, Homo sapiens
acccuguuuucagcuaaa

SEQ ID NO: 886541 - RNA, 22 nt, Homo sapiens
acccuucccaaucagcacugaa

SEQ ID NO: 886542 - RNA, 16 nt, Homo sapiens
accgagucucuucucc

SEQ ID NO: 886543 - RNA, 23 nt, Homo sapiens
accgauuugcacccaugccauag

SEQ ID NO: 886544 - RNA, 21 nt, Homo sapiens
accgcauggaacagugcagga

SEQ ID NO: 886545 - RNA, 15 nt, Homo sapiens
accgggcugggagcu

SEQ ID NO: 886546 - RNA, 16 nt, Homo sapiens
accgggguucaagcca

SEQ ID NO: 886547 - RNA, 15 nt, Homo sapiens
accgucccucaguga

SEQ ID NO: 886548 - RNA, 19 nt, Homo sapiens
accguggaccuuccugcca

SEQ ID NO: 886549 - RNA, 17 nt, Homo sapiens
accguggcccuuccugg

SEQ ID NO: 886550 - RNA, 22 nt, Homo sapiens
accuaaacauagaaauugccug

SEQ ID NO: 886551 - RNA, 20 nt, Homo sapiens
augaagcaagccccacuuau

SEQ ID NO: 886552 - RNA, 12 nt, Homo sapiens
augaagcuggaa

SEQ ID NO: 886553 - RNA, 20 nt, Homo sapiens
augaaggacgugucucagga

SEQ ID NO: 886554 - RNA, 18 nt, Homo sapiens
augaaguuauucuugaca

SEQ ID NO: 886555 - RNA, 21 nt, Homo sapiens
augaauauuuuugucauuaaa

SEQ ID NO: 886556 - RNA, 21 nt, Homo sapiens
augaaucccacccacauguga

SEQ ID NO: 886557 - RNA, 19 nt, Homo sapiens
augaaugaggucccaggca

SEQ ID NO: 886558 - RNA, 23 nt, Homo sapiens
augaauguuuacacucuuuguaa

SEQ ID NO: 886559 - RNA, 19 nt, Homo sapiens
augaauugcauuuuacuuu

SEQ ID NO: 886560 - RNA, 13 nt, Homo sapiens
augaauugucuuc

SEQ ID NO: 886561 - RNA, 15 nt, Homo sapiens
augaauuuacuacuu

SEQ ID NO: 886562 - RNA, 14 nt, Homo sapiens
augacaaacccagg

SEQ ID NO: 886563 - RNA, 11 nt, Homo sapiens
augacacugac

SEQ ID NO: 886564 - RNA, 23 nt, Homo sapiens
augacagggaugccaacaccuuc

SEQ ID NO: 886565 - RNA, 15 nt, Homo sapiens
augacaucaacauuc

SEQ ID NO: 886566 - RNA, 16 nt, Homo sapiens
augacaucaacauucc

SEQ ID NO: 886567 - RNA, 23 nt, Homo sapiens
auggcggcccccccagcugucau

SEQ ID NO: 886568 - RNA, 18 nt, Homo sapiens
auggcucuggcaccacua

SEQ ID NO: 886569 - RNA, 23 nt, Homo sapiens
auggcucuucaccugggcgccaa

SEQ ID NO: 886570 - RNA, 15 nt, Homo sapiens
auggcuggggggcca

SEQ ID NO: 886571 - RNA, 17 nt, Homo sapiens
auggcugugccucugcc

SEQ ID NO: 886572 - RNA, 17 nt, Homo sapiens
augggaacaaggcaaug

SEQ ID NO: 886573 - RNA, 17 nt, Homo sapiens
augggaaccccuucauc

SEQ ID NO: 886574 - RNA, 20 nt, Homo sapiens
augggaauucuuuacaauaa

SEQ ID NO: 886575 - RNA, 13 nt, Homo sapiens
augggacugagcc

SEQ ID NO: 886576 - RNA, 12 nt, Homo sapiens
augggaucugua

SEQ ID NO: 886577 - RNA, 20 nt, Homo sapiens
augggcaaauuaaggcauaa

SEQ ID NO: 886578 - RNA, 18 nt, Homo sapiens
augggcucaagucacuuu

SEQ ID NO: 886579 - RNA, 14 nt, Homo sapiens
augggucaaagccg

SEQ ID NO: 886580 - RNA, 16 nt, Homo sapiens
augguaauuguugcua

SEQ ID NO: 886581 - RNA, 18 nt, Homo sapiens
auggucacaagcacaaag

SEQ ID NO: 886582 - RNA, 23 nt, Homo sapiens
auggucagcucacacccuaauaa

SEQ ID NO: 886583 - RNA, 20 nt, Homo sapiens
auggugaaaccucaucucua

SEQ ID NO: 886584 - RNA, 21 nt, Homo sapiens
auggugagagauaagaucuau

SEQ ID NO: 886585 - RNA, 17 nt, Homo sapiens
auggugggcacagaagu

SEQ ID NO: 886586 - RNA, 20 nt, Homo sapiens
augguucucagaucuugaca

SEQ ID NO: 886587 - RNA, 14 nt, Homo sapiens
augguuuacugcug

SEQ ID NO: 886588 - RNA, 21 nt, Homo sapiens
augguuugcaaggaagccaca

SEQ ID NO: 886589 - RNA, 21 nt, Homo sapiens
augguuuucuccaagagcuac

SEQ ID NO: 886590 - RNA, 17 nt, Homo sapiens
auguaaacccucaaggg

SEQ ID NO: 886591 - RNA, 14 nt, Homo sapiens
auguaacauuaauu

SEQ ID NO: 886592 - RNA, 21 nt, Homo sapiens
auguaacgaaugguacuacaa

SEQ ID NO: 886593 - RNA, 24 nt, Homo sapiens
auguaaggucuucuuguguccuga

SEQ ID NO: 886594 - RNA, 16 nt, Homo sapiens
auguaaugcauaggaa

SEQ ID NO: 886595 - RNA, 22 nt, Homo sapiens
auguaauuuagcaguccaaaga

SEQ ID NO: 886596 - RNA, 15 nt, Homo sapiens
auguacacacacaga

SEQ ID NO: 886597 - RNA, 21 nt, Homo sapiens
auguacacacacagaugcaca

SEQ ID NO: 886598 - RNA, 18 nt, Homo sapiens
auguaccacugagccuga

SEQ ID NO: 886599 - RNA, 19 nt, Homo sapiens
auguagccuggcccuggaa

SEQ ID NO: 886600 - RNA, 19 nt, Homo sapiens
auguaggcaauacauguau

SEQ ID NO: 886601 - RNA, 17 nt, Homo sapiens
auguauacacacauaua

SEQ ID NO: 886602 - RNA, 22 nt, Homo sapiens
auguauaucuauaucucuaaac

SEQ ID NO: 886603 - RNA, 22 nt, Homo sapiens
auguaucuaccucacuauucaa

SEQ ID NO: 886604 - RNA, 15 nt, Homo sapiens
auguaugcgugcaug

SEQ ID NO: 886605 - RNA, 20 nt, Homo sapiens
auguauggagcucuaaccca

SEQ ID NO: 886606 - RNA, 18 nt, Homo sapiens
auguauuguaaacaugug

SEQ ID NO: 886607 - RNA, 15 nt, Homo sapiens
auguauuugucaaug

SEQ ID NO: 886608 - RNA, 20 nt, Homo sapiens
auguauuugucaaugcauca

SEQ ID NO: 886609 - RNA, 22 nt, Homo sapiens
auguauuuuguauuugcauaug

SEQ ID NO: 886610 - RNA, 24 nt, Homo sapiens
auguauuuuguauuugcauaugua

SEQ ID NO: 886611 - RNA, 17 nt, Homo sapiens
auguauuuuugucauag

SEQ ID NO: 886612 - RNA, 23 nt, Homo sapiens
augucaaguaccaaaauguuaau

SEQ ID NO: 886613 - RNA, 13 nt, Homo sapiens
augucaccaccuu

SEQ ID NO: 886614 - RNA, 20 nt, Homo sapiens
augucaccguggaccuuccu

SEQ ID NO: 886615 - RNA, 15 nt, Homo sapiens
augucacugcucuug

SEQ ID NO: 886616 - RNA, 14 nt, Homo sapiens
augucagcuuaaaa

SEQ ID NO: 886617 - RNA, 21 nt, Homo sapiens
augucaggcaaagugcugcug

SEQ ID NO: 886618 - RNA, 18 nt, Homo sapiens
augucauauuggcaguug

SEQ ID NO: 886619 - RNA, 13 nt, Homo sapiens
augucaucaaaua

SEQ ID NO: 886620 - RNA, 21 nt, Homo sapiens
augucaucaaauauuaccaaa

SEQ ID NO: 886621 - RNA, 12 nt, Homo sapiens
augucauucauu

SEQ ID NO: 886622 - RNA, 15 nt, Homo sapiens
auguccaaguccaac

SEQ ID NO: 886623 - RNA, 23 nt, Homo sapiens
augucccuugcugugagcaagaa

SEQ ID NO: 886624 - RNA, 17 nt, Homo sapiens
auguccuguggugacag

SEQ ID NO: 886625 - RNA, 15 nt, Homo sapiens
augucgaacucugaa

SEQ ID NO: 886626 - RNA, 15 nt, Homo sapiens
augucucagaccacu

SEQ ID NO: 886627 - RNA, 14 nt, Homo sapiens
augucuccaucucu

SEQ ID NO: 886628 - RNA, 21 nt, Homo sapiens
augucucucagaauucuucag

SEQ ID NO: 886629 - RNA, 17 nt, Homo sapiens
augucucuuguagaaga

SEQ ID NO: 886630 - RNA, 17 nt, Homo sapiens
augucugccacagagag

SEQ ID NO: 886631 - RNA, 16 nt, Homo sapiens
augugaaaaauguguc

SEQ ID NO: 886632 - RNA, 14 nt, Homo sapiens
augugaacugcuga

SEQ ID NO: 886633 - RNA, 16 nt, Homo sapiens
augugacacauucucu

SEQ ID NO: 886634 - RNA, 19 nt, Homo sapiens
augugagcugucacugugg

SEQ ID NO: 886635 - RNA, 14 nt, Homo sapiens
augugauaucugaa

SEQ ID NO: 886636 - RNA, 18 nt, Homo sapiens
augugauuuauuuugaaa

SEQ ID NO: 886637 - RNA, 11 nt, Homo sapiens
augugccaagg

SEQ ID NO: 886638 - RNA, 20 nt, Homo sapiens
auguggaguggacauucaaa

SEQ ID NO: 886639 - RNA, 18 nt, Homo sapiens
augugggagggagcagac

SEQ ID NO: 886640 - RNA, 18 nt, Homo sapiens
auguguagccugugcaug

SEQ ID NO: 886641 - RNA, 12 nt, Homo sapiens
auguguauauau

SEQ ID NO: 886642 - RNA, 19 nt, Homo sapiens
augugugaaggucuugccu

SEQ ID NO: 886643 - RNA, 16 nt, Homo sapiens
auguguggauguguaa

SEQ ID NO: 886644 - RNA, 14 nt, Homo sapiens
auguguggugcuaa

SEQ ID NO: 886645 - RNA, 20 nt, Homo sapiens
auguguugccuggaagcaca

SEQ ID NO: 886646 - RNA, 23 nt, Homo sapiens
auguuaagcaaaggaaaccaaag

SEQ ID NO: 886647 - RNA, 19 nt, Homo sapiens
auguuaauuaaacugaaga

SEQ ID NO: 886648 - RNA, 17 nt, Homo sapiens
auguuacacuaagggug

SEQ ID NO: 886649 - RNA, 21 nt, Homo sapiens
auguuagauuccucuugccuc

SEQ ID NO: 886650 - RNA, 19 nt, Homo sapiens
auguuaggaaaauuucaca

SEQ ID NO: 886651 - RNA, 23 nt, Homo sapiens
auguuaggaaaauuucacauuaa

SEQ ID NO: 886652 - RNA, 22 nt, Homo sapiens
auguucacuuauugacuauuau

SEQ ID NO: 886653 - RNA, 19 nt, Homo sapiens
auguuccaauaaaacuuua

SEQ ID NO: 886654 - RNA, 14 nt, Homo sapiens
auguucugggacac

SEQ ID NO: 886655 - RNA, 20 nt, Homo sapiens
auguucugggacacaguuca

SEQ ID NO: 886656 - RNA, 18 nt, Homo sapiens
auguugagcugaguuccu

SEQ ID NO: 886657 - RNA, 23 nt, Homo sapiens
auguugcaugccuauguacucua

SEQ ID NO: 886658 - RNA, 13 nt, Homo sapiens
auguuggucaaaa

SEQ ID NO: 886659 - RNA, 18 nt, Homo sapiens
auguuguaauucaugcca

SEQ ID NO: 886660 - RNA, 15 nt, Homo sapiens
auguuucacaacagg

SEQ ID NO: 886661 - RNA, 21 nt, Homo sapiens
auguuucaggagagaguugaa

SEQ ID NO: 886662 - RNA, 22 nt, Homo sapiens
auguuucugucacaucagcucc

SEQ ID NO: 886663 - RNA, 12 nt, Homo sapiens
auguuugcacuu

SEQ ID NO: 886664 - RNA, 14 nt, Homo sapiens
auguuugcacuuug

SEQ ID NO: 886665 - RNA, 17 nt, Homo sapiens
auguuugcuauugacaa

SEQ ID NO: 886666 - RNA, 16 nt, Homo sapiens
agucucacuguugccc

SEQ ID NO: 886667 - RNA, 23 nt, Homo sapiens
agucuccucucugagacugcuaa

SEQ ID NO: 886668 - RNA, 11 nt, Homo sapiens
agucucugugc

SEQ ID NO: 886669 - RNA, 13 nt, Homo sapiens
agucucuucugau

SEQ ID NO: 886670 - RNA, 17 nt, Homo sapiens
agucugauucccaagcu

SEQ ID NO: 886671 - RNA, 22 nt, Homo sapiens
agucugcauaaacuucaucuuc

SEQ ID NO: 886672 - RNA, 15 nt, Homo sapiens
agucugggugucuca

SEQ ID NO: 886673 - RNA, 15 nt, Homo sapiens
agucugguguucuga

SEQ ID NO: 886674 - RNA, 21 nt, Homo sapiens
agucuugguuccucuacuacu

SEQ ID NO: 886675 - RNA, 13 nt, Homo sapiens
agucuugucagaa

SEQ ID NO: 886676 - RNA, 19 nt, Homo sapiens
agucuugucauugccagcu

SEQ ID NO: 886677 - RNA, 17 nt, Homo sapiens
agugaaaauaauuuguu

SEQ ID NO: 886678 - RNA, 18 nt, Homo sapiens
agugaaagagaguaccau

SEQ ID NO: 886679 - RNA, 18 nt, Homo sapiens
agugaaagaguagugcau

SEQ ID NO: 886680 - RNA, 14 nt, Homo sapiens
agugaaauaauuaa

SEQ ID NO: 886681 - RNA, 17 nt, Homo sapiens
agugaacacacucagca

SEQ ID NO: 886682 - RNA, 16 nt, Homo sapiens
agugaagaugccagug

SEQ ID NO: 886683 - RNA, 18 nt, Homo sapiens
agugaauaaccacuuaaa

SEQ ID NO: 886684 - RNA, 11 nt, Homo sapiens
agugacagagg

SEQ ID NO: 886685 - RNA, 15 nt, Homo sapiens
agugacauccaggag

SEQ ID NO: 886686 - RNA, 19 nt, Homo sapiens
agugacccacaugccauuu

SEQ ID NO: 886687 - RNA, 21 nt, Homo sapiens
agugaccgaaagguuauguua

SEQ ID NO: 886688 - RNA, 20 nt, Homo sapiens
agugagacaaucacagcucc

SEQ ID NO: 886689 - RNA, 15 nt, Homo sapiens
agugagaucuucaau

SEQ ID NO: 886690 - RNA, 22 nt, Homo sapiens
agugauaucaccucucuucagc

SEQ ID NO: 886691 - RNA, 20 nt, Homo sapiens
agugaucucccugaacauuu

SEQ ID NO: 886692 - RNA, 19 nt, Homo sapiens
agugaugacuggcuugaga

SEQ ID NO: 886693 - RNA, 16 nt, Homo sapiens
agugauguacgagcug

SEQ ID NO: 886694 - RNA, 17 nt, Homo sapiens
agugauugauagagugu

SEQ ID NO: 886695 - RNA, 16 nt, Homo sapiens
agugauuugccucaac

SEQ ID NO: 886696 - RNA, 18 nt, Homo sapiens
agugcaaaguuauucccc

SEQ ID NO: 886697 - RNA, 17 nt, Homo sapiens
agugcaaauuugauaca

SEQ ID NO: 886698 - RNA, 19 nt, Homo sapiens
agugcacacggaugcacag

SEQ ID NO: 886699 - RNA, 21 nt, Homo sapiens
agugcagagaaagaaagggaa

SEQ ID NO: 886700 - RNA, 14 nt, Homo sapiens
agugcaucucagcc

SEQ ID NO: 886701 - RNA, 18 nt, Homo sapiens
agugccaauauuucugau

SEQ ID NO: 886702 - RNA, 16 nt, Homo sapiens
agugccacucauuccu

SEQ ID NO: 886703 - RNA, 16 nt, Homo sapiens
agugcccagcaugaag

SEQ ID NO: 886704 - RNA, 14 nt, Homo sapiens
agugcccucaucca

SEQ ID NO: 886705 - RNA, 14 nt, Homo sapiens
agugccuaccccag

SEQ ID NO: 886706 - RNA, 14 nt, Homo sapiens
agugccugagaugc

SEQ ID NO: 886707 - RNA, 16 nt, Homo sapiens
agugcgccuugcaaaa

SEQ ID NO: 886708 - RNA, 22 nt, Homo sapiens
agugcuaagaaagcaagccaau

SEQ ID NO: 886709 - RNA, 12 nt, Homo sapiens
agugcuaccucu

SEQ ID NO: 886710 - RNA, 16 nt, Homo sapiens
agugcuagcuagccag

SEQ ID NO: 886711 - RNA, 15 nt, Homo sapiens
agugcuaugccaagc

SEQ ID NO: 886712 - RNA, 14 nt, Homo sapiens
acgguggucuuuga

SEQ ID NO: 886713 - RNA, 20 nt, Homo sapiens
acgguguugcagagacgcaa

SEQ ID NO: 886714 - RNA, 13 nt, Homo sapiens
acgucuugcuauu

SEQ ID NO: 886715 - RNA, 16 nt, Homo sapiens
acgugaagccacagga

SEQ ID NO: 886716 - RNA, 16 nt, Homo sapiens
acgugccagcucuagu

SEQ ID NO: 886717 - RNA, 13 nt, Homo sapiens
acgugucucagga

SEQ ID NO: 886718 - RNA, 19 nt, Homo sapiens
acgugugcagacuguggcu

SEQ ID NO: 886719 - RNA, 19 nt, Homo sapiens
acguuacugcauacugauc

SEQ ID NO: 886720 - RNA, 22 nt, Homo sapiens
acguugccuaauaaacauccuu

SEQ ID NO: 886721 - RNA, 20 nt, Homo sapiens
acguuggccuaacacugggc

SEQ ID NO: 886722 - RNA, 14 nt, Homo sapiens
acuaaaaaucauga

SEQ ID NO: 886723 - RNA, 18 nt, Homo sapiens
acuaaacaacuaccuccu

SEQ ID NO: 886724 - RNA, 20 nt, Homo sapiens
acuaaccccaacgcacagga

SEQ ID NO: 886725 - RNA, 17 nt, Homo sapiens
acuaaggugugcucuga

SEQ ID NO: 886726 - RNA, 17 nt, Homo sapiens
acuaauauccugucucu

SEQ ID NO: 886727 - RNA, 14 nt, Homo sapiens
acuacacuaauaaa

SEQ ID NO: 886728 - RNA, 17 nt, Homo sapiens
acuacaggcucaugcca

SEQ ID NO: 886729 - RNA, 21 nt, Homo sapiens
acuacaguguuuuccuuugca

SEQ ID NO: 886730 - RNA, 13 nt, Homo sapiens
acuacaugcacuu

SEQ ID NO: 886731 - RNA, 18 nt, Homo sapiens
acuaccaaaugagcauua

SEQ ID NO: 886732 - RNA, 20 nt, Homo sapiens
acuaccaaaugagcauuagc

SEQ ID NO: 886733 - RNA, 22 nt, Homo sapiens
acuacuaaagugccuaccccag

SEQ ID NO: 886734 - RNA, 16 nt, Homo sapiens
acuacucuacuuccuc

SEQ ID NO: 886735 - RNA, 16 nt, Homo sapiens
acuagaaaacauucca

SEQ ID NO: 886736 - RNA, 13 nt, Homo sapiens
acuagaaccugga

SEQ ID NO: 886737 - RNA, 15 nt, Homo sapiens
acuagaacucuccau

SEQ ID NO: 886738 - RNA, 13 nt, Homo sapiens
acuagacauuacc

SEQ ID NO: 886739 - RNA, 15 nt, Homo sapiens
acuagagcucaggcc

SEQ ID NO: 886740 - RNA, 22 nt, Homo sapiens
acuagagcugggaaacagggag

SEQ ID NO: 886741 - RNA, 11 nt, Homo sapiens
acuagaucucc

SEQ ID NO: 886742 - RNA, 15 nt, Homo sapiens
acuagccugugauua

SEQ ID NO: 886743 - RNA, 21 nt, Homo sapiens
acuaggaccucauaucuuccu

SEQ ID NO: 886744 - RNA, 12 nt, Homo sapiens
acuaguaacaug

SEQ ID NO: 886745 - RNA, 17 nt, Homo sapiens
acuaguugaacaucuca

SEQ ID NO: 886746 - RNA, 21 nt, Homo sapiens
acuaguugaacaucucacuuu

SEQ ID NO: 886747 - RNA, 15 nt, Homo sapiens
acuaguuuccagugg

SEQ ID NO: 886748 - RNA, 14 nt, Homo sapiens
acuauaaacuacug

SEQ ID NO: 886749 - RNA, 21 nt, Homo sapiens
acuauaaagcaguagacaauc

SEQ ID NO: 886750 - RNA, 20 nt, Homo sapiens
acuauaaucucuugaauuug

SEQ ID NO: 886751 - RNA, 13 nt, Homo sapiens
acuauacaacaau

SEQ ID NO: 886752 - RNA, 16 nt, Homo sapiens
acuauauucucagugu

SEQ ID NO: 886753 - RNA, 14 nt, Homo sapiens
acuaucacauacaa

SEQ ID NO: 886754 - RNA, 18 nt, Homo sapiens
acuauccaacuuaacaug

SEQ ID NO: 886755 - RNA, 12 nt, Homo sapiens
acuaugugaugu

SEQ ID NO: 886756 - RNA, 15 nt, Homo sapiens
acuauguuucuauuc

SEQ ID NO: 886757 - RNA, 16 nt, Homo sapiens
acuauuaaaacagcca

SEQ ID NO: 886758 - RNA, 16 nt, Homo sapiens
acuauuaaagugccau

SEQ ID NO: 886759 - RNA, 17 nt, Homo sapiens
acuauuaagagcaauaa

SEQ ID NO: 886760 - RNA, 15 nt, Homo sapiens
acuauuagacaugaa

SEQ ID NO: 886761 - RNA, 20 nt, Homo sapiens
agggacugacaaaagacuug

SEQ ID NO: 886762 - RNA, 17 nt, Homo sapiens
agggacuuuagagaaua

SEQ ID NO: 886763 - RNA, 13 nt, Homo sapiens
agggagacagaga

SEQ ID NO: 886764 - RNA, 15 nt, Homo sapiens
agggagacugcaucu

SEQ ID NO: 886765 - RNA, 14 nt, Homo sapiens
agggagcacugggu

SEQ ID NO: 886766 - RNA, 23 nt, Homo sapiens
agggaggcuuccugacugacaca

SEQ ID NO: 886767 - RNA, 23 nt, Homo sapiens
agggauaacacugucuaccucac

SEQ ID NO: 886768 - RNA, 16 nt, Homo sapiens
agggaugacugugauu

SEQ ID NO: 886769 - RNA, 22 nt, Homo sapiens
agggaugccacccagcaacaca

SEQ ID NO: 886770 - RNA, 19 nt, Homo sapiens
agggaugcugccugaguca

SEQ ID NO: 886771 - RNA, 23 nt, Homo sapiens
agggauggggcagucucugccca

SEQ ID NO: 886772 - RNA, 13 nt, Homo sapiens
agggauguaucaa

SEQ ID NO: 886773 - RNA, 16 nt, Homo sapiens
agggauuccccuaacc

SEQ ID NO: 886774 - RNA, 23 nt, Homo sapiens
agggcaacaauacaugcugcuaa

SEQ ID NO: 886775 - RNA, 19 nt, Homo sapiens
agggcagugacaaguggag

SEQ ID NO: 886776 - RNA, 18 nt, Homo sapiens
agggccaagcaccuagcc

SEQ ID NO: 886777 - RNA, 17 nt, Homo sapiens
agggcccagcuguagcc

SEQ ID NO: 886778 - RNA, 16 nt, Homo sapiens
agggccccagcacuaa

SEQ ID NO: 886779 - RNA, 23 nt, Homo sapiens
agggcuagaaccuggagagcuag

SEQ ID NO: 886780 - RNA, 23 nt, Homo sapiens
agggcuagaaucuggagagcuag

SEQ ID NO: 886781 - RNA, 12 nt, Homo sapiens
agggcucugagg

SEQ ID NO: 886782 - RNA, 22 nt, Homo sapiens
agggcugccccuguagguugcu

SEQ ID NO: 886783 - RNA, 17 nt, Homo sapiens
agggcuuauccaugccu

SEQ ID NO: 886784 - RNA, 15 nt, Homo sapiens
agggcuuucucagga

SEQ ID NO: 886785 - RNA, 21 nt, Homo sapiens
aggggaccacaccucccugaa

SEQ ID NO: 886786 - RNA, 23 nt, Homo sapiens
aggggaccaugaagagacucucu

SEQ ID NO: 886787 - RNA, 21 nt, Homo sapiens
aggggauagagagagaccacu

SEQ ID NO: 886788 - RNA, 20 nt, Homo sapiens
aggggccugcccagugcacu

SEQ ID NO: 886789 - RNA, 14 nt, Homo sapiens
aggggccugggaaa

SEQ ID NO: 886790 - RNA, 20 nt, Homo sapiens
agggggguugugaggccugg

SEQ ID NO: 886791 - RNA, 19 nt, Homo sapiens
agggguacauuucccugug

SEQ ID NO: 886792 - RNA, 22 nt, Homo sapiens
agggguacauuucccugugcug

SEQ ID NO: 886793 - RNA, 15 nt, Homo sapiens
aggggugcugcuccu

SEQ ID NO: 886794 - RNA, 19 nt, Homo sapiens
agggguggaguuuuguaua

SEQ ID NO: 886795 - RNA, 18 nt, Homo sapiens
aggggugugauuggagug

SEQ ID NO: 886796 - RNA, 18 nt, Homo sapiens
aggguaagacaauaugaa

SEQ ID NO: 886797 - RNA, 21 nt, Homo sapiens
aggguaccuugaacacugggg

SEQ ID NO: 886798 - RNA, 20 nt, Homo sapiens
aggguagauaaccuguacuu

SEQ ID NO: 886799 - RNA, 23 nt, Homo sapiens
aggguagucugguuucuagacuu

SEQ ID NO: 886800 - RNA, 22 nt, Homo sapiens
agggucacuaaccaagccagaa

SEQ ID NO: 886801 - RNA, 14 nt, Homo sapiens
agggucuggcuguc

SEQ ID NO: 886802 - RNA, 22 nt, Homo sapiens
agggugguuuggcaacaccucc

SEQ ID NO: 886803 - RNA, 15 nt, Homo sapiens
aggguguaucuagcu

SEQ ID NO: 886804 - RNA, 22 nt, Homo sapiens
aggguugggguagcccauguua

SEQ ID NO: 886805 - RNA, 23 nt, Homo sapiens
aggguuggguucaucugagcaag

SEQ ID NO: 886806 - RNA, 21 nt, Homo sapiens
agguaauucucccuaaggaau

SEQ ID NO: 886807 - RNA, 20 nt, Homo sapiens
agguagcccagcacugugaa

SEQ ID NO: 886808 - RNA, 13 nt, Homo sapiens
agguaugagccag

SEQ ID NO: 886809 - RNA, 14 nt, Homo sapiens
agguaugagccagg

SEQ ID NO: 886810 - RNA, 13 nt, Homo sapiens
aggucaacaucua

SEQ ID NO: 886811 - RNA, 12 nt, Homo sapiens
aggucacugggu

SEQ ID NO: 886812 - RNA, 20 nt, Homo sapiens
aggucagcgugcuuagccuc

SEQ ID NO: 886813 - RNA, 18 nt, Homo sapiens
aggucauuauuuuuuaca

SEQ ID NO: 886814 - RNA, 17 nt, Homo sapiens
aggucauuuucuauuca

SEQ ID NO: 886815 - RNA, 18 nt, Homo sapiens
aggucccugcuuaccuga

SEQ ID NO: 886816 - RNA, 16 nt, Homo sapiens
agguccucaguguccu

SEQ ID NO: 886817 - RNA, 23 nt, Homo sapiens
agguccuccucucucuacuugaa

SEQ ID NO: 886818 - RNA, 23 nt, Homo sapiens
agguccucuacuuaaugagauag

SEQ ID NO: 886819 - RNA, 13 nt, Homo sapiens
aggucuccaaaau

SEQ ID NO: 886820 - RNA, 15 nt, Homo sapiens
aggucucugaacuca

SEQ ID NO: 886821 - RNA, 16 nt, Homo sapiens
aggucugaaauggagg

SEQ ID NO: 886822 - RNA, 16 nt, Homo sapiens
aggucugacacgucug

SEQ ID NO: 886823 - RNA, 13 nt, Homo sapiens
aggugacagagug

SEQ ID NO: 886824 - RNA, 18 nt, Homo sapiens
aggugaugguaacugcac

SEQ ID NO: 886825 - RNA, 13 nt, Homo sapiens
aggugcaagagac

SEQ ID NO: 886826 - RNA, 15 nt, Homo sapiens
aggugcccaggagaa

SEQ ID NO: 886827 - RNA, 17 nt, Homo sapiens
aggugcuacaaaaacac

SEQ ID NO: 886828 - RNA, 20 nt, Homo sapiens
aggugcuacaaaaacacagc

SEQ ID NO: 886829 - RNA, 15 nt, Homo sapiens
aggugcugacaaaga

SEQ ID NO: 886830 - RNA, 17 nt, Homo sapiens
ggccuaugcacauaugg

SEQ ID NO: 886831 - RNA, 19 nt, Homo sapiens
ggccuccacucagcaguaa

SEQ ID NO: 886832 - RNA, 12 nt, Homo sapiens
ggccucccucaa

SEQ ID NO: 886833 - RNA, 15 nt, Homo sapiens
ggccucuuucugugc

SEQ ID NO: 886834 - RNA, 17 nt, Homo sapiens
ggccugcugcugagaac

SEQ ID NO: 886835 - RNA, 20 nt, Homo sapiens
ggccuggccccuucuccucu

SEQ ID NO: 886836 - RNA, 16 nt, Homo sapiens
ggccuucacagugacc

SEQ ID NO: 886837 - RNA, 16 nt, Homo sapiens
ggccuuguucugucac

SEQ ID NO: 886838 - RNA, 19 nt, Homo sapiens
ggccuuuuucauaaacuga

SEQ ID NO: 886839 - RNA, 17 nt, Homo sapiens
ggcgaaucuacagaaca

SEQ ID NO: 886840 - RNA, 15 nt, Homo sapiens
ggcgaccccucagug

SEQ ID NO: 886841 - RNA, 13 nt, Homo sapiens
ggcgaguggcacg

SEQ ID NO: 886842 - RNA, 13 nt, Homo sapiens
ggcgcaugugcca

SEQ ID NO: 886843 - RNA, 23 nt, Homo sapiens
ggcggcacauuggcaguguguca

SEQ ID NO: 886844 - RNA, 14 nt, Homo sapiens
ggcggcuccagguc

SEQ ID NO: 886845 - RNA, 23 nt, Homo sapiens
ggcguagacuugacaacauccca

SEQ ID NO: 886846 - RNA, 19 nt, Homo sapiens
ggcuaaacaagggcaguga

SEQ ID NO: 886847 - RNA, 20 nt, Homo sapiens
ggcuaaacaagggcagugag

SEQ ID NO: 886848 - RNA, 19 nt, Homo sapiens
ggcuaaaugaaguguguua

SEQ ID NO: 886849 - RNA, 12 nt, Homo sapiens
ggcuaagugauc

SEQ ID NO: 886850 - RNA, 17 nt, Homo sapiens
ggcuagaaccuggagaa

SEQ ID NO: 886851 - RNA, 16 nt, Homo sapiens
ggcuagaacuggagag

SEQ ID NO: 886852 - RNA, 12 nt, Homo sapiens
ggcuagucauaa

SEQ ID NO: 886853 - RNA, 19 nt, Homo sapiens
ggcucagcggggacagcuc

SEQ ID NO: 886854 - RNA, 13 nt, Homo sapiens
ggcucaugaccug

SEQ ID NO: 886855 - RNA, 22 nt, Homo sapiens
ggcuccacagaggccacaaaau

SEQ ID NO: 886856 - RNA, 18 nt, Homo sapiens
ggcuccugccuugaugaa

SEQ ID NO: 886857 - RNA, 18 nt, Homo sapiens
ggcuccugugcuacuuug

SEQ ID NO: 886858 - RNA, 15 nt, Homo sapiens
ggcucuaacgccuga

SEQ ID NO: 886859 - RNA, 18 nt, Homo sapiens
ggcucuggagccagagag

SEQ ID NO: 886860 - RNA, 19 nt, Homo sapiens
ggcugaauccgugguggca

SEQ ID NO: 886861 - RNA, 21 nt, Homo sapiens
ggcugaauccgugguggcacc

SEQ ID NO: 886862 - RNA, 23 nt, Homo sapiens
ggcugacaccuaccaugcugcuu

SEQ ID NO: 886863 - RNA, 19 nt, Homo sapiens
ggcugagagaggaagagcu

SEQ ID NO: 886864 - RNA, 12 nt, Homo sapiens
ggcugagcucuu

SEQ ID NO: 886865 - RNA, 14 nt, Homo sapiens
ggcugagcucuuau

SEQ ID NO: 886866 - RNA, 15 nt, Homo sapiens
ggcugagcucuuauc

SEQ ID NO: 886867 - RNA, 18 nt, Homo sapiens
ggcugagugagccacaga

SEQ ID NO: 886868 - RNA, 11 nt, Homo sapiens
ggcugcacaga

SEQ ID NO: 886869 - RNA, 21 nt, Homo sapiens
ggcugcucgaagaacaauguc

SEQ ID NO: 886870 - RNA, 18 nt, Homo sapiens
ggcuggaaaagucacaca

SEQ ID NO: 886871 - RNA, 18 nt, Homo sapiens
ggcuggcugaguggaaug

SEQ ID NO: 886872 - RNA, 22 nt, Homo sapiens
ggcugggggccucagugccacu

SEQ ID NO: 886873 - RNA, 18 nt, Homo sapiens
ggcugguagagcagguga

SEQ ID NO: 886874 - RNA, 12 nt, Homo sapiens
ggcugguccuga

SEQ ID NO: 886875 - RNA, 15 nt, Homo sapiens
ggcugguuaauucca

SEQ ID NO: 886876 - RNA, 23 nt, Homo sapiens
ggcuguccauggcagcuggucuu

SEQ ID NO: 886877 - RNA, 10 nt, Homo sapiens
ggcugugagg

SEQ ID NO: 886878 - RNA, 16 nt, Homo sapiens
ggcuucaguggcagcu

SEQ ID NO: 886879 - RNA, 14 nt, Homo sapiens
ggcuucccaugucu

SEQ ID NO: 886880 - RNA, 22 nt, Homo sapiens
ggcuucggacagugcccaugca

SEQ ID NO: 886881 - RNA, 13 nt, Homo sapiens
ggcuucuccugac

SEQ ID NO: 886882 - RNA, 16 nt, Homo sapiens
ggcuugaaaugcauua

SEQ ID NO: 886883 - RNA, 22 nt, Homo sapiens
ggcuuucuggagaggagggaug

SEQ ID NO: 886884 - RNA, 12 nt, Homo sapiens
gggaaacuggcu

SEQ ID NO: 886885 - RNA, 13 nt, Homo sapiens
gggaacucuccaa

SEQ ID NO: 886886 - RNA, 14 nt, Homo sapiens
gggaagaaacacuc

SEQ ID NO: 886887 - RNA, 15 nt, Homo sapiens
gggaagagugcauuu

SEQ ID NO: 886888 - RNA, 17 nt, Homo sapiens
gggaaggcugcugugua

SEQ ID NO: 886889 - RNA, 20 nt, Homo sapiens
gggacaaaggagccugugaa

SEQ ID NO: 886890 - RNA, 14 nt, Homo sapiens
gggacaagaaucaa

SEQ ID NO: 886891 - RNA, 17 nt, Homo sapiens
gggacaauaaauuuugc

SEQ ID NO: 886892 - RNA, 22 nt, Homo sapiens
gggacagcgccaccucuuguca

SEQ ID NO: 886893 - RNA, 15 nt, Homo sapiens
gggacauuccaaaga

SEQ ID NO: 886894 - RNA, 16 nt, Homo sapiens
gggaccacaccucccu

SEQ ID NO: 886895 - RNA, 14 nt, Homo sapiens
gggaccagggaugg

SEQ ID NO: 886896 - RNA, 19 nt, Homo sapiens
gggaccuaagccacguuaa

SEQ ID NO: 886897 - RNA, 13 nt, Homo sapiens
gggacugagccug

SEQ ID NO: 886898 - RNA, 22 nt, Homo sapiens
gggagagaacuuaaaaaagcaa

SEQ ID NO: 886899 - RNA, 23 nt, Homo sapiens
gggagagacacucccagggacaa

SEQ ID NO: 886900 - RNA, 19 nt, Homo sapiens
guaucuaccucacuauuca

SEQ ID NO: 886901 - RNA, 20 nt, Homo sapiens
guaucuagcucuaguucaaa

SEQ ID NO: 886902 - RNA, 18 nt, Homo sapiens
guaucucggaccuuucag

SEQ ID NO: 886903 - RNA, 14 nt, Homo sapiens
guaucucuaugugg

SEQ ID NO: 886904 - RNA, 17 nt, Homo sapiens
guaugaucacggcucac

SEQ ID NO: 886905 - RNA, 15 nt, Homo sapiens
guaugggaagccaua

SEQ ID NO: 886906 - RNA, 22 nt, Homo sapiens
guauguauggaugcguggauau

SEQ ID NO: 886907 - RNA, 14 nt, Homo sapiens
guaugucugccuaa

SEQ ID NO: 886908 - RNA, 16 nt, Homo sapiens
guaugugcgugcaugu

SEQ ID NO: 886909 - RNA, 15 nt, Homo sapiens
guauguuauugcaua

SEQ ID NO: 886910 - RNA, 12 nt, Homo sapiens
guauuaaacuug

SEQ ID NO: 886911 - RNA, 18 nt, Homo sapiens
guauuauuuacaaugcag

SEQ ID NO: 886912 - RNA, 20 nt, Homo sapiens
guauuauuuacaaugcagaa

SEQ ID NO: 886913 - RNA, 20 nt, Homo sapiens
guauucauuuuuucuacccu

SEQ ID NO: 886914 - RNA, 18 nt, Homo sapiens
guauugacaggaauacuu

SEQ ID NO: 886915 - RNA, 13 nt, Homo sapiens
guauugccacaau

SEQ ID NO: 886916 - RNA, 14 nt, Homo sapiens
guauuuagugucuu

SEQ ID NO: 886917 - RNA, 18 nt, Homo sapiens
guauuugucaaugcauca

SEQ ID NO: 886918 - RNA, 21 nt, Homo sapiens
guauuuuaggcagggauuuga

SEQ ID NO: 886919 - RNA, 15 nt, Homo sapiens
guauuuuugucauag

SEQ ID NO: 886920 - RNA, 15 nt, Homo sapiens
guauuuuugucauau

SEQ ID NO: 886921 - RNA, 22 nt, Homo sapiens
gucaaaguaaaacuugcugccu

SEQ ID NO: 886922 - RNA, 21 nt, Homo sapiens
gucaacaaccaugccagggau

SEQ ID NO: 886923 - RNA, 22 nt, Homo sapiens
gucaacuucagagacuaucuga

SEQ ID NO: 886924 - RNA, 16 nt, Homo sapiens
gucaagcgugcagcuu

SEQ ID NO: 886925 - RNA, 23 nt, Homo sapiens
gucaauaccccuguuaagcaauu

SEQ ID NO: 886926 - RNA, 21 nt, Homo sapiens
gucaauauuaaauacagacac

SEQ ID NO: 886927 - RNA, 12 nt, Homo sapiens
gucaaugcauca

SEQ ID NO: 886928 - RNA, 11 nt, Homo sapiens
gucaaugccac

SEQ ID NO: 886929 - RNA, 17 nt, Homo sapiens
gucaauuaguacaguag

SEQ ID NO: 886930 - RNA, 22 nt, Homo sapiens
gucaauuggaaagacuauccaa

SEQ ID NO: 886931 - RNA, 15 nt, Homo sapiens
gucacacaguauuaa

SEQ ID NO: 886932 - RNA, 20 nt, Homo sapiens
gucacauauacaaaagcaag

SEQ ID NO: 886933 - RNA, 15 nt, Homo sapiens
gucacaugcuuuguu

SEQ ID NO: 886934 - RNA, 17 nt, Homo sapiens
gucacauggccuaugca

SEQ ID NO: 886935 - RNA, 18 nt, Homo sapiens
gucacauggccuaugcac

SEQ ID NO: 886936 - RNA, 23 nt, Homo sapiens
gucacauggccuaugcacauaug

SEQ ID NO: 886937 - RNA, 18 nt, Homo sapiens
gucaccagcuaucuguca

SEQ ID NO: 886938 - RNA, 17 nt, Homo sapiens
gucaccagcugccaaaa

SEQ ID NO: 886939 - RNA, 13 nt, Homo sapiens
gucaccucagaga

SEQ ID NO: 886940 - RNA, 21 nt, Homo sapiens
gucacuaaccaagccagaaac

SEQ ID NO: 886941 - RNA, 17 nt, Homo sapiens
gucagaacucuguguug

SEQ ID NO: 886942 - RNA, 15 nt, Homo sapiens
gucagaccaguacug

SEQ ID NO: 886943 - RNA, 17 nt, Homo sapiens
gucagaguucugcucua

SEQ ID NO: 886944 - RNA, 15 nt, Homo sapiens
gucagccacaccugu

SEQ ID NO: 886945 - RNA, 19 nt, Homo sapiens
gucaggaaucaugaucuga

SEQ ID NO: 886946 - RNA, 19 nt, Homo sapiens
gucaggacuugaacccagg

SEQ ID NO: 886947 - RNA, 20 nt, Homo sapiens
gucagucugggugucucagg

SEQ ID NO: 886948 - RNA, 21 nt, Homo sapiens
gucaucaaauauuaccaaaaa

SEQ ID NO: 886949 - RNA, 16 nt, Homo sapiens
gucauccacagcccaa

SEQ ID NO: 886950 - RNA, 12 nt, Homo sapiens
gucauucuggga

SEQ ID NO: 886951 - RNA, 14 nt, Homo sapiens
gucauuucauuucc

SEQ ID NO: 886952 - RNA, 23 nt, Homo sapiens
gucauuuugggaccuauaucuca

SEQ ID NO: 886953 - RNA, 16 nt, Homo sapiens
guccaaaauguugauc

SEQ ID NO: 886954 - RNA, 13 nt, Homo sapiens
guccaagggccau

SEQ ID NO: 886955 - RNA, 16 nt, Homo sapiens
guccaaguccaaccug

SEQ ID NO: 886956 - RNA, 16 nt, Homo sapiens
guccacaucuucucag

SEQ ID NO: 886957 - RNA, 14 nt, Homo sapiens
guccacucugaaua

SEQ ID NO: 886958 - RNA, 18 nt, Homo sapiens
guccacucugaauaccaa

SEQ ID NO: 886959 - RNA, 18 nt, Homo sapiens
guccagcuugcucuucag

SEQ ID NO: 886960 - RNA, 19 nt, Homo sapiens
guccaggcccaaggaguaa

SEQ ID NO: 886961 - RNA, 11 nt, Homo sapiens
guccaugccua

SEQ ID NO: 886962 - RNA, 13 nt, Homo sapiens
gucccaaccugau

SEQ ID NO: 886963 - RNA, 18 nt, Homo sapiens
gucccaaccugaucccac

SEQ ID NO: 886964 - RNA, 19 nt, Homo sapiens
gucccagagguuaucugcc

SEQ ID NO: 886965 - RNA, 18 nt, Homo sapiens
gucccagcuacucaggag

SEQ ID NO: 886966 - RNA, 15 nt, Homo sapiens
guccccuccacuguc

SEQ ID NO: 886967 - RNA, 17 nt, Homo sapiens
guccccuccacugucac

SEQ ID NO: 886968 - RNA, 16 nt, Homo sapiens
gucccggguguguaca

SEQ ID NO: 886969 - RNA, 20 nt, Homo sapiens
gucccuacuagagaccucuc

SEQ ID NO: 886970 - RNA, 12 nt, Homo sapiens
gucccucggagc

SEQ ID NO: 886971 - RNA, 18 nt, Homo sapiens
gucccuguuguaacugcc

SEQ ID NO: 886972 - RNA, 14 nt, Homo sapiens
gucccuugcugaca

SEQ ID NO: 886973 - RNA, 17 nt, Homo sapiens
gucccuugcugugagca

SEQ ID NO: 886974 - RNA, 13 nt, Homo sapiens
gucccuuggagac

SEQ ID NO: 886975 - RNA, 15 nt, Homo sapiens
guccgaucuuugacu

SEQ ID NO: 886976 - RNA, 17 nt, Homo sapiens
guccgccaaacacucca

SEQ ID NO: 886977 - RNA, 21 nt, Homo sapiens
guccgccuggccggcuccagu

SEQ ID NO: 886978 - RNA, 14 nt, Homo sapiens
guccguggaaccag

SEQ ID NO: 886979 - RNA, 18 nt, Homo sapiens
guccuacucugugucagg

SEQ ID NO: 886980 - RNA, 18 nt, Homo sapiens
guccuauccaaaggaauc

SEQ ID NO: 886981 - RNA, 17 nt, Homo sapiens
guccugcccucugggag

SEQ ID NO: 886982 - RNA, 14 nt, Homo sapiens
guccugcucucuuc

SEQ ID NO: 886983 - RNA, 15 nt, Homo sapiens
guccugcuggcaccu

SEQ ID NO: 886984 - RNA, 14 nt, Homo sapiens
guccuggcuucuag

SEQ ID NO: 886985 - RNA, 23 nt, Homo sapiens
guccugggaauaugcuagugaug

SEQ ID NO: 886986 - RNA, 22 nt, Homo sapiens
guccugguggggcagcuccucu

SEQ ID NO: 886987 - RNA, 17 nt, Homo sapiens
guccuuggaaguuucau

SEQ ID NO: 886988 - RNA, 20 nt, Homo sapiens
guccuuuuauaaacauuggu

SEQ ID NO: 886989 - RNA, 13 nt, Homo sapiens
gucgaagcuuuga

SEQ ID NO: 886990 - RNA, 19 nt, Homo sapiens
gucgaauguuagauuccuc

SEQ ID NO: 886991 - RNA, 16 nt, Homo sapiens
gucggcacgucccaug

SEQ ID NO: 886992 - RNA, 22 nt, Homo sapiens
gucggcacgucccaugugcaug

SEQ ID NO: 886993 - RNA, 16 nt, Homo sapiens
gucuaaaaacaccaaa

SEQ ID NO: 886994 - RNA, 15 nt, Homo sapiens
gucucaagacugaaa

SEQ ID NO: 886995 - RNA, 19 nt, Homo sapiens
gucucaagagggcacuggu

SEQ ID NO: 886996 - RNA, 17 nt, Homo sapiens
gucucacuauguugccc

SEQ ID NO: 886997 - RNA, 18 nt, Homo sapiens
gucucacugaacuagaag

SEQ ID NO: 886998 - RNA, 17 nt, Homo sapiens
gucucagaccacuauuc

SEQ ID NO: 886999 - RNA, 18 nt, Homo sapiens
gucucccuaaaauaaaaa

SEQ ID NO: 887000 - RNA, 15 nt, Homo sapiens
gucucgaacuccugg

SEQ ID NO: 887001 - RNA, 11 nt, Homo sapiens
gucucuagcca

SEQ ID NO: 887002 - RNA, 20 nt, Homo sapiens
gucucucggguucaagcaau

SEQ ID NO: 887003 - RNA, 20 nt, Homo sapiens
gucucucuaaacccaaauaa

SEQ ID NO: 887004 - RNA, 15 nt, Homo sapiens
gucucugcaucucau

SEQ ID NO: 887005 - RNA, 15 nt, Homo sapiens
gucugaaagacagaa

SEQ ID NO: 887006 - RNA, 19 nt, Homo sapiens
gucugaacggcugaauaug

SEQ ID NO: 887007 - RNA, 22 nt, Homo sapiens
gucugagcuucaguauaaaaga

SEQ ID NO: 887008 - RNA, 12 nt, Homo sapiens
gucugagguccu

SEQ ID NO: 887009 - RNA, 21 nt, Homo sapiens
gucugagguccugagcacugc

SEQ ID NO: 887010 - RNA, 15 nt, Homo sapiens
gucugauuggcucac

SEQ ID NO: 887011 - RNA, 21 nt, Homo sapiens
gucugauuggcucacccaagc

SEQ ID NO: 887012 - RNA, 22 nt, Homo sapiens
gucugcaaugucccuugcacag

SEQ ID NO: 887013 - RNA, 18 nt, Homo sapiens
gucugccagccagcagcc

SEQ ID NO: 887014 - RNA, 15 nt, Homo sapiens
gucugccccacccuc

SEQ ID NO: 887015 - RNA, 21 nt, Homo sapiens
gugguuuaugucaucauacau

SEQ ID NO: 887016 - RNA, 22 nt, Homo sapiens
guguaaauacaguggaucucaa

SEQ ID NO: 887017 - RNA, 23 nt, Homo sapiens
guguaaauggagcuuguacauau

SEQ ID NO: 887018 - RNA, 14 nt, Homo sapiens
guguaaguaauuau

SEQ ID NO: 887019 - RNA, 13 nt, Homo sapiens
guguacucuuuau

SEQ ID NO: 887020 - RNA, 15 nt, Homo sapiens
guguagcuuugcucu

SEQ ID NO: 887021 - RNA, 19 nt, Homo sapiens
guguaucgcugccuugcca

SEQ ID NO: 887022 - RNA, 16 nt, Homo sapiens
guguaugcucauacuu

SEQ ID NO: 887023 - RNA, 12 nt, Homo sapiens
guguauguguau

SEQ ID NO: 887024 - RNA, 13 nt, Homo sapiens
guguauuugccag

SEQ ID NO: 887025 - RNA, 16 nt, Homo sapiens
guguauuuugagauaa

SEQ ID NO: 887026 - RNA, 20 nt, Homo sapiens
gugucaggcagguuugccag

SEQ ID NO: 887027 - RNA, 14 nt, Homo sapiens
gugucauaccacaa

SEQ ID NO: 887028 - RNA, 16 nt, Homo sapiens
guguccccuccacugu

SEQ ID NO: 887029 - RNA, 16 nt, Homo sapiens
guguccguggaaccag

SEQ ID NO: 887030 - RNA, 19 nt, Homo sapiens
gugucuggaaaagcacuuu

SEQ ID NO: 887031 - RNA, 20 nt, Homo sapiens
gugucuguacacguguccug

SEQ ID NO: 887032 - RNA, 20 nt, Homo sapiens
gugugacagucuugcauucu

SEQ ID NO: 887033 - RNA, 15 nt, Homo sapiens
gugugcagacugugg

SEQ ID NO: 887034 - RNA, 16 nt, Homo sapiens
gugugcauguguguau

SEQ ID NO: 887035 - RNA, 14 nt, Homo sapiens
gugugccauuuuaa

SEQ ID NO: 887036 - RNA, 20 nt, Homo sapiens
guguguugucugugcagcug

SEQ ID NO: 887037 - RNA, 14 nt, Homo sapiens
guguuaacaaugca

SEQ ID NO: 887038 - RNA, 19 nt, Homo sapiens
guguuacccaguaacucau

SEQ ID NO: 887039 - RNA, 16 nt, Homo sapiens
guguuacuguugcacu

SEQ ID NO: 887040 - RNA, 13 nt, Homo sapiens
guguuaggcacag

SEQ ID NO: 887041 - RNA, 13 nt, Homo sapiens
guguucagugccu

SEQ ID NO: 887042 - RNA, 16 nt, Homo sapiens
guguuccuucauuaac

SEQ ID NO: 887043 - RNA, 21 nt, Homo sapiens
guguugaagaagaguuugcaa

SEQ ID NO: 887044 - RNA, 14 nt, Homo sapiens
guguugaccacaga

SEQ ID NO: 887045 - RNA, 17 nt, Homo sapiens
guguugccuccuaccuu

SEQ ID NO: 887046 - RNA, 20 nt, Homo sapiens
guguuggaaaaugugcaaua

SEQ ID NO: 887047 - RNA, 23 nt, Homo sapiens
guguugggaauugcaugccaucu

SEQ ID NO: 887048 - RNA, 19 nt, Homo sapiens
guguugguguauuugccag

SEQ ID NO: 887049 - RNA, 14 nt, Homo sapiens
guuaaaaaguucau

SEQ ID NO: 887050 - RNA, 17 nt, Homo sapiens
guuaaaauuuaaccuac

SEQ ID NO: 887051 - RNA, 23 nt, Homo sapiens
guuaaacacgugucuauaaugga

SEQ ID NO: 887052 - RNA, 14 nt, Homo sapiens
guuaaagugaauaa

SEQ ID NO: 887053 - RNA, 19 nt, Homo sapiens
guuaaggcagugacuuuag

SEQ ID NO: 887054 - RNA, 16 nt, Homo sapiens
guuaagugaaugucua

SEQ ID NO: 887055 - RNA, 12 nt, Homo sapiens
guuaagugcagg

SEQ ID NO: 887056 - RNA, 17 nt, Homo sapiens
guuaaucauguauuaaa

SEQ ID NO: 887057 - RNA, 11 nt, Homo sapiens
guuaaugccau

SEQ ID NO: 887058 - RNA, 16 nt, Homo sapiens
guuaauucagcacuga

SEQ ID NO: 887059 - RNA, 21 nt, Homo sapiens
guuacagcgagaggcagagaa

SEQ ID NO: 887060 - RNA, 21 nt, Homo sapiens
guuacagcuaugcacuguaaa

SEQ ID NO: 887061 - RNA, 15 nt, Homo sapiens
guuaccaacuaccua

SEQ ID NO: 887062 - RNA, 18 nt, Homo sapiens
guuacccugcauguuggc

SEQ ID NO: 887063 - RNA, 11 nt, Homo sapiens
aaaaaaaagca

SEQ ID NO: 887064 - RNA, 12 nt, Homo sapiens
aaaaaaauugca

SEQ ID NO: 887065 - RNA, 21 nt, Homo sapiens
aaaaaacauuuguacauuccu

SEQ ID NO: 887066 - RNA, 14 nt, Homo sapiens
aaaaaacucuugau

SEQ ID NO: 887067 - RNA, 13 nt, Homo sapiens
aaaaaaucuucca

SEQ ID NO: 887068 - RNA, 11 nt, Homo sapiens
aaaaacaggaa

SEQ ID NO: 887069 - RNA, 12 nt, Homo sapiens
aaaaacauuugu

SEQ ID NO: 887070 - RNA, 19 nt, Homo sapiens
aaaaacuauuaacaacuug

SEQ ID NO: 887071 - RNA, 17 nt, Homo sapiens
aaaaagaagcaaccuca

SEQ ID NO: 887072 - RNA, 11 nt, Homo sapiens
aaaaagagcca

SEQ ID NO: 887073 - RNA, 17 nt, Homo sapiens
aaaaagaggcauuccag

SEQ ID NO: 887074 - RNA, 13 nt, Homo sapiens
aaaaagcaucaug

SEQ ID NO: 887075 - RNA, 16 nt, Homo sapiens
aaaaagcaugaucuga

SEQ ID NO: 887076 - RNA, 17 nt, Homo sapiens
aaaaaggaacacuggaa

SEQ ID NO: 887077 - RNA, 13 nt, Homo sapiens
aaaaaguaaucaa

SEQ ID NO: 887078 - RNA, 17 nt, Homo sapiens
aaaaauacucacauggc

SEQ ID NO: 887079 - RNA, 21 nt, Homo sapiens
aaaaauauguugaguguucau

SEQ ID NO: 887080 - RNA, 17 nt, Homo sapiens
aaaaaucagcuggguac

SEQ ID NO: 887081 - RNA, 11 nt, Homo sapiens
aaaaaugauuu

SEQ ID NO: 887082 - RNA, 15 nt, Homo sapiens
aaaaaugggaacaag

SEQ ID NO: 887083 - RNA, 16 nt, Homo sapiens
aaaaaugugucuguaa

SEQ ID NO: 887084 - RNA, 20 nt, Homo sapiens
aaaacaaaugggaaaauguc

SEQ ID NO: 887085 - RNA, 12 nt, Homo sapiens
aaaacacugugu

SEQ ID NO: 887086 - RNA, 23 nt, Homo sapiens
aaaacaguuuugucagucuuucu

SEQ ID NO: 887087 - RNA, 11 nt, Homo sapiens
aaaacauauca

SEQ ID NO: 887088 - RNA, 13 nt, Homo sapiens
aaaacaucacuga

SEQ ID NO: 887089 - RNA, 23 nt, Homo sapiens
aaaacauuuuacuuuaaaaggag

SEQ ID NO: 887090 - RNA, 15 nt, Homo sapiens
aaaacccagcaugua

SEQ ID NO: 887091 - RNA, 21 nt, Homo sapiens
aaaaccgcaaggguagacugg

SEQ ID NO: 887092 - RNA, 12 nt, Homo sapiens
aaaaccuagcau

SEQ ID NO: 887093 - RNA, 16 nt, Homo sapiens
aaaaccucacuugaag

SEQ ID NO: 887094 - RNA, 15 nt, Homo sapiens
aaaaccuuuccccag

SEQ ID NO: 887095 - RNA, 21 nt, Homo sapiens
aaaacggugcauccacgcaca

SEQ ID NO: 887096 - RNA, 13 nt, Homo sapiens
aaaacuaauuucc

SEQ ID NO: 887097 - RNA, 20 nt, Homo sapiens
aaaacucauuacuuuuccau

SEQ ID NO: 887098 - RNA, 21 nt, Homo sapiens
aaaacuccacagucaauauua

SEQ ID NO: 887099 - RNA, 14 nt, Homo sapiens
aaaacuccaucuca

SEQ ID NO: 887100 - RNA, 14 nt, Homo sapiens
aaaacugacagagg

SEQ ID NO: 887101 - RNA, 17 nt, Homo sapiens
aaaacugauuuuuagcu

SEQ ID NO: 887102 - RNA, 20 nt, Homo sapiens
aaaacugauuuuuagcuuua

SEQ ID NO: 887103 - RNA, 18 nt, Homo sapiens
aaaacugcugaacuugac

SEQ ID NO: 887104 - RNA, 19 nt, Homo sapiens
caccucagacaauccacuc

SEQ ID NO: 887105 - RNA, 16 nt, Homo sapiens
caccucagcugauauu

SEQ ID NO: 887106 - RNA, 15 nt, Homo sapiens
caccucagugcccac

SEQ ID NO: 887107 - RNA, 22 nt, Homo sapiens
caccuccauuucucuccaggaa

SEQ ID NO: 887108 - RNA, 14 nt, Homo sapiens
caccuccuagccac

SEQ ID NO: 887109 - RNA, 22 nt, Homo sapiens
caccuccuuccucaguccugga

SEQ ID NO: 887110 - RNA, 19 nt, Homo sapiens
caccucuggcuuugucucu

SEQ ID NO: 887111 - RNA, 19 nt, Homo sapiens
caccugacaauggcagcua

SEQ ID NO: 887112 - RNA, 18 nt, Homo sapiens
caccugaccagaaugcgc

SEQ ID NO: 887113 - RNA, 18 nt, Homo sapiens
caccugcacgugaucugc

SEQ ID NO: 887114 - RNA, 15 nt, Homo sapiens
caccuggauugcaga

SEQ ID NO: 887115 - RNA, 16 nt, Homo sapiens
caccugggguauggca

SEQ ID NO: 887116 - RNA, 16 nt, Homo sapiens
caccuucaauacuuca

SEQ ID NO: 887117 - RNA, 18 nt, Homo sapiens
caccuucaccuucaucca

SEQ ID NO: 887118 - RNA, 18 nt, Homo sapiens
caccuuguuacacauuau

SEQ ID NO: 887119 - RNA, 16 nt, Homo sapiens
cacgaacccaccugcu

SEQ ID NO: 887120 - RNA, 18 nt, Homo sapiens
cacgaauccugacaccac

SEQ ID NO: 887121 - RNA, 22 nt, Homo sapiens
cacgcacauagagauaugcaca

SEQ ID NO: 887122 - RNA, 16 nt, Homo sapiens
cacgcuggagugcagu

SEQ ID NO: 887123 - RNA, 16 nt, Homo sapiens
cacggaugcacacaca

SEQ ID NO: 887124 - RNA, 16 nt, Homo sapiens
cacggaugcacagaga

SEQ ID NO: 887125 - RNA, 19 nt, Homo sapiens
cacggcagcuguagcuccc

SEQ ID NO: 887126 - RNA, 13 nt, Homo sapiens
cacgucugccagg

SEQ ID NO: 887127 - RNA, 15 nt, Homo sapiens
cacgugccugugauc

SEQ ID NO: 887128 - RNA, 18 nt, Homo sapiens
cacgugugaaguguagug

SEQ ID NO: 887129 - RNA, 13 nt, Homo sapiens
cacguuuguauca

SEQ ID NO: 887130 - RNA, 19 nt, Homo sapiens
cacuaaacagacuauuuaa

SEQ ID NO: 887131 - RNA, 16 nt, Homo sapiens
cacuaaccacgcugga

SEQ ID NO: 887132 - RNA, 19 nt, Homo sapiens
cacuaacccguuuuauucu

SEQ ID NO: 887133 - RNA, 17 nt, Homo sapiens
cacuaaggugugcucug

SEQ ID NO: 887134 - RNA, 14 nt, Homo sapiens
cacuacagauauca

SEQ ID NO: 887135 - RNA, 12 nt, Homo sapiens
cacuacuuaaaa

SEQ ID NO: 887136 - RNA, 17 nt, Homo sapiens
cacuagaaaacauucca

SEQ ID NO: 887137 - RNA, 13 nt, Homo sapiens
cacuagacugugc

SEQ ID NO: 887138 - RNA, 12 nt, Homo sapiens
cacuagcauuuu

SEQ ID NO: 887139 - RNA, 16 nt, Homo sapiens
cacuauccucacuccc

SEQ ID NO: 887140 - RNA, 14 nt, Homo sapiens
cacuauuuacauac

SEQ ID NO: 887141 - RNA, 21 nt, Homo sapiens
cacucaaaaaggugugucaaa

SEQ ID NO: 887142 - RNA, 12 nt, Homo sapiens
cacucacuccag

SEQ ID NO: 887143 - RNA, 21 nt, Homo sapiens
cacucaggccaacaagccaac

SEQ ID NO: 887144 - RNA, 22 nt, Homo sapiens
cacuccaccacccaaaagucaa

SEQ ID NO: 887145 - RNA, 22 nt, Homo sapiens
cacuccagcccuguccccugaa

SEQ ID NO: 887146 - RNA, 21 nt, Homo sapiens
cacuccccccauaucuuuaaa

SEQ ID NO: 887147 - RNA, 13 nt, Homo sapiens
cacucuacccuau

SEQ ID NO: 887148 - RNA, 19 nt, Homo sapiens
cacucuacccuauacaacu

SEQ ID NO: 887149 - RNA, 21 nt, Homo sapiens
cacucuacugcaagacuuaaa

SEQ ID NO: 887150 - RNA, 20 nt, Homo sapiens
cacucugaauaccaagugug

SEQ ID NO: 887151 - RNA, 22 nt, Homo sapiens
cacucuuauugcccacgcugga

SEQ ID NO: 887152 - RNA, 15 nt, Homo sapiens
cacucuucuugagca

SEQ ID NO: 887153 - RNA, 16 nt, Homo sapiens
cacugaagugcuugca

SEQ ID NO: 887154 - RNA, 23 nt, Homo sapiens
cacugaaugccucaaugugacca

SEQ ID NO: 887155 - RNA, 13 nt, Homo sapiens
aaacaaaucuuca

SEQ ID NO: 887156 - RNA, 20 nt, Homo sapiens
aaacaauuggcaaacuuugu

SEQ ID NO: 887157 - RNA, 14 nt, Homo sapiens
aaacacacuguaaa

SEQ ID NO: 887158 - RNA, 17 nt, Homo sapiens
aaacaccaaaaagggau

SEQ ID NO: 887159 - RNA, 19 nt, Homo sapiens
aaacacccuuuccaaagca

SEQ ID NO: 887160 - RNA, 17 nt, Homo sapiens
aaacacucaacaauaaa

SEQ ID NO: 887161 - RNA, 18 nt, Homo sapiens
aaacacucaacaauaaag

SEQ ID NO: 887162 - RNA, 12 nt, Homo sapiens
aaacacuguaau

SEQ ID NO: 887163 - RNA, 19 nt, Homo sapiens
aaacagauuguuugcaaag

SEQ ID NO: 887164 - RNA, 19 nt, Homo sapiens
aaacagguggagaaauucc

SEQ ID NO: 887165 - RNA, 17 nt, Homo sapiens
aaacauauguauacaaa

SEQ ID NO: 887166 - RNA, 15 nt, Homo sapiens
aaacaugcacgguga

SEQ ID NO: 887167 - RNA, 24 nt, Homo sapiens
aaacaugcuaaauaguucuaucag

SEQ ID NO: 887168 - RNA, 21 nt, Homo sapiens
aaacauuaaaagaagacugga

SEQ ID NO: 887169 - RNA, 23 nt, Homo sapiens
aaacauucacacagggcucuuug

SEQ ID NO: 887170 - RNA, 18 nt, Homo sapiens
aaacauucaucaagcugu

SEQ ID NO: 887171 - RNA, 11 nt, Homo sapiens
aaacauucucu

SEQ ID NO: 887172 - RNA, 15 nt, Homo sapiens
aaacauugugccaug

SEQ ID NO: 887173 - RNA, 23 nt, Homo sapiens
aaaccaagauagauccauuugga

SEQ ID NO: 887174 - RNA, 21 nt, Homo sapiens
aaaccaagucuacuucacuaa

SEQ ID NO: 887175 - RNA, 16 nt, Homo sapiens
aaaccaauagcuuuaa

SEQ ID NO: 887176 - RNA, 13 nt, Homo sapiens
aaaccaaugauuc

SEQ ID NO: 887177 - RNA, 14 nt, Homo sapiens
aaacccagcaugua

SEQ ID NO: 887178 - RNA, 15 nt, Homo sapiens
aaacccagcucccuu

SEQ ID NO: 887179 - RNA, 21 nt, Homo sapiens
aaacccagcucccuucuuccc

SEQ ID NO: 887180 - RNA, 15 nt, Homo sapiens
aaacccuaucuguga

SEQ ID NO: 887181 - RNA, 16 nt, Homo sapiens
aaacccuucuuuacua

SEQ ID NO: 887182 - RNA, 18 nt, Homo sapiens
aaaccuagcaucuuacaa

SEQ ID NO: 887183 - RNA, 22 nt, Homo sapiens
aaaccucuauauguugcugaaa

SEQ ID NO: 887184 - RNA, 17 nt, Homo sapiens
aaaccugugugccauuu

SEQ ID NO: 887185 - RNA, 18 nt, Homo sapiens
aaaccuuuccccagacac

SEQ ID NO: 887186 - RNA, 23 nt, Homo sapiens
aaacgccuuuuauucuauuuaca

SEQ ID NO: 887187 - RNA, 12 nt, Homo sapiens
aaacgugcuccc

SEQ ID NO: 887188 - RNA, 17 nt, Homo sapiens
aaacuaaaucucuaaua

SEQ ID NO: 887189 - RNA, 24 nt, Homo sapiens
aaacuaacacagccaucaagggaa

SEQ ID NO: 887190 - RNA, 18 nt, Homo sapiens
aaacuacacaucccuaau

SEQ ID NO: 887191 - RNA, 17 nt, Homo sapiens
aaacuacccuccagagu

SEQ ID NO: 887192 - RNA, 17 nt, Homo sapiens
aaacuccugacuuugug

SEQ ID NO: 887193 - RNA, 22 nt, Homo sapiens
aaacugagaugugaacacauca

SEQ ID NO: 887194 - RNA, 19 nt, Homo sapiens
aaacugagccucuuuucaa

SEQ ID NO: 887195 - RNA, 17 nt, Homo sapiens
aaacugcacugccaugu

SEQ ID NO: 887196 - RNA, 15 nt, Homo sapiens
aaacugccuuucugc

SEQ ID NO: 887197 - RNA, 11 nt, Homo sapiens
aaacugcugaa

SEQ ID NO: 887198 - RNA, 19 nt, Homo sapiens
aaacuggacuugucuuccu

SEQ ID NO: 887199 - RNA, 18 nt, Homo sapiens
aaacugguuuguugcagc

SEQ ID NO: 887200 - RNA, 16 nt, Homo sapiens
aaacuuagcaacuugg

SEQ ID NO: 887201 - RNA, 18 nt, Homo sapiens
aaacuuaugcuaguuuau

SEQ ID NO: 887202 - RNA, 20 nt, Homo sapiens
aaacuuccuaaugauuagca

SEQ ID NO: 887203 - RNA, 21 nt, Homo sapiens
aaacuugcauacagagacaga

SEQ ID NO: 887204 - RNA, 19 nt, Homo sapiens
aaacuuguaaaugcuguca

SEQ ID NO: 887205 - RNA, 23 nt, Homo sapiens
aaacuuugugccuuugaccaucu

SEQ ID NO: 887206 - RNA, 14 nt, Homo sapiens
aaagaaacacucaa

SEQ ID NO: 887207 - RNA, 13 nt, Homo sapiens
aaagaaccaaaag

SEQ ID NO: 887208 - RNA, 21 nt, Homo sapiens
aaagaagacgcucagcacugu

SEQ ID NO: 887209 - RNA, 24 nt, Homo sapiens
aaagaagauuuugccacauuugau

SEQ ID NO: 887210 - RNA, 22 nt, Homo sapiens
aaagaagcuucaugccagguua

SEQ ID NO: 887211 - RNA, 21 nt, Homo sapiens
aaagaaggcacagguguaaau

SEQ ID NO: 887212 - RNA, 14 nt, Homo sapiens
aaagaaguaaaagc

SEQ ID NO: 887213 - RNA, 20 nt, Homo sapiens
aaagaaguguuccuucauua

SEQ ID NO: 887214 - RNA, 20 nt, Homo sapiens
aaagaaguuaacuacagugu

SEQ ID NO: 887215 - RNA, 16 nt, Homo sapiens
aaagaaguuucuggag

SEQ ID NO: 887216 - RNA, 18 nt, Homo sapiens
aaagaauaaaugaaucuu

SEQ ID NO: 887217 - RNA, 13 nt, Homo sapiens
aaagaaucucaag

SEQ ID NO: 887218 - RNA, 13 nt, Homo sapiens
aaauauucucucc

SEQ ID NO: 887219 - RNA, 17 nt, Homo sapiens
aaauauugcuucaauaa

SEQ ID NO: 887220 - RNA, 19 nt, Homo sapiens
aaauauuuacauaugaaau

SEQ ID NO: 887221 - RNA, 18 nt, Homo sapiens
aaauauuucaugauucac

SEQ ID NO: 887222 - RNA, 18 nt, Homo sapiens
aaauauuugcuaugaagc

SEQ ID NO: 887223 - RNA, 23 nt, Homo sapiens
aaauauuuuauaugaaauguuuc

SEQ ID NO: 887224 - RNA, 15 nt, Homo sapiens
aaaucaacuugugua

SEQ ID NO: 887225 - RNA, 20 nt, Homo sapiens
aaaucaccacaccaaaccuc

SEQ ID NO: 887226 - RNA, 12 nt, Homo sapiens
aaaucacuauaa

SEQ ID NO: 887227 - RNA, 11 nt, Homo sapiens
aaaucacuugu

SEQ ID NO: 887228 - RNA, 16 nt, Homo sapiens
aaaucagcacauuccu

SEQ ID NO: 887229 - RNA, 18 nt, Homo sapiens
aaaucagcacauuccucc

SEQ ID NO: 887230 - RNA, 17 nt, Homo sapiens
aaaucaugaauauuuca

SEQ ID NO: 887231 - RNA, 18 nt, Homo sapiens
aaaucaugguuguaguga

SEQ ID NO: 887232 - RNA, 14 nt, Homo sapiens
aaaucauuucugca

SEQ ID NO: 887233 - RNA, 21 nt, Homo sapiens
aaauccuuauuuauauaucag

SEQ ID NO: 887234 - RNA, 16 nt, Homo sapiens
aaaucuaguuuacuuc

SEQ ID NO: 887235 - RNA, 19 nt, Homo sapiens
aaaucugacaagacugaaa

SEQ ID NO: 887236 - RNA, 17 nt, Homo sapiens
aaaucugggcauugagc

SEQ ID NO: 887237 - RNA, 15 nt, Homo sapiens
aaaucuuaacuugaa

SEQ ID NO: 887238 - RNA, 13 nt, Homo sapiens
aaaucuuccuugu

SEQ ID NO: 887239 - RNA, 19 nt, Homo sapiens
aaaugaaacaaauaaucac

SEQ ID NO: 887240 - RNA, 15 nt, Homo sapiens
aaaugaaagcaugug

SEQ ID NO: 887241 - RNA, 17 nt, Homo sapiens
aaaugaaguauuucuca

SEQ ID NO: 887242 - RNA, 12 nt, Homo sapiens
aaaugacugcug

SEQ ID NO: 887243 - RNA, 13 nt, Homo sapiens
aaaugaguauuuc

SEQ ID NO: 887244 - RNA, 19 nt, Homo sapiens
aaaugaguucaacuuugag

SEQ ID NO: 887245 - RNA, 15 nt, Homo sapiens
aaaugcaaacacugu

SEQ ID NO: 887246 - RNA, 16 nt, Homo sapiens
aaaugcaaacacugug

SEQ ID NO: 887247 - RNA, 18 nt, Homo sapiens
aaaugcaaacacugugua

SEQ ID NO: 887248 - RNA, 23 nt, Homo sapiens
aaaugcaaggugaacaccacuuu

SEQ ID NO: 887249 - RNA, 12 nt, Homo sapiens
aaaugcacugug

SEQ ID NO: 887250 - RNA, 13 nt, Homo sapiens
aaaugcauggugc

SEQ ID NO: 887251 - RNA, 17 nt, Homo sapiens
aaaugcauggugcaguu

SEQ ID NO: 887252 - RNA, 15 nt, Homo sapiens
aaaugcauguccuca

SEQ ID NO: 887253 - RNA, 17 nt, Homo sapiens
aaaugcauguccucaaa

SEQ ID NO: 887254 - RNA, 12 nt, Homo sapiens
aaaugccagucu

SEQ ID NO: 887255 - RNA, 14 nt, Homo sapiens
aaauggaguauuuu

SEQ ID NO: 887256 - RNA, 22 nt, Homo sapiens
aaauguacacuggauauguugu

SEQ ID NO: 887257 - RNA, 17 nt, Homo sapiens
aaauguagguaugaaua

SEQ ID NO: 887258 - RNA, 19 nt, Homo sapiens
aaauguauauacacauaua

SEQ ID NO: 887259 - RNA, 16 nt, Homo sapiens
aaauguauuaucacca

SEQ ID NO: 887260 - RNA, 12 nt, Homo sapiens
aaaugucaguaa

SEQ ID NO: 887261 - RNA, 18 nt, Homo sapiens
aaaugucuggucugucca

SEQ ID NO: 887262 - RNA, 22 nt, Homo sapiens
aaaugugacccagauccucaca

SEQ ID NO: 887263 - RNA, 16 nt, Homo sapiens
aaauguuauuauguca

SEQ ID NO: 887264 - RNA, 21 nt, Homo sapiens
aaauguucagcuucagacuuu

SEQ ID NO: 887265 - RNA, 20 nt, Homo sapiens
aaauuaaaugcauguccuca

SEQ ID NO: 887266 - RNA, 16 nt, Homo sapiens
aaauuacaauugucau

SEQ ID NO: 887267 - RNA, 13 nt, Homo sapiens
aaauuacauuaaa

SEQ ID NO: 887268 - RNA, 17 nt, Homo sapiens
aaauuagcugugugaaa

SEQ ID NO: 887269 - RNA, 17 nt, Homo sapiens
aaauuauaagaugucau

SEQ ID NO: 887270 - RNA, 23 nt, Homo sapiens
aaauuauacuguagcugaugaaa

SEQ ID NO: 887271 - RNA, 20 nt, Homo sapiens
cagagccuggggcaucccag

SEQ ID NO: 887272 - RNA, 19 nt, Homo sapiens
cagagcugauggagaagga

SEQ ID NO: 887273 - RNA, 16 nt, Homo sapiens
cagagcuggaaggcag

SEQ ID NO: 887274 - RNA, 14 nt, Homo sapiens
cagagcuuccucag

SEQ ID NO: 887275 - RNA, 23 nt, Homo sapiens
cagaggaggccggugaagugcau

SEQ ID NO: 887276 - RNA, 21 nt, Homo sapiens
cagaggauuuaacugugaacc

SEQ ID NO: 887277 - RNA, 22 nt, Homo sapiens
cagaggcagcgaguuguggaaa

SEQ ID NO: 887278 - RNA, 21 nt, Homo sapiens
cagaggcauuuaaaauggaaa

SEQ ID NO: 887279 - RNA, 15 nt, Homo sapiens
cagaggccauggcag

SEQ ID NO: 887280 - RNA, 14 nt, Homo sapiens
cagaggcggaaacc

SEQ ID NO: 887281 - RNA, 20 nt, Homo sapiens
cagaggcugcaaggauucag

SEQ ID NO: 887282 - RNA, 17 nt, Homo sapiens
cagaggcugcaggacuu

SEQ ID NO: 887283 - RNA, 15 nt, Homo sapiens
cagaggcuucuucag

SEQ ID NO: 887284 - RNA, 20 nt, Homo sapiens
cagagggcguguuguuuuac

SEQ ID NO: 887285 - RNA, 23 nt, Homo sapiens
cagagguaaaagugugagcagug

SEQ ID NO: 887286 - RNA, 16 nt, Homo sapiens
cagagucaaauuugaa

SEQ ID NO: 887287 - RNA, 12 nt, Homo sapiens
cagagucucacu

SEQ ID NO: 887288 - RNA, 19 nt, Homo sapiens
cagagugugcagacugaug

SEQ ID NO: 887289 - RNA, 21 nt, Homo sapiens
cagaguuccauguuuguacuc

SEQ ID NO: 887290 - RNA, 15 nt, Homo sapiens
cagaguucugcucua

SEQ ID NO: 887291 - RNA, 18 nt, Homo sapiens
cagaguuguacacugugu

SEQ ID NO: 887292 - RNA, 21 nt, Homo sapiens
cagauacuucccauuuuggaa

SEQ ID NO: 887293 - RNA, 15 nt, Homo sapiens
cagauagccagacac

SEQ ID NO: 887294 - RNA, 17 nt, Homo sapiens
cagauauacacauggau

SEQ ID NO: 887295 - RNA, 19 nt, Homo sapiens
cagauauacacauggaugc

SEQ ID NO: 887296 - RNA, 13 nt, Homo sapiens
cagauaugcacac

SEQ ID NO: 887297 - RNA, 14 nt, Homo sapiens
cagaucaaauuuca

SEQ ID NO: 887298 - RNA, 21 nt, Homo sapiens
cagaucacucaaaaaggugug

SEQ ID NO: 887299 - RNA, 22 nt, Homo sapiens
cagauccucugcugacuccaua

SEQ ID NO: 887300 - RNA, 16 nt, Homo sapiens
cagaucugaacacagu

SEQ ID NO: 887301 - RNA, 16 nt, Homo sapiens
cagaucugcacugggu

SEQ ID NO: 887302 - RNA, 18 nt, Homo sapiens
cagaucuuuuugugaaau

SEQ ID NO: 887303 - RNA, 21 nt, Homo sapiens
cagaugaaauuuauuuccauc

SEQ ID NO: 887304 - RNA, 14 nt, Homo sapiens
cagaugaucucucc

SEQ ID NO: 887305 - RNA, 20 nt, Homo sapiens
cagaugcaaucucuugucuc

SEQ ID NO: 887306 - RNA, 11 nt, Homo sapiens
cagaugcacac

SEQ ID NO: 887307 - RNA, 15 nt, Homo sapiens
cagaugcacacacag

SEQ ID NO: 887308 - RNA, 16 nt, Homo sapiens
cagaugcacacacaga

SEQ ID NO: 887309 - RNA, 20 nt, Homo sapiens
cagaugcaccccaacauuga

SEQ ID NO: 887310 - RNA, 22 nt, Homo sapiens
cagaugcuggggagaaugaaga

SEQ ID NO: 887311 - RNA, 17 nt, Homo sapiens
cagaugguuaaauauca

SEQ ID NO: 887312 - RNA, 17 nt, Homo sapiens
cagauguaaaugccaca

SEQ ID NO: 887313 - RNA, 17 nt, Homo sapiens
cagauuugcuguucacc

SEQ ID NO: 887314 - RNA, 21 nt, Homo sapiens
cagauuugcuguucacccaca

SEQ ID NO: 887315 - RNA, 19 nt, Homo sapiens
cagauuuuuacacauguau

SEQ ID NO: 887316 - RNA, 16 nt, Homo sapiens
cagcaaaagaagacaa

SEQ ID NO: 887317 - RNA, 23 nt, Homo sapiens
cagcaaaagaagacaacauuucu

SEQ ID NO: 887318 - RNA, 19 nt, Homo sapiens
cagcaaagugucaguguug

SEQ ID NO: 887319 - RNA, 13 nt, Homo sapiens
cagcaacaggaau

SEQ ID NO: 887320 - RNA, 11 nt, Homo sapiens
cagcacccucc

SEQ ID NO: 887321 - RNA, 10 nt, Homo sapiens
cagcacuaac

SEQ ID NO: 887322 - RNA, 15 nt, Homo sapiens
cagcacuaauucaac

SEQ ID NO: 887323 - RNA, 15 nt, Homo sapiens
cagcagaaagguuag

SEQ ID NO: 887324 - RNA, 24 nt, Homo sapiens
cagcagaaagguuaguaucaucag

SEQ ID NO: 887325 - RNA, 14 nt, Homo sapiens
cagcagaagccaaa

SEQ ID NO: 887326 - RNA, 20 nt, Homo sapiens
cagcagccagcucucagcca

SEQ ID NO: 887327 - RNA, 17 nt, Homo sapiens
cagcagcgguaccccag

SEQ ID NO: 887328 - RNA, 21 nt, Homo sapiens
cagcagggucuugcuguaacu

SEQ ID NO: 887329 - RNA, 20 nt, Homo sapiens
cagcauaccuuggacugacu

SEQ ID NO: 887330 - RNA, 12 nt, Homo sapiens
cagcauuugcca

SEQ ID NO: 887331 - RNA, 13 nt, Homo sapiens
cagccaacaaaca

SEQ ID NO: 887332 - RNA, 17 nt, Homo sapiens
cagccaacaaacauaga

SEQ ID NO: 887333 - RNA, 16 nt, Homo sapiens
ccucuuccccuugccc

SEQ ID NO: 887334 - RNA, 21 nt, Homo sapiens
ccucuucccgggaucacuuaa

SEQ ID NO: 887335 - RNA, 21 nt, Homo sapiens
ccucuuccgugacgucacugg

SEQ ID NO: 887336 - RNA, 21 nt, Homo sapiens
ccucuuggaccucugcucuga

SEQ ID NO: 887337 - RNA, 16 nt, Homo sapiens
ccucuuguugcugagu

SEQ ID NO: 887338 - RNA, 20 nt, Homo sapiens
ccucuuuauuuuuugauuga

SEQ ID NO: 887339 - RNA, 23 nt, Homo sapiens
ccucuuucuuucuuuuguguugg

SEQ ID NO: 887340 - RNA, 14 nt, Homo sapiens
ccugaaaaacugau

SEQ ID NO: 887341 - RNA, 17 nt, Homo sapiens
ccugaaccugggaacca

SEQ ID NO: 887342 - RNA, 13 nt, Homo sapiens
ccugaaugaaaua

SEQ ID NO: 887343 - RNA, 15 nt, Homo sapiens
ccugacaccaccauc

SEQ ID NO: 887344 - RNA, 18 nt, Homo sapiens
ccugacaccaccaucuau

SEQ ID NO: 887345 - RNA, 21 nt, Homo sapiens
ccugacaccgucccucaguga

SEQ ID NO: 887346 - RNA, 21 nt, Homo sapiens
ccugacagguucccagcagcu

SEQ ID NO: 887347 - RNA, 21 nt, Homo sapiens
ccugacauuaagacacaccuc

SEQ ID NO: 887348 - RNA, 15 nt, Homo sapiens
ccugacgacacugaa

SEQ ID NO: 887349 - RNA, 13 nt, Homo sapiens
ccugagaccaguu

SEQ ID NO: 887350 - RNA, 22 nt, Homo sapiens
ccugagauggggaugagggcag

SEQ ID NO: 887351 - RNA, 15 nt, Homo sapiens
ccugagccacaaaaa

SEQ ID NO: 887352 - RNA, 20 nt, Homo sapiens
ccugagcucgguggacccag

SEQ ID NO: 887353 - RNA, 22 nt, Homo sapiens
ccugaggaucuagcuucaugcc

SEQ ID NO: 887354 - RNA, 12 nt, Homo sapiens
ccugauaagcaa

SEQ ID NO: 887355 - RNA, 14 nt, Homo sapiens
ccugauacugggua

SEQ ID NO: 887356 - RNA, 17 nt, Homo sapiens
ccugauacuggguacaa

SEQ ID NO: 887357 - RNA, 13 nt, Homo sapiens
ccugaucaccucu

SEQ ID NO: 887358 - RNA, 17 nt, Homo sapiens
ccugcaaagggaacuga

SEQ ID NO: 887359 - RNA, 24 nt, Homo sapiens
ccugcaccgagagagauggaauaa

SEQ ID NO: 887360 - RNA, 15 nt, Homo sapiens
ccugcacgccaccgc

SEQ ID NO: 887361 - RNA, 20 nt, Homo sapiens
ccugcagccuccuccugacc

SEQ ID NO: 887362 - RNA, 19 nt, Homo sapiens
ccugcaggccaagagcaga

SEQ ID NO: 887363 - RNA, 14 nt, Homo sapiens
ccugcauccaaucu

SEQ ID NO: 887364 - RNA, 18 nt, Homo sapiens
ccugcauugcugagucaa

SEQ ID NO: 887365 - RNA, 15 nt, Homo sapiens
ccugcccaugugucc

SEQ ID NO: 887366 - RNA, 16 nt, Homo sapiens
ccugcccugcugccgc

SEQ ID NO: 887367 - RNA, 16 nt, Homo sapiens
ccugccuccagcacuc

SEQ ID NO: 887368 - RNA, 15 nt, Homo sapiens
ccugccucugacuca

SEQ ID NO: 887369 - RNA, 20 nt, Homo sapiens
ccugccucugacucacacuu

SEQ ID NO: 887370 - RNA, 17 nt, Homo sapiens
ccugccuuccaaccccu

SEQ ID NO: 887371 - RNA, 19 nt, Homo sapiens
ccugcgagaggucccugcu

SEQ ID NO: 887372 - RNA, 14 nt, Homo sapiens
ccugcgauuuugcc

SEQ ID NO: 887373 - RNA, 13 nt, Homo sapiens
ccugcgggcaccu

SEQ ID NO: 887374 - RNA, 23 nt, Homo sapiens
ccugcgugccgggagaggacucu

SEQ ID NO: 887375 - RNA, 21 nt, Homo sapiens
ccugcuaccaaggcccagcua

SEQ ID NO: 887376 - RNA, 16 nt, Homo sapiens
ccugcuagcuguagaa

SEQ ID NO: 887377 - RNA, 13 nt, Homo sapiens
ccugcuccuccca

SEQ ID NO: 887378 - RNA, 18 nt, Homo sapiens
ccugcucuccucuugcca

SEQ ID NO: 887379 - RNA, 19 nt, Homo sapiens
ccugcugcgucagaccagu

SEQ ID NO: 887380 - RNA, 23 nt, Homo sapiens
ccugcuggaaaccacacuucuug

SEQ ID NO: 887381 - RNA, 14 nt, Homo sapiens
ccugcugugcccuc

SEQ ID NO: 887382 - RNA, 14 nt, Homo sapiens
ccugcuuaccugac

SEQ ID NO: 887383 - RNA, 13 nt, Homo sapiens
ccugcuucucugg

SEQ ID NO: 887384 - RNA, 16 nt, Homo sapiens
ccuggaaaugugcuaa

SEQ ID NO: 887385 - RNA, 20 nt, Homo sapiens
ccuggaaauuaaacccugcc

SEQ ID NO: 887386 - RNA, 20 nt, Homo sapiens
ccuggacugggagguagaua

SEQ ID NO: 887387 - RNA, 14 nt, Homo sapiens
ccuggagaugauga

SEQ ID NO: 887388 - RNA, 19 nt, Homo sapiens
ccuggauguguggggcaug

SEQ ID NO: 887389 - RNA, 15 nt, Homo sapiens
ccuggcacacaucag

SEQ ID NO: 887390 - RNA, 17 nt, Homo sapiens
acaucacuacaguacag

SEQ ID NO: 887391 - RNA, 16 nt, Homo sapiens
acaucauccuccuuau

SEQ ID NO: 887392 - RNA, 15 nt, Homo sapiens
acaucaugcauucac

SEQ ID NO: 887393 - RNA, 22 nt, Homo sapiens
acauccaaccccccaccugcca

SEQ ID NO: 887394 - RNA, 21 nt, Homo sapiens
acauccaaggagaaacagaga

SEQ ID NO: 887395 - RNA, 14 nt, Homo sapiens
acauccauucccaa

SEQ ID NO: 887396 - RNA, 23 nt, Homo sapiens
acauccuccaauuccacagucuc

SEQ ID NO: 887397 - RNA, 23 nt, Homo sapiens
acauccugcuuucccuccccaaa

SEQ ID NO: 887398 - RNA, 15 nt, Homo sapiens
acaucuaagccuguu

SEQ ID NO: 887399 - RNA, 20 nt, Homo sapiens
acaucuauuauaaaaccaug

SEQ ID NO: 887400 - RNA, 23 nt, Homo sapiens
acaucuccucuaucacauuacau

SEQ ID NO: 887401 - RNA, 18 nt, Homo sapiens
acaucugugucucuggaa

SEQ ID NO: 887402 - RNA, 18 nt, Homo sapiens
acaugaacagaaacaaua

SEQ ID NO: 887403 - RNA, 11 nt, Homo sapiens
acaugacuguu

SEQ ID NO: 887404 - RNA, 14 nt, Homo sapiens
acaugaugugagau

SEQ ID NO: 887405 - RNA, 13 nt, Homo sapiens
acaugcacugacc

SEQ ID NO: 887406 - RNA, 14 nt, Homo sapiens
acaugcacugaccc

SEQ ID NO: 887407 - RNA, 23 nt, Homo sapiens
acaugcagcccagaauagcuuug

SEQ ID NO: 887408 - RNA, 17 nt, Homo sapiens
acaugcagcucugauga

SEQ ID NO: 887409 - RNA, 18 nt, Homo sapiens
acaugcugcuaauucaaa

SEQ ID NO: 887410 - RNA, 22 nt, Homo sapiens
acauggagagagacucaaagag

SEQ ID NO: 887411 - RNA, 14 nt, Homo sapiens
acauggaugcacac

SEQ ID NO: 887412 - RNA, 16 nt, Homo sapiens
acauggaugcacacac

SEQ ID NO: 887413 - RNA, 24 nt, Homo sapiens
acauggcaaaaccccaucucuacu

SEQ ID NO: 887414 - RNA, 14 nt, Homo sapiens
acauggccuaugca

SEQ ID NO: 887415 - RNA, 16 nt, Homo sapiens
acauggccuaugcaca

SEQ ID NO: 887416 - RNA, 17 nt, Homo sapiens
acauggccuaugcacau

SEQ ID NO: 887417 - RNA, 16 nt, Homo sapiens
acauggcuggcacuga

SEQ ID NO: 887418 - RNA, 22 nt, Homo sapiens
acauggcuggcacugagcagua

SEQ ID NO: 887419 - RNA, 23 nt, Homo sapiens
acauggggcauagaaacugagga

SEQ ID NO: 887420 - RNA, 17 nt, Homo sapiens
acauggugaaacccugu

SEQ ID NO: 887421 - RNA, 15 nt, Homo sapiens
acauguaccacugag

SEQ ID NO: 887422 - RNA, 17 nt, Homo sapiens
acaugugacacauaugc

SEQ ID NO: 887423 - RNA, 18 nt, Homo sapiens
acaugugacacauaugca

SEQ ID NO: 887424 - RNA, 10 nt, Homo sapiens
acaugugcuu

SEQ ID NO: 887425 - RNA, 20 nt, Homo sapiens
acauguguguauauaugugu

SEQ ID NO: 887426 - RNA, 14 nt, Homo sapiens
acauuaaaccugga

SEQ ID NO: 887427 - RNA, 13 nt, Homo sapiens
acauuaaauucac

SEQ ID NO: 887428 - RNA, 22 nt, Homo sapiens
acauuaguaucccacuagccca

SEQ ID NO: 887429 - RNA, 14 nt, Homo sapiens
acauuaucaucuga

SEQ ID NO: 887430 - RNA, 14 nt, Homo sapiens
acauuaugccuuaa

SEQ ID NO: 887431 - RNA, 19 nt, Homo sapiens
acauuaugugugcaugugu

SEQ ID NO: 887432 - RNA, 21 nt, Homo sapiens
acauucaaggcauuucuauca

SEQ ID NO: 887433 - RNA, 20 nt, Homo sapiens
acauuccaaugcauugcuaa

SEQ ID NO: 887434 - RNA, 13 nt, Homo sapiens
acauuccaggaaa

SEQ ID NO: 887435 - RNA, 15 nt, Homo sapiens
acauucccccaacau

SEQ ID NO: 887436 - RNA, 16 nt, Homo sapiens
acauuccuccuacuuc

SEQ ID NO: 887437 - RNA, 21 nt, Homo sapiens
acauucuuguuuuaagugccu

SEQ ID NO: 887438 - RNA, 11 nt, Homo sapiens
acauugaacaa

SEQ ID NO: 887439 - RNA, 23 nt, Homo sapiens
acauuggcagugugucacacuga

SEQ ID NO: 887440 - RNA, 13 nt, Homo sapiens
acauugguauauu

SEQ ID NO: 887441 - RNA, 16 nt, Homo sapiens
acauugguauucuggg

SEQ ID NO: 887442 - RNA, 15 nt, Homo sapiens
acauugucaccauuu

SEQ ID NO: 887443 - RNA, 22 nt, Homo sapiens
acauuuaauacagcagugucau

SEQ ID NO: 887444 - RNA, 20 nt, Homo sapiens
acauuuacugaccauguacu

SEQ ID NO: 887445 - RNA, 19 nt, Homo sapiens
acauuucccuccugggaga

SEQ ID NO: 887446 - RNA, 14 nt, Homo sapiens
acauuuggcauuug

SEQ ID NO: 887447 - RNA, 22 nt, Homo sapiens
acauuugguauauuaccucaaa

SEQ ID NO: 887448 - RNA, 14 nt, Homo sapiens
acccuccuguccag

SEQ ID NO: 887449 - RNA, 21 nt, Homo sapiens
acccuccuguccagcagguag

SEQ ID NO: 887450 - RNA, 16 nt, Homo sapiens
acccugaagauuucag

SEQ ID NO: 887451 - RNA, 21 nt, Homo sapiens
acccugaaugguuccaugccu

SEQ ID NO: 887452 - RNA, 23 nt, Homo sapiens
acccugaccgugcuaacugugug

SEQ ID NO: 887453 - RNA, 21 nt, Homo sapiens
acccugcagagcacacaggua

SEQ ID NO: 887454 - RNA, 16 nt, Homo sapiens
acccugggauucagga

SEQ ID NO: 887455 - RNA, 22 nt, Homo sapiens
acccuuccuacagauagucaaa

SEQ ID NO: 887456 - RNA, 16 nt, Homo sapiens
acccuuggacuugagg

SEQ ID NO: 887457 - RNA, 17 nt, Homo sapiens
acccuuucucugagaga

SEQ ID NO: 887458 - RNA, 21 nt, Homo sapiens
acccuuuuccuccagacagau

SEQ ID NO: 887459 - RNA, 13 nt, Homo sapiens
accgagcaauuuu

SEQ ID NO: 887460 - RNA, 20 nt, Homo sapiens
accgagcgcuuucuggaaaa

SEQ ID NO: 887461 - RNA, 12 nt, Homo sapiens
accgcgugccau

SEQ ID NO: 887462 - RNA, 21 nt, Homo sapiens
accgggacuucaaagccguga

SEQ ID NO: 887463 - RNA, 22 nt, Homo sapiens
accgggagccucccccucagau

SEQ ID NO: 887464 - RNA, 23 nt, Homo sapiens
accguuuuucaagaaaacuggaa

SEQ ID NO: 887465 - RNA, 16 nt, Homo sapiens
accuaaaugaccucag

SEQ ID NO: 887466 - RNA, 16 nt, Homo sapiens
accuaaauuugguucu

SEQ ID NO: 887467 - RNA, 11 nt, Homo sapiens
accuacaaggu

SEQ ID NO: 887468 - RNA, 14 nt, Homo sapiens
accuacuagacaau

SEQ ID NO: 887469 - RNA, 18 nt, Homo sapiens
accuacuuacaugcauua

SEQ ID NO: 887470 - RNA, 23 nt, Homo sapiens
accuagggagguugaagaaugag

SEQ ID NO: 887471 - RNA, 23 nt, Homo sapiens
accuauaauguguguauguguau

SEQ ID NO: 887472 - RNA, 21 nt, Homo sapiens
accuaugucccuucucaugcc

SEQ ID NO: 887473 - RNA, 17 nt, Homo sapiens
accucaaccuaugguau

SEQ ID NO: 887474 - RNA, 22 nt, Homo sapiens
accucaccagaauugugcaaau

SEQ ID NO: 887475 - RNA, 16 nt, Homo sapiens
accucacuaugcugcu

SEQ ID NO: 887476 - RNA, 12 nt, Homo sapiens
accucacugggg

SEQ ID NO: 887477 - RNA, 17 nt, Homo sapiens
accucagacaauccacu

SEQ ID NO: 887478 - RNA, 20 nt, Homo sapiens
accucagccaaacacagagc

SEQ ID NO: 887479 - RNA, 16 nt, Homo sapiens
accucagcugcacauu

SEQ ID NO: 887480 - RNA, 19 nt, Homo sapiens
accucagcugcacauuccu

SEQ ID NO: 887481 - RNA, 17 nt, Homo sapiens
accucagugucauuuau

SEQ ID NO: 887482 - RNA, 12 nt, Homo sapiens
accucaguuuua

SEQ ID NO: 887483 - RNA, 22 nt, Homo sapiens
accucaguuuuaucauuuucaa

SEQ ID NO: 887484 - RNA, 21 nt, Homo sapiens
accucauaucuuccucaucag

SEQ ID NO: 887485 - RNA, 14 nt, Homo sapiens
accucauaugcuau

SEQ ID NO: 887486 - RNA, 21 nt, Homo sapiens
accucaugcugagcgcugugu

SEQ ID NO: 887487 - RNA, 18 nt, Homo sapiens
accucauuccugggacua

SEQ ID NO: 887488 - RNA, 16 nt, Homo sapiens
accuccagaggugaug

SEQ ID NO: 887489 - RNA, 13 nt, Homo sapiens
accucccaaagug

SEQ ID NO: 887490 - RNA, 15 nt, Homo sapiens
accucccaguuugcu

SEQ ID NO: 887491 - RNA, 23 nt, Homo sapiens
accuccuauccuuggagagcagc

SEQ ID NO: 887492 - RNA, 16 nt, Homo sapiens
accuccuggaaggcag

SEQ ID NO: 887493 - RNA, 13 nt, Homo sapiens
accucuacaagca

SEQ ID NO: 887494 - RNA, 14 nt, Homo sapiens
accucugaccaaca

SEQ ID NO: 887495 - RNA, 23 nt, Homo sapiens
accucugccugaagucacacagu

SEQ ID NO: 887496 - RNA, 14 nt, Homo sapiens
accucuucucuucc

SEQ ID NO: 887497 - RNA, 13 nt, Homo sapiens
accucuugggcau

SEQ ID NO: 887498 - RNA, 18 nt, Homo sapiens
accucuugggcaugcuca

SEQ ID NO: 887499 - RNA, 13 nt, Homo sapiens
accugaaggugcu

SEQ ID NO: 887500 - RNA, 16 nt, Homo sapiens
accugacaggccuucu

SEQ ID NO: 887501 - RNA, 20 nt, Homo sapiens
accugcauguguuguacaau

SEQ ID NO: 887502 - RNA, 16 nt, Homo sapiens
accugcccucucucag

SEQ ID NO: 887503 - RNA, 15 nt, Homo sapiens
accugcugcugcuau

SEQ ID NO: 887504 - RNA, 18 nt, Homo sapiens
accuggaaggggcaaaga

SEQ ID NO: 887505 - RNA, 21 nt, Homo sapiens
ucaaacugcaugauucaugcc

SEQ ID NO: 887506 - RNA, 14 nt, Homo sapiens
ucaaagacaaugga

SEQ ID NO: 887507 - RNA, 20 nt, Homo sapiens
ucaaagacagagaagaccaa

SEQ ID NO: 887508 - RNA, 12 nt, Homo sapiens
ucaaagcacugu

SEQ ID NO: 887509 - RNA, 14 nt, Homo sapiens
ucaaagcacuguuu

SEQ ID NO: 887510 - RNA, 20 nt, Homo sapiens
ucaaagcacuguuucucuca

SEQ ID NO: 887511 - RNA, 13 nt, Homo sapiens
ucaaagcaguagu

SEQ ID NO: 887512 - RNA, 23 nt, Homo sapiens
ucaaagcucuauuaagauuucca

SEQ ID NO: 887513 - RNA, 16 nt, Homo sapiens
ucaaaggaagacuuga

SEQ ID NO: 887514 - RNA, 15 nt, Homo sapiens
ucaaaguaaaacuug

SEQ ID NO: 887515 - RNA, 13 nt, Homo sapiens
ucaaauaaaaagu

SEQ ID NO: 887516 - RNA, 13 nt, Homo sapiens
ucaaauagcauaa

SEQ ID NO: 887517 - RNA, 21 nt, Homo sapiens
ucaaauaugcaaagcacugac

SEQ ID NO: 887518 - RNA, 20 nt, Homo sapiens
ucaaauauuaccaaaaaagu

SEQ ID NO: 887519 - RNA, 12 nt, Homo sapiens
ucaaaugcacau

SEQ ID NO: 887520 - RNA, 20 nt, Homo sapiens
ucaaauggacucauggcuua

SEQ ID NO: 887521 - RNA, 15 nt, Homo sapiens
ucaaaugucagagcu

SEQ ID NO: 887522 - RNA, 19 nt, Homo sapiens
ucaaaugucagagcuaugu

SEQ ID NO: 887523 - RNA, 17 nt, Homo sapiens
ucaaauugcuacauagu

SEQ ID NO: 887524 - RNA, 22 nt, Homo sapiens
ucaaauuucuguucucucuucc

SEQ ID NO: 887525 - RNA, 23 nt, Homo sapiens
ucaaauuuugaugccaagaaagu

SEQ ID NO: 887526 - RNA, 16 nt, Homo sapiens
ucaacaaccaugccag

SEQ ID NO: 887527 - RNA, 21 nt, Homo sapiens
ucaacaaguaacuuuguagaa

SEQ ID NO: 887528 - RNA, 16 nt, Homo sapiens
ucaacaguucaaagaa

SEQ ID NO: 887529 - RNA, 21 nt, Homo sapiens
ucaacauucccccaacauuac

SEQ ID NO: 887530 - RNA, 15 nt, Homo sapiens
ucaaccacucgccga

SEQ ID NO: 887531 - RNA, 15 nt, Homo sapiens
ucaaccgcuugccau

SEQ ID NO: 887532 - RNA, 17 nt, Homo sapiens
ucaacugaaaagacuca

SEQ ID NO: 887533 - RNA, 14 nt, Homo sapiens
ucaagaaaacugga

SEQ ID NO: 887534 - RNA, 16 nt, Homo sapiens
ucaagaaaacuggaaa

SEQ ID NO: 887535 - RNA, 15 nt, Homo sapiens
ucaagaaacugagga

SEQ ID NO: 887536 - RNA, 23 nt, Homo sapiens
ucaagaaaugaaugcuccaugaa

SEQ ID NO: 887537 - RNA, 15 nt, Homo sapiens
ucaagagacacugcu

SEQ ID NO: 887538 - RNA, 17 nt, Homo sapiens
ucaagagugagugaaca

SEQ ID NO: 887539 - RNA, 14 nt, Homo sapiens
ucaagagugcaguu

SEQ ID NO: 887540 - RNA, 17 nt, Homo sapiens
ucaagaugacagcucuu

SEQ ID NO: 887541 - RNA, 13 nt, Homo sapiens
ucaagcaugcaau

SEQ ID NO: 887542 - RNA, 19 nt, Homo sapiens
ucaagccaguacgugcuaa

SEQ ID NO: 887543 - RNA, 18 nt, Homo sapiens
ucaagcccuuuacuugac

SEQ ID NO: 887544 - RNA, 22 nt, Homo sapiens
ucaagcgauucuucugccucag

SEQ ID NO: 887545 - RNA, 18 nt, Homo sapiens
ucaagcuagaaggccaca

SEQ ID NO: 887546 - RNA, 14 nt, Homo sapiens
ucaaggaauuugca

SEQ ID NO: 887547 - RNA, 21 nt, Homo sapiens
ucaaggacuccugucuguccu

SEQ ID NO: 887548 - RNA, 20 nt, Homo sapiens
ucaagggauguauuggaaca

SEQ ID NO: 887549 - RNA, 15 nt, Homo sapiens
ucaagggccagucag

SEQ ID NO: 887550 - RNA, 18 nt, Homo sapiens
ucaagggguguucaguua

SEQ ID NO: 887551 - RNA, 20 nt, Homo sapiens
ucaaguauuagggguaauau

SEQ ID NO: 887552 - RNA, 19 nt, Homo sapiens
ucaaguccuacaagcuaaa

SEQ ID NO: 887553 - RNA, 13 nt, Homo sapiens
ucaagucuggauc

SEQ ID NO: 887554 - RNA, 22 nt, Homo sapiens
ucaagugauccacccaccucag

SEQ ID NO: 887555 - RNA, 20 nt, Homo sapiens
ucaagugauccaccugccuu

SEQ ID NO: 887556 - RNA, 15 nt, Homo sapiens
ucaaguugcuucuca

SEQ ID NO: 887557 - RNA, 16 nt, Homo sapiens
ucaaguuuuucagaaa

SEQ ID NO: 887558 - RNA, 15 nt, Homo sapiens
ucaauaaaagaauuc

SEQ ID NO: 887559 - RNA, 19 nt, Homo sapiens
ucaauaaauuaaguuuuau

SEQ ID NO: 887560 - RNA, 13 nt, Homo sapiens
ucaauaagccagc

SEQ ID NO: 887561 - RNA, 17 nt, Homo sapiens
ucaauaauauuagcuua

SEQ ID NO: 887562 - RNA, 21 nt, Homo sapiens
ucaauaugaaggacuauuaau

SEQ ID NO: 887563 - RNA, 14 nt, Homo sapiens
agggaaaguuaaaa

SEQ ID NO: 887564 - RNA, 23 nt, Homo sapiens
agggaaaguuaaaaguguugauu

SEQ ID NO: 887565 - RNA, 17 nt, Homo sapiens
agggaaauucacacugu

SEQ ID NO: 887566 - RNA, 18 nt, Homo sapiens
agggaaauucacacugug

SEQ ID NO: 887567 - RNA, 18 nt, Homo sapiens
agggaacaagcauucucc

SEQ ID NO: 887568 - RNA, 21 nt, Homo sapiens
agggaacccugcuugcacuuu

SEQ ID NO: 887569 - RNA, 18 nt, Homo sapiens
agggaacgggguccuuca

SEQ ID NO: 887570 - RNA, 22 nt, Homo sapiens
agggaaggaacucuggcuucca

SEQ ID NO: 887571 - RNA, 20 nt, Homo sapiens
agggaauggcacagcccaaa

SEQ ID NO: 887572 - RNA, 19 nt, Homo sapiens
agggacaaaacacuguguc

SEQ ID NO: 887573 - RNA, 14 nt, Homo sapiens
agggacccacuuca

SEQ ID NO: 887574 - RNA, 16 nt, Homo sapiens
agggacuccaguucac

SEQ ID NO: 887575 - RNA, 18 nt, Homo sapiens
agggacugucgcugcuuc

SEQ ID NO: 887576 - RNA, 22 nt, Homo sapiens
agggacuucugucuucacaaca

SEQ ID NO: 887577 - RNA, 14 nt, Homo sapiens
agggagacagagac

SEQ ID NO: 887578 - RNA, 18 nt, Homo sapiens
agggagacugcaucucaa

SEQ ID NO: 887579 - RNA, 15 nt, Homo sapiens
agggagagccaucac

SEQ ID NO: 887580 - RNA, 23 nt, Homo sapiens
agggagccaucccuucccugucc

SEQ ID NO: 887581 - RNA, 19 nt, Homo sapiens
agggagccgcaccuuguca

SEQ ID NO: 887582 - RNA, 22 nt, Homo sapiens
agggagggacacuuacccaagg

SEQ ID NO: 887583 - RNA, 17 nt, Homo sapiens
agggauccguacauuca

SEQ ID NO: 887584 - RNA, 19 nt, Homo sapiens
agggaucuugcauucccag

SEQ ID NO: 887585 - RNA, 19 nt, Homo sapiens
agggaugucacgucuugaa

SEQ ID NO: 887586 - RNA, 15 nt, Homo sapiens
agggauguucuagcc

SEQ ID NO: 887587 - RNA, 22 nt, Homo sapiens
agggcaaaugacaugcacugac

SEQ ID NO: 887588 - RNA, 16 nt, Homo sapiens
agggcaauaaaugccc

SEQ ID NO: 887589 - RNA, 15 nt, Homo sapiens
agggcacaggagcua

SEQ ID NO: 887590 - RNA, 16 nt, Homo sapiens
agggcacucacaugcc

SEQ ID NO: 887591 - RNA, 21 nt, Homo sapiens
agggcagaaggggaagauacu

SEQ ID NO: 887592 - RNA, 22 nt, Homo sapiens
agggcagccaggggcugcucau

SEQ ID NO: 887593 - RNA, 15 nt, Homo sapiens
agggcaggcuugcca

SEQ ID NO: 887594 - RNA, 18 nt, Homo sapiens
agggcaguaccugggaaa

SEQ ID NO: 887595 - RNA, 19 nt, Homo sapiens
agggcaguaucucucugcc

SEQ ID NO: 887596 - RNA, 17 nt, Homo sapiens
agggcauggccaggugg

SEQ ID NO: 887597 - RNA, 23 nt, Homo sapiens
agggccuagcuuucauuugacac

SEQ ID NO: 887598 - RNA, 13 nt, Homo sapiens
agggccucuggga

SEQ ID NO: 887599 - RNA, 23 nt, Homo sapiens
agggcuagaaccuguagagcuag

SEQ ID NO: 887600 - RNA, 21 nt, Homo sapiens
agggcugaccugccucucaca

SEQ ID NO: 887601 - RNA, 23 nt, Homo sapiens
agggcuggaaucuggagagcuag

SEQ ID NO: 887602 - RNA, 16 nt, Homo sapiens
agggcuggcugcugga

SEQ ID NO: 887603 - RNA, 13 nt, Homo sapiens
agggcugugcuga

SEQ ID NO: 887604 - RNA, 14 nt, Homo sapiens
aggggcaccugcca

SEQ ID NO: 887605 - RNA, 20 nt, Homo sapiens
agggggcgcucaggacccag

SEQ ID NO: 887606 - RNA, 13 nt, Homo sapiens
agggggugugcgu

SEQ ID NO: 887607 - RNA, 21 nt, Homo sapiens
agggguaauauauugcugcug

SEQ ID NO: 887608 - RNA, 18 nt, Homo sapiens
aggggugauucugaaacc

SEQ ID NO: 887609 - RNA, 19 nt, Homo sapiens
agggucaggcggggugcug

SEQ ID NO: 887610 - RNA, 20 nt, Homo sapiens
aggguccccagcugguccag

SEQ ID NO: 887611 - RNA, 16 nt, Homo sapiens
aggguccgcaccagcu

SEQ ID NO: 887612 - RNA, 14 nt, Homo sapiens
agggucucuucagg

SEQ ID NO: 887613 - RNA, 23 nt, Homo sapiens
agggucuuccuccuaaauuucca

SEQ ID NO: 887614 - RNA, 17 nt, Homo sapiens
agggucuuugcaagaau

SEQ ID NO: 887615 - RNA, 23 nt, Homo sapiens
aggguguaucuagcucuaguuca

SEQ ID NO: 887616 - RNA, 21 nt, Homo sapiens
aggguugggcgugcuaccugc

SEQ ID NO: 887617 - RNA, 22 nt, Homo sapiens
aggguugggcgugcuaccugca

SEQ ID NO: 887618 - RNA, 19 nt, Homo sapiens
aggguugggcuggugucac

SEQ ID NO: 887619 - RNA, 17 nt, Homo sapiens
agguaaacaaacaaaua

SEQ ID NO: 887620 - RNA, 12 nt, Homo sapiens
ugcagagcaaug

SEQ ID NO: 887621 - RNA, 16 nt, Homo sapiens
ugcagagcugaagauu

SEQ ID NO: 887622 - RNA, 17 nt, Homo sapiens
ugcagcagaagccaaau

SEQ ID NO: 887623 - RNA, 22 nt, Homo sapiens
ugcagcagugagucucuucaga

SEQ ID NO: 887624 - RNA, 14 nt, Homo sapiens
ugcagccaugacca

SEQ ID NO: 887625 - RNA, 19 nt, Homo sapiens
ugcagcccagaauagcuuu

SEQ ID NO: 887626 - RNA, 21 nt, Homo sapiens
ugcagcggcacaaaugcaccu

SEQ ID NO: 887627 - RNA, 20 nt, Homo sapiens
ugcagcuuaaaacaagcaaa

SEQ ID NO: 887628 - RNA, 23 nt, Homo sapiens
ugcagcuucggggcaagugagac

SEQ ID NO: 887629 - RNA, 14 nt, Homo sapiens
ugcagcuuguucag

SEQ ID NO: 887630 - RNA, 14 nt, Homo sapiens
ugcaggaaaacuga

SEQ ID NO: 887631 - RNA, 23 nt, Homo sapiens
ugcaggaagugucuagaggaaua

SEQ ID NO: 887632 - RNA, 19 nt, Homo sapiens
ugcagggaagagggcagua

SEQ ID NO: 887633 - RNA, 14 nt, Homo sapiens
ugcagggacugcca

SEQ ID NO: 887634 - RNA, 21 nt, Homo sapiens
ugcagggggugugucugcuca

SEQ ID NO: 887635 - RNA, 22 nt, Homo sapiens
ugcaguauuuuauuaaagcaac

SEQ ID NO: 887636 - RNA, 16 nt, Homo sapiens
ugcaguccccagucac

SEQ ID NO: 887637 - RNA, 22 nt, Homo sapiens
ugcagucucagagacuauuuag

SEQ ID NO: 887638 - RNA, 18 nt, Homo sapiens
ugcagugguaugaucacg

SEQ ID NO: 887639 - RNA, 18 nt, Homo sapiens
ugcaguuccugaguaccu

SEQ ID NO: 887640 - RNA, 18 nt, Homo sapiens
ugcauaaaccaaugagcu

SEQ ID NO: 887641 - RNA, 21 nt, Homo sapiens
ugcauaaaugugguacaagca

SEQ ID NO: 887642 - RNA, 18 nt, Homo sapiens
ugcauacagagacagaua

SEQ ID NO: 887643 - RNA, 19 nt, Homo sapiens
ugcauagagccacguaugu

SEQ ID NO: 887644 - RNA, 17 nt, Homo sapiens
ugcaucaucagccuauu

SEQ ID NO: 887645 - RNA, 15 nt, Homo sapiens
ugcaugaaucuguac

SEQ ID NO: 887646 - RNA, 19 nt, Homo sapiens
ugcaugauuuuauacauag

SEQ ID NO: 887647 - RNA, 16 nt, Homo sapiens
ugcaugcacuucuuac

SEQ ID NO: 887648 - RNA, 17 nt, Homo sapiens
ugcaugcacuucuuaca

SEQ ID NO: 887649 - RNA, 11 nt, Homo sapiens
ugcaugccaaa

SEQ ID NO: 887650 - RNA, 14 nt, Homo sapiens
ugcaugcucaggac

SEQ ID NO: 887651 - RNA, 13 nt, Homo sapiens
ugcauguaugugc

SEQ ID NO: 887652 - RNA, 13 nt, Homo sapiens
ugcauguaugugu

SEQ ID NO: 887653 - RNA, 22 nt, Homo sapiens
ugcauguccucuuguugcugag

SEQ ID NO: 887654 - RNA, 19 nt, Homo sapiens
ugcauguuggcccagaccu

SEQ ID NO: 887655 - RNA, 21 nt, Homo sapiens
ugcauuaaaaaugcauauacu

SEQ ID NO: 887656 - RNA, 20 nt, Homo sapiens
ugcauuacugcaugcacuuc

SEQ ID NO: 887657 - RNA, 18 nt, Homo sapiens
ugcauuagaaacugaaaa

SEQ ID NO: 887658 - RNA, 16 nt, Homo sapiens
ugcauuauucauaugc

SEQ ID NO: 887659 - RNA, 23 nt, Homo sapiens
ugcauuuauaaauguguggugcu

SEQ ID NO: 887660 - RNA, 17 nt, Homo sapiens
ugcauuucugucucucu

SEQ ID NO: 887661 - RNA, 19 nt, Homo sapiens
ugcauuuucccagauacuu

SEQ ID NO: 887662 - RNA, 13 nt, Homo sapiens
ugccaacugguca

SEQ ID NO: 887663 - RNA, 23 nt, Homo sapiens
ugccaagcccucaauaagccagc

SEQ ID NO: 887664 - RNA, 15 nt, Homo sapiens
ugccaauuagcaauu

SEQ ID NO: 887665 - RNA, 12 nt, Homo sapiens
ugccacaaugcc

SEQ ID NO: 887666 - RNA, 14 nt, Homo sapiens
ugccacaaugccuc

SEQ ID NO: 887667 - RNA, 17 nt, Homo sapiens
ugccaccuccuggaagg

SEQ ID NO: 887668 - RNA, 14 nt, Homo sapiens
ugccacucauuccu

SEQ ID NO: 887669 - RNA, 21 nt, Homo sapiens
ugccacuccugcuucucuggg

SEQ ID NO: 887670 - RNA, 14 nt, Homo sapiens
ugccacugccucuu

SEQ ID NO: 887671 - RNA, 14 nt, Homo sapiens
ugccagacaugugg

SEQ ID NO: 887672 - RNA, 18 nt, Homo sapiens
ugccagacuuaaaucaca

SEQ ID NO: 887673 - RNA, 20 nt, Homo sapiens
ugccagagcccaagugccau

SEQ ID NO: 887674 - RNA, 17 nt, Homo sapiens
ugccagccgugaugcuc

SEQ ID NO: 887675 - RNA, 15 nt, Homo sapiens
ugccagcucagguga

SEQ ID NO: 887676 - RNA, 22 nt, Homo sapiens
ugccaggaccagucccagagca

SEQ ID NO: 887677 - RNA, 19 nt, Homo sapiens
cgcuuuguacuuugugcaa

SEQ ID NO: 887678 - RNA, 22 nt, Homo sapiens
cggaaccugaaggugcugacaa

SEQ ID NO: 887679 - RNA, 16 nt, Homo sapiens
cggaagccaacuuggc

SEQ ID NO: 887680 - RNA, 14 nt, Homo sapiens
cggacagugcccau

SEQ ID NO: 887681 - RNA, 16 nt, Homo sapiens
cggacccaucuuugcu

SEQ ID NO: 887682 - RNA, 23 nt, Homo sapiens
cggacugcaagcagggcucugcc

SEQ ID NO: 887683 - RNA, 22 nt, Homo sapiens
cggagccauuuuuagcucugau

SEQ ID NO: 887684 - RNA, 17 nt, Homo sapiens
cggagccuccucucuca

SEQ ID NO: 887685 - RNA, 16 nt, Homo sapiens
cggagcuugcagugag

SEQ ID NO: 887686 - RNA, 12 nt, Homo sapiens
cggagcuuucaa

SEQ ID NO: 887687 - RNA, 15 nt, Homo sapiens
cggauuccuuuauga

SEQ ID NO: 887688 - RNA, 19 nt, Homo sapiens
cggcaucgggccaucucag

SEQ ID NO: 887689 - RNA, 17 nt, Homo sapiens
cggccagccuugcacug

SEQ ID NO: 887690 - RNA, 21 nt, Homo sapiens
cggccccugcugguucagggu

SEQ ID NO: 887691 - RNA, 15 nt, Homo sapiens
cggccuugggaaauc

SEQ ID NO: 887692 - RNA, 21 nt, Homo sapiens
cggcugcgucuccuccgcaca

SEQ ID NO: 887693 - RNA, 21 nt, Homo sapiens
cgggaagcgaugaauuuggag

SEQ ID NO: 887694 - RNA, 17 nt, Homo sapiens
cgggagccguagagggu

SEQ ID NO: 887695 - RNA, 18 nt, Homo sapiens
cgggcugggagcucugca

SEQ ID NO: 887696 - RNA, 21 nt, Homo sapiens
cggggcgaccccucagugcuc

SEQ ID NO: 887697 - RNA, 18 nt, Homo sapiens
cgggggccagacacagau

SEQ ID NO: 887698 - RNA, 15 nt, Homo sapiens
cggggugcuguggug

SEQ ID NO: 887699 - RNA, 15 nt, Homo sapiens
cggguggaucaccug

SEQ ID NO: 887700 - RNA, 14 nt, Homo sapiens
cggucccacacugg

SEQ ID NO: 887701 - RNA, 13 nt, Homo sapiens
cggugaaauccag

SEQ ID NO: 887702 - RNA, 16 nt, Homo sapiens
cgguggacccagggau

SEQ ID NO: 887703 - RNA, 18 nt, Homo sapiens
cgguggcucuugccugua

SEQ ID NO: 887704 - RNA, 18 nt, Homo sapiens
cggugucuggaaaagcac

SEQ ID NO: 887705 - RNA, 19 nt, Homo sapiens
cggugucuggaaaagcacu

SEQ ID NO: 887706 - RNA, 17 nt, Homo sapiens
cgguguuuaaagucaac

SEQ ID NO: 887707 - RNA, 14 nt, Homo sapiens
cguaacaacugugg

SEQ ID NO: 887708 - RNA, 15 nt, Homo sapiens
cguaacaacuguggu

SEQ ID NO: 887709 - RNA, 13 nt, Homo sapiens
cguagccaucucu

SEQ ID NO: 887710 - RNA, 18 nt, Homo sapiens
cguagcuuucccaaauaa

SEQ ID NO: 887711 - RNA, 14 nt, Homo sapiens
cguaguucccugaa

SEQ ID NO: 887712 - RNA, 11 nt, Homo sapiens
cguaucaugca

SEQ ID NO: 887713 - RNA, 21 nt, Homo sapiens
cguaucugcucuuaggugcuu

SEQ ID NO: 887714 - RNA, 17 nt, Homo sapiens
cgucagaccaguacugg

SEQ ID NO: 887715 - RNA, 20 nt, Homo sapiens
cgucagaccaguacugggaa

SEQ ID NO: 887716 - RNA, 18 nt, Homo sapiens
cgucucaaaaacaaaaca

SEQ ID NO: 887717 - RNA, 15 nt, Homo sapiens
cgucucaagacugaa

SEQ ID NO: 887718 - RNA, 20 nt, Homo sapiens
cgucucuacuaaaaauacaa

SEQ ID NO: 887719 - RNA, 15 nt, Homo sapiens
cgucuucuguauacu

SEQ ID NO: 887720 - RNA, 16 nt, Homo sapiens
cgugaaagcagaugag

SEQ ID NO: 887721 - RNA, 23 nt, Homo sapiens
cgugaaauugaugccaguggaau

SEQ ID NO: 887722 - RNA, 19 nt, Homo sapiens
cgugaacugcgugccagug

SEQ ID NO: 887723 - RNA, 14 nt, Homo sapiens
cgugacaacaugcg

SEQ ID NO: 887724 - RNA, 9 nt, Homo sapiens
cgugcaaua

SEQ ID NO: 887725 - RNA, 17 nt, Homo sapiens
cgugcacacaccagagc

SEQ ID NO: 887726 - RNA, 13 nt, Homo sapiens
cgugccugugauc

SEQ ID NO: 887727 - RNA, 19 nt, Homo sapiens
cgugcugcaugccuggucu

SEQ ID NO: 887728 - RNA, 22 nt, Homo sapiens
cguggacucugcacaugucuug

SEQ ID NO: 887729 - RNA, 18 nt, Homo sapiens
cguguagugucuguaaua

SEQ ID NO: 887730 - RNA, 16 nt, Homo sapiens
cguguccagcacagaa

SEQ ID NO: 887731 - RNA, 20 nt, Homo sapiens
cguguccagcacagaaggaa

SEQ ID NO: 887732 - RNA, 13 nt, Homo sapiens
cgugucucaggag

SEQ ID NO: 887733 - RNA, 22 nt, Homo sapiens
cguguguauuagaaugcaugua

SEQ ID NO: 887734 - RNA, 19 nt, Homo sapiens
cguguguguguuucaucug

SEQ ID NO: 887735 - RNA, 18 nt, Homo sapiens
agucucucccgauaucac

SEQ ID NO: 887736 - RNA, 13 nt, Homo sapiens
agucucugcugcu

SEQ ID NO: 887737 - RNA, 16 nt, Homo sapiens
agucugaaagacagaa

SEQ ID NO: 887738 - RNA, 21 nt, Homo sapiens
agucugaggccccuuaacuca

SEQ ID NO: 887739 - RNA, 16 nt, Homo sapiens
agucugucauccagaa

SEQ ID NO: 887740 - RNA, 23 nt, Homo sapiens
agucuuaaaauaacuuauaucau

SEQ ID NO: 887741 - RNA, 14 nt, Homo sapiens
agucuuaauauaua

SEQ ID NO: 887742 - RNA, 18 nt, Homo sapiens
agucuugcucuguugccc

SEQ ID NO: 887743 - RNA, 13 nt, Homo sapiens
agugaaaaaucug

SEQ ID NO: 887744 - RNA, 17 nt, Homo sapiens
agugaaagaguagugca

SEQ ID NO: 887745 - RNA, 20 nt, Homo sapiens
agugaaagaguagugcauuu

SEQ ID NO: 887746 - RNA, 16 nt, Homo sapiens
agugaaagccagauuc

SEQ ID NO: 887747 - RNA, 14 nt, Homo sapiens
agugaacacacuca

SEQ ID NO: 887748 - RNA, 23 nt, Homo sapiens
agugaacuauuucuacacagugg

SEQ ID NO: 887749 - RNA, 16 nt, Homo sapiens
agugaauaaacuucag

SEQ ID NO: 887750 - RNA, 21 nt, Homo sapiens
agugaauugacccauguuccc

SEQ ID NO: 887751 - RNA, 18 nt, Homo sapiens
agugacagagacccagau

SEQ ID NO: 887752 - RNA, 20 nt, Homo sapiens
agugacaucucuuugauguc

SEQ ID NO: 887753 - RNA, 19 nt, Homo sapiens
agugacaugggugugccag

SEQ ID NO: 887754 - RNA, 12 nt, Homo sapiens
agugacauuugu

SEQ ID NO: 887755 - RNA, 21 nt, Homo sapiens
agugaccaggcucacaacugu

SEQ ID NO: 887756 - RNA, 21 nt, Homo sapiens
agugaccauaaaggcauggca

SEQ ID NO: 887757 - RNA, 17 nt, Homo sapiens
agugaccccagccuccu

SEQ ID NO: 887758 - RNA, 17 nt, Homo sapiens
agugacuuuacaggagg

SEQ ID NO: 887759 - RNA, 20 nt, Homo sapiens
agugacuuuagaaacaaauu

SEQ ID NO: 887760 - RNA, 15 nt, Homo sapiens
agugagaaaccagcc

SEQ ID NO: 887761 - RNA, 22 nt, Homo sapiens
agugagaucuucaaugcuuccu

SEQ ID NO: 887762 - RNA, 16 nt, Homo sapiens
agugagcucuggauga

SEQ ID NO: 887763 - RNA, 17 nt, Homo sapiens
agugagcucuggaugaa

SEQ ID NO: 887764 - RNA, 22 nt, Homo sapiens
agugauaucccccagccucaag

SEQ ID NO: 887765 - RNA, 17 nt, Homo sapiens
agugauaugauguguag

SEQ ID NO: 887766 - RNA, 19 nt, Homo sapiens
agugaucaguaugcuguuu

SEQ ID NO: 887767 - RNA, 17 nt, Homo sapiens
agugauugacacacagc

SEQ ID NO: 887768 - RNA, 22 nt, Homo sapiens
agugauugauagaguguuauca

SEQ ID NO: 887769 - RNA, 17 nt, Homo sapiens
agugauuucauucugcc

SEQ ID NO: 887770 - RNA, 20 nt, Homo sapiens
agugcaauuuccccucugug

SEQ ID NO: 887771 - RNA, 16 nt, Homo sapiens
agugcacuguauauag

SEQ ID NO: 887772 - RNA, 18 nt, Homo sapiens
agugcagggaaccgugau

SEQ ID NO: 887773 - RNA, 21 nt, Homo sapiens
agugcagugagccgagaucac

SEQ ID NO: 887774 - RNA, 23 nt, Homo sapiens
agugcaguggugcgaucuuggcu

SEQ ID NO: 887775 - RNA, 23 nt, Homo sapiens
agugcaucugggaagauuucuac

SEQ ID NO: 887776 - RNA, 21 nt, Homo sapiens
agugcauuuaugagcucuuca

SEQ ID NO: 887777 - RNA, 17 nt, Homo sapiens
agugccaauauuucuga

SEQ ID NO: 887778 - RNA, 19 nt, Homo sapiens
agugccacuugacauuccu

SEQ ID NO: 887779 - RNA, 15 nt, Homo sapiens
agugccaucccacau

SEQ ID NO: 887780 - RNA, 13 nt, Homo sapiens
agugccugagaca

SEQ ID NO: 887781 - RNA, 13 nt, Homo sapiens
agugccugcugaa

SEQ ID NO: 887782 - RNA, 14 nt, Homo sapiens
agugccuggcaagg

SEQ ID NO: 887783 - RNA, 14 nt, Homo sapiens
agugccuuaccucc

SEQ ID NO: 887784 - RNA, 14 nt, Homo sapiens
agugccuuuaguuu

SEQ ID NO: 887785 - RNA, 14 nt, Homo sapiens
agugcuaguauuau

SEQ ID NO: 887786 - RNA, 17 nt, Homo sapiens
agugcuaugccaagcca

SEQ ID NO: 887787 - RNA, 19 nt, Homo sapiens
agugcugagaaggacaccu

SEQ ID NO: 887788 - RNA, 22 nt, Homo sapiens
agugcugagaaggacaccuccu

SEQ ID NO: 887789 - RNA, 21 nt, Homo sapiens
agugcuugauugcguggaauu

SEQ ID NO: 887790 - RNA, 13 nt, Homo sapiens
aguggagaggaaa

SEQ ID NO: 887791 - RNA, 15 nt, Homo sapiens
aguggaucuccaagg

SEQ ID NO: 887792 - RNA, 13 nt, Homo sapiens
auaaagauguuau

SEQ ID NO: 887793 - RNA, 17 nt, Homo sapiens
auaaagcccuugaacca

SEQ ID NO: 887794 - RNA, 18 nt, Homo sapiens
auaaagcccuugaaccag

SEQ ID NO: 887795 - RNA, 15 nt, Homo sapiens
auaaaggcauggcau

SEQ ID NO: 887796 - RNA, 22 nt, Homo sapiens
auaaaggucuuugcacauguga

SEQ ID NO: 887797 - RNA, 23 nt, Homo sapiens
auaaaggugauugauuguauugc

SEQ ID NO: 887798 - RNA, 19 nt, Homo sapiens
auaaagguuuuugaauuca

SEQ ID NO: 887799 - RNA, 17 nt, Homo sapiens
auaaaguaccauuaguu

SEQ ID NO: 887800 - RNA, 13 nt, Homo sapiens
auaaagugaucag

SEQ ID NO: 887801 - RNA, 22 nt, Homo sapiens
auaaauccucagguaguacugg

SEQ ID NO: 887802 - RNA, 17 nt, Homo sapiens
auaaaugaaucuuacuc

SEQ ID NO: 887803 - RNA, 19 nt, Homo sapiens
auaaauguaaauauguaca

SEQ ID NO: 887804 - RNA, 20 nt, Homo sapiens
auaaauguauaggcagaugu

SEQ ID NO: 887805 - RNA, 21 nt, Homo sapiens
auaaaugucuuaaucaugaga

SEQ ID NO: 887806 - RNA, 18 nt, Homo sapiens
auaaaugugguacaagca

SEQ ID NO: 887807 - RNA, 17 nt, Homo sapiens
auaaauguguaaaugug

SEQ ID NO: 887808 - RNA, 22 nt, Homo sapiens
auaaauguuauguuugcuaaaa

SEQ ID NO: 887809 - RNA, 14 nt, Homo sapiens
auaaauucaaacca

SEQ ID NO: 887810 - RNA, 23 nt, Homo sapiens
auaacauaaauuuaucaucucga

SEQ ID NO: 887811 - RNA, 12 nt, Homo sapiens
auaaccacuuaa

SEQ ID NO: 887812 - RNA, 19 nt, Homo sapiens
auaaccccaggcaucccau

SEQ ID NO: 887813 - RNA, 23 nt, Homo sapiens
auaaccuucaugaugaauuacuu

SEQ ID NO: 887814 - RNA, 23 nt, Homo sapiens
auaaccuuccuucuaaacauuuu

SEQ ID NO: 887815 - RNA, 14 nt, Homo sapiens
auaacuagaucucc

SEQ ID NO: 887816 - RNA, 22 nt, Homo sapiens
auaacuaggcguggacuuacua

SEQ ID NO: 887817 - RNA, 18 nt, Homo sapiens
auaacuaguguugcuugg

SEQ ID NO: 887818 - RNA, 21 nt, Homo sapiens
auaacuuaaaaaaaugacaga

SEQ ID NO: 887819 - RNA, 14 nt, Homo sapiens
auaacuuauaucau

SEQ ID NO: 887820 - RNA, 18 nt, Homo sapiens
auaacuuguccuauguca

SEQ ID NO: 887821 - RNA, 14 nt, Homo sapiens
auaagaaacacaaa

SEQ ID NO: 887822 - RNA, 14 nt, Homo sapiens
auaagaacgucauu

SEQ ID NO: 887823 - RNA, 15 nt, Homo sapiens
auaagaucugagauu

SEQ ID NO: 887824 - RNA, 23 nt, Homo sapiens
auaagcaaagggagcacuggguu

SEQ ID NO: 887825 - RNA, 19 nt, Homo sapiens
auaagcagaagcacauaug

SEQ ID NO: 887826 - RNA, 16 nt, Homo sapiens
auaagcaucuguguaa

SEQ ID NO: 887827 - RNA, 20 nt, Homo sapiens
auaaguccacaucuucucag

SEQ ID NO: 887828 - RNA, 21 nt, Homo sapiens
auaaguccacaucuucucagu

SEQ ID NO: 887829 - RNA, 19 nt, Homo sapiens
auaauaaaaagacuauuaa

SEQ ID NO: 887830 - RNA, 16 nt, Homo sapiens
auaauacuagucuuau

SEQ ID NO: 887831 - RNA, 14 nt, Homo sapiens
auaauauaagccau

SEQ ID NO: 887832 - RNA, 20 nt, Homo sapiens
auaaucacauuaucaucuga

SEQ ID NO: 887833 - RNA, 14 nt, Homo sapiens
auaaucacauugac

SEQ ID NO: 887834 - RNA, 18 nt, Homo sapiens
auaaucaucucugucaca

SEQ ID NO: 887835 - RNA, 21 nt, Homo sapiens
auaaucuuuggguaacuucaa

SEQ ID NO: 887836 - RNA, 18 nt, Homo sapiens
auaaugaaaauuaugaua

SEQ ID NO: 887837 - RNA, 17 nt, Homo sapiens
auaaugcuguugccuca

SEQ ID NO: 887838 - RNA, 18 nt, Homo sapiens
auaaugcuguugccucau

SEQ ID NO: 887839 - RNA, 17 nt, Homo sapiens
auaaugggaagccugua

SEQ ID NO: 887840 - RNA, 19 nt, Homo sapiens
auaaugguugacuggguuu

SEQ ID NO: 887841 - RNA, 14 nt, Homo sapiens
auaaugguuuacug

SEQ ID NO: 887842 - RNA, 13 nt, Homo sapiens
auaauguguguau

SEQ ID NO: 887843 - RNA, 14 nt, Homo sapiens
auaauucuaugaga

SEQ ID NO: 887844 - RNA, 12 nt, Homo sapiens
auaauuguguac

SEQ ID NO: 887845 - RNA, 16 nt, Homo sapiens
auaauuguguacaaag

SEQ ID NO: 887846 - RNA, 15 nt, Homo sapiens
auaauuuaacuucag

SEQ ID NO: 887847 - RNA, 20 nt, Homo sapiens
auaauuucaucccuauuuau

SEQ ID NO: 887848 - RNA, 17 nt, Homo sapiens
auacaaacaagcacaga

SEQ ID NO: 887849 - RNA, 19 nt, Homo sapiens
auacaaauuguuucuggaa

SEQ ID NO: 887850 - RNA, 15 nt, Homo sapiens
cuaggaggaaaaaga

SEQ ID NO: 887851 - RNA, 21 nt, Homo sapiens
cuaggccacuccuccaaagga

SEQ ID NO: 887852 - RNA, 18 nt, Homo sapiens
cuaggccagagcgggggu

SEQ ID NO: 887853 - RNA, 21 nt, Homo sapiens
cuagggcuggagggacaggga

SEQ ID NO: 887854 - RNA, 22 nt, Homo sapiens
cuagggucaggcggggugcugu

SEQ ID NO: 887855 - RNA, 21 nt, Homo sapiens
cuaggucaaaacauucaggua

SEQ ID NO: 887856 - RNA, 12 nt, Homo sapiens
cuaggucuguaa

SEQ ID NO: 887857 - RNA, 20 nt, Homo sapiens
cuagguucuaaaaauuguga

SEQ ID NO: 887858 - RNA, 16 nt, Homo sapiens
cuaguagcggaucuca

SEQ ID NO: 887859 - RNA, 15 nt, Homo sapiens
cuagucauaaccuua

SEQ ID NO: 887860 - RNA, 15 nt, Homo sapiens
cuagucugcuagcca

SEQ ID NO: 887861 - RNA, 18 nt, Homo sapiens
cuagugaagauguuguca

SEQ ID NO: 887862 - RNA, 16 nt, Homo sapiens
cuagugacaagcuccu

SEQ ID NO: 887863 - RNA, 12 nt, Homo sapiens
cuagugcuacug

SEQ ID NO: 887864 - RNA, 16 nt, Homo sapiens
cuaguggaaaugagcg

SEQ ID NO: 887865 - RNA, 22 nt, Homo sapiens
cuaguuuaauuaacuaugugau

SEQ ID NO: 887866 - RNA, 21 nt, Homo sapiens
cuaguuuauuggaaguguuca

SEQ ID NO: 887867 - RNA, 20 nt, Homo sapiens
cuaguuugaccucacaguga

SEQ ID NO: 887868 - RNA, 18 nt, Homo sapiens
cuauaacaugucuuucag

SEQ ID NO: 887869 - RNA, 23 nt, Homo sapiens
cuauaacaugucuuucagcauua

SEQ ID NO: 887870 - RNA, 13 nt, Homo sapiens
cuauaaugagccg

SEQ ID NO: 887871 - RNA, 12 nt, Homo sapiens
cuauaaugugug

SEQ ID NO: 887872 - RNA, 17 nt, Homo sapiens
cuauacagugcauccuu

SEQ ID NO: 887873 - RNA, 18 nt, Homo sapiens
cuauagccuaggugacag

SEQ ID NO: 887874 - RNA, 15 nt, Homo sapiens
cuauaggucagagau

SEQ ID NO: 887875 - RNA, 17 nt, Homo sapiens
cuauauacaugugugua

SEQ ID NO: 887876 - RNA, 21 nt, Homo sapiens
cuauauguguauuauguaugc

SEQ ID NO: 887877 - RNA, 15 nt, Homo sapiens
cuauauugugccaag

SEQ ID NO: 887878 - RNA, 18 nt, Homo sapiens
cuauauuuagauuguuaa

SEQ ID NO: 887879 - RNA, 16 nt, Homo sapiens
cuaucaaaacauauca

SEQ ID NO: 887880 - RNA, 12 nt, Homo sapiens
cuauccuuccag

SEQ ID NO: 887881 - RNA, 22 nt, Homo sapiens
cuaugaaggcuguacacugcac

SEQ ID NO: 887882 - RNA, 21 nt, Homo sapiens
cuaugagaauugggauuacau

SEQ ID NO: 887883 - RNA, 17 nt, Homo sapiens
cuaugcaagccuugcua

SEQ ID NO: 887884 - RNA, 15 nt, Homo sapiens
cuaugcaauucuuaa

SEQ ID NO: 887885 - RNA, 14 nt, Homo sapiens
cuaugcacauaugg

SEQ ID NO: 887886 - RNA, 14 nt, Homo sapiens
cuaugccaagccau

SEQ ID NO: 887887 - RNA, 10 nt, Homo sapiens
cuauggaugu

SEQ ID NO: 887888 - RNA, 15 nt, Homo sapiens
cuauguaugcaucua

SEQ ID NO: 887889 - RNA, 22 nt, Homo sapiens
cuauguauggaauacaguguua

SEQ ID NO: 887890 - RNA, 19 nt, Homo sapiens
cuaugucauuucauuuccu

SEQ ID NO: 887891 - RNA, 15 nt, Homo sapiens
cuaugugauguuaac

SEQ ID NO: 887892 - RNA, 13 nt, Homo sapiens
cuaugugggacac

SEQ ID NO: 887893 - RNA, 23 nt, Homo sapiens
cuaugugggacaccucaaauaca

SEQ ID NO: 887894 - RNA, 21 nt, Homo sapiens
cuauuaaaagaauccaaauuc

SEQ ID NO: 887895 - RNA, 20 nt, Homo sapiens
cuauuaaauguauaugucau

SEQ ID NO: 887896 - RNA, 16 nt, Homo sapiens
cuauuacaccaaauaa

SEQ ID NO: 887897 - RNA, 21 nt, Homo sapiens
cuauuauaaaaccauguugau

SEQ ID NO: 887898 - RNA, 22 nt, Homo sapiens
cuauuauaaaaucuuacuuugu

SEQ ID NO: 887899 - RNA, 23 nt, Homo sapiens
cuauuauagaauggaacucaagg

SEQ ID NO: 887900 - RNA, 21 nt, Homo sapiens
cuauuaugggaaugacucuga

SEQ ID NO: 887901 - RNA, 18 nt, Homo sapiens
cuauucccuaacucucgg

SEQ ID NO: 887902 - RNA, 22 nt, Homo sapiens
cuauugaacugagccaaacaca

SEQ ID NO: 887903 - RNA, 21 nt, Homo sapiens
cuauugguaauaaaccuugau

SEQ ID NO: 887904 - RNA, 23 nt, Homo sapiens
cuauugguaauaaaccuugaugg

SEQ ID NO: 887905 - RNA, 21 nt, Homo sapiens
cuauuuauucauucagugaga

SEQ ID NO: 887906 - RNA, 14 nt, Homo sapiens
caaucuuguccaca

SEQ ID NO: 887907 - RNA, 19 nt, Homo sapiens
caaugaaauauuugcuuau

SEQ ID NO: 887908 - RNA, 13 nt, Homo sapiens
caaugacacauag

SEQ ID NO: 887909 - RNA, 16 nt, Homo sapiens
caaugauucauaacaa

SEQ ID NO: 887910 - RNA, 19 nt, Homo sapiens
caaugcaaagauucacaua

SEQ ID NO: 887911 - RNA, 15 nt, Homo sapiens
caaugcacacacaca

SEQ ID NO: 887912 - RNA, 17 nt, Homo sapiens
caaugcacauuaguuuu

SEQ ID NO: 887913 - RNA, 16 nt, Homo sapiens
caaugcacgcacacau

SEQ ID NO: 887914 - RNA, 15 nt, Homo sapiens
caaugccuauaaaau

SEQ ID NO: 887915 - RNA, 19 nt, Homo sapiens
caaugcuuccuccuuggaa

SEQ ID NO: 887916 - RNA, 21 nt, Homo sapiens
caaugcuuugggaggccaagg

SEQ ID NO: 887917 - RNA, 16 nt, Homo sapiens
caauggaaacaaucuu

SEQ ID NO: 887918 - RNA, 18 nt, Homo sapiens
caauggaaacuguaccau

SEQ ID NO: 887919 - RNA, 23 nt, Homo sapiens
caauggaaacuguaccauacaca

SEQ ID NO: 887920 - RNA, 16 nt, Homo sapiens
caauggagacugucuc

SEQ ID NO: 887921 - RNA, 22 nt, Homo sapiens
caaugggagggggcuccaugga

SEQ ID NO: 887922 - RNA, 16 nt, Homo sapiens
caaugguagcaaaaca

SEQ ID NO: 887923 - RNA, 20 nt, Homo sapiens
caaugucagaaacucgauga

SEQ ID NO: 887924 - RNA, 15 nt, Homo sapiens
caauguuagccucaa

SEQ ID NO: 887925 - RNA, 15 nt, Homo sapiens
caauguuuaugcaag

SEQ ID NO: 887926 - RNA, 19 nt, Homo sapiens
caauuaaacagccaaauaa

SEQ ID NO: 887927 - RNA, 21 nt, Homo sapiens
caauuagcaauugacugucac

SEQ ID NO: 887928 - RNA, 23 nt, Homo sapiens
caauuauggagugucaccagcug

SEQ ID NO: 887929 - RNA, 13 nt, Homo sapiens
caauuccucuggg

SEQ ID NO: 887930 - RNA, 20 nt, Homo sapiens
caauucuauuacgugcaaua

SEQ ID NO: 887931 - RNA, 17 nt, Homo sapiens
caauucuccugccucag

SEQ ID NO: 887932 - RNA, 10 nt, Homo sapiens
caauucugua

SEQ ID NO: 887933 - RNA, 19 nt, Homo sapiens
caauucuuacaaacaugug

SEQ ID NO: 887934 - RNA, 20 nt, Homo sapiens
caauugacugucacuguucc

SEQ ID NO: 887935 - RNA, 15 nt, Homo sapiens
caauuguacauuccc

SEQ ID NO: 887936 - RNA, 12 nt, Homo sapiens
caauugucugcc

SEQ ID NO: 887937 - RNA, 23 nt, Homo sapiens
caauuuuaauugauuauucugau

SEQ ID NO: 887938 - RNA, 16 nt, Homo sapiens
caauuuucagguuucu

SEQ ID NO: 887939 - RNA, 18 nt, Homo sapiens
cacaaaaaggcauaugca

SEQ ID NO: 887940 - RNA, 19 nt, Homo sapiens
cacaaaaaggcauaugcaa

SEQ ID NO: 887941 - RNA, 21 nt, Homo sapiens
cacaaaaaggcauaugcaaua

SEQ ID NO: 887942 - RNA, 12 nt, Homo sapiens
cacaaaaugcaa

SEQ ID NO: 887943 - RNA, 18 nt, Homo sapiens
cacaaaccuuacuaugga

SEQ ID NO: 887944 - RNA, 15 nt, Homo sapiens
cacaacuaggaccuc

SEQ ID NO: 887945 - RNA, 19 nt, Homo sapiens
cacaacugacacaggaaac

SEQ ID NO: 887946 - RNA, 23 nt, Homo sapiens
cacaagaggaauaagaauggagc

SEQ ID NO: 887947 - RNA, 12 nt, Homo sapiens
cacaagcucaga

SEQ ID NO: 887948 - RNA, 17 nt, Homo sapiens
cacaagcuggaagcaca

SEQ ID NO: 887949 - RNA, 15 nt, Homo sapiens
cacaaggcugaccaa

SEQ ID NO: 887950 - RNA, 17 nt, Homo sapiens
cacaaguagggagcuca

SEQ ID NO: 887951 - RNA, 18 nt, Homo sapiens
cacaauuuauauuuuccc

SEQ ID NO: 887952 - RNA, 22 nt, Homo sapiens
cacacaacuaggaaguggcuga

SEQ ID NO: 887953 - RNA, 15 nt, Homo sapiens
cacacaaggugcaaa

SEQ ID NO: 887954 - RNA, 15 nt, Homo sapiens
cacacacacaccaau

SEQ ID NO: 887955 - RNA, 23 nt, Homo sapiens
cacacacagaugcacacacagau

SEQ ID NO: 887956 - RNA, 13 nt, Homo sapiens
cacacacauggau

SEQ ID NO: 887957 - RNA, 15 nt, Homo sapiens
cacacacggaugcac

SEQ ID NO: 887958 - RNA, 22 nt, Homo sapiens
cacacacggaugcacacacaga

SEQ ID NO: 887959 - RNA, 21 nt, Homo sapiens
cacacagauaccccacguucu

SEQ ID NO: 887960 - RNA, 15 nt, Homo sapiens
cacacagaugcacac

SEQ ID NO: 887961 - RNA, 21 nt, Homo sapiens
cacacagaugcacacacagau

SEQ ID NO: 887962 - RNA, 17 nt, Homo sapiens
cacacauggaugcacac

SEQ ID NO: 887963 - RNA, 12 nt, Homo sapiens
cacaccaucucc

SEQ ID NO: 887964 - RNA, 20 nt, Homo sapiens
cacacccgccgccuccugca

SEQ ID NO: 887965 - RNA, 14 nt, Homo sapiens
cacacccuccccau

SEQ ID NO: 887966 - RNA, 16 nt, Homo sapiens
cacaccgauguacaca

SEQ ID NO: 887967 - RNA, 23 nt, Homo sapiens
cacaccgauguacacacacagau

SEQ ID NO: 887968 - RNA, 20 nt, Homo sapiens
cacaccucacgcucuggaca

SEQ ID NO: 887969 - RNA, 19 nt, Homo sapiens
cacaccucuaggacuccac

SEQ ID NO: 887970 - RNA, 15 nt, Homo sapiens
cacacgcaggaacuc

SEQ ID NO: 887971 - RNA, 14 nt, Homo sapiens
cacacgcgugcaca

SEQ ID NO: 887972 - RNA, 16 nt, Homo sapiens
cacacgcgugcacaca

SEQ ID NO: 887973 - RNA, 19 nt, Homo sapiens
cacacggaugcacagagau

SEQ ID NO: 887974 - RNA, 20 nt, Homo sapiens
cacacggaugcacagagaua

SEQ ID NO: 887975 - RNA, 13 nt, Homo sapiens
cacacugagcugg

SEQ ID NO: 887976 - RNA, 13 nt, Homo sapiens
cacacuucuugaa

SEQ ID NO: 887977 - RNA, 20 nt, Homo sapiens
cacacuucuugaaacagccu

SEQ ID NO: 887978 - RNA, 18 nt, Homo sapiens
cacacuuguauauugaaa

SEQ ID NO: 887979 - RNA, 16 nt, Homo sapiens
cacagaaacauuuuca

SEQ ID NO: 887980 - RNA, 17 nt, Homo sapiens
cacagaaauacaugaaa

SEQ ID NO: 887981 - RNA, 21 nt, Homo sapiens
cacagaacuauguacuuuaaa

SEQ ID NO: 887982 - RNA, 14 nt, Homo sapiens
cacagaagccagga

SEQ ID NO: 887983 - RNA, 18 nt, Homo sapiens
cacagaaggaaucugugc

SEQ ID NO: 887984 - RNA, 11 nt, Homo sapiens
cacagacacac

SEQ ID NO: 887985 - RNA, 15 nt, Homo sapiens
cacagacagauccca

SEQ ID NO: 887986 - RNA, 16 nt, Homo sapiens
cacagaccaccugcuu

SEQ ID NO: 887987 - RNA, 21 nt, Homo sapiens
cacagacccacacauguuuac

SEQ ID NO: 887988 - RNA, 16 nt, Homo sapiens
cacagacugcgauuug

SEQ ID NO: 887989 - RNA, 16 nt, Homo sapiens
cacagagauaugcaca

SEQ ID NO: 887990 - RNA, 14 nt, Homo sapiens
cacagagcaauggu

SEQ ID NO: 887991 - RNA, 17 nt, Homo sapiens
cacagagccugccucag

SEQ ID NO: 887992 - RNA, 14 nt, Homo sapiens
cacagagguuuuaa

SEQ ID NO: 887993 - RNA, 23 nt, Homo sapiens
cacagauauacacauggaugcac

SEQ ID NO: 887994 - RNA, 17 nt, Homo sapiens
cacagcaagaugaauuu

SEQ ID NO: 887995 - RNA, 13 nt, Homo sapiens
cacagcacccagg

SEQ ID NO: 887996 - RNA, 19 nt, Homo sapiens
cacagcacccaggcuccau

SEQ ID NO: 887997 - RNA, 15 nt, Homo sapiens
cacagcacuaauuca

SEQ ID NO: 887998 - RNA, 17 nt, Homo sapiens
cacagcagcaauaugcu

SEQ ID NO: 887999 - RNA, 21 nt, Homo sapiens
cacagcagccccugcacaaag

SEQ ID NO: 888000 - RNA, 15 nt, Homo sapiens
cacagcagcugaaca

SEQ ID NO: 888001 - RNA, 20 nt, Homo sapiens
cacagcagcugaacagccaa

SEQ ID NO: 888002 - RNA, 13 nt, Homo sapiens
cacagcuaugaag

SEQ ID NO: 888003 - RNA, 21 nt, Homo sapiens
cacagcugcagcugggcccca

SEQ ID NO: 888004 - RNA, 18 nt, Homo sapiens
cacaggauccuauucuca

SEQ ID NO: 888005 - RNA, 18 nt, Homo sapiens
cacaggcagguccagggu

SEQ ID NO: 888006 - RNA, 20 nt, Homo sapiens
cacagggaugaccuggaguc

SEQ ID NO: 888007 - RNA, 23 nt, Homo sapiens
cacaggguuuuguauucuuuacu

SEQ ID NO: 888008 - RNA, 13 nt, Homo sapiens
cacagguuuucag

SEQ ID NO: 888009 - RNA, 21 nt, Homo sapiens
cacaguacaauguuucagaag

SEQ ID NO: 888010 - RNA, 23 nt, Homo sapiens
cacaguauuacuucugcuacaua

SEQ ID NO: 888011 - RNA, 20 nt, Homo sapiens
cacagucucugggagacuuu

SEQ ID NO: 888012 - RNA, 12 nt, Homo sapiens
cacauaaaggua

SEQ ID NO: 888013 - RNA, 12 nt, Homo sapiens
cacauacauugc

SEQ ID NO: 888014 - RNA, 15 nt, Homo sapiens
cacauagagauaugc

SEQ ID NO: 888015 - RNA, 16 nt, Homo sapiens
cacauagagauaugca

SEQ ID NO: 888016 - RNA, 21 nt, Homo sapiens
cacauagauuaauggcacuga

SEQ ID NO: 888017 - RNA, 22 nt, Homo sapiens
cacauagauuaauggcacugau

SEQ ID NO: 888018 - RNA, 12 nt, Homo sapiens
cacauagcacag

SEQ ID NO: 888019 - RNA, 17 nt, Homo sapiens
cacauaggcaauaucuu

SEQ ID NO: 888020 - RNA, 13 nt, Homo sapiens
cacauauggacuc

SEQ ID NO: 888021 - RNA, 14 nt, Homo sapiens
cuuuauuugcugua

SEQ ID NO: 888022 - RNA, 18 nt, Homo sapiens
cuuuauuuguauuugcca

SEQ ID NO: 888023 - RNA, 22 nt, Homo sapiens
cuuuauuuguauuugccauuca

SEQ ID NO: 888024 - RNA, 23 nt, Homo sapiens
cuuuauuuguauuugccauucag

SEQ ID NO: 888025 - RNA, 20 nt, Homo sapiens
cuuucaacaaugacuaauga

SEQ ID NO: 888026 - RNA, 19 nt, Homo sapiens
cuuucagcauuaggcuuuu

SEQ ID NO: 888027 - RNA, 19 nt, Homo sapiens
cuuucccaugauccagaac

SEQ ID NO: 888028 - RNA, 16 nt, Homo sapiens
cuuuccccagacacau

SEQ ID NO: 888029 - RNA, 21 nt, Homo sapiens
cuuucccccaccccagaguug

SEQ ID NO: 888030 - RNA, 13 nt, Homo sapiens
cuuucccuuccag

SEQ ID NO: 888031 - RNA, 22 nt, Homo sapiens
cuuuccugggggaugugcacgg

SEQ ID NO: 888032 - RNA, 21 nt, Homo sapiens
cuuucuacaccuguugcaccu

SEQ ID NO: 888033 - RNA, 22 nt, Homo sapiens
cuuucuauugaaaaaucaccac

SEQ ID NO: 888034 - RNA, 15 nt, Homo sapiens
cuuucucagccacaa

SEQ ID NO: 888035 - RNA, 19 nt, Homo sapiens
cuuucucaguucagaguug

SEQ ID NO: 888036 - RNA, 12 nt, Homo sapiens
cuuucucugcaa

SEQ ID NO: 888037 - RNA, 20 nt, Homo sapiens
cuuucugagaguuggcucag

SEQ ID NO: 888038 - RNA, 15 nt, Homo sapiens
cuuucuuauuuugua

SEQ ID NO: 888039 - RNA, 17 nt, Homo sapiens
cuuucuuuaccugagac

SEQ ID NO: 888040 - RNA, 14 nt, Homo sapiens
cuuugauaugacug

SEQ ID NO: 888041 - RNA, 14 nt, Homo sapiens
cuuugcacauguga

SEQ ID NO: 888042 - RNA, 20 nt, Homo sapiens
cuuugcagaccgcauaguca

SEQ ID NO: 888043 - RNA, 14 nt, Homo sapiens
cuuugcagcaauga

SEQ ID NO: 888044 - RNA, 16 nt, Homo sapiens
cuuugcaggcccagca

SEQ ID NO: 888045 - RNA, 18 nt, Homo sapiens
cuuugcucuuucuugacu

SEQ ID NO: 888046 - RNA, 15 nt, Homo sapiens
cuuugcucuuuggua

SEQ ID NO: 888047 - RNA, 20 nt, Homo sapiens
cuuuggaaacaggaccacaa

SEQ ID NO: 888048 - RNA, 22 nt, Homo sapiens
cuuuguaaaggucagagucaaa

SEQ ID NO: 888049 - RNA, 15 nt, Homo sapiens
cuuuguaugcacuuu

SEQ ID NO: 888050 - RNA, 22 nt, Homo sapiens
cuuugucauucaagccugugaa

SEQ ID NO: 888051 - RNA, 22 nt, Homo sapiens
cuuugugucgauuucaccaaga

SEQ ID NO: 888052 - RNA, 19 nt, Homo sapiens
cuuuguucacuagacugug

SEQ ID NO: 888053 - RNA, 20 nt, Homo sapiens
cuuuguugccuuaucuugaa

SEQ ID NO: 888054 - RNA, 16 nt, Homo sapiens
cuuuguuuugcacuga

SEQ ID NO: 888055 - RNA, 15 nt, Homo sapiens
cuuuuaagaaacaca

SEQ ID NO: 888056 - RNA, 22 nt, Homo sapiens
cuuuuaagcaaaguugggugua

SEQ ID NO: 888057 - RNA, 19 nt, Homo sapiens
cuuuuaauuaauauguuca

SEQ ID NO: 888058 - RNA, 22 nt, Homo sapiens
cuuuuacuuuuugccccuucca

SEQ ID NO: 888059 - RNA, 19 nt, Homo sapiens
cuuuuaguaaagucaagga

SEQ ID NO: 888060 - RNA, 16 nt, Homo sapiens
cuuuuaguuguaucuc

SEQ ID NO: 888061 - RNA, 13 nt, Homo sapiens
cuuuuauaacuag

SEQ ID NO: 888062 - RNA, 20 nt, Homo sapiens
cuuuuaucugcccagaauuc

SEQ ID NO: 888063 - RNA, 19 nt, Homo sapiens
cuuuuauuugaaaugucau

SEQ ID NO: 888064 - RNA, 19 nt, Homo sapiens
cuuuucaaaacugcuaaau

SEQ ID NO: 888065 - RNA, 15 nt, Homo sapiens
cuuuucaugucauuu

SEQ ID NO: 888066 - RNA, 21 nt, Homo sapiens
cuuuucccccaaagaugugua

SEQ ID NO: 888067 - RNA, 21 nt, Homo sapiens
cuuuuccccggucccuugaga

SEQ ID NO: 888068 - RNA, 16 nt, Homo sapiens
cuuuucugaggacuca

SEQ ID NO: 888069 - RNA, 21 nt, Homo sapiens
cuuuucuuuauugcugugaau

SEQ ID NO: 888070 - RNA, 15 nt, Homo sapiens
cuuuucuuuccucag

SEQ ID NO: 888071 - RNA, 22 nt, Homo sapiens
cuuuugacaaauucuuuuucac

SEQ ID NO: 888072 - RNA, 15 nt, Homo sapiens
cuuuugcaacaagac

SEQ ID NO: 888073 - RNA, 20 nt, Homo sapiens
cuuuugcuugaaaccaaaga

SEQ ID NO: 888074 - RNA, 16 nt, Homo sapiens
cuuuugucauguggcu

SEQ ID NO: 888075 - RNA, 12 nt, Homo sapiens
cuuuuguuucag

SEQ ID NO: 888076 - RNA, 21 nt, Homo sapiens
cuuuuuaauuuuuugauugga

SEQ ID NO: 888077 - RNA, 13 nt, Homo sapiens
cuuuuugaucuca

SEQ ID NO: 888078 - RNA, 14 nt, Homo sapiens
cuuuuuuucuuugg

SEQ ID NO: 888079 - RNA, 22 nt, Homo sapiens
gaaaaaaaaaaaaaaucacugu

SEQ ID NO: 888080 - RNA, 18 nt, Homo sapiens
gaaaaaaaauaauagaaa

SEQ ID NO: 888081 - RNA, 19 nt, Homo sapiens
gaaaaaaguuuugaugaaa

SEQ ID NO: 888082 - RNA, 16 nt, Homo sapiens
gaaaaacaagucuuua

SEQ ID NO: 888083 - RNA, 22 nt, Homo sapiens
gaaaaaccaaugauucauaaca

SEQ ID NO: 888084 - RNA, 13 nt, Homo sapiens
gaaaaagagccau

SEQ ID NO: 888085 - RNA, 14 nt, Homo sapiens
gaaaaagagccauu

SEQ ID NO: 888086 - RNA, 17 nt, Homo sapiens
gaaaaauaugugcuuga

SEQ ID NO: 888087 - RNA, 22 nt, Homo sapiens
gaaaaaugggaacaaggcaaug

SEQ ID NO: 888088 - RNA, 15 nt, Homo sapiens
gaaaacauaugcauu

SEQ ID NO: 888089 - RNA, 20 nt, Homo sapiens
gaaaacauucauccaguugc

SEQ ID NO: 888090 - RNA, 12 nt, Homo sapiens
gaaaacuggaaa

SEQ ID NO: 888091 - RNA, 23 nt, Homo sapiens
gaaaagaacacuagagucuguca

SEQ ID NO: 888092 - RNA, 23 nt, Homo sapiens
gaaaagauucccacccaauucaa

SEQ ID NO: 888093 - RNA, 14 nt, Homo sapiens
gaaaagguuaacag

SEQ ID NO: 888094 - RNA, 17 nt, Homo sapiens
gaaaaguuauguagaaa

SEQ ID NO: 888095 - RNA, 16 nt, Homo sapiens
gaaaauaaaagcacuu

SEQ ID NO: 888096 - RNA, 14 nt, Homo sapiens
gaaaauaaaccaag

SEQ ID NO: 888097 - RNA, 12 nt, Homo sapiens
gaaaauaaguga

SEQ ID NO: 888098 - RNA, 22 nt, Homo sapiens
gaaaauauauuuaauaccuuug

SEQ ID NO: 888099 - RNA, 17 nt, Homo sapiens
gaaaauaugauguuuca

SEQ ID NO: 888100 - RNA, 18 nt, Homo sapiens
gaaaaucaaccagcagga

SEQ ID NO: 888101 - RNA, 17 nt, Homo sapiens
gaaaaucaucuuggcca

SEQ ID NO: 888102 - RNA, 22 nt, Homo sapiens
gaaaaucgugacaacacuugug

SEQ ID NO: 888103 - RNA, 13 nt, Homo sapiens
aguuuugaugaaa

SEQ ID NO: 888104 - RNA, 22 nt, Homo sapiens
aguuuuucagaaagcauuacau

SEQ ID NO: 888105 - RNA, 17 nt, Homo sapiens
aguuuuugauagcuuua

SEQ ID NO: 888106 - RNA, 15 nt, Homo sapiens
aguuuuuguuucaca

SEQ ID NO: 888107 - RNA, 12 nt, Homo sapiens
auaaaaauaccu

SEQ ID NO: 888108 - RNA, 16 nt, Homo sapiens
auaaaaauacuaugaa

SEQ ID NO: 888109 - RNA, 22 nt, Homo sapiens
auaaaaccagagcaggaaagau

SEQ ID NO: 888110 - RNA, 21 nt, Homo sapiens
auaaaaccucagggacaacau

SEQ ID NO: 888111 - RNA, 21 nt, Homo sapiens
auaaaagaaccgagcaauuuu

SEQ ID NO: 888112 - RNA, 14 nt, Homo sapiens
auaaaaguacugaa

SEQ ID NO: 888113 - RNA, 19 nt, Homo sapiens
auaaaaucugugaauuaaa

SEQ ID NO: 888114 - RNA, 19 nt, Homo sapiens
auaaaaugcuuuauuaauu

SEQ ID NO: 888115 - RNA, 16 nt, Homo sapiens
auaaaauuaugccaua

SEQ ID NO: 888116 - RNA, 14 nt, Homo sapiens
auaaaauugcacuu

SEQ ID NO: 888117 - RNA, 20 nt, Homo sapiens
auaaacaaauaacaaugugc

SEQ ID NO: 888118 - RNA, 22 nt, Homo sapiens
auaaacacccaugaaucaaaga

SEQ ID NO: 888119 - RNA, 19 nt, Homo sapiens
auaaacauuaaacacugua

SEQ ID NO: 888120 - RNA, 21 nt, Homo sapiens
auaaacauugguauauuucca

SEQ ID NO: 888121 - RNA, 17 nt, Homo sapiens
auaaagaauauuuacaa

SEQ ID NO: 888122 - RNA, 15 nt, Homo sapiens
auaaagcaagacaga

SEQ ID NO: 888123 - RNA, 16 nt, Homo sapiens
auaaagccaguggaaa

SEQ ID NO: 888124 - RNA, 16 nt, Homo sapiens
auaaagugccaguuug

SEQ ID NO: 888125 - RNA, 15 nt, Homo sapiens
auaaauagaguucca

SEQ ID NO: 888126 - RNA, 14 nt, Homo sapiens
auaaauaugcucag

SEQ ID NO: 888127 - RNA, 20 nt, Homo sapiens
auaaaugaaguauuucucac

SEQ ID NO: 888128 - RNA, 12 nt, Homo sapiens
auaaaugaaucu

SEQ ID NO: 888129 - RNA, 17 nt, Homo sapiens
auaaaugauguacuaca

SEQ ID NO: 888130 - RNA, 22 nt, Homo sapiens
auaaaugcaugauuuuauacau

SEQ ID NO: 888131 - RNA, 22 nt, Homo sapiens
aaugcuguuuuaaaaacaaaga

SEQ ID NO: 888132 - RNA, 19 nt, Homo sapiens
aaugcuuuuugaauguuau

SEQ ID NO: 888133 - RNA, 20 nt, Homo sapiens
aauggacauaagacagacag

SEQ ID NO: 888134 - RNA, 20 nt, Homo sapiens
aauggagggaauaauaccua

SEQ ID NO: 888135 - RNA, 19 nt, Homo sapiens
aauggagugggagaucagc

SEQ ID NO: 888136 - RNA, 15 nt, Homo sapiens
aauggcucugugaaa

SEQ ID NO: 888137 - RNA, 23 nt, Homo sapiens
aauggcuguaaacuauaaacuac

SEQ ID NO: 888138 - RNA, 21 nt, Homo sapiens
aauggcuuuaugcuaguuuga

SEQ ID NO: 888139 - RNA, 14 nt, Homo sapiens
aaugggugauaucc

SEQ ID NO: 888140 - RNA, 20 nt, Homo sapiens
aaugggugauauccugaaaa

SEQ ID NO: 888141 - RNA, 14 nt, Homo sapiens
aaugguuuacugcu

SEQ ID NO: 888142 - RNA, 14 nt, Homo sapiens
aaugguuugaauau

SEQ ID NO: 888143 - RNA, 15 nt, Homo sapiens
aauguauauacacau

SEQ ID NO: 888144 - RNA, 17 nt, Homo sapiens
aauguauaugucauuua

SEQ ID NO: 888145 - RNA, 14 nt, Homo sapiens
aauguaugcauuca

SEQ ID NO: 888146 - RNA, 11 nt, Homo sapiens
aaugucacaau

SEQ ID NO: 888147 - RNA, 16 nt, Homo sapiens
aaugucacauaaugaa

SEQ ID NO: 888148 - RNA, 19 nt, Homo sapiens
aaugucagaaaccaguuau

SEQ ID NO: 888149 - RNA, 16 nt, Homo sapiens
aaugucaguaaugcaa

SEQ ID NO: 888150 - RNA, 20 nt, Homo sapiens
aaugucaucaaauauuacca

SEQ ID NO: 888151 - RNA, 16 nt, Homo sapiens
aaugugaccaggggug

SEQ ID NO: 888152 - RNA, 21 nt, Homo sapiens
aaugugcaaauuuugcauuua

SEQ ID NO: 888153 - RNA, 11 nt, Homo sapiens
aaugugcaaua

SEQ ID NO: 888154 - RNA, 18 nt, Homo sapiens
aauguguaagcauuguau

SEQ ID NO: 888155 - RNA, 12 nt, Homo sapiens
aauguguacaaa

SEQ ID NO: 888156 - RNA, 20 nt, Homo sapiens
aaugugugaaggucuugccu

SEQ ID NO: 888157 - RNA, 17 nt, Homo sapiens
aaugugugucugaagac

SEQ ID NO: 888158 - RNA, 20 nt, Homo sapiens
aauguuaacuaaauaacuuu

SEQ ID NO: 888159 - RNA, 18 nt, Homo sapiens
aauguuacauuauuauca

SEQ ID NO: 888160 - RNA, 15 nt, Homo sapiens
aauguuguccaggaa

SEQ ID NO: 888161 - RNA, 19 nt, Homo sapiens
aauguuuaagauaaacaga

SEQ ID NO: 888162 - RNA, 16 nt, Homo sapiens
aauguuucacuaugau

SEQ ID NO: 888163 - RNA, 23 nt, Homo sapiens
aauguuuccaaccuggaguauaa

SEQ ID NO: 888164 - RNA, 20 nt, Homo sapiens
aauguuuucuucaucuguga

SEQ ID NO: 888165 - RNA, 13 nt, Homo sapiens
aauuaaaaaccac

SEQ ID NO: 888166 - RNA, 14 nt, Homo sapiens
aauuaaaguauaca

SEQ ID NO: 888167 - RNA, 22 nt, Homo sapiens
aauuaaaugcauguccucaaaa

SEQ ID NO: 888168 - RNA, 15 nt, Homo sapiens
aauuaagguuugccc

SEQ ID NO: 888169 - RNA, 22 nt, Homo sapiens
aauuaccagaguuguucugucu

SEQ ID NO: 888170 - RNA, 12 nt, Homo sapiens
aauuagcaauug

SEQ ID NO: 888171 - RNA, 19 nt, Homo sapiens
aauuaggagaggcagagau

SEQ ID NO: 888172 - RNA, 16 nt, Homo sapiens
aauuaguacaguagcu

SEQ ID NO: 888173 - RNA, 21 nt, Homo sapiens
aauuauacaucacagcagugc

SEQ ID NO: 888174 - RNA, 17 nt, Homo sapiens
aauuauauuguccuccc

SEQ ID NO: 888175 - RNA, 18 nt, Homo sapiens
aauuaucggaagcagugc

SEQ ID NO: 888176 - RNA, 20 nt, Homo sapiens
aauuaucggaagcagugccu

SEQ ID NO: 888177 - RNA, 18 nt, Homo sapiens
aauucaacauauaccuua

SEQ ID NO: 888178 - RNA, 13 nt, Homo sapiens
aauucacucccac

SEQ ID NO: 888179 - RNA, 14 nt, Homo sapiens
aauucagcaaagaa

SEQ ID NO: 888180 - RNA, 13 nt, Homo sapiens
aauucagcacuga

SEQ ID NO: 888181 - RNA, 13 nt, Homo sapiens
aauucccagcugu

SEQ ID NO: 888182 - RNA, 18 nt, Homo sapiens
aauucccauuuugcaaaa

SEQ ID NO: 888183 - RNA, 12 nt, Homo sapiens
aauuccuaguca

SEQ ID NO: 888184 - RNA, 22 nt, Homo sapiens
aauuccuuagcuuagaccucag

SEQ ID NO: 888185 - RNA, 15 nt, Homo sapiens
aauucuaaaugcugg

SEQ ID NO: 888186 - RNA, 17 nt, Homo sapiens
aauucuaggcaucccag

SEQ ID NO: 888187 - RNA, 14 nt, Homo sapiens
aauucuaugagaua

SEQ ID NO: 888188 - RNA, 16 nt, Homo sapiens
aauucucaaccuacca

SEQ ID NO: 888189 - RNA, 16 nt, Homo sapiens
aauucucaugugaucc

SEQ ID NO: 888190 - RNA, 20 nt, Homo sapiens
aauucucauuugucacacac

SEQ ID NO: 888191 - RNA, 19 nt, Homo sapiens
aauucuccuguugcaauga

SEQ ID NO: 888192 - RNA, 17 nt, Homo sapiens
aauucugcucagauaga

SEQ ID NO: 888193 - RNA, 22 nt, Homo sapiens
aauucuggcugcgggucucaga

SEQ ID NO: 888194 - RNA, 16 nt, Homo sapiens
aauucuugaaguucau

SEQ ID NO: 888195 - RNA, 16 nt, Homo sapiens
aauucuuuacaauaaa

SEQ ID NO: 888196 - RNA, 20 nt, Homo sapiens
agcaugucucaauaguaaaa

SEQ ID NO: 888197 - RNA, 19 nt, Homo sapiens
agcauguggggaagcaaga

SEQ ID NO: 888198 - RNA, 12 nt, Homo sapiens
agcauguuucau

SEQ ID NO: 888199 - RNA, 17 nt, Homo sapiens
agcauuucccccaggga

SEQ ID NO: 888200 - RNA, 13 nt, Homo sapiens
agccaaaauacuu

SEQ ID NO: 888201 - RNA, 14 nt, Homo sapiens
agccaaacacuguu

SEQ ID NO: 888202 - RNA, 13 nt, Homo sapiens
agccaaacagagc

SEQ ID NO: 888203 - RNA, 20 nt, Homo sapiens
agccaaacagagccuucaca

SEQ ID NO: 888204 - RNA, 15 nt, Homo sapiens
agccaaaugcauggu

SEQ ID NO: 888205 - RNA, 17 nt, Homo sapiens
agccaacacccugucua

SEQ ID NO: 888206 - RNA, 13 nt, Homo sapiens
agccaacuccucc

SEQ ID NO: 888207 - RNA, 21 nt, Homo sapiens
agccaacugccccgggugccu

SEQ ID NO: 888208 - RNA, 23 nt, Homo sapiens
agccaagguagggucacuaacca

SEQ ID NO: 888209 - RNA, 14 nt, Homo sapiens
agccaauagacuga

SEQ ID NO: 888210 - RNA, 19 nt, Homo sapiens
agccaauauuuacucauca

SEQ ID NO: 888211 - RNA, 16 nt, Homo sapiens
agccacacaggaagaa

SEQ ID NO: 888212 - RNA, 14 nt, Homo sapiens
agccacagaccacc

SEQ ID NO: 888213 - RNA, 16 nt, Homo sapiens
agccacagaccaccug

SEQ ID NO: 888214 - RNA, 20 nt, Homo sapiens
agccacaucacuacaguaca

SEQ ID NO: 888215 - RNA, 22 nt, Homo sapiens
agccaccucccaaggacuuucc

SEQ ID NO: 888216 - RNA, 21 nt, Homo sapiens
agccaccugggggagcuggaa

SEQ ID NO: 888217 - RNA, 14 nt, Homo sapiens
agccacgugaaugg

SEQ ID NO: 888218 - RNA, 22 nt, Homo sapiens
agccacuuagcaggaaguacuc

SEQ ID NO: 888219 - RNA, 20 nt, Homo sapiens
agccagaaacguaacugugu

SEQ ID NO: 888220 - RNA, 14 nt, Homo sapiens
agccagacuggcac

SEQ ID NO: 888221 - RNA, 20 nt, Homo sapiens
agccagaggaggccggugaa

SEQ ID NO: 888222 - RNA, 11 nt, Homo sapiens
agccagaguuc

SEQ ID NO: 888223 - RNA, 18 nt, Homo sapiens
agccaggcugagugagcc

SEQ ID NO: 888224 - RNA, 23 nt, Homo sapiens
agccaggcugagugagccacaga

SEQ ID NO: 888225 - RNA, 17 nt, Homo sapiens
agccaggggcugcucau

SEQ ID NO: 888226 - RNA, 14 nt, Homo sapiens
agccagggucucac

SEQ ID NO: 888227 - RNA, 15 nt, Homo sapiens
agccaguacagagaa

SEQ ID NO: 888228 - RNA, 20 nt, Homo sapiens
agccaguacagagaaauucu

SEQ ID NO: 888229 - RNA, 12 nt, Homo sapiens
agccaguauuuc

SEQ ID NO: 888230 - RNA, 17 nt, Homo sapiens
agccaguggcaguguau

SEQ ID NO: 888231 - RNA, 14 nt, Homo sapiens
agccauaugcaaua

SEQ ID NO: 888232 - RNA, 20 nt, Homo sapiens
agccaugaucgagccacugc

SEQ ID NO: 888233 - RNA, 21 nt, Homo sapiens
agccaugaucgagccacugca

SEQ ID NO: 888234 - RNA, 18 nt, Homo sapiens
agccaugccucaugccac

SEQ ID NO: 888235 - RNA, 19 nt, Homo sapiens
agccauguaccaguguacu

SEQ ID NO: 888236 - RNA, 22 nt, Homo sapiens
agccauucuuacucgggcgacc

SEQ ID NO: 888237 - RNA, 23 nt, Homo sapiens
agccauuuuuagcucugaucagc

SEQ ID NO: 888238 - RNA, 20 nt, Homo sapiens
agcccaaauggcucugugaa

SEQ ID NO: 888239 - RNA, 20 nt, Homo sapiens
agcccaacagacaccaucuu

SEQ ID NO: 888240 - RNA, 16 nt, Homo sapiens
agcccaagguuaaaaa

SEQ ID NO: 888241 - RNA, 14 nt, Homo sapiens
agcccaagugccau

SEQ ID NO: 888242 - RNA, 15 nt, Homo sapiens
agcccaagugccauc

SEQ ID NO: 888243 - RNA, 16 nt, Homo sapiens
agcccaagugccaucc

SEQ ID NO: 888244 - RNA, 19 nt, Homo sapiens
agcccaagugccaucccac

SEQ ID NO: 888245 - RNA, 18 nt, Homo sapiens
agcccacagcagcaauau

SEQ ID NO: 888246 - RNA, 20 nt, Homo sapiens
agcccagccaccucccaagg

SEQ ID NO: 888247 - RNA, 19 nt, Homo sapiens
agcccaugcucaaccacug

SEQ ID NO: 888248 - RNA, 14 nt, Homo sapiens
agcccauggcuuua

SEQ ID NO: 888249 - RNA, 23 nt, Homo sapiens
agcccauggcuuuagcuaccuca

SEQ ID NO: 888250 - RNA, 21 nt, Homo sapiens
agcccauuggcucccaucuga

SEQ ID NO: 888251 - RNA, 18 nt, Homo sapiens
agccccaagccaugguga

SEQ ID NO: 888252 - RNA, 19 nt, Homo sapiens
agccccaggccucuguguc

SEQ ID NO: 888253 - RNA, 15 nt, Homo sapiens
agcccccagguugcc

SEQ ID NO: 888254 - RNA, 16 nt, Homo sapiens
agcccccuacugagaa

SEQ ID NO: 888255 - RNA, 17 nt, Homo sapiens
agccccggacucaggcc

SEQ ID NO: 888256 - RNA, 12 nt, Homo sapiens
agccccuagugc

SEQ ID NO: 888257 - RNA, 18 nt, Homo sapiens
agcccucaauaagccagc

SEQ ID NO: 888258 - RNA, 19 nt, Homo sapiens
agcccucccuggcauguca

SEQ ID NO: 888259 - RNA, 16 nt, Homo sapiens
agcccugggggccagc

SEQ ID NO: 888260 - RNA, 20 nt, Homo sapiens
agcccuucaugcauuugcac

SEQ ID NO: 888261 - RNA, 15 nt, Homo sapiens
agcccuuuacuugac

SEQ ID NO: 888262 - RNA, 20 nt, Homo sapiens
agccgagauugcaccacugc

SEQ ID NO: 888263 - RNA, 19 nt, Homo sapiens
agccgcagacaaguaauca

SEQ ID NO: 888264 - RNA, 15 nt, Homo sapiens
uaaacuuucucugca

SEQ ID NO: 888265 - RNA, 21 nt, Homo sapiens
uaaacuuucucugcaaagacu

SEQ ID NO: 888266 - RNA, 20 nt, Homo sapiens
uaaagaaguaaauuugucca

SEQ ID NO: 888267 - RNA, 14 nt, Homo sapiens
uaaagaaguuugau

SEQ ID NO: 888268 - RNA, 19 nt, Homo sapiens
uaaagaauaaaugaaucuu

SEQ ID NO: 888269 - RNA, 14 nt, Homo sapiens
uaaagagcauggaa

SEQ ID NO: 888270 - RNA, 16 nt, Homo sapiens
uaaagaggcgucuugu

SEQ ID NO: 888271 - RNA, 16 nt, Homo sapiens
uaaagaugaucuacuc

SEQ ID NO: 888272 - RNA, 17 nt, Homo sapiens
uaaagaugaucuacuca

SEQ ID NO: 888273 - RNA, 22 nt, Homo sapiens
uaaagauuuuuuaauaauuuag

SEQ ID NO: 888274 - RNA, 21 nt, Homo sapiens
uaaagcaguguuuucaccuca

SEQ ID NO: 888275 - RNA, 16 nt, Homo sapiens
uaaagccaguggcagu

SEQ ID NO: 888276 - RNA, 20 nt, Homo sapiens
uaaagcccaaccuccugacc

SEQ ID NO: 888277 - RNA, 19 nt, Homo sapiens
uaaagcuuucugacaagau

SEQ ID NO: 888278 - RNA, 19 nt, Homo sapiens
uaaagcuuugucuuuuugu

SEQ ID NO: 888279 - RNA, 14 nt, Homo sapiens
uaaaggccuggaac

SEQ ID NO: 888280 - RNA, 22 nt, Homo sapiens
uaaaggcuuuuggcagcaaagu

SEQ ID NO: 888281 - RNA, 18 nt, Homo sapiens
uaaaguaauuuugugaaa

SEQ ID NO: 888282 - RNA, 20 nt, Homo sapiens
uaaaguacauuauuuaugaa

SEQ ID NO: 888283 - RNA, 17 nt, Homo sapiens
uaaagucaacaaccaug

SEQ ID NO: 888284 - RNA, 17 nt, Homo sapiens
uaaagugccaguuugcu

SEQ ID NO: 888285 - RNA, 18 nt, Homo sapiens
uaaauaaaguaucaugca

SEQ ID NO: 888286 - RNA, 15 nt, Homo sapiens
uaaauaaaucauuaa

SEQ ID NO: 888287 - RNA, 19 nt, Homo sapiens
uaaauaauguuaucugugu

SEQ ID NO: 888288 - RNA, 23 nt, Homo sapiens
uaaauacacaacacacacacucu

SEQ ID NO: 888289 - RNA, 19 nt, Homo sapiens
uaaauagaccucucaauuu

SEQ ID NO: 888290 - RNA, 12 nt, Homo sapiens
uaaauagcucag

SEQ ID NO: 888291 - RNA, 14 nt, Homo sapiens
uaaauagugcagaa

SEQ ID NO: 888292 - RNA, 20 nt, Homo sapiens
uaaauaucauccugccuuca

SEQ ID NO: 888293 - RNA, 14 nt, Homo sapiens
uaaauaugaaauga

SEQ ID NO: 888294 - RNA, 15 nt, Homo sapiens
uaaauauuucaugau

SEQ ID NO: 888295 - RNA, 20 nt, Homo sapiens
uaaaucuguuauuuugcuau

SEQ ID NO: 888296 - RNA, 21 nt, Homo sapiens
uaaaucuuucuuuugauucuu

SEQ ID NO: 888297 - RNA, 15 nt, Homo sapiens
uaaaugaagugcaaa

SEQ ID NO: 888298 - RNA, 12 nt, Homo sapiens
uaaaugaccuca

SEQ ID NO: 888299 - RNA, 16 nt, Homo sapiens
uaaaugcauguccuca

SEQ ID NO: 888300 - RNA, 17 nt, Homo sapiens
uaaaugccaacauaccc

SEQ ID NO: 888301 - RNA, 13 nt, Homo sapiens
uaaaugcccaguu

SEQ ID NO: 888302 - RNA, 17 nt, Homo sapiens
uaaaugggcagugccuc

SEQ ID NO: 888303 - RNA, 20 nt, Homo sapiens
uaaauguaucuuauucacau

SEQ ID NO: 888304 - RNA, 16 nt, Homo sapiens
uaaauguguaaaugug

SEQ ID NO: 888305 - RNA, 14 nt, Homo sapiens
uaaauuaguauuua

SEQ ID NO: 888306 - RNA, 19 nt, Homo sapiens
uaaauuauggcucuucacc

SEQ ID NO: 888307 - RNA, 20 nt, Homo sapiens
uaaauugaaauauaaugcaa

SEQ ID NO: 888308 - RNA, 23 nt, Homo sapiens
uaaauugcuuuuguugugacuuu

SEQ ID NO: 888309 - RNA, 21 nt, Homo sapiens
uaaauuggaauuuucuuaccc

SEQ ID NO: 888310 - RNA, 20 nt, Homo sapiens
uaaauuguuuuuacugauga

SEQ ID NO: 888311 - RNA, 13 nt, Homo sapiens
uaaauuuauuuca

SEQ ID NO: 888312 - RNA, 15 nt, Homo sapiens
aucugccuuuaccua

SEQ ID NO: 888313 - RNA, 18 nt, Homo sapiens
aucugggagaauuuucaa

SEQ ID NO: 888314 - RNA, 18 nt, Homo sapiens
aucuguaaggaacuggaa

SEQ ID NO: 888315 - RNA, 19 nt, Homo sapiens
aucuguaaggaacuggaac

SEQ ID NO: 888316 - RNA, 15 nt, Homo sapiens
aucugucaucucucu

SEQ ID NO: 888317 - RNA, 20 nt, Homo sapiens
aucugucuugccagccagaa

SEQ ID NO: 888318 - RNA, 22 nt, Homo sapiens
aucugugcaaauccuugauacu

SEQ ID NO: 888319 - RNA, 15 nt, Homo sapiens
aucuguguugucucu

SEQ ID NO: 888320 - RNA, 16 nt, Homo sapiens
aucuguuauccugcua

SEQ ID NO: 888321 - RNA, 21 nt, Homo sapiens
aucuguuugaucccuguuacc

SEQ ID NO: 888322 - RNA, 17 nt, Homo sapiens
aucuuaaaaaccugccu

SEQ ID NO: 888323 - RNA, 14 nt, Homo sapiens
aucuuaaaugacag

SEQ ID NO: 888324 - RNA, 14 nt, Homo sapiens
aucuuaaaugccag

SEQ ID NO: 888325 - RNA, 22 nt, Homo sapiens
aucuuaauuuuuuuuaauguac

SEQ ID NO: 888326 - RNA, 14 nt, Homo sapiens
aucuuagcuuucca

SEQ ID NO: 888327 - RNA, 15 nt, Homo sapiens
aucuuauauaguuua

SEQ ID NO: 888328 - RNA, 17 nt, Homo sapiens
aucuucaaccuuaagga

SEQ ID NO: 888329 - RNA, 12 nt, Homo sapiens
aucuucagcucc

SEQ ID NO: 888330 - RNA, 15 nt, Homo sapiens
aucuuccccggaugu

SEQ ID NO: 888331 - RNA, 20 nt, Homo sapiens
aucuuguuaaauugcuuauu

SEQ ID NO: 888332 - RNA, 18 nt, Homo sapiens
aucuuuccuugucucuca

SEQ ID NO: 888333 - RNA, 14 nt, Homo sapiens
aucuuuugugagau

SEQ ID NO: 888334 - RNA, 23 nt, Homo sapiens
aucuuuuugagagaaccuuauau

SEQ ID NO: 888335 - RNA, 17 nt, Homo sapiens
augaaacaaauaaucac

SEQ ID NO: 888336 - RNA, 14 nt, Homo sapiens
augaaaucugagga

SEQ ID NO: 888337 - RNA, 15 nt, Homo sapiens
augaaaucuugcaau

SEQ ID NO: 888338 - RNA, 17 nt, Homo sapiens
augaaaugacugucuaa

SEQ ID NO: 888339 - RNA, 19 nt, Homo sapiens
augaaaugauaaagauguc

SEQ ID NO: 888340 - RNA, 15 nt, Homo sapiens
augaaaugcucuccu

SEQ ID NO: 888341 - RNA, 20 nt, Homo sapiens
augaaauguuucacuaugau

SEQ ID NO: 888342 - RNA, 18 nt, Homo sapiens
augaacaugugaaguuau

SEQ ID NO: 888343 - RNA, 21 nt, Homo sapiens
augaaccacguguuuugacau

SEQ ID NO: 888344 - RNA, 16 nt, Homo sapiens
augaacuguccuucca

SEQ ID NO: 888345 - RNA, 13 nt, Homo sapiens
augaacugugaca

SEQ ID NO: 888346 - RNA, 21 nt, Homo sapiens
augaagaugucuaauaguuau

SEQ ID NO: 888347 - RNA, 21 nt, Homo sapiens
augaagauucuccugugcuag

SEQ ID NO: 888348 - RNA, 21 nt, Homo sapiens
augaagccugugccaccugca

SEQ ID NO: 888349 - RNA, 20 nt, Homo sapiens
augaaggcuguacacugcac

SEQ ID NO: 888350 - RNA, 18 nt, Homo sapiens
augaauauuuuguaacua

SEQ ID NO: 888351 - RNA, 20 nt, Homo sapiens
augaauauuuuguaacuauu

SEQ ID NO: 888352 - RNA, 19 nt, Homo sapiens
augaaucaaagacauggaa

SEQ ID NO: 888353 - RNA, 19 nt, Homo sapiens
augaaucccauaauugaca

SEQ ID NO: 888354 - RNA, 15 nt, Homo sapiens
augacaaacccagga

SEQ ID NO: 888355 - RNA, 16 nt, Homo sapiens
augacaaaggcacuga

SEQ ID NO: 888356 - RNA, 20 nt, Homo sapiens
augacaaaguuacaaauuca

SEQ ID NO: 888357 - RNA, 20 nt, Homo sapiens
augacagaaugcuguuuuaa

SEQ ID NO: 888358 - RNA, 17 nt, Homo sapiens
augacagccagagccug

SEQ ID NO: 888359 - RNA, 19 nt, Homo sapiens
augacagcucuucuaagga

SEQ ID NO: 888360 - RNA, 17 nt, Homo sapiens
augacagggaugccaac

SEQ ID NO: 888361 - RNA, 14 nt, Homo sapiens
augacaucuucaaa

SEQ ID NO: 888362 - RNA, 12 nt, Homo sapiens
augacauguuau

SEQ ID NO: 888363 - RNA, 17 nt, Homo sapiens
augacccuccuguccag

SEQ ID NO: 888364 - RNA, 18 nt, Homo sapiens
augaccuaaccuaagcaa

SEQ ID NO: 888365 - RNA, 21 nt, Homo sapiens
augaccuaguaaacuuuguac

SEQ ID NO: 888366 - RNA, 11 nt, Homo sapiens
augaccugcug

SEQ ID NO: 888367 - RNA, 18 nt, Homo sapiens
augaccuguauuuugcca

SEQ ID NO: 888368 - RNA, 22 nt, Homo sapiens
augaccuguuauuaccauuagc

SEQ ID NO: 888369 - RNA, 18 nt, Homo sapiens
augaccuuauaguguuaa

SEQ ID NO: 888370 - RNA, 17 nt, Homo sapiens
augaccuuguugcauga

SEQ ID NO: 888371 - RNA, 17 nt, Homo sapiens
augacguguccuacagc

SEQ ID NO: 888372 - RNA, 19 nt, Homo sapiens
augacuaaagcagggacaa

SEQ ID NO: 888373 - RNA, 13 nt, Homo sapiens
augacucagcaua

SEQ ID NO: 888374 - RNA, 17 nt, Homo sapiens
augacucagcauaccug

SEQ ID NO: 888375 - RNA, 22 nt, Homo sapiens
augacuguuuuuauaugcacau

SEQ ID NO: 888376 - RNA, 22 nt, Homo sapiens
augacuguuuuucggacaguuu

SEQ ID NO: 888377 - RNA, 22 nt, Homo sapiens
augacuucugccccagcuuuau

SEQ ID NO: 888378 - RNA, 18 nt, Homo sapiens
augggaucccaggccagg

SEQ ID NO: 888379 - RNA, 23 nt, Homo sapiens
augggaucuguaaggaacuggaa

SEQ ID NO: 888380 - RNA, 19 nt, Homo sapiens
augggcacaugaggagggu

SEQ ID NO: 888381 - RNA, 23 nt, Homo sapiens
auggggauaaaggagaaggcaug

SEQ ID NO: 888382 - RNA, 22 nt, Homo sapiens
auggggcgaucaaguccagagc

SEQ ID NO: 888383 - RNA, 21 nt, Homo sapiens
auggggguggggaggcaagaa

SEQ ID NO: 888384 - RNA, 14 nt, Homo sapiens
auggggugggccca

SEQ ID NO: 888385 - RNA, 21 nt, Homo sapiens
augggugauuccuucaauuca

SEQ ID NO: 888386 - RNA, 17 nt, Homo sapiens
augggugugccaggcua

SEQ ID NO: 888387 - RNA, 16 nt, Homo sapiens
augguaaaaguuacuu

SEQ ID NO: 888388 - RNA, 14 nt, Homo sapiens
augguaacugcaca

SEQ ID NO: 888389 - RNA, 15 nt, Homo sapiens
augguacuacaacca

SEQ ID NO: 888390 - RNA, 21 nt, Homo sapiens
augguacuaguguuuuuuaga

SEQ ID NO: 888391 - RNA, 21 nt, Homo sapiens
auggucacgagguccagaccc

SEQ ID NO: 888392 - RNA, 14 nt, Homo sapiens
augguccugugaug

SEQ ID NO: 888393 - RNA, 19 nt, Homo sapiens
auggugaaaccucaucucu

SEQ ID NO: 888394 - RNA, 21 nt, Homo sapiens
auggugaaaccucaucucuac

SEQ ID NO: 888395 - RNA, 20 nt, Homo sapiens
auggugcaaauccuacugaa

SEQ ID NO: 888396 - RNA, 15 nt, Homo sapiens
auggugcacugagcu

SEQ ID NO: 888397 - RNA, 21 nt, Homo sapiens
augguguguuccuaacauaaa

SEQ ID NO: 888398 - RNA, 15 nt, Homo sapiens
augguuaaauaucac

SEQ ID NO: 888399 - RNA, 16 nt, Homo sapiens
augguuacucuuguca

SEQ ID NO: 888400 - RNA, 15 nt, Homo sapiens
augguuuacugcugu

SEQ ID NO: 888401 - RNA, 21 nt, Homo sapiens
augguuuccaagggucuuccu

SEQ ID NO: 888402 - RNA, 13 nt, Homo sapiens
augguuucuccag

SEQ ID NO: 888403 - RNA, 17 nt, Homo sapiens
auguaaacagugccugc

SEQ ID NO: 888404 - RNA, 16 nt, Homo sapiens
auguaaaggccuuuaa

SEQ ID NO: 888405 - RNA, 22 nt, Homo sapiens
auguaauaaaucugagccuaaa

SEQ ID NO: 888406 - RNA, 23 nt, Homo sapiens
auguaaugcauaggaaguauggc

SEQ ID NO: 888407 - RNA, 12 nt, Homo sapiens
auguacaaauag

SEQ ID NO: 888408 - RNA, 16 nt, Homo sapiens
auguacacacacagau

SEQ ID NO: 888409 - RNA, 16 nt, Homo sapiens
auguaccaguguacug

SEQ ID NO: 888410 - RNA, 19 nt, Homo sapiens
auguaccaguguacugcuu

SEQ ID NO: 888411 - RNA, 18 nt, Homo sapiens
auguacgaaacuguauga

SEQ ID NO: 888412 - RNA, 21 nt, Homo sapiens
auguaguaguuugggugugua

SEQ ID NO: 888413 - RNA, 23 nt, Homo sapiens
auguaguccguuaacacuacuua

SEQ ID NO: 888414 - RNA, 22 nt, Homo sapiens
auguagugugucagaguaacau

SEQ ID NO: 888415 - RNA, 17 nt, Homo sapiens
auguauaaagacaccuu

SEQ ID NO: 888416 - RNA, 13 nt, Homo sapiens
auguauaaauguu

SEQ ID NO: 888417 - RNA, 12 nt, Homo sapiens
auguauacacac

SEQ ID NO: 888418 - RNA, 17 nt, Homo sapiens
auguaucuaccaucuaa

SEQ ID NO: 888419 - RNA, 15 nt, Homo sapiens
auguaucuaccucac

SEQ ID NO: 888420 - RNA, 13 nt, Homo sapiens
auguaugcauuca

SEQ ID NO: 888421 - RNA, 19 nt, Homo sapiens
auguaugcauucauccaac

SEQ ID NO: 888422 - RNA, 22 nt, Homo sapiens
auguaugucuuggacacuguac

SEQ ID NO: 888423 - RNA, 17 nt, Homo sapiens
auguauuaucacaucaa

SEQ ID NO: 888424 - RNA, 21 nt, Homo sapiens
auguauuuauauuuugugcua

SEQ ID NO: 888425 - RNA, 19 nt, Homo sapiens
auguauuuuugucauagca

SEQ ID NO: 888426 - RNA, 17 nt, Homo sapiens
augucaaauaucucaga

SEQ ID NO: 888427 - RNA, 21 nt, Homo sapiens
uaauuauuccacucaauaugu

SEQ ID NO: 888428 - RNA, 18 nt, Homo sapiens
uaauucaacauauaccuu

SEQ ID NO: 888429 - RNA, 14 nt, Homo sapiens
uaauucagcacuga

SEQ ID NO: 888430 - RNA, 19 nt, Homo sapiens
uaauucagcacugauuuca

SEQ ID NO: 888431 - RNA, 15 nt, Homo sapiens
uaauucuaugagaua

SEQ ID NO: 888432 - RNA, 17 nt, Homo sapiens
uaauucugcuucuagua

SEQ ID NO: 888433 - RNA, 19 nt, Homo sapiens
uaauugaucaaauucauuu

SEQ ID NO: 888434 - RNA, 21 nt, Homo sapiens
uaauugauuauucugauucca

SEQ ID NO: 888435 - RNA, 14 nt, Homo sapiens
uaauugcauauaaa

SEQ ID NO: 888436 - RNA, 16 nt, Homo sapiens
uaauugcuuacauuuu

SEQ ID NO: 888437 - RNA, 23 nt, Homo sapiens
uaauugugaauaaaaauugauga

SEQ ID NO: 888438 - RNA, 13 nt, Homo sapiens
uaauuguguacaa

SEQ ID NO: 888439 - RNA, 21 nt, Homo sapiens
uaauuuaucuugucucugggc

SEQ ID NO: 888440 - RNA, 17 nt, Homo sapiens
uaauuucaggaauugaa

SEQ ID NO: 888441 - RNA, 17 nt, Homo sapiens
uaauuuccucugacaug

SEQ ID NO: 888442 - RNA, 16 nt, Homo sapiens
uaauuugaauggugca

SEQ ID NO: 888443 - RNA, 18 nt, Homo sapiens
uaauuugauacugaccuu

SEQ ID NO: 888444 - RNA, 21 nt, Homo sapiens
uaauuugauaguauugugcau

SEQ ID NO: 888445 - RNA, 18 nt, Homo sapiens
uaauuuguaucugaagga

SEQ ID NO: 888446 - RNA, 15 nt, Homo sapiens
uaauuuguuguacuu

SEQ ID NO: 888447 - RNA, 15 nt, Homo sapiens
uaauuuugccauccu

SEQ ID NO: 888448 - RNA, 17 nt, Homo sapiens
uaauuuuuacaugacca

SEQ ID NO: 888449 - RNA, 15 nt, Homo sapiens
uacaaaaaacaacaa

SEQ ID NO: 888450 - RNA, 15 nt, Homo sapiens
uacaaaaacacagca

SEQ ID NO: 888451 - RNA, 14 nt, Homo sapiens
uacaaaguauuugc

SEQ ID NO: 888452 - RNA, 11 nt, Homo sapiens
uacaaccagag

SEQ ID NO: 888453 - RNA, 17 nt, Homo sapiens
uacaaccugaauacccu

SEQ ID NO: 888454 - RNA, 18 nt, Homo sapiens
uacaacuugcauauguca

SEQ ID NO: 888455 - RNA, 14 nt, Homo sapiens
uacaaggacaaugc

SEQ ID NO: 888456 - RNA, 17 nt, Homo sapiens
uacaaggcacuugucac

SEQ ID NO: 888457 - RNA, 19 nt, Homo sapiens
uacaauaauucuaugagau

SEQ ID NO: 888458 - RNA, 17 nt, Homo sapiens
uacaaucugcacuuuaa

SEQ ID NO: 888459 - RNA, 19 nt, Homo sapiens
uacaauguucuguuguaaa

SEQ ID NO: 888460 - RNA, 13 nt, Homo sapiens
uacaauugucauu

SEQ ID NO: 888461 - RNA, 17 nt, Homo sapiens
uacacaaaagccaaaag

SEQ ID NO: 888462 - RNA, 19 nt, Homo sapiens
uacacacacagaugcacac

SEQ ID NO: 888463 - RNA, 13 nt, Homo sapiens
uacacacauauac

SEQ ID NO: 888464 - RNA, 20 nt, Homo sapiens
uacacacccauagugcacac

SEQ ID NO: 888465 - RNA, 14 nt, Homo sapiens
uacacauacauaca

SEQ ID NO: 888466 - RNA, 15 nt, Homo sapiens
uacacauacauacau

SEQ ID NO: 888467 - RNA, 20 nt, Homo sapiens
uacacauacugcaugcucag

SEQ ID NO: 888468 - RNA, 13 nt, Homo sapiens
uacacauauaccu

SEQ ID NO: 888469 - RNA, 15 nt, Homo sapiens
uacacauauaccuau

SEQ ID NO: 888470 - RNA, 20 nt, Homo sapiens
uacacauguaucuaugcauu

SEQ ID NO: 888471 - RNA, 22 nt, Homo sapiens
uacacauucucacaauuguaaa

SEQ ID NO: 888472 - RNA, 21 nt, Homo sapiens
uacacauuggaaggcucccua

SEQ ID NO: 888473 - RNA, 13 nt, Homo sapiens
uacaccacucugg

SEQ ID NO: 888474 - RNA, 16 nt, Homo sapiens
uacacuauugcauugu

SEQ ID NO: 888475 - RNA, 19 nt, Homo sapiens
uacagaauggaaccaaaau

SEQ ID NO: 888476 - RNA, 18 nt, Homo sapiens
uacagagaaaagacauaa

SEQ ID NO: 888477 - RNA, 14 nt, Homo sapiens
uacagauagucaaa

SEQ ID NO: 888478 - RNA, 15 nt, Homo sapiens
uacagaugcacccca

SEQ ID NO: 888479 - RNA, 18 nt, Homo sapiens
uacagauguaaaugccac

SEQ ID NO: 888480 - RNA, 23 nt, Homo sapiens
uacagcagaaaaucuuuuacuag

SEQ ID NO: 888481 - RNA, 15 nt, Homo sapiens
uacaggagugagcac

SEQ ID NO: 888482 - RNA, 19 nt, Homo sapiens
uacaggcaacaaugagcag

SEQ ID NO: 888483 - RNA, 17 nt, Homo sapiens
uacaggccucgcuacaa

SEQ ID NO: 888484 - RNA, 17 nt, Homo sapiens
uacaguaaauaaauugu

SEQ ID NO: 888485 - RNA, 12 nt, Homo sapiens
uacaguguuauu

SEQ ID NO: 888486 - RNA, 16 nt, Homo sapiens
uacaguuaacucuccc

SEQ ID NO: 888487 - RNA, 15 nt, Homo sapiens
uacauaacuugauau

SEQ ID NO: 888488 - RNA, 13 nt, Homo sapiens
uacauaagaccau

SEQ ID NO: 888489 - RNA, 20 nt, Homo sapiens
uacauacaggccauacuuua

SEQ ID NO: 888490 - RNA, 23 nt, Homo sapiens
uacauacaggccauacuuuacaa

SEQ ID NO: 888491 - RNA, 12 nt, Homo sapiens
uacauacauaca

SEQ ID NO: 888492 - RNA, 13 nt, Homo sapiens
uacauacauacau

SEQ ID NO: 888493 - RNA, 15 nt, Homo sapiens
uacuuuaccuccuau

SEQ ID NO: 888494 - RNA, 21 nt, Homo sapiens
uacuuuauguauggagcucua

SEQ ID NO: 888495 - RNA, 20 nt, Homo sapiens
uacuuuauuuguauuugcca

SEQ ID NO: 888496 - RNA, 20 nt, Homo sapiens
uacuuucaucuauucuuucc

SEQ ID NO: 888497 - RNA, 23 nt, Homo sapiens
uagaaaaacuuuuaaacaugaga

SEQ ID NO: 888498 - RNA, 17 nt, Homo sapiens
uagaaaaaucucauucc

SEQ ID NO: 888499 - RNA, 14 nt, Homo sapiens
uagaaaacauucca

SEQ ID NO: 888500 - RNA, 20 nt, Homo sapiens
uagaaaagcaaagggugcua

SEQ ID NO: 888501 - RNA, 19 nt, Homo sapiens
uagaaaaguuauguagaaa

SEQ ID NO: 888502 - RNA, 20 nt, Homo sapiens
uagaaaaguuauguagaaaa

SEQ ID NO: 888503 - RNA, 12 nt, Homo sapiens
uagaaacacagu

SEQ ID NO: 888504 - RNA, 15 nt, Homo sapiens
uagaaacaugacacu

SEQ ID NO: 888505 - RNA, 22 nt, Homo sapiens
uagaaacugaggccauuauuuc

SEQ ID NO: 888506 - RNA, 20 nt, Homo sapiens
uagaaauaccucauucgccu

SEQ ID NO: 888507 - RNA, 14 nt, Homo sapiens
uagaaaugagccag

SEQ ID NO: 888508 - RNA, 17 nt, Homo sapiens
uagaacaaugcuauaau

SEQ ID NO: 888509 - RNA, 16 nt, Homo sapiens
uagaacacugcauuag

SEQ ID NO: 888510 - RNA, 11 nt, Homo sapiens
uagaaccucac

SEQ ID NO: 888511 - RNA, 17 nt, Homo sapiens
uagaaccucaccuguua

SEQ ID NO: 888512 - RNA, 11 nt, Homo sapiens
uagaaccugga

SEQ ID NO: 888513 - RNA, 17 nt, Homo sapiens
uagaaccuggagccacu

SEQ ID NO: 888514 - RNA, 18 nt, Homo sapiens
uagaacuauuaaaacagc

SEQ ID NO: 888515 - RNA, 18 nt, Homo sapiens
uagaacucuccaucuuau

SEQ ID NO: 888516 - RNA, 14 nt, Homo sapiens
uagaagagccugac

SEQ ID NO: 888517 - RNA, 20 nt, Homo sapiens
uagaagccaguacagagaaa

SEQ ID NO: 888518 - RNA, 18 nt, Homo sapiens
uagaagccugcagcggca

SEQ ID NO: 888519 - RNA, 17 nt, Homo sapiens
uagaaggccacauguca

SEQ ID NO: 888520 - RNA, 20 nt, Homo sapiens
uagaagggcuagaaccugga

SEQ ID NO: 888521 - RNA, 12 nt, Homo sapiens
uagaagucacac

SEQ ID NO: 888522 - RNA, 17 nt, Homo sapiens
uagaauauuuauuaccu

SEQ ID NO: 888523 - RNA, 20 nt, Homo sapiens
uagaauauuuauuaccucug

SEQ ID NO: 888524 - RNA, 14 nt, Homo sapiens
uagaaugcauguaa

SEQ ID NO: 888525 - RNA, 12 nt, Homo sapiens
uagaauugggaa

SEQ ID NO: 888526 - RNA, 16 nt, Homo sapiens
uagacaagcuugucca

SEQ ID NO: 888527 - RNA, 21 nt, Homo sapiens
uagacaguacucuuaacuccu

SEQ ID NO: 888528 - RNA, 20 nt, Homo sapiens
uagacaugaaaucugaggaa

SEQ ID NO: 888529 - RNA, 20 nt, Homo sapiens
uagacugaagagaccacagc

SEQ ID NO: 888530 - RNA, 22 nt, Homo sapiens
uagagaagccggcucuucaaag

SEQ ID NO: 888531 - RNA, 15 nt, Homo sapiens
uagagacacagagau

SEQ ID NO: 888532 - RNA, 21 nt, Homo sapiens
uagagacaggguuuugccaug

SEQ ID NO: 888533 - RNA, 17 nt, Homo sapiens
uagagacuuugugaaaa

SEQ ID NO: 888534 - RNA, 15 nt, Homo sapiens
uagagauaugcacac

SEQ ID NO: 888535 - RNA, 14 nt, Homo sapiens
uagagauaugcaga

SEQ ID NO: 888536 - RNA, 18 nt, Homo sapiens
uagagauaugcagaagga

SEQ ID NO: 888537 - RNA, 21 nt, Homo sapiens
uagagccagcccauggcuuua

SEQ ID NO: 888538 - RNA, 18 nt, Homo sapiens
uagagccagggucucacu

SEQ ID NO: 888539 - RNA, 19 nt, Homo sapiens
uagagcugggaaacaggga

SEQ ID NO: 888540 - RNA, 12 nt, Homo sapiens
uagaggagcaac

SEQ ID NO: 888541 - RNA, 23 nt, Homo sapiens
uagaggugggcagcugggcccca

SEQ ID NO: 888542 - RNA, 16 nt, Homo sapiens
auucagauugacaagg

SEQ ID NO: 888543 - RNA, 20 nt, Homo sapiens
auucagcacaccccaaggga

SEQ ID NO: 888544 - RNA, 22 nt, Homo sapiens
auucagcauuauuccuccagga

SEQ ID NO: 888545 - RNA, 23 nt, Homo sapiens
auucagugcuguacuugaugaca

SEQ ID NO: 888546 - RNA, 20 nt, Homo sapiens
auucaucuauggagggcaga

SEQ ID NO: 888547 - RNA, 14 nt, Homo sapiens
auucauguggaaua

SEQ ID NO: 888548 - RNA, 15 nt, Homo sapiens
auucauuuaacagag

SEQ ID NO: 888549 - RNA, 14 nt, Homo sapiens
auucauuucaucua

SEQ ID NO: 888550 - RNA, 20 nt, Homo sapiens
auucauuucaucuacuacag

SEQ ID NO: 888551 - RNA, 20 nt, Homo sapiens
auucauuuuuuucacuggag

SEQ ID NO: 888552 - RNA, 14 nt, Homo sapiens
auuccaacagcuca

SEQ ID NO: 888553 - RNA, 22 nt, Homo sapiens
auuccaacagcucaagucuucc

SEQ ID NO: 888554 - RNA, 19 nt, Homo sapiens
auuccaaggaguuccauga

SEQ ID NO: 888555 - RNA, 16 nt, Homo sapiens
auuccaccuucccaug

SEQ ID NO: 888556 - RNA, 17 nt, Homo sapiens
auuccagaccugaagaa

SEQ ID NO: 888557 - RNA, 16 nt, Homo sapiens
auuccagucucugcau

SEQ ID NO: 888558 - RNA, 22 nt, Homo sapiens
auuccauaaucaaucuaucaau

SEQ ID NO: 888559 - RNA, 18 nt, Homo sapiens
auuccaugggauguuaag

SEQ ID NO: 888560 - RNA, 16 nt, Homo sapiens
auucccacagcacuaa

SEQ ID NO: 888561 - RNA, 21 nt, Homo sapiens
auucccacagcacuaauucaa

SEQ ID NO: 888562 - RNA, 22 nt, Homo sapiens
auuccccucgugugacucucuu

SEQ ID NO: 888563 - RNA, 13 nt, Homo sapiens
auucccuuuccca

SEQ ID NO: 888564 - RNA, 20 nt, Homo sapiens
auuccugggccuguccccca

SEQ ID NO: 888565 - RNA, 21 nt, Homo sapiens
auuccuguuucugaaccauua

SEQ ID NO: 888566 - RNA, 22 nt, Homo sapiens
auuccuguuucugaaccauuac

SEQ ID NO: 888567 - RNA, 18 nt, Homo sapiens
auuccuucacucauccag

SEQ ID NO: 888568 - RNA, 17 nt, Homo sapiens
auucgugacaacaugcg

SEQ ID NO: 888569 - RNA, 16 nt, Homo sapiens
auucuaaugucuucau

SEQ ID NO: 888570 - RNA, 14 nt, Homo sapiens
auucuacacugagg

SEQ ID NO: 888571 - RNA, 11 nt, Homo sapiens
auucuacauau

SEQ ID NO: 888572 - RNA, 18 nt, Homo sapiens
auucuacugaacacuuca

SEQ ID NO: 888573 - RNA, 23 nt, Homo sapiens
auucuacuucugucuuccuucau

SEQ ID NO: 888574 - RNA, 20 nt, Homo sapiens
auucuagccaaacuauucua

SEQ ID NO: 888575 - RNA, 13 nt, Homo sapiens
auucuaguacuug

SEQ ID NO: 888576 - RNA, 19 nt, Homo sapiens
auucuaucacuggcaauau

SEQ ID NO: 888577 - RNA, 17 nt, Homo sapiens
auucucagugcucuccu

SEQ ID NO: 888578 - RNA, 21 nt, Homo sapiens
auucucaucuacucauugucu

SEQ ID NO: 888579 - RNA, 14 nt, Homo sapiens
auucucaugugauc

SEQ ID NO: 888580 - RNA, 15 nt, Homo sapiens
auucuccugucagag

SEQ ID NO: 888581 - RNA, 15 nt, Homo sapiens
auucucgaacugcau

SEQ ID NO: 888582 - RNA, 20 nt, Homo sapiens
auucuggcugcaagggccag

SEQ ID NO: 888583 - RNA, 20 nt, Homo sapiens
auucuggcugcgggucucag

SEQ ID NO: 888584 - RNA, 17 nt, Homo sapiens
auucuggucuucacugc

SEQ ID NO: 888585 - RNA, 19 nt, Homo sapiens
auucuggucuucacugcca

SEQ ID NO: 888586 - RNA, 18 nt, Homo sapiens
auucuuaauaggcuuuau

SEQ ID NO: 888587 - RNA, 20 nt, Homo sapiens
auucuuacaaacaugugguu

SEQ ID NO: 888588 - RNA, 20 nt, Homo sapiens
auucuuauuuaaguuauuga

SEQ ID NO: 888589 - RNA, 17 nt, Homo sapiens
auucuugacaugagaaa

SEQ ID NO: 888590 - RNA, 15 nt, Homo sapiens
auucuuguccuggcu

SEQ ID NO: 888591 - RNA, 15 nt, Homo sapiens
auucuugugccucag

SEQ ID NO: 888592 - RNA, 19 nt, Homo sapiens
auucuuguuuuaagugccu

SEQ ID NO: 888593 - RNA, 20 nt, Homo sapiens
auucuuuaaauuucaucuca

SEQ ID NO: 888594 - RNA, 20 nt, Homo sapiens
auucuuuucuuuuccauuua

SEQ ID NO: 888595 - RNA, 22 nt, Homo sapiens
auugaaggagaaaaugcauuau

SEQ ID NO: 888596 - RNA, 21 nt, Homo sapiens
auugaaucccuuaaacucagg

SEQ ID NO: 888597 - RNA, 20 nt, Homo sapiens
auugaauuggauacaaggau

SEQ ID NO: 888598 - RNA, 23 nt, Homo sapiens
auugaccucagcugcacauuccu

SEQ ID NO: 888599 - RNA, 19 nt, Homo sapiens
auugacugaacugcacguu

SEQ ID NO: 888600 - RNA, 17 nt, Homo sapiens
auugacugucacuguuc

SEQ ID NO: 888601 - RNA, 15 nt, Homo sapiens
auugagaaacaugaa

SEQ ID NO: 888602 - RNA, 22 nt, Homo sapiens
auugaggaggacuacuauuuga

SEQ ID NO: 888603 - RNA, 13 nt, Homo sapiens
auugaugccagug

SEQ ID NO: 888604 - RNA, 12 nt, Homo sapiens
auugauguugcu

SEQ ID NO: 888605 - RNA, 21 nt, Homo sapiens
auugcacgggagaauauacaa

SEQ ID NO: 888606 - RNA, 11 nt, Homo sapiens
auugcacucag

SEQ ID NO: 888607 - RNA, 15 nt, Homo sapiens
uagggauaacacugu

SEQ ID NO: 888608 - RNA, 23 nt, Homo sapiens
uagggcaacaauacaugcugcua

SEQ ID NO: 888609 - RNA, 17 nt, Homo sapiens
uagggcagucaguagua

SEQ ID NO: 888610 - RNA, 18 nt, Homo sapiens
uagggcuuauccaugccu

SEQ ID NO: 888611 - RNA, 17 nt, Homo sapiens
uaggguccuggcccucu

SEQ ID NO: 888612 - RNA, 16 nt, Homo sapiens
uagguacgucaaagca

SEQ ID NO: 888613 - RNA, 21 nt, Homo sapiens
uagguagaauuuaacaugacu

SEQ ID NO: 888614 - RNA, 17 nt, Homo sapiens
uaggugucuguuuccca

SEQ ID NO: 888615 - RNA, 14 nt, Homo sapiens
uagguuuacauuca

SEQ ID NO: 888616 - RNA, 19 nt, Homo sapiens
uagguuuccacugccaaaa

SEQ ID NO: 888617 - RNA, 14 nt, Homo sapiens
uaguaaacuuugua

SEQ ID NO: 888618 - RNA, 22 nt, Homo sapiens
uaguaaagacaggguuucacca

SEQ ID NO: 888619 - RNA, 15 nt, Homo sapiens
uaguaacaguuguga

SEQ ID NO: 888620 - RNA, 14 nt, Homo sapiens
uaguaacauagaca

SEQ ID NO: 888621 - RNA, 21 nt, Homo sapiens
uaguaacuacuuuuuauacuc

SEQ ID NO: 888622 - RNA, 18 nt, Homo sapiens
uaguaagggaacuaugga

SEQ ID NO: 888623 - RNA, 22 nt, Homo sapiens
uaguaauuguaaguaccccuga

SEQ ID NO: 888624 - RNA, 20 nt, Homo sapiens
uaguaauugucaauaccccu

SEQ ID NO: 888625 - RNA, 13 nt, Homo sapiens
uaguacugggaau

SEQ ID NO: 888626 - RNA, 22 nt, Homo sapiens
uaguaguuucucuguaaggcaa

SEQ ID NO: 888627 - RNA, 16 nt, Homo sapiens
uaguaucacauagaag

SEQ ID NO: 888628 - RNA, 22 nt, Homo sapiens
uagucaacaugccauaucucau

SEQ ID NO: 888629 - RNA, 16 nt, Homo sapiens
uagucaaggaggaaag

SEQ ID NO: 888630 - RNA, 13 nt, Homo sapiens
uagucacaaaaau

SEQ ID NO: 888631 - RNA, 19 nt, Homo sapiens
uagucacauggccuaugca

SEQ ID NO: 888632 - RNA, 20 nt, Homo sapiens
uagucacauggccuaugcac

SEQ ID NO: 888633 - RNA, 21 nt, Homo sapiens
uagucacauggccuaugcaca

SEQ ID NO: 888634 - RNA, 19 nt, Homo sapiens
uagucagaagcagguucuu

SEQ ID NO: 888635 - RNA, 16 nt, Homo sapiens
uaguccaaagacuuaa

SEQ ID NO: 888636 - RNA, 22 nt, Homo sapiens
uaguccccaucagcaccaugga

SEQ ID NO: 888637 - RNA, 14 nt, Homo sapiens
uaguccguuaacac

SEQ ID NO: 888638 - RNA, 16 nt, Homo sapiens
uagugcacacuuguau

SEQ ID NO: 888639 - RNA, 14 nt, Homo sapiens
uagugcacuagcau

SEQ ID NO: 888640 - RNA, 14 nt, Homo sapiens
uagugccugagaug

SEQ ID NO: 888641 - RNA, 23 nt, Homo sapiens
uagugcuuuaccuuuauuaauga

SEQ ID NO: 888642 - RNA, 22 nt, Homo sapiens
uaguggcuuuuuuccuccugug

SEQ ID NO: 888643 - RNA, 14 nt, Homo sapiens
uaguguaacacugc

SEQ ID NO: 888644 - RNA, 12 nt, Homo sapiens
uagugucacuua

SEQ ID NO: 888645 - RNA, 18 nt, Homo sapiens
uaguguccaaauucucac

SEQ ID NO: 888646 - RNA, 23 nt, Homo sapiens
uagugucuugaauguaagaacau

SEQ ID NO: 888647 - RNA, 23 nt, Homo sapiens
uaguuaaguauuuacagauguua

SEQ ID NO: 888648 - RNA, 16 nt, Homo sapiens
uaguuaauuauuucaa

SEQ ID NO: 888649 - RNA, 22 nt, Homo sapiens
uaguuccucuucuuaaggggau

SEQ ID NO: 888650 - RNA, 18 nt, Homo sapiens
uaguucuaggguuucccu

SEQ ID NO: 888651 - RNA, 19 nt, Homo sapiens
uaguucuugugcauguuua

SEQ ID NO: 888652 - RNA, 15 nt, Homo sapiens
uaguugaacaucuca

SEQ ID NO: 888653 - RNA, 22 nt, Homo sapiens
uaguuuaauuaacuaugugaug

SEQ ID NO: 888654 - RNA, 22 nt, Homo sapiens
uaguuuacagaauggaaccaaa

SEQ ID NO: 888655 - RNA, 14 nt, Homo sapiens
uaguuuauuucaac

SEQ ID NO: 888656 - RNA, 14 nt, Homo sapiens
auuuauauguuaau

SEQ ID NO: 888657 - RNA, 14 nt, Homo sapiens
auuuaucagugaca

SEQ ID NO: 888658 - RNA, 14 nt, Homo sapiens
auuuaucaucucga

SEQ ID NO: 888659 - RNA, 14 nt, Homo sapiens
auuuaucugugcaa

SEQ ID NO: 888660 - RNA, 20 nt, Homo sapiens
auuuauggucaacacuuaag

SEQ ID NO: 888661 - RNA, 19 nt, Homo sapiens
auuuauuagcagaaaugua

SEQ ID NO: 888662 - RNA, 18 nt, Homo sapiens
auuuauuggggugccuau

SEQ ID NO: 888663 - RNA, 17 nt, Homo sapiens
auuuauuuuuuuacuuc

SEQ ID NO: 888664 - RNA, 22 nt, Homo sapiens
auuucaaccagcauucaugccg

SEQ ID NO: 888665 - RNA, 20 nt, Homo sapiens
auuucaaccgcuugccauau

SEQ ID NO: 888666 - RNA, 18 nt, Homo sapiens
auuucagauaaacaacaa

SEQ ID NO: 888667 - RNA, 18 nt, Homo sapiens
auuucauaccuaucaucu

SEQ ID NO: 888668 - RNA, 17 nt, Homo sapiens
auuucaucugagugugg

SEQ ID NO: 888669 - RNA, 15 nt, Homo sapiens
auuucauguaaccaa

SEQ ID NO: 888670 - RNA, 15 nt, Homo sapiens
auuucauuaccaagu

SEQ ID NO: 888671 - RNA, 15 nt, Homo sapiens
auuucccagaaggga

SEQ ID NO: 888672 - RNA, 15 nt, Homo sapiens
auuucccucuacuga

SEQ ID NO: 888673 - RNA, 16 nt, Homo sapiens
auuuccuaaugucaga

SEQ ID NO: 888674 - RNA, 20 nt, Homo sapiens
auuuccucccucacaugaua

SEQ ID NO: 888675 - RNA, 19 nt, Homo sapiens
auuuccuccgucaccucag

SEQ ID NO: 888676 - RNA, 13 nt, Homo sapiens
auuuccugacaga

SEQ ID NO: 888677 - RNA, 21 nt, Homo sapiens
auuuccuuuccagucauuuca

SEQ ID NO: 888678 - RNA, 15 nt, Homo sapiens
auuucuacacagugg

SEQ ID NO: 888679 - RNA, 13 nt, Homo sapiens
auuucuagcagag

SEQ ID NO: 888680 - RNA, 15 nt, Homo sapiens
auuucuagguaggaa

SEQ ID NO: 888681 - RNA, 23 nt, Homo sapiens
auuucucaaucagugcagugaua

SEQ ID NO: 888682 - RNA, 23 nt, Homo sapiens
auuucucauuugaguauuacaau

SEQ ID NO: 888683 - RNA, 20 nt, Homo sapiens
auuucuccugacuccaguga

SEQ ID NO: 888684 - RNA, 17 nt, Homo sapiens
auuucugaaaugacaga

SEQ ID NO: 888685 - RNA, 18 nt, Homo sapiens
auuucuggaaaacugccu

SEQ ID NO: 888686 - RNA, 15 nt, Homo sapiens
auuucugucucucuc

SEQ ID NO: 888687 - RNA, 16 nt, Homo sapiens
auuucuguguuacuca

SEQ ID NO: 888688 - RNA, 16 nt, Homo sapiens
auuucuguuugaaugc

SEQ ID NO: 888689 - RNA, 15 nt, Homo sapiens
auuucuuuucaggga

SEQ ID NO: 888690 - RNA, 20 nt, Homo sapiens
auuucuuuucauuguaauca

SEQ ID NO: 888691 - RNA, 21 nt, Homo sapiens
auuucuuuuuuaaaugaagaa

SEQ ID NO: 888692 - RNA, 14 nt, Homo sapiens
auuugaagaagagu

SEQ ID NO: 888693 - RNA, 18 nt, Homo sapiens
auuugaauuucaguaaac

SEQ ID NO: 888694 - RNA, 16 nt, Homo sapiens
auuugagcaugcacag

SEQ ID NO: 888695 - RNA, 14 nt, Homo sapiens
auuugcccuaucau

SEQ ID NO: 888696 - RNA, 21 nt, Homo sapiens
auuugccuguaacaagccaga

SEQ ID NO: 888697 - RNA, 16 nt, Homo sapiens
auuugcuguucaccca

SEQ ID NO: 888698 - RNA, 20 nt, Homo sapiens
auuuggauaaaaggaaccaa

SEQ ID NO: 888699 - RNA, 14 nt, Homo sapiens
auuugucaaugcau

SEQ ID NO: 888700 - RNA, 16 nt, Homo sapiens
auuugucaaugcauca

SEQ ID NO: 888701 - RNA, 19 nt, Homo sapiens
auuuguggaggacuuugaa

SEQ ID NO: 888702 - RNA, 19 nt, Homo sapiens
auuugugucaaugggcaau

SEQ ID NO: 888703 - RNA, 20 nt, Homo sapiens
auuuguuaaugguuugaaua

SEQ ID NO: 888704 - RNA, 17 nt, Homo sapiens
auuuguuuggucacugc

SEQ ID NO: 888705 - RNA, 20 nt, Homo sapiens
auuuguuuucuucuguaugu

SEQ ID NO: 888706 - RNA, 18 nt, Homo sapiens
auuuuaaaaacuaaaaag

SEQ ID NO: 888707 - RNA, 13 nt, Homo sapiens
auuuuaagugcuu

SEQ ID NO: 888708 - RNA, 22 nt, Homo sapiens
auuuuaauaaaaugaaaggguc

SEQ ID NO: 888709 - RNA, 13 nt, Homo sapiens
auuuuaauuaucu

SEQ ID NO: 888710 - RNA, 14 nt, Homo sapiens
auuuuaauuaucuu

SEQ ID NO: 888711 - RNA, 19 nt, Homo sapiens
auuuuaccugggauaugac

SEQ ID NO: 888712 - RNA, 18 nt, Homo sapiens
auuuuacuaccaaugcca

SEQ ID NO: 888713 - RNA, 15 nt, Homo sapiens
auuuuagaugcaaug

SEQ ID NO: 888714 - RNA, 21 nt, Homo sapiens
auuuuagcaaagauaucucau

SEQ ID NO: 888715 - RNA, 20 nt, Homo sapiens
auuuuagcaggguacauauu

SEQ ID NO: 888716 - RNA, 23 nt, Homo sapiens
auuuuagggcuguagacuuacuu

SEQ ID NO: 888717 - RNA, 15 nt, Homo sapiens
auuuuaguuccuuua

SEQ ID NO: 888718 - RNA, 18 nt, Homo sapiens
auuuuauauauuauguca

SEQ ID NO: 888719 - RNA, 14 nt, Homo sapiens
auuuuaugcugcug

SEQ ID NO: 888720 - RNA, 21 nt, Homo sapiens
auuuuaugugcuucacauaau

SEQ ID NO: 888721 - RNA, 19 nt, Homo sapiens
uauuggacugauaaucucu

SEQ ID NO: 888722 - RNA, 20 nt, Homo sapiens
uauuggaugacuaacuauca

SEQ ID NO: 888723 - RNA, 15 nt, Homo sapiens
uauuguauaaacuau

SEQ ID NO: 888724 - RNA, 15 nt, Homo sapiens
uauugucauaaccaa

SEQ ID NO: 888725 - RNA, 16 nt, Homo sapiens
uauugucauaaccaac

SEQ ID NO: 888726 - RNA, 14 nt, Homo sapiens
uauuguccauauca

SEQ ID NO: 888727 - RNA, 19 nt, Homo sapiens
uauugugccaauauguauu

SEQ ID NO: 888728 - RNA, 23 nt, Homo sapiens
uauuuaaaaaauaaaaaaauaca

SEQ ID NO: 888729 - RNA, 21 nt, Homo sapiens
uauuuaaauaaaaucauauug

SEQ ID NO: 888730 - RNA, 18 nt, Homo sapiens
uauuuacauacaggccau

SEQ ID NO: 888731 - RNA, 16 nt, Homo sapiens
uauuuacauuuuccaa

SEQ ID NO: 888732 - RNA, 13 nt, Homo sapiens
uauuuauaacuca

SEQ ID NO: 888733 - RNA, 15 nt, Homo sapiens
uauuuauagucacaa

SEQ ID NO: 888734 - RNA, 13 nt, Homo sapiens
uauuuauauauca

SEQ ID NO: 888735 - RNA, 14 nt, Homo sapiens
uauuuaugccucug

SEQ ID NO: 888736 - RNA, 16 nt, Homo sapiens
uauuucaaaacacauc

SEQ ID NO: 888737 - RNA, 21 nt, Homo sapiens
uauuucaaccgcuugccauau

SEQ ID NO: 888738 - RNA, 15 nt, Homo sapiens
uauuucagaaauaca

SEQ ID NO: 888739 - RNA, 12 nt, Homo sapiens
uauuucaggcau

SEQ ID NO: 888740 - RNA, 15 nt, Homo sapiens
uauuucauaaacaac

SEQ ID NO: 888741 - RNA, 16 nt, Homo sapiens
uauuucauccaguuug

SEQ ID NO: 888742 - RNA, 19 nt, Homo sapiens
uauuuccugcuacacaaaa

SEQ ID NO: 888743 - RNA, 23 nt, Homo sapiens
uauuuccuuuccagucauuucaa

SEQ ID NO: 888744 - RNA, 14 nt, Homo sapiens
uauuucuaugcaaa

SEQ ID NO: 888745 - RNA, 21 nt, Homo sapiens
uauuucucaacaaagcacagu

SEQ ID NO: 888746 - RNA, 15 nt, Homo sapiens
uauuucuugcauuca

SEQ ID NO: 888747 - RNA, 14 nt, Homo sapiens
uauuugaauaucau

SEQ ID NO: 888748 - RNA, 17 nt, Homo sapiens
uauuugcaagacauaga

SEQ ID NO: 888749 - RNA, 15 nt, Homo sapiens
uauuuguauuugcca

SEQ ID NO: 888750 - RNA, 20 nt, Homo sapiens
uauuugugugugugauauau

SEQ ID NO: 888751 - RNA, 15 nt, Homo sapiens
uauuuuaagacguga

SEQ ID NO: 888752 - RNA, 20 nt, Homo sapiens
uauuuuauucccuuucacaa

SEQ ID NO: 888753 - RNA, 14 nt, Homo sapiens
uauuuuccaugaaa

SEQ ID NO: 888754 - RNA, 16 nt, Homo sapiens
uauuuugccagacuua

SEQ ID NO: 888755 - RNA, 16 nt, Homo sapiens
uauuuuuagacagagu

SEQ ID NO: 888756 - RNA, 14 nt, Homo sapiens
uauuuuuaugugca

SEQ ID NO: 888757 - RNA, 16 nt, Homo sapiens
uauuuuuguacguuau

SEQ ID NO: 888758 - RNA, 16 nt, Homo sapiens
uauuuuuuaaagucua

SEQ ID NO: 888759 - RNA, 16 nt, Homo sapiens
uauuuuuuacuuugcc

SEQ ID NO: 888760 - RNA, 18 nt, Homo sapiens
uauuuuuuuaagcuguaa

SEQ ID NO: 888761 - RNA, 14 nt, Homo sapiens
ucaaaaaguacaau

SEQ ID NO: 888762 - RNA, 20 nt, Homo sapiens
ucaaaaauacucacauggcu

SEQ ID NO: 888763 - RNA, 13 nt, Homo sapiens
ucaaaacaaucaa

SEQ ID NO: 888764 - RNA, 18 nt, Homo sapiens
ucaaaacccaacaugacu

SEQ ID NO: 888765 - RNA, 14 nt, Homo sapiens
ucaaaaccuuucaa

SEQ ID NO: 888766 - RNA, 17 nt, Homo sapiens
ucaaaacugcacuguca

SEQ ID NO: 888767 - RNA, 15 nt, Homo sapiens
ucaaaagagucuuaa

SEQ ID NO: 888768 - RNA, 19 nt, Homo sapiens
ucaaaauaagaaaauaacc

SEQ ID NO: 888769 - RNA, 18 nt, Homo sapiens
ucaaacauauguauacaa

SEQ ID NO: 888770 - RNA, 20 nt, Homo sapiens
ucaaacuccuggacucaugc

SEQ ID NO: 888771 - RNA, 17 nt, Homo sapiens
ucaaacugcaugauuca

SEQ ID NO: 888772 - RNA, 21 nt, Homo sapiens
caaccuguucuuccuaccaaa

SEQ ID NO: 888773 - RNA, 17 nt, Homo sapiens
caaccuuuaaaaaagca

SEQ ID NO: 888774 - RNA, 21 nt, Homo sapiens
caacgcacaggaaaagguagc

SEQ ID NO: 888775 - RNA, 17 nt, Homo sapiens
caacuaacguacauuca

SEQ ID NO: 888776 - RNA, 19 nt, Homo sapiens
caacuaggauacuuucuac

SEQ ID NO: 888777 - RNA, 18 nt, Homo sapiens
caacuauuaaagugccau

SEQ ID NO: 888778 - RNA, 18 nt, Homo sapiens
caacuauuuauugaauga

SEQ ID NO: 888779 - RNA, 18 nt, Homo sapiens
caacucagaaugcucuac

SEQ ID NO: 888780 - RNA, 12 nt, Homo sapiens
caacuccagcuc

SEQ ID NO: 888781 - RNA, 12 nt, Homo sapiens
caacuccuggaa

SEQ ID NO: 888782 - RNA, 15 nt, Homo sapiens
caacucuccacucca

SEQ ID NO: 888783 - RNA, 22 nt, Homo sapiens
caacucucuccuguauaaucuc

SEQ ID NO: 888784 - RNA, 12 nt, Homo sapiens
caacugacacag

SEQ ID NO: 888785 - RNA, 13 nt, Homo sapiens
caacugaccagcc

SEQ ID NO: 888786 - RNA, 20 nt, Homo sapiens
caacugcagaaaauguccuc

SEQ ID NO: 888787 - RNA, 23 nt, Homo sapiens
caacugugcuacacuugcaccug

SEQ ID NO: 888788 - RNA, 23 nt, Homo sapiens
caacuguuuuugaagaagggaaa

SEQ ID NO: 888789 - RNA, 21 nt, Homo sapiens
caacuuaagcugggauaauca

SEQ ID NO: 888790 - RNA, 13 nt, Homo sapiens
caacuuggcuuuc

SEQ ID NO: 888791 - RNA, 21 nt, Homo sapiens
caacuugguuauuguaggcaa

SEQ ID NO: 888792 - RNA, 18 nt, Homo sapiens
caacuuguguucuauuaa

SEQ ID NO: 888793 - RNA, 19 nt, Homo sapiens
caacuuguguucuauuaau

SEQ ID NO: 888794 - RNA, 15 nt, Homo sapiens
caacuuuccuuaaaa

SEQ ID NO: 888795 - RNA, 15 nt, Homo sapiens
caagaaaacuggaaa

SEQ ID NO: 888796 - RNA, 12 nt, Homo sapiens
caagaaacagaa

SEQ ID NO: 888797 - RNA, 12 nt, Homo sapiens
caagaaccugcu

SEQ ID NO: 888798 - RNA, 15 nt, Homo sapiens
caagaagcaugcaga

SEQ ID NO: 888799 - RNA, 12 nt, Homo sapiens
caagaaggugag

SEQ ID NO: 888800 - RNA, 16 nt, Homo sapiens
caagaaguacaugaag

SEQ ID NO: 888801 - RNA, 21 nt, Homo sapiens
caagaagucuugagaaaaaga

SEQ ID NO: 888802 - RNA, 15 nt, Homo sapiens
caagacuuccaggua

SEQ ID NO: 888803 - RNA, 18 nt, Homo sapiens
caagacuugauacugcaa

SEQ ID NO: 888804 - RNA, 12 nt, Homo sapiens
caagacuuugac

SEQ ID NO: 888805 - RNA, 14 nt, Homo sapiens
caagagacacugcu

SEQ ID NO: 888806 - RNA, 14 nt, Homo sapiens
caagagacugaguc

SEQ ID NO: 888807 - RNA, 23 nt, Homo sapiens
caagagagaaagaaguaggcaug

SEQ ID NO: 888808 - RNA, 13 nt, Homo sapiens
caagagcccuguc

SEQ ID NO: 888809 - RNA, 16 nt, Homo sapiens
caagaggagacuuuaa

SEQ ID NO: 888810 - RNA, 16 nt, Homo sapiens
caagaggcccagggag

SEQ ID NO: 888811 - RNA, 16 nt, Homo sapiens
caagaggcuccugucc

SEQ ID NO: 888812 - RNA, 14 nt, Homo sapiens
caagaggucuccau

SEQ ID NO: 888813 - RNA, 16 nt, Homo sapiens
caagagguggggacca

SEQ ID NO: 888814 - RNA, 21 nt, Homo sapiens
caagaggugguagaaccacuu

SEQ ID NO: 888815 - RNA, 21 nt, Homo sapiens
caagaguuuauuuccaaauaa

SEQ ID NO: 888816 - RNA, 17 nt, Homo sapiens
caagauaaaaccagagc

SEQ ID NO: 888817 - RNA, 15 nt, Homo sapiens
caagauacauuucau

SEQ ID NO: 888818 - RNA, 17 nt, Homo sapiens
caagauacauuucaucu

SEQ ID NO: 888819 - RNA, 21 nt, Homo sapiens
caagauggaggggcugacuca

SEQ ID NO: 888820 - RNA, 15 nt, Homo sapiens
caagaugggcacaug

SEQ ID NO: 888821 - RNA, 18 nt, Homo sapiens
caagaugugggcagugau

SEQ ID NO: 888822 - RNA, 23 nt, Homo sapiens
caagauuggccugaggcugcacu

SEQ ID NO: 888823 - RNA, 22 nt, Homo sapiens
caagauuucagaagccaaguuu

SEQ ID NO: 888824 - RNA, 19 nt, Homo sapiens
caagcacaaagcucaagau

SEQ ID NO: 888825 - RNA, 17 nt, Homo sapiens
caagcagguaagagcug

SEQ ID NO: 888826 - RNA, 21 nt, Homo sapiens
caagcauggucccacaucccu

SEQ ID NO: 888827 - RNA, 18 nt, Homo sapiens
caagccaguacgugcuaa

SEQ ID NO: 888828 - RNA, 17 nt, Homo sapiens
caagccccucagcccuu

SEQ ID NO: 888829 - RNA, 21 nt, Homo sapiens
caagcccuggcaacauaguga

SEQ ID NO: 888830 - RNA, 14 nt, Homo sapiens
caagcgauucucau

SEQ ID NO: 888831 - RNA, 21 nt, Homo sapiens
caagcuaccuucaugucacug

SEQ ID NO: 888832 - RNA, 19 nt, Homo sapiens
caagcugcuuaaguucuua

SEQ ID NO: 888833 - RNA, 14 nt, Homo sapiens
caagcuuguauaua

SEQ ID NO: 888834 - RNA, 20 nt, Homo sapiens
caagcuuuggguuggagcug

SEQ ID NO: 888835 - RNA, 22 nt, Homo sapiens
caaggaaccuaauugaaauuua

SEQ ID NO: 888836 - RNA, 16 nt, Homo sapiens
caggcucauaugcguc

SEQ ID NO: 888837 - RNA, 17 nt, Homo sapiens
caggcugggauggagca

SEQ ID NO: 888838 - RNA, 19 nt, Homo sapiens
cagggaacaagcauucucc

SEQ ID NO: 888839 - RNA, 16 nt, Homo sapiens
cagggaauugauucaa

SEQ ID NO: 888840 - RNA, 15 nt, Homo sapiens
cagggacccacuuca

SEQ ID NO: 888841 - RNA, 22 nt, Homo sapiens
cagggacucaaggguccagaag

SEQ ID NO: 888842 - RNA, 13 nt, Homo sapiens
cagggagcccuuu

SEQ ID NO: 888843 - RNA, 16 nt, Homo sapiens
cagggaggaugccaca

SEQ ID NO: 888844 - RNA, 22 nt, Homo sapiens
cagggcaaaugacaugcacuga

SEQ ID NO: 888845 - RNA, 18 nt, Homo sapiens
cagggcauuuugguccaa

SEQ ID NO: 888846 - RNA, 20 nt, Homo sapiens
cagggcccugagcucggugg

SEQ ID NO: 888847 - RNA, 14 nt, Homo sapiens
cagggccugucuca

SEQ ID NO: 888848 - RNA, 18 nt, Homo sapiens
cagggcucagccuggugg

SEQ ID NO: 888849 - RNA, 17 nt, Homo sapiens
caggggaccacaccucc

SEQ ID NO: 888850 - RNA, 21 nt, Homo sapiens
caggggccugcccagugcacu

SEQ ID NO: 888851 - RNA, 20 nt, Homo sapiens
cagggggugugucugcucag

SEQ ID NO: 888852 - RNA, 18 nt, Homo sapiens
caggggucgucaccaccu

SEQ ID NO: 888853 - RNA, 19 nt, Homo sapiens
caggguaucccagaccccu

SEQ ID NO: 888854 - RNA, 13 nt, Homo sapiens
cagggucuugcaa

SEQ ID NO: 888855 - RNA, 16 nt, Homo sapiens
cagggucuugcuguaa

SEQ ID NO: 888856 - RNA, 14 nt, Homo sapiens
cagggugcauguga

SEQ ID NO: 888857 - RNA, 12 nt, Homo sapiens
caggguggggga

SEQ ID NO: 888858 - RNA, 17 nt, Homo sapiens
caggguguuaaggcagu

SEQ ID NO: 888859 - RNA, 17 nt, Homo sapiens
cagguagggccagcuca

SEQ ID NO: 888860 - RNA, 14 nt, Homo sapiens
caggucaacuucag

SEQ ID NO: 888861 - RNA, 17 nt, Homo sapiens
caggucaucuccuuuca

SEQ ID NO: 888862 - RNA, 17 nt, Homo sapiens
cagguccucaguguccu

SEQ ID NO: 888863 - RNA, 14 nt, Homo sapiens
caggucuagacuuu

SEQ ID NO: 888864 - RNA, 15 nt, Homo sapiens
caggucuagacuuuc

SEQ ID NO: 888865 - RNA, 17 nt, Homo sapiens
caggucuagacuuucuc

SEQ ID NO: 888866 - RNA, 21 nt, Homo sapiens
caggucucuccacugcucuca

SEQ ID NO: 888867 - RNA, 21 nt, Homo sapiens
caggugauccacccaccucag

SEQ ID NO: 888868 - RNA, 15 nt, Homo sapiens
caggugcugccaucc

SEQ ID NO: 888869 - RNA, 23 nt, Homo sapiens
cagguggauuuuguggaggugag

SEQ ID NO: 888870 - RNA, 16 nt, Homo sapiens
cagguggcaucucuaa

SEQ ID NO: 888871 - RNA, 15 nt, Homo sapiens
caggugggaaauggu

SEQ ID NO: 888872 - RNA, 20 nt, Homo sapiens
caggugugagccacccugcc

SEQ ID NO: 888873 - RNA, 20 nt, Homo sapiens
cagguguugccauuucucug

SEQ ID NO: 888874 - RNA, 14 nt, Homo sapiens
cagguguuuauaca

SEQ ID NO: 888875 - RNA, 13 nt, Homo sapiens
cagguuagccuuu

SEQ ID NO: 888876 - RNA, 17 nt, Homo sapiens
cagguucccagcagcug

SEQ ID NO: 888877 - RNA, 12 nt, Homo sapiens
cagguuugccag

SEQ ID NO: 888878 - RNA, 19 nt, Homo sapiens
cagguuuugaaaauguaca

SEQ ID NO: 888879 - RNA, 15 nt, Homo sapiens
caguaaaaacuugua

SEQ ID NO: 888880 - RNA, 16 nt, Homo sapiens
caguaaaaacuuguac

SEQ ID NO: 888881 - RNA, 17 nt, Homo sapiens
caguaaacuuucucugc

SEQ ID NO: 888882 - RNA, 19 nt, Homo sapiens
caguaaacuuucucugcaa

SEQ ID NO: 888883 - RNA, 13 nt, Homo sapiens
caguacaugggaa

SEQ ID NO: 888884 - RNA, 13 nt, Homo sapiens
caguagaguagaa

SEQ ID NO: 888885 - RNA, 16 nt, Homo sapiens
caguagcuguggugag

SEQ ID NO: 888886 - RNA, 13 nt, Homo sapiens
caguaggcuuuau

SEQ ID NO: 888887 - RNA, 12 nt, Homo sapiens
caguaguauucu

SEQ ID NO: 888888 - RNA, 15 nt, Homo sapiens
caguaugaaugaugu

SEQ ID NO: 888889 - RNA, 17 nt, Homo sapiens
cagucauuggguuuuau

SEQ ID NO: 888890 - RNA, 12 nt, Homo sapiens
aaccaaugauuc

SEQ ID NO: 888891 - RNA, 15 nt, Homo sapiens
aaccacaacugacac

SEQ ID NO: 888892 - RNA, 21 nt, Homo sapiens
aaccacuuaaaaaauguccau

SEQ ID NO: 888893 - RNA, 23 nt, Homo sapiens
aaccacuuugccucugaaacuua

SEQ ID NO: 888894 - RNA, 13 nt, Homo sapiens
aaccagccacaca

SEQ ID NO: 888895 - RNA, 22 nt, Homo sapiens
aaccauaguuauuuacuugaaa

SEQ ID NO: 888896 - RNA, 13 nt, Homo sapiens
aaccauccaucug

SEQ ID NO: 888897 - RNA, 15 nt, Homo sapiens
aaccaucccugaugu

SEQ ID NO: 888898 - RNA, 14 nt, Homo sapiens
aaccaugguaugaa

SEQ ID NO: 888899 - RNA, 19 nt, Homo sapiens
aacccaaaaccucaugaca

SEQ ID NO: 888900 - RNA, 11 nt, Homo sapiens
aacccaaauaa

SEQ ID NO: 888901 - RNA, 17 nt, Homo sapiens
aacccaacaugacuguu

SEQ ID NO: 888902 - RNA, 13 nt, Homo sapiens
aacccaaccucau

SEQ ID NO: 888903 - RNA, 20 nt, Homo sapiens
aacccaauucaggacuggcu

SEQ ID NO: 888904 - RNA, 12 nt, Homo sapiens
aacccaccagcc

SEQ ID NO: 888905 - RNA, 20 nt, Homo sapiens
aacccaccaucuacccacuu

SEQ ID NO: 888906 - RNA, 16 nt, Homo sapiens
aacccaucagacaggu

SEQ ID NO: 888907 - RNA, 13 nt, Homo sapiens
aaccccuuuccac

SEQ ID NO: 888908 - RNA, 23 nt, Homo sapiens
aacccgagaaaacaaacccaggu

SEQ ID NO: 888909 - RNA, 14 nt, Homo sapiens
aacccucacugugu

SEQ ID NO: 888910 - RNA, 18 nt, Homo sapiens
aacccugccccacuucuc

SEQ ID NO: 888911 - RNA, 13 nt, Homo sapiens
aacccugggacgu

SEQ ID NO: 888912 - RNA, 13 nt, Homo sapiens
aaccgacuuuucu

SEQ ID NO: 888913 - RNA, 22 nt, Homo sapiens
aaccgcauggaacagugcagga

SEQ ID NO: 888914 - RNA, 19 nt, Homo sapiens
aaccggcauauuauuccau

SEQ ID NO: 888915 - RNA, 14 nt, Homo sapiens
aaccuaaacauaga

SEQ ID NO: 888916 - RNA, 15 nt, Homo sapiens
aaccuauccuuccag

SEQ ID NO: 888917 - RNA, 23 nt, Homo sapiens
aaccuauuuaaaacagugaauua

SEQ ID NO: 888918 - RNA, 14 nt, Homo sapiens
aaccucacuugaag

SEQ ID NO: 888919 - RNA, 20 nt, Homo sapiens
aaccucaggcuuccuuggca

SEQ ID NO: 888920 - RNA, 12 nt, Homo sapiens
aaccucaucucu

SEQ ID NO: 888921 - RNA, 15 nt, Homo sapiens
aaccucauuccccaa

SEQ ID NO: 888922 - RNA, 12 nt, Homo sapiens
aaccucauucuc

SEQ ID NO: 888923 - RNA, 18 nt, Homo sapiens
aaccucucuaagccacag

SEQ ID NO: 888924 - RNA, 19 nt, Homo sapiens
aaccugaaggugcugacaa

SEQ ID NO: 888925 - RNA, 16 nt, Homo sapiens
aaccugaauuauucca

SEQ ID NO: 888926 - RNA, 20 nt, Homo sapiens
aaccugaugccccuucccca

SEQ ID NO: 888927 - RNA, 18 nt, Homo sapiens
aaccugcccacccacucc

SEQ ID NO: 888928 - RNA, 13 nt, Homo sapiens
aaccugcucuccu

SEQ ID NO: 888929 - RNA, 21 nt, Homo sapiens
aaccuggcagguuagaaccua

SEQ ID NO: 888930 - RNA, 12 nt, Homo sapiens
aaccugggaugu

SEQ ID NO: 888931 - RNA, 20 nt, Homo sapiens
aaccuugauuuaaaauauca

SEQ ID NO: 888932 - RNA, 11 nt, Homo sapiens
aaccuuucaaa

SEQ ID NO: 888933 - RNA, 16 nt, Homo sapiens
aacgaaugguacuaca

SEQ ID NO: 888934 - RNA, 22 nt, Homo sapiens
aacgacaaaucaccauguaaca

SEQ ID NO: 888935 - RNA, 18 nt, Homo sapiens
aacgauucccccagucau

SEQ ID NO: 888936 - RNA, 16 nt, Homo sapiens
aacgccuuuuauucua

SEQ ID NO: 888937 - RNA, 22 nt, Homo sapiens
aacgggacccccuggcccugcc

SEQ ID NO: 888938 - RNA, 14 nt, Homo sapiens
aacuaaaaagccau

SEQ ID NO: 888939 - RNA, 14 nt, Homo sapiens
aacuaaaagcauag

SEQ ID NO: 888940 - RNA, 14 nt, Homo sapiens
aacuaaauaaagcu

SEQ ID NO: 888941 - RNA, 13 nt, Homo sapiens
aacuaacacagcc

SEQ ID NO: 888942 - RNA, 22 nt, Homo sapiens
aacuaacccuuaaaaaugcaca

SEQ ID NO: 888943 - RNA, 17 nt, Homo sapiens
aacuaacguacauucaa

SEQ ID NO: 888944 - RNA, 17 nt, Homo sapiens
aacuaauaaaagcauaa

SEQ ID NO: 888945 - RNA, 22 nt, Homo sapiens
aacuaauaaaagcauaaaugca

SEQ ID NO: 888946 - RNA, 21 nt, Homo sapiens
aacuaauaaucaccauaugcu

SEQ ID NO: 888947 - RNA, 15 nt, Homo sapiens
aacuacacuaauaaa

SEQ ID NO: 888948 - RNA, 22 nt, Homo sapiens
aacuacagaguuuaugauuuaa

SEQ ID NO: 888949 - RNA, 17 nt, Homo sapiens
aacuacauuaguacaca

SEQ ID NO: 888950 - RNA, 21 nt, Homo sapiens
aacuacucagcucuccugcug

SEQ ID NO: 888951 - RNA, 17 nt, Homo sapiens
aacuagaaaucugccaa

SEQ ID NO: 888952 - RNA, 22 nt, Homo sapiens
caugaaaugucuggucugucca

SEQ ID NO: 888953 - RNA, 22 nt, Homo sapiens
caugaacacacauggaugcaca

SEQ ID NO: 888954 - RNA, 17 nt, Homo sapiens
caugaacagaaacaaua

SEQ ID NO: 888955 - RNA, 20 nt, Homo sapiens
caugaaccucaagcugcauc

SEQ ID NO: 888956 - RNA, 15 nt, Homo sapiens
caugaacgcacuuua

SEQ ID NO: 888957 - RNA, 23 nt, Homo sapiens
caugaacuauuuacauuuuccaa

SEQ ID NO: 888958 - RNA, 13 nt, Homo sapiens
caugaagaccaca

SEQ ID NO: 888959 - RNA, 14 nt, Homo sapiens
caugaauauuucaa

SEQ ID NO: 888960 - RNA, 14 nt, Homo sapiens
caugaaucaaagac

SEQ ID NO: 888961 - RNA, 13 nt, Homo sapiens
caugaaugcacac

SEQ ID NO: 888962 - RNA, 18 nt, Homo sapiens
caugacacugaccuugga

SEQ ID NO: 888963 - RNA, 24 nt, Homo sapiens
caugaccuccguguagugucugua

SEQ ID NO: 888964 - RNA, 20 nt, Homo sapiens
caugacucagcauaccugcu

SEQ ID NO: 888965 - RNA, 17 nt, Homo sapiens
caugagaaaaucaguaa

SEQ ID NO: 888966 - RNA, 15 nt, Homo sapiens
caugagaauaaagau

SEQ ID NO: 888967 - RNA, 13 nt, Homo sapiens
caugauacuauuc

SEQ ID NO: 888968 - RNA, 15 nt, Homo sapiens
caugauacuauucag

SEQ ID NO: 888969 - RNA, 21 nt, Homo sapiens
caugaucgagccacugcacuc

SEQ ID NO: 888970 - RNA, 22 nt, Homo sapiens
caugauuucauuucaacuguuu

SEQ ID NO: 888971 - RNA, 20 nt, Homo sapiens
caugauuuuauacauaguca

SEQ ID NO: 888972 - RNA, 21 nt, Homo sapiens
caugauuuuauacauagucac

SEQ ID NO: 888973 - RNA, 23 nt, Homo sapiens
caugauuuuauacauagucacaa

SEQ ID NO: 888974 - RNA, 13 nt, Homo sapiens
caugcacuucuua

SEQ ID NO: 888975 - RNA, 20 nt, Homo sapiens
caugccaaugcacgcacaca

SEQ ID NO: 888976 - RNA, 17 nt, Homo sapiens
caugccauuuguacuga

SEQ ID NO: 888977 - RNA, 18 nt, Homo sapiens
caugccgggcgcaguggc

SEQ ID NO: 888978 - RNA, 15 nt, Homo sapiens
caugccuccaaaaau

SEQ ID NO: 888979 - RNA, 21 nt, Homo sapiens
caugccuccaaaaauucacau

SEQ ID NO: 888980 - RNA, 15 nt, Homo sapiens
caugcucaaccacug

SEQ ID NO: 888981 - RNA, 20 nt, Homo sapiens
caugcugcuuuuuggcacag

SEQ ID NO: 888982 - RNA, 14 nt, Homo sapiens
caugcuggggcaag

SEQ ID NO: 888983 - RNA, 17 nt, Homo sapiens
caugcuuaaauauugaa

SEQ ID NO: 888984 - RNA, 23 nt, Homo sapiens
caugcuuuagauuauauauuccg

SEQ ID NO: 888985 - RNA, 23 nt, Homo sapiens
caugcuuucccaccagcauguca

SEQ ID NO: 888986 - RNA, 17 nt, Homo sapiens
cauggaaaagcccagug

SEQ ID NO: 888987 - RNA, 22 nt, Homo sapiens
cauggaacucagcugucugugg

SEQ ID NO: 888988 - RNA, 20 nt, Homo sapiens
cauggacucuggguuucaua

SEQ ID NO: 888989 - RNA, 14 nt, Homo sapiens
cauggaugagcaca

SEQ ID NO: 888990 - RNA, 16 nt, Homo sapiens
cauggaugcacacaca

SEQ ID NO: 888991 - RNA, 22 nt, Homo sapiens
cauggcacucuucccaccucag

SEQ ID NO: 888992 - RNA, 15 nt, Homo sapiens
cauggcagugaugaa

SEQ ID NO: 888993 - RNA, 15 nt, Homo sapiens
cauggcauugaacug

SEQ ID NO: 888994 - RNA, 14 nt, Homo sapiens
cauggccuaagggc

SEQ ID NO: 888995 - RNA, 17 nt, Homo sapiens
cauggccuaugcacaua

SEQ ID NO: 888996 - RNA, 19 nt, Homo sapiens
cauggccuaugcacauaug

SEQ ID NO: 888997 - RNA, 15 nt, Homo sapiens
cauggccuucccucc

SEQ ID NO: 888998 - RNA, 13 nt, Homo sapiens
cauggugacacac

SEQ ID NO: 888999 - RNA, 19 nt, Homo sapiens
cauguaaaccuaagcacgu

SEQ ID NO: 889000 - RNA, 19 nt, Homo sapiens
cauguaaaugauuaucucc

SEQ ID NO: 889001 - RNA, 17 nt, Homo sapiens
cauguaacaaccagaga

SEQ ID NO: 889002 - RNA, 22 nt, Homo sapiens
cauguaugucuuggacacugua

SEQ ID NO: 889003 - RNA, 15 nt, Homo sapiens
cauguaugugcacau

SEQ ID NO: 889004 - RNA, 20 nt, Homo sapiens
cauguauugugccaaucugu

SEQ ID NO: 889005 - RNA, 13 nt, Homo sapiens
caugucaccucag

SEQ ID NO: 889006 - RNA, 17 nt, Homo sapiens
aagcuagaaggccacau

SEQ ID NO: 889007 - RNA, 15 nt, Homo sapiens
aagcucaugagauga

SEQ ID NO: 889008 - RNA, 12 nt, Homo sapiens
aagcuccacugu

SEQ ID NO: 889009 - RNA, 14 nt, Homo sapiens
aagcuccacuguca

SEQ ID NO: 889010 - RNA, 15 nt, Homo sapiens
aagcuccacugucac

SEQ ID NO: 889011 - RNA, 11 nt, Homo sapiens
aagcucucuuu

SEQ ID NO: 889012 - RNA, 23 nt, Homo sapiens
aagcucugcuccucuccccagca

SEQ ID NO: 889013 - RNA, 20 nt, Homo sapiens
aagcugaagaaaaugaagcc

SEQ ID NO: 889014 - RNA, 23 nt, Homo sapiens
aagcugaagaaaaugaagcccua

SEQ ID NO: 889015 - RNA, 12 nt, Homo sapiens
aagcugacagca

SEQ ID NO: 889016 - RNA, 19 nt, Homo sapiens
aagcugagaagaagcugag

SEQ ID NO: 889017 - RNA, 21 nt, Homo sapiens
aagcugaggauccucacagga

SEQ ID NO: 889018 - RNA, 13 nt, Homo sapiens
aagcugcuuugga

SEQ ID NO: 889019 - RNA, 14 nt, Homo sapiens
aagcuggaagcaca

SEQ ID NO: 889020 - RNA, 18 nt, Homo sapiens
aagcuggagcucuuggaa

SEQ ID NO: 889021 - RNA, 22 nt, Homo sapiens
aagcuggugccccacugaauuu

SEQ ID NO: 889022 - RNA, 15 nt, Homo sapiens
aagcuguccuugagc

SEQ ID NO: 889023 - RNA, 17 nt, Homo sapiens
aagcuguuccacuucuc

SEQ ID NO: 889024 - RNA, 14 nt, Homo sapiens
aagcuucaagugau

SEQ ID NO: 889025 - RNA, 22 nt, Homo sapiens
aagcuuccauuccaagccugac

SEQ ID NO: 889026 - RNA, 16 nt, Homo sapiens
aagcuugucugaucgu

SEQ ID NO: 889027 - RNA, 12 nt, Homo sapiens
aagcuuugaacc

SEQ ID NO: 889028 - RNA, 14 nt, Homo sapiens
aaggaaaccaaagg

SEQ ID NO: 889029 - RNA, 12 nt, Homo sapiens
aaggaaagccaa

SEQ ID NO: 889030 - RNA, 13 nt, Homo sapiens
aaggaaccaacca

SEQ ID NO: 889031 - RNA, 22 nt, Homo sapiens
aaggaacucuggcuuccaggua

SEQ ID NO: 889032 - RNA, 15 nt, Homo sapiens
aaggaagaagccaga

SEQ ID NO: 889033 - RNA, 14 nt, Homo sapiens
aaggaagacuugaa

SEQ ID NO: 889034 - RNA, 22 nt, Homo sapiens
aaggaaggcuccaucuccagug

SEQ ID NO: 889035 - RNA, 23 nt, Homo sapiens
aaggaagggacugacaagaagcu

SEQ ID NO: 889036 - RNA, 13 nt, Homo sapiens
aaggaaucugugc

SEQ ID NO: 889037 - RNA, 22 nt, Homo sapiens
aaggaccugcauuuuccuacau

SEQ ID NO: 889038 - RNA, 15 nt, Homo sapiens
aaggacgugucucag

SEQ ID NO: 889039 - RNA, 15 nt, Homo sapiens
aaggagaacuaucca

SEQ ID NO: 889040 - RNA, 17 nt, Homo sapiens
aaggagaacuauccaaa

SEQ ID NO: 889041 - RNA, 18 nt, Homo sapiens
aaggagaacuauccaaaa

SEQ ID NO: 889042 - RNA, 19 nt, Homo sapiens
aaggagacaaaacuagaga

SEQ ID NO: 889043 - RNA, 23 nt, Homo sapiens
aaggagauauggcuaguggcaau

SEQ ID NO: 889044 - RNA, 21 nt, Homo sapiens
aaggagauucaaacucaauga

SEQ ID NO: 889045 - RNA, 23 nt, Homo sapiens
aaggagcaaaacgccucuuuucc

SEQ ID NO: 889046 - RNA, 17 nt, Homo sapiens
aaggaguaaguacaaau

SEQ ID NO: 889047 - RNA, 17 nt, Homo sapiens
aaggaguccuugcauca

SEQ ID NO: 889048 - RNA, 20 nt, Homo sapiens
aaggaguucguggcugcaaa

SEQ ID NO: 889049 - RNA, 14 nt, Homo sapiens
aaggauauuuacua

SEQ ID NO: 889050 - RNA, 12 nt, Homo sapiens
aaggaugaauga

SEQ ID NO: 889051 - RNA, 15 nt, Homo sapiens
aaggaugacacugcc

SEQ ID NO: 889052 - RNA, 24 nt, Homo sapiens
aaggaugacuuuuuuucugauuca

SEQ ID NO: 889053 - RNA, 18 nt, Homo sapiens
aaggauggagccagcucu

SEQ ID NO: 889054 - RNA, 20 nt, Homo sapiens
aaggauuaagauacacuccu

SEQ ID NO: 889055 - RNA, 18 nt, Homo sapiens
aaggauuguugggcuugg

SEQ ID NO: 889056 - RNA, 12 nt, Homo sapiens
aaggcaaaaaga

SEQ ID NO: 889057 - RNA, 17 nt, Homo sapiens
aaggcaaagagaccacu

SEQ ID NO: 889058 - RNA, 16 nt, Homo sapiens
aaggcaaauauaagcu

SEQ ID NO: 889059 - RNA, 15 nt, Homo sapiens
aaggcauuucuauca

SEQ ID NO: 889060 - RNA, 14 nt, Homo sapiens
aaggccacauguca

SEQ ID NO: 889061 - RNA, 15 nt, Homo sapiens
aaggccacaugucac

SEQ ID NO: 889062 - RNA, 22 nt, Homo sapiens
aaggccagcgccagaacccaga

SEQ ID NO: 889063 - RNA, 18 nt, Homo sapiens
aaggcccacuguccagca

SEQ ID NO: 889064 - RNA, 16 nt, Homo sapiens
aaggcuccaucuccag

SEQ ID NO: 889065 - RNA, 12 nt, Homo sapiens
aaggcucuacac

SEQ ID NO: 889066 - RNA, 14 nt, Homo sapiens
aaggcugagcucuu

SEQ ID NO: 889067 - RNA, 15 nt, Homo sapiens
cuggcuggccagucu

SEQ ID NO: 889068 - RNA, 15 nt, Homo sapiens
cuggcuucagccucc

SEQ ID NO: 889069 - RNA, 23 nt, Homo sapiens
cuggcuuccagguaucuccagga

SEQ ID NO: 889070 - RNA, 13 nt, Homo sapiens
cuggcuuugcaag

SEQ ID NO: 889071 - RNA, 14 nt, Homo sapiens
cugggaaacaggga

SEQ ID NO: 889072 - RNA, 12 nt, Homo sapiens
cugggaacuggu

SEQ ID NO: 889073 - RNA, 13 nt, Homo sapiens
cugggacuuucac

SEQ ID NO: 889074 - RNA, 16 nt, Homo sapiens
cugggagaaccucagg

SEQ ID NO: 889075 - RNA, 17 nt, Homo sapiens
cugggaggcggagagua

SEQ ID NO: 889076 - RNA, 21 nt, Homo sapiens
cugggcaacagaugaagaccc

SEQ ID NO: 889077 - RNA, 22 nt, Homo sapiens
cugggcagcauagcaagacaca

SEQ ID NO: 889078 - RNA, 20 nt, Homo sapiens
cugggccaaguuccucuagu

SEQ ID NO: 889079 - RNA, 15 nt, Homo sapiens
cugggccaguuccuc

SEQ ID NO: 889080 - RNA, 15 nt, Homo sapiens
cugggccccaccacc

SEQ ID NO: 889081 - RNA, 18 nt, Homo sapiens
cugggccugcuuuuccag

SEQ ID NO: 889082 - RNA, 16 nt, Homo sapiens
cugggccugugcagca

SEQ ID NO: 889083 - RNA, 21 nt, Homo sapiens
cugggccuuuccugugccaac

SEQ ID NO: 889084 - RNA, 22 nt, Homo sapiens
cugggcugcuacccagaaauca

SEQ ID NO: 889085 - RNA, 22 nt, Homo sapiens
cugggcuucuguccaaggcaca

SEQ ID NO: 889086 - RNA, 13 nt, Homo sapiens
cuggggacaccag

SEQ ID NO: 889087 - RNA, 21 nt, Homo sapiens
cuggggacagguccucagugu

SEQ ID NO: 889088 - RNA, 19 nt, Homo sapiens
cuggggagaaugaagagcu

SEQ ID NO: 889089 - RNA, 18 nt, Homo sapiens
cuggggcucuaacgccug

SEQ ID NO: 889090 - RNA, 16 nt, Homo sapiens
cuggggcucucagugu

SEQ ID NO: 889091 - RNA, 14 nt, Homo sapiens
cuggggcucugugc

SEQ ID NO: 889092 - RNA, 14 nt, Homo sapiens
cugggggugggggc

SEQ ID NO: 889093 - RNA, 23 nt, Homo sapiens
cugggguggggguggggagaccu

SEQ ID NO: 889094 - RNA, 18 nt, Homo sapiens
cugggucaagggccaguc

SEQ ID NO: 889095 - RNA, 22 nt, Homo sapiens
cuggguccgccuuaaucuggaa

SEQ ID NO: 889096 - RNA, 19 nt, Homo sapiens
cugggugguguacaagcau

SEQ ID NO: 889097 - RNA, 17 nt, Homo sapiens
cuggguuucucuguaua

SEQ ID NO: 889098 - RNA, 15 nt, Homo sapiens
cuggguuuucuaacu

SEQ ID NO: 889099 - RNA, 20 nt, Homo sapiens
cugguaauuuaagauuccag

SEQ ID NO: 889100 - RNA, 18 nt, Homo sapiens
cuggucaggcccacugca

SEQ ID NO: 889101 - RNA, 17 nt, Homo sapiens
cuggucagguauuucag

SEQ ID NO: 889102 - RNA, 13 nt, Homo sapiens
cuggucuugugga

SEQ ID NO: 889103 - RNA, 15 nt, Homo sapiens
cugguggaccacagg

SEQ ID NO: 889104 - RNA, 20 nt, Homo sapiens
cugguggcaccagaugcaac

SEQ ID NO: 889105 - RNA, 18 nt, Homo sapiens
cuggugguggcaccaucu

SEQ ID NO: 889106 - RNA, 12 nt, Homo sapiens
cugguguagcuc

SEQ ID NO: 889107 - RNA, 13 nt, Homo sapiens
cugguuaauucca

SEQ ID NO: 889108 - RNA, 16 nt, Homo sapiens
cugguuaauuccauaa

SEQ ID NO: 889109 - RNA, 21 nt, Homo sapiens
cugguugcuucagaccugaca

SEQ ID NO: 889110 - RNA, 16 nt, Homo sapiens
cugguugucaguuaca

SEQ ID NO: 889111 - RNA, 20 nt, Homo sapiens
cugguuucuguucuguugau

SEQ ID NO: 889112 - RNA, 14 nt, Homo sapiens
cuguaaaauuuguu

SEQ ID NO: 889113 - RNA, 13 nt, Homo sapiens
cuguaaacauuca

SEQ ID NO: 889114 - RNA, 14 nt, Homo sapiens
cuguaaacauucau

SEQ ID NO: 889115 - RNA, 17 nt, Homo sapiens
cuguaaauacaugugug

SEQ ID NO: 889116 - RNA, 19 nt, Homo sapiens
cuguaacucagacauucca

SEQ ID NO: 889117 - RNA, 16 nt, Homo sapiens
cuguaaggaacuggaa

SEQ ID NO: 889118 - RNA, 20 nt, Homo sapiens
cuguaaucccagcacuuugg

SEQ ID NO: 889119 - RNA, 21 nt, Homo sapiens
cuguaaucccagcuacuuggg

SEQ ID NO: 889120 - RNA, 13 nt, Homo sapiens
cuguacacugcac

SEQ ID NO: 889121 - RNA, 21 nt, Homo sapiens
cuguacccaauuuaauuccau

SEQ ID NO: 889122 - RNA, 19 nt, Homo sapiens
cuguagaacaccccugugc

SEQ ID NO: 889123 - RNA, 11 nt, Homo sapiens
cuguagacuua

SEQ ID NO: 889124 - RNA, 20 nt, Homo sapiens
cuguagauaaagugguuuga

SEQ ID NO: 889125 - RNA, 16 nt, Homo sapiens
cuguaggaagauuccc

SEQ ID NO: 889126 - RNA, 17 nt, Homo sapiens
cuguagguuaaaugcag

SEQ ID NO: 889127 - RNA, 18 nt, Homo sapiens
cuguagguuaaaugcagg

SEQ ID NO: 889128 - RNA, 22 nt, Homo sapiens
cuguaguugcguggacucugca

SEQ ID NO: 889129 - RNA, 20 nt, Homo sapiens
auggccagugugaucccaag

SEQ ID NO: 889130 - RNA, 16 nt, Homo sapiens
auggcuauaggugcua

SEQ ID NO: 889131 - RNA, 18 nt, Homo sapiens
auggcucaggcaagcccc

SEQ ID NO: 889132 - RNA, 15 nt, Homo sapiens
auggcucaugaccug

SEQ ID NO: 889133 - RNA, 15 nt, Homo sapiens
auggcucugugaaau

SEQ ID NO: 889134 - RNA, 15 nt, Homo sapiens
auggcuuuaugcuag

SEQ ID NO: 889135 - RNA, 13 nt, Homo sapiens
augggaugaaugg

SEQ ID NO: 889136 - RNA, 17 nt, Homo sapiens
augggauucagugcuuc

SEQ ID NO: 889137 - RNA, 22 nt, Homo sapiens
augggauuucauguaaccaaga

SEQ ID NO: 889138 - RNA, 19 nt, Homo sapiens
augggcaaagcugugcacu

SEQ ID NO: 889139 - RNA, 20 nt, Homo sapiens
augggcagugccuccuggga

SEQ ID NO: 889140 - RNA, 18 nt, Homo sapiens
augguaaaaccccaucuc

SEQ ID NO: 889141 - RNA, 18 nt, Homo sapiens
augguacuauguuagccc

SEQ ID NO: 889142 - RNA, 15 nt, Homo sapiens
augguagcaaaacaa

SEQ ID NO: 889143 - RNA, 21 nt, Homo sapiens
augguaugcuggccagcaccc

SEQ ID NO: 889144 - RNA, 18 nt, Homo sapiens
auggucaaucccaaaagu

SEQ ID NO: 889145 - RNA, 16 nt, Homo sapiens
auggucauugcaggaa

SEQ ID NO: 889146 - RNA, 17 nt, Homo sapiens
augguccuccauuucaa

SEQ ID NO: 889147 - RNA, 21 nt, Homo sapiens
augguccuggggcucugugca

SEQ ID NO: 889148 - RNA, 23 nt, Homo sapiens
auggugacuaacaguuacaugaa

SEQ ID NO: 889149 - RNA, 20 nt, Homo sapiens
augguggcgcgcaccuguaa

SEQ ID NO: 889150 - RNA, 14 nt, Homo sapiens
auggugggaacccu

SEQ ID NO: 889151 - RNA, 19 nt, Homo sapiens
auggugguaaacauucucu

SEQ ID NO: 889152 - RNA, 20 nt, Homo sapiens
augguguaaugcacaauuua

SEQ ID NO: 889153 - RNA, 17 nt, Homo sapiens
augguuaccgaggaccc

SEQ ID NO: 889154 - RNA, 15 nt, Homo sapiens
augguucccaauaaa

SEQ ID NO: 889155 - RNA, 15 nt, Homo sapiens
augguugccaggacg

SEQ ID NO: 889156 - RNA, 14 nt, Homo sapiens
augguuuacaugaa

SEQ ID NO: 889157 - RNA, 14 nt, Homo sapiens
augguuuuacucau

SEQ ID NO: 889158 - RNA, 21 nt, Homo sapiens
auguaaaauaaguauuuccau

SEQ ID NO: 889159 - RNA, 15 nt, Homo sapiens
auguaaaccuaagca

SEQ ID NO: 889160 - RNA, 18 nt, Homo sapiens
auguaaaccuaagcacgu

SEQ ID NO: 889161 - RNA, 16 nt, Homo sapiens
auguaaaugccacaaa

SEQ ID NO: 889162 - RNA, 20 nt, Homo sapiens
auguaacauuaauucuacua

SEQ ID NO: 889163 - RNA, 15 nt, Homo sapiens
auguaacgaauggua

SEQ ID NO: 889164 - RNA, 12 nt, Homo sapiens
auguaacuauaa

SEQ ID NO: 889165 - RNA, 12 nt, Homo sapiens
auguaacuuuuc

SEQ ID NO: 889166 - RNA, 13 nt, Homo sapiens
auguacacacaca

SEQ ID NO: 889167 - RNA, 22 nt, Homo sapiens
auguacacacacagaugcacac

SEQ ID NO: 889168 - RNA, 21 nt, Homo sapiens
auguacaugaagaagcuaaau

SEQ ID NO: 889169 - RNA, 16 nt, Homo sapiens
auguacucuacgccaa

SEQ ID NO: 889170 - RNA, 23 nt, Homo sapiens
auguagaaauauuauaaauccaa

SEQ ID NO: 889171 - RNA, 18 nt, Homo sapiens
auguaggguaaggugccu

SEQ ID NO: 889172 - RNA, 18 nt, Homo sapiens
auguaguacuaacuaagg

SEQ ID NO: 889173 - RNA, 22 nt, Homo sapiens
auguauauauauauaguaacua

SEQ ID NO: 889174 - RNA, 19 nt, Homo sapiens
auguauauuaaaacugcac

SEQ ID NO: 889175 - RNA, 16 nt, Homo sapiens
auguaucuaugcauuu

SEQ ID NO: 889176 - RNA, 21 nt, Homo sapiens
auguaugugcacaugugucug

SEQ ID NO: 889177 - RNA, 17 nt, Homo sapiens
auguauuaucaccagca

SEQ ID NO: 889178 - RNA, 17 nt, Homo sapiens
auguauuggaacauguc

SEQ ID NO: 889179 - RNA, 22 nt, Homo sapiens
auguauuuuccugcauaaucau

SEQ ID NO: 889180 - RNA, 16 nt, Homo sapiens
auguauuuugucauau

SEQ ID NO: 889181 - RNA, 16 nt, Homo sapiens
augucaaccagugagg

SEQ ID NO: 889182 - RNA, 22 nt, Homo sapiens
aucauacuaccggcuacaucaa

SEQ ID NO: 889183 - RNA, 18 nt, Homo sapiens
aucauauugaauguuucc

SEQ ID NO: 889184 - RNA, 18 nt, Homo sapiens
aucaucaccacaccguga

SEQ ID NO: 889185 - RNA, 19 nt, Homo sapiens
aucauccagaaguuccuca

SEQ ID NO: 889186 - RNA, 18 nt, Homo sapiens
aucauccugccuucaugg

SEQ ID NO: 889187 - RNA, 20 nt, Homo sapiens
aucaucucgaccacuuuuca

SEQ ID NO: 889188 - RNA, 12 nt, Homo sapiens
aucaucucucau

SEQ ID NO: 889189 - RNA, 16 nt, Homo sapiens
aucauggcaacauaau

SEQ ID NO: 889190 - RNA, 16 nt, Homo sapiens
aucauggcagugauga

SEQ ID NO: 889191 - RNA, 18 nt, Homo sapiens
aucauggcagugaugaaa

SEQ ID NO: 889192 - RNA, 17 nt, Homo sapiens
aucauguaaaugauuau

SEQ ID NO: 889193 - RNA, 20 nt, Homo sapiens
aucauuguaaauuauuucau

SEQ ID NO: 889194 - RNA, 17 nt, Homo sapiens
auccaagaagcaugcag

SEQ ID NO: 889195 - RNA, 16 nt, Homo sapiens
auccaagaaucaguga

SEQ ID NO: 889196 - RNA, 23 nt, Homo sapiens
auccaagcgaggucaacagagaa

SEQ ID NO: 889197 - RNA, 22 nt, Homo sapiens
auccacaaaaacaacuuauuau

SEQ ID NO: 889198 - RNA, 14 nt, Homo sapiens
auccacaagccauu

SEQ ID NO: 889199 - RNA, 15 nt, Homo sapiens
auccacaagccauuu

SEQ ID NO: 889200 - RNA, 15 nt, Homo sapiens
auccacccaccucag

SEQ ID NO: 889201 - RNA, 13 nt, Homo sapiens
auccacugugcca

SEQ ID NO: 889202 - RNA, 15 nt, Homo sapiens
auccacugugccaug

SEQ ID NO: 889203 - RNA, 16 nt, Homo sapiens
auccagaaauaaugaa

SEQ ID NO: 889204 - RNA, 21 nt, Homo sapiens
auccagaagguuugcaccccu

SEQ ID NO: 889205 - RNA, 20 nt, Homo sapiens
auccagaccucuacaagcaa

SEQ ID NO: 889206 - RNA, 21 nt, Homo sapiens
auccagaccucuacaagcaaa

SEQ ID NO: 889207 - RNA, 17 nt, Homo sapiens
auccaggacucugucaa

SEQ ID NO: 889208 - RNA, 16 nt, Homo sapiens
auccaguugcaauaaa

SEQ ID NO: 889209 - RNA, 22 nt, Homo sapiens
auccauaacacccccaccccaa

SEQ ID NO: 889210 - RNA, 22 nt, Homo sapiens
auccauagugcacuagcauuuu

SEQ ID NO: 889211 - RNA, 20 nt, Homo sapiens
auccaucugggcuaccccac

SEQ ID NO: 889212 - RNA, 22 nt, Homo sapiens
auccaugccugggaaaugccac

SEQ ID NO: 889213 - RNA, 18 nt, Homo sapiens
auccaugcgucaguuuuu

SEQ ID NO: 889214 - RNA, 16 nt, Homo sapiens
auccauuuaugucuca

SEQ ID NO: 889215 - RNA, 20 nt, Homo sapiens
auccauuuggacaaaaugga

SEQ ID NO: 889216 - RNA, 15 nt, Homo sapiens
aucccaaaggacagc

SEQ ID NO: 889217 - RNA, 15 nt, Homo sapiens
aucccaagguuucca

SEQ ID NO: 889218 - RNA, 15 nt, Homo sapiens
aucccaauucauuuc

SEQ ID NO: 889219 - RNA, 14 nt, Homo sapiens
auccccagccagaa

SEQ ID NO: 889220 - RNA, 18 nt, Homo sapiens
auccccagcgauucccuc

SEQ ID NO: 889221 - RNA, 18 nt, Homo sapiens
aucccccuugccaaauuc

SEQ ID NO: 889222 - RNA, 14 nt, Homo sapiens
auccccucaaaauc

SEQ ID NO: 889223 - RNA, 17 nt, Homo sapiens
auccccuggacugggag

SEQ ID NO: 889224 - RNA, 19 nt, Homo sapiens
auccccuggacugggaggu

SEQ ID NO: 889225 - RNA, 19 nt, Homo sapiens
aucccgucuucuccaacac

SEQ ID NO: 889226 - RNA, 21 nt, Homo sapiens
aucccuaacaucaugcauuca

SEQ ID NO: 889227 - RNA, 14 nt, Homo sapiens
aucccuacaaaaaa

SEQ ID NO: 889228 - RNA, 20 nt, Homo sapiens
aucccugcagccugguagaa

SEQ ID NO: 889229 - RNA, 12 nt, Homo sapiens
aucccuuuccag

SEQ ID NO: 889230 - RNA, 19 nt, Homo sapiens
auccgaaguaugagggaaa

SEQ ID NO: 889231 - RNA, 15 nt, Homo sapiens
auccgaggcaggguc

SEQ ID NO: 889232 - RNA, 16 nt, Homo sapiens
auccuaaauaauguua

SEQ ID NO: 889233 - RNA, 22 nt, Homo sapiens
auccuaggcuuaaaugcaauau

SEQ ID NO: 889234 - RNA, 15 nt, Homo sapiens
auccucauuacccag

SEQ ID NO: 889235 - RNA, 15 nt, Homo sapiens
auccuccugccucag

SEQ ID NO: 889236 - RNA, 16 nt, Homo sapiens
auccugcgagcuccuu

SEQ ID NO: 889237 - RNA, 16 nt, Homo sapiens
auccugcuagcuguag

SEQ ID NO: 889238 - RNA, 18 nt, Homo sapiens
auccuuauuuauauauca

SEQ ID NO: 889239 - RNA, 21 nt, Homo sapiens
auccuugaacugucagcccac

SEQ ID NO: 889240 - RNA, 16 nt, Homo sapiens
auccuugauaaaugcc

SEQ ID NO: 889241 - RNA, 21 nt, Homo sapiens
auccuugggagucauuaccac

SEQ ID NO: 889242 - RNA, 16 nt, Homo sapiens
auccuuuaucaagaag

SEQ ID NO: 889243 - RNA, 23 nt, Homo sapiens
auccuuugaguuauaguuugcuu

SEQ ID NO: 889244 - RNA, 16 nt, Homo sapiens
aucgagucuaccucuu

SEQ ID NO: 889245 - RNA, 20 nt, Homo sapiens
aucgaucuguacuguaauuu

SEQ ID NO: 889246 - RNA, 22 nt, Homo sapiens
aucgcaccuuuuauaccagaga

SEQ ID NO: 889247 - RNA, 18 nt, Homo sapiens
aucgcugccuugccaugu

SEQ ID NO: 889248 - RNA, 20 nt, Homo sapiens
aucgcugccuugccaugucu

SEQ ID NO: 889249 - RNA, 16 nt, Homo sapiens
aucgggccaucucaga

SEQ ID NO: 889250 - RNA, 12 nt, Homo sapiens
aucgugcuaaau

SEQ ID NO: 889251 - RNA, 21 nt, Homo sapiens
aucguggugugucaaugccac

SEQ ID NO: 889252 - RNA, 18 nt, Homo sapiens
aucuaaaaagacuaaccu

SEQ ID NO: 889253 - RNA, 20 nt, Homo sapiens
aucuaaagccaguggcagug

SEQ ID NO: 889254 - RNA, 19 nt, Homo sapiens
aucuaagaaaauuauguau

SEQ ID NO: 889255 - RNA, 18 nt, Homo sapiens
aucuaagccuuuccauaa

SEQ ID NO: 889256 - RNA, 14 nt, Homo sapiens
aucuaauacacuuu

SEQ ID NO: 889257 - RNA, 15 nt, Homo sapiens
aucuacucauugucu

SEQ ID NO: 889258 - RNA, 18 nt, Homo sapiens
aucuagaggcuuccuuca

SEQ ID NO: 889259 - RNA, 14 nt, Homo sapiens
aucuaguucucaau

SEQ ID NO: 889260 - RNA, 16 nt, Homo sapiens
aucuaguuuacuuccu

SEQ ID NO: 889261 - RNA, 17 nt, Homo sapiens
aucuaucaauagucaag

SEQ ID NO: 889262 - RNA, 13 nt, Homo sapiens
aucuaugcaauuu

SEQ ID NO: 889263 - RNA, 17 nt, Homo sapiens
aucuauuauaaaaccau

SEQ ID NO: 889264 - RNA, 16 nt, Homo sapiens
aucuauuucugagaag

SEQ ID NO: 889265 - RNA, 16 nt, Homo sapiens
aucucaagagcccugu

SEQ ID NO: 889266 - RNA, 17 nt, Homo sapiens
aucucacucuguugccc

SEQ ID NO: 889267 - RNA, 19 nt, Homo sapiens
aucucacucuguugcccag

SEQ ID NO: 889268 - RNA, 15 nt, Homo sapiens
aucucagccuaccau

SEQ ID NO: 889269 - RNA, 21 nt, Homo sapiens
aucucagggaaacuugcguac

SEQ ID NO: 889270 - RNA, 14 nt, Homo sapiens
aucucaguggcaca

SEQ ID NO: 889271 - RNA, 19 nt, Homo sapiens
aucucauaccucugaccaa

SEQ ID NO: 889272 - RNA, 16 nt, Homo sapiens
aucucauggaaacugg

SEQ ID NO: 889273 - RNA, 17 nt, Homo sapiens
aucucauuuaagggaaa

SEQ ID NO: 889274 - RNA, 12 nt, Homo sapiens
aucuccaaggac

SEQ ID NO: 889275 - RNA, 21 nt, Homo sapiens
aucuccacggucagauuugcu

SEQ ID NO: 889276 - RNA, 13 nt, Homo sapiens
aucuccacuguua

SEQ ID NO: 889277 - RNA, 21 nt, Homo sapiens
aucuccaggauugaagagcau

SEQ ID NO: 889278 - RNA, 20 nt, Homo sapiens
aucuccaguauucuugucaa

SEQ ID NO: 889279 - RNA, 17 nt, Homo sapiens
aucuccccaggccucca

SEQ ID NO: 889280 - RNA, 23 nt, Homo sapiens
aucucccuagccugcuuuugucc

SEQ ID NO: 889281 - RNA, 22 nt, Homo sapiens
aucuccuaaaagugguuuuuau

SEQ ID NO: 889282 - RNA, 20 nt, Homo sapiens
aucucgcaguacauguuacu

SEQ ID NO: 889283 - RNA, 24 nt, Homo sapiens
aucucuaacauaugauacugaugc

SEQ ID NO: 889284 - RNA, 13 nt, Homo sapiens
aucucucuacucc

SEQ ID NO: 889285 - RNA, 16 nt, Homo sapiens
aucucugcuuacuaau

SEQ ID NO: 889286 - RNA, 21 nt, Homo sapiens
aucucuuaaaaaaugaauuug

SEQ ID NO: 889287 - RNA, 19 nt, Homo sapiens
aucucuucuuuuaaaccau

SEQ ID NO: 889288 - RNA, 13 nt, Homo sapiens
aucucuugucaua

SEQ ID NO: 889289 - RNA, 16 nt, Homo sapiens
aucucuuugaugucau

SEQ ID NO: 889290 - RNA, 20 nt, Homo sapiens
aucugaaaggcacacuuuga

SEQ ID NO: 889291 - RNA, 13 nt, Homo sapiens
aucugaacacagu

SEQ ID NO: 889292 - RNA, 16 nt, Homo sapiens
aucugaggaaggugcu

SEQ ID NO: 889293 - RNA, 12 nt, Homo sapiens
aucugcacuggg

SEQ ID NO: 889294 - RNA, 22 nt, Homo sapiens
aucugcagggagcaacucucca

SEQ ID NO: 889295 - RNA, 17 nt, Homo sapiens
aucugccauaaagccau

SEQ ID NO: 889296 - RNA, 20 nt, Homo sapiens
aucugccccaguagucagaa

SEQ ID NO: 889297 - RNA, 17 nt, Homo sapiens
gcacaucacaacauuua

SEQ ID NO: 889298 - RNA, 15 nt, Homo sapiens
gcacauccauuccca

SEQ ID NO: 889299 - RNA, 17 nt, Homo sapiens
gcacauccauucccaag

SEQ ID NO: 889300 - RNA, 15 nt, Homo sapiens
gcaccaccaugccag

SEQ ID NO: 889301 - RNA, 17 nt, Homo sapiens
gcaccccccaagcuguu

SEQ ID NO: 889302 - RNA, 16 nt, Homo sapiens
gcaccccugucucuag

SEQ ID NO: 889303 - RNA, 18 nt, Homo sapiens
gcaccgagagagauggaa

SEQ ID NO: 889304 - RNA, 21 nt, Homo sapiens
gcaccgggcccuccuugccug

SEQ ID NO: 889305 - RNA, 17 nt, Homo sapiens
gcaccuacuuacaugca

SEQ ID NO: 889306 - RNA, 18 nt, Homo sapiens
gcaccuacuuacaugcau

SEQ ID NO: 889307 - RNA, 17 nt, Homo sapiens
gcaccucagacaaucca

SEQ ID NO: 889308 - RNA, 16 nt, Homo sapiens
gcaccuguacucagga

SEQ ID NO: 889309 - RNA, 21 nt, Homo sapiens
gcaccuguagucccagcuacu

SEQ ID NO: 889310 - RNA, 20 nt, Homo sapiens
gcacgcacaugccaaugcac

SEQ ID NO: 889311 - RNA, 19 nt, Homo sapiens
gcacgcggcggacugggca

SEQ ID NO: 889312 - RNA, 18 nt, Homo sapiens
gcacgguggcucaggccu

SEQ ID NO: 889313 - RNA, 17 nt, Homo sapiens
gcacuaauugacccaaa

SEQ ID NO: 889314 - RNA, 12 nt, Homo sapiens
gcacuagcauuu

SEQ ID NO: 889315 - RNA, 20 nt, Homo sapiens
gcacuaggucaaaacauuca

SEQ ID NO: 889316 - RNA, 18 nt, Homo sapiens
gcacucacccaugugcca

SEQ ID NO: 889317 - RNA, 19 nt, Homo sapiens
gcacucagaagacacugau

SEQ ID NO: 889318 - RNA, 17 nt, Homo sapiens
gcacuccagaauccaca

SEQ ID NO: 889319 - RNA, 19 nt, Homo sapiens
gcacugaaaauaccaucag

SEQ ID NO: 889320 - RNA, 16 nt, Homo sapiens
gcacugaggaccagcc

SEQ ID NO: 889321 - RNA, 14 nt, Homo sapiens
gcacugcuccagug

SEQ ID NO: 889322 - RNA, 20 nt, Homo sapiens
gcacugugaccgagaacuuu

SEQ ID NO: 889323 - RNA, 22 nt, Homo sapiens
gcacuuggaaagguuucaagac

SEQ ID NO: 889324 - RNA, 22 nt, Homo sapiens
gcacuuuaacccucucuucccu

SEQ ID NO: 889325 - RNA, 15 nt, Homo sapiens
gcacuuuaacugacu

SEQ ID NO: 889326 - RNA, 14 nt, Homo sapiens
gcagaaaacacagc

SEQ ID NO: 889327 - RNA, 13 nt, Homo sapiens
gcagaaccaaagc

SEQ ID NO: 889328 - RNA, 16 nt, Homo sapiens
gcagaagcacauauga

SEQ ID NO: 889329 - RNA, 18 nt, Homo sapiens
gcagaaguauaaagugau

SEQ ID NO: 889330 - RNA, 22 nt, Homo sapiens
gcagaaucccggcugucaaggg

SEQ ID NO: 889331 - RNA, 12 nt, Homo sapiens
gcagacagcagg

SEQ ID NO: 889332 - RNA, 22 nt, Homo sapiens
gcagacaggaggaaucauguca

SEQ ID NO: 889333 - RNA, 16 nt, Homo sapiens
gcagacucacuguggg

SEQ ID NO: 889334 - RNA, 21 nt, Homo sapiens
gcagagaacuggaaagacaua

SEQ ID NO: 889335 - RNA, 23 nt, Homo sapiens
gcagagagguggagaacugggau

SEQ ID NO: 889336 - RNA, 16 nt, Homo sapiens
gcagagccaccagggc

SEQ ID NO: 889337 - RNA, 20 nt, Homo sapiens
gcagagcccgaauuccugac

SEQ ID NO: 889338 - RNA, 21 nt, Homo sapiens
gcagagcggggaggugccuga

SEQ ID NO: 889339 - RNA, 12 nt, Homo sapiens
gcagaguauuuc

SEQ ID NO: 889340 - RNA, 20 nt, Homo sapiens
gcagauaaagacagcugaca

SEQ ID NO: 889341 - RNA, 19 nt, Homo sapiens
gcagauacaggaaaagcug

SEQ ID NO: 889342 - RNA, 23 nt, Homo sapiens
gcagaucuuuuugugaaauucaa

SEQ ID NO: 889343 - RNA, 9 nt, Homo sapiens
gcagcacuu

SEQ ID NO: 889344 - RNA, 19 nt, Homo sapiens
gcagcaggaggcuagcaaa

SEQ ID NO: 889345 - RNA, 15 nt, Homo sapiens
gcagcauuccaugac

SEQ ID NO: 889346 - RNA, 17 nt, Homo sapiens
gcagccccacacccgcc

SEQ ID NO: 889347 - RNA, 15 nt, Homo sapiens
gcagcccgaagccca

SEQ ID NO: 889348 - RNA, 23 nt, Homo sapiens
gcagcccgaagcccaguuucccu

SEQ ID NO: 889349 - RNA, 20 nt, Homo sapiens
gcagcccggcgccaccaucc

SEQ ID NO: 889350 - RNA, 16 nt, Homo sapiens
gcagccuccuccugac

SEQ ID NO: 889351 - RNA, 14 nt, Homo sapiens
gcagcgcgugcaca

SEQ ID NO: 889352 - RNA, 22 nt, Homo sapiens
gcagcgguagcaucugagcucc

SEQ ID NO: 889353 - RNA, 22 nt, Homo sapiens
gcagcugauuuugucacugucu

SEQ ID NO: 889354 - RNA, 16 nt, Homo sapiens
gcagcugggccggcca

SEQ ID NO: 889355 - RNA, 23 nt, Homo sapiens
gcagcugucauggaaaagcccag

SEQ ID NO: 889356 - RNA, 18 nt, Homo sapiens
gcagcuuguugguuguca

SEQ ID NO: 889357 - RNA, 15 nt, Homo sapiens
gcaggaagugucuag

SEQ ID NO: 889358 - RNA, 12 nt, Homo sapiens
gcaggaccagga

SEQ ID NO: 889359 - RNA, 15 nt, Homo sapiens
gcaggaguagcugag

SEQ ID NO: 889360 - RNA, 13 nt, Homo sapiens
gcaggaucucagc

SEQ ID NO: 889361 - RNA, 22 nt, Homo sapiens
gcaggcaccuuaguggcuuuuu

SEQ ID NO: 889362 - RNA, 14 nt, Homo sapiens
gcaggcagccccac

SEQ ID NO: 889363 - RNA, 20 nt, Homo sapiens
gcagggccuugcccagagau

SEQ ID NO: 889364 - RNA, 16 nt, Homo sapiens
gcaggggccgagccau

SEQ ID NO: 889365 - RNA, 21 nt, Homo sapiens
gcagguuaacagcugucuaug

SEQ ID NO: 889366 - RNA, 16 nt, Homo sapiens
gcagguucgugcccug

SEQ ID NO: 889367 - RNA, 13 nt, Homo sapiens
gcaguauggccau

SEQ ID NO: 889368 - RNA, 16 nt, Homo sapiens
gcaguauggccauggg

SEQ ID NO: 889369 - RNA, 15 nt, Homo sapiens
gcagugagcugagau

SEQ ID NO: 889370 - RNA, 20 nt, Homo sapiens
gcaguucucgcagauguuac

SEQ ID NO: 889371 - RNA, 14 nt, Homo sapiens
gcaguuggcagaaa

SEQ ID NO: 889372 - RNA, 19 nt, Homo sapiens
gcauaaacuucaucuucaa

SEQ ID NO: 889373 - RNA, 21 nt, Homo sapiens
gcauagggucuggaacaccag

SEQ ID NO: 889374 - RNA, 15 nt, Homo sapiens
gcauaguaauagggc

SEQ ID NO: 889375 - RNA, 20 nt, Homo sapiens
gcauaguucccauguuaaau

SEQ ID NO: 889376 - RNA, 15 nt, Homo sapiens
gcaucaaauauuugu

SEQ ID NO: 889377 - RNA, 11 nt, Homo sapiens
gcaucagagau

SEQ ID NO: 889378 - RNA, 22 nt, Homo sapiens
gcaucguggugugucaaugcca

SEQ ID NO: 889379 - RNA, 14 nt, Homo sapiens
gcaucuacacagcc

SEQ ID NO: 889380 - RNA, 22 nt, Homo sapiens
gcaucuauucuuuguaccaucu

SEQ ID NO: 889381 - RNA, 23 nt, Homo sapiens
gcaucuauucuuuguaccaucug

SEQ ID NO: 889382 - RNA, 13 nt, Homo sapiens
gcaucucagccua

SEQ ID NO: 889383 - RNA, 12 nt, Homo sapiens
gcaucuguguaa

SEQ ID NO: 889384 - RNA, 22 nt, Homo sapiens
gcaucuucuggagucuccagug

SEQ ID NO: 889385 - RNA, 16 nt, Homo sapiens
gcaugaacacacaugg

SEQ ID NO: 889386 - RNA, 18 nt, Homo sapiens
gcaugagaaucacuugaa

SEQ ID NO: 889387 - RNA, 18 nt, Homo sapiens
gcaugcaauaaugugcaa

SEQ ID NO: 889388 - RNA, 21 nt, Homo sapiens
gcaugccggugaucccuagcu

SEQ ID NO: 889389 - RNA, 17 nt, Homo sapiens
gcaugccuggucuuucc

SEQ ID NO: 889390 - RNA, 15 nt, Homo sapiens
gcauggaacagugca

SEQ ID NO: 889391 - RNA, 14 nt, Homo sapiens
gcauggugcaguug

SEQ ID NO: 889392 - RNA, 18 nt, Homo sapiens
gcaugucucaauaguaaa

SEQ ID NO: 889393 - RNA, 13 nt, Homo sapiens
gcaugugccaguu

SEQ ID NO: 889394 - RNA, 16 nt, Homo sapiens
gcauguggagacacuc

SEQ ID NO: 889395 - RNA, 20 nt, Homo sapiens
gcauguuggcccagaccuca

SEQ ID NO: 889396 - RNA, 17 nt, Homo sapiens
gcauuaaauuuuagcaa

SEQ ID NO: 889397 - RNA, 13 nt, Homo sapiens
gcauuacugggaa

SEQ ID NO: 889398 - RNA, 17 nt, Homo sapiens
gcauuagaaacugaaaa

SEQ ID NO: 889399 - RNA, 15 nt, Homo sapiens
gcauucacaucucau

SEQ ID NO: 889400 - RNA, 21 nt, Homo sapiens
gcauucauuucucuugcaaua

SEQ ID NO: 889401 - RNA, 15 nt, Homo sapiens
gcauugaacauuucu

SEQ ID NO: 889402 - RNA, 17 nt, Homo sapiens
gcauugcuucagaauga

SEQ ID NO: 889403 - RNA, 15 nt, Homo sapiens
gcauuuacucucuua

SEQ ID NO: 889404 - RNA, 19 nt, Homo sapiens
gcauuuauuaccuugguau

SEQ ID NO: 889405 - RNA, 19 nt, Homo sapiens
gcauuuucacauuuugccu

SEQ ID NO: 889406 - RNA, 16 nt, Homo sapiens
gcauuuuuacuacuau

SEQ ID NO: 889407 - RNA, 15 nt, Homo sapiens
gcauuuuuugcaagu

SEQ ID NO: 889408 - RNA, 14 nt, Homo sapiens
gccaaacacagagc

SEQ ID NO: 889409 - RNA, 18 nt, Homo sapiens
gccaaacagccccaaagu

SEQ ID NO: 889410 - RNA, 15 nt, Homo sapiens
gccaaacucugccag

SEQ ID NO: 889411 - RNA, 18 nt, Homo sapiens
gccaacaccuucuuggcu

SEQ ID NO: 889412 - RNA, 15 nt, Homo sapiens
aucaaugucacuuaa

SEQ ID NO: 889413 - RNA, 23 nt, Homo sapiens
aucaauguucacgcaacuugaaa

SEQ ID NO: 889414 - RNA, 18 nt, Homo sapiens
aucaauuauuacauuuau

SEQ ID NO: 889415 - RNA, 19 nt, Homo sapiens
aucaauucaacacauuacu

SEQ ID NO: 889416 - RNA, 17 nt, Homo sapiens
aucaauuuguaauugcu

SEQ ID NO: 889417 - RNA, 16 nt, Homo sapiens
aucaauuuuuauacau

SEQ ID NO: 889418 - RNA, 11 nt, Homo sapiens
aucacaacauu

SEQ ID NO: 889419 - RNA, 15 nt, Homo sapiens
aucacaccucugggc

SEQ ID NO: 889420 - RNA, 23 nt, Homo sapiens
aucacagggccccagaaggcagg

SEQ ID NO: 889421 - RNA, 20 nt, Homo sapiens
aucacaguguuugcaauggu

SEQ ID NO: 889422 - RNA, 14 nt, Homo sapiens
aucacauacaauuu

SEQ ID NO: 889423 - RNA, 22 nt, Homo sapiens
aucacauagaagcuguccuuga

SEQ ID NO: 889424 - RNA, 13 nt, Homo sapiens
aucaccagagguc

SEQ ID NO: 889425 - RNA, 19 nt, Homo sapiens
aucaccagcagacacugcc

SEQ ID NO: 889426 - RNA, 18 nt, Homo sapiens
aucaccauguaacaacca

SEQ ID NO: 889427 - RNA, 15 nt, Homo sapiens
aucaccucaggccag

SEQ ID NO: 889428 - RNA, 21 nt, Homo sapiens
aucaccuugauaaugggauga

SEQ ID NO: 889429 - RNA, 15 nt, Homo sapiens
aucacgccacugcac

SEQ ID NO: 889430 - RNA, 17 nt, Homo sapiens
aucacggcucacugcag

SEQ ID NO: 889431 - RNA, 22 nt, Homo sapiens
aucacggcucacugcagccuca

SEQ ID NO: 889432 - RNA, 19 nt, Homo sapiens
aucacguacaccauaugca

SEQ ID NO: 889433 - RNA, 17 nt, Homo sapiens
aucacuuggagccagga

SEQ ID NO: 889434 - RNA, 22 nt, Homo sapiens
aucagaccauaauguuacauua

SEQ ID NO: 889435 - RNA, 17 nt, Homo sapiens
aucagacuccugugcaa

SEQ ID NO: 889436 - RNA, 18 nt, Homo sapiens
aucagacuccugugcaac

SEQ ID NO: 889437 - RNA, 12 nt, Homo sapiens
aucagacuguag

SEQ ID NO: 889438 - RNA, 22 nt, Homo sapiens
aucagaguugcuuuucuaaucu

SEQ ID NO: 889439 - RNA, 13 nt, Homo sapiens
aucagaucugucu

SEQ ID NO: 889440 - RNA, 23 nt, Homo sapiens
aucagcacugccggcccagugac

SEQ ID NO: 889441 - RNA, 18 nt, Homo sapiens
aucagcagagaacuggaa

SEQ ID NO: 889442 - RNA, 13 nt, Homo sapiens
aucagcauuaguc

SEQ ID NO: 889443 - RNA, 22 nt, Homo sapiens
aucagccucacugagcuaauaa

SEQ ID NO: 889444 - RNA, 20 nt, Homo sapiens
aucagccuccgccauuccaa

SEQ ID NO: 889445 - RNA, 21 nt, Homo sapiens
aucaggcuauguauggaauac

SEQ ID NO: 889446 - RNA, 13 nt, Homo sapiens
aucaggguuugca

SEQ ID NO: 889447 - RNA, 23 nt, Homo sapiens
aucagugacagaguucacuauaa

SEQ ID NO: 889448 - RNA, 19 nt, Homo sapiens
aucaguggacaaggggaga

SEQ ID NO: 889449 - RNA, 13 nt, Homo sapiens
aucaguuacuggu

SEQ ID NO: 889450 - RNA, 15 nt, Homo sapiens
aucaguugcagauag

SEQ ID NO: 889451 - RNA, 14 nt, Homo sapiens
aggaagacuugaag

SEQ ID NO: 889452 - RNA, 15 nt, Homo sapiens
aggaagagugugcuu

SEQ ID NO: 889453 - RNA, 22 nt, Homo sapiens
aggaagaugaagagaagcugag

SEQ ID NO: 889454 - RNA, 17 nt, Homo sapiens
aggaagcaagaaagccg

SEQ ID NO: 889455 - RNA, 19 nt, Homo sapiens
aggaagccccaagccaugg

SEQ ID NO: 889456 - RNA, 23 nt, Homo sapiens
aggaagccccaagccauggugac

SEQ ID NO: 889457 - RNA, 19 nt, Homo sapiens
aggaagcuccacugucacc

SEQ ID NO: 889458 - RNA, 22 nt, Homo sapiens
aggaagcuccacugucacccuc

SEQ ID NO: 889459 - RNA, 14 nt, Homo sapiens
aggaagcuccaguu

SEQ ID NO: 889460 - RNA, 22 nt, Homo sapiens
aggaaggcaaagccccuggaaa

SEQ ID NO: 889461 - RNA, 17 nt, Homo sapiens
aggaagggaaagccaga

SEQ ID NO: 889462 - RNA, 15 nt, Homo sapiens
aggaagggcauccuu

SEQ ID NO: 889463 - RNA, 22 nt, Homo sapiens
aggaagggcgugucccauggga

SEQ ID NO: 889464 - RNA, 23 nt, Homo sapiens
aggaagguagcccagcacuguga

SEQ ID NO: 889465 - RNA, 16 nt, Homo sapiens
aggaaggugcuugccu

SEQ ID NO: 889466 - RNA, 15 nt, Homo sapiens
aggaagguggugcuu

SEQ ID NO: 889467 - RNA, 18 nt, Homo sapiens
aggaauaagaauggagca

SEQ ID NO: 889468 - RNA, 21 nt, Homo sapiens
aggaauauuugcaagacauag

SEQ ID NO: 889469 - RNA, 17 nt, Homo sapiens
aggaaucaaaaauugaa

SEQ ID NO: 889470 - RNA, 13 nt, Homo sapiens
aggaaucauguca

SEQ ID NO: 889471 - RNA, 22 nt, Homo sapiens
aggaaucggagcgaagcagaga

SEQ ID NO: 889472 - RNA, 12 nt, Homo sapiens
aggaaucucaga

SEQ ID NO: 889473 - RNA, 17 nt, Homo sapiens
aggaaucugaaaguaua

SEQ ID NO: 889474 - RNA, 14 nt, Homo sapiens
aggaaucugccauu

SEQ ID NO: 889475 - RNA, 15 nt, Homo sapiens
aggaauuguuuuuau

SEQ ID NO: 889476 - RNA, 21 nt, Homo sapiens
aggacaaccauuccagacugc

SEQ ID NO: 889477 - RNA, 22 nt, Homo sapiens
aggacaauucacuucauugacc

SEQ ID NO: 889478 - RNA, 17 nt, Homo sapiens
aggacaccagccuggug

SEQ ID NO: 889479 - RNA, 21 nt, Homo sapiens
aggacagggaggugaccccag

SEQ ID NO: 889480 - RNA, 16 nt, Homo sapiens
aggacaguugggcuau

SEQ ID NO: 889481 - RNA, 21 nt, Homo sapiens
aggacaugaaaaauugcuaug

SEQ ID NO: 889482 - RNA, 20 nt, Homo sapiens
aggacauugcggacagccac

SEQ ID NO: 889483 - RNA, 18 nt, Homo sapiens
aggacauuuuacugcagu

SEQ ID NO: 889484 - RNA, 13 nt, Homo sapiens
aggaccacagugg

SEQ ID NO: 889485 - RNA, 13 nt, Homo sapiens
aggaccagagcua

SEQ ID NO: 889486 - RNA, 16 nt, Homo sapiens
aggaccccaaccccuc

SEQ ID NO: 889487 - RNA, 15 nt, Homo sapiens
aggaccugagccugc

SEQ ID NO: 889488 - RNA, 21 nt, Homo sapiens
aggacgguuaacuuguauauu

SEQ ID NO: 889489 - RNA, 16 nt, Homo sapiens
aggacgugucucagga

SEQ ID NO: 889490 - RNA, 22 nt, Homo sapiens
aggacuaacacucagaagccug

SEQ ID NO: 889491 - RNA, 23 nt, Homo sapiens
aggacuacacaucagggcuugau

SEQ ID NO: 889492 - RNA, 17 nt, Homo sapiens
aggacuagaaccuggag

SEQ ID NO: 889493 - RNA, 12 nt, Homo sapiens
aggacuccuuaa

SEQ ID NO: 889494 - RNA, 17 nt, Homo sapiens
aggacuucugccugaac

SEQ ID NO: 889495 - RNA, 19 nt, Homo sapiens
aggacuugugucucugugc

SEQ ID NO: 889496 - RNA, 22 nt, Homo sapiens
aggacuuuaucuaauaccucug

SEQ ID NO: 889497 - RNA, 13 nt, Homo sapiens
aggagaaacugag

SEQ ID NO: 889498 - RNA, 21 nt, Homo sapiens
aggagaaggacauuuuacugc

SEQ ID NO: 889499 - RNA, 13 nt, Homo sapiens
aggagaaggugcc

SEQ ID NO: 889500 - RNA, 14 nt, Homo sapiens
aggagaccagcuca

SEQ ID NO: 889501 - RNA, 16 nt, Homo sapiens
aggagaccagcucaga

SEQ ID NO: 889502 - RNA, 15 nt, Homo sapiens
aggagacccacaggu

SEQ ID NO: 889503 - RNA, 14 nt, Homo sapiens
aggagcaaaacgcc

SEQ ID NO: 889504 - RNA, 17 nt, Homo sapiens
aggagcuuccagugcau

SEQ ID NO: 889505 - RNA, 15 nt, Homo sapiens
aggagcuugcaagaa

SEQ ID NO: 889506 - RNA, 21 nt, Homo sapiens
aggaggacgguuaacuuguau

SEQ ID NO: 889507 - RNA, 19 nt, Homo sapiens
aggaggacuacuauuugaa

SEQ ID NO: 889508 - RNA, 17 nt, Homo sapiens
aggaggcugcaugcucu

SEQ ID NO: 889509 - RNA, 22 nt, Homo sapiens
aggagggggucguggagagcua

SEQ ID NO: 889510 - RNA, 21 nt, Homo sapiens
aggagguagcucccagcacuc

SEQ ID NO: 889511 - RNA, 23 nt, Homo sapiens
aggaggugcuaucgcaccacugu

SEQ ID NO: 889512 - RNA, 17 nt, Homo sapiens
aggagucagaaacuguu

SEQ ID NO: 889513 - RNA, 15 nt, Homo sapiens
aggauaagagggauu

SEQ ID NO: 889514 - RNA, 21 nt, Homo sapiens
aggauagaauauuuacaauaa

SEQ ID NO: 889515 - RNA, 13 nt, Homo sapiens
aggaucccuccau

SEQ ID NO: 889516 - RNA, 17 nt, Homo sapiens
aggaucgccugagccca

SEQ ID NO: 889517 - RNA, 12 nt, Homo sapiens
aggaucucagcc

SEQ ID NO: 889518 - RNA, 22 nt, Homo sapiens
aggaugauuuccuggggcacag

SEQ ID NO: 889519 - RNA, 17 nt, Homo sapiens
aggauucauguggaaua

SEQ ID NO: 889520 - RNA, 19 nt, Homo sapiens
aggauuccaaaguuuugaa

SEQ ID NO: 889521 - RNA, 20 nt, Homo sapiens
aggcaaaauugauauacuuu

SEQ ID NO: 889522 - RNA, 13 nt, Homo sapiens
aggcaaaggccag

SEQ ID NO: 889523 - RNA, 16 nt, Homo sapiens
aggcaaauauaagcug

SEQ ID NO: 889524 - RNA, 13 nt, Homo sapiens
aggcaagagaaaa

SEQ ID NO: 889525 - RNA, 15 nt, Homo sapiens
aggcaauacauguau

SEQ ID NO: 889526 - RNA, 21 nt, Homo sapiens
aggcacaaaccuuacuaugga

SEQ ID NO: 889527 - RNA, 22 nt, Homo sapiens
aggcaccaguuacccugcaugu

SEQ ID NO: 889528 - RNA, 19 nt, Homo sapiens
aggcacgcaccaccaugcc

SEQ ID NO: 889529 - RNA, 23 nt, Homo sapiens
aggcagagacaauaaaacauucc

SEQ ID NO: 889530 - RNA, 12 nt, Homo sapiens
aggcagcuccaa

SEQ ID NO: 889531 - RNA, 19 nt, Homo sapiens
aggcagcuggaugagacuu

SEQ ID NO: 889532 - RNA, 15 nt, Homo sapiens
aggcaggaggaucac

SEQ ID NO: 889533 - RNA, 16 nt, Homo sapiens
aggcauauacaaauaa

SEQ ID NO: 889534 - RNA, 16 nt, Homo sapiens
aggcaucuacacagcc

SEQ ID NO: 889535 - RNA, 14 nt, Homo sapiens
aggcauuugccuaa

SEQ ID NO: 889536 - RNA, 13 nt, Homo sapiens
aggccaacaaacc

SEQ ID NO: 889537 - RNA, 12 nt, Homo sapiens
aggccagcagca

SEQ ID NO: 889538 - RNA, 13 nt, Homo sapiens
aggccagugccag

SEQ ID NO: 889539 - RNA, 14 nt, Homo sapiens
aggccauccauuca

SEQ ID NO: 889540 - RNA, 13 nt, Homo sapiens
aggcccaagagau

SEQ ID NO: 889541 - RNA, 15 nt, Homo sapiens
aggcccagcagccuu

SEQ ID NO: 889542 - RNA, 20 nt, Homo sapiens
aggcccagggagcaauggga

SEQ ID NO: 889543 - RNA, 14 nt, Homo sapiens
aggccccaugaccu

SEQ ID NO: 889544 - RNA, 17 nt, Homo sapiens
aggccgagccaauagac

SEQ ID NO: 889545 - RNA, 13 nt, Homo sapiens
agcagauggagua

SEQ ID NO: 889546 - RNA, 14 nt, Homo sapiens
agcagcaauaugcu

SEQ ID NO: 889547 - RNA, 16 nt, Homo sapiens
agcagcauucagcaca

SEQ ID NO: 889548 - RNA, 13 nt, Homo sapiens
agcaggccaggga

SEQ ID NO: 889549 - RNA, 16 nt, Homo sapiens
agcaggcuacugucag

SEQ ID NO: 889550 - RNA, 19 nt, Homo sapiens
agcagggaauugauccacu

SEQ ID NO: 889551 - RNA, 14 nt, Homo sapiens
agcagggcucugcc

SEQ ID NO: 889552 - RNA, 13 nt, Homo sapiens
agcaguaaacuuu

SEQ ID NO: 889553 - RNA, 17 nt, Homo sapiens
agcagugccuuccauaa

SEQ ID NO: 889554 - RNA, 16 nt, Homo sapiens
agcagugguauuaaua

SEQ ID NO: 889555 - RNA, 15 nt, Homo sapiens
agcagugucuuccau

SEQ ID NO: 889556 - RNA, 17 nt, Homo sapiens
agcagugucuuccauaa

SEQ ID NO: 889557 - RNA, 18 nt, Homo sapiens
agcauaaguuucugggac

SEQ ID NO: 889558 - RNA, 13 nt, Homo sapiens
agcauaaugcucc

SEQ ID NO: 889559 - RNA, 14 nt, Homo sapiens
agcauaaugcuccc

SEQ ID NO: 889560 - RNA, 17 nt, Homo sapiens
agauaauaucugugagg

SEQ ID NO: 889561 - RNA, 13 nt, Homo sapiens
agauaauugccau

SEQ ID NO: 889562 - RNA, 13 nt, Homo sapiens
agauacauuucau

SEQ ID NO: 889563 - RNA, 14 nt, Homo sapiens
agauagaaccugga

SEQ ID NO: 889564 - RNA, 23 nt, Homo sapiens
agauagauauuccuauugugcaa

SEQ ID NO: 889565 - RNA, 18 nt, Homo sapiens
agauagaugguacucucc

SEQ ID NO: 889566 - RNA, 20 nt, Homo sapiens
agauaguacauaaagguggu

SEQ ID NO: 889567 - RNA, 11 nt, Homo sapiens
agauaugauau

SEQ ID NO: 889568 - RNA, 17 nt, Homo sapiens
agauauuauucauucau

SEQ ID NO: 889569 - RNA, 15 nt, Homo sapiens
agaucacaauacuca

SEQ ID NO: 889570 - RNA, 17 nt, Homo sapiens
agaucacgccacugcac

SEQ ID NO: 889571 - RNA, 17 nt, Homo sapiens
agaucagccacaccuuu

SEQ ID NO: 889572 - RNA, 14 nt, Homo sapiens
agaucauggcccac

SEQ ID NO: 889573 - RNA, 16 nt, Homo sapiens
acagaaggaugaauga

SEQ ID NO: 889574 - RNA, 18 nt, Homo sapiens
acagaagucuugucucaa

SEQ ID NO: 889575 - RNA, 17 nt, Homo sapiens
acagaaugaaucccaua

SEQ ID NO: 889576 - RNA, 20 nt, Homo sapiens
acagaauuuuaaagagcaua

SEQ ID NO: 889577 - RNA, 23 nt, Homo sapiens
acagacaccaucuuuugugagau

SEQ ID NO: 889578 - RNA, 12 nt, Homo sapiens
agaaaucugcca

SEQ ID NO: 889579 - RNA, 12 nt, Homo sapiens
agaaaugaauau

SEQ ID NO: 889580 - RNA, 14 nt, Homo sapiens
agaaaugacuuuga

SEQ ID NO: 889581 - RNA, 21 nt, Homo sapiens
agaaaugcuuuccaaaaccgc

SEQ ID NO: 889582 - RNA, 22 nt, Homo sapiens
agaaauuccaggaaaaucugca

SEQ ID NO: 889583 - RNA, 19 nt, Homo sapiens
agaaauuugccaauuuacu

SEQ ID NO: 889584 - RNA, 23 nt, Homo sapiens
agaaauuuucauucagguauuug

SEQ ID NO: 889585 - RNA, 18 nt, Homo sapiens
gaggucccugccaguguu

SEQ ID NO: 889586 - RNA, 17 nt, Homo sapiens
gagguccugagcacugc

SEQ ID NO: 889587 - RNA, 14 nt, Homo sapiens
gagguccugcauuu

SEQ ID NO: 889588 - RNA, 12 nt, Homo sapiens
gagguggcugcu

SEQ ID NO: 889589 - RNA, 18 nt, Homo sapiens
gaggugggcagcagcuca

SEQ ID NO: 889590 - RNA, 20 nt, Homo sapiens
gagguggggcuggaugucuc

SEQ ID NO: 889591 - RNA, 20 nt, Homo sapiens
gaggugggguacauuucucu

SEQ ID NO: 889592 - RNA, 16 nt, Homo sapiens
gagguugaagaaugag

SEQ ID NO: 889593 - RNA, 13 nt, Homo sapiens
gagguugcaguga

SEQ ID NO: 889594 - RNA, 15 nt, Homo sapiens
gaguacaaacacagg

SEQ ID NO: 889595 - RNA, 23 nt, Homo sapiens
gaguaccaaauccacaagccauu

SEQ ID NO: 889596 - RNA, 19 nt, Homo sapiens
gaguaccuuaaucugccau

SEQ ID NO: 889597 - RNA, 18 nt, Homo sapiens
gaguagagggcacugggu

SEQ ID NO: 889598 - RNA, 15 nt, Homo sapiens
gaguaucuaaagcca

SEQ ID NO: 889599 - RNA, 18 nt, Homo sapiens
gagucaacuggcuggcca

SEQ ID NO: 889600 - RNA, 17 nt, Homo sapiens
gagucacaguugacaaa

SEQ ID NO: 889601 - RNA, 20 nt, Homo sapiens
gagucaggccuuaauuuuca

SEQ ID NO: 889602 - RNA, 17 nt, Homo sapiens
gagucaugcacucaggc

SEQ ID NO: 889603 - RNA, 19 nt, Homo sapiens
gagucucccuuagcgccau

SEQ ID NO: 889604 - RNA, 22 nt, Homo sapiens
gcccuuuuuuguggugucuagc

SEQ ID NO: 889605 - RNA, 13 nt, Homo sapiens
gccgacucaggga

SEQ ID NO: 889606 - RNA, 21 nt, Homo sapiens
gccgagauugcgccacugcag

SEQ ID NO: 889607 - RNA, 14 nt, Homo sapiens
gccgcauggcacuc

SEQ ID NO: 889608 - RNA, 21 nt, Homo sapiens
gccgccuggagaugacuugag

SEQ ID NO: 889609 - RNA, 13 nt, Homo sapiens
gccgcgugugaca

SEQ ID NO: 889610 - RNA, 14 nt, Homo sapiens
gccgcgugugacag

SEQ ID NO: 889611 - RNA, 22 nt, Homo sapiens
gccggcaaccccaguucugcuc

SEQ ID NO: 889612 - RNA, 20 nt, Homo sapiens
gccggcuccaguuuccccau

SEQ ID NO: 889613 - RNA, 13 nt, Homo sapiens
gccggcucugccu

SEQ ID NO: 889614 - RNA, 17 nt, Homo sapiens
gccggcucuucaaagac

SEQ ID NO: 889615 - RNA, 16 nt, Homo sapiens
gccgggcugcacagac

SEQ ID NO: 889616 - RNA, 22 nt, Homo sapiens
gccgugcucgcccacaaacuga

SEQ ID NO: 889617 - RNA, 17 nt, Homo sapiens
gccuacaaauguuuuca

SEQ ID NO: 889618 - RNA, 19 nt, Homo sapiens
gccuacacccgucuugggg

SEQ ID NO: 889619 - RNA, 22 nt, Homo sapiens
gccuacccccugaaagugacag

SEQ ID NO: 889620 - RNA, 21 nt, Homo sapiens
gccuaggaguugaguacagug

SEQ ID NO: 889621 - RNA, 23 nt, Homo sapiens
gccuaguaagggaacuauggaaa

SEQ ID NO: 889622 - RNA, 18 nt, Homo sapiens
gccuaugauaaauucaca

SEQ ID NO: 889623 - RNA, 19 nt, Homo sapiens
gccucaacaacguaaacuu

SEQ ID NO: 889624 - RNA, 14 nt, Homo sapiens
gccucaaugugacc

SEQ ID NO: 889625 - RNA, 12 nt, Homo sapiens
gccucacuuuua

SEQ ID NO: 889626 - RNA, 20 nt, Homo sapiens
gccucaggggccucagggga

SEQ ID NO: 889627 - RNA, 12 nt, Homo sapiens
gccucaguucua

SEQ ID NO: 889628 - RNA, 23 nt, Homo sapiens
gccucauauuuaaagacagggaa

SEQ ID NO: 889629 - RNA, 13 nt, Homo sapiens
gccucaucuucaa

SEQ ID NO: 889630 - RNA, 21 nt, Homo sapiens
gccucaugcugacuugcagag

SEQ ID NO: 889631 - RNA, 21 nt, Homo sapiens
gccuccaagccauucacuucc

SEQ ID NO: 889632 - RNA, 18 nt, Homo sapiens
gccuccaaggggcuuugu

SEQ ID NO: 889633 - RNA, 13 nt, Homo sapiens
gccuccagcacuc

SEQ ID NO: 889634 - RNA, 21 nt, Homo sapiens
gccuccaggagccuacccccu

SEQ ID NO: 889635 - RNA, 23 nt, Homo sapiens
gccucccucccgggggcacugcc

SEQ ID NO: 889636 - RNA, 17 nt, Homo sapiens
gccucccuuucugggag

SEQ ID NO: 889637 - RNA, 15 nt, Homo sapiens
gccuccugcaccgag

SEQ ID NO: 889638 - RNA, 13 nt, Homo sapiens
gccuccuggccag

SEQ ID NO: 889639 - RNA, 15 nt, Homo sapiens
gccuccugggaccau

SEQ ID NO: 889640 - RNA, 14 nt, Homo sapiens
gccucuacugggaa

SEQ ID NO: 889641 - RNA, 17 nt, Homo sapiens
gccucugccccaagggg

SEQ ID NO: 889642 - RNA, 22 nt, Homo sapiens
gccucugccccuggccuuugag

SEQ ID NO: 889643 - RNA, 13 nt, Homo sapiens
gccucugcuuguu

SEQ ID NO: 889644 - RNA, 17 nt, Homo sapiens
gccucuuguacaguuaa

SEQ ID NO: 889645 - RNA, 14 nt, Homo sapiens
gccugaaccacagc

SEQ ID NO: 889646 - RNA, 13 nt, Homo sapiens
gccugaaccuggg

SEQ ID NO: 889647 - RNA, 18 nt, Homo sapiens
gccugacgaacuccuuga

SEQ ID NO: 889648 - RNA, 22 nt, Homo sapiens
gccugacuagaccccacccuga

SEQ ID NO: 889649 - RNA, 11 nt, Homo sapiens
gccugagcaac

SEQ ID NO: 889650 - RNA, 21 nt, Homo sapiens
gccugagugcuuuaccuuuaa

SEQ ID NO: 889651 - RNA, 22 nt, Homo sapiens
gccugagugcuuuaccuuuaaa

SEQ ID NO: 889652 - RNA, 13 nt, Homo sapiens
gccugcagccucc

SEQ ID NO: 889653 - RNA, 22 nt, Homo sapiens
gccugccagcugggcuuggaag

SEQ ID NO: 889654 - RNA, 21 nt, Homo sapiens
gccugcccagugcacuugcug

SEQ ID NO: 889655 - RNA, 15 nt, Homo sapiens
gccuggaagccaaac

SEQ ID NO: 889656 - RNA, 20 nt, Homo sapiens
gccuggaagccaaacaaagg

SEQ ID NO: 889657 - RNA, 18 nt, Homo sapiens
gccuggaccgcuucccag

SEQ ID NO: 889658 - RNA, 22 nt, Homo sapiens
gccuggaucucacaagcacuuu

SEQ ID NO: 889659 - RNA, 23 nt, Homo sapiens
gccuggaucuccccacucuaggg

SEQ ID NO: 889660 - RNA, 17 nt, Homo sapiens
gccuggccaacauggug

SEQ ID NO: 889661 - RNA, 20 nt, Homo sapiens
gccuggccaacauggugaaa

SEQ ID NO: 889662 - RNA, 23 nt, Homo sapiens
gccuggcccauagaaacaugaca

SEQ ID NO: 889663 - RNA, 18 nt, Homo sapiens
gccuggccggcuccaguu

SEQ ID NO: 889664 - RNA, 21 nt, Homo sapiens
gccuggcuccccacgagucac

SEQ ID NO: 889665 - RNA, 18 nt, Homo sapiens
gccugggcuguggacaga

SEQ ID NO: 889666 - RNA, 17 nt, Homo sapiens
gccugggcuuaugcccu

SEQ ID NO: 889667 - RNA, 18 nt, Homo sapiens
gccugguagaauugggaa

SEQ ID NO: 889668 - RNA, 14 nt, Homo sapiens
gccugguggcagcu

SEQ ID NO: 889669 - RNA, 13 nt, Homo sapiens
gccuguaauccca

SEQ ID NO: 889670 - RNA, 19 nt, Homo sapiens
gccugugaucccagcuacu

SEQ ID NO: 889671 - RNA, 19 nt, Homo sapiens
gccugugcccacgugugca

SEQ ID NO: 889672 - RNA, 23 nt, Homo sapiens
guuggcccagaccucaggugcua

SEQ ID NO: 889673 - RNA, 18 nt, Homo sapiens
guuggccuaacacugggc

SEQ ID NO: 889674 - RNA, 21 nt, Homo sapiens
guuggugggggucagucacuu

SEQ ID NO: 889675 - RNA, 18 nt, Homo sapiens
guuguacuguaugcaguu

SEQ ID NO: 889676 - RNA, 20 nt, Homo sapiens
guuguacuuuuuauucaauu

SEQ ID NO: 889677 - RNA, 15 nt, Homo sapiens
guugucacaccugaa

SEQ ID NO: 889678 - RNA, 16 nt, Homo sapiens
guuguggaugcuccag

SEQ ID NO: 889679 - RNA, 19 nt, Homo sapiens
guuguguuaacaaugcagu

SEQ ID NO: 889680 - RNA, 23 nt, Homo sapiens
guuguuaaaacugguuuagcaca

SEQ ID NO: 889681 - RNA, 20 nt, Homo sapiens
guuguuaaugaaaaugucag

SEQ ID NO: 889682 - RNA, 23 nt, Homo sapiens
guuguucucuucuuuaaagggau

SEQ ID NO: 889683 - RNA, 18 nt, Homo sapiens
guuuaaaaaaaguauaua

SEQ ID NO: 889684 - RNA, 22 nt, Homo sapiens
guuuaacugggagugauaugau

SEQ ID NO: 889685 - RNA, 20 nt, Homo sapiens
guuuaagucucugacucuug

SEQ ID NO: 889686 - RNA, 19 nt, Homo sapiens
guuuaccucuucuaugcaa

SEQ ID NO: 889687 - RNA, 21 nt, Homo sapiens
guuuacuucucaccauuugag

SEQ ID NO: 889688 - RNA, 17 nt, Homo sapiens
guuuagaagagccugac

SEQ ID NO: 889689 - RNA, 17 nt, Homo sapiens
guuuaguugcagacuca

SEQ ID NO: 889690 - RNA, 17 nt, Homo sapiens
guuuauauaauuuugca

SEQ ID NO: 889691 - RNA, 15 nt, Homo sapiens
guuucaaacuccuga

SEQ ID NO: 889692 - RNA, 22 nt, Homo sapiens
guuucaaauggacucauggcuu

SEQ ID NO: 889693 - RNA, 20 nt, Homo sapiens
guuucauguuuugugacuau

SEQ ID NO: 889694 - RNA, 23 nt, Homo sapiens
guuucccgcuccaagagaauuca

SEQ ID NO: 889695 - RNA, 20 nt, Homo sapiens
guuucuccuuuugaccaaau

SEQ ID NO: 889696 - RNA, 22 nt, Homo sapiens
guuucucuugaagaacugacua

SEQ ID NO: 889697 - RNA, 18 nt, Homo sapiens
guuucugaaccauuacug

SEQ ID NO: 889698 - RNA, 21 nt, Homo sapiens
guuucugaaccauuacuguaa

SEQ ID NO: 889699 - RNA, 20 nt, Homo sapiens
guuucuugcucugagugcua

SEQ ID NO: 889700 - RNA, 18 nt, Homo sapiens
guuugaccucauuuguaa

SEQ ID NO: 889701 - RNA, 17 nt, Homo sapiens
guuugagcucaggcauu

SEQ ID NO: 889702 - RNA, 22 nt, Homo sapiens
guuugaugucauuaauguguug

SEQ ID NO: 889703 - RNA, 18 nt, Homo sapiens
guuugcagaaaagcaccu

SEQ ID NO: 889704 - RNA, 19 nt, Homo sapiens
guuuggaaguguuaacuau

SEQ ID NO: 889705 - RNA, 16 nt, Homo sapiens
guuugggccacugcca

SEQ ID NO: 889706 - RNA, 21 nt, Homo sapiens
guuuguauagaguucauccca

SEQ ID NO: 889707 - RNA, 12 nt, Homo sapiens
guuuguguggau

SEQ ID NO: 889708 - RNA, 23 nt, Homo sapiens
guuuguugugcuugcugguacua

SEQ ID NO: 889709 - RNA, 23 nt, Homo sapiens
guuuuaaauuauaagaugucauc

SEQ ID NO: 889710 - RNA, 17 nt, Homo sapiens
guuuuaacaguucacuu

SEQ ID NO: 889711 - RNA, 21 nt, Homo sapiens
guuuuaagagaagaugugauu

SEQ ID NO: 889712 - RNA, 22 nt, Homo sapiens
guuuuaagaggcagggucucac

SEQ ID NO: 889713 - RNA, 20 nt, Homo sapiens
guuuuaaugacaaggugaua

SEQ ID NO: 889714 - RNA, 14 nt, Homo sapiens
guuuuaauuccaau

SEQ ID NO: 889715 - RNA, 18 nt, Homo sapiens
guuuuagaguaugcaaga

SEQ ID NO: 889716 - RNA, 13 nt, Homo sapiens
guuuucaaauguc

SEQ ID NO: 889717 - RNA, 18 nt, Homo sapiens
guuuucaugagcugagug

SEQ ID NO: 889718 - RNA, 18 nt, Homo sapiens
guuuuguaccaacacaca

SEQ ID NO: 889719 - RNA, 15 nt, Homo sapiens
uuggauguggagcuc

SEQ ID NO: 889720 - RNA, 15 nt, Homo sapiens
uuggcacugagauau

SEQ ID NO: 889721 - RNA, 23 nt, Homo sapiens
uuggcagaaaggauguuuugucc

SEQ ID NO: 889722 - RNA, 19 nt, Homo sapiens
uuggccucccaaagugcua

SEQ ID NO: 889723 - RNA, 20 nt, Homo sapiens
uuggcuaucuacugagacau

SEQ ID NO: 889724 - RNA, 16 nt, Homo sapiens
uuggcucacugcaacu

SEQ ID NO: 889725 - RNA, 23 nt, Homo sapiens
uuggcucaggcagacaagagcug

SEQ ID NO: 889726 - RNA, 11 nt, Homo sapiens
uuggcugugag

SEQ ID NO: 889727 - RNA, 17 nt, Homo sapiens
uugguacuuguuucacc

SEQ ID NO: 889728 - RNA, 13 nt, Homo sapiens
uuggucacugcua

SEQ ID NO: 889729 - RNA, 19 nt, Homo sapiens
uuggucacugcuacaccuu

SEQ ID NO: 889730 - RNA, 12 nt, Homo sapiens
uuggucucagcu

SEQ ID NO: 889731 - RNA, 17 nt, Homo sapiens
uuguaaauagcucaggu

SEQ ID NO: 889732 - RNA, 20 nt, Homo sapiens
uuguaacgaagacacagacu

SEQ ID NO: 889733 - RNA, 22 nt, Homo sapiens
uuguaagcacugacugggacca

SEQ ID NO: 889734 - RNA, 19 nt, Homo sapiens
uuguaaguuuaugucuaaa

SEQ ID NO: 889735 - RNA, 19 nt, Homo sapiens
uuguaauaugucugccaca

SEQ ID NO: 889736 - RNA, 18 nt, Homo sapiens
uuguacaaagauaugcua

SEQ ID NO: 889737 - RNA, 15 nt, Homo sapiens
uuguacaauaccaga

SEQ ID NO: 889738 - RNA, 15 nt, Homo sapiens
uuguacauauggaaa

SEQ ID NO: 889739 - RNA, 19 nt, Homo sapiens
uuguacauuccugauacug

SEQ ID NO: 889740 - RNA, 20 nt, Homo sapiens
uuguaccccaucccuuccuc

SEQ ID NO: 889741 - RNA, 17 nt, Homo sapiens
uuguacuccugugcugg

SEQ ID NO: 889742 - RNA, 17 nt, Homo sapiens
uuguacuuuuuauucaa

SEQ ID NO: 889743 - RNA, 17 nt, Homo sapiens
uuguagaccacuguccu

SEQ ID NO: 889744 - RNA, 21 nt, Homo sapiens
uuguagagccagggucucacu

SEQ ID NO: 889745 - RNA, 15 nt, Homo sapiens
uuguagcagaaggca

SEQ ID NO: 889746 - RNA, 16 nt, Homo sapiens
uuguaggugaaagugu

SEQ ID NO: 889747 - RNA, 21 nt, Homo sapiens
uuguauauuccaccauucaca

SEQ ID NO: 889748 - RNA, 21 nt, Homo sapiens
uuguauguuaaagcaucagag

SEQ ID NO: 889749 - RNA, 22 nt, Homo sapiens
uuguauguuaaguuacuucacu

SEQ ID NO: 889750 - RNA, 18 nt, Homo sapiens
uuguauuugcauauguau

SEQ ID NO: 889751 - RNA, 13 nt, Homo sapiens
uuguauuugccau

SEQ ID NO: 889752 - RNA, 16 nt, Homo sapiens
uugucaaaaaguggau

SEQ ID NO: 889753 - RNA, 17 nt, Homo sapiens
uugucaaagcauugaga

SEQ ID NO: 889754 - RNA, 18 nt, Homo sapiens
uugucaagagagagucaa

SEQ ID NO: 889755 - RNA, 15 nt, Homo sapiens
uugucaaugcaucaa

SEQ ID NO: 889756 - RNA, 23 nt, Homo sapiens
uugucacuaugcuauuucuggcc

SEQ ID NO: 889757 - RNA, 12 nt, Homo sapiens
uugucagaauuu

SEQ ID NO: 889758 - RNA, 14 nt, Homo sapiens
uugucauauggaau

SEQ ID NO: 889759 - RNA, 13 nt, Homo sapiens
uugucauauguau

SEQ ID NO: 889760 - RNA, 22 nt, Homo sapiens
uugucauggaaaauguccugug

SEQ ID NO: 889761 - RNA, 20 nt, Homo sapiens
uugucauuauguacaauaca

SEQ ID NO: 889762 - RNA, 18 nt, Homo sapiens
uugucauucaagccugug

SEQ ID NO: 889763 - RNA, 13 nt, Homo sapiens
uugucauuuauaa

SEQ ID NO: 889764 - RNA, 15 nt, Homo sapiens
uugucgaguuuacuu

SEQ ID NO: 889765 - RNA, 10 nt, Homo sapiens
uugucucaag

SEQ ID NO: 889766 - RNA, 17 nt, Homo sapiens
uugucucugcaucucau

SEQ ID NO: 889767 - RNA, 18 nt, Homo sapiens
uugugaucuaucaauagu

SEQ ID NO: 889768 - RNA, 14 nt, Homo sapiens
uugugccaauaugu

SEQ ID NO: 889769 - RNA, 18 nt, Homo sapiens
uugugcuugcugguacua

SEQ ID NO: 889770 - RNA, 15 nt, Homo sapiens
uuguguccugaugaa

SEQ ID NO: 889771 - RNA, 16 nt, Homo sapiens
uugugugguggcaccu

SEQ ID NO: 889772 - RNA, 22 nt, Homo sapiens
uuguguguguguguugauccca

SEQ ID NO: 889773 - RNA, 13 nt, Homo sapiens
uuguguucucaaa

SEQ ID NO: 889774 - RNA, 21 nt, Homo sapiens
uuguuaaacacgugucuauaa

SEQ ID NO: 889775 - RNA, 12 nt, Homo sapiens
uuguuauuucag

SEQ ID NO: 889776 - RNA, 19 nt, Homo sapiens
uuguucgccgcguggaaug

SEQ ID NO: 889777 - RNA, 14 nt, Homo sapiens
uuguugcugucaag

SEQ ID NO: 889778 - RNA, 20 nt, Homo sapiens
uuguuuccauucuuguccug

SEQ ID NO: 889779 - RNA, 19 nt, Homo sapiens
uuguuugugaaacaaaaaa

SEQ ID NO: 889780 - RNA, 18 nt, Homo sapiens
uuguuuucauuaucucaa

SEQ ID NO: 889781 - RNA, 23 nt, Homo sapiens
uuguuuucccgagcaaagucuaa

SEQ ID NO: 889782 - RNA, 20 nt, Homo sapiens
uuguuuuuaaguccuguaua

SEQ ID NO: 889783 - RNA, 14 nt, Homo sapiens
uuuaaaaaaccaug

SEQ ID NO: 889784 - RNA, 16 nt, Homo sapiens
uuuaaaaaagcuuaaa

SEQ ID NO: 889785 - RNA, 12 nt, Homo sapiens
uuuaaaaaccaa

SEQ ID NO: 889786 - RNA, 13 nt, Homo sapiens
uuuaaaaagcuag

SEQ ID NO: 889787 - RNA, 17 nt, Homo sapiens
uuuaaaaguuucaaugu

SEQ ID NO: 889788 - RNA, 21 nt, Homo sapiens
uuuaaaaucauuucugcauca

SEQ ID NO: 889789 - RNA, 14 nt, Homo sapiens
uuuaaacauaggaa

SEQ ID NO: 889790 - RNA, 16 nt, Homo sapiens
uuuaaaccagcagaaa

SEQ ID NO: 889791 - RNA, 15 nt, Homo sapiens
uuuaaaccgcuaaaa

SEQ ID NO: 889792 - RNA, 16 nt, Homo sapiens
uuuaaacuauaagcaa

SEQ ID NO: 889793 - RNA, 14 nt, Homo sapiens
uuuaaauagaccuc

SEQ ID NO: 889794 - RNA, 20 nt, Homo sapiens
uuuaaaugaugauuccuuga

SEQ ID NO: 889795 - RNA, 15 nt, Homo sapiens
uuuaaauuauacugu

SEQ ID NO: 889796 - RNA, 17 nt, Homo sapiens
uuuaacaaaacaagaaa

SEQ ID NO: 889797 - RNA, 14 nt, Homo sapiens
uuuaacacuaaaaa

SEQ ID NO: 889798 - RNA, 16 nt, Homo sapiens
uuuaacccucucuucc

SEQ ID NO: 889799 - RNA, 15 nt, Homo sapiens
uuuaaccuacuagac

SEQ ID NO: 889800 - RNA, 18 nt, Homo sapiens
uuuaacuggcuucagccu

SEQ ID NO: 889801 - RNA, 12 nt, Homo sapiens
uuuaagaagcau

SEQ ID NO: 889802 - RNA, 12 nt, Homo sapiens
uuuaaggauaaa

SEQ ID NO: 889803 - RNA, 15 nt, Homo sapiens
uuuaaguaauuuugc

SEQ ID NO: 889804 - RNA, 15 nt, Homo sapiens
uuuaaguauauagua

SEQ ID NO: 889805 - RNA, 17 nt, Homo sapiens
uuuaauaaaaguacuga

SEQ ID NO: 889806 - RNA, 23 nt, Homo sapiens
guugucucucuaaacccaaauaa

SEQ ID NO: 889807 - RNA, 18 nt, Homo sapiens
guugugaaugucauucac

SEQ ID NO: 889808 - RNA, 15 nt, Homo sapiens
guuguucacauauau

SEQ ID NO: 889809 - RNA, 12 nt, Homo sapiens
guuguuguucuc

SEQ ID NO: 889810 - RNA, 24 nt, Homo sapiens
guuguuuucagacucagacuccau

SEQ ID NO: 889811 - RNA, 16 nt, Homo sapiens
guuuaaaaaaaguaua

SEQ ID NO: 889812 - RNA, 15 nt, Homo sapiens
guuuaaaaaccaaau

SEQ ID NO: 889813 - RNA, 23 nt, Homo sapiens
guuuaaaaaccaaauaagcaucu

SEQ ID NO: 889814 - RNA, 20 nt, Homo sapiens
guuuaaacauaggaaagaag

SEQ ID NO: 889815 - RNA, 12 nt, Homo sapiens
guuuaaagucaa

SEQ ID NO: 889816 - RNA, 12 nt, Homo sapiens
guuuacugcugu

SEQ ID NO: 889817 - RNA, 18 nt, Homo sapiens
guuuaggcauccugugug

SEQ ID NO: 889818 - RNA, 13 nt, Homo sapiens
guuuaugucauca

SEQ ID NO: 889819 - RNA, 14 nt, Homo sapiens
guuucaaaccagga

SEQ ID NO: 889820 - RNA, 14 nt, Homo sapiens
guuucaccauacuu

SEQ ID NO: 889821 - RNA, 20 nt, Homo sapiens
guuucagaauuuuguauauu

SEQ ID NO: 889822 - RNA, 19 nt, Homo sapiens
guuucaggacauggggcau

SEQ ID NO: 889823 - RNA, 18 nt, Homo sapiens
guuucaguugacaaaaua

SEQ ID NO: 889824 - RNA, 19 nt, Homo sapiens
guuucaucuguucauucac

SEQ ID NO: 889825 - RNA, 14 nt, Homo sapiens
guuucauucaucca

SEQ ID NO: 889826 - RNA, 16 nt, Homo sapiens
guuucauuguguguua

SEQ ID NO: 889827 - RNA, 13 nt, Homo sapiens
guuuccaguggau

SEQ ID NO: 889828 - RNA, 24 nt, Homo sapiens
guuuccauaggaaucauguuggau

SEQ ID NO: 889829 - RNA, 17 nt, Homo sapiens
guuucccauaauuuucu

SEQ ID NO: 889830 - RNA, 17 nt, Homo sapiens
guuucccguauugacag

SEQ ID NO: 889831 - RNA, 20 nt, Homo sapiens
guuucuagcuagaaauauga

SEQ ID NO: 889832 - RNA, 19 nt, Homo sapiens
guuucucccccugccaguc

SEQ ID NO: 889833 - RNA, 21 nt, Homo sapiens
guuucucuugaagaacugacu

SEQ ID NO: 889834 - RNA, 18 nt, Homo sapiens
uuuguuauuuuuccccaa

SEQ ID NO: 889835 - RNA, 15 nt, Homo sapiens
uuuguucacaugcau

SEQ ID NO: 889836 - RNA, 19 nt, Homo sapiens
uuuguucacuucgaugacu

SEQ ID NO: 889837 - RNA, 13 nt, Homo sapiens
uuuguucagagag

SEQ ID NO: 889838 - RNA, 18 nt, Homo sapiens
uuuuaaaaaaauucauca

SEQ ID NO: 889839 - RNA, 13 nt, Homo sapiens
uuuuaacaucuga

SEQ ID NO: 889840 - RNA, 12 nt, Homo sapiens
uuuuaacugcau

SEQ ID NO: 889841 - RNA, 18 nt, Homo sapiens
uuuuaagcuauauaggaa

SEQ ID NO: 889842 - RNA, 13 nt, Homo sapiens
uuuuaauguacaa

SEQ ID NO: 889843 - RNA, 12 nt, Homo sapiens
uuuuaauugauu

SEQ ID NO: 889844 - RNA, 16 nt, Homo sapiens
uuuuacuacuguggaa

SEQ ID NO: 889845 - RNA, 12 nt, Homo sapiens
uuuuagaguaug

SEQ ID NO: 889846 - RNA, 18 nt, Homo sapiens
uuuuagcgugcucacuga

SEQ ID NO: 889847 - RNA, 14 nt, Homo sapiens
uuuuagcuuuacaa

SEQ ID NO: 889848 - RNA, 16 nt, Homo sapiens
uuuuagggcuguagac

SEQ ID NO: 889849 - RNA, 18 nt, Homo sapiens
uuuuaguagacaguagga

SEQ ID NO: 889850 - RNA, 22 nt, Homo sapiens
uuuuauauauuaugucauucau

SEQ ID NO: 889851 - RNA, 21 nt, Homo sapiens
uuuuaucuuuaaucuccucuu

SEQ ID NO: 889852 - RNA, 18 nt, Homo sapiens
uuuuauuuccacauaaag

SEQ ID NO: 889853 - RNA, 21 nt, Homo sapiens
uuuuauuuuuaugugcucuca

SEQ ID NO: 889854 - RNA, 17 nt, Homo sapiens
uuuucaaaaaacauuaa

SEQ ID NO: 889855 - RNA, 17 nt, Homo sapiens
uuuucaaaacugcuaaa

SEQ ID NO: 889856 - RNA, 21 nt, Homo sapiens
uuuucaaagauguguugcuau

SEQ ID NO: 889857 - RNA, 19 nt, Homo sapiens
uuuucaaaugucagcuuaa

SEQ ID NO: 889858 - RNA, 20 nt, Homo sapiens
uuuucaaaugucagcuuaaa

SEQ ID NO: 889859 - RNA, 17 nt, Homo sapiens
uuuucaacaaguaacuu

SEQ ID NO: 889860 - RNA, 22 nt, Homo sapiens
uuuucaaguugagaacaaaaau

SEQ ID NO: 889861 - RNA, 22 nt, Homo sapiens
uuuucaauuuugcaugcucgau

SEQ ID NO: 889862 - RNA, 13 nt, Homo sapiens
uuuucacacugau

SEQ ID NO: 889863 - RNA, 21 nt, Homo sapiens
uuuucacugcuggcugccuua

SEQ ID NO: 889864 - RNA, 17 nt, Homo sapiens
uuuucagaguugcuuua

SEQ ID NO: 889865 - RNA, 12 nt, Homo sapiens
uuuucaguauga

SEQ ID NO: 889866 - RNA, 12 nt, Homo sapiens
uuuucauuucac

SEQ ID NO: 889867 - RNA, 22 nt, Homo sapiens
uuuuccuaaaaauaagcuuuau

SEQ ID NO: 889868 - RNA, 15 nt, Homo sapiens
uuuuccuccaggcaa

SEQ ID NO: 889869 - RNA, 13 nt, Homo sapiens
uuuucgaacauuc

SEQ ID NO: 889870 - RNA, 19 nt, Homo sapiens
uuuucguguaucucuaugu

SEQ ID NO: 889871 - RNA, 15 nt, Homo sapiens
uuuucuaacuguaaa

SEQ ID NO: 889872 - RNA, 21 nt, Homo sapiens
uuuucuaagguucucauagga

SEQ ID NO: 889873 - RNA, 16 nt, Homo sapiens
uuuucucugugcuuca

SEQ ID NO: 889874 - RNA, 19 nt, Homo sapiens
uuuucuggaauacaugaaa

SEQ ID NO: 889875 - RNA, 13 nt, Homo sapiens
uuuucuucaucug

SEQ ID NO: 889876 - RNA, 22 nt, Homo sapiens
uuuugaccaaauaaaguaccau

SEQ ID NO: 889877 - RNA, 16 nt, Homo sapiens
uuuugagagacagggu

SEQ ID NO: 889878 - RNA, 14 nt, Homo sapiens
uuuugagaguauau

SEQ ID NO: 889879 - RNA, 22 nt, Homo sapiens
uuuugaugugaaaaucaugaaa

SEQ ID NO: 889880 - RNA, 13 nt, Homo sapiens
uuuugcacugaca

SEQ ID NO: 889881 - RNA, 19 nt, Homo sapiens
uuuugguauuacacuguau

SEQ ID NO: 889882 - RNA, 22 nt, Homo sapiens
uuuuggugguccccacagccuc

SEQ ID NO: 889883 - RNA, 17 nt, Homo sapiens
uuuuuaacaggaauuua

SEQ ID NO: 889884 - RNA, 23 nt, Homo sapiens
uuuuuaauaaaaguacugaagac

SEQ ID NO: 889885 - RNA, 17 nt, Homo sapiens
uuuuuacaguuaugcau

SEQ ID NO: 889886 - RNA, 12 nt, Homo sapiens
uuuuuacuauua

SEQ ID NO: 889887 - RNA, 18 nt, Homo sapiens
uuuuuacugugcauacau

SEQ ID NO: 889888 - RNA, 15 nt, Homo sapiens
uuuuuacuuccacag

SEQ ID NO: 889889 - RNA, 10 nt, Homo sapiens
uuuuuaguuu

SEQ ID NO: 889890 - RNA, 17 nt, Homo sapiens
uuuuuauucuccuccuc

SEQ ID NO: 889891 - RNA, 19 nt, Homo sapiens
uuuuucaagaaaacuggaa

SEQ ID NO: 889892 - RNA, 22 nt, Homo sapiens
uuuuuccucccuuucccugaga

SEQ ID NO: 889893 - RNA, 16 nt, Homo sapiens
uuuuucuaagguucuc

SEQ ID NO: 889894 - RNA, 12 nt, Homo sapiens
uuuuugcuaaac

SEQ ID NO: 889895 - RNA, 14 nt, Homo sapiens
uuuuuguacacauc

SEQ ID NO: 889896 - RNA, 19 nt, Homo sapiens
uuuuuuaaauaaaagcagc

SEQ ID NO: 889897 - RNA, 14 nt, Homo sapiens
uaagaaccugaaua

SEQ ID NO: 889898 - RNA, 20 nt, Homo sapiens
uaagaagaaugcuuaaucag

SEQ ID NO: 889899 - RNA, 17 nt, Homo sapiens
uaagaaucauagugcca

SEQ ID NO: 889900 - RNA, 17 nt, Homo sapiens
uaagaccauaacagcca

SEQ ID NO: 889901 - RNA, 14 nt, Homo sapiens
uaagacucauuccc

SEQ ID NO: 889902 - RNA, 21 nt, Homo sapiens
uaagaggauagaauacaugga

SEQ ID NO: 889903 - RNA, 14 nt, Homo sapiens
uaagaggcagugag

SEQ ID NO: 889904 - RNA, 16 nt, Homo sapiens
uaagaggcagugagau

SEQ ID NO: 889905 - RNA, 24 nt, Homo sapiens
uaagaguggaaccaacacuaacau

SEQ ID NO: 889906 - RNA, 13 nt, Homo sapiens
uaagaguuacuua

SEQ ID NO: 889907 - RNA, 15 nt, Homo sapiens
uaagaguuguaugaa

SEQ ID NO: 889908 - RNA, 14 nt, Homo sapiens
uaagauacacuccu

SEQ ID NO: 889909 - RNA, 22 nt, Homo sapiens
uaagccaacuuuaauugcuuaa

SEQ ID NO: 889910 - RNA, 15 nt, Homo sapiens
uaagccuuuccauaa

SEQ ID NO: 889911 - RNA, 16 nt, Homo sapiens
uaagcuaucuucaaau

SEQ ID NO: 889912 - RNA, 19 nt, Homo sapiens
uaagcucccagggccuguc

SEQ ID NO: 889913 - RNA, 11 nt, Homo sapiens
uaagcuuuauu

SEQ ID NO: 889914 - RNA, 17 nt, Homo sapiens
uaaggacauuaaaagcu

SEQ ID NO: 889915 - RNA, 21 nt, Homo sapiens
uaaggacauuaaaagcuauca

SEQ ID NO: 889916 - RNA, 15 nt, Homo sapiens
uaaggauugugauau

SEQ ID NO: 889917 - RNA, 23 nt, Homo sapiens
uaagggccacaucccacugccac

SEQ ID NO: 889918 - RNA, 21 nt, Homo sapiens
uaagggcuggucucugcugaa

SEQ ID NO: 889919 - RNA, 15 nt, Homo sapiens
uaagggucuguugua

SEQ ID NO: 889920 - RNA, 20 nt, Homo sapiens
uaaggucacauugugccuuu

SEQ ID NO: 889921 - RNA, 23 nt, Homo sapiens
uaagguguugguguauuugccag

SEQ ID NO: 889922 - RNA, 14 nt, Homo sapiens
uaaguaaaccaaaa

SEQ ID NO: 889923 - RNA, 15 nt, Homo sapiens
uaaguaaaccaaaaa

SEQ ID NO: 889924 - RNA, 17 nt, Homo sapiens
uacaggugugagucacc

SEQ ID NO: 889925 - RNA, 13 nt, Homo sapiens
uacaguagugcau

SEQ ID NO: 889926 - RNA, 16 nt, Homo sapiens
uacaguguauguacua

SEQ ID NO: 889927 - RNA, 20 nt, Homo sapiens
uacaguguauguacuaagca

SEQ ID NO: 889928 - RNA, 20 nt, Homo sapiens
uacauaaaggugguaugugu

SEQ ID NO: 889929 - RNA, 18 nt, Homo sapiens
uacauaaaguacauaaca

SEQ ID NO: 889930 - RNA, 15 nt, Homo sapiens
uacauacagagguaa

SEQ ID NO: 889931 - RNA, 20 nt, Homo sapiens
uacauauaauaaacuuuuca

SEQ ID NO: 889932 - RNA, 15 nt, Homo sapiens
uacauauguagacua

SEQ ID NO: 889933 - RNA, 24 nt, Homo sapiens
uacaucaccuuuuugacuuuucca

SEQ ID NO: 889934 - RNA, 18 nt, Homo sapiens
uacauccagaaagaagga

SEQ ID NO: 889935 - RNA, 15 nt, Homo sapiens
uacaucuucagcucc

SEQ ID NO: 889936 - RNA, 15 nt, Homo sapiens
uacaugaauugcauu

SEQ ID NO: 889937 - RNA, 20 nt, Homo sapiens
uacaugcauuacugcaugca

SEQ ID NO: 889938 - RNA, 23 nt, Homo sapiens
uacaugcauuacugcaugcacuu

SEQ ID NO: 889939 - RNA, 13 nt, Homo sapiens
uacauguaucuaa

SEQ ID NO: 889940 - RNA, 19 nt, Homo sapiens
uacauguguggauguguaa

SEQ ID NO: 889941 - RNA, 24 nt, Homo sapiens
uacauucccuaucaaaacauauca

SEQ ID NO: 889942 - RNA, 17 nt, Homo sapiens
uacauucccugcaucca

SEQ ID NO: 889943 - RNA, 12 nt, Homo sapiens
uacauucccugg

SEQ ID NO: 889944 - RNA, 17 nt, Homo sapiens
uacauuccucagcugcc

SEQ ID NO: 889945 - RNA, 13 nt, Homo sapiens
uacauugaucaag

SEQ ID NO: 889946 - RNA, 18 nt, Homo sapiens
uacauugccaauuuucca

SEQ ID NO: 889947 - RNA, 15 nt, Homo sapiens
uacauuucuguucau

SEQ ID NO: 889948 - RNA, 10 nt, Homo sapiens
uaccaaauau

SEQ ID NO: 889949 - RNA, 19 nt, Homo sapiens
uaccaaauccacaagccau

SEQ ID NO: 889950 - RNA, 16 nt, Homo sapiens
uaccaaaugagcauua

SEQ ID NO: 889951 - RNA, 18 nt, Homo sapiens
uaccaagccccuuggccc

SEQ ID NO: 889952 - RNA, 12 nt, Homo sapiens
uaccaaggccca

SEQ ID NO: 889953 - RNA, 22 nt, Homo sapiens
uaccacagaaguucaauacuca

SEQ ID NO: 889954 - RNA, 21 nt, Homo sapiens
uaccacguuacugcauacuga

SEQ ID NO: 889955 - RNA, 14 nt, Homo sapiens
uaccagauauuuga

SEQ ID NO: 889956 - RNA, 23 nt, Homo sapiens
uaccagcagugugucaggugcug

SEQ ID NO: 889957 - RNA, 21 nt, Homo sapiens
uaccagcuaacuccagucucc

SEQ ID NO: 889958 - RNA, 18 nt, Homo sapiens
uaccagugaaccaaagag

SEQ ID NO: 889959 - RNA, 17 nt, Homo sapiens
uaccauauacagcucag

SEQ ID NO: 889960 - RNA, 14 nt, Homo sapiens
uaccaucuaaucua

SEQ ID NO: 889961 - RNA, 13 nt, Homo sapiens
uaccaugcugcuu

SEQ ID NO: 889962 - RNA, 23 nt, Homo sapiens
uacccagagaauauauacauucu

SEQ ID NO: 889963 - RNA, 19 nt, Homo sapiens
uacccauucuucagugccu

SEQ ID NO: 889964 - RNA, 20 nt, Homo sapiens
uacccccugaaagugacaga

SEQ ID NO: 889965 - RNA, 22 nt, Homo sapiens
uaccccugcuaaggaguucuca

SEQ ID NO: 889966 - RNA, 18 nt, Homo sapiens
uaccccuguuaagcaauu

SEQ ID NO: 889967 - RNA, 18 nt, Homo sapiens
uacccuguaacaugcaau

SEQ ID NO: 889968 - RNA, 21 nt, Homo sapiens
uacccuucuuuaaaucaaaag

SEQ ID NO: 889969 - RNA, 18 nt, Homo sapiens
uaccgcgucuacccuggg

SEQ ID NO: 889970 - RNA, 20 nt, Homo sapiens
uaccucccccugccuuccaa

SEQ ID NO: 889971 - RNA, 17 nt, Homo sapiens
uaccuccuguguggaag

SEQ ID NO: 889972 - RNA, 13 nt, Homo sapiens
uaccucucucuuc

SEQ ID NO: 889973 - RNA, 16 nt, Homo sapiens
uaccucuucaguaggu

SEQ ID NO: 889974 - RNA, 18 nt, Homo sapiens
uaccugaccaacaguucc

SEQ ID NO: 889975 - RNA, 13 nt, Homo sapiens
uaccugagcauuc

SEQ ID NO: 889976 - RNA, 21 nt, Homo sapiens
uaccugcauguguuguacaau

SEQ ID NO: 889977 - RNA, 17 nt, Homo sapiens
uaccugcccucucucag

SEQ ID NO: 889978 - RNA, 17 nt, Homo sapiens
uaccugcgauguuuacg

SEQ ID NO: 889979 - RNA, 11 nt, Homo sapiens
uaccugggaaa

SEQ ID NO: 889980 - RNA, 20 nt, Homo sapiens
uaccuguggugauguugcca

SEQ ID NO: 889981 - RNA, 22 nt, Homo sapiens
uaccuuaaaauguaaaacaaaa

SEQ ID NO: 889982 - RNA, 19 nt, Homo sapiens
uaccuuccuuaagccagga

SEQ ID NO: 889983 - RNA, 17 nt, Homo sapiens
uaccuugaacacugggg

SEQ ID NO: 889984 - RNA, 21 nt, Homo sapiens
uacgcucauuguagaaaagcu

SEQ ID NO: 889985 - RNA, 14 nt, Homo sapiens
uacgcucucugucu

SEQ ID NO: 889986 - RNA, 15 nt, Homo sapiens
uacgguggucuuuga

SEQ ID NO: 889987 - RNA, 20 nt, Homo sapiens
uacguuuccugagaaguguc

SEQ ID NO: 889988 - RNA, 17 nt, Homo sapiens
uacuaaaaaucaugaga

SEQ ID NO: 889989 - RNA, 23 nt, Homo sapiens
uacuaagccacaagaaauuugau

SEQ ID NO: 889990 - RNA, 15 nt, Homo sapiens
uacuaaggagcauga

SEQ ID NO: 889991 - RNA, 13 nt, Homo sapiens
uacuaaugugccc

SEQ ID NO: 889992 - RNA, 17 nt, Homo sapiens
uacuacccgagcccagc

SEQ ID NO: 889993 - RNA, 19 nt, Homo sapiens
uacuaguuuuccuugaaaa

SEQ ID NO: 889994 - RNA, 17 nt, Homo sapiens
uacuaucucuugucaua

SEQ ID NO: 889995 - RNA, 20 nt, Homo sapiens
uacuauuauauuauguaguc

SEQ ID NO: 889996 - RNA, 16 nt, Homo sapiens
uacuauuugaagcaau

SEQ ID NO: 889997 - RNA, 23 nt, Homo sapiens
uacucaaggaauuugcauuuagu

SEQ ID NO: 889998 - RNA, 22 nt, Homo sapiens
uacucagacuguugcacucuaa

SEQ ID NO: 889999 - RNA, 23 nt, Homo sapiens
uacucauuuggaaaugcuacaaa

SEQ ID NO: 890000 - RNA, 19 nt, Homo sapiens
uacucuauguaugcaucua

SEQ ID NO: 890001 - RNA, 10 nt, Homo sapiens
uacucucuua

SEQ ID NO: 890002 - RNA, 20 nt, Homo sapiens
uacucuggagagacugugcu

SEQ ID NO: 890003 - RNA, 15 nt, Homo sapiens
uacugaacacuucaa

SEQ ID NO: 890004 - RNA, 20 nt, Homo sapiens
uacugagacaugacuaggaa

SEQ ID NO: 890005 - RNA, 14 nt, Homo sapiens
uacugagagcaugu

SEQ ID NO: 890006 - RNA, 17 nt, Homo sapiens
uacugaugauguagaua

SEQ ID NO: 890007 - RNA, 17 nt, Homo sapiens
uacugcaugcucaggac

SEQ ID NO: 890008 - RNA, 17 nt, Homo sapiens
uacugccggucacccag

SEQ ID NO: 890009 - RNA, 13 nt, Homo sapiens
uacugccuagaaa

SEQ ID NO: 890010 - RNA, 19 nt, Homo sapiens
uacugcuagauaucacuua

SEQ ID NO: 890011 - RNA, 19 nt, Homo sapiens
uacugcuucuuuucacuuc

SEQ ID NO: 890012 - RNA, 14 nt, Homo sapiens
ucaugauaaucugg

SEQ ID NO: 890013 - RNA, 13 nt, Homo sapiens
ucaugauucacaa

SEQ ID NO: 890014 - RNA, 23 nt, Homo sapiens
ucaugauuucaaugauuguuuaa

SEQ ID NO: 890015 - RNA, 14 nt, Homo sapiens
ucaugcauuugcac

SEQ ID NO: 890016 - RNA, 23 nt, Homo sapiens
ucaugcucagcccugacuggugc

SEQ ID NO: 890017 - RNA, 20 nt, Homo sapiens
ucaugcuuuaaaguguaaua

SEQ ID NO: 890018 - RNA, 17 nt, Homo sapiens
ucauggaaaagcccagu

SEQ ID NO: 890019 - RNA, 20 nt, Homo sapiens
ucauggacagauagacagug

SEQ ID NO: 890020 - RNA, 15 nt, Homo sapiens
ucauggguacccaga

SEQ ID NO: 890021 - RNA, 15 nt, Homo sapiens
ucauggugcacugag

SEQ ID NO: 890022 - RNA, 17 nt, Homo sapiens
ucaugguguccagacag

SEQ ID NO: 890023 - RNA, 19 nt, Homo sapiens
ucauguaaccaagaguauu

SEQ ID NO: 890024 - RNA, 16 nt, Homo sapiens
ucauguacauuggucu

SEQ ID NO: 890025 - RNA, 13 nt, Homo sapiens
ucauguacuuccu

SEQ ID NO: 890026 - RNA, 15 nt, Homo sapiens
ucaugugaaaauaau

SEQ ID NO: 890027 - RNA, 15 nt, Homo sapiens
ucaugugauccuuuu

SEQ ID NO: 890028 - RNA, 13 nt, Homo sapiens
ucauguucuugca

SEQ ID NO: 890029 - RNA, 21 nt, Homo sapiens
ucauguugaagccacugccuu

SEQ ID NO: 890030 - RNA, 18 nt, Homo sapiens
ucauuacuaaccauaguu

SEQ ID NO: 890031 - RNA, 23 nt, Homo sapiens
ucauuagaggaagaaaaccagcg

SEQ ID NO: 890032 - RNA, 14 nt, Homo sapiens
ucccauccaucagc

SEQ ID NO: 890033 - RNA, 14 nt, Homo sapiens
ucccaugauccaga

SEQ ID NO: 890034 - RNA, 17 nt, Homo sapiens
ucccauguugcaugccu

SEQ ID NO: 890035 - RNA, 22 nt, Homo sapiens
ucccauuuguaauguaucuuau

SEQ ID NO: 890036 - RNA, 14 nt, Homo sapiens
uccccaaacugugc

SEQ ID NO: 890037 - RNA, 21 nt, Homo sapiens
uccccaagcuggcagcuguca

SEQ ID NO: 890038 - RNA, 22 nt, Homo sapiens
uccccaauuaucuuauuuaauu

SEQ ID NO: 890039 - RNA, 20 nt, Homo sapiens
uccccacaccucccuacucc

SEQ ID NO: 890040 - RNA, 14 nt, Homo sapiens
uccccacauaccau

SEQ ID NO: 890041 - RNA, 18 nt, Homo sapiens
uccccacauauggcacaa

SEQ ID NO: 890042 - RNA, 20 nt, Homo sapiens
uccccaccuuccccagacuc

SEQ ID NO: 890043 - RNA, 18 nt, Homo sapiens
uccccagcaccuuccuga

SEQ ID NO: 890044 - RNA, 23 nt, Homo sapiens
uccccagcccuggcucugcaaug

SEQ ID NO: 890045 - RNA, 18 nt, Homo sapiens
uccccaggggaaaaugaa

SEQ ID NO: 890046 - RNA, 19 nt, Homo sapiens
uccccaucuggguccuugc

SEQ ID NO: 890047 - RNA, 15 nt, Homo sapiens
uccccccucacucca

SEQ ID NO: 890048 - RNA, 17 nt, Homo sapiens
ucccccgacacugcugc

SEQ ID NO: 890049 - RNA, 22 nt, Homo sapiens
uccccuagcuuuccccagacac

SEQ ID NO: 890050 - RNA, 15 nt, Homo sapiens
uccccuccucacagu

SEQ ID NO: 890051 - RNA, 23 nt, Homo sapiens
uccccuggggucucugcugcauu

SEQ ID NO: 890052 - RNA, 19 nt, Homo sapiens
ucccgggagaggagaucag

SEQ ID NO: 890053 - RNA, 20 nt, Homo sapiens
ucccuaaaauaaaaaccaga

SEQ ID NO: 890054 - RNA, 13 nt, Homo sapiens
ucccuaacaucau

SEQ ID NO: 890055 - RNA, 16 nt, Homo sapiens
ucccuaacaucaugca

SEQ ID NO: 890056 - RNA, 23 nt, Homo sapiens
ucccuacccacucuuugcuacaa

SEQ ID NO: 890057 - RNA, 19 nt, Homo sapiens
ucccucaaaugacccaaag

SEQ ID NO: 890058 - RNA, 13 nt, Homo sapiens
ucccucaacccca

SEQ ID NO: 890059 - RNA, 19 nt, Homo sapiens
ucccucaugagcacagggu

SEQ ID NO: 890060 - RNA, 21 nt, Homo sapiens
ucccucccgggggcacugccu

SEQ ID NO: 890061 - RNA, 15 nt, Homo sapiens
ucccuccucacuugc

SEQ ID NO: 890062 - RNA, 17 nt, Homo sapiens
ucccuccuuauuuuuga

SEQ ID NO: 890063 - RNA, 22 nt, Homo sapiens
ucccucuucuucucccugugug

SEQ ID NO: 890064 - RNA, 14 nt, Homo sapiens
ucccucuuugccug

SEQ ID NO: 890065 - RNA, 16 nt, Homo sapiens
ucccugcuaccaaggc

SEQ ID NO: 890066 - RNA, 16 nt, Homo sapiens
ucccugcuuaccugac

SEQ ID NO: 890067 - RNA, 19 nt, Homo sapiens
ucccugcuuugaggacaaa

SEQ ID NO: 890068 - RNA, 14 nt, Homo sapiens
ucccuggaccucug

SEQ ID NO: 890069 - RNA, 16 nt, Homo sapiens
ucccuggaucagaaca

SEQ ID NO: 890070 - RNA, 20 nt, Homo sapiens
ucccugggccugcugcugag

SEQ ID NO: 890071 - RNA, 23 nt, Homo sapiens
ucccuggggucacaugcuuuguu

SEQ ID NO: 890072 - RNA, 16 nt, Homo sapiens
ucccuguguggcugcu

SEQ ID NO: 890073 - RNA, 17 nt, Homo sapiens
ucccuguuaucugcuag

SEQ ID NO: 890074 - RNA, 14 nt, Homo sapiens
ucccuguuccucaa

SEQ ID NO: 890075 - RNA, 12 nt, Homo sapiens
ucccuuccugac

SEQ ID NO: 890076 - RNA, 14 nt, Homo sapiens
ucccuucuucccua

SEQ ID NO: 890077 - RNA, 17 nt, Homo sapiens
ucccuucuucccuagcc

SEQ ID NO: 890078 - RNA, 17 nt, Homo sapiens
ucccuugcucagugccu

SEQ ID NO: 890079 - RNA, 17 nt, Homo sapiens
ucccuuggcagaguaug

SEQ ID NO: 890080 - RNA, 14 nt, Homo sapiens
ucccuuuccuccac

SEQ ID NO: 890081 - RNA, 16 nt, Homo sapiens
uccgacugcuagggag

SEQ ID NO: 890082 - RNA, 13 nt, Homo sapiens
uccgaguguuugc

SEQ ID NO: 890083 - RNA, 15 nt, Homo sapiens
uccgcaccagcugcu

SEQ ID NO: 890084 - RNA, 16 nt, Homo sapiens
uccgccaaacacucca

SEQ ID NO: 890085 - RNA, 13 nt, Homo sapiens
uccgccauuccaa

SEQ ID NO: 890086 - RNA, 20 nt, Homo sapiens
uccgccauuccaagucaaca

SEQ ID NO: 890087 - RNA, 12 nt, Homo sapiens
uccggcugccuc

SEQ ID NO: 890088 - RNA, 23 nt, Homo sapiens
uccggguggaaaagaaucccugc

SEQ ID NO: 890089 - RNA, 23 nt, Homo sapiens
uccggugucuggaaaagcacuuu

SEQ ID NO: 890090 - RNA, 20 nt, Homo sapiens
uccguaaacauauaucuuac

SEQ ID NO: 890091 - RNA, 13 nt, Homo sapiens
uccguacauucaa

SEQ ID NO: 890092 - RNA, 14 nt, Homo sapiens
uccgucaccucaga

SEQ ID NO: 890093 - RNA, 19 nt, Homo sapiens
uccgucucaaaaaaagggc

SEQ ID NO: 890094 - RNA, 16 nt, Homo sapiens
uccuaaaugcagugaa

SEQ ID NO: 890095 - RNA, 18 nt, Homo sapiens
uccuaacccccuuacugu

SEQ ID NO: 890096 - RNA, 23 nt, Homo sapiens
uccuaagccuguugcugaaguca

SEQ ID NO: 890097 - RNA, 16 nt, Homo sapiens
uccuacaaaauggagg

SEQ ID NO: 890098 - RNA, 16 nt, Homo sapiens
uccuacaguggcuguc

SEQ ID NO: 890099 - RNA, 17 nt, Homo sapiens
uccuacaguggcuguca

SEQ ID NO: 890100 - RNA, 19 nt, Homo sapiens
uccuaccuauauuacacaa

SEQ ID NO: 890101 - RNA, 14 nt, Homo sapiens
uccuacuacuuugu

SEQ ID NO: 890102 - RNA, 17 nt, Homo sapiens
uccuacucagacuguug

SEQ ID NO: 890103 - RNA, 18 nt, Homo sapiens
uccuacucagacuguugc

SEQ ID NO: 890104 - RNA, 16 nt, Homo sapiens
uccuacugauguuccu

SEQ ID NO: 890105 - RNA, 19 nt, Homo sapiens
uccuauuaaaacacagcuu

SEQ ID NO: 890106 - RNA, 15 nt, Homo sapiens
uccuauuauguguuc

SEQ ID NO: 890107 - RNA, 17 nt, Homo sapiens
uccuauucuauugcagu

SEQ ID NO: 890108 - RNA, 19 nt, Homo sapiens
uccucaagggccaggacuu

SEQ ID NO: 890109 - RNA, 22 nt, Homo sapiens
uccucaauucaauguggugaug

SEQ ID NO: 890110 - RNA, 21 nt, Homo sapiens
uccucaucaguagaugguacg

SEQ ID NO: 890111 - RNA, 20 nt, Homo sapiens
uccucauuuauaaaauaaug

SEQ ID NO: 890112 - RNA, 17 nt, Homo sapiens
uccuccacaauagcaga

SEQ ID NO: 890113 - RNA, 18 nt, Homo sapiens
uccuccacagugcugcuu

SEQ ID NO: 890114 - RNA, 16 nt, Homo sapiens
uccuccacucacucca

SEQ ID NO: 890115 - RNA, 18 nt, Homo sapiens
uccuccacuccaccucca

SEQ ID NO: 890116 - RNA, 22 nt, Homo sapiens
uccuccagaccccuguggcaga

SEQ ID NO: 890117 - RNA, 16 nt, Homo sapiens
uccuccaucuuagaua

SEQ ID NO: 890118 - RNA, 19 nt, Homo sapiens
uccucccaaaauacuacac

SEQ ID NO: 890119 - RNA, 14 nt, Homo sapiens
uccucccaccucag

SEQ ID NO: 890120 - RNA, 15 nt, Homo sapiens
uccucccaccucagc

SEQ ID NO: 890121 - RNA, 15 nt, Homo sapiens
uccuccccucuugag

SEQ ID NO: 890122 - RNA, 22 nt, Homo sapiens
uccucccuuguggcuuccucag

SEQ ID NO: 890123 - RNA, 19 nt, Homo sapiens
uccuccgucaccucagaga

SEQ ID NO: 890124 - RNA, 22 nt, Homo sapiens
uccuccuacuucccuuuccucc

SEQ ID NO: 890125 - RNA, 14 nt, Homo sapiens
uccuccuguguaca

SEQ ID NO: 890126 - RNA, 14 nt, Homo sapiens
uccuccuuugccua

SEQ ID NO: 890127 - RNA, 18 nt, Homo sapiens
uccucgggggaaagcaca

SEQ ID NO: 890128 - RNA, 20 nt, Homo sapiens
cugccuuccaggagcaauuu

SEQ ID NO: 890129 - RNA, 13 nt, Homo sapiens
cugccuugaugaa

SEQ ID NO: 890130 - RNA, 16 nt, Homo sapiens
cugcgacgcaggugua

SEQ ID NO: 890131 - RNA, 14 nt, Homo sapiens
cugcgagcauuucc

SEQ ID NO: 890132 - RNA, 19 nt, Homo sapiens
cugcgccggguaccaugga

SEQ ID NO: 890133 - RNA, 23 nt, Homo sapiens
cugcgggcaccagaaugcuaaag

SEQ ID NO: 890134 - RNA, 22 nt, Homo sapiens
cugcgucgaagcuuugaaggcc

SEQ ID NO: 890135 - RNA, 14 nt, Homo sapiens
cugcuaaauacugu

SEQ ID NO: 890136 - RNA, 17 nt, Homo sapiens
cugcuaaggcugccuca

SEQ ID NO: 890137 - RNA, 20 nt, Homo sapiens
cugcuacacaaaagccaaaa

SEQ ID NO: 890138 - RNA, 13 nt, Homo sapiens
cugcuaccaaggc

SEQ ID NO: 890139 - RNA, 13 nt, Homo sapiens
cugcucaaguuga

SEQ ID NO: 890140 - RNA, 18 nt, Homo sapiens
cugcucguccccaaguga

SEQ ID NO: 890141 - RNA, 12 nt, Homo sapiens
cugcucucaugc

SEQ ID NO: 890142 - RNA, 12 nt, Homo sapiens
cugcucugcuau

SEQ ID NO: 890143 - RNA, 18 nt, Homo sapiens
cugcucuggaaaauguga

SEQ ID NO: 890144 - RNA, 15 nt, Homo sapiens
cugcucuuaggugcu

SEQ ID NO: 890145 - RNA, 18 nt, Homo sapiens
cugcugaaacaacaaaua

SEQ ID NO: 890146 - RNA, 13 nt, Homo sapiens
cugcugacagugu

SEQ ID NO: 890147 - RNA, 14 nt, Homo sapiens
cugcugaucaauga

SEQ ID NO: 890148 - RNA, 22 nt, Homo sapiens
cugcugcggugucacugggcua

SEQ ID NO: 890149 - RNA, 14 nt, Homo sapiens
cugcugcuaaggcu

SEQ ID NO: 890150 - RNA, 18 nt, Homo sapiens
cugcugcugaccugauca

SEQ ID NO: 890151 - RNA, 13 nt, Homo sapiens
cugcugcugagaa

SEQ ID NO: 890152 - RNA, 12 nt, Homo sapiens
cugcuguauacu

SEQ ID NO: 890153 - RNA, 19 nt, Homo sapiens
cugcugucaccuugcucag

SEQ ID NO: 890154 - RNA, 21 nt, Homo sapiens
cugcugugcccucccauagca

SEQ ID NO: 890155 - RNA, 21 nt, Homo sapiens
cugcuguugcuggacugagga

SEQ ID NO: 890156 - RNA, 13 nt, Homo sapiens
cugcuuacuaaug

SEQ ID NO: 890157 - RNA, 11 nt, Homo sapiens
cugcuucucag

SEQ ID NO: 890158 - RNA, 16 nt, Homo sapiens
cugcuuguauuuucca

SEQ ID NO: 890159 - RNA, 13 nt, Homo sapiens
cugcuuguuggcu

SEQ ID NO: 890160 - RNA, 20 nt, Homo sapiens
cugcuuuucuucccagcaaa

SEQ ID NO: 890161 - RNA, 21 nt, Homo sapiens
cugcuuuuuccagauucuucc

SEQ ID NO: 890162 - RNA, 16 nt, Homo sapiens
cuggaaaacucaggau

SEQ ID NO: 890163 - RNA, 18 nt, Homo sapiens
cuggaaaacucaggauuc

SEQ ID NO: 890164 - RNA, 22 nt, Homo sapiens
cuggaaaacucaggauucucac

SEQ ID NO: 890165 - RNA, 15 nt, Homo sapiens
cuggaaaacugccuu

SEQ ID NO: 890166 - RNA, 22 nt, Homo sapiens
cuggaaaccacacuucuugaaa

SEQ ID NO: 890167 - RNA, 20 nt, Homo sapiens
cuggaacugucucucaugaa

SEQ ID NO: 890168 - RNA, 23 nt, Homo sapiens
cuggaagaaggaagaagccagac

SEQ ID NO: 890169 - RNA, 17 nt, Homo sapiens
cuggaaggggcaaagaa

SEQ ID NO: 890170 - RNA, 12 nt, Homo sapiens
cuggaaguagaa

SEQ ID NO: 890171 - RNA, 14 nt, Homo sapiens
cuggaauacaugaa

SEQ ID NO: 890172 - RNA, 21 nt, Homo sapiens
cuggaaucaaggaauccugag

SEQ ID NO: 890173 - RNA, 16 nt, Homo sapiens
cuggaauggaauucag

SEQ ID NO: 890174 - RNA, 20 nt, Homo sapiens
cuggaauguaaucaauguuu

SEQ ID NO: 890175 - RNA, 15 nt, Homo sapiens
cuggaccacugggca

SEQ ID NO: 890176 - RNA, 16 nt, Homo sapiens
cuggagaugaugauga

SEQ ID NO: 890177 - RNA, 19 nt, Homo sapiens
cuggagcuggcuuugccaa

SEQ ID NO: 890178 - RNA, 17 nt, Homo sapiens
cuggaggaguuccuuga

SEQ ID NO: 890179 - RNA, 20 nt, Homo sapiens
cuggagggcuagaaucugga

SEQ ID NO: 890180 - RNA, 13 nt, Homo sapiens
cuggagugcagug

SEQ ID NO: 890181 - RNA, 20 nt, Homo sapiens
cuggaguggaguggcacgau

SEQ ID NO: 890182 - RNA, 15 nt, Homo sapiens
cuggaucuaucugua

SEQ ID NO: 890183 - RNA, 20 nt, Homo sapiens
cuggaucucacaagcacuuu

SEQ ID NO: 890184 - RNA, 19 nt, Homo sapiens
cuggaugagacuuccaaac

SEQ ID NO: 890185 - RNA, 12 nt, Homo sapiens
cuggaugcgugc

SEQ ID NO: 890186 - RNA, 13 nt, Homo sapiens
cuggaugucucca

SEQ ID NO: 890187 - RNA, 19 nt, Homo sapiens
cuggcaauguuuauuucau

SEQ ID NO: 890188 - RNA, 16 nt, Homo sapiens
cuggcacccaauguuu

SEQ ID NO: 890189 - RNA, 18 nt, Homo sapiens
cuggcacuuagcccaaga

SEQ ID NO: 890190 - RNA, 21 nt, Homo sapiens
cuggcagagcccccaaggacu

SEQ ID NO: 890191 - RNA, 14 nt, Homo sapiens
cuggcauggugcuu

SEQ ID NO: 890192 - RNA, 12 nt, Homo sapiens
cuggccagagag

SEQ ID NO: 890193 - RNA, 17 nt, Homo sapiens
cuggccuugucaggacc

SEQ ID NO: 890194 - RNA, 13 nt, Homo sapiens
cuggcuccagaau

SEQ ID NO: 890195 - RNA, 13 nt, Homo sapiens
cuggcugagcuga

SEQ ID NO: 890196 - RNA, 14 nt, Homo sapiens
cuggcugucuuccc

SEQ ID NO: 890197 - RNA, 23 nt, Homo sapiens
cugggaaaaaaguuuugaugaaa

SEQ ID NO: 890198 - RNA, 16 nt, Homo sapiens
cugggaacuuccucag

SEQ ID NO: 890199 - RNA, 16 nt, Homo sapiens
cugggauaugacaagc

SEQ ID NO: 890200 - RNA, 15 nt, Homo sapiens
cugggauuacaggug

SEQ ID NO: 890201 - RNA, 19 nt, Homo sapiens
uacuucauuuucagaguga

SEQ ID NO: 890202 - RNA, 23 nt, Homo sapiens
uacuucccuuuccuccacucccc

SEQ ID NO: 890203 - RNA, 18 nt, Homo sapiens
uacuucggggcugggaag

SEQ ID NO: 890204 - RNA, 12 nt, Homo sapiens
uacuucucacca

SEQ ID NO: 890205 - RNA, 19 nt, Homo sapiens
uacuugaaauaccagugaa

SEQ ID NO: 890206 - RNA, 22 nt, Homo sapiens
uacuugaaauaccagugaacca

SEQ ID NO: 890207 - RNA, 14 nt, Homo sapiens
uacuugcacaagcu

SEQ ID NO: 890208 - RNA, 17 nt, Homo sapiens
uacuugccacacacugu

SEQ ID NO: 890209 - RNA, 14 nt, Homo sapiens
uacuuguggacaca

SEQ ID NO: 890210 - RNA, 21 nt, Homo sapiens
uacuuguuucaccauacuuca

SEQ ID NO: 890211 - RNA, 17 nt, Homo sapiens
uacuuguuuucacuuua

SEQ ID NO: 890212 - RNA, 21 nt, Homo sapiens
uacuuuauguuacuacaugca

SEQ ID NO: 890213 - RNA, 17 nt, Homo sapiens
uacuuucuguugccaca

SEQ ID NO: 890214 - RNA, 20 nt, Homo sapiens
uacuuuucagaauugaagga

SEQ ID NO: 890215 - RNA, 17 nt, Homo sapiens
uacuuuuuauacuccau

SEQ ID NO: 890216 - RNA, 12 nt, Homo sapiens
uacuuuuugccc

SEQ ID NO: 890217 - RNA, 13 nt, Homo sapiens
uagaaaaacuugg

SEQ ID NO: 890218 - RNA, 17 nt, Homo sapiens
uagaaaauuuucuaguc

SEQ ID NO: 890219 - RNA, 22 nt, Homo sapiens
uagaaagaauguguugccuccu

SEQ ID NO: 890220 - RNA, 14 nt, Homo sapiens
uagaaaguucaaaa

SEQ ID NO: 890221 - RNA, 16 nt, Homo sapiens
uagaacuccaguacuc

SEQ ID NO: 890222 - RNA, 17 nt, Homo sapiens
uagaagaaagggcaaga

SEQ ID NO: 890223 - RNA, 19 nt, Homo sapiens
uagaagagccugacugugu

SEQ ID NO: 890224 - RNA, 20 nt, Homo sapiens
uagaaggguaccuugaacac

SEQ ID NO: 890225 - RNA, 15 nt, Homo sapiens
uagaagucucuucca

SEQ ID NO: 890226 - RNA, 20 nt, Homo sapiens
uagaagugguuuccugauaa

SEQ ID NO: 890227 - RNA, 23 nt, Homo sapiens
uagaaguguuaacuuagcuugaa

SEQ ID NO: 890228 - RNA, 16 nt, Homo sapiens
uagaauagugcauugu

SEQ ID NO: 890229 - RNA, 12 nt, Homo sapiens
uagaaucuggag

SEQ ID NO: 890230 - RNA, 17 nt, Homo sapiens
uagaaugcuuggcacuc

SEQ ID NO: 890231 - RNA, 23 nt, Homo sapiens
uagaauguuacuuuggaaugacu

SEQ ID NO: 890232 - RNA, 17 nt, Homo sapiens
uagaauuggagaguaaa

SEQ ID NO: 890233 - RNA, 16 nt, Homo sapiens
uagaauuuaacaugac

SEQ ID NO: 890234 - RNA, 17 nt, Homo sapiens
uagaauuuaacaugacu

SEQ ID NO: 890235 - RNA, 18 nt, Homo sapiens
uagacacaucaaaugccc

SEQ ID NO: 890236 - RNA, 13 nt, Homo sapiens
uagacagccaggu

SEQ ID NO: 890237 - RNA, 15 nt, Homo sapiens
uagacaguacucuua

SEQ ID NO: 890238 - RNA, 22 nt, Homo sapiens
uagacaguacucuuaacuccua

SEQ ID NO: 890239 - RNA, 23 nt, Homo sapiens
uagacuauaagcagaagcacaua

SEQ ID NO: 890240 - RNA, 19 nt, Homo sapiens
uagacuauauacaugugug

SEQ ID NO: 890241 - RNA, 23 nt, Homo sapiens
uagacugccaugcuagacaagcu

SEQ ID NO: 890242 - RNA, 22 nt, Homo sapiens
uagacuguacuuauuuuccaau

SEQ ID NO: 890243 - RNA, 19 nt, Homo sapiens
uuacaauuauggaaauaua

SEQ ID NO: 890244 - RNA, 19 nt, Homo sapiens
uuacacaguugcugucaua

SEQ ID NO: 890245 - RNA, 12 nt, Homo sapiens
uuacacaugaca

SEQ ID NO: 890246 - RNA, 20 nt, Homo sapiens
aagagacuggagcaucugac

SEQ ID NO: 890247 - RNA, 21 nt, Homo sapiens
aagagagaacaacuacuguga

SEQ ID NO: 890248 - RNA, 17 nt, Homo sapiens
aagagagagacccucac

SEQ ID NO: 890249 - RNA, 21 nt, Homo sapiens
aagagagaucuugauccacag

SEQ ID NO: 890250 - RNA, 21 nt, Homo sapiens
aagagaggaaugccuguguga

SEQ ID NO: 890251 - RNA, 13 nt, Homo sapiens
aagagaguaccau

SEQ ID NO: 890252 - RNA, 23 nt, Homo sapiens
aagagaucacaauacucaaaaga

SEQ ID NO: 890253 - RNA, 14 nt, Homo sapiens
aagagccauguacc

SEQ ID NO: 890254 - RNA, 16 nt, Homo sapiens
aagagccugacugugu

SEQ ID NO: 890255 - RNA, 15 nt, Homo sapiens
aagagcuuacaagac

SEQ ID NO: 890256 - RNA, 15 nt, Homo sapiens
aagaggauagaauac

SEQ ID NO: 890257 - RNA, 16 nt, Homo sapiens
aagaggcagcuugaaa

SEQ ID NO: 890258 - RNA, 13 nt, Homo sapiens
aagaggcagugag

SEQ ID NO: 890259 - RNA, 11 nt, Homo sapiens
aagagggaugu

SEQ ID NO: 890260 - RNA, 16 nt, Homo sapiens
aagagggucugaggaa

SEQ ID NO: 890261 - RNA, 14 nt, Homo sapiens
aagaggucugagcc

SEQ ID NO: 890262 - RNA, 12 nt, Homo sapiens
aagaggugaccc

SEQ ID NO: 890263 - RNA, 17 nt, Homo sapiens
aagaguagugcauuuaa

SEQ ID NO: 890264 - RNA, 19 nt, Homo sapiens
aagagugagacuccgucuc

SEQ ID NO: 890265 - RNA, 20 nt, Homo sapiens
aagagugagacuccgucuca

SEQ ID NO: 890266 - RNA, 21 nt, Homo sapiens
aagaguucuuaaggauuguga

SEQ ID NO: 890267 - RNA, 19 nt, Homo sapiens
aagaguuucuccuuuugac

SEQ ID NO: 890268 - RNA, 15 nt, Homo sapiens
aagauagcagggcau

SEQ ID NO: 890269 - RNA, 17 nt, Homo sapiens
aagauaguaucuuuuaa

SEQ ID NO: 890270 - RNA, 13 nt, Homo sapiens
aagauauaugaau

SEQ ID NO: 890271 - RNA, 17 nt, Homo sapiens
aagauaucagagcucuu

SEQ ID NO: 890272 - RNA, 17 nt, Homo sapiens
aagaucuugucuccacu

SEQ ID NO: 890273 - RNA, 20 nt, Homo sapiens
aagaugaaaaauggucccuu

SEQ ID NO: 890274 - RNA, 17 nt, Homo sapiens
aagaugaagacaacagc

SEQ ID NO: 890275 - RNA, 21 nt, Homo sapiens
aagaugaagagaagcugagaa

SEQ ID NO: 890276 - RNA, 21 nt, Homo sapiens
aagaugcuuuguuucuuucau

SEQ ID NO: 890277 - RNA, 22 nt, Homo sapiens
aagaugugggcagugaugucac

SEQ ID NO: 890278 - RNA, 21 nt, Homo sapiens
aagauucacauaguuuauuuc

SEQ ID NO: 890279 - RNA, 22 nt, Homo sapiens
aagauucacuaaagcagcacau

SEQ ID NO: 890280 - RNA, 17 nt, Homo sapiens
aagauuucagaagccaa

SEQ ID NO: 890281 - RNA, 20 nt, Homo sapiens
aagauuuugccacauuugau

SEQ ID NO: 890282 - RNA, 20 nt, Homo sapiens
aagauuuuuaauuacaauaa

SEQ ID NO: 890283 - RNA, 22 nt, Homo sapiens
aagauuuuuuuuguaacuucaa

SEQ ID NO: 890284 - RNA, 17 nt, Homo sapiens
aagcaaaagucagucuu

SEQ ID NO: 890285 - RNA, 21 nt, Homo sapiens
aagcaaagacuaugaggaaua

SEQ ID NO: 890286 - RNA, 18 nt, Homo sapiens
aagcaaaggaaaccaaag

SEQ ID NO: 890287 - RNA, 18 nt, Homo sapiens
aagcaacuugcuucuaaa

SEQ ID NO: 890288 - RNA, 13 nt, Homo sapiens
aagcaaggccaaa

SEQ ID NO: 890289 - RNA, 22 nt, Homo sapiens
aagcaauaaaaauacuaugaaa

SEQ ID NO: 890290 - RNA, 12 nt, Homo sapiens
aagcacaugugu

SEQ ID NO: 890291 - RNA, 16 nt, Homo sapiens
aagcacugacugggac

SEQ ID NO: 890292 - RNA, 15 nt, Homo sapiens
aagcagagcuuccuc

SEQ ID NO: 890293 - RNA, 17 nt, Homo sapiens
aagcagauuuaacaauu

SEQ ID NO: 890294 - RNA, 16 nt, Homo sapiens
aagcaguagacaaucc

SEQ ID NO: 890295 - RNA, 21 nt, Homo sapiens
aagcaguguuuucaccucaua

SEQ ID NO: 890296 - RNA, 15 nt, Homo sapiens
aagcaucaccucagg

SEQ ID NO: 890297 - RNA, 16 nt, Homo sapiens
aagcaucaccucaggc

SEQ ID NO: 890298 - RNA, 13 nt, Homo sapiens
aagcaucagagau

SEQ ID NO: 890299 - RNA, 23 nt, Homo sapiens
aagcaugacuauuuccaccauca

SEQ ID NO: 890300 - RNA, 23 nt, Homo sapiens
aagcaugucucaauaguaaaaga

SEQ ID NO: 890301 - RNA, 12 nt, Homo sapiens
aagcauuugccc

SEQ ID NO: 890302 - RNA, 19 nt, Homo sapiens
aagcauuuuaaaugucagu

SEQ ID NO: 890303 - RNA, 17 nt, Homo sapiens
aagccaaacucugccag

SEQ ID NO: 890304 - RNA, 20 nt, Homo sapiens
aagccacagcuggugguauc

SEQ ID NO: 890305 - RNA, 15 nt, Homo sapiens
aagccacucuuccaa

SEQ ID NO: 890306 - RNA, 19 nt, Homo sapiens
aagccagcugcaggaauca

SEQ ID NO: 890307 - RNA, 21 nt, Homo sapiens
aagccaggguccugaguggcu

SEQ ID NO: 890308 - RNA, 16 nt, Homo sapiens
aagccauuauucacua

SEQ ID NO: 890309 - RNA, 15 nt, Homo sapiens
aagcccaauauuaua

SEQ ID NO: 890310 - RNA, 22 nt, Homo sapiens
aagcccaccugcacgugaucug

SEQ ID NO: 890311 - RNA, 16 nt, Homo sapiens
aagcccagugaccuga

SEQ ID NO: 890312 - RNA, 21 nt, Homo sapiens
aagccccuggaaaugugcuaa

SEQ ID NO: 890313 - RNA, 14 nt, Homo sapiens
aagcccuaagugac

SEQ ID NO: 890314 - RNA, 13 nt, Homo sapiens
aagcccuggcaac

SEQ ID NO: 890315 - RNA, 12 nt, Homo sapiens
aagcccuugaac

SEQ ID NO: 890316 - RNA, 19 nt, Homo sapiens
aagccggcucuucaaagac

SEQ ID NO: 890317 - RNA, 22 nt, Homo sapiens
aagccucuggaaaacucaggau

SEQ ID NO: 890318 - RNA, 20 nt, Homo sapiens
aagccucugguggaaccugc

SEQ ID NO: 890319 - RNA, 18 nt, Homo sapiens
aagccugugccaccugca

SEQ ID NO: 890320 - RNA, 16 nt, Homo sapiens
aagccuuuugcucaca

SEQ ID NO: 890321 - RNA, 18 nt, Homo sapiens
aagcgugagccacugcac

SEQ ID NO: 890322 - RNA, 20 nt, Homo sapiens
aagcuaaaauuagaugaacu

SEQ ID NO: 890323 - RNA, 20 nt, Homo sapiens
aagcucaggaggcgaauaaa

SEQ ID NO: 890324 - RNA, 19 nt, Homo sapiens
aaguucugguaugaacuug

SEQ ID NO: 890325 - RNA, 22 nt, Homo sapiens
aaguucuucuccaauccuauca

SEQ ID NO: 890326 - RNA, 18 nt, Homo sapiens
aaguugacuuuaacaagg

SEQ ID NO: 890327 - RNA, 20 nt, Homo sapiens
aaguugcugaugaacucuua

SEQ ID NO: 890328 - RNA, 20 nt, Homo sapiens
aaguuguuauuucaguuuua

SEQ ID NO: 890329 - RNA, 20 nt, Homo sapiens
aaguuuagugcccucaucca

SEQ ID NO: 890330 - RNA, 13 nt, Homo sapiens
aaguuuucaggac

SEQ ID NO: 890331 - RNA, 14 nt, Homo sapiens
aauaaaaaaauaca

SEQ ID NO: 890332 - RNA, 18 nt, Homo sapiens
aauaaaaaauacaauuca

SEQ ID NO: 890333 - RNA, 14 nt, Homo sapiens
aauaaaacauuccu

SEQ ID NO: 890334 - RNA, 13 nt, Homo sapiens
aauaaaagccucu

SEQ ID NO: 890335 - RNA, 16 nt, Homo sapiens
aauaaaaguuuacaga

SEQ ID NO: 890336 - RNA, 17 nt, Homo sapiens
aauaaacgucuugccac

SEQ ID NO: 890337 - RNA, 20 nt, Homo sapiens
aauaaagcccuugaaccagc

SEQ ID NO: 890338 - RNA, 14 nt, Homo sapiens
aauaaagcuugcaa

SEQ ID NO: 890339 - RNA, 15 nt, Homo sapiens
aauaaaguaccauua

SEQ ID NO: 890340 - RNA, 12 nt, Homo sapiens
aauaaaguguau

SEQ ID NO: 890341 - RNA, 20 nt, Homo sapiens
aauaaaugaaucuuacuccu

SEQ ID NO: 890342 - RNA, 18 nt, Homo sapiens
aauaaaugccaacauacc

SEQ ID NO: 890343 - RNA, 19 nt, Homo sapiens
aauaacuagaucuccugua

SEQ ID NO: 890344 - RNA, 16 nt, Homo sapiens
aauaagaaacaugaug

SEQ ID NO: 890345 - RNA, 20 nt, Homo sapiens
aauaaggcuccuucaugugg

SEQ ID NO: 890346 - RNA, 19 nt, Homo sapiens
aauaaguacuguguacaga

SEQ ID NO: 890347 - RNA, 22 nt, Homo sapiens
aauaauagacacuggagacuug

SEQ ID NO: 890348 - RNA, 14 nt, Homo sapiens
aauaauauuagcuu

SEQ ID NO: 890349 - RNA, 22 nt, Homo sapiens
aauaaucauucuuuccccucag

SEQ ID NO: 890350 - RNA, 16 nt, Homo sapiens
aauaaugaacagcaga

SEQ ID NO: 890351 - RNA, 22 nt, Homo sapiens
aauaaugaaguuauucuugaca

SEQ ID NO: 890352 - RNA, 22 nt, Homo sapiens
aauaaugaguuagaacuauuaa

SEQ ID NO: 890353 - RNA, 13 nt, Homo sapiens
aauaauguauaca

SEQ ID NO: 890354 - RNA, 15 nt, Homo sapiens
aauaauguauacaca

SEQ ID NO: 890355 - RNA, 16 nt, Homo sapiens
aauaauguauacacau

SEQ ID NO: 890356 - RNA, 20 nt, Homo sapiens
aauaauguuguaauucaugc

SEQ ID NO: 890357 - RNA, 22 nt, Homo sapiens
aauaauuacccacaaaugccac

SEQ ID NO: 890358 - RNA, 14 nt, Homo sapiens
aauaauugauuuca

SEQ ID NO: 890359 - RNA, 22 nt, Homo sapiens
aauaauuuagacuucaagcaug

SEQ ID NO: 890360 - RNA, 17 nt, Homo sapiens
aauacaagccacuaccu

SEQ ID NO: 890361 - RNA, 20 nt, Homo sapiens
aauacaagccacuaccuucu

SEQ ID NO: 890362 - RNA, 15 nt, Homo sapiens
aauacauaagaccau

SEQ ID NO: 890363 - RNA, 20 nt, Homo sapiens
aauacaugcugcuaauucaa

SEQ ID NO: 890364 - RNA, 13 nt, Homo sapiens
aauacauguaucu

SEQ ID NO: 890365 - RNA, 20 nt, Homo sapiens
aauaccagugaaccaaagag

SEQ ID NO: 890366 - RNA, 19 nt, Homo sapiens
aauaccccuguuaagcaau

SEQ ID NO: 890367 - RNA, 20 nt, Homo sapiens
aauaccuuaguuuuuuccac

SEQ ID NO: 890368 - RNA, 11 nt, Homo sapiens
aauacugaugu

SEQ ID NO: 890369 - RNA, 14 nt, Homo sapiens
aauacugcucugaa

SEQ ID NO: 890370 - RNA, 12 nt, Homo sapiens
aauacuguacau

SEQ ID NO: 890371 - RNA, 16 nt, Homo sapiens
aauacuuaacauugau

SEQ ID NO: 890372 - RNA, 14 nt, Homo sapiens
aauacuuaacucaa

SEQ ID NO: 890373 - RNA, 14 nt, Homo sapiens
aauagacacaucaa

SEQ ID NO: 890374 - RNA, 16 nt, Homo sapiens
aauagacaguagccaa

SEQ ID NO: 890375 - RNA, 20 nt, Homo sapiens
aauagagcgugugcuguuga

SEQ ID NO: 890376 - RNA, 21 nt, Homo sapiens
aauagauggauuuguaucaau

SEQ ID NO: 890377 - RNA, 14 nt, Homo sapiens
aauagccauaugca

SEQ ID NO: 890378 - RNA, 14 nt, Homo sapiens
aauagcucuuucag

SEQ ID NO: 890379 - RNA, 14 nt, Homo sapiens
aauaggccauguua

SEQ ID NO: 890380 - RNA, 23 nt, Homo sapiens
aauaguaaaagauaacaagaucu

SEQ ID NO: 890381 - RNA, 14 nt, Homo sapiens
aauaguaaaugcuu

SEQ ID NO: 890382 - RNA, 18 nt, Homo sapiens
aauaguuuugauccuaaa

SEQ ID NO: 890383 - RNA, 16 nt, Homo sapiens
aauauaaaguguaaua

SEQ ID NO: 890384 - RNA, 22 nt, Homo sapiens
aauauaaauuuguguucucaaa

SEQ ID NO: 890385 - RNA, 17 nt, Homo sapiens
aauauaagaacuugaua

SEQ ID NO: 890386 - RNA, 17 nt, Homo sapiens
aauauauauacauaugu

SEQ ID NO: 890387 - RNA, 17 nt, Homo sapiens
aauauaucaauguaaca

SEQ ID NO: 890388 - RNA, 16 nt, Homo sapiens
aauauauuucuugcua

SEQ ID NO: 890389 - RNA, 13 nt, Homo sapiens
aauaucaaugaag

SEQ ID NO: 890390 - RNA, 19 nt, Homo sapiens
aauaucauuaaauuggaau

SEQ ID NO: 890391 - RNA, 14 nt, Homo sapiens
aauaucuaccugcc

SEQ ID NO: 890392 - RNA, 23 nt, Homo sapiens
aauaucuaccugcccucucucag

SEQ ID NO: 890393 - RNA, 19 nt, Homo sapiens
aauaucuugaaacauagag

SEQ ID NO: 890394 - RNA, 23 nt, Homo sapiens
aauaucuuuaauagguuaauauc

SEQ ID NO: 890395 - RNA, 19 nt, Homo sapiens
aauauggacaaagaaggca

SEQ ID NO: 890396 - RNA, 22 nt, Homo sapiens
aauauguauuguaaacaugugu

SEQ ID NO: 890397 - RNA, 14 nt, Homo sapiens
aauaugucaguuug

SEQ ID NO: 890398 - RNA, 11 nt, Homo sapiens
aauaugugcuu

SEQ ID NO: 890399 - RNA, 15 nt, Homo sapiens
aauauuauaaaucca

SEQ ID NO: 890400 - RNA, 23 nt, Homo sapiens
aauauuaucacgcagaucacuaa

SEQ ID NO: 890401 - RNA, 15 nt, Homo sapiens
aauauuauuugcuaa

SEQ ID NO: 890402 - RNA, 17 nt, Homo sapiens
aauauuauuugcuaauu

SEQ ID NO: 890403 - RNA, 21 nt, Homo sapiens
aaggcaaagccccuggaaaug

SEQ ID NO: 890404 - RNA, 22 nt, Homo sapiens
aaggcaaggucaccugccucuu

SEQ ID NO: 890405 - RNA, 17 nt, Homo sapiens
aaggcacguuuggcauu

SEQ ID NO: 890406 - RNA, 15 nt, Homo sapiens
aaggcagccaggcug

SEQ ID NO: 890407 - RNA, 21 nt, Homo sapiens
aaggcaggagaaucgcuuaaa

SEQ ID NO: 890408 - RNA, 19 nt, Homo sapiens
aaggcaggaggaucacuug

SEQ ID NO: 890409 - RNA, 20 nt, Homo sapiens
aaggcagugaacacacucag

SEQ ID NO: 890410 - RNA, 21 nt, Homo sapiens
aaggccaagaaucaagcuaga

SEQ ID NO: 890411 - RNA, 20 nt, Homo sapiens
aaggccacggccuugugucu

SEQ ID NO: 890412 - RNA, 16 nt, Homo sapiens
aaggcccacuguccag

SEQ ID NO: 890413 - RNA, 19 nt, Homo sapiens
aaggcccucuauuucucuc

SEQ ID NO: 890414 - RNA, 13 nt, Homo sapiens
aaggcuccaucuc

SEQ ID NO: 890415 - RNA, 22 nt, Homo sapiens
aaggcucugagcaaauguggcu

SEQ ID NO: 890416 - RNA, 14 nt, Homo sapiens
aaggcugcugugua

SEQ ID NO: 890417 - RNA, 18 nt, Homo sapiens
aaggcugggcaccucuag

SEQ ID NO: 890418 - RNA, 19 nt, Homo sapiens
aaggcuugaaguaaccuua

SEQ ID NO: 890419 - RNA, 22 nt, Homo sapiens
aaggcuugaaguaaccuuauag

SEQ ID NO: 890420 - RNA, 11 nt, Homo sapiens
aagggacacac

SEQ ID NO: 890421 - RNA, 17 nt, Homo sapiens
aagggauaguccaaaga

SEQ ID NO: 890422 - RNA, 14 nt, Homo sapiens
aagggauggcaaga

SEQ ID NO: 890423 - RNA, 14 nt, Homo sapiens
aagggccagcccua

SEQ ID NO: 890424 - RNA, 13 nt, Homo sapiens
aagggcugugcug

SEQ ID NO: 890425 - RNA, 15 nt, Homo sapiens
aaggggaacgcagag

SEQ ID NO: 890426 - RNA, 20 nt, Homo sapiens
aaggggacagcgccaccucu

SEQ ID NO: 890427 - RNA, 18 nt, Homo sapiens
aaggggaggggaugucag

SEQ ID NO: 890428 - RNA, 21 nt, Homo sapiens
aaggggcaaagaaaagccaga

SEQ ID NO: 890429 - RNA, 19 nt, Homo sapiens
aaggggcacgccugcccag

SEQ ID NO: 890430 - RNA, 19 nt, Homo sapiens
aaggggcuguuacauaaca

SEQ ID NO: 890431 - RNA, 22 nt, Homo sapiens
aaggguaccuugaacacugggg

SEQ ID NO: 890432 - RNA, 13 nt, Homo sapiens
aaggguacugaaa

SEQ ID NO: 890433 - RNA, 15 nt, Homo sapiens
aagggugacauccca

SEQ ID NO: 890434 - RNA, 18 nt, Homo sapiens
aagggugggaagcuugcu

SEQ ID NO: 890435 - RNA, 23 nt, Homo sapiens
aaggguuauagacugccaugcua

SEQ ID NO: 890436 - RNA, 20 nt, Homo sapiens
aagguagcccagcacuguga

SEQ ID NO: 890437 - RNA, 18 nt, Homo sapiens
aaggucacauugugccuu

SEQ ID NO: 890438 - RNA, 15 nt, Homo sapiens
aaggucagagucaaa

SEQ ID NO: 890439 - RNA, 16 nt, Homo sapiens
aaggucccuuguuucc

SEQ ID NO: 890440 - RNA, 15 nt, Homo sapiens
aaggucuucagccau

SEQ ID NO: 890441 - RNA, 14 nt, Homo sapiens
aaggucuugccuga

SEQ ID NO: 890442 - RNA, 20 nt, Homo sapiens
aaggucuugccugaauccau

SEQ ID NO: 890443 - RNA, 17 nt, Homo sapiens
aaggugauugauuguau

SEQ ID NO: 890444 - RNA, 24 nt, Homo sapiens
aaggugugcucugaucauccacug

SEQ ID NO: 890445 - RNA, 17 nt, Homo sapiens
aagguguuuccauuucu

SEQ ID NO: 890446 - RNA, 16 nt, Homo sapiens
aagguuaacagauaca

SEQ ID NO: 890447 - RNA, 21 nt, Homo sapiens
aagguucuuuagcugucacuu

SEQ ID NO: 890448 - RNA, 17 nt, Homo sapiens
aagguugugcccuccac

SEQ ID NO: 890449 - RNA, 13 nt, Homo sapiens
aaguaaaaccaca

SEQ ID NO: 890450 - RNA, 20 nt, Homo sapiens
aaguaaaacuugcugccuga

SEQ ID NO: 890451 - RNA, 13 nt, Homo sapiens
aaguaacacucac

SEQ ID NO: 890452 - RNA, 15 nt, Homo sapiens
aaguaacuuuuacaa

SEQ ID NO: 890453 - RNA, 15 nt, Homo sapiens
aaguaaguaccacuc

SEQ ID NO: 890454 - RNA, 18 nt, Homo sapiens
aaguaaguaccacucagg

SEQ ID NO: 890455 - RNA, 14 nt, Homo sapiens
aaguaaugcuucaa

SEQ ID NO: 890456 - RNA, 17 nt, Homo sapiens
aaguaauguuaauucuu

SEQ ID NO: 890457 - RNA, 23 nt, Homo sapiens
aaguaauuaucgggaacaguguu

SEQ ID NO: 890458 - RNA, 20 nt, Homo sapiens
aaguaauuccucucacuaaa

SEQ ID NO: 890459 - RNA, 22 nt, Homo sapiens
aaguaauuccucucacuaaacu

SEQ ID NO: 890460 - RNA, 18 nt, Homo sapiens
aaguacauaaaguacaua

SEQ ID NO: 890461 - RNA, 15 nt, Homo sapiens
aaguaccacucaggc

SEQ ID NO: 890462 - RNA, 15 nt, Homo sapiens
aaguaccuguaguga

SEQ ID NO: 890463 - RNA, 18 nt, Homo sapiens
aaguaccuguagugagaa

SEQ ID NO: 890464 - RNA, 14 nt, Homo sapiens
aaguagaauccuaa

SEQ ID NO: 890465 - RNA, 17 nt, Homo sapiens
aaguagcacccuggauu

SEQ ID NO: 890466 - RNA, 18 nt, Homo sapiens
aaguagcucuggugaccu

SEQ ID NO: 890467 - RNA, 22 nt, Homo sapiens
aaguaggauucaucauuccaua

SEQ ID NO: 890468 - RNA, 14 nt, Homo sapiens
aaguagggacuucu

SEQ ID NO: 890469 - RNA, 18 nt, Homo sapiens
aaguagguuuacauucau

SEQ ID NO: 890470 - RNA, 19 nt, Homo sapiens
aaguauaaagucacuucca

SEQ ID NO: 890471 - RNA, 14 nt, Homo sapiens
aaguauaaagugau

SEQ ID NO: 890472 - RNA, 21 nt, Homo sapiens
aaguauacauuuuugcauugc

SEQ ID NO: 890473 - RNA, 20 nt, Homo sapiens
aaguauccaauuaugugaca

SEQ ID NO: 890474 - RNA, 17 nt, Homo sapiens
aaguaugagggaaaaug

SEQ ID NO: 890475 - RNA, 14 nt, Homo sapiens
aaguauuaauguac

SEQ ID NO: 890476 - RNA, 18 nt, Homo sapiens
aaguauuauuuauuugaa

SEQ ID NO: 890477 - RNA, 12 nt, Homo sapiens
aagucacauaua

SEQ ID NO: 890478 - RNA, 19 nt, Homo sapiens
aagucaccacuccauuccc

SEQ ID NO: 890479 - RNA, 21 nt, Homo sapiens
aagucaccacuccauucccaa

SEQ ID NO: 890480 - RNA, 13 nt, Homo sapiens
aagucacugcaca

SEQ ID NO: 890481 - RNA, 23 nt, Homo sapiens
gagaggucucagguucuuuccau

SEQ ID NO: 890482 - RNA, 20 nt, Homo sapiens
gagaguccucuggauggcac

SEQ ID NO: 890483 - RNA, 14 nt, Homo sapiens
gagaguuucuguua

SEQ ID NO: 890484 - RNA, 14 nt, Homo sapiens
gagauagaaccugg

SEQ ID NO: 890485 - RNA, 17 nt, Homo sapiens
gagauagguacuauuau

SEQ ID NO: 890486 - RNA, 14 nt, Homo sapiens
gagaucgagaccau

SEQ ID NO: 890487 - RNA, 16 nt, Homo sapiens
gagaucguuguuuaca

SEQ ID NO: 890488 - RNA, 16 nt, Homo sapiens
gagaucuuacagguau

SEQ ID NO: 890489 - RNA, 17 nt, Homo sapiens
gagauggaauaaagccc

SEQ ID NO: 890490 - RNA, 20 nt, Homo sapiens
gagauggcgcuauugcacuc

SEQ ID NO: 890491 - RNA, 18 nt, Homo sapiens
gagauggggacaggugaa

SEQ ID NO: 890492 - RNA, 22 nt, Homo sapiens
gagauugcgccacugcacucca

SEQ ID NO: 890493 - RNA, 17 nt, Homo sapiens
gagauuuaccagggaug

SEQ ID NO: 890494 - RNA, 21 nt, Homo sapiens
gagauuucaguuacuuaccug

SEQ ID NO: 890495 - RNA, 20 nt, Homo sapiens
gagauuuugucgggacagag

SEQ ID NO: 890496 - RNA, 21 nt, Homo sapiens
gagcaaauaaagaccugagaa

SEQ ID NO: 890497 - RNA, 14 nt, Homo sapiens
gagcaacagaguga

SEQ ID NO: 890498 - RNA, 21 nt, Homo sapiens
gagcaaccccuguacccagcu

SEQ ID NO: 890499 - RNA, 17 nt, Homo sapiens
gagcaagugacaugcca

SEQ ID NO: 890500 - RNA, 23 nt, Homo sapiens
gagcaaugggagggggcuccaug

SEQ ID NO: 890501 - RNA, 18 nt, Homo sapiens
cuuccuggaguacaaaca

SEQ ID NO: 890502 - RNA, 14 nt, Homo sapiens
cuuccuggguccug

SEQ ID NO: 890503 - RNA, 18 nt, Homo sapiens
cuuccugugcccugcaaa

SEQ ID NO: 890504 - RNA, 19 nt, Homo sapiens
cuuccuuucuuucucucuc

SEQ ID NO: 890505 - RNA, 11 nt, Homo sapiens
cuucgcugcca

SEQ ID NO: 890506 - RNA, 22 nt, Homo sapiens
cuucgcugccaggacaccugcc

SEQ ID NO: 890507 - RNA, 22 nt, Homo sapiens
cuucgggagggcacucacaugc

SEQ ID NO: 890508 - RNA, 18 nt, Homo sapiens
cuucgguuucugagcaua

SEQ ID NO: 890509 - RNA, 12 nt, Homo sapiens
cuucgguuugua

SEQ ID NO: 890510 - RNA, 13 nt, Homo sapiens
cuucuaaacauuu

SEQ ID NO: 890511 - RNA, 18 nt, Homo sapiens
cuucuauuccauggcuaa

SEQ ID NO: 890512 - RNA, 22 nt, Homo sapiens
cuucuauuccauggcuaacugg

SEQ ID NO: 890513 - RNA, 11 nt, Homo sapiens
cuucucaaaag

SEQ ID NO: 890514 - RNA, 15 nt, Homo sapiens
cuucuccaaaugaga

SEQ ID NO: 890515 - RNA, 21 nt, Homo sapiens
cuucuccaacaccaccucucc

SEQ ID NO: 890516 - RNA, 18 nt, Homo sapiens
cuucucuacagacuucuc

SEQ ID NO: 890517 - RNA, 11 nt, Homo sapiens
cuucucuccau

SEQ ID NO: 890518 - RNA, 15 nt, Homo sapiens
cuucucuuugccuca

SEQ ID NO: 890519 - RNA, 14 nt, Homo sapiens
cuucugaagaucuc

SEQ ID NO: 890520 - RNA, 21 nt, Homo sapiens
cuucugagcaccuacuuacau

SEQ ID NO: 890521 - RNA, 16 nt, Homo sapiens
cuucugcacccagaaa

SEQ ID NO: 890522 - RNA, 22 nt, Homo sapiens
cuucugcuguauacuguacuga

SEQ ID NO: 890523 - RNA, 16 nt, Homo sapiens
cuucuggagucuccag

SEQ ID NO: 890524 - RNA, 12 nt, Homo sapiens
cuucugguccuu

SEQ ID NO: 890525 - RNA, 17 nt, Homo sapiens
cuucugucugcagugug

SEQ ID NO: 890526 - RNA, 14 nt, Homo sapiens
cuucuuaaucugaa

SEQ ID NO: 890527 - RNA, 17 nt, Homo sapiens
cuucuuagcaccacaaa

SEQ ID NO: 890528 - RNA, 16 nt, Homo sapiens
cuucuuccuuaauuca

SEQ ID NO: 890529 - RNA, 16 nt, Homo sapiens
cuucuugaaacagccu

SEQ ID NO: 890530 - RNA, 18 nt, Homo sapiens
cuucuuguguccugauga

SEQ ID NO: 890531 - RNA, 13 nt, Homo sapiens
cuugaacacuggg

SEQ ID NO: 890532 - RNA, 14 nt, Homo sapiens
cuugaacacugggg

SEQ ID NO: 890533 - RNA, 13 nt, Homo sapiens
cuugaagaacuga

SEQ ID NO: 890534 - RNA, 16 nt, Homo sapiens
cuugaauauuugcuua

SEQ ID NO: 890535 - RNA, 17 nt, Homo sapiens
cuugaaucaaagcaguu

SEQ ID NO: 890536 - RNA, 19 nt, Homo sapiens
cuugaccucaggugaucca

SEQ ID NO: 890537 - RNA, 15 nt, Homo sapiens
cuugacuaucacaua

SEQ ID NO: 890538 - RNA, 18 nt, Homo sapiens
cuugacuaucacauacaa

SEQ ID NO: 890539 - RNA, 21 nt, Homo sapiens
cuugagcagaccgugauuugg

SEQ ID NO: 890540 - RNA, 21 nt, Homo sapiens
cuugaggcggauggcugugac

SEQ ID NO: 890541 - RNA, 23 nt, Homo sapiens
cuugaggggcccacagacagauc

SEQ ID NO: 890542 - RNA, 21 nt, Homo sapiens
cuugagguggugccuucucac

SEQ ID NO: 890543 - RNA, 17 nt, Homo sapiens
cuugauccacagaaaua

SEQ ID NO: 890544 - RNA, 13 nt, Homo sapiens
cuugaucuguaua

SEQ ID NO: 890545 - RNA, 21 nt, Homo sapiens
cuugaugaagccugugccacc

SEQ ID NO: 890546 - RNA, 20 nt, Homo sapiens
cuugcacuccggagguagag

SEQ ID NO: 890547 - RNA, 21 nt, Homo sapiens
cuugcagauacauucaugagg

SEQ ID NO: 890548 - RNA, 18 nt, Homo sapiens
cuugcaucaagggcuuua

SEQ ID NO: 890549 - RNA, 16 nt, Homo sapiens
cuugccaccaccagau

SEQ ID NO: 890550 - RNA, 13 nt, Homo sapiens
cuugccagcauuu

SEQ ID NO: 890551 - RNA, 20 nt, Homo sapiens
cuugcccagagaugccucca

SEQ ID NO: 890552 - RNA, 17 nt, Homo sapiens
cuugcccccucaucuca

SEQ ID NO: 890553 - RNA, 23 nt, Homo sapiens
cuugcccccucaucucacugccc

SEQ ID NO: 890554 - RNA, 23 nt, Homo sapiens
cuugcccgccagccucagugcca

SEQ ID NO: 890555 - RNA, 15 nt, Homo sapiens
cuugccuaggccaaa

SEQ ID NO: 890556 - RNA, 18 nt, Homo sapiens
cuugccugaauccaucag

SEQ ID NO: 890557 - RNA, 21 nt, Homo sapiens
cuugccugaauccaucaggac

SEQ ID NO: 890558 - RNA, 21 nt, Homo sapiens
cuugcuauuugagcaugcaca

SEQ ID NO: 890559 - RNA, 17 nt, Homo sapiens
cuugcuccuguguaaaa

SEQ ID NO: 890560 - RNA, 16 nt, Homo sapiens
cuugcugcugagugca

SEQ ID NO: 890561 - RNA, 16 nt, Homo sapiens
cuugcuggacggggac

SEQ ID NO: 890562 - RNA, 23 nt, Homo sapiens
cuuggaaagcaucaccucaggcc

SEQ ID NO: 890563 - RNA, 15 nt, Homo sapiens
cuuggaaagguuuca

SEQ ID NO: 890564 - RNA, 18 nt, Homo sapiens
cuuggaaugaauucucuc

SEQ ID NO: 890565 - RNA, 15 nt, Homo sapiens
cuuggagaacuuucc

SEQ ID NO: 890566 - RNA, 13 nt, Homo sapiens
cuuggaggccacc

SEQ ID NO: 890567 - RNA, 13 nt, Homo sapiens
cuuggcugugagg

SEQ ID NO: 890568 - RNA, 18 nt, Homo sapiens
cuugggaccuguuuagag

SEQ ID NO: 890569 - RNA, 16 nt, Homo sapiens
cuugggcuacuggcag

SEQ ID NO: 890570 - RNA, 19 nt, Homo sapiens
cuugggcuacuggcagcuc

SEQ ID NO: 890571 - RNA, 21 nt, Homo sapiens
cuuggggggugaugagggcag

SEQ ID NO: 890572 - RNA, 17 nt, Homo sapiens
cuugggguaagccagag

SEQ ID NO: 890573 - RNA, 15 nt, Homo sapiens
cuugguaaauuguaa

SEQ ID NO: 890574 - RNA, 20 nt, Homo sapiens
cuugguuacuuaagaggcag

SEQ ID NO: 890575 - RNA, 21 nt, Homo sapiens
cuugguuuuuggcucuuucag

SEQ ID NO: 890576 - RNA, 20 nt, Homo sapiens
cuuguaaaggugcugcacug

SEQ ID NO: 890577 - RNA, 17 nt, Homo sapiens
cuuguagccagccgggg

SEQ ID NO: 890578 - RNA, 15 nt, Homo sapiens
cuuguauauacauau

SEQ ID NO: 890579 - RNA, 12 nt, Homo sapiens
cuuguaucugaa

SEQ ID NO: 890580 - RNA, 15 nt, Homo sapiens
cuuguccauguaaua

SEQ ID NO: 890581 - RNA, 15 nt, Homo sapiens
cuuguccuaugucaa

SEQ ID NO: 890582 - RNA, 14 nt, Homo sapiens
cuugucuccauuug

SEQ ID NO: 890583 - RNA, 15 nt, Homo sapiens
cuguugcacugaugu

SEQ ID NO: 890584 - RNA, 17 nt, Homo sapiens
cuguugcgccacugaga

SEQ ID NO: 890585 - RNA, 12 nt, Homo sapiens
cuguuggucugu

SEQ ID NO: 890586 - RNA, 18 nt, Homo sapiens
cuguuguaacugcccaag

SEQ ID NO: 890587 - RNA, 21 nt, Homo sapiens
cuguuguuccuucacauuuaa

SEQ ID NO: 890588 - RNA, 23 nt, Homo sapiens
cuguuuacaaaagcccaauguaa

SEQ ID NO: 890589 - RNA, 17 nt, Homo sapiens
cuguuuauauugguaua

SEQ ID NO: 890590 - RNA, 18 nt, Homo sapiens
cuguuucaaugaccugua

SEQ ID NO: 890591 - RNA, 19 nt, Homo sapiens
cuguuuccauagggugaca

SEQ ID NO: 890592 - RNA, 17 nt, Homo sapiens
cuguuucuaacucaggg

SEQ ID NO: 890593 - RNA, 16 nt, Homo sapiens
cuguuuuaaugacaag

SEQ ID NO: 890594 - RNA, 15 nt, Homo sapiens
cuguuuuuauaugca

SEQ ID NO: 890595 - RNA, 21 nt, Homo sapiens
cuguuuuuuuaagaaagugca

SEQ ID NO: 890596 - RNA, 17 nt, Homo sapiens
cuuaaaaacagcuguaa

SEQ ID NO: 890597 - RNA, 12 nt, Homo sapiens
cuuaaaagagua

SEQ ID NO: 890598 - RNA, 15 nt, Homo sapiens
cuuaaacuugaccca

SEQ ID NO: 890599 - RNA, 22 nt, Homo sapiens
cuuaaaugccuccuucucugcc

SEQ ID NO: 890600 - RNA, 24 nt, Homo sapiens
cuuaaauuuuaagcuugaagauua

SEQ ID NO: 890601 - RNA, 14 nt, Homo sapiens
cuuaacauucugua

SEQ ID NO: 890602 - RNA, 14 nt, Homo sapiens
cuuaacuauucaau

SEQ ID NO: 890603 - RNA, 15 nt, Homo sapiens
cuuaacugugugaag

SEQ ID NO: 890604 - RNA, 13 nt, Homo sapiens
cuuaagcugggau

SEQ ID NO: 890605 - RNA, 16 nt, Homo sapiens
cuuaauaauugcauau

SEQ ID NO: 890606 - RNA, 18 nt, Homo sapiens
cuuaauagccauaugcaa

SEQ ID NO: 890607 - RNA, 15 nt, Homo sapiens
cuuaaucaugagaua

SEQ ID NO: 890608 - RNA, 16 nt, Homo sapiens
cuuaaucuccacuguu

SEQ ID NO: 890609 - RNA, 20 nt, Homo sapiens
cuuaaucuccacuguuauuc

SEQ ID NO: 890610 - RNA, 15 nt, Homo sapiens
cuuaauguuuauucc

SEQ ID NO: 890611 - RNA, 18 nt, Homo sapiens
cuuacaaacaugugguua

SEQ ID NO: 890612 - RNA, 21 nt, Homo sapiens
cuuacacuacauuagaacacu

SEQ ID NO: 890613 - RNA, 14 nt, Homo sapiens
cuuacaugauucau

SEQ ID NO: 890614 - RNA, 15 nt, Homo sapiens
cuuacaugcauuacu

SEQ ID NO: 890615 - RNA, 13 nt, Homo sapiens
cuuacuacuugcc

SEQ ID NO: 890616 - RNA, 21 nt, Homo sapiens
cuuacugcaaccuuugccucc

SEQ ID NO: 890617 - RNA, 14 nt, Homo sapiens
cuuacuuaaaccca

SEQ ID NO: 890618 - RNA, 14 nt, Homo sapiens
cuuacuuauucuuc

SEQ ID NO: 890619 - RNA, 20 nt, Homo sapiens
cuuagaaaucauuguagaaa

SEQ ID NO: 890620 - RNA, 18 nt, Homo sapiens
cuuagaauaaaauuguaa

SEQ ID NO: 890621 - RNA, 22 nt, Homo sapiens
cuuagacuaguugaacaucuca

SEQ ID NO: 890622 - RNA, 23 nt, Homo sapiens
cuuagauaaucgagucuaccucu

SEQ ID NO: 890623 - RNA, 22 nt, Homo sapiens
cuuagaugagggugacugucaa

SEQ ID NO: 890624 - RNA, 20 nt, Homo sapiens
cuuagauuagcucuggacca

SEQ ID NO: 890625 - RNA, 16 nt, Homo sapiens
cuuagcugucugcuca

SEQ ID NO: 890626 - RNA, 16 nt, Homo sapiens
cuuaggaaccuaccag

SEQ ID NO: 890627 - RNA, 11 nt, Homo sapiens
cuuaggugcca

SEQ ID NO: 890628 - RNA, 17 nt, Homo sapiens
cuuauaaagcauugcaa

SEQ ID NO: 890629 - RNA, 18 nt, Homo sapiens
cuuauagaaaguucaaaa

SEQ ID NO: 890630 - RNA, 18 nt, Homo sapiens
cuuauauaguauucauuu

SEQ ID NO: 890631 - RNA, 17 nt, Homo sapiens
cuuauccaugccuggga

SEQ ID NO: 890632 - RNA, 15 nt, Homo sapiens
cuuaugaaacuaaga

SEQ ID NO: 890633 - RNA, 18 nt, Homo sapiens
cuuaugccuauaccugaa

SEQ ID NO: 890634 - RNA, 13 nt, Homo sapiens
cuuaugugagccc

SEQ ID NO: 890635 - RNA, 14 nt, Homo sapiens
cuuauugacuauua

SEQ ID NO: 890636 - RNA, 21 nt, Homo sapiens
cuuauuggccacugggucuca

SEQ ID NO: 890637 - RNA, 14 nt, Homo sapiens
cuuauuguaccucu

SEQ ID NO: 890638 - RNA, 15 nt, Homo sapiens
cuuauuuauauauca

SEQ ID NO: 890639 - RNA, 21 nt, Homo sapiens
cuuauuuauauaucaguuaua

SEQ ID NO: 890640 - RNA, 15 nt, Homo sapiens
cuuauuucauaaaca

SEQ ID NO: 890641 - RNA, 14 nt, Homo sapiens
cuuauuucccucau

SEQ ID NO: 890642 - RNA, 17 nt, Homo sapiens
cuuauuuuugacagugu

SEQ ID NO: 890643 - RNA, 23 nt, Homo sapiens
cuucaaauugucuuuugucaugu

SEQ ID NO: 890644 - RNA, 17 nt, Homo sapiens
cuucaagcacccuguuc

SEQ ID NO: 890645 - RNA, 21 nt, Homo sapiens
cuucaagugauauauguauuu

SEQ ID NO: 890646 - RNA, 19 nt, Homo sapiens
cuucaaguuaaagugaaua

SEQ ID NO: 890647 - RNA, 16 nt, Homo sapiens
cuucaaguuagcucag

SEQ ID NO: 890648 - RNA, 14 nt, Homo sapiens
cuucacaacagauu

SEQ ID NO: 890649 - RNA, 22 nt, Homo sapiens
cuucacaaccagccacacagag

SEQ ID NO: 890650 - RNA, 13 nt, Homo sapiens
cuucacagugacc

SEQ ID NO: 890651 - RNA, 13 nt, Homo sapiens
cuucacaguguuu

SEQ ID NO: 890652 - RNA, 23 nt, Homo sapiens
cuucacuaccaaaugagcauuag

SEQ ID NO: 890653 - RNA, 16 nt, Homo sapiens
cuucacucacugucaa

SEQ ID NO: 890654 - RNA, 18 nt, Homo sapiens
cuucacugccaugccuca

SEQ ID NO: 890655 - RNA, 20 nt, Homo sapiens
cuucagaauauggacaaaga

SEQ ID NO: 890656 - RNA, 15 nt, Homo sapiens
cuucagaccugacac

SEQ ID NO: 890657 - RNA, 16 nt, Homo sapiens
cuucagauuuguguua

SEQ ID NO: 890658 - RNA, 20 nt, Homo sapiens
cuucagccccuagugcuauu

SEQ ID NO: 890659 - RNA, 21 nt, Homo sapiens
cuucagccuagccgaccucag

SEQ ID NO: 890660 - RNA, 18 nt, Homo sapiens
cuucaggacuauuucacu

SEQ ID NO: 890661 - RNA, 21 nt, Homo sapiens
cuucagggcuggaaaagucac

SEQ ID NO: 890662 - RNA, 15 nt, Homo sapiens
cuucagggugaguga

SEQ ID NO: 890663 - RNA, 22 nt, Homo sapiens
cuucagguucuuucugaaaucg

SEQ ID NO: 890664 - RNA, 22 nt, Homo sapiens
aacccgagaaaacaaacccagg

SEQ ID NO: 890665 - RNA, 22 nt, Homo sapiens
aacccugcuugcacuuuguaac

SEQ ID NO: 890666 - RNA, 19 nt, Homo sapiens
aacccuguauggcacuuau

SEQ ID NO: 890667 - RNA, 18 nt, Homo sapiens
aacccuuuuccuccagac

SEQ ID NO: 890668 - RNA, 14 nt, Homo sapiens
aaccgcuugccaua

SEQ ID NO: 890669 - RNA, 20 nt, Homo sapiens
aaccgcuugccauauuccga

SEQ ID NO: 890670 - RNA, 16 nt, Homo sapiens
aaccgugauaagccuu

SEQ ID NO: 890671 - RNA, 16 nt, Homo sapiens
aaccguguccagcaca

SEQ ID NO: 890672 - RNA, 17 nt, Homo sapiens
aaccuagcaucuuacaa

SEQ ID NO: 890673 - RNA, 22 nt, Homo sapiens
aaccuagccuuagaagucacac

SEQ ID NO: 890674 - RNA, 16 nt, Homo sapiens
aaccucaaacugggua

SEQ ID NO: 890675 - RNA, 21 nt, Homo sapiens
aaccucauuccccaaccacuu

SEQ ID NO: 890676 - RNA, 17 nt, Homo sapiens
aaccuccacaguagcau

SEQ ID NO: 890677 - RNA, 20 nt, Homo sapiens
aaccuccccgcagagcuccc

SEQ ID NO: 890678 - RNA, 17 nt, Homo sapiens
aaccucucuaagccaca

SEQ ID NO: 890679 - RNA, 21 nt, Homo sapiens
aaccugaugccccuuccccaa

SEQ ID NO: 890680 - RNA, 20 nt, Homo sapiens
aaccugcccacccacuccuu

SEQ ID NO: 890681 - RNA, 21 nt, Homo sapiens
aaccuggagagcuagaaccua

SEQ ID NO: 890682 - RNA, 14 nt, Homo sapiens
aaccuggagaugau

SEQ ID NO: 890683 - RNA, 21 nt, Homo sapiens
aaccuggagccacuucuaucu

SEQ ID NO: 890684 - RNA, 18 nt, Homo sapiens
aaccuggaguauaauauu

SEQ ID NO: 890685 - RNA, 17 nt, Homo sapiens
aaccugguggcaccaga

SEQ ID NO: 890686 - RNA, 19 nt, Homo sapiens
aaccugguggcaccagaug

SEQ ID NO: 890687 - RNA, 18 nt, Homo sapiens
aaccuguccauaaaguaa

SEQ ID NO: 890688 - RNA, 13 nt, Homo sapiens
aaccugugucuua

SEQ ID NO: 890689 - RNA, 14 nt, Homo sapiens
aaccugugugccau

SEQ ID NO: 890690 - RNA, 21 nt, Homo sapiens
aaccuuaaccucucuaagcca

SEQ ID NO: 890691 - RNA, 15 nt, Homo sapiens
aaccuugcagcauuu

SEQ ID NO: 890692 - RNA, 18 nt, Homo sapiens
aaccuugucucuaugcca

SEQ ID NO: 890693 - RNA, 15 nt, Homo sapiens
aaccuuuccccagac

SEQ ID NO: 890694 - RNA, 18 nt, Homo sapiens
aaccuuuucaugccuuua

SEQ ID NO: 890695 - RNA, 12 nt, Homo sapiens
aacgcacaggaa

SEQ ID NO: 890696 - RNA, 15 nt, Homo sapiens
aacggagagugcuug

SEQ ID NO: 890697 - RNA, 16 nt, Homo sapiens
aacggagagugcuugg

SEQ ID NO: 890698 - RNA, 18 nt, Homo sapiens
aacggcuccaggauuuua

SEQ ID NO: 890699 - RNA, 22 nt, Homo sapiens
aacguggguauuuccugcuaca

SEQ ID NO: 890700 - RNA, 17 nt, Homo sapiens
aacuaagacauaugcau

SEQ ID NO: 890701 - RNA, 23 nt, Homo sapiens
aacuaauuuccucugacauguaa

SEQ ID NO: 890702 - RNA, 17 nt, Homo sapiens
aacuaccuccucagucu

SEQ ID NO: 890703 - RNA, 20 nt, Homo sapiens
aacuacuaaagugccuaccc

SEQ ID NO: 890704 - RNA, 13 nt, Homo sapiens
aacuacugugauc

SEQ ID NO: 890705 - RNA, 14 nt, Homo sapiens
aacuaggaccucau

SEQ ID NO: 890706 - RNA, 13 nt, Homo sapiens
aacuauauucuca

SEQ ID NO: 890707 - RNA, 22 nt, Homo sapiens
aacuaugugauguuaacuauua

SEQ ID NO: 890708 - RNA, 17 nt, Homo sapiens
aacuauuaaagugccau

SEQ ID NO: 890709 - RNA, 21 nt, Homo sapiens
aacuauuggagggugggagag

SEQ ID NO: 890710 - RNA, 17 nt, Homo sapiens
aacuauuuauugaauga

SEQ ID NO: 890711 - RNA, 14 nt, Homo sapiens
aacuauuuauuuca

SEQ ID NO: 890712 - RNA, 16 nt, Homo sapiens
aacuauuuauuucacc

SEQ ID NO: 890713 - RNA, 20 nt, Homo sapiens
aacuauuucuacacaguggg

SEQ ID NO: 890714 - RNA, 20 nt, Homo sapiens
aacucaauauuuuccaugaa

SEQ ID NO: 890715 - RNA, 14 nt, Homo sapiens
aacucagagccucc

SEQ ID NO: 890716 - RNA, 13 nt, Homo sapiens
aacuccaucucaa

SEQ ID NO: 890717 - RNA, 16 nt, Homo sapiens
aacuccuauaauuccc

SEQ ID NO: 890718 - RNA, 14 nt, Homo sapiens
aacuccuccuugcc

SEQ ID NO: 890719 - RNA, 18 nt, Homo sapiens
aacuccuggagauuucag

SEQ ID NO: 890720 - RNA, 19 nt, Homo sapiens
aacucuccuacacuuccau

SEQ ID NO: 890721 - RNA, 12 nt, Homo sapiens
aacucucuccac

SEQ ID NO: 890722 - RNA, 19 nt, Homo sapiens
aacucucugagauguguuc

SEQ ID NO: 890723 - RNA, 22 nt, Homo sapiens
aacucugacaagggcugaccug

SEQ ID NO: 890724 - RNA, 17 nt, Homo sapiens
aacucuucuacuuucau

SEQ ID NO: 890725 - RNA, 14 nt, Homo sapiens
aacugaagccagaa

SEQ ID NO: 890726 - RNA, 10 nt, Homo sapiens
aacugacaca

SEQ ID NO: 890727 - RNA, 19 nt, Homo sapiens
aacugaggccauuauuuca

SEQ ID NO: 890728 - RNA, 21 nt, Homo sapiens
aacugauuuuuagcuuuacaa

SEQ ID NO: 890729 - RNA, 19 nt, Homo sapiens
aacugcaaauauugucaua

SEQ ID NO: 890730 - RNA, 14 nt, Homo sapiens
aacugcacugucaa

SEQ ID NO: 890731 - RNA, 22 nt, Homo sapiens
aacugcaguauggccaugggcu

SEQ ID NO: 890732 - RNA, 16 nt, Homo sapiens
aacuggaugaggucau

SEQ ID NO: 890733 - RNA, 18 nt, Homo sapiens
aacuggccaagcugaggu

SEQ ID NO: 890734 - RNA, 11 nt, Homo sapiens
aacuggcuguu

SEQ ID NO: 890735 - RNA, 19 nt, Homo sapiens
aacuggguacuuguggaca

SEQ ID NO: 890736 - RNA, 15 nt, Homo sapiens
aacugguucaugaaa

SEQ ID NO: 890737 - RNA, 12 nt, Homo sapiens
aacugucucuca

SEQ ID NO: 890738 - RNA, 22 nt, Homo sapiens
aacugugcccugccuucagcuu

SEQ ID NO: 890739 - RNA, 21 nt, Homo sapiens
aacugugugcagacucaauaa

SEQ ID NO: 890740 - RNA, 22 nt, Homo sapiens
aacuguuuuugaagaagggaaa

SEQ ID NO: 890741 - RNA, 12 nt, Homo sapiens
aacuuaauguuc

SEQ ID NO: 890742 - RNA, 18 nt, Homo sapiens
aacuuagguuagugacaa

SEQ ID NO: 890743 - RNA, 17 nt, Homo sapiens
aacuucagcaccaugga

SEQ ID NO: 890744 - RNA, 13 nt, Homo sapiens
aacuucaucuuca

SEQ ID NO: 890745 - RNA, 23 nt, Homo sapiens
aacuuccacauuauacauuugau

SEQ ID NO: 890746 - RNA, 23 nt, Homo sapiens
aacuuccuaaugauuagcacuua

SEQ ID NO: 890747 - RNA, 22 nt, Homo sapiens
aacuuccuuggacucauuuuaa

SEQ ID NO: 890748 - RNA, 21 nt, Homo sapiens
aacuucuugaaucuagggagg

SEQ ID NO: 890749 - RNA, 15 nt, Homo sapiens
aacuugaacugauuc

SEQ ID NO: 890750 - RNA, 23 nt, Homo sapiens
aacuugaggacacauguccagug

SEQ ID NO: 890751 - RNA, 17 nt, Homo sapiens
aacuuguaucugaagac

SEQ ID NO: 890752 - RNA, 23 nt, Homo sapiens
aacuuugacaaccaugagaccac

SEQ ID NO: 890753 - RNA, 13 nt, Homo sapiens
aacuuuguauuaa

SEQ ID NO: 890754 - RNA, 18 nt, Homo sapiens
aacuuuguauuaaugugu

SEQ ID NO: 890755 - RNA, 23 nt, Homo sapiens
aacuuugugccuuugaccaucuc

SEQ ID NO: 890756 - RNA, 16 nt, Homo sapiens
aacuuuugugcucccc

SEQ ID NO: 890757 - RNA, 20 nt, Homo sapiens
aagaaaaaguugcagucuca

SEQ ID NO: 890758 - RNA, 16 nt, Homo sapiens
aagaaaacaucacuga

SEQ ID NO: 890759 - RNA, 13 nt, Homo sapiens
aagaaaaccagcg

SEQ ID NO: 890760 - RNA, 13 nt, Homo sapiens
aagaaaagccaga

SEQ ID NO: 890761 - RNA, 22 nt, Homo sapiens
aagaaaaucaaagcugaggaca

SEQ ID NO: 890762 - RNA, 15 nt, Homo sapiens
aagaaaauuauguau

SEQ ID NO: 890763 - RNA, 22 nt, Homo sapiens
aagaaacagauaccauacucau

SEQ ID NO: 890764 - RNA, 22 nt, Homo sapiens
aagaaaccuucagauuuguguu

SEQ ID NO: 890765 - RNA, 16 nt, Homo sapiens
aagaaaggaacugagg

SEQ ID NO: 890766 - RNA, 12 nt, Homo sapiens
aagaaagggcaa

SEQ ID NO: 890767 - RNA, 13 nt, Homo sapiens
aagaaagugcaga

SEQ ID NO: 890768 - RNA, 18 nt, Homo sapiens
aagaaauccaguuuccca

SEQ ID NO: 890769 - RNA, 12 nt, Homo sapiens
aagaaaugaaua

SEQ ID NO: 890770 - RNA, 12 nt, Homo sapiens
aagaaauuccug

SEQ ID NO: 890771 - RNA, 17 nt, Homo sapiens
aagaaauuccuguagca

SEQ ID NO: 890772 - RNA, 21 nt, Homo sapiens
aagaaauuccuguagcaucuu

SEQ ID NO: 890773 - RNA, 14 nt, Homo sapiens
aagaaauucuguca

SEQ ID NO: 890774 - RNA, 17 nt, Homo sapiens
aagaacaguaacugcca

SEQ ID NO: 890775 - RNA, 16 nt, Homo sapiens
aagaaccgagcaauuu

SEQ ID NO: 890776 - RNA, 14 nt, Homo sapiens
aagaagaauauucu

SEQ ID NO: 890777 - RNA, 16 nt, Homo sapiens
aagaagacauggagac

SEQ ID NO: 890778 - RNA, 15 nt, Homo sapiens
aagaagagaucagga

SEQ ID NO: 890779 - RNA, 22 nt, Homo sapiens
cugaaauugcguucuaagaggu

SEQ ID NO: 890780 - RNA, 14 nt, Homo sapiens
cugaaccacuuugc

SEQ ID NO: 890781 - RNA, 16 nt, Homo sapiens
cugaaccugggaacca

SEQ ID NO: 890782 - RNA, 14 nt, Homo sapiens
cugaacuauuucag

SEQ ID NO: 890783 - RNA, 20 nt, Homo sapiens
cugaagaacaguaacugcca

SEQ ID NO: 890784 - RNA, 11 nt, Homo sapiens
cugaagccaga

SEQ ID NO: 890785 - RNA, 18 nt, Homo sapiens
cugaagcugacagcacua

SEQ ID NO: 890786 - RNA, 20 nt, Homo sapiens
cugaagucaguuucuaucau

SEQ ID NO: 890787 - RNA, 22 nt, Homo sapiens
cugaaguuagggaugacuguga

SEQ ID NO: 890788 - RNA, 15 nt, Homo sapiens
cugaauaaacaggaa

SEQ ID NO: 890789 - RNA, 14 nt, Homo sapiens
cugaaugacaucaa

SEQ ID NO: 890790 - RNA, 18 nt, Homo sapiens
cugaaugccucaauguga

SEQ ID NO: 890791 - RNA, 20 nt, Homo sapiens
cugaaugccucaaugugacc

SEQ ID NO: 890792 - RNA, 21 nt, Homo sapiens
cugaaugucuuacugugauca

SEQ ID NO: 890793 - RNA, 16 nt, Homo sapiens
cugacaccucacugag

SEQ ID NO: 890794 - RNA, 11 nt, Homo sapiens
cugacaucucc

SEQ ID NO: 890795 - RNA, 19 nt, Homo sapiens
cugacaugcaucaucucau

SEQ ID NO: 890796 - RNA, 13 nt, Homo sapiens
cugacaugucuca

SEQ ID NO: 890797 - RNA, 22 nt, Homo sapiens
cugacauuaagacacaccucug

SEQ ID NO: 890798 - RNA, 18 nt, Homo sapiens
cugaccaaagagaagcaa

SEQ ID NO: 890799 - RNA, 17 nt, Homo sapiens
cugaccaacauggugaa

SEQ ID NO: 890800 - RNA, 12 nt, Homo sapiens
cugaccaagaga

SEQ ID NO: 890801 - RNA, 15 nt, Homo sapiens
cugaccaagagagaa

SEQ ID NO: 890802 - RNA, 13 nt, Homo sapiens
cugaccccaaaga

SEQ ID NO: 890803 - RNA, 18 nt, Homo sapiens
cugaccccugcaccagcc

SEQ ID NO: 890804 - RNA, 19 nt, Homo sapiens
cugaccucaggugauccac

SEQ ID NO: 890805 - RNA, 21 nt, Homo sapiens
cugaccuuucugagugacaug

SEQ ID NO: 890806 - RNA, 13 nt, Homo sapiens
cugacuaccagcu

SEQ ID NO: 890807 - RNA, 14 nt, Homo sapiens
cugacuaccagcua

SEQ ID NO: 890808 - RNA, 21 nt, Homo sapiens
cugacuauugaaguugcagau

SEQ ID NO: 890809 - RNA, 22 nt, Homo sapiens
cugacuccuuagagacaucaaa

SEQ ID NO: 890810 - RNA, 15 nt, Homo sapiens
cugacugaugacaaa

SEQ ID NO: 890811 - RNA, 16 nt, Homo sapiens
cugacuguacuccucc

SEQ ID NO: 890812 - RNA, 22 nt, Homo sapiens
cugacuguguucagugccuugg

SEQ ID NO: 890813 - RNA, 13 nt, Homo sapiens
cugagaaacuucc

SEQ ID NO: 890814 - RNA, 18 nt, Homo sapiens
cugagaaacuuccuuuga

SEQ ID NO: 890815 - RNA, 17 nt, Homo sapiens
cugagaaauguucagaa

SEQ ID NO: 890816 - RNA, 15 nt, Homo sapiens
cugagaaggacaccu

SEQ ID NO: 890817 - RNA, 16 nt, Homo sapiens
cugagaaggacaccuc

SEQ ID NO: 890818 - RNA, 16 nt, Homo sapiens
cugagaauagugucug

SEQ ID NO: 890819 - RNA, 14 nt, Homo sapiens
cugagaaucuagcc

SEQ ID NO: 890820 - RNA, 16 nt, Homo sapiens
cugagaauuccaagga

SEQ ID NO: 890821 - RNA, 18 nt, Homo sapiens
cugagacaugacuaggaa

SEQ ID NO: 890822 - RNA, 19 nt, Homo sapiens
cugagacuauuuuaacugg

SEQ ID NO: 890823 - RNA, 22 nt, Homo sapiens
cugagacuucaggugcauucca

SEQ ID NO: 890824 - RNA, 18 nt, Homo sapiens
cugagacuuucagugcac

SEQ ID NO: 890825 - RNA, 16 nt, Homo sapiens
cugagagcucacagua

SEQ ID NO: 890826 - RNA, 20 nt, Homo sapiens
cugagaguuggcucaggcag

SEQ ID NO: 890827 - RNA, 19 nt, Homo sapiens
cugagaugcacgaugcugg

SEQ ID NO: 890828 - RNA, 16 nt, Homo sapiens
cugagcaccuacuuac

SEQ ID NO: 890829 - RNA, 18 nt, Homo sapiens
cugagcaccucagccuuu

SEQ ID NO: 890830 - RNA, 16 nt, Homo sapiens
cugagcaguaccagug

SEQ ID NO: 890831 - RNA, 15 nt, Homo sapiens
cugagcauaaugcuc

SEQ ID NO: 890832 - RNA, 13 nt, Homo sapiens
cugagcccuggca

SEQ ID NO: 890833 - RNA, 13 nt, Homo sapiens
cugagccuagcua

SEQ ID NO: 890834 - RNA, 17 nt, Homo sapiens
cugagcgagcacaccuu

SEQ ID NO: 890835 - RNA, 22 nt, Homo sapiens
cugagcuagaauuauucucuua

SEQ ID NO: 890836 - RNA, 17 nt, Homo sapiens
cugagcuccugucccag

SEQ ID NO: 890837 - RNA, 20 nt, Homo sapiens
cugagcugaacccauuuuga

SEQ ID NO: 890838 - RNA, 22 nt, Homo sapiens
cugaggaagcacagcagcaucu

SEQ ID NO: 890839 - RNA, 20 nt, Homo sapiens
cugaggcaggagaauggugu

SEQ ID NO: 890840 - RNA, 18 nt, Homo sapiens
cugaggcaggaggauugc

SEQ ID NO: 890841 - RNA, 20 nt, Homo sapiens
cugaggcauuuuuacuacua

SEQ ID NO: 890842 - RNA, 21 nt, Homo sapiens
cugaggcccagaaagaggcag

SEQ ID NO: 890843 - RNA, 17 nt, Homo sapiens
cugaggcuccugugcua

SEQ ID NO: 890844 - RNA, 21 nt, Homo sapiens
cugaggguccccaccugggac

SEQ ID NO: 890845 - RNA, 15 nt, Homo sapiens
cugaggucacugggu

SEQ ID NO: 890846 - RNA, 20 nt, Homo sapiens
cugaguggaaugcagggaag

SEQ ID NO: 890847 - RNA, 19 nt, Homo sapiens
cugaguuauuuugcuaaac

SEQ ID NO: 890848 - RNA, 22 nt, Homo sapiens
cugauaaacauuaaacacugua

SEQ ID NO: 890849 - RNA, 22 nt, Homo sapiens
cugauaauauguuugagguuaa

SEQ ID NO: 890850 - RNA, 13 nt, Homo sapiens
cuccuaaccuaga

SEQ ID NO: 890851 - RNA, 20 nt, Homo sapiens
cuccucacaguugccaugua

SEQ ID NO: 890852 - RNA, 20 nt, Homo sapiens
cuccuccagggccacgugcc

SEQ ID NO: 890853 - RNA, 20 nt, Homo sapiens
cuccucccaaaauacuacac

SEQ ID NO: 890854 - RNA, 15 nt, Homo sapiens
cuccucuaucacauu

SEQ ID NO: 890855 - RNA, 16 nt, Homo sapiens
cuccucuccccagcaa

SEQ ID NO: 890856 - RNA, 21 nt, Homo sapiens
cuccucuccuagccccuguca

SEQ ID NO: 890857 - RNA, 14 nt, Homo sapiens
cuccucuugccacu

SEQ ID NO: 890858 - RNA, 16 nt, Homo sapiens
cuccugacaugucuca

SEQ ID NO: 890859 - RNA, 16 nt, Homo sapiens
cuccugccuugaugaa

SEQ ID NO: 890860 - RNA, 15 nt, Homo sapiens
cuccuguguacaggg

SEQ ID NO: 890861 - RNA, 18 nt, Homo sapiens
cuccuguuagcuguuauu

SEQ ID NO: 890862 - RNA, 16 nt, Homo sapiens
cuccuguugcaaugac

SEQ ID NO: 890863 - RNA, 16 nt, Homo sapiens
cuccuuagagacauca

SEQ ID NO: 890864 - RNA, 13 nt, Homo sapiens
cuccuugcacuuu

SEQ ID NO: 890865 - RNA, 20 nt, Homo sapiens
cuccuuggucuaagugugcu

SEQ ID NO: 890866 - RNA, 17 nt, Homo sapiens
cuccuuuggccauucca

SEQ ID NO: 890867 - RNA, 14 nt, Homo sapiens
cuccuuuugaccaa

SEQ ID NO: 890868 - RNA, 24 nt, Homo sapiens
cuccuuuugcuguuuggauguuuc

SEQ ID NO: 890869 - RNA, 20 nt, Homo sapiens
cucgauuauucccuguacaa

SEQ ID NO: 890870 - RNA, 17 nt, Homo sapiens
cucgcaugccagagccu

SEQ ID NO: 890871 - RNA, 21 nt, Homo sapiens
cucggagaagagcuguucaca

SEQ ID NO: 890872 - RNA, 12 nt, Homo sapiens
cucguaccagcc

SEQ ID NO: 890873 - RNA, 16 nt, Homo sapiens
cucgugccaugaucug

SEQ ID NO: 890874 - RNA, 20 nt, Homo sapiens
cucuaaaaauaaaaugaugu

SEQ ID NO: 890875 - RNA, 18 nt, Homo sapiens
cucuaacgccugagccca

SEQ ID NO: 890876 - RNA, 14 nt, Homo sapiens
cucuaaguuuagaa

SEQ ID NO: 890877 - RNA, 16 nt, Homo sapiens
cucuacagacuucucc

SEQ ID NO: 890878 - RNA, 18 nt, Homo sapiens
cucuacuccuaccucagc

SEQ ID NO: 890879 - RNA, 13 nt, Homo sapiens
cucuacucuggaa

SEQ ID NO: 890880 - RNA, 21 nt, Homo sapiens
cucuagaacaugcacauuuau

SEQ ID NO: 890881 - RNA, 20 nt, Homo sapiens
cucuagccugggccagagaa

SEQ ID NO: 890882 - RNA, 19 nt, Homo sapiens
cucuaggccuguugccucg

SEQ ID NO: 890883 - RNA, 12 nt, Homo sapiens
cucuaguuuuaa

SEQ ID NO: 890884 - RNA, 18 nt, Homo sapiens
cucuauguaugcaucuau

SEQ ID NO: 890885 - RNA, 19 nt, Homo sapiens
cucuauucaauuuaauucu

SEQ ID NO: 890886 - RNA, 13 nt, Homo sapiens
cucucaggggcca

SEQ ID NO: 890887 - RNA, 17 nt, Homo sapiens
cucuccaacaucuucaa

SEQ ID NO: 890888 - RNA, 20 nt, Homo sapiens
cucucccaugcacacaaaca

SEQ ID NO: 890889 - RNA, 14 nt, Homo sapiens
cucuccucuugcca

SEQ ID NO: 890890 - RNA, 13 nt, Homo sapiens
cucuccugcugca

SEQ ID NO: 890891 - RNA, 16 nt, Homo sapiens
cucuccuuguucugau

SEQ ID NO: 890892 - RNA, 14 nt, Homo sapiens
cucucgaugccacu

SEQ ID NO: 890893 - RNA, 18 nt, Homo sapiens
cucucuaaaaauaaaaug

SEQ ID NO: 890894 - RNA, 17 nt, Homo sapiens
cucucuaaacccaaaua

SEQ ID NO: 890895 - RNA, 12 nt, Homo sapiens
cucucucugugu

SEQ ID NO: 890896 - RNA, 18 nt, Homo sapiens
cucucugagacugcuaag

SEQ ID NO: 890897 - RNA, 17 nt, Homo sapiens
cucucugagaugccccu

SEQ ID NO: 890898 - RNA, 12 nt, Homo sapiens
cucucugcucca

SEQ ID NO: 890899 - RNA, 15 nt, Homo sapiens
cucugaaauuuccca

SEQ ID NO: 890900 - RNA, 12 nt, Homo sapiens
cucugaagucac

SEQ ID NO: 890901 - RNA, 15 nt, Homo sapiens
cucugacacacagcu

SEQ ID NO: 890902 - RNA, 14 nt, Homo sapiens
cucugacuggaguc

SEQ ID NO: 890903 - RNA, 21 nt, Homo sapiens
cucugaggacacuaaccacgc

SEQ ID NO: 890904 - RNA, 12 nt, Homo sapiens
cucugauaccuc

SEQ ID NO: 890905 - RNA, 20 nt, Homo sapiens
cucugaugagagagugcuga

SEQ ID NO: 890906 - RNA, 13 nt, Homo sapiens
cucugcacauguc

SEQ ID NO: 890907 - RNA, 13 nt, Homo sapiens
cucugcaguauuu

SEQ ID NO: 890908 - RNA, 19 nt, Homo sapiens
cucugccagccacauccaa

SEQ ID NO: 890909 - RNA, 20 nt, Homo sapiens
cucugccccuucuguuucca

SEQ ID NO: 890910 - RNA, 13 nt, Homo sapiens
cucugcuccagag

SEQ ID NO: 890911 - RNA, 23 nt, Homo sapiens
cucugcuccccagugcuaccucu

SEQ ID NO: 890912 - RNA, 13 nt, Homo sapiens
cucugcugcauuu

SEQ ID NO: 890913 - RNA, 22 nt, Homo sapiens
cucuggaaaacucaggauucuc

SEQ ID NO: 890914 - RNA, 18 nt, Homo sapiens
cucuggaaaaugugaccc

SEQ ID NO: 890915 - RNA, 20 nt, Homo sapiens
cucuggacaggcauguucuc

SEQ ID NO: 890916 - RNA, 13 nt, Homo sapiens
cucuggaccagcc

SEQ ID NO: 890917 - RNA, 15 nt, Homo sapiens
cucuggaccagccug

SEQ ID NO: 890918 - RNA, 19 nt, Homo sapiens
cucuggaccagccuguugg

SEQ ID NO: 890919 - RNA, 16 nt, Homo sapiens
cucuggagccagagag

SEQ ID NO: 890920 - RNA, 18 nt, Homo sapiens
cccacuuucaccaguuuc

SEQ ID NO: 890921 - RNA, 14 nt, Homo sapiens
cccagaauagcuuu

SEQ ID NO: 890922 - RNA, 23 nt, Homo sapiens
cccagaggccaggaaucugccau

SEQ ID NO: 890923 - RNA, 21 nt, Homo sapiens
cccagaggugacccaaugcuc

SEQ ID NO: 890924 - RNA, 21 nt, Homo sapiens
cccagagugugaaacuuccua

SEQ ID NO: 890925 - RNA, 12 nt, Homo sapiens
cccagauugcaa

SEQ ID NO: 890926 - RNA, 11 nt, Homo sapiens
cccagcacugu

SEQ ID NO: 890927 - RNA, 15 nt, Homo sapiens
cccagcagacuugag

SEQ ID NO: 890928 - RNA, 19 nt, Homo sapiens
cccagcagcgguaccccag

SEQ ID NO: 890929 - RNA, 15 nt, Homo sapiens
cccagccacucggga

SEQ ID NO: 890930 - RNA, 21 nt, Homo sapiens
cccagccuagcccacuuguca

SEQ ID NO: 890931 - RNA, 17 nt, Homo sapiens
cccagccucgcaugcca

SEQ ID NO: 890932 - RNA, 17 nt, Homo sapiens
cccagcugucuguguca

SEQ ID NO: 890933 - RNA, 17 nt, Homo sapiens
cccaggaaggacugugc

SEQ ID NO: 890934 - RNA, 14 nt, Homo sapiens
cccaggaguuugag

SEQ ID NO: 890935 - RNA, 19 nt, Homo sapiens
cccaggcugcacugcagug

SEQ ID NO: 890936 - RNA, 19 nt, Homo sapiens
cccaggcuggaguacagug

SEQ ID NO: 890937 - RNA, 18 nt, Homo sapiens
cccaggcuggagugcagu

SEQ ID NO: 890938 - RNA, 22 nt, Homo sapiens
cccaggcuucacccugaauggu

SEQ ID NO: 890939 - RNA, 13 nt, Homo sapiens
cccagggcuaccc

SEQ ID NO: 890940 - RNA, 19 nt, Homo sapiens
cccaggucucuccacugcu

SEQ ID NO: 890941 - RNA, 22 nt, Homo sapiens
cccaguccgccaaacacuccac

SEQ ID NO: 890942 - RNA, 22 nt, Homo sapiens
cccagugcuucuccaacacuga

SEQ ID NO: 890943 - RNA, 12 nt, Homo sapiens
cccaguguaaag

SEQ ID NO: 890944 - RNA, 23 nt, Homo sapiens
cccaguuaaauuuucauuucaga

SEQ ID NO: 890945 - RNA, 12 nt, Homo sapiens
cccaguucugcu

SEQ ID NO: 890946 - RNA, 17 nt, Homo sapiens
cccauaauuuucuucau

SEQ ID NO: 890947 - RNA, 17 nt, Homo sapiens
cccauagaaacaugaca

SEQ ID NO: 890948 - RNA, 21 nt, Homo sapiens
cccauagaaacaugacacuga

SEQ ID NO: 890949 - RNA, 14 nt, Homo sapiens
cccauagcuuccau

SEQ ID NO: 890950 - RNA, 15 nt, Homo sapiens
cccaucaccuacuca

SEQ ID NO: 890951 - RNA, 16 nt, Homo sapiens
cccauccccuuuccuc

SEQ ID NO: 890952 - RNA, 19 nt, Homo sapiens
cccaucuaagcugcagcuu

SEQ ID NO: 890953 - RNA, 21 nt, Homo sapiens
cccaucugaaccacuuugccu

SEQ ID NO: 890954 - RNA, 21 nt, Homo sapiens
cccaugagaguagagggcacu

SEQ ID NO: 890955 - RNA, 20 nt, Homo sapiens
cccaugcccuggauccauca

SEQ ID NO: 890956 - RNA, 20 nt, Homo sapiens
cccaugcucaaccacugugg

SEQ ID NO: 890957 - RNA, 13 nt, Homo sapiens
cccauggccacuu

SEQ ID NO: 890958 - RNA, 18 nt, Homo sapiens
cccaugggggugcugcag

SEQ ID NO: 890959 - RNA, 17 nt, Homo sapiens
cccauguugcaugccua

SEQ ID NO: 890960 - RNA, 21 nt, Homo sapiens
cccauuacuuuaauacucacc

SEQ ID NO: 890961 - RNA, 17 nt, Homo sapiens
cccauucagacacuuca

SEQ ID NO: 890962 - RNA, 18 nt, Homo sapiens
cccauuuguaauguaucu

SEQ ID NO: 890963 - RNA, 23 nt, Homo sapiens
ccccaaacauuaaucaccaaagu

SEQ ID NO: 890964 - RNA, 23 nt, Homo sapiens
ccccaacaucucccucccacauu

SEQ ID NO: 890965 - RNA, 19 nt, Homo sapiens
ccccaacuauuaaagugcc

SEQ ID NO: 890966 - RNA, 14 nt, Homo sapiens
ccccaagugaccua

SEQ ID NO: 890967 - RNA, 22 nt, Homo sapiens
ccccaccugccauuugcacccu

SEQ ID NO: 890968 - RNA, 14 nt, Homo sapiens
ccccaccuggcuca

SEQ ID NO: 890969 - RNA, 12 nt, Homo sapiens
ccccacucuaua

SEQ ID NO: 890970 - RNA, 10 nt, Homo sapiens
ccccagacag

SEQ ID NO: 890971 - RNA, 17 nt, Homo sapiens
ccccagaguugggaugc

SEQ ID NO: 890972 - RNA, 12 nt, Homo sapiens
ccccagccaugg

SEQ ID NO: 890973 - RNA, 15 nt, Homo sapiens
ccccagccaugguga

SEQ ID NO: 890974 - RNA, 15 nt, Homo sapiens
ccccagcccuuugca

SEQ ID NO: 890975 - RNA, 15 nt, Homo sapiens
ccccagcgauucccu

SEQ ID NO: 890976 - RNA, 13 nt, Homo sapiens
ccccauuugcaca

SEQ ID NO: 890977 - RNA, 13 nt, Homo sapiens
cccccacuuggga

SEQ ID NO: 890978 - RNA, 11 nt, Homo sapiens
cccccagugug

SEQ ID NO: 890979 - RNA, 14 nt, Homo sapiens
cccccgcuccagau

SEQ ID NO: 890980 - RNA, 21 nt, Homo sapiens
cccccugacauuaucuuggau

SEQ ID NO: 890981 - RNA, 16 nt, Homo sapiens
cccccugcagcuugua

SEQ ID NO: 890982 - RNA, 14 nt, Homo sapiens
cccccugccagucu

SEQ ID NO: 890983 - RNA, 14 nt, Homo sapiens
cccccugcugcuca

SEQ ID NO: 890984 - RNA, 13 nt, Homo sapiens
ccccgcuccagau

SEQ ID NO: 890985 - RNA, 18 nt, Homo sapiens
ccccuaugcccacucuaa

SEQ ID NO: 890986 - RNA, 15 nt, Homo sapiens
ccccucggagaagag

SEQ ID NO: 890987 - RNA, 21 nt, Homo sapiens
ccccugaccucaccuuugcaa

SEQ ID NO: 890988 - RNA, 14 nt, Homo sapiens
ccccugccuuugaa

SEQ ID NO: 890989 - RNA, 14 nt, Homo sapiens
ccccuggcuuuuca

SEQ ID NO: 890990 - RNA, 22 nt, Homo sapiens
ccccuuaaggguugaaggcagu

SEQ ID NO: 890991 - RNA, 22 nt, Homo sapiens
ccccuuauccaggacucuguca

SEQ ID NO: 890992 - RNA, 17 nt, Homo sapiens
cccgaauuuagucacac

SEQ ID NO: 890993 - RNA, 18 nt, Homo sapiens
cccgcaguugugccaaag

SEQ ID NO: 890994 - RNA, 19 nt, Homo sapiens
cccggcugucaaggggugu

SEQ ID NO: 890995 - RNA, 17 nt, Homo sapiens
cccuaagaggcagugag

SEQ ID NO: 890996 - RNA, 15 nt, Homo sapiens
cccuaauaaguccac

SEQ ID NO: 890997 - RNA, 21 nt, Homo sapiens
cccuaauaaguccacaucuuc

SEQ ID NO: 890998 - RNA, 15 nt, Homo sapiens
cccuacccucacuca

SEQ ID NO: 890999 - RNA, 13 nt, Homo sapiens
cccuagcagugaa

SEQ ID NO: 891000 - RNA, 19 nt, Homo sapiens
cccuagcgcucucuuccag

SEQ ID NO: 891001 - RNA, 13 nt, Homo sapiens
cccuaugcuccag

SEQ ID NO: 891002 - RNA, 13 nt, Homo sapiens
cccuauuaaccua

SEQ ID NO: 891003 - RNA, 20 nt, Homo sapiens
cccucaaaugacccaaagac

SEQ ID NO: 891004 - RNA, 22 nt, Homo sapiens
cccucacuccugccaguugaaa

SEQ ID NO: 891005 - RNA, 11 nt, Homo sapiens
cccucagggau

SEQ ID NO: 891006 - RNA, 16 nt, Homo sapiens
cccucauuaugacucu

SEQ ID NO: 891007 - RNA, 14 nt, Homo sapiens
cccuccacugucac

SEQ ID NO: 891008 - RNA, 14 nt, Homo sapiens
cccucccauagcac

SEQ ID NO: 891009 - RNA, 13 nt, Homo sapiens
cccuccccauuca

SEQ ID NO: 891010 - RNA, 17 nt, Homo sapiens
cccucccuggcauguca

SEQ ID NO: 891011 - RNA, 23 nt, Homo sapiens
cccucggugaugcggacaucuca

SEQ ID NO: 891012 - RNA, 16 nt, Homo sapiens
cccucucuugccuuuc

SEQ ID NO: 891013 - RNA, 17 nt, Homo sapiens
cccugaaaacccagaga

SEQ ID NO: 891014 - RNA, 13 nt, Homo sapiens
cccugaacaucug

SEQ ID NO: 891015 - RNA, 18 nt, Homo sapiens
cccugacauuaucuugga

SEQ ID NO: 891016 - RNA, 13 nt, Homo sapiens
cccugacauuucu

SEQ ID NO: 891017 - RNA, 16 nt, Homo sapiens
cccugaccucccagcc

SEQ ID NO: 891018 - RNA, 11 nt, Homo sapiens
ccucagaugau

SEQ ID NO: 891019 - RNA, 14 nt, Homo sapiens
ccucagaugaucuc

SEQ ID NO: 891020 - RNA, 21 nt, Homo sapiens
ccucagccuugaaaaacaagu

SEQ ID NO: 891021 - RNA, 21 nt, Homo sapiens
ccucaggauuucauugacuga

SEQ ID NO: 891022 - RNA, 18 nt, Homo sapiens
ccucagguaguacuggga

SEQ ID NO: 891023 - RNA, 21 nt, Homo sapiens
ccucaguuuccugaccuauga

SEQ ID NO: 891024 - RNA, 20 nt, Homo sapiens
ccucauuccccaaccacuuc

SEQ ID NO: 891025 - RNA, 17 nt, Homo sapiens
ccucauuuaucccucaa

SEQ ID NO: 891026 - RNA, 13 nt, Homo sapiens
ccuccaaaugcca

SEQ ID NO: 891027 - RNA, 21 nt, Homo sapiens
ccuccaagccauucacuuccc

SEQ ID NO: 891028 - RNA, 17 nt, Homo sapiens
ccuccagagacaggaaa

SEQ ID NO: 891029 - RNA, 22 nt, Homo sapiens
ccuccaggaugaguuacuugaa

SEQ ID NO: 891030 - RNA, 16 nt, Homo sapiens
ccuccagguauuugag

SEQ ID NO: 891031 - RNA, 12 nt, Homo sapiens
ccuccauuugca

SEQ ID NO: 891032 - RNA, 20 nt, Homo sapiens
ccucccaaagugcuaguauu

SEQ ID NO: 891033 - RNA, 18 nt, Homo sapiens
ccucccaguuugcugggu

SEQ ID NO: 891034 - RNA, 20 nt, Homo sapiens
ccucccgggggcacugccug

SEQ ID NO: 891035 - RNA, 22 nt, Homo sapiens
ccucccuauuaaccuagagauu

SEQ ID NO: 891036 - RNA, 20 nt, Homo sapiens
ccucccugugugaaauguau

SEQ ID NO: 891037 - RNA, 16 nt, Homo sapiens
ccucccuuucugggag

SEQ ID NO: 891038 - RNA, 21 nt, Homo sapiens
cagccugcagacucacugugg

SEQ ID NO: 891039 - RNA, 19 nt, Homo sapiens
cagccugggugacagagca

SEQ ID NO: 891040 - RNA, 22 nt, Homo sapiens
cagccuucugacaagcaagggc

SEQ ID NO: 891041 - RNA, 17 nt, Homo sapiens
cagcgaaugaaugcugu

SEQ ID NO: 891042 - RNA, 14 nt, Homo sapiens
cagcgcgugcacag

SEQ ID NO: 891043 - RNA, 15 nt, Homo sapiens
cagcggaggagacca

SEQ ID NO: 891044 - RNA, 21 nt, Homo sapiens
cagcgggaucucguaucuuua

SEQ ID NO: 891045 - RNA, 20 nt, Homo sapiens
cagcggucauucuacacuga

SEQ ID NO: 891046 - RNA, 15 nt, Homo sapiens
cagcgugcuuagccu

SEQ ID NO: 891047 - RNA, 22 nt, Homo sapiens
cagcuaagcccccuacugagaa

SEQ ID NO: 891048 - RNA, 14 nt, Homo sapiens
cagcuaaugggaca

SEQ ID NO: 891049 - RNA, 22 nt, Homo sapiens
cagcuacauuccucagcugcca

SEQ ID NO: 891050 - RNA, 19 nt, Homo sapiens
cagcuacucaggaggcuaa

SEQ ID NO: 891051 - RNA, 17 nt, Homo sapiens
cagcuaggaugugcauu

SEQ ID NO: 891052 - RNA, 21 nt, Homo sapiens
cagcuagugacccacaugcca

SEQ ID NO: 891053 - RNA, 20 nt, Homo sapiens
cagcuaucugucaucucucu

SEQ ID NO: 891054 - RNA, 13 nt, Homo sapiens
cagcucagagaug

SEQ ID NO: 891055 - RNA, 15 nt, Homo sapiens
cagcucagaggccca

SEQ ID NO: 891056 - RNA, 20 nt, Homo sapiens
cagcuccagaauaccuucuu

SEQ ID NO: 891057 - RNA, 20 nt, Homo sapiens
cagcucuguguuucugggga

SEQ ID NO: 891058 - RNA, 16 nt, Homo sapiens
cagcugaacagccaaa

SEQ ID NO: 891059 - RNA, 13 nt, Homo sapiens
cagcugacagaua

SEQ ID NO: 891060 - RNA, 19 nt, Homo sapiens
cagcugcgguccacccagg

SEQ ID NO: 891061 - RNA, 15 nt, Homo sapiens
cagcugcuacaagaa

SEQ ID NO: 891062 - RNA, 17 nt, Homo sapiens
cagcugcucccaaauaa

SEQ ID NO: 891063 - RNA, 12 nt, Homo sapiens
cagcugcugaag

SEQ ID NO: 891064 - RNA, 21 nt, Homo sapiens
cagcuggacaauaugaaucuu

SEQ ID NO: 891065 - RNA, 15 nt, Homo sapiens
cagcuggugcugcaa

SEQ ID NO: 891066 - RNA, 15 nt, Homo sapiens
cagcuguagccaugg

SEQ ID NO: 891067 - RNA, 13 nt, Homo sapiens
cagcugucauuca

SEQ ID NO: 891068 - RNA, 15 nt, Homo sapiens
cagcuguguucacac

SEQ ID NO: 891069 - RNA, 20 nt, Homo sapiens
cagcuguguucacacuguaa

SEQ ID NO: 891070 - RNA, 21 nt, Homo sapiens
cagcuucauuuccgugaaggg

SEQ ID NO: 891071 - RNA, 15 nt, Homo sapiens
caggaaaaucugcac

SEQ ID NO: 891072 - RNA, 14 nt, Homo sapiens
caggaaaccacuua

SEQ ID NO: 891073 - RNA, 19 nt, Homo sapiens
caggaacacccgacuccuc

SEQ ID NO: 891074 - RNA, 21 nt, Homo sapiens
caggaacagagacucuggaag

SEQ ID NO: 891075 - RNA, 23 nt, Homo sapiens
caggaagucucucccgauaucac

SEQ ID NO: 891076 - RNA, 16 nt, Homo sapiens
caggaaucucagagac

SEQ ID NO: 891077 - RNA, 14 nt, Homo sapiens
caggacaccugccc

SEQ ID NO: 891078 - RNA, 21 nt, Homo sapiens
caggacacggggcaguggcaa

SEQ ID NO: 891079 - RNA, 14 nt, Homo sapiens
caggagacaguuca

SEQ ID NO: 891080 - RNA, 13 nt, Homo sapiens
caggagacccaga

SEQ ID NO: 891081 - RNA, 22 nt, Homo sapiens
caggagaggggcagaacagccg

SEQ ID NO: 891082 - RNA, 17 nt, Homo sapiens
caggagaucgagaccau

SEQ ID NO: 891083 - RNA, 17 nt, Homo sapiens
caggagcugaagcccau

SEQ ID NO: 891084 - RNA, 18 nt, Homo sapiens
caggaggcuuggaaagca

SEQ ID NO: 891085 - RNA, 20 nt, Homo sapiens
caggagguggagguugcagu

SEQ ID NO: 891086 - RNA, 15 nt, Homo sapiens
caggagguuguggau

SEQ ID NO: 891087 - RNA, 20 nt, Homo sapiens
caggaguugacgcauccugc

SEQ ID NO: 891088 - RNA, 19 nt, Homo sapiens
caggauaccauauacagcu

SEQ ID NO: 891089 - RNA, 15 nt, Homo sapiens
caggauacucuguca

SEQ ID NO: 891090 - RNA, 23 nt, Homo sapiens
caggaucacaagaaucaccucaa

SEQ ID NO: 891091 - RNA, 22 nt, Homo sapiens
caggauggaauccuacagccuc

SEQ ID NO: 891092 - RNA, 17 nt, Homo sapiens
caggauguggcacugcu

SEQ ID NO: 891093 - RNA, 22 nt, Homo sapiens
caggauuuuagugcuugccacc

SEQ ID NO: 891094 - RNA, 14 nt, Homo sapiens
caggcaagugaaga

SEQ ID NO: 891095 - RNA, 17 nt, Homo sapiens
caggcacccaccaucau

SEQ ID NO: 891096 - RNA, 23 nt, Homo sapiens
caggcacgaacccaccugcugag

SEQ ID NO: 891097 - RNA, 14 nt, Homo sapiens
caggcacugagaau

SEQ ID NO: 891098 - RNA, 18 nt, Homo sapiens
caggcagagaaucauacu

SEQ ID NO: 891099 - RNA, 17 nt, Homo sapiens
caggcagaucacaaggu

SEQ ID NO: 891100 - RNA, 16 nt, Homo sapiens
caggcaugcaccagug

SEQ ID NO: 891101 - RNA, 13 nt, Homo sapiens
caggcccagagaa

SEQ ID NO: 891102 - RNA, 19 nt, Homo sapiens
caggcucagacucuggguc

SEQ ID NO: 891103 - RNA, 23 nt, Homo sapiens
caggcugagcaccucagccuuua

SEQ ID NO: 891104 - RNA, 19 nt, Homo sapiens
caggcuguaagcauucuga

SEQ ID NO: 891105 - RNA, 22 nt, Homo sapiens
caggcugugggucugcaccucu

SEQ ID NO: 891106 - RNA, 13 nt, Homo sapiens
cagggaauuucag

SEQ ID NO: 891107 - RNA, 17 nt, Homo sapiens
cagggacccacuucaca

SEQ ID NO: 891108 - RNA, 19 nt, Homo sapiens
cagggagaccgagcgcuuu

SEQ ID NO: 891109 - RNA, 14 nt, Homo sapiens
cagggaggaugcca

SEQ ID NO: 891110 - RNA, 13 nt, Homo sapiens
cagggaugccaac

SEQ ID NO: 891111 - RNA, 17 nt, Homo sapiens
cagggaugccaacaccu

SEQ ID NO: 891112 - RNA, 18 nt, Homo sapiens
cagggauuuuuauuugua

SEQ ID NO: 891113 - RNA, 14 nt, Homo sapiens
cagggcaaucaaug

SEQ ID NO: 891114 - RNA, 13 nt, Homo sapiens
cagggcacugucu

SEQ ID NO: 891115 - RNA, 22 nt, Homo sapiens
cagggcagccuccaccuugcuc

SEQ ID NO: 891116 - RNA, 13 nt, Homo sapiens
cagggcaucccau

SEQ ID NO: 891117 - RNA, 21 nt, Homo sapiens
cagggcucagccuggugggcc

SEQ ID NO: 891118 - RNA, 22 nt, Homo sapiens
cagggcucagccuggugggccu

SEQ ID NO: 891119 - RNA, 22 nt, Homo sapiens
caggggcaaagaacugccccau

SEQ ID NO: 891120 - RNA, 21 nt, Homo sapiens
caggggucgucaccaccucuc

SEQ ID NO: 891121 - RNA, 23 nt, Homo sapiens
caggggucucccuggagugcagu

SEQ ID NO: 891122 - RNA, 19 nt, Homo sapiens
caggggugccugugggggu

SEQ ID NO: 891123 - RNA, 20 nt, Homo sapiens
caggggugcuaugacaugca

SEQ ID NO: 891124 - RNA, 19 nt, Homo sapiens
caggguccagacccugaag

SEQ ID NO: 891125 - RNA, 15 nt, Homo sapiens
caggguucugaggca

SEQ ID NO: 891126 - RNA, 21 nt, Homo sapiens
caggguucugaggcaaauggc

SEQ ID NO: 891127 - RNA, 14 nt, Homo sapiens
caggguugaucaca

SEQ ID NO: 891128 - RNA, 20 nt, Homo sapiens
caggguugaucacacucugg

SEQ ID NO: 891129 - RNA, 23 nt, Homo sapiens
caggguuuacccagugggacaga

SEQ ID NO: 891130 - RNA, 21 nt, Homo sapiens
caggguuucaccauauuggcc

SEQ ID NO: 891131 - RNA, 21 nt, Homo sapiens
cagguacugauccuguuucuu

SEQ ID NO: 891132 - RNA, 20 nt, Homo sapiens
cagguagaacacaaggucau

SEQ ID NO: 891133 - RNA, 21 nt, Homo sapiens
cagguagaacacaaggucauu

SEQ ID NO: 891134 - RNA, 21 nt, Homo sapiens
cagguagugggugaaugugug

SEQ ID NO: 891135 - RNA, 21 nt, Homo sapiens
cagguauuuuaacugugugaa

SEQ ID NO: 891136 - RNA, 14 nt, Homo sapiens
caggucaacaucua

SEQ ID NO: 891137 - RNA, 15 nt, Homo sapiens
caggucaugcugcug

SEQ ID NO: 891138 - RNA, 18 nt, Homo sapiens
caggucucccuggaucag

SEQ ID NO: 891139 - RNA, 14 nt, Homo sapiens
caggugaauggagg

SEQ ID NO: 891140 - RNA, 16 nt, Homo sapiens
caggugauccacccac

SEQ ID NO: 891141 - RNA, 19 nt, Homo sapiens
caggugccaguuauggcua

SEQ ID NO: 891142 - RNA, 15 nt, Homo sapiens
caggugccuaccacc

SEQ ID NO: 891143 - RNA, 14 nt, Homo sapiens
caggugcugacaau

SEQ ID NO: 891144 - RNA, 14 nt, Homo sapiens
caggugcugccauc

SEQ ID NO: 891145 - RNA, 13 nt, Homo sapiens
caggugcuucagg

SEQ ID NO: 891146 - RNA, 15 nt, Homo sapiens
cagguggccuagcag

SEQ ID NO: 891147 - RNA, 19 nt, Homo sapiens
cagguguaagccaccgugc

SEQ ID NO: 891148 - RNA, 20 nt, Homo sapiens
cagguguaagccaccgugcc

SEQ ID NO: 891149 - RNA, 16 nt, Homo sapiens
ccagcuuuaucuguca

SEQ ID NO: 891150 - RNA, 15 nt, Homo sapiens
ccaggaaggcagcug

SEQ ID NO: 891151 - RNA, 16 nt, Homo sapiens
ccaggaauaggcauuu

SEQ ID NO: 891152 - RNA, 13 nt, Homo sapiens
ccaggaaugccuc

SEQ ID NO: 891153 - RNA, 17 nt, Homo sapiens
ccaggagagagaucuag

SEQ ID NO: 891154 - RNA, 23 nt, Homo sapiens
ccaggagguggagguugcaguga

SEQ ID NO: 891155 - RNA, 19 nt, Homo sapiens
ccaggaguucugaagcuga

SEQ ID NO: 891156 - RNA, 20 nt, Homo sapiens
ccaggaugaaggcgugcaag

SEQ ID NO: 891157 - RNA, 19 nt, Homo sapiens
ccaggaugaguuacuugaa

SEQ ID NO: 891158 - RNA, 22 nt, Homo sapiens
ccaggauggcgugugugccgug

SEQ ID NO: 891159 - RNA, 16 nt, Homo sapiens
ccaggauggugcagga

SEQ ID NO: 891160 - RNA, 14 nt, Homo sapiens
ccaggcacugcugc

SEQ ID NO: 891161 - RNA, 15 nt, Homo sapiens
ccaggccaaugcagc

SEQ ID NO: 891162 - RNA, 18 nt, Homo sapiens
ccaggccgccugccauac

SEQ ID NO: 891163 - RNA, 14 nt, Homo sapiens
ccaggcuagaggca

SEQ ID NO: 891164 - RNA, 18 nt, Homo sapiens
ccaggcuggagugcagua

SEQ ID NO: 891165 - RNA, 23 nt, Homo sapiens
ccaggcuggcagauuuccaaaag

SEQ ID NO: 891166 - RNA, 20 nt, Homo sapiens
ccaggcugugggucugcacc

SEQ ID NO: 891167 - RNA, 14 nt, Homo sapiens
ccaggcuguuucuu

SEQ ID NO: 891168 - RNA, 21 nt, Homo sapiens
ccaggcuucacccugaauggu

SEQ ID NO: 891169 - RNA, 18 nt, Homo sapiens
ccagggaugacauguccc

SEQ ID NO: 891170 - RNA, 22 nt, Homo sapiens
ccaggguugaucacacucuggg

SEQ ID NO: 891171 - RNA, 20 nt, Homo sapiens
ccaggucguccaagcaaaaa

SEQ ID NO: 891172 - RNA, 12 nt, Homo sapiens
ccaguccaugag

SEQ ID NO: 891173 - RNA, 20 nt, Homo sapiens
ccagucuugucauugccagc

SEQ ID NO: 891174 - RNA, 17 nt, Homo sapiens
ccagugaaccaaagaga

SEQ ID NO: 891175 - RNA, 15 nt, Homo sapiens
ccaguggcaguguau

SEQ ID NO: 891176 - RNA, 12 nt, Homo sapiens
ccagugucccca

SEQ ID NO: 891177 - RNA, 23 nt, Homo sapiens
ccaguguccccuccacugucaca

SEQ ID NO: 891178 - RNA, 18 nt, Homo sapiens
ccaguucaucuauggcag

SEQ ID NO: 891179 - RNA, 13 nt, Homo sapiens
ccauaaagugcca

SEQ ID NO: 891180 - RNA, 12 nt, Homo sapiens
ccauaacagcca

SEQ ID NO: 891181 - RNA, 13 nt, Homo sapiens
ccauaacagccaa

SEQ ID NO: 891182 - RNA, 20 nt, Homo sapiens
ccauaaucucauucaaagaa

SEQ ID NO: 891183 - RNA, 14 nt, Homo sapiens
ccauaauguuacau

SEQ ID NO: 891184 - RNA, 14 nt, Homo sapiens
ccauacacauugga

SEQ ID NO: 891185 - RNA, 13 nt, Homo sapiens
ccauagauggguc

SEQ ID NO: 891186 - RNA, 19 nt, Homo sapiens
ccauagcaagauugcuuaa

SEQ ID NO: 891187 - RNA, 23 nt, Homo sapiens
ccauaguggagagaacugaauaa

SEQ ID NO: 891188 - RNA, 24 nt, Homo sapiens
ccauauggaggccucacacccaga

SEQ ID NO: 891189 - RNA, 18 nt, Homo sapiens
ccauaugucugcuucugu

SEQ ID NO: 891190 - RNA, 15 nt, Homo sapiens
ccaucacacaugcau

SEQ ID NO: 891191 - RNA, 22 nt, Homo sapiens
ccaucacccccuaccccagaaa

SEQ ID NO: 891192 - RNA, 15 nt, Homo sapiens
ccaucaccuacucac

SEQ ID NO: 891193 - RNA, 19 nt, Homo sapiens
ccaucagcuggguggugua

SEQ ID NO: 891194 - RNA, 18 nt, Homo sapiens
ccaucaggccuaaucuca

SEQ ID NO: 891195 - RNA, 16 nt, Homo sapiens
ccaucaguuacugguu

SEQ ID NO: 891196 - RNA, 17 nt, Homo sapiens
ccaucaugcuugauuga

SEQ ID NO: 891197 - RNA, 17 nt, Homo sapiens
ccauccaauucuuugaa

SEQ ID NO: 891198 - RNA, 14 nt, Homo sapiens
ccauccauauacuu

SEQ ID NO: 891199 - RNA, 19 nt, Homo sapiens
ccauccccuggacugggag

SEQ ID NO: 891200 - RNA, 19 nt, Homo sapiens
ccauccuaccaaugcaugc

SEQ ID NO: 891201 - RNA, 16 nt, Homo sapiens
ccaucggcuuccauau

SEQ ID NO: 891202 - RNA, 22 nt, Homo sapiens
ccaucguccuuccucucaagcu

SEQ ID NO: 891203 - RNA, 15 nt, Homo sapiens
ccaucucauucaggu

SEQ ID NO: 891204 - RNA, 16 nt, Homo sapiens
ccaucucugauuuuca

SEQ ID NO: 891205 - RNA, 13 nt, Homo sapiens
ccaucugcuccuc

SEQ ID NO: 891206 - RNA, 22 nt, Homo sapiens
ccaucugucuugccagccagaa

SEQ ID NO: 891207 - RNA, 17 nt, Homo sapiens
ccaucuuuuaauaugcu

SEQ ID NO: 891208 - RNA, 23 nt, Homo sapiens
ccaucuuuugugagauguaauug

SEQ ID NO: 891209 - RNA, 15 nt, Homo sapiens
ccaugaaaaugcaac

SEQ ID NO: 891210 - RNA, 17 nt, Homo sapiens
ccaugaaaaugcaacaa

SEQ ID NO: 891211 - RNA, 15 nt, Homo sapiens
ccaugaaucaaagac

SEQ ID NO: 891212 - RNA, 23 nt, Homo sapiens
ccaugagaguagagggcacuggg

SEQ ID NO: 891213 - RNA, 15 nt, Homo sapiens
ccaugagaguuucaa

SEQ ID NO: 891214 - RNA, 23 nt, Homo sapiens
ccaugaggccuuuccccagugug

SEQ ID NO: 891215 - RNA, 20 nt, Homo sapiens
ccaugccacccuguuuucag

SEQ ID NO: 891216 - RNA, 23 nt, Homo sapiens
ccaugccccccguggcuggcacc

SEQ ID NO: 891217 - RNA, 21 nt, Homo sapiens
ccaugccucuccaacaucuuc

SEQ ID NO: 891218 - RNA, 15 nt, Homo sapiens
ccaugcgcugcucaa

SEQ ID NO: 891219 - RNA, 14 nt, Homo sapiens
ccaugcuucuugcc

SEQ ID NO: 891220 - RNA, 23 nt, Homo sapiens
ccaugcuuuccuuuucuuccuuc

SEQ ID NO: 891221 - RNA, 16 nt, Homo sapiens
ccauggacacauuuuc

SEQ ID NO: 891222 - RNA, 15 nt, Homo sapiens
ccaugggauguuaag

SEQ ID NO: 891223 - RNA, 23 nt, Homo sapiens
ccaugggcuagugugaguggcag

SEQ ID NO: 891224 - RNA, 16 nt, Homo sapiens
ccaugggggugcugca

SEQ ID NO: 891225 - RNA, 17 nt, Homo sapiens
ccaugggggugcugcag

SEQ ID NO: 891226 - RNA, 21 nt, Homo sapiens
ccauguaccaguguacugcuu

SEQ ID NO: 891227 - RNA, 17 nt, Homo sapiens
ccauguaucuaccucac

SEQ ID NO: 891228 - RNA, 19 nt, Homo sapiens
ccaugucgccucugcauuc

SEQ ID NO: 891229 - RNA, 17 nt, Homo sapiens
ccauguuggccaggcug

SEQ ID NO: 891230 - RNA, 15 nt, Homo sapiens
ccauguuuaaacuuu

SEQ ID NO: 891231 - RNA, 18 nt, Homo sapiens
ccauguuugguuguaaau

SEQ ID NO: 891232 - RNA, 12 nt, Homo sapiens
ccauuacuguaa

SEQ ID NO: 891233 - RNA, 18 nt, Homo sapiens
ccauuauaaaaaauuaaa

SEQ ID NO: 891234 - RNA, 23 nt, Homo sapiens
ccauuauuucaaccgcuugccau

SEQ ID NO: 891235 - RNA, 13 nt, Homo sapiens
ccauuuccugaga

SEQ ID NO: 891236 - RNA, 13 nt, Homo sapiens
ccauuuguaaugu

SEQ ID NO: 891237 - RNA, 19 nt, Homo sapiens
ccauuuuggaaguuuucag

SEQ ID NO: 891238 - RNA, 22 nt, Homo sapiens
cccaaaaccuuuccccagacac

SEQ ID NO: 891239 - RNA, 19 nt, Homo sapiens
cccaaaagucaccacucca

SEQ ID NO: 891240 - RNA, 15 nt, Homo sapiens
cccaaaggcauccau

SEQ ID NO: 891241 - RNA, 14 nt, Homo sapiens
cccaaauccagugu

SEQ ID NO: 891242 - RNA, 14 nt, Homo sapiens
cccaaaucccacag

SEQ ID NO: 891243 - RNA, 13 nt, Homo sapiens
cccaacaugacug

SEQ ID NO: 891244 - RNA, 19 nt, Homo sapiens
cccaacuagacauuaccaa

SEQ ID NO: 891245 - RNA, 11 nt, Homo sapiens
cccaagccaga

SEQ ID NO: 891246 - RNA, 23 nt, Homo sapiens
cccaaguguugaggggaccaaag

SEQ ID NO: 891247 - RNA, 18 nt, Homo sapiens
cccaaguuauugggaugu

SEQ ID NO: 891248 - RNA, 11 nt, Homo sapiens
acugaccagcc

SEQ ID NO: 891249 - RNA, 15 nt, Homo sapiens
acugaccugccugua

SEQ ID NO: 891250 - RNA, 19 nt, Homo sapiens
acugagaugugaacacauc

SEQ ID NO: 891251 - RNA, 20 nt, Homo sapiens
acugagauuuugguauuaca

SEQ ID NO: 891252 - RNA, 20 nt, Homo sapiens
acugagcaguaccagugugc

SEQ ID NO: 891253 - RNA, 21 nt, Homo sapiens
acugagccaaacacacuguaa

SEQ ID NO: 891254 - RNA, 16 nt, Homo sapiens
acugagccucuuuuca

SEQ ID NO: 891255 - RNA, 13 nt, Homo sapiens
acugagcggacag

SEQ ID NO: 891256 - RNA, 14 nt, Homo sapiens
acugauccuguuuc

SEQ ID NO: 891257 - RNA, 20 nt, Homo sapiens
acugaugcgaaaacuugaau

SEQ ID NO: 891258 - RNA, 20 nt, Homo sapiens
acugauguccggagagacag

SEQ ID NO: 891259 - RNA, 21 nt, Homo sapiens
acugauguuacaucacagugu

SEQ ID NO: 891260 - RNA, 14 nt, Homo sapiens
acugauuaccuccu

SEQ ID NO: 891261 - RNA, 20 nt, Homo sapiens
acugauuucacaacagauca

SEQ ID NO: 891262 - RNA, 20 nt, Homo sapiens
acugcaagcagggcucugcc

SEQ ID NO: 891263 - RNA, 18 nt, Homo sapiens
acugcacagugcaucuca

SEQ ID NO: 891264 - RNA, 19 nt, Homo sapiens
acugcacagugcaucucag

SEQ ID NO: 891265 - RNA, 14 nt, Homo sapiens
acugcacucuagcc

SEQ ID NO: 891266 - RNA, 13 nt, Homo sapiens
acugcagcugcug

SEQ ID NO: 891267 - RNA, 20 nt, Homo sapiens
acugcagggacugccagucc

SEQ ID NO: 891268 - RNA, 14 nt, Homo sapiens
acugcagugagaau

SEQ ID NO: 891269 - RNA, 15 nt, Homo sapiens
acugcaugcacuucu

SEQ ID NO: 891270 - RNA, 19 nt, Homo sapiens
acugcauuuuuaaauacaa

SEQ ID NO: 891271 - RNA, 14 nt, Homo sapiens
acugccacccuuga

SEQ ID NO: 891272 - RNA, 17 nt, Homo sapiens
acugccagcagcuguuu

SEQ ID NO: 891273 - RNA, 19 nt, Homo sapiens
acugccaggagggacaaag

SEQ ID NO: 891274 - RNA, 21 nt, Homo sapiens
acugccaucaagaugagagaa

SEQ ID NO: 891275 - RNA, 13 nt, Homo sapiens
acugccaugccuc

SEQ ID NO: 891276 - RNA, 20 nt, Homo sapiens
acugccaugcuagacaagcu

SEQ ID NO: 891277 - RNA, 16 nt, Homo sapiens
acugccucuccagcac

SEQ ID NO: 891278 - RNA, 16 nt, Homo sapiens
acugccuuaaugagaa

SEQ ID NO: 891279 - RNA, 22 nt, Homo sapiens
acugcucaagagaagcacauga

SEQ ID NO: 891280 - RNA, 15 nt, Homo sapiens
acugcucgucuauca

SEQ ID NO: 891281 - RNA, 20 nt, Homo sapiens
acugcucgucuaucaccagg

SEQ ID NO: 891282 - RNA, 17 nt, Homo sapiens
acugcugcagacaccug

SEQ ID NO: 891283 - RNA, 19 nt, Homo sapiens
acugcugcccagccuccaa

SEQ ID NO: 891284 - RNA, 20 nt, Homo sapiens
acugcuguucauguuacuca

SEQ ID NO: 891285 - RNA, 17 nt, Homo sapiens
acuggaaagacauagcc

SEQ ID NO: 891286 - RNA, 15 nt, Homo sapiens
acuggaagcacagcu

SEQ ID NO: 891287 - RNA, 18 nt, Homo sapiens
acuggacaucacagcaga

SEQ ID NO: 891288 - RNA, 20 nt, Homo sapiens
acuggacuugagcuuggcag

SEQ ID NO: 891289 - RNA, 19 nt, Homo sapiens
acuggacuugucuuccuug

SEQ ID NO: 891290 - RNA, 19 nt, Homo sapiens
acuggagcaucugacucac

SEQ ID NO: 891291 - RNA, 21 nt, Homo sapiens
acuggagcaucugacucacaa

SEQ ID NO: 891292 - RNA, 16 nt, Homo sapiens
acuggauauguuguua

SEQ ID NO: 891293 - RNA, 15 nt, Homo sapiens
acuggaugaggucau

SEQ ID NO: 891294 - RNA, 23 nt, Homo sapiens
acuggccagagagggcccagcug

SEQ ID NO: 891295 - RNA, 19 nt, Homo sapiens
acugggccuccaaccaugu

SEQ ID NO: 891296 - RNA, 14 nt, Homo sapiens
acuuuaaugggagg

SEQ ID NO: 891297 - RNA, 23 nt, Homo sapiens
acuuuacaggagguuguggaugc

SEQ ID NO: 891298 - RNA, 18 nt, Homo sapiens
acuuucagguacuaaaua

SEQ ID NO: 891299 - RNA, 22 nt, Homo sapiens
acuuuccauagggccuccuuag

SEQ ID NO: 891300 - RNA, 14 nt, Homo sapiens
acuuucucugcaaa

SEQ ID NO: 891301 - RNA, 16 nt, Homo sapiens
acuuugaaucugcaac

SEQ ID NO: 891302 - RNA, 14 nt, Homo sapiens
acuuugaguaccaa

SEQ ID NO: 891303 - RNA, 14 nt, Homo sapiens
acuuugaucucugc

SEQ ID NO: 891304 - RNA, 17 nt, Homo sapiens
acuuugguacauggcca

SEQ ID NO: 891305 - RNA, 21 nt, Homo sapiens
acuuugguucucuccaggaag

SEQ ID NO: 891306 - RNA, 19 nt, Homo sapiens
acuuuguauuaauguguua

SEQ ID NO: 891307 - RNA, 12 nt, Homo sapiens
acuuugugaaaa

SEQ ID NO: 891308 - RNA, 14 nt, Homo sapiens
acuuuuccuuugaa

SEQ ID NO: 891309 - RNA, 23 nt, Homo sapiens
acuuuucugugucauaccacaau

SEQ ID NO: 891310 - RNA, 18 nt, Homo sapiens
acuuuuuacagugcuauu

SEQ ID NO: 891311 - RNA, 17 nt, Homo sapiens
acuuuuuagccagugac

SEQ ID NO: 891312 - RNA, 19 nt, Homo sapiens
acuuuuucugagcuuuuca

SEQ ID NO: 891313 - RNA, 11 nt, Homo sapiens
acuuuuugccc

SEQ ID NO: 891314 - RNA, 23 nt, Homo sapiens
agaaaaaaaaaaaaaaucacugu

SEQ ID NO: 891315 - RNA, 14 nt, Homo sapiens
agaaaaagagccau

SEQ ID NO: 891316 - RNA, 17 nt, Homo sapiens
agaaaacacagccugug

SEQ ID NO: 891317 - RNA, 19 nt, Homo sapiens
agaaaaccagcgcaaggaa

SEQ ID NO: 891318 - RNA, 13 nt, Homo sapiens
agaaaacuggaaa

SEQ ID NO: 891319 - RNA, 13 nt, Homo sapiens
agaaaagcacuuu

SEQ ID NO: 891320 - RNA, 12 nt, Homo sapiens
agaaaagccaga

SEQ ID NO: 891321 - RNA, 21 nt, Homo sapiens
agaaaaguagguuuacauuca

SEQ ID NO: 891322 - RNA, 16 nt, Homo sapiens
agaaaaucaaccagca

SEQ ID NO: 891323 - RNA, 16 nt, Homo sapiens
agaaaaucuuuuacua

SEQ ID NO: 891324 - RNA, 22 nt, Homo sapiens
agaaacagagguggcugcugug

SEQ ID NO: 891325 - RNA, 20 nt, Homo sapiens
agaaacagauaccauacuca

SEQ ID NO: 891326 - RNA, 16 nt, Homo sapiens
agaaacaugaauuauu

SEQ ID NO: 891327 - RNA, 16 nt, Homo sapiens
agaaacaugacacuga

SEQ ID NO: 891328 - RNA, 12 nt, Homo sapiens
agaaacccaagu

SEQ ID NO: 891329 - RNA, 12 nt, Homo sapiens
agaaacugagaa

SEQ ID NO: 891330 - RNA, 23 nt, Homo sapiens
agaaacugaggccauuauuucaa

SEQ ID NO: 891331 - RNA, 17 nt, Homo sapiens
agaaacuuccuuugaga

SEQ ID NO: 891332 - RNA, 15 nt, Homo sapiens
agaaagaaugcaaga

SEQ ID NO: 891333 - RNA, 15 nt, Homo sapiens
agaaagagucaggcc

SEQ ID NO: 891334 - RNA, 16 nt, Homo sapiens
agaaagcaacaguuac

SEQ ID NO: 891335 - RNA, 18 nt, Homo sapiens
agaaagccaggguccuga

SEQ ID NO: 891336 - RNA, 17 nt, Homo sapiens
agaaaggagcucugaau

SEQ ID NO: 891337 - RNA, 22 nt, Homo sapiens
agaaagguaaacaaacaaauaa

SEQ ID NO: 891338 - RNA, 17 nt, Homo sapiens
agaaauagacaguauau

SEQ ID NO: 891339 - RNA, 13 nt, Homo sapiens
agaaaugggagaa

SEQ ID NO: 891340 - RNA, 14 nt, Homo sapiens
agaaauuagcugug

SEQ ID NO: 891341 - RNA, 22 nt, Homo sapiens
agaaauuccuguagcaucuucu

SEQ ID NO: 891342 - RNA, 14 nt, Homo sapiens
agaaauucuguggu

SEQ ID NO: 891343 - RNA, 18 nt, Homo sapiens
agaaauuuuacugacaga

SEQ ID NO: 891344 - RNA, 15 nt, Homo sapiens
agaacaaacaccucc

SEQ ID NO: 891345 - RNA, 14 nt, Homo sapiens
agacguguacauag

SEQ ID NO: 891346 - RNA, 14 nt, Homo sapiens
agacuaaccugccc

SEQ ID NO: 891347 - RNA, 19 nt, Homo sapiens
agacuaguugaacaucuca

SEQ ID NO: 891348 - RNA, 20 nt, Homo sapiens
agacuaguugaacaucucac

SEQ ID NO: 891349 - RNA, 20 nt, Homo sapiens
agacucagggccccagcacu

SEQ ID NO: 891350 - RNA, 20 nt, Homo sapiens
agacucaugaaagaccugaa

SEQ ID NO: 891351 - RNA, 15 nt, Homo sapiens
agacuccugugcaac

SEQ ID NO: 891352 - RNA, 14 nt, Homo sapiens
agacugaaagaaua

SEQ ID NO: 891353 - RNA, 20 nt, Homo sapiens
agacugaagauggaaaaagu

SEQ ID NO: 891354 - RNA, 16 nt, Homo sapiens
agacugacaccucacu

SEQ ID NO: 891355 - RNA, 19 nt, Homo sapiens
agacugcugggacuggcca

SEQ ID NO: 891356 - RNA, 17 nt, Homo sapiens
agacuggaagcacagcu

SEQ ID NO: 891357 - RNA, 19 nt, Homo sapiens
agacugucucaagagggca

SEQ ID NO: 891358 - RNA, 13 nt, Homo sapiens
agacuucccugaa

SEQ ID NO: 891359 - RNA, 19 nt, Homo sapiens
agacuucucuuugccucaa

SEQ ID NO: 891360 - RNA, 19 nt, Homo sapiens
agacuugacaacaucccac

SEQ ID NO: 891361 - RNA, 15 nt, Homo sapiens
agacuugacagugga

SEQ ID NO: 891362 - RNA, 16 nt, Homo sapiens
agacuuggggaccaga

SEQ ID NO: 891363 - RNA, 21 nt, Homo sapiens
agacuuguguccccaccucag

SEQ ID NO: 891364 - RNA, 23 nt, Homo sapiens
agagaaagaaagggaaacuggcu

SEQ ID NO: 891365 - RNA, 14 nt, Homo sapiens
agagaacaacuacu

SEQ ID NO: 891366 - RNA, 18 nt, Homo sapiens
agagaacaggggcuucuu

SEQ ID NO: 891367 - RNA, 23 nt, Homo sapiens
agagaacuggaaagacauagcca

SEQ ID NO: 891368 - RNA, 23 nt, Homo sapiens
agagaagaccaaagcauugccug

SEQ ID NO: 891369 - RNA, 14 nt, Homo sapiens
agagaagaggcugg

SEQ ID NO: 891370 - RNA, 9 nt, Homo sapiens
agagaagau

SEQ ID NO: 891371 - RNA, 22 nt, Homo sapiens
agagaauuguaucauuugaaca

SEQ ID NO: 891372 - RNA, 20 nt, Homo sapiens
agagacacucccagggacaa

SEQ ID NO: 891373 - RNA, 12 nt, Homo sapiens
agagacaggguc

SEQ ID NO: 891374 - RNA, 21 nt, Homo sapiens
agagacaggguuuugccaugu

SEQ ID NO: 891375 - RNA, 16 nt, Homo sapiens
agagacauugccucca

SEQ ID NO: 891376 - RNA, 16 nt, Homo sapiens
agagaccccuuccuuu

SEQ ID NO: 891377 - RNA, 18 nt, Homo sapiens
agagacuauuuagacaaa

SEQ ID NO: 891378 - RNA, 21 nt, Homo sapiens
agagacuuggggaaauugcuu

SEQ ID NO: 891379 - RNA, 21 nt, Homo sapiens
agagagagggccugcuggaga

SEQ ID NO: 891380 - RNA, 16 nt, Homo sapiens
agagagauauaucuga

SEQ ID NO: 891381 - RNA, 14 nt, Homo sapiens
agagagauggaaua

SEQ ID NO: 891382 - RNA, 20 nt, Homo sapiens
agagaggccuuuuguuuaaa

SEQ ID NO: 891383 - RNA, 21 nt, Homo sapiens
agagagucuuccagguacuga

SEQ ID NO: 891384 - RNA, 22 nt, Homo sapiens
agagagucuuccagguacugau

SEQ ID NO: 891385 - RNA, 13 nt, Homo sapiens
agagauacauucc

SEQ ID NO: 891386 - RNA, 23 nt, Homo sapiens
agagaugauucggauuugacaaa

SEQ ID NO: 891387 - RNA, 23 nt, Homo sapiens
agagauuuucuuggcaguauucc

SEQ ID NO: 891388 - RNA, 23 nt, Homo sapiens
agagauuuugucgggacagagag

SEQ ID NO: 891389 - RNA, 19 nt, Homo sapiens
agagcaagacucugucuca

SEQ ID NO: 891390 - RNA, 18 nt, Homo sapiens
agagcaaugguagcaaaa

SEQ ID NO: 891391 - RNA, 20 nt, Homo sapiens
agagcacacuuaugggccaa

SEQ ID NO: 891392 - RNA, 13 nt, Homo sapiens
agagcagaaccaa

SEQ ID NO: 891393 - RNA, 13 nt, Homo sapiens
agagcauaggguc

SEQ ID NO: 891394 - RNA, 18 nt, Homo sapiens
agagccaccagggcacug

SEQ ID NO: 891395 - RNA, 14 nt, Homo sapiens
agagccacuaccuu

SEQ ID NO: 891396 - RNA, 11 nt, Homo sapiens
agagccaguga

SEQ ID NO: 891397 - RNA, 18 nt, Homo sapiens
agagccagugaaggagcc

SEQ ID NO: 891398 - RNA, 16 nt, Homo sapiens
agagcccaagugccau

SEQ ID NO: 891399 - RNA, 17 nt, Homo sapiens
agagccugagucacugg

SEQ ID NO: 891400 - RNA, 14 nt, Homo sapiens
agagcuauggugag

SEQ ID NO: 891401 - RNA, 19 nt, Homo sapiens
agagcugggaaacagggag

SEQ ID NO: 891402 - RNA, 19 nt, Homo sapiens
agagcuggggagggagagc

SEQ ID NO: 891403 - RNA, 16 nt, Homo sapiens
agagcugggugucaag

SEQ ID NO: 891404 - RNA, 15 nt, Homo sapiens
agagcuuucaaguac

SEQ ID NO: 891405 - RNA, 17 nt, Homo sapiens
agaggaagaaaaccagc

SEQ ID NO: 891406 - RNA, 17 nt, Homo sapiens
agaggacgggaggcugg

SEQ ID NO: 891407 - RNA, 13 nt, Homo sapiens
agaggacugagac

SEQ ID NO: 891408 - RNA, 16 nt, Homo sapiens
agaggauuuaacugug

SEQ ID NO: 891409 - RNA, 16 nt, Homo sapiens
agaggcaacugcccag

SEQ ID NO: 891410 - RNA, 13 nt, Homo sapiens
agaggcaccugcu

SEQ ID NO: 891411 - RNA, 14 nt, Homo sapiens
agaggccauggcag

SEQ ID NO: 891412 - RNA, 16 nt, Homo sapiens
acacacagaugcacac

SEQ ID NO: 891413 - RNA, 13 nt, Homo sapiens
acacacagucuca

SEQ ID NO: 891414 - RNA, 23 nt, Homo sapiens
acacacccauagugcacacuugu

SEQ ID NO: 891415 - RNA, 15 nt, Homo sapiens
acacacggaugcaca

SEQ ID NO: 891416 - RNA, 20 nt, Homo sapiens
acacacggaugcacacacag

SEQ ID NO: 891417 - RNA, 21 nt, Homo sapiens
acacacggaugcacacacaga

SEQ ID NO: 891418 - RNA, 14 nt, Homo sapiens
acacagauaugcac

SEQ ID NO: 891419 - RNA, 16 nt, Homo sapiens
acacagauaugcacac

SEQ ID NO: 891420 - RNA, 21 nt, Homo sapiens
acacagauggucacacagaga

SEQ ID NO: 891421 - RNA, 23 nt, Homo sapiens
acacagauuuuugggcuccacuc

SEQ ID NO: 891422 - RNA, 13 nt, Homo sapiens
acacaggccugug

SEQ ID NO: 891423 - RNA, 14 nt, Homo sapiens
acacagggugcaug

SEQ ID NO: 891424 - RNA, 19 nt, Homo sapiens
acacaguauuaagugacag

SEQ ID NO: 891425 - RNA, 15 nt, Homo sapiens
acacauauacauaua

SEQ ID NO: 891426 - RNA, 17 nt, Homo sapiens
acacauauacauauaua

SEQ ID NO: 891427 - RNA, 21 nt, Homo sapiens
acacaucccggccucuuccac

SEQ ID NO: 891428 - RNA, 16 nt, Homo sapiens
acacauggaugcacac

SEQ ID NO: 891429 - RNA, 16 nt, Homo sapiens
acacauggaugcacgc

SEQ ID NO: 891430 - RNA, 16 nt, Homo sapiens
acacauguaucuaugc

SEQ ID NO: 891431 - RNA, 17 nt, Homo sapiens
acacauguccaguggga

SEQ ID NO: 891432 - RNA, 16 nt, Homo sapiens
acaccagguagaacac

SEQ ID NO: 891433 - RNA, 20 nt, Homo sapiens
acaccaucuuaaaugacagu

SEQ ID NO: 891434 - RNA, 14 nt, Homo sapiens
acacccagagggua

SEQ ID NO: 891435 - RNA, 22 nt, Homo sapiens
acacccauagugcacacuugua

SEQ ID NO: 891436 - RNA, 14 nt, Homo sapiens
acaccccucccaca

SEQ ID NO: 891437 - RNA, 17 nt, Homo sapiens
acacccgacuccucaaa

SEQ ID NO: 891438 - RNA, 13 nt, Homo sapiens
acacccuaauaag

SEQ ID NO: 891439 - RNA, 16 nt, Homo sapiens
acaccgauguacacac

SEQ ID NO: 891440 - RNA, 17 nt, Homo sapiens
acaccgcgcaucucuuc

SEQ ID NO: 891441 - RNA, 19 nt, Homo sapiens
acaccucuaggacuccaca

SEQ ID NO: 891442 - RNA, 21 nt, Homo sapiens
acaccuguaaucccagcacuu

SEQ ID NO: 891443 - RNA, 15 nt, Homo sapiens
acacgaauugcucaa

SEQ ID NO: 891444 - RNA, 22 nt, Homo sapiens
acacgaauugcucaaugcauga

SEQ ID NO: 891445 - RNA, 20 nt, Homo sapiens
acacgagcaggcuacuguca

SEQ ID NO: 891446 - RNA, 16 nt, Homo sapiens
acacgccaaugcacac

SEQ ID NO: 891447 - RNA, 12 nt, Homo sapiens
acacgcuuucac

SEQ ID NO: 891448 - RNA, 16 nt, Homo sapiens
acacguggguauuuaa

SEQ ID NO: 891449 - RNA, 23 nt, Homo sapiens
acacuaacgauuuguuaaugaua

SEQ ID NO: 891450 - RNA, 16 nt, Homo sapiens
acacuaccuuaucagg

SEQ ID NO: 891451 - RNA, 19 nt, Homo sapiens
acacuauaaagguugacaa

SEQ ID NO: 891452 - RNA, 17 nt, Homo sapiens
acacucaaaucaagaaa

SEQ ID NO: 891453 - RNA, 14 nt, Homo sapiens
acacucaacaauaa

SEQ ID NO: 891454 - RNA, 15 nt, Homo sapiens
acacucaacaauaaa

SEQ ID NO: 891455 - RNA, 20 nt, Homo sapiens
acacucacuccacaacccaa

SEQ ID NO: 891456 - RNA, 17 nt, Homo sapiens
acacucagaagccuggg

SEQ ID NO: 891457 - RNA, 22 nt, Homo sapiens
acacucuucugaauugacugua

SEQ ID NO: 891458 - RNA, 22 nt, Homo sapiens
acacugggcugcagagacugga

SEQ ID NO: 891459 - RNA, 19 nt, Homo sapiens
acacuguccccacagcagg

SEQ ID NO: 891460 - RNA, 16 nt, Homo sapiens
acacugugaagacaau

SEQ ID NO: 891461 - RNA, 18 nt, Homo sapiens
cauuguagaaaagcuaua

SEQ ID NO: 891462 - RNA, 13 nt, Homo sapiens
cauuguauguauc

SEQ ID NO: 891463 - RNA, 19 nt, Homo sapiens
cauugucgcucagcaauag

SEQ ID NO: 891464 - RNA, 12 nt, Homo sapiens
cauugucugugg

SEQ ID NO: 891465 - RNA, 15 nt, Homo sapiens
cauuuaauuugaaau

SEQ ID NO: 891466 - RNA, 23 nt, Homo sapiens
cauuuaauuugaaauuugacuca

SEQ ID NO: 891467 - RNA, 22 nt, Homo sapiens
cauuuaccucgaggcucuucca

SEQ ID NO: 891468 - RNA, 22 nt, Homo sapiens
cauuuagaggacauucuggaaa

SEQ ID NO: 891469 - RNA, 13 nt, Homo sapiens
cauuucaacucca

SEQ ID NO: 891470 - RNA, 17 nt, Homo sapiens
cauuucaucuacuacag

SEQ ID NO: 891471 - RNA, 13 nt, Homo sapiens
cauuucccugugc

SEQ ID NO: 891472 - RNA, 16 nt, Homo sapiens
cauuucccugugcuga

SEQ ID NO: 891473 - RNA, 23 nt, Homo sapiens
cauuuccuccgucaccucagaga

SEQ ID NO: 891474 - RNA, 15 nt, Homo sapiens
cauuucgccccucau

SEQ ID NO: 891475 - RNA, 18 nt, Homo sapiens
cauuucuacugugacuga

SEQ ID NO: 891476 - RNA, 14 nt, Homo sapiens
cauuucuaucacau

SEQ ID NO: 891477 - RNA, 23 nt, Homo sapiens
cauuucuuauuugugcucuguga

SEQ ID NO: 891478 - RNA, 17 nt, Homo sapiens
cauuucuugauguugcu

SEQ ID NO: 891479 - RNA, 22 nt, Homo sapiens
cauuucuuuuccaaaauuacuu

SEQ ID NO: 891480 - RNA, 22 nt, Homo sapiens
cauuuggauaaaaggaaccaac

SEQ ID NO: 891481 - RNA, 15 nt, Homo sapiens
cauuuuacugucugu

SEQ ID NO: 891482 - RNA, 19 nt, Homo sapiens
cauuuugcaaaauuuccag

SEQ ID NO: 891483 - RNA, 22 nt, Homo sapiens
cauuuugggaccuauaucucag

SEQ ID NO: 891484 - RNA, 15 nt, Homo sapiens
cauuuuguuauagaa

SEQ ID NO: 891485 - RNA, 23 nt, Homo sapiens
cauuuuuuucacuggaguuacau

SEQ ID NO: 891486 - RNA, 13 nt, Homo sapiens
ccaaaaaccucac

SEQ ID NO: 891487 - RNA, 15 nt, Homo sapiens
ccaaaaguacuuacc

SEQ ID NO: 891488 - RNA, 16 nt, Homo sapiens
ccaaaauacuucugag

SEQ ID NO: 891489 - RNA, 21 nt, Homo sapiens
ccaaacacuguuucuaacuca

SEQ ID NO: 891490 - RNA, 17 nt, Homo sapiens
ccaaacagaacuaugga

SEQ ID NO: 891491 - RNA, 22 nt, Homo sapiens
ccaaacccaugaggcaauguca

SEQ ID NO: 891492 - RNA, 19 nt, Homo sapiens
ccaaagaaauguaagggaa

SEQ ID NO: 891493 - RNA, 14 nt, Homo sapiens
ccaaaggacauuau

SEQ ID NO: 891494 - RNA, 20 nt, Homo sapiens
ccaaaggcauccauagugca

SEQ ID NO: 891495 - RNA, 22 nt, Homo sapiens
ccaaaggggcugcuggggcaug

SEQ ID NO: 891496 - RNA, 20 nt, Homo sapiens
ccaaagugaccuacccagag

SEQ ID NO: 891497 - RNA, 13 nt, Homo sapiens
ccaaaguguuaau

SEQ ID NO: 891498 - RNA, 16 nt, Homo sapiens
ccaaauaaaguaccau

SEQ ID NO: 891499 - RNA, 16 nt, Homo sapiens
ccaaauccacaagcca

SEQ ID NO: 891500 - RNA, 16 nt, Homo sapiens
ccaaaucccacagggc

SEQ ID NO: 891501 - RNA, 23 nt, Homo sapiens
ccaaaugacaagucacacccucc

SEQ ID NO: 891502 - RNA, 11 nt, Homo sapiens
ccaaaugaugc

SEQ ID NO: 891503 - RNA, 13 nt, Homo sapiens
ccaaaugcugucu

SEQ ID NO: 891504 - RNA, 15 nt, Homo sapiens
ccaaauggacauaag

SEQ ID NO: 891505 - RNA, 13 nt, Homo sapiens
ccaaauuccaugu

SEQ ID NO: 891506 - RNA, 13 nt, Homo sapiens
ccaaauugcuacc

SEQ ID NO: 891507 - RNA, 15 nt, Homo sapiens
ccaaauugcuucuag

SEQ ID NO: 891508 - RNA, 22 nt, Homo sapiens
ccaacaaacaaugccaucacug

SEQ ID NO: 891509 - RNA, 12 nt, Homo sapiens
ccaacacccaaa

SEQ ID NO: 891510 - RNA, 14 nt, Homo sapiens
ccaacauugagaug

SEQ ID NO: 891511 - RNA, 17 nt, Homo sapiens
ccaaccccccaccugcc

SEQ ID NO: 891512 - RNA, 16 nt, Homo sapiens
ccaacccugcccacuu

SEQ ID NO: 891513 - RNA, 15 nt, Homo sapiens
ccaacgacaaagcca

SEQ ID NO: 891514 - RNA, 14 nt, Homo sapiens
ccaacugcugauca

SEQ ID NO: 891515 - RNA, 21 nt, Homo sapiens
ccaacuucauuugaugcuaaa

SEQ ID NO: 891516 - RNA, 15 nt, Homo sapiens
aagugccuaccccag

SEQ ID NO: 891517 - RNA, 19 nt, Homo sapiens
aagugcuaugccaagccau

SEQ ID NO: 891518 - RNA, 21 nt, Homo sapiens
aagugcugggauuacaggugu

SEQ ID NO: 891519 - RNA, 23 nt, Homo sapiens
aagugcugggauuacagguguga

SEQ ID NO: 891520 - RNA, 19 nt, Homo sapiens
aagugguaggaaagccuca

SEQ ID NO: 891521 - RNA, 20 nt, Homo sapiens
aaguguguugggaauugcau

SEQ ID NO: 891522 - RNA, 14 nt, Homo sapiens
aaguguuccuucau

SEQ ID NO: 891523 - RNA, 18 nt, Homo sapiens
aaguuauacuguggcuau

SEQ ID NO: 891524 - RNA, 22 nt, Homo sapiens
aaguuauacuguggcuaugcaa

SEQ ID NO: 891525 - RNA, 21 nt, Homo sapiens
aaguuauaguauaucuggaca

SEQ ID NO: 891526 - RNA, 24 nt, Homo sapiens
aaguuauuaacgggcauguauuau

SEQ ID NO: 891527 - RNA, 14 nt, Homo sapiens
aaguuauugauguu

SEQ ID NO: 891528 - RNA, 16 nt, Homo sapiens
aaguuauugauguuuu

SEQ ID NO: 891529 - RNA, 19 nt, Homo sapiens
aaguuauuguguugccuua

SEQ ID NO: 891530 - RNA, 22 nt, Homo sapiens
aaguuccaguguucucucuuau

SEQ ID NO: 891531 - RNA, 22 nt, Homo sapiens
aaguucgaagcuccgugaguga

SEQ ID NO: 891532 - RNA, 13 nt, Homo sapiens
aaguugagaacaa

SEQ ID NO: 891533 - RNA, 17 nt, Homo sapiens
aaguugcucugaaguca

SEQ ID NO: 891534 - RNA, 22 nt, Homo sapiens
aaguuggguguaauuaggugaa

SEQ ID NO: 891535 - RNA, 15 nt, Homo sapiens
aaguuggguuaggag

SEQ ID NO: 891536 - RNA, 15 nt, Homo sapiens
aaguuucaaugugau

SEQ ID NO: 891537 - RNA, 19 nt, Homo sapiens
aaguuucuaguaucacaua

SEQ ID NO: 891538 - RNA, 22 nt, Homo sapiens
aaguuuuaagagaagaugugau

SEQ ID NO: 891539 - RNA, 20 nt, Homo sapiens
aaguuuuucagaaagcauua

SEQ ID NO: 891540 - RNA, 14 nt, Homo sapiens
aauaaaaacacuua

SEQ ID NO: 891541 - RNA, 18 nt, Homo sapiens
aauaaaaacccuguaugg

SEQ ID NO: 891542 - RNA, 13 nt, Homo sapiens
aauaaaaacugac

SEQ ID NO: 891543 - RNA, 14 nt, Homo sapiens
aauaaaaacugacu

SEQ ID NO: 891544 - RNA, 18 nt, Homo sapiens
aauaaaacuuaugcuagu

SEQ ID NO: 891545 - RNA, 13 nt, Homo sapiens
aauaaaagcacuu

SEQ ID NO: 891546 - RNA, 14 nt, Homo sapiens
aauaaaagcacuua

SEQ ID NO: 891547 - RNA, 13 nt, Homo sapiens
aauaaaaugaugu

SEQ ID NO: 891548 - RNA, 16 nt, Homo sapiens
aauaaacucucuaggg

SEQ ID NO: 891549 - RNA, 21 nt, Homo sapiens
aauaaagcugcugagaaucua

SEQ ID NO: 891550 - RNA, 16 nt, Homo sapiens
aauaaauaaaugcaau

SEQ ID NO: 891551 - RNA, 15 nt, Homo sapiens
aauaaauaugcucag

SEQ ID NO: 891552 - RNA, 16 nt, Homo sapiens
aauaaauguacauuaa

SEQ ID NO: 891553 - RNA, 16 nt, Homo sapiens
aauaaaugugccuuca

SEQ ID NO: 891554 - RNA, 11 nt, Homo sapiens
aauaagcuuua

SEQ ID NO: 891555 - RNA, 12 nt, Homo sapiens
aauaagcuuuau

SEQ ID NO: 891556 - RNA, 20 nt, Homo sapiens
aauaaggggcaccugggaaa

SEQ ID NO: 891557 - RNA, 15 nt, Homo sapiens
aauaagguacaagaa

SEQ ID NO: 891558 - RNA, 14 nt, Homo sapiens
aauaauaauuuucc

SEQ ID NO: 891559 - RNA, 14 nt, Homo sapiens
aauaauacacuaau

SEQ ID NO: 891560 - RNA, 20 nt, Homo sapiens
aauaauauauccacaucuaa

SEQ ID NO: 891561 - RNA, 18 nt, Homo sapiens
aauaauaugcugccaaau

SEQ ID NO: 891562 - RNA, 21 nt, Homo sapiens
aauaaugaguuagaacuauua

SEQ ID NO: 891563 - RNA, 16 nt, Homo sapiens
aauaauguaagggucu

SEQ ID NO: 891564 - RNA, 14 nt, Homo sapiens
aauaauuaaugugu

SEQ ID NO: 891565 - RNA, 18 nt, Homo sapiens
aauaauucaugauucaac

SEQ ID NO: 891566 - RNA, 13 nt, Homo sapiens
aauaauuguguac

SEQ ID NO: 891567 - RNA, 15 nt, Homo sapiens
aauacaaacaagcac

SEQ ID NO: 891568 - RNA, 16 nt, Homo sapiens
aauacacaacacacac

SEQ ID NO: 891569 - RNA, 21 nt, Homo sapiens
aauacauaccuacugacugau

SEQ ID NO: 891570 - RNA, 22 nt, Homo sapiens
aauaccagugaaccaaagagac

SEQ ID NO: 891571 - RNA, 12 nt, Homo sapiens
aauacuacugua

SEQ ID NO: 891572 - RNA, 17 nt, Homo sapiens
aauacucaccuccuccc

SEQ ID NO: 891573 - RNA, 19 nt, Homo sapiens
aauacugccggucacccag

SEQ ID NO: 891574 - RNA, 21 nt, Homo sapiens
aauacuuuuuucuaguuucag

SEQ ID NO: 891575 - RNA, 15 nt, Homo sapiens
aauagacacaucaaa

SEQ ID NO: 891576 - RNA, 23 nt, Homo sapiens
aaugagaaacuuugaucucugcu

SEQ ID NO: 891577 - RNA, 21 nt, Homo sapiens
aaugagaagaaugacuaugca

SEQ ID NO: 891578 - RNA, 19 nt, Homo sapiens
aaugagaaggagucagaaa

SEQ ID NO: 891579 - RNA, 20 nt, Homo sapiens
aaugagaucguuguuuacag

SEQ ID NO: 891580 - RNA, 24 nt, Homo sapiens
aaugagcaugaacuguccuuccau

SEQ ID NO: 891581 - RNA, 17 nt, Homo sapiens
aaugagcuguaucugua

SEQ ID NO: 891582 - RNA, 15 nt, Homo sapiens
aaugagugugacuau

SEQ ID NO: 891583 - RNA, 19 nt, Homo sapiens
aaugaguuagaacuauuaa

SEQ ID NO: 891584 - RNA, 20 nt, Homo sapiens
aaugaguuuuaaagauguaa

SEQ ID NO: 891585 - RNA, 19 nt, Homo sapiens
aaugauaaagaugucaaau

SEQ ID NO: 891586 - RNA, 21 nt, Homo sapiens
aaugauaagcaggaaggaugg

SEQ ID NO: 891587 - RNA, 20 nt, Homo sapiens
aaugauccguuccauugcaa

SEQ ID NO: 891588 - RNA, 16 nt, Homo sapiens
aaugaugccacuuccc

SEQ ID NO: 891589 - RNA, 11 nt, Homo sapiens
aaugauuagaa

SEQ ID NO: 891590 - RNA, 14 nt, Homo sapiens
aaugauuagcacuu

SEQ ID NO: 891591 - RNA, 19 nt, Homo sapiens
aaugauucauaacaaugua

SEQ ID NO: 891592 - RNA, 23 nt, Homo sapiens
aaugauuucaugcuaucucugug

SEQ ID NO: 891593 - RNA, 13 nt, Homo sapiens
aaugcaaaaaucu

SEQ ID NO: 891594 - RNA, 16 nt, Homo sapiens
aaugcaacaacaugua

SEQ ID NO: 891595 - RNA, 14 nt, Homo sapiens
aaugcacaucucau

SEQ ID NO: 891596 - RNA, 14 nt, Homo sapiens
aaugcauugcuaaa

SEQ ID NO: 891597 - RNA, 20 nt, Homo sapiens
aaugcccaguucacuucuuu

SEQ ID NO: 891598 - RNA, 16 nt, Homo sapiens
aaugccucaaugugac

SEQ ID NO: 891599 - RNA, 19 nt, Homo sapiens
aaugccuccaagccauuca

SEQ ID NO: 891600 - RNA, 21 nt, Homo sapiens
aaugcuggguguugcauuucu

SEQ ID NO: 891601 - RNA, 21 nt, Homo sapiens
aaugcuguagaaugcuuggca

SEQ ID NO: 891602 - RNA, 21 nt, Homo sapiens
aaugcuuccuccuuggaagag

SEQ ID NO: 891603 - RNA, 15 nt, Homo sapiens
aauggaaacauuuac

SEQ ID NO: 891604 - RNA, 15 nt, Homo sapiens
aauggacguacuggu

SEQ ID NO: 891605 - RNA, 20 nt, Homo sapiens
aauggcucaugaccuggaaa

SEQ ID NO: 891606 - RNA, 20 nt, Homo sapiens
aauggguacaauguacauua

SEQ ID NO: 891607 - RNA, 21 nt, Homo sapiens
aauggguacaauguacauuau

SEQ ID NO: 891608 - RNA, 14 nt, Homo sapiens
aauggucaguugua

SEQ ID NO: 891609 - RNA, 15 nt, Homo sapiens
aaugguuuacugcug

SEQ ID NO: 891610 - RNA, 20 nt, Homo sapiens
aauguaaauuaaaauuucca

SEQ ID NO: 891611 - RNA, 20 nt, Homo sapiens
aauguaacucuauaguuauu

SEQ ID NO: 891612 - RNA, 20 nt, Homo sapiens
aauguaagggaaacugccag

SEQ ID NO: 891613 - RNA, 18 nt, Homo sapiens
aauguagugaagggaugu

SEQ ID NO: 891614 - RNA, 20 nt, Homo sapiens
aauguauauaaaguacuuua

SEQ ID NO: 891615 - RNA, 20 nt, Homo sapiens
aauguauauacacauauacc

SEQ ID NO: 891616 - RNA, 21 nt, Homo sapiens
aauguauuugucaaugcauca

SEQ ID NO: 891617 - RNA, 16 nt, Homo sapiens
aaugucagaaaccagu

SEQ ID NO: 891618 - RNA, 21 nt, Homo sapiens
aaugucaguuacaauaugaga

SEQ ID NO: 891619 - RNA, 16 nt, Homo sapiens
aaugucuggucugucc

SEQ ID NO: 891620 - RNA, 16 nt, Homo sapiens
aaugucuuacugugau

SEQ ID NO: 891621 - RNA, 17 nt, Homo sapiens
aaugucuuacugugauc

SEQ ID NO: 891622 - RNA, 21 nt, Homo sapiens
aaugugauauuugaagcauca

SEQ ID NO: 891623 - RNA, 20 nt, Homo sapiens
aaugugcaaguuguacugua

SEQ ID NO: 891624 - RNA, 13 nt, Homo sapiens
aaugugcauuucu

SEQ ID NO: 891625 - RNA, 19 nt, Homo sapiens
aaugugugaaggucuugcc

SEQ ID NO: 891626 - RNA, 20 nt, Homo sapiens
aauguuagauuccucuugcc

SEQ ID NO: 891627 - RNA, 22 nt, Homo sapiens
aauguuauuuuuuaauuauuau

SEQ ID NO: 891628 - RNA, 19 nt, Homo sapiens
aauguucaucaauucccau

SEQ ID NO: 891629 - RNA, 23 nt, Homo sapiens
aauguucucuggguagguguuga

SEQ ID NO: 891630 - RNA, 15 nt, Homo sapiens
aauguuguaauucau

SEQ ID NO: 891631 - RNA, 17 nt, Homo sapiens
ccagagguuaucugccu

SEQ ID NO: 891632 - RNA, 23 nt, Homo sapiens
ccagaucagauucuucucuuaau

SEQ ID NO: 891633 - RNA, 20 nt, Homo sapiens
ccagauguuuacagacugug

SEQ ID NO: 891634 - RNA, 13 nt, Homo sapiens
ccagcaacacaga

SEQ ID NO: 891635 - RNA, 18 nt, Homo sapiens
ccagcacucaaccaaccu

SEQ ID NO: 891636 - RNA, 18 nt, Homo sapiens
ccagcacucugaaacuga

SEQ ID NO: 891637 - RNA, 12 nt, Homo sapiens
ccagcacuuugg

SEQ ID NO: 891638 - RNA, 18 nt, Homo sapiens
ccagcagggccucaaagu

SEQ ID NO: 891639 - RNA, 16 nt, Homo sapiens
ccagcagugguauuaa

SEQ ID NO: 891640 - RNA, 16 nt, Homo sapiens
ccagcaugucacuccc

SEQ ID NO: 891641 - RNA, 20 nt, Homo sapiens
ccagccaucaugugccugga

SEQ ID NO: 891642 - RNA, 14 nt, Homo sapiens
ccagccucagcuca

SEQ ID NO: 891643 - RNA, 21 nt, Homo sapiens
ccagcgagcaucccgggcaag

SEQ ID NO: 891644 - RNA, 18 nt, Homo sapiens
ccagcggcugggugguga

SEQ ID NO: 891645 - RNA, 15 nt, Homo sapiens
ccagcuacucaggag

SEQ ID NO: 891646 - RNA, 21 nt, Homo sapiens
ccagcuacucaggaggcugag

SEQ ID NO: 891647 - RNA, 21 nt, Homo sapiens
ccagcuacucgggaggcugag

SEQ ID NO: 891648 - RNA, 19 nt, Homo sapiens
ccagcucccuaggagacca

SEQ ID NO: 891649 - RNA, 15 nt, Homo sapiens
ccagcucccuucuuc

SEQ ID NO: 891650 - RNA, 16 nt, Homo sapiens
ccagcucuaguuuuca

SEQ ID NO: 891651 - RNA, 16 nt, Homo sapiens
ccagcugcaccugcca

SEQ ID NO: 891652 - RNA, 18 nt, Homo sapiens
ccagcugcucccaaauaa

SEQ ID NO: 891653 - RNA, 10 nt, Homo sapiens
ccagcuguca

SEQ ID NO: 891654 - RNA, 12 nt, Homo sapiens
ccaggaaggcag

SEQ ID NO: 891655 - RNA, 22 nt, Homo sapiens
ccaggaagguagcccagcacug

SEQ ID NO: 891656 - RNA, 23 nt, Homo sapiens
ccaggaagguagcccagcacugu

SEQ ID NO: 891657 - RNA, 20 nt, Homo sapiens
ccaggaggaauaagcuccca

SEQ ID NO: 891658 - RNA, 15 nt, Homo sapiens
ccaggcacuguugcu

SEQ ID NO: 891659 - RNA, 18 nt, Homo sapiens
ccaggcaggucuugaacu

SEQ ID NO: 891660 - RNA, 18 nt, Homo sapiens
ccaggcaucccaucccuu

SEQ ID NO: 891661 - RNA, 22 nt, Homo sapiens
ccaggcccggggcuggcggcua

SEQ ID NO: 891662 - RNA, 21 nt, Homo sapiens
ccaggcugagguccugaucag

SEQ ID NO: 891663 - RNA, 21 nt, Homo sapiens
ccaggcugagugagccacaga

SEQ ID NO: 891664 - RNA, 18 nt, Homo sapiens
ccaggcugcacugcagug

SEQ ID NO: 891665 - RNA, 19 nt, Homo sapiens
ccaggcugcacugcaguga

SEQ ID NO: 891666 - RNA, 17 nt, Homo sapiens
ccaggcuggagugcagu

SEQ ID NO: 891667 - RNA, 20 nt, Homo sapiens
ccaggcuggcgugcaguggu

SEQ ID NO: 891668 - RNA, 15 nt, Homo sapiens
ccagggaugacaugu

SEQ ID NO: 891669 - RNA, 19 nt, Homo sapiens
ccagggccugggggcagug

SEQ ID NO: 891670 - RNA, 22 nt, Homo sapiens
ccaggggaaugaucucugauga

SEQ ID NO: 891671 - RNA, 23 nt, Homo sapiens
ccaggggaaugaucucugaugac

SEQ ID NO: 891672 - RNA, 15 nt, Homo sapiens
ccaggggagcaguaa

SEQ ID NO: 891673 - RNA, 20 nt, Homo sapiens
ccaggguccugaguggcuga

SEQ ID NO: 891674 - RNA, 22 nt, Homo sapiens
ccaggucucuccacugcucuca

SEQ ID NO: 891675 - RNA, 14 nt, Homo sapiens
ccagguuagccuuu

SEQ ID NO: 891676 - RNA, 19 nt, Homo sapiens
ccagguugccugggccacg

SEQ ID NO: 891677 - RNA, 24 nt, Homo sapiens
ccaguaagguuauaacuguggcua

SEQ ID NO: 891678 - RNA, 13 nt, Homo sapiens
ccaguacugggaa

SEQ ID NO: 891679 - RNA, 17 nt, Homo sapiens
ccaguaguggacaacag

SEQ ID NO: 891680 - RNA, 22 nt, Homo sapiens
ccaguauuuuuauuucuuuaau

SEQ ID NO: 891681 - RNA, 22 nt, Homo sapiens
ccagucacgagcccgcucugca

SEQ ID NO: 891682 - RNA, 15 nt, Homo sapiens
ccagucauucuggga

SEQ ID NO: 891683 - RNA, 16 nt, Homo sapiens
ccagucauucugggaa

SEQ ID NO: 891684 - RNA, 16 nt, Homo sapiens
ccaguccgccaaacac

SEQ ID NO: 891685 - RNA, 20 nt, Homo sapiens
ccaguccuggggagcuucac

SEQ ID NO: 891686 - RNA, 14 nt, Homo sapiens
ccagugaaccaaag

SEQ ID NO: 891687 - RNA, 16 nt, Homo sapiens
ccagugaaccaaagag

SEQ ID NO: 891688 - RNA, 16 nt, Homo sapiens
ccagugagcuuaucau

SEQ ID NO: 891689 - RNA, 19 nt, Homo sapiens
ccaguggugaagaaaacuc

SEQ ID NO: 891690 - RNA, 14 nt, Homo sapiens
ccaguguacugcuu

SEQ ID NO: 891691 - RNA, 18 nt, Homo sapiens
ccaguguacugcuuucaa

SEQ ID NO: 891692 - RNA, 23 nt, Homo sapiens
ccagugugcuugcccaccacagc

SEQ ID NO: 891693 - RNA, 16 nt, Homo sapiens
ccaguuccuccaagag

SEQ ID NO: 891694 - RNA, 22 nt, Homo sapiens
ccaguuccuguagaacugagaa

SEQ ID NO: 891695 - RNA, 19 nt, Homo sapiens
ccaguuugcuuaguucuca

SEQ ID NO: 891696 - RNA, 18 nt, Homo sapiens
ccaguuuuuguugcuuga

SEQ ID NO: 891697 - RNA, 16 nt, Homo sapiens
ccauaaacacccauga

SEQ ID NO: 891698 - RNA, 23 nt, Homo sapiens
ccauaaacacccaugaaucaaag

SEQ ID NO: 891699 - RNA, 19 nt, Homo sapiens
ccauaaccccaggcauccc

SEQ ID NO: 891700 - RNA, 15 nt, Homo sapiens
ccauaaggccagaaa

SEQ ID NO: 891701 - RNA, 13 nt, Homo sapiens
ccauaauguuaca

SEQ ID NO: 891702 - RNA, 20 nt, Homo sapiens
ccauaccccugccuggguuu

SEQ ID NO: 891703 - RNA, 19 nt, Homo sapiens
ccauacuuucccacagcac

SEQ ID NO: 891704 - RNA, 13 nt, Homo sapiens
ccauagaaacaug

SEQ ID NO: 891705 - RNA, 22 nt, Homo sapiens
ccauagaaacaugacacugacc

SEQ ID NO: 891706 - RNA, 13 nt, Homo sapiens
ccauagaaacuga

SEQ ID NO: 891707 - RNA, 20 nt, Homo sapiens
ccauagccaaccuguaguuu

SEQ ID NO: 891708 - RNA, 13 nt, Homo sapiens
ccauagcugguua

SEQ ID NO: 891709 - RNA, 18 nt, Homo sapiens
ccauagugcacacuugua

SEQ ID NO: 891710 - RNA, 20 nt, Homo sapiens
ccauaguuauuuacuugaaa

SEQ ID NO: 891711 - RNA, 20 nt, Homo sapiens
ccauauaucuuauguuaaag

SEQ ID NO: 891712 - RNA, 22 nt, Homo sapiens
ccauaugaauuuacuacuuuaa

SEQ ID NO: 891713 - RNA, 15 nt, Homo sapiens
ccauauucacaccuc

SEQ ID NO: 891714 - RNA, 19 nt, Homo sapiens
ccauauucccacagcacua

SEQ ID NO: 891715 - RNA, 14 nt, Homo sapiens
ccaucaacaagucu

SEQ ID NO: 891716 - RNA, 14 nt, Homo sapiens
ccaucaccuacuca

SEQ ID NO: 891717 - RNA, 20 nt, Homo sapiens
ccauccaccaggccuuugag

SEQ ID NO: 891718 - RNA, 22 nt, Homo sapiens
ccauccagccgcugcacaucac

SEQ ID NO: 891719 - RNA, 12 nt, Homo sapiens
ccauccagguuc

SEQ ID NO: 891720 - RNA, 20 nt, Homo sapiens
ccauccaugagaguuucaaa

SEQ ID NO: 891721 - RNA, 19 nt, Homo sapiens
ccauccauucacagccagg

SEQ ID NO: 891722 - RNA, 20 nt, Homo sapiens
ccauccuaccaaugcaugca

SEQ ID NO: 891723 - RNA, 13 nt, Homo sapiens
ccauccuauuuaa

SEQ ID NO: 891724 - RNA, 22 nt, Homo sapiens
ccauccuauuuaacuggcuuca

SEQ ID NO: 891725 - RNA, 18 nt, Homo sapiens
ccaucugaaccacuuugc

SEQ ID NO: 891726 - RNA, 22 nt, Homo sapiens
ccaugaaacuuuagagauuaac

SEQ ID NO: 891727 - RNA, 14 nt, Homo sapiens
ccaugaagaccaca

SEQ ID NO: 891728 - RNA, 13 nt, Homo sapiens
ccaugaagcugga

SEQ ID NO: 891729 - RNA, 17 nt, Homo sapiens
ccaugaggcaaugucag

SEQ ID NO: 891730 - RNA, 12 nt, Homo sapiens
ccaugccucaag

SEQ ID NO: 891731 - RNA, 23 nt, Homo sapiens
ccaugccucuccaacaucuucaa

SEQ ID NO: 891732 - RNA, 16 nt, Homo sapiens
ccaugcuagacaagcu

SEQ ID NO: 891733 - RNA, 22 nt, Homo sapiens
ccauggcaccuuuugcacauaa

SEQ ID NO: 891734 - RNA, 17 nt, Homo sapiens
ccaugggccugggccug

SEQ ID NO: 891735 - RNA, 16 nt, Homo sapiens
ccauggugcuuguuaa

SEQ ID NO: 891736 - RNA, 17 nt, Homo sapiens
ccauguaccaguguacu

SEQ ID NO: 891737 - RNA, 22 nt, Homo sapiens
ccauguggguguggcaguuaca

SEQ ID NO: 891738 - RNA, 13 nt, Homo sapiens
ccauguuauguga

SEQ ID NO: 891739 - RNA, 22 nt, Homo sapiens
ccauguuaugugacuaucuuua

SEQ ID NO: 891740 - RNA, 13 nt, Homo sapiens
ccauuacuguaau

SEQ ID NO: 891741 - RNA, 21 nt, Homo sapiens
ccauuacuuuaauacucaccu

SEQ ID NO: 891742 - RNA, 21 nt, Homo sapiens
ccauuccuggaaucaaggaau

SEQ ID NO: 891743 - RNA, 21 nt, Homo sapiens
ccauucuacauacuauggaau

SEQ ID NO: 891744 - RNA, 15 nt, Homo sapiens
ccauugcuguuguug

SEQ ID NO: 891745 - RNA, 14 nt, Homo sapiens
aauguuuacacucu

SEQ ID NO: 891746 - RNA, 18 nt, Homo sapiens
aauguuucacuaugauuu

SEQ ID NO: 891747 - RNA, 18 nt, Homo sapiens
aauguuugaguaccugau

SEQ ID NO: 891748 - RNA, 21 nt, Homo sapiens
aauguuugaguuuucaaagau

SEQ ID NO: 891749 - RNA, 22 nt, Homo sapiens
aauguuugucuggauuggcuau

SEQ ID NO: 891750 - RNA, 23 nt, Homo sapiens
aauguuuuuauuuucucuaucaa

SEQ ID NO: 891751 - RNA, 14 nt, Homo sapiens
aauuaaacccugcc

SEQ ID NO: 891752 - RNA, 15 nt, Homo sapiens
aauuaaagcuguuau

SEQ ID NO: 891753 - RNA, 14 nt, Homo sapiens
aauuaaaugcaugu

SEQ ID NO: 891754 - RNA, 15 nt, Homo sapiens
aauuaaaugcauguc

SEQ ID NO: 891755 - RNA, 18 nt, Homo sapiens
aauuaaaugcauguccuc

SEQ ID NO: 891756 - RNA, 22 nt, Homo sapiens
aauuaacaaaagauucuguaag

SEQ ID NO: 891757 - RNA, 19 nt, Homo sapiens
aauuaagagauacauuccc

SEQ ID NO: 891758 - RNA, 12 nt, Homo sapiens
aauuaagugcaa

SEQ ID NO: 891759 - RNA, 13 nt, Homo sapiens
aauuaagugcaau

SEQ ID NO: 891760 - RNA, 12 nt, Homo sapiens
aauuacuucuuc

SEQ ID NO: 891761 - RNA, 13 nt, Homo sapiens
aauuagaugaacu

SEQ ID NO: 891762 - RNA, 21 nt, Homo sapiens
aauuagccagugaaaaacuau

SEQ ID NO: 891763 - RNA, 21 nt, Homo sapiens
aauuauauuaaagaaccaaaa

SEQ ID NO: 891764 - RNA, 18 nt, Homo sapiens
aauuaucgggaacagugu

SEQ ID NO: 891765 - RNA, 12 nt, Homo sapiens
aauuaugccaua

SEQ ID NO: 891766 - RNA, 19 nt, Homo sapiens
aauuauuaugacucaauaa

SEQ ID NO: 891767 - RNA, 21 nt, Homo sapiens
aauuauuauuuauauauguau

SEQ ID NO: 891768 - RNA, 22 nt, Homo sapiens
aauuauuccuuuccuagacuaa

SEQ ID NO: 891769 - RNA, 16 nt, Homo sapiens
aauucaaugucuuaaa

SEQ ID NO: 891770 - RNA, 16 nt, Homo sapiens
aauucacauaggcaau

SEQ ID NO: 891771 - RNA, 13 nt, Homo sapiens
aauucagugaaga

SEQ ID NO: 891772 - RNA, 14 nt, Homo sapiens
aauucaucagucau

SEQ ID NO: 891773 - RNA, 20 nt, Homo sapiens
aauucauuuuuuucacugga

SEQ ID NO: 891774 - RNA, 13 nt, Homo sapiens
aauuccaauauga

SEQ ID NO: 891775 - RNA, 18 nt, Homo sapiens
aauuccaucccaucaucu

SEQ ID NO: 891776 - RNA, 18 nt, Homo sapiens
aauuccauuuccaguuca

SEQ ID NO: 891777 - RNA, 22 nt, Homo sapiens
aauuccuaauaaguuugaucaa

SEQ ID NO: 891778 - RNA, 22 nt, Homo sapiens
aauuccuguauucuacagcaga

SEQ ID NO: 891779 - RNA, 14 nt, Homo sapiens
aauuccuugauuca

SEQ ID NO: 891780 - RNA, 19 nt, Homo sapiens
aauucuccugccucagccu

SEQ ID NO: 891781 - RNA, 21 nt, Homo sapiens
aauucucuuuaguucugucag

SEQ ID NO: 891782 - RNA, 15 nt, Homo sapiens
aauucugcucagaua

SEQ ID NO: 891783 - RNA, 20 nt, Homo sapiens
aauucuggaaaugucuuucu

SEQ ID NO: 891784 - RNA, 13 nt, Homo sapiens
aauucugugaaga

SEQ ID NO: 891785 - RNA, 19 nt, Homo sapiens
aauucuuacaaacaugugg

SEQ ID NO: 891786 - RNA, 18 nt, Homo sapiens
aauucuuuuucacacuga

SEQ ID NO: 891787 - RNA, 19 nt, Homo sapiens
aauugaaauauaaugcaaa

SEQ ID NO: 891788 - RNA, 13 nt, Homo sapiens
aauugaacuacuu

SEQ ID NO: 891789 - RNA, 23 nt, Homo sapiens
aauugaagagagauauaucugaa

SEQ ID NO: 891790 - RNA, 13 nt, Homo sapiens
aauugacugucac

SEQ ID NO: 891791 - RNA, 21 nt, Homo sapiens
aauugauuauucugauuccac

SEQ ID NO: 891792 - RNA, 20 nt, Homo sapiens
aauugcacuuuuaaaccucu

SEQ ID NO: 891793 - RNA, 22 nt, Homo sapiens
aauugcagaugguuaaauauca

SEQ ID NO: 891794 - RNA, 17 nt, Homo sapiens
aauugcuagugauuuca

SEQ ID NO: 891795 - RNA, 21 nt, Homo sapiens
aauuggguggggggaaugagc

SEQ ID NO: 891796 - RNA, 20 nt, Homo sapiens
aauuguaacuacacuaauaa

SEQ ID NO: 891797 - RNA, 22 nt, Homo sapiens
aauuguaaguaccccugauaag

SEQ ID NO: 891798 - RNA, 21 nt, Homo sapiens
aauugucauuuauaaaaccau

SEQ ID NO: 891799 - RNA, 17 nt, Homo sapiens
aauugugaucagaccau

SEQ ID NO: 891800 - RNA, 17 nt, Homo sapiens
aauugugcgacuucaca

SEQ ID NO: 891801 - RNA, 12 nt, Homo sapiens
aauuguuugacc

SEQ ID NO: 891802 - RNA, 23 nt, Homo sapiens
aauuuaaaaauaagaaaauacau

SEQ ID NO: 891803 - RNA, 17 nt, Homo sapiens
aauuuaaaacacagaga

SEQ ID NO: 891804 - RNA, 21 nt, Homo sapiens
aauuuaaaacacagagaugcu

SEQ ID NO: 891805 - RNA, 12 nt, Homo sapiens
aauuuacuguga

SEQ ID NO: 891806 - RNA, 21 nt, Homo sapiens
aauuuaggaccaauaccuccu

SEQ ID NO: 891807 - RNA, 21 nt, Homo sapiens
aauuuauauaaaaauaccuua

SEQ ID NO: 891808 - RNA, 19 nt, Homo sapiens
aauuucauaccuaucaucu

SEQ ID NO: 891809 - RNA, 22 nt, Homo sapiens
aauuuccacaagcauugcuuca

SEQ ID NO: 891810 - RNA, 20 nt, Homo sapiens
aauuucuaccuuuacuacau

SEQ ID NO: 891811 - RNA, 19 nt, Homo sapiens
aauuucuggaaaacugccu

SEQ ID NO: 891812 - RNA, 19 nt, Homo sapiens
aauuugaaauuugacucau

SEQ ID NO: 891813 - RNA, 17 nt, Homo sapiens
aauuugaauggugcaga

SEQ ID NO: 891814 - RNA, 14 nt, Homo sapiens
aauuugacucauga

SEQ ID NO: 891815 - RNA, 15 nt, Homo sapiens
aauuugccaccacua

SEQ ID NO: 891816 - RNA, 12 nt, Homo sapiens
aauuugccugua

SEQ ID NO: 891817 - RNA, 21 nt, Homo sapiens
aauuuggccagacacaggugc

SEQ ID NO: 891818 - RNA, 21 nt, Homo sapiens
aauuugggggacuuacaugau

SEQ ID NO: 891819 - RNA, 21 nt, Homo sapiens
aauuugguaaauuaguauuua

SEQ ID NO: 891820 - RNA, 17 nt, Homo sapiens
aauuugguguggcugua

SEQ ID NO: 891821 - RNA, 21 nt, Homo sapiens
aauuuguaagcaacuugcuuc

SEQ ID NO: 891822 - RNA, 14 nt, Homo sapiens
aauuuguguucuca

SEQ ID NO: 891823 - RNA, 18 nt, Homo sapiens
aauuuguuuuauauucuc

SEQ ID NO: 891824 - RNA, 17 nt, Homo sapiens
aauuuuaaauguucaca

SEQ ID NO: 891825 - RNA, 22 nt, Homo sapiens
aauuuuaaauguucacaacaua

SEQ ID NO: 891826 - RNA, 13 nt, Homo sapiens
aauuuuaauugau

SEQ ID NO: 891827 - RNA, 16 nt, Homo sapiens
aauuuuagcgugcuca

SEQ ID NO: 891828 - RNA, 17 nt, Homo sapiens
aauuuucaagagaagaa

SEQ ID NO: 891829 - RNA, 23 nt, Homo sapiens
aauuuuguguguaccugugacua

SEQ ID NO: 891830 - RNA, 21 nt, Homo sapiens
aauuuuguuuguaauccugua

SEQ ID NO: 891831 - RNA, 15 nt, Homo sapiens
aauuuuuacugagaa

SEQ ID NO: 891832 - RNA, 17 nt, Homo sapiens
aauuuuuauacauauca

SEQ ID NO: 891833 - RNA, 22 nt, Homo sapiens
aauuuuuauacauaucagaaaa

SEQ ID NO: 891834 - RNA, 20 nt, Homo sapiens
aauuuuugaacaacuguugg

SEQ ID NO: 891835 - RNA, 23 nt, Homo sapiens
aauuuuuuaguauaaguacauua

SEQ ID NO: 891836 - RNA, 13 nt, Homo sapiens
acaaaaacacagc

SEQ ID NO: 891837 - RNA, 21 nt, Homo sapiens
acaaaaauguaaugaucauaa

SEQ ID NO: 891838 - RNA, 21 nt, Homo sapiens
acaaaagcccaauguaaugca

SEQ ID NO: 891839 - RNA, 13 nt, Homo sapiens
acaaaauaauuua

SEQ ID NO: 891840 - RNA, 21 nt, Homo sapiens
acaaaauguacgaaacuguau

SEQ ID NO: 891841 - RNA, 14 nt, Homo sapiens
acaaacaaugccau

SEQ ID NO: 891842 - RNA, 16 nt, Homo sapiens
acaaacaaugccauca

SEQ ID NO: 891843 - RNA, 14 nt, Homo sapiens
acaaacaugugguu

SEQ ID NO: 891844 - RNA, 18 nt, Homo sapiens
acaaaccacaacugacac

SEQ ID NO: 891845 - RNA, 16 nt, Homo sapiens
acaaaccacuguacau

SEQ ID NO: 891846 - RNA, 16 nt, Homo sapiens
acaaacuacauguaau

SEQ ID NO: 891847 - RNA, 15 nt, Homo sapiens
acaaagaacaagcau

SEQ ID NO: 891848 - RNA, 15 nt, Homo sapiens
acaaagauaugcuaa

SEQ ID NO: 891849 - RNA, 15 nt, Homo sapiens
acaaagcacaguguu

SEQ ID NO: 891850 - RNA, 18 nt, Homo sapiens
acaaagcccuuccauguc

SEQ ID NO: 891851 - RNA, 23 nt, Homo sapiens
acaaagcugaagaaaaugaagcc

SEQ ID NO: 891852 - RNA, 15 nt, Homo sapiens
acaaaggcccagcag

SEQ ID NO: 891853 - RNA, 18 nt, Homo sapiens
acaaagggaaggcugcug

SEQ ID NO: 891854 - RNA, 14 nt, Homo sapiens
acaaaguauuugcu

SEQ ID NO: 891855 - RNA, 22 nt, Homo sapiens
acaaauaaucaaaacccaacau

SEQ ID NO: 891856 - RNA, 22 nt, Homo sapiens
acaaauaauuuuuaaauauaag

SEQ ID NO: 891857 - RNA, 13 nt, Homo sapiens
acaaauauuccug

SEQ ID NO: 891858 - RNA, 16 nt, Homo sapiens
acaaauuauguuacau

SEQ ID NO: 891859 - RNA, 21 nt, Homo sapiens
ccauugucaccuaacucugaa

SEQ ID NO: 891860 - RNA, 18 nt, Homo sapiens
ccauuguuccuuaccuuu

SEQ ID NO: 891861 - RNA, 21 nt, Homo sapiens
ccauuuguuggggcaguggua

SEQ ID NO: 891862 - RNA, 18 nt, Homo sapiens
ccauuuuucuagacuguc

SEQ ID NO: 891863 - RNA, 14 nt, Homo sapiens
cccaaagugcuagu

SEQ ID NO: 891864 - RNA, 19 nt, Homo sapiens
cccaaagugcuaguauuau

SEQ ID NO: 891865 - RNA, 20 nt, Homo sapiens
cccaaauuaaguauguuuga

SEQ ID NO: 891866 - RNA, 16 nt, Homo sapiens
cccaaauuucauaccu

SEQ ID NO: 891867 - RNA, 19 nt, Homo sapiens
cccaacagcaccaauugua

SEQ ID NO: 891868 - RNA, 21 nt, Homo sapiens
cccaacccugcccacuucagc

SEQ ID NO: 891869 - RNA, 23 nt, Homo sapiens
cccaaccucaaugcccugccauu

SEQ ID NO: 891870 - RNA, 18 nt, Homo sapiens
cccaaccucauggucaug

SEQ ID NO: 891871 - RNA, 16 nt, Homo sapiens
cccaacgcacaggaaa

SEQ ID NO: 891872 - RNA, 18 nt, Homo sapiens
cccaacuccuuccagcua

SEQ ID NO: 891873 - RNA, 23 nt, Homo sapiens
cccaacugcucugcccacuguga

SEQ ID NO: 891874 - RNA, 17 nt, Homo sapiens
cccaaggcaguguuccu

SEQ ID NO: 891875 - RNA, 17 nt, Homo sapiens
cccaauaaaagugacuc

SEQ ID NO: 891876 - RNA, 22 nt, Homo sapiens
cccaaugcacauccauucccaa

SEQ ID NO: 891877 - RNA, 21 nt, Homo sapiens
cccaauucaggacuggcucac

SEQ ID NO: 891878 - RNA, 13 nt, Homo sapiens
cccacaauggagu

SEQ ID NO: 891879 - RNA, 17 nt, Homo sapiens
cccacagaacugcuuac

SEQ ID NO: 891880 - RNA, 20 nt, Homo sapiens
cccacagcagcaauaugcuu

SEQ ID NO: 891881 - RNA, 15 nt, Homo sapiens
cccacauaccaucug

SEQ ID NO: 891882 - RNA, 21 nt, Homo sapiens
cccaccaacucugcacuccau

SEQ ID NO: 891883 - RNA, 11 nt, Homo sapiens
cccaccaucua

SEQ ID NO: 891884 - RNA, 17 nt, Homo sapiens
cccacccacaugugaca

SEQ ID NO: 891885 - RNA, 21 nt, Homo sapiens
cccacccuccuuucaccacau

SEQ ID NO: 891886 - RNA, 14 nt, Homo sapiens
cccaccucaggcug

SEQ ID NO: 891887 - RNA, 22 nt, Homo sapiens
cccacucccaggaccaagauug

SEQ ID NO: 891888 - RNA, 14 nt, Homo sapiens
cccacuggccaguc

SEQ ID NO: 891889 - RNA, 18 nt, Homo sapiens
cccacuguggccuggcau

SEQ ID NO: 891890 - RNA, 19 nt, Homo sapiens
cccacuucucuacucugga

SEQ ID NO: 891891 - RNA, 20 nt, Homo sapiens
cccacuucucuacucuggaa

SEQ ID NO: 891892 - RNA, 23 nt, Homo sapiens
cccacuuuccuacaaaauggagg

SEQ ID NO: 891893 - RNA, 14 nt, Homo sapiens
cccagaaagaggca

SEQ ID NO: 891894 - RNA, 19 nt, Homo sapiens
cccagaaccacacuguuga

SEQ ID NO: 891895 - RNA, 12 nt, Homo sapiens
cccagaaggcag

SEQ ID NO: 891896 - RNA, 22 nt, Homo sapiens
cccagaccuuuuauccacuuac

SEQ ID NO: 891897 - RNA, 22 nt, Homo sapiens
cccagacucaaacucaagguca

SEQ ID NO: 891898 - RNA, 14 nt, Homo sapiens
cccagacucagcuc

SEQ ID NO: 891899 - RNA, 17 nt, Homo sapiens
cccagacuuucuacacc

SEQ ID NO: 891900 - RNA, 20 nt, Homo sapiens
cccagagaagcaaguggcuu

SEQ ID NO: 891901 - RNA, 21 nt, Homo sapiens
cccagagaggggacauuuccc

SEQ ID NO: 891902 - RNA, 12 nt, Homo sapiens
cccagagcagga

SEQ ID NO: 891903 - RNA, 12 nt, Homo sapiens
cccagauccuca

SEQ ID NO: 891904 - RNA, 14 nt, Homo sapiens
cccagauccucugc

SEQ ID NO: 891905 - RNA, 23 nt, Homo sapiens
cccagauccucugcugacuccau

SEQ ID NO: 891906 - RNA, 12 nt, Homo sapiens
cccagaucucau

SEQ ID NO: 891907 - RNA, 16 nt, Homo sapiens
cccagcaacacaagcu

SEQ ID NO: 891908 - RNA, 14 nt, Homo sapiens
cccagcaacacaga

SEQ ID NO: 891909 - RNA, 13 nt, Homo sapiens
cccagcacuguga

SEQ ID NO: 891910 - RNA, 13 nt, Homo sapiens
cccagcacuuugg

SEQ ID NO: 891911 - RNA, 15 nt, Homo sapiens
cccagcauguacaaa

SEQ ID NO: 891912 - RNA, 18 nt, Homo sapiens
cccagccgaaaagcuuuu

SEQ ID NO: 891913 - RNA, 15 nt, Homo sapiens
cccagccuacugccu

SEQ ID NO: 891914 - RNA, 22 nt, Homo sapiens
cccagcgagcaucccgggcaag

SEQ ID NO: 891915 - RNA, 16 nt, Homo sapiens
cccagcuacucaggag

SEQ ID NO: 891916 - RNA, 11 nt, Homo sapiens
cccagcucucg

SEQ ID NO: 891917 - RNA, 22 nt, Homo sapiens
cccagcucugcuuuuuccagau

SEQ ID NO: 891918 - RNA, 17 nt, Homo sapiens
cccagcuguagccaugg

SEQ ID NO: 891919 - RNA, 16 nt, Homo sapiens
cccaggaacugggcca

SEQ ID NO: 891920 - RNA, 23 nt, Homo sapiens
cccaggaggucgaccccaaagcc

SEQ ID NO: 891921 - RNA, 13 nt, Homo sapiens
cccaggccaggga

SEQ ID NO: 891922 - RNA, 17 nt, Homo sapiens
cccaggcuggagugcag

SEQ ID NO: 891923 - RNA, 17 nt, Homo sapiens
cccagggaagccaaaag

SEQ ID NO: 891924 - RNA, 13 nt, Homo sapiens
cccagggcacuuc

SEQ ID NO: 891925 - RNA, 22 nt, Homo sapiens
cccagggcccuaacgggggugc

SEQ ID NO: 891926 - RNA, 18 nt, Homo sapiens
cccagguggcugacccag

SEQ ID NO: 891927 - RNA, 16 nt, Homo sapiens
cccagucucccaccuu

SEQ ID NO: 891928 - RNA, 16 nt, Homo sapiens
cccaguggaacaguca

SEQ ID NO: 891929 - RNA, 14 nt, Homo sapiens
cccaguguaaagaa

SEQ ID NO: 891930 - RNA, 21 nt, Homo sapiens
cccaguguuugggguguuuca

SEQ ID NO: 891931 - RNA, 12 nt, Homo sapiens
cccauaaggcca

SEQ ID NO: 891932 - RNA, 15 nt, Homo sapiens
cccaugaaucaaaga

SEQ ID NO: 891933 - RNA, 23 nt, Homo sapiens
cccaugaguagugcccacuugag

SEQ ID NO: 891934 - RNA, 22 nt, Homo sapiens
cccauugaaacaaaacauugau

SEQ ID NO: 891935 - RNA, 15 nt, Homo sapiens
cccauuucuauuuau

SEQ ID NO: 891936 - RNA, 17 nt, Homo sapiens
cccauuuuaucuuugaa

SEQ ID NO: 891937 - RNA, 17 nt, Homo sapiens
cccauuuugagugacuc

SEQ ID NO: 891938 - RNA, 23 nt, Homo sapiens
ccccaaaaccuuuccccagacac

SEQ ID NO: 891939 - RNA, 13 nt, Homo sapiens
ccccaaagucuua

SEQ ID NO: 891940 - RNA, 16 nt, Homo sapiens
ccccaacauugagaug

SEQ ID NO: 891941 - RNA, 19 nt, Homo sapiens
ccccaagcagccagccagu

SEQ ID NO: 891942 - RNA, 11 nt, Homo sapiens
ccccaccucag

SEQ ID NO: 891943 - RNA, 21 nt, Homo sapiens
ccccaccuuugggaucagccu

SEQ ID NO: 891944 - RNA, 13 nt, Homo sapiens
ccccacgugugaa

SEQ ID NO: 891945 - RNA, 16 nt, Homo sapiens
ccccacuucucuacuc

SEQ ID NO: 891946 - RNA, 22 nt, Homo sapiens
ccccacuucucuacucuggaag

SEQ ID NO: 891947 - RNA, 13 nt, Homo sapiens
ccccagacacugg

SEQ ID NO: 891948 - RNA, 19 nt, Homo sapiens
ccccagaggccucucucuc

SEQ ID NO: 891949 - RNA, 15 nt, Homo sapiens
ccccagcaguugaau

SEQ ID NO: 891950 - RNA, 16 nt, Homo sapiens
ccccagcccacaggug

SEQ ID NO: 891951 - RNA, 19 nt, Homo sapiens
ccccagcuuuaucugucac

SEQ ID NO: 891952 - RNA, 21 nt, Homo sapiens
ccccagguugccugggccacg

SEQ ID NO: 891953 - RNA, 15 nt, Homo sapiens
ccccagugcccacag

SEQ ID NO: 891954 - RNA, 15 nt, Homo sapiens
ccccaguucugcucc

SEQ ID NO: 891955 - RNA, 19 nt, Homo sapiens
ccccauaaucucauucaaa

SEQ ID NO: 891956 - RNA, 21 nt, Homo sapiens
ccccaucaucccagcugcucc

SEQ ID NO: 891957 - RNA, 17 nt, Homo sapiens
ccccaucucauucaggu

SEQ ID NO: 891958 - RNA, 22 nt, Homo sapiens
ccccaucuguuaaaugagagaa

SEQ ID NO: 891959 - RNA, 19 nt, Homo sapiens
cccccacccaguccgccaa

SEQ ID NO: 891960 - RNA, 13 nt, Homo sapiens
cccccacugccac

SEQ ID NO: 891961 - RNA, 20 nt, Homo sapiens
cccccugacauuaucuugga

SEQ ID NO: 891962 - RNA, 15 nt, Homo sapiens
cccccugccagugcc

SEQ ID NO: 891963 - RNA, 14 nt, Homo sapiens
ccccgacuucaucc

SEQ ID NO: 891964 - RNA, 12 nt, Homo sapiens
ccccggcugcuu

SEQ ID NO: 891965 - RNA, 16 nt, Homo sapiens
ccccuaagaggcagug

SEQ ID NO: 891966 - RNA, 13 nt, Homo sapiens
ccccuacaugaaa

SEQ ID NO: 891967 - RNA, 22 nt, Homo sapiens
ccccuagugcuauucuguguug

SEQ ID NO: 891968 - RNA, 11 nt, Homo sapiens
ccccucaaaaa

SEQ ID NO: 891969 - RNA, 15 nt, Homo sapiens
ccccucacucuguca

SEQ ID NO: 891970 - RNA, 22 nt, Homo sapiens
ccccucagagcucuuaugugga

SEQ ID NO: 891971 - RNA, 12 nt, Homo sapiens
ccccucaucuca

SEQ ID NO: 891972 - RNA, 12 nt, Homo sapiens
ccccuccacugu

SEQ ID NO: 891973 - RNA, 21 nt, Homo sapiens
ccccugccucaagaaauugcc

SEQ ID NO: 891974 - RNA, 17 nt, Homo sapiens
acaaauuauguuacauc

SEQ ID NO: 891975 - RNA, 21 nt, Homo sapiens
acaaauucuuuuucacacuga

SEQ ID NO: 891976 - RNA, 19 nt, Homo sapiens
acaaauuguucauguuacc

SEQ ID NO: 891977 - RNA, 17 nt, Homo sapiens
acaacaaccuggucaca

SEQ ID NO: 891978 - RNA, 22 nt, Homo sapiens
acaacagcaaaacuccaucuca

SEQ ID NO: 891979 - RNA, 17 nt, Homo sapiens
acaacauaaggagaaug

SEQ ID NO: 891980 - RNA, 22 nt, Homo sapiens
acaacauaaggagaauguaucu

SEQ ID NO: 891981 - RNA, 18 nt, Homo sapiens
acaacauccauguccuau

SEQ ID NO: 891982 - RNA, 14 nt, Homo sapiens
acaacauuuacuua

SEQ ID NO: 891983 - RNA, 14 nt, Homo sapiens
acaacauuucucaa

SEQ ID NO: 891984 - RNA, 22 nt, Homo sapiens
acaacauuucucaaaugcacau

SEQ ID NO: 891985 - RNA, 16 nt, Homo sapiens
acaacugguccacuca

SEQ ID NO: 891986 - RNA, 12 nt, Homo sapiens
acaacugugguc

SEQ ID NO: 891987 - RNA, 20 nt, Homo sapiens
acaacuuguguucuauuaau

SEQ ID NO: 891988 - RNA, 16 nt, Homo sapiens
acaagaagaccagacu

SEQ ID NO: 891989 - RNA, 22 nt, Homo sapiens
acaagaagccacagaccuagga

SEQ ID NO: 891990 - RNA, 15 nt, Homo sapiens
acaagacacccaagu

SEQ ID NO: 891991 - RNA, 22 nt, Homo sapiens
acaagagccauguaccagugua

SEQ ID NO: 891992 - RNA, 12 nt, Homo sapiens
acaagagcugcu

SEQ ID NO: 891993 - RNA, 12 nt, Homo sapiens
acaagcaaugga

SEQ ID NO: 891994 - RNA, 13 nt, Homo sapiens
acaagcauucucc

SEQ ID NO: 891995 - RNA, 18 nt, Homo sapiens
acaagcuuguauauacau

SEQ ID NO: 891996 - RNA, 17 nt, Homo sapiens
acaagcuuguccaugua

SEQ ID NO: 891997 - RNA, 21 nt, Homo sapiens
acaaggacuagagcucaggcc

SEQ ID NO: 891998 - RNA, 15 nt, Homo sapiens
acaaguaaucacuaa

SEQ ID NO: 891999 - RNA, 15 nt, Homo sapiens
acaagugcgccuugc

SEQ ID NO: 892000 - RNA, 21 nt, Homo sapiens
acaaguuucccaaauucccug

SEQ ID NO: 892001 - RNA, 18 nt, Homo sapiens
acaauaaaaauuccaaau

SEQ ID NO: 892002 - RNA, 16 nt, Homo sapiens
acaauaaaacauuccu

SEQ ID NO: 892003 - RNA, 21 nt, Homo sapiens
acaauaaauauucugcaugga

SEQ ID NO: 892004 - RNA, 16 nt, Homo sapiens
acaauaaggucaaugc

SEQ ID NO: 892005 - RNA, 21 nt, Homo sapiens
acaauaauauauccacaucua

SEQ ID NO: 892006 - RNA, 17 nt, Homo sapiens
acaauaaugaguucacu

SEQ ID NO: 892007 - RNA, 17 nt, Homo sapiens
acaauacaugcugcuaa

SEQ ID NO: 892008 - RNA, 23 nt, Homo sapiens
acaauacgugaaagaugcaagca

SEQ ID NO: 892009 - RNA, 22 nt, Homo sapiens
acaaucaugagucagacauuug

SEQ ID NO: 892010 - RNA, 13 nt, Homo sapiens
acaauccacucuc

SEQ ID NO: 892011 - RNA, 14 nt, Homo sapiens
acaauccacucuca

SEQ ID NO: 892012 - RNA, 21 nt, Homo sapiens
acaauccccacauaccaucug

SEQ ID NO: 892013 - RNA, 22 nt, Homo sapiens
acaaucuuuccuugucucucau

SEQ ID NO: 892014 - RNA, 21 nt, Homo sapiens
acaaugaaggaaaaccucacu

SEQ ID NO: 892015 - RNA, 14 nt, Homo sapiens
acaaugcagaauuu

SEQ ID NO: 892016 - RNA, 18 nt, Homo sapiens
acaaugcaguagccagca

SEQ ID NO: 892017 - RNA, 16 nt, Homo sapiens
acaaugccaucacugg

SEQ ID NO: 892018 - RNA, 12 nt, Homo sapiens
acaaugccucuc

SEQ ID NO: 892019 - RNA, 15 nt, Homo sapiens
acaauguauaagcua

SEQ ID NO: 892020 - RNA, 17 nt, Homo sapiens
acaauuaaacagccaaa

SEQ ID NO: 892021 - RNA, 20 nt, Homo sapiens
acaauuccauuuccaguuca

SEQ ID NO: 892022 - RNA, 15 nt, Homo sapiens
acaauuugcacuguu

SEQ ID NO: 892023 - RNA, 14 nt, Homo sapiens
acacaaauucuaaa

SEQ ID NO: 892024 - RNA, 13 nt, Homo sapiens
acacaacuaggaa

SEQ ID NO: 892025 - RNA, 21 nt, Homo sapiens
acacaacuaggaaguggcuga

SEQ ID NO: 892026 - RNA, 18 nt, Homo sapiens
acacaaggugcaaaucaa

SEQ ID NO: 892027 - RNA, 14 nt, Homo sapiens
acacacacaccucu

SEQ ID NO: 892028 - RNA, 15 nt, Homo sapiens
acacacaccaaugcg

SEQ ID NO: 892029 - RNA, 16 nt, Homo sapiens
acacacagauaugcac

SEQ ID NO: 892030 - RNA, 17 nt, Homo sapiens
acacacagauaugcaca

SEQ ID NO: 892031 - RNA, 12 nt, Homo sapiens
acacacauacau

SEQ ID NO: 892032 - RNA, 15 nt, Homo sapiens
acacacgccaaugca

SEQ ID NO: 892033 - RNA, 16 nt, Homo sapiens
acacacucaaaucaag

SEQ ID NO: 892034 - RNA, 14 nt, Homo sapiens
acacacugacauua

SEQ ID NO: 892035 - RNA, 16 nt, Homo sapiens
acacacugacauuaua

SEQ ID NO: 892036 - RNA, 12 nt, Homo sapiens
acacacuguaaa

SEQ ID NO: 892037 - RNA, 15 nt, Homo sapiens
acacagagauaugca

SEQ ID NO: 892038 - RNA, 15 nt, Homo sapiens
acacagagcaauggu

SEQ ID NO: 892039 - RNA, 12 nt, Homo sapiens
acacagagccug

SEQ ID NO: 892040 - RNA, 14 nt, Homo sapiens
acacagaugcacac

SEQ ID NO: 892041 - RNA, 19 nt, Homo sapiens
acacagauggucacacaga

SEQ ID NO: 892042 - RNA, 22 nt, Homo sapiens
acacagauggucacacagagau

SEQ ID NO: 892043 - RNA, 15 nt, Homo sapiens
acacagcaguaugaa

SEQ ID NO: 892044 - RNA, 12 nt, Homo sapiens
acacagcuccuc

SEQ ID NO: 892045 - RNA, 20 nt, Homo sapiens
acacagcucuucuccaggcu

SEQ ID NO: 892046 - RNA, 21 nt, Homo sapiens
acacagcucuucuccaggcug

SEQ ID NO: 892047 - RNA, 23 nt, Homo sapiens
acacaggaaaccaacacccaaag

SEQ ID NO: 892048 - RNA, 18 nt, Homo sapiens
acacaggcaaaauccuug

SEQ ID NO: 892049 - RNA, 21 nt, Homo sapiens
acacaggcccggcuccaggcu

SEQ ID NO: 892050 - RNA, 15 nt, Homo sapiens
acacagggcucuuug

SEQ ID NO: 892051 - RNA, 18 nt, Homo sapiens
acacagggugcaugugag

SEQ ID NO: 892052 - RNA, 17 nt, Homo sapiens
acacaguauuacuucug

SEQ ID NO: 892053 - RNA, 15 nt, Homo sapiens
acacagucaccuucu

SEQ ID NO: 892054 - RNA, 19 nt, Homo sapiens
acacaguguuccagcugcc

SEQ ID NO: 892055 - RNA, 15 nt, Homo sapiens
acacauacauugcca

SEQ ID NO: 892056 - RNA, 20 nt, Homo sapiens
acacauacugcaugcucagg

SEQ ID NO: 892057 - RNA, 17 nt, Homo sapiens
acacaucaggaguucaa

SEQ ID NO: 892058 - RNA, 18 nt, Homo sapiens
acacauggacacaccaga

SEQ ID NO: 892059 - RNA, 23 nt, Homo sapiens
acacauuaaaggguagccuacaa

SEQ ID NO: 892060 - RNA, 21 nt, Homo sapiens
acacauucuuaacacaugucc

SEQ ID NO: 892061 - RNA, 19 nt, Homo sapiens
acaccaccucuccagaggc

SEQ ID NO: 892062 - RNA, 13 nt, Homo sapiens
acaccacgaauuu

SEQ ID NO: 892063 - RNA, 19 nt, Homo sapiens
acaccaucacccucugggc

SEQ ID NO: 892064 - RNA, 21 nt, Homo sapiens
acaccauucaucucuaacaua

SEQ ID NO: 892065 - RNA, 23 nt, Homo sapiens
acacccaagaagaaaugcuuucc

SEQ ID NO: 892066 - RNA, 19 nt, Homo sapiens
acacccagucuguucccca

SEQ ID NO: 892067 - RNA, 17 nt, Homo sapiens
acacccaugaaucaaag

SEQ ID NO: 892068 - RNA, 16 nt, Homo sapiens
acacccgacuccucaa

SEQ ID NO: 892069 - RNA, 23 nt, Homo sapiens
acacccgccgccuccugcaccga

SEQ ID NO: 892070 - RNA, 23 nt, Homo sapiens
acacccuaauaaguccacaucuu

SEQ ID NO: 892071 - RNA, 19 nt, Homo sapiens
acacccuuuuaacauuuau

SEQ ID NO: 892072 - RNA, 17 nt, Homo sapiens
acaccgaugugcgcaca

SEQ ID NO: 892073 - RNA, 15 nt, Homo sapiens
acaccucccuacucc

SEQ ID NO: 892074 - RNA, 13 nt, Homo sapiens
acaccucccugaa

SEQ ID NO: 892075 - RNA, 20 nt, Homo sapiens
acaccucuccuuugugacuu

SEQ ID NO: 892076 - RNA, 16 nt, Homo sapiens
acaccugacacaucuu

SEQ ID NO: 892077 - RNA, 14 nt, Homo sapiens
acaccuucuuggcu

SEQ ID NO: 892078 - RNA, 14 nt, Homo sapiens
acacggaggcaucu

SEQ ID NO: 892079 - RNA, 22 nt, Homo sapiens
acacguguggcgggcaguggga

SEQ ID NO: 892080 - RNA, 21 nt, Homo sapiens
acacuagcuaaggaagggaaa

SEQ ID NO: 892081 - RNA, 18 nt, Homo sapiens
acacucuagugacuuccu

SEQ ID NO: 892082 - RNA, 16 nt, Homo sapiens
acacugaccuguguuc

SEQ ID NO: 892083 - RNA, 20 nt, Homo sapiens
acacugcacgaauggaagag

SEQ ID NO: 892084 - RNA, 18 nt, Homo sapiens
acacugguggaggagcug

SEQ ID NO: 892085 - RNA, 16 nt, Homo sapiens
acacuguaaacauuca

SEQ ID NO: 892086 - RNA, 16 nt, Homo sapiens
acacugucuaccucac

SEQ ID NO: 892087 - RNA, 18 nt, Homo sapiens
acacuucucaggacacag

SEQ ID NO: 892088 - RNA, 17 nt, Homo sapiens
acacuucugacuucacu

SEQ ID NO: 892089 - RNA, 18 nt, Homo sapiens
ccccuggguaacugucaa

SEQ ID NO: 892090 - RNA, 14 nt, Homo sapiens
ccccuuggcuguga

SEQ ID NO: 892091 - RNA, 15 nt, Homo sapiens
cccgaaugccuguca

SEQ ID NO: 892092 - RNA, 16 nt, Homo sapiens
cccgacuccucaaaag

SEQ ID NO: 892093 - RNA, 19 nt, Homo sapiens
cccgagcuagagugcagug

SEQ ID NO: 892094 - RNA, 22 nt, Homo sapiens
cccgcaggcagccccacacccg

SEQ ID NO: 892095 - RNA, 12 nt, Homo sapiens
cccgcucugcac

SEQ ID NO: 892096 - RNA, 15 nt, Homo sapiens
cccggccccaucaga

SEQ ID NO: 892097 - RNA, 21 nt, Homo sapiens
cccggcucccccugcuucuca

SEQ ID NO: 892098 - RNA, 17 nt, Homo sapiens
cccgugccaaguccagg

SEQ ID NO: 892099 - RNA, 20 nt, Homo sapiens
cccguggucuccuugcacuu

SEQ ID NO: 892100 - RNA, 23 nt, Homo sapiens
cccuaaggaaaucaaaucccauu

SEQ ID NO: 892101 - RNA, 14 nt, Homo sapiens
cccuacccacuucc

SEQ ID NO: 892102 - RNA, 12 nt, Homo sapiens
cccuauuacuug

SEQ ID NO: 892103 - RNA, 14 nt, Homo sapiens
cccuauuacuuguu

SEQ ID NO: 892104 - RNA, 17 nt, Homo sapiens
cccucagggaucuugca

SEQ ID NO: 892105 - RNA, 12 nt, Homo sapiens
cccucaguuuuu

SEQ ID NO: 892106 - RNA, 19 nt, Homo sapiens
cccucauccuuuuacuuuu

SEQ ID NO: 892107 - RNA, 19 nt, Homo sapiens
cccucaucucacugcccag

SEQ ID NO: 892108 - RNA, 13 nt, Homo sapiens
cccuccacuucaa

SEQ ID NO: 892109 - RNA, 21 nt, Homo sapiens
cccuccauccggcuccuguca

SEQ ID NO: 892110 - RNA, 13 nt, Homo sapiens
cccucccaacaga

SEQ ID NO: 892111 - RNA, 20 nt, Homo sapiens
cccucccaccuccgcuggga

SEQ ID NO: 892112 - RNA, 13 nt, Homo sapiens
cccucccagagaa

SEQ ID NO: 892113 - RNA, 16 nt, Homo sapiens
cccucccugugugaaa

SEQ ID NO: 892114 - RNA, 18 nt, Homo sapiens
cccuccuggagcauccca

SEQ ID NO: 892115 - RNA, 17 nt, Homo sapiens
cccucucccaugcacac

SEQ ID NO: 892116 - RNA, 18 nt, Homo sapiens
cccucuccccucauggag

SEQ ID NO: 892117 - RNA, 23 nt, Homo sapiens
cccucucccuggggauaugcaac

SEQ ID NO: 892118 - RNA, 23 nt, Homo sapiens
cccucugcuuuucuucccagcaa

SEQ ID NO: 892119 - RNA, 12 nt, Homo sapiens
cccucuggaucc

SEQ ID NO: 892120 - RNA, 18 nt, Homo sapiens
cccucuggcacuccagaa

SEQ ID NO: 892121 - RNA, 15 nt, Homo sapiens
cccugaagauuucag

SEQ ID NO: 892122 - RNA, 19 nt, Homo sapiens
cccugaccgugcuaacugu

SEQ ID NO: 892123 - RNA, 11 nt, Homo sapiens
cccugaccucc

SEQ ID NO: 892124 - RNA, 18 nt, Homo sapiens
cccugacgacacugaaga

SEQ ID NO: 892125 - RNA, 15 nt, Homo sapiens
cccugagguccugca

SEQ ID NO: 892126 - RNA, 16 nt, Homo sapiens
cccugagucaccagga

SEQ ID NO: 892127 - RNA, 17 nt, Homo sapiens
cccugcagccaaacaga

SEQ ID NO: 892128 - RNA, 16 nt, Homo sapiens
cccugccccacuucuc

SEQ ID NO: 892129 - RNA, 15 nt, Homo sapiens
cccugccccugccuu

SEQ ID NO: 892130 - RNA, 13 nt, Homo sapiens
cccugcccggcug

SEQ ID NO: 892131 - RNA, 15 nt, Homo sapiens
cccugccucaagaaa

SEQ ID NO: 892132 - RNA, 16 nt, Homo sapiens
cccugcuugcacuuug

SEQ ID NO: 892133 - RNA, 17 nt, Homo sapiens
cccuggccucacgccca

SEQ ID NO: 892134 - RNA, 14 nt, Homo sapiens
cccuggcucugcca

SEQ ID NO: 892135 - RNA, 11 nt, Homo sapiens
cccuguacaau

SEQ ID NO: 892136 - RNA, 18 nt, Homo sapiens
cccugucucuacuaaaaa

SEQ ID NO: 892137 - RNA, 18 nt, Homo sapiens
cccuuacuaugaucucag

SEQ ID NO: 892138 - RNA, 16 nt, Homo sapiens
cccuuauuuucaagaa

SEQ ID NO: 892139 - RNA, 19 nt, Homo sapiens
cccuuccuacagauaguca

SEQ ID NO: 892140 - RNA, 13 nt, Homo sapiens
cccuucugcugua

SEQ ID NO: 892141 - RNA, 21 nt, Homo sapiens
cccuucuuuaaaucaaaagcu

SEQ ID NO: 892142 - RNA, 13 nt, Homo sapiens
cccuugaaccagc

SEQ ID NO: 892143 - RNA, 16 nt, Homo sapiens
cccuuggagccaaugg

SEQ ID NO: 892144 - RNA, 15 nt, Homo sapiens
cccuuggcugugagg

SEQ ID NO: 892145 - RNA, 23 nt, Homo sapiens
cccuuuagggaaauucaaagcag

SEQ ID NO: 892146 - RNA, 19 nt, Homo sapiens
cccuuuucuguauguccuu

SEQ ID NO: 892147 - RNA, 19 nt, Homo sapiens
ucaggaagggaaagccaga

SEQ ID NO: 892148 - RNA, 18 nt, Homo sapiens
ucaggagaucgagaccau

SEQ ID NO: 892149 - RNA, 19 nt, Homo sapiens
ucaggaucaagaaaguguu

SEQ ID NO: 892150 - RNA, 21 nt, Homo sapiens
ucaggcagacaagagcugcug

SEQ ID NO: 892151 - RNA, 20 nt, Homo sapiens
ucaggcagguuugccaguga

SEQ ID NO: 892152 - RNA, 18 nt, Homo sapiens
ucaggccaacaagccaac

SEQ ID NO: 892153 - RNA, 16 nt, Homo sapiens
ucaggcggggugcugu

SEQ ID NO: 892154 - RNA, 22 nt, Homo sapiens
ucagggcugccacuaaccugua

SEQ ID NO: 892155 - RNA, 17 nt, Homo sapiens
ucaggggccucagggga

SEQ ID NO: 892156 - RNA, 18 nt, Homo sapiens
ucagguauagcugacauc

SEQ ID NO: 892157 - RNA, 13 nt, Homo sapiens
ucaggugauccac

SEQ ID NO: 892158 - RNA, 14 nt, Homo sapiens
ucaguaaacaauga

SEQ ID NO: 892159 - RNA, 20 nt, Homo sapiens
ucaguaaauauuaaccugaa

SEQ ID NO: 892160 - RNA, 22 nt, Homo sapiens
ucaguaguauucuaaagcuuuc

SEQ ID NO: 892161 - RNA, 20 nt, Homo sapiens
ucaguaugggaaccccaaau

SEQ ID NO: 892162 - RNA, 16 nt, Homo sapiens
ucaguccccauggcac

SEQ ID NO: 892163 - RNA, 17 nt, Homo sapiens
ucagugaaaaauaauua

SEQ ID NO: 892164 - RNA, 20 nt, Homo sapiens
ucagugaagaugccagugaa

SEQ ID NO: 892165 - RNA, 21 nt, Homo sapiens
ucagugcacacggaugcacag

SEQ ID NO: 892166 - RNA, 19 nt, Homo sapiens
ucaguggcauucacaucuc

SEQ ID NO: 892167 - RNA, 22 nt, Homo sapiens
ucaguguagaaccuaauucaau

SEQ ID NO: 892168 - RNA, 17 nt, Homo sapiens
ucaguuccucuuugcau

SEQ ID NO: 892169 - RNA, 20 nt, Homo sapiens
ucaguuucaauucagugcug

SEQ ID NO: 892170 - RNA, 23 nt, Homo sapiens
ucauaaacugagccucuuuucaa

SEQ ID NO: 892171 - RNA, 21 nt, Homo sapiens
ucauaacaauguaugugaaag

SEQ ID NO: 892172 - RNA, 21 nt, Homo sapiens
ucauaagaaugaauaauaauu

SEQ ID NO: 892173 - RNA, 15 nt, Homo sapiens
ucauacaaaacuguu

SEQ ID NO: 892174 - RNA, 22 nt, Homo sapiens
ucauacacaagucuaacaguua

SEQ ID NO: 892175 - RNA, 20 nt, Homo sapiens
ucauaccucugaccaacagg

SEQ ID NO: 892176 - RNA, 22 nt, Homo sapiens
ucauaguggcuuaaaacaacac

SEQ ID NO: 892177 - RNA, 22 nt, Homo sapiens
ucauaugguugacaguaugcau

SEQ ID NO: 892178 - RNA, 23 nt, Homo sapiens
ucauauugguauucacuaaucug

SEQ ID NO: 892179 - RNA, 14 nt, Homo sapiens
ucauauuuuguaua

SEQ ID NO: 892180 - RNA, 19 nt, Homo sapiens
ucaucaacuuauuauauga

SEQ ID NO: 892181 - RNA, 19 nt, Homo sapiens
ucaucaauucccauugcau

SEQ ID NO: 892182 - RNA, 20 nt, Homo sapiens
ucaucaauuuaaaaucauuc

SEQ ID NO: 892183 - RNA, 22 nt, Homo sapiens
ucaucaauuuuuauacauauca

SEQ ID NO: 892184 - RNA, 15 nt, Homo sapiens
ucaucagcauaccuu

SEQ ID NO: 892185 - RNA, 22 nt, Homo sapiens
ucaucaggcuuggaaugaauuc

SEQ ID NO: 892186 - RNA, 14 nt, Homo sapiens
ucaucaggucauua

SEQ ID NO: 892187 - RNA, 11 nt, Homo sapiens
ucaucauauga

SEQ ID NO: 892188 - RNA, 16 nt, Homo sapiens
ucauccacugugccau

SEQ ID NO: 892189 - RNA, 14 nt, Homo sapiens
ucauccauguccaa

SEQ ID NO: 892190 - RNA, 17 nt, Homo sapiens
ucauccccucguccugu

SEQ ID NO: 892191 - RNA, 21 nt, Homo sapiens
ucaucgaaaauucauuucaca

SEQ ID NO: 892192 - RNA, 18 nt, Homo sapiens
ucaucuacaagcauuugc

SEQ ID NO: 892193 - RNA, 22 nt, Homo sapiens
ucaucuacacagcaguaugaau

SEQ ID NO: 892194 - RNA, 16 nt, Homo sapiens
ucaucuacuacagggu

SEQ ID NO: 892195 - RNA, 19 nt, Homo sapiens
ucaucuccuuuauugcagu

SEQ ID NO: 892196 - RNA, 16 nt, Homo sapiens
ucaucucucaucacuu

SEQ ID NO: 892197 - RNA, 22 nt, Homo sapiens
ucaucucuucuuuuaaaccauu

SEQ ID NO: 892198 - RNA, 14 nt, Homo sapiens
ucaucuugacaugu

SEQ ID NO: 892199 - RNA, 15 nt, Homo sapiens
ucaugacagccagag

SEQ ID NO: 892200 - RNA, 18 nt, Homo sapiens
ucaugaguaccucaaagg

SEQ ID NO: 892201 - RNA, 18 nt, Homo sapiens
ucaugaguuucccagaga

SEQ ID NO: 892202 - RNA, 20 nt, Homo sapiens
ucaugcaagugcuaugccaa

SEQ ID NO: 892203 - RNA, 14 nt, Homo sapiens
acuauagcccaggu

SEQ ID NO: 892204 - RNA, 18 nt, Homo sapiens
acuaucaaacugaagcca

SEQ ID NO: 892205 - RNA, 23 nt, Homo sapiens
acuaucucuagagugagaaucug

SEQ ID NO: 892206 - RNA, 16 nt, Homo sapiens
acuaucugauuuccua

SEQ ID NO: 892207 - RNA, 15 nt, Homo sapiens
acuaugaucacagug

SEQ ID NO: 892208 - RNA, 14 nt, Homo sapiens
acuauggagccugg

SEQ ID NO: 892209 - RNA, 17 nt, Homo sapiens
acuaugguucccaauaa

SEQ ID NO: 892210 - RNA, 22 nt, Homo sapiens
acuauguuccaauaaaacuuua

SEQ ID NO: 892211 - RNA, 16 nt, Homo sapiens
acuauuaaaacuaaua

SEQ ID NO: 892212 - RNA, 16 nt, Homo sapiens
acuauuacaccaaaua

SEQ ID NO: 892213 - RNA, 15 nt, Homo sapiens
acuauuaccaugaga

SEQ ID NO: 892214 - RNA, 15 nt, Homo sapiens
acuauucaaacaguc

SEQ ID NO: 892215 - RNA, 18 nt, Homo sapiens
acuauugaaguugcagau

SEQ ID NO: 892216 - RNA, 23 nt, Homo sapiens
acuauugaauuggauacaaggau

SEQ ID NO: 892217 - RNA, 20 nt, Homo sapiens
acuauugguaauaaaccuug

SEQ ID NO: 892218 - RNA, 17 nt, Homo sapiens
acuauuuaugaaggcaa

SEQ ID NO: 892219 - RNA, 18 nt, Homo sapiens
acucaaccaucaauggaa

SEQ ID NO: 892220 - RNA, 19 nt, Homo sapiens
acucaagaggcugaggcag

SEQ ID NO: 892221 - RNA, 18 nt, Homo sapiens
acucaaguuuuuacaaaa

SEQ ID NO: 892222 - RNA, 20 nt, Homo sapiens
acucacaagaagaccagacu

SEQ ID NO: 892223 - RNA, 17 nt, Homo sapiens
acucaccucugccucaa

SEQ ID NO: 892224 - RNA, 21 nt, Homo sapiens
acucacuccagcccaacagaa

SEQ ID NO: 892225 - RNA, 21 nt, Homo sapiens
acucacugacucuucuaugca

SEQ ID NO: 892226 - RNA, 14 nt, Homo sapiens
acucacugugggaa

SEQ ID NO: 892227 - RNA, 16 nt, Homo sapiens
acucagaagacacuga

SEQ ID NO: 892228 - RNA, 15 nt, Homo sapiens
acucagacauuccaa

SEQ ID NO: 892229 - RNA, 12 nt, Homo sapiens
acucagacuguu

SEQ ID NO: 892230 - RNA, 18 nt, Homo sapiens
acucaguuguuccuacuc

SEQ ID NO: 892231 - RNA, 16 nt, Homo sapiens
acucaguuuucuugca

SEQ ID NO: 892232 - RNA, 13 nt, Homo sapiens
acucauaacucau

SEQ ID NO: 892233 - RNA, 20 nt, Homo sapiens
acucauaggcuuauuuccaa

SEQ ID NO: 892234 - RNA, 19 nt, Homo sapiens
acucaucccuguuccucaa

SEQ ID NO: 892235 - RNA, 17 nt, Homo sapiens
acucauggguacccaga

SEQ ID NO: 892236 - RNA, 22 nt, Homo sapiens
acucauucuucuguacgucuga

SEQ ID NO: 892237 - RNA, 13 nt, Homo sapiens
acucauugucuca

SEQ ID NO: 892238 - RNA, 14 nt, Homo sapiens
acucauugucucag

SEQ ID NO: 892239 - RNA, 15 nt, Homo sapiens
acucauugucucagu

SEQ ID NO: 892240 - RNA, 17 nt, Homo sapiens
acucauuuuuguuuuca

SEQ ID NO: 892241 - RNA, 19 nt, Homo sapiens
acuccaagauucaaagaga

SEQ ID NO: 892242 - RNA, 18 nt, Homo sapiens
acuccaagcuucaaguga

SEQ ID NO: 892243 - RNA, 21 nt, Homo sapiens
acuccacaguuuugccuuaaa

SEQ ID NO: 892244 - RNA, 18 nt, Homo sapiens
acuccacccccuccagcu

SEQ ID NO: 892245 - RNA, 15 nt, Homo sapiens
acuccagcccugucc

SEQ ID NO: 892246 - RNA, 13 nt, Homo sapiens
acuccagccugag

SEQ ID NO: 892247 - RNA, 22 nt, Homo sapiens
acucccacagaggagagaggcu

SEQ ID NO: 892248 - RNA, 12 nt, Homo sapiens
acucccaggacc

SEQ ID NO: 892249 - RNA, 14 nt, Homo sapiens
acucccauuuuccc

SEQ ID NO: 892250 - RNA, 22 nt, Homo sapiens
acucccuucccccauccuccag

SEQ ID NO: 892251 - RNA, 20 nt, Homo sapiens
acuccuauaaggagaguuca

SEQ ID NO: 892252 - RNA, 22 nt, Homo sapiens
acuccucaaaagcaaaugagau

SEQ ID NO: 892253 - RNA, 22 nt, Homo sapiens
acuccucagaucugaacacagu

SEQ ID NO: 892254 - RNA, 18 nt, Homo sapiens
acuccucuuauuugcuca

SEQ ID NO: 892255 - RNA, 20 nt, Homo sapiens
acuccuuauauugcugugag

SEQ ID NO: 892256 - RNA, 21 nt, Homo sapiens
acuccuugugguuuaugucau

SEQ ID NO: 892257 - RNA, 17 nt, Homo sapiens
acucguucuucugggaa

SEQ ID NO: 892258 - RNA, 18 nt, Homo sapiens
acucuaaauauuucauga

SEQ ID NO: 892259 - RNA, 13 nt, Homo sapiens
acucuacccuaua

SEQ ID NO: 892260 - RNA, 14 nt, Homo sapiens
acucuaguauucca

SEQ ID NO: 892261 - RNA, 21 nt, Homo sapiens
acucucaccgacuuauucuga

SEQ ID NO: 892262 - RNA, 17 nt, Homo sapiens
acucugaggacauggag

SEQ ID NO: 892263 - RNA, 14 nt, Homo sapiens
acucugcacuccau

SEQ ID NO: 892264 - RNA, 19 nt, Homo sapiens
acucugcgguggugccaga

SEQ ID NO: 892265 - RNA, 21 nt, Homo sapiens
acucuggaaguccccgggagc

SEQ ID NO: 892266 - RNA, 20 nt, Homo sapiens
acucuggagagacugugcug

SEQ ID NO: 892267 - RNA, 17 nt, Homo sapiens
acucugggcuccucaac

SEQ ID NO: 892268 - RNA, 22 nt, Homo sapiens
acucuggguuuauuacauggca

SEQ ID NO: 892269 - RNA, 14 nt, Homo sapiens
acucuggguuucau

SEQ ID NO: 892270 - RNA, 16 nt, Homo sapiens
acucugguggugcuuu

SEQ ID NO: 892271 - RNA, 22 nt, Homo sapiens
acucugugccagagccuggggc

SEQ ID NO: 892272 - RNA, 12 nt, Homo sapiens
acucugugucag

SEQ ID NO: 892273 - RNA, 16 nt, Homo sapiens
acucuucccaccucag

SEQ ID NO: 892274 - RNA, 22 nt, Homo sapiens
acucuucugagcaccuacuuac

SEQ ID NO: 892275 - RNA, 19 nt, Homo sapiens
acucuuguuuucaguuuca

SEQ ID NO: 892276 - RNA, 15 nt, Homo sapiens
acugaaaaaugucag

SEQ ID NO: 892277 - RNA, 15 nt, Homo sapiens
acugaaaacuguaaa

SEQ ID NO: 892278 - RNA, 14 nt, Homo sapiens
acugaaaugcuagc

SEQ ID NO: 892279 - RNA, 14 nt, Homo sapiens
acugaacauuugcu

SEQ ID NO: 892280 - RNA, 14 nt, Homo sapiens
acugaacgagggau

SEQ ID NO: 892281 - RNA, 23 nt, Homo sapiens
acugaagagaccacagcaauugg

SEQ ID NO: 892282 - RNA, 14 nt, Homo sapiens
acugaagugcuugc

SEQ ID NO: 892283 - RNA, 17 nt, Homo sapiens
acugacaccucacugag

SEQ ID NO: 892284 - RNA, 19 nt, Homo sapiens
acugacacuuugccagaaa

SEQ ID NO: 892285 - RNA, 19 nt, Homo sapiens
acugaccagccuccaugcu

SEQ ID NO: 892286 - RNA, 22 nt, Homo sapiens
acugaccccaucaccuacucac

SEQ ID NO: 892287 - RNA, 13 nt, Homo sapiens
acugacccuggag

SEQ ID NO: 892288 - RNA, 15 nt, Homo sapiens
acugacuaccagcua

SEQ ID NO: 892289 - RNA, 13 nt, Homo sapiens
acugacuccuuag

SEQ ID NO: 892290 - RNA, 14 nt, Homo sapiens
acugagccuagcua

SEQ ID NO: 892291 - RNA, 22 nt, Homo sapiens
acugaggccuucucaaacuuua

SEQ ID NO: 892292 - RNA, 12 nt, Homo sapiens
acugagggccac

SEQ ID NO: 892293 - RNA, 15 nt, Homo sapiens
acugaggucacuggg

SEQ ID NO: 892294 - RNA, 16 nt, Homo sapiens
acugagugacucuaua

SEQ ID NO: 892295 - RNA, 13 nt, Homo sapiens
acugauaaucucu

SEQ ID NO: 892296 - RNA, 19 nt, Homo sapiens
acugauccuguuucuugcu

SEQ ID NO: 892297 - RNA, 17 nt, Homo sapiens
acugaugccauguuuag

SEQ ID NO: 892298 - RNA, 19 nt, Homo sapiens
acugaugcgaaaacuugaa

SEQ ID NO: 892299 - RNA, 19 nt, Homo sapiens
acugaugggcaacccccag

SEQ ID NO: 892300 - RNA, 18 nt, Homo sapiens
acugcaagaaguacauga

SEQ ID NO: 892301 - RNA, 20 nt, Homo sapiens
acugcacacacagcuccucu

SEQ ID NO: 892302 - RNA, 20 nt, Homo sapiens
acugcacacaugguuuccaa

SEQ ID NO: 892303 - RNA, 22 nt, Homo sapiens
acugcacaucuagagaaaaaca

SEQ ID NO: 892304 - RNA, 20 nt, Homo sapiens
acugcaccgggccacagaga

SEQ ID NO: 892305 - RNA, 16 nt, Homo sapiens
acugcagauagccaga

SEQ ID NO: 892306 - RNA, 17 nt, Homo sapiens
acugcaugcacuucuua

SEQ ID NO: 892307 - RNA, 15 nt, Homo sapiens
acugccaugccucaa

SEQ ID NO: 892308 - RNA, 20 nt, Homo sapiens
acugccaugccucaagaaca

SEQ ID NO: 892309 - RNA, 20 nt, Homo sapiens
acugccucuuccucccucau

SEQ ID NO: 892310 - RNA, 17 nt, Homo sapiens
acugccuucaccuucac

SEQ ID NO: 892311 - RNA, 18 nt, Homo sapiens
acugccuuccacaauuca

SEQ ID NO: 892312 - RNA, 23 nt, Homo sapiens
acugcgacgcagguguaccuccc

SEQ ID NO: 892313 - RNA, 13 nt, Homo sapiens
acugcuccagugg

SEQ ID NO: 892314 - RNA, 13 nt, Homo sapiens
acugcucugccca

SEQ ID NO: 892315 - RNA, 16 nt, Homo sapiens
acugcuuuguauccau

SEQ ID NO: 892316 - RNA, 18 nt, Homo sapiens
acuggaggcaaauuucag

SEQ ID NO: 892317 - RNA, 22 nt, Homo sapiens
acuggcacaguuuucugagaaa

SEQ ID NO: 892318 - RNA, 15 nt, Homo sapiens
ucaugcaaucuuccu

SEQ ID NO: 892319 - RNA, 13 nt, Homo sapiens
ucaugcauuugca

SEQ ID NO: 892320 - RNA, 16 nt, Homo sapiens
ucaugcuuuguaccaa

SEQ ID NO: 892321 - RNA, 16 nt, Homo sapiens
ucauggaaaagcccag

SEQ ID NO: 892322 - RNA, 12 nt, Homo sapiens
ucauggaacuca

SEQ ID NO: 892323 - RNA, 18 nt, Homo sapiens
ucauggagaaacauccua

SEQ ID NO: 892324 - RNA, 20 nt, Homo sapiens
ucauggcagcuaagccacau

SEQ ID NO: 892325 - RNA, 21 nt, Homo sapiens
ucauguaaaccuaagcacgua

SEQ ID NO: 892326 - RNA, 13 nt, Homo sapiens
ucauguaaccaag

SEQ ID NO: 892327 - RNA, 14 nt, Homo sapiens
ucauguaaccaaga

SEQ ID NO: 892328 - RNA, 22 nt, Homo sapiens
ucaugucucagccuccucagua

SEQ ID NO: 892329 - RNA, 13 nt, Homo sapiens
ucaugugugcaug

SEQ ID NO: 892330 - RNA, 14 nt, Homo sapiens
ucauguuccucaaa

SEQ ID NO: 892331 - RNA, 16 nt, Homo sapiens
ucauguuggauaguca

SEQ ID NO: 892332 - RNA, 21 nt, Homo sapiens
ucauuaaaaaugaaagccaaa

SEQ ID NO: 892333 - RNA, 20 nt, Homo sapiens
ucauuauaaacgugaugauc

SEQ ID NO: 892334 - RNA, 16 nt, Homo sapiens
ucauuauuuuuuacaa

SEQ ID NO: 892335 - RNA, 17 nt, Homo sapiens
ucauucaauaucugaca

SEQ ID NO: 892336 - RNA, 23 nt, Homo sapiens
ucauucaccaaaugaugccacuu

SEQ ID NO: 892337 - RNA, 22 nt, Homo sapiens
ucauuccugaaagaaacaguua

SEQ ID NO: 892338 - RNA, 17 nt, Homo sapiens
ucauucgccugugggaa

SEQ ID NO: 892339 - RNA, 12 nt, Homo sapiens
ucauucugggaa

SEQ ID NO: 892340 - RNA, 15 nt, Homo sapiens
ucauucuucuggcaa

SEQ ID NO: 892341 - RNA, 16 nt, Homo sapiens
ucauucuuugaaggau

SEQ ID NO: 892342 - RNA, 14 nt, Homo sapiens
ucauuuaagggaaa

SEQ ID NO: 892343 - RNA, 21 nt, Homo sapiens
ucauuuauucuucuuuuccaa

SEQ ID NO: 892344 - RNA, 22 nt, Homo sapiens
ucauuuccuccgucaccucaga

SEQ ID NO: 892345 - RNA, 12 nt, Homo sapiens
ucauuugaacaa

SEQ ID NO: 892346 - RNA, 18 nt, Homo sapiens
ucauuuuaacaucugaga

SEQ ID NO: 892347 - RNA, 19 nt, Homo sapiens
ucauuuuaacaucugagaa

SEQ ID NO: 892348 - RNA, 23 nt, Homo sapiens
ucauuuugggaccuauaucucag

SEQ ID NO: 892349 - RNA, 23 nt, Homo sapiens
ucauuuuuuucacuggaguuaca

SEQ ID NO: 892350 - RNA, 18 nt, Homo sapiens
uccaaacagaaaagugca

SEQ ID NO: 892351 - RNA, 16 nt, Homo sapiens
uccaaagaacagccug

SEQ ID NO: 892352 - RNA, 20 nt, Homo sapiens
uccaaagcacauugaaagag

SEQ ID NO: 892353 - RNA, 18 nt, Homo sapiens
uccaaagugccacucauu

SEQ ID NO: 892354 - RNA, 20 nt, Homo sapiens
uccaaauaaggauuuguuca

SEQ ID NO: 892355 - RNA, 19 nt, Homo sapiens
uccaaaugauuuucaucaa

SEQ ID NO: 892356 - RNA, 15 nt, Homo sapiens
uccaacagacagggc

SEQ ID NO: 892357 - RNA, 19 nt, Homo sapiens
uccaaccccccaccugcca

SEQ ID NO: 892358 - RNA, 16 nt, Homo sapiens
uccaaccgaccagcuu

SEQ ID NO: 892359 - RNA, 13 nt, Homo sapiens
uccaagaacaauu

SEQ ID NO: 892360 - RNA, 18 nt, Homo sapiens
uccaagaggucuccauca

SEQ ID NO: 892361 - RNA, 20 nt, Homo sapiens
uccaagcaaaaacaaauggg

SEQ ID NO: 892362 - RNA, 22 nt, Homo sapiens
uccaagcauaccaacacgagca

SEQ ID NO: 892363 - RNA, 19 nt, Homo sapiens
uccaagguguaacucuaau

SEQ ID NO: 892364 - RNA, 13 nt, Homo sapiens
uccaagugccaau

SEQ ID NO: 892365 - RNA, 19 nt, Homo sapiens
uccaaguuccugcacucca

SEQ ID NO: 892366 - RNA, 17 nt, Homo sapiens
uccaauaggcauuugau

SEQ ID NO: 892367 - RNA, 13 nt, Homo sapiens
uccacaagccauu

SEQ ID NO: 892368 - RNA, 16 nt, Homo sapiens
uccacaauaaggucaa

SEQ ID NO: 892369 - RNA, 19 nt, Homo sapiens
uccacacugucagagcugu

SEQ ID NO: 892370 - RNA, 15 nt, Homo sapiens
uccacagacucccuc

SEQ ID NO: 892371 - RNA, 15 nt, Homo sapiens
uccacagucucuggg

SEQ ID NO: 892372 - RNA, 18 nt, Homo sapiens
uccacaguuuugccuuaa

SEQ ID NO: 892373 - RNA, 19 nt, Homo sapiens
uccacaguuuugccuuaaa

SEQ ID NO: 892374 - RNA, 15 nt, Homo sapiens
uccacccagcaaaga

SEQ ID NO: 892375 - RNA, 20 nt, Homo sapiens
uccacccaggcugcacugca

SEQ ID NO: 892376 - RNA, 13 nt, Homo sapiens
uccaccuaccugc

SEQ ID NO: 892377 - RNA, 14 nt, Homo sapiens
uccaccuugcucuu

SEQ ID NO: 892378 - RNA, 15 nt, Homo sapiens
uccaccuuguuacac

SEQ ID NO: 892379 - RNA, 15 nt, Homo sapiens
uccacgagcuauauu

SEQ ID NO: 892380 - RNA, 19 nt, Homo sapiens
uccacucaauaugugauuu

SEQ ID NO: 892381 - RNA, 14 nt, Homo sapiens
uccacucacuccag

SEQ ID NO: 892382 - RNA, 17 nt, Homo sapiens
uccacugaggaugugag

SEQ ID NO: 892383 - RNA, 14 nt, Homo sapiens
uccacugugccaug

SEQ ID NO: 892384 - RNA, 14 nt, Homo sapiens
uccacuucucuaga

SEQ ID NO: 892385 - RNA, 20 nt, Homo sapiens
uccacuucuuaaugcuuucc

SEQ ID NO: 892386 - RNA, 16 nt, Homo sapiens
uccagaaaaugaacac

SEQ ID NO: 892387 - RNA, 21 nt, Homo sapiens
uccagaaagaaggacacuugu

SEQ ID NO: 892388 - RNA, 19 nt, Homo sapiens
uccagacagagcccuguga

SEQ ID NO: 892389 - RNA, 14 nt, Homo sapiens
uccagacccggcug

SEQ ID NO: 892390 - RNA, 15 nt, Homo sapiens
uccagaccucuacaa

SEQ ID NO: 892391 - RNA, 15 nt, Homo sapiens
uccagagaguggcuc

SEQ ID NO: 892392 - RNA, 18 nt, Homo sapiens
uccagaggguugugauuu

SEQ ID NO: 892393 - RNA, 23 nt, Homo sapiens
uccagaggugaugguaacugcac

SEQ ID NO: 892394 - RNA, 19 nt, Homo sapiens
uccagaugccuuccugucu

SEQ ID NO: 892395 - RNA, 14 nt, Homo sapiens
uccagcaugcaucc

SEQ ID NO: 892396 - RNA, 14 nt, Homo sapiens
uccagcauuugcca

SEQ ID NO: 892397 - RNA, 19 nt, Homo sapiens
uccagccgcugcacaucac

SEQ ID NO: 892398 - RNA, 15 nt, Homo sapiens
uccagcucaccagcc

SEQ ID NO: 892399 - RNA, 19 nt, Homo sapiens
uccaggaauaggcauuugc

SEQ ID NO: 892400 - RNA, 13 nt, Homo sapiens
uccaggacaugau

SEQ ID NO: 892401 - RNA, 23 nt, Homo sapiens
uccaggcaaaauugauauacuuu

SEQ ID NO: 892402 - RNA, 16 nt, Homo sapiens
uccaggcccaaggagu

SEQ ID NO: 892403 - RNA, 15 nt, Homo sapiens
uccagggagaccuag

SEQ ID NO: 892404 - RNA, 22 nt, Homo sapiens
uccaggggcacacaaugcuauu

SEQ ID NO: 892405 - RNA, 19 nt, Homo sapiens
uccaguauucuugucaaaa

SEQ ID NO: 892406 - RNA, 14 nt, Homo sapiens
uccagugagcuuau

SEQ ID NO: 892407 - RNA, 17 nt, Homo sapiens
uccagugguaccagcuc

SEQ ID NO: 892408 - RNA, 14 nt, Homo sapiens
uccaguucaucuau

SEQ ID NO: 892409 - RNA, 15 nt, Homo sapiens
uccaguucaugagaa

SEQ ID NO: 892410 - RNA, 21 nt, Homo sapiens
uccauagggccuccuuagauc

SEQ ID NO: 892411 - RNA, 16 nt, Homo sapiens
uccaucaacacugcgc

SEQ ID NO: 892412 - RNA, 19 nt, Homo sapiens
uccaucauggcagugauga

SEQ ID NO: 892413 - RNA, 16 nt, Homo sapiens
uccauccccaaacugu

SEQ ID NO: 892414 - RNA, 12 nt, Homo sapiens
uccaucccgaaa

SEQ ID NO: 892415 - RNA, 17 nt, Homo sapiens
uccaucucugucucaaa

SEQ ID NO: 892416 - RNA, 19 nt, Homo sapiens
uccaucuguggaaaugaca

SEQ ID NO: 892417 - RNA, 22 nt, Homo sapiens
uccaugaaguuugaacuucaua

SEQ ID NO: 892418 - RNA, 21 nt, Homo sapiens
uccauggcagcuggucuuuau

SEQ ID NO: 892419 - RNA, 23 nt, Homo sapiens
uccauguaggaaaguaaaaugga

SEQ ID NO: 892420 - RNA, 12 nt, Homo sapiens
uccauguaucua

SEQ ID NO: 892421 - RNA, 16 nt, Homo sapiens
uccauguauucacaca

SEQ ID NO: 892422 - RNA, 20 nt, Homo sapiens
uccaugucccuguauaauuc

SEQ ID NO: 892423 - RNA, 15 nt, Homo sapiens
uccauguuuguaaaa

SEQ ID NO: 892424 - RNA, 12 nt, Homo sapiens
uccauucccaag

SEQ ID NO: 892425 - RNA, 15 nt, Homo sapiens
uccauuucaacucca

SEQ ID NO: 892426 - RNA, 21 nt, Homo sapiens
uccauuucucaaucagugcag

SEQ ID NO: 892427 - RNA, 19 nt, Homo sapiens
uccauuuggugaccaucug

SEQ ID NO: 892428 - RNA, 21 nt, Homo sapiens
uccauuuuacagaagcauuuu

SEQ ID NO: 892429 - RNA, 14 nt, Homo sapiens
ucccaaagcucaga

SEQ ID NO: 892430 - RNA, 23 nt, Homo sapiens
ucccaaccucaaugcccugccau

SEQ ID NO: 892431 - RNA, 17 nt, Homo sapiens
ucccaacucgaugggca

SEQ ID NO: 892432 - RNA, 14 nt, Homo sapiens
ucccaacucuagcc

SEQ ID NO: 892433 - RNA, 14 nt, Homo sapiens
acuggcagcuccuc

SEQ ID NO: 892434 - RNA, 15 nt, Homo sapiens
acuggcagcuccucu

SEQ ID NO: 892435 - RNA, 12 nt, Homo sapiens
acuggcauuaau

SEQ ID NO: 892436 - RNA, 20 nt, Homo sapiens
acuggccugauugcagagua

SEQ ID NO: 892437 - RNA, 21 nt, Homo sapiens
acuggcuggccagucuggguc

SEQ ID NO: 892438 - RNA, 23 nt, Homo sapiens
acuggcuucucuuucucugagug

SEQ ID NO: 892439 - RNA, 21 nt, Homo sapiens
acugggcuaccgugagaucca

SEQ ID NO: 892440 - RNA, 19 nt, Homo sapiens
acuggggucuguguggugc

SEQ ID NO: 892441 - RNA, 21 nt, Homo sapiens
acuggucuuguggaauuggga

SEQ ID NO: 892442 - RNA, 23 nt, Homo sapiens
acugguucauauuggacugauaa

SEQ ID NO: 892443 - RNA, 17 nt, Homo sapiens
acuguaaauauccacag

SEQ ID NO: 892444 - RNA, 21 nt, Homo sapiens
acuguaauuaaguaaaccaaa

SEQ ID NO: 892445 - RNA, 13 nt, Homo sapiens
acuguacuccucc

SEQ ID NO: 892446 - RNA, 14 nt, Homo sapiens
acuguacugagaca

SEQ ID NO: 892447 - RNA, 16 nt, Homo sapiens
acuguagcugaugaaa

SEQ ID NO: 892448 - RNA, 16 nt, Homo sapiens
acuguaggcagggaac

SEQ ID NO: 892449 - RNA, 16 nt, Homo sapiens
acuguccuacccaccc

SEQ ID NO: 892450 - RNA, 15 nt, Homo sapiens
acugucgagucccca

SEQ ID NO: 892451 - RNA, 12 nt, Homo sapiens
acugucucaaga

SEQ ID NO: 892452 - RNA, 14 nt, Homo sapiens
acugucucucauga

SEQ ID NO: 892453 - RNA, 15 nt, Homo sapiens
acugucucucaugaa

SEQ ID NO: 892454 - RNA, 16 nt, Homo sapiens
acugucuugaagacaa

SEQ ID NO: 892455 - RNA, 15 nt, Homo sapiens
acugugaaaccacua

SEQ ID NO: 892456 - RNA, 14 nt, Homo sapiens
acugugagacugua

SEQ ID NO: 892457 - RNA, 19 nt, Homo sapiens
acuguggagguacacucuu

SEQ ID NO: 892458 - RNA, 15 nt, Homo sapiens
acuguguagacuccu

SEQ ID NO: 892459 - RNA, 12 nt, Homo sapiens
acuguugcacug

SEQ ID NO: 892460 - RNA, 20 nt, Homo sapiens
acuguuggagcuacugcaaa

SEQ ID NO: 892461 - RNA, 17 nt, Homo sapiens
acuguuguacaagcuca

SEQ ID NO: 892462 - RNA, 15 nt, Homo sapiens
acuguuucuuaccuu

SEQ ID NO: 892463 - RNA, 20 nt, Homo sapiens
acuguuuucucucucuaugg

SEQ ID NO: 892464 - RNA, 16 nt, Homo sapiens
acuuaaaaauauccau

SEQ ID NO: 892465 - RNA, 13 nt, Homo sapiens
acuuaacauugau

SEQ ID NO: 892466 - RNA, 23 nt, Homo sapiens
acuuaagguuaccuuuguuccca

SEQ ID NO: 892467 - RNA, 21 nt, Homo sapiens
acuuaauguuugguaacuuuu

SEQ ID NO: 892468 - RNA, 11 nt, Homo sapiens
acuuacaugau

SEQ ID NO: 892469 - RNA, 14 nt, Homo sapiens
acuuacaugcauua

SEQ ID NO: 892470 - RNA, 11 nt, Homo sapiens
acuuacccaag

SEQ ID NO: 892471 - RNA, 20 nt, Homo sapiens
acuuacccuaaaacaugugu

SEQ ID NO: 892472 - RNA, 12 nt, Homo sapiens
acuuagcaacuu

SEQ ID NO: 892473 - RNA, 17 nt, Homo sapiens
acuuagcaugucccuac

SEQ ID NO: 892474 - RNA, 15 nt, Homo sapiens
acuuauaucaucagc

SEQ ID NO: 892475 - RNA, 16 nt, Homo sapiens
acuuauaucaucagca

SEQ ID NO: 892476 - RNA, 14 nt, Homo sapiens
acuuaucacaugga

SEQ ID NO: 892477 - RNA, 14 nt, Homo sapiens
acuuaucuugcucu

SEQ ID NO: 892478 - RNA, 19 nt, Homo sapiens
acuucaagagccucuggca

SEQ ID NO: 892479 - RNA, 13 nt, Homo sapiens
acuucaagugacc

SEQ ID NO: 892480 - RNA, 19 nt, Homo sapiens
acuucaauccauguaggaa

SEQ ID NO: 892481 - RNA, 14 nt, Homo sapiens
acuucacaauguau

SEQ ID NO: 892482 - RNA, 17 nt, Homo sapiens
acuucacuaaugacgau

SEQ ID NO: 892483 - RNA, 13 nt, Homo sapiens
acuucagcccagc

SEQ ID NO: 892484 - RNA, 23 nt, Homo sapiens
acuucagguggagagcacuagaa

SEQ ID NO: 892485 - RNA, 18 nt, Homo sapiens
acuucaguugcuuugcag

SEQ ID NO: 892486 - RNA, 16 nt, Homo sapiens
acuucauaaauguuca

SEQ ID NO: 892487 - RNA, 18 nt, Homo sapiens
acuucaugaggaggucag

SEQ ID NO: 892488 - RNA, 18 nt, Homo sapiens
acuucauuugaugcuaaa

SEQ ID NO: 892489 - RNA, 19 nt, Homo sapiens
acuucauuugaugcuaaau

SEQ ID NO: 892490 - RNA, 22 nt, Homo sapiens
acuuccacauuauacauuugau

SEQ ID NO: 892491 - RNA, 20 nt, Homo sapiens
acuuccauucccguggucuc

SEQ ID NO: 892492 - RNA, 19 nt, Homo sapiens
acuuccugugacuucagcu

SEQ ID NO: 892493 - RNA, 22 nt, Homo sapiens
acuuccuugguuuggacacagu

SEQ ID NO: 892494 - RNA, 13 nt, Homo sapiens
acuuccuuugaga

SEQ ID NO: 892495 - RNA, 21 nt, Homo sapiens
acuucuaaaugaagugcaaau

SEQ ID NO: 892496 - RNA, 22 nt, Homo sapiens
acuucuaaguaaaaccacagca

SEQ ID NO: 892497 - RNA, 19 nt, Homo sapiens
acuucuagagauaguacau

SEQ ID NO: 892498 - RNA, 18 nt, Homo sapiens
acuucuaugcaaaugccu

SEQ ID NO: 892499 - RNA, 18 nt, Homo sapiens
acuucucaggacacaggc

SEQ ID NO: 892500 - RNA, 12 nt, Homo sapiens
acuucucugagu

SEQ ID NO: 892501 - RNA, 22 nt, Homo sapiens
acuucugucuucacaacagauu

SEQ ID NO: 892502 - RNA, 14 nt, Homo sapiens
acuucugucuuccu

SEQ ID NO: 892503 - RNA, 24 nt, Homo sapiens
acuucuuacaauaauucuaugaga

SEQ ID NO: 892504 - RNA, 18 nt, Homo sapiens
acuugaaaaaauguucua

SEQ ID NO: 892505 - RNA, 13 nt, Homo sapiens
acuugaaauacca

SEQ ID NO: 892506 - RNA, 19 nt, Homo sapiens
acuugacaacaucccacag

SEQ ID NO: 892507 - RNA, 13 nt, Homo sapiens
acuugacauuccu

SEQ ID NO: 892508 - RNA, 16 nt, Homo sapiens
acuugagcuguauaua

SEQ ID NO: 892509 - RNA, 19 nt, Homo sapiens
acuugaggcuggcacuccc

SEQ ID NO: 892510 - RNA, 13 nt, Homo sapiens
acuugauuccuug

SEQ ID NO: 892511 - RNA, 21 nt, Homo sapiens
acuugcaccugguacugcaca

SEQ ID NO: 892512 - RNA, 22 nt, Homo sapiens
acuugcagauacauucaugagg

SEQ ID NO: 892513 - RNA, 15 nt, Homo sapiens
acuugcauacagaga

SEQ ID NO: 892514 - RNA, 17 nt, Homo sapiens
acuugcauacagagaca

SEQ ID NO: 892515 - RNA, 19 nt, Homo sapiens
acuugccaggcucccuuuc

SEQ ID NO: 892516 - RNA, 21 nt, Homo sapiens
acuugcccugccacuuugcau

SEQ ID NO: 892517 - RNA, 13 nt, Homo sapiens
acuuggggaccag

SEQ ID NO: 892518 - RNA, 17 nt, Homo sapiens
acuuggggcaccuugcu

SEQ ID NO: 892519 - RNA, 19 nt, Homo sapiens
acuuggggcaccuugcucc

SEQ ID NO: 892520 - RNA, 22 nt, Homo sapiens
acuugguuuuuggcucuuucag

SEQ ID NO: 892521 - RNA, 23 nt, Homo sapiens
acuuguaaauaaauagauuugau

SEQ ID NO: 892522 - RNA, 18 nt, Homo sapiens
acuugucaccaugagaua

SEQ ID NO: 892523 - RNA, 21 nt, Homo sapiens
acuuguuucaccauacuucau

SEQ ID NO: 892524 - RNA, 22 nt, Homo sapiens
acuuuaaaaaaaucauaugcua

SEQ ID NO: 892525 - RNA, 13 nt, Homo sapiens
acuuuaacccucu

SEQ ID NO: 892526 - RNA, 17 nt, Homo sapiens
acuuuaacccucucuuc

SEQ ID NO: 892527 - RNA, 14 nt, Homo sapiens
acuuuaacugacuu

SEQ ID NO: 892528 - RNA, 16 nt, Homo sapiens
acuuuaacugacuuaa

SEQ ID NO: 892529 - RNA, 17 nt, Homo sapiens
acuuuaauucucuuacu

SEQ ID NO: 892530 - RNA, 20 nt, Homo sapiens
acuuuagaguagcaugagag

SEQ ID NO: 892531 - RNA, 21 nt, Homo sapiens
acuuuaggaggaggugggggc

SEQ ID NO: 892532 - RNA, 22 nt, Homo sapiens
acuuuauaaauaaacaugagcg

SEQ ID NO: 892533 - RNA, 18 nt, Homo sapiens
acuuuaucuaauaccucu

SEQ ID NO: 892534 - RNA, 15 nt, Homo sapiens
acuuuauguauggag

SEQ ID NO: 892535 - RNA, 20 nt, Homo sapiens
acuuuauguuacuacaugca

SEQ ID NO: 892536 - RNA, 23 nt, Homo sapiens
acuuuauguuacuacaugcacuu

SEQ ID NO: 892537 - RNA, 15 nt, Homo sapiens
acuuucagaguuuga

SEQ ID NO: 892538 - RNA, 19 nt, Homo sapiens
acuuucauuaaagcauuua

SEQ ID NO: 892539 - RNA, 22 nt, Homo sapiens
acuuuccacuccuggcugagag

SEQ ID NO: 892540 - RNA, 19 nt, Homo sapiens
acuuucucuucauacuuuu

SEQ ID NO: 892541 - RNA, 14 nt, Homo sapiens
acuuugaauaaugg

SEQ ID NO: 892542 - RNA, 22 nt, Homo sapiens
acuuugaauaauggaaucuaua

SEQ ID NO: 892543 - RNA, 12 nt, Homo sapiens
acuuugacaaau

SEQ ID NO: 892544 - RNA, 16 nt, Homo sapiens
acuuugaucucugcuu

SEQ ID NO: 892545 - RNA, 17 nt, Homo sapiens
acuuugaucucugcuua

SEQ ID NO: 892546 - RNA, 15 nt, Homo sapiens
acuuugcacagcucu

SEQ ID NO: 892547 - RNA, 17 nt, Homo sapiens
acuuugggaggccaagg

SEQ ID NO: 892548 - RNA, 21 nt, Homo sapiens
ucccaauaaaagugacucuca

SEQ ID NO: 892549 - RNA, 22 nt, Homo sapiens
ucccaauaaaagugacucucag

SEQ ID NO: 892550 - RNA, 23 nt, Homo sapiens
ucccaauaacuaaugcuaagaaa

SEQ ID NO: 892551 - RNA, 17 nt, Homo sapiens
ucccaaugcacauccau

SEQ ID NO: 892552 - RNA, 16 nt, Homo sapiens
ucccaauucauuucau

SEQ ID NO: 892553 - RNA, 17 nt, Homo sapiens
ucccacaaucugggacu

SEQ ID NO: 892554 - RNA, 16 nt, Homo sapiens
ucccacaggcccuucc

SEQ ID NO: 892555 - RNA, 14 nt, Homo sapiens
ucccacccaacagc

SEQ ID NO: 892556 - RNA, 21 nt, Homo sapiens
ucccacccaacagcucagaga

SEQ ID NO: 892557 - RNA, 19 nt, Homo sapiens
ucccacccacaugugacac

SEQ ID NO: 892558 - RNA, 21 nt, Homo sapiens
ucccacccacaugugacacau

SEQ ID NO: 892559 - RNA, 16 nt, Homo sapiens
ucccaccccacuccag

SEQ ID NO: 892560 - RNA, 15 nt, Homo sapiens
ucccacucaguccau

SEQ ID NO: 892561 - RNA, 23 nt, Homo sapiens
ucccagaaauuagaaaccuuaau

SEQ ID NO: 892562 - RNA, 18 nt, Homo sapiens
ucccagaagggaguugcu

SEQ ID NO: 892563 - RNA, 14 nt, Homo sapiens
ucccagagcccagg

SEQ ID NO: 892564 - RNA, 22 nt, Homo sapiens
ucccagaggcagagccugaguc

SEQ ID NO: 892565 - RNA, 12 nt, Homo sapiens
ucccagauccuc

SEQ ID NO: 892566 - RNA, 18 nt, Homo sapiens
ucccagaugccccagcaa

SEQ ID NO: 892567 - RNA, 23 nt, Homo sapiens
ucccagcagcccuaaggaucucu

SEQ ID NO: 892568 - RNA, 20 nt, Homo sapiens
ucccagcagcgguaccccag

SEQ ID NO: 892569 - RNA, 18 nt, Homo sapiens
ucccagcaugcugagauu

SEQ ID NO: 892570 - RNA, 19 nt, Homo sapiens
ucccagcaugcugagauua

SEQ ID NO: 892571 - RNA, 20 nt, Homo sapiens
ucccagcaugcugagauuac

SEQ ID NO: 892572 - RNA, 22 nt, Homo sapiens
ucccagccccaggggugccugu

SEQ ID NO: 892573 - RNA, 19 nt, Homo sapiens
ucccagcccuauggaugug

SEQ ID NO: 892574 - RNA, 15 nt, Homo sapiens
ucccagcuacuuggg

SEQ ID NO: 892575 - RNA, 19 nt, Homo sapiens
ucccaggccccaugaccuc

SEQ ID NO: 892576 - RNA, 19 nt, Homo sapiens
ucccauaagcuaagccuua

SEQ ID NO: 892577 - RNA, 20 nt, Homo sapiens
ucccauccccuggacuggga

SEQ ID NO: 892578 - RNA, 14 nt, Homo sapiens
ucccauguauuuau

SEQ ID NO: 892579 - RNA, 18 nt, Homo sapiens
ucccauguugcaugccua

SEQ ID NO: 892580 - RNA, 20 nt, Homo sapiens
ucccauuuccugagaccaca

SEQ ID NO: 892581 - RNA, 17 nt, Homo sapiens
uccccaaaggcauccau

SEQ ID NO: 892582 - RNA, 16 nt, Homo sapiens
uccccaaccacuucau

SEQ ID NO: 892583 - RNA, 22 nt, Homo sapiens
uccccaaucccggucaugcuuu

SEQ ID NO: 892584 - RNA, 12 nt, Homo sapiens
uccccaccucag

SEQ ID NO: 892585 - RNA, 11 nt, Homo sapiens
uccccagcucc

SEQ ID NO: 892586 - RNA, 23 nt, Homo sapiens
uccccaggucucuccacugcucu

SEQ ID NO: 892587 - RNA, 18 nt, Homo sapiens
uccccagugcuaccucuc

SEQ ID NO: 892588 - RNA, 11 nt, Homo sapiens
uccccaucagc

SEQ ID NO: 892589 - RNA, 20 nt, Homo sapiens
uccccauuaguauccuguua

SEQ ID NO: 892590 - RNA, 16 nt, Homo sapiens
ucccccaccccagagu

SEQ ID NO: 892591 - RNA, 16 nt, Homo sapiens
ucccccacgugugaag

SEQ ID NO: 892592 - RNA, 20 nt, Homo sapiens
ucccccagucauucugggaa

SEQ ID NO: 892593 - RNA, 20 nt, Homo sapiens
ucccccaucccccacugcca

SEQ ID NO: 892594 - RNA, 14 nt, Homo sapiens
uccccgggggagga

SEQ ID NO: 892595 - RNA, 22 nt, Homo sapiens
uccccgggggcagacaccugug

SEQ ID NO: 892596 - RNA, 14 nt, Homo sapiens
uccccucacucugu

SEQ ID NO: 892597 - RNA, 20 nt, Homo sapiens
uccccuccguaggagcucac

SEQ ID NO: 892598 - RNA, 13 nt, Homo sapiens
uccccucggagaa

SEQ ID NO: 892599 - RNA, 15 nt, Homo sapiens
uccccugaagacuua

SEQ ID NO: 892600 - RNA, 11 nt, Homo sapiens
uccccuguggu

SEQ ID NO: 892601 - RNA, 15 nt, Homo sapiens
uccccuuggcuguga

SEQ ID NO: 892602 - RNA, 21 nt, Homo sapiens
ucccgagcuacucucuugcca

SEQ ID NO: 892603 - RNA, 23 nt, Homo sapiens
ucccgauaucaaaaagacugugg

SEQ ID NO: 892604 - RNA, 19 nt, Homo sapiens
ucccgccuuccuccuccac

SEQ ID NO: 892605 - RNA, 17 nt, Homo sapiens
ucccgggggcacugccu

SEQ ID NO: 892606 - RNA, 16 nt, Homo sapiens
ucccggguguguacac

SEQ ID NO: 892607 - RNA, 17 nt, Homo sapiens
ucccuauuaaccuagag

SEQ ID NO: 892608 - RNA, 22 nt, Homo sapiens
ucccucaaaugcgcgugugcac

SEQ ID NO: 892609 - RNA, 20 nt, Homo sapiens
ucccucccagagaacagggg

SEQ ID NO: 892610 - RNA, 22 nt, Homo sapiens
ucccucccgggggcacugccug

SEQ ID NO: 892611 - RNA, 19 nt, Homo sapiens
ucccuccucacuugcccug

SEQ ID NO: 892612 - RNA, 20 nt, Homo sapiens
ucccuccuucccuucucucc

SEQ ID NO: 892613 - RNA, 18 nt, Homo sapiens
ucccugggaacugguuca

SEQ ID NO: 892614 - RNA, 19 nt, Homo sapiens
ucccuguuaucugcuagau

SEQ ID NO: 892615 - RNA, 16 nt, Homo sapiens
ucccuugcuguuuuca

SEQ ID NO: 892616 - RNA, 18 nt, Homo sapiens
ucccuuuccuacucucag

SEQ ID NO: 892617 - RNA, 13 nt, Homo sapiens
ucccuuucuggga

SEQ ID NO: 892618 - RNA, 20 nt, Homo sapiens
ucccuuuuugucucucaugg

SEQ ID NO: 892619 - RNA, 14 nt, Homo sapiens
uccgccaaacacuc

SEQ ID NO: 892620 - RNA, 21 nt, Homo sapiens
uccgccugcagaggacagagc

SEQ ID NO: 892621 - RNA, 16 nt, Homo sapiens
uccggagaauugccuc

SEQ ID NO: 892622 - RNA, 13 nt, Homo sapiens
uccggugugagau

SEQ ID NO: 892623 - RNA, 23 nt, Homo sapiens
uccgucaccucagagacauacac

SEQ ID NO: 892624 - RNA, 18 nt, Homo sapiens
uccuaaaucuuccagcau

SEQ ID NO: 892625 - RNA, 21 nt, Homo sapiens
uccuaaaucuuccagcaugca

SEQ ID NO: 892626 - RNA, 14 nt, Homo sapiens
uccuaaauuuccag

SEQ ID NO: 892627 - RNA, 20 nt, Homo sapiens
uccuaacccccuuacugugc

SEQ ID NO: 892628 - RNA, 16 nt, Homo sapiens
uccuaaggacacacua

SEQ ID NO: 892629 - RNA, 15 nt, Homo sapiens
uccuaauaugcuuua

SEQ ID NO: 892630 - RNA, 21 nt, Homo sapiens
uccuacacccuuggacuugag

SEQ ID NO: 892631 - RNA, 15 nt, Homo sapiens
uccuaccuauauuac

SEQ ID NO: 892632 - RNA, 18 nt, Homo sapiens
uccuacucugugucaggu

SEQ ID NO: 892633 - RNA, 17 nt, Homo sapiens
uccuagaauggaugugc

SEQ ID NO: 892634 - RNA, 23 nt, Homo sapiens
uccuagaauggaugugcucacug

SEQ ID NO: 892635 - RNA, 19 nt, Homo sapiens
uccuagaggugggcagcug

SEQ ID NO: 892636 - RNA, 21 nt, Homo sapiens
uccuagccacaucacuacagu

SEQ ID NO: 892637 - RNA, 20 nt, Homo sapiens
uccuaggccacaccaucucc

SEQ ID NO: 892638 - RNA, 14 nt, Homo sapiens
uccuagugaaagag

SEQ ID NO: 892639 - RNA, 23 nt, Homo sapiens
uccuaucacugauaguguccaaa

SEQ ID NO: 892640 - RNA, 18 nt, Homo sapiens
uccucacaguugccaugu

SEQ ID NO: 892641 - RNA, 22 nt, Homo sapiens
uccucagagaauuucuaccauu

SEQ ID NO: 892642 - RNA, 14 nt, Homo sapiens
uccucaggauuuca

SEQ ID NO: 892643 - RNA, 24 nt, Homo sapiens
uccucagggacagagacaccugca

SEQ ID NO: 892644 - RNA, 21 nt, Homo sapiens
uccucaggggccugcccagug

SEQ ID NO: 892645 - RNA, 12 nt, Homo sapiens
uccucagugucc

SEQ ID NO: 892646 - RNA, 17 nt, Homo sapiens
uccuccccuccuggcac

SEQ ID NO: 892647 - RNA, 16 nt, Homo sapiens
uccucccucacaugau

SEQ ID NO: 892648 - RNA, 15 nt, Homo sapiens
uccucccucauucca

SEQ ID NO: 892649 - RNA, 15 nt, Homo sapiens
uccuccgucaccuca

SEQ ID NO: 892650 - RNA, 12 nt, Homo sapiens
uccuccguccac

SEQ ID NO: 892651 - RNA, 16 nt, Homo sapiens
uccuccgucugcaaug

SEQ ID NO: 892652 - RNA, 21 nt, Homo sapiens
uccuccucucucuacuugaau

SEQ ID NO: 892653 - RNA, 17 nt, Homo sapiens
uccucgggggaaagcac

SEQ ID NO: 892654 - RNA, 20 nt, Homo sapiens
uccucuaagccacucuucca

SEQ ID NO: 892655 - RNA, 19 nt, Homo sapiens
uccucucaagcuagccaga

SEQ ID NO: 892656 - RNA, 16 nt, Homo sapiens
uccucuccacugccuu

SEQ ID NO: 892657 - RNA, 18 nt, Homo sapiens
uccucuccacugccuucg

SEQ ID NO: 892658 - RNA, 22 nt, Homo sapiens
uccucucccgcgggccuggaca

SEQ ID NO: 892659 - RNA, 16 nt, Homo sapiens
uccucucuucucuauu

SEQ ID NO: 892660 - RNA, 11 nt, Homo sapiens
uccucugacau

SEQ ID NO: 892661 - RNA, 22 nt, Homo sapiens
uccucugacuggagucuaggaa

SEQ ID NO: 892662 - RNA, 14 nt, Homo sapiens
acuuugggcccaga

SEQ ID NO: 892663 - RNA, 11 nt, Homo sapiens
acuuugugcaa

SEQ ID NO: 892664 - RNA, 18 nt, Homo sapiens
acuuuuaaugccuuccac

SEQ ID NO: 892665 - RNA, 17 nt, Homo sapiens
acuuuucuaacauaugu

SEQ ID NO: 892666 - RNA, 21 nt, Homo sapiens
acuuuucuuuauugcugugaa

SEQ ID NO: 892667 - RNA, 17 nt, Homo sapiens
acuuuugcaugaaaaua

SEQ ID NO: 892668 - RNA, 16 nt, Homo sapiens
acuuuuuagccaguga

SEQ ID NO: 892669 - RNA, 14 nt, Homo sapiens
acuuuuuauucaau

SEQ ID NO: 892670 - RNA, 22 nt, Homo sapiens
acuuuuucagaguugcuuuaaa

SEQ ID NO: 892671 - RNA, 17 nt, Homo sapiens
agaaaaaacuagagccu

SEQ ID NO: 892672 - RNA, 12 nt, Homo sapiens
agaaaaaaucug

SEQ ID NO: 892673 - RNA, 14 nt, Homo sapiens
agaaaacauuccaa

SEQ ID NO: 892674 - RNA, 15 nt, Homo sapiens
agaaaaccauuuuag

SEQ ID NO: 892675 - RNA, 14 nt, Homo sapiens
agaaaacuggaaau

SEQ ID NO: 892676 - RNA, 15 nt, Homo sapiens
agaaaacuguuaaua

SEQ ID NO: 892677 - RNA, 13 nt, Homo sapiens
agaaaagccagag

SEQ ID NO: 892678 - RNA, 19 nt, Homo sapiens
agaaaaguagguuuacauu

SEQ ID NO: 892679 - RNA, 17 nt, Homo sapiens
agaaaauaaaagcacuu

SEQ ID NO: 892680 - RNA, 18 nt, Homo sapiens
agaaaaucaucuuggcca

SEQ ID NO: 892681 - RNA, 16 nt, Homo sapiens
agaaaauuaguaauug

SEQ ID NO: 892682 - RNA, 11 nt, Homo sapiens
agaaacacagg

SEQ ID NO: 892683 - RNA, 17 nt, Homo sapiens
agaaacaugacacugac

SEQ ID NO: 892684 - RNA, 19 nt, Homo sapiens
agaaacaugacacugaccu

SEQ ID NO: 892685 - RNA, 20 nt, Homo sapiens
agaaaccaagagaaguuuug

SEQ ID NO: 892686 - RNA, 19 nt, Homo sapiens
agaaaccaagucuacuuca

SEQ ID NO: 892687 - RNA, 16 nt, Homo sapiens
agaaacguaacugugu

SEQ ID NO: 892688 - RNA, 17 nt, Homo sapiens
agaaacguaacugugug

SEQ ID NO: 892689 - RNA, 19 nt, Homo sapiens
agaaacugaggccauuauu

SEQ ID NO: 892690 - RNA, 14 nt, Homo sapiens
agaaacuuaaacaa

SEQ ID NO: 892691 - RNA, 15 nt, Homo sapiens
agaaagaaacacuca

SEQ ID NO: 892692 - RNA, 12 nt, Homo sapiens
agaaagacugga

SEQ ID NO: 892693 - RNA, 17 nt, Homo sapiens
agaaagaggcagugauu

SEQ ID NO: 892694 - RNA, 18 nt, Homo sapiens
agaaagccguacugucua

SEQ ID NO: 892695 - RNA, 20 nt, Homo sapiens
agaaagccuucauaagccua

SEQ ID NO: 892696 - RNA, 19 nt, Homo sapiens
agaaagcucugcaugugug

SEQ ID NO: 892697 - RNA, 22 nt, Homo sapiens
agaaaggagaacuauccaaaac

SEQ ID NO: 892698 - RNA, 23 nt, Homo sapiens
agaaaggagcucugaaucugaua

SEQ ID NO: 892699 - RNA, 13 nt, Homo sapiens
agaaaggccugag

SEQ ID NO: 892700 - RNA, 20 nt, Homo sapiens
agaaagggagggcucugagg

SEQ ID NO: 892701 - RNA, 14 nt, Homo sapiens
agaaaguacuucuu

SEQ ID NO: 892702 - RNA, 14 nt, Homo sapiens
agaaagugcagaau

SEQ ID NO: 892703 - RNA, 12 nt, Homo sapiens
agaaaguucuca

SEQ ID NO: 892704 - RNA, 18 nt, Homo sapiens
agaaauaaaaauaccucu

SEQ ID NO: 892705 - RNA, 19 nt, Homo sapiens
agaaauaaaaauaccucuu

SEQ ID NO: 892706 - RNA, 16 nt, Homo sapiens
agaaauacugcucuga

SEQ ID NO: 892707 - RNA, 16 nt, Homo sapiens
agaaauauauauacau

SEQ ID NO: 892708 - RNA, 17 nt, Homo sapiens
agaaaucagcacauucc

SEQ ID NO: 892709 - RNA, 17 nt, Homo sapiens
agaaaucuuuauucuua

SEQ ID NO: 892710 - RNA, 15 nt, Homo sapiens
agaaauguauccuga

SEQ ID NO: 892711 - RNA, 13 nt, Homo sapiens
agaaauuccugua

SEQ ID NO: 892712 - RNA, 19 nt, Homo sapiens
agaaauuccuguagcaucu

SEQ ID NO: 892713 - RNA, 22 nt, Homo sapiens
agaaauugcauuuccugacaga

SEQ ID NO: 892714 - RNA, 20 nt, Homo sapiens
agaacaagcaacauaaaaca

SEQ ID NO: 892715 - RNA, 15 nt, Homo sapiens
agaacaaugcuauaa

SEQ ID NO: 892716 - RNA, 16 nt, Homo sapiens
agaacacaaggucauu

SEQ ID NO: 892717 - RNA, 12 nt, Homo sapiens
agaacacccacu

SEQ ID NO: 892718 - RNA, 21 nt, Homo sapiens
agaacaccuuuguuuugcacu

SEQ ID NO: 892719 - RNA, 17 nt, Homo sapiens
agaacagaggcauuuaa

SEQ ID NO: 892720 - RNA, 15 nt, Homo sapiens
agaacagcagacuca

SEQ ID NO: 892721 - RNA, 19 nt, Homo sapiens
agaacaguaacugccauca

SEQ ID NO: 892722 - RNA, 22 nt, Homo sapiens
agaacauuccucugcagcacuu

SEQ ID NO: 892723 - RNA, 12 nt, Homo sapiens
agaaccaaagca

SEQ ID NO: 892724 - RNA, 15 nt, Homo sapiens
agaaccacuuggcug

SEQ ID NO: 892725 - RNA, 13 nt, Homo sapiens
agaacccuuccug

SEQ ID NO: 892726 - RNA, 18 nt, Homo sapiens
agaacccuuggagccaau

SEQ ID NO: 892727 - RNA, 18 nt, Homo sapiens
agaacugaauaaacagga

SEQ ID NO: 892728 - RNA, 19 nt, Homo sapiens
agaacugaggucacugggu

SEQ ID NO: 892729 - RNA, 23 nt, Homo sapiens
agaacuggaaagacauagccaac

SEQ ID NO: 892730 - RNA, 13 nt, Homo sapiens
agaacuugauaua

SEQ ID NO: 892731 - RNA, 15 nt, Homo sapiens
agaagaaagggcaag

SEQ ID NO: 892732 - RNA, 13 nt, Homo sapiens
agaagacacugca

SEQ ID NO: 892733 - RNA, 12 nt, Homo sapiens
agaagagccuga

SEQ ID NO: 892734 - RNA, 20 nt, Homo sapiens
agaagagccugacuguguuc

SEQ ID NO: 892735 - RNA, 16 nt, Homo sapiens
agaagaggcuggugcu

SEQ ID NO: 892736 - RNA, 14 nt, Homo sapiens
agaagaguuugcaa

SEQ ID NO: 892737 - RNA, 19 nt, Homo sapiens
agaagaucuaauaccaucc

SEQ ID NO: 892738 - RNA, 19 nt, Homo sapiens
agaagauuuuaugcugcug

SEQ ID NO: 892739 - RNA, 13 nt, Homo sapiens
agaagauuuugcc

SEQ ID NO: 892740 - RNA, 17 nt, Homo sapiens
agaagauuuugccacau

SEQ ID NO: 892741 - RNA, 21 nt, Homo sapiens
agaagauuuugccacauuuga

SEQ ID NO: 892742 - RNA, 23 nt, Homo sapiens
agaagccaaaauacuucugagac

SEQ ID NO: 892743 - RNA, 17 nt, Homo sapiens
agaagccccuaggcaaa

SEQ ID NO: 892744 - RNA, 18 nt, Homo sapiens
agaagcucccagaugcug

SEQ ID NO: 892745 - RNA, 16 nt, Homo sapiens
agaaggacaccuccuu

SEQ ID NO: 892746 - RNA, 16 nt, Homo sapiens
agaaggacaugugcua

SEQ ID NO: 892747 - RNA, 18 nt, Homo sapiens
agaaggaguucugacauu

SEQ ID NO: 892748 - RNA, 10 nt, Homo sapiens
agaagggaug

SEQ ID NO: 892749 - RNA, 15 nt, Homo sapiens
agaagggccagcccu

SEQ ID NO: 892750 - RNA, 12 nt, Homo sapiens
agaaggggacag

SEQ ID NO: 892751 - RNA, 22 nt, Homo sapiens
agaaggguuuuccacccuggaa

SEQ ID NO: 892752 - RNA, 14 nt, Homo sapiens
agaagguccuuaau

SEQ ID NO: 892753 - RNA, 14 nt, Homo sapiens
agaagguugcucua

SEQ ID NO: 892754 - RNA, 22 nt, Homo sapiens
agaagguuugcaccccuccuau

SEQ ID NO: 892755 - RNA, 17 nt, Homo sapiens
agaaguaaaagcuaauu

SEQ ID NO: 892756 - RNA, 13 nt, Homo sapiens
agaaguaggcaug

SEQ ID NO: 892757 - RNA, 20 nt, Homo sapiens
agaagucauaaacagcauuu

SEQ ID NO: 892758 - RNA, 22 nt, Homo sapiens
agaagucaugaagcccaaguga

SEQ ID NO: 892759 - RNA, 21 nt, Homo sapiens
agaagucauggcccaaaucca

SEQ ID NO: 892760 - RNA, 15 nt, Homo sapiens
agaagucccucccau

SEQ ID NO: 892761 - RNA, 16 nt, Homo sapiens
agaaguguuccuucau

SEQ ID NO: 892762 - RNA, 17 nt, Homo sapiens
agaaguuaagcagccuu

SEQ ID NO: 892763 - RNA, 18 nt, Homo sapiens
agaauaaaaauugacuuc

SEQ ID NO: 892764 - RNA, 20 nt, Homo sapiens
agaauaaaugaaucuuacuc

SEQ ID NO: 892765 - RNA, 22 nt, Homo sapiens
agaauaaaugaaucuuacuccu

SEQ ID NO: 892766 - RNA, 12 nt, Homo sapiens
agaauaaugugu

SEQ ID NO: 892767 - RNA, 14 nt, Homo sapiens
agaauacacuauca

SEQ ID NO: 892768 - RNA, 13 nt, Homo sapiens
agaauagugcauu

SEQ ID NO: 892769 - RNA, 19 nt, Homo sapiens
agaauauuuauuaccucug

SEQ ID NO: 892770 - RNA, 18 nt, Homo sapiens
agaaucaaauugcuacau

SEQ ID NO: 892771 - RNA, 17 nt, Homo sapiens
agaaucacuugcacucc

SEQ ID NO: 892772 - RNA, 22 nt, Homo sapiens
agaauccacaaagccgugccuu

SEQ ID NO: 892773 - RNA, 18 nt, Homo sapiens
agaaucuagauaggugcu

SEQ ID NO: 892774 - RNA, 19 nt, Homo sapiens
agaaucuauuuccuuucca

SEQ ID NO: 892775 - RNA, 14 nt, Homo sapiens
agaaugaaguggag

SEQ ID NO: 892776 - RNA, 12 nt, Homo sapiens
agaaugcaugua

SEQ ID NO: 892777 - RNA, 16 nt, Homo sapiens
agaauggaugugcuca

SEQ ID NO: 892778 - RNA, 19 nt, Homo sapiens
uccucugcugacuccauau

SEQ ID NO: 892779 - RNA, 13 nt, Homo sapiens
uccucugcugcuc

SEQ ID NO: 892780 - RNA, 15 nt, Homo sapiens
uccucuugaaccaca

SEQ ID NO: 892781 - RNA, 14 nt, Homo sapiens
uccucuugccacug

SEQ ID NO: 892782 - RNA, 21 nt, Homo sapiens
uccucuugccucucucaggag

SEQ ID NO: 892783 - RNA, 14 nt, Homo sapiens
uccucuugcucaaa

SEQ ID NO: 892784 - RNA, 15 nt, Homo sapiens
uccucuuugcaugga

SEQ ID NO: 892785 - RNA, 23 nt, Homo sapiens
uccugagaggugcugcaggcaaa

SEQ ID NO: 892786 - RNA, 14 nt, Homo sapiens
uccugauaaacauu

SEQ ID NO: 892787 - RNA, 17 nt, Homo sapiens
uccugauaaacauuaaa

SEQ ID NO: 892788 - RNA, 23 nt, Homo sapiens
uccugcaccgagagagauggaau

SEQ ID NO: 892789 - RNA, 20 nt, Homo sapiens
uccugcacuccagaauccac

SEQ ID NO: 892790 - RNA, 14 nt, Homo sapiens
uccugcccaaguga

SEQ ID NO: 892791 - RNA, 22 nt, Homo sapiens
uccugcccccagccauggugag

SEQ ID NO: 892792 - RNA, 15 nt, Homo sapiens
uccugccucuacugg

SEQ ID NO: 892793 - RNA, 18 nt, Homo sapiens
uccugccuugaugaagcc

SEQ ID NO: 892794 - RNA, 22 nt, Homo sapiens
uccugcuggaugcgugcccuga

SEQ ID NO: 892795 - RNA, 13 nt, Homo sapiens
uccuggaaccaau

SEQ ID NO: 892796 - RNA, 15 nt, Homo sapiens
uccuggaaugaagca

SEQ ID NO: 892797 - RNA, 18 nt, Homo sapiens
uccuggaguacaaacaca

SEQ ID NO: 892798 - RNA, 22 nt, Homo sapiens
uccuggccccagcccccaccuc

SEQ ID NO: 892799 - RNA, 15 nt, Homo sapiens
uccuggcugagagag

SEQ ID NO: 892800 - RNA, 22 nt, Homo sapiens
uccugggagagaaggagaucag

SEQ ID NO: 892801 - RNA, 22 nt, Homo sapiens
uccuggggagcuucacaaacau

SEQ ID NO: 892802 - RNA, 20 nt, Homo sapiens
uccugggggaugugcacggc

SEQ ID NO: 892803 - RNA, 17 nt, Homo sapiens
uccugguauuauuuaca

SEQ ID NO: 892804 - RNA, 18 nt, Homo sapiens
uccugguauuauuuacaa

SEQ ID NO: 892805 - RNA, 13 nt, Homo sapiens
uccuguaagacaa

SEQ ID NO: 892806 - RNA, 18 nt, Homo sapiens
uccuguacauuucacaaa

SEQ ID NO: 892807 - RNA, 14 nt, Homo sapiens
uccuguauucuaca

SEQ ID NO: 892808 - RNA, 20 nt, Homo sapiens
uccuguccaaccuaaccccu

SEQ ID NO: 892809 - RNA, 15 nt, Homo sapiens
uccugucccuaccca

SEQ ID NO: 892810 - RNA, 13 nt, Homo sapiens
uccugucugccag

SEQ ID NO: 892811 - RNA, 12 nt, Homo sapiens
uccugugcuacu

SEQ ID NO: 892812 - RNA, 13 nt, Homo sapiens
uccuguguggaag

SEQ ID NO: 892813 - RNA, 13 nt, Homo sapiens
uccuguuacuuaa

SEQ ID NO: 892814 - RNA, 19 nt, Homo sapiens
uccuguuagcauaauguga

SEQ ID NO: 892815 - RNA, 24 nt, Homo sapiens
uccuguugcaaugacacauaggaa

SEQ ID NO: 892816 - RNA, 20 nt, Homo sapiens
uccuuaauagccauaugcaa

SEQ ID NO: 892817 - RNA, 16 nt, Homo sapiens
uccuuagagacaucaa

SEQ ID NO: 892818 - RNA, 16 nt, Homo sapiens
uccuuccagcuaguga

SEQ ID NO: 892819 - RNA, 14 nt, Homo sapiens
uccuugcaccugca

SEQ ID NO: 892820 - RNA, 12 nt, Homo sapiens
uccuugcacuuu

SEQ ID NO: 892821 - RNA, 19 nt, Homo sapiens
uccuugucucucauucucu

SEQ ID NO: 892822 - RNA, 20 nt, Homo sapiens
uccuuuaaauccuuccauga

SEQ ID NO: 892823 - RNA, 23 nt, Homo sapiens
uccuuuaggucugguuguugcac

SEQ ID NO: 892824 - RNA, 17 nt, Homo sapiens
uccuuucagcaagacuu

SEQ ID NO: 892825 - RNA, 23 nt, Homo sapiens
uccuuuccaagcuccucgugaua

SEQ ID NO: 892826 - RNA, 16 nt, Homo sapiens
uccuuucuccagccag

SEQ ID NO: 892827 - RNA, 23 nt, Homo sapiens
uccuuucucuaucccaagccaac

SEQ ID NO: 892828 - RNA, 13 nt, Homo sapiens
uccuuuugaccaa

SEQ ID NO: 892829 - RNA, 14 nt, Homo sapiens
uccuuuugaccaaa

SEQ ID NO: 892830 - RNA, 15 nt, Homo sapiens
uccuuuugaccaaau

SEQ ID NO: 892831 - RNA, 15 nt, Homo sapiens
uccuuuuguguacag

SEQ ID NO: 892832 - RNA, 18 nt, Homo sapiens
ucgaauuuuucagaugau

SEQ ID NO: 892833 - RNA, 13 nt, Homo sapiens
ucgagguggauca

SEQ ID NO: 892834 - RNA, 14 nt, Homo sapiens
ucgagucuaccucu

SEQ ID NO: 892835 - RNA, 20 nt, Homo sapiens
ucgauuagacuggacagcuu

SEQ ID NO: 892836 - RNA, 21 nt, Homo sapiens
ucgccccaggcccucccugac

SEQ ID NO: 892837 - RNA, 13 nt, Homo sapiens
ucgccggccuugu

SEQ ID NO: 892838 - RNA, 22 nt, Homo sapiens
ucgccguguuacuguugcacug

SEQ ID NO: 892839 - RNA, 19 nt, Homo sapiens
ucgcuacaagaaccugcua

SEQ ID NO: 892840 - RNA, 22 nt, Homo sapiens
ucgcuccugugucuugcaaugg

SEQ ID NO: 892841 - RNA, 16 nt, Homo sapiens
ucggaagacuugccac

SEQ ID NO: 892842 - RNA, 18 nt, Homo sapiens
ucggagacagugaucucc

SEQ ID NO: 892843 - RNA, 22 nt, Homo sapiens
ucgggaaauuauuaugacucaa

SEQ ID NO: 892844 - RNA, 15 nt, Homo sapiens
ucggggaacuccugg

SEQ ID NO: 892845 - RNA, 20 nt, Homo sapiens
ucgguagaggauuucuaguu

SEQ ID NO: 892846 - RNA, 14 nt, Homo sapiens
ucguagccaucucu

SEQ ID NO: 892847 - RNA, 21 nt, Homo sapiens
ucgucuccugacaugucucac

SEQ ID NO: 892848 - RNA, 13 nt, Homo sapiens
ucgugacaacaug

SEQ ID NO: 892849 - RNA, 23 nt, Homo sapiens
ucgugggagagagacguguacau

SEQ ID NO: 892850 - RNA, 23 nt, Homo sapiens
ucguggggggagguggacagucc

SEQ ID NO: 892851 - RNA, 21 nt, Homo sapiens
ucguggguguguguagccaag

SEQ ID NO: 892852 - RNA, 16 nt, Homo sapiens
ucgugguagaagccag

SEQ ID NO: 892853 - RNA, 19 nt, Homo sapiens
ucguggugugucaaugcca

SEQ ID NO: 892854 - RNA, 17 nt, Homo sapiens
ucgugugauuuccuaca

SEQ ID NO: 892855 - RNA, 18 nt, Homo sapiens
ucguuuucauaacuugcu

SEQ ID NO: 892856 - RNA, 15 nt, Homo sapiens
ucuaaaaugcuuuua

SEQ ID NO: 892857 - RNA, 16 nt, Homo sapiens
ucuaaacugcuguuaa

SEQ ID NO: 892858 - RNA, 20 nt, Homo sapiens
ucuaaauauuucaugauuca

SEQ ID NO: 892859 - RNA, 12 nt, Homo sapiens
ucuaaaugaagu

SEQ ID NO: 892860 - RNA, 19 nt, Homo sapiens
ucuaaaugaagugcaaauu

SEQ ID NO: 892861 - RNA, 11 nt, Homo sapiens
ucuaaccucag

SEQ ID NO: 892862 - RNA, 19 nt, Homo sapiens
ucuaacuagaaaucugcca

SEQ ID NO: 892863 - RNA, 14 nt, Homo sapiens
ucuaacucaggggu

SEQ ID NO: 892864 - RNA, 17 nt, Homo sapiens
ucuaacuguaaaucacu

SEQ ID NO: 892865 - RNA, 14 nt, Homo sapiens
ucuaagagaucugg

SEQ ID NO: 892866 - RNA, 15 nt, Homo sapiens
ucuaagccaacuuua

SEQ ID NO: 892867 - RNA, 22 nt, Homo sapiens
ucuaagcugcagcuuccuguca

SEQ ID NO: 892868 - RNA, 20 nt, Homo sapiens
ucuaaguggaaaaaguauua

SEQ ID NO: 892869 - RNA, 15 nt, Homo sapiens
ucuaagugugcugca

SEQ ID NO: 892870 - RNA, 20 nt, Homo sapiens
ucuaauacaaagaugagcuc

SEQ ID NO: 892871 - RNA, 21 nt, Homo sapiens
ucuaaugacacgguaggccaa

SEQ ID NO: 892872 - RNA, 14 nt, Homo sapiens
ucuacaagcauuug

SEQ ID NO: 892873 - RNA, 23 nt, Homo sapiens
ucuacaagcauuugcccugugga

SEQ ID NO: 892874 - RNA, 12 nt, Homo sapiens
ucuacacagccu

SEQ ID NO: 892875 - RNA, 13 nt, Homo sapiens
ucuacacauauau

SEQ ID NO: 892876 - RNA, 13 nt, Homo sapiens
ucuacacugagga

SEQ ID NO: 892877 - RNA, 13 nt, Homo sapiens
ucuacagccucag

SEQ ID NO: 892878 - RNA, 17 nt, Homo sapiens
ucuaccccugcuaagga

SEQ ID NO: 892879 - RNA, 15 nt, Homo sapiens
ucuacccuauacaac

SEQ ID NO: 892880 - RNA, 15 nt, Homo sapiens
ucuaccugagcauuc

SEQ ID NO: 892881 - RNA, 11 nt, Homo sapiens
ucuaccugugg

SEQ ID NO: 892882 - RNA, 14 nt, Homo sapiens
ucuaccuucagggu

SEQ ID NO: 892883 - RNA, 16 nt, Homo sapiens
ucuaccuuuacuacau

SEQ ID NO: 892884 - RNA, 22 nt, Homo sapiens
ucuacgcucuccuuucuuucua

SEQ ID NO: 892885 - RNA, 20 nt, Homo sapiens
ucuacguauaaauaugaaau

SEQ ID NO: 892886 - RNA, 14 nt, Homo sapiens
ucuacuacagggug

SEQ ID NO: 892887 - RNA, 11 nt, Homo sapiens
ucuacugccuu

SEQ ID NO: 892888 - RNA, 18 nt, Homo sapiens
ucuacuggucuuguggaa

SEQ ID NO: 892889 - RNA, 22 nt, Homo sapiens
ucuagaacacaggcaaaauccu

SEQ ID NO: 892890 - RNA, 16 nt, Homo sapiens
ucuagacuugugcuga

SEQ ID NO: 892891 - RNA, 22 nt, Homo sapiens
ucuagagauuuucuuggcagua

SEQ ID NO: 892892 - RNA, 19 nt, Homo sapiens
ucuagccuggcaacagagc

SEQ ID NO: 892893 - RNA, 18 nt, Homo sapiens
agaauggguuuacucuca

SEQ ID NO: 892894 - RNA, 17 nt, Homo sapiens
agaauguaucuccuccu

SEQ ID NO: 892895 - RNA, 21 nt, Homo sapiens
agaauguuacuuuggaaugac

SEQ ID NO: 892896 - RNA, 19 nt, Homo sapiens
agaauuaaaacuaugaaau

SEQ ID NO: 892897 - RNA, 17 nt, Homo sapiens
agaauuccugaagccag

SEQ ID NO: 892898 - RNA, 23 nt, Homo sapiens
agaauucugcuaccucacugggg

SEQ ID NO: 892899 - RNA, 13 nt, Homo sapiens
agaauuguaucau

SEQ ID NO: 892900 - RNA, 17 nt, Homo sapiens
agaauuguccaugugcu

SEQ ID NO: 892901 - RNA, 21 nt, Homo sapiens
agaauuuauucaauuccucug

SEQ ID NO: 892902 - RNA, 20 nt, Homo sapiens
agaauuucuuugucauucaa

SEQ ID NO: 892903 - RNA, 19 nt, Homo sapiens
agaauuuggauacacucuc

SEQ ID NO: 892904 - RNA, 23 nt, Homo sapiens
agaauuugguaaauuaguauuua

SEQ ID NO: 892905 - RNA, 15 nt, Homo sapiens
agaauuuguccaaua

SEQ ID NO: 892906 - RNA, 13 nt, Homo sapiens
agaauuuuccuaa

SEQ ID NO: 892907 - RNA, 15 nt, Homo sapiens
agacaaaacuagaga

SEQ ID NO: 892908 - RNA, 15 nt, Homo sapiens
agacaaaccacugua

SEQ ID NO: 892909 - RNA, 14 nt, Homo sapiens
agacaaagcaaagc

SEQ ID NO: 892910 - RNA, 18 nt, Homo sapiens
agacaacagcauaacuaa

SEQ ID NO: 892911 - RNA, 13 nt, Homo sapiens
agacaacauuucu

SEQ ID NO: 892912 - RNA, 18 nt, Homo sapiens
agacaacugguccacuca

SEQ ID NO: 892913 - RNA, 21 nt, Homo sapiens
agacaauggcuuacuccagga

SEQ ID NO: 892914 - RNA, 23 nt, Homo sapiens
agacacagcgucccuagcaguga

SEQ ID NO: 892915 - RNA, 12 nt, Homo sapiens
agacaccugccu

SEQ ID NO: 892916 - RNA, 16 nt, Homo sapiens
agacaccugccuuaac

SEQ ID NO: 892917 - RNA, 18 nt, Homo sapiens
agacaccuugacagggca

SEQ ID NO: 892918 - RNA, 15 nt, Homo sapiens
agacacgcucuucua

SEQ ID NO: 892919 - RNA, 18 nt, Homo sapiens
agacacuucauggaccaa

SEQ ID NO: 892920 - RNA, 14 nt, Homo sapiens
agacagaaugucac

SEQ ID NO: 892921 - RNA, 16 nt, Homo sapiens
agacagagacagagag

SEQ ID NO: 892922 - RNA, 15 nt, Homo sapiens
agacagagcccugug

SEQ ID NO: 892923 - RNA, 20 nt, Homo sapiens
agacagaguuuucacucuua

SEQ ID NO: 892924 - RNA, 20 nt, Homo sapiens
agacagggucucacuauguu

SEQ ID NO: 892925 - RNA, 19 nt, Homo sapiens
agacaggguuuugccaugu

SEQ ID NO: 892926 - RNA, 19 nt, Homo sapiens
agacaggucuagacuuucu

SEQ ID NO: 892927 - RNA, 19 nt, Homo sapiens
agacauacgaaacacaaac

SEQ ID NO: 892928 - RNA, 19 nt, Homo sapiens
agacauaguucagccacaa

SEQ ID NO: 892929 - RNA, 16 nt, Homo sapiens
agacaugaaugcacac

SEQ ID NO: 892930 - RNA, 12 nt, Homo sapiens
agacauuccaag

SEQ ID NO: 892931 - RNA, 19 nt, Homo sapiens
agaccaaaggauccagaga

SEQ ID NO: 892932 - RNA, 13 nt, Homo sapiens
agaccaccucuca

SEQ ID NO: 892933 - RNA, 23 nt, Homo sapiens
agaccacuauucuuaacuauuca

SEQ ID NO: 892934 - RNA, 14 nt, Homo sapiens
agaccagaagugga

SEQ ID NO: 892935 - RNA, 24 nt, Homo sapiens
agaccagccugaccaacaugguga

SEQ ID NO: 892936 - RNA, 15 nt, Homo sapiens
agaccauaauguuac

SEQ ID NO: 892937 - RNA, 22 nt, Homo sapiens
agacccacgugcuaggggauga

SEQ ID NO: 892938 - RNA, 14 nt, Homo sapiens
agacccaguguaaa

SEQ ID NO: 892939 - RNA, 21 nt, Homo sapiens
agacccaguguaaagaauaaa

SEQ ID NO: 892940 - RNA, 22 nt, Homo sapiens
agaccucucaauuucuggaaaa

SEQ ID NO: 892941 - RNA, 23 nt, Homo sapiens
agaccucugugaggaaagcacac

SEQ ID NO: 892942 - RNA, 19 nt, Homo sapiens
agaccugacaagcacugcu

SEQ ID NO: 892943 - RNA, 19 nt, Homo sapiens
agaccuguaaucauauaau

SEQ ID NO: 892944 - RNA, 20 nt, Homo sapiens
agaccuuguuucaaucuuug

SEQ ID NO: 892945 - RNA, 20 nt, Homo sapiens
agacgcucaagaauccucug

SEQ ID NO: 892946 - RNA, 14 nt, Homo sapiens
agacgucucaagac

SEQ ID NO: 892947 - RNA, 15 nt, Homo sapiens
agacuacagccagaa

SEQ ID NO: 892948 - RNA, 21 nt, Homo sapiens
agacuaucuuacuauuucaca

SEQ ID NO: 892949 - RNA, 22 nt, Homo sapiens
agacuaugaggaauauuugcaa

SEQ ID NO: 892950 - RNA, 13 nt, Homo sapiens
agacuauggagcc

SEQ ID NO: 892951 - RNA, 20 nt, Homo sapiens
agacuauggagccuggcaca

SEQ ID NO: 892952 - RNA, 21 nt, Homo sapiens
agacuaugugucaugauuuca

SEQ ID NO: 892953 - RNA, 13 nt, Homo sapiens
agacucaaacuca

SEQ ID NO: 892954 - RNA, 21 nt, Homo sapiens
agacucagggccccagcacua

SEQ ID NO: 892955 - RNA, 23 nt, Homo sapiens
agacucauucccuagaucuuucu

SEQ ID NO: 892956 - RNA, 13 nt, Homo sapiens
agacuccaaagaa

SEQ ID NO: 892957 - RNA, 17 nt, Homo sapiens
agacucuaaauauuuca

SEQ ID NO: 892958 - RNA, 14 nt, Homo sapiens
agacucugucucaa

SEQ ID NO: 892959 - RNA, 23 nt, Homo sapiens
agacugaauuuuaaauguucaca

SEQ ID NO: 892960 - RNA, 18 nt, Homo sapiens
agacugcagcugcugaag

SEQ ID NO: 892961 - RNA, 13 nt, Homo sapiens
agacugcaucuca

SEQ ID NO: 892962 - RNA, 14 nt, Homo sapiens
agacugcaucucaa

SEQ ID NO: 892963 - RNA, 18 nt, Homo sapiens
agacuggaacuugaacug

SEQ ID NO: 892964 - RNA, 15 nt, Homo sapiens
agacuggaagcacag

SEQ ID NO: 892965 - RNA, 22 nt, Homo sapiens
agacugugcugggaacauguac

SEQ ID NO: 892966 - RNA, 23 nt, Homo sapiens
agacuguugcucaaaucuauuca

SEQ ID NO: 892967 - RNA, 21 nt, Homo sapiens
agacuuaaauaguucaguaua

SEQ ID NO: 892968 - RNA, 16 nt, Homo sapiens
agacuucgacucagga

SEQ ID NO: 892969 - RNA, 19 nt, Homo sapiens
agacuuggggaaauugcuu

SEQ ID NO: 892970 - RNA, 15 nt, Homo sapiens
agacuuggggaccag

SEQ ID NO: 892971 - RNA, 18 nt, Homo sapiens
agacuuggggaccagagg

SEQ ID NO: 892972 - RNA, 21 nt, Homo sapiens
agagaaaccuccggugugaga

SEQ ID NO: 892973 - RNA, 21 nt, Homo sapiens
agagaaagagagagaauucuu

SEQ ID NO: 892974 - RNA, 20 nt, Homo sapiens
agagaauauuucaaaugaac

SEQ ID NO: 892975 - RNA, 13 nt, Homo sapiens
agagaaucugaag

SEQ ID NO: 892976 - RNA, 14 nt, Homo sapiens
agagaauucacuuu

SEQ ID NO: 892977 - RNA, 18 nt, Homo sapiens
agagacaauaaaacauuc

SEQ ID NO: 892978 - RNA, 21 nt, Homo sapiens
agagacaauaaaacauuccug

SEQ ID NO: 892979 - RNA, 13 nt, Homo sapiens
agagacaccugca

SEQ ID NO: 892980 - RNA, 11 nt, Homo sapiens
agagacagggu

SEQ ID NO: 892981 - RNA, 23 nt, Homo sapiens
agagaccuugcgaccauguguag

SEQ ID NO: 892982 - RNA, 16 nt, Homo sapiens
agagacuauuuagaca

SEQ ID NO: 892983 - RNA, 12 nt, Homo sapiens
agagacugagcc

SEQ ID NO: 892984 - RNA, 13 nt, Homo sapiens
agagacugaguca

SEQ ID NO: 892985 - RNA, 13 nt, Homo sapiens
agagacuggagca

SEQ ID NO: 892986 - RNA, 19 nt, Homo sapiens
agagacuggagcaucugac

SEQ ID NO: 892987 - RNA, 21 nt, Homo sapiens
agagacuuggggaccagaggu

SEQ ID NO: 892988 - RNA, 17 nt, Homo sapiens
agagagauauaucugaa

SEQ ID NO: 892989 - RNA, 17 nt, Homo sapiens
agagagaugaucgugcc

SEQ ID NO: 892990 - RNA, 20 nt, Homo sapiens
agagagcaccuggugaucac

SEQ ID NO: 892991 - RNA, 15 nt, Homo sapiens
agagagcagaaauaa

SEQ ID NO: 892992 - RNA, 22 nt, Homo sapiens
agagagcucgcucuugggaguc

SEQ ID NO: 892993 - RNA, 19 nt, Homo sapiens
agagagggccugcuggaga

SEQ ID NO: 892994 - RNA, 17 nt, Homo sapiens
agagaggggacauuucc

SEQ ID NO: 892995 - RNA, 17 nt, Homo sapiens
agagaggguggugaccu

SEQ ID NO: 892996 - RNA, 16 nt, Homo sapiens
agagaguccucuggau

SEQ ID NO: 892997 - RNA, 13 nt, Homo sapiens
agagauacuugua

SEQ ID NO: 892998 - RNA, 21 nt, Homo sapiens
agagaugauucggauuugaca

SEQ ID NO: 892999 - RNA, 21 nt, Homo sapiens
agagauggaauaaagcccuug

SEQ ID NO: 893000 - RNA, 16 nt, Homo sapiens
agagauucuugugccu

SEQ ID NO: 893001 - RNA, 15 nt, Homo sapiens
agagauuuccuccau

SEQ ID NO: 893002 - RNA, 16 nt, Homo sapiens
agagauuugaauagaa

SEQ ID NO: 893003 - RNA, 17 nt, Homo sapiens
agagcaaucaaagcagc

SEQ ID NO: 893004 - RNA, 13 nt, Homo sapiens
agagcacacugua

SEQ ID NO: 893005 - RNA, 15 nt, Homo sapiens
agagcacugcuccag

SEQ ID NO: 893006 - RNA, 14 nt, Homo sapiens
agagcagcuggcuc

SEQ ID NO: 893007 - RNA, 14 nt, Homo sapiens
agagcaucaugccu

SEQ ID NO: 893008 - RNA, 23 nt, Homo sapiens
ucuagcuauuauuuucuuuaaag

SEQ ID NO: 893009 - RNA, 21 nt, Homo sapiens
ucuaggacuagaaaaacuugg

SEQ ID NO: 893010 - RNA, 14 nt, Homo sapiens
ucuaggacuccaca

SEQ ID NO: 893011 - RNA, 18 nt, Homo sapiens
ucuaggagucaacuggcu

SEQ ID NO: 893012 - RNA, 15 nt, Homo sapiens
ucuaguaucacauag

SEQ ID NO: 893013 - RNA, 21 nt, Homo sapiens
ucuagucuccuuugcacugag

SEQ ID NO: 893014 - RNA, 15 nt, Homo sapiens
ucuagugcuacugcu

SEQ ID NO: 893015 - RNA, 17 nt, Homo sapiens
ucuaguuagcugcuuua

SEQ ID NO: 893016 - RNA, 20 nt, Homo sapiens
ucuaguuucuugugggcuaa

SEQ ID NO: 893017 - RNA, 13 nt, Homo sapiens
ucuauaaauaacc

SEQ ID NO: 893018 - RNA, 23 nt, Homo sapiens
ucuauacuagggacuggaucuca

SEQ ID NO: 893019 - RNA, 21 nt, Homo sapiens
ucuauagagaaaaacuuucau

SEQ ID NO: 893020 - RNA, 19 nt, Homo sapiens
ucuaucccacccaacagcu

SEQ ID NO: 893021 - RNA, 21 nt, Homo sapiens
ucuaugagauagguacuauua

SEQ ID NO: 893022 - RNA, 11 nt, Homo sapiens
ucuauguaucu

SEQ ID NO: 893023 - RNA, 15 nt, Homo sapiens
ucuauguaugcaucu

SEQ ID NO: 893024 - RNA, 15 nt, Homo sapiens
ucuauuaaauguaua

SEQ ID NO: 893025 - RNA, 16 nt, Homo sapiens
ucuauuacgugcaaua

SEQ ID NO: 893026 - RNA, 16 nt, Homo sapiens
ucuauuauaaaaccau

SEQ ID NO: 893027 - RNA, 14 nt, Homo sapiens
ucuauuauagccac

SEQ ID NO: 893028 - RNA, 13 nt, Homo sapiens
ucuauuccugacc

SEQ ID NO: 893029 - RNA, 20 nt, Homo sapiens
ucuauugaaaaaucaccaca

SEQ ID NO: 893030 - RNA, 16 nt, Homo sapiens
ucucaaaaaaagggca

SEQ ID NO: 893031 - RNA, 21 nt, Homo sapiens
ucucaaaacugcacugucaag

SEQ ID NO: 893032 - RNA, 15 nt, Homo sapiens
ucucaaagaaucuca

SEQ ID NO: 893033 - RNA, 21 nt, Homo sapiens
ucucaaauccuugagcacuca

SEQ ID NO: 893034 - RNA, 16 nt, Homo sapiens
ucucaaaugcacaucu

SEQ ID NO: 893035 - RNA, 18 nt, Homo sapiens
ucucaaaugcacaucuca

SEQ ID NO: 893036 - RNA, 13 nt, Homo sapiens
ucucaaauucuca

SEQ ID NO: 893037 - RNA, 14 nt, Homo sapiens
ucucaaauucucaa

SEQ ID NO: 893038 - RNA, 14 nt, Homo sapiens
ucucaacuacucag

SEQ ID NO: 893039 - RNA, 15 nt, Homo sapiens
ucucacaagcacuuu

SEQ ID NO: 893040 - RNA, 15 nt, Homo sapiens
ucucacacagcagua

SEQ ID NO: 893041 - RNA, 20 nt, Homo sapiens
ucucacucugucgcccaguc

SEQ ID NO: 893042 - RNA, 16 nt, Homo sapiens
ucucacuguugcccag

SEQ ID NO: 893043 - RNA, 20 nt, Homo sapiens
ucucacuuauaccaaaggga

SEQ ID NO: 893044 - RNA, 14 nt, Homo sapiens
ucucacuugucuca

SEQ ID NO: 893045 - RNA, 23 nt, Homo sapiens
ucucacuuugccccaguuacaaa

SEQ ID NO: 893046 - RNA, 16 nt, Homo sapiens
ucucagaauccaaaga

SEQ ID NO: 893047 - RNA, 21 nt, Homo sapiens
ucucagccauaaagugccagu

SEQ ID NO: 893048 - RNA, 21 nt, Homo sapiens
ucucagccuaccaugagaaua

SEQ ID NO: 893049 - RNA, 14 nt, Homo sapiens
ucucagccuccuca

SEQ ID NO: 893050 - RNA, 15 nt, Homo sapiens
ucucagccucugauc

SEQ ID NO: 893051 - RNA, 14 nt, Homo sapiens
ucucaguucagagu

SEQ ID NO: 893052 - RNA, 22 nt, Homo sapiens
ucucaucagaaaugucaucaaa

SEQ ID NO: 893053 - RNA, 23 nt, Homo sapiens
ucucaucaguguccucuugcuca

SEQ ID NO: 893054 - RNA, 21 nt, Homo sapiens
ucucaugagugccaagcaaaa

SEQ ID NO: 893055 - RNA, 22 nt, Homo sapiens
ucucauguugaagccacugccu

SEQ ID NO: 893056 - RNA, 14 nt, Homo sapiens
ucuccaaaugagau

SEQ ID NO: 893057 - RNA, 18 nt, Homo sapiens
ucuccaccuuguuacaca

SEQ ID NO: 893058 - RNA, 22 nt, Homo sapiens
ucuccagccaucaagagacuga

SEQ ID NO: 893059 - RNA, 20 nt, Homo sapiens
ucuccaggauugaagagcau

SEQ ID NO: 893060 - RNA, 22 nt, Homo sapiens
ucuccagugguugcuguugaug

SEQ ID NO: 893061 - RNA, 18 nt, Homo sapiens
ucuccagugugaauauau

SEQ ID NO: 893062 - RNA, 20 nt, Homo sapiens
ucuccaugcccaaccuaaga

SEQ ID NO: 893063 - RNA, 14 nt, Homo sapiens
ucuccauuuuacag

SEQ ID NO: 893064 - RNA, 13 nt, Homo sapiens
ucuccuacuuuac

SEQ ID NO: 893065 - RNA, 14 nt, Homo sapiens
ucuccucagaagaa

SEQ ID NO: 893066 - RNA, 16 nt, Homo sapiens
ucuccucugauuauca

SEQ ID NO: 893067 - RNA, 20 nt, Homo sapiens
ucuccucuggggaagaccuu

SEQ ID NO: 893068 - RNA, 13 nt, Homo sapiens
ucuccugcugcag

SEQ ID NO: 893069 - RNA, 13 nt, Homo sapiens
ucuccuuuggcca

SEQ ID NO: 893070 - RNA, 18 nt, Homo sapiens
ucuccuuuggccauucca

SEQ ID NO: 893071 - RNA, 15 nt, Homo sapiens
ucuccuuuugaccaa

SEQ ID NO: 893072 - RNA, 21 nt, Homo sapiens
ucucggaccuuucagcuguga

SEQ ID NO: 893073 - RNA, 18 nt, Homo sapiens
ucucguaacugguuucau

SEQ ID NO: 893074 - RNA, 20 nt, Homo sapiens
ucucuaacauaugauacuga

SEQ ID NO: 893075 - RNA, 21 nt, Homo sapiens
ucucuacuaaaaacacaaaag

SEQ ID NO: 893076 - RNA, 15 nt, Homo sapiens
ucucuagagugagaa

SEQ ID NO: 893077 - RNA, 18 nt, Homo sapiens
ucucuagcuuuaggggac

SEQ ID NO: 893078 - RNA, 18 nt, Homo sapiens
ucucuaggccuguugccu

SEQ ID NO: 893079 - RNA, 17 nt, Homo sapiens
ucucuaucccaagccaa

SEQ ID NO: 893080 - RNA, 13 nt, Homo sapiens
ucucuaugaucuu

SEQ ID NO: 893081 - RNA, 13 nt, Homo sapiens
ucucuauuccuga

SEQ ID NO: 893082 - RNA, 21 nt, Homo sapiens
ucucuccacgguagcacuuga

SEQ ID NO: 893083 - RNA, 14 nt, Homo sapiens
ucucucucuguccu

SEQ ID NO: 893084 - RNA, 10 nt, Homo sapiens
ucucucugca

SEQ ID NO: 893085 - RNA, 17 nt, Homo sapiens
ucucucugccuauuuau

SEQ ID NO: 893086 - RNA, 11 nt, Homo sapiens
ucucucugugg

SEQ ID NO: 893087 - RNA, 19 nt, Homo sapiens
ucucugaagcauguuucau

SEQ ID NO: 893088 - RNA, 16 nt, Homo sapiens
ucucugagauguguuc

SEQ ID NO: 893089 - RNA, 13 nt, Homo sapiens
ucucugcaucuca

SEQ ID NO: 893090 - RNA, 18 nt, Homo sapiens
ucucugccaagcccucaa

SEQ ID NO: 893091 - RNA, 14 nt, Homo sapiens
ucucugcucuugcc

SEQ ID NO: 893092 - RNA, 15 nt, Homo sapiens
ucucuggcgcaucac

SEQ ID NO: 893093 - RNA, 13 nt, Homo sapiens
ucucugucucaaa

SEQ ID NO: 893094 - RNA, 19 nt, Homo sapiens
ucucugugcuuugacucac

SEQ ID NO: 893095 - RNA, 19 nt, Homo sapiens
ucucuguguuacccaguaa

SEQ ID NO: 893096 - RNA, 18 nt, Homo sapiens
ucucuuacccagaauauu

SEQ ID NO: 893097 - RNA, 21 nt, Homo sapiens
ucucuuaccgcgagacugaga

SEQ ID NO: 893098 - RNA, 18 nt, Homo sapiens
ucucuucagaaaacccuu

SEQ ID NO: 893099 - RNA, 17 nt, Homo sapiens
ucucuugccagcauuuu

SEQ ID NO: 893100 - RNA, 21 nt, Homo sapiens
ucucuugccagcauuuucaca

SEQ ID NO: 893101 - RNA, 16 nt, Homo sapiens
ucucuuggccuguccu

SEQ ID NO: 893102 - RNA, 14 nt, Homo sapiens
ucucuuucugcaaa

SEQ ID NO: 893103 - RNA, 13 nt, Homo sapiens
ucucuuucuuauu

SEQ ID NO: 893104 - RNA, 14 nt, Homo sapiens
ucucuuugccucaa

SEQ ID NO: 893105 - RNA, 16 nt, Homo sapiens
ucucuuugguguuaca

SEQ ID NO: 893106 - RNA, 19 nt, Homo sapiens
ucucuuuuuaccuuuaaca

SEQ ID NO: 893107 - RNA, 23 nt, Homo sapiens
ucucuuuuuagagaaauuugcca

SEQ ID NO: 893108 - RNA, 19 nt, Homo sapiens
ucugaaaggcacacuuuga

SEQ ID NO: 893109 - RNA, 16 nt, Homo sapiens
ucugaaaugaccucaa

SEQ ID NO: 893110 - RNA, 19 nt, Homo sapiens
ucugaacacauacuagaaa

SEQ ID NO: 893111 - RNA, 13 nt, Homo sapiens
ucugaaccauuac

SEQ ID NO: 893112 - RNA, 15 nt, Homo sapiens
ucugaagucacugca

SEQ ID NO: 893113 - RNA, 16 nt, Homo sapiens
ucugaauaacauuugu

SEQ ID NO: 893114 - RNA, 15 nt, Homo sapiens
ucugacacuaccuua

SEQ ID NO: 893115 - RNA, 14 nt, Homo sapiens
ucugacauucauuu

SEQ ID NO: 893116 - RNA, 16 nt, Homo sapiens
ucugacucacaagaag

SEQ ID NO: 893117 - RNA, 20 nt, Homo sapiens
ucugacucacaagaagacca

SEQ ID NO: 893118 - RNA, 14 nt, Homo sapiens
ucugacucuugccu

SEQ ID NO: 893119 - RNA, 15 nt, Homo sapiens
ucugacuuugagacg

SEQ ID NO: 893120 - RNA, 20 nt, Homo sapiens
ucugagacuauaacugucau

SEQ ID NO: 893121 - RNA, 12 nt, Homo sapiens
ucugagcaccua

SEQ ID NO: 893122 - RNA, 19 nt, Homo sapiens
ucugagcaccuacuuacau

SEQ ID NO: 893123 - RNA, 11 nt, Homo sapiens
ucugagcccac

SEQ ID NO: 893124 - RNA, 15 nt, Homo sapiens
agagccagcucucuc

SEQ ID NO: 893125 - RNA, 16 nt, Homo sapiens
agagccaggcucugcc

SEQ ID NO: 893126 - RNA, 13 nt, Homo sapiens
agagccagggucu

SEQ ID NO: 893127 - RNA, 13 nt, Homo sapiens
agagccagugaag

SEQ ID NO: 893128 - RNA, 18 nt, Homo sapiens
agagcccagggcauccca

SEQ ID NO: 893129 - RNA, 14 nt, Homo sapiens
agagcccaugcuca

SEQ ID NO: 893130 - RNA, 15 nt, Homo sapiens
agagcccugagcuca

SEQ ID NO: 893131 - RNA, 15 nt, Homo sapiens
agagccgcauggcac

SEQ ID NO: 893132 - RNA, 14 nt, Homo sapiens
agagccuccuccag

SEQ ID NO: 893133 - RNA, 19 nt, Homo sapiens
agagccugagucacugguc

SEQ ID NO: 893134 - RNA, 20 nt, Homo sapiens
agagccugugcuaaagaagc

SEQ ID NO: 893135 - RNA, 20 nt, Homo sapiens
agagcgagacuccgucucaa

SEQ ID NO: 893136 - RNA, 19 nt, Homo sapiens
agagcggcugcccgacuca

SEQ ID NO: 893137 - RNA, 13 nt, Homo sapiens
agagcuagggcug

SEQ ID NO: 893138 - RNA, 23 nt, Homo sapiens
agagcuauggugagguguggaua

SEQ ID NO: 893139 - RNA, 18 nt, Homo sapiens
agagcugauggagaagga

SEQ ID NO: 893140 - RNA, 12 nt, Homo sapiens
agagcugggaaa

SEQ ID NO: 893141 - RNA, 22 nt, Homo sapiens
agagcuuacaagacccuaugaa

SEQ ID NO: 893142 - RNA, 21 nt, Homo sapiens
agaggagaagagacauguacc

SEQ ID NO: 893143 - RNA, 12 nt, Homo sapiens
agaggagcacua

SEQ ID NO: 893144 - RNA, 13 nt, Homo sapiens
agaggagguuugg

SEQ ID NO: 893145 - RNA, 16 nt, Homo sapiens
agaggcaccuguccca

SEQ ID NO: 893146 - RNA, 19 nt, Homo sapiens
agaggcagggucucacucu

SEQ ID NO: 893147 - RNA, 20 nt, Homo sapiens
agaggccaaggaggccuugg

SEQ ID NO: 893148 - RNA, 21 nt, Homo sapiens
agaggcggaaaccuugcagca

SEQ ID NO: 893149 - RNA, 22 nt, Homo sapiens
agaggcuauuauuuucacugua

SEQ ID NO: 893150 - RNA, 15 nt, Homo sapiens
agaggcuuccuucau

SEQ ID NO: 893151 - RNA, 18 nt, Homo sapiens
agagggcaaguguuccca

SEQ ID NO: 893152 - RNA, 21 nt, Homo sapiens
agagggcugcgagcauuuccc

SEQ ID NO: 893153 - RNA, 16 nt, Homo sapiens
agaggggaagggccag

SEQ ID NO: 893154 - RNA, 16 nt, Homo sapiens
agaggggacauuuccc

SEQ ID NO: 893155 - RNA, 16 nt, Homo sapiens
agaggggccugggaaa

SEQ ID NO: 893156 - RNA, 11 nt, Homo sapiens
agagggggccu

SEQ ID NO: 893157 - RNA, 21 nt, Homo sapiens
agagguaaaagugugagcagu

SEQ ID NO: 893158 - RNA, 15 nt, Homo sapiens
agagguaacuaucaa

SEQ ID NO: 893159 - RNA, 18 nt, Homo sapiens
agagguagcgagcugcuc

SEQ ID NO: 893160 - RNA, 13 nt, Homo sapiens
agaggucugagcc

SEQ ID NO: 893161 - RNA, 19 nt, Homo sapiens
agaggugacaguggaugac

SEQ ID NO: 893162 - RNA, 20 nt, Homo sapiens
agaggugacccaaugcuccu

SEQ ID NO: 893163 - RNA, 18 nt, Homo sapiens
agaggugcugucagcuca

SEQ ID NO: 893164 - RNA, 13 nt, Homo sapiens
agagguggcugcu

SEQ ID NO: 893165 - RNA, 19 nt, Homo sapiens
agaguaaauagcauucucu

SEQ ID NO: 893166 - RNA, 16 nt, Homo sapiens
agaguagagggcacug

SEQ ID NO: 893167 - RNA, 17 nt, Homo sapiens
agaguauuucugcccca

SEQ ID NO: 893168 - RNA, 14 nt, Homo sapiens
agagucacugaccc

SEQ ID NO: 893169 - RNA, 16 nt, Homo sapiens
agagugaaauaauuaa

SEQ ID NO: 893170 - RNA, 22 nt, Homo sapiens
agagugacauccaggaggaaua

SEQ ID NO: 893171 - RNA, 20 nt, Homo sapiens
agagugagacuccgucucaa

SEQ ID NO: 893172 - RNA, 18 nt, Homo sapiens
agagugagacucgucuca

SEQ ID NO: 893173 - RNA, 20 nt, Homo sapiens
agagugagacucugucucaa

SEQ ID NO: 893174 - RNA, 20 nt, Homo sapiens
agagugagagacauuaacuc

SEQ ID NO: 893175 - RNA, 16 nt, Homo sapiens
agagugcaguggugca

SEQ ID NO: 893176 - RNA, 22 nt, Homo sapiens
agagugccguaacaacuguggu

SEQ ID NO: 893177 - RNA, 22 nt, Homo sapiens
agaguggaaccaacacuaacau

SEQ ID NO: 893178 - RNA, 17 nt, Homo sapiens
agaguggcccagaauug

SEQ ID NO: 893179 - RNA, 14 nt, Homo sapiens
agaguucauggaau

SEQ ID NO: 893180 - RNA, 15 nt, Homo sapiens
agaguucugcucuag

SEQ ID NO: 893181 - RNA, 21 nt, Homo sapiens
agaguugggaugcggggcaga

SEQ ID NO: 893182 - RNA, 14 nt, Homo sapiens
agaguuucuccuuu

SEQ ID NO: 893183 - RNA, 21 nt, Homo sapiens
agaguuucuccuuuugaccaa

SEQ ID NO: 893184 - RNA, 23 nt, Homo sapiens
agauaaaagaaccgagcaauuuu

SEQ ID NO: 893185 - RNA, 22 nt, Homo sapiens
agauaacagcuuaacauuuaca

SEQ ID NO: 893186 - RNA, 23 nt, Homo sapiens
agauaacagcuuaacauuuacau

SEQ ID NO: 893187 - RNA, 13 nt, Homo sapiens
agauaacugagaa

SEQ ID NO: 893188 - RNA, 21 nt, Homo sapiens
agauaaucgagucuaccucuu

SEQ ID NO: 893189 - RNA, 16 nt, Homo sapiens
agauacauuucaucug

SEQ ID NO: 893190 - RNA, 14 nt, Homo sapiens
agauacuggcgcca

SEQ ID NO: 893191 - RNA, 22 nt, Homo sapiens
agauagauccauuuggacaaaa

SEQ ID NO: 893192 - RNA, 21 nt, Homo sapiens
agauagcaucuuauacgagua

SEQ ID NO: 893193 - RNA, 14 nt, Homo sapiens
agauagccagacac

SEQ ID NO: 893194 - RNA, 15 nt, Homo sapiens
agauagguaaauacc

SEQ ID NO: 893195 - RNA, 17 nt, Homo sapiens
agauauacugggagaaa

SEQ ID NO: 893196 - RNA, 17 nt, Homo sapiens
agauaucagagcucuua

SEQ ID NO: 893197 - RNA, 17 nt, Homo sapiens
agauaucaguuaucaau

SEQ ID NO: 893198 - RNA, 15 nt, Homo sapiens
agauaugcacacacc

SEQ ID NO: 893199 - RNA, 20 nt, Homo sapiens
agauauuucccaauacauac

SEQ ID NO: 893200 - RNA, 16 nt, Homo sapiens
agaucacauauucuag

SEQ ID NO: 893201 - RNA, 12 nt, Homo sapiens
agaucacgccac

SEQ ID NO: 893202 - RNA, 18 nt, Homo sapiens
agaucacgccacugcacu

SEQ ID NO: 893203 - RNA, 11 nt, Homo sapiens
agaucagggca

SEQ ID NO: 893204 - RNA, 23 nt, Homo sapiens
agaucauguaaggaagggacuga

SEQ ID NO: 893205 - RNA, 17 nt, Homo sapiens
agaucauuuucuuaucu

SEQ ID NO: 893206 - RNA, 22 nt, Homo sapiens
agauccacccucaaaugucaga

SEQ ID NO: 893207 - RNA, 15 nt, Homo sapiens
agaucguuguuuaca

SEQ ID NO: 893208 - RNA, 14 nt, Homo sapiens
agaucuauguacug

SEQ ID NO: 893209 - RNA, 17 nt, Homo sapiens
agaucuauguacuguaa

SEQ ID NO: 893210 - RNA, 12 nt, Homo sapiens
agaucugcacug

SEQ ID NO: 893211 - RNA, 20 nt, Homo sapiens
agaucuuucaggaaagacgg

SEQ ID NO: 893212 - RNA, 19 nt, Homo sapiens
agaucuuuuaaaaaggcag

SEQ ID NO: 893213 - RNA, 22 nt, Homo sapiens
agaugaacuauuagacaugaaa

SEQ ID NO: 893214 - RNA, 16 nt, Homo sapiens
agaugaagacaacagc

SEQ ID NO: 893215 - RNA, 15 nt, Homo sapiens
agaugaccugcugcu

SEQ ID NO: 893216 - RNA, 15 nt, Homo sapiens
agaugagcagucaca

SEQ ID NO: 893217 - RNA, 16 nt, Homo sapiens
agaugagggugacugu

SEQ ID NO: 893218 - RNA, 14 nt, Homo sapiens
agaugaugaugauc

SEQ ID NO: 893219 - RNA, 19 nt, Homo sapiens
agaugauuaaacagacuuu

SEQ ID NO: 893220 - RNA, 12 nt, Homo sapiens
agaugcacacac

SEQ ID NO: 893221 - RNA, 15 nt, Homo sapiens
agaugcccuccaauc

SEQ ID NO: 893222 - RNA, 20 nt, Homo sapiens
agaugccuuccugucuuucu

SEQ ID NO: 893223 - RNA, 14 nt, Homo sapiens
agaugcugggccag

SEQ ID NO: 893224 - RNA, 15 nt, Homo sapiens
agaugcugggccagu

SEQ ID NO: 893225 - RNA, 20 nt, Homo sapiens
agaugcugggccaguuccuc

SEQ ID NO: 893226 - RNA, 17 nt, Homo sapiens
agauggaauaaagcccu

SEQ ID NO: 893227 - RNA, 20 nt, Homo sapiens
agauggaguucuugugccau

SEQ ID NO: 893228 - RNA, 16 nt, Homo sapiens
agauggauagucuguc

SEQ ID NO: 893229 - RNA, 19 nt, Homo sapiens
agauggauagucuguccaa

SEQ ID NO: 893230 - RNA, 21 nt, Homo sapiens
agauggauguuugucaaaaag

SEQ ID NO: 893231 - RNA, 22 nt, Homo sapiens
agauggauguuugucaaaaagu

SEQ ID NO: 893232 - RNA, 16 nt, Homo sapiens
agauggcauguguuua

SEQ ID NO: 893233 - RNA, 23 nt, Homo sapiens
agauggccgggacaugcagcucu

SEQ ID NO: 893234 - RNA, 22 nt, Homo sapiens
agaugggcaaauuaaggcauaa

SEQ ID NO: 893235 - RNA, 16 nt, Homo sapiens
agauggggacagguga

SEQ ID NO: 893236 - RNA, 21 nt, Homo sapiens
agaugggguuucacuguguug

SEQ ID NO: 893237 - RNA, 22 nt, Homo sapiens
agaugguccuccauuucaacuc

SEQ ID NO: 893238 - RNA, 18 nt, Homo sapiens
agaugguggugagcacau

SEQ ID NO: 893239 - RNA, 15 nt, Homo sapiens
ucugaggaaggugcu

SEQ ID NO: 893240 - RNA, 20 nt, Homo sapiens
ucugauacccagagcauuac

SEQ ID NO: 893241 - RNA, 13 nt, Homo sapiens
ucugauaccucaa

SEQ ID NO: 893242 - RNA, 16 nt, Homo sapiens
ucugauauaacaaacu

SEQ ID NO: 893243 - RNA, 19 nt, Homo sapiens
ucugaucaguuuccuccaa

SEQ ID NO: 893244 - RNA, 22 nt, Homo sapiens
ucugaucauccacugugccaug

SEQ ID NO: 893245 - RNA, 15 nt, Homo sapiens
ucugaugcaucagaa

SEQ ID NO: 893246 - RNA, 19 nt, Homo sapiens
ucugauuuuuaauuucuau

SEQ ID NO: 893247 - RNA, 12 nt, Homo sapiens
ucugcacccagg

SEQ ID NO: 893248 - RNA, 12 nt, Homo sapiens
ucugcacugggu

SEQ ID NO: 893249 - RNA, 18 nt, Homo sapiens
ucugcagggagcaacucu

SEQ ID NO: 893250 - RNA, 20 nt, Homo sapiens
ucugcagggagcaacucucc

SEQ ID NO: 893251 - RNA, 23 nt, Homo sapiens
ucugcagggggugugucugcuca

SEQ ID NO: 893252 - RNA, 17 nt, Homo sapiens
ucugcauaaacuucauc

SEQ ID NO: 893253 - RNA, 13 nt, Homo sapiens
ucugccaagcccu

SEQ ID NO: 893254 - RNA, 16 nt, Homo sapiens
ucugccauaaagccau

SEQ ID NO: 893255 - RNA, 16 nt, Homo sapiens
ucugccauuacucugc

SEQ ID NO: 893256 - RNA, 15 nt, Homo sapiens
ucugcccacugugaa

SEQ ID NO: 893257 - RNA, 14 nt, Homo sapiens
ucugcccagaauuc

SEQ ID NO: 893258 - RNA, 20 nt, Homo sapiens
ucugccccagcucuggcuuc

SEQ ID NO: 893259 - RNA, 15 nt, Homo sapiens
ucugccccagcuuua

SEQ ID NO: 893260 - RNA, 21 nt, Homo sapiens
ucugcccuguauauaauacua

SEQ ID NO: 893261 - RNA, 16 nt, Homo sapiens
ucugccucccuagcuu

SEQ ID NO: 893262 - RNA, 19 nt, Homo sapiens
ucugccucugacacacagc

SEQ ID NO: 893263 - RNA, 20 nt, Homo sapiens
ucugcucacauaucugucau

SEQ ID NO: 893264 - RNA, 22 nt, Homo sapiens
ucugcucugaggcuuccagaga

SEQ ID NO: 893265 - RNA, 18 nt, Homo sapiens
ucugcucugaugcaucag

SEQ ID NO: 893266 - RNA, 18 nt, Homo sapiens
ucugcugacagacacagg

SEQ ID NO: 893267 - RNA, 23 nt, Homo sapiens
ucugcuguauacuguacugagac

SEQ ID NO: 893268 - RNA, 23 nt, Homo sapiens
ucugcuuuucuucccagcaaagg

SEQ ID NO: 893269 - RNA, 19 nt, Homo sapiens
ucuggaaagggcacgagag

SEQ ID NO: 893270 - RNA, 20 nt, Homo sapiens
ucuggaagccuggacucuaa

SEQ ID NO: 893271 - RNA, 16 nt, Homo sapiens
ucuggaauacaugaaa

SEQ ID NO: 893272 - RNA, 19 nt, Homo sapiens
ucuggacccuccacuucaa

SEQ ID NO: 893273 - RNA, 21 nt, Homo sapiens
ucuggaggacacacagucuca

SEQ ID NO: 893274 - RNA, 13 nt, Homo sapiens
ucuggcaucucuu

SEQ ID NO: 893275 - RNA, 15 nt, Homo sapiens
ucuggccacugcugc

SEQ ID NO: 893276 - RNA, 16 nt, Homo sapiens
ucuggccaggcauggc

SEQ ID NO: 893277 - RNA, 12 nt, Homo sapiens
ucuggccucaga

SEQ ID NO: 893278 - RNA, 18 nt, Homo sapiens
ucuggcugaggauuucaa

SEQ ID NO: 893279 - RNA, 18 nt, Homo sapiens
ucuggcuuuacauuuuau

SEQ ID NO: 893280 - RNA, 16 nt, Homo sapiens
ucugggaagauuucua

SEQ ID NO: 893281 - RNA, 16 nt, Homo sapiens
ucugggagacuuuccc

SEQ ID NO: 893282 - RNA, 14 nt, Homo sapiens
ucugggagccugac

SEQ ID NO: 893283 - RNA, 23 nt, Homo sapiens
ucugggagguuacugucugguag

SEQ ID NO: 893284 - RNA, 20 nt, Homo sapiens
ucugggauucccaccaaggu

SEQ ID NO: 893285 - RNA, 18 nt, Homo sapiens
ucugggcccccacuuuca

SEQ ID NO: 893286 - RNA, 14 nt, Homo sapiens
ucuggguccuugca

SEQ ID NO: 893287 - RNA, 14 nt, Homo sapiens
ucuggucuguccac

SEQ ID NO: 893288 - RNA, 17 nt, Homo sapiens
ucuggugcuuucuguca

SEQ ID NO: 893289 - RNA, 20 nt, Homo sapiens
ucugguuuuaacaauuuccu

SEQ ID NO: 893290 - RNA, 16 nt, Homo sapiens
ucugucaccaagccuu

SEQ ID NO: 893291 - RNA, 12 nt, Homo sapiens
ucugucaccagc

SEQ ID NO: 893292 - RNA, 17 nt, Homo sapiens
ucugucauccagaaaau

SEQ ID NO: 893293 - RNA, 12 nt, Homo sapiens
ucuguccaggcc

SEQ ID NO: 893294 - RNA, 14 nt, Homo sapiens
ucugucccaaagaa

SEQ ID NO: 893295 - RNA, 16 nt, Homo sapiens
ucugucccucuuugcc

SEQ ID NO: 893296 - RNA, 18 nt, Homo sapiens
ucuguccguuuacuccaa

SEQ ID NO: 893297 - RNA, 17 nt, Homo sapiens
ucuguccuacucugugu

SEQ ID NO: 893298 - RNA, 19 nt, Homo sapiens
ucugugacuccuggucuga

SEQ ID NO: 893299 - RNA, 15 nt, Homo sapiens
ucugugcacuagccu

SEQ ID NO: 893300 - RNA, 22 nt, Homo sapiens
ucuguggaguuugacauuguau

SEQ ID NO: 893301 - RNA, 21 nt, Homo sapiens
ucuguguagcaagcuauucaa

SEQ ID NO: 893302 - RNA, 14 nt, Homo sapiens
ucuguuauugcacu

SEQ ID NO: 893303 - RNA, 14 nt, Homo sapiens
ucuguuguccauca

SEQ ID NO: 893304 - RNA, 15 nt, Homo sapiens
ucuguuuugugaccu

SEQ ID NO: 893305 - RNA, 18 nt, Homo sapiens
ucuguuuuuaaaaaucau

SEQ ID NO: 893306 - RNA, 15 nt, Homo sapiens
ucuuaaaauguuaac

SEQ ID NO: 893307 - RNA, 14 nt, Homo sapiens
ucuuaacuauucaa

SEQ ID NO: 893308 - RNA, 13 nt, Homo sapiens
ucuuaacuugaag

SEQ ID NO: 893309 - RNA, 16 nt, Homo sapiens
ucuuaaguagggacuu

SEQ ID NO: 893310 - RNA, 13 nt, Homo sapiens
ucuuaaugcuuuc

SEQ ID NO: 893311 - RNA, 18 nt, Homo sapiens
ucuuacaaaggugaaaau

SEQ ID NO: 893312 - RNA, 19 nt, Homo sapiens
ucuuacaguggagugagau

SEQ ID NO: 893313 - RNA, 15 nt, Homo sapiens
ucuuacauaaucaca

SEQ ID NO: 893314 - RNA, 20 nt, Homo sapiens
ucuuacuucccuaaugaagu

SEQ ID NO: 893315 - RNA, 23 nt, Homo sapiens
ucuuacuuuuggauaauauccac

SEQ ID NO: 893316 - RNA, 19 nt, Homo sapiens
ucuuagccucccaaagugc

SEQ ID NO: 893317 - RNA, 16 nt, Homo sapiens
ucuuagcugucugcuc

SEQ ID NO: 893318 - RNA, 16 nt, Homo sapiens
ucuuauuuauauauga

SEQ ID NO: 893319 - RNA, 14 nt, Homo sapiens
ucuuauuugcaaua

SEQ ID NO: 893320 - RNA, 15 nt, Homo sapiens
ucuucaaaugucuaa

SEQ ID NO: 893321 - RNA, 12 nt, Homo sapiens
ucuucagccuag

SEQ ID NO: 893322 - RNA, 15 nt, Homo sapiens
ucuucauucuuugaa

SEQ ID NO: 893323 - RNA, 19 nt, Homo sapiens
ucuuccagaagaugcccuc

SEQ ID NO: 893324 - RNA, 15 nt, Homo sapiens
ucuuccagaaggcaa

SEQ ID NO: 893325 - RNA, 17 nt, Homo sapiens
ucuuccagcaugcaucc

SEQ ID NO: 893326 - RNA, 16 nt, Homo sapiens
ucuuccagguacugau

SEQ ID NO: 893327 - RNA, 19 nt, Homo sapiens
ucuuccaucugauugugau

SEQ ID NO: 893328 - RNA, 20 nt, Homo sapiens
ucuuccuaccaaauauaaac

SEQ ID NO: 893329 - RNA, 17 nt, Homo sapiens
ucuuccucacuaugaca

SEQ ID NO: 893330 - RNA, 20 nt, Homo sapiens
ucuuccuuacccugcgauuu

SEQ ID NO: 893331 - RNA, 15 nt, Homo sapiens
ucuucgcugcuagag

SEQ ID NO: 893332 - RNA, 15 nt, Homo sapiens
ucuucuacaaccaga

SEQ ID NO: 893333 - RNA, 16 nt, Homo sapiens
ucuucuaccauuugaa

SEQ ID NO: 893334 - RNA, 23 nt, Homo sapiens
ucuucuauauuccgggugccauu

SEQ ID NO: 893335 - RNA, 18 nt, Homo sapiens
ucuucuccaacaccaccu

SEQ ID NO: 893336 - RNA, 19 nt, Homo sapiens
ucuucuccaacaccaccuc

SEQ ID NO: 893337 - RNA, 13 nt, Homo sapiens
ucuucuccacugg

SEQ ID NO: 893338 - RNA, 14 nt, Homo sapiens
ucuucucucggggc

SEQ ID NO: 893339 - RNA, 23 nt, Homo sapiens
ucuucugccccagcuuugcagga

SEQ ID NO: 893340 - RNA, 13 nt, Homo sapiens
ucuucugccucag

SEQ ID NO: 893341 - RNA, 16 nt, Homo sapiens
ucuucuuuuaaaccau

SEQ ID NO: 893342 - RNA, 13 nt, Homo sapiens
ucuugaaagcugu

SEQ ID NO: 893343 - RNA, 17 nt, Homo sapiens
ucuugaaaucugaaugc

SEQ ID NO: 893344 - RNA, 20 nt, Homo sapiens
ucuugaaccccuggccucaa

SEQ ID NO: 893345 - RNA, 12 nt, Homo sapiens
ucuugacauuca

SEQ ID NO: 893346 - RNA, 20 nt, Homo sapiens
ucuugacauucaaggcauuu

SEQ ID NO: 893347 - RNA, 22 nt, Homo sapiens
ucuugccugaauccaucaggac

SEQ ID NO: 893348 - RNA, 24 nt, Homo sapiens
ucuugcuguaacucagacauucca

SEQ ID NO: 893349 - RNA, 15 nt, Homo sapiens
ucuuggcaguauucc

SEQ ID NO: 893350 - RNA, 18 nt, Homo sapiens
ucuuggccgacucaggga

SEQ ID NO: 893351 - RNA, 21 nt, Homo sapiens
ucuugggguuuucaguaugaa

SEQ ID NO: 893352 - RNA, 14 nt, Homo sapiens
ucuugguccuguca

SEQ ID NO: 893353 - RNA, 17 nt, Homo sapiens
ucuugucauugccagcu

SEQ ID NO: 893354 - RNA, 14 nt, Homo sapiens
agauguaaaugcca

SEQ ID NO: 893355 - RNA, 17 nt, Homo sapiens
agauguaaaugccacaa

SEQ ID NO: 893356 - RNA, 18 nt, Homo sapiens
agauguauaaaucuuucu

SEQ ID NO: 893357 - RNA, 18 nt, Homo sapiens
agaugugaugcugguacc

SEQ ID NO: 893358 - RNA, 20 nt, Homo sapiens
agauguggcaaagugcugua

SEQ ID NO: 893359 - RNA, 21 nt, Homo sapiens
agauuaccaaagaagauuuug

SEQ ID NO: 893360 - RNA, 15 nt, Homo sapiens
agauuagcucuggac

SEQ ID NO: 893361 - RNA, 16 nt, Homo sapiens
agauuauuaagggaau

SEQ ID NO: 893362 - RNA, 17 nt, Homo sapiens
agauucaaacucaauga

SEQ ID NO: 893363 - RNA, 19 nt, Homo sapiens
agauucccucuuccugcca

SEQ ID NO: 893364 - RNA, 15 nt, Homo sapiens
agauugcaccacugc

SEQ ID NO: 893365 - RNA, 22 nt, Homo sapiens
agauuguucuguccaguuucca

SEQ ID NO: 893366 - RNA, 14 nt, Homo sapiens
agauuuaacacuaa

SEQ ID NO: 893367 - RNA, 21 nt, Homo sapiens
agauuucuccugacuccagug

SEQ ID NO: 893368 - RNA, 16 nt, Homo sapiens
agauuuuaugcugcug

SEQ ID NO: 893369 - RNA, 20 nt, Homo sapiens
agauuuucauguucuugcag

SEQ ID NO: 893370 - RNA, 23 nt, Homo sapiens
agauuuucauguucuugcaguca

SEQ ID NO: 893371 - RNA, 13 nt, Homo sapiens
agauuuucuugca

SEQ ID NO: 893372 - RNA, 20 nt, Homo sapiens
agauuuugucgggacagaga

SEQ ID NO: 893373 - RNA, 23 nt, Homo sapiens
agauuuuuguuuuccacugugcu

SEQ ID NO: 893374 - RNA, 20 nt, Homo sapiens
agcaaaacaauaaacuagca

SEQ ID NO: 893375 - RNA, 17 nt, Homo sapiens
agcaaaagucauuacac

SEQ ID NO: 893376 - RNA, 22 nt, Homo sapiens
agcaaaucuacuucaacacuuc

SEQ ID NO: 893377 - RNA, 22 nt, Homo sapiens
agcaaauggagaaguucaggaa

SEQ ID NO: 893378 - RNA, 15 nt, Homo sapiens
agcaaauguggcucc

SEQ ID NO: 893379 - RNA, 18 nt, Homo sapiens
agcaaccucccaacccag

SEQ ID NO: 893380 - RNA, 16 nt, Homo sapiens
agcaacucacacggga

SEQ ID NO: 893381 - RNA, 17 nt, Homo sapiens
agcaacucagaaugcuc

SEQ ID NO: 893382 - RNA, 13 nt, Homo sapiens
agcaacugcagaa

SEQ ID NO: 893383 - RNA, 14 nt, Homo sapiens
agcaagacacaucc

SEQ ID NO: 893384 - RNA, 18 nt, Homo sapiens
agcaagacuucucuuugc

SEQ ID NO: 893385 - RNA, 23 nt, Homo sapiens
agcaagacuucucuuugccucaa

SEQ ID NO: 893386 - RNA, 14 nt, Homo sapiens
agcaagcuauucaa

SEQ ID NO: 893387 - RNA, 23 nt, Homo sapiens
agcaaugggagggggcuccaugg

SEQ ID NO: 893388 - RNA, 19 nt, Homo sapiens
agcaauuauugugccucag

SEQ ID NO: 893389 - RNA, 20 nt, Homo sapiens
agcaauugacugucacuguu

SEQ ID NO: 893390 - RNA, 20 nt, Homo sapiens
agcacacaauaagcauucaa

SEQ ID NO: 893391 - RNA, 15 nt, Homo sapiens
agcacagcagcaucu

SEQ ID NO: 893392 - RNA, 20 nt, Homo sapiens
agcacagcagccccugcaca

SEQ ID NO: 893393 - RNA, 17 nt, Homo sapiens
agcaccuacuuacaugc

SEQ ID NO: 893394 - RNA, 18 nt, Homo sapiens
agcaccuacuuacaugca

SEQ ID NO: 893395 - RNA, 15 nt, Homo sapiens
agcacuaaagcagug

SEQ ID NO: 893396 - RNA, 22 nt, Homo sapiens
agcacucagaaaagaaaaccau

SEQ ID NO: 893397 - RNA, 21 nt, Homo sapiens
agcacugacugggaccaggca

SEQ ID NO: 893398 - RNA, 15 nt, Homo sapiens
agcacugccaggagg

SEQ ID NO: 893399 - RNA, 20 nt, Homo sapiens
agcacugccaggagggacaa

SEQ ID NO: 893400 - RNA, 21 nt, Homo sapiens
agcacugccaggagggacaaa

SEQ ID NO: 893401 - RNA, 15 nt, Homo sapiens
agcacugcuccagug

SEQ ID NO: 893402 - RNA, 18 nt, Homo sapiens
agcacugcuccagugggg

SEQ ID NO: 893403 - RNA, 14 nt, Homo sapiens
agcacuuaauaauu

SEQ ID NO: 893404 - RNA, 20 nt, Homo sapiens
agcagaagcacauaugaacu

SEQ ID NO: 893405 - RNA, 14 nt, Homo sapiens
agcagaagccaaau

SEQ ID NO: 893406 - RNA, 15 nt, Homo sapiens
agcagagaacuggaa

SEQ ID NO: 893407 - RNA, 16 nt, Homo sapiens
agcagagcuuccucag

SEQ ID NO: 893408 - RNA, 12 nt, Homo sapiens
agcagaugcaau

SEQ ID NO: 893409 - RNA, 15 nt, Homo sapiens
agcagaugcaaucuc

SEQ ID NO: 893410 - RNA, 16 nt, Homo sapiens
agcagauuguguaaca

SEQ ID NO: 893411 - RNA, 13 nt, Homo sapiens
agcagauuuaaca

SEQ ID NO: 893412 - RNA, 18 nt, Homo sapiens
agcagcacgauuuugcac

SEQ ID NO: 893413 - RNA, 17 nt, Homo sapiens
agcagcccagggcacuu

SEQ ID NO: 893414 - RNA, 18 nt, Homo sapiens
agcagcccuaaggaucuc

SEQ ID NO: 893415 - RNA, 21 nt, Homo sapiens
agcagcuucaguuguuuuccc

SEQ ID NO: 893416 - RNA, 16 nt, Homo sapiens
agcaggaaaguacaga

SEQ ID NO: 893417 - RNA, 15 nt, Homo sapiens
agcaggaacuuugcc

SEQ ID NO: 893418 - RNA, 12 nt, Homo sapiens
agcaggcucaga

SEQ ID NO: 893419 - RNA, 22 nt, Homo sapiens
agcagucacacuguuacuccac

SEQ ID NO: 893420 - RNA, 12 nt, Homo sapiens
agcagucagggu

SEQ ID NO: 893421 - RNA, 16 nt, Homo sapiens
agcagugccuuccaua

SEQ ID NO: 893422 - RNA, 19 nt, Homo sapiens
agcaguguuuucaccucau

SEQ ID NO: 893423 - RNA, 18 nt, Homo sapiens
agcauaccaacacgagca

SEQ ID NO: 893424 - RNA, 16 nt, Homo sapiens
agcaucaccucaggcc

SEQ ID NO: 893425 - RNA, 17 nt, Homo sapiens
agcaucaccucaggcca

SEQ ID NO: 893426 - RNA, 21 nt, Homo sapiens
agcauccuggccaacauggug

SEQ ID NO: 893427 - RNA, 18 nt, Homo sapiens
agcaucucuguguaccca

SEQ ID NO: 893428 - RNA, 18 nt, Homo sapiens
agcaucugccucuauuca

SEQ ID NO: 893429 - RNA, 16 nt, Homo sapiens
agcaucuguguaaccu

SEQ ID NO: 893430 - RNA, 17 nt, Homo sapiens
agcaucuuauacgagua

SEQ ID NO: 893431 - RNA, 20 nt, Homo sapiens
agcaugaagguggggccagu

SEQ ID NO: 893432 - RNA, 15 nt, Homo sapiens
agcaugaugagaguu

SEQ ID NO: 893433 - RNA, 14 nt, Homo sapiens
agcaugauugugac

SEQ ID NO: 893434 - RNA, 15 nt, Homo sapiens
agcauggacucuggg

SEQ ID NO: 893435 - RNA, 20 nt, Homo sapiens
agcauggucacaagcacaaa

SEQ ID NO: 893436 - RNA, 22 nt, Homo sapiens
agcauuaacuuauugucuaggc

SEQ ID NO: 893437 - RNA, 14 nt, Homo sapiens
agcauuacaguggg

SEQ ID NO: 893438 - RNA, 22 nt, Homo sapiens
agcauuacgugagccagguaau

SEQ ID NO: 893439 - RNA, 16 nt, Homo sapiens
agcauucugucuugaa

SEQ ID NO: 893440 - RNA, 17 nt, Homo sapiens
agcauugggcugggcuc

SEQ ID NO: 893441 - RNA, 17 nt, Homo sapiens
agcauuucaaaauggac

SEQ ID NO: 893442 - RNA, 21 nt, Homo sapiens
agcauuucccucccgggagag

SEQ ID NO: 893443 - RNA, 19 nt, Homo sapiens
agcauuucuugauguugcu

SEQ ID NO: 893444 - RNA, 14 nt, Homo sapiens
agccaaacaaaggc

SEQ ID NO: 893445 - RNA, 14 nt, Homo sapiens
agccaaacucugcc

SEQ ID NO: 893446 - RNA, 15 nt, Homo sapiens
agccaaacucugcca

SEQ ID NO: 893447 - RNA, 16 nt, Homo sapiens
agccaaacucugccag

SEQ ID NO: 893448 - RNA, 21 nt, Homo sapiens
agccaaacucugccagccaca

SEQ ID NO: 893449 - RNA, 16 nt, Homo sapiens
agccaacuuuaauugc

SEQ ID NO: 893450 - RNA, 19 nt, Homo sapiens
agccacaccuuuuccagga

SEQ ID NO: 893451 - RNA, 16 nt, Homo sapiens
agccacacuucucagg

SEQ ID NO: 893452 - RNA, 15 nt, Homo sapiens
agccacagaagccag

SEQ ID NO: 893453 - RNA, 15 nt, Homo sapiens
agccacaucacuaca

SEQ ID NO: 893454 - RNA, 17 nt, Homo sapiens
agccacauuuugcauua

SEQ ID NO: 893455 - RNA, 13 nt, Homo sapiens
agccaccaagaca

SEQ ID NO: 893456 - RNA, 15 nt, Homo sapiens
agccacuaccuucug

SEQ ID NO: 893457 - RNA, 13 nt, Homo sapiens
agccacuugacua

SEQ ID NO: 893458 - RNA, 14 nt, Homo sapiens
agccagccugggac

SEQ ID NO: 893459 - RNA, 16 nt, Homo sapiens
agccagcucugcauua

SEQ ID NO: 893460 - RNA, 11 nt, Homo sapiens
agccauaugca

SEQ ID NO: 893461 - RNA, 18 nt, Homo sapiens
agccauauucacaccuca

SEQ ID NO: 893462 - RNA, 23 nt, Homo sapiens
agccaucaccuugauaaugggau

SEQ ID NO: 893463 - RNA, 19 nt, Homo sapiens
agccaugacgucaauagca

SEQ ID NO: 893464 - RNA, 19 nt, Homo sapiens
agccauggugacacacagc

SEQ ID NO: 893465 - RNA, 22 nt, Homo sapiens
agccauggugacacacagcagc

SEQ ID NO: 893466 - RNA, 20 nt, Homo sapiens
agccauguaccaguguacug

SEQ ID NO: 893467 - RNA, 16 nt, Homo sapiens
agcccaagaggacuga

SEQ ID NO: 893468 - RNA, 17 nt, Homo sapiens
agcccagaaaaccucca

SEQ ID NO: 893469 - RNA, 20 nt, Homo sapiens
ucuuuaagaaucuauuuccu

SEQ ID NO: 893470 - RNA, 19 nt, Homo sapiens
ucuuuaagaguauguugcu

SEQ ID NO: 893471 - RNA, 20 nt, Homo sapiens
ucuuuacaauaaacauagcu

SEQ ID NO: 893472 - RNA, 14 nt, Homo sapiens
ucuuuaugacuguu

SEQ ID NO: 893473 - RNA, 22 nt, Homo sapiens
ucuuucaaaguguaagcacuuc

SEQ ID NO: 893474 - RNA, 22 nt, Homo sapiens
ucuuucagauggaggugccaua

SEQ ID NO: 893475 - RNA, 14 nt, Homo sapiens
ucuuucagcacuca

SEQ ID NO: 893476 - RNA, 20 nt, Homo sapiens
ucuuucuaacuccagugaag

SEQ ID NO: 893477 - RNA, 17 nt, Homo sapiens
ucuuugaagagauuuca

SEQ ID NO: 893478 - RNA, 16 nt, Homo sapiens
ucuuugcucauggcaa

SEQ ID NO: 893479 - RNA, 21 nt, Homo sapiens
ucuuuguaagaguggaaccaa

SEQ ID NO: 893480 - RNA, 14 nt, Homo sapiens
ucuuuguacauuuu

SEQ ID NO: 893481 - RNA, 14 nt, Homo sapiens
ucuuuuaaaccauu

SEQ ID NO: 893482 - RNA, 14 nt, Homo sapiens
ucuuuuacuguaau

SEQ ID NO: 893483 - RNA, 15 nt, Homo sapiens
ucuuuuagugauacu

SEQ ID NO: 893484 - RNA, 11 nt, Homo sapiens
ucuuuugcucu

SEQ ID NO: 893485 - RNA, 15 nt, Homo sapiens
ucuuuuucacacuga

SEQ ID NO: 893486 - RNA, 18 nt, Homo sapiens
ucuuuuuugucucaagau

SEQ ID NO: 893487 - RNA, 17 nt, Homo sapiens
ugaaaaaaaaaagacaa

SEQ ID NO: 893488 - RNA, 17 nt, Homo sapiens
ugaaaaaaaguacaugu

SEQ ID NO: 893489 - RNA, 15 nt, Homo sapiens
ugaaaaaaaugcauu

SEQ ID NO: 893490 - RNA, 17 nt, Homo sapiens
ugaaaaacagaaagcau

SEQ ID NO: 893491 - RNA, 21 nt, Homo sapiens
ugaaaaaugguaauuguugcu

SEQ ID NO: 893492 - RNA, 18 nt, Homo sapiens
ugaaaacucacuucaaug

SEQ ID NO: 893493 - RNA, 17 nt, Homo sapiens
ugaaaagacucaguguu

SEQ ID NO: 893494 - RNA, 16 nt, Homo sapiens
ugaaaagacuccaaag

SEQ ID NO: 893495 - RNA, 11 nt, Homo sapiens
ugaaaauaacu

SEQ ID NO: 893496 - RNA, 22 nt, Homo sapiens
ugaaaauaauuguuccaaauga

SEQ ID NO: 893497 - RNA, 15 nt, Homo sapiens
ugaaaauaugauguu

SEQ ID NO: 893498 - RNA, 14 nt, Homo sapiens
ugaaaaugaaugcu

SEQ ID NO: 893499 - RNA, 21 nt, Homo sapiens
ugaaaaugucagaaaccaguu

SEQ ID NO: 893500 - RNA, 20 nt, Homo sapiens
ugaaaauguuguuaugcuau

SEQ ID NO: 893501 - RNA, 15 nt, Homo sapiens
ugaaaauuguagggu

SEQ ID NO: 893502 - RNA, 17 nt, Homo sapiens
ugaaacaaauaaucaca

SEQ ID NO: 893503 - RNA, 21 nt, Homo sapiens
ugaaacaagcaacagauggau

SEQ ID NO: 893504 - RNA, 12 nt, Homo sapiens
ugaaaccaaaga

SEQ ID NO: 893505 - RNA, 15 nt, Homo sapiens
ugaaaccucaucucu

SEQ ID NO: 893506 - RNA, 23 nt, Homo sapiens
ugaaacugagaugugaacacauc

SEQ ID NO: 893507 - RNA, 19 nt, Homo sapiens
ugaaacuucauaaauguuc

SEQ ID NO: 893508 - RNA, 24 nt, Homo sapiens
ugaaacuuuagagauuaacgacaa

SEQ ID NO: 893509 - RNA, 17 nt, Homo sapiens
ugaaagaaccaaaagag

SEQ ID NO: 893510 - RNA, 23 nt, Homo sapiens
ugaaagaaccaaaagagaucaca

SEQ ID NO: 893511 - RNA, 14 nt, Homo sapiens
ugaaagaccuucuc

SEQ ID NO: 893512 - RNA, 16 nt, Homo sapiens
ugaaagagaguaccau

SEQ ID NO: 893513 - RNA, 16 nt, Homo sapiens
ugaaagaguagugcau

SEQ ID NO: 893514 - RNA, 10 nt, Homo sapiens
ugaaagcaga

SEQ ID NO: 893515 - RNA, 14 nt, Homo sapiens
ugaaagcagaugag

SEQ ID NO: 893516 - RNA, 22 nt, Homo sapiens
ugaaaggaagcuccacugucac

SEQ ID NO: 893517 - RNA, 16 nt, Homo sapiens
ugaaaggcacacuuug

SEQ ID NO: 893518 - RNA, 17 nt, Homo sapiens
ugaaaggcacacuuuga

SEQ ID NO: 893519 - RNA, 13 nt, Homo sapiens
ugaaagugcaaag

SEQ ID NO: 893520 - RNA, 14 nt, Homo sapiens
ugaaauaaaagccu

SEQ ID NO: 893521 - RNA, 19 nt, Homo sapiens
ugaaauaauuaaaaaccac

SEQ ID NO: 893522 - RNA, 13 nt, Homo sapiens
ugaaauaccagug

SEQ ID NO: 893523 - RNA, 21 nt, Homo sapiens
ugaaauaccagugaaccaaag

SEQ ID NO: 893524 - RNA, 15 nt, Homo sapiens
ugaaaucucagaauu

SEQ ID NO: 893525 - RNA, 21 nt, Homo sapiens
ugaaaucugaggaaggugcuu

SEQ ID NO: 893526 - RNA, 20 nt, Homo sapiens
ugaaauuauguauguuuaca

SEQ ID NO: 893527 - RNA, 16 nt, Homo sapiens
ugaaauugaaccuggu

SEQ ID NO: 893528 - RNA, 15 nt, Homo sapiens
ugaaauugaugccag

SEQ ID NO: 893529 - RNA, 19 nt, Homo sapiens
ugaaauuuaauauagcuau

SEQ ID NO: 893530 - RNA, 19 nt, Homo sapiens
ugaaauuucccacacccca

SEQ ID NO: 893531 - RNA, 16 nt, Homo sapiens
ugaaauuuuaauugaa

SEQ ID NO: 893532 - RNA, 21 nt, Homo sapiens
ugaaauuuucuagacuuucug

SEQ ID NO: 893533 - RNA, 16 nt, Homo sapiens
ugaacaaauggccuuu

SEQ ID NO: 893534 - RNA, 17 nt, Homo sapiens
ugaacaauucucucuua

SEQ ID NO: 893535 - RNA, 20 nt, Homo sapiens
ugaacacaauugauacuuca

SEQ ID NO: 893536 - RNA, 15 nt, Homo sapiens
ugaacacaucagcuu

SEQ ID NO: 893537 - RNA, 21 nt, Homo sapiens
ugaacaucuuuaggagacuaa

SEQ ID NO: 893538 - RNA, 13 nt, Homo sapiens
ugaaccaaagaga

SEQ ID NO: 893539 - RNA, 14 nt, Homo sapiens
ugaaccacuuugcc

SEQ ID NO: 893540 - RNA, 13 nt, Homo sapiens
ugaaccauuacug

SEQ ID NO: 893541 - RNA, 23 nt, Homo sapiens
ugaaccccuggccucaagcaauc

SEQ ID NO: 893542 - RNA, 18 nt, Homo sapiens
ugaacggcugaauaugaa

SEQ ID NO: 893543 - RNA, 17 nt, Homo sapiens
ugaacuauuagacauga

SEQ ID NO: 893544 - RNA, 21 nt, Homo sapiens
ugaacuauuucuacacagugg

SEQ ID NO: 893545 - RNA, 20 nt, Homo sapiens
ugaacugagccaaacacacu

SEQ ID NO: 893546 - RNA, 14 nt, Homo sapiens
ugaacuguccuucc

SEQ ID NO: 893547 - RNA, 19 nt, Homo sapiens
ugaacuguuuuccuggcau

SEQ ID NO: 893548 - RNA, 14 nt, Homo sapiens
ugaacuucagggag

SEQ ID NO: 893549 - RNA, 24 nt, Homo sapiens
ugaacuuggaaagaaaugcccauc

SEQ ID NO: 893550 - RNA, 17 nt, Homo sapiens
ugaacuuucacauagca

SEQ ID NO: 893551 - RNA, 18 nt, Homo sapiens
ugaacuuucacauagcac

SEQ ID NO: 893552 - RNA, 11 nt, Homo sapiens
ugaacuuuguc

SEQ ID NO: 893553 - RNA, 19 nt, Homo sapiens
ugaagaaaaaauacauuuu

SEQ ID NO: 893554 - RNA, 15 nt, Homo sapiens
ugaagaaaagcacuu

SEQ ID NO: 893555 - RNA, 21 nt, Homo sapiens
ugaagaaaagugaaugcucaa

SEQ ID NO: 893556 - RNA, 18 nt, Homo sapiens
ugaagaacaguaacugcc

SEQ ID NO: 893557 - RNA, 21 nt, Homo sapiens
ugaagaacaucccaagccaga

SEQ ID NO: 893558 - RNA, 20 nt, Homo sapiens
ugaagaagaguuugcaaaug

SEQ ID NO: 893559 - RNA, 14 nt, Homo sapiens
ugaagacaaaccac

SEQ ID NO: 893560 - RNA, 17 nt, Homo sapiens
ugaagacaaaccacugu

SEQ ID NO: 893561 - RNA, 13 nt, Homo sapiens
ugaagacauucca

SEQ ID NO: 893562 - RNA, 15 nt, Homo sapiens
ugaagaccacaucca

SEQ ID NO: 893563 - RNA, 18 nt, Homo sapiens
ugaagaccuaaaugaccu

SEQ ID NO: 893564 - RNA, 15 nt, Homo sapiens
ugaagagaagcugag

SEQ ID NO: 893565 - RNA, 14 nt, Homo sapiens
ugaagagagauaua

SEQ ID NO: 893566 - RNA, 13 nt, Homo sapiens
ugaagagguguuu

SEQ ID NO: 893567 - RNA, 12 nt, Homo sapiens
ugaagaguacag

SEQ ID NO: 893568 - RNA, 19 nt, Homo sapiens
ugaagauucuccugugcua

SEQ ID NO: 893569 - RNA, 14 nt, Homo sapiens
ugaagccagaucca

SEQ ID NO: 893570 - RNA, 20 nt, Homo sapiens
ugaagccccuuguccucucc

SEQ ID NO: 893571 - RNA, 20 nt, Homo sapiens
ugaaggacgugucucaggag

SEQ ID NO: 893572 - RNA, 16 nt, Homo sapiens
ugaaggagaaaaugca

SEQ ID NO: 893573 - RNA, 13 nt, Homo sapiens
ugaaggagccagu

SEQ ID NO: 893574 - RNA, 23 nt, Homo sapiens
ugaaggaggugagggaugugaau

SEQ ID NO: 893575 - RNA, 19 nt, Homo sapiens
ugaaggaguccuugcauca

SEQ ID NO: 893576 - RNA, 13 nt, Homo sapiens
ugaaggcuguaca

SEQ ID NO: 893577 - RNA, 18 nt, Homo sapiens
ugaagggggcggccuaug

SEQ ID NO: 893578 - RNA, 18 nt, Homo sapiens
ugaagucaccgggaugaa

SEQ ID NO: 893579 - RNA, 12 nt, Homo sapiens
ugaagugcaaau

SEQ ID NO: 893580 - RNA, 17 nt, Homo sapiens
ugaaguggccagaugag

SEQ ID NO: 893581 - RNA, 20 nt, Homo sapiens
ugaaguuaagaaccugaaua

SEQ ID NO: 893582 - RNA, 17 nt, Homo sapiens
ugaauaaaaacccugua

SEQ ID NO: 893583 - RNA, 17 nt, Homo sapiens
ugaauaaguauucuuca

SEQ ID NO: 893584 - RNA, 15 nt, Homo sapiens
agcccagcacuguga

SEQ ID NO: 893585 - RNA, 15 nt, Homo sapiens
agcccagccuagccc

SEQ ID NO: 893586 - RNA, 15 nt, Homo sapiens
agcccauaaggccag

SEQ ID NO: 893587 - RNA, 13 nt, Homo sapiens
agcccaugcuuuc

SEQ ID NO: 893588 - RNA, 22 nt, Homo sapiens
agcccauuggcucccaucugaa

SEQ ID NO: 893589 - RNA, 17 nt, Homo sapiens
agccccagugacagcua

SEQ ID NO: 893590 - RNA, 22 nt, Homo sapiens
agccccauucugccugcccagg

SEQ ID NO: 893591 - RNA, 16 nt, Homo sapiens
agccccgcccgccugg

SEQ ID NO: 893592 - RNA, 15 nt, Homo sapiens
agcccucaggccagu

SEQ ID NO: 893593 - RNA, 17 nt, Homo sapiens
agcccucaggccagugc

SEQ ID NO: 893594 - RNA, 17 nt, Homo sapiens
agcccugcagccaaaca

SEQ ID NO: 893595 - RNA, 21 nt, Homo sapiens
agcccuggcccagagcuggaa

SEQ ID NO: 893596 - RNA, 21 nt, Homo sapiens
agcccugggccccaccaccua

SEQ ID NO: 893597 - RNA, 19 nt, Homo sapiens
agcccugguccuagacaua

SEQ ID NO: 893598 - RNA, 15 nt, Homo sapiens
agcccugugaggcug

SEQ ID NO: 893599 - RNA, 16 nt, Homo sapiens
agcccuuagcagggaa

SEQ ID NO: 893600 - RNA, 16 nt, Homo sapiens
agcccuuccuagaaga

SEQ ID NO: 893601 - RNA, 15 nt, Homo sapiens
agcccuugaaccagc

SEQ ID NO: 893602 - RNA, 15 nt, Homo sapiens
agcccuuggaucagu

SEQ ID NO: 893603 - RNA, 15 nt, Homo sapiens
agccgaaaagcuuuu

SEQ ID NO: 893604 - RNA, 12 nt, Homo sapiens
agccgaccucag

SEQ ID NO: 893605 - RNA, 23 nt, Homo sapiens
agccgagauggcgcuauugcacu

SEQ ID NO: 893606 - RNA, 16 nt, Homo sapiens
agccgcugcacaucac

SEQ ID NO: 893607 - RNA, 18 nt, Homo sapiens
agccgcugcugagcugcg

SEQ ID NO: 893608 - RNA, 14 nt, Homo sapiens
agccgugaugcuca

SEQ ID NO: 893609 - RNA, 19 nt, Homo sapiens
agccgugucguaugaccua

SEQ ID NO: 893610 - RNA, 14 nt, Homo sapiens
agccuaaggcugua

SEQ ID NO: 893611 - RNA, 20 nt, Homo sapiens
agccuacugccucuccagca

SEQ ID NO: 893612 - RNA, 18 nt, Homo sapiens
agccuaggugacagagug

SEQ ID NO: 893613 - RNA, 15 nt, Homo sapiens
agccuauuuauuuga

SEQ ID NO: 893614 - RNA, 12 nt, Homo sapiens
agccucaagucu

SEQ ID NO: 893615 - RNA, 14 nt, Homo sapiens
agccucccaaagug

SEQ ID NO: 893616 - RNA, 17 nt, Homo sapiens
agccucccaaguagcug

SEQ ID NO: 893617 - RNA, 17 nt, Homo sapiens
agccucccucugaccug

SEQ ID NO: 893618 - RNA, 19 nt, Homo sapiens
agccuccugccuaccccaa

SEQ ID NO: 893619 - RNA, 14 nt, Homo sapiens
agccucuccaggaa

SEQ ID NO: 893620 - RNA, 19 nt, Homo sapiens
agccucuucgcugaccucg

SEQ ID NO: 893621 - RNA, 19 nt, Homo sapiens
agccucuucugccaagaga

SEQ ID NO: 893622 - RNA, 21 nt, Homo sapiens
agccugaaugucuuacuguga

SEQ ID NO: 893623 - RNA, 23 nt, Homo sapiens
agccugaccuuucugagugacau

SEQ ID NO: 893624 - RNA, 15 nt, Homo sapiens
agccugacuguguuc

SEQ ID NO: 893625 - RNA, 15 nt, Homo sapiens
agccugagaugggga

SEQ ID NO: 893626 - RNA, 20 nt, Homo sapiens
agccugauuauccuauaggc

SEQ ID NO: 893627 - RNA, 21 nt, Homo sapiens
agccugcuuuuguccuguuau

SEQ ID NO: 893628 - RNA, 17 nt, Homo sapiens
agccuggcaacagagca

SEQ ID NO: 893629 - RNA, 21 nt, Homo sapiens
agccuggcccuggaacuagaa

SEQ ID NO: 893630 - RNA, 18 nt, Homo sapiens
agccuggggcaucccaga

SEQ ID NO: 893631 - RNA, 14 nt, Homo sapiens
agccuguauagaca

SEQ ID NO: 893632 - RNA, 20 nt, Homo sapiens
agccugugaacccaggacaa

SEQ ID NO: 893633 - RNA, 12 nt, Homo sapiens
agccugugauua

SEQ ID NO: 893634 - RNA, 22 nt, Homo sapiens
agccugugcauguaugucuugg

SEQ ID NO: 893635 - RNA, 16 nt, Homo sapiens
agccugugcuaaagaa

SEQ ID NO: 893636 - RNA, 21 nt, Homo sapiens
agccuguucauggcagaugua

SEQ ID NO: 893637 - RNA, 15 nt, Homo sapiens
agccuguugcugaag

SEQ ID NO: 893638 - RNA, 22 nt, Homo sapiens
agccuguuggacccgcucugga

SEQ ID NO: 893639 - RNA, 16 nt, Homo sapiens
agccuucugacaagca

SEQ ID NO: 893640 - RNA, 13 nt, Homo sapiens
agccuucugauga

SEQ ID NO: 893641 - RNA, 14 nt, Homo sapiens
agccuucugaugag

SEQ ID NO: 893642 - RNA, 21 nt, Homo sapiens
agccuucugaugagacugcag

SEQ ID NO: 893643 - RNA, 18 nt, Homo sapiens
agccuugcaucaagggcu

SEQ ID NO: 893644 - RNA, 15 nt, Homo sapiens
agccuuucuuaugga

SEQ ID NO: 893645 - RNA, 16 nt, Homo sapiens
agcgagcuaugaucgc

SEQ ID NO: 893646 - RNA, 18 nt, Homo sapiens
agcgcaucaggccuggca

SEQ ID NO: 893647 - RNA, 23 nt, Homo sapiens
agcgcuguguuaggcacaggcug

SEQ ID NO: 893648 - RNA, 14 nt, Homo sapiens
agcggaucucacuc

SEQ ID NO: 893649 - RNA, 18 nt, Homo sapiens
agcguaacaaacaaaauc

SEQ ID NO: 893650 - RNA, 15 nt, Homo sapiens
agcguagcuaaguga

SEQ ID NO: 893651 - RNA, 18 nt, Homo sapiens
agcgucccuagcagugaa

SEQ ID NO: 893652 - RNA, 15 nt, Homo sapiens
agcgugaaagcagau

SEQ ID NO: 893653 - RNA, 13 nt, Homo sapiens
agcgugagccacu

SEQ ID NO: 893654 - RNA, 21 nt, Homo sapiens
agcgugcccugccccucuggc

SEQ ID NO: 893655 - RNA, 16 nt, Homo sapiens
agcuaaacaugcugcc

SEQ ID NO: 893656 - RNA, 13 nt, Homo sapiens
agcuaagccacau

SEQ ID NO: 893657 - RNA, 20 nt, Homo sapiens
agcuaaguucuaaguucaug

SEQ ID NO: 893658 - RNA, 14 nt, Homo sapiens
agcuacaauaucuu

SEQ ID NO: 893659 - RNA, 20 nt, Homo sapiens
agcuaccucacuaugcugcu

SEQ ID NO: 893660 - RNA, 19 nt, Homo sapiens
agcuacucacuuaucugau

SEQ ID NO: 893661 - RNA, 10 nt, Homo sapiens
agcuacugaa

SEQ ID NO: 893662 - RNA, 18 nt, Homo sapiens
agcuacuugggaggcuga

SEQ ID NO: 893663 - RNA, 14 nt, Homo sapiens
agcuagaaccugga

SEQ ID NO: 893664 - RNA, 15 nt, Homo sapiens
agcuagaaccuggag

SEQ ID NO: 893665 - RNA, 15 nt, Homo sapiens
agcuagaaugcacac

SEQ ID NO: 893666 - RNA, 20 nt, Homo sapiens
agcuagagugcaguggugca

SEQ ID NO: 893667 - RNA, 22 nt, Homo sapiens
agcuauuuucaacauaacugaa

SEQ ID NO: 893668 - RNA, 15 nt, Homo sapiens
agcucaggcacacuu

SEQ ID NO: 893669 - RNA, 22 nt, Homo sapiens
agcucaggugucccugcacuug

SEQ ID NO: 893670 - RNA, 21 nt, Homo sapiens
agcuccccugggggcuagcag

SEQ ID NO: 893671 - RNA, 20 nt, Homo sapiens
agcuccgcuaagaccucccc

SEQ ID NO: 893672 - RNA, 23 nt, Homo sapiens
agcuccuucuguccuacucugug

SEQ ID NO: 893673 - RNA, 13 nt, Homo sapiens
agcuccuugacuc

SEQ ID NO: 893674 - RNA, 15 nt, Homo sapiens
agcucuaguucaaau

SEQ ID NO: 893675 - RNA, 12 nt, Homo sapiens
agcucucucuac

SEQ ID NO: 893676 - RNA, 14 nt, Homo sapiens
agcucucuuuccca

SEQ ID NO: 893677 - RNA, 15 nt, Homo sapiens
agcucugaacaaaag

SEQ ID NO: 893678 - RNA, 16 nt, Homo sapiens
agcucugaacaaaagc

SEQ ID NO: 893679 - RNA, 19 nt, Homo sapiens
agcucugcuccucucccca

SEQ ID NO: 893680 - RNA, 14 nt, Homo sapiens
agcucuggaccagc

SEQ ID NO: 893681 - RNA, 24 nt, Homo sapiens
agcucuggaugaagcucuggccaa

SEQ ID NO: 893682 - RNA, 15 nt, Homo sapiens
agcucuggcuuccag

SEQ ID NO: 893683 - RNA, 14 nt, Homo sapiens
agcucuggugaccu

SEQ ID NO: 893684 - RNA, 15 nt, Homo sapiens
agcucuuaauguugc

SEQ ID NO: 893685 - RNA, 19 nt, Homo sapiens
agcucuuuguucaguugac

SEQ ID NO: 893686 - RNA, 12 nt, Homo sapiens
agcugaagugaa

SEQ ID NO: 893687 - RNA, 13 nt, Homo sapiens
agcugacaucucc

SEQ ID NO: 893688 - RNA, 16 nt, Homo sapiens
agcugagccuucugau

SEQ ID NO: 893689 - RNA, 19 nt, Homo sapiens
agcugagccuucugaugag

SEQ ID NO: 893690 - RNA, 20 nt, Homo sapiens
agcugauuuugucacugucu

SEQ ID NO: 893691 - RNA, 14 nt, Homo sapiens
agcugcaacggaau

SEQ ID NO: 893692 - RNA, 13 nt, Homo sapiens
agcugcaccugcc

SEQ ID NO: 893693 - RNA, 21 nt, Homo sapiens
agcugcagucaacaguucaaa

SEQ ID NO: 893694 - RNA, 20 nt, Homo sapiens
agcugcaugggugccugcug

SEQ ID NO: 893695 - RNA, 17 nt, Homo sapiens
agcugccuuuuuuaaca

SEQ ID NO: 893696 - RNA, 22 nt, Homo sapiens
agcugccuuuuuuaacacuaga

SEQ ID NO: 893697 - RNA, 24 nt, Homo sapiens
agcugccuuuuuuaacacuagaaa

SEQ ID NO: 893698 - RNA, 16 nt, Homo sapiens
agcugcucccaaauaa

SEQ ID NO: 893699 - RNA, 20 nt, Homo sapiens
ugaauagcgaaucaucucaa

SEQ ID NO: 893700 - RNA, 21 nt, Homo sapiens
ugaauagcgaaucaucucaaa

SEQ ID NO: 893701 - RNA, 14 nt, Homo sapiens
ugaauaugacaaag

SEQ ID NO: 893702 - RNA, 22 nt, Homo sapiens
ugaauccaucaggacuugggaa

SEQ ID NO: 893703 - RNA, 21 nt, Homo sapiens
ugaaugaccuuguugcaugau

SEQ ID NO: 893704 - RNA, 13 nt, Homo sapiens
ugaaugacguguc

SEQ ID NO: 893705 - RNA, 18 nt, Homo sapiens
ugaaugugucacuacuca

SEQ ID NO: 893706 - RNA, 20 nt, Homo sapiens
ugaauuuuguguguaccugu

SEQ ID NO: 893707 - RNA, 12 nt, Homo sapiens
ugacaaauugaa

SEQ ID NO: 893708 - RNA, 19 nt, Homo sapiens
ugacaacauuucuauagcc

SEQ ID NO: 893709 - RNA, 15 nt, Homo sapiens
ugacaagauggaaaa

SEQ ID NO: 893710 - RNA, 16 nt, Homo sapiens
ugacaagggcugaccu

SEQ ID NO: 893711 - RNA, 23 nt, Homo sapiens
ugacaauaugauuuuaaauuuga

SEQ ID NO: 893712 - RNA, 15 nt, Homo sapiens
ugacaauggcagcua

SEQ ID NO: 893713 - RNA, 16 nt, Homo sapiens
ugacacacagcacucu

SEQ ID NO: 893714 - RNA, 13 nt, Homo sapiens
ugacacacagcuc

SEQ ID NO: 893715 - RNA, 12 nt, Homo sapiens
ugacaccuggau

SEQ ID NO: 893716 - RNA, 18 nt, Homo sapiens
ugacacgucugccuaccc

SEQ ID NO: 893717 - RNA, 14 nt, Homo sapiens
ugacagaaaugcaa

SEQ ID NO: 893718 - RNA, 15 nt, Homo sapiens
ugacagaacacuguc

SEQ ID NO: 893719 - RNA, 23 nt, Homo sapiens
ugacagccagagccugucuuuca

SEQ ID NO: 893720 - RNA, 21 nt, Homo sapiens
ugacagccuccgucagacucc

SEQ ID NO: 893721 - RNA, 20 nt, Homo sapiens
ugacaggccauccauucaca

SEQ ID NO: 893722 - RNA, 18 nt, Homo sapiens
ugacaggcccaguggaac

SEQ ID NO: 893723 - RNA, 19 nt, Homo sapiens
ugacagguucccagcagcu

SEQ ID NO: 893724 - RNA, 12 nt, Homo sapiens
ugacagugaauu

SEQ ID NO: 893725 - RNA, 19 nt, Homo sapiens
ugacaucuccucuaucaca

SEQ ID NO: 893726 - RNA, 19 nt, Homo sapiens
ugacaucucuuugauguca

SEQ ID NO: 893727 - RNA, 14 nt, Homo sapiens
ugacaugccaucca

SEQ ID NO: 893728 - RNA, 18 nt, Homo sapiens
ugacaugggugugccagg

SEQ ID NO: 893729 - RNA, 15 nt, Homo sapiens
ugacaugucucacag

SEQ ID NO: 893730 - RNA, 22 nt, Homo sapiens
ugacauucugauucgaaugaca

SEQ ID NO: 893731 - RNA, 20 nt, Homo sapiens
ugacauugcuucugcuaaau

SEQ ID NO: 893732 - RNA, 16 nt, Homo sapiens
ugacauuguauguauc

SEQ ID NO: 893733 - RNA, 19 nt, Homo sapiens
ugaccaaauaaaguaccau

SEQ ID NO: 893734 - RNA, 14 nt, Homo sapiens
ugaccaacaguucc

SEQ ID NO: 893735 - RNA, 18 nt, Homo sapiens
ugaccaauacuacuguaa

SEQ ID NO: 893736 - RNA, 22 nt, Homo sapiens
ugaccauaaaggcauggcauuu

SEQ ID NO: 893737 - RNA, 16 nt, Homo sapiens
ugaccaucgcaaccag

SEQ ID NO: 893738 - RNA, 12 nt, Homo sapiens
ugacccaaagac

SEQ ID NO: 893739 - RNA, 15 nt, Homo sapiens
ugacccaaagaccaa

SEQ ID NO: 893740 - RNA, 16 nt, Homo sapiens
ugaccgaguaccugcu

SEQ ID NO: 893741 - RNA, 13 nt, Homo sapiens
ugaccucagcaaa

SEQ ID NO: 893742 - RNA, 14 nt, Homo sapiens
ugaccucagcugca

SEQ ID NO: 893743 - RNA, 20 nt, Homo sapiens
ugaccugcugagcucugaga

SEQ ID NO: 893744 - RNA, 20 nt, Homo sapiens
ugaccugcugugcaccuuac

SEQ ID NO: 893745 - RNA, 23 nt, Homo sapiens
ugaccuguuauuaccauuagcau

SEQ ID NO: 893746 - RNA, 14 nt, Homo sapiens
ugaccuugaucaag

SEQ ID NO: 893747 - RNA, 21 nt, Homo sapiens
ugaccuuggagagacacagcg

SEQ ID NO: 893748 - RNA, 14 nt, Homo sapiens
ugaccuuguagcua

SEQ ID NO: 893749 - RNA, 12 nt, Homo sapiens
ugacgagcucac

SEQ ID NO: 893750 - RNA, 22 nt, Homo sapiens
ugacggcugcucgaagaacaau

SEQ ID NO: 893751 - RNA, 20 nt, Homo sapiens
ugacggucccacacugguga

SEQ ID NO: 893752 - RNA, 22 nt, Homo sapiens
ugacgucacuggaccacugggc

SEQ ID NO: 893753 - RNA, 23 nt, Homo sapiens
ugacgugcaccuguacucaggag

SEQ ID NO: 893754 - RNA, 18 nt, Homo sapiens
ugacuaaagcagggacaa

SEQ ID NO: 893755 - RNA, 18 nt, Homo sapiens
ugacuauuuccaccauca

SEQ ID NO: 893756 - RNA, 16 nt, Homo sapiens
ugacucagcauaccug

SEQ ID NO: 893757 - RNA, 16 nt, Homo sapiens
ugacucugacuuugag

SEQ ID NO: 893758 - RNA, 14 nt, Homo sapiens
ugacugaaaccacu

SEQ ID NO: 893759 - RNA, 18 nt, Homo sapiens
ugacuguguucagugccu

SEQ ID NO: 893760 - RNA, 21 nt, Homo sapiens
ugacuguguucagugccuugg

SEQ ID NO: 893761 - RNA, 15 nt, Homo sapiens
ugacuuaaguggcau

SEQ ID NO: 893762 - RNA, 15 nt, Homo sapiens
ugacuuccacaccua

SEQ ID NO: 893763 - RNA, 18 nt, Homo sapiens
ugacuucucccaucuagu

SEQ ID NO: 893764 - RNA, 19 nt, Homo sapiens
ugacuugacagaacacugu

SEQ ID NO: 893765 - RNA, 22 nt, Homo sapiens
ugacuugcagaguucauggaau

SEQ ID NO: 893766 - RNA, 15 nt, Homo sapiens
ugacuuuuaucugua

SEQ ID NO: 893767 - RNA, 16 nt, Homo sapiens
ugagaaacugauuuau

SEQ ID NO: 893768 - RNA, 16 nt, Homo sapiens
ugagaaagaaugagca

SEQ ID NO: 893769 - RNA, 20 nt, Homo sapiens
ugagaaagccuucauaagcc

SEQ ID NO: 893770 - RNA, 14 nt, Homo sapiens
ugagaaaggauuaa

SEQ ID NO: 893771 - RNA, 18 nt, Homo sapiens
ugagaaggagucagaaac

SEQ ID NO: 893772 - RNA, 21 nt, Homo sapiens
ugagaaucgaccucacuguca

SEQ ID NO: 893773 - RNA, 19 nt, Homo sapiens
ugagaaugagggccaagaa

SEQ ID NO: 893774 - RNA, 13 nt, Homo sapiens
ugagacaagcccu

SEQ ID NO: 893775 - RNA, 20 nt, Homo sapiens
ugagacccccaucucuacaa

SEQ ID NO: 893776 - RNA, 17 nt, Homo sapiens
ugagacuauaacuguca

SEQ ID NO: 893777 - RNA, 15 nt, Homo sapiens
ugagacuccgucuca

SEQ ID NO: 893778 - RNA, 22 nt, Homo sapiens
ugagagcauugggauaucuccu

SEQ ID NO: 893779 - RNA, 19 nt, Homo sapiens
ugagagcugcucuggaaaa

SEQ ID NO: 893780 - RNA, 18 nt, Homo sapiens
ugagaggggaacagacug

SEQ ID NO: 893781 - RNA, 15 nt, Homo sapiens
ugagauccuuuaaau

SEQ ID NO: 893782 - RNA, 23 nt, Homo sapiens
ugagauccuuuaaauccuuccau

SEQ ID NO: 893783 - RNA, 23 nt, Homo sapiens
ugagaucgugccguuacucucca

SEQ ID NO: 893784 - RNA, 16 nt, Homo sapiens
ugagaucuuacaggua

SEQ ID NO: 893785 - RNA, 15 nt, Homo sapiens
ugagauugugcccag

SEQ ID NO: 893786 - RNA, 16 nt, Homo sapiens
ugagcaagcuaugagg

SEQ ID NO: 893787 - RNA, 11 nt, Homo sapiens
ugagcacacac

SEQ ID NO: 893788 - RNA, 18 nt, Homo sapiens
ugagcacccccucauucc

SEQ ID NO: 893789 - RNA, 17 nt, Homo sapiens
ugagcaccgucauggcu

SEQ ID NO: 893790 - RNA, 15 nt, Homo sapiens
ugagcacucuacugc

SEQ ID NO: 893791 - RNA, 19 nt, Homo sapiens
ugagcaggcugagcaccuc

SEQ ID NO: 893792 - RNA, 18 nt, Homo sapiens
ugagcauggucacaagca

SEQ ID NO: 893793 - RNA, 17 nt, Homo sapiens
ugagccaaacacacugu

SEQ ID NO: 893794 - RNA, 18 nt, Homo sapiens
ugagccaaacacacugua

SEQ ID NO: 893795 - RNA, 12 nt, Homo sapiens
ugagccaaagag

SEQ ID NO: 893796 - RNA, 13 nt, Homo sapiens
ugagccacugcac

SEQ ID NO: 893797 - RNA, 14 nt, Homo sapiens
ugagccgcugugag

SEQ ID NO: 893798 - RNA, 22 nt, Homo sapiens
ugagccuucugaugagacugca

SEQ ID NO: 893799 - RNA, 14 nt, Homo sapiens
ugagcgcuguguua

SEQ ID NO: 893800 - RNA, 19 nt, Homo sapiens
ugagcucacugaaaagacu

SEQ ID NO: 893801 - RNA, 13 nt, Homo sapiens
ugagcucaggcau

SEQ ID NO: 893802 - RNA, 15 nt, Homo sapiens
ugagcuccccaaaaa

SEQ ID NO: 893803 - RNA, 22 nt, Homo sapiens
ugagcugcaacuucuuacuucc

SEQ ID NO: 893804 - RNA, 16 nt, Homo sapiens
ugaggaaggugcuugc

SEQ ID NO: 893805 - RNA, 12 nt, Homo sapiens
ugaggacacgug

SEQ ID NO: 893806 - RNA, 22 nt, Homo sapiens
ugaggacauggagagagacuca

SEQ ID NO: 893807 - RNA, 19 nt, Homo sapiens
ugaggagagaaggacaugu

SEQ ID NO: 893808 - RNA, 15 nt, Homo sapiens
ugaggagcugacaua

SEQ ID NO: 893809 - RNA, 12 nt, Homo sapiens
ugaggauuucaa

SEQ ID NO: 893810 - RNA, 20 nt, Homo sapiens
ugaggauuuugauccaagcu

SEQ ID NO: 893811 - RNA, 14 nt, Homo sapiens
ugaggcaaaggcca

SEQ ID NO: 893812 - RNA, 13 nt, Homo sapiens
ugaggcaggagaa

SEQ ID NO: 893813 - RNA, 23 nt, Homo sapiens
ugaggcaggaggaucacagugac

SEQ ID NO: 893814 - RNA, 13 nt, Homo sapiens
agcugcucuggaa

SEQ ID NO: 893815 - RNA, 21 nt, Homo sapiens
agcugcuugacuaucacauac

SEQ ID NO: 893816 - RNA, 14 nt, Homo sapiens
agcuggaacccugg

SEQ ID NO: 893817 - RNA, 19 nt, Homo sapiens
agcuggacaugcuuuggca

SEQ ID NO: 893818 - RNA, 19 nt, Homo sapiens
agcuggcauuggucugcug

SEQ ID NO: 893819 - RNA, 23 nt, Homo sapiens
agcuggcucuccaccuuguuaca

SEQ ID NO: 893820 - RNA, 17 nt, Homo sapiens
agcugggacuacaggug

SEQ ID NO: 893821 - RNA, 23 nt, Homo sapiens
agcugggauaaucacauuaucau

SEQ ID NO: 893822 - RNA, 20 nt, Homo sapiens
agcugggccccaugcucugc

SEQ ID NO: 893823 - RNA, 13 nt, Homo sapiens
agcugggccgagu

SEQ ID NO: 893824 - RNA, 12 nt, Homo sapiens
agcuggugcugc

SEQ ID NO: 893825 - RNA, 18 nt, Homo sapiens
agcugguuggagagcuag

SEQ ID NO: 893826 - RNA, 15 nt, Homo sapiens
agcuguaacuaacuc

SEQ ID NO: 893827 - RNA, 22 nt, Homo sapiens
agcuguagcucccgagcuacuc

SEQ ID NO: 893828 - RNA, 22 nt, Homo sapiens
agcugucaucaauuaaaggcaa

SEQ ID NO: 893829 - RNA, 16 nt, Homo sapiens
agcugucgcaucucag

SEQ ID NO: 893830 - RNA, 17 nt, Homo sapiens
agcugugaccugcugag

SEQ ID NO: 893831 - RNA, 20 nt, Homo sapiens
agcugugaccugcugagcuc

SEQ ID NO: 893832 - RNA, 16 nt, Homo sapiens
agcugugcacuugcag

SEQ ID NO: 893833 - RNA, 13 nt, Homo sapiens
agcuguguucaca

SEQ ID NO: 893834 - RNA, 16 nt, Homo sapiens
agcuguuuucccugac

SEQ ID NO: 893835 - RNA, 16 nt, Homo sapiens
agcuuaaaacaagcaa

SEQ ID NO: 893836 - RNA, 23 nt, Homo sapiens
agcuuaaauaaauucaaaccauu

SEQ ID NO: 893837 - RNA, 13 nt, Homo sapiens
agcuuagaccuca

SEQ ID NO: 893838 - RNA, 14 nt, Homo sapiens
agcuucaacccuca

SEQ ID NO: 893839 - RNA, 21 nt, Homo sapiens
agcuucagaaguuuggcaaua

SEQ ID NO: 893840 - RNA, 14 nt, Homo sapiens
agcuuccagugcau

SEQ ID NO: 893841 - RNA, 21 nt, Homo sapiens
agcuuccugucaacacuucuc

SEQ ID NO: 893842 - RNA, 16 nt, Homo sapiens
agcuugaaaacucacu

SEQ ID NO: 893843 - RNA, 22 nt, Homo sapiens
agcuugauccagaccucuacaa

SEQ ID NO: 893844 - RNA, 13 nt, Homo sapiens
agcuugcagugag

SEQ ID NO: 893845 - RNA, 18 nt, Homo sapiens
agcuuuaggggaccauga

SEQ ID NO: 893846 - RNA, 17 nt, Homo sapiens
agcuuuauuugcuguac

SEQ ID NO: 893847 - RNA, 22 nt, Homo sapiens
agcuuuauuuuuuaaguauuua

SEQ ID NO: 893848 - RNA, 19 nt, Homo sapiens
agcuuucuucuacaaccag

SEQ ID NO: 893849 - RNA, 23 nt, Homo sapiens
agcuuuugaggggcugacuucaa

SEQ ID NO: 893850 - RNA, 14 nt, Homo sapiens
aggaaaaccaggga

SEQ ID NO: 893851 - RNA, 12 nt, Homo sapiens
aggaaaccaaag

SEQ ID NO: 893852 - RNA, 12 nt, Homo sapiens
aggaaacuugca

SEQ ID NO: 893853 - RNA, 22 nt, Homo sapiens
aggaaacuugcauacagagaca

SEQ ID NO: 893854 - RNA, 23 nt, Homo sapiens
aggaaagcaaaauccaacuaaug

SEQ ID NO: 893855 - RNA, 15 nt, Homo sapiens
aggaaagccaaacac

SEQ ID NO: 893856 - RNA, 18 nt, Homo sapiens
aggaaagggauaguccaa

SEQ ID NO: 893857 - RNA, 21 nt, Homo sapiens
aggaaaggggcgagcacccac

SEQ ID NO: 893858 - RNA, 16 nt, Homo sapiens
aggaaccaaccaacaa

SEQ ID NO: 893859 - RNA, 19 nt, Homo sapiens
aggaaccucaaacugggua

SEQ ID NO: 893860 - RNA, 20 nt, Homo sapiens
aggaagaaaaccagcgcaag

SEQ ID NO: 893861 - RNA, 22 nt, Homo sapiens
aggaagaccaagacacagauca

SEQ ID NO: 893862 - RNA, 20 nt, Homo sapiens
aggaagacuugaagcacaga

SEQ ID NO: 893863 - RNA, 11 nt, Homo sapiens
aggaagcaagc

SEQ ID NO: 893864 - RNA, 17 nt, Homo sapiens
aggaagcuccacuguca

SEQ ID NO: 893865 - RNA, 14 nt, Homo sapiens
aggaaggacugugc

SEQ ID NO: 893866 - RNA, 15 nt, Homo sapiens
aggaaggcagcugcu

SEQ ID NO: 893867 - RNA, 20 nt, Homo sapiens
aggaagguagcccagcacug

SEQ ID NO: 893868 - RNA, 21 nt, Homo sapiens
aggaauagucgcgcaagcauc

SEQ ID NO: 893869 - RNA, 13 nt, Homo sapiens
aggaauauuugca

SEQ ID NO: 893870 - RNA, 17 nt, Homo sapiens
aggaauuaaguuaggga

SEQ ID NO: 893871 - RNA, 16 nt, Homo sapiens
aggaauuugcauuuag

SEQ ID NO: 893872 - RNA, 11 nt, Homo sapiens
aggacaaugcc

SEQ ID NO: 893873 - RNA, 18 nt, Homo sapiens
aggacagccgccuggaga

SEQ ID NO: 893874 - RNA, 22 nt, Homo sapiens
aggacauucuggaaaagcaaaa

SEQ ID NO: 893875 - RNA, 19 nt, Homo sapiens
aggacccauagaugaacua

SEQ ID NO: 893876 - RNA, 18 nt, Homo sapiens
aggacccugguuacucug

SEQ ID NO: 893877 - RNA, 17 nt, Homo sapiens
aggaccugagucugcua

SEQ ID NO: 893878 - RNA, 23 nt, Homo sapiens
aggacgccacucauuucaucuca

SEQ ID NO: 893879 - RNA, 18 nt, Homo sapiens
aggacgguuaacuuguau

SEQ ID NO: 893880 - RNA, 13 nt, Homo sapiens
aggacgugucuca

SEQ ID NO: 893881 - RNA, 23 nt, Homo sapiens
aggacuagggcuuauccaugccu

SEQ ID NO: 893882 - RNA, 20 nt, Homo sapiens
aggacuuaacggcuccagga

SEQ ID NO: 893883 - RNA, 15 nt, Homo sapiens
aggacuugaacccag

SEQ ID NO: 893884 - RNA, 22 nt, Homo sapiens
aggagacgggggagcagcacga

SEQ ID NO: 893885 - RNA, 22 nt, Homo sapiens
aggagacucaccucugccucaa

SEQ ID NO: 893886 - RNA, 15 nt, Homo sapiens
aggagagggggcaag

SEQ ID NO: 893887 - RNA, 20 nt, Homo sapiens
aggagaucgagaccauccug

SEQ ID NO: 893888 - RNA, 20 nt, Homo sapiens
aggagauggaaguugcagug

SEQ ID NO: 893889 - RNA, 22 nt, Homo sapiens
aggagcaaauguuucugcagua

SEQ ID NO: 893890 - RNA, 14 nt, Homo sapiens
aggagcaauuugca

SEQ ID NO: 893891 - RNA, 14 nt, Homo sapiens
aggagcuuccagug

SEQ ID NO: 893892 - RNA, 18 nt, Homo sapiens
aggagcuuccagugcaug

SEQ ID NO: 893893 - RNA, 15 nt, Homo sapiens
aggaggacuugcagg

SEQ ID NO: 893894 - RNA, 14 nt, Homo sapiens
aggaggaguuccuc

SEQ ID NO: 893895 - RNA, 21 nt, Homo sapiens
aggaggcccuggugucaggca

SEQ ID NO: 893896 - RNA, 23 nt, Homo sapiens
aggaggcgcagcccgaagcccag

SEQ ID NO: 893897 - RNA, 18 nt, Homo sapiens
aggagggacaagaaucaa

SEQ ID NO: 893898 - RNA, 18 nt, Homo sapiens
aggagggagagaacuuaa

SEQ ID NO: 893899 - RNA, 23 nt, Homo sapiens
aggagggcgugacucacccaagc

SEQ ID NO: 893900 - RNA, 22 nt, Homo sapiens
aggaggggcccacaauggagug

SEQ ID NO: 893901 - RNA, 19 nt, Homo sapiens
aggagggguuaaagcugcc

SEQ ID NO: 893902 - RNA, 22 nt, Homo sapiens
aggagguagcucccagcacuca

SEQ ID NO: 893903 - RNA, 22 nt, Homo sapiens
aggagguuuggggucugccacc

SEQ ID NO: 893904 - RNA, 16 nt, Homo sapiens
aggaugacacugccag

SEQ ID NO: 893905 - RNA, 17 nt, Homo sapiens
aggaugaguuacuugaa

SEQ ID NO: 893906 - RNA, 21 nt, Homo sapiens
aggaugauaaaagcacuuacu

SEQ ID NO: 893907 - RNA, 15 nt, Homo sapiens
aggauggcaagcacg

SEQ ID NO: 893908 - RNA, 18 nt, Homo sapiens
aggauggcgugugugccg

SEQ ID NO: 893909 - RNA, 19 nt, Homo sapiens
aggauguggcacugcuuga

SEQ ID NO: 893910 - RNA, 21 nt, Homo sapiens
aggauuaaugguccugugaug

SEQ ID NO: 893911 - RNA, 13 nt, Homo sapiens
aggcaaaaagaca

SEQ ID NO: 893912 - RNA, 19 nt, Homo sapiens
aggcaaagugcugcuggaa

SEQ ID NO: 893913 - RNA, 14 nt, Homo sapiens
aggcaaauggcaca

SEQ ID NO: 893914 - RNA, 13 nt, Homo sapiens
aggcaaccuuccc

SEQ ID NO: 893915 - RNA, 14 nt, Homo sapiens
aggcaacugugagu

SEQ ID NO: 893916 - RNA, 19 nt, Homo sapiens
aggcaagaaccaguguuua

SEQ ID NO: 893917 - RNA, 17 nt, Homo sapiens
aggcaauacauguaucu

SEQ ID NO: 893918 - RNA, 23 nt, Homo sapiens
aggcagaauccuacaacuuccac

SEQ ID NO: 893919 - RNA, 14 nt, Homo sapiens
aggcagagaaucau

SEQ ID NO: 893920 - RNA, 16 nt, Homo sapiens
aggcagagaaucauac

SEQ ID NO: 893921 - RNA, 21 nt, Homo sapiens
aggcagagauagaaccuggag

SEQ ID NO: 893922 - RNA, 13 nt, Homo sapiens
aggcagagccuga

SEQ ID NO: 893923 - RNA, 23 nt, Homo sapiens
aggcaggaggaucacagugaccu

SEQ ID NO: 893924 - RNA, 20 nt, Homo sapiens
aggcaggaggauugcuugag

SEQ ID NO: 893925 - RNA, 19 nt, Homo sapiens
aggcaggcucccccugccu

SEQ ID NO: 893926 - RNA, 18 nt, Homo sapiens
aggcagggcaaaugacau

SEQ ID NO: 893927 - RNA, 14 nt, Homo sapiens
aggcagggucucac

SEQ ID NO: 893928 - RNA, 13 nt, Homo sapiens
ugaggcccagaaa

SEQ ID NO: 893929 - RNA, 19 nt, Homo sapiens
ugaggccgggcgcaguggc

SEQ ID NO: 893930 - RNA, 16 nt, Homo sapiens
ugaggccuuacuuaaa

SEQ ID NO: 893931 - RNA, 17 nt, Homo sapiens
ugaggcggauggcugug

SEQ ID NO: 893932 - RNA, 21 nt, Homo sapiens
ugaggcggguggaucacuuga

SEQ ID NO: 893933 - RNA, 17 nt, Homo sapiens
ugagggaaaacauaaua

SEQ ID NO: 893934 - RNA, 11 nt, Homo sapiens
ugagggucccc

SEQ ID NO: 893935 - RNA, 14 nt, Homo sapiens
ugagguacagcaga

SEQ ID NO: 893936 - RNA, 21 nt, Homo sapiens
ugagguccugaucagcuucaa

SEQ ID NO: 893937 - RNA, 16 nt, Homo sapiens
ugaguaccucaaagga

SEQ ID NO: 893938 - RNA, 16 nt, Homo sapiens
ugagucaaaagccugg

SEQ ID NO: 893939 - RNA, 14 nt, Homo sapiens
ugagucgaggacag

SEQ ID NO: 893940 - RNA, 15 nt, Homo sapiens
ugagugagccacaga

SEQ ID NO: 893941 - RNA, 22 nt, Homo sapiens
ugagugcuggauauuuuacuac

SEQ ID NO: 893942 - RNA, 16 nt, Homo sapiens
ugaguggcagccaugc

SEQ ID NO: 893943 - RNA, 19 nt, Homo sapiens
ugaguugcccaucuuguuu

SEQ ID NO: 893944 - RNA, 14 nt, Homo sapiens
ugauaaagagggau

SEQ ID NO: 893945 - RNA, 13 nt, Homo sapiens
ugauaagcaaauu

SEQ ID NO: 893946 - RNA, 19 nt, Homo sapiens
ugauacaagaaagcaaugc

SEQ ID NO: 893947 - RNA, 14 nt, Homo sapiens
ugauacauauguga

SEQ ID NO: 893948 - RNA, 11 nt, Homo sapiens
ugauagcuuua

SEQ ID NO: 893949 - RNA, 20 nt, Homo sapiens
ugauaguuaauuauuucaac

SEQ ID NO: 893950 - RNA, 14 nt, Homo sapiens
ugauauaugccuau

SEQ ID NO: 893951 - RNA, 20 nt, Homo sapiens
ugauaugaaaaauaugauau

SEQ ID NO: 893952 - RNA, 19 nt, Homo sapiens
ugauauuauggcaagugau

SEQ ID NO: 893953 - RNA, 16 nt, Homo sapiens
ugauauuuuaugcaaa

SEQ ID NO: 893954 - RNA, 17 nt, Homo sapiens
ugauauuuuuacuugca

SEQ ID NO: 893955 - RNA, 17 nt, Homo sapiens
ugaucaaaaauaaacua

SEQ ID NO: 893956 - RNA, 12 nt, Homo sapiens
ugaucaauccuu

SEQ ID NO: 893957 - RNA, 12 nt, Homo sapiens
ugaucacaguga

SEQ ID NO: 893958 - RNA, 21 nt, Homo sapiens
ugaucaggcuauguauggaau

SEQ ID NO: 893959 - RNA, 21 nt, Homo sapiens
ugauccacaaaaacaacuuau

SEQ ID NO: 893960 - RNA, 21 nt, Homo sapiens
ugaucgcgccacuacacucca

SEQ ID NO: 893961 - RNA, 17 nt, Homo sapiens
ugaucuugauugugggu

SEQ ID NO: 893962 - RNA, 13 nt, Homo sapiens
ugaugaucuuugc

SEQ ID NO: 893963 - RNA, 17 nt, Homo sapiens
ugaugauuaauucaccu

SEQ ID NO: 893964 - RNA, 13 nt, Homo sapiens
ugaugccauguaa

SEQ ID NO: 893965 - RNA, 17 nt, Homo sapiens
ugaugccccuuccccaa

SEQ ID NO: 893966 - RNA, 16 nt, Homo sapiens
ugaugcuaccaugccu

SEQ ID NO: 893967 - RNA, 21 nt, Homo sapiens
ugauggagauauuuacaugaa

SEQ ID NO: 893968 - RNA, 16 nt, Homo sapiens
ugauggccaggccaga

SEQ ID NO: 893969 - RNA, 14 nt, Homo sapiens
ugaugggguggaag

SEQ ID NO: 893970 - RNA, 11 nt, Homo sapiens
ugauggugcug

SEQ ID NO: 893971 - RNA, 13 nt, Homo sapiens
ugauguccagaag

SEQ ID NO: 893972 - RNA, 15 nt, Homo sapiens
ugauuaaaacauuau

SEQ ID NO: 893973 - RNA, 13 nt, Homo sapiens
ugauuaacuugcu

SEQ ID NO: 893974 - RNA, 21 nt, Homo sapiens
ugauuagaaggcaaguuucua

SEQ ID NO: 893975 - RNA, 15 nt, Homo sapiens
ugauuagcacuuaau

SEQ ID NO: 893976 - RNA, 21 nt, Homo sapiens
ugauuaguauucaggcacuga

SEQ ID NO: 893977 - RNA, 23 nt, Homo sapiens
ugauuauacgacuuuuaagcaaa

SEQ ID NO: 893978 - RNA, 22 nt, Homo sapiens
ugauuaugccacugcuuuccag

SEQ ID NO: 893979 - RNA, 14 nt, Homo sapiens
ugauucacuauuag

SEQ ID NO: 893980 - RNA, 18 nt, Homo sapiens
ugauucagacagcuuaug

SEQ ID NO: 893981 - RNA, 12 nt, Homo sapiens
ugauucugggau

SEQ ID NO: 893982 - RNA, 13 nt, Homo sapiens
ugauuggcucacc

SEQ ID NO: 893983 - RNA, 21 nt, Homo sapiens
ugauuguuuaauuguagguca

SEQ ID NO: 893984 - RNA, 14 nt, Homo sapiens
ugauuucagaagga

SEQ ID NO: 893985 - RNA, 14 nt, Homo sapiens
ugauuugcuaucaa

SEQ ID NO: 893986 - RNA, 13 nt, Homo sapiens
cuauuuauuucac

SEQ ID NO: 893987 - RNA, 15 nt, Homo sapiens
cuauuuccaccauca

SEQ ID NO: 893988 - RNA, 18 nt, Homo sapiens
cuauuuguuguuuuuaac

SEQ ID NO: 893989 - RNA, 19 nt, Homo sapiens
cuauuuuaagacgugaaug

SEQ ID NO: 893990 - RNA, 23 nt, Homo sapiens
cuauuuuuauuuguuugugcauu

SEQ ID NO: 893991 - RNA, 23 nt, Homo sapiens
cuauuuuuuaauaaaaguacuga

SEQ ID NO: 893992 - RNA, 17 nt, Homo sapiens
cucaaaaaaagggcaau

SEQ ID NO: 893993 - RNA, 22 nt, Homo sapiens
cucaaaauaccaugccauuuaa

SEQ ID NO: 893994 - RNA, 22 nt, Homo sapiens
cucaaagagggagugcauuuau

SEQ ID NO: 893995 - RNA, 20 nt, Homo sapiens
cucaaauaaaaagugcuuuu

SEQ ID NO: 893996 - RNA, 22 nt, Homo sapiens
cucaaaucauuuaagaaggagu

SEQ ID NO: 893997 - RNA, 13 nt, Homo sapiens
cucaaaucuccag

SEQ ID NO: 893998 - RNA, 16 nt, Homo sapiens
cucaaaugacccaaag

SEQ ID NO: 893999 - RNA, 13 nt, Homo sapiens
cucaaaugcacau

SEQ ID NO: 894000 - RNA, 14 nt, Homo sapiens
cucaaaugcuaaau

SEQ ID NO: 894001 - RNA, 20 nt, Homo sapiens
cucaacaaagcacaguguua

SEQ ID NO: 894002 - RNA, 18 nt, Homo sapiens
cucaacaauaaagacuga

SEQ ID NO: 894003 - RNA, 14 nt, Homo sapiens
cucaaccuauggua

SEQ ID NO: 894004 - RNA, 22 nt, Homo sapiens
cucaaccuccugggcuaaguga

SEQ ID NO: 894005 - RNA, 16 nt, Homo sapiens
cucaagacugaaacgg

SEQ ID NO: 894006 - RNA, 14 nt, Homo sapiens
cucaagcacuaaaa

SEQ ID NO: 894007 - RNA, 23 nt, Homo sapiens
cucaaggguuauagacugccaug

SEQ ID NO: 894008 - RNA, 19 nt, Homo sapiens
cucaagucuucccugauca

SEQ ID NO: 894009 - RNA, 22 nt, Homo sapiens
cucaagugauucuccugccuca

SEQ ID NO: 894010 - RNA, 23 nt, Homo sapiens
cucaaguuuuucagaaagcauua

SEQ ID NO: 894011 - RNA, 16 nt, Homo sapiens
cucaauaagccagcaa

SEQ ID NO: 894012 - RNA, 17 nt, Homo sapiens
cucaaucacugcucccc

SEQ ID NO: 894013 - RNA, 16 nt, Homo sapiens
cucacaagaagaccag

SEQ ID NO: 894014 - RNA, 14 nt, Homo sapiens
cucacaauuguaaa

SEQ ID NO: 894015 - RNA, 13 nt, Homo sapiens
cucacacuauggc

SEQ ID NO: 894016 - RNA, 18 nt, Homo sapiens
cucacagaagaauaugac

SEQ ID NO: 894017 - RNA, 17 nt, Homo sapiens
cucacauaucugucauu

SEQ ID NO: 894018 - RNA, 16 nt, Homo sapiens
cucacaucuguccaga

SEQ ID NO: 894019 - RNA, 14 nt, Homo sapiens
cucaccggcaugcu

SEQ ID NO: 894020 - RNA, 20 nt, Homo sapiens
cucacgccuguaaucccagc

SEQ ID NO: 894021 - RNA, 13 nt, Homo sapiens
cucacucaggacu

SEQ ID NO: 894022 - RNA, 15 nt, Homo sapiens
cucacucggcuucca

SEQ ID NO: 894023 - RNA, 20 nt, Homo sapiens
cucacucggcuuccagggag

SEQ ID NO: 894024 - RNA, 13 nt, Homo sapiens
cucacucugucac

SEQ ID NO: 894025 - RNA, 13 nt, Homo sapiens
cucacugauauau

SEQ ID NO: 894026 - RNA, 21 nt, Homo sapiens
cucacugggccuccaaccaug

SEQ ID NO: 894027 - RNA, 22 nt, Homo sapiens
cucagaagacacugaugggcaa

SEQ ID NO: 894028 - RNA, 17 nt, Homo sapiens
cucagacuguugcacuc

SEQ ID NO: 894029 - RNA, 14 nt, Homo sapiens
cucagagacuauuu

SEQ ID NO: 894030 - RNA, 15 nt, Homo sapiens
cucagaucuugacag

SEQ ID NO: 894031 - RNA, 12 nt, Homo sapiens
cucagcauaccu

SEQ ID NO: 894032 - RNA, 13 nt, Homo sapiens
cucagcauaccug

SEQ ID NO: 894033 - RNA, 21 nt, Homo sapiens
cucagcauaccugcuggugca

SEQ ID NO: 894034 - RNA, 15 nt, Homo sapiens
cucagcugcacauuc

SEQ ID NO: 894035 - RNA, 18 nt, Homo sapiens
cucagcugcucgcacaga

SEQ ID NO: 894036 - RNA, 19 nt, Homo sapiens
cucagcuucauuuccguga

SEQ ID NO: 894037 - RNA, 20 nt, Homo sapiens
cucaggacggaaggucaguu

SEQ ID NO: 894038 - RNA, 22 nt, Homo sapiens
cucaggauccagucccuuacac

SEQ ID NO: 894039 - RNA, 13 nt, Homo sapiens
cucaggauuucau

SEQ ID NO: 894040 - RNA, 17 nt, Homo sapiens
cucaggcuuccuuggca

SEQ ID NO: 894041 - RNA, 14 nt, Homo sapiens
cucagggacaacau

SEQ ID NO: 894042 - RNA, 17 nt, Homo sapiens
cucaggggugauucuga

SEQ ID NO: 894043 - RNA, 14 nt, Homo sapiens
cucagguaguacug

SEQ ID NO: 894044 - RNA, 15 nt, Homo sapiens
cucagguaguacugg

SEQ ID NO: 894045 - RNA, 19 nt, Homo sapiens
auacaagaaagcaaugcca

SEQ ID NO: 894046 - RNA, 19 nt, Homo sapiens
auacaagccacuaccuucu

SEQ ID NO: 894047 - RNA, 15 nt, Homo sapiens
auacacauacauaca

SEQ ID NO: 894048 - RNA, 15 nt, Homo sapiens
auacacauggaugca

SEQ ID NO: 894049 - RNA, 14 nt, Homo sapiens
auacagaaugaauc

SEQ ID NO: 894050 - RNA, 19 nt, Homo sapiens
auacagagguaacuaucaa

SEQ ID NO: 894051 - RNA, 22 nt, Homo sapiens
auacagcccucccccagcaguu

SEQ ID NO: 894052 - RNA, 12 nt, Homo sapiens
auacagugucuu

SEQ ID NO: 894053 - RNA, 13 nt, Homo sapiens
auacauacauaca

SEQ ID NO: 894054 - RNA, 17 nt, Homo sapiens
auaccaguacucaguau

SEQ ID NO: 894055 - RNA, 16 nt, Homo sapiens
auaccagugaaccaaa

SEQ ID NO: 894056 - RNA, 21 nt, Homo sapiens
auacccaaguuauugggaugu

SEQ ID NO: 894057 - RNA, 14 nt, Homo sapiens
auaccuaucaucuu

SEQ ID NO: 894058 - RNA, 18 nt, Homo sapiens
auaccuuuauugugaucu

SEQ ID NO: 894059 - RNA, 19 nt, Homo sapiens
auacgaaacacaaaccaca

SEQ ID NO: 894060 - RNA, 22 nt, Homo sapiens
auacgcaaacacaccgaugcac

SEQ ID NO: 894061 - RNA, 18 nt, Homo sapiens
auacgcgggcgcugccug

SEQ ID NO: 894062 - RNA, 17 nt, Homo sapiens
auacgugucugugugua

SEQ ID NO: 894063 - RNA, 18 nt, Homo sapiens
auacuaaaaaucaugaga

SEQ ID NO: 894064 - RNA, 21 nt, Homo sapiens
auacuaauugagaaacaugaa

SEQ ID NO: 894065 - RNA, 17 nt, Homo sapiens
auacuaccaagugacca

SEQ ID NO: 894066 - RNA, 16 nt, Homo sapiens
auacuaccggcuacau

SEQ ID NO: 894067 - RNA, 16 nt, Homo sapiens
auacuaucucuuguca

SEQ ID NO: 894068 - RNA, 18 nt, Homo sapiens
auacugaccuuguagcua

SEQ ID NO: 894069 - RNA, 15 nt, Homo sapiens
auacugauauuucau

SEQ ID NO: 894070 - RNA, 17 nt, Homo sapiens
auacugcaugcucagga

SEQ ID NO: 894071 - RNA, 21 nt, Homo sapiens
auacugcucaucauuccuuga

SEQ ID NO: 894072 - RNA, 14 nt, Homo sapiens
auacuggguacaag

SEQ ID NO: 894073 - RNA, 16 nt, Homo sapiens
auacuguacugagaca

SEQ ID NO: 894074 - RNA, 21 nt, Homo sapiens
auacuguacugagacauuaca

SEQ ID NO: 894075 - RNA, 14 nt, Homo sapiens
auacuucacucacu

SEQ ID NO: 894076 - RNA, 19 nt, Homo sapiens
auacuuuuuucuaguuuca

SEQ ID NO: 894077 - RNA, 16 nt, Homo sapiens
auagaaacaugacacu

SEQ ID NO: 894078 - RNA, 16 nt, Homo sapiens
auagaaagcuguuuau

SEQ ID NO: 894079 - RNA, 23 nt, Homo sapiens
auagaaauguaaaaguacucuga

SEQ ID NO: 894080 - RNA, 17 nt, Homo sapiens
auagaaugcugaacuca

SEQ ID NO: 894081 - RNA, 20 nt, Homo sapiens
auagagcuuucaaguacaug

SEQ ID NO: 894082 - RNA, 21 nt, Homo sapiens
auagagugacuccaagaacaa

SEQ ID NO: 894083 - RNA, 20 nt, Homo sapiens
auagauccuauuacuguuuc

SEQ ID NO: 894084 - RNA, 16 nt, Homo sapiens
auagaugugaucacug

SEQ ID NO: 894085 - RNA, 17 nt, Homo sapiens
auagauuaauggcacug

SEQ ID NO: 894086 - RNA, 19 nt, Homo sapiens
auagauuaauggcacugau

SEQ ID NO: 894087 - RNA, 13 nt, Homo sapiens
auagcaagacaca

SEQ ID NO: 894088 - RNA, 21 nt, Homo sapiens
auagccuaauacaacauguag

SEQ ID NO: 894089 - RNA, 17 nt, Homo sapiens
auagccuaggugacaga

SEQ ID NO: 894090 - RNA, 18 nt, Homo sapiens
auagcuauuuucuuacag

SEQ ID NO: 894091 - RNA, 23 nt, Homo sapiens
auagcugccuuuuuuaacacuag

SEQ ID NO: 894092 - RNA, 14 nt, Homo sapiens
auagcuuccaugag

SEQ ID NO: 894093 - RNA, 13 nt, Homo sapiens
auaggacaauuca

SEQ ID NO: 894094 - RNA, 17 nt, Homo sapiens
auaggcaaaaucugaca

SEQ ID NO: 894095 - RNA, 20 nt, Homo sapiens
auaggcccuggaugugccca

SEQ ID NO: 894096 - RNA, 19 nt, Homo sapiens
auagggugcaguuuuccag

SEQ ID NO: 894097 - RNA, 14 nt, Homo sapiens
auagguaugagcca

SEQ ID NO: 894098 - RNA, 19 nt, Homo sapiens
auaggucauuuucuauuca

SEQ ID NO: 894099 - RNA, 20 nt, Homo sapiens
auaggucauuuucuauucac

SEQ ID NO: 894100 - RNA, 19 nt, Homo sapiens
auaggugcuacaaaaacac

SEQ ID NO: 894101 - RNA, 17 nt, Homo sapiens
auaguaacuacuuuuua

SEQ ID NO: 894102 - RNA, 19 nt, Homo sapiens
auaguacuggcaugguacg

SEQ ID NO: 894103 - RNA, 15 nt, Homo sapiens
auaguauaccauaca

SEQ ID NO: 894104 - RNA, 14 nt, Homo sapiens
auagucacaaaaau

SEQ ID NO: 894105 - RNA, 23 nt, Homo sapiens
auagucacauggccuaugcacau

SEQ ID NO: 894106 - RNA, 17 nt, Homo sapiens
auaguccauggacaaua

SEQ ID NO: 894107 - RNA, 12 nt, Homo sapiens
auaguguccaaa

SEQ ID NO: 894108 - RNA, 23 nt, Homo sapiens
auaguguuggaaaaugugcaaua

SEQ ID NO: 894109 - RNA, 20 nt, Homo sapiens
auaguuauauuugcugauac

SEQ ID NO: 894110 - RNA, 15 nt, Homo sapiens
auaguuaugccugua

SEQ ID NO: 894111 - RNA, 18 nt, Homo sapiens
auaguuauuuacuugaaa

SEQ ID NO: 894112 - RNA, 18 nt, Homo sapiens
auaguucuaucaggaaaa

SEQ ID NO: 894113 - RNA, 15 nt, Homo sapiens
auaguucuuacuacu

SEQ ID NO: 894114 - RNA, 22 nt, Homo sapiens
auauaauguaguaugauguaau

SEQ ID NO: 894115 - RNA, 12 nt, Homo sapiens
auauacaaauag

SEQ ID NO: 894116 - RNA, 20 nt, Homo sapiens
auauacauauguagacuaua

SEQ ID NO: 894117 - RNA, 17 nt, Homo sapiens
auauaggagcaauacua

SEQ ID NO: 894118 - RNA, 18 nt, Homo sapiens
auauaguauucauuuucc

SEQ ID NO: 894119 - RNA, 16 nt, Homo sapiens
auauauaguagcauuu

SEQ ID NO: 894120 - RNA, 21 nt, Homo sapiens
auauauauguauauacauauc

SEQ ID NO: 894121 - RNA, 13 nt, Homo sapiens
auauaucaaggau

SEQ ID NO: 894122 - RNA, 16 nt, Homo sapiens
auauauuuauaacuca

SEQ ID NO: 894123 - RNA, 17 nt, Homo sapiens
auaucaaaaaguauuaa

SEQ ID NO: 894124 - RNA, 13 nt, Homo sapiens
auaucaagauguu

SEQ ID NO: 894125 - RNA, 14 nt, Homo sapiens
auaucaccucucuu

SEQ ID NO: 894126 - RNA, 14 nt, Homo sapiens
auaucacuuacuca

SEQ ID NO: 894127 - RNA, 12 nt, Homo sapiens
auaucagaaaag

SEQ ID NO: 894128 - RNA, 13 nt, Homo sapiens
auaucagagcucu

SEQ ID NO: 894129 - RNA, 21 nt, Homo sapiens
auaucaucagcauaccuuuau

SEQ ID NO: 894130 - RNA, 21 nt, Homo sapiens
auaucauccugccuucaugga

SEQ ID NO: 894131 - RNA, 23 nt, Homo sapiens
auaucaugccccuguacuccagc

SEQ ID NO: 894132 - RNA, 13 nt, Homo sapiens
auauccaagaagc

SEQ ID NO: 894133 - RNA, 12 nt, Homo sapiens
auauccacagac

SEQ ID NO: 894134 - RNA, 13 nt, Homo sapiens
auauccacaucua

SEQ ID NO: 894135 - RNA, 16 nt, Homo sapiens
auauccagauggcaug

SEQ ID NO: 894136 - RNA, 17 nt, Homo sapiens
auauccagauggcaugu

SEQ ID NO: 894137 - RNA, 21 nt, Homo sapiens
auaucugugaggugcugauga

SEQ ID NO: 894138 - RNA, 14 nt, Homo sapiens
auaucuuauguuaa

SEQ ID NO: 894139 - RNA, 15 nt, Homo sapiens
auaucuuauguuaaa

SEQ ID NO: 894140 - RNA, 14 nt, Homo sapiens
auaugaaguguuag

SEQ ID NO: 894141 - RNA, 16 nt, Homo sapiens
auaugauauguaaaca

SEQ ID NO: 894142 - RNA, 16 nt, Homo sapiens
auaugaugccuuuucc

SEQ ID NO: 894143 - RNA, 14 nt, Homo sapiens
auaugcaaagcacu

SEQ ID NO: 894144 - RNA, 21 nt, Homo sapiens
auaugcacaauagcaguugaa

SEQ ID NO: 894145 - RNA, 17 nt, Homo sapiens
auaugcacacacacgga

SEQ ID NO: 894146 - RNA, 16 nt, Homo sapiens
auaugcacacacagau

SEQ ID NO: 894147 - RNA, 20 nt, Homo sapiens
auaugcacacacagaugcac

SEQ ID NO: 894148 - RNA, 14 nt, Homo sapiens
auaugcauuaugaa

SEQ ID NO: 894149 - RNA, 18 nt, Homo sapiens
auauguagcccucaugau

SEQ ID NO: 894150 - RNA, 22 nt, Homo sapiens
auauguagcccucaugauaauc

SEQ ID NO: 894151 - RNA, 18 nt, Homo sapiens
auauguauauacauauca

SEQ ID NO: 894152 - RNA, 12 nt, Homo sapiens
auauguauauau

SEQ ID NO: 894153 - RNA, 21 nt, Homo sapiens
auauguguauauauacauaca

SEQ ID NO: 894154 - RNA, 20 nt, Homo sapiens
auauuaaaacugcacugcca

SEQ ID NO: 894155 - RNA, 17 nt, Homo sapiens
auauuauaauaauguuc

SEQ ID NO: 894156 - RNA, 15 nt, Homo sapiens
auauuaugucauuca

SEQ ID NO: 894157 - RNA, 18 nt, Homo sapiens
auauucaauaaagcugcu

SEQ ID NO: 894158 - RNA, 21 nt, Homo sapiens
auauucagagauguaccaugu

SEQ ID NO: 894159 - RNA, 22 nt, Homo sapiens
auauuccauauauuagcauuua

SEQ ID NO: 894160 - RNA, 17 nt, Homo sapiens
cucagucccaucagaga

SEQ ID NO: 894161 - RNA, 13 nt, Homo sapiens
cucagugggacaa

SEQ ID NO: 894162 - RNA, 22 nt, Homo sapiens
cucaguuagaauuuuccuaaaa

SEQ ID NO: 894163 - RNA, 17 nt, Homo sapiens
cucauacuuaagcaaaa

SEQ ID NO: 894164 - RNA, 16 nt, Homo sapiens
cucauaucuuccucau

SEQ ID NO: 894165 - RNA, 14 nt, Homo sapiens
cucaucaacaaaga

SEQ ID NO: 894166 - RNA, 13 nt, Homo sapiens
cucaucacuggau

SEQ ID NO: 894167 - RNA, 14 nt, Homo sapiens
cucaucauuccuug

SEQ ID NO: 894168 - RNA, 14 nt, Homo sapiens
cucaucccuguucc

SEQ ID NO: 894169 - RNA, 17 nt, Homo sapiens
cucaucccuguuccuca

SEQ ID NO: 894170 - RNA, 14 nt, Homo sapiens
cucauccuccuucu

SEQ ID NO: 894171 - RNA, 18 nt, Homo sapiens
cucaucuacaagcauuug

SEQ ID NO: 894172 - RNA, 12 nt, Homo sapiens
cucaucucacug

SEQ ID NO: 894173 - RNA, 12 nt, Homo sapiens
cucaucuugccc

SEQ ID NO: 894174 - RNA, 16 nt, Homo sapiens
cucaugagcacagggu

SEQ ID NO: 894175 - RNA, 16 nt, Homo sapiens
cucauuuaucccucaa

SEQ ID NO: 894176 - RNA, 13 nt, Homo sapiens
cucauuucaucuc

SEQ ID NO: 894177 - RNA, 13 nt, Homo sapiens
cucauuugucaca

SEQ ID NO: 894178 - RNA, 23 nt, Homo sapiens
cuccacaauagcagacaguguuu

SEQ ID NO: 894179 - RNA, 15 nt, Homo sapiens
cuccacagugcugcu

SEQ ID NO: 894180 - RNA, 18 nt, Homo sapiens
cuccaccaacccaucaga

SEQ ID NO: 894181 - RNA, 19 nt, Homo sapiens
cuccacccuauauguagua

SEQ ID NO: 894182 - RNA, 12 nt, Homo sapiens
cuccacccugag

SEQ ID NO: 894183 - RNA, 14 nt, Homo sapiens
cuccaccucuccuu

SEQ ID NO: 894184 - RNA, 16 nt, Homo sapiens
cuccagaacaaaccuc

SEQ ID NO: 894185 - RNA, 16 nt, Homo sapiens
cuccagcauccugcuu

SEQ ID NO: 894186 - RNA, 22 nt, Homo sapiens
cuccagccagcaaugaugucca

SEQ ID NO: 894187 - RNA, 22 nt, Homo sapiens
cuccagcucaccagccccagug

SEQ ID NO: 894188 - RNA, 17 nt, Homo sapiens
cuccaggaaggggaguu

SEQ ID NO: 894189 - RNA, 17 nt, Homo sapiens
cuccaggaugaguuacu

SEQ ID NO: 894190 - RNA, 20 nt, Homo sapiens
cuccaggaugaguuacuuga

SEQ ID NO: 894191 - RNA, 21 nt, Homo sapiens
cuccaggaugaguuacuugaa

SEQ ID NO: 894192 - RNA, 14 nt, Homo sapiens
cuccaggcucuuug

SEQ ID NO: 894193 - RNA, 22 nt, Homo sapiens
cuccagucuccugacauuaaga

SEQ ID NO: 894194 - RNA, 17 nt, Homo sapiens
cuccauacauaacuuga

SEQ ID NO: 894195 - RNA, 17 nt, Homo sapiens
cuccauauuuauuuaaa

SEQ ID NO: 894196 - RNA, 15 nt, Homo sapiens
cuccaucaugcuuga

SEQ ID NO: 894197 - RNA, 13 nt, Homo sapiens
cuccaucauggca

SEQ ID NO: 894198 - RNA, 19 nt, Homo sapiens
cuccauccggcuccuguca

SEQ ID NO: 894199 - RNA, 12 nt, Homo sapiens
cuccaucuccag

SEQ ID NO: 894200 - RNA, 15 nt, Homo sapiens
cuccaucuccagugg

SEQ ID NO: 894201 - RNA, 14 nt, Homo sapiens
cuccaucucugucu

SEQ ID NO: 894202 - RNA, 23 nt, Homo sapiens
cuccauggccaccccgugccacc

SEQ ID NO: 894203 - RNA, 15 nt, Homo sapiens
cuccauuacuaaaga

SEQ ID NO: 894204 - RNA, 19 nt, Homo sapiens
cuccauucugaccauuuca

SEQ ID NO: 894205 - RNA, 21 nt, Homo sapiens
cuccauuugcaauugaccucu

SEQ ID NO: 894206 - RNA, 21 nt, Homo sapiens
cuccauuuuacagaagcauuu

SEQ ID NO: 894207 - RNA, 16 nt, Homo sapiens
cucccaaagugcuagu

SEQ ID NO: 894208 - RNA, 16 nt, Homo sapiens
cucccacacuccccca

SEQ ID NO: 894209 - RNA, 14 nt, Homo sapiens
cucccacagaggag

SEQ ID NO: 894210 - RNA, 15 nt, Homo sapiens
cucccagcccuaugg

SEQ ID NO: 894211 - RNA, 16 nt, Homo sapiens
cucccaguucuacaag

SEQ ID NO: 894212 - RNA, 15 nt, Homo sapiens
cucccauagcacugc

SEQ ID NO: 894213 - RNA, 21 nt, Homo sapiens
cucccaucucuaccccaaaga

SEQ ID NO: 894214 - RNA, 16 nt, Homo sapiens
cucccaugcacacaaa

SEQ ID NO: 894215 - RNA, 14 nt, Homo sapiens
cuccccacacgugc

SEQ ID NO: 894216 - RNA, 13 nt, Homo sapiens
cuccccacucuag

SEQ ID NO: 894217 - RNA, 23 nt, Homo sapiens
cuccccagcccuggcucugcaau

SEQ ID NO: 894218 - RNA, 17 nt, Homo sapiens
cuccccccaacacaauc

SEQ ID NO: 894219 - RNA, 14 nt, Homo sapiens
cuccccccacugca

SEQ ID NO: 894220 - RNA, 14 nt, Homo sapiens
cuccccgccugucc

SEQ ID NO: 894221 - RNA, 23 nt, Homo sapiens
cuccccuauguaaaacuuagcaa

SEQ ID NO: 894222 - RNA, 19 nt, Homo sapiens
cuccccucccccacucuau

SEQ ID NO: 894223 - RNA, 19 nt, Homo sapiens
cuccccucugcccuguaua

SEQ ID NO: 894224 - RNA, 15 nt, Homo sapiens
cucccuggcauguca

SEQ ID NO: 894225 - RNA, 15 nt, Homo sapiens
cucccuguaacucca

SEQ ID NO: 894226 - RNA, 18 nt, Homo sapiens
cucccuguguggcugcug

SEQ ID NO: 894227 - RNA, 20 nt, Homo sapiens
cucccuguuaucugcuagau

SEQ ID NO: 894228 - RNA, 21 nt, Homo sapiens
cucccuuccugaggagcuguu

SEQ ID NO: 894229 - RNA, 19 nt, Homo sapiens
cucccuuguggcuuccuca

SEQ ID NO: 894230 - RNA, 11 nt, Homo sapiens
cuccgaauaaa

SEQ ID NO: 894231 - RNA, 13 nt, Homo sapiens
cuccgccauucca

SEQ ID NO: 894232 - RNA, 20 nt, Homo sapiens
cuccuaaacaaaaacacauu

SEQ ID NO: 894233 - RNA, 18 nt, Homo sapiens
cuccuaaauuuccagggg

SEQ ID NO: 894234 - RNA, 20 nt, Homo sapiens
cuccuaccugcugcugcuau

SEQ ID NO: 894235 - RNA, 22 nt, Homo sapiens
cuccucacaguugccauguaga

SEQ ID NO: 894236 - RNA, 21 nt, Homo sapiens
cuccucagaucugaacacagu

SEQ ID NO: 894237 - RNA, 18 nt, Homo sapiens
cuccuccaucucuggcca

SEQ ID NO: 894238 - RNA, 22 nt, Homo sapiens
cuccucuguccaggcacugcug

SEQ ID NO: 894239 - RNA, 13 nt, Homo sapiens
cuccugaaguuag

SEQ ID NO: 894240 - RNA, 23 nt, Homo sapiens
cuccugacauuaagacacaccuc

SEQ ID NO: 894241 - RNA, 20 nt, Homo sapiens
cuccugaccucaagugaucc

SEQ ID NO: 894242 - RNA, 18 nt, Homo sapiens
cuccugagcucaagugau

SEQ ID NO: 894243 - RNA, 13 nt, Homo sapiens
cuccugauggcca

SEQ ID NO: 894244 - RNA, 15 nt, Homo sapiens
cuccugcaggugucu

SEQ ID NO: 894245 - RNA, 15 nt, Homo sapiens
cuccugcccaggaga

SEQ ID NO: 894246 - RNA, 17 nt, Homo sapiens
cuccugcugccuaauaa

SEQ ID NO: 894247 - RNA, 20 nt, Homo sapiens
cuccuggccucaagugauuc

SEQ ID NO: 894248 - RNA, 14 nt, Homo sapiens
cuccugugcaacuu

SEQ ID NO: 894249 - RNA, 20 nt, Homo sapiens
cuccugugcuagaugugcaa

SEQ ID NO: 894250 - RNA, 13 nt, Homo sapiens
cuccugugugcug

SEQ ID NO: 894251 - RNA, 21 nt, Homo sapiens
cuccuguguggacguugccug

SEQ ID NO: 894252 - RNA, 19 nt, Homo sapiens
cuccuuagcaggcuaugaa

SEQ ID NO: 894253 - RNA, 13 nt, Homo sapiens
cuccuucccgccg

SEQ ID NO: 894254 - RNA, 15 nt, Homo sapiens
cuccuuccugugauu

SEQ ID NO: 894255 - RNA, 14 nt, Homo sapiens
cuccuugcacuuuc

SEQ ID NO: 894256 - RNA, 10 nt, Homo sapiens
cuccuugccu

SEQ ID NO: 894257 - RNA, 22 nt, Homo sapiens
cuccuuggugaagaacauccca

SEQ ID NO: 894258 - RNA, 14 nt, Homo sapiens
cuccuuggugccug

SEQ ID NO: 894259 - RNA, 19 nt, Homo sapiens
cuccuuucuuucuaacucc

SEQ ID NO: 894260 - RNA, 13 nt, Homo sapiens
cuccuuuugacca

SEQ ID NO: 894261 - RNA, 17 nt, Homo sapiens
cuccuuuugaccaaaua

SEQ ID NO: 894262 - RNA, 18 nt, Homo sapiens
cucgaacuccugaccuca

SEQ ID NO: 894263 - RNA, 16 nt, Homo sapiens
cucgaugaagcccaau

SEQ ID NO: 894264 - RNA, 22 nt, Homo sapiens
cucgauuauucccuguacaaua

SEQ ID NO: 894265 - RNA, 14 nt, Homo sapiens
cucgccgucuguga

SEQ ID NO: 894266 - RNA, 18 nt, Homo sapiens
cucgccuuuuaggcucag

SEQ ID NO: 894267 - RNA, 14 nt, Homo sapiens
cucgcuacaagaac

SEQ ID NO: 894268 - RNA, 17 nt, Homo sapiens
cucggccucccaaagug

SEQ ID NO: 894269 - RNA, 21 nt, Homo sapiens
cucggggcgaccccucagugc

SEQ ID NO: 894270 - RNA, 22 nt, Homo sapiens
cucgggggaaagcacaccucau

SEQ ID NO: 894271 - RNA, 21 nt, Homo sapiens
cucgggugcauuugagagaag

SEQ ID NO: 894272 - RNA, 20 nt, Homo sapiens
cucguauaugucucaggucc

SEQ ID NO: 894273 - RNA, 11 nt, Homo sapiens
cucgugccaug

SEQ ID NO: 894274 - RNA, 20 nt, Homo sapiens
cucuaaauauuucaugauuc

SEQ ID NO: 894275 - RNA, 14 nt, Homo sapiens
cucuaaaucuuccu

SEQ ID NO: 894276 - RNA, 18 nt, Homo sapiens
auauucccacagcacuaa

SEQ ID NO: 894277 - RNA, 20 nt, Homo sapiens
auauuccgggugccauuccc

SEQ ID NO: 894278 - RNA, 18 nt, Homo sapiens
auauuccuauauguagcu

SEQ ID NO: 894279 - RNA, 21 nt, Homo sapiens
auauuccugcauuugugaaau

SEQ ID NO: 894280 - RNA, 16 nt, Homo sapiens
auauucucuccacuuu

SEQ ID NO: 894281 - RNA, 16 nt, Homo sapiens
auauugaaaagauagg

SEQ ID NO: 894282 - RNA, 15 nt, Homo sapiens
auauuggacugauaa

SEQ ID NO: 894283 - RNA, 12 nt, Homo sapiens
auauuuacuacu

SEQ ID NO: 894284 - RNA, 19 nt, Homo sapiens
auauuuauagcaauccaug

SEQ ID NO: 894285 - RNA, 18 nt, Homo sapiens
auauuucaggcauacuga

SEQ ID NO: 894286 - RNA, 18 nt, Homo sapiens
auauuuccauucaugcca

SEQ ID NO: 894287 - RNA, 21 nt, Homo sapiens
auauuugcugauacuaucucu

SEQ ID NO: 894288 - RNA, 16 nt, Homo sapiens
auauuuuagccuuaaa

SEQ ID NO: 894289 - RNA, 20 nt, Homo sapiens
auauuuucccucucuugccu

SEQ ID NO: 894290 - RNA, 18 nt, Homo sapiens
auauuuuguaacuauuac

SEQ ID NO: 894291 - RNA, 14 nt, Homo sapiens
auauuuuucaacca

SEQ ID NO: 894292 - RNA, 13 nt, Homo sapiens
aucaaaacauauc

SEQ ID NO: 894293 - RNA, 14 nt, Homo sapiens
aucaaaacauauca

SEQ ID NO: 894294 - RNA, 19 nt, Homo sapiens
aucaaaacccaacaugacu

SEQ ID NO: 894295 - RNA, 16 nt, Homo sapiens
aucaaaaucacuaucu

SEQ ID NO: 894296 - RNA, 21 nt, Homo sapiens
aucaaaugccccgaauuuagu

SEQ ID NO: 894297 - RNA, 14 nt, Homo sapiens
aucaaauugcuaca

SEQ ID NO: 894298 - RNA, 13 nt, Homo sapiens
aucaacacugcgc

SEQ ID NO: 894299 - RNA, 21 nt, Homo sapiens
aucaaccauaugaauuuacua

SEQ ID NO: 894300 - RNA, 19 nt, Homo sapiens
aucaacuuauuauaugacu

SEQ ID NO: 894301 - RNA, 13 nt, Homo sapiens
aucaagcuguaca

SEQ ID NO: 894302 - RNA, 14 nt, Homo sapiens
aucaagggcuuuau

SEQ ID NO: 894303 - RNA, 18 nt, Homo sapiens
aucaaugaaaugcuuguu

SEQ ID NO: 894304 - RNA, 11 nt, Homo sapiens
aucaaugucac

SEQ ID NO: 894305 - RNA, 16 nt, Homo sapiens
aucaauuaaaggcaaa

SEQ ID NO: 894306 - RNA, 21 nt, Homo sapiens
aucaauucuauuacgugcaau

SEQ ID NO: 894307 - RNA, 22 nt, Homo sapiens
aucaauuuaccuacucuaugua

SEQ ID NO: 894308 - RNA, 16 nt, Homo sapiens
aucacaccucugggcu

SEQ ID NO: 894309 - RNA, 21 nt, Homo sapiens
aucacauagaagcuguccuug

SEQ ID NO: 894310 - RNA, 19 nt, Homo sapiens
aucaccaggaucgcuuugu

SEQ ID NO: 894311 - RNA, 15 nt, Homo sapiens
aucaccucucuucag

SEQ ID NO: 894312 - RNA, 21 nt, Homo sapiens
aucaccucuggcuuugucucu

SEQ ID NO: 894313 - RNA, 22 nt, Homo sapiens
aucaccuuuuugacuuuuccaa

SEQ ID NO: 894314 - RNA, 21 nt, Homo sapiens
aucacgccacugcacuccagc

SEQ ID NO: 894315 - RNA, 23 nt, Homo sapiens
aucacggcucacugcagccucaa

SEQ ID NO: 894316 - RNA, 19 nt, Homo sapiens
aucacuaagggauggggca

SEQ ID NO: 894317 - RNA, 23 nt, Homo sapiens
aucacuagccaugauaacugcaa

SEQ ID NO: 894318 - RNA, 20 nt, Homo sapiens
aucacugauugggugccaug

SEQ ID NO: 894319 - RNA, 22 nt, Homo sapiens
aucacuuacucaguuagaauuu

SEQ ID NO: 894320 - RNA, 17 nt, Homo sapiens
aucacuugcacuccgga

SEQ ID NO: 894321 - RNA, 17 nt, Homo sapiens
aucagaaucauugaagu

SEQ ID NO: 894322 - RNA, 16 nt, Homo sapiens
aucagacuagugacaa

SEQ ID NO: 894323 - RNA, 21 nt, Homo sapiens
aucagccuccgccauuccaag

SEQ ID NO: 894324 - RNA, 15 nt, Homo sapiens
aucagcgcccuggag

SEQ ID NO: 894325 - RNA, 21 nt, Homo sapiens
aucagcuucaaggaguaugca

SEQ ID NO: 894326 - RNA, 13 nt, Homo sapiens
aucaggauuucau

SEQ ID NO: 894327 - RNA, 20 nt, Homo sapiens
aucaggccuggcacgguggc

SEQ ID NO: 894328 - RNA, 15 nt, Homo sapiens
aucaggucauuauuu

SEQ ID NO: 894329 - RNA, 22 nt, Homo sapiens
aucaggucauuauuuuuuacaa

SEQ ID NO: 894330 - RNA, 14 nt, Homo sapiens
aucaguaugcuguu

SEQ ID NO: 894331 - RNA, 21 nt, Homo sapiens
aucagucuuggaauacuugaa

SEQ ID NO: 894332 - RNA, 15 nt, Homo sapiens
aucagugcacacgga

SEQ ID NO: 894333 - RNA, 13 nt, Homo sapiens
aucagugcaguga

SEQ ID NO: 894334 - RNA, 14 nt, Homo sapiens
aucagugcagugau

SEQ ID NO: 894335 - RNA, 15 nt, Homo sapiens
aucagugcagugaua

SEQ ID NO: 894336 - RNA, 15 nt, Homo sapiens
aucaguggcugccuu

SEQ ID NO: 894337 - RNA, 20 nt, Homo sapiens
aucaguuuuuucaccuggaa

SEQ ID NO: 894338 - RNA, 17 nt, Homo sapiens
aucauagcucacuguaa

SEQ ID NO: 894339 - RNA, 22 nt, Homo sapiens
aucauaugguugacaguaugca

SEQ ID NO: 894340 - RNA, 21 nt, Homo sapiens
aucaucaccacaccgugagca

SEQ ID NO: 894341 - RNA, 19 nt, Homo sapiens
aucauccacugugccaugu

SEQ ID NO: 894342 - RNA, 20 nt, Homo sapiens
aucaugaaaaugucuauuca

SEQ ID NO: 894343 - RNA, 19 nt, Homo sapiens
aucauguuaccauuacaaa

SEQ ID NO: 894344 - RNA, 18 nt, Homo sapiens
aucauguuggauagucag

SEQ ID NO: 894345 - RNA, 21 nt, Homo sapiens
aucauguuggauagucagcug

SEQ ID NO: 894346 - RNA, 13 nt, Homo sapiens
aucauuccuugag

SEQ ID NO: 894347 - RNA, 19 nt, Homo sapiens
aucauuuauuuacaucuau

SEQ ID NO: 894348 - RNA, 22 nt, Homo sapiens
aucauuuauuuacaucuaugua

SEQ ID NO: 894349 - RNA, 14 nt, Homo sapiens
aucauuugcaaugc

SEQ ID NO: 894350 - RNA, 17 nt, Homo sapiens
aucauuugcaaugcccu

SEQ ID NO: 894351 - RNA, 22 nt, Homo sapiens
aucauuuuaagaagacaugaca

SEQ ID NO: 894352 - RNA, 19 nt, Homo sapiens
auccaaccccccaccugcc

SEQ ID NO: 894353 - RNA, 18 nt, Homo sapiens
auccaagaaucagugaag

SEQ ID NO: 894354 - RNA, 14 nt, Homo sapiens
auccaauccucagg

SEQ ID NO: 894355 - RNA, 20 nt, Homo sapiens
auccacccucaaaugucaga

SEQ ID NO: 894356 - RNA, 17 nt, Homo sapiens
auccacgcacacaugga

SEQ ID NO: 894357 - RNA, 13 nt, Homo sapiens
auccacugcaaua

SEQ ID NO: 894358 - RNA, 11 nt, Homo sapiens
auccacugugc

SEQ ID NO: 894359 - RNA, 23 nt, Homo sapiens
auccagaacugaggucacugggu

SEQ ID NO: 894360 - RNA, 16 nt, Homo sapiens
auccagaccucuacaa

SEQ ID NO: 894361 - RNA, 18 nt, Homo sapiens
auccagaggguugugauu

SEQ ID NO: 894362 - RNA, 15 nt, Homo sapiens
auccaggugggagag

SEQ ID NO: 894363 - RNA, 17 nt, Homo sapiens
auccauaaggugcagua

SEQ ID NO: 894364 - RNA, 19 nt, Homo sapiens
auccaucaggacuugggaa

SEQ ID NO: 894365 - RNA, 21 nt, Homo sapiens
auccauuuggacaaaauggaa

SEQ ID NO: 894366 - RNA, 12 nt, Homo sapiens
aucccaagccaa

SEQ ID NO: 894367 - RNA, 14 nt, Homo sapiens
aucccaagccagaa

SEQ ID NO: 894368 - RNA, 20 nt, Homo sapiens
aucccacccaacagcucaga

SEQ ID NO: 894369 - RNA, 15 nt, Homo sapiens
aucccagcuacucaa

SEQ ID NO: 894370 - RNA, 22 nt, Homo sapiens
aucccaggaggggccucugaaa

SEQ ID NO: 894371 - RNA, 17 nt, Homo sapiens
aucccauccaucagcuc

SEQ ID NO: 894372 - RNA, 17 nt, Homo sapiens
aucccaucuaagcugca

SEQ ID NO: 894373 - RNA, 19 nt, Homo sapiens
aucccaugggggugcugca

SEQ ID NO: 894374 - RNA, 17 nt, Homo sapiens
auccccaaaaaacaaga

SEQ ID NO: 894375 - RNA, 19 nt, Homo sapiens
auccccagccuacugccuc

SEQ ID NO: 894376 - RNA, 15 nt, Homo sapiens
aucccccagccucaa

SEQ ID NO: 894377 - RNA, 22 nt, Homo sapiens
aucccgccucuucuucuucaga

SEQ ID NO: 894378 - RNA, 21 nt, Homo sapiens
aucccggaagggacuuacuua

SEQ ID NO: 894379 - RNA, 21 nt, Homo sapiens
aucccggcugucaaggggugu

SEQ ID NO: 894380 - RNA, 18 nt, Homo sapiens
aucccucugucaggguca

SEQ ID NO: 894381 - RNA, 22 nt, Homo sapiens
aucccuucccuguccaccucac

SEQ ID NO: 894382 - RNA, 13 nt, Homo sapiens
auccgaaguauga

SEQ ID NO: 894383 - RNA, 21 nt, Homo sapiens
auccuaggcuuaaaugcaaua

SEQ ID NO: 894384 - RNA, 22 nt, Homo sapiens
auccuaugguuucuccauccaa

SEQ ID NO: 894385 - RNA, 21 nt, Homo sapiens
auccucaacaacaaaccaaaa

SEQ ID NO: 894386 - RNA, 22 nt, Homo sapiens
auccucaacaacaaaccaaaac

SEQ ID NO: 894387 - RNA, 15 nt, Homo sapiens
auccucacaaccacc

SEQ ID NO: 894388 - RNA, 18 nt, Homo sapiens
auccucacaggagcagac

SEQ ID NO: 894389 - RNA, 15 nt, Homo sapiens
auccucaggauuuca

SEQ ID NO: 894390 - RNA, 17 nt, Homo sapiens
cucuaacgccugagccc

SEQ ID NO: 894391 - RNA, 17 nt, Homo sapiens
cucuaagccaacuuuaa

SEQ ID NO: 894392 - RNA, 19 nt, Homo sapiens
cucuaagccacucuuccaa

SEQ ID NO: 894393 - RNA, 17 nt, Homo sapiens
cucuacaaaaaccaaaa

SEQ ID NO: 894394 - RNA, 13 nt, Homo sapiens
cucuacgccaaag

SEQ ID NO: 894395 - RNA, 14 nt, Homo sapiens
cucuacgccaaagu

SEQ ID NO: 894396 - RNA, 20 nt, Homo sapiens
cucuacuaaaaauacaaaaa

SEQ ID NO: 894397 - RNA, 23 nt, Homo sapiens
cucuacuacuuuuacuacaguga

SEQ ID NO: 894398 - RNA, 19 nt, Homo sapiens
cucuacugcaagacuuaaa

SEQ ID NO: 894399 - RNA, 16 nt, Homo sapiens
cucuacuuaaugagau

SEQ ID NO: 894400 - RNA, 21 nt, Homo sapiens
cucuacuugaauacucucaca

SEQ ID NO: 894401 - RNA, 18 nt, Homo sapiens
cucuagagaaaagucuac

SEQ ID NO: 894402 - RNA, 17 nt, Homo sapiens
cucuagcuacacuauug

SEQ ID NO: 894403 - RNA, 15 nt, Homo sapiens
cucuauauauacaug

SEQ ID NO: 894404 - RNA, 15 nt, Homo sapiens
cucuauguggaucua

SEQ ID NO: 894405 - RNA, 22 nt, Homo sapiens
cucuauuucucucuuucuuggu

SEQ ID NO: 894406 - RNA, 17 nt, Homo sapiens
cucucaagcuagccaga

SEQ ID NO: 894407 - RNA, 15 nt, Homo sapiens
cucucaauaugcuua

SEQ ID NO: 894408 - RNA, 17 nt, Homo sapiens
cucucaauuucuggaaa

SEQ ID NO: 894409 - RNA, 15 nt, Homo sapiens
cucuccgaccagaca

SEQ ID NO: 894410 - RNA, 19 nt, Homo sapiens
cucuccuuuggccauucca

SEQ ID NO: 894411 - RNA, 16 nt, Homo sapiens
cucucuaaacccaaau

SEQ ID NO: 894412 - RNA, 12 nt, Homo sapiens
cucucucagguc

SEQ ID NO: 894413 - RNA, 13 nt, Homo sapiens
cucucucucucuu

SEQ ID NO: 894414 - RNA, 16 nt, Homo sapiens
cucucugcaaggcccu

SEQ ID NO: 894415 - RNA, 13 nt, Homo sapiens
cucucugccuauu

SEQ ID NO: 894416 - RNA, 18 nt, Homo sapiens
cucucuuagggaaaccaa

SEQ ID NO: 894417 - RNA, 23 nt, Homo sapiens
cucucuugcaggaaggacuauga

SEQ ID NO: 894418 - RNA, 22 nt, Homo sapiens
cucugaaacuuaauuacaucca

SEQ ID NO: 894419 - RNA, 16 nt, Homo sapiens
cucugaagcauguuuc

SEQ ID NO: 894420 - RNA, 19 nt, Homo sapiens
cucugaagucacaucacag

SEQ ID NO: 894421 - RNA, 22 nt, Homo sapiens
cucugaauauuuuguaauaaag

SEQ ID NO: 894422 - RNA, 21 nt, Homo sapiens
cucugacaagggcugaccugc

SEQ ID NO: 894423 - RNA, 15 nt, Homo sapiens
cucugacucuugccu

SEQ ID NO: 894424 - RNA, 14 nt, Homo sapiens
cucugagaacagac

SEQ ID NO: 894425 - RNA, 20 nt, Homo sapiens
cucugagcaaauguggcucc

SEQ ID NO: 894426 - RNA, 15 nt, Homo sapiens
cucugagugcuagcu

SEQ ID NO: 894427 - RNA, 15 nt, Homo sapiens
cucugauacccagag

SEQ ID NO: 894428 - RNA, 12 nt, Homo sapiens
cucugcacaugu

SEQ ID NO: 894429 - RNA, 14 nt, Homo sapiens
cucugcacaugucu

SEQ ID NO: 894430 - RNA, 18 nt, Homo sapiens
cucugcacuccauggcca

SEQ ID NO: 894431 - RNA, 13 nt, Homo sapiens
cucugcaucucau

SEQ ID NO: 894432 - RNA, 19 nt, Homo sapiens
cucugccagucgguuccca

SEQ ID NO: 894433 - RNA, 20 nt, Homo sapiens
cucugcccaaacauaaagag

SEQ ID NO: 894434 - RNA, 14 nt, Homo sapiens
cucugccugaaguc

SEQ ID NO: 894435 - RNA, 19 nt, Homo sapiens
cucugccugagacuuucag

SEQ ID NO: 894436 - RNA, 15 nt, Homo sapiens
cucugcugacuccau

SEQ ID NO: 894437 - RNA, 23 nt, Homo sapiens
cucugcuuuucuucccagcaaag

SEQ ID NO: 894438 - RNA, 17 nt, Homo sapiens
cucugcuuuuuccagau

SEQ ID NO: 894439 - RNA, 22 nt, Homo sapiens
cucugcuuuuuccagauucuuc

SEQ ID NO: 894440 - RNA, 14 nt, Homo sapiens
cucuggaacccagg

SEQ ID NO: 894441 - RNA, 11 nt, Homo sapiens
cucuggaccaa

SEQ ID NO: 894442 - RNA, 16 nt, Homo sapiens
cucuggaccagccugu

SEQ ID NO: 894443 - RNA, 16 nt, Homo sapiens
cucuggagagacugug

SEQ ID NO: 894444 - RNA, 22 nt, Homo sapiens
cucuggaugaagcucuggccaa

SEQ ID NO: 894445 - RNA, 22 nt, Homo sapiens
cucuggcaucucuuucugcaaa

SEQ ID NO: 894446 - RNA, 19 nt, Homo sapiens
cucuggccacugcugcaga

SEQ ID NO: 894447 - RNA, 22 nt, Homo sapiens
cucuggguagguguugaaaaug

SEQ ID NO: 894448 - RNA, 18 nt, Homo sapiens
cucugugcuuugacucac

SEQ ID NO: 894449 - RNA, 14 nt, Homo sapiens
cucugugucaggug

SEQ ID NO: 894450 - RNA, 16 nt, Homo sapiens
cucuuaaugcuguguu

SEQ ID NO: 894451 - RNA, 20 nt, Homo sapiens
cucuuaccgcgagacugaga

SEQ ID NO: 894452 - RNA, 19 nt, Homo sapiens
cucuuagcuuucucagggg

SEQ ID NO: 894453 - RNA, 15 nt, Homo sapiens
cucuuauuugguaua

SEQ ID NO: 894454 - RNA, 12 nt, Homo sapiens
cucuucaaagac

SEQ ID NO: 894455 - RNA, 21 nt, Homo sapiens
cucuucaacugaccagccucc

SEQ ID NO: 894456 - RNA, 17 nt, Homo sapiens
cucuucagccccuagug

SEQ ID NO: 894457 - RNA, 16 nt, Homo sapiens
cucuucccgggaucac

SEQ ID NO: 894458 - RNA, 20 nt, Homo sapiens
cucuucccgggaucacuuaa

SEQ ID NO: 894459 - RNA, 16 nt, Homo sapiens
cucuuccugcaaggac

SEQ ID NO: 894460 - RNA, 13 nt, Homo sapiens
cucuuccugccaa

SEQ ID NO: 894461 - RNA, 23 nt, Homo sapiens
cucuucucuuccuguaacacaag

SEQ ID NO: 894462 - RNA, 22 nt, Homo sapiens
cucuucuuccccagguccuucc

SEQ ID NO: 894463 - RNA, 20 nt, Homo sapiens
cucuugaauuccugggcuca

SEQ ID NO: 894464 - RNA, 13 nt, Homo sapiens
cucuugaggccag

SEQ ID NO: 894465 - RNA, 22 nt, Homo sapiens
cucuugagguggugccuucuca

SEQ ID NO: 894466 - RNA, 13 nt, Homo sapiens
cucuuggugccuc

SEQ ID NO: 894467 - RNA, 17 nt, Homo sapiens
cucuuuaaauggcuuua

SEQ ID NO: 894468 - RNA, 19 nt, Homo sapiens
cucuuuagcauugaagugu

SEQ ID NO: 894469 - RNA, 13 nt, Homo sapiens
cucuuuaugacug

SEQ ID NO: 894470 - RNA, 20 nt, Homo sapiens
cucuuucuuauuuuguaaua

SEQ ID NO: 894471 - RNA, 13 nt, Homo sapiens
cucuuucuugacu

SEQ ID NO: 894472 - RNA, 14 nt, Homo sapiens
cucuuuguccccaa

SEQ ID NO: 894473 - RNA, 18 nt, Homo sapiens
cucuuuugaauccaugcu

SEQ ID NO: 894474 - RNA, 19 nt, Homo sapiens
cucuuuugaauccaugcuu

SEQ ID NO: 894475 - RNA, 15 nt, Homo sapiens
cugaaaaacauucca

SEQ ID NO: 894476 - RNA, 14 nt, Homo sapiens
cugaaaacuguaaa

SEQ ID NO: 894477 - RNA, 23 nt, Homo sapiens
cugaaaaucacuauaaccaucag

SEQ ID NO: 894478 - RNA, 13 nt, Homo sapiens
cugaaaaucugga

SEQ ID NO: 894479 - RNA, 12 nt, Homo sapiens
cugaaacugugu

SEQ ID NO: 894480 - RNA, 18 nt, Homo sapiens
cugaaagacagaauguca

SEQ ID NO: 894481 - RNA, 19 nt, Homo sapiens
cugaaagacagaaugucac

SEQ ID NO: 894482 - RNA, 21 nt, Homo sapiens
cugaaagucuguguccaauua

SEQ ID NO: 894483 - RNA, 22 nt, Homo sapiens
cugaaauuauuuuuaaggauaa

SEQ ID NO: 894484 - RNA, 21 nt, Homo sapiens
cugaagaaaaugaagcccuau

SEQ ID NO: 894485 - RNA, 15 nt, Homo sapiens
cugaagaacaguaac

SEQ ID NO: 894486 - RNA, 14 nt, Homo sapiens
cugaagaccuccac

SEQ ID NO: 894487 - RNA, 16 nt, Homo sapiens
cugaagccagauccac

SEQ ID NO: 894488 - RNA, 20 nt, Homo sapiens
cugaagcgacuauaaagguu

SEQ ID NO: 894489 - RNA, 22 nt, Homo sapiens
cugaagcugacagcacuacaaa

SEQ ID NO: 894490 - RNA, 19 nt, Homo sapiens
cugaagggugacaucccag

SEQ ID NO: 894491 - RNA, 16 nt, Homo sapiens
cugaaggugcugacaa

SEQ ID NO: 894492 - RNA, 16 nt, Homo sapiens
cugaagucacaucaca

SEQ ID NO: 894493 - RNA, 17 nt, Homo sapiens
cugaauauaacaaccuu

SEQ ID NO: 894494 - RNA, 22 nt, Homo sapiens
cugaauauggacccugcugaaa

SEQ ID NO: 894495 - RNA, 13 nt, Homo sapiens
cugaaugacauau

SEQ ID NO: 894496 - RNA, 21 nt, Homo sapiens
cugaaugguuccaugccugag

SEQ ID NO: 894497 - RNA, 15 nt, Homo sapiens
cugaauucuuuucaa

SEQ ID NO: 894498 - RNA, 22 nt, Homo sapiens
cugaauuuguaagcaacuugcu

SEQ ID NO: 894499 - RNA, 14 nt, Homo sapiens
cugacaagauggaa

SEQ ID NO: 894500 - RNA, 13 nt, Homo sapiens
cugacaagcacug

SEQ ID NO: 894501 - RNA, 18 nt, Homo sapiens
cugacacacagcucuguc

SEQ ID NO: 894502 - RNA, 13 nt, Homo sapiens
cugacacaggaaa

SEQ ID NO: 894503 - RNA, 11 nt, Homo sapiens
cugacaccacc

SEQ ID NO: 894504 - RNA, 15 nt, Homo sapiens
cugacaccaccaucu

SEQ ID NO: 894505 - RNA, 22 nt, Homo sapiens
auccucugagugugaccaggca

SEQ ID NO: 894506 - RNA, 18 nt, Homo sapiens
auccugacaccaccaucu

SEQ ID NO: 894507 - RNA, 22 nt, Homo sapiens
auccugauaaacauuaaacacu

SEQ ID NO: 894508 - RNA, 21 nt, Homo sapiens
auccugaugcuguugggaaaa

SEQ ID NO: 894509 - RNA, 18 nt, Homo sapiens
auccugcuagcuguagaa

SEQ ID NO: 894510 - RNA, 22 nt, Homo sapiens
auccugcucauaacaucuuuga

SEQ ID NO: 894511 - RNA, 15 nt, Homo sapiens
auccuucaccagagc

SEQ ID NO: 894512 - RNA, 13 nt, Homo sapiens
auccuuuacuguu

SEQ ID NO: 894513 - RNA, 15 nt, Homo sapiens
auccuuuacuguuag

SEQ ID NO: 894514 - RNA, 15 nt, Homo sapiens
auccuuucuauugaa

SEQ ID NO: 894515 - RNA, 20 nt, Homo sapiens
aucgauccuggauucacuca

SEQ ID NO: 894516 - RNA, 16 nt, Homo sapiens
aucgaucuguacugua

SEQ ID NO: 894517 - RNA, 16 nt, Homo sapiens
aucgcugccuugccau

SEQ ID NO: 894518 - RNA, 16 nt, Homo sapiens
aucguuagaggagcaa

SEQ ID NO: 894519 - RNA, 14 nt, Homo sapiens
aucuaaacaaugua

SEQ ID NO: 894520 - RNA, 18 nt, Homo sapiens
aucuaaagccaguggcag

SEQ ID NO: 894521 - RNA, 14 nt, Homo sapiens
aucuaaauagcccu

SEQ ID NO: 894522 - RNA, 15 nt, Homo sapiens
aucuaauaccauccu

SEQ ID NO: 894523 - RNA, 18 nt, Homo sapiens
aucuaaucuaugcaugua

SEQ ID NO: 894524 - RNA, 14 nt, Homo sapiens
aucuaauuuauaca

SEQ ID NO: 894525 - RNA, 17 nt, Homo sapiens
aucuacagcucaccucu

SEQ ID NO: 894526 - RNA, 16 nt, Homo sapiens
aucuacccacuuacua

SEQ ID NO: 894527 - RNA, 20 nt, Homo sapiens
aucuacccacuuacuaaccu

SEQ ID NO: 894528 - RNA, 20 nt, Homo sapiens
aucuaccugcccucucucag

SEQ ID NO: 894529 - RNA, 18 nt, Homo sapiens
aucuacugagacaugacu

SEQ ID NO: 894530 - RNA, 16 nt, Homo sapiens
aucuagcuucaugccu

SEQ ID NO: 894531 - RNA, 20 nt, Homo sapiens
aucuaguucucaaucacugc

SEQ ID NO: 894532 - RNA, 12 nt, Homo sapiens
aucuaguuuacu

SEQ ID NO: 894533 - RNA, 21 nt, Homo sapiens
aucuauaaaaagaaguguucc

SEQ ID NO: 894534 - RNA, 12 nt, Homo sapiens
aucuauaucucu

SEQ ID NO: 894535 - RNA, 15 nt, Homo sapiens
aucucacaagcacuu

SEQ ID NO: 894536 - RNA, 16 nt, Homo sapiens
aucucacaagcacuuu

SEQ ID NO: 894537 - RNA, 23 nt, Homo sapiens
aucucauucccagagucagagga

SEQ ID NO: 894538 - RNA, 13 nt, Homo sapiens
aucuccaguggga

SEQ ID NO: 894539 - RNA, 21 nt, Homo sapiens
aucucgugccagggcaggcua

SEQ ID NO: 894540 - RNA, 22 nt, Homo sapiens
aucucuaacauaugauacugau

SEQ ID NO: 894541 - RNA, 16 nt, Homo sapiens
aucucuaauauggcaa

SEQ ID NO: 894542 - RNA, 16 nt, Homo sapiens
aucucuagagugagaa

SEQ ID NO: 894543 - RNA, 12 nt, Homo sapiens
aucucuaugugg

SEQ ID NO: 894544 - RNA, 13 nt, Homo sapiens
aucucucaucacu

SEQ ID NO: 894545 - RNA, 16 nt, Homo sapiens
aucucucugccuauuu

SEQ ID NO: 894546 - RNA, 15 nt, Homo sapiens
aucucugaaagcaca

SEQ ID NO: 894547 - RNA, 16 nt, Homo sapiens
aucucuuccuacccaa

SEQ ID NO: 894548 - RNA, 15 nt, Homo sapiens
aucucuuugauguca

SEQ ID NO: 894549 - RNA, 13 nt, Homo sapiens
aucugaaccacuu

SEQ ID NO: 894550 - RNA, 13 nt, Homo sapiens
aucugacaagacu

SEQ ID NO: 894551 - RNA, 23 nt, Homo sapiens
aucugacucacaagaagaccaga

SEQ ID NO: 894552 - RNA, 19 nt, Homo sapiens
aucugagaaaagcuuugaa

SEQ ID NO: 894553 - RNA, 14 nt, Homo sapiens
aucugagaagacaa

SEQ ID NO: 894554 - RNA, 13 nt, Homo sapiens
aucugagaucucc

SEQ ID NO: 894555 - RNA, 15 nt, Homo sapiens
aucugagcaaugacu

SEQ ID NO: 894556 - RNA, 15 nt, Homo sapiens
aucugauaugcagag

SEQ ID NO: 894557 - RNA, 15 nt, Homo sapiens
aucugaucugaguga

SEQ ID NO: 894558 - RNA, 14 nt, Homo sapiens
aucugcagcuaacu

SEQ ID NO: 894559 - RNA, 17 nt, Homo sapiens
aucugcauuccccgcug

SEQ ID NO: 894560 - RNA, 22 nt, Homo sapiens
aucugccuaggguccuguccau

SEQ ID NO: 894561 - RNA, 16 nt, Homo sapiens
aucugccuuuguuucu

SEQ ID NO: 894562 - RNA, 21 nt, Homo sapiens
aucugcucuuaggugcuucuu

SEQ ID NO: 894563 - RNA, 17 nt, Homo sapiens
aucuggguucacugcaa

SEQ ID NO: 894564 - RNA, 14 nt, Homo sapiens
aucuguccaaggaa

SEQ ID NO: 894565 - RNA, 17 nt, Homo sapiens
aucugugcaaauccuug

SEQ ID NO: 894566 - RNA, 16 nt, Homo sapiens
aucuguggucuucaaa

SEQ ID NO: 894567 - RNA, 22 nt, Homo sapiens
aucuguuacugaaaugaggaga

SEQ ID NO: 894568 - RNA, 20 nt, Homo sapiens
aucuguuugaucccuguuac

SEQ ID NO: 894569 - RNA, 14 nt, Homo sapiens
aucuuagcaugccu

SEQ ID NO: 894570 - RNA, 17 nt, Homo sapiens
aucuucaagguguaaaa

SEQ ID NO: 894571 - RNA, 17 nt, Homo sapiens
aucuucaaugcuuccuc

SEQ ID NO: 894572 - RNA, 20 nt, Homo sapiens
aucuucaggacuauuucacu

SEQ ID NO: 894573 - RNA, 15 nt, Homo sapiens
aucuucuuaugcaau

SEQ ID NO: 894574 - RNA, 17 nt, Homo sapiens
aucuugcacauauuuga

SEQ ID NO: 894575 - RNA, 17 nt, Homo sapiens
aucuugcucugcugaca

SEQ ID NO: 894576 - RNA, 19 nt, Homo sapiens
aucuuggacugacauuuag

SEQ ID NO: 894577 - RNA, 22 nt, Homo sapiens
aucuuguucuuuaaaaucacaa

SEQ ID NO: 894578 - RNA, 18 nt, Homo sapiens
aucuuuaaaauacacacu

SEQ ID NO: 894579 - RNA, 12 nt, Homo sapiens
aucuuucaggaa

SEQ ID NO: 894580 - RNA, 21 nt, Homo sapiens
aucuuuccucccuccucccac

SEQ ID NO: 894581 - RNA, 13 nt, Homo sapiens
aucuuucuuacua

SEQ ID NO: 894582 - RNA, 18 nt, Homo sapiens
aucuuucuuuaccugaga

SEQ ID NO: 894583 - RNA, 12 nt, Homo sapiens
aucuuugcagac

SEQ ID NO: 894584 - RNA, 14 nt, Homo sapiens
aucuuugugacagg

SEQ ID NO: 894585 - RNA, 22 nt, Homo sapiens
aucuuuuucucuaaaauagcca

SEQ ID NO: 894586 - RNA, 13 nt, Homo sapiens
augaaaaaauuag

SEQ ID NO: 894587 - RNA, 23 nt, Homo sapiens
augaaaacucauuacuuuuccau

SEQ ID NO: 894588 - RNA, 15 nt, Homo sapiens
augaaaacugaauca

SEQ ID NO: 894589 - RNA, 19 nt, Homo sapiens
augaaaacugaaucaagaa

SEQ ID NO: 894590 - RNA, 13 nt, Homo sapiens
augaaaaugucag

SEQ ID NO: 894591 - RNA, 18 nt, Homo sapiens
augaaacaaauaaucaca

SEQ ID NO: 894592 - RNA, 18 nt, Homo sapiens
augaaagacuuacaggcc

SEQ ID NO: 894593 - RNA, 12 nt, Homo sapiens
augaaagcaauc

SEQ ID NO: 894594 - RNA, 13 nt, Homo sapiens
augaaaucuugca

SEQ ID NO: 894595 - RNA, 22 nt, Homo sapiens
augaaaugaggucagagccugc

SEQ ID NO: 894596 - RNA, 16 nt, Homo sapiens
augaaaugggcuuuaa

SEQ ID NO: 894597 - RNA, 21 nt, Homo sapiens
augaacacagccugggaccag

SEQ ID NO: 894598 - RNA, 17 nt, Homo sapiens
augaacuggaccugcac

SEQ ID NO: 894599 - RNA, 13 nt, Homo sapiens
augaacuuugucc

SEQ ID NO: 894600 - RNA, 15 nt, Homo sapiens
augaagacccagugu

SEQ ID NO: 894601 - RNA, 19 nt, Homo sapiens
augaagacccaguguaaag

SEQ ID NO: 894602 - RNA, 18 nt, Homo sapiens
augaagagaagcugagaa

SEQ ID NO: 894603 - RNA, 22 nt, Homo sapiens
augaagauuuuuaauuacaaua

SEQ ID NO: 894604 - RNA, 23 nt, Homo sapiens
augaagcccguguccugccuuga

SEQ ID NO: 894605 - RNA, 18 nt, Homo sapiens
augaaggacgugucucag

SEQ ID NO: 894606 - RNA, 12 nt, Homo sapiens
augaagugcaaa

SEQ ID NO: 894607 - RNA, 13 nt, Homo sapiens
augaauacaauua

SEQ ID NO: 894608 - RNA, 20 nt, Homo sapiens
augaauagcgaaucaucuca

SEQ ID NO: 894609 - RNA, 21 nt, Homo sapiens
augaauagcgaaucaucucaa

SEQ ID NO: 894610 - RNA, 14 nt, Homo sapiens
augaaucaaagaca

SEQ ID NO: 894611 - RNA, 12 nt, Homo sapiens
augaaugcacac

SEQ ID NO: 894612 - RNA, 19 nt, Homo sapiens
augaaugugcauuucuuga

SEQ ID NO: 894613 - RNA, 18 nt, Homo sapiens
augaauguucuugguucc

SEQ ID NO: 894614 - RNA, 11 nt, Homo sapiens
augaauucuua

SEQ ID NO: 894615 - RNA, 18 nt, Homo sapiens
augaauugacagacuguu

SEQ ID NO: 894616 - RNA, 15 nt, Homo sapiens
augaauuuggccaga

SEQ ID NO: 894617 - RNA, 16 nt, Homo sapiens
augacacucuucugaa

SEQ ID NO: 894618 - RNA, 12 nt, Homo sapiens
augacacugagc

SEQ ID NO: 894619 - RNA, 18 nt, Homo sapiens
augacagcugucccuguc

SEQ ID NO: 894620 - RNA, 13 nt, Homo sapiens
augacaucacuug

SEQ ID NO: 894621 - RNA, 20 nt, Homo sapiens
cugacaccgucccucaguga

SEQ ID NO: 894622 - RNA, 21 nt, Homo sapiens
cugacacuaccuuaucaggca

SEQ ID NO: 894623 - RNA, 18 nt, Homo sapiens
cugacagauacauagaug

SEQ ID NO: 894624 - RNA, 14 nt, Homo sapiens
cugacaggccuucu

SEQ ID NO: 894625 - RNA, 14 nt, Homo sapiens
cugacagugcccag

SEQ ID NO: 894626 - RNA, 19 nt, Homo sapiens
cugacaucuccucuaucac

SEQ ID NO: 894627 - RNA, 13 nt, Homo sapiens
cugaccaaagaga

SEQ ID NO: 894628 - RNA, 23 nt, Homo sapiens
cugacccaagagguggggaccaa

SEQ ID NO: 894629 - RNA, 13 nt, Homo sapiens
cugacccacagcc

SEQ ID NO: 894630 - RNA, 20 nt, Homo sapiens
cugacccuccuccacuccac

SEQ ID NO: 894631 - RNA, 15 nt, Homo sapiens
cugaccgaguaccug

SEQ ID NO: 894632 - RNA, 14 nt, Homo sapiens
cugaccuguguucc

SEQ ID NO: 894633 - RNA, 15 nt, Homo sapiens
cugacuaacuauaag

SEQ ID NO: 894634 - RNA, 20 nt, Homo sapiens
cugacucacaagaagaccag

SEQ ID NO: 894635 - RNA, 21 nt, Homo sapiens
cugacucacaagaagaccaga

SEQ ID NO: 894636 - RNA, 12 nt, Homo sapiens
cugacucuugcc

SEQ ID NO: 894637 - RNA, 16 nt, Homo sapiens
cugacugacacaggcc

SEQ ID NO: 894638 - RNA, 20 nt, Homo sapiens
cugacuuaaguggcauuaaa

SEQ ID NO: 894639 - RNA, 15 nt, Homo sapiens
cugagaaauguucag

SEQ ID NO: 894640 - RNA, 16 nt, Homo sapiens
cugagagacccaagga

SEQ ID NO: 894641 - RNA, 22 nt, Homo sapiens
cugagcaccuacuuacaugcau

SEQ ID NO: 894642 - RNA, 13 nt, Homo sapiens
cugagcaggauuu

SEQ ID NO: 894643 - RNA, 14 nt, Homo sapiens
cugagcaguaccag

SEQ ID NO: 894644 - RNA, 20 nt, Homo sapiens
cugagccaaacacacuguaa

SEQ ID NO: 894645 - RNA, 17 nt, Homo sapiens
cugagccugccgagcaa

SEQ ID NO: 894646 - RNA, 16 nt, Homo sapiens
cugagcuagugauuug

SEQ ID NO: 894647 - RNA, 17 nt, Homo sapiens
cugagcuagugauuugc

SEQ ID NO: 894648 - RNA, 18 nt, Homo sapiens
cugagcuggaucacuuga

SEQ ID NO: 894649 - RNA, 19 nt, Homo sapiens
cugaggaagaagggauaau

SEQ ID NO: 894650 - RNA, 13 nt, Homo sapiens
cugaggaccagcc

SEQ ID NO: 894651 - RNA, 20 nt, Homo sapiens
cugaggagucugagguccug

SEQ ID NO: 894652 - RNA, 18 nt, Homo sapiens
cugaggaugugagccuga

SEQ ID NO: 894653 - RNA, 13 nt, Homo sapiens
cugaggauuucaa

SEQ ID NO: 894654 - RNA, 17 nt, Homo sapiens
cugaggcagacagcagc

SEQ ID NO: 894655 - RNA, 15 nt, Homo sapiens
cugagguccugagca

SEQ ID NO: 894656 - RNA, 21 nt, Homo sapiens
cugaguagcuaggacuauggg

SEQ ID NO: 894657 - RNA, 15 nt, Homo sapiens
cugagucugcagaug

SEQ ID NO: 894658 - RNA, 19 nt, Homo sapiens
cugagugagccacagacca

SEQ ID NO: 894659 - RNA, 15 nt, Homo sapiens
cugagugcaccacuu

SEQ ID NO: 894660 - RNA, 14 nt, Homo sapiens
cugaguggcugaaa

SEQ ID NO: 894661 - RNA, 13 nt, Homo sapiens
cugaguggggcca

SEQ ID NO: 894662 - RNA, 18 nt, Homo sapiens
cugauaugggacugagcc

SEQ ID NO: 894663 - RNA, 22 nt, Homo sapiens
cugaucagcaugggaaugugcc

SEQ ID NO: 894664 - RNA, 14 nt, Homo sapiens
cugaucauuacaug

SEQ ID NO: 894665 - RNA, 14 nt, Homo sapiens
cugaucgugcuaaa

SEQ ID NO: 894666 - RNA, 22 nt, Homo sapiens
cugaugaaaaauaugugcuuga

SEQ ID NO: 894667 - RNA, 15 nt, Homo sapiens
cugaugacuugcuua

SEQ ID NO: 894668 - RNA, 18 nt, Homo sapiens
cugaugagaaaggccuga

SEQ ID NO: 894669 - RNA, 21 nt, Homo sapiens
cugaugagagagugcugagaa

SEQ ID NO: 894670 - RNA, 21 nt, Homo sapiens
cugauggaccgggugggccug

SEQ ID NO: 894671 - RNA, 12 nt, Homo sapiens
cugaugggacau

SEQ ID NO: 894672 - RNA, 21 nt, Homo sapiens
cugauguaguuaaguauuuac

SEQ ID NO: 894673 - RNA, 15 nt, Homo sapiens
cugauuccacuuuua

SEQ ID NO: 894674 - RNA, 19 nt, Homo sapiens
cugauuuuuagcuuuacaa

SEQ ID NO: 894675 - RNA, 13 nt, Homo sapiens
cugcaacggaauu

SEQ ID NO: 894676 - RNA, 15 nt, Homo sapiens
cugcaagaaguacau

SEQ ID NO: 894677 - RNA, 19 nt, Homo sapiens
cugcaaggauucagcauua

SEQ ID NO: 894678 - RNA, 17 nt, Homo sapiens
cugcaagugacaucucu

SEQ ID NO: 894679 - RNA, 20 nt, Homo sapiens
cugcaauacuaauugagaaa

SEQ ID NO: 894680 - RNA, 17 nt, Homo sapiens
cugcaauuuuaauugau

SEQ ID NO: 894681 - RNA, 21 nt, Homo sapiens
cugcacaaagcccuuccaugu

SEQ ID NO: 894682 - RNA, 19 nt, Homo sapiens
cugcacaugucuuguacau

SEQ ID NO: 894683 - RNA, 12 nt, Homo sapiens
cugcacauuccu

SEQ ID NO: 894684 - RNA, 20 nt, Homo sapiens
cugcacauuuuguacaaaga

SEQ ID NO: 894685 - RNA, 17 nt, Homo sapiens
cugcaccgagagagaug

SEQ ID NO: 894686 - RNA, 19 nt, Homo sapiens
cugcacuccagaauccaca

SEQ ID NO: 894687 - RNA, 16 nt, Homo sapiens
cugcacuccauggcca

SEQ ID NO: 894688 - RNA, 14 nt, Homo sapiens
cugcacuugcagac

SEQ ID NO: 894689 - RNA, 19 nt, Homo sapiens
cugcagagcugacccagag

SEQ ID NO: 894690 - RNA, 16 nt, Homo sapiens
cugcagcuuccuguca

SEQ ID NO: 894691 - RNA, 15 nt, Homo sapiens
cugcaggaaucaaaa

SEQ ID NO: 894692 - RNA, 23 nt, Homo sapiens
cugcaggcaaagugagacugaca

SEQ ID NO: 894693 - RNA, 21 nt, Homo sapiens
cugcaguagucucugugcuuu

SEQ ID NO: 894694 - RNA, 14 nt, Homo sapiens
cugcauaaucauau

SEQ ID NO: 894695 - RNA, 21 nt, Homo sapiens
cugcauccccuuggcugugag

SEQ ID NO: 894696 - RNA, 15 nt, Homo sapiens
cugcaugcucaggac

SEQ ID NO: 894697 - RNA, 14 nt, Homo sapiens
cugcauguucugcu

SEQ ID NO: 894698 - RNA, 19 nt, Homo sapiens
cugcauuugugucaucuug

SEQ ID NO: 894699 - RNA, 16 nt, Homo sapiens
cugccaaggaugacac

SEQ ID NO: 894700 - RNA, 19 nt, Homo sapiens
cugccaccacgucugccag

SEQ ID NO: 894701 - RNA, 17 nt, Homo sapiens
cugccaccagucacugu

SEQ ID NO: 894702 - RNA, 15 nt, Homo sapiens
cugccacccuugacg

SEQ ID NO: 894703 - RNA, 21 nt, Homo sapiens
cugccagagcccaagugccau

SEQ ID NO: 894704 - RNA, 14 nt, Homo sapiens
cugccagagcuuug

SEQ ID NO: 894705 - RNA, 14 nt, Homo sapiens
cugccauaaagcca

SEQ ID NO: 894706 - RNA, 17 nt, Homo sapiens
cugccauaaagccauuc

SEQ ID NO: 894707 - RNA, 17 nt, Homo sapiens
cugccaugccacugcca

SEQ ID NO: 894708 - RNA, 23 nt, Homo sapiens
cugccccacuucucuacucugga

SEQ ID NO: 894709 - RNA, 14 nt, Homo sapiens
cugcccucucucag

SEQ ID NO: 894710 - RNA, 17 nt, Homo sapiens
cugcccugcucugggga

SEQ ID NO: 894711 - RNA, 16 nt, Homo sapiens
cugccgcugcaccacg

SEQ ID NO: 894712 - RNA, 15 nt, Homo sapiens
cugccggcccaguga

SEQ ID NO: 894713 - RNA, 18 nt, Homo sapiens
cugccuaaguggcugcug

SEQ ID NO: 894714 - RNA, 15 nt, Homo sapiens
cugccucccuagcuu

SEQ ID NO: 894715 - RNA, 15 nt, Homo sapiens
cugccuccucuucaa

SEQ ID NO: 894716 - RNA, 19 nt, Homo sapiens
cugccucuccagcacuucu

SEQ ID NO: 894717 - RNA, 23 nt, Homo sapiens
cugccucugccaugcccagagaa

SEQ ID NO: 894718 - RNA, 15 nt, Homo sapiens
cugccugaagucaca

SEQ ID NO: 894719 - RNA, 16 nt, Homo sapiens
cugccugcuccaagaa

SEQ ID NO: 894720 - RNA, 22 nt, Homo sapiens
cugccugugcaugaccugauca

SEQ ID NO: 894721 - RNA, 18 nt, Homo sapiens
cugccuugaagccacuga

SEQ ID NO: 894722 - RNA, 14 nt, Homo sapiens
cugccuugaugaag

SEQ ID NO: 894723 - RNA, 23 nt, Homo sapiens
cugccuuuuaucugcccagaauu

SEQ ID NO: 894724 - RNA, 18 nt, Homo sapiens
cugccuuuuuuaacacua

SEQ ID NO: 894725 - RNA, 15 nt, Homo sapiens
cugcgagcauuuccc

SEQ ID NO: 894726 - RNA, 13 nt, Homo sapiens
cugcgggggagug

SEQ ID NO: 894727 - RNA, 17 nt, Homo sapiens
cugcuaauagcugcuag

SEQ ID NO: 894728 - RNA, 22 nt, Homo sapiens
cugcuacaccuuagcagcucuu

SEQ ID NO: 894729 - RNA, 16 nt, Homo sapiens
cugcuaccucacuggg

SEQ ID NO: 894730 - RNA, 22 nt, Homo sapiens
cugcucaagagaagcacaugaa

SEQ ID NO: 894731 - RNA, 12 nt, Homo sapiens
cugcuccagaga

SEQ ID NO: 894732 - RNA, 15 nt, Homo sapiens
cugcuccgagucuuc

SEQ ID NO: 894733 - RNA, 20 nt, Homo sapiens
cugcucgaagaacaauguca

SEQ ID NO: 894734 - RNA, 17 nt, Homo sapiens
cugcucugaggcuucca

SEQ ID NO: 894735 - RNA, 18 nt, Homo sapiens
cugcucugcccacuguga

SEQ ID NO: 894736 - RNA, 14 nt, Homo sapiens
augacaugcacuga

SEQ ID NO: 894737 - RNA, 23 nt, Homo sapiens
augacaugccacccucuccaugc

SEQ ID NO: 894738 - RNA, 16 nt, Homo sapiens
augaccaguucuggcc

SEQ ID NO: 894739 - RNA, 13 nt, Homo sapiens
augacccaaagac

SEQ ID NO: 894740 - RNA, 15 nt, Homo sapiens
augacccaaagacca

SEQ ID NO: 894741 - RNA, 16 nt, Homo sapiens
augacccaaagaccaa

SEQ ID NO: 894742 - RNA, 14 nt, Homo sapiens
augacccacccagu

SEQ ID NO: 894743 - RNA, 21 nt, Homo sapiens
augaccuccguguagugucug

SEQ ID NO: 894744 - RNA, 13 nt, Homo sapiens
augaccuggaaau

SEQ ID NO: 894745 - RNA, 10 nt, Homo sapiens
augacuaugc

SEQ ID NO: 894746 - RNA, 16 nt, Homo sapiens
augacugaugacauau

SEQ ID NO: 894747 - RNA, 21 nt, Homo sapiens
augacuucugccccagcuuua

SEQ ID NO: 894748 - RNA, 19 nt, Homo sapiens
augacuugggcacccccag

SEQ ID NO: 894749 - RNA, 17 nt, Homo sapiens
augagaugacauucacc

SEQ ID NO: 894750 - RNA, 18 nt, Homo sapiens
augagcaaggacaaccug

SEQ ID NO: 894751 - RNA, 20 nt, Homo sapiens
augagcacacacacaccaau

SEQ ID NO: 894752 - RNA, 17 nt, Homo sapiens
augagcaccccuaugcc

SEQ ID NO: 894753 - RNA, 17 nt, Homo sapiens
augagcaugaacugucc

SEQ ID NO: 894754 - RNA, 13 nt, Homo sapiens
augaggauaucau

SEQ ID NO: 894755 - RNA, 18 nt, Homo sapiens
augagugauucuugacau

SEQ ID NO: 894756 - RNA, 16 nt, Homo sapiens
augaguuuauauggaa

SEQ ID NO: 894757 - RNA, 22 nt, Homo sapiens
augaguuuuugauagcuuuauu

SEQ ID NO: 894758 - RNA, 15 nt, Homo sapiens
augauaaaagcacuu

SEQ ID NO: 894759 - RNA, 14 nt, Homo sapiens
augauaaugaaacu

SEQ ID NO: 894760 - RNA, 20 nt, Homo sapiens
augauaauggaaagcagcag

SEQ ID NO: 894761 - RNA, 14 nt, Homo sapiens
augauagcuacugu

SEQ ID NO: 894762 - RNA, 17 nt, Homo sapiens
augauauuuuaugcaaa

SEQ ID NO: 894763 - RNA, 14 nt, Homo sapiens
augaucacggcuca

SEQ ID NO: 894764 - RNA, 20 nt, Homo sapiens
augaucacggcucacugcag

SEQ ID NO: 894765 - RNA, 13 nt, Homo sapiens
augaucucccugc

SEQ ID NO: 894766 - RNA, 19 nt, Homo sapiens
augaugagaguuucuguua

SEQ ID NO: 894767 - RNA, 19 nt, Homo sapiens
augaugagcuccucuuccu

SEQ ID NO: 894768 - RNA, 22 nt, Homo sapiens
augaugaguaacuuaaccagca

SEQ ID NO: 894769 - RNA, 19 nt, Homo sapiens
augaugaucuuuaaaauac

SEQ ID NO: 894770 - RNA, 18 nt, Homo sapiens
augaugcuaccaugccuc

SEQ ID NO: 894771 - RNA, 14 nt, Homo sapiens
augauggugcugac

SEQ ID NO: 894772 - RNA, 19 nt, Homo sapiens
augaugugaguacccagga

SEQ ID NO: 894773 - RNA, 20 nt, Homo sapiens
augauuagcacuuaauaauu

SEQ ID NO: 894774 - RNA, 22 nt, Homo sapiens
augauucagaaauuuucauuca

SEQ ID NO: 894775 - RNA, 15 nt, Homo sapiens
augauuccuugagca

SEQ ID NO: 894776 - RNA, 21 nt, Homo sapiens
augauuccuugagcauuuuau

SEQ ID NO: 894777 - RNA, 18 nt, Homo sapiens
augauuuagguacgucaa

SEQ ID NO: 894778 - RNA, 22 nt, Homo sapiens
augauuuccuggggcacagugg

SEQ ID NO: 894779 - RNA, 17 nt, Homo sapiens
augcaaaaaaucuucca

SEQ ID NO: 894780 - RNA, 16 nt, Homo sapiens
augcaaaagucuuccu

SEQ ID NO: 894781 - RNA, 14 nt, Homo sapiens
augcaaagcacuga

SEQ ID NO: 894782 - RNA, 15 nt, Homo sapiens
augcaaaguagcaau

SEQ ID NO: 894783 - RNA, 16 nt, Homo sapiens
augcaaaguagcaauu

SEQ ID NO: 894784 - RNA, 23 nt, Homo sapiens
augcaagugcuaugccaagccau

SEQ ID NO: 894785 - RNA, 21 nt, Homo sapiens
augcacacaaacaccuccuag

SEQ ID NO: 894786 - RNA, 20 nt, Homo sapiens
augcacacacagaugcacac

SEQ ID NO: 894787 - RNA, 22 nt, Homo sapiens
augcacacacauggaugagcac

SEQ ID NO: 894788 - RNA, 16 nt, Homo sapiens
augcacagagauaugc

SEQ ID NO: 894789 - RNA, 17 nt, Homo sapiens
augcacagagauaugca

SEQ ID NO: 894790 - RNA, 19 nt, Homo sapiens
augcacauccauucccaag

SEQ ID NO: 894791 - RNA, 13 nt, Homo sapiens
augcacaucucau

SEQ ID NO: 894792 - RNA, 12 nt, Homo sapiens
augcacauguaa

SEQ ID NO: 894793 - RNA, 23 nt, Homo sapiens
augcacugugacaccagaauaau

SEQ ID NO: 894794 - RNA, 18 nt, Homo sapiens
augcaguauugagcacug

SEQ ID NO: 894795 - RNA, 18 nt, Homo sapiens
augcagugguaugaucac

SEQ ID NO: 894796 - RNA, 20 nt, Homo sapiens
augcauaggaaguauggcau

SEQ ID NO: 894797 - RNA, 15 nt, Homo sapiens
augcauauacuuuaa

SEQ ID NO: 894798 - RNA, 14 nt, Homo sapiens
augcauuacugcau

SEQ ID NO: 894799 - RNA, 14 nt, Homo sapiens
augcauucauccaa

SEQ ID NO: 894800 - RNA, 23 nt, Homo sapiens
augcauuuucaagauacauuuca

SEQ ID NO: 894801 - RNA, 17 nt, Homo sapiens
augccaagaaaguauuu

SEQ ID NO: 894802 - RNA, 17 nt, Homo sapiens
augccaccuccuggaag

SEQ ID NO: 894803 - RNA, 11 nt, Homo sapiens
augccacugcu

SEQ ID NO: 894804 - RNA, 14 nt, Homo sapiens
augccacuucccag

SEQ ID NO: 894805 - RNA, 19 nt, Homo sapiens
augccagggacugacaaaa

SEQ ID NO: 894806 - RNA, 23 nt, Homo sapiens
augccagugaaacuucaagcaaa

SEQ ID NO: 894807 - RNA, 13 nt, Homo sapiens
augccaucuguuu

SEQ ID NO: 894808 - RNA, 14 nt, Homo sapiens
augcccaaccuaag

SEQ ID NO: 894809 - RNA, 16 nt, Homo sapiens
augcccagagaaucag

SEQ ID NO: 894810 - RNA, 20 nt, Homo sapiens
augccccgaauuuagucaca

SEQ ID NO: 894811 - RNA, 16 nt, Homo sapiens
augccggggacagaga

SEQ ID NO: 894812 - RNA, 22 nt, Homo sapiens
augccuaauaaacaauucaagu

SEQ ID NO: 894813 - RNA, 19 nt, Homo sapiens
augccuaauauuuaggcaa

SEQ ID NO: 894814 - RNA, 18 nt, Homo sapiens
augccuauaaaaugccca

SEQ ID NO: 894815 - RNA, 20 nt, Homo sapiens
augccuauguacucuacgcc

SEQ ID NO: 894816 - RNA, 15 nt, Homo sapiens
augccuuaagccaau

SEQ ID NO: 894817 - RNA, 19 nt, Homo sapiens
augccuucacuuuacaaau

SEQ ID NO: 894818 - RNA, 22 nt, Homo sapiens
augccuuucuguaaccaaaaau

SEQ ID NO: 894819 - RNA, 16 nt, Homo sapiens
augcgcacaaggcuga

SEQ ID NO: 894820 - RNA, 14 nt, Homo sapiens
augcuaccaugccu

SEQ ID NO: 894821 - RNA, 22 nt, Homo sapiens
augcuaguuugaccucauuugu

SEQ ID NO: 894822 - RNA, 23 nt, Homo sapiens
augcugaaaaucaaaguaaaaaa

SEQ ID NO: 894823 - RNA, 18 nt, Homo sapiens
augcugcaaauaaauuca

SEQ ID NO: 894824 - RNA, 17 nt, Homo sapiens
augcuggccuguggcag

SEQ ID NO: 894825 - RNA, 16 nt, Homo sapiens
augcuggcuguuggcu

SEQ ID NO: 894826 - RNA, 16 nt, Homo sapiens
augcuggguguugcau

SEQ ID NO: 894827 - RNA, 15 nt, Homo sapiens
augcugugcucuuug

SEQ ID NO: 894828 - RNA, 19 nt, Homo sapiens
augcuuauuguacuuguua

SEQ ID NO: 894829 - RNA, 11 nt, Homo sapiens
augcuuuacaa

SEQ ID NO: 894830 - RNA, 21 nt, Homo sapiens
augcuuuccuuuucuuccuuc

SEQ ID NO: 894831 - RNA, 15 nt, Homo sapiens
augcuuugcuucaaa

SEQ ID NO: 894832 - RNA, 23 nt, Homo sapiens
augcuuuguuuccauucuugucc

SEQ ID NO: 894833 - RNA, 23 nt, Homo sapiens
auggaaaagcccagugaccugac

SEQ ID NO: 894834 - RNA, 14 nt, Homo sapiens
auggaacagugcag

SEQ ID NO: 894835 - RNA, 17 nt, Homo sapiens
auggaagaaaugggaga

SEQ ID NO: 894836 - RNA, 13 nt, Homo sapiens
auggaagugucug

SEQ ID NO: 894837 - RNA, 18 nt, Homo sapiens
auggacgaacaggggcca

SEQ ID NO: 894838 - RNA, 14 nt, Homo sapiens
auggacucuucccc

SEQ ID NO: 894839 - RNA, 17 nt, Homo sapiens
auggacucuucccccac

SEQ ID NO: 894840 - RNA, 12 nt, Homo sapiens
auggagaagcuc

SEQ ID NO: 894841 - RNA, 19 nt, Homo sapiens
auggagaggcggccucgug

SEQ ID NO: 894842 - RNA, 18 nt, Homo sapiens
auggagaggggguacaau

SEQ ID NO: 894843 - RNA, 18 nt, Homo sapiens
auggagccagcucugcau

SEQ ID NO: 894844 - RNA, 18 nt, Homo sapiens
auggagggagccaucccu

SEQ ID NO: 894845 - RNA, 14 nt, Homo sapiens
auggauagucuguc

SEQ ID NO: 894846 - RNA, 15 nt, Homo sapiens
auggaugcguggaua

SEQ ID NO: 894847 - RNA, 23 nt, Homo sapiens
auggauuugaugaaagugcaaag

SEQ ID NO: 894848 - RNA, 22 nt, Homo sapiens
auggcaccacugcacuccagcc

SEQ ID NO: 894849 - RNA, 21 nt, Homo sapiens
auggcaguccagccagcuccu

SEQ ID NO: 894850 - RNA, 23 nt, Homo sapiens
auggcauugaacugguucaugaa

SEQ ID NO: 894851 - RNA, 14 nt, Homo sapiens
cugcucugcuauau

SEQ ID NO: 894852 - RNA, 21 nt, Homo sapiens
cugcugacaggauguggcacu

SEQ ID NO: 894853 - RNA, 19 nt, Homo sapiens
cugcugagcugcgugccac

SEQ ID NO: 894854 - RNA, 18 nt, Homo sapiens
cugcugagugcaccacuu

SEQ ID NO: 894855 - RNA, 21 nt, Homo sapiens
cugcugcagacaccugccuua

SEQ ID NO: 894856 - RNA, 12 nt, Homo sapiens
cugcugcugcua

SEQ ID NO: 894857 - RNA, 12 nt, Homo sapiens
cugcuguguagc

SEQ ID NO: 894858 - RNA, 18 nt, Homo sapiens
cugcugugugaauuccca

SEQ ID NO: 894859 - RNA, 19 nt, Homo sapiens
cugcuucacaaaccuugcu

SEQ ID NO: 894860 - RNA, 22 nt, Homo sapiens
cugcuucuuuucacuucagagc

SEQ ID NO: 894861 - RNA, 15 nt, Homo sapiens
cugcuugcacuuugu

SEQ ID NO: 894862 - RNA, 19 nt, Homo sapiens
cugcuuuucugaggacuca

SEQ ID NO: 894863 - RNA, 19 nt, Homo sapiens
cugcuuuuugacaugaaca

SEQ ID NO: 894864 - RNA, 16 nt, Homo sapiens
cuggaaaagcacuuua

SEQ ID NO: 894865 - RNA, 20 nt, Homo sapiens
cuggaaaccacacuucuuga

SEQ ID NO: 894866 - RNA, 23 nt, Homo sapiens
cuggaaaggcucagucucaggag

SEQ ID NO: 894867 - RNA, 20 nt, Homo sapiens
cuggaaaucuggauuuucag

SEQ ID NO: 894868 - RNA, 12 nt, Homo sapiens
cuggaacccagg

SEQ ID NO: 894869 - RNA, 16 nt, Homo sapiens
cuggaacugucucuca

SEQ ID NO: 894870 - RNA, 23 nt, Homo sapiens
cuggaagcauguaggagaaucca

SEQ ID NO: 894871 - RNA, 23 nt, Homo sapiens
cuggaaggucaauuucaguguau

SEQ ID NO: 894872 - RNA, 23 nt, Homo sapiens
cuggaauaagaagcaaauaaaua

SEQ ID NO: 894873 - RNA, 16 nt, Homo sapiens
cuggaaucaauuuccc

SEQ ID NO: 894874 - RNA, 18 nt, Homo sapiens
cuggacccuccacuucaa

SEQ ID NO: 894875 - RNA, 18 nt, Homo sapiens
cuggacggggacugggga

SEQ ID NO: 894876 - RNA, 20 nt, Homo sapiens
cuggacuggguuuugucucu

SEQ ID NO: 894877 - RNA, 11 nt, Homo sapiens
cuggacuguca

SEQ ID NO: 894878 - RNA, 14 nt, Homo sapiens
cuggagaugaugau

SEQ ID NO: 894879 - RNA, 17 nt, Homo sapiens
cuggagcaaaagucauu

SEQ ID NO: 894880 - RNA, 17 nt, Homo sapiens
cuggaggcaaauuucag

SEQ ID NO: 894881 - RNA, 21 nt, Homo sapiens
cuggaggcagaaucccggcug

SEQ ID NO: 894882 - RNA, 16 nt, Homo sapiens
cuggaggucacauuca

SEQ ID NO: 894883 - RNA, 17 nt, Homo sapiens
cuggaggugggagacaa

SEQ ID NO: 894884 - RNA, 20 nt, Homo sapiens
cuggagugcaguggugcgau

SEQ ID NO: 894885 - RNA, 19 nt, Homo sapiens
cuggauaccagauauuuga

SEQ ID NO: 894886 - RNA, 19 nt, Homo sapiens
cuggaucucacaagcacuu

SEQ ID NO: 894887 - RNA, 17 nt, Homo sapiens
cuggaucucagccucug

SEQ ID NO: 894888 - RNA, 13 nt, Homo sapiens
cuggauggcacca

SEQ ID NO: 894889 - RNA, 17 nt, Homo sapiens
cuggauggcaccagagg

SEQ ID NO: 894890 - RNA, 23 nt, Homo sapiens
cuggaugugcccacagggaccaa

SEQ ID NO: 894891 - RNA, 15 nt, Homo sapiens
cuggcacaggacuga

SEQ ID NO: 894892 - RNA, 15 nt, Homo sapiens
cuggcacaguuuucu

SEQ ID NO: 894893 - RNA, 15 nt, Homo sapiens
cuggcacuccccuga

SEQ ID NO: 894894 - RNA, 20 nt, Homo sapiens
cuggcacuuagcccaagagg

SEQ ID NO: 894895 - RNA, 19 nt, Homo sapiens
cuggcaguugaauggggcg

SEQ ID NO: 894896 - RNA, 20 nt, Homo sapiens
cuggcaucuuucaacaauga

SEQ ID NO: 894897 - RNA, 15 nt, Homo sapiens
cuggcaugacacucu

SEQ ID NO: 894898 - RNA, 21 nt, Homo sapiens
cuggccaaccaaagacacugu

SEQ ID NO: 894899 - RNA, 16 nt, Homo sapiens
cuggccucaagcaauc

SEQ ID NO: 894900 - RNA, 22 nt, Homo sapiens
cuggccuugucaggacccaggc

SEQ ID NO: 894901 - RNA, 20 nt, Homo sapiens
cuggcgugcaguggugcgau

SEQ ID NO: 894902 - RNA, 14 nt, Homo sapiens
cuggcucucagaag

SEQ ID NO: 894903 - RNA, 18 nt, Homo sapiens
cuggcugagcugaaccca

SEQ ID NO: 894904 - RNA, 21 nt, Homo sapiens
agggaagagagggguacauuu

SEQ ID NO: 894905 - RNA, 13 nt, Homo sapiens
agggaagcaggga

SEQ ID NO: 894906 - RNA, 13 nt, Homo sapiens
agggaagccaaaa

SEQ ID NO: 894907 - RNA, 19 nt, Homo sapiens
agggaaggcugcuguguag

SEQ ID NO: 894908 - RNA, 10 nt, Homo sapiens
agggacacac

SEQ ID NO: 894909 - RNA, 19 nt, Homo sapiens
agggacacguuaggaaugu

SEQ ID NO: 894910 - RNA, 14 nt, Homo sapiens
agggacacuuaccc

SEQ ID NO: 894911 - RNA, 17 nt, Homo sapiens
agggagacugcaucuca

SEQ ID NO: 894912 - RNA, 21 nt, Homo sapiens
agggagcaacucuccacucca

SEQ ID NO: 894913 - RNA, 16 nt, Homo sapiens
agggagccgagaucac

SEQ ID NO: 894914 - RNA, 14 nt, Homo sapiens
agggagcucacucc

SEQ ID NO: 894915 - RNA, 16 nt, Homo sapiens
agggaggccgaagcua

SEQ ID NO: 894916 - RNA, 15 nt, Homo sapiens
agggagggcucugag

SEQ ID NO: 894917 - RNA, 16 nt, Homo sapiens
agggagggcucugagg

SEQ ID NO: 894918 - RNA, 22 nt, Homo sapiens
agggaucuugcauucccagugg

SEQ ID NO: 894919 - RNA, 15 nt, Homo sapiens
agggaugaccuggag

SEQ ID NO: 894920 - RNA, 17 nt, Homo sapiens
agggaugcugccugagu

SEQ ID NO: 894921 - RNA, 16 nt, Homo sapiens
agggauguaacuauug

SEQ ID NO: 894922 - RNA, 21 nt, Homo sapiens
agggcaagaaggaaauagcca

SEQ ID NO: 894923 - RNA, 23 nt, Homo sapiens
agggcaaguguucccaaauugac

SEQ ID NO: 894924 - RNA, 15 nt, Homo sapiens
agggcaaucuugucc

SEQ ID NO: 894925 - RNA, 12 nt, Homo sapiens
agggcacugggu

SEQ ID NO: 894926 - RNA, 21 nt, Homo sapiens
agggcaggcuugccaccgggg

SEQ ID NO: 894927 - RNA, 22 nt, Homo sapiens
agggcaggcuugccaccgggga

SEQ ID NO: 894928 - RNA, 20 nt, Homo sapiens
agggcaguaucucucugccu

SEQ ID NO: 894929 - RNA, 18 nt, Homo sapiens
agggccaggauuccucuc

SEQ ID NO: 894930 - RNA, 22 nt, Homo sapiens
agggccaggauuccucucucag

SEQ ID NO: 894931 - RNA, 10 nt, Homo sapiens
agggccaguc

SEQ ID NO: 894932 - RNA, 18 nt, Homo sapiens
agggccccucccucugcc

SEQ ID NO: 894933 - RNA, 19 nt, Homo sapiens
agggcgaguucagcaaaga

SEQ ID NO: 894934 - RNA, 14 nt, Homo sapiens
agggcuagaaccua

SEQ ID NO: 894935 - RNA, 17 nt, Homo sapiens
agggcuagaaccuggag

SEQ ID NO: 894936 - RNA, 20 nt, Homo sapiens
agggcucccgagucaugcac

SEQ ID NO: 894937 - RNA, 14 nt, Homo sapiens
agggcucuuugaug

SEQ ID NO: 894938 - RNA, 15 nt, Homo sapiens
agggcugaaagccau

SEQ ID NO: 894939 - RNA, 13 nt, Homo sapiens
agggcugccugaa

SEQ ID NO: 894940 - RNA, 20 nt, Homo sapiens
agggcuggcugcuggaagaa

SEQ ID NO: 894941 - RNA, 17 nt, Homo sapiens
aggggaggaucacugga

SEQ ID NO: 894942 - RNA, 21 nt, Homo sapiens
aggggcaaagaaaagccagag

SEQ ID NO: 894943 - RNA, 17 nt, Homo sapiens
aggggcaaagaacugcc

SEQ ID NO: 894944 - RNA, 23 nt, Homo sapiens
aggggcaggccugggacccagcu

SEQ ID NO: 894945 - RNA, 16 nt, Homo sapiens
aggggccgagccauuu

SEQ ID NO: 894946 - RNA, 16 nt, Homo sapiens
aggggcucagcaaggu

SEQ ID NO: 894947 - RNA, 19 nt, Homo sapiens
aggggcucagcaaggugug

SEQ ID NO: 894948 - RNA, 18 nt, Homo sapiens
agggggugugucugcuca

SEQ ID NO: 894949 - RNA, 12 nt, Homo sapiens
aggggguugugg

SEQ ID NO: 894950 - RNA, 17 nt, Homo sapiens
aggggugauuucagaga

SEQ ID NO: 894951 - RNA, 22 nt, Homo sapiens
agggguugcgggggagcuggaa

SEQ ID NO: 894952 - RNA, 16 nt, Homo sapiens
aggguaccuugaacac

SEQ ID NO: 894953 - RNA, 18 nt, Homo sapiens
aggguaugggaagccaua

SEQ ID NO: 894954 - RNA, 17 nt, Homo sapiens
aggguauuaauaugcua

SEQ ID NO: 894955 - RNA, 23 nt, Homo sapiens
agggucacuaaccaagccagaaa

SEQ ID NO: 894956 - RNA, 13 nt, Homo sapiens
agggucucuucag

SEQ ID NO: 894957 - RNA, 19 nt, Homo sapiens
agggucuggaacaccaggc

SEQ ID NO: 894958 - RNA, 17 nt, Homo sapiens
agggugggaagcuugcu

SEQ ID NO: 894959 - RNA, 23 nt, Homo sapiens
agguaauccuauuaaaacacagc

SEQ ID NO: 894960 - RNA, 14 nt, Homo sapiens
aggucaaugccaga

SEQ ID NO: 894961 - RNA, 16 nt, Homo sapiens
aggucagagaugggcu

SEQ ID NO: 894962 - RNA, 14 nt, Homo sapiens
aggucagguguuca

SEQ ID NO: 894963 - RNA, 17 nt, Homo sapiens
aggucauagcagugcuu

SEQ ID NO: 894964 - RNA, 16 nt, Homo sapiens
aggucauuacuaacca

SEQ ID NO: 894965 - RNA, 19 nt, Homo sapiens
aggucauuacuaaccauag

SEQ ID NO: 894966 - RNA, 18 nt, Homo sapiens
aggucccaccuccauuug

SEQ ID NO: 894967 - RNA, 16 nt, Homo sapiens
aggucccugcuuaccu

SEQ ID NO: 894968 - RNA, 22 nt, Homo sapiens
agguccgcccgaccaggaucag

SEQ ID NO: 894969 - RNA, 14 nt, Homo sapiens
agguccggaggggu

SEQ ID NO: 894970 - RNA, 21 nt, Homo sapiens
agguccucccgggagcacaga

SEQ ID NO: 894971 - RNA, 22 nt, Homo sapiens
agguccuccucucucuacuuga

SEQ ID NO: 894972 - RNA, 20 nt, Homo sapiens
agguccucuacuuaaugaga

SEQ ID NO: 894973 - RNA, 14 nt, Homo sapiens
aggucuaaugauau

SEQ ID NO: 894974 - RNA, 11 nt, Homo sapiens
aggucucagcc

SEQ ID NO: 894975 - RNA, 21 nt, Homo sapiens
aggucuugccugaauccauca

SEQ ID NO: 894976 - RNA, 15 nt, Homo sapiens
aggugaccccagggc

SEQ ID NO: 894977 - RNA, 15 nt, Homo sapiens
aggugagaccaccuc

SEQ ID NO: 894978 - RNA, 16 nt, Homo sapiens
aggugauccacccacc

SEQ ID NO: 894979 - RNA, 20 nt, Homo sapiens
aggugauccacccaccucag

SEQ ID NO: 894980 - RNA, 23 nt, Homo sapiens
aggugauccacccaccuuggccu

SEQ ID NO: 894981 - RNA, 13 nt, Homo sapiens
aggugcaagccac

SEQ ID NO: 894982 - RNA, 19 nt, Homo sapiens
aggugcaagccacuauguc

SEQ ID NO: 894983 - RNA, 13 nt, Homo sapiens
agguggcucucca

SEQ ID NO: 894984 - RNA, 17 nt, Homo sapiens
aggugggcagcagcuca

SEQ ID NO: 894985 - RNA, 16 nt, Homo sapiens
agguggugccuucuca

SEQ ID NO: 894986 - RNA, 20 nt, Homo sapiens
agguguggccugcacugggu

SEQ ID NO: 894987 - RNA, 13 nt, Homo sapiens
agguuagaaccua

SEQ ID NO: 894988 - RNA, 21 nt, Homo sapiens
agguuaggaaggcagcauucc

SEQ ID NO: 894989 - RNA, 18 nt, Homo sapiens
agguuaucaaccauauga

SEQ ID NO: 894990 - RNA, 12 nt, Homo sapiens
agguuccaguga

SEQ ID NO: 894991 - RNA, 14 nt, Homo sapiens
agguucuuuccaug

SEQ ID NO: 894992 - RNA, 13 nt, Homo sapiens
agguugcagugag

SEQ ID NO: 894993 - RNA, 20 nt, Homo sapiens
agguugcagugagccaugau

SEQ ID NO: 894994 - RNA, 16 nt, Homo sapiens
agguugccugggccac

SEQ ID NO: 894995 - RNA, 21 nt, Homo sapiens
agguuggccuuacgaaauccu

SEQ ID NO: 894996 - RNA, 15 nt, Homo sapiens
uccugcccucuggga

SEQ ID NO: 894997 - RNA, 14 nt, Homo sapiens
uccugccucaggcu

SEQ ID NO: 894998 - RNA, 18 nt, Homo sapiens
uccugccuccagcacucc

SEQ ID NO: 894999 - RNA, 19 nt, Homo sapiens
uccugccuccagcacuccc

SEQ ID NO: 895000 - RNA, 19 nt, Homo sapiens
uccugccucuacugggaag

SEQ ID NO: 895001 - RNA, 13 nt, Homo sapiens
uccugccuugaug

SEQ ID NO: 895002 - RNA, 22 nt, Homo sapiens
uccugcuacacaaaagccaaaa

SEQ ID NO: 895003 - RNA, 16 nt, Homo sapiens
uccugcuagcuguaga

SEQ ID NO: 895004 - RNA, 13 nt, Homo sapiens
uccugcucucuuc

SEQ ID NO: 895005 - RNA, 13 nt, Homo sapiens
uccugcugccuaa

SEQ ID NO: 895006 - RNA, 23 nt, Homo sapiens
uccuggaaccaaucccgugaaag

SEQ ID NO: 895007 - RNA, 17 nt, Homo sapiens
uccuggcaugacacucu

SEQ ID NO: 895008 - RNA, 16 nt, Homo sapiens
uccuggcuaacacgug

SEQ ID NO: 895009 - RNA, 18 nt, Homo sapiens
uccuggcuaacacgugaa

SEQ ID NO: 895010 - RNA, 22 nt, Homo sapiens
uccuggcuggaccagccacugu

SEQ ID NO: 895011 - RNA, 20 nt, Homo sapiens
uccugggaccauggacacau

SEQ ID NO: 895012 - RNA, 18 nt, Homo sapiens
uccugggagaaccucagg

SEQ ID NO: 895013 - RNA, 20 nt, Homo sapiens
uccugggagaaccucaggcu

SEQ ID NO: 895014 - RNA, 16 nt, Homo sapiens
uccugggagugagcug

SEQ ID NO: 895015 - RNA, 18 nt, Homo sapiens
uccuggguggacuuuuga

SEQ ID NO: 895016 - RNA, 16 nt, Homo sapiens
uccuggugauucugau

SEQ ID NO: 895017 - RNA, 16 nt, Homo sapiens
uccuguacauuucaca

SEQ ID NO: 895018 - RNA, 17 nt, Homo sapiens
uccuguauaaauacuga

SEQ ID NO: 895019 - RNA, 22 nt, Homo sapiens
uccuguauucuacagcagauac

SEQ ID NO: 895020 - RNA, 13 nt, Homo sapiens
uccuguccaugcc

SEQ ID NO: 895021 - RNA, 22 nt, Homo sapiens
uccugucuuggaaggacuacua

SEQ ID NO: 895022 - RNA, 14 nt, Homo sapiens
uccugugaauuucu

SEQ ID NO: 895023 - RNA, 18 nt, Homo sapiens
uccugugcuggacuguuu

SEQ ID NO: 895024 - RNA, 19 nt, Homo sapiens
uccuguguggaagaaggaa

SEQ ID NO: 895025 - RNA, 22 nt, Homo sapiens
uccugugugugcgccuacagga

SEQ ID NO: 895026 - RNA, 19 nt, Homo sapiens
uccuguuucuugcucugag

SEQ ID NO: 895027 - RNA, 18 nt, Homo sapiens
uccuuagcuuagaccuca

SEQ ID NO: 895028 - RNA, 18 nt, Homo sapiens
uccuuaggaacagcucuu

SEQ ID NO: 895029 - RNA, 22 nt, Homo sapiens
uccuuauuuaucaacaucuuuu

SEQ ID NO: 895030 - RNA, 16 nt, Homo sapiens
uccuucccccaucccc

SEQ ID NO: 895031 - RNA, 15 nt, Homo sapiens
uccuucccugggaag

SEQ ID NO: 895032 - RNA, 14 nt, Homo sapiens
uccuuccuucccug

SEQ ID NO: 895033 - RNA, 17 nt, Homo sapiens
uccuugauacugcucau

SEQ ID NO: 895034 - RNA, 13 nt, Homo sapiens
uccuugauucaca

SEQ ID NO: 895035 - RNA, 19 nt, Homo sapiens
uccuuggaaauacuuuauc

SEQ ID NO: 895036 - RNA, 23 nt, Homo sapiens
uccuuggggcacagucauucaca

SEQ ID NO: 895037 - RNA, 20 nt, Homo sapiens
uccuugugguuuaugucauc

SEQ ID NO: 895038 - RNA, 17 nt, Homo sapiens
uccuuuaccuaccaccu

SEQ ID NO: 895039 - RNA, 15 nt, Homo sapiens
uccuuuacuaaucca

SEQ ID NO: 895040 - RNA, 21 nt, Homo sapiens
uccuuuaucaagaagucugaa

SEQ ID NO: 895041 - RNA, 23 nt, Homo sapiens
uccuuugaguuauaguuugcuuu

SEQ ID NO: 895042 - RNA, 16 nt, Homo sapiens
uccuuuggccauucca

SEQ ID NO: 895043 - RNA, 18 nt, Homo sapiens
uccuuuuagguagaauuu

SEQ ID NO: 895044 - RNA, 17 nt, Homo sapiens
uccuuuugaccaaauaa

SEQ ID NO: 895045 - RNA, 18 nt, Homo sapiens
uccuuuuucaacuuggaa

SEQ ID NO: 895046 - RNA, 23 nt, Homo sapiens
ucgaaaauucauuucacauuaau

SEQ ID NO: 895047 - RNA, 20 nt, Homo sapiens
ucgaaccaaggcagccucca

SEQ ID NO: 895048 - RNA, 19 nt, Homo sapiens
ucgaccacuuuucaguuca

SEQ ID NO: 895049 - RNA, 16 nt, Homo sapiens
ucgagaccaaccugac

SEQ ID NO: 895050 - RNA, 23 nt, Homo sapiens
ucgaguaacuuuaaaaaaaucau

SEQ ID NO: 895051 - RNA, 15 nt, Homo sapiens
ucgagucuaccucuu

SEQ ID NO: 895052 - RNA, 15 nt, Homo sapiens
ucgaguuuacuucau

SEQ ID NO: 895053 - RNA, 16 nt, Homo sapiens
ucgauucaaacugcuc

SEQ ID NO: 895054 - RNA, 22 nt, Homo sapiens
ucgauuucaccaagaaguggag

SEQ ID NO: 895055 - RNA, 11 nt, Homo sapiens
ucgcaucucag

SEQ ID NO: 895056 - RNA, 20 nt, Homo sapiens
ucgcccacaaacugauuucu

SEQ ID NO: 895057 - RNA, 17 nt, Homo sapiens
ucgcccaggagacaucc

SEQ ID NO: 895058 - RNA, 17 nt, Homo sapiens
ucgcucuugggagucag

SEQ ID NO: 895059 - RNA, 18 nt, Homo sapiens
ucgcugccaggacaccug

SEQ ID NO: 895060 - RNA, 12 nt, Homo sapiens
ucgcugugaaaa

SEQ ID NO: 895061 - RNA, 19 nt, Homo sapiens
ucggcaucgggccaucuca

SEQ ID NO: 895062 - RNA, 14 nt, Homo sapiens
ucgggaacaguguu

SEQ ID NO: 895063 - RNA, 17 nt, Homo sapiens
ucgggaggcugaggcag

SEQ ID NO: 895064 - RNA, 22 nt, Homo sapiens
ucggggaacuccuggaaauauc

SEQ ID NO: 895065 - RNA, 10 nt, Homo sapiens
ucguagccaa

SEQ ID NO: 895066 - RNA, 15 nt, Homo sapiens
ucgugacaacacuug

SEQ ID NO: 895067 - RNA, 17 nt, Homo sapiens
ucuaaaaagacuaaccu

SEQ ID NO: 895068 - RNA, 24 nt, Homo sapiens
ucuaaacauuuugggguuagaccu

SEQ ID NO: 895069 - RNA, 22 nt, Homo sapiens
ucuaaauauuucaugauucaca

SEQ ID NO: 895070 - RNA, 23 nt, Homo sapiens
ucuaaaugaagugcaaauuugau

SEQ ID NO: 895071 - RNA, 19 nt, Homo sapiens
ucuaacauaugauacugau

SEQ ID NO: 895072 - RNA, 20 nt, Homo sapiens
ucuaacuagaaaucugccaa

SEQ ID NO: 895073 - RNA, 12 nt, Homo sapiens
ucuaacucuccc

SEQ ID NO: 895074 - RNA, 20 nt, Homo sapiens
ucuaagguaguaacuuucca

SEQ ID NO: 895075 - RNA, 16 nt, Homo sapiens
ucuaaguaaaaccaca

SEQ ID NO: 895076 - RNA, 19 nt, Homo sapiens
ucuaaguaaaaccacagca

SEQ ID NO: 895077 - RNA, 18 nt, Homo sapiens
ucuaagugguauauacau

SEQ ID NO: 895078 - RNA, 17 nt, Homo sapiens
ucuaaguucauguuugu

SEQ ID NO: 895079 - RNA, 22 nt, Homo sapiens
ucuaaucuuuuaauguauuugu

SEQ ID NO: 895080 - RNA, 20 nt, Homo sapiens
ucuacaaaaaauaaaaacac

SEQ ID NO: 895081 - RNA, 14 nt, Homo sapiens
ucuacaaaggccau

SEQ ID NO: 895082 - RNA, 13 nt, Homo sapiens
ucuacaaccagag

SEQ ID NO: 895083 - RNA, 19 nt, Homo sapiens
ucuacacauacugcaugcu

SEQ ID NO: 895084 - RNA, 14 nt, Homo sapiens
ucuacagaggccau

SEQ ID NO: 895085 - RNA, 15 nt, Homo sapiens
ucuacauacuaugga

SEQ ID NO: 895086 - RNA, 16 nt, Homo sapiens
ucuaccauuugaauuu

SEQ ID NO: 895087 - RNA, 20 nt, Homo sapiens
ucuacccggcccagagaccc

SEQ ID NO: 895088 - RNA, 20 nt, Homo sapiens
ucuaccucugucacccgagc

SEQ ID NO: 895089 - RNA, 22 nt, Homo sapiens
ucuaccugaccaacaguuccuu

SEQ ID NO: 895090 - RNA, 14 nt, Homo sapiens
ucuaccugcaagau

SEQ ID NO: 895091 - RNA, 18 nt, Homo sapiens
ucuaccugcccucucuca

SEQ ID NO: 895092 - RNA, 16 nt, Homo sapiens
ucuaccuggucucucc

SEQ ID NO: 895093 - RNA, 12 nt, Homo sapiens
ugucgcaucuca

SEQ ID NO: 895094 - RNA, 13 nt, Homo sapiens
ugucgucuuuaug

SEQ ID NO: 895095 - RNA, 18 nt, Homo sapiens
ugucucaacuacucagcu

SEQ ID NO: 895096 - RNA, 16 nt, Homo sapiens
ugucucagaccacuau

SEQ ID NO: 895097 - RNA, 17 nt, Homo sapiens
ugucucuagccacuuug

SEQ ID NO: 895098 - RNA, 16 nt, Homo sapiens
ugucucucucuguccu

SEQ ID NO: 895099 - RNA, 16 nt, Homo sapiens
ugucucugcaucucau

SEQ ID NO: 895100 - RNA, 19 nt, Homo sapiens
ugucugaacggcugaauau

SEQ ID NO: 895101 - RNA, 14 nt, Homo sapiens
ugucugcacccagg

SEQ ID NO: 895102 - RNA, 12 nt, Homo sapiens
ugucugccacag

SEQ ID NO: 895103 - RNA, 19 nt, Homo sapiens
ugucugccagccagcagcc

SEQ ID NO: 895104 - RNA, 17 nt, Homo sapiens
ugucugcucaguaauuu

SEQ ID NO: 895105 - RNA, 18 nt, Homo sapiens
ugucuggaaaagcacuuu

SEQ ID NO: 895106 - RNA, 15 nt, Homo sapiens
ugucuggaagcugag

SEQ ID NO: 895107 - RNA, 17 nt, Homo sapiens
ugucugucaccagcuau

SEQ ID NO: 895108 - RNA, 15 nt, Homo sapiens
ugucuguuaacuuaa

SEQ ID NO: 895109 - RNA, 22 nt, Homo sapiens
ugucuguuuuuguaacuuaaaa

SEQ ID NO: 895110 - RNA, 22 nt, Homo sapiens
ugucuuacagagaaaagacaua

SEQ ID NO: 895111 - RNA, 23 nt, Homo sapiens
ugucuuacagagaaaagacauaa

SEQ ID NO: 895112 - RNA, 22 nt, Homo sapiens
ugucuucagccucuccaggcac

SEQ ID NO: 895113 - RNA, 12 nt, Homo sapiens
ugucuuccauaa

SEQ ID NO: 895114 - RNA, 15 nt, Homo sapiens
ugucuugccagccag

SEQ ID NO: 895115 - RNA, 17 nt, Homo sapiens
ugucuugccagccagaa

SEQ ID NO: 895116 - RNA, 22 nt, Homo sapiens
ugucuuguccccucuugaccca

SEQ ID NO: 895117 - RNA, 22 nt, Homo sapiens
ugucuuugacuugguuaaagga

SEQ ID NO: 895118 - RNA, 16 nt, Homo sapiens
ugugaaagaaccaaaa

SEQ ID NO: 895119 - RNA, 21 nt, Homo sapiens
ugugaaaggaagcuccacugu

SEQ ID NO: 895120 - RNA, 22 nt, Homo sapiens
ugugaaaguaugugauaucuga

SEQ ID NO: 895121 - RNA, 12 nt, Homo sapiens
ugugaaagucag

SEQ ID NO: 895122 - RNA, 19 nt, Homo sapiens
ugugaacacaucagcuugc

SEQ ID NO: 895123 - RNA, 22 nt, Homo sapiens
ugugaauaaaaacccuguaugg

SEQ ID NO: 895124 - RNA, 21 nt, Homo sapiens
ugugaauagucugugugcaca

SEQ ID NO: 895125 - RNA, 12 nt, Homo sapiens
ugugaaugaccu

SEQ ID NO: 895126 - RNA, 13 nt, Homo sapiens
ugugacacauaug

SEQ ID NO: 895127 - RNA, 15 nt, Homo sapiens
ugugacagucuugca

SEQ ID NO: 895128 - RNA, 18 nt, Homo sapiens
ugugacagucuugcauuc

SEQ ID NO: 895129 - RNA, 18 nt, Homo sapiens
ugugaccaaaaguuacau

SEQ ID NO: 895130 - RNA, 19 nt, Homo sapiens
ugugaccacauacguguua

SEQ ID NO: 895131 - RNA, 15 nt, Homo sapiens
ugugacuauguucca

SEQ ID NO: 895132 - RNA, 17 nt, Homo sapiens
ugugacugccaaggugu

SEQ ID NO: 895133 - RNA, 19 nt, Homo sapiens
ugugacuuuuucagaguug

SEQ ID NO: 895134 - RNA, 20 nt, Homo sapiens
ugugacuuuuucagaguugc

SEQ ID NO: 895135 - RNA, 21 nt, Homo sapiens
ugugaguugcacagcuaugaa

SEQ ID NO: 895136 - RNA, 14 nt, Homo sapiens
ugugauauaugcau

SEQ ID NO: 895137 - RNA, 20 nt, Homo sapiens
ugugauuuuaauuugauaca

SEQ ID NO: 895138 - RNA, 13 nt, Homo sapiens
ugugcagacugug

SEQ ID NO: 895139 - RNA, 20 nt, Homo sapiens
ugugcagguuuugaaaaugu

SEQ ID NO: 895140 - RNA, 19 nt, Homo sapiens
ugugcaguuaauacuuaac

SEQ ID NO: 895141 - RNA, 23 nt, Homo sapiens
ugugccaaacuaccguucccaaa

SEQ ID NO: 895142 - RNA, 11 nt, Homo sapiens
ugugccagcuc

SEQ ID NO: 895143 - RNA, 15 nt, Homo sapiens
ugugccccaugucca

SEQ ID NO: 895144 - RNA, 22 nt, Homo sapiens
ugugccccauguccaaguccaa

SEQ ID NO: 895145 - RNA, 22 nt, Homo sapiens
ugugccuuaggaaaagcauuug

SEQ ID NO: 895146 - RNA, 15 nt, Homo sapiens
ugugcgccuacagga

SEQ ID NO: 895147 - RNA, 12 nt, Homo sapiens
ugugcuauugaa

SEQ ID NO: 895148 - RNA, 17 nt, Homo sapiens
ugugcucuucugucugc

SEQ ID NO: 895149 - RNA, 15 nt, Homo sapiens
ugugcuucacauaau

SEQ ID NO: 895150 - RNA, 14 nt, Homo sapiens
uguggaaaaaucca

SEQ ID NO: 895151 - RNA, 22 nt, Homo sapiens
uguggauaaggcuuaggugcca

SEQ ID NO: 895152 - RNA, 14 nt, Homo sapiens
uguggauuccagca

SEQ ID NO: 895153 - RNA, 19 nt, Homo sapiens
uguggauuccagcauuugc

SEQ ID NO: 895154 - RNA, 15 nt, Homo sapiens
uguggccccaacaca

SEQ ID NO: 895155 - RNA, 19 nt, Homo sapiens
uguggcuaucugcauuuau

SEQ ID NO: 895156 - RNA, 17 nt, Homo sapiens
uguggcugcuagcacuu

SEQ ID NO: 895157 - RNA, 15 nt, Homo sapiens
uguggcuuaguaaua

SEQ ID NO: 895158 - RNA, 22 nt, Homo sapiens
ugugggacugacauuucucaau

SEQ ID NO: 895159 - RNA, 20 nt, Homo sapiens
ugugggcccagcuacaagga

SEQ ID NO: 895160 - RNA, 20 nt, Homo sapiens
ugugggguccccaucauccc

SEQ ID NO: 895161 - RNA, 14 nt, Homo sapiens
ugugggucugggga

SEQ ID NO: 895162 - RNA, 19 nt, Homo sapiens
uguggguguggcaguuaca

SEQ ID NO: 895163 - RNA, 20 nt, Homo sapiens
uguggguuuuuucacauaaa

SEQ ID NO: 895164 - RNA, 13 nt, Homo sapiens
ugugguacaagca

SEQ ID NO: 895165 - RNA, 16 nt, Homo sapiens
uguggugcccaugagg

SEQ ID NO: 895166 - RNA, 19 nt, Homo sapiens
ugugguuaaugccauggac

SEQ ID NO: 895167 - RNA, 22 nt, Homo sapiens
ugugguuaaugccauggacaga

SEQ ID NO: 895168 - RNA, 13 nt, Homo sapiens
ugugguuuacuag

SEQ ID NO: 895169 - RNA, 14 nt, Homo sapiens
ugugguuuauguca

SEQ ID NO: 895170 - RNA, 13 nt, Homo sapiens
uguguacagggaa

SEQ ID NO: 895171 - RNA, 22 nt, Homo sapiens
uguguacccacuccucacugcc

SEQ ID NO: 895172 - RNA, 22 nt, Homo sapiens
uguguacucuuuauuucuagca

SEQ ID NO: 895173 - RNA, 22 nt, Homo sapiens
uguguagcucuguccacucuga

SEQ ID NO: 895174 - RNA, 11 nt, Homo sapiens
uguguauauau

SEQ ID NO: 895175 - RNA, 22 nt, Homo sapiens
uguguauauauaguagcauuuc

SEQ ID NO: 895176 - RNA, 14 nt, Homo sapiens
ugugucaaugccac

SEQ ID NO: 895177 - RNA, 15 nt, Homo sapiens
ugugucaaugccaca

SEQ ID NO: 895178 - RNA, 16 nt, Homo sapiens
uguguccccaccucag

SEQ ID NO: 895179 - RNA, 19 nt, Homo sapiens
uguguccccaccucaggcu

SEQ ID NO: 895180 - RNA, 22 nt, Homo sapiens
uguguccguggaaccaguccua

SEQ ID NO: 895181 - RNA, 18 nt, Homo sapiens
uguguccuugugugcauu

SEQ ID NO: 895182 - RNA, 21 nt, Homo sapiens
ugugucgauuucaccaagaag

SEQ ID NO: 895183 - RNA, 13 nt, Homo sapiens
ugugugcauguau

SEQ ID NO: 895184 - RNA, 12 nt, Homo sapiens
uguguggcugcu

SEQ ID NO: 895185 - RNA, 13 nt, Homo sapiens
uguguuaguaaua

SEQ ID NO: 895186 - RNA, 16 nt, Homo sapiens
uguguucacacuguaa

SEQ ID NO: 895187 - RNA, 17 nt, Homo sapiens
uguguucacacuguaaa

SEQ ID NO: 895188 - RNA, 13 nt, Homo sapiens
uguguucagugcc

SEQ ID NO: 895189 - RNA, 19 nt, Homo sapiens
uguguuccuaacauaaaau

SEQ ID NO: 895190 - RNA, 18 nt, Homo sapiens
uguguucucuauugcugc

SEQ ID NO: 895191 - RNA, 13 nt, Homo sapiens
uguguugggaccu

SEQ ID NO: 895192 - RNA, 14 nt, Homo sapiens
uguguuuccuucag

SEQ ID NO: 895193 - RNA, 13 nt, Homo sapiens
uguuaaaauaacu

SEQ ID NO: 895194 - RNA, 16 nt, Homo sapiens
uguuaaacaugcuaaa

SEQ ID NO: 895195 - RNA, 20 nt, Homo sapiens
uguuaaauauuuacauauga

SEQ ID NO: 895196 - RNA, 12 nt, Homo sapiens
uguuaacaaugc

SEQ ID NO: 895197 - RNA, 14 nt, Homo sapiens
uguuaauaucuuga

SEQ ID NO: 895198 - RNA, 17 nt, Homo sapiens
uguuagauuccucuugc

SEQ ID NO: 895199 - RNA, 18 nt, Homo sapiens
uguuaggaagggacugca

SEQ ID NO: 895200 - RNA, 19 nt, Homo sapiens
uguuagugugugugcaugu

SEQ ID NO: 895201 - RNA, 19 nt, Homo sapiens
uguuauguuugcacuuugu

SEQ ID NO: 895202 - RNA, 12 nt, Homo sapiens
uguucaauguuu

SEQ ID NO: 895203 - RNA, 21 nt, Homo sapiens
uucgaggcgguuuccaggaag

SEQ ID NO: 895204 - RNA, 15 nt, Homo sapiens
uucgagguggaucac

SEQ ID NO: 895205 - RNA, 23 nt, Homo sapiens
uucgauacaccgggccuggagaa

SEQ ID NO: 895206 - RNA, 16 nt, Homo sapiens
uucgcugccaggacac

SEQ ID NO: 895207 - RNA, 18 nt, Homo sapiens
uucguggagcccagcgag

SEQ ID NO: 895208 - RNA, 16 nt, Homo sapiens
uucuaaauugagauuc

SEQ ID NO: 895209 - RNA, 14 nt, Homo sapiens
uucuaacuguaaau

SEQ ID NO: 895210 - RNA, 22 nt, Homo sapiens
uucuaagugguauauacauaug

SEQ ID NO: 895211 - RNA, 14 nt, Homo sapiens
uucuacagcagaua

SEQ ID NO: 895212 - RNA, 22 nt, Homo sapiens
uucuaccuguguucauucuuac

SEQ ID NO: 895213 - RNA, 17 nt, Homo sapiens
uucuaggaagcuccagu

SEQ ID NO: 895214 - RNA, 21 nt, Homo sapiens
uucuaggcaguucaaagcagg

SEQ ID NO: 895215 - RNA, 15 nt, Homo sapiens
uucuaggcaucccag

SEQ ID NO: 895216 - RNA, 23 nt, Homo sapiens
uucuauauugugccaagcgaaaa

SEQ ID NO: 895217 - RNA, 21 nt, Homo sapiens
uucuaucccacccaacagcuc

SEQ ID NO: 895218 - RNA, 16 nt, Homo sapiens
uucuaucuccaaauga

SEQ ID NO: 895219 - RNA, 16 nt, Homo sapiens
uucuaugcaagccuug

SEQ ID NO: 895220 - RNA, 20 nt, Homo sapiens
uucuauggccauuacuaaca

SEQ ID NO: 895221 - RNA, 17 nt, Homo sapiens
uucuauuacgugcaaua

SEQ ID NO: 895222 - RNA, 13 nt, Homo sapiens
uucuauucaaaag

SEQ ID NO: 895223 - RNA, 20 nt, Homo sapiens
uucuauugaaaaaucaccac

SEQ ID NO: 895224 - RNA, 15 nt, Homo sapiens
uucuauuuauuuacu

SEQ ID NO: 895225 - RNA, 17 nt, Homo sapiens
uucucacacuagccuua

SEQ ID NO: 895226 - RNA, 12 nt, Homo sapiens
uucucacacugg

SEQ ID NO: 895227 - RNA, 16 nt, Homo sapiens
uucucaccauuugagu

SEQ ID NO: 895228 - RNA, 20 nt, Homo sapiens
uucucacuccuaccugguaa

SEQ ID NO: 895229 - RNA, 18 nt, Homo sapiens
uucucaggacacaggccu

SEQ ID NO: 895230 - RNA, 21 nt, Homo sapiens
uucucaucauauuguauguaa

SEQ ID NO: 895231 - RNA, 23 nt, Homo sapiens
uucuccaccaacuggagcacuga

SEQ ID NO: 895232 - RNA, 11 nt, Homo sapiens
uucuccacugg

SEQ ID NO: 895233 - RNA, 19 nt, Homo sapiens
uucuccuaggagaagcagc

SEQ ID NO: 895234 - RNA, 16 nt, Homo sapiens
uucuccugugacccca

SEQ ID NO: 895235 - RNA, 15 nt, Homo sapiens
uucuccuguugcaau

SEQ ID NO: 895236 - RNA, 16 nt, Homo sapiens
uucuccuuuugaccaa

SEQ ID NO: 895237 - RNA, 23 nt, Homo sapiens
uucucgcuggaaucaauuuccca

SEQ ID NO: 895238 - RNA, 14 nt, Homo sapiens
uucucuaaauauga

SEQ ID NO: 895239 - RNA, 23 nt, Homo sapiens
uucucucugugguggagaaccac

SEQ ID NO: 895240 - RNA, 17 nt, Homo sapiens
uucucucuuaguaacau

SEQ ID NO: 895241 - RNA, 18 nt, Homo sapiens
uucucucuuauuccacuu

SEQ ID NO: 895242 - RNA, 14 nt, Homo sapiens
uucucugaaggaca

SEQ ID NO: 895243 - RNA, 15 nt, Homo sapiens
uucugaccuccccac

SEQ ID NO: 895244 - RNA, 19 nt, Homo sapiens
uucugaugagaaaggccug

SEQ ID NO: 895245 - RNA, 19 nt, Homo sapiens
uucugcuaccucacugggg

SEQ ID NO: 895246 - RNA, 18 nt, Homo sapiens
uucugcuguauacuguac

SEQ ID NO: 895247 - RNA, 14 nt, Homo sapiens
uucuggaauguaau

SEQ ID NO: 895248 - RNA, 18 nt, Homo sapiens
uucuggagucuccagugg

SEQ ID NO: 895249 - RNA, 18 nt, Homo sapiens
uucuggccucagaccaac

SEQ ID NO: 895250 - RNA, 18 nt, Homo sapiens
uucugggaacuuccucag

SEQ ID NO: 895251 - RNA, 19 nt, Homo sapiens
uucuggguggccucgggac

SEQ ID NO: 895252 - RNA, 18 nt, Homo sapiens
uucugggugggugaaagg

SEQ ID NO: 895253 - RNA, 15 nt, Homo sapiens
uucugguuacugugg

SEQ ID NO: 895254 - RNA, 21 nt, Homo sapiens
uucuguccuuuuggcacugag

SEQ ID NO: 895255 - RNA, 12 nt, Homo sapiens
uucuguggcuca

SEQ ID NO: 895256 - RNA, 13 nt, Homo sapiens
uucugugucauac

SEQ ID NO: 895257 - RNA, 15 nt, Homo sapiens
uucuguuauugcacu

SEQ ID NO: 895258 - RNA, 14 nt, Homo sapiens
uucuguugauccca

SEQ ID NO: 895259 - RNA, 21 nt, Homo sapiens
uucuguugaucccacuucacu

SEQ ID NO: 895260 - RNA, 13 nt, Homo sapiens
uucuguugccaca

SEQ ID NO: 895261 - RNA, 14 nt, Homo sapiens
uucuguuuccauag

SEQ ID NO: 895262 - RNA, 22 nt, Homo sapiens
uucuguuugaaugcggaaccau

SEQ ID NO: 895263 - RNA, 17 nt, Homo sapiens
uucuuaaagaguucuua

SEQ ID NO: 895264 - RNA, 13 nt, Homo sapiens
uucuuaaggggau

SEQ ID NO: 895265 - RNA, 18 nt, Homo sapiens
uucuuaaucaagaauauu

SEQ ID NO: 895266 - RNA, 16 nt, Homo sapiens
uucuuacaaacaugug

SEQ ID NO: 895267 - RNA, 22 nt, Homo sapiens
uucuuacaauaauucuaugaga

SEQ ID NO: 895268 - RNA, 20 nt, Homo sapiens
uucuuauuuuguaauaaacu

SEQ ID NO: 895269 - RNA, 21 nt, Homo sapiens
uucuucaucccuuuccaguua

SEQ ID NO: 895270 - RNA, 16 nt, Homo sapiens
uucuucaucuugacau

SEQ ID NO: 895271 - RNA, 13 nt, Homo sapiens
uucuucuauucca

SEQ ID NO: 895272 - RNA, 16 nt, Homo sapiens
uucuucuguauguuag

SEQ ID NO: 895273 - RNA, 13 nt, Homo sapiens
uucuucuuuaggc

SEQ ID NO: 895274 - RNA, 12 nt, Homo sapiens
uucuugccucau

SEQ ID NO: 895275 - RNA, 20 nt, Homo sapiens
uucuuggaccccugaauuca

SEQ ID NO: 895276 - RNA, 18 nt, Homo sapiens
uucuuggggucccaggga

SEQ ID NO: 895277 - RNA, 20 nt, Homo sapiens
uucuuguauauuauggaaga

SEQ ID NO: 895278 - RNA, 14 nt, Homo sapiens
uucuuucaaagugu

SEQ ID NO: 895279 - RNA, 23 nt, Homo sapiens
uucuuuccucuuccccuugcccu

SEQ ID NO: 895280 - RNA, 17 nt, Homo sapiens
uucuuuguaccaucugu

SEQ ID NO: 895281 - RNA, 16 nt, Homo sapiens
uucuuuuucacacuga

SEQ ID NO: 895282 - RNA, 17 nt, Homo sapiens
uucuuuuucacacugau

SEQ ID NO: 895283 - RNA, 12 nt, Homo sapiens
uugaaaaccugg

SEQ ID NO: 895284 - RNA, 13 nt, Homo sapiens
uugaaaaccuggc

SEQ ID NO: 895285 - RNA, 17 nt, Homo sapiens
uugaaaauaauuguucc

SEQ ID NO: 895286 - RNA, 14 nt, Homo sapiens
uugaaauaguugau

SEQ ID NO: 895287 - RNA, 16 nt, Homo sapiens
uugaacugauucacau

SEQ ID NO: 895288 - RNA, 18 nt, Homo sapiens
uugaacugguucaugaaa

SEQ ID NO: 895289 - RNA, 15 nt, Homo sapiens
uugaacugguuguga

SEQ ID NO: 895290 - RNA, 23 nt, Homo sapiens
uugaacuuaaauaaaugucauua

SEQ ID NO: 895291 - RNA, 22 nt, Homo sapiens
uugaacuucauaagguaauuca

SEQ ID NO: 895292 - RNA, 18 nt, Homo sapiens
uugaagaagaguuucucc

SEQ ID NO: 895293 - RNA, 21 nt, Homo sapiens
uugaagaagaguuucuccuuu

SEQ ID NO: 895294 - RNA, 17 nt, Homo sapiens
uugaagaucccuauuau

SEQ ID NO: 895295 - RNA, 16 nt, Homo sapiens
uugaagccacugccuu

SEQ ID NO: 895296 - RNA, 20 nt, Homo sapiens
uugaaggagaaaaugcauua

SEQ ID NO: 895297 - RNA, 14 nt, Homo sapiens
uugaaguaugguug

SEQ ID NO: 895298 - RNA, 18 nt, Homo sapiens
uugaauaaagccugcuuu

SEQ ID NO: 895299 - RNA, 16 nt, Homo sapiens
uugaauauaaacacua

SEQ ID NO: 895300 - RNA, 20 nt, Homo sapiens
uugaaucuacaaaaaacaac

SEQ ID NO: 895301 - RNA, 18 nt, Homo sapiens
uugaaugcggaaccauag

SEQ ID NO: 895302 - RNA, 16 nt, Homo sapiens
uugaauggaagcaaaa

SEQ ID NO: 895303 - RNA, 21 nt, Homo sapiens
uugaauggagauucugauuca

SEQ ID NO: 895304 - RNA, 17 nt, Homo sapiens
uugaauguaagaacaug

SEQ ID NO: 895305 - RNA, 19 nt, Homo sapiens
uugaauuugccuuccucau

SEQ ID NO: 895306 - RNA, 18 nt, Homo sapiens
uugaauuugguaucuuau

SEQ ID NO: 895307 - RNA, 17 nt, Homo sapiens
uugacaaccaugagacc

SEQ ID NO: 895308 - RNA, 13 nt, Homo sapiens
uugacacacagca

SEQ ID NO: 895309 - RNA, 17 nt, Homo sapiens
uugacaggaauacuuaa

SEQ ID NO: 895310 - RNA, 13 nt, Homo sapiens
uugacaggccauc

SEQ ID NO: 895311 - RNA, 16 nt, Homo sapiens
uugacaggccauccau

SEQ ID NO: 895312 - RNA, 23 nt, Homo sapiens
uugacaggccauccauucacagc

SEQ ID NO: 895313 - RNA, 12 nt, Homo sapiens
uugacaucaugu

SEQ ID NO: 895314 - RNA, 12 nt, Homo sapiens
uugaccaaauaa

SEQ ID NO: 895315 - RNA, 15 nt, Homo sapiens
uugaccaaauaaagu

SEQ ID NO: 895316 - RNA, 19 nt, Homo sapiens
uugaccaaauaaaguacca

SEQ ID NO: 895317 - RNA, 16 nt, Homo sapiens
uuuggaaguguuaacu

SEQ ID NO: 895318 - RNA, 14 nt, Homo sapiens
uuuggccauuccaa

SEQ ID NO: 895319 - RNA, 21 nt, Homo sapiens
uuuggggagacgguguugcag

SEQ ID NO: 895320 - RNA, 22 nt, Homo sapiens
uuugggggacuuacaugauuca

SEQ ID NO: 895321 - RNA, 20 nt, Homo sapiens
uuugggguccuagcccagug

SEQ ID NO: 895322 - RNA, 20 nt, Homo sapiens
uuugggguugaaaauucaaa

SEQ ID NO: 895323 - RNA, 18 nt, Homo sapiens
uuugguaggcuuaucaaa

SEQ ID NO: 895324 - RNA, 10 nt, Homo sapiens
uuuguaaaac

SEQ ID NO: 895325 - RNA, 21 nt, Homo sapiens
uuuguagagccagggucucac

SEQ ID NO: 895326 - RNA, 14 nt, Homo sapiens
uuuguauucaugaa

SEQ ID NO: 895327 - RNA, 21 nt, Homo sapiens
uuugucagucugggugucuca

SEQ ID NO: 895328 - RNA, 12 nt, Homo sapiens
uuugucauauau

SEQ ID NO: 895329 - RNA, 18 nt, Homo sapiens
uuugucucugcaucucau

SEQ ID NO: 895330 - RNA, 18 nt, Homo sapiens
uuuguggaggacuuugaa

SEQ ID NO: 895331 - RNA, 13 nt, Homo sapiens
uuuguguaugugu

SEQ ID NO: 895332 - RNA, 21 nt, Homo sapiens
uguucacacuguaaacauuca

SEQ ID NO: 895333 - RNA, 12 nt, Homo sapiens
uguucacauaua

SEQ ID NO: 895334 - RNA, 18 nt, Homo sapiens
uguucacuuauugacuau

SEQ ID NO: 895335 - RNA, 18 nt, Homo sapiens
uguucagagaggccuuuu

SEQ ID NO: 895336 - RNA, 13 nt, Homo sapiens
uuugugugauuga

SEQ ID NO: 895337 - RNA, 15 nt, Homo sapiens
uuugugugugugaua

SEQ ID NO: 895338 - RNA, 14 nt, Homo sapiens
uuuguuuuaaauac

SEQ ID NO: 895339 - RNA, 16 nt, Homo sapiens
uuuguuuugcacugac

SEQ ID NO: 895340 - RNA, 15 nt, Homo sapiens
uuuuaaaaguuucaa

SEQ ID NO: 895341 - RNA, 22 nt, Homo sapiens
uuuuaaaguauguuauugcaua

SEQ ID NO: 895342 - RNA, 13 nt, Homo sapiens
uuuuaaauuugaa

SEQ ID NO: 895343 - RNA, 17 nt, Homo sapiens
uuuuaagaagcauuuua

SEQ ID NO: 895344 - RNA, 14 nt, Homo sapiens
uuuuaagcuguaaa

SEQ ID NO: 895345 - RNA, 14 nt, Homo sapiens
uuuuaauaugacaa

SEQ ID NO: 895346 - RNA, 19 nt, Homo sapiens
uuuuaauuuauuucaucca

SEQ ID NO: 895347 - RNA, 12 nt, Homo sapiens
uuuuacaccagu

SEQ ID NO: 895348 - RNA, 19 nt, Homo sapiens
uuuuagaggaagaccaaaa

SEQ ID NO: 895349 - RNA, 20 nt, Homo sapiens
uuuuagucuaauugaauccc

SEQ ID NO: 895350 - RNA, 22 nt, Homo sapiens
uuuuauaaauucagaaagucau

SEQ ID NO: 895351 - RNA, 15 nt, Homo sapiens
uuuuauacuaccaag

SEQ ID NO: 895352 - RNA, 21 nt, Homo sapiens
uuuuauauauuaugucauuca

SEQ ID NO: 895353 - RNA, 13 nt, Homo sapiens
uuuuaucugccuu

SEQ ID NO: 895354 - RNA, 23 nt, Homo sapiens
uuuuauuuuuagacagagucuca

SEQ ID NO: 895355 - RNA, 18 nt, Homo sapiens
uuuucaaagauguguugc

SEQ ID NO: 895356 - RNA, 22 nt, Homo sapiens
uuuucaagauacauuucaucug

SEQ ID NO: 895357 - RNA, 23 nt, Homo sapiens
uuuucaauaaugugaacugcuga

SEQ ID NO: 895358 - RNA, 12 nt, Homo sapiens
uuuucaaucuca

SEQ ID NO: 895359 - RNA, 18 nt, Homo sapiens
uuuucaaugcacauuagu

SEQ ID NO: 895360 - RNA, 15 nt, Homo sapiens
uuuucagaccccagc

SEQ ID NO: 895361 - RNA, 14 nt, Homo sapiens
uuuucauuaucuca

SEQ ID NO: 895362 - RNA, 17 nt, Homo sapiens
uuuucauugauaugaaa

SEQ ID NO: 895363 - RNA, 13 nt, Homo sapiens
uuuuccacuuaga

SEQ ID NO: 895364 - RNA, 12 nt, Homo sapiens
uuuuccaggaau

SEQ ID NO: 895365 - RNA, 21 nt, Homo sapiens
uuuucccgagcaaagucuaaa

SEQ ID NO: 895366 - RNA, 13 nt, Homo sapiens
uuuuccuaaaaau

SEQ ID NO: 895367 - RNA, 18 nt, Homo sapiens
uuuuccucgccuaggccu

SEQ ID NO: 895368 - RNA, 21 nt, Homo sapiens
uuuucuuaaauauuaugugaa

SEQ ID NO: 895369 - RNA, 18 nt, Homo sapiens
uuuucuuauuuaacuuaa

SEQ ID NO: 895370 - RNA, 15 nt, Homo sapiens
uuuucuugccaauga

SEQ ID NO: 895371 - RNA, 12 nt, Homo sapiens
uuuucuuggcag

SEQ ID NO: 895372 - RNA, 18 nt, Homo sapiens
uuuugaaaaagcgaaaaa

SEQ ID NO: 895373 - RNA, 23 nt, Homo sapiens
uuuugaccaaauaaaguaccauu

SEQ ID NO: 895374 - RNA, 21 nt, Homo sapiens
uuuugaggaauuaucauggga

SEQ ID NO: 895375 - RNA, 14 nt, Homo sapiens
uuuugaguaucucg

SEQ ID NO: 895376 - RNA, 14 nt, Homo sapiens
uuuugauagauauc

SEQ ID NO: 895377 - RNA, 14 nt, Homo sapiens
uuuugauagcuuua

SEQ ID NO: 895378 - RNA, 22 nt, Homo sapiens
uuuugcacauaacaugcuuuag

SEQ ID NO: 895379 - RNA, 22 nt, Homo sapiens
uuuugcugucuuucucuaaaua

SEQ ID NO: 895380 - RNA, 19 nt, Homo sapiens
uuuuguaauaaacucucua

SEQ ID NO: 895381 - RNA, 14 nt, Homo sapiens
uuuugucacugucu

SEQ ID NO: 895382 - RNA, 22 nt, Homo sapiens
uuuuguggugucuagcauuaac

SEQ ID NO: 895383 - RNA, 21 nt, Homo sapiens
uuuuuacacauguaucuaugc

SEQ ID NO: 895384 - RNA, 12 nt, Homo sapiens
uuuuuagcuuua

SEQ ID NO: 895385 - RNA, 19 nt, Homo sapiens
uuuuuaguagagauggggu

SEQ ID NO: 895386 - RNA, 16 nt, Homo sapiens
uuuuuaugugcaauaa

SEQ ID NO: 895387 - RNA, 12 nt, Homo sapiens
uuuuugcuauau

SEQ ID NO: 895388 - RNA, 16 nt, Homo sapiens
uuuuugguguauuuga

SEQ ID NO: 895389 - RNA, 16 nt, Homo sapiens
uuuuugucauagcagc

SEQ ID NO: 895390 - RNA, 21 nt, Homo sapiens
uuuuuguuucuuccaaagcac

SEQ ID NO: 895391 - RNA, 12 nt, Homo sapiens
uuuuuugauuga

SEQ ID NO: 895392 - RNA, 21 nt, Homo sapiens
uuuuuuguuauguuugcacuu

SEQ ID NO: 895393 - RNA, 15 nt, Homo sapiens
cuaaauuuccagggg

SEQ ID NO: 895394 - RNA, 13 nt, Homo sapiens
cuaacauaaaaua

SEQ ID NO: 895395 - RNA, 15 nt, Homo sapiens
cuaacaucaugcauu

SEQ ID NO: 895396 - RNA, 14 nt, Homo sapiens
cuaaccaaaugcug

SEQ ID NO: 895397 - RNA, 17 nt, Homo sapiens
cuaaccagccuggucaa

SEQ ID NO: 895398 - RNA, 22 nt, Homo sapiens
cuaacuacaaggacaaugccuu

SEQ ID NO: 895399 - RNA, 15 nt, Homo sapiens
cuaacuccagucucc

SEQ ID NO: 895400 - RNA, 13 nt, Homo sapiens
cuaacuccaguga

SEQ ID NO: 895401 - RNA, 15 nt, Homo sapiens
cuaacuccagugaag

SEQ ID NO: 895402 - RNA, 20 nt, Homo sapiens
cuaagaagcgagcacugacc

SEQ ID NO: 895403 - RNA, 20 nt, Homo sapiens
cuaagccacauggcugggau

SEQ ID NO: 895404 - RNA, 11 nt, Homo sapiens
cuaagccuuuc

SEQ ID NO: 895405 - RNA, 23 nt, Homo sapiens
cuaagcgaauguguacaaagugu

SEQ ID NO: 895406 - RNA, 17 nt, Homo sapiens
cuaaggcucuauuuccu

SEQ ID NO: 895407 - RNA, 14 nt, Homo sapiens
cuaaggugugcucu

SEQ ID NO: 895408 - RNA, 18 nt, Homo sapiens
cuaaguaaaaccacagca

SEQ ID NO: 895409 - RNA, 13 nt, Homo sapiens
cuaauaaacaauu

SEQ ID NO: 895410 - RNA, 22 nt, Homo sapiens
cuaauagagugguacagcacug

SEQ ID NO: 895411 - RNA, 17 nt, Homo sapiens
cuaauauguaacaagcc

SEQ ID NO: 895412 - RNA, 15 nt, Homo sapiens
cuaaucagcucccuu

SEQ ID NO: 895413 - RNA, 20 nt, Homo sapiens
cuaaugauauuuuaugcaaa

SEQ ID NO: 895414 - RNA, 20 nt, Homo sapiens
cuaaugauuagcacuuaaua

SEQ ID NO: 895415 - RNA, 22 nt, Homo sapiens
cuaauguaugcauucauccaac

SEQ ID NO: 895416 - RNA, 22 nt, Homo sapiens
cuaauuaaaaaguuaaucuuca

SEQ ID NO: 895417 - RNA, 23 nt, Homo sapiens
cuaauuaaaaaguuaaucuucau

SEQ ID NO: 895418 - RNA, 13 nt, Homo sapiens
gcuuaccugacac

SEQ ID NO: 895419 - RNA, 20 nt, Homo sapiens
gcuuagacuucgacucagga

SEQ ID NO: 895420 - RNA, 12 nt, Homo sapiens
gcuuauggccag

SEQ ID NO: 895421 - RNA, 15 nt, Homo sapiens
gcuuauucuugagca

SEQ ID NO: 895422 - RNA, 19 nt, Homo sapiens
gcuuauuguacuuguuauc

SEQ ID NO: 895423 - RNA, 19 nt, Homo sapiens
gcuucaacauucuuugcaa

SEQ ID NO: 895424 - RNA, 19 nt, Homo sapiens
gcuucaaguguugcucuug

SEQ ID NO: 895425 - RNA, 16 nt, Homo sapiens
gcuucauuuccugugu

SEQ ID NO: 895426 - RNA, 16 nt, Homo sapiens
gcuuccagaccaccug

SEQ ID NO: 895427 - RNA, 13 nt, Homo sapiens
gcuuccagugcau

SEQ ID NO: 895428 - RNA, 17 nt, Homo sapiens
gcuucccagaggccagg

SEQ ID NO: 895429 - RNA, 15 nt, Homo sapiens
gcuucuagaucugga

SEQ ID NO: 895430 - RNA, 14 nt, Homo sapiens
gcuucuaguauuuu

SEQ ID NO: 895431 - RNA, 13 nt, Homo sapiens
gcuucuccugacc

SEQ ID NO: 895432 - RNA, 17 nt, Homo sapiens
gcuucucuuucucugag

SEQ ID NO: 895433 - RNA, 15 nt, Homo sapiens
gcuucuguccaggac

SEQ ID NO: 895434 - RNA, 15 nt, Homo sapiens
gcuugaaguaaccuu

SEQ ID NO: 895435 - RNA, 17 nt, Homo sapiens
gcuugagccugucacgu

SEQ ID NO: 895436 - RNA, 21 nt, Homo sapiens
gcuugcccuguuaaaagauga

SEQ ID NO: 895437 - RNA, 20 nt, Homo sapiens
gcuuguccugcucucuucag

SEQ ID NO: 895438 - RNA, 14 nt, Homo sapiens
gcuuguguuuuuaa

SEQ ID NO: 895439 - RNA, 15 nt, Homo sapiens
gcuuguuggcuuccg

SEQ ID NO: 895440 - RNA, 13 nt, Homo sapiens
gcuuuagggcaau

SEQ ID NO: 895441 - RNA, 19 nt, Homo sapiens
gcuuucugaagcuuuacca

SEQ ID NO: 895442 - RNA, 13 nt, Homo sapiens
gcuuugacucacc

SEQ ID NO: 895443 - RNA, 19 nt, Homo sapiens
gcuuugacucaccuguuac

SEQ ID NO: 895444 - RNA, 14 nt, Homo sapiens
gcuuugaggacaaa

SEQ ID NO: 895445 - RNA, 15 nt, Homo sapiens
gcuuugaggacaaag

SEQ ID NO: 895446 - RNA, 14 nt, Homo sapiens
gcuuugccugcuug

SEQ ID NO: 895447 - RNA, 13 nt, Homo sapiens
gcuuuguuuccau

SEQ ID NO: 895448 - RNA, 19 nt, Homo sapiens
gcuuuguuuugucuuacaa

SEQ ID NO: 895449 - RNA, 18 nt, Homo sapiens
gcuuuuaagaaacacagg

SEQ ID NO: 895450 - RNA, 22 nt, Homo sapiens
gcuuuuggugguccccacagcc

SEQ ID NO: 895451 - RNA, 14 nt, Homo sapiens
gcuuuuuaauugag

SEQ ID NO: 895452 - RNA, 14 nt, Homo sapiens
ggaaaacucaggau

SEQ ID NO: 895453 - RNA, 16 nt, Homo sapiens
ggaaaagaggaguuuc

SEQ ID NO: 895454 - RNA, 19 nt, Homo sapiens
ggaaaagcaaaacuguagg

SEQ ID NO: 895455 - RNA, 14 nt, Homo sapiens
ggaaaagcccagug

SEQ ID NO: 895456 - RNA, 17 nt, Homo sapiens
ggaaaaggccuggggug

SEQ ID NO: 895457 - RNA, 22 nt, Homo sapiens
ggaaaagguagcuuaccugaca

SEQ ID NO: 895458 - RNA, 19 nt, Homo sapiens
ggaaaauaaauuauauuaa

SEQ ID NO: 895459 - RNA, 22 nt, Homo sapiens
ggaaaaugugcaauaugugaug

SEQ ID NO: 895460 - RNA, 17 nt, Homo sapiens
ggaaaauuucacauuaa

SEQ ID NO: 895461 - RNA, 21 nt, Homo sapiens
ggaaacagagaacccuguggg

SEQ ID NO: 895462 - RNA, 15 nt, Homo sapiens
ggaaaccacacuucu

SEQ ID NO: 895463 - RNA, 16 nt, Homo sapiens
ggaaagaaaugcccau

SEQ ID NO: 895464 - RNA, 16 nt, Homo sapiens
ggaaagaugaugcaag

SEQ ID NO: 895465 - RNA, 13 nt, Homo sapiens
ggaaagcagccau

SEQ ID NO: 895466 - RNA, 15 nt, Homo sapiens
ggaaagcagccguuu

SEQ ID NO: 895467 - RNA, 16 nt, Homo sapiens
ggaaagcaucaccuca

SEQ ID NO: 895468 - RNA, 19 nt, Homo sapiens
ggaaagccucacugauaua

SEQ ID NO: 895469 - RNA, 20 nt, Homo sapiens
ggaaaggaggcaugccucug

SEQ ID NO: 895470 - RNA, 17 nt, Homo sapiens
ggaaaguaaauauuuca

SEQ ID NO: 895471 - RNA, 18 nt, Homo sapiens
ggaaaguaaauauuucag

SEQ ID NO: 895472 - RNA, 23 nt, Homo sapiens
ggaaaguaaauauuucaggcaua

SEQ ID NO: 895473 - RNA, 16 nt, Homo sapiens
ggaaauaaaccuggag

SEQ ID NO: 895474 - RNA, 21 nt, Homo sapiens
ggaaaugugucuugucuccau

SEQ ID NO: 895475 - RNA, 18 nt, Homo sapiens
ggaacagacaacagaagu

SEQ ID NO: 895476 - RNA, 17 nt, Homo sapiens
ggaaccaaaauguauaa

SEQ ID NO: 895477 - RNA, 23 nt, Homo sapiens
ggaaccaaccaacaaacaaugcc

SEQ ID NO: 895478 - RNA, 14 nt, Homo sapiens
ggaaccaugaagcu

SEQ ID NO: 895479 - RNA, 22 nt, Homo sapiens
ggaacuagagggauacacugaa

SEQ ID NO: 895480 - RNA, 13 nt, Homo sapiens
ggaacucucucca

SEQ ID NO: 895481 - RNA, 16 nt, Homo sapiens
ggaacucuuaagcaau

SEQ ID NO: 895482 - RNA, 23 nt, Homo sapiens
ggaacugggccaacucaccugag

SEQ ID NO: 895483 - RNA, 22 nt, Homo sapiens
ggaacugguucaagagacacug

SEQ ID NO: 895484 - RNA, 17 nt, Homo sapiens
ggaagaaagaaugcaag

SEQ ID NO: 895485 - RNA, 12 nt, Homo sapiens
ggaagaccaaga

SEQ ID NO: 895486 - RNA, 22 nt, Homo sapiens
ggaagacgccuuucuccuccaa

SEQ ID NO: 895487 - RNA, 19 nt, Homo sapiens
cgaacaaacugaugcgaaa

SEQ ID NO: 895488 - RNA, 22 nt, Homo sapiens
cgaacgcucuuagcuuucucag

SEQ ID NO: 895489 - RNA, 22 nt, Homo sapiens
cgaagaccuucugaagaucuca

SEQ ID NO: 895490 - RNA, 17 nt, Homo sapiens
cgaagcugugaacucag

SEQ ID NO: 895491 - RNA, 17 nt, Homo sapiens
cgaagggggucaaagga

SEQ ID NO: 895492 - RNA, 13 nt, Homo sapiens
cgaaucaucucaa

SEQ ID NO: 895493 - RNA, 18 nt, Homo sapiens
cgaccugcggcugcugug

SEQ ID NO: 895494 - RNA, 19 nt, Homo sapiens
cgacuucaucccaaaggac

SEQ ID NO: 895495 - RNA, 15 nt, Homo sapiens
cgagagagucuucca

SEQ ID NO: 895496 - RNA, 21 nt, Homo sapiens
cgagaucacgccacugcacuc

SEQ ID NO: 895497 - RNA, 15 nt, Homo sapiens
cgagcagcugagcag

SEQ ID NO: 895498 - RNA, 22 nt, Homo sapiens
cgagcuaugaucgcgccacuac

SEQ ID NO: 895499 - RNA, 16 nt, Homo sapiens
cgagggauaauucaaa

SEQ ID NO: 895500 - RNA, 13 nt, Homo sapiens
cgaggggcgcgau

SEQ ID NO: 895501 - RNA, 14 nt, Homo sapiens
cgagucucuucucc

SEQ ID NO: 895502 - RNA, 14 nt, Homo sapiens
cgaguguuugccag

SEQ ID NO: 895503 - RNA, 18 nt, Homo sapiens
cgaucuggguucacugca

SEQ ID NO: 895504 - RNA, 22 nt, Homo sapiens
cgaugccgugugucucgucucc

SEQ ID NO: 895505 - RNA, 17 nt, Homo sapiens
cgauguacacacacaga

SEQ ID NO: 895506 - RNA, 19 nt, Homo sapiens
cgaugugcgcacacacaga

SEQ ID NO: 895507 - RNA, 15 nt, Homo sapiens
cgcaaacacaccgau

SEQ ID NO: 895508 - RNA, 21 nt, Homo sapiens
cgcaaacacaccgaugcacac

SEQ ID NO: 895509 - RNA, 15 nt, Homo sapiens
cgcaacaacaaggac

SEQ ID NO: 895510 - RNA, 20 nt, Homo sapiens
gcccagccaacugccccggg

SEQ ID NO: 895511 - RNA, 20 nt, Homo sapiens
gcccagccauuaccauggag

SEQ ID NO: 895512 - RNA, 12 nt, Homo sapiens
gcccagcuacau

SEQ ID NO: 895513 - RNA, 15 nt, Homo sapiens
gcccagcugcaccug

SEQ ID NO: 895514 - RNA, 17 nt, Homo sapiens
gcccaggccugccuguu

SEQ ID NO: 895515 - RNA, 20 nt, Homo sapiens
gcccaggcuggagugcagua

SEQ ID NO: 895516 - RNA, 20 nt, Homo sapiens
gcccagggaagccaaaagau

SEQ ID NO: 895517 - RNA, 15 nt, Homo sapiens
gcccagggagcaaug

SEQ ID NO: 895518 - RNA, 16 nt, Homo sapiens
gcccagggcaucccau

SEQ ID NO: 895519 - RNA, 17 nt, Homo sapiens
gcccagucgauaucuca

SEQ ID NO: 895520 - RNA, 14 nt, Homo sapiens
gcccagugaccuga

SEQ ID NO: 895521 - RNA, 18 nt, Homo sapiens
gcccaguuggguggaugc

SEQ ID NO: 895522 - RNA, 18 nt, Homo sapiens
gcccaucauacgcauggu

SEQ ID NO: 895523 - RNA, 22 nt, Homo sapiens
gcccauggcuuuagcuaccuca

SEQ ID NO: 895524 - RNA, 21 nt, Homo sapiens
gcccauuggcucccaucugaa

SEQ ID NO: 895525 - RNA, 18 nt, Homo sapiens
gccccagaaggcagggaa

SEQ ID NO: 895526 - RNA, 14 nt, Homo sapiens
gccccagaucugcc

SEQ ID NO: 895527 - RNA, 23 nt, Homo sapiens
gccccagcacuaaagcaguggac

SEQ ID NO: 895528 - RNA, 21 nt, Homo sapiens
gccccuuggcgggcagcccag

SEQ ID NO: 895529 - RNA, 18 nt, Homo sapiens
gcccgacagccuggcaca

SEQ ID NO: 895530 - RNA, 17 nt, Homo sapiens
gcccgaccccaucucau

SEQ ID NO: 895531 - RNA, 20 nt, Homo sapiens
gcccgggacagggucuugca

SEQ ID NO: 895532 - RNA, 19 nt, Homo sapiens
gcccucaggccagugccag

SEQ ID NO: 895533 - RNA, 19 nt, Homo sapiens
gcccucccccagcaguuga

SEQ ID NO: 895534 - RNA, 18 nt, Homo sapiens
gcccuccuacagcacucc

SEQ ID NO: 895535 - RNA, 11 nt, Homo sapiens
gcccugaccuc

SEQ ID NO: 895536 - RNA, 13 nt, Homo sapiens
gcccugcacagau

SEQ ID NO: 895537 - RNA, 16 nt, Homo sapiens
gcccugcugugggaga

SEQ ID NO: 895538 - RNA, 18 nt, Homo sapiens
gcccuggagggaggcucu

SEQ ID NO: 895539 - RNA, 14 nt, Homo sapiens
gcccuggauccauc

SEQ ID NO: 895540 - RNA, 16 nt, Homo sapiens
gcccuggcugacccca

SEQ ID NO: 895541 - RNA, 20 nt, Homo sapiens
gcccuggcugaccccaaaga

SEQ ID NO: 895542 - RNA, 22 nt, Homo sapiens
gcccugggaccgcuacaccacu

SEQ ID NO: 895543 - RNA, 19 nt, Homo sapiens
gcccugggcucaucagccu

SEQ ID NO: 895544 - RNA, 18 nt, Homo sapiens
gcccuggggccuguacug

SEQ ID NO: 895545 - RNA, 15 nt, Homo sapiens
gcccuggugcugcca

SEQ ID NO: 895546 - RNA, 17 nt, Homo sapiens
gcccugguguguuucca

SEQ ID NO: 895547 - RNA, 15 nt, Homo sapiens
gcccuucaugcauuu

SEQ ID NO: 895548 - RNA, 18 nt, Homo sapiens
gcccuucccacagcauuc

SEQ ID NO: 895549 - RNA, 15 nt, Homo sapiens
gcccuucccacugga

SEQ ID NO: 895550 - RNA, 22 nt, Homo sapiens
gcccuuccuccugaagccucug

SEQ ID NO: 895551 - RNA, 22 nt, Homo sapiens
gcccuucugaugagaaaggccu

SEQ ID NO: 895552 - RNA, 17 nt, Homo sapiens
gcccuucuuucuacccu

SEQ ID NO: 895553 - RNA, 21 nt, Homo sapiens
gcccuugcccugaccucccag

SEQ ID NO: 895554 - RNA, 16 nt, Homo sapiens
ugaauuuuaaauguuc

SEQ ID NO: 895555 - RNA, 18 nt, Homo sapiens
ugacaaaauaacauuuga

SEQ ID NO: 895556 - RNA, 19 nt, Homo sapiens
ugacaacaucccacagugg

SEQ ID NO: 895557 - RNA, 19 nt, Homo sapiens
ugacaaccuuuguguaaua

SEQ ID NO: 895558 - RNA, 23 nt, Homo sapiens
ugacaagcaagggcugugcugag

SEQ ID NO: 895559 - RNA, 14 nt, Homo sapiens
ugacaagcacugcu

SEQ ID NO: 895560 - RNA, 15 nt, Homo sapiens
ugacaauaauuucag

SEQ ID NO: 895561 - RNA, 12 nt, Homo sapiens
ugacacacagca

SEQ ID NO: 895562 - RNA, 15 nt, Homo sapiens
ugacacacagcacuc

SEQ ID NO: 895563 - RNA, 18 nt, Homo sapiens
ugacacacagcagcacug

SEQ ID NO: 895564 - RNA, 12 nt, Homo sapiens
ugacacacagcu

SEQ ID NO: 895565 - RNA, 14 nt, Homo sapiens
ugacacauaugcac

SEQ ID NO: 895566 - RNA, 12 nt, Homo sapiens
uucaacuuugag

SEQ ID NO: 895567 - RNA, 20 nt, Homo sapiens
uucaagacuugauacugcaa

SEQ ID NO: 895568 - RNA, 21 nt, Homo sapiens
uucaaggcauuucuaucacau

SEQ ID NO: 895569 - RNA, 23 nt, Homo sapiens
uucaaggcauuucuaucacauau

SEQ ID NO: 895570 - RNA, 18 nt, Homo sapiens
uucaagguguaaaauauc

SEQ ID NO: 895571 - RNA, 14 nt, Homo sapiens
uucaaguugagaac

SEQ ID NO: 895572 - RNA, 21 nt, Homo sapiens
uucaauaaaaaauacaauuca

SEQ ID NO: 895573 - RNA, 20 nt, Homo sapiens
uucaauaaagcugcugagaa

SEQ ID NO: 895574 - RNA, 12 nt, Homo sapiens
uucaauacucau

SEQ ID NO: 895575 - RNA, 15 nt, Homo sapiens
uucaaugcacauuag

SEQ ID NO: 895576 - RNA, 15 nt, Homo sapiens
uucacaaugaaaugc

SEQ ID NO: 895577 - RNA, 11 nt, Homo sapiens
uucacacugca

SEQ ID NO: 895578 - RNA, 21 nt, Homo sapiens
uucacagcagccacuugacua

SEQ ID NO: 895579 - RNA, 10 nt, Homo sapiens
uucacagcca

SEQ ID NO: 895580 - RNA, 14 nt, Homo sapiens
uucacagccaggag

SEQ ID NO: 895581 - RNA, 19 nt, Homo sapiens
uucacauaacuucucugag

SEQ ID NO: 895582 - RNA, 19 nt, Homo sapiens
uucacauacacucaaacaa

SEQ ID NO: 895583 - RNA, 19 nt, Homo sapiens
uucacauaguuuauuucaa

SEQ ID NO: 895584 - RNA, 17 nt, Homo sapiens
uucaccaaaugaugcca

SEQ ID NO: 895585 - RNA, 15 nt, Homo sapiens
uucaccagauuugcu

SEQ ID NO: 895586 - RNA, 17 nt, Homo sapiens
uucaccccugcacuuca

SEQ ID NO: 895587 - RNA, 16 nt, Homo sapiens
uucaccuggaagcauu

SEQ ID NO: 895588 - RNA, 14 nt, Homo sapiens
uucacgcaacuuga

SEQ ID NO: 895589 - RNA, 15 nt, Homo sapiens
uucacugccaugccu

SEQ ID NO: 895590 - RNA, 20 nt, Homo sapiens
uucacuguagaaugauuuca

SEQ ID NO: 895591 - RNA, 21 nt, Homo sapiens
uucacuuuuuacagugcuauu

SEQ ID NO: 895592 - RNA, 17 nt, Homo sapiens
uucagacacuucaugga

SEQ ID NO: 895593 - RNA, 15 nt, Homo sapiens
uucagagaagucagu

SEQ ID NO: 895594 - RNA, 15 nt, Homo sapiens
uucagagccagugaa

SEQ ID NO: 895595 - RNA, 22 nt, Homo sapiens
uucagagggcguguuguuuuac

SEQ ID NO: 895596 - RNA, 19 nt, Homo sapiens
uucagaguuguacacugug

SEQ ID NO: 895597 - RNA, 17 nt, Homo sapiens
uucagauugacaaggua

SEQ ID NO: 895598 - RNA, 20 nt, Homo sapiens
uucagcauuauuccuccagg

SEQ ID NO: 895599 - RNA, 13 nt, Homo sapiens
uucagccaccucu

SEQ ID NO: 895600 - RNA, 20 nt, Homo sapiens
uucagcgagacccuugcauu

SEQ ID NO: 895601 - RNA, 20 nt, Homo sapiens
uucagcuccagcucaccagc

SEQ ID NO: 895602 - RNA, 17 nt, Homo sapiens
uucaggaagaugaaaga

SEQ ID NO: 895603 - RNA, 13 nt, Homo sapiens
uucagugcuucuu

SEQ ID NO: 895604 - RNA, 18 nt, Homo sapiens
uucagugguccugucaag

SEQ ID NO: 895605 - RNA, 23 nt, Homo sapiens
uucaguggugugaucuuggcuca

SEQ ID NO: 895606 - RNA, 18 nt, Homo sapiens
uucagugucaacuauuca

SEQ ID NO: 895607 - RNA, 22 nt, Homo sapiens
uucaguugacaaaauauauaau

SEQ ID NO: 895608 - RNA, 17 nt, Homo sapiens
uucauaaggccugcccu

SEQ ID NO: 895609 - RNA, 16 nt, Homo sapiens
uucauaagguaauuca

SEQ ID NO: 895610 - RNA, 22 nt, Homo sapiens
uucauaauaaacuagauacugu

SEQ ID NO: 895611 - RNA, 23 nt, Homo sapiens
uucaucaauuuuuauacauauca

SEQ ID NO: 895612 - RNA, 14 nt, Homo sapiens
uucaucagcauuua

SEQ ID NO: 895613 - RNA, 14 nt, Homo sapiens
uucaucuaauguga

SEQ ID NO: 895614 - RNA, 14 nt, Homo sapiens
uucaucuacuacag

SEQ ID NO: 895615 - RNA, 17 nt, Homo sapiens
uucaucuacuacagggu

SEQ ID NO: 895616 - RNA, 20 nt, Homo sapiens
uucaucucaggccucccuca

SEQ ID NO: 895617 - RNA, 16 nt, Homo sapiens
uucaucuggauuccag

SEQ ID NO: 895618 - RNA, 16 nt, Homo sapiens
uucaugcauuugcacu

SEQ ID NO: 895619 - RNA, 12 nt, Homo sapiens
uucauggaccaa

SEQ ID NO: 895620 - RNA, 22 nt, Homo sapiens
uucauggugcacugagcugcaa

SEQ ID NO: 895621 - RNA, 15 nt, Homo sapiens
uucauguaaccaaga

SEQ ID NO: 895622 - RNA, 19 nt, Homo sapiens
uucauguaauaaaucugag

SEQ ID NO: 895623 - RNA, 21 nt, Homo sapiens
uucauuaucucaaaacugcac

SEQ ID NO: 895624 - RNA, 18 nt, Homo sapiens
uucauucucuuauauagu

SEQ ID NO: 895625 - RNA, 15 nt, Homo sapiens
uucauuguguucucu

SEQ ID NO: 895626 - RNA, 17 nt, Homo sapiens
uuccaaagaacagccug

SEQ ID NO: 895627 - RNA, 20 nt, Homo sapiens
uuccaaaggcauaagacccu

SEQ ID NO: 895628 - RNA, 19 nt, Homo sapiens
uuccaaauuggauacugcu

SEQ ID NO: 895629 - RNA, 17 nt, Homo sapiens
uuccaaccccuuuccac

SEQ ID NO: 895630 - RNA, 23 nt, Homo sapiens
uuccaaggguaugggaagccaua

SEQ ID NO: 895631 - RNA, 17 nt, Homo sapiens
uuccaauaaaacuuuau

SEQ ID NO: 895632 - RNA, 16 nt, Homo sapiens
uuccacaauucacuag

SEQ ID NO: 895633 - RNA, 20 nt, Homo sapiens
uuccacaccuagcaucucau

SEQ ID NO: 895634 - RNA, 15 nt, Homo sapiens
uuccacgagcuauau

SEQ ID NO: 895635 - RNA, 23 nt, Homo sapiens
uuccacuuagaaauugcauuucc

SEQ ID NO: 895636 - RNA, 15 nt, Homo sapiens
uuccacuucuaugca

SEQ ID NO: 895637 - RNA, 18 nt, Homo sapiens
uuccacuuugaguaccaa

SEQ ID NO: 895638 - RNA, 15 nt, Homo sapiens
uuccagcauuugcca

SEQ ID NO: 895639 - RNA, 23 nt, Homo sapiens
uuccaggaguucugaagcugaca

SEQ ID NO: 895640 - RNA, 18 nt, Homo sapiens
uuccaucccuacuuuuca

SEQ ID NO: 895641 - RNA, 12 nt, Homo sapiens
uuccauguuaaa

SEQ ID NO: 895642 - RNA, 20 nt, Homo sapiens
uucccaaauaaacucuaaac

SEQ ID NO: 895643 - RNA, 18 nt, Homo sapiens
uucccaaauuucauaccu

SEQ ID NO: 895644 - RNA, 20 nt, Homo sapiens
uucccaacuagacauuacca

SEQ ID NO: 895645 - RNA, 16 nt, Homo sapiens
uucccaagagcaucau

SEQ ID NO: 895646 - RNA, 11 nt, Homo sapiens
uucccaccacc

SEQ ID NO: 895647 - RNA, 12 nt, Homo sapiens
uucccaccucag

SEQ ID NO: 895648 - RNA, 22 nt, Homo sapiens
uucccacuggaggucacauuca

SEQ ID NO: 895649 - RNA, 21 nt, Homo sapiens
uucccauuacuuuaauacuca

SEQ ID NO: 895650 - RNA, 14 nt, Homo sapiens
uuccccacucaaug

SEQ ID NO: 895651 - RNA, 13 nt, Homo sapiens
uucccccagacag

SEQ ID NO: 895652 - RNA, 19 nt, Homo sapiens
uucccucuuuccccaccuc

SEQ ID NO: 895653 - RNA, 13 nt, Homo sapiens
uucccugagucac

SEQ ID NO: 895654 - RNA, 19 nt, Homo sapiens
uucccuuccaguuccggga

SEQ ID NO: 895655 - RNA, 20 nt, Homo sapiens
uucccuucucuccuucccuc

SEQ ID NO: 895656 - RNA, 18 nt, Homo sapiens
uucccuuggauguagucu

SEQ ID NO: 895657 - RNA, 12 nt, Homo sapiens
uuccuaacauaa

SEQ ID NO: 895658 - RNA, 16 nt, Homo sapiens
uuccuaauaugcuuua

SEQ ID NO: 895659 - RNA, 21 nt, Homo sapiens
uuccuacacccuuggacuuga

SEQ ID NO: 895660 - RNA, 20 nt, Homo sapiens
uuccuauuuggggcuugcau

SEQ ID NO: 895661 - RNA, 12 nt, Homo sapiens
uuccucacuaug

SEQ ID NO: 895662 - RNA, 16 nt, Homo sapiens
uuccucagaucaucca

SEQ ID NO: 895663 - RNA, 15 nt, Homo sapiens
uuccucgcaggucuc

SEQ ID NO: 895664 - RNA, 19 nt, Homo sapiens
uuccucgcaggucucagcc

SEQ ID NO: 895665 - RNA, 16 nt, Homo sapiens
uuccucgccucuccca

SEQ ID NO: 895666 - RNA, 23 nt, Homo sapiens
uuccucucugaguggacuggccu

SEQ ID NO: 895667 - RNA, 14 nt, Homo sapiens
uuccugaagccaga

SEQ ID NO: 895668 - RNA, 15 nt, Homo sapiens
uuccugauacugggu

SEQ ID NO: 895669 - RNA, 19 nt, Homo sapiens
uuccuggaguacaaacaca

SEQ ID NO: 895670 - RNA, 13 nt, Homo sapiens
uuccugguauuau

SEQ ID NO: 895671 - RNA, 13 nt, Homo sapiens
uuccuuaagccag

SEQ ID NO: 895672 - RNA, 12 nt, Homo sapiens
uuccuucacuca

SEQ ID NO: 895673 - RNA, 20 nt, Homo sapiens
uuccuucagugcaucuggga

SEQ ID NO: 895674 - RNA, 18 nt, Homo sapiens
uuccuucugcacccagaa

SEQ ID NO: 895675 - RNA, 11 nt, Homo sapiens
uuccuugagaa

SEQ ID NO: 895676 - RNA, 16 nt, Homo sapiens
uuccuugggaugaucu

SEQ ID NO: 895677 - RNA, 20 nt, Homo sapiens
uuccuuuuaaaacacuucca

SEQ ID NO: 895678 - RNA, 20 nt, Homo sapiens
uucgaaaccuguccauaaag

SEQ ID NO: 895679 - RNA, 20 nt, Homo sapiens
uucgagaccagccuggccaa

SEQ ID NO: 895680 - RNA, 15 nt, Homo sapiens
uggagcagaaagcca

SEQ ID NO: 895681 - RNA, 18 nt, Homo sapiens
uugaccggcagaauguuc

SEQ ID NO: 895682 - RNA, 16 nt, Homo sapiens
uugacugcuuggaacu

SEQ ID NO: 895683 - RNA, 23 nt, Homo sapiens
uugacugucacuguuccuuguca

SEQ ID NO: 895684 - RNA, 17 nt, Homo sapiens
uugacuugacagaacac

SEQ ID NO: 895685 - RNA, 22 nt, Homo sapiens
uugacuugugucuguccaagaa

SEQ ID NO: 895686 - RNA, 18 nt, Homo sapiens
uugagaaagaaugagcau

SEQ ID NO: 895687 - RNA, 14 nt, Homo sapiens
uugagaaccugugc

SEQ ID NO: 895688 - RNA, 18 nt, Homo sapiens
uugagaauacacuaucaa

SEQ ID NO: 895689 - RNA, 17 nt, Homo sapiens
uugagacaggaugguua

SEQ ID NO: 895690 - RNA, 14 nt, Homo sapiens
uugagagacagggu

SEQ ID NO: 895691 - RNA, 13 nt, Homo sapiens
uugagagggauuu

SEQ ID NO: 895692 - RNA, 18 nt, Homo sapiens
uugagaguugcuggugua

SEQ ID NO: 895693 - RNA, 23 nt, Homo sapiens
uugagcuccccaaaaaccucacc

SEQ ID NO: 895694 - RNA, 14 nt, Homo sapiens
uugaggaauuauca

SEQ ID NO: 895695 - RNA, 22 nt, Homo sapiens
uugaggaggggcaccugccacc

SEQ ID NO: 895696 - RNA, 15 nt, Homo sapiens
uugagggguggaccc

SEQ ID NO: 895697 - RNA, 18 nt, Homo sapiens
uugagguuuucugugcuu

SEQ ID NO: 895698 - RNA, 20 nt, Homo sapiens
uugagugacucgaggguugg

SEQ ID NO: 895699 - RNA, 17 nt, Homo sapiens
uugaguucaaauuuugc

SEQ ID NO: 895700 - RNA, 16 nt, Homo sapiens
uugaguuucucuccac

SEQ ID NO: 895701 - RNA, 12 nt, Homo sapiens
uugauagcagaa

SEQ ID NO: 895702 - RNA, 20 nt, Homo sapiens
uugaucccacuucacuguga

SEQ ID NO: 895703 - RNA, 14 nt, Homo sapiens
uugaucucugcuua

SEQ ID NO: 895704 - RNA, 19 nt, Homo sapiens
uugaugauuaauucaccuu

SEQ ID NO: 895705 - RNA, 22 nt, Homo sapiens
uugauggauuaauuaaauaagu

SEQ ID NO: 895706 - RNA, 23 nt, Homo sapiens
uugauggugcuccccuuccugcc

SEQ ID NO: 895707 - RNA, 16 nt, Homo sapiens
uugauuaaaacauuau

SEQ ID NO: 895708 - RNA, 18 nt, Homo sapiens
uugauuaaaaucuggcaa

SEQ ID NO: 895709 - RNA, 17 nt, Homo sapiens
uugauucacaaugaaau

SEQ ID NO: 895710 - RNA, 17 nt, Homo sapiens
uugauuuauauguguaa

SEQ ID NO: 895711 - RNA, 15 nt, Homo sapiens
uugauuucauuaaua

SEQ ID NO: 895712 - RNA, 23 nt, Homo sapiens
uugcaaaaauuauaaaguaauuu

SEQ ID NO: 895713 - RNA, 17 nt, Homo sapiens
uugcaaccacugcaacg

SEQ ID NO: 895714 - RNA, 14 nt, Homo sapiens
uugcaauggcagcc

SEQ ID NO: 895715 - RNA, 23 nt, Homo sapiens
uugcacagcucuccggucucucu

SEQ ID NO: 895716 - RNA, 16 nt, Homo sapiens
uugcacccaugccaua

SEQ ID NO: 895717 - RNA, 23 nt, Homo sapiens
uugcaccccuccuauaccauaug

SEQ ID NO: 895718 - RNA, 22 nt, Homo sapiens
uugcacuaggucaaaacauuca

SEQ ID NO: 895719 - RNA, 11 nt, Homo sapiens
uugcacugugg

SEQ ID NO: 895720 - RNA, 18 nt, Homo sapiens
uugcacuguuuucugucg

SEQ ID NO: 895721 - RNA, 11 nt, Homo sapiens
uugcacuuugu

SEQ ID NO: 895722 - RNA, 18 nt, Homo sapiens
uugcaggcucugggcuca

SEQ ID NO: 895723 - RNA, 16 nt, Homo sapiens
uugcagugagccauga

SEQ ID NO: 895724 - RNA, 13 nt, Homo sapiens
uugcauaugcaua

SEQ ID NO: 895725 - RNA, 20 nt, Homo sapiens
uugcaucuguuuugugaccu

SEQ ID NO: 895726 - RNA, 17 nt, Homo sapiens
uugccaaguuuuaagag

SEQ ID NO: 895727 - RNA, 18 nt, Homo sapiens
uugccagaugcaauacaa

SEQ ID NO: 895728 - RNA, 21 nt, Homo sapiens
uugccauuucucugcuuaccc

SEQ ID NO: 895729 - RNA, 23 nt, Homo sapiens
uugcccaucauacgcaugguccu

SEQ ID NO: 895730 - RNA, 19 nt, Homo sapiens
uugcccccuccccacuuuu

SEQ ID NO: 895731 - RNA, 18 nt, Homo sapiens
uugccccuuccacuuuga

SEQ ID NO: 895732 - RNA, 11 nt, Homo sapiens
uugcccuguga

SEQ ID NO: 895733 - RNA, 14 nt, Homo sapiens
uugccuaaauccaa

SEQ ID NO: 895734 - RNA, 19 nt, Homo sapiens
uugccuaauaaacauccuu

SEQ ID NO: 895735 - RNA, 18 nt, Homo sapiens
uugccuccuuauuuauca

SEQ ID NO: 895736 - RNA, 14 nt, Homo sapiens
uugcgaaugugcag

SEQ ID NO: 895737 - RNA, 19 nt, Homo sapiens
uugcgccacugcacuccag

SEQ ID NO: 895738 - RNA, 17 nt, Homo sapiens
uugcuacauaguccaaa

SEQ ID NO: 895739 - RNA, 17 nt, Homo sapiens
uugcuacugguucagca

SEQ ID NO: 895740 - RNA, 14 nt, Homo sapiens
uugcuaugaagcgu

SEQ ID NO: 895741 - RNA, 14 nt, Homo sapiens
uugcuccuugacau

SEQ ID NO: 895742 - RNA, 12 nt, Homo sapiens
uugcugacuuua

SEQ ID NO: 895743 - RNA, 22 nt, Homo sapiens
uugcugccaaacacccaugccc

SEQ ID NO: 895744 - RNA, 14 nt, Homo sapiens
uugcuggacuguca

SEQ ID NO: 895745 - RNA, 20 nt, Homo sapiens
uugcuuuaaaguaccuguag

SEQ ID NO: 895746 - RNA, 17 nt, Homo sapiens
uuggaaagcaucaccuc

SEQ ID NO: 895747 - RNA, 23 nt, Homo sapiens
uuggaaagcaucaccucaggcca

SEQ ID NO: 895748 - RNA, 16 nt, Homo sapiens
uuggaaagguuucaag

SEQ ID NO: 895749 - RNA, 18 nt, Homo sapiens
uuggaaaguucagccaga

SEQ ID NO: 895750 - RNA, 20 nt, Homo sapiens
uuggaagaggacuccuuaaa

SEQ ID NO: 895751 - RNA, 22 nt, Homo sapiens
uuggaagagggcgaguucagca

SEQ ID NO: 895752 - RNA, 20 nt, Homo sapiens
uuggaaggcucccuaacaca

SEQ ID NO: 895753 - RNA, 20 nt, Homo sapiens
uuggaaguguucccugagaa

SEQ ID NO: 895754 - RNA, 14 nt, Homo sapiens
uuggaauacuugaa

SEQ ID NO: 895755 - RNA, 12 nt, Homo sapiens
uuggaauucugg

SEQ ID NO: 895756 - RNA, 14 nt, Homo sapiens
uuggaauucuggau

SEQ ID NO: 895757 - RNA, 14 nt, Homo sapiens
uuggacagcugcuu

SEQ ID NO: 895758 - RNA, 15 nt, Homo sapiens
uuggagagacacagc

SEQ ID NO: 895759 - RNA, 22 nt, Homo sapiens
uuggagagcagcuggcucucca

SEQ ID NO: 895760 - RNA, 18 nt, Homo sapiens
uuggauuauucauuuaaa

SEQ ID NO: 895761 - RNA, 13 nt, Homo sapiens
uuggcaacagaag

SEQ ID NO: 895762 - RNA, 20 nt, Homo sapiens
uuggcaacagaagcaguuga

SEQ ID NO: 895763 - RNA, 12 nt, Homo sapiens
uuggcagugugu

SEQ ID NO: 895764 - RNA, 21 nt, Homo sapiens
uuggcagugugucacacugag

SEQ ID NO: 895765 - RNA, 13 nt, Homo sapiens
uuggcaugaaggu

SEQ ID NO: 895766 - RNA, 13 nt, Homo sapiens
uugggagcacugg

SEQ ID NO: 895767 - RNA, 14 nt, Homo sapiens
uugggaggccaagg

SEQ ID NO: 895768 - RNA, 21 nt, Homo sapiens
uugggaugagaaugaaagcuu

SEQ ID NO: 895769 - RNA, 21 nt, Homo sapiens
uugggaugcggggcagagcca

SEQ ID NO: 895770 - RNA, 18 nt, Homo sapiens
uugggaugggaucccagg

SEQ ID NO: 895771 - RNA, 20 nt, Homo sapiens
uugggauucuaggaaaccca

SEQ ID NO: 895772 - RNA, 20 nt, Homo sapiens
uugggauuuugguuucuucc

SEQ ID NO: 895773 - RNA, 15 nt, Homo sapiens
uugggcaugcucagc

SEQ ID NO: 895774 - RNA, 10 nt, Homo sapiens
uugggcuccu

SEQ ID NO: 895775 - RNA, 16 nt, Homo sapiens
uugggcuggugucacc

SEQ ID NO: 895776 - RNA, 20 nt, Homo sapiens
uuggggaugagaaagguuga

SEQ ID NO: 895777 - RNA, 21 nt, Homo sapiens
uuggggcacagucauucacau

SEQ ID NO: 895778 - RNA, 12 nt, Homo sapiens
uugggggcucca

SEQ ID NO: 895779 - RNA, 21 nt, Homo sapiens
uugguacuacuagaugucuuu

SEQ ID NO: 895780 - RNA, 21 nt, Homo sapiens
uugguacuagauacugaaugu

SEQ ID NO: 895781 - RNA, 16 nt, Homo sapiens
uuggucccgugcagcu

SEQ ID NO: 895782 - RNA, 11 nt, Homo sapiens
uuggugccacu

SEQ ID NO: 895783 - RNA, 16 nt, Homo sapiens
uugguuagcuggacau

SEQ ID NO: 895784 - RNA, 22 nt, Homo sapiens
uugguugaacuaugcugaagag

SEQ ID NO: 895785 - RNA, 20 nt, Homo sapiens
uuguaaaauauuuaugagaa

SEQ ID NO: 895786 - RNA, 23 nt, Homo sapiens
uuguaaacagcuaauaaugaagu

SEQ ID NO: 895787 - RNA, 16 nt, Homo sapiens
uuguaacuucaaauau

SEQ ID NO: 895788 - RNA, 20 nt, Homo sapiens
uuguaagaguggaaccaaca

SEQ ID NO: 895789 - RNA, 17 nt, Homo sapiens
uuguaaguugaagcaaa

SEQ ID NO: 895790 - RNA, 14 nt, Homo sapiens
uuguaauaaacucu

SEQ ID NO: 895791 - RNA, 21 nt, Homo sapiens
uuguaauaguccauggacaau

SEQ ID NO: 895792 - RNA, 13 nt, Homo sapiens
uuguaauugcuua

SEQ ID NO: 895793 - RNA, 20 nt, Homo sapiens
uuguacagacguaugcuuau

SEQ ID NO: 895794 - RNA, 12 nt, Homo sapiens
uuguacauuccc

SEQ ID NO: 895795 - RNA, 14 nt, Homo sapiens
uuaguauaaguaca

SEQ ID NO: 895796 - RNA, 13 nt, Homo sapiens
uuaguaucucauc

SEQ ID NO: 895797 - RNA, 22 nt, Homo sapiens
uuaguauuauuguugcauuaaa

SEQ ID NO: 895798 - RNA, 20 nt, Homo sapiens
uuaguccgcaaguucaggga

SEQ ID NO: 895799 - RNA, 18 nt, Homo sapiens
uuagucugucauccagaa

SEQ ID NO: 895800 - RNA, 17 nt, Homo sapiens
uuaguuaagucauccac

SEQ ID NO: 895801 - RNA, 23 nt, Homo sapiens
uuauaaaagaauaaaauugcacu

SEQ ID NO: 895802 - RNA, 19 nt, Homo sapiens
uuauaauaaaauugguguu

SEQ ID NO: 895803 - RNA, 16 nt, Homo sapiens
uuauaauaauguucuc

SEQ ID NO: 895804 - RNA, 12 nt, Homo sapiens
uuauacauauca

SEQ ID NO: 895805 - RNA, 19 nt, Homo sapiens
uuauacuguggcuaugcaa

SEQ ID NO: 895806 - RNA, 18 nt, Homo sapiens
uuauagccgaaaugaucu

SEQ ID NO: 895807 - RNA, 14 nt, Homo sapiens
uuauagguuuccac

SEQ ID NO: 895808 - RNA, 15 nt, Homo sapiens
uuauagguuuccacu

SEQ ID NO: 895809 - RNA, 16 nt, Homo sapiens
uuauauauuacuuguu

SEQ ID NO: 895810 - RNA, 19 nt, Homo sapiens
uuauauauuaugucauuca

SEQ ID NO: 895811 - RNA, 13 nt, Homo sapiens
uuauaucaucagc

SEQ ID NO: 895812 - RNA, 20 nt, Homo sapiens
uuauaugaaauguuucacua

SEQ ID NO: 895813 - RNA, 21 nt, Homo sapiens
uuauaugacaauccugaagaa

SEQ ID NO: 895814 - RNA, 16 nt, Homo sapiens
uuauauguaguacuaa

SEQ ID NO: 895815 - RNA, 23 nt, Homo sapiens
uuauauucaaggaucucaaagaa

SEQ ID NO: 895816 - RNA, 15 nt, Homo sapiens
uuauauuuacuuuaa

SEQ ID NO: 895817 - RNA, 20 nt, Homo sapiens
uuaucaaaaaguacaauaau

SEQ ID NO: 895818 - RNA, 23 nt, Homo sapiens
uuaucaaaaucuuucagcacuca

SEQ ID NO: 895819 - RNA, 14 nt, Homo sapiens
uuaucagucauaac

SEQ ID NO: 895820 - RNA, 20 nt, Homo sapiens
uuaucaucucgaccacuuuu

SEQ ID NO: 895821 - RNA, 18 nt, Homo sapiens
uuaucgggagcagugucu

SEQ ID NO: 895822 - RNA, 12 nt, Homo sapiens
uuaucugugcaa

SEQ ID NO: 895823 - RNA, 13 nt, Homo sapiens
uuaucugugcaaa

SEQ ID NO: 895824 - RNA, 15 nt, Homo sapiens
uuaucuugacauuca

SEQ ID NO: 895825 - RNA, 15 nt, Homo sapiens
uuaucuuggacugac

SEQ ID NO: 895826 - RNA, 22 nt, Homo sapiens
uuaugagcucuucauguuucag

SEQ ID NO: 895827 - RNA, 22 nt, Homo sapiens
uuauggcaagugauaucaccuc

SEQ ID NO: 895828 - RNA, 14 nt, Homo sapiens
uuauguaaucucac

SEQ ID NO: 895829 - RNA, 11 nt, Homo sapiens
uuaugugacaa

SEQ ID NO: 895830 - RNA, 11 nt, Homo sapiens
uuaugugcaau

SEQ ID NO: 895831 - RNA, 12 nt, Homo sapiens
uuaugugcaaua

SEQ ID NO: 895832 - RNA, 17 nt, Homo sapiens
uuauguuugcacuuugu

SEQ ID NO: 895833 - RNA, 20 nt, Homo sapiens
uuauuaaugaacugugacag

SEQ ID NO: 895834 - RNA, 14 nt, Homo sapiens
uuauuaaugacaaa

SEQ ID NO: 895835 - RNA, 15 nt, Homo sapiens
uuauuaccucugaua

SEQ ID NO: 895836 - RNA, 21 nt, Homo sapiens
uuauuaccucugauaccucaa

SEQ ID NO: 895837 - RNA, 15 nt, Homo sapiens
uuauuauaugacuag

SEQ ID NO: 895838 - RNA, 17 nt, Homo sapiens
uuauucaagugccucuu

SEQ ID NO: 895839 - RNA, 12 nt, Homo sapiens
uuauucagugau

SEQ ID NO: 895840 - RNA, 17 nt, Homo sapiens
uuauucauucagugaga

SEQ ID NO: 895841 - RNA, 14 nt, Homo sapiens
uuauuccuccagga

SEQ ID NO: 895842 - RNA, 15 nt, Homo sapiens
uuauuccuuugcaua

SEQ ID NO: 895843 - RNA, 15 nt, Homo sapiens
uuauucucuucacuc

SEQ ID NO: 895844 - RNA, 16 nt, Homo sapiens
uuauucugauuccacu

SEQ ID NO: 895845 - RNA, 12 nt, Homo sapiens
uuauugagcucu

SEQ ID NO: 895846 - RNA, 15 nt, Homo sapiens
uuauugcacuaugaa

SEQ ID NO: 895847 - RNA, 18 nt, Homo sapiens
uuauugguguuuacccag

SEQ ID NO: 895848 - RNA, 14 nt, Homo sapiens
uuauugucuaggcc

SEQ ID NO: 895849 - RNA, 16 nt, Homo sapiens
uuauuguugcauuaaa

SEQ ID NO: 895850 - RNA, 20 nt, Homo sapiens
uuauuuacaaugcagaauuu

SEQ ID NO: 895851 - RNA, 22 nt, Homo sapiens
uuauuuaguuggaggccuuuag

SEQ ID NO: 895852 - RNA, 14 nt, Homo sapiens
uuauuuauauauga

SEQ ID NO: 895853 - RNA, 17 nt, Homo sapiens
uuauuuguacaguucag

SEQ ID NO: 895854 - RNA, 22 nt, Homo sapiens
uuauuuuucauauugugccaau

SEQ ID NO: 895855 - RNA, 12 nt, Homo sapiens
uuauuuuugcaa

SEQ ID NO: 895856 - RNA, 14 nt, Homo sapiens
uucaaaacauugug

SEQ ID NO: 895857 - RNA, 22 nt, Homo sapiens
uucaaaacauugugccauguca

SEQ ID NO: 895858 - RNA, 18 nt, Homo sapiens
uucaaaagguuauauacc

SEQ ID NO: 895859 - RNA, 18 nt, Homo sapiens
uucaaacugcaugauuca

SEQ ID NO: 895860 - RNA, 19 nt, Homo sapiens
uucaaacugcaugauucau

SEQ ID NO: 895861 - RNA, 18 nt, Homo sapiens
uucaaagacagagaagac

SEQ ID NO: 895862 - RNA, 20 nt, Homo sapiens
uucaaagacagagaagacca

SEQ ID NO: 895863 - RNA, 15 nt, Homo sapiens
uucaaagcaggguuc

SEQ ID NO: 895864 - RNA, 15 nt, Homo sapiens
uucaaccacuguaaa

SEQ ID NO: 895865 - RNA, 19 nt, Homo sapiens
uucaacuaguaccacagaa

SEQ ID NO: 895866 - RNA, 14 nt, Homo sapiens
uucaacuccagaag

SEQ ID NO: 895867 - RNA, 11 nt, Homo sapiens
uucaacuggag

SEQ ID NO: 895868 - RNA, 16 nt, Homo sapiens
uucaagccugugaaua

SEQ ID NO: 895869 - RNA, 14 nt, Homo sapiens
uucaaggaaaguga

SEQ ID NO: 895870 - RNA, 13 nt, Homo sapiens
uucaagguguaaa

SEQ ID NO: 895871 - RNA, 18 nt, Homo sapiens
uucaaguauuagggguaa

SEQ ID NO: 895872 - RNA, 12 nt, Homo sapiens
uucaauacuuca

SEQ ID NO: 895873 - RNA, 21 nt, Homo sapiens
uucaaucccggaagggacuua

SEQ ID NO: 895874 - RNA, 18 nt, Homo sapiens
uucaaucuuugcuguaua

SEQ ID NO: 895875 - RNA, 12 nt, Homo sapiens
uucaaugaacaa

SEQ ID NO: 895876 - RNA, 17 nt, Homo sapiens
uucaaugcuuccuccuu

SEQ ID NO: 895877 - RNA, 22 nt, Homo sapiens
uucaauucucauuugucacaca

SEQ ID NO: 895878 - RNA, 20 nt, Homo sapiens
uucacaaaaaggcauaugca

SEQ ID NO: 895879 - RNA, 23 nt, Homo sapiens
uucacaaaaaggcauaugcaaua

SEQ ID NO: 895880 - RNA, 19 nt, Homo sapiens
uucacaaaguuuguucccu

SEQ ID NO: 895881 - RNA, 23 nt, Homo sapiens
uucacaccucacgcucuggacau

SEQ ID NO: 895882 - RNA, 13 nt, Homo sapiens
uucacagccagac

SEQ ID NO: 895883 - RNA, 19 nt, Homo sapiens
uucacagccagacuggcac

SEQ ID NO: 895884 - RNA, 10 nt, Homo sapiens
uucacauaaa

SEQ ID NO: 895885 - RNA, 22 nt, Homo sapiens
uucacauauauguaauuuagca

SEQ ID NO: 895886 - RNA, 16 nt, Homo sapiens
uucacaucagcuuuag

SEQ ID NO: 895887 - RNA, 19 nt, Homo sapiens
uucacauucccaucuguca

SEQ ID NO: 895888 - RNA, 13 nt, Homo sapiens
uucacauuuugcc

SEQ ID NO: 895889 - RNA, 17 nt, Homo sapiens
uucaccacaugugcaca

SEQ ID NO: 895890 - RNA, 16 nt, Homo sapiens
uucaccacauucguca

SEQ ID NO: 895891 - RNA, 15 nt, Homo sapiens
uucaccauacuucau

SEQ ID NO: 895892 - RNA, 15 nt, Homo sapiens
uucacugcacaagau

SEQ ID NO: 895893 - RNA, 13 nt, Homo sapiens
uucacuucagagc

SEQ ID NO: 895894 - RNA, 20 nt, Homo sapiens
uucagaaauaaaaugaaaug

SEQ ID NO: 895895 - RNA, 19 nt, Homo sapiens
uucagaacagaggcauuua

SEQ ID NO: 895896 - RNA, 18 nt, Homo sapiens
uucagaagaaaaagaagc

SEQ ID NO: 895897 - RNA, 17 nt, Homo sapiens
uucagaagagaugggcu

SEQ ID NO: 895898 - RNA, 22 nt, Homo sapiens
uucagaagccccauuugcacag

SEQ ID NO: 895899 - RNA, 14 nt, Homo sapiens
uucagaccagugaa

SEQ ID NO: 895900 - RNA, 23 nt, Homo sapiens
uucagaguugcuuuaaaguaccu

SEQ ID NO: 895901 - RNA, 14 nt, Homo sapiens
uucagccaccucuc

SEQ ID NO: 895902 - RNA, 20 nt, Homo sapiens
uucagccuagccgaccucag

SEQ ID NO: 895903 - RNA, 18 nt, Homo sapiens
uucaucaauuuucacuug

SEQ ID NO: 895904 - RNA, 21 nt, Homo sapiens
uucaucaauuuuuauacauau

SEQ ID NO: 895905 - RNA, 15 nt, Homo sapiens
uucaucagaccacuc

SEQ ID NO: 895906 - RNA, 22 nt, Homo sapiens
uucaucagacuccugugcaacu

SEQ ID NO: 895907 - RNA, 13 nt, Homo sapiens
uucauccaaggaa

SEQ ID NO: 895908 - RNA, 19 nt, Homo sapiens
uucaucuacuacaggguga

SEQ ID NO: 895909 - RNA, 15 nt, Homo sapiens
uucaucuauucuuuc

SEQ ID NO: 895910 - RNA, 11 nt, Homo sapiens
uucaugaacac

SEQ ID NO: 895911 - RNA, 20 nt, Homo sapiens
uucaugacuuuuccauguau

SEQ ID NO: 895912 - RNA, 18 nt, Homo sapiens
uucauucaguacaagaga

SEQ ID NO: 895913 - RNA, 15 nt, Homo sapiens
uucauuguaaucaaa

SEQ ID NO: 895914 - RNA, 23 nt, Homo sapiens
uucauuucagauaaacaacaaau

SEQ ID NO: 895915 - RNA, 18 nt, Homo sapiens
uuccaaccccuuuccacg

SEQ ID NO: 895916 - RNA, 20 nt, Homo sapiens
uuccaacuaacguacauuca

SEQ ID NO: 895917 - RNA, 18 nt, Homo sapiens
uuccaagauaaaaccaga

SEQ ID NO: 895918 - RNA, 14 nt, Homo sapiens
uuccaagugccaau

SEQ ID NO: 895919 - RNA, 22 nt, Homo sapiens
uuccaaguuccugcacuccaga

SEQ ID NO: 895920 - RNA, 20 nt, Homo sapiens
uuccacaagaugcugcaaug

SEQ ID NO: 895921 - RNA, 21 nt, Homo sapiens
uuccacacagggugcauguga

SEQ ID NO: 895922 - RNA, 18 nt, Homo sapiens
uuccacaccuagcaucuc

SEQ ID NO: 895923 - RNA, 20 nt, Homo sapiens
uuccacagaauacaagccac

SEQ ID NO: 895924 - RNA, 13 nt, Homo sapiens
uuccacauuaauu

SEQ ID NO: 895925 - RNA, 14 nt, Homo sapiens
uuccaccaucaaau

SEQ ID NO: 895926 - RNA, 19 nt, Homo sapiens
uuccaccaucaaaugcugu

SEQ ID NO: 895927 - RNA, 16 nt, Homo sapiens
uuccacuggcuccaca

SEQ ID NO: 895928 - RNA, 20 nt, Homo sapiens
uuccacuggcuccacaucca

SEQ ID NO: 895929 - RNA, 13 nt, Homo sapiens
uuccagacugcuu

SEQ ID NO: 895930 - RNA, 14 nt, Homo sapiens
uuccagcauuugcc

SEQ ID NO: 895931 - RNA, 22 nt, Homo sapiens
uuccagccccuauguuauugau

SEQ ID NO: 895932 - RNA, 20 nt, Homo sapiens
uuccagcuagugacccacau

SEQ ID NO: 895933 - RNA, 23 nt, Homo sapiens
uuccagggcauccgcagcccagg

SEQ ID NO: 895934 - RNA, 19 nt, Homo sapiens
uuccaguucaucuauggca

SEQ ID NO: 895935 - RNA, 23 nt, Homo sapiens
uuccauaaccccaggcaucccau

SEQ ID NO: 895936 - RNA, 21 nt, Homo sapiens
uuccaucugauugugauguga

SEQ ID NO: 895937 - RNA, 16 nt, Homo sapiens
uuccaugaaaaugcaa

SEQ ID NO: 895938 - RNA, 22 nt, Homo sapiens
uuccaugagaacagcaggguag

SEQ ID NO: 895939 - RNA, 20 nt, Homo sapiens
uuccauuuccaguucaucua

SEQ ID NO: 895940 - RNA, 20 nt, Homo sapiens
uucccaagcucuagugggaa

SEQ ID NO: 895941 - RNA, 13 nt, Homo sapiens
uucccagcugucu

SEQ ID NO: 895942 - RNA, 12 nt, Homo sapiens
uucccaguaauu

SEQ ID NO: 895943 - RNA, 17 nt, Homo sapiens
uuccccaagaaggugag

SEQ ID NO: 895944 - RNA, 14 nt, Homo sapiens
uucccccagacaga

SEQ ID NO: 895945 - RNA, 22 nt, Homo sapiens
uuccccucuacuccaugcacau

SEQ ID NO: 895946 - RNA, 14 nt, Homo sapiens
uucccuaaugaagu

SEQ ID NO: 895947 - RNA, 21 nt, Homo sapiens
uucccuaggcugagcuggcau

SEQ ID NO: 895948 - RNA, 20 nt, Homo sapiens
uucccuaucaaaacauauca

SEQ ID NO: 895949 - RNA, 20 nt, Homo sapiens
uucccugaaaacccagagag

SEQ ID NO: 895950 - RNA, 22 nt, Homo sapiens
uucccugaauguauugaacuug

SEQ ID NO: 895951 - RNA, 14 nt, Homo sapiens
uuccguaaacauau

SEQ ID NO: 895952 - RNA, 15 nt, Homo sapiens
uuccguaaacauaua

SEQ ID NO: 895953 - RNA, 17 nt, Homo sapiens
uuccuaacauuuugaag

SEQ ID NO: 895954 - RNA, 20 nt, Homo sapiens
uuccuaagccuguugcugaa

SEQ ID NO: 895955 - RNA, 19 nt, Homo sapiens
uuccuauuuguuuucaugg

SEQ ID NO: 895956 - RNA, 22 nt, Homo sapiens
uuccuauuuuaaaaccaugcag

SEQ ID NO: 895957 - RNA, 22 nt, Homo sapiens
uuccucacuaguguaaacaaaa

SEQ ID NO: 895958 - RNA, 20 nt, Homo sapiens
uuccucacuaugacacugag

SEQ ID NO: 895959 - RNA, 14 nt, Homo sapiens
uuccucagcugcca

SEQ ID NO: 895960 - RNA, 20 nt, Homo sapiens
uuccucagggacagagacac

SEQ ID NO: 895961 - RNA, 20 nt, Homo sapiens
uuccuccugaagccucugcc

SEQ ID NO: 895962 - RNA, 17 nt, Homo sapiens
uuccucgcaggucucag

SEQ ID NO: 895963 - RNA, 13 nt, Homo sapiens
uuccucuugccuc

SEQ ID NO: 895964 - RNA, 15 nt, Homo sapiens
uuccugaaugaaaua

SEQ ID NO: 895965 - RNA, 20 nt, Homo sapiens
uuccugacccucccuaccug

SEQ ID NO: 895966 - RNA, 16 nt, Homo sapiens
uuccugagaccacaga

SEQ ID NO: 895967 - RNA, 13 nt, Homo sapiens
uuccugagaccuc

SEQ ID NO: 895968 - RNA, 17 nt, Homo sapiens
uuccugcuacacaaaag

SEQ ID NO: 895969 - RNA, 22 nt, Homo sapiens
uuccuuagcuuagaccucagcc

SEQ ID NO: 895970 - RNA, 16 nt, Homo sapiens
uuccuugauucacaau

SEQ ID NO: 895971 - RNA, 17 nt, Homo sapiens
uuccuugggaugaucuu

SEQ ID NO: 895972 - RNA, 12 nt, Homo sapiens
uuccuuuugcca

SEQ ID NO: 895973 - RNA, 16 nt, Homo sapiens
uucgaaugacacuguu

SEQ ID NO: 895974 - RNA, 20 nt, Homo sapiens
uucgacccuuucucugagag

SEQ ID NO: 895975 - RNA, 11 nt, Homo sapiens
uucgcuugcuu

SEQ ID NO: 895976 - RNA, 18 nt, Homo sapiens
uucgguacuuacccggag

SEQ ID NO: 895977 - RNA, 20 nt, Homo sapiens
uucuaaguggggugcauccc

SEQ ID NO: 895978 - RNA, 23 nt, Homo sapiens
uucuaaucuuguuaaauugcuua

SEQ ID NO: 895979 - RNA, 14 nt, Homo sapiens
uucuaaugucuuca

SEQ ID NO: 895980 - RNA, 22 nt, Homo sapiens
uucuacacaguaaaaacuugua

SEQ ID NO: 895981 - RNA, 19 nt, Homo sapiens
uucuacauacuauggaauu

SEQ ID NO: 895982 - RNA, 15 nt, Homo sapiens
uucuaccauuugaau

SEQ ID NO: 895983 - RNA, 21 nt, Homo sapiens
uucuaccuuuaaaauuuacca

SEQ ID NO: 895984 - RNA, 20 nt, Homo sapiens
uucuagaucuggaaccuuac

SEQ ID NO: 895985 - RNA, 13 nt, Homo sapiens
uucuagcuacaau

SEQ ID NO: 895986 - RNA, 16 nt, Homo sapiens
uucuaggaagcuccag

SEQ ID NO: 895987 - RNA, 15 nt, Homo sapiens
uucuaggucuguaau

SEQ ID NO: 895988 - RNA, 22 nt, Homo sapiens
uucuagucuccuuugcacugag

SEQ ID NO: 895989 - RNA, 22 nt, Homo sapiens
uucuaguguaacacugcaagaa

SEQ ID NO: 895990 - RNA, 22 nt, Homo sapiens
uucuauuacgugcaauacuuca

SEQ ID NO: 895991 - RNA, 12 nt, Homo sapiens
uucuauuccuau

SEQ ID NO: 895992 - RNA, 15 nt, Homo sapiens
uucuauucuaaguaa

SEQ ID NO: 895993 - RNA, 12 nt, Homo sapiens
uucuauuuacaa

SEQ ID NO: 895994 - RNA, 22 nt, Homo sapiens
uucucaaaugcuaaaugcaaac

SEQ ID NO: 895995 - RNA, 16 nt, Homo sapiens
uucucacacuauggca

SEQ ID NO: 895996 - RNA, 17 nt, Homo sapiens
uucucacacuauggcag

SEQ ID NO: 895997 - RNA, 16 nt, Homo sapiens
uucucacuccaccacc

SEQ ID NO: 895998 - RNA, 17 nt, Homo sapiens
uucucagccacaaaaua

SEQ ID NO: 895999 - RNA, 20 nt, Homo sapiens
uucucaguaaauauuaaccu

SEQ ID NO: 896000 - RNA, 23 nt, Homo sapiens
uucucaguaaauauuaaccugaa

SEQ ID NO: 896001 - RNA, 16 nt, Homo sapiens
uucucaucauauugua

SEQ ID NO: 896002 - RNA, 18 nt, Homo sapiens
uucucaucauauuguaug

SEQ ID NO: 896003 - RNA, 15 nt, Homo sapiens
uucucauuugucaca

SEQ ID NO: 896004 - RNA, 19 nt, Homo sapiens
uucucccucacuccugcca

SEQ ID NO: 896005 - RNA, 11 nt, Homo sapiens
uucuccugacc

SEQ ID NO: 896006 - RNA, 22 nt, Homo sapiens
uucuccuguugcaaugacacau

SEQ ID NO: 896007 - RNA, 15 nt, Homo sapiens
uucucuauuuugccu

SEQ ID NO: 896008 - RNA, 19 nt, Homo sapiens
gcuacugcaaaugcuauau

SEQ ID NO: 896009 - RNA, 13 nt, Homo sapiens
gcuacuugggagg

SEQ ID NO: 896010 - RNA, 15 nt, Homo sapiens
gcuagaaauaagccc

SEQ ID NO: 896011 - RNA, 11 nt, Homo sapiens
gcuagaaccug

SEQ ID NO: 896012 - RNA, 18 nt, Homo sapiens
gcuagacaagcuugucca

SEQ ID NO: 896013 - RNA, 23 nt, Homo sapiens
gcuagacuaggagguuccggugu

SEQ ID NO: 896014 - RNA, 19 nt, Homo sapiens
gcuagagugcaguggcaug

SEQ ID NO: 896015 - RNA, 18 nt, Homo sapiens
gcuaggagcaaagccugu

SEQ ID NO: 896016 - RNA, 13 nt, Homo sapiens
gcuaggauuacag

SEQ ID NO: 896017 - RNA, 15 nt, Homo sapiens
gcuagggaguggucu

SEQ ID NO: 896018 - RNA, 12 nt, Homo sapiens
gcuagugccuga

SEQ ID NO: 896019 - RNA, 15 nt, Homo sapiens
gcuaguuugaccuca

SEQ ID NO: 896020 - RNA, 18 nt, Homo sapiens
gcuauaugccuuaagcca

SEQ ID NO: 896021 - RNA, 15 nt, Homo sapiens
gcuauccaaauaacu

SEQ ID NO: 896022 - RNA, 11 nt, Homo sapiens
gcuaugaauga

SEQ ID NO: 896023 - RNA, 14 nt, Homo sapiens
gcuauuacugucug

SEQ ID NO: 896024 - RNA, 17 nt, Homo sapiens
gcuauuugagcaugcac

SEQ ID NO: 896025 - RNA, 11 nt, Homo sapiens
gcuauuugccu

SEQ ID NO: 896026 - RNA, 19 nt, Homo sapiens
gcucaaucaugaguaccuc

SEQ ID NO: 896027 - RNA, 16 nt, Homo sapiens
gcucacacccuaauaa

SEQ ID NO: 896028 - RNA, 20 nt, Homo sapiens
gcucacaccuguaaucccag

SEQ ID NO: 896029 - RNA, 20 nt, Homo sapiens
gcucacagcuggaacccugg

SEQ ID NO: 896030 - RNA, 18 nt, Homo sapiens
gcucagaggcccaggaau

SEQ ID NO: 896031 - RNA, 21 nt, Homo sapiens
gcucagguuuccuuccuucgc

SEQ ID NO: 896032 - RNA, 19 nt, Homo sapiens
gcucauccaggguguuaca

SEQ ID NO: 896033 - RNA, 23 nt, Homo sapiens
gcucauuuaguuagaaaauaagg

SEQ ID NO: 896034 - RNA, 15 nt, Homo sapiens
gcucauuuuaggccu

SEQ ID NO: 896035 - RNA, 21 nt, Homo sapiens
gcuccagagagaggaugcaga

SEQ ID NO: 896036 - RNA, 17 nt, Homo sapiens
gcuccagaucugcacug

SEQ ID NO: 896037 - RNA, 22 nt, Homo sapiens
gcuccaguauggaagaaugggg

SEQ ID NO: 896038 - RNA, 18 nt, Homo sapiens
gcuccaucuccaguggga

SEQ ID NO: 896039 - RNA, 23 nt, Homo sapiens
gcuccccugggggcuagcagaag

SEQ ID NO: 896040 - RNA, 18 nt, Homo sapiens
gcuccuaguuugaccuca

SEQ ID NO: 896041 - RNA, 17 nt, Homo sapiens
gcuccugccuugaugaa

SEQ ID NO: 896042 - RNA, 15 nt, Homo sapiens
gcuccugugcuacuu

SEQ ID NO: 896043 - RNA, 17 nt, Homo sapiens
gcuccuuuaccuaccac

SEQ ID NO: 896044 - RNA, 15 nt, Homo sapiens
gcucggggugcacag

SEQ ID NO: 896045 - RNA, 23 nt, Homo sapiens
gcucucaccgggcuacuaccugg

SEQ ID NO: 896046 - RNA, 15 nt, Homo sapiens
gcucugacauucuga

SEQ ID NO: 896047 - RNA, 22 nt, Homo sapiens
gcucugcaaugggcacugggau

SEQ ID NO: 896048 - RNA, 23 nt, Homo sapiens
gcucugcccacugugaaaccacu

SEQ ID NO: 896049 - RNA, 14 nt, Homo sapiens
gcucuggacaggca

SEQ ID NO: 896050 - RNA, 15 nt, Homo sapiens
gcucuggcaccacua

SEQ ID NO: 896051 - RNA, 23 nt, Homo sapiens
gcucuggcuguuugucuauaugu

SEQ ID NO: 896052 - RNA, 16 nt, Homo sapiens
gcucuguccacucuga

SEQ ID NO: 896053 - RNA, 23 nt, Homo sapiens
gcucuguguuucuggggacacca

SEQ ID NO: 896054 - RNA, 22 nt, Homo sapiens
gcucuuaggugcuucuucacuu

SEQ ID NO: 896055 - RNA, 16 nt, Homo sapiens
gcucuuggaagagcuc

SEQ ID NO: 896056 - RNA, 17 nt, Homo sapiens
gcucuuucccuuuauca

SEQ ID NO: 896057 - RNA, 18 nt, Homo sapiens
gcugaauagcuucuccaa

SEQ ID NO: 896058 - RNA, 16 nt, Homo sapiens
gcugaauuucaggcau

SEQ ID NO: 896059 - RNA, 12 nt, Homo sapiens
gcugacaucucc

SEQ ID NO: 896060 - RNA, 21 nt, Homo sapiens
gcugacaucuccucuaucaca

SEQ ID NO: 896061 - RNA, 15 nt, Homo sapiens
gcugacggaagccaa

SEQ ID NO: 896062 - RNA, 18 nt, Homo sapiens
gcugacuguacuccuccc

SEQ ID NO: 896063 - RNA, 21 nt, Homo sapiens
gcugagagaguuaagugaaug

SEQ ID NO: 896064 - RNA, 18 nt, Homo sapiens
gcugagccuucugaugag

SEQ ID NO: 896065 - RNA, 13 nt, Homo sapiens
gcugagcucugag

SEQ ID NO: 896066 - RNA, 16 nt, Homo sapiens
gcugagcugaacccau

SEQ ID NO: 896067 - RNA, 21 nt, Homo sapiens
gcugaggcaggaggaucgccu

SEQ ID NO: 896068 - RNA, 13 nt, Homo sapiens
gcugagggcauua

SEQ ID NO: 896069 - RNA, 21 nt, Homo sapiens
gcugaggggaggaucacugga

SEQ ID NO: 896070 - RNA, 19 nt, Homo sapiens
gcugaguuuccccacuuua

SEQ ID NO: 896071 - RNA, 15 nt, Homo sapiens
gcugauacuaucucu

SEQ ID NO: 896072 - RNA, 14 nt, Homo sapiens
gcugauucaagaaa

SEQ ID NO: 896073 - RNA, 19 nt, Homo sapiens
gcugauucaagaaacagaa

SEQ ID NO: 896074 - RNA, 14 nt, Homo sapiens
gcugcaagggccag

SEQ ID NO: 896075 - RNA, 21 nt, Homo sapiens
gcugcacaucacaacauuuac

SEQ ID NO: 896076 - RNA, 14 nt, Homo sapiens
auauaccuuacuga

SEQ ID NO: 896077 - RNA, 16 nt, Homo sapiens
auauaggagcaauacu

SEQ ID NO: 896078 - RNA, 13 nt, Homo sapiens
auauaguuuacua

SEQ ID NO: 896079 - RNA, 21 nt, Homo sapiens
auauauacacauacauacaca

SEQ ID NO: 896080 - RNA, 14 nt, Homo sapiens
auauauaccacuuu

SEQ ID NO: 896081 - RNA, 12 nt, Homo sapiens
auauauaugugu

SEQ ID NO: 896082 - RNA, 21 nt, Homo sapiens
auauaucuaugucuauaucau

SEQ ID NO: 896083 - RNA, 20 nt, Homo sapiens
auauauuuaugaaugugcau

SEQ ID NO: 896084 - RNA, 22 nt, Homo sapiens
auaucaauuaauuugaaaacau

SEQ ID NO: 896085 - RNA, 22 nt, Homo sapiens
auaucaugcuuuaaaguguaau

SEQ ID NO: 896086 - RNA, 23 nt, Homo sapiens
auauccagauggcauguguuuac

SEQ ID NO: 896087 - RNA, 16 nt, Homo sapiens
auauccagcugaguga

SEQ ID NO: 896088 - RNA, 19 nt, Homo sapiens
auauccucucagcucucuu

SEQ ID NO: 896089 - RNA, 16 nt, Homo sapiens
auaucgggucacuguc

SEQ ID NO: 896090 - RNA, 13 nt, Homo sapiens
auaucuaccugcc

SEQ ID NO: 896091 - RNA, 21 nt, Homo sapiens
auaucuaccugcccucucuca

SEQ ID NO: 896092 - RNA, 18 nt, Homo sapiens
auaucuauaguagucaau

SEQ ID NO: 896093 - RNA, 21 nt, Homo sapiens
auaucugacaguuacucuuca

SEQ ID NO: 896094 - RNA, 23 nt, Homo sapiens
auaucuucaggacuauuucacua

SEQ ID NO: 896095 - RNA, 19 nt, Homo sapiens
auaucuucauacaaugaca

SEQ ID NO: 896096 - RNA, 20 nt, Homo sapiens
auaucuugaagaauauuguu

SEQ ID NO: 896097 - RNA, 21 nt, Homo sapiens
auaugaacaaacuaugaucac

SEQ ID NO: 896098 - RNA, 18 nt, Homo sapiens
auaugaacuggaccugca

SEQ ID NO: 896099 - RNA, 18 nt, Homo sapiens
auaugauuuuuauccaug

SEQ ID NO: 896100 - RNA, 22 nt, Homo sapiens
auaugcacacacacggaugcac

SEQ ID NO: 896101 - RNA, 19 nt, Homo sapiens
auaugcacacacauggaug

SEQ ID NO: 896102 - RNA, 16 nt, Homo sapiens
auaugcacacaccgau

SEQ ID NO: 896103 - RNA, 13 nt, Homo sapiens
auaugcacaugua

SEQ ID NO: 896104 - RNA, 20 nt, Homo sapiens
auaugcaccaaaucaucucu

SEQ ID NO: 896105 - RNA, 18 nt, Homo sapiens
auaugcaccuugugucug

SEQ ID NO: 896106 - RNA, 14 nt, Homo sapiens
auaugcugccaaau

SEQ ID NO: 896107 - RNA, 18 nt, Homo sapiens
auauggaaaaaaugaacu

SEQ ID NO: 896108 - RNA, 20 nt, Homo sapiens
auauggaaaaaaugaacuuu

SEQ ID NO: 896109 - RNA, 16 nt, Homo sapiens
auauggaaauccuguu

SEQ ID NO: 896110 - RNA, 16 nt, Homo sapiens
auauggaaauucugcu

SEQ ID NO: 896111 - RNA, 16 nt, Homo sapiens
auauggcagugucuuu

SEQ ID NO: 896112 - RNA, 16 nt, Homo sapiens
auaugggcucaaguca

SEQ ID NO: 896113 - RNA, 19 nt, Homo sapiens
auauguaaauagugcagaa

SEQ ID NO: 896114 - RNA, 15 nt, Homo sapiens
auauguauauauaug

SEQ ID NO: 896115 - RNA, 14 nt, Homo sapiens
auaugucuagcuca

SEQ ID NO: 896116 - RNA, 22 nt, Homo sapiens
auaugucugcuucuguccagga

SEQ ID NO: 896117 - RNA, 18 nt, Homo sapiens
auaugugcgucucucuuu

SEQ ID NO: 896118 - RNA, 19 nt, Homo sapiens
auauguguauauauauaug

SEQ ID NO: 896119 - RNA, 16 nt, Homo sapiens
auauguguucauuaaa

SEQ ID NO: 896120 - RNA, 16 nt, Homo sapiens
auauguucaacuggag

SEQ ID NO: 896121 - RNA, 21 nt, Homo sapiens
auauguuuuaagaggcagggu

SEQ ID NO: 896122 - RNA, 15 nt, Homo sapiens
auauuaaagcaccaa

SEQ ID NO: 896123 - RNA, 18 nt, Homo sapiens
auauuauaaauaaaugcc

SEQ ID NO: 896124 - RNA, 16 nt, Homo sapiens
auauuaugugaaauca

SEQ ID NO: 896125 - RNA, 18 nt, Homo sapiens
auauuauuugcuaauuaa

SEQ ID NO: 896126 - RNA, 18 nt, Homo sapiens
auauuccauccauauacu

SEQ ID NO: 896127 - RNA, 21 nt, Homo sapiens
auauucucaguguagggcaga

SEQ ID NO: 896128 - RNA, 18 nt, Homo sapiens
auauucugguuacugugg

SEQ ID NO: 896129 - RNA, 22 nt, Homo sapiens
auauuggucauugccuugccaa

SEQ ID NO: 896130 - RNA, 18 nt, Homo sapiens
auauuuaauggcaaugca

SEQ ID NO: 896131 - RNA, 21 nt, Homo sapiens
auauuuaugagaaaguucuca

SEQ ID NO: 896132 - RNA, 14 nt, Homo sapiens
auauuucaauguua

SEQ ID NO: 896133 - RNA, 18 nt, Homo sapiens
auauuugaagcaucacau

SEQ ID NO: 896134 - RNA, 23 nt, Homo sapiens
auauuugaauguguaagcauugu

SEQ ID NO: 896135 - RNA, 22 nt, Homo sapiens
auauuuguaucacaaaucuuaa

SEQ ID NO: 896136 - RNA, 14 nt, Homo sapiens
auauuuuagaugca

SEQ ID NO: 896137 - RNA, 23 nt, Homo sapiens
auauuuucuggguuaaaacccca

SEQ ID NO: 896138 - RNA, 16 nt, Homo sapiens
auauuuugcauaguac

SEQ ID NO: 896139 - RNA, 18 nt, Homo sapiens
auauuuuuaugugcaaua

SEQ ID NO: 896140 - RNA, 17 nt, Homo sapiens
auauuuuucaaccagca

SEQ ID NO: 896141 - RNA, 15 nt, Homo sapiens
aucaaaacauaucaa

SEQ ID NO: 896142 - RNA, 21 nt, Homo sapiens
aucaaaaucuuucagcacuca

SEQ ID NO: 896143 - RNA, 16 nt, Homo sapiens
aucaaaccccauggag

SEQ ID NO: 896144 - RNA, 15 nt, Homo sapiens
aucaaauugcuacau

SEQ ID NO: 896145 - RNA, 22 nt, Homo sapiens
aucaaauugcuacauaguccaa

SEQ ID NO: 896146 - RNA, 23 nt, Homo sapiens
aucaaccagcaggaaaguacaga

SEQ ID NO: 896147 - RNA, 20 nt, Homo sapiens
aucaacuuauuauaugacua

SEQ ID NO: 896148 - RNA, 17 nt, Homo sapiens
aucaagcccuuuacuug

SEQ ID NO: 896149 - RNA, 23 nt, Homo sapiens
aucaauccuucuuauguuugcuu

SEQ ID NO: 896150 - RNA, 13 nt, Homo sapiens
aucaaugucacuu

SEQ ID NO: 896151 - RNA, 15 nt, Homo sapiens
uuuauugugaucuau

SEQ ID NO: 896152 - RNA, 18 nt, Homo sapiens
uuuauuuaagcaucaaau

SEQ ID NO: 896153 - RNA, 17 nt, Homo sapiens
uuuauuuguauuugcca

SEQ ID NO: 896154 - RNA, 12 nt, Homo sapiens
uuucaaaacaca

SEQ ID NO: 896155 - RNA, 12 nt, Homo sapiens
uuucaaagugua

SEQ ID NO: 896156 - RNA, 16 nt, Homo sapiens
uuucaacaaguaacuu

SEQ ID NO: 896157 - RNA, 13 nt, Homo sapiens
uuucaaccagcau

SEQ ID NO: 896158 - RNA, 17 nt, Homo sapiens
uuucaacuaauauaucu

SEQ ID NO: 896159 - RNA, 12 nt, Homo sapiens
uuucaacuauuu

SEQ ID NO: 896160 - RNA, 21 nt, Homo sapiens
uuucaagacuugauacugcaa

SEQ ID NO: 896161 - RNA, 22 nt, Homo sapiens
uuucaaucucaucugauaugca

SEQ ID NO: 896162 - RNA, 22 nt, Homo sapiens
uuucacaaaaaggcauaugcaa

SEQ ID NO: 896163 - RNA, 14 nt, Homo sapiens
uuucacuaugauuu

SEQ ID NO: 896164 - RNA, 17 nt, Homo sapiens
uuucagagccagugaag

SEQ ID NO: 896165 - RNA, 14 nt, Homo sapiens
uuucagagugacac

SEQ ID NO: 896166 - RNA, 18 nt, Homo sapiens
uuucagauaaacaacaaa

SEQ ID NO: 896167 - RNA, 18 nt, Homo sapiens
uuucaguauaauuuaacu

SEQ ID NO: 896168 - RNA, 18 nt, Homo sapiens
uuucauaaccuagccuua

SEQ ID NO: 896169 - RNA, 15 nt, Homo sapiens
uuucaucuccagugu

SEQ ID NO: 896170 - RNA, 22 nt, Homo sapiens
uuucaucugcugcugaaacugu

SEQ ID NO: 896171 - RNA, 22 nt, Homo sapiens
uuucauggaaguggcagugaaa

SEQ ID NO: 896172 - RNA, 23 nt, Homo sapiens
uuucauuagaggaagaaaaccag

SEQ ID NO: 896173 - RNA, 18 nt, Homo sapiens
uuucauuguaaucaaaaa

SEQ ID NO: 896174 - RNA, 18 nt, Homo sapiens
uuucauuguguucucuau

SEQ ID NO: 896175 - RNA, 19 nt, Homo sapiens
uuuccaaagggcaguaaag

SEQ ID NO: 896176 - RNA, 18 nt, Homo sapiens
uuuccaagauaaaaccag

SEQ ID NO: 896177 - RNA, 15 nt, Homo sapiens
uuuccagucauuuca

SEQ ID NO: 896178 - RNA, 23 nt, Homo sapiens
uuucccaugauccagaacugagg

SEQ ID NO: 896179 - RNA, 12 nt, Homo sapiens
uuuccccagugu

SEQ ID NO: 896180 - RNA, 19 nt, Homo sapiens
uuucccccaaagaugugua

SEQ ID NO: 896181 - RNA, 18 nt, Homo sapiens
uuucccgcuccaagagaa

SEQ ID NO: 896182 - RNA, 13 nt, Homo sapiens
uuucccuuccagu

SEQ ID NO: 896183 - RNA, 22 nt, Homo sapiens
uuuccuaaagucucugcugcua

SEQ ID NO: 896184 - RNA, 13 nt, Homo sapiens
uuuccuccccacc

SEQ ID NO: 896185 - RNA, 21 nt, Homo sapiens
uuuccuccuguguacagggaa

SEQ ID NO: 896186 - RNA, 21 nt, Homo sapiens
uuuccucgccuaggccuguga

SEQ ID NO: 896187 - RNA, 15 nt, Homo sapiens
uuuccuucagugcau

SEQ ID NO: 896188 - RNA, 15 nt, Homo sapiens
uuuccuuuuaugaga

SEQ ID NO: 896189 - RNA, 13 nt, Homo sapiens
uuucgaacauucu

SEQ ID NO: 896190 - RNA, 23 nt, Homo sapiens
uuucuaaagcucugaacaaaagc

SEQ ID NO: 896191 - RNA, 11 nt, Homo sapiens
uuucuauucac

SEQ ID NO: 896192 - RNA, 20 nt, Homo sapiens
uuucucccacauauucacau

SEQ ID NO: 896193 - RNA, 16 nt, Homo sapiens
uuucucuaaaacugcc

SEQ ID NO: 896194 - RNA, 21 nt, Homo sapiens
uuucucugagcagucagggug

SEQ ID NO: 896195 - RNA, 18 nt, Homo sapiens
uuucucuugaagaacuga

SEQ ID NO: 896196 - RNA, 14 nt, Homo sapiens
uuucugagaaagac

SEQ ID NO: 896197 - RNA, 12 nt, Homo sapiens
uuucugagcuuu

SEQ ID NO: 896198 - RNA, 19 nt, Homo sapiens
uuucugcuaaaaaguccuu

SEQ ID NO: 896199 - RNA, 22 nt, Homo sapiens
uuucugcuaaaaaguccuugau

SEQ ID NO: 896200 - RNA, 23 nt, Homo sapiens
uuucugcucccucgacacuugau

SEQ ID NO: 896201 - RNA, 18 nt, Homo sapiens
uuucuggaaaacugccuu

SEQ ID NO: 896202 - RNA, 21 nt, Homo sapiens
uuucuggauaucaagauguua

SEQ ID NO: 896203 - RNA, 16 nt, Homo sapiens
uuucugucacaucagc

SEQ ID NO: 896204 - RNA, 22 nt, Homo sapiens
uuucuucagagagcuaaauuac

SEQ ID NO: 896205 - RNA, 16 nt, Homo sapiens
uuucuucaugcaauga

SEQ ID NO: 896206 - RNA, 12 nt, Homo sapiens
uuucuugccuca

SEQ ID NO: 896207 - RNA, 22 nt, Homo sapiens
uuucuuuaauaguuuugauccu

SEQ ID NO: 896208 - RNA, 23 nt, Homo sapiens
uuucuuuguaaaggucagaguca

SEQ ID NO: 896209 - RNA, 16 nt, Homo sapiens
uuugaaaaagcgaaaa

SEQ ID NO: 896210 - RNA, 18 nt, Homo sapiens
uuugaagcaucacauaaa

SEQ ID NO: 896211 - RNA, 18 nt, Homo sapiens
uuugaaguggccagauga

SEQ ID NO: 896212 - RNA, 17 nt, Homo sapiens
uuugaaugaguuuauau

SEQ ID NO: 896213 - RNA, 13 nt, Homo sapiens
uuugaauggugca

SEQ ID NO: 896214 - RNA, 23 nt, Homo sapiens
uuugaauuucaguaaacaaugaa

SEQ ID NO: 896215 - RNA, 14 nt, Homo sapiens
uuugacaaccauga

SEQ ID NO: 896216 - RNA, 13 nt, Homo sapiens
uuugacccacuca

SEQ ID NO: 896217 - RNA, 19 nt, Homo sapiens
uuugaccucauuuguaaaa

SEQ ID NO: 896218 - RNA, 13 nt, Homo sapiens
uuugacgagcuca

SEQ ID NO: 896219 - RNA, 22 nt, Homo sapiens
uuugagaacaauggagauauca

SEQ ID NO: 896220 - RNA, 16 nt, Homo sapiens
uuugaggcaaaggcca

SEQ ID NO: 896221 - RNA, 21 nt, Homo sapiens
uuugaggcaaaggccagcagc

SEQ ID NO: 896222 - RNA, 19 nt, Homo sapiens
uuugagugucuuugacuug

SEQ ID NO: 896223 - RNA, 15 nt, Homo sapiens
uuugaguugaauuua

SEQ ID NO: 896224 - RNA, 18 nt, Homo sapiens
uuugauaugaaguguuag

SEQ ID NO: 896225 - RNA, 15 nt, Homo sapiens
uuugaucacacagcc

SEQ ID NO: 896226 - RNA, 16 nt, Homo sapiens
uuugaucacacagcca

SEQ ID NO: 896227 - RNA, 21 nt, Homo sapiens
uuugaucucacacaccagggc

SEQ ID NO: 896228 - RNA, 20 nt, Homo sapiens
uuugaugauuaauucaccuu

SEQ ID NO: 896229 - RNA, 15 nt, Homo sapiens
uuugaugcauuucca

SEQ ID NO: 896230 - RNA, 22 nt, Homo sapiens
uuugaugccaagaaaguauuug

SEQ ID NO: 896231 - RNA, 14 nt, Homo sapiens
uuugauguuuacag

SEQ ID NO: 896232 - RNA, 21 nt, Homo sapiens
uuugcaaaauuuccaguaccu

SEQ ID NO: 896233 - RNA, 21 nt, Homo sapiens
uuugcaauggcuauauggcaa

SEQ ID NO: 896234 - RNA, 16 nt, Homo sapiens
uuugcacccaugccau

SEQ ID NO: 896235 - RNA, 19 nt, Homo sapiens
uuugcagcagugagucucu

SEQ ID NO: 896236 - RNA, 17 nt, Homo sapiens
uuugcagcugugccaua

SEQ ID NO: 896237 - RNA, 15 nt, Homo sapiens
uuugcauuccaugau

SEQ ID NO: 896238 - RNA, 16 nt, Homo sapiens
uaaagauaaaauaucc

SEQ ID NO: 896239 - RNA, 22 nt, Homo sapiens
uaaagcaguguuuucaccucau

SEQ ID NO: 896240 - RNA, 13 nt, Homo sapiens
uaaagcccuugaa

SEQ ID NO: 896241 - RNA, 14 nt, Homo sapiens
uaaagcccuugaac

SEQ ID NO: 896242 - RNA, 18 nt, Homo sapiens
uaaagcucaucagcuauc

SEQ ID NO: 896243 - RNA, 22 nt, Homo sapiens
uaaagcugccggcacagaacuu

SEQ ID NO: 896244 - RNA, 23 nt, Homo sapiens
uaaagcuuguuuguucuaguuag

SEQ ID NO: 896245 - RNA, 19 nt, Homo sapiens
uaaaggaagucaccaaaau

SEQ ID NO: 896246 - RNA, 23 nt, Homo sapiens
uaaagggcaggugguucuaauau

SEQ ID NO: 896247 - RNA, 13 nt, Homo sapiens
uaaaguaccauua

SEQ ID NO: 896248 - RNA, 23 nt, Homo sapiens
uaaaguagcaggacucggaauuc

SEQ ID NO: 896249 - RNA, 16 nt, Homo sapiens
uaaaguauauauuuau

SEQ ID NO: 896250 - RNA, 19 nt, Homo sapiens
uaaaguauguuauugcaua

SEQ ID NO: 896251 - RNA, 21 nt, Homo sapiens
uaaagucaacaaccaugccag

SEQ ID NO: 896252 - RNA, 16 nt, Homo sapiens
uaaaguccguauuucu

SEQ ID NO: 896253 - RNA, 14 nt, Homo sapiens
uaaagugauuucau

SEQ ID NO: 896254 - RNA, 18 nt, Homo sapiens
uaaagugguucuggauau

SEQ ID NO: 896255 - RNA, 15 nt, Homo sapiens
uaaaguugauaaaga

SEQ ID NO: 896256 - RNA, 15 nt, Homo sapiens
uaaauaacagugugu

SEQ ID NO: 896257 - RNA, 18 nt, Homo sapiens
uaaauaauguauacacau

SEQ ID NO: 896258 - RNA, 12 nt, Homo sapiens
uaaauacagaca

SEQ ID NO: 896259 - RNA, 19 nt, Homo sapiens
uaaauacaguggaucucaa

SEQ ID NO: 896260 - RNA, 15 nt, Homo sapiens
uaaauagaccucuca

SEQ ID NO: 896261 - RNA, 19 nt, Homo sapiens
uaaaucaaugucacuuaaa

SEQ ID NO: 896262 - RNA, 20 nt, Homo sapiens
uaaauccuugggagucauua

SEQ ID NO: 896263 - RNA, 12 nt, Homo sapiens
uaaaucuaauca

SEQ ID NO: 896264 - RNA, 16 nt, Homo sapiens
uaaaucugagaucucc

SEQ ID NO: 896265 - RNA, 17 nt, Homo sapiens
ucuggagucuccagugg

SEQ ID NO: 896266 - RNA, 14 nt, Homo sapiens
ucuggauaacaaga

SEQ ID NO: 896267 - RNA, 22 nt, Homo sapiens
ucuggauaacaagacuuugacu

SEQ ID NO: 896268 - RNA, 13 nt, Homo sapiens
ucuggauuuuccc

SEQ ID NO: 896269 - RNA, 20 nt, Homo sapiens
ucuggcaacccuagucugcu

SEQ ID NO: 896270 - RNA, 22 nt, Homo sapiens
ucuggcagccacacuucucagg

SEQ ID NO: 896271 - RNA, 20 nt, Homo sapiens
ucuggccaaccaaagacacu

SEQ ID NO: 896272 - RNA, 16 nt, Homo sapiens
ucuggccacugcugca

SEQ ID NO: 896273 - RNA, 16 nt, Homo sapiens
ucuggcccuucuugcc

SEQ ID NO: 896274 - RNA, 20 nt, Homo sapiens
ucuggccugggcgacagagc

SEQ ID NO: 896275 - RNA, 18 nt, Homo sapiens
ucugggauucccaccaag

SEQ ID NO: 896276 - RNA, 14 nt, Homo sapiens
ucugggcauugagc

SEQ ID NO: 896277 - RNA, 17 nt, Homo sapiens
ucugggccaaguuccuc

SEQ ID NO: 896278 - RNA, 14 nt, Homo sapiens
ucuguaagagaauu

SEQ ID NO: 896279 - RNA, 12 nt, Homo sapiens
ucuguaccuugc

SEQ ID NO: 896280 - RNA, 21 nt, Homo sapiens
ucugucaccagcuaucuguca

SEQ ID NO: 896281 - RNA, 16 nt, Homo sapiens
ucugucaucucucugg

SEQ ID NO: 896282 - RNA, 15 nt, Homo sapiens
ucuguccaaggcaca

SEQ ID NO: 896283 - RNA, 22 nt, Homo sapiens
ucuguccacucugaauaccaag

SEQ ID NO: 896284 - RNA, 13 nt, Homo sapiens
ucugucuggcuga

SEQ ID NO: 896285 - RNA, 22 nt, Homo sapiens
ucugucuguagagccgcauggc

SEQ ID NO: 896286 - RNA, 17 nt, Homo sapiens
ucugucuuccuucauua

SEQ ID NO: 896287 - RNA, 17 nt, Homo sapiens
ucugugaagaaugaagu

SEQ ID NO: 896288 - RNA, 17 nt, Homo sapiens
ucugugcuuugacucac

SEQ ID NO: 896289 - RNA, 23 nt, Homo sapiens
ucugugcuuugacucaccuguua

SEQ ID NO: 896290 - RNA, 13 nt, Homo sapiens
ucuguguaaccuc

SEQ ID NO: 896291 - RNA, 15 nt, Homo sapiens
ucugugucucuggaa

SEQ ID NO: 896292 - RNA, 15 nt, Homo sapiens
ucuguuaaucaugua

SEQ ID NO: 896293 - RNA, 16 nt, Homo sapiens
ucuguucugccuuccg

SEQ ID NO: 896294 - RNA, 22 nt, Homo sapiens
ucuguuuauaugacauuguuaa

SEQ ID NO: 896295 - RNA, 16 nt, Homo sapiens
ucuuaaaauaacuuau

SEQ ID NO: 896296 - RNA, 23 nt, Homo sapiens
ucuuaaaggagaaguagcuguga

SEQ ID NO: 896297 - RNA, 20 nt, Homo sapiens
ucuuaauucaacuaguacca

SEQ ID NO: 896298 - RNA, 21 nt, Homo sapiens
ucuuacaauaauucuaugaga

SEQ ID NO: 896299 - RNA, 22 nt, Homo sapiens
ucuuacaauaauucuaugagau

SEQ ID NO: 896300 - RNA, 15 nt, Homo sapiens
ucuuagccucccaaa

SEQ ID NO: 896301 - RNA, 13 nt, Homo sapiens
ucuuagugucacu

SEQ ID NO: 896302 - RNA, 15 nt, Homo sapiens
ucuuagugucacuua

SEQ ID NO: 896303 - RNA, 17 nt, Homo sapiens
ucuuauauaguauucau

SEQ ID NO: 896304 - RNA, 19 nt, Homo sapiens
ucuuaugaaaugggcuuua

SEQ ID NO: 896305 - RNA, 15 nt, Homo sapiens
ucuuauguuugcuuu

SEQ ID NO: 896306 - RNA, 16 nt, Homo sapiens
ucuuauuuaacuuaac

SEQ ID NO: 896307 - RNA, 22 nt, Homo sapiens
ucuuauuuaauuuuugcaauua

SEQ ID NO: 896308 - RNA, 14 nt, Homo sapiens
ucuuauuuccucaa

SEQ ID NO: 896309 - RNA, 17 nt, Homo sapiens
ucuucaaagacaaugga

SEQ ID NO: 896310 - RNA, 19 nt, Homo sapiens
ucuucaacuuuugugcucc

SEQ ID NO: 896311 - RNA, 18 nt, Homo sapiens
ucuucaccccccacucac

SEQ ID NO: 896312 - RNA, 15 nt, Homo sapiens
ucuucacucccaaua

SEQ ID NO: 896313 - RNA, 14 nt, Homo sapiens
ucuucaucugugac

SEQ ID NO: 896314 - RNA, 18 nt, Homo sapiens
ucuuccaaagcacauuga

SEQ ID NO: 896315 - RNA, 19 nt, Homo sapiens
ucuuccagggccucuggga

SEQ ID NO: 896316 - RNA, 20 nt, Homo sapiens
ucuuccagggccucugggag

SEQ ID NO: 896317 - RNA, 21 nt, Homo sapiens
ucuuccaggucccagagggug

SEQ ID NO: 896318 - RNA, 13 nt, Homo sapiens
ucuuccaucugau

SEQ ID NO: 896319 - RNA, 14 nt, Homo sapiens
ucuucccaccucag

SEQ ID NO: 896320 - RNA, 14 nt, Homo sapiens
ucuucccuccuucc

SEQ ID NO: 896321 - RNA, 23 nt, Homo sapiens
ucuucccuguaugauuccuugau

SEQ ID NO: 896322 - RNA, 14 nt, Homo sapiens
ucuuccuaccaaau

SEQ ID NO: 896323 - RNA, 14 nt, Homo sapiens
ucuuccugccucag

SEQ ID NO: 896324 - RNA, 17 nt, Homo sapiens
ucuuccuuggccuauuc

SEQ ID NO: 896325 - RNA, 16 nt, Homo sapiens
ucuucggggugugaug

SEQ ID NO: 896326 - RNA, 20 nt, Homo sapiens
ucuucgguguuuaaagucaa

SEQ ID NO: 896327 - RNA, 16 nt, Homo sapiens
ucuucuaaaaugcuuu

SEQ ID NO: 896328 - RNA, 14 nt, Homo sapiens
ucuucuccacugga

SEQ ID NO: 896329 - RNA, 15 nt, Homo sapiens
ucuucugagcaccua

SEQ ID NO: 896330 - RNA, 22 nt, Homo sapiens
ucuucuuauucaugcuuucucc

SEQ ID NO: 896331 - RNA, 19 nt, Homo sapiens
ucuucuuguguccugauga

SEQ ID NO: 896332 - RNA, 21 nt, Homo sapiens
ucuugaagggcaggugcuuca

SEQ ID NO: 896333 - RNA, 15 nt, Homo sapiens
ucuugaaguucaugg

SEQ ID NO: 896334 - RNA, 15 nt, Homo sapiens
ucuugacauucacuu

SEQ ID NO: 896335 - RNA, 23 nt, Homo sapiens
ucuugagguuuucugugcuuuga

SEQ ID NO: 896336 - RNA, 17 nt, Homo sapiens
ucuugcagucaucagaa

SEQ ID NO: 896337 - RNA, 17 nt, Homo sapiens
ucuugccucucucagga

SEQ ID NO: 896338 - RNA, 16 nt, Homo sapiens
ucuuggaauacuugaa

SEQ ID NO: 896339 - RNA, 13 nt, Homo sapiens
ucuuggacacugu

SEQ ID NO: 896340 - RNA, 14 nt, Homo sapiens
ucuuggaccccuga

SEQ ID NO: 896341 - RNA, 21 nt, Homo sapiens
ucuuggagcgagcagaugcaa

SEQ ID NO: 896342 - RNA, 16 nt, Homo sapiens
ucuuggcaguauucca

SEQ ID NO: 896343 - RNA, 20 nt, Homo sapiens
ucuugggaauuuucuuccaa

SEQ ID NO: 896344 - RNA, 24 nt, Homo sapiens
ucuugggggguuuuuacuccagug

SEQ ID NO: 896345 - RNA, 15 nt, Homo sapiens
ucuugguacuacuag

SEQ ID NO: 896346 - RNA, 16 nt, Homo sapiens
ucuuggugucuguccu

SEQ ID NO: 896347 - RNA, 19 nt, Homo sapiens
ucuuguccacagucuccca

SEQ ID NO: 896348 - RNA, 18 nt, Homo sapiens
ucuuguuuuaagugccuu

SEQ ID NO: 896349 - RNA, 22 nt, Homo sapiens
ucuuguuuuuuuuuuccacuua

SEQ ID NO: 896350 - RNA, 21 nt, Homo sapiens
ucuuuaaccucaucuacaagc

SEQ ID NO: 896351 - RNA, 13 nt, Homo sapiens
ucuuuacuagaua

SEQ ID NO: 896352 - RNA, 19 nt, Homo sapiens
ucuuuaggagacuaaugga

SEQ ID NO: 896353 - RNA, 19 nt, Homo sapiens
ucuuuaucagugauggucu

SEQ ID NO: 896354 - RNA, 18 nt, Homo sapiens
ucuuucuaacuccaguga

SEQ ID NO: 896355 - RNA, 19 nt, Homo sapiens
ucuuucucccucaccccca

SEQ ID NO: 896356 - RNA, 19 nt, Homo sapiens
ucuuucuguuauugcacua

SEQ ID NO: 896357 - RNA, 17 nt, Homo sapiens
ucuuucuuggugucugu

SEQ ID NO: 896358 - RNA, 17 nt, Homo sapiens
ucuuucuuuaccugaga

SEQ ID NO: 896359 - RNA, 17 nt, Homo sapiens
ucuuugagaacaaugga

SEQ ID NO: 896360 - RNA, 20 nt, Homo sapiens
ucuuugauucaaagcacugu

SEQ ID NO: 896361 - RNA, 18 nt, Homo sapiens
ucuuugcagagccuuuua

SEQ ID NO: 896362 - RNA, 12 nt, Homo sapiens
ucuuugcaugga

SEQ ID NO: 896363 - RNA, 12 nt, Homo sapiens
ucuuugcuacaa

SEQ ID NO: 896364 - RNA, 22 nt, Homo sapiens
ucuuugcucauggcaacaguua

SEQ ID NO: 896365 - RNA, 16 nt, Homo sapiens
ucuuuuacaauccuaa

SEQ ID NO: 896366 - RNA, 21 nt, Homo sapiens
ugucccucuuugccuguguga

SEQ ID NO: 896367 - RNA, 19 nt, Homo sapiens
uguccgacucuucugagca

SEQ ID NO: 896368 - RNA, 16 nt, Homo sapiens
uguccggagaugagau

SEQ ID NO: 896369 - RNA, 16 nt, Homo sapiens
uguccuggcaccaaau

SEQ ID NO: 896370 - RNA, 16 nt, Homo sapiens
ugucgauuucaccaag

SEQ ID NO: 896371 - RNA, 22 nt, Homo sapiens
uguucauuaaauuuucuaugcu

SEQ ID NO: 896372 - RNA, 14 nt, Homo sapiens
uguucauucacugc

SEQ ID NO: 896373 - RNA, 13 nt, Homo sapiens
uguuccaaaaaga

SEQ ID NO: 896374 - RNA, 22 nt, Homo sapiens
uguucccuccagcagugguauu

SEQ ID NO: 896375 - RNA, 23 nt, Homo sapiens
uguuccuguugaaucuugcacau

SEQ ID NO: 896376 - RNA, 15 nt, Homo sapiens
uguuccuucacauuu

SEQ ID NO: 896377 - RNA, 14 nt, Homo sapiens
uguucuaaguauuu

SEQ ID NO: 896378 - RNA, 18 nt, Homo sapiens
uguucucaaaugcuaaau

SEQ ID NO: 896379 - RNA, 22 nt, Homo sapiens
uguucucaaaugcuaaaugcaa

SEQ ID NO: 896380 - RNA, 23 nt, Homo sapiens
uguucugaauaauuucuuacuaa

SEQ ID NO: 896381 - RNA, 20 nt, Homo sapiens
uguucuggccucagaccaac

SEQ ID NO: 896382 - RNA, 19 nt, Homo sapiens
uguucuugcagucaucaga

SEQ ID NO: 896383 - RNA, 14 nt, Homo sapiens
uguugaaucuugca

SEQ ID NO: 896384 - RNA, 16 nt, Homo sapiens
uguugaaucuugcaca

SEQ ID NO: 896385 - RNA, 20 nt, Homo sapiens
uguugauaaauuccacugga

SEQ ID NO: 896386 - RNA, 11 nt, Homo sapiens
uguugauccca

SEQ ID NO: 896387 - RNA, 16 nt, Homo sapiens
uguugcgccacugaga

SEQ ID NO: 896388 - RNA, 22 nt, Homo sapiens
uguugcugagucugcagaugag

SEQ ID NO: 896389 - RNA, 19 nt, Homo sapiens
uguuggauagucagcugua

SEQ ID NO: 896390 - RNA, 15 nt, Homo sapiens
uguuggccaguguga

SEQ ID NO: 896391 - RNA, 19 nt, Homo sapiens
uguugguggccucugcuug

SEQ ID NO: 896392 - RNA, 16 nt, Homo sapiens
uguugucacaccugaa

SEQ ID NO: 896393 - RNA, 14 nt, Homo sapiens
uguuuacuuuaugu

SEQ ID NO: 896394 - RNA, 17 nt, Homo sapiens
uguuucagggggccuuu

SEQ ID NO: 896395 - RNA, 19 nt, Homo sapiens
uguuucuaaaacuaugguu

SEQ ID NO: 896396 - RNA, 18 nt, Homo sapiens
uguuucucccacauauuc

SEQ ID NO: 896397 - RNA, 22 nt, Homo sapiens
uguuucugaaccauuacuguaa

SEQ ID NO: 896398 - RNA, 16 nt, Homo sapiens
uguuucugaaugacau

SEQ ID NO: 896399 - RNA, 13 nt, Homo sapiens
uguuucuuccaaa

SEQ ID NO: 896400 - RNA, 17 nt, Homo sapiens
uguuucuuucauaugaa

SEQ ID NO: 896401 - RNA, 15 nt, Homo sapiens
uguuugaccuucaca

SEQ ID NO: 896402 - RNA, 12 nt, Homo sapiens
uguuugcacuuu

SEQ ID NO: 896403 - RNA, 13 nt, Homo sapiens
uguuugcucuugc

SEQ ID NO: 896404 - RNA, 14 nt, Homo sapiens
uguuugcucuugca

SEQ ID NO: 896405 - RNA, 20 nt, Homo sapiens
uguuugcugaagugaaaaaa

SEQ ID NO: 896406 - RNA, 15 nt, Homo sapiens
uguuugucauaugga

SEQ ID NO: 896407 - RNA, 20 nt, Homo sapiens
uguuugucauauggaauuua

SEQ ID NO: 896408 - RNA, 19 nt, Homo sapiens
uguuuguguggauacccag

SEQ ID NO: 896409 - RNA, 23 nt, Homo sapiens
uguuuuaauuccaauaugaugac

SEQ ID NO: 896410 - RNA, 13 nt, Homo sapiens
uguuuuaucauua

SEQ ID NO: 896411 - RNA, 19 nt, Homo sapiens
uguuuucaccucauaugcu

SEQ ID NO: 896412 - RNA, 19 nt, Homo sapiens
uguuuucucagaacagcug

SEQ ID NO: 896413 - RNA, 12 nt, Homo sapiens
uguuuuguacaa

SEQ ID NO: 896414 - RNA, 22 nt, Homo sapiens
uguuuuguaucaaaaucacuau

SEQ ID NO: 896415 - RNA, 15 nt, Homo sapiens
uguuuuuaacaacua

SEQ ID NO: 896416 - RNA, 17 nt, Homo sapiens
uguuuuugaaaagcuaa

SEQ ID NO: 896417 - RNA, 19 nt, Homo sapiens
uguuuuuuuuuuccacuua

SEQ ID NO: 896418 - RNA, 17 nt, Homo sapiens
uuaaaaaaauaagaaga

SEQ ID NO: 896419 - RNA, 14 nt, Homo sapiens
uuaaaaaagcaaaa

SEQ ID NO: 896420 - RNA, 17 nt, Homo sapiens
uuaaaacauaagaacgu

SEQ ID NO: 896421 - RNA, 20 nt, Homo sapiens
uuaaaacguagaggauuuau

SEQ ID NO: 896422 - RNA, 12 nt, Homo sapiens
uuaaaagaauuu

SEQ ID NO: 896423 - RNA, 19 nt, Homo sapiens
uuaaaagugacauuugucu

SEQ ID NO: 896424 - RNA, 19 nt, Homo sapiens
uuaaaaguugugauuccag

SEQ ID NO: 896425 - RNA, 18 nt, Homo sapiens
uuaaaauauguaugucua

SEQ ID NO: 896426 - RNA, 15 nt, Homo sapiens
uuaaaaucauaaaua

SEQ ID NO: 896427 - RNA, 14 nt, Homo sapiens
uuaaaaugagaucg

SEQ ID NO: 896428 - RNA, 11 nt, Homo sapiens
uuaaaauggaa

SEQ ID NO: 896429 - RNA, 23 nt, Homo sapiens
uuaaaauuaaaugcauguccuca

SEQ ID NO: 896430 - RNA, 14 nt, Homo sapiens
uuaaacagccaaau

SEQ ID NO: 896431 - RNA, 15 nt, Homo sapiens
uuaaaccacuguaua

SEQ ID NO: 896432 - RNA, 12 nt, Homo sapiens
uuaaacugauua

SEQ ID NO: 896433 - RNA, 20 nt, Homo sapiens
uuaaagaaaaaaaaagucag

SEQ ID NO: 896434 - RNA, 21 nt, Homo sapiens
uuaaagaagucauaaacagca

SEQ ID NO: 896435 - RNA, 20 nt, Homo sapiens
uuaaagcuuauuaaaacuca

SEQ ID NO: 896436 - RNA, 23 nt, Homo sapiens
uuaaaggagaaguagcugugaac

SEQ ID NO: 896437 - RNA, 19 nt, Homo sapiens
uuaaaguaaugagcaugau

SEQ ID NO: 896438 - RNA, 18 nt, Homo sapiens
uuaaaguaccuguaguga

SEQ ID NO: 896439 - RNA, 13 nt, Homo sapiens
uuaaagucuucca

SEQ ID NO: 896440 - RNA, 19 nt, Homo sapiens
uuaaauaaaucauuaauac

SEQ ID NO: 896441 - RNA, 17 nt, Homo sapiens
uuaaauaguucaguaua

SEQ ID NO: 896442 - RNA, 23 nt, Homo sapiens
uuaaauauauuucuugcuauugu

SEQ ID NO: 896443 - RNA, 13 nt, Homo sapiens
uuaaaugcauguc

SEQ ID NO: 896444 - RNA, 16 nt, Homo sapiens
uuaaaugccuccuucu

SEQ ID NO: 896445 - RNA, 14 nt, Homo sapiens
uuaaauggcuuuau

SEQ ID NO: 896446 - RNA, 12 nt, Homo sapiens
uuaaauguaguu

SEQ ID NO: 896447 - RNA, 15 nt, Homo sapiens
uuaaaugucaguuac

SEQ ID NO: 896448 - RNA, 22 nt, Homo sapiens
uuaaauucacaugcagucucag

SEQ ID NO: 896449 - RNA, 20 nt, Homo sapiens
uuaaauuugggggacuuaca

SEQ ID NO: 896450 - RNA, 23 nt, Homo sapiens
uuaacaaauuauguuacaucugu

SEQ ID NO: 896451 - RNA, 16 nt, Homo sapiens
uuaacaucaucaggcu

SEQ ID NO: 896452 - RNA, 20 nt, Homo sapiens
uuaacgacccagucaaugaa

SEQ ID NO: 896453 - RNA, 20 nt, Homo sapiens
uuaacugacuuaaguggcau

SEQ ID NO: 896454 - RNA, 23 nt, Homo sapiens
uuaagaagaaauacccacuaaca

SEQ ID NO: 896455 - RNA, 15 nt, Homo sapiens
uuaagacaugcacua

SEQ ID NO: 896456 - RNA, 18 nt, Homo sapiens
uuaagagaagaugugauu

SEQ ID NO: 896457 - RNA, 22 nt, Homo sapiens
uuaagcugggauaaucacauua

SEQ ID NO: 896458 - RNA, 17 nt, Homo sapiens
uuaagcuuaugucagac

SEQ ID NO: 896459 - RNA, 21 nt, Homo sapiens
uuaaggagaggagaaacugag

SEQ ID NO: 896460 - RNA, 16 nt, Homo sapiens
uuaagggaauaagcca

SEQ ID NO: 896461 - RNA, 19 nt, Homo sapiens
uuaaggggagcaacagagg

SEQ ID NO: 896462 - RNA, 13 nt, Homo sapiens
uuaagguacuuaa

SEQ ID NO: 896463 - RNA, 17 nt, Homo sapiens
uuaagguagaaccucac

SEQ ID NO: 896464 - RNA, 21 nt, Homo sapiens
uuaagguuuuacuuuucugaa

SEQ ID NO: 896465 - RNA, 20 nt, Homo sapiens
uuaauaaaaacuucagaaaa

SEQ ID NO: 896466 - RNA, 16 nt, Homo sapiens
uuaauaaaaguacuga

SEQ ID NO: 896467 - RNA, 16 nt, Homo sapiens
uuaauaagucauugaa

SEQ ID NO: 896468 - RNA, 13 nt, Homo sapiens
uuaauacaaagaa

SEQ ID NO: 896469 - RNA, 20 nt, Homo sapiens
uuaauacagggcauuuuggu

SEQ ID NO: 896470 - RNA, 14 nt, Homo sapiens
uuaauaguauuuau

SEQ ID NO: 896471 - RNA, 21 nt, Homo sapiens
uuaauaguuucugauucacua

SEQ ID NO: 896472 - RNA, 23 nt, Homo sapiens
uuaauauguuaaccucaguguca

SEQ ID NO: 896473 - RNA, 15 nt, Homo sapiens
uuaaucaugagauaa

SEQ ID NO: 896474 - RNA, 19 nt, Homo sapiens
uuaaugaagacccagugua

SEQ ID NO: 896475 - RNA, 17 nt, Homo sapiens
uuaaugucuggugcuuu

SEQ ID NO: 896476 - RNA, 17 nt, Homo sapiens
uuaauuaauauguucau

SEQ ID NO: 896477 - RNA, 16 nt, Homo sapiens
uuaauucacucccaca

SEQ ID NO: 896478 - RNA, 17 nt, Homo sapiens
uuaauuggaauucugga

SEQ ID NO: 896479 - RNA, 21 nt, Homo sapiens
uuaauuucuacacacccauag

SEQ ID NO: 896480 - RNA, 16 nt, Homo sapiens
uuacaaaggugaaaau

SEQ ID NO: 896481 - RNA, 16 nt, Homo sapiens
uuacaaugcagaauuu

SEQ ID NO: 896482 - RNA, 12 nt, Homo sapiens
uucugcacugaa

SEQ ID NO: 896483 - RNA, 19 nt, Homo sapiens
uucugcuccucuccaggca

SEQ ID NO: 896484 - RNA, 17 nt, Homo sapiens
uucugcuguauacugua

SEQ ID NO: 896485 - RNA, 20 nt, Homo sapiens
uucuggacccguucaacuuu

SEQ ID NO: 896486 - RNA, 13 nt, Homo sapiens
uucugggacacag

SEQ ID NO: 896487 - RNA, 15 nt, Homo sapiens
uucuguaaccaaaaa

SEQ ID NO: 896488 - RNA, 16 nt, Homo sapiens
uucuguccaaggcaca

SEQ ID NO: 896489 - RNA, 15 nt, Homo sapiens
uucuguccaggacau

SEQ ID NO: 896490 - RNA, 17 nt, Homo sapiens
uucuguccaguuuccaa

SEQ ID NO: 896491 - RNA, 12 nt, Homo sapiens
uucugucuguag

SEQ ID NO: 896492 - RNA, 13 nt, Homo sapiens
uucuguuuccaua

SEQ ID NO: 896493 - RNA, 12 nt, Homo sapiens
uucuguuuccca

SEQ ID NO: 896494 - RNA, 15 nt, Homo sapiens
uucuuaaauaagaaa

SEQ ID NO: 896495 - RNA, 13 nt, Homo sapiens
uucuuaacuauuc

SEQ ID NO: 896496 - RNA, 15 nt, Homo sapiens
uucuuacccauauau

SEQ ID NO: 896497 - RNA, 19 nt, Homo sapiens
uucuuacuucccuaaugaa

SEQ ID NO: 896498 - RNA, 12 nt, Homo sapiens
uucuuauggaag

SEQ ID NO: 896499 - RNA, 17 nt, Homo sapiens
uucuuccuaccaaauau

SEQ ID NO: 896500 - RNA, 21 nt, Homo sapiens
uucuucucccuguguggcugc

SEQ ID NO: 896501 - RNA, 13 nt, Homo sapiens
uucuucugccuca

SEQ ID NO: 896502 - RNA, 13 nt, Homo sapiens
uucuucugggaac

SEQ ID NO: 896503 - RNA, 22 nt, Homo sapiens
uucuucuucagaagacacugca

SEQ ID NO: 896504 - RNA, 13 nt, Homo sapiens
uucuugcagauca

SEQ ID NO: 896505 - RNA, 16 nt, Homo sapiens
uucuugugaaaccaca

SEQ ID NO: 896506 - RNA, 15 nt, Homo sapiens
uucuuuacauuugau

SEQ ID NO: 896507 - RNA, 14 nt, Homo sapiens
uucuuuaccugaga

SEQ ID NO: 896508 - RNA, 23 nt, Homo sapiens
uucuuuacuaaagauaucagagc

SEQ ID NO: 896509 - RNA, 22 nt, Homo sapiens
uucuuuucagcagagucuagua

SEQ ID NO: 896510 - RNA, 18 nt, Homo sapiens
uucuuuuucguuggugua

SEQ ID NO: 896511 - RNA, 16 nt, Homo sapiens
uugaaaacucacagaa

SEQ ID NO: 896512 - RNA, 12 nt, Homo sapiens
uugaaaauguuc

SEQ ID NO: 896513 - RNA, 18 nt, Homo sapiens
uugaaacccauuaggcau

SEQ ID NO: 896514 - RNA, 21 nt, Homo sapiens
uugaaagugaauaaacuucag

SEQ ID NO: 896515 - RNA, 21 nt, Homo sapiens
uugaaauaccagugaaccaaa

SEQ ID NO: 896516 - RNA, 15 nt, Homo sapiens
uugaaaucugaaugc

SEQ ID NO: 896517 - RNA, 16 nt, Homo sapiens
uugaaauuugacucau

SEQ ID NO: 896518 - RNA, 18 nt, Homo sapiens
uugaaauuugccuugagu

SEQ ID NO: 896519 - RNA, 23 nt, Homo sapiens
uugaacaacuaggcuucagcaua

SEQ ID NO: 896520 - RNA, 13 nt, Homo sapiens
uugaaccaauaau

SEQ ID NO: 896521 - RNA, 18 nt, Homo sapiens
uugaacugguugugaaua

SEQ ID NO: 896522 - RNA, 21 nt, Homo sapiens
uugaacuuaaauaaaugucau

SEQ ID NO: 896523 - RNA, 12 nt, Homo sapiens
uugaacuuggaa

SEQ ID NO: 896524 - RNA, 23 nt, Homo sapiens
uugaagauggauguuugucaaaa

SEQ ID NO: 896525 - RNA, 20 nt, Homo sapiens
uugaagggcaggugcuucag

SEQ ID NO: 896526 - RNA, 19 nt, Homo sapiens
uugaaguaggacuuuccua

SEQ ID NO: 896527 - RNA, 21 nt, Homo sapiens
uugaaguuuuagcggucaauu

SEQ ID NO: 896528 - RNA, 21 nt, Homo sapiens
uugaauaaagccugcuuuuua

SEQ ID NO: 896529 - RNA, 18 nt, Homo sapiens
uugaauggucuucugcca

SEQ ID NO: 896530 - RNA, 19 nt, Homo sapiens
uugaauguuuauguucuca

SEQ ID NO: 896531 - RNA, 19 nt, Homo sapiens
uugacaaagaaacccaagu

SEQ ID NO: 896532 - RNA, 16 nt, Homo sapiens
uugacagaacacuguc

SEQ ID NO: 896533 - RNA, 19 nt, Homo sapiens
uugacaguucauauguacc

SEQ ID NO: 896534 - RNA, 14 nt, Homo sapiens
uugacauaacacua

SEQ ID NO: 896535 - RNA, 11 nt, Homo sapiens
uugacauuccu

SEQ ID NO: 896536 - RNA, 12 nt, Homo sapiens
uugaccacagag

SEQ ID NO: 896537 - RNA, 16 nt, Homo sapiens
uugacccauguucccu

SEQ ID NO: 896538 - RNA, 15 nt, Homo sapiens
uugacgccaccauaa

SEQ ID NO: 896539 - RNA, 13 nt, Homo sapiens
uugacuaucacau

SEQ ID NO: 896540 - RNA, 20 nt, Homo sapiens
uugacuauuauagaauggaa

SEQ ID NO: 896541 - RNA, 16 nt, Homo sapiens
uugacugagacuggaa

SEQ ID NO: 896542 - RNA, 17 nt, Homo sapiens
uugagaaagccuucaua

SEQ ID NO: 896543 - RNA, 13 nt, Homo sapiens
uugagaccagccu

SEQ ID NO: 896544 - RNA, 14 nt, Homo sapiens
uugagcuguccuau

SEQ ID NO: 896545 - RNA, 17 nt, Homo sapiens
uugaggacacaugucca

SEQ ID NO: 896546 - RNA, 18 nt, Homo sapiens
uugaggggcugacuucaa

SEQ ID NO: 896547 - RNA, 12 nt, Homo sapiens
uugauauacuuu

SEQ ID NO: 896548 - RNA, 17 nt, Homo sapiens
uugauucaaagcacugu

SEQ ID NO: 896549 - RNA, 22 nt, Homo sapiens
uugcaaacccugguugcuguau

SEQ ID NO: 896550 - RNA, 20 nt, Homo sapiens
uugcaacaagacaaagcaaa

SEQ ID NO: 896551 - RNA, 22 nt, Homo sapiens
uugcaagacaaaguugaaugua

SEQ ID NO: 896552 - RNA, 14 nt, Homo sapiens
uugcacaugugacc

SEQ ID NO: 896553 - RNA, 20 nt, Homo sapiens
uugcaccccuccuauaccau

SEQ ID NO: 896554 - RNA, 12 nt, Homo sapiens
uugcacuaugaa

SEQ ID NO: 896555 - RNA, 14 nt, Homo sapiens
uugcagacaggcaa

SEQ ID NO: 896556 - RNA, 16 nt, Homo sapiens
uugcagauccuugaua

SEQ ID NO: 896557 - RNA, 15 nt, Homo sapiens
uugcagcagaagcca

SEQ ID NO: 896558 - RNA, 19 nt, Homo sapiens
uugcauauaaaaugcuuua

SEQ ID NO: 896559 - RNA, 12 nt, Homo sapiens
uugcauauguau

SEQ ID NO: 896560 - RNA, 13 nt, Homo sapiens
uugcauaugucau

SEQ ID NO: 896561 - RNA, 23 nt, Homo sapiens
uugcaugccaucuccacccugag

SEQ ID NO: 896562 - RNA, 22 nt, Homo sapiens
uugcauuaaaaaugcauauacu

SEQ ID NO: 896563 - RNA, 14 nt, Homo sapiens
uugccacacacugu

SEQ ID NO: 896564 - RNA, 18 nt, Homo sapiens
uugccaugucuuguucag

SEQ ID NO: 896565 - RNA, 14 nt, Homo sapiens
uugccauguuggcc

SEQ ID NO: 896566 - RNA, 19 nt, Homo sapiens
uugcccugaguggaucucc

SEQ ID NO: 896567 - RNA, 14 nt, Homo sapiens
uugccuaaacccua

SEQ ID NO: 896568 - RNA, 13 nt, Homo sapiens
uugcggacagcca

SEQ ID NO: 896569 - RNA, 15 nt, Homo sapiens
uugcuaaaauauuau

SEQ ID NO: 896570 - RNA, 11 nt, Homo sapiens
uugcucaaggc

SEQ ID NO: 896571 - RNA, 21 nt, Homo sapiens
uugcucuuggaaagcugauga

SEQ ID NO: 896572 - RNA, 22 nt, Homo sapiens
uugcugaguccaacaauguugu

SEQ ID NO: 896573 - RNA, 15 nt, Homo sapiens
uugcugauacuaucu

SEQ ID NO: 896574 - RNA, 22 nt, Homo sapiens
uugcuguaacucagacauucca

SEQ ID NO: 896575 - RNA, 12 nt, Homo sapiens
uugcuguucacc

SEQ ID NO: 896576 - RNA, 17 nt, Homo sapiens
uugcuuauguaaucuca

SEQ ID NO: 896577 - RNA, 15 nt, Homo sapiens
uugcuuauucuaggu

SEQ ID NO: 896578 - RNA, 10 nt, Homo sapiens
uugcuucuag

SEQ ID NO: 896579 - RNA, 21 nt, Homo sapiens
uugcuugccgagccuaaugaa

SEQ ID NO: 896580 - RNA, 14 nt, Homo sapiens
uugcuuuaaaguac

SEQ ID NO: 896581 - RNA, 19 nt, Homo sapiens
uuggaaaggaccuuaccug

SEQ ID NO: 896582 - RNA, 14 nt, Homo sapiens
uuggaauacuaaaa

SEQ ID NO: 896583 - RNA, 18 nt, Homo sapiens
uuggacaacugacaauau

SEQ ID NO: 896584 - RNA, 18 nt, Homo sapiens
uuggacugacuaccagcu

SEQ ID NO: 896585 - RNA, 21 nt, Homo sapiens
uuggacugauaaucucuuuaa

SEQ ID NO: 896586 - RNA, 13 nt, Homo sapiens
uuggagacggcca

SEQ ID NO: 896587 - RNA, 20 nt, Homo sapiens
uuggagcaagugacaugcca

SEQ ID NO: 896588 - RNA, 22 nt, Homo sapiens
uuuacuggaccccgccucccag

SEQ ID NO: 896589 - RNA, 13 nt, Homo sapiens
uuuacuuccucag

SEQ ID NO: 896590 - RNA, 21 nt, Homo sapiens
uuuagaagagccugacugugu

SEQ ID NO: 896591 - RNA, 19 nt, Homo sapiens
uuuagagauggggucuugc

SEQ ID NO: 896592 - RNA, 15 nt, Homo sapiens
uuuagaguaugcaag

SEQ ID NO: 896593 - RNA, 19 nt, Homo sapiens
uuuagauuaaacaaacaaa

SEQ ID NO: 896594 - RNA, 18 nt, Homo sapiens
uuuagcauugaagugucg

SEQ ID NO: 896595 - RNA, 16 nt, Homo sapiens
uuuagccagugacuuu

SEQ ID NO: 896596 - RNA, 18 nt, Homo sapiens
uuuagccuggauguugcu

SEQ ID NO: 896597 - RNA, 19 nt, Homo sapiens
uuuagcguagcuaagugaa

SEQ ID NO: 896598 - RNA, 22 nt, Homo sapiens
uuuagcuaccucacuaugcugc

SEQ ID NO: 896599 - RNA, 15 nt, Homo sapiens
uuuagugauacugga

SEQ ID NO: 896600 - RNA, 23 nt, Homo sapiens
gccaacagccccccccuugaauc

SEQ ID NO: 896601 - RNA, 16 nt, Homo sapiens
gccaacucacucuuau

SEQ ID NO: 896602 - RNA, 17 nt, Homo sapiens
gccaacuccuccuugcc

SEQ ID NO: 896603 - RNA, 18 nt, Homo sapiens
gccaagaaucaagcuaga

SEQ ID NO: 896604 - RNA, 18 nt, Homo sapiens
gccaauauuucugauaua

SEQ ID NO: 896605 - RNA, 18 nt, Homo sapiens
gccaaucuucaguauuuu

SEQ ID NO: 896606 - RNA, 12 nt, Homo sapiens
gccaaugcacac

SEQ ID NO: 896607 - RNA, 12 nt, Homo sapiens
gccaauuuacuu

SEQ ID NO: 896608 - RNA, 11 nt, Homo sapiens
gccacaaagaa

SEQ ID NO: 896609 - RNA, 18 nt, Homo sapiens
gccacaaagaagaaguuu

SEQ ID NO: 896610 - RNA, 14 nt, Homo sapiens
gccacaacccuguu

SEQ ID NO: 896611 - RNA, 14 nt, Homo sapiens
gccacaaugccucu

SEQ ID NO: 896612 - RNA, 15 nt, Homo sapiens
gccacagaagccagg

SEQ ID NO: 896613 - RNA, 13 nt, Homo sapiens
gccaccaagacag

SEQ ID NO: 896614 - RNA, 22 nt, Homo sapiens
gccaccacccuacuucauuuuc

SEQ ID NO: 896615 - RNA, 15 nt, Homo sapiens
gccaccauccugcag

SEQ ID NO: 896616 - RNA, 14 nt, Homo sapiens
gccacccagcaaca

SEQ ID NO: 896617 - RNA, 21 nt, Homo sapiens
gccacguguucucacacuggu

SEQ ID NO: 896618 - RNA, 16 nt, Homo sapiens
gccacucauuccugua

SEQ ID NO: 896619 - RNA, 14 nt, Homo sapiens
gccacugaccucac

SEQ ID NO: 896620 - RNA, 13 nt, Homo sapiens
gccacugcacucc

SEQ ID NO: 896621 - RNA, 18 nt, Homo sapiens
gccacugguuucucagaa

SEQ ID NO: 896622 - RNA, 14 nt, Homo sapiens
gccagaaaacauau

SEQ ID NO: 896623 - RNA, 23 nt, Homo sapiens
gccagaaagaaguuaacuacagu

SEQ ID NO: 896624 - RNA, 18 nt, Homo sapiens
gccagacuggcacaguuu

SEQ ID NO: 896625 - RNA, 18 nt, Homo sapiens
gccagagcccaagugcca

SEQ ID NO: 896626 - RNA, 20 nt, Homo sapiens
gccagcacaggggccccaga

SEQ ID NO: 896627 - RNA, 14 nt, Homo sapiens
gccagcagcuguuu

SEQ ID NO: 896628 - RNA, 17 nt, Homo sapiens
gccagccgugaugcuca

SEQ ID NO: 896629 - RNA, 16 nt, Homo sapiens
gccagcucagucccau

SEQ ID NO: 896630 - RNA, 15 nt, Homo sapiens
gccagcucucucuac

SEQ ID NO: 896631 - RNA, 18 nt, Homo sapiens
gccagcugcaucuacuca

SEQ ID NO: 896632 - RNA, 19 nt, Homo sapiens
gccagcugucgcaucucag

SEQ ID NO: 896633 - RNA, 16 nt, Homo sapiens
gccaggacaccugccc

SEQ ID NO: 896634 - RNA, 16 nt, Homo sapiens
gccaggacgaauugag

SEQ ID NO: 896635 - RNA, 22 nt, Homo sapiens
gccaggagaugcugggccaguu

SEQ ID NO: 896636 - RNA, 23 nt, Homo sapiens
gccaggauggcgugugugccgug

SEQ ID NO: 896637 - RNA, 18 nt, Homo sapiens
gccagggcccugcagagg

SEQ ID NO: 896638 - RNA, 14 nt, Homo sapiens
gccagggucucacu

SEQ ID NO: 896639 - RNA, 16 nt, Homo sapiens
gccagucuugccuagg

SEQ ID NO: 896640 - RNA, 18 nt, Homo sapiens
gccauauucacaccucac

SEQ ID NO: 896641 - RNA, 22 nt, Homo sapiens
gccauauucuguuggccagugu

SEQ ID NO: 896642 - RNA, 14 nt, Homo sapiens
gccaucaagggaau

SEQ ID NO: 896643 - RNA, 22 nt, Homo sapiens
gccaucagggugggccacucuc

SEQ ID NO: 896644 - RNA, 16 nt, Homo sapiens
gccaucccgucuucuc

SEQ ID NO: 896645 - RNA, 18 nt, Homo sapiens
gccaugauggugcugacc

SEQ ID NO: 896646 - RNA, 17 nt, Homo sapiens
gccaugccucaagaaca

SEQ ID NO: 896647 - RNA, 15 nt, Homo sapiens
gccaugcuucuugcc

SEQ ID NO: 896648 - RNA, 16 nt, Homo sapiens
gccaugcuucuugccc

SEQ ID NO: 896649 - RNA, 20 nt, Homo sapiens
gccauucagucuagcuuuua

SEQ ID NO: 896650 - RNA, 22 nt, Homo sapiens
gccauuccaagucaacacucuu

SEQ ID NO: 896651 - RNA, 17 nt, Homo sapiens
gccauucccacuaagcu

SEQ ID NO: 896652 - RNA, 13 nt, Homo sapiens
gccauuccuggaa

SEQ ID NO: 896653 - RNA, 23 nt, Homo sapiens
gccauugaauuugccuuccucau

SEQ ID NO: 896654 - RNA, 13 nt, Homo sapiens
gccauuuguacug

SEQ ID NO: 896655 - RNA, 13 nt, Homo sapiens
gcccaaacauaaa

SEQ ID NO: 896656 - RNA, 16 nt, Homo sapiens
gcccaagagaugaaga

SEQ ID NO: 896657 - RNA, 16 nt, Homo sapiens
gcccaagaggacugag

SEQ ID NO: 896658 - RNA, 15 nt, Homo sapiens
gcccaagaggucuga

SEQ ID NO: 896659 - RNA, 22 nt, Homo sapiens
gcccaagcagagugauucaggg

SEQ ID NO: 896660 - RNA, 17 nt, Homo sapiens
gcccaaggcaguguucc

SEQ ID NO: 896661 - RNA, 18 nt, Homo sapiens
gcccaaucauuugcaaug

SEQ ID NO: 896662 - RNA, 19 nt, Homo sapiens
gcccaaucauuugcaaugc

SEQ ID NO: 896663 - RNA, 21 nt, Homo sapiens
gcccaaucauuugcaaugccc

SEQ ID NO: 896664 - RNA, 13 nt, Homo sapiens
gcccacaaagggg

SEQ ID NO: 896665 - RNA, 20 nt, Homo sapiens
gcccacagcagcaauaugcu

SEQ ID NO: 896666 - RNA, 16 nt, Homo sapiens
gcccacagggaccaag

SEQ ID NO: 896667 - RNA, 18 nt, Homo sapiens
gcccacucccaggaccaa

SEQ ID NO: 896668 - RNA, 20 nt, Homo sapiens
gcccagaaagaggcagugau

SEQ ID NO: 896669 - RNA, 19 nt, Homo sapiens
gcccagaauugcauucuga

SEQ ID NO: 896670 - RNA, 11 nt, Homo sapiens
gcccagcacug

SEQ ID NO: 896671 - RNA, 23 nt, Homo sapiens
aauagaucaaaguccagcaggca

SEQ ID NO: 896672 - RNA, 22 nt, Homo sapiens
aauagcacauccuccaacguua

SEQ ID NO: 896673 - RNA, 18 nt, Homo sapiens
aauagccauguacuauaa

SEQ ID NO: 896674 - RNA, 15 nt, Homo sapiens
aauagccucccugua

SEQ ID NO: 896675 - RNA, 18 nt, Homo sapiens
aauagccugcgcuguuuu

SEQ ID NO: 896676 - RNA, 18 nt, Homo sapiens
aauagcgaaucaucucaa

SEQ ID NO: 896677 - RNA, 17 nt, Homo sapiens
aauagcuauugcaugua

SEQ ID NO: 896678 - RNA, 12 nt, Homo sapiens
aauagcugcuag

SEQ ID NO: 896679 - RNA, 21 nt, Homo sapiens
aauagcugggacuacaggugu

SEQ ID NO: 896680 - RNA, 23 nt, Homo sapiens
aauagcugggacuacagguguga

SEQ ID NO: 896681 - RNA, 14 nt, Homo sapiens
aauaggcauuugau

SEQ ID NO: 896682 - RNA, 14 nt, Homo sapiens
aauaguauuuauga

SEQ ID NO: 896683 - RNA, 16 nt, Homo sapiens
aauaguucaguauaaa

SEQ ID NO: 896684 - RNA, 15 nt, Homo sapiens
aauauaaaacuuaca

SEQ ID NO: 896685 - RNA, 13 nt, Homo sapiens
aauauaaaugcau

SEQ ID NO: 896686 - RNA, 21 nt, Homo sapiens
aauauagcguucccaacaaca

SEQ ID NO: 896687 - RNA, 14 nt, Homo sapiens
aauaucacaucacu

SEQ ID NO: 896688 - RNA, 15 nt, Homo sapiens
aauaucaguuacuca

SEQ ID NO: 896689 - RNA, 14 nt, Homo sapiens
aauauccaccacuu

SEQ ID NO: 896690 - RNA, 17 nt, Homo sapiens
aauauccgaacuuuaau

SEQ ID NO: 896691 - RNA, 19 nt, Homo sapiens
aauaugcacaauagcaguu

SEQ ID NO: 896692 - RNA, 16 nt, Homo sapiens
aauaugcuuuacaauc

SEQ ID NO: 896693 - RNA, 17 nt, Homo sapiens
aauaugggcucaaguca

SEQ ID NO: 896694 - RNA, 20 nt, Homo sapiens
aauauggugggcacagaagu

SEQ ID NO: 896695 - RNA, 19 nt, Homo sapiens
aauaugucugccacagaga

SEQ ID NO: 896696 - RNA, 20 nt, Homo sapiens
aauaugucugccacagagag

SEQ ID NO: 896697 - RNA, 11 nt, Homo sapiens
aauauguucua

SEQ ID NO: 896698 - RNA, 17 nt, Homo sapiens
aauauguugaguguuca

SEQ ID NO: 896699 - RNA, 21 nt, Homo sapiens
aauauguuucuaaaaauuggu

SEQ ID NO: 896700 - RNA, 13 nt, Homo sapiens
aauauuaaauaca

SEQ ID NO: 896701 - RNA, 12 nt, Homo sapiens
aauauuaaggag

SEQ ID NO: 896702 - RNA, 11 nt, Homo sapiens
aauauucaaua

SEQ ID NO: 896703 - RNA, 23 nt, Homo sapiens
aauauuccuauauguagcuuuau

SEQ ID NO: 896704 - RNA, 12 nt, Homo sapiens
aauauuccugaa

SEQ ID NO: 896705 - RNA, 19 nt, Homo sapiens
aauauuuaaacagcagugu

SEQ ID NO: 896706 - RNA, 17 nt, Homo sapiens
aauauuuaaguauauag

SEQ ID NO: 896707 - RNA, 14 nt, Homo sapiens
aauauuuaggcaag

SEQ ID NO: 896708 - RNA, 18 nt, Homo sapiens
aauauuuaggcaagagaa

SEQ ID NO: 896709 - RNA, 16 nt, Homo sapiens
aauauuucaugauuca

SEQ ID NO: 896710 - RNA, 20 nt, Homo sapiens
aauauuucccccuuacuacu

SEQ ID NO: 896711 - RNA, 15 nt, Homo sapiens
aauauuugcuaugaa

SEQ ID NO: 896712 - RNA, 18 nt, Homo sapiens
aauauuugcugacagcug

SEQ ID NO: 896713 - RNA, 16 nt, Homo sapiens
aauauuuuagccuuaa

SEQ ID NO: 896714 - RNA, 15 nt, Homo sapiens
aauauuuuccaugaa

SEQ ID NO: 896715 - RNA, 23 nt, Homo sapiens
aauauuuuccaugaaaaugcaac

SEQ ID NO: 896716 - RNA, 17 nt, Homo sapiens
aauauuuuuaugugcaa

SEQ ID NO: 896717 - RNA, 12 nt, Homo sapiens
aaucaaagacau

SEQ ID NO: 896718 - RNA, 20 nt, Homo sapiens
aaucaaauaugcaaagcacu

SEQ ID NO: 896719 - RNA, 12 nt, Homo sapiens
aaucaaccagca

SEQ ID NO: 896720 - RNA, 16 nt, Homo sapiens
aaucaagagugaguga

SEQ ID NO: 896721 - RNA, 21 nt, Homo sapiens
aaucacaacacagagcugcua

SEQ ID NO: 896722 - RNA, 12 nt, Homo sapiens
aaucacuaaccc

SEQ ID NO: 896723 - RNA, 20 nt, Homo sapiens
aaucagauuauuaagggaau

SEQ ID NO: 896724 - RNA, 17 nt, Homo sapiens
aaucagcauucucacuc

SEQ ID NO: 896725 - RNA, 19 nt, Homo sapiens
aaucauauaauaaauguac

SEQ ID NO: 896726 - RNA, 22 nt, Homo sapiens
aaucauaugguugacaguaugc

SEQ ID NO: 896727 - RNA, 21 nt, Homo sapiens
ccaagaacuuuucccccaaag

SEQ ID NO: 896728 - RNA, 18 nt, Homo sapiens
ccaagaaggugagugcuu

SEQ ID NO: 896729 - RNA, 18 nt, Homo sapiens
ccaagaaugagaagaaug

SEQ ID NO: 896730 - RNA, 18 nt, Homo sapiens
ccaagaggagacuuuaau

SEQ ID NO: 896731 - RNA, 14 nt, Homo sapiens
ccaagaggucucca

SEQ ID NO: 896732 - RNA, 22 nt, Homo sapiens
ccaagauggaggggcugacuca

SEQ ID NO: 896733 - RNA, 21 nt, Homo sapiens
ccaagaugggcacaugaggag

SEQ ID NO: 896734 - RNA, 14 nt, Homo sapiens
ccaagccaugguga

SEQ ID NO: 896735 - RNA, 15 nt, Homo sapiens
ccaagccauggugac

SEQ ID NO: 896736 - RNA, 16 nt, Homo sapiens
ccaagcccucaauaag

SEQ ID NO: 896737 - RNA, 19 nt, Homo sapiens
ccaagcugaagugaaggag

SEQ ID NO: 896738 - RNA, 18 nt, Homo sapiens
ccaaggaugacacugcca

SEQ ID NO: 896739 - RNA, 21 nt, Homo sapiens
ccaaggaugacacugccaguc

SEQ ID NO: 896740 - RNA, 21 nt, Homo sapiens
ccaaggcaggaggaucacuug

SEQ ID NO: 896741 - RNA, 14 nt, Homo sapiens
ccaaggcugcucag

SEQ ID NO: 896742 - RNA, 20 nt, Homo sapiens
ccaaggguaugggaagccau

SEQ ID NO: 896743 - RNA, 14 nt, Homo sapiens
ccaagggucuuccu

SEQ ID NO: 896744 - RNA, 20 nt, Homo sapiens
ccaaggguuucugacccaag

SEQ ID NO: 896745 - RNA, 16 nt, Homo sapiens
ccaaguccagguccug

SEQ ID NO: 896746 - RNA, 15 nt, Homo sapiens
ccaaguuacuugaaa

SEQ ID NO: 896747 - RNA, 15 nt, Homo sapiens
ccaaguugaaaucag

SEQ ID NO: 896748 - RNA, 18 nt, Homo sapiens
ccaauaaaagugacucuc

SEQ ID NO: 896749 - RNA, 12 nt, Homo sapiens
ccaauaccuccu

SEQ ID NO: 896750 - RNA, 12 nt, Homo sapiens
ccaauacuacug

SEQ ID NO: 896751 - RNA, 12 nt, Homo sapiens
ccaauagcuuua

SEQ ID NO: 896752 - RNA, 17 nt, Homo sapiens
ccaauaggcauuugauu

SEQ ID NO: 896753 - RNA, 16 nt, Homo sapiens
ccaauauuuguagaag

SEQ ID NO: 896754 - RNA, 15 nt, Homo sapiens
ccaauccagguggga

SEQ ID NO: 896755 - RNA, 11 nt, Homo sapiens
ccaaugcacac

SEQ ID NO: 896756 - RNA, 13 nt, Homo sapiens
ccaaugcacacac

SEQ ID NO: 896757 - RNA, 18 nt, Homo sapiens
ccaaugcacacacacaga

SEQ ID NO: 896758 - RNA, 13 nt, Homo sapiens
ccaaugcaugcag

SEQ ID NO: 896759 - RNA, 14 nt, Homo sapiens
ccaaugccuugaca

SEQ ID NO: 896760 - RNA, 22 nt, Homo sapiens
ccaauucaaucccggaagggac

SEQ ID NO: 896761 - RNA, 15 nt, Homo sapiens
ccaauuguacauucc

SEQ ID NO: 896762 - RNA, 22 nt, Homo sapiens
ccaauuuaaagaaaacuguuaa

SEQ ID NO: 896763 - RNA, 15 nt, Homo sapiens
ccaauuuauuuuaac

SEQ ID NO: 896764 - RNA, 13 nt, Homo sapiens
ccacaacugacac

SEQ ID NO: 896765 - RNA, 18 nt, Homo sapiens
ccacaacugacacaggaa

SEQ ID NO: 896766 - RNA, 17 nt, Homo sapiens
ccacaagcaauggaccu

SEQ ID NO: 896767 - RNA, 13 nt, Homo sapiens
ccacaagccauuu

SEQ ID NO: 896768 - RNA, 17 nt, Homo sapiens
ccacaauggagugggag

SEQ ID NO: 896769 - RNA, 15 nt, Homo sapiens
ccacacaaaauguca

SEQ ID NO: 896770 - RNA, 14 nt, Homo sapiens
ccacacacagagga

SEQ ID NO: 896771 - RNA, 13 nt, Homo sapiens
ccacaccaaaguc

SEQ ID NO: 896772 - RNA, 19 nt, Homo sapiens
ccacacgcguguguacaca

SEQ ID NO: 896773 - RNA, 14 nt, Homo sapiens
ccacacuucuugaa

SEQ ID NO: 896774 - RNA, 17 nt, Homo sapiens
ccacagacaacauggaa

SEQ ID NO: 896775 - RNA, 19 nt, Homo sapiens
ccacagaugcuugugauuu

SEQ ID NO: 896776 - RNA, 23 nt, Homo sapiens
ccacagcacccaggcuccauggg

SEQ ID NO: 896777 - RNA, 13 nt, Homo sapiens
ccacagcacuaau

SEQ ID NO: 896778 - RNA, 18 nt, Homo sapiens
ccacagcagcaauaugcu

SEQ ID NO: 896779 - RNA, 23 nt, Homo sapiens
ccacagcaguugaaaagacucca

SEQ ID NO: 896780 - RNA, 23 nt, Homo sapiens
ccacagccaagguagggucacua

SEQ ID NO: 896781 - RNA, 22 nt, Homo sapiens
ccacagcgauccacggagcuga

SEQ ID NO: 896782 - RNA, 11 nt, Homo sapiens
ccacagggaac

SEQ ID NO: 896783 - RNA, 14 nt, Homo sapiens
ccacaguagcauuu

SEQ ID NO: 896784 - RNA, 20 nt, Homo sapiens
ccacaucacuacaguacagu

SEQ ID NO: 896785 - RNA, 11 nt, Homo sapiens
ccacaucuaag

SEQ ID NO: 896786 - RNA, 16 nt, Homo sapiens
ccacaucuaaugucuc

SEQ ID NO: 896787 - RNA, 17 nt, Homo sapiens
uacaugcauuacugcau

SEQ ID NO: 896788 - RNA, 16 nt, Homo sapiens
uacauguaauccauca

SEQ ID NO: 896789 - RNA, 14 nt, Homo sapiens
uacauguuacuugu

SEQ ID NO: 896790 - RNA, 19 nt, Homo sapiens
uacauuccucagcugccaa

SEQ ID NO: 896791 - RNA, 19 nt, Homo sapiens
uacauucuccuuuuugccc

SEQ ID NO: 896792 - RNA, 19 nt, Homo sapiens
uacauucuuuaucuugaca

SEQ ID NO: 896793 - RNA, 20 nt, Homo sapiens
uacauucuuuaucuugacau

SEQ ID NO: 896794 - RNA, 23 nt, Homo sapiens
uacauuguuugucugucuucaua

SEQ ID NO: 896795 - RNA, 18 nt, Homo sapiens
uacauuucccugugcuga

SEQ ID NO: 896796 - RNA, 15 nt, Homo sapiens
uacauuuggugcacu

SEQ ID NO: 896797 - RNA, 16 nt, Homo sapiens
uaccaaaaaaguauuu

SEQ ID NO: 896798 - RNA, 16 nt, Homo sapiens
uaccaaguccugggaa

SEQ ID NO: 896799 - RNA, 14 nt, Homo sapiens
uaccaaugcaugca

SEQ ID NO: 896800 - RNA, 23 nt, Homo sapiens
uaccacagaaguucaauacucau

SEQ ID NO: 896801 - RNA, 18 nt, Homo sapiens
uaccagagaccugaggca

SEQ ID NO: 896802 - RNA, 22 nt, Homo sapiens
uaccagauauuugaaucuuucu

SEQ ID NO: 896803 - RNA, 17 nt, Homo sapiens
uaccagugaaccaaaga

SEQ ID NO: 896804 - RNA, 16 nt, Homo sapiens
uaccauaugucugcuu

SEQ ID NO: 896805 - RNA, 17 nt, Homo sapiens
uacccaaggcucuucuc

SEQ ID NO: 896806 - RNA, 16 nt, Homo sapiens
uacccaauuuaauucc

SEQ ID NO: 896807 - RNA, 12 nt, Homo sapiens
uacccacuucca

SEQ ID NO: 896808 - RNA, 16 nt, Homo sapiens
uacccccccuccugcu

SEQ ID NO: 896809 - RNA, 23 nt, Homo sapiens
uacccucccagcgaguugcgcug

SEQ ID NO: 896810 - RNA, 16 nt, Homo sapiens
uaccuaacauuauuua

SEQ ID NO: 896811 - RNA, 20 nt, Homo sapiens
uaccuagagcaggcacuuga

SEQ ID NO: 896812 - RNA, 21 nt, Homo sapiens
uaccuauuauaaaaucuuacu

SEQ ID NO: 896813 - RNA, 14 nt, Homo sapiens
uaccucacuggggu

SEQ ID NO: 896814 - RNA, 18 nt, Homo sapiens
uaccucccccugccuucc

SEQ ID NO: 896815 - RNA, 19 nt, Homo sapiens
uaccucccccugccuucca

SEQ ID NO: 896816 - RNA, 21 nt, Homo sapiens
uaccucccccugccuuccaac

SEQ ID NO: 896817 - RNA, 18 nt, Homo sapiens
uaccuccuguguggaaga

SEQ ID NO: 896818 - RNA, 16 nt, Homo sapiens
uaccugcugcugcuau

SEQ ID NO: 896819 - RNA, 16 nt, Homo sapiens
uaccuguagugagaaa

SEQ ID NO: 896820 - RNA, 20 nt, Homo sapiens
uaccuguguuucuugccuca

SEQ ID NO: 896821 - RNA, 16 nt, Homo sapiens
uaccuugguauaucau

SEQ ID NO: 896822 - RNA, 22 nt, Homo sapiens
uaccuugguauaucauacuggu

SEQ ID NO: 896823 - RNA, 17 nt, Homo sapiens
uacgaccgggaggucca

SEQ ID NO: 896824 - RNA, 21 nt, Homo sapiens
uacgaccgggagguccaccug

SEQ ID NO: 896825 - RNA, 17 nt, Homo sapiens
uacgugccaggcacugu

SEQ ID NO: 896826 - RNA, 19 nt, Homo sapiens
uacgugucuguguguauau

SEQ ID NO: 896827 - RNA, 22 nt, Homo sapiens
uacguuuuacaauguaacuaua

SEQ ID NO: 896828 - RNA, 15 nt, Homo sapiens
uacuaaaaauacaaa

SEQ ID NO: 896829 - RNA, 14 nt, Homo sapiens
uacuaaagugucua

SEQ ID NO: 896830 - RNA, 22 nt, Homo sapiens
uacuaaugugccccauguccaa

SEQ ID NO: 896831 - RNA, 21 nt, Homo sapiens
uacuacuugccacacacuguu

SEQ ID NO: 896832 - RNA, 19 nt, Homo sapiens
uacuagaucuuacaucugc

SEQ ID NO: 896833 - RNA, 20 nt, Homo sapiens
uacuauucuguuaaaaucag

SEQ ID NO: 896834 - RNA, 15 nt, Homo sapiens
uacuccuaccucagc

SEQ ID NO: 896835 - RNA, 12 nt, Homo sapiens
uacucuauguau

SEQ ID NO: 896836 - RNA, 15 nt, Homo sapiens
uacucuauguaugca

SEQ ID NO: 896837 - RNA, 14 nt, Homo sapiens
uacucuccaaccug

SEQ ID NO: 896838 - RNA, 22 nt, Homo sapiens
uacucuggagagacugugcugg

SEQ ID NO: 896839 - RNA, 18 nt, Homo sapiens
uacugacugaugacaaac

SEQ ID NO: 896840 - RNA, 14 nt, Homo sapiens
uacugagacauuac

SEQ ID NO: 896841 - RNA, 14 nt, Homo sapiens
uacugcaugcacuu

SEQ ID NO: 896842 - RNA, 22 nt, Homo sapiens
uacugcucaucauuccuugaga

SEQ ID NO: 896843 - RNA, 22 nt, Homo sapiens
uacugcugucauuguccaugcc

SEQ ID NO: 896844 - RNA, 18 nt, Homo sapiens
uacugguuucaguugaca

SEQ ID NO: 896845 - RNA, 18 nt, Homo sapiens
uacuguaauagugugauu

SEQ ID NO: 896846 - RNA, 17 nt, Homo sapiens
uacuguagcugaugaaa

SEQ ID NO: 896847 - RNA, 14 nt, Homo sapiens
uacugugcauacau

SEQ ID NO: 896848 - RNA, 20 nt, Homo sapiens
uacugugcgcgugugugugc

SEQ ID NO: 896849 - RNA, 16 nt, Homo sapiens
uacuguuccaaaaaga

SEQ ID NO: 896850 - RNA, 15 nt, Homo sapiens
uacuguugcacugau

SEQ ID NO: 896851 - RNA, 13 nt, Homo sapiens
uacuuacaugcau

SEQ ID NO: 896852 - RNA, 15 nt, Homo sapiens
uacuuaggaauuucu

SEQ ID NO: 896853 - RNA, 19 nt, Homo sapiens
uacuuauucuuccgucaca

SEQ ID NO: 896854 - RNA, 12 nt, Homo sapiens
uacuuauuuucc

SEQ ID NO: 896855 - RNA, 13 nt, Homo sapiens
uacuuauuuucca

SEQ ID NO: 896856 - RNA, 18 nt, Homo sapiens
uacuuauuuuccaauaaa

SEQ ID NO: 896857 - RNA, 23 nt, Homo sapiens
uacuuauuuucuggaucuaucug

SEQ ID NO: 896858 - RNA, 15 nt, Homo sapiens
uacuucacuaaugac

SEQ ID NO: 896859 - RNA, 18 nt, Homo sapiens
cugcacuaaaauucacuu

SEQ ID NO: 896860 - RNA, 14 nt, Homo sapiens
cugcagaaggccaa

SEQ ID NO: 896861 - RNA, 14 nt, Homo sapiens
cugcagagauccag

SEQ ID NO: 896862 - RNA, 23 nt, Homo sapiens
cugcagaggggaaaccaguguag

SEQ ID NO: 896863 - RNA, 14 nt, Homo sapiens
cugcagcacuuuaa

SEQ ID NO: 896864 - RNA, 15 nt, Homo sapiens
cugcagcggcacaaa

SEQ ID NO: 896865 - RNA, 22 nt, Homo sapiens
cugcaggaacgagcacuggcca

SEQ ID NO: 896866 - RNA, 14 nt, Homo sapiens
cugcaggaaucaaa

SEQ ID NO: 896867 - RNA, 22 nt, Homo sapiens
cugcaggcaaagugagacugac

SEQ ID NO: 896868 - RNA, 21 nt, Homo sapiens
cugcaguauggccaugggcug

SEQ ID NO: 896869 - RNA, 21 nt, Homo sapiens
cugcagucaacaguucaaaga

SEQ ID NO: 896870 - RNA, 16 nt, Homo sapiens
cugcaguuccugagua

SEQ ID NO: 896871 - RNA, 14 nt, Homo sapiens
cugcaucucaaaaa

SEQ ID NO: 896872 - RNA, 23 nt, Homo sapiens
cugcaugcacuucuuacaauaau

SEQ ID NO: 896873 - RNA, 14 nt, Homo sapiens
cugcaugcucagga

SEQ ID NO: 896874 - RNA, 12 nt, Homo sapiens
cugcaugcucug

SEQ ID NO: 896875 - RNA, 18 nt, Homo sapiens
cugcauuugugucaucuu

SEQ ID NO: 896876 - RNA, 16 nt, Homo sapiens
cugccaaaacaaugcc

SEQ ID NO: 896877 - RNA, 13 nt, Homo sapiens
cugccaagccacc

SEQ ID NO: 896878 - RNA, 15 nt, Homo sapiens
cugccaagccuauug

SEQ ID NO: 896879 - RNA, 12 nt, Homo sapiens
cugccacuucca

SEQ ID NO: 896880 - RNA, 16 nt, Homo sapiens
cugccagccuggcuuc

SEQ ID NO: 896881 - RNA, 12 nt, Homo sapiens
cugccaguguuu

SEQ ID NO: 896882 - RNA, 15 nt, Homo sapiens
cugccauaaagccau

SEQ ID NO: 896883 - RNA, 14 nt, Homo sapiens
cugccauacgcggg

SEQ ID NO: 896884 - RNA, 16 nt, Homo sapiens
cugccaugcccagaga

SEQ ID NO: 896885 - RNA, 14 nt, Homo sapiens
cugcccaaugccuu

SEQ ID NO: 896886 - RNA, 13 nt, Homo sapiens
cugcccacccacu

SEQ ID NO: 896887 - RNA, 20 nt, Homo sapiens
cugcccaggaaggacugugc

SEQ ID NO: 896888 - RNA, 19 nt, Homo sapiens
cugccccacuucucuacuc

SEQ ID NO: 896889 - RNA, 16 nt, Homo sapiens
cugccccagcuuuauc

SEQ ID NO: 896890 - RNA, 13 nt, Homo sapiens
cugccccaucucc

SEQ ID NO: 896891 - RNA, 15 nt, Homo sapiens
cugcccgacucaggu

SEQ ID NO: 896892 - RNA, 16 nt, Homo sapiens
cugcccgacucagguc

SEQ ID NO: 896893 - RNA, 16 nt, Homo sapiens
cugcccuucgcugcca

SEQ ID NO: 896894 - RNA, 18 nt, Homo sapiens
cugccuacaaaauggaga

SEQ ID NO: 896895 - RNA, 21 nt, Homo sapiens
cugccuaggguccuguccaug

SEQ ID NO: 896896 - RNA, 23 nt, Homo sapiens
cugccuaguaagggaacuaugga

SEQ ID NO: 896897 - RNA, 23 nt, Homo sapiens
cugccuccagaauggucuuucua

SEQ ID NO: 896898 - RNA, 17 nt, Homo sapiens
cugccucuauucaauuu

SEQ ID NO: 896899 - RNA, 17 nt, Homo sapiens
cugccugaagucacaca

SEQ ID NO: 896900 - RNA, 16 nt, Homo sapiens
cugccugcggcccaga

SEQ ID NO: 896901 - RNA, 20 nt, Homo sapiens
cugccuuaaugagaacauuu

SEQ ID NO: 896902 - RNA, 19 nt, Homo sapiens
uccugccaccagucacugu

SEQ ID NO: 896903 - RNA, 17 nt, Homo sapiens
uccugccgcaacaguuu

SEQ ID NO: 896904 - RNA, 18 nt, Homo sapiens
uccugccucuacugggaa

SEQ ID NO: 896905 - RNA, 18 nt, Homo sapiens
uccugccuguagcaguga

SEQ ID NO: 896906 - RNA, 14 nt, Homo sapiens
uccugccuugauga

SEQ ID NO: 896907 - RNA, 21 nt, Homo sapiens
uccugcugcuguaacugcuga

SEQ ID NO: 896908 - RNA, 15 nt, Homo sapiens
uccuggacagcugug

SEQ ID NO: 896909 - RNA, 21 nt, Homo sapiens
uccuggcaucuuucaacaaug

SEQ ID NO: 896910 - RNA, 16 nt, Homo sapiens
uccuggcaugacacuc

SEQ ID NO: 896911 - RNA, 18 nt, Homo sapiens
uccuggcaugacacucua

SEQ ID NO: 896912 - RNA, 19 nt, Homo sapiens
uccuggccaacauggugaa

SEQ ID NO: 896913 - RNA, 17 nt, Homo sapiens
uccugggaauaugcuag

SEQ ID NO: 896914 - RNA, 23 nt, Homo sapiens
uccugguuaaauuugaauuucag

SEQ ID NO: 896915 - RNA, 19 nt, Homo sapiens
uccuguauucuacagcaga

SEQ ID NO: 896916 - RNA, 11 nt, Homo sapiens
uccugugaaag

SEQ ID NO: 896917 - RNA, 11 nt, Homo sapiens
uccugugcaac

SEQ ID NO: 896918 - RNA, 16 nt, Homo sapiens
uccugugccccucaga

SEQ ID NO: 896919 - RNA, 15 nt, Homo sapiens
uccugugcuacuuug

SEQ ID NO: 896920 - RNA, 18 nt, Homo sapiens
uccugugcuacuuugccu

SEQ ID NO: 896921 - RNA, 20 nt, Homo sapiens
uccugugggugugucucucg

SEQ ID NO: 896922 - RNA, 20 nt, Homo sapiens
uccugugucuugcaauggca

SEQ ID NO: 896923 - RNA, 24 nt, Homo sapiens
uccuguuucugaaccauuacugua

SEQ ID NO: 896924 - RNA, 19 nt, Homo sapiens
uccuuaauagccauaugca

SEQ ID NO: 896925 - RNA, 23 nt, Homo sapiens
uccuuaauagccauaugcaauaa

SEQ ID NO: 896926 - RNA, 17 nt, Homo sapiens
uccuuacucccaggcac

SEQ ID NO: 896927 - RNA, 20 nt, Homo sapiens
uccuuagcuuagaccucagc

SEQ ID NO: 896928 - RNA, 14 nt, Homo sapiens
uccuucaauucaaa

SEQ ID NO: 896929 - RNA, 13 nt, Homo sapiens
uccuucacauuua

SEQ ID NO: 896930 - RNA, 12 nt, Homo sapiens
uccuucauuucc

SEQ ID NO: 896931 - RNA, 15 nt, Homo sapiens
uccuucugcuggaua

SEQ ID NO: 896932 - RNA, 21 nt, Homo sapiens
uccuugaaaaaaaguugcuuu

SEQ ID NO: 896933 - RNA, 18 nt, Homo sapiens
uccuugauaaaugccuca

SEQ ID NO: 896934 - RNA, 18 nt, Homo sapiens
uccuugggaugaucuuga

SEQ ID NO: 896935 - RNA, 21 nt, Homo sapiens
uccuuggggcacagucauuca

SEQ ID NO: 896936 - RNA, 14 nt, Homo sapiens
uccuuguaucugua

SEQ ID NO: 896937 - RNA, 18 nt, Homo sapiens
uccuuuaccuaccaccuu

SEQ ID NO: 896938 - RNA, 22 nt, Homo sapiens
uccuuuacuaauccaacccaug

SEQ ID NO: 896939 - RNA, 17 nt, Homo sapiens
uccuuuagcgcccaguu

SEQ ID NO: 896940 - RNA, 14 nt, Homo sapiens
uccuuucaccacau

SEQ ID NO: 896941 - RNA, 22 nt, Homo sapiens
uccuuugacuuauuguccccac

SEQ ID NO: 896942 - RNA, 22 nt, Homo sapiens
uccuuuggccauuccaacagcu

SEQ ID NO: 896943 - RNA, 24 nt, Homo sapiens
uccuuuugaccaaauaaaguacca

SEQ ID NO: 896944 - RNA, 16 nt, Homo sapiens
uccuuuuugcaguaua

SEQ ID NO: 896945 - RNA, 19 nt, Homo sapiens
ucgaaaugaauuuaucuga

SEQ ID NO: 896946 - RNA, 19 nt, Homo sapiens
ucgaagcuccgugagugaa

SEQ ID NO: 896947 - RNA, 17 nt, Homo sapiens
ucgagguagguggauca

SEQ ID NO: 896948 - RNA, 19 nt, Homo sapiens
ucgauccuggauucacuca

SEQ ID NO: 896949 - RNA, 20 nt, Homo sapiens
ucgauccuggauucacucac

SEQ ID NO: 896950 - RNA, 14 nt, Homo sapiens
ucgauuagacugga

SEQ ID NO: 896951 - RNA, 18 nt, Homo sapiens
ucgcagcuuuuagaccaa

SEQ ID NO: 896952 - RNA, 23 nt, Homo sapiens
ucgccguguuacuguugcacuga

SEQ ID NO: 896953 - RNA, 12 nt, Homo sapiens
ucgcuacaagaa

SEQ ID NO: 896954 - RNA, 22 nt, Homo sapiens
ucgcucagcaauagggugcagu

SEQ ID NO: 896955 - RNA, 16 nt, Homo sapiens
ucgcuccccacucugc

SEQ ID NO: 896956 - RNA, 14 nt, Homo sapiens
ucgcucgacugcga

SEQ ID NO: 896957 - RNA, 20 nt, Homo sapiens
ucggaagacuugccacuuuu

SEQ ID NO: 896958 - RNA, 14 nt, Homo sapiens
ucggggugugauga

SEQ ID NO: 896959 - RNA, 15 nt, Homo sapiens
ucguaaauauucccu

SEQ ID NO: 896960 - RNA, 13 nt, Homo sapiens
ucguaaggguugc

SEQ ID NO: 896961 - RNA, 13 nt, Homo sapiens
ucguagccaucuc

SEQ ID NO: 896962 - RNA, 20 nt, Homo sapiens
ucguggguguguguagccaa

SEQ ID NO: 896963 - RNA, 17 nt, Homo sapiens
ucuaaaacugccuucca

SEQ ID NO: 896964 - RNA, 17 nt, Homo sapiens
ucuaaaaucccuuucaa

SEQ ID NO: 896965 - RNA, 14 nt, Homo sapiens
ucuaaacccaaaua

SEQ ID NO: 896966 - RNA, 18 nt, Homo sapiens
ucuaaaucugagaucucc

SEQ ID NO: 896967 - RNA, 23 nt, Homo sapiens
ucuaacaccaacauaagguacua

SEQ ID NO: 896968 - RNA, 12 nt, Homo sapiens
ucuaacauaugu

SEQ ID NO: 896969 - RNA, 14 nt, Homo sapiens
ucuaacauauguau

SEQ ID NO: 896970 - RNA, 17 nt, Homo sapiens
ucuaacccccagugcca

SEQ ID NO: 896971 - RNA, 17 nt, Homo sapiens
ucuaacuccagugaagu

SEQ ID NO: 896972 - RNA, 13 nt, Homo sapiens
ucuaaguauuuga

SEQ ID NO: 896973 - RNA, 18 nt, Homo sapiens
ucuaauauuuuuagcucu

SEQ ID NO: 896974 - RNA, 12 nt, Homo sapiens
ucuaaucuaugc

SEQ ID NO: 896975 - RNA, 16 nt, Homo sapiens
ucuaauguaugcauuc

SEQ ID NO: 896976 - RNA, 19 nt, Homo sapiens
ucuacaaacucccacuugu

SEQ ID NO: 896977 - RNA, 21 nt, Homo sapiens
ucuacaaacucccacuuguca

SEQ ID NO: 896978 - RNA, 23 nt, Homo sapiens
gagacacuauuuaucugugcaaa

SEQ ID NO: 896979 - RNA, 15 nt, Homo sapiens
gagacacugugcuau

SEQ ID NO: 896980 - RNA, 18 nt, Homo sapiens
gagacagaccgggguuca

SEQ ID NO: 896981 - RNA, 19 nt, Homo sapiens
gagacagauauacugggag

SEQ ID NO: 896982 - RNA, 12 nt, Homo sapiens
gagacagucuca

SEQ ID NO: 896983 - RNA, 15 nt, Homo sapiens
gagacauacaccuau

SEQ ID NO: 896984 - RNA, 21 nt, Homo sapiens
gagacauacaccuaugucauu

SEQ ID NO: 896985 - RNA, 13 nt, Homo sapiens
gagacauugccuc

SEQ ID NO: 896986 - RNA, 18 nt, Homo sapiens
gagaccagcccagccaac

SEQ ID NO: 896987 - RNA, 23 nt, Homo sapiens
gagaccagccugggcaacaaagu

SEQ ID NO: 896988 - RNA, 17 nt, Homo sapiens
gagaccaggccugagca

SEQ ID NO: 896989 - RNA, 15 nt, Homo sapiens
gagaccauccuggcc

SEQ ID NO: 896990 - RNA, 21 nt, Homo sapiens
gagacgcagcccugggggcca

SEQ ID NO: 896991 - RNA, 17 nt, Homo sapiens
gagacggccaagugaag

SEQ ID NO: 896992 - RNA, 14 nt, Homo sapiens
gagacugcgggaug

SEQ ID NO: 896993 - RNA, 21 nt, Homo sapiens
gagacugucucaagagggcac

SEQ ID NO: 896994 - RNA, 13 nt, Homo sapiens
gagagaaaaaaga

SEQ ID NO: 896995 - RNA, 21 nt, Homo sapiens
gagagaacaacuacugugauc

SEQ ID NO: 896996 - RNA, 19 nt, Homo sapiens
gagagaacuuaaaaaagca

SEQ ID NO: 896997 - RNA, 15 nt, Homo sapiens
gagagaagaaagugu

SEQ ID NO: 896998 - RNA, 13 nt, Homo sapiens
gagagacccaagg

SEQ ID NO: 896999 - RNA, 19 nt, Homo sapiens
gagagauuuguggaaaaau

SEQ ID NO: 897000 - RNA, 14 nt, Homo sapiens
gagagcgaaggggg

SEQ ID NO: 897001 - RNA, 20 nt, Homo sapiens
gagagcggcugcccgacuca

SEQ ID NO: 897002 - RNA, 23 nt, Homo sapiens
gagagcuaaauuacaauugucau

SEQ ID NO: 897003 - RNA, 19 nt, Homo sapiens
gagaggaaaggacaugggu

SEQ ID NO: 897004 - RNA, 12 nt, Homo sapiens
gagaggacucug

SEQ ID NO: 897005 - RNA, 21 nt, Homo sapiens
gagaggagggaugcugccuga

SEQ ID NO: 897006 - RNA, 15 nt, Homo sapiens
gagaguagagggcac

SEQ ID NO: 897007 - RNA, 24 nt, Homo sapiens
gagagugcugagaaggacaccucc

SEQ ID NO: 897008 - RNA, 20 nt, Homo sapiens
gagauauggcuaguggcaau

SEQ ID NO: 897009 - RNA, 17 nt, Homo sapiens
gagauccuuuaaauccu

SEQ ID NO: 897010 - RNA, 20 nt, Homo sapiens
gagaucguuguuuacagugu

SEQ ID NO: 897011 - RNA, 20 nt, Homo sapiens
gagaugcaugcgcaggcuca

SEQ ID NO: 897012 - RNA, 14 nt, Homo sapiens
gagaugcugggcca

SEQ ID NO: 897013 - RNA, 17 nt, Homo sapiens
gagauggaggaaaguga

SEQ ID NO: 897014 - RNA, 23 nt, Homo sapiens
gagauggccuggggaagcuguga

SEQ ID NO: 897015 - RNA, 23 nt, Homo sapiens
gagaugggcuuguuuucuugcca

SEQ ID NO: 897016 - RNA, 19 nt, Homo sapiens
gagauggggucuugcuaua

SEQ ID NO: 897017 - RNA, 20 nt, Homo sapiens
gagauggggucuugcuauau

SEQ ID NO: 897018 - RNA, 20 nt, Homo sapiens
gagaugggugauuccuucaa

SEQ ID NO: 897019 - RNA, 18 nt, Homo sapiens
gagauucuugugccucag

SEQ ID NO: 897020 - RNA, 20 nt, Homo sapiens
gagauugcaccauugcgcuc

SEQ ID NO: 897021 - RNA, 15 nt, Homo sapiens
gagauuuucuuggca

SEQ ID NO: 897022 - RNA, 23 nt, Homo sapiens
gagauuuucuuggcaguauucca

SEQ ID NO: 897023 - RNA, 19 nt, Homo sapiens
gagauuuugucgggacaga

SEQ ID NO: 897024 - RNA, 15 nt, Homo sapiens
gagcaacagaggaca

SEQ ID NO: 897025 - RNA, 22 nt, Homo sapiens
gagcaagaucuugucuccacua

SEQ ID NO: 897026 - RNA, 16 nt, Homo sapiens
gagcaagugacaugcc

SEQ ID NO: 897027 - RNA, 20 nt, Homo sapiens
gagcaauucuccugccucag

SEQ ID NO: 897028 - RNA, 16 nt, Homo sapiens
gagcacaaaaugauaa

SEQ ID NO: 897029 - RNA, 11 nt, Homo sapiens
gagcacacugu

SEQ ID NO: 897030 - RNA, 17 nt, Homo sapiens
gagcacaucugggaggc

SEQ ID NO: 897031 - RNA, 23 nt, Homo sapiens
gagcacugccaggagggacaaag

SEQ ID NO: 897032 - RNA, 21 nt, Homo sapiens
gagcacuggguugacuuucag

SEQ ID NO: 897033 - RNA, 19 nt, Homo sapiens
gagcagcuuuggaaacagg

SEQ ID NO: 897034 - RNA, 16 nt, Homo sapiens
gagcaggcuacuguca

SEQ ID NO: 897035 - RNA, 17 nt, Homo sapiens
gagcaggggcaggguga

SEQ ID NO: 897036 - RNA, 13 nt, Homo sapiens
gagcaggguccug

SEQ ID NO: 897037 - RNA, 22 nt, Homo sapiens
gagcaguaaacuuucucugcaa

SEQ ID NO: 897038 - RNA, 15 nt, Homo sapiens
gagcagucagggugg

SEQ ID NO: 897039 - RNA, 19 nt, Homo sapiens
gagcauuuauaaauggaca

SEQ ID NO: 897040 - RNA, 16 nt, Homo sapiens
gagccaaacacacugu

SEQ ID NO: 897041 - RNA, 14 nt, Homo sapiens
gagccaagcuucaa

SEQ ID NO: 897042 - RNA, 17 nt, Homo sapiens
gagccaagcuucaaccc

SEQ ID NO: 897043 - RNA, 21 nt, Homo sapiens
gagcccgcucugcacagggau

SEQ ID NO: 897044 - RNA, 16 nt, Homo sapiens
gagccgagauugcacc

SEQ ID NO: 897045 - RNA, 24 nt, Homo sapiens
gagccgcugcugagcugcgugcca

SEQ ID NO: 897046 - RNA, 12 nt, Homo sapiens
gagccgcuguga

SEQ ID NO: 897047 - RNA, 20 nt, Homo sapiens
gagccucgguggccaugcuu

SEQ ID NO: 897048 - RNA, 14 nt, Homo sapiens
gagccugacugugu

SEQ ID NO: 897049 - RNA, 18 nt, Homo sapiens
gagccugagccacaaaaa

SEQ ID NO: 897050 - RNA, 12 nt, Homo sapiens
gagccugcaguu

SEQ ID NO: 897051 - RNA, 18 nt, Homo sapiens
gagccuggggcaucccag

SEQ ID NO: 897052 - RNA, 23 nt, Homo sapiens
gagccuuuuaccccugcacaguu

SEQ ID NO: 897053 - RNA, 16 nt, Homo sapiens
gagcucacaaggcagc

SEQ ID NO: 897054 - RNA, 18 nt, Homo sapiens
gagcucagccgugcacuc

SEQ ID NO: 897055 - RNA, 15 nt, Homo sapiens
gagcuccccaaaaac

SEQ ID NO: 897056 - RNA, 22 nt, Homo sapiens
gagcucuuaacuacaguggcug

SEQ ID NO: 897057 - RNA, 21 nt, Homo sapiens
gagcugaauuaccuuucacuu

SEQ ID NO: 897058 - RNA, 20 nt, Homo sapiens
gagcugacccagaguggagu

SEQ ID NO: 897059 - RNA, 15 nt, Homo sapiens
gagcugccagccggg

SEQ ID NO: 897060 - RNA, 14 nt, Homo sapiens
gagcugcgugccac

SEQ ID NO: 897061 - RNA, 21 nt, Homo sapiens
gagcuggaaauaaaccuggag

SEQ ID NO: 897062 - RNA, 20 nt, Homo sapiens
gagcugggcaccacaggcug

SEQ ID NO: 897063 - RNA, 17 nt, Homo sapiens
gagcuguggacuuuguu

SEQ ID NO: 897064 - RNA, 19 nt, Homo sapiens
gagcuuagccuugugcccu

SEQ ID NO: 897065 - RNA, 13 nt, Homo sapiens
gagcuucaguaua

SEQ ID NO: 897066 - RNA, 18 nt, Homo sapiens
gagcuucaguauaaaaga

SEQ ID NO: 897067 - RNA, 12 nt, Homo sapiens
gagcuuccucag

SEQ ID NO: 897068 - RNA, 22 nt, Homo sapiens
gaggaaaaacgaucgcugugaa

SEQ ID NO: 897069 - RNA, 18 nt, Homo sapiens
gaggacagagcuggcugu

SEQ ID NO: 897070 - RNA, 22 nt, Homo sapiens
gaggacauucuggaaaagcaaa

SEQ ID NO: 897071 - RNA, 22 nt, Homo sapiens
gaggagucugagguccugagca

SEQ ID NO: 897072 - RNA, 14 nt, Homo sapiens
gaggaguuccuuga

SEQ ID NO: 897073 - RNA, 20 nt, Homo sapiens
gaggauugcuucuugugaaa

SEQ ID NO: 897074 - RNA, 15 nt, Homo sapiens
gaggcaagaaccagu

SEQ ID NO: 897075 - RNA, 15 nt, Homo sapiens
gaggcagaacaggcu

SEQ ID NO: 897076 - RNA, 17 nt, Homo sapiens
gaggcagaauaagaaaa

SEQ ID NO: 897077 - RNA, 18 nt, Homo sapiens
gaggcagacagcagcuca

SEQ ID NO: 897078 - RNA, 23 nt, Homo sapiens
gaggcauuccagccccuauguua

SEQ ID NO: 897079 - RNA, 21 nt, Homo sapiens
gaggcccccuggugugucuga

SEQ ID NO: 897080 - RNA, 19 nt, Homo sapiens
gaggcggguggaucacuug

SEQ ID NO: 897081 - RNA, 12 nt, Homo sapiens
gaggcuccugug

SEQ ID NO: 897082 - RNA, 21 nt, Homo sapiens
gaggcugagcuggaucacuug

SEQ ID NO: 897083 - RNA, 22 nt, Homo sapiens
gaggcugcggccuaggggucca

SEQ ID NO: 897084 - RNA, 20 nt, Homo sapiens
gaggcuuccugacugacaca

SEQ ID NO: 897085 - RNA, 20 nt, Homo sapiens
gaggcuugccccacccaaca

SEQ ID NO: 897086 - RNA, 12 nt, Homo sapiens
gaggcuuggaaa

SEQ ID NO: 897087 - RNA, 16 nt, Homo sapiens
gagggaggagaaugag

SEQ ID NO: 897088 - RNA, 20 nt, Homo sapiens
gagggcaaacccaaaaccuc

SEQ ID NO: 897089 - RNA, 20 nt, Homo sapiens
gagggcuagaaccuagaagg

SEQ ID NO: 897090 - RNA, 15 nt, Homo sapiens
gagggcugccugaaa

SEQ ID NO: 897091 - RNA, 20 nt, Homo sapiens
gagguagcucccagcacuca

SEQ ID NO: 897092 - RNA, 19 nt, Homo sapiens
ucuacacaguaaaaacuug

SEQ ID NO: 897093 - RNA, 23 nt, Homo sapiens
ucuacacagugggaacucugaca

SEQ ID NO: 897094 - RNA, 15 nt, Homo sapiens
ucuacacauacugca

SEQ ID NO: 897095 - RNA, 21 nt, Homo sapiens
ucuacagccucagaaaccaga

SEQ ID NO: 897096 - RNA, 16 nt, Homo sapiens
ucuaccaucuaaucua

SEQ ID NO: 897097 - RNA, 13 nt, Homo sapiens
ucuaccgaccugu

SEQ ID NO: 897098 - RNA, 23 nt, Homo sapiens
ucuaccuuuaaaauuuaccacag

SEQ ID NO: 897099 - RNA, 13 nt, Homo sapiens
ucuacuacagggu

SEQ ID NO: 897100 - RNA, 17 nt, Homo sapiens
ucuacuccaugcacaua

SEQ ID NO: 897101 - RNA, 17 nt, Homo sapiens
ucuacuccuaccucagc

SEQ ID NO: 897102 - RNA, 18 nt, Homo sapiens
ucuacugagacaugacua

SEQ ID NO: 897103 - RNA, 18 nt, Homo sapiens
ucuacugcaagacuuaaa

SEQ ID NO: 897104 - RNA, 18 nt, Homo sapiens
ucuacugccuuggacaac

SEQ ID NO: 897105 - RNA, 15 nt, Homo sapiens
ucuagaaacagaucu

SEQ ID NO: 897106 - RNA, 15 nt, Homo sapiens
ucuagaacacaggca

SEQ ID NO: 897107 - RNA, 15 nt, Homo sapiens
ucuagagaacaugcc

SEQ ID NO: 897108 - RNA, 17 nt, Homo sapiens
ucuaggaaacccaagga

SEQ ID NO: 897109 - RNA, 13 nt, Homo sapiens
ucuaggcaguuca

SEQ ID NO: 897110 - RNA, 22 nt, Homo sapiens
ucuaguccuauucuauugcagu

SEQ ID NO: 897111 - RNA, 20 nt, Homo sapiens
ucuaguucaaauuauuugga

SEQ ID NO: 897112 - RNA, 23 nt, Homo sapiens
ucuaguuccucuucuuaagggga

SEQ ID NO: 897113 - RNA, 13 nt, Homo sapiens
ucuaucuuauaua

SEQ ID NO: 897114 - RNA, 23 nt, Homo sapiens
ucuaucuugaauuucaugcuuuc

SEQ ID NO: 897115 - RNA, 13 nt, Homo sapiens
ucuaugcauguau

SEQ ID NO: 897116 - RNA, 23 nt, Homo sapiens
ucuaugggacucaaugcacugac

SEQ ID NO: 897117 - RNA, 18 nt, Homo sapiens
ucuaugguugacauugua

SEQ ID NO: 897118 - RNA, 13 nt, Homo sapiens
ucuauguacugua

SEQ ID NO: 897119 - RNA, 18 nt, Homo sapiens
ucuauguaugcaucuaua

SEQ ID NO: 897120 - RNA, 13 nt, Homo sapiens
ucuauugcugcuc

SEQ ID NO: 897121 - RNA, 21 nt, Homo sapiens
ucuauuuacauaaaaugggug

SEQ ID NO: 897122 - RNA, 16 nt, Homo sapiens
ucuauuuccuuuccag

SEQ ID NO: 897123 - RNA, 20 nt, Homo sapiens
ucucaaacucuugaccucag

SEQ ID NO: 897124 - RNA, 20 nt, Homo sapiens
ucucaaauccugaugcuguu

SEQ ID NO: 897125 - RNA, 14 nt, Homo sapiens
ucucaaaugcacau

SEQ ID NO: 897126 - RNA, 19 nt, Homo sapiens
ucucaaaugcacaucucau

SEQ ID NO: 897127 - RNA, 21 nt, Homo sapiens
ucucaaauucucaaccuacca

SEQ ID NO: 897128 - RNA, 17 nt, Homo sapiens
ucucaaucagugcagug

SEQ ID NO: 897129 - RNA, 21 nt, Homo sapiens
ucucaaugugaaaaauguguc

SEQ ID NO: 897130 - RNA, 20 nt, Homo sapiens
ucuggcuaaauggacaucau

SEQ ID NO: 897131 - RNA, 17 nt, Homo sapiens
ucuggcuuuacauuuua

SEQ ID NO: 897132 - RNA, 20 nt, Homo sapiens
ucuggcuuugucucuagccg

SEQ ID NO: 897133 - RNA, 20 nt, Homo sapiens
ucugggcuuggggcuuccua

SEQ ID NO: 897134 - RNA, 21 nt, Homo sapiens
ucuggggaagaccuuguccca

SEQ ID NO: 897135 - RNA, 15 nt, Homo sapiens
ucuggggacaccagc

SEQ ID NO: 897136 - RNA, 17 nt, Homo sapiens
ucuguaaggaacuggaa

SEQ ID NO: 897137 - RNA, 18 nt, Homo sapiens
ucuguaaucaaacugcaa

SEQ ID NO: 897138 - RNA, 12 nt, Homo sapiens
ucuguaaucuuc

SEQ ID NO: 897139 - RNA, 19 nt, Homo sapiens
ucuguagcuuguucccugu

SEQ ID NO: 897140 - RNA, 22 nt, Homo sapiens
ucuguaggucccacucccacag

SEQ ID NO: 897141 - RNA, 14 nt, Homo sapiens
ucugucaccagcua

SEQ ID NO: 897142 - RNA, 15 nt, Homo sapiens
ucugugaggugcuga

SEQ ID NO: 897143 - RNA, 24 nt, Homo sapiens
ucuguguaaaucuaacuacaagga

SEQ ID NO: 897144 - RNA, 13 nt, Homo sapiens
ucuguucacuuuu

SEQ ID NO: 897145 - RNA, 17 nt, Homo sapiens
ucuguuccccauggcca

SEQ ID NO: 897146 - RNA, 17 nt, Homo sapiens
ucuguuggccaguguga

SEQ ID NO: 897147 - RNA, 20 nt, Homo sapiens
ucuguuggccagugugacaa

SEQ ID NO: 897148 - RNA, 15 nt, Homo sapiens
ucuguuguccaucau

SEQ ID NO: 897149 - RNA, 16 nt, Homo sapiens
ucuguuucccaccuca

SEQ ID NO: 897150 - RNA, 18 nt, Homo sapiens
ucuguuuuuuuaagaaag

SEQ ID NO: 897151 - RNA, 18 nt, Homo sapiens
ucuuaaaacacuuuucaa

SEQ ID NO: 897152 - RNA, 18 nt, Homo sapiens
ucuuaaaggaaaagucaa

SEQ ID NO: 897153 - RNA, 16 nt, Homo sapiens
ucuuaacuauucaaug

SEQ ID NO: 897154 - RNA, 16 nt, Homo sapiens
ucuuaauaggcuuuau

SEQ ID NO: 897155 - RNA, 13 nt, Homo sapiens
ucuuaaucuaaga

SEQ ID NO: 897156 - RNA, 22 nt, Homo sapiens
ucuuaauucaacuaguaccaca

SEQ ID NO: 897157 - RNA, 19 nt, Homo sapiens
ucuuacaauaauucuauga

SEQ ID NO: 897158 - RNA, 15 nt, Homo sapiens
ucuuacagcacaucu

SEQ ID NO: 897159 - RNA, 14 nt, Homo sapiens
ucuuacuuaugugu

SEQ ID NO: 897160 - RNA, 16 nt, Homo sapiens
ucuuagaaguggacca

SEQ ID NO: 897161 - RNA, 18 nt, Homo sapiens
ucuuagcugaacaaugaa

SEQ ID NO: 897162 - RNA, 11 nt, Homo sapiens
ucuuagcuguc

SEQ ID NO: 897163 - RNA, 12 nt, Homo sapiens
ucuuagcuuucu

SEQ ID NO: 897164 - RNA, 17 nt, Homo sapiens
ucuuagggcagucagua

SEQ ID NO: 897165 - RNA, 16 nt, Homo sapiens
ucuuaugaaaugggcu

SEQ ID NO: 897166 - RNA, 18 nt, Homo sapiens
ucuuauuagaacaggcaa

SEQ ID NO: 897167 - RNA, 18 nt, Homo sapiens
ucuuauucucacuccacc

SEQ ID NO: 897168 - RNA, 14 nt, Homo sapiens
ucuucaaccuuaag

SEQ ID NO: 897169 - RNA, 17 nt, Homo sapiens
ucuucaauaaauuaagu

SEQ ID NO: 897170 - RNA, 18 nt, Homo sapiens
ucuucacaacagauuauu

SEQ ID NO: 897171 - RNA, 21 nt, Homo sapiens
ucuucagaauauggacaaaga

SEQ ID NO: 897172 - RNA, 11 nt, Homo sapiens
ucuucagccac

SEQ ID NO: 897173 - RNA, 21 nt, Homo sapiens
ucuucaggguguuaaggcagu

SEQ ID NO: 897174 - RNA, 22 nt, Homo sapiens
ucuucaggguguuaaggcagug

SEQ ID NO: 897175 - RNA, 17 nt, Homo sapiens
ucuucaguuuuaggcuu

SEQ ID NO: 897176 - RNA, 14 nt, Homo sapiens
ucuucauggccaua

SEQ ID NO: 897177 - RNA, 18 nt, Homo sapiens
ucuucauguuucaggaga

SEQ ID NO: 897178 - RNA, 22 nt, Homo sapiens
ucuuccacccauucccccaugu

SEQ ID NO: 897179 - RNA, 16 nt, Homo sapiens
ucuuccagcaugcauc

SEQ ID NO: 897180 - RNA, 16 nt, Homo sapiens
ucuuccuaguauauua

SEQ ID NO: 897181 - RNA, 21 nt, Homo sapiens
ucuuccuuucuaaaucugaga

SEQ ID NO: 897182 - RNA, 15 nt, Homo sapiens
ucuucuaaccucagc

SEQ ID NO: 897183 - RNA, 14 nt, Homo sapiens
ucuucucccugugu

SEQ ID NO: 897184 - RNA, 17 nt, Homo sapiens
ucuucuccuaugcauuu

SEQ ID NO: 897185 - RNA, 18 nt, Homo sapiens
ucuucugaauugacugua

SEQ ID NO: 897186 - RNA, 16 nt, Homo sapiens
ucuucugagcaccuac

SEQ ID NO: 897187 - RNA, 16 nt, Homo sapiens
ucuucugggaacuucc

SEQ ID NO: 897188 - RNA, 20 nt, Homo sapiens
ucuucugggaacuuccucag

SEQ ID NO: 897189 - RNA, 13 nt, Homo sapiens
ucuucugucugca

SEQ ID NO: 897190 - RNA, 15 nt, Homo sapiens
ucuucuuagcaccac

SEQ ID NO: 897191 - RNA, 17 nt, Homo sapiens
ucuucuuauucaugcuu

SEQ ID NO: 897192 - RNA, 21 nt, Homo sapiens
ucuugaaacauagagaucuau

SEQ ID NO: 897193 - RNA, 14 nt, Homo sapiens
ucuugaagaauauu

SEQ ID NO: 897194 - RNA, 18 nt, Homo sapiens
ucuugaauauuugcuuaa

SEQ ID NO: 897195 - RNA, 13 nt, Homo sapiens
ucuugacauguaa

SEQ ID NO: 897196 - RNA, 17 nt, Homo sapiens
ucuugacauucaaggca

SEQ ID NO: 897197 - RNA, 22 nt, Homo sapiens
ucuugaccucaggugauccacc

SEQ ID NO: 897198 - RNA, 15 nt, Homo sapiens
ucuugaggccaggag

SEQ ID NO: 897199 - RNA, 11 nt, Homo sapiens
ucuugcauucu

SEQ ID NO: 897200 - RNA, 17 nt, Homo sapiens
ucuugccccuccagaga

SEQ ID NO: 897201 - RNA, 22 nt, Homo sapiens
ucuugcuguaacucagacauuc

SEQ ID NO: 897202 - RNA, 19 nt, Homo sapiens
ucuuggaccucugcucuga

SEQ ID NO: 897203 - RNA, 20 nt, Homo sapiens
ucuuggcucacuacagccuc

SEQ ID NO: 897204 - RNA, 12 nt, Homo sapiens
ucuuggugccuc

SEQ ID NO: 897205 - RNA, 12 nt, Homo sapiens
ucuugucucaca

SEQ ID NO: 897206 - RNA, 17 nt, Homo sapiens
ucuugucucacaugcua

SEQ ID NO: 897207 - RNA, 14 nt, Homo sapiens
ucuuguucauccaa

SEQ ID NO: 897208 - RNA, 13 nt, Homo sapiens
gauggugcugacc

SEQ ID NO: 897209 - RNA, 20 nt, Homo sapiens
gauggugguaaacauucucu

SEQ ID NO: 897210 - RNA, 13 nt, Homo sapiens
gauguacacacac

SEQ ID NO: 897211 - RNA, 18 nt, Homo sapiens
gauguaggguaaggugcc

SEQ ID NO: 897212 - RNA, 15 nt, Homo sapiens
gaugucaggcccaga

SEQ ID NO: 897213 - RNA, 20 nt, Homo sapiens
gauguccagaagaauauuca

SEQ ID NO: 897214 - RNA, 13 nt, Homo sapiens
gaugugggguccc

SEQ ID NO: 897215 - RNA, 14 nt, Homo sapiens
gauuaaacagacuu

SEQ ID NO: 897216 - RNA, 20 nt, Homo sapiens
gauuagcucuggaccagccu

SEQ ID NO: 897217 - RNA, 23 nt, Homo sapiens
gauuauacgacuuuuaagcaaag

SEQ ID NO: 897218 - RNA, 19 nt, Homo sapiens
gauuauucccuguacaaua

SEQ ID NO: 897219 - RNA, 12 nt, Homo sapiens
gauuauuugaac

SEQ ID NO: 897220 - RNA, 23 nt, Homo sapiens
gauuauuuguuauuuguacaguu

SEQ ID NO: 897221 - RNA, 21 nt, Homo sapiens
gauucacaacuaggaccucau

SEQ ID NO: 897222 - RNA, 14 nt, Homo sapiens
gauucacaucucau

SEQ ID NO: 897223 - RNA, 20 nt, Homo sapiens
gauucauuuuaacaucugag

SEQ ID NO: 897224 - RNA, 12 nt, Homo sapiens
gauuccagagag

SEQ ID NO: 897225 - RNA, 11 nt, Homo sapiens
gauuccauuug

SEQ ID NO: 897226 - RNA, 13 nt, Homo sapiens
gauucccagagac

SEQ ID NO: 897227 - RNA, 16 nt, Homo sapiens
gauuccucuugccucu

SEQ ID NO: 897228 - RNA, 13 nt, Homo sapiens
gauuccugcauuu

SEQ ID NO: 897229 - RNA, 22 nt, Homo sapiens
gauuccuuuugauggggagaaa

SEQ ID NO: 897230 - RNA, 14 nt, Homo sapiens
gauucgaaugacac

SEQ ID NO: 897231 - RNA, 13 nt, Homo sapiens
gauucuccuguca

SEQ ID NO: 897232 - RNA, 16 nt, Homo sapiens
gauucuuccaucugau

SEQ ID NO: 897233 - RNA, 18 nt, Homo sapiens
gauucuugacauucacuu

SEQ ID NO: 897234 - RNA, 17 nt, Homo sapiens
gauugacacacagcacu

SEQ ID NO: 897235 - RNA, 16 nt, Homo sapiens
gauugagaaguuuugu

SEQ ID NO: 897236 - RNA, 13 nt, Homo sapiens
gauugauggugcu

SEQ ID NO: 897237 - RNA, 19 nt, Homo sapiens
gauugugaccuccagaggu

SEQ ID NO: 897238 - RNA, 17 nt, Homo sapiens
gauugugcccagcccuu

SEQ ID NO: 897239 - RNA, 19 nt, Homo sapiens
gauugugguacaaucucaa

SEQ ID NO: 897240 - RNA, 17 nt, Homo sapiens
gauuguucaucaugaca

SEQ ID NO: 897241 - RNA, 22 nt, Homo sapiens
gauuguucuguccaguuuccaa

SEQ ID NO: 897242 - RNA, 15 nt, Homo sapiens
gauuuaaaauaucac

SEQ ID NO: 897243 - RNA, 21 nt, Homo sapiens
gauuuaaugaagacccagugu

SEQ ID NO: 897244 - RNA, 21 nt, Homo sapiens
gauuuacugcaagaaguacau

SEQ ID NO: 897245 - RNA, 21 nt, Homo sapiens
gcacugcuaggcgagugccag

SEQ ID NO: 897246 - RNA, 15 nt, Homo sapiens
gcacugcuccagugg

SEQ ID NO: 897247 - RNA, 18 nt, Homo sapiens
gcacugugaagacccagc

SEQ ID NO: 897248 - RNA, 20 nt, Homo sapiens
gcacuugcagauacauucau

SEQ ID NO: 897249 - RNA, 19 nt, Homo sapiens
gcacuuggggcaccuugcu

SEQ ID NO: 897250 - RNA, 21 nt, Homo sapiens
gcacuuuacagaugagauucc

SEQ ID NO: 897251 - RNA, 22 nt, Homo sapiens
gcagaaaccaagucuacuucac

SEQ ID NO: 897252 - RNA, 21 nt, Homo sapiens
gcagaagaauugaacccagga

SEQ ID NO: 897253 - RNA, 12 nt, Homo sapiens
gcagaaguauaa

SEQ ID NO: 897254 - RNA, 17 nt, Homo sapiens
gcagacaccugccuuaa

SEQ ID NO: 897255 - RNA, 13 nt, Homo sapiens
gcagacacugccg

SEQ ID NO: 897256 - RNA, 17 nt, Homo sapiens
gcagaccaucuccagca

SEQ ID NO: 897257 - RNA, 16 nt, Homo sapiens
gcagaccgggggccag

SEQ ID NO: 897258 - RNA, 21 nt, Homo sapiens
gcagacugcaaaucugccuga

SEQ ID NO: 897259 - RNA, 13 nt, Homo sapiens
gcagacugucccu

SEQ ID NO: 897260 - RNA, 21 nt, Homo sapiens
gcagagaccuugcgaccaugu

SEQ ID NO: 897261 - RNA, 22 nt, Homo sapiens
gcagagagguggagaacuggga

SEQ ID NO: 897262 - RNA, 20 nt, Homo sapiens
gcagagguaaaagugugagc

SEQ ID NO: 897263 - RNA, 18 nt, Homo sapiens
gcagaggugagcagagga

SEQ ID NO: 897264 - RNA, 21 nt, Homo sapiens
gcagagugagacucgucucaa

SEQ ID NO: 897265 - RNA, 18 nt, Homo sapiens
gcagagugauucaggggc

SEQ ID NO: 897266 - RNA, 11 nt, Homo sapiens
gcagcaaugag

SEQ ID NO: 897267 - RNA, 14 nt, Homo sapiens
gcagcagaagccaa

SEQ ID NO: 897268 - RNA, 16 nt, Homo sapiens
gcagcagcucagccuc

SEQ ID NO: 897269 - RNA, 21 nt, Homo sapiens
gcagcagugagcuucuauuaa

SEQ ID NO: 897270 - RNA, 17 nt, Homo sapiens
gcagcaguuccaugaag

SEQ ID NO: 897271 - RNA, 17 nt, Homo sapiens
gcagcauuccaugacca

SEQ ID NO: 897272 - RNA, 16 nt, Homo sapiens
gcagccacugugcuga

SEQ ID NO: 897273 - RNA, 21 nt, Homo sapiens
gcagccaggggcugcucauca

SEQ ID NO: 897274 - RNA, 15 nt, Homo sapiens
gcagccauccaugag

SEQ ID NO: 897275 - RNA, 15 nt, Homo sapiens
gcagcccagccucug

SEQ ID NO: 897276 - RNA, 16 nt, Homo sapiens
gcagccccacacccgc

SEQ ID NO: 897277 - RNA, 20 nt, Homo sapiens
gcagcccuaaggaucucuca

SEQ ID NO: 897278 - RNA, 14 nt, Homo sapiens
gcagccuucugaca

SEQ ID NO: 897279 - RNA, 21 nt, Homo sapiens
gcagcugucauggaaaagccc

SEQ ID NO: 897280 - RNA, 22 nt, Homo sapiens
gcagcugucauggaaaagccca

SEQ ID NO: 897281 - RNA, 14 nt, Homo sapiens
gcaggaaguacuca

SEQ ID NO: 897282 - RNA, 21 nt, Homo sapiens
gcaggaggcuagcaaagcuua

SEQ ID NO: 897283 - RNA, 18 nt, Homo sapiens
gcaggaguagcugagcuc

SEQ ID NO: 897284 - RNA, 20 nt, Homo sapiens
gcaggcagccccacacccgc

SEQ ID NO: 897285 - RNA, 21 nt, Homo sapiens
gcaggcagccccacacccgcc

SEQ ID NO: 897286 - RNA, 18 nt, Homo sapiens
gcaggcccccaggugcca

SEQ ID NO: 897287 - RNA, 18 nt, Homo sapiens
gcaggccuaggaccucag

SEQ ID NO: 897288 - RNA, 15 nt, Homo sapiens
gcaggcuacugucag

SEQ ID NO: 897289 - RNA, 21 nt, Homo sapiens
gcaggcuauuuguucagagag

SEQ ID NO: 897290 - RNA, 17 nt, Homo sapiens
gcaggcucagacucugg

SEQ ID NO: 897291 - RNA, 15 nt, Homo sapiens
gcagggcaaaugaca

SEQ ID NO: 897292 - RNA, 23 nt, Homo sapiens
gcagggcaaaugacaugcacuga

SEQ ID NO: 897293 - RNA, 23 nt, Homo sapiens
gcagggguccuuggugugacccu

SEQ ID NO: 897294 - RNA, 21 nt, Homo sapiens
gcaggucccuuuuugucucuc

SEQ ID NO: 897295 - RNA, 20 nt, Homo sapiens
gcaguagacuauaagcagaa

SEQ ID NO: 897296 - RNA, 23 nt, Homo sapiens
gcaguauccaauaggcauuugau

SEQ ID NO: 897297 - RNA, 19 nt, Homo sapiens
gcaguauugccacaaugcc

SEQ ID NO: 897298 - RNA, 19 nt, Homo sapiens
gcagucaacaguucaaaga

SEQ ID NO: 897299 - RNA, 22 nt, Homo sapiens
gcagucagggugggaagaaaga

SEQ ID NO: 897300 - RNA, 21 nt, Homo sapiens
gcagucccagcuacucaggag

SEQ ID NO: 897301 - RNA, 20 nt, Homo sapiens
gcagucuuggcucacuacag

SEQ ID NO: 897302 - RNA, 16 nt, Homo sapiens
gcagugaacacacuca

SEQ ID NO: 897303 - RNA, 18 nt, Homo sapiens
gcagugacgugcaccugu

SEQ ID NO: 897304 - RNA, 15 nt, Homo sapiens
gcagugacuuuagaa

SEQ ID NO: 897305 - RNA, 21 nt, Homo sapiens
gcagugacuuuagaaacaaau

SEQ ID NO: 897306 - RNA, 21 nt, Homo sapiens
gcagugagcugauaucaugcc

SEQ ID NO: 897307 - RNA, 13 nt, Homo sapiens
gcagugaugucac

SEQ ID NO: 897308 - RNA, 17 nt, Homo sapiens
gcagugcaagagacucu

SEQ ID NO: 897309 - RNA, 14 nt, Homo sapiens
gcagugugucacac

SEQ ID NO: 897310 - RNA, 18 nt, Homo sapiens
gcaguguuuucaccucau

SEQ ID NO: 897311 - RNA, 16 nt, Homo sapiens
gcaguucacaggguau

SEQ ID NO: 897312 - RNA, 22 nt, Homo sapiens
gcaguugaaacaagaagccaca

SEQ ID NO: 897313 - RNA, 21 nt, Homo sapiens
gcaguuugcuuuguaugcacu

SEQ ID NO: 897314 - RNA, 21 nt, Homo sapiens
gcauaaguuucugggaccuca

SEQ ID NO: 897315 - RNA, 21 nt, Homo sapiens
gcauaaucagcgcccuggagu

SEQ ID NO: 897316 - RNA, 14 nt, Homo sapiens
gcauaccugcuggu

SEQ ID NO: 897317 - RNA, 12 nt, Homo sapiens
gcauaccuuuau

SEQ ID NO: 897318 - RNA, 20 nt, Homo sapiens
gcauaccuuuauugugaucu

SEQ ID NO: 897319 - RNA, 14 nt, Homo sapiens
gcauagaaacugag

SEQ ID NO: 897320 - RNA, 16 nt, Homo sapiens
gcauagcaagacacau

SEQ ID NO: 897321 - RNA, 18 nt, Homo sapiens
gcauaucaaaaaguauua

SEQ ID NO: 897322 - RNA, 16 nt, Homo sapiens
gcaucaucagccuauu

SEQ ID NO: 897323 - RNA, 15 nt, Homo sapiens
ugaauuucuaaaaaa

SEQ ID NO: 897324 - RNA, 21 nt, Homo sapiens
ugaauuuggccugcacuaauu

SEQ ID NO: 897325 - RNA, 14 nt, Homo sapiens
ugaauuuuguugcu

SEQ ID NO: 897326 - RNA, 21 nt, Homo sapiens
ugacaaagaugaccugcugcu

SEQ ID NO: 897327 - RNA, 23 nt, Homo sapiens
ugacaaauucuuuuucacacuga

SEQ ID NO: 897328 - RNA, 18 nt, Homo sapiens
ugacaagcaagggcugug

SEQ ID NO: 897329 - RNA, 18 nt, Homo sapiens
ugacaauacugcugccuu

SEQ ID NO: 897330 - RNA, 20 nt, Homo sapiens
ugacacacagcagcacugca

SEQ ID NO: 897331 - RNA, 13 nt, Homo sapiens
ugacacauaugca

SEQ ID NO: 897332 - RNA, 15 nt, Homo sapiens
ugacaccgaguucca

SEQ ID NO: 897333 - RNA, 21 nt, Homo sapiens
ugacaccgaguuccaccccau

SEQ ID NO: 897334 - RNA, 20 nt, Homo sapiens
ugacaccgucccucagugau

SEQ ID NO: 897335 - RNA, 22 nt, Homo sapiens
ugacaccgucccucagugauac

SEQ ID NO: 897336 - RNA, 17 nt, Homo sapiens
ugacacuuugccagaaa

SEQ ID NO: 897337 - RNA, 22 nt, Homo sapiens
ugacagauacauagauggacca

SEQ ID NO: 897338 - RNA, 12 nt, Homo sapiens
ugacagccagag

SEQ ID NO: 897339 - RNA, 22 nt, Homo sapiens
ugacagcugaccuuugucaucu

SEQ ID NO: 897340 - RNA, 14 nt, Homo sapiens
ugacaggcaaugcu

SEQ ID NO: 897341 - RNA, 12 nt, Homo sapiens
ugacaguauauu

SEQ ID NO: 897342 - RNA, 14 nt, Homo sapiens
ugacaucacuugua

SEQ ID NO: 897343 - RNA, 13 nt, Homo sapiens
ugacaugcacuga

SEQ ID NO: 897344 - RNA, 14 nt, Homo sapiens
ugacaugucucaca

SEQ ID NO: 897345 - RNA, 12 nt, Homo sapiens
ugacaugugcuu

SEQ ID NO: 897346 - RNA, 14 nt, Homo sapiens
ugacaugugcuuug

SEQ ID NO: 897347 - RNA, 14 nt, Homo sapiens
ugacauuauaucau

SEQ ID NO: 897348 - RNA, 15 nt, Homo sapiens
ugacauuguauguau

SEQ ID NO: 897349 - RNA, 14 nt, Homo sapiens
ugacauuguuggcc

SEQ ID NO: 897350 - RNA, 16 nt, Homo sapiens
ugaccagcaaauacuc

SEQ ID NO: 897351 - RNA, 11 nt, Homo sapiens
ugaccaggaac

SEQ ID NO: 897352 - RNA, 23 nt, Homo sapiens
ugaccaucucuuaggucuaauga

SEQ ID NO: 897353 - RNA, 16 nt, Homo sapiens
ugaccauuucaggggu

SEQ ID NO: 897354 - RNA, 13 nt, Homo sapiens
ugacccaaagacc

SEQ ID NO: 897355 - RNA, 14 nt, Homo sapiens
ugaccccaaagagc

SEQ ID NO: 897356 - RNA, 20 nt, Homo sapiens
ugaccccaucaccuacucac

SEQ ID NO: 897357 - RNA, 22 nt, Homo sapiens
ugaccccuguccccacacugac

SEQ ID NO: 897358 - RNA, 19 nt, Homo sapiens
ugacccuccuguccagcag

SEQ ID NO: 897359 - RNA, 22 nt, Homo sapiens
ugauguuguuacugauucuccu

SEQ ID NO: 897360 - RNA, 15 nt, Homo sapiens
ugauuacuaugcucu

SEQ ID NO: 897361 - RNA, 23 nt, Homo sapiens
ugauucaaaagaugccauucaua

SEQ ID NO: 897362 - RNA, 19 nt, Homo sapiens
ugauucacaacuaggaccu

SEQ ID NO: 897363 - RNA, 21 nt, Homo sapiens
ugauucacaacuaggaccuca

SEQ ID NO: 897364 - RNA, 14 nt, Homo sapiens
ugauucgaaugaca

SEQ ID NO: 897365 - RNA, 22 nt, Homo sapiens
ugauucuccugccucagccucc

SEQ ID NO: 897366 - RNA, 17 nt, Homo sapiens
ugauucugaaucugaaa

SEQ ID NO: 897367 - RNA, 23 nt, Homo sapiens
ugauucuuucccuuccuuuccuc

SEQ ID NO: 897368 - RNA, 19 nt, Homo sapiens
ugauugaaaauaguaaaug

SEQ ID NO: 897369 - RNA, 22 nt, Homo sapiens
ugauuuagggaagcagggacac

SEQ ID NO: 897370 - RNA, 14 nt, Homo sapiens
ugauuucucugaac

SEQ ID NO: 897371 - RNA, 18 nt, Homo sapiens
ugauuugacccacucaca

SEQ ID NO: 897372 - RNA, 18 nt, Homo sapiens
ugauuuuauacauaguca

SEQ ID NO: 897373 - RNA, 17 nt, Homo sapiens
ugauuuugucacugucu

SEQ ID NO: 897374 - RNA, 15 nt, Homo sapiens
ugcaaaaguggaauc

SEQ ID NO: 897375 - RNA, 13 nt, Homo sapiens
ugcaaagcacuga

SEQ ID NO: 897376 - RNA, 16 nt, Homo sapiens
ugcaaagugcccucau

SEQ ID NO: 897377 - RNA, 14 nt, Homo sapiens
ugcaacaacaugua

SEQ ID NO: 897378 - RNA, 17 nt, Homo sapiens
ugcaaccuuugccuccc

SEQ ID NO: 897379 - RNA, 19 nt, Homo sapiens
ugcaagacaaaguugaaug

SEQ ID NO: 897380 - RNA, 15 nt, Homo sapiens
ugcaagagacucugg

SEQ ID NO: 897381 - RNA, 19 nt, Homo sapiens
ugcaagauuucacaucagc

SEQ ID NO: 897382 - RNA, 23 nt, Homo sapiens
ugcaagcuucuuuuaguuguauc

SEQ ID NO: 897383 - RNA, 20 nt, Homo sapiens
ugcaaggauucagcauuauu

SEQ ID NO: 897384 - RNA, 19 nt, Homo sapiens
ugcaaggcuaagaaguacu

SEQ ID NO: 897385 - RNA, 17 nt, Homo sapiens
ugcaaguggaugcauuc

SEQ ID NO: 897386 - RNA, 14 nt, Homo sapiens
ugcaauauguauua

SEQ ID NO: 897387 - RNA, 14 nt, Homo sapiens
ugcaauauuuacau

SEQ ID NO: 897388 - RNA, 16 nt, Homo sapiens
ugcaauauuuacauuu

SEQ ID NO: 897389 - RNA, 18 nt, Homo sapiens
ugcaaucucuugucucac

SEQ ID NO: 897390 - RNA, 14 nt, Homo sapiens
ugcacacacacaga

SEQ ID NO: 897391 - RNA, 17 nt, Homo sapiens
ugcacacacacagagau

SEQ ID NO: 897392 - RNA, 21 nt, Homo sapiens
ugcacacacacagagauaugc

SEQ ID NO: 897393 - RNA, 22 nt, Homo sapiens
ugcacacacacagagauaugca

SEQ ID NO: 897394 - RNA, 21 nt, Homo sapiens
ugcacacacacggaugcacac

SEQ ID NO: 897395 - RNA, 13 nt, Homo sapiens
ugcacacacagau

SEQ ID NO: 897396 - RNA, 16 nt, Homo sapiens
ugcacacacagaugca

SEQ ID NO: 897397 - RNA, 11 nt, Homo sapiens
ugcacacuugu

SEQ ID NO: 897398 - RNA, 13 nt, Homo sapiens
ugcacagcaacug

SEQ ID NO: 897399 - RNA, 14 nt, Homo sapiens
ugcacagcugcuug

SEQ ID NO: 897400 - RNA, 17 nt, Homo sapiens
ugcacaugcacgugugu

SEQ ID NO: 897401 - RNA, 20 nt, Homo sapiens
ugcacaugucuuguacaugu

SEQ ID NO: 897402 - RNA, 23 nt, Homo sapiens
ugcacaugucuuguacaugugua

SEQ ID NO: 897403 - RNA, 18 nt, Homo sapiens
ugcaccccuccccauuca

SEQ ID NO: 897404 - RNA, 18 nt, Homo sapiens
ugcaccuguacucaggag

SEQ ID NO: 897405 - RNA, 21 nt, Homo sapiens
ugcaccuugugucuguacacg

SEQ ID NO: 897406 - RNA, 21 nt, Homo sapiens
ugcacuaggucaaaacauuca

SEQ ID NO: 897407 - RNA, 14 nt, Homo sapiens
ugcacuccagccug

SEQ ID NO: 897408 - RNA, 14 nt, Homo sapiens
ugcacugacaagau

SEQ ID NO: 897409 - RNA, 13 nt, Homo sapiens
ugcacugacaugu

SEQ ID NO: 897410 - RNA, 15 nt, Homo sapiens
ugcacugagggccac

SEQ ID NO: 897411 - RNA, 21 nt, Homo sapiens
ugcacuguauauagaagucua

SEQ ID NO: 897412 - RNA, 20 nt, Homo sapiens
ugcagacucuacagaggcca

SEQ ID NO: 897413 - RNA, 20 nt, Homo sapiens
ugcagagaaagaaagggaaa

SEQ ID NO: 897414 - RNA, 16 nt, Homo sapiens
ugcagaguaggcagcu

SEQ ID NO: 897415 - RNA, 17 nt, Homo sapiens
ugcagauagccagacac

SEQ ID NO: 897416 - RNA, 23 nt, Homo sapiens
ugcagaugagcagucacacuguu

SEQ ID NO: 897417 - RNA, 15 nt, Homo sapiens
ugcagaugaggacua

SEQ ID NO: 897418 - RNA, 16 nt, Homo sapiens
ugcagccaaacagagc

SEQ ID NO: 897419 - RNA, 21 nt, Homo sapiens
ugcagccccagcugacaccug

SEQ ID NO: 897420 - RNA, 21 nt, Homo sapiens
ugcagccccggcugacaccug

SEQ ID NO: 897421 - RNA, 22 nt, Homo sapiens
ugcagcuuccugucaacacuuc

SEQ ID NO: 897422 - RNA, 23 nt, Homo sapiens
ugcaggugucuauccaccugggg

SEQ ID NO: 897423 - RNA, 20 nt, Homo sapiens
ugcaguauggccaugggcug

SEQ ID NO: 897424 - RNA, 22 nt, Homo sapiens
ugcagucccagcuacucaggag

SEQ ID NO: 897425 - RNA, 20 nt, Homo sapiens
ugcaguccgcagucuggccu

SEQ ID NO: 897426 - RNA, 21 nt, Homo sapiens
ugcagucucagagacuauuua

SEQ ID NO: 897427 - RNA, 16 nt, Homo sapiens
ugcagucuuggcucac

SEQ ID NO: 897428 - RNA, 14 nt, Homo sapiens
ugcagugggccauc

SEQ ID NO: 897429 - RNA, 15 nt, Homo sapiens
ugcaguuaauacuua

SEQ ID NO: 897430 - RNA, 14 nt, Homo sapiens
ugcaguuccaucag

SEQ ID NO: 897431 - RNA, 20 nt, Homo sapiens
ugcaguuccugaguaccuuc

SEQ ID NO: 897432 - RNA, 15 nt, Homo sapiens
ugcaguuuccaaucc

SEQ ID NO: 897433 - RNA, 22 nt, Homo sapiens
ugcaguuuccaaucccauagau

SEQ ID NO: 897434 - RNA, 22 nt, Homo sapiens
ugcauaaucauaugguugacag

SEQ ID NO: 897435 - RNA, 16 nt, Homo sapiens
ugcauacuacucucaa

SEQ ID NO: 897436 - RNA, 14 nt, Homo sapiens
ugcauaggaaguau

SEQ ID NO: 897437 - RNA, 21 nt, Homo sapiens
ugcauaguucccauguuaaau

SEQ ID NO: 897438 - RNA, 14 nt, Homo sapiens
gcccgaggaccggg

SEQ ID NO: 897439 - RNA, 18 nt, Homo sapiens
gcccgggcacuggugggu

SEQ ID NO: 897440 - RNA, 22 nt, Homo sapiens
gcccucaauaagccagcaaacc

SEQ ID NO: 897441 - RNA, 16 nt, Homo sapiens
gcccucauccauuuau

SEQ ID NO: 897442 - RNA, 17 nt, Homo sapiens
gcccuccaccuaccugc

SEQ ID NO: 897443 - RNA, 19 nt, Homo sapiens
gcccuccccaucccaugua

SEQ ID NO: 897444 - RNA, 11 nt, Homo sapiens
gcccucuggga

SEQ ID NO: 897445 - RNA, 13 nt, Homo sapiens
gcccugaacaaaa

SEQ ID NO: 897446 - RNA, 18 nt, Homo sapiens
gcccugcgaaguggcucu

SEQ ID NO: 897447 - RNA, 20 nt, Homo sapiens
gcccuggcuggaguucagug

SEQ ID NO: 897448 - RNA, 18 nt, Homo sapiens
gcccuguuuauauuggua

SEQ ID NO: 897449 - RNA, 18 nt, Homo sapiens
gcccuuccucuccacugc

SEQ ID NO: 897450 - RNA, 14 nt, Homo sapiens
gcccuucgcugcca

SEQ ID NO: 897451 - RNA, 22 nt, Homo sapiens
gcccuucgcugccaggacaccu

SEQ ID NO: 897452 - RNA, 19 nt, Homo sapiens
gcccuugcccugaccuccc

SEQ ID NO: 897453 - RNA, 21 nt, Homo sapiens
gccgagaucacgccacugcac

SEQ ID NO: 897454 - RNA, 21 nt, Homo sapiens
gccgagauugcaccacugcac

SEQ ID NO: 897455 - RNA, 23 nt, Homo sapiens
gccgcaaaucaaccccagacuca

SEQ ID NO: 897456 - RNA, 16 nt, Homo sapiens
gccgcagggacgggga

SEQ ID NO: 897457 - RNA, 11 nt, Homo sapiens
gccggaccaag

SEQ ID NO: 897458 - RNA, 13 nt, Homo sapiens
gccggacguggug

SEQ ID NO: 897459 - RNA, 13 nt, Homo sapiens
gccguacugucua

SEQ ID NO: 897460 - RNA, 18 nt, Homo sapiens
gccguccauggcaccagc

SEQ ID NO: 897461 - RNA, 19 nt, Homo sapiens
gccgugccuucagcucuac

SEQ ID NO: 897462 - RNA, 22 nt, Homo sapiens
gccuaaauaaaaaguauacuuu

SEQ ID NO: 897463 - RNA, 13 nt, Homo sapiens
gccuaacacuggg

SEQ ID NO: 897464 - RNA, 19 nt, Homo sapiens
gccuaacaugauuauuuga

SEQ ID NO: 897465 - RNA, 17 nt, Homo sapiens
gccuaauacaacaugua

SEQ ID NO: 897466 - RNA, 23 nt, Homo sapiens
gccuacagauaauuuauuuugua

SEQ ID NO: 897467 - RNA, 19 nt, Homo sapiens
gccuacugccucuccagca

SEQ ID NO: 897468 - RNA, 23 nt, Homo sapiens
gccuagauccacacacagaggaa

SEQ ID NO: 897469 - RNA, 12 nt, Homo sapiens
gccuaggguaca

SEQ ID NO: 897470 - RNA, 14 nt, Homo sapiens
gccuaggguccugu

SEQ ID NO: 897471 - RNA, 20 nt, Homo sapiens
gccuauaaucccagcacuuu

SEQ ID NO: 897472 - RNA, 16 nt, Homo sapiens
gccuaugcacauaugg

SEQ ID NO: 897473 - RNA, 12 nt, Homo sapiens
gcucacuguucu

SEQ ID NO: 897474 - RNA, 13 nt, Homo sapiens
gcucacuguucua

SEQ ID NO: 897475 - RNA, 21 nt, Homo sapiens
gcucagcccugacuggugcua

SEQ ID NO: 897476 - RNA, 14 nt, Homo sapiens
gcucaguagccuuu

SEQ ID NO: 897477 - RNA, 15 nt, Homo sapiens
gcucagucucaggag

SEQ ID NO: 897478 - RNA, 13 nt, Homo sapiens
gcuccacugucac

SEQ ID NO: 897479 - RNA, 13 nt, Homo sapiens
gcuccagcaucca

SEQ ID NO: 897480 - RNA, 23 nt, Homo sapiens
gcuccagggcagccuccaccuug

SEQ ID NO: 897481 - RNA, 16 nt, Homo sapiens
gcuccaucuccagugg

SEQ ID NO: 897482 - RNA, 21 nt, Homo sapiens
gcucccacuauggugggagac

SEQ ID NO: 897483 - RNA, 17 nt, Homo sapiens
gcucccccugcuucuca

SEQ ID NO: 897484 - RNA, 17 nt, Homo sapiens
gcucccuaggagaccaa

SEQ ID NO: 897485 - RNA, 17 nt, Homo sapiens
gcuccugccacugaccu

SEQ ID NO: 897486 - RNA, 16 nt, Homo sapiens
gcuccugggcagcuug

SEQ ID NO: 897487 - RNA, 15 nt, Homo sapiens
gcuccugucugccag

SEQ ID NO: 897488 - RNA, 17 nt, Homo sapiens
gcucgcccacaaacuga

SEQ ID NO: 897489 - RNA, 13 nt, Homo sapiens
gcucuaguucaaa

SEQ ID NO: 897490 - RNA, 16 nt, Homo sapiens
gcucuauuaagauuuc

SEQ ID NO: 897491 - RNA, 19 nt, Homo sapiens
gcucucagaagguauuccu

SEQ ID NO: 897492 - RNA, 20 nt, Homo sapiens
gcucugagaggcccuggauc

SEQ ID NO: 897493 - RNA, 13 nt, Homo sapiens
gcucugagugcua

SEQ ID NO: 897494 - RNA, 14 nt, Homo sapiens
gcucugcaggcacc

SEQ ID NO: 897495 - RNA, 14 nt, Homo sapiens
gcucugcaugugug

SEQ ID NO: 897496 - RNA, 22 nt, Homo sapiens
gcucugcccucccuggccucac

SEQ ID NO: 897497 - RNA, 18 nt, Homo sapiens
gcucuggaaaaugugacc

SEQ ID NO: 897498 - RNA, 22 nt, Homo sapiens
gcucuggcaccacuaggguccu

SEQ ID NO: 897499 - RNA, 17 nt, Homo sapiens
gcucugggauagcugac

SEQ ID NO: 897500 - RNA, 19 nt, Homo sapiens
gcucuuaggugcuucuuca

SEQ ID NO: 897501 - RNA, 13 nt, Homo sapiens
gcucuucaaagac

SEQ ID NO: 897502 - RNA, 15 nt, Homo sapiens
gcucuucacucagcc

SEQ ID NO: 897503 - RNA, 18 nt, Homo sapiens
gcucuuccuuacucccag

SEQ ID NO: 897504 - RNA, 14 nt, Homo sapiens
gcucuucuaaggaa

SEQ ID NO: 897505 - RNA, 21 nt, Homo sapiens
gcucuucuacguauaaauaug

SEQ ID NO: 897506 - RNA, 14 nt, Homo sapiens
gcucuuuagcauug

SEQ ID NO: 897507 - RNA, 23 nt, Homo sapiens
gcucuuucagagaggucucaggu

SEQ ID NO: 897508 - RNA, 20 nt, Homo sapiens
gcugaaaaucacuauaacca

SEQ ID NO: 897509 - RNA, 12 nt, Homo sapiens
gcugaacacugg

SEQ ID NO: 897510 - RNA, 20 nt, Homo sapiens
gcugaagacaaaccacugua

SEQ ID NO: 897511 - RNA, 20 nt, Homo sapiens
gcugaagugaaaaaaaaaga

SEQ ID NO: 897512 - RNA, 19 nt, Homo sapiens
gcugacaaagaugaccugc

SEQ ID NO: 897513 - RNA, 17 nt, Homo sapiens
gcugagaagaagcugag

SEQ ID NO: 897514 - RNA, 20 nt, Homo sapiens
gcugagauugcgccacugca

SEQ ID NO: 897515 - RNA, 23 nt, Homo sapiens
gcugaggcggguggaucaccuga

SEQ ID NO: 897516 - RNA, 17 nt, Homo sapiens
gcugaggugcccaggag

SEQ ID NO: 897517 - RNA, 16 nt, Homo sapiens
gcugagucaccuccuc

SEQ ID NO: 897518 - RNA, 22 nt, Homo sapiens
gcugagucccuccaugcaaaag

SEQ ID NO: 897519 - RNA, 14 nt, Homo sapiens
gcugagucugcaga

SEQ ID NO: 897520 - RNA, 16 nt, Homo sapiens
gcugagucugcagaug

SEQ ID NO: 897521 - RNA, 16 nt, Homo sapiens
gcugagugcaccacuu

SEQ ID NO: 897522 - RNA, 14 nt, Homo sapiens
gcugaucaguuuuu

SEQ ID NO: 897523 - RNA, 21 nt, Homo sapiens
gcugaucaguuuuuucaccug

SEQ ID NO: 897524 - RNA, 21 nt, Homo sapiens
gcugaugaacucuuaaucaaa

SEQ ID NO: 897525 - RNA, 16 nt, Homo sapiens
gcugauucaagaaaca

SEQ ID NO: 897526 - RNA, 20 nt, Homo sapiens
gcugauuuccaggccccuga

SEQ ID NO: 897527 - RNA, 13 nt, Homo sapiens
gcugcacauuccu

SEQ ID NO: 897528 - RNA, 14 nt, Homo sapiens
gcugcagugaccca

SEQ ID NO: 897529 - RNA, 16 nt, Homo sapiens
gcugcauuugugucau

SEQ ID NO: 897530 - RNA, 20 nt, Homo sapiens
gcugccaugccacugccagg

SEQ ID NO: 897531 - RNA, 19 nt, Homo sapiens
gcugccccuggugcacugg

SEQ ID NO: 897532 - RNA, 12 nt, Homo sapiens
gcugccuaauaa

SEQ ID NO: 897533 - RNA, 15 nt, Homo sapiens
gcugcgagcauuucc

SEQ ID NO: 897534 - RNA, 19 nt, Homo sapiens
gcugcggccuaggggucca

SEQ ID NO: 897535 - RNA, 22 nt, Homo sapiens
gcugcgucuccuccgcacaccu

SEQ ID NO: 897536 - RNA, 13 nt, Homo sapiens
gcugcuagcacuu

SEQ ID NO: 897537 - RNA, 14 nt, Homo sapiens
gcugcucuauugua

SEQ ID NO: 897538 - RNA, 17 nt, Homo sapiens
gcugcucucaugccugc

SEQ ID NO: 897539 - RNA, 13 nt, Homo sapiens
gcugcucugccau

SEQ ID NO: 897540 - RNA, 11 nt, Homo sapiens
gcugcugcuac

SEQ ID NO: 897541 - RNA, 16 nt, Homo sapiens
gcugcugugugccuuc

SEQ ID NO: 897542 - RNA, 20 nt, Homo sapiens
gcuggaaaagucacacagac

SEQ ID NO: 897543 - RNA, 18 nt, Homo sapiens
gcuggaaauaaaccugga

SEQ ID NO: 897544 - RNA, 21 nt, Homo sapiens
gcuggaaauaaaccuggagau

SEQ ID NO: 897545 - RNA, 16 nt, Homo sapiens
gcuggagcccagcauu

SEQ ID NO: 897546 - RNA, 19 nt, Homo sapiens
gcuggaguacagugacacg

SEQ ID NO: 897547 - RNA, 14 nt, Homo sapiens
gcuggagugcagua

SEQ ID NO: 897548 - RNA, 20 nt, Homo sapiens
gcuggagugcaguagcacga

SEQ ID NO: 897549 - RNA, 19 nt, Homo sapiens
gcuggcccgucauguuccu

SEQ ID NO: 897550 - RNA, 13 nt, Homo sapiens
gcuggcugcagug

SEQ ID NO: 897551 - RNA, 15 nt, Homo sapiens
gcugggaacauguac

SEQ ID NO: 897552 - RNA, 21 nt, Homo sapiens
gcugggaacauguaccacuga

SEQ ID NO: 897553 - RNA, 15 nt, Homo sapiens
gcugggcaccacagg

SEQ ID NO: 897554 - RNA, 22 nt, Homo sapiens
gcugggccaguuccuccaagag

SEQ ID NO: 897555 - RNA, 20 nt, Homo sapiens
ugcugcccugcucuggggau

SEQ ID NO: 897556 - RNA, 11 nt, Homo sapiens
ugcugcuccua

SEQ ID NO: 897557 - RNA, 23 nt, Homo sapiens
ugcugcugagugcaccacuucaa

SEQ ID NO: 897558 - RNA, 14 nt, Homo sapiens
ugcuggagcuggcu

SEQ ID NO: 897559 - RNA, 18 nt, Homo sapiens
ugcuggccuggaucuccc

SEQ ID NO: 897560 - RNA, 20 nt, Homo sapiens
ugcugggcccuggccuggau

SEQ ID NO: 897561 - RNA, 23 nt, Homo sapiens
ugcuguacuuuauuuguauuugc

SEQ ID NO: 897562 - RNA, 23 nt, Homo sapiens
ugcugugcccucccauagcacug

SEQ ID NO: 897563 - RNA, 20 nt, Homo sapiens
ugcugugcuagugccugaga

SEQ ID NO: 897564 - RNA, 14 nt, Homo sapiens
ugcugugugccuuc

SEQ ID NO: 897565 - RNA, 18 nt, Homo sapiens
ugcuuaaacuugacccag

SEQ ID NO: 897566 - RNA, 21 nt, Homo sapiens
ugcuuaaguucuuaaguauug

SEQ ID NO: 897567 - RNA, 13 nt, Homo sapiens
ugcuuacaaaguc

SEQ ID NO: 897568 - RNA, 19 nt, Homo sapiens
ugcuuacccuucaccuuug

SEQ ID NO: 897569 - RNA, 13 nt, Homo sapiens
ugcuuaccuguga

SEQ ID NO: 897570 - RNA, 15 nt, Homo sapiens
ugcuuaccugugaga

SEQ ID NO: 897571 - RNA, 15 nt, Homo sapiens
ugcuuaguaucucau

SEQ ID NO: 897572 - RNA, 16 nt, Homo sapiens
ugcuuaugacaucacu

SEQ ID NO: 897573 - RNA, 22 nt, Homo sapiens
ugcuucaaguguugcucuugga

SEQ ID NO: 897574 - RNA, 13 nt, Homo sapiens
ugcuucagccucc

SEQ ID NO: 897575 - RNA, 17 nt, Homo sapiens
ugcuucaggauaccaua

SEQ ID NO: 897576 - RNA, 18 nt, Homo sapiens
ugcuucaggauaccauau

SEQ ID NO: 897577 - RNA, 14 nt, Homo sapiens
ugcuucaugcucag

SEQ ID NO: 897578 - RNA, 17 nt, Homo sapiens
ugcuuccacuucuaugc

SEQ ID NO: 897579 - RNA, 19 nt, Homo sapiens
ugcuuccacuucuaugcaa

SEQ ID NO: 897580 - RNA, 13 nt, Homo sapiens
ugcuucuaguauu

SEQ ID NO: 897581 - RNA, 13 nt, Homo sapiens
ugcuucugcuaaa

SEQ ID NO: 897582 - RNA, 23 nt, Homo sapiens
ugcuugaaaugagaaacuuugau

SEQ ID NO: 897583 - RNA, 13 nt, Homo sapiens
ugcuugcacuuug

SEQ ID NO: 897584 - RNA, 18 nt, Homo sapiens
ugcuugccaccaccagau

SEQ ID NO: 897585 - RNA, 14 nt, Homo sapiens
ugcuuggguguaac

SEQ ID NO: 897586 - RNA, 20 nt, Homo sapiens
ugcuuuccagccugggcaac

SEQ ID NO: 897587 - RNA, 13 nt, Homo sapiens
ugcuuugacucac

SEQ ID NO: 897588 - RNA, 20 nt, Homo sapiens
gucacauaaugaaugcuauu

SEQ ID NO: 897589 - RNA, 18 nt, Homo sapiens
gucacauuguaacugaac

SEQ ID NO: 897590 - RNA, 11 nt, Homo sapiens
gucaccaaaau

SEQ ID NO: 897591 - RNA, 17 nt, Homo sapiens
gucaccaauguacccac

SEQ ID NO: 897592 - RNA, 19 nt, Homo sapiens
gucaccagcaacaucucga

SEQ ID NO: 897593 - RNA, 22 nt, Homo sapiens
gucacccgagcuagagugcagu

SEQ ID NO: 897594 - RNA, 16 nt, Homo sapiens
gucacccuucugggca

SEQ ID NO: 897595 - RNA, 16 nt, Homo sapiens
gucaccuaacucugaa

SEQ ID NO: 897596 - RNA, 18 nt, Homo sapiens
gucaccucagcugauauu

SEQ ID NO: 897597 - RNA, 11 nt, Homo sapiens
gucaccuugcu

SEQ ID NO: 897598 - RNA, 12 nt, Homo sapiens
gucacugucuca

SEQ ID NO: 897599 - RNA, 12 nt, Homo sapiens
gucacugucuuc

SEQ ID NO: 897600 - RNA, 22 nt, Homo sapiens
gucacuuuuuaaaccacuguau

SEQ ID NO: 897601 - RNA, 19 nt, Homo sapiens
gucagaaacucgaugaaug

SEQ ID NO: 897602 - RNA, 23 nt, Homo sapiens
gucagaauuucuuugucauucaa

SEQ ID NO: 897603 - RNA, 19 nt, Homo sapiens
gucagaccaguacugggaa

SEQ ID NO: 897604 - RNA, 22 nt, Homo sapiens
gucagauuugcuguucacccac

SEQ ID NO: 897605 - RNA, 21 nt, Homo sapiens
gucaggaagggaaagccagaa

SEQ ID NO: 897606 - RNA, 13 nt, Homo sapiens
gucaggacuguga

SEQ ID NO: 897607 - RNA, 14 nt, Homo sapiens
gucaggacugugac

SEQ ID NO: 897608 - RNA, 23 nt, Homo sapiens
gucaguugaggaauaugacuguu

SEQ ID NO: 897609 - RNA, 21 nt, Homo sapiens
gucaguuucauggaggggaaa

SEQ ID NO: 897610 - RNA, 14 nt, Homo sapiens
gucauaaacagcau

SEQ ID NO: 897611 - RNA, 20 nt, Homo sapiens
gucaucaaauauuaccaaaa

SEQ ID NO: 897612 - RNA, 19 nt, Homo sapiens
gucaugcacucaggcagac

SEQ ID NO: 897613 - RNA, 15 nt, Homo sapiens
gucauucuacacuga

SEQ ID NO: 897614 - RNA, 17 nt, Homo sapiens
gucauucuacacugagg

SEQ ID NO: 897615 - RNA, 15 nt, Homo sapiens
gucauuuucuauuca

SEQ ID NO: 897616 - RNA, 16 nt, Homo sapiens
gucauuuucuauucac

SEQ ID NO: 897617 - RNA, 20 nt, Homo sapiens
guccaacaacuccaggaaaa

SEQ ID NO: 897618 - RNA, 19 nt, Homo sapiens
guccacccaggcugcacug

SEQ ID NO: 897619 - RNA, 18 nt, Homo sapiens
guccacucucggggcccu

SEQ ID NO: 897620 - RNA, 18 nt, Homo sapiens
guccagaagaauauucag

SEQ ID NO: 897621 - RNA, 19 nt, Homo sapiens
guccagaauaagugcuguu

SEQ ID NO: 897622 - RNA, 21 nt, Homo sapiens
guccagacagagcccugugag

SEQ ID NO: 897623 - RNA, 21 nt, Homo sapiens
guccagacccugaagauuuca

SEQ ID NO: 897624 - RNA, 13 nt, Homo sapiens
guccagcacagaa

SEQ ID NO: 897625 - RNA, 17 nt, Homo sapiens
guccaggguugaucaca

SEQ ID NO: 897626 - RNA, 12 nt, Homo sapiens
guccagugcaac

SEQ ID NO: 897627 - RNA, 13 nt, Homo sapiens
guccagugcaacc

SEQ ID NO: 897628 - RNA, 19 nt, Homo sapiens
gucccaaacagagggccac

SEQ ID NO: 897629 - RNA, 24 nt, Homo sapiens
gucccaaccugaucccacgaggga

SEQ ID NO: 897630 - RNA, 16 nt, Homo sapiens
gucccaagcccaggga

SEQ ID NO: 897631 - RNA, 19 nt, Homo sapiens
gucccacucccacagagga

SEQ ID NO: 897632 - RNA, 20 nt, Homo sapiens
gucccagagguuaucugccu

SEQ ID NO: 897633 - RNA, 16 nt, Homo sapiens
gucccaucugcuccuc

SEQ ID NO: 897634 - RNA, 20 nt, Homo sapiens
guccccaaauugcuaccucu

SEQ ID NO: 897635 - RNA, 13 nt, Homo sapiens
guccccagggaca

SEQ ID NO: 897636 - RNA, 17 nt, Homo sapiens
gucccccacgugugaag

SEQ ID NO: 897637 - RNA, 14 nt, Homo sapiens
gucccccccagugc

SEQ ID NO: 897638 - RNA, 18 nt, Homo sapiens
guccccucacucugucag

SEQ ID NO: 897639 - RNA, 16 nt, Homo sapiens
guccccuccacuguca

SEQ ID NO: 897640 - RNA, 16 nt, Homo sapiens
guccccucuugaccca

SEQ ID NO: 897641 - RNA, 14 nt, Homo sapiens
gucccucagugaua

SEQ ID NO: 897642 - RNA, 15 nt, Homo sapiens
gucccucagugauac

SEQ ID NO: 897643 - RNA, 16 nt, Homo sapiens
gucccucccaucucua

SEQ ID NO: 897644 - RNA, 23 nt, Homo sapiens
gucccuucuucccuaaucagcuc

SEQ ID NO: 897645 - RNA, 21 nt, Homo sapiens
gucccuugcuguuuucaucuc

SEQ ID NO: 897646 - RNA, 21 nt, Homo sapiens
guccuaacccccuuacugugc

SEQ ID NO: 897647 - RNA, 18 nt, Homo sapiens
guccuaaggacacacuaa

SEQ ID NO: 897648 - RNA, 11 nt, Homo sapiens
guccucaaaac

SEQ ID NO: 897649 - RNA, 20 nt, Homo sapiens
guccucaguguccucagggg

SEQ ID NO: 897650 - RNA, 22 nt, Homo sapiens
guccuccauuucaacuccagaa

SEQ ID NO: 897651 - RNA, 20 nt, Homo sapiens
guccucccacccuaccacag

SEQ ID NO: 897652 - RNA, 23 nt, Homo sapiens
guccuccuuguucuacucauaua

SEQ ID NO: 897653 - RNA, 14 nt, Homo sapiens
guccugagcacugc

SEQ ID NO: 897654 - RNA, 22 nt, Homo sapiens
guccugaguguucaugcuuugu

SEQ ID NO: 897655 - RNA, 16 nt, Homo sapiens
guccugcagcuucggg

SEQ ID NO: 897656 - RNA, 21 nt, Homo sapiens
guccugcugugugaauuccca

SEQ ID NO: 897657 - RNA, 23 nt, Homo sapiens
guccuguuaacgucaucucaggg

SEQ ID NO: 897658 - RNA, 22 nt, Homo sapiens
guccuucaaguuagcucaggag

SEQ ID NO: 897659 - RNA, 13 nt, Homo sapiens
guccuucauucuu

SEQ ID NO: 897660 - RNA, 22 nt, Homo sapiens
guccuuccugugcccugcaaau

SEQ ID NO: 897661 - RNA, 16 nt, Homo sapiens
guccuuuuguaccaug

SEQ ID NO: 897662 - RNA, 17 nt, Homo sapiens
gucgaauguuagauucc

SEQ ID NO: 897663 - RNA, 12 nt, Homo sapiens
gucgcaucucag

SEQ ID NO: 897664 - RNA, 17 nt, Homo sapiens
gucgucaaguugcagau

SEQ ID NO: 897665 - RNA, 16 nt, Homo sapiens
gucuaaagagcuuuag

SEQ ID NO: 897666 - RNA, 22 nt, Homo sapiens
gucuaaauaaaugaaguauuuc

SEQ ID NO: 897667 - RNA, 14 nt, Homo sapiens
gucuaacaguuaau

SEQ ID NO: 897668 - RNA, 13 nt, Homo sapiens
gucuagacuuucu

SEQ ID NO: 897669 - RNA, 14 nt, Homo sapiens
gucuagccacugau

SEQ ID NO: 897670 - RNA, 18 nt, Homo sapiens
gucuaugggacucaaugc

SEQ ID NO: 897671 - RNA, 22 nt, Homo sapiens
gucuauguaggccccuggucug

SEQ ID NO: 897672 - RNA, 22 nt, Homo sapiens
gucucaacuacucagcucuccu

SEQ ID NO: 897673 - RNA, 18 nt, Homo sapiens
uucacaacaggcauucca

SEQ ID NO: 897674 - RNA, 16 nt, Homo sapiens
uucacacugaccaaga

SEQ ID NO: 897675 - RNA, 16 nt, Homo sapiens
uucacagccaggagau

SEQ ID NO: 897676 - RNA, 14 nt, Homo sapiens
uucacagugaccau

SEQ ID NO: 897677 - RNA, 18 nt, Homo sapiens
uucacauaaaaccucauu

SEQ ID NO: 897678 - RNA, 18 nt, Homo sapiens
uucacauaggcaauaucu

SEQ ID NO: 897679 - RNA, 14 nt, Homo sapiens
uucacaucacugau

SEQ ID NO: 897680 - RNA, 19 nt, Homo sapiens
uucaccaagaaguggagac

SEQ ID NO: 897681 - RNA, 12 nt, Homo sapiens
uucaccaguuuc

SEQ ID NO: 897682 - RNA, 20 nt, Homo sapiens
uucaccuuccagugucucgg

SEQ ID NO: 897683 - RNA, 14 nt, Homo sapiens
uucacuaaugacga

SEQ ID NO: 897684 - RNA, 12 nt, Homo sapiens
uucacuacauua

SEQ ID NO: 897685 - RNA, 15 nt, Homo sapiens
uucacuagacugugc

SEQ ID NO: 897686 - RNA, 18 nt, Homo sapiens
uucacuauaaaugguguu

SEQ ID NO: 897687 - RNA, 14 nt, Homo sapiens
uucacuguugaaaa

SEQ ID NO: 897688 - RNA, 14 nt, Homo sapiens
uucacuuauugacu

SEQ ID NO: 897689 - RNA, 12 nt, Homo sapiens
uucacuuuacaa

SEQ ID NO: 897690 - RNA, 13 nt, Homo sapiens
uucacuuuacaaa

SEQ ID NO: 897691 - RNA, 20 nt, Homo sapiens
uucagaccagugaaagagua

SEQ ID NO: 897692 - RNA, 19 nt, Homo sapiens
uucagauauauuuuucaca

SEQ ID NO: 897693 - RNA, 22 nt, Homo sapiens
uucagauggaggugccauauca

SEQ ID NO: 897694 - RNA, 22 nt, Homo sapiens
uucagcaguaacaggaaaccac

SEQ ID NO: 897695 - RNA, 19 nt, Homo sapiens
uucagccccuagugcuauu

SEQ ID NO: 897696 - RNA, 15 nt, Homo sapiens
uucagccugaggcug

SEQ ID NO: 897697 - RNA, 13 nt, Homo sapiens
uucagcucuacag

SEQ ID NO: 897698 - RNA, 18 nt, Homo sapiens
uucagcugugaacaugga

SEQ ID NO: 897699 - RNA, 16 nt, Homo sapiens
uucagcuucagacuuu

SEQ ID NO: 897700 - RNA, 22 nt, Homo sapiens
uucaggacauggggcauagaaa

SEQ ID NO: 897701 - RNA, 18 nt, Homo sapiens
uucagguacuaaauaccu

SEQ ID NO: 897702 - RNA, 18 nt, Homo sapiens
uucagugcuguacuugau

SEQ ID NO: 897703 - RNA, 17 nt, Homo sapiens
gucuugcaauggcagcc

SEQ ID NO: 897704 - RNA, 18 nt, Homo sapiens
gucuuggacacuguacaa

SEQ ID NO: 897705 - RNA, 15 nt, Homo sapiens
gucuuggccugccuc

SEQ ID NO: 897706 - RNA, 22 nt, Homo sapiens
gucuuuaacaucuugaacuggu

SEQ ID NO: 897707 - RNA, 14 nt, Homo sapiens
gucuuuaaucccag

SEQ ID NO: 897708 - RNA, 23 nt, Homo sapiens
gucuuucugacaucagcagagaa

SEQ ID NO: 897709 - RNA, 13 nt, Homo sapiens
gugaaacaaaaaa

SEQ ID NO: 897710 - RNA, 19 nt, Homo sapiens
gugaaagaaaauucuugga

SEQ ID NO: 897711 - RNA, 21 nt, Homo sapiens
gugaaaggaagcuccacuguc

SEQ ID NO: 897712 - RNA, 16 nt, Homo sapiens
gugaacacacucagca

SEQ ID NO: 897713 - RNA, 15 nt, Homo sapiens
gugaacacaucagcu

SEQ ID NO: 897714 - RNA, 13 nt, Homo sapiens
gugaaccaaagag

SEQ ID NO: 897715 - RNA, 15 nt, Homo sapiens
gugaaccaucauuau

SEQ ID NO: 897716 - RNA, 14 nt, Homo sapiens
gugaacuuacacuu

SEQ ID NO: 897717 - RNA, 14 nt, Homo sapiens
gugaaggagccagu

SEQ ID NO: 897718 - RNA, 23 nt, Homo sapiens
gugaauagucugugugcacaaug

SEQ ID NO: 897719 - RNA, 14 nt, Homo sapiens
gugaaucagacccu

SEQ ID NO: 897720 - RNA, 17 nt, Homo sapiens
gugaaugggacuauuca

SEQ ID NO: 897721 - RNA, 19 nt, Homo sapiens
gugacaacacuuguguuau

SEQ ID NO: 897722 - RNA, 12 nt, Homo sapiens
gugacacauaug

SEQ ID NO: 897723 - RNA, 13 nt, Homo sapiens
gugacacauaugc

SEQ ID NO: 897724 - RNA, 13 nt, Homo sapiens
gugacacccaaga

SEQ ID NO: 897725 - RNA, 19 nt, Homo sapiens
gugacauauauauguauau

SEQ ID NO: 897726 - RNA, 14 nt, Homo sapiens
gugaccagggguga

SEQ ID NO: 897727 - RNA, 21 nt, Homo sapiens
gugaccucugccugaagucac

SEQ ID NO: 897728 - RNA, 16 nt, Homo sapiens
gugacucuaccugcaa

SEQ ID NO: 897729 - RNA, 22 nt, Homo sapiens
gugacuuccucgccucucccac

SEQ ID NO: 897730 - RNA, 16 nt, Homo sapiens
gugagaaaaggggcau

SEQ ID NO: 897731 - RNA, 21 nt, Homo sapiens
gugagaagacuggcaggcagc

SEQ ID NO: 897732 - RNA, 13 nt, Homo sapiens
gugagaccaccuc

SEQ ID NO: 897733 - RNA, 19 nt, Homo sapiens
gugagugcuugucauggaa

SEQ ID NO: 897734 - RNA, 15 nt, Homo sapiens
gugaguggcagccau

SEQ ID NO: 897735 - RNA, 13 nt, Homo sapiens
gugauacccaagu

SEQ ID NO: 897736 - RNA, 15 nt, Homo sapiens
gugauauaugccuau

SEQ ID NO: 897737 - RNA, 22 nt, Homo sapiens
gugaucacugagacagccacuu

SEQ ID NO: 897738 - RNA, 22 nt, Homo sapiens
gugaucagaccauaauguuaca

SEQ ID NO: 897739 - RNA, 17 nt, Homo sapiens
gugaucaguaugcuguu

SEQ ID NO: 897740 - RNA, 13 nt, Homo sapiens
gugauccacccac

SEQ ID NO: 897741 - RNA, 20 nt, Homo sapiens
gugaucuaucaauagucaag

SEQ ID NO: 897742 - RNA, 15 nt, Homo sapiens
gugauuuacgcucau

SEQ ID NO: 897743 - RNA, 13 nt, Homo sapiens
gugauuucagaga

SEQ ID NO: 897744 - RNA, 17 nt, Homo sapiens
gugauuuggaagagagg

SEQ ID NO: 897745 - RNA, 19 nt, Homo sapiens
gugcaaaguucccuacuuc

SEQ ID NO: 897746 - RNA, 20 nt, Homo sapiens
gugcaacgcuuuuugggaga

SEQ ID NO: 897747 - RNA, 15 nt, Homo sapiens
gugcaagucuuguca

SEQ ID NO: 897748 - RNA, 17 nt, Homo sapiens
gugcaaguggaugcauu

SEQ ID NO: 897749 - RNA, 23 nt, Homo sapiens
gugcacaugugucugugugguau

SEQ ID NO: 897750 - RNA, 18 nt, Homo sapiens
gugcacguacacacacau

SEQ ID NO: 897751 - RNA, 18 nt, Homo sapiens
gugcagggaaccgugaua

SEQ ID NO: 897752 - RNA, 16 nt, Homo sapiens
gugcagggacaaagag

SEQ ID NO: 897753 - RNA, 12 nt, Homo sapiens
gugcagugauac

SEQ ID NO: 897754 - RNA, 17 nt, Homo sapiens
gugcaguugacagcagg

SEQ ID NO: 897755 - RNA, 18 nt, Homo sapiens
gugcaugugagcacaugc

SEQ ID NO: 897756 - RNA, 22 nt, Homo sapiens
gugcauuuaauuggaguaucua

SEQ ID NO: 897757 - RNA, 16 nt, Homo sapiens
gugcauuuaugagcuc

SEQ ID NO: 897758 - RNA, 17 nt, Homo sapiens
gugccaauauuucugau

SEQ ID NO: 897759 - RNA, 14 nt, Homo sapiens
gugccacucauucc

SEQ ID NO: 897760 - RNA, 18 nt, Homo sapiens
gugccacuugacauuccu

SEQ ID NO: 897761 - RNA, 17 nt, Homo sapiens
gugccagcucaggugac

SEQ ID NO: 897762 - RNA, 17 nt, Homo sapiens
gugccaguuggggcccc

SEQ ID NO: 897763 - RNA, 15 nt, Homo sapiens
gugccgugacagggc

SEQ ID NO: 897764 - RNA, 18 nt, Homo sapiens
gugccugagacacccggu

SEQ ID NO: 897765 - RNA, 22 nt, Homo sapiens
gugccuggaaauuaaacccugc

SEQ ID NO: 897766 - RNA, 20 nt, Homo sapiens
gugccuucucacaucugucc

SEQ ID NO: 897767 - RNA, 15 nt, Homo sapiens
gugcgcacacacaga

SEQ ID NO: 897768 - RNA, 20 nt, Homo sapiens
gugcucgcccacaaacugau

SEQ ID NO: 897769 - RNA, 22 nt, Homo sapiens
gugcucggcuguaaacagcucu

SEQ ID NO: 897770 - RNA, 23 nt, Homo sapiens
gugcugcauggagugagcaguag

SEQ ID NO: 897771 - RNA, 15 nt, Homo sapiens
gugcuggagacacuc

SEQ ID NO: 897772 - RNA, 19 nt, Homo sapiens
gugcugggauuacaggugu

SEQ ID NO: 897773 - RNA, 20 nt, Homo sapiens
gugcugggauuacaggugua

SEQ ID NO: 897774 - RNA, 15 nt, Homo sapiens
gugcugucagcucag

SEQ ID NO: 897775 - RNA, 13 nt, Homo sapiens
guggaacaaaagu

SEQ ID NO: 897776 - RNA, 11 nt, Homo sapiens
guggaaccagu

SEQ ID NO: 897777 - RNA, 16 nt, Homo sapiens
guggaaugcagggaag

SEQ ID NO: 897778 - RNA, 20 nt, Homo sapiens
guggaccacaggcaucuaca

SEQ ID NO: 897779 - RNA, 21 nt, Homo sapiens
guggagaaauuccuugauuca

SEQ ID NO: 897780 - RNA, 20 nt, Homo sapiens
guggagaacugggauuugaa

SEQ ID NO: 897781 - RNA, 17 nt, Homo sapiens
guggagaugcagaggua

SEQ ID NO: 897782 - RNA, 15 nt, Homo sapiens
guggauccacugugc

SEQ ID NO: 897783 - RNA, 23 nt, Homo sapiens
guggauuccugggcaagaaccua

SEQ ID NO: 897784 - RNA, 14 nt, Homo sapiens
guggcaacccucac

SEQ ID NO: 897785 - RNA, 17 nt, Homo sapiens
guggcaacccucacugu

SEQ ID NO: 897786 - RNA, 20 nt, Homo sapiens
guggcaacccucacuguguu

SEQ ID NO: 897787 - RNA, 16 nt, Homo sapiens
guggcaccgagaccaa

SEQ ID NO: 897788 - RNA, 22 nt, Homo sapiens
uucuacuuucaucuauucuuuc

SEQ ID NO: 897789 - RNA, 11 nt, Homo sapiens
uucuaggcauc

SEQ ID NO: 897790 - RNA, 15 nt, Homo sapiens
uucuauauugugcca

SEQ ID NO: 897791 - RNA, 19 nt, Homo sapiens
uucuaucugggcuguugcu

SEQ ID NO: 897792 - RNA, 16 nt, Homo sapiens
uucucacacuggugga

SEQ ID NO: 897793 - RNA, 22 nt, Homo sapiens
uucucagaccugcgcacuccau

SEQ ID NO: 897794 - RNA, 14 nt, Homo sapiens
uucuccaaaugaga

SEQ ID NO: 897795 - RNA, 21 nt, Homo sapiens
uucuccaccugaagugaugau

SEQ ID NO: 897796 - RNA, 12 nt, Homo sapiens
uucucccugugu

SEQ ID NO: 897797 - RNA, 19 nt, Homo sapiens
uucuccuccagguauuuga

SEQ ID NO: 897798 - RNA, 19 nt, Homo sapiens
uucuccuuuugaccaaaua

SEQ ID NO: 897799 - RNA, 14 nt, Homo sapiens
uucucgaacugcau

SEQ ID NO: 897800 - RNA, 20 nt, Homo sapiens
uucucgugguagaagccagu

SEQ ID NO: 897801 - RNA, 15 nt, Homo sapiens
uucucuauugcugcu

SEQ ID NO: 897802 - RNA, 16 nt, Homo sapiens
uucucuauugcugcuc

SEQ ID NO: 897803 - RNA, 20 nt, Homo sapiens
uucucucacuuugauuugcu

SEQ ID NO: 897804 - RNA, 15 nt, Homo sapiens
uucucucccauacca

SEQ ID NO: 897805 - RNA, 15 nt, Homo sapiens
uucucucguaacugg

SEQ ID NO: 897806 - RNA, 13 nt, Homo sapiens
uucucucucuggu

SEQ ID NO: 897807 - RNA, 17 nt, Homo sapiens
uucucuggguagguguu

SEQ ID NO: 897808 - RNA, 17 nt, Homo sapiens
uucucuguaaggcaaaa

SEQ ID NO: 897809 - RNA, 14 nt, Homo sapiens
uucucuuugccuca

SEQ ID NO: 897810 - RNA, 14 nt, Homo sapiens
uucugaaccauuac

SEQ ID NO: 897811 - RNA, 17 nt, Homo sapiens
uucugaaccauuacugu

SEQ ID NO: 897812 - RNA, 22 nt, Homo sapiens
uucugaacuggaacaugggcau

SEQ ID NO: 897813 - RNA, 16 nt, Homo sapiens
uucugaauugacugua

SEQ ID NO: 897814 - RNA, 17 nt, Homo sapiens
uucugagaaagacuauu

SEQ ID NO: 897815 - RNA, 22 nt, Homo sapiens
uucugagaguuggcucaggcag

SEQ ID NO: 897816 - RNA, 20 nt, Homo sapiens
uucugagcauaaugcuccca

SEQ ID NO: 897817 - RNA, 13 nt, Homo sapiens
uucugaggcaaau

SEQ ID NO: 897818 - RNA, 19 nt, Homo sapiens
acugcagauagccagacac

SEQ ID NO: 897819 - RNA, 16 nt, Homo sapiens
acugcaguauggccau

SEQ ID NO: 897820 - RNA, 20 nt, Homo sapiens
acugcauaaaccaaugagcu

SEQ ID NO: 897821 - RNA, 15 nt, Homo sapiens
acugcaucucaaaaa

SEQ ID NO: 897822 - RNA, 20 nt, Homo sapiens
acugccuuccaggagcaauu

SEQ ID NO: 897823 - RNA, 18 nt, Homo sapiens
acugcgaucuucagagca

SEQ ID NO: 897824 - RNA, 21 nt, Homo sapiens
acugcgugccaguguccccac

SEQ ID NO: 897825 - RNA, 20 nt, Homo sapiens
acugcuaggcgagugccagg

SEQ ID NO: 897826 - RNA, 18 nt, Homo sapiens
acugcugaucaaugaaau

SEQ ID NO: 897827 - RNA, 22 nt, Homo sapiens
acugcugcccagccuccaagcu

SEQ ID NO: 897828 - RNA, 18 nt, Homo sapiens
acugcuuggaacuggaau

SEQ ID NO: 897829 - RNA, 16 nt, Homo sapiens
acuggaacagcccauu

SEQ ID NO: 897830 - RNA, 14 nt, Homo sapiens
acuggaaccaggga

SEQ ID NO: 897831 - RNA, 18 nt, Homo sapiens
acuggacugugugcaacg

SEQ ID NO: 897832 - RNA, 21 nt, Homo sapiens
acuggagacuuggaagaguug

SEQ ID NO: 897833 - RNA, 22 nt, Homo sapiens
acuggagaggcuagaaccaaga

SEQ ID NO: 897834 - RNA, 15 nt, Homo sapiens
acuggagcaucugac

SEQ ID NO: 897835 - RNA, 19 nt, Homo sapiens
acuggauauguuguuaaac

SEQ ID NO: 897836 - RNA, 16 nt, Homo sapiens
acuggcaggcagcaga

SEQ ID NO: 897837 - RNA, 20 nt, Homo sapiens
acugggagaaaugacuuuga

SEQ ID NO: 897838 - RNA, 19 nt, Homo sapiens
acugggcaaugauggcaau

SEQ ID NO: 897839 - RNA, 17 nt, Homo sapiens
acuggucccaaguagua

SEQ ID NO: 897840 - RNA, 15 nt, Homo sapiens
acugguuucaguuga

SEQ ID NO: 897841 - RNA, 14 nt, Homo sapiens
acugguuucucaga

SEQ ID NO: 897842 - RNA, 15 nt, Homo sapiens
acuguaaacauucau

SEQ ID NO: 897843 - RNA, 19 nt, Homo sapiens
acuguaaacauucaucaag

SEQ ID NO: 897844 - RNA, 16 nt, Homo sapiens
acuguacauagaugua

SEQ ID NO: 897845 - RNA, 18 nt, Homo sapiens
acuguauauagaagucua

SEQ ID NO: 897846 - RNA, 17 nt, Homo sapiens
acugucaaguacaagca

SEQ ID NO: 897847 - RNA, 18 nt, Homo sapiens
acugucuauguugugauc

SEQ ID NO: 897848 - RNA, 22 nt, Homo sapiens
acugucuucacaaccuccgugc

SEQ ID NO: 897849 - RNA, 22 nt, Homo sapiens
acugucuugaagacaauggcuu

SEQ ID NO: 897850 - RNA, 19 nt, Homo sapiens
acugugaggggaaggccuu

SEQ ID NO: 897851 - RNA, 23 nt, Homo sapiens
acugugcaggaguggccggggaa

SEQ ID NO: 897852 - RNA, 23 nt, Homo sapiens
acuguggagaaauaaaaauaccu

SEQ ID NO: 897853 - RNA, 15 nt, Homo sapiens
acuguggccuggcau

SEQ ID NO: 897854 - RNA, 20 nt, Homo sapiens
acuguggcugcuagcacuug

SEQ ID NO: 897855 - RNA, 22 nt, Homo sapiens
acuguuauucuauuauaucaga

SEQ ID NO: 897856 - RNA, 13 nt, Homo sapiens
acuguugcucaaa

SEQ ID NO: 897857 - RNA, 16 nt, Homo sapiens
acuguuguacaagcuc

SEQ ID NO: 897858 - RNA, 15 nt, Homo sapiens
acuguuuccugagua

SEQ ID NO: 897859 - RNA, 14 nt, Homo sapiens
acuguuucucucac

SEQ ID NO: 897860 - RNA, 22 nt, Homo sapiens
acuguuuuuauaugcacaugua

SEQ ID NO: 897861 - RNA, 17 nt, Homo sapiens
acuuaaaaaaaugacag

SEQ ID NO: 897862 - RNA, 19 nt, Homo sapiens
acuuaaccagcacauuucu

SEQ ID NO: 897863 - RNA, 17 nt, Homo sapiens
acuuaacugugugaaga

SEQ ID NO: 897864 - RNA, 13 nt, Homo sapiens
acuuaagaggcag

SEQ ID NO: 897865 - RNA, 19 nt, Homo sapiens
acuuaaggauggagccagc

SEQ ID NO: 897866 - RNA, 17 nt, Homo sapiens
acuuaaguggcauuaaa

SEQ ID NO: 897867 - RNA, 14 nt, Homo sapiens
acuuacaugauuca

SEQ ID NO: 897868 - RNA, 17 nt, Homo sapiens
acuuaccuagauucuac

SEQ ID NO: 897869 - RNA, 16 nt, Homo sapiens
acuuacuuauucuucc

SEQ ID NO: 897870 - RNA, 20 nt, Homo sapiens
acuuagcuggccacagugag

SEQ ID NO: 897871 - RNA, 14 nt, Homo sapiens
acuuauaccaaagg

SEQ ID NO: 897872 - RNA, 20 nt, Homo sapiens
acuuauguauuuaugaccuu

SEQ ID NO: 897873 - RNA, 13 nt, Homo sapiens
acuucaagugcau

SEQ ID NO: 897874 - RNA, 16 nt, Homo sapiens
acuucacaauguauau

SEQ ID NO: 897875 - RNA, 14 nt, Homo sapiens
acuucacauugcaa

SEQ ID NO: 897876 - RNA, 16 nt, Homo sapiens
acuucacuaccaaaug

SEQ ID NO: 897877 - RNA, 12 nt, Homo sapiens
acuucagucuuc

SEQ ID NO: 897878 - RNA, 13 nt, Homo sapiens
acuuccacuccaa

SEQ ID NO: 897879 - RNA, 11 nt, Homo sapiens
acuucccugaa

SEQ ID NO: 897880 - RNA, 14 nt, Homo sapiens
acuuccugcacuga

SEQ ID NO: 897881 - RNA, 19 nt, Homo sapiens
acuucguguccgacucuuc

SEQ ID NO: 897882 - RNA, 17 nt, Homo sapiens
acuucuaagagcauaga

SEQ ID NO: 897883 - RNA, 19 nt, Homo sapiens
acuucuaaguaaaaccaca

SEQ ID NO: 897884 - RNA, 13 nt, Homo sapiens
acuucucuagaga

SEQ ID NO: 897885 - RNA, 12 nt, Homo sapiens
acuucucuccag

SEQ ID NO: 897886 - RNA, 16 nt, Homo sapiens
acuucucuuugccuca

SEQ ID NO: 897887 - RNA, 14 nt, Homo sapiens
acuucugcagcuau

SEQ ID NO: 897888 - RNA, 19 nt, Homo sapiens
acuucugccccagcuuuau

SEQ ID NO: 897889 - RNA, 21 nt, Homo sapiens
acuucugucuuccuucauuau

SEQ ID NO: 897890 - RNA, 21 nt, Homo sapiens
acuugaaucaaagcaguuaac

SEQ ID NO: 897891 - RNA, 22 nt, Homo sapiens
acuugcaccugguacugcacau

SEQ ID NO: 897892 - RNA, 21 nt, Homo sapiens
acuuguaauuucuaacuccuu

SEQ ID NO: 897893 - RNA, 13 nt, Homo sapiens
acuuguacuaugu

SEQ ID NO: 897894 - RNA, 18 nt, Homo sapiens
acuuguccuuuuguacca

SEQ ID NO: 897895 - RNA, 20 nt, Homo sapiens
acuugucuuacauaaucaca

SEQ ID NO: 897896 - RNA, 16 nt, Homo sapiens
acuugugccagcagaa

SEQ ID NO: 897897 - RNA, 18 nt, Homo sapiens
acuuguggacacagcucu

SEQ ID NO: 897898 - RNA, 20 nt, Homo sapiens
acuuguugcugauucaagaa

SEQ ID NO: 897899 - RNA, 18 nt, Homo sapiens
acuuuaacccucucuucc

SEQ ID NO: 897900 - RNA, 14 nt, Homo sapiens
acuuuaaccuuaga

SEQ ID NO: 897901 - RNA, 14 nt, Homo sapiens
acuuuaagauguuu

SEQ ID NO: 897902 - RNA, 13 nt, Homo sapiens
acuuuaaugggag

SEQ ID NO: 897903 - RNA, 13 nt, Homo sapiens
acuuuaauucuca

SEQ ID NO: 897904 - RNA, 15 nt, Homo sapiens
acuuuaccacuaugc

SEQ ID NO: 897905 - RNA, 17 nt, Homo sapiens
acuuuaccacuaugcaa

SEQ ID NO: 897906 - RNA, 19 nt, Homo sapiens
acuuuauuuguauuugcca

SEQ ID NO: 897907 - RNA, 17 nt, Homo sapiens
acuuuccagugaggaaa

SEQ ID NO: 897908 - RNA, 23 nt, Homo sapiens
acuuucccagaaaaaaaaaaacu

SEQ ID NO: 897909 - RNA, 16 nt, Homo sapiens
acuuucucugcaaaga

SEQ ID NO: 897910 - RNA, 22 nt, Homo sapiens
acuuucuguugccacaacccug

SEQ ID NO: 897911 - RNA, 18 nt, Homo sapiens
acuuugaguuagugccau

SEQ ID NO: 897912 - RNA, 22 nt, Homo sapiens
acuuugguggccacauaagcca

SEQ ID NO: 897913 - RNA, 17 nt, Homo sapiens
acuuugucucugagaac

SEQ ID NO: 897914 - RNA, 23 nt, Homo sapiens
acuuuuaaguugcugaugaacuc

SEQ ID NO: 897915 - RNA, 17 nt, Homo sapiens
acuuuuacuacagugac

SEQ ID NO: 897916 - RNA, 18 nt, Homo sapiens
acuuuucaguucaguggc

SEQ ID NO: 897917 - RNA, 20 nt, Homo sapiens
acuuuucuaacauaugucua

SEQ ID NO: 897918 - RNA, 17 nt, Homo sapiens
acuuuugaaaagcuuuu

SEQ ID NO: 897919 - RNA, 18 nt, Homo sapiens
acuuuuuuucugauucaa

SEQ ID NO: 897920 - RNA, 15 nt, Homo sapiens
agaaaaaacaccacc

SEQ ID NO: 897921 - RNA, 12 nt, Homo sapiens
agaaaaauuauu

SEQ ID NO: 897922 - RNA, 12 nt, Homo sapiens
agaaaacacagc

SEQ ID NO: 897923 - RNA, 19 nt, Homo sapiens
agaaaagauuuaaguaauu

SEQ ID NO: 897924 - RNA, 12 nt, Homo sapiens
agaaaagcagac

SEQ ID NO: 897925 - RNA, 20 nt, Homo sapiens
agaaaagguacauguuuaca

SEQ ID NO: 897926 - RNA, 18 nt, Homo sapiens
agaaaagugaaugcucaa

SEQ ID NO: 897927 - RNA, 21 nt, Homo sapiens
agaaaaucaaccagcaggaaa

SEQ ID NO: 897928 - RNA, 12 nt, Homo sapiens
agaaaaugcauu

SEQ ID NO: 897929 - RNA, 12 nt, Homo sapiens
agaaacacucaa

SEQ ID NO: 897930 - RNA, 19 nt, Homo sapiens
agaaacacucuuauuccca

SEQ ID NO: 897931 - RNA, 18 nt, Homo sapiens
agaaacaugacacugacc

SEQ ID NO: 897932 - RNA, 21 nt, Homo sapiens
agaaaccuuauuguaccucuc

SEQ ID NO: 897933 - RNA, 18 nt, Homo sapiens
agaccaguugggagcacu

SEQ ID NO: 897934 - RNA, 17 nt, Homo sapiens
agaccauugucuuccaa

SEQ ID NO: 897935 - RNA, 22 nt, Homo sapiens
agaccauugucuuccaacccca

SEQ ID NO: 897936 - RNA, 18 nt, Homo sapiens
agaccauuuguauuacca

SEQ ID NO: 897937 - RNA, 15 nt, Homo sapiens
agacccaguguaaag

SEQ ID NO: 897938 - RNA, 20 nt, Homo sapiens
agaccgggguucaagccaug

SEQ ID NO: 897939 - RNA, 16 nt, Homo sapiens
agaccuaggauuucau

SEQ ID NO: 897940 - RNA, 22 nt, Homo sapiens
agaccucucaacagaucugugg

SEQ ID NO: 897941 - RNA, 16 nt, Homo sapiens
agaccugacaagcacu

SEQ ID NO: 897942 - RNA, 23 nt, Homo sapiens
agaccuguugguuagcuggacau

SEQ ID NO: 897943 - RNA, 19 nt, Homo sapiens
agaccuucugaagaucuca

SEQ ID NO: 897944 - RNA, 22 nt, Homo sapiens
agacgcagcccugggggccagc

SEQ ID NO: 897945 - RNA, 19 nt, Homo sapiens
agacgucucaagacugaaa

SEQ ID NO: 897946 - RNA, 13 nt, Homo sapiens
agacuauauacau

SEQ ID NO: 897947 - RNA, 12 nt, Homo sapiens
agacucacugug

SEQ ID NO: 897948 - RNA, 13 nt, Homo sapiens
agacucacugugg

SEQ ID NO: 897949 - RNA, 17 nt, Homo sapiens
agacucacugugggaag

SEQ ID NO: 897950 - RNA, 18 nt, Homo sapiens
agacucagcuccagaaua

SEQ ID NO: 897951 - RNA, 17 nt, Homo sapiens
agacucaguuugucaga

SEQ ID NO: 897952 - RNA, 21 nt, Homo sapiens
agacucgucucaaaaaaaaga

SEQ ID NO: 897953 - RNA, 18 nt, Homo sapiens
agacucuaaauauuucau

SEQ ID NO: 897954 - RNA, 20 nt, Homo sapiens
agacucuacagaggccaugg

SEQ ID NO: 897955 - RNA, 14 nt, Homo sapiens
agacucucuuaggg

SEQ ID NO: 897956 - RNA, 13 nt, Homo sapiens
agacucugucuca

SEQ ID NO: 897957 - RNA, 18 nt, Homo sapiens
agacugcuaaguaggggc

SEQ ID NO: 897958 - RNA, 18 nt, Homo sapiens
agacuggauucgugacaa

SEQ ID NO: 897959 - RNA, 17 nt, Homo sapiens
agacugguuagacagua

SEQ ID NO: 897960 - RNA, 22 nt, Homo sapiens
agacuguggcugcuagcacuug

SEQ ID NO: 897961 - RNA, 14 nt, Homo sapiens
agacuguugcacuc

SEQ ID NO: 897962 - RNA, 15 nt, Homo sapiens
agacuguugcucaaa

SEQ ID NO: 897963 - RNA, 17 nt, Homo sapiens
agacuuaaaucacagau

SEQ ID NO: 897964 - RNA, 18 nt, Homo sapiens
agacuuaggaaccuacca

SEQ ID NO: 897965 - RNA, 20 nt, Homo sapiens
agacuuuaccacuaugcaau

SEQ ID NO: 897966 - RNA, 15 nt, Homo sapiens
agacuuuuaucaaaa

SEQ ID NO: 897967 - RNA, 16 nt, Homo sapiens
agagaaaaaccaauga

SEQ ID NO: 897968 - RNA, 13 nt, Homo sapiens
agagaaaacuuau

SEQ ID NO: 897969 - RNA, 15 nt, Homo sapiens
agagaaaagacauaa

SEQ ID NO: 897970 - RNA, 18 nt, Homo sapiens
agagaaagaaguaggcau

SEQ ID NO: 897971 - RNA, 16 nt, Homo sapiens
agagaaaguacuucuc

SEQ ID NO: 897972 - RNA, 15 nt, Homo sapiens
agagaacaggggcuu

SEQ ID NO: 897973 - RNA, 13 nt, Homo sapiens
agagaacuggagg

SEQ ID NO: 897974 - RNA, 18 nt, Homo sapiens
agagaagaccucugugag

SEQ ID NO: 897975 - RNA, 20 nt, Homo sapiens
agagaagauagcagggcaug

SEQ ID NO: 897976 - RNA, 19 nt, Homo sapiens
agagaaggacaugugcuau

SEQ ID NO: 897977 - RNA, 19 nt, Homo sapiens
agagaaggcuuccuccagc

SEQ ID NO: 897978 - RNA, 20 nt, Homo sapiens
agagaauggguuuacucuca

SEQ ID NO: 897979 - RNA, 21 nt, Homo sapiens
agagaccuugcgaccaugugu

SEQ ID NO: 897980 - RNA, 13 nt, Homo sapiens
agagacucuggcc

SEQ ID NO: 897981 - RNA, 18 nt, Homo sapiens
agagacugugcugggaac

SEQ ID NO: 897982 - RNA, 15 nt, Homo sapiens
agagagaucuagaaa

SEQ ID NO: 897983 - RNA, 13 nt, Homo sapiens
agagagauggaau

SEQ ID NO: 897984 - RNA, 12 nt, Homo sapiens
agagaggcaugu

SEQ ID NO: 897985 - RNA, 15 nt, Homo sapiens
agagaggcaugugau

SEQ ID NO: 897986 - RNA, 22 nt, Homo sapiens
agagagggccugcuggagagca

SEQ ID NO: 897987 - RNA, 12 nt, Homo sapiens
agagaguaccau

SEQ ID NO: 897988 - RNA, 14 nt, Homo sapiens
agagagucuuccag

SEQ ID NO: 897989 - RNA, 19 nt, Homo sapiens
agagaucacaauacucaaa

SEQ ID NO: 897990 - RNA, 22 nt, Homo sapiens
agagaugauucggauuugacaa

SEQ ID NO: 897991 - RNA, 19 nt, Homo sapiens
agagauggaauaaagcccu

SEQ ID NO: 897992 - RNA, 23 nt, Homo sapiens
agagauggaauaaagcccuugaa

SEQ ID NO: 897993 - RNA, 16 nt, Homo sapiens
agagauguagcagaau

SEQ ID NO: 897994 - RNA, 15 nt, Homo sapiens
agagcaaaaugaugc

SEQ ID NO: 897995 - RNA, 20 nt, Homo sapiens
agagcaagacucugucucaa

SEQ ID NO: 897996 - RNA, 15 nt, Homo sapiens
agagcacacuguagc

SEQ ID NO: 897997 - RNA, 15 nt, Homo sapiens
agagcagaaccaaag

SEQ ID NO: 897998 - RNA, 17 nt, Homo sapiens
agagcaggaaugggaag

SEQ ID NO: 897999 - RNA, 21 nt, Homo sapiens
agagcauggaaaaauacugcc

SEQ ID NO: 898000 - RNA, 14 nt, Homo sapiens
agagccagcucucu

SEQ ID NO: 898001 - RNA, 23 nt, Homo sapiens
agagcccuucaugcauuugcacu

SEQ ID NO: 898002 - RNA, 19 nt, Homo sapiens
agagccugugcuaaagaag

SEQ ID NO: 898003 - RNA, 19 nt, Homo sapiens
agagcuagaaccuagaagg

SEQ ID NO: 898004 - RNA, 14 nt, Homo sapiens
agagcuauguuccc

SEQ ID NO: 898005 - RNA, 11 nt, Homo sapiens
agagcucuuaa

SEQ ID NO: 898006 - RNA, 23 nt, Homo sapiens
agagcugggauguuucugucaca

SEQ ID NO: 898007 - RNA, 19 nt, Homo sapiens
agaggaauaagaauggagc

SEQ ID NO: 898008 - RNA, 11 nt, Homo sapiens
agaggacaaga

SEQ ID NO: 898009 - RNA, 22 nt, Homo sapiens
agaggacagagcuggcugucuu

SEQ ID NO: 898010 - RNA, 19 nt, Homo sapiens
agaggaccugagucugcua

SEQ ID NO: 898011 - RNA, 17 nt, Homo sapiens
agaggagagaggcucag

SEQ ID NO: 898012 - RNA, 23 nt, Homo sapiens
agaggagguuuggggucugccac

SEQ ID NO: 898013 - RNA, 19 nt, Homo sapiens
agaggcaugugaugugcaa

SEQ ID NO: 898014 - RNA, 22 nt, Homo sapiens
agaggcuaagaugagauuugcc

SEQ ID NO: 898015 - RNA, 14 nt, Homo sapiens
agaggcuccugucc

SEQ ID NO: 898016 - RNA, 19 nt, Homo sapiens
agaggcugcagaaggccaa

SEQ ID NO: 898017 - RNA, 19 nt, Homo sapiens
agaggcuuccuucauuucc

SEQ ID NO: 898018 - RNA, 21 nt, Homo sapiens
agagggaccaaauugcuucua

SEQ ID NO: 898019 - RNA, 13 nt, Homo sapiens
agagggagugcau

SEQ ID NO: 898020 - RNA, 21 nt, Homo sapiens
agagggcagcccccacuuucc

SEQ ID NO: 898021 - RNA, 15 nt, Homo sapiens
agaggggcagccgcu

SEQ ID NO: 898022 - RNA, 15 nt, Homo sapiens
agaggggcuguccau

SEQ ID NO: 898023 - RNA, 17 nt, Homo sapiens
agagggggcaagggcaa

SEQ ID NO: 898024 - RNA, 20 nt, Homo sapiens
agagggggccuucacaguga

SEQ ID NO: 898025 - RNA, 14 nt, Homo sapiens
agaggguguuugca

SEQ ID NO: 898026 - RNA, 21 nt, Homo sapiens
agaggucucagguucuuucca

SEQ ID NO: 898027 - RNA, 17 nt, Homo sapiens
agaggugacaguggaug

SEQ ID NO: 898028 - RNA, 14 nt, Homo sapiens
agaggugagaccaa

SEQ ID NO: 898029 - RNA, 20 nt, Homo sapiens
agagguggcugcugugcuag

SEQ ID NO: 898030 - RNA, 19 nt, Homo sapiens
agaggugguagaaccacuu

SEQ ID NO: 898031 - RNA, 16 nt, Homo sapiens
agaguaaugaggcuug

SEQ ID NO: 898032 - RNA, 13 nt, Homo sapiens
agaguacagaugu

SEQ ID NO: 898033 - RNA, 19 nt, Homo sapiens
agaguagagggcacugggu

SEQ ID NO: 898034 - RNA, 12 nt, Homo sapiens
agaguagucaug

SEQ ID NO: 898035 - RNA, 12 nt, Homo sapiens
agagucacugac

SEQ ID NO: 898036 - RNA, 21 nt, Homo sapiens
agaguccuauuugcacuguag

SEQ ID NO: 898037 - RNA, 14 nt, Homo sapiens
agaguccucuggau

SEQ ID NO: 898038 - RNA, 18 nt, Homo sapiens
agaguccucuggauggca

SEQ ID NO: 898039 - RNA, 17 nt, Homo sapiens
agaguccuuucaggaag

SEQ ID NO: 898040 - RNA, 23 nt, Homo sapiens
agagucugaaagacagaauguca

SEQ ID NO: 898041 - RNA, 16 nt, Homo sapiens
agagugacacccaaga

SEQ ID NO: 898042 - RNA, 19 nt, Homo sapiens
agagugagacuccgucuca

SEQ ID NO: 898043 - RNA, 19 nt, Homo sapiens
agagugagacucgucucaa

SEQ ID NO: 898044 - RNA, 19 nt, Homo sapiens
agagugcugccaguccucu

SEQ ID NO: 898045 - RNA, 19 nt, Homo sapiens
agaguguuaucagucauaa

SEQ ID NO: 898046 - RNA, 21 nt, Homo sapiens
agaguguuccuguugaaucuu

SEQ ID NO: 898047 - RNA, 22 nt, Homo sapiens
agaguguuuggggguuccguga

SEQ ID NO: 898048 - RNA, 16 nt, Homo sapiens
agcagcgguaccccag

SEQ ID NO: 898049 - RNA, 22 nt, Homo sapiens
agcaggcuggagcccagcauuc

SEQ ID NO: 898050 - RNA, 16 nt, Homo sapiens
agcagguaggaggcaa

SEQ ID NO: 898051 - RNA, 19 nt, Homo sapiens
agcagguagugggugaaug

SEQ ID NO: 898052 - RNA, 16 nt, Homo sapiens
agcagguggcaucucu

SEQ ID NO: 898053 - RNA, 19 nt, Homo sapiens
agcagguggcaucucuaau

SEQ ID NO: 898054 - RNA, 16 nt, Homo sapiens
agcaguaaacuuucuc

SEQ ID NO: 898055 - RNA, 17 nt, Homo sapiens
agcaguaccagugugcu

SEQ ID NO: 898056 - RNA, 16 nt, Homo sapiens
agcagugucuuccaua

SEQ ID NO: 898057 - RNA, 22 nt, Homo sapiens
agcagugucuuccauaauguau

SEQ ID NO: 898058 - RNA, 20 nt, Homo sapiens
agcauaaugcucccaucucc

SEQ ID NO: 898059 - RNA, 14 nt, Homo sapiens
agcaucaccucagg

SEQ ID NO: 898060 - RNA, 21 nt, Homo sapiens
agcaucacuugggauuaauau

SEQ ID NO: 898061 - RNA, 11 nt, Homo sapiens
agcaucagaaa

SEQ ID NO: 898062 - RNA, 19 nt, Homo sapiens
agcaugcaauaaugugcaa

SEQ ID NO: 898063 - RNA, 15 nt, Homo sapiens
agcauuacagugggu

SEQ ID NO: 898064 - RNA, 18 nt, Homo sapiens
agcauuaugauguggguc

SEQ ID NO: 898065 - RNA, 18 nt, Homo sapiens
agcauuguaaaugugcuu

SEQ ID NO: 898066 - RNA, 13 nt, Homo sapiens
agcauuucuugau

SEQ ID NO: 898067 - RNA, 21 nt, Homo sapiens
agcauuuucuugaaccaauaa

SEQ ID NO: 898068 - RNA, 23 nt, Homo sapiens
agccaaacacuguuucuaacuca

SEQ ID NO: 898069 - RNA, 18 nt, Homo sapiens
agccaaauaaaaccucag

SEQ ID NO: 898070 - RNA, 19 nt, Homo sapiens
agccaaccaagagcacauu

SEQ ID NO: 898071 - RNA, 21 nt, Homo sapiens
agccaacucacucuuaugaaa

SEQ ID NO: 898072 - RNA, 18 nt, Homo sapiens
agccaacuuuaauugcuu

SEQ ID NO: 898073 - RNA, 20 nt, Homo sapiens
agccaagaucgcgccacugc

SEQ ID NO: 898074 - RNA, 19 nt, Homo sapiens
agccaauaaaucaacucca

SEQ ID NO: 898075 - RNA, 13 nt, Homo sapiens
agccacacagagc

SEQ ID NO: 898076 - RNA, 21 nt, Homo sapiens
agccacccaggggaaugaucu

SEQ ID NO: 898077 - RNA, 17 nt, Homo sapiens
agccacccugaggaguc

SEQ ID NO: 898078 - RNA, 22 nt, Homo sapiens
agccacccugaggagucugagg

SEQ ID NO: 898079 - RNA, 14 nt, Homo sapiens
agccaccuuccagu

SEQ ID NO: 898080 - RNA, 13 nt, Homo sapiens
agccacucuucca

SEQ ID NO: 898081 - RNA, 16 nt, Homo sapiens
agccacugguuucuca

SEQ ID NO: 898082 - RNA, 18 nt, Homo sapiens
agccacugguuucucaga

SEQ ID NO: 898083 - RNA, 15 nt, Homo sapiens
agccacugugcugaa

SEQ ID NO: 898084 - RNA, 19 nt, Homo sapiens
agccagagccugucuuuca

SEQ ID NO: 898085 - RNA, 13 nt, Homo sapiens
agccagauucaaa

SEQ ID NO: 898086 - RNA, 13 nt, Homo sapiens
agccagcaaacca

SEQ ID NO: 898087 - RNA, 16 nt, Homo sapiens
agccagcaaugauguc

SEQ ID NO: 898088 - RNA, 15 nt, Homo sapiens
agccagcagccagcu

SEQ ID NO: 898089 - RNA, 18 nt, Homo sapiens
agccagcagccagcucuc

SEQ ID NO: 898090 - RNA, 19 nt, Homo sapiens
agccagcagccagcucuca

SEQ ID NO: 898091 - RNA, 14 nt, Homo sapiens
agccagcccugccu

SEQ ID NO: 898092 - RNA, 15 nt, Homo sapiens
agccagcuguguuca

SEQ ID NO: 898093 - RNA, 18 nt, Homo sapiens
agccagguuagccuuugc

SEQ ID NO: 898094 - RNA, 12 nt, Homo sapiens
agccaguggcag

SEQ ID NO: 898095 - RNA, 18 nt, Homo sapiens
agccauaaagugccaguu

SEQ ID NO: 898096 - RNA, 16 nt, Homo sapiens
agccaucaagagacug

SEQ ID NO: 898097 - RNA, 11 nt, Homo sapiens
agccaugggcc

SEQ ID NO: 898098 - RNA, 20 nt, Homo sapiens
agccauguacuauaauguga

SEQ ID NO: 898099 - RNA, 17 nt, Homo sapiens
agccauuuuuagcucug

SEQ ID NO: 898100 - RNA, 19 nt, Homo sapiens
agccauuuuuuaaaugaca

SEQ ID NO: 898101 - RNA, 18 nt, Homo sapiens
agcccaagugccauccca

SEQ ID NO: 898102 - RNA, 21 nt, Homo sapiens
agcccacacaugaaccauccu

SEQ ID NO: 898103 - RNA, 16 nt, Homo sapiens
agcccaccuuggcuca

SEQ ID NO: 898104 - RNA, 20 nt, Homo sapiens
agcccagaaaaccuccagua

SEQ ID NO: 898105 - RNA, 18 nt, Homo sapiens
agcccagaauagcuuuga

SEQ ID NO: 898106 - RNA, 14 nt, Homo sapiens
agcccagccauuac

SEQ ID NO: 898107 - RNA, 19 nt, Homo sapiens
agcccagccuagcgugccc

SEQ ID NO: 898108 - RNA, 17 nt, Homo sapiens
agcccagcuacauuccu

SEQ ID NO: 898109 - RNA, 12 nt, Homo sapiens
agcccagugugg

SEQ ID NO: 898110 - RNA, 15 nt, Homo sapiens
agcccauaaagcaag

SEQ ID NO: 898111 - RNA, 22 nt, Homo sapiens
agcccaugcucaaccacugugg

SEQ ID NO: 898112 - RNA, 16 nt, Homo sapiens
agcccaugcuuuccca

SEQ ID NO: 898113 - RNA, 19 nt, Homo sapiens
agcccauggccucuggcca

SEQ ID NO: 898114 - RNA, 20 nt, Homo sapiens
agccccagcugacaccugga

SEQ ID NO: 898115 - RNA, 18 nt, Homo sapiens
agcccccacuucucucca

SEQ ID NO: 898116 - RNA, 24 nt, Homo sapiens
agcccccuggaugggcauugggcu

SEQ ID NO: 898117 - RNA, 21 nt, Homo sapiens
agccccuuacuaugaucucag

SEQ ID NO: 898118 - RNA, 15 nt, Homo sapiens
agcccgggugugccu

SEQ ID NO: 898119 - RNA, 13 nt, Homo sapiens
agcccuauuacuu

SEQ ID NO: 898120 - RNA, 21 nt, Homo sapiens
agcccucaggccagugccagg

SEQ ID NO: 898121 - RNA, 17 nt, Homo sapiens
agcccugagcucaggcu

SEQ ID NO: 898122 - RNA, 16 nt, Homo sapiens
agcccugggaccgcua

SEQ ID NO: 898123 - RNA, 18 nt, Homo sapiens
agcccugucgagacacuu

SEQ ID NO: 898124 - RNA, 13 nt, Homo sapiens
agccgaccucagc

SEQ ID NO: 898125 - RNA, 20 nt, Homo sapiens
agccgagauugcgccacugc

SEQ ID NO: 898126 - RNA, 21 nt, Homo sapiens
agccgagauugcgccacugca

SEQ ID NO: 898127 - RNA, 18 nt, Homo sapiens
agccgcgugugacagucu

SEQ ID NO: 898128 - RNA, 22 nt, Homo sapiens
agccgcgugugacagucuugca

SEQ ID NO: 898129 - RNA, 13 nt, Homo sapiens
agccgcugugagc

SEQ ID NO: 898130 - RNA, 16 nt, Homo sapiens
agccggggcacuuuca

SEQ ID NO: 898131 - RNA, 22 nt, Homo sapiens
agccggggguggugacaugugc

SEQ ID NO: 898132 - RNA, 14 nt, Homo sapiens
agccggguaccuca

SEQ ID NO: 898133 - RNA, 18 nt, Homo sapiens
agccguuccgucccaaac

SEQ ID NO: 898134 - RNA, 19 nt, Homo sapiens
agccuaacaugauuauuug

SEQ ID NO: 898135 - RNA, 19 nt, Homo sapiens
agccuacacuauucuagca

SEQ ID NO: 898136 - RNA, 18 nt, Homo sapiens
agccuagcccacuuguca

SEQ ID NO: 898137 - RNA, 18 nt, Homo sapiens
agccuagccgaccucagc

SEQ ID NO: 898138 - RNA, 17 nt, Homo sapiens
agccuauugugccucug

SEQ ID NO: 898139 - RNA, 23 nt, Homo sapiens
agccucaagucuuauuuccucaa

SEQ ID NO: 898140 - RNA, 15 nt, Homo sapiens
agccucagugccacu

SEQ ID NO: 898141 - RNA, 19 nt, Homo sapiens
agccuccccaccuucuuca

SEQ ID NO: 898142 - RNA, 22 nt, Homo sapiens
agccucccccucagaugaucuc

SEQ ID NO: 898143 - RNA, 17 nt, Homo sapiens
agccucccccugcugcu

SEQ ID NO: 898144 - RNA, 20 nt, Homo sapiens
agccucccccugcugcucau

SEQ ID NO: 898145 - RNA, 18 nt, Homo sapiens
agccucccuguaacucca

SEQ ID NO: 898146 - RNA, 19 nt, Homo sapiens
agccucgcaacccgugcca

SEQ ID NO: 898147 - RNA, 19 nt, Homo sapiens
agccucgguggccaugcuu

SEQ ID NO: 898148 - RNA, 14 nt, Homo sapiens
agccucugaucagu

SEQ ID NO: 898149 - RNA, 19 nt, Homo sapiens
agccucugaucaguuucac

SEQ ID NO: 898150 - RNA, 14 nt, Homo sapiens
agccucugcugcca

SEQ ID NO: 898151 - RNA, 12 nt, Homo sapiens
agccucuguccc

SEQ ID NO: 898152 - RNA, 13 nt, Homo sapiens
agccugagccaca

SEQ ID NO: 898153 - RNA, 20 nt, Homo sapiens
agccugcagacucacugugg

SEQ ID NO: 898154 - RNA, 21 nt, Homo sapiens
agccugcucccccacccccuc

SEQ ID NO: 898155 - RNA, 15 nt, Homo sapiens
agccuggagggaugc

SEQ ID NO: 898156 - RNA, 14 nt, Homo sapiens
agccuggcaacaca

SEQ ID NO: 898157 - RNA, 14 nt, Homo sapiens
agccuggcacagga

SEQ ID NO: 898158 - RNA, 21 nt, Homo sapiens
agccuggcacagggcaguggg

SEQ ID NO: 898159 - RNA, 17 nt, Homo sapiens
agccuggccaacaugau

SEQ ID NO: 898160 - RNA, 17 nt, Homo sapiens
agccuggccuccugccu

SEQ ID NO: 898161 - RNA, 13 nt, Homo sapiens
agccugggaccag

SEQ ID NO: 898162 - RNA, 14 nt, Homo sapiens
agccugggcaacaa

SEQ ID NO: 898163 - RNA, 15 nt, Homo sapiens
aggaccuucccaagu

SEQ ID NO: 898164 - RNA, 15 nt, Homo sapiens
aggacuaacacucag

SEQ ID NO: 898165 - RNA, 13 nt, Homo sapiens
aggacuugaaccc

SEQ ID NO: 898166 - RNA, 17 nt, Homo sapiens
aggagaagcagccuccu

SEQ ID NO: 898167 - RNA, 17 nt, Homo sapiens
aggagaaucacuugcac

SEQ ID NO: 898168 - RNA, 14 nt, Homo sapiens
aggagacauuggua

SEQ ID NO: 898169 - RNA, 22 nt, Homo sapiens
aggagaccauuuguauuaccau

SEQ ID NO: 898170 - RNA, 15 nt, Homo sapiens
aggagacucaccucu

SEQ ID NO: 898171 - RNA, 21 nt, Homo sapiens
aggagacuuaggaaccuacca

SEQ ID NO: 898172 - RNA, 23 nt, Homo sapiens
aggagagaggcucagccacacag

SEQ ID NO: 898173 - RNA, 16 nt, Homo sapiens
aggagaucgagaccau

SEQ ID NO: 898174 - RNA, 13 nt, Homo sapiens
aggagauggcaua

SEQ ID NO: 898175 - RNA, 19 nt, Homo sapiens
aggagauuuuccuuccuac

SEQ ID NO: 898176 - RNA, 19 nt, Homo sapiens
aggagcugauuuccaggcc

SEQ ID NO: 898177 - RNA, 15 nt, Homo sapiens
aggagcugucuccag

SEQ ID NO: 898178 - RNA, 18 nt, Homo sapiens
aggagcuugcaagaagca

SEQ ID NO: 898179 - RNA, 23 nt, Homo sapiens
aggaggaccccgggcguggacca

SEQ ID NO: 898180 - RNA, 20 nt, Homo sapiens
aggaggcggagguugcagug

SEQ ID NO: 898181 - RNA, 20 nt, Homo sapiens
aggaggcuuaggacuuucca

SEQ ID NO: 898182 - RNA, 21 nt, Homo sapiens
aggagggagggacacuuaccc

SEQ ID NO: 898183 - RNA, 15 nt, Homo sapiens
aggagggcuguagga

SEQ ID NO: 898184 - RNA, 20 nt, Homo sapiens
aggagguggagguugcagug

SEQ ID NO: 898185 - RNA, 20 nt, Homo sapiens
aggagucaacguguuuaccu

SEQ ID NO: 898186 - RNA, 15 nt, Homo sapiens
aggagucaacuggcu

SEQ ID NO: 898187 - RNA, 18 nt, Homo sapiens
aggaguucaagaccagcc

SEQ ID NO: 898188 - RNA, 22 nt, Homo sapiens
aggaguucucaucccucuguca

SEQ ID NO: 898189 - RNA, 17 nt, Homo sapiens
aggauagaauacaugga

SEQ ID NO: 898190 - RNA, 16 nt, Homo sapiens
aggauaucgggucacu

SEQ ID NO: 898191 - RNA, 17 nt, Homo sapiens
aggauauuuucuuccaa

SEQ ID NO: 898192 - RNA, 14 nt, Homo sapiens
aggaucucucagga

SEQ ID NO: 898193 - RNA, 18 nt, Homo sapiens
aggaugauaaaagcacuu

SEQ ID NO: 898194 - RNA, 15 nt, Homo sapiens
aggaugugagccuga

SEQ ID NO: 898195 - RNA, 16 nt, Homo sapiens
aggaugugcauucucc

SEQ ID NO: 898196 - RNA, 16 nt, Homo sapiens
aggauguuuuucauga

SEQ ID NO: 898197 - RNA, 17 nt, Homo sapiens
aggauuaagauacacuc

SEQ ID NO: 898198 - RNA, 14 nt, Homo sapiens
aggauugcuacugu

SEQ ID NO: 898199 - RNA, 15 nt, Homo sapiens
aggauuucaugauuu

SEQ ID NO: 898200 - RNA, 21 nt, Homo sapiens
aggcaacugugaguccgggaa

SEQ ID NO: 898201 - RNA, 17 nt, Homo sapiens
aggcaagccccucagcc

SEQ ID NO: 898202 - RNA, 15 nt, Homo sapiens
aggcaccugcuggaa

SEQ ID NO: 898203 - RNA, 22 nt, Homo sapiens
aggcaccuggccugcugggaac

SEQ ID NO: 898204 - RNA, 18 nt, Homo sapiens
aggcaccuuaguggcuuu

SEQ ID NO: 898205 - RNA, 22 nt, Homo sapiens
aggcacugcugcccagccucca

SEQ ID NO: 898206 - RNA, 16 nt, Homo sapiens
aggcacugguggcauc

SEQ ID NO: 898207 - RNA, 19 nt, Homo sapiens
aggcacuugucacuaugcu

SEQ ID NO: 898208 - RNA, 15 nt, Homo sapiens
aggcagaccauccac

SEQ ID NO: 898209 - RNA, 20 nt, Homo sapiens
aggcagagaaucauacuuag

SEQ ID NO: 898210 - RNA, 15 nt, Homo sapiens
aggcagagacaauaa

SEQ ID NO: 898211 - RNA, 17 nt, Homo sapiens
aggcagagguggugggg

SEQ ID NO: 898212 - RNA, 20 nt, Homo sapiens
aggcagcagaaaucauuuuc

SEQ ID NO: 898213 - RNA, 15 nt, Homo sapiens
aggcagccacagaca

SEQ ID NO: 898214 - RNA, 17 nt, Homo sapiens
aggcaggagaauggugu

SEQ ID NO: 898215 - RNA, 20 nt, Homo sapiens
aggcaggaggaucacuugga

SEQ ID NO: 898216 - RNA, 21 nt, Homo sapiens
aggcagggcaaaugcuugauu

SEQ ID NO: 898217 - RNA, 23 nt, Homo sapiens
aggcaggggugggagagccagcu

SEQ ID NO: 898218 - RNA, 20 nt, Homo sapiens
aggcagggucucacucuguc

SEQ ID NO: 898219 - RNA, 13 nt, Homo sapiens
aggcaguguuccu

SEQ ID NO: 898220 - RNA, 22 nt, Homo sapiens
aggcauaaagacuaauuagcaa

SEQ ID NO: 898221 - RNA, 22 nt, Homo sapiens
aggcauaagacccuaagccucc

SEQ ID NO: 898222 - RNA, 15 nt, Homo sapiens
aggcauacugacacu

SEQ ID NO: 898223 - RNA, 11 nt, Homo sapiens
aggcauaugca

SEQ ID NO: 898224 - RNA, 16 nt, Homo sapiens
aggcaugauguuaacc

SEQ ID NO: 898225 - RNA, 14 nt, Homo sapiens
aggcauuucuauca

SEQ ID NO: 898226 - RNA, 19 nt, Homo sapiens
aggccaagggccaagagaa

SEQ ID NO: 898227 - RNA, 21 nt, Homo sapiens
aggccaccuggccaggagcuu

SEQ ID NO: 898228 - RNA, 15 nt, Homo sapiens
aggccagugccagga

SEQ ID NO: 898229 - RNA, 18 nt, Homo sapiens
aggcccagaaagaggcag

SEQ ID NO: 898230 - RNA, 23 nt, Homo sapiens
aggccccuggucugcccugggcu

SEQ ID NO: 898231 - RNA, 18 nt, Homo sapiens
aggcccuaagaugccuug

SEQ ID NO: 898232 - RNA, 16 nt, Homo sapiens
aggcccuccaugggcu

SEQ ID NO: 898233 - RNA, 16 nt, Homo sapiens
aggcccuugggcaccu

SEQ ID NO: 898234 - RNA, 20 nt, Homo sapiens
aggccgggcgcaguggcuca

SEQ ID NO: 898235 - RNA, 21 nt, Homo sapiens
aggccggugugggcugugucg

SEQ ID NO: 898236 - RNA, 14 nt, Homo sapiens
aggccugcccuccc

SEQ ID NO: 898237 - RNA, 20 nt, Homo sapiens
aggccuggccagaugcacca

SEQ ID NO: 898238 - RNA, 15 nt, Homo sapiens
aggccuguguagcug

SEQ ID NO: 898239 - RNA, 21 nt, Homo sapiens
aggccuuuccccaguguggcc

SEQ ID NO: 898240 - RNA, 17 nt, Homo sapiens
aggcgcaugugccaguu

SEQ ID NO: 898241 - RNA, 16 nt, Homo sapiens
aggcggaagaaucacu

SEQ ID NO: 898242 - RNA, 19 nt, Homo sapiens
aggcggcacauuggcagug

SEQ ID NO: 898243 - RNA, 18 nt, Homo sapiens
aggcgggcggcacgccaa

SEQ ID NO: 898244 - RNA, 17 nt, Homo sapiens
aggcggggugcuguggu

SEQ ID NO: 898245 - RNA, 20 nt, Homo sapiens
aggcggguggaucacuugag

SEQ ID NO: 898246 - RNA, 21 nt, Homo sapiens
aggcuaagaugagauuugcca

SEQ ID NO: 898247 - RNA, 17 nt, Homo sapiens
aggcuacuggcauuaau

SEQ ID NO: 898248 - RNA, 17 nt, Homo sapiens
aggcuauagcugggaac

SEQ ID NO: 898249 - RNA, 17 nt, Homo sapiens
aggcucaauauuccuga

SEQ ID NO: 898250 - RNA, 19 nt, Homo sapiens
aggcucagccacacaggaa

SEQ ID NO: 898251 - RNA, 12 nt, Homo sapiens
aggcucuucucc

SEQ ID NO: 898252 - RNA, 16 nt, Homo sapiens
aggcugaccaagagag

SEQ ID NO: 898253 - RNA, 18 nt, Homo sapiens
aggcugaggcaggaggau

SEQ ID NO: 898254 - RNA, 20 nt, Homo sapiens
aggcugcagcgagcuaugau

SEQ ID NO: 898255 - RNA, 18 nt, Homo sapiens
aggcugcccugaacaaaa

SEQ ID NO: 898256 - RNA, 14 nt, Homo sapiens
aggcugcucuugaa

SEQ ID NO: 898257 - RNA, 20 nt, Homo sapiens
aggcuggagauccuaacuga

SEQ ID NO: 898258 - RNA, 18 nt, Homo sapiens
aggcuggagcccagcauu

SEQ ID NO: 898259 - RNA, 17 nt, Homo sapiens
aggcuggaguacaguga

SEQ ID NO: 898260 - RNA, 21 nt, Homo sapiens
aggcuggcagauuuccaaaag

SEQ ID NO: 898261 - RNA, 16 nt, Homo sapiens
aggcuguacacugcac

SEQ ID NO: 898262 - RNA, 20 nt, Homo sapiens
aggcugucgugagcuaugau

SEQ ID NO: 898263 - RNA, 15 nt, Homo sapiens
aggcuucacccugaa

SEQ ID NO: 898264 - RNA, 14 nt, Homo sapiens
agggaaagccagaa

SEQ ID NO: 898265 - RNA, 19 nt, Homo sapiens
agggaaccgugauaagccu

SEQ ID NO: 898266 - RNA, 20 nt, Homo sapiens
agggaagagugcauuuuccc

SEQ ID NO: 898267 - RNA, 23 nt, Homo sapiens
agggaagcuguuugugugucugg

SEQ ID NO: 898268 - RNA, 17 nt, Homo sapiens
agggaaggguuugccaa

SEQ ID NO: 898269 - RNA, 17 nt, Homo sapiens
agggacaaaacacugug

SEQ ID NO: 898270 - RNA, 16 nt, Homo sapiens
agggacgaucuuugaa

SEQ ID NO: 898271 - RNA, 14 nt, Homo sapiens
agggagaagggaug

SEQ ID NO: 898272 - RNA, 13 nt, Homo sapiens
agggagccuggaa

SEQ ID NO: 898273 - RNA, 22 nt, Homo sapiens
agggagcucacucccacuggaa

SEQ ID NO: 898274 - RNA, 14 nt, Homo sapiens
agggaguugcucac

SEQ ID NO: 898275 - RNA, 23 nt, Homo sapiens
agggaugccaacaccuucuuggc

SEQ ID NO: 898276 - RNA, 17 nt, Homo sapiens
agggcaacccaccaucu

SEQ ID NO: 898277 - RNA, 16 nt, Homo sapiens
agcacugcuccagugg

SEQ ID NO: 898278 - RNA, 23 nt, Homo sapiens
agcacugcuguguccgcuuucau

SEQ ID NO: 898279 - RNA, 12 nt, Homo sapiens
agcacuggguug

SEQ ID NO: 898280 - RNA, 21 nt, Homo sapiens
agcacuguuggagcuacugca

SEQ ID NO: 898281 - RNA, 16 nt, Homo sapiens
agcacuguuucucuca

SEQ ID NO: 898282 - RNA, 16 nt, Homo sapiens
agcacuuaauaauugc

SEQ ID NO: 898283 - RNA, 23 nt, Homo sapiens
agcacuuuaacccucucuucccu

SEQ ID NO: 898284 - RNA, 13 nt, Homo sapiens
agcagaaagccag

SEQ ID NO: 898285 - RNA, 13 nt, Homo sapiens
agcagaaccaaag

SEQ ID NO: 898286 - RNA, 17 nt, Homo sapiens
agcagaaugaagaccua

SEQ ID NO: 898287 - RNA, 12 nt, Homo sapiens
agcagacacugc

SEQ ID NO: 898288 - RNA, 15 nt, Homo sapiens
agcagaggaguccag

SEQ ID NO: 898289 - RNA, 18 nt, Homo sapiens
agcagauaaagacagcug

SEQ ID NO: 898290 - RNA, 14 nt, Homo sapiens
agcagauacuuugu

SEQ ID NO: 898291 - RNA, 16 nt, Homo sapiens
agcagaugguccucca

SEQ ID NO: 898292 - RNA, 16 nt, Homo sapiens
agcagcacaugguguu

SEQ ID NO: 898293 - RNA, 15 nt, Homo sapiens
agcagccacuugacu

SEQ ID NO: 898294 - RNA, 21 nt, Homo sapiens
agcagcccuaaggaucucuca

SEQ ID NO: 898295 - RNA, 21 nt, Homo sapiens
agcagcucuuccccuuuccug

SEQ ID NO: 898296 - RNA, 12 nt, Homo sapiens
agcagcugagca

SEQ ID NO: 898297 - RNA, 14 nt, Homo sapiens
agcaggaacagaga

SEQ ID NO: 898298 - RNA, 13 nt, Homo sapiens
agcagggacaccc

SEQ ID NO: 898299 - RNA, 19 nt, Homo sapiens
agcaggguucugaggcaaa

SEQ ID NO: 898300 - RNA, 14 nt, Homo sapiens
agcagguggcagaa

SEQ ID NO: 898301 - RNA, 19 nt, Homo sapiens
agcaggugguccugagacc

SEQ ID NO: 898302 - RNA, 20 nt, Homo sapiens
agcaguaaacuuucucugca

SEQ ID NO: 898303 - RNA, 13 nt, Homo sapiens
agcaguaagcuau

SEQ ID NO: 898304 - RNA, 19 nt, Homo sapiens
agcaguaagcuaucuucaa

SEQ ID NO: 898305 - RNA, 21 nt, Homo sapiens
agcagugugucaggugcugca

SEQ ID NO: 898306 - RNA, 21 nt, Homo sapiens
agcaguugaaacaagaagcca

SEQ ID NO: 898307 - RNA, 14 nt, Homo sapiens
agcaguugugucag

SEQ ID NO: 898308 - RNA, 19 nt, Homo sapiens
agcaguuguuauuuaguga

SEQ ID NO: 898309 - RNA, 22 nt, Homo sapiens
agcaguuugcuuuguaugcacu

SEQ ID NO: 898310 - RNA, 21 nt, Homo sapiens
agcauaaugcucccaucuccu

SEQ ID NO: 898311 - RNA, 19 nt, Homo sapiens
agcauaauucggaagggaa

SEQ ID NO: 898312 - RNA, 18 nt, Homo sapiens
agcauaccuuggacugac

SEQ ID NO: 898313 - RNA, 14 nt, Homo sapiens
agcaucaaagcacu

SEQ ID NO: 898314 - RNA, 23 nt, Homo sapiens
agcaucauuguaaauuauuucau

SEQ ID NO: 898315 - RNA, 13 nt, Homo sapiens
agcaucugacuca

SEQ ID NO: 898316 - RNA, 19 nt, Homo sapiens
agcaucugacucacaagaa

SEQ ID NO: 898317 - RNA, 15 nt, Homo sapiens
agcaucugagcuccu

SEQ ID NO: 898318 - RNA, 17 nt, Homo sapiens
agcaugaagacccugga

SEQ ID NO: 898319 - RNA, 17 nt, Homo sapiens
agcaugacuauuuccac

SEQ ID NO: 898320 - RNA, 11 nt, Homo sapiens
agcauggaaaa

SEQ ID NO: 898321 - RNA, 16 nt, Homo sapiens
agcauggacucugggu

SEQ ID NO: 898322 - RNA, 17 nt, Homo sapiens
agcauggagagccucuu

SEQ ID NO: 898323 - RNA, 20 nt, Homo sapiens
agcaugggacugugccuuug

SEQ ID NO: 898324 - RNA, 23 nt, Homo sapiens
agaacaaaccucuauauguugcu

SEQ ID NO: 898325 - RNA, 15 nt, Homo sapiens
agaacaacuacugug

SEQ ID NO: 898326 - RNA, 12 nt, Homo sapiens
agaacagccgcu

SEQ ID NO: 898327 - RNA, 13 nt, Homo sapiens
agaacaguuugua

SEQ ID NO: 898328 - RNA, 14 nt, Homo sapiens
agaaccaagcuuca

SEQ ID NO: 898329 - RNA, 21 nt, Homo sapiens
agaaccaagcuucagagccua

SEQ ID NO: 898330 - RNA, 17 nt, Homo sapiens
agaaccacuuggcugcu

SEQ ID NO: 898331 - RNA, 13 nt, Homo sapiens
agaaccauuacaa

SEQ ID NO: 898332 - RNA, 18 nt, Homo sapiens
agaacccccacauuuacc

SEQ ID NO: 898333 - RNA, 13 nt, Homo sapiens
agaaccuagaagg

SEQ ID NO: 898334 - RNA, 11 nt, Homo sapiens
agaaccucagg

SEQ ID NO: 898335 - RNA, 12 nt, Homo sapiens
agaaccucaggc

SEQ ID NO: 898336 - RNA, 15 nt, Homo sapiens
agaaccugugcucua

SEQ ID NO: 898337 - RNA, 12 nt, Homo sapiens
agaacucuccau

SEQ ID NO: 898338 - RNA, 18 nt, Homo sapiens
agaacucugggcugcuac

SEQ ID NO: 898339 - RNA, 21 nt, Homo sapiens
agaagaaaaaguugcagucuc

SEQ ID NO: 898340 - RNA, 22 nt, Homo sapiens
agaagaaaaaguugcagucuca

SEQ ID NO: 898341 - RNA, 21 nt, Homo sapiens
agaagaaaacgaacugggaaa

SEQ ID NO: 898342 - RNA, 21 nt, Homo sapiens
agaagaaguuuaaaaaaccau

SEQ ID NO: 898343 - RNA, 18 nt, Homo sapiens
agaagacaacauuucuca

SEQ ID NO: 898344 - RNA, 19 nt, Homo sapiens
agaagacaacauuucucaa

SEQ ID NO: 898345 - RNA, 19 nt, Homo sapiens
agaagacacugaugggcaa

SEQ ID NO: 898346 - RNA, 13 nt, Homo sapiens
agaagacuggaag

SEQ ID NO: 898347 - RNA, 12 nt, Homo sapiens
agaagacugggc

SEQ ID NO: 898348 - RNA, 14 nt, Homo sapiens
agaagagacaggag

SEQ ID NO: 898349 - RNA, 14 nt, Homo sapiens
agaagagcuguuca

SEQ ID NO: 898350 - RNA, 19 nt, Homo sapiens
agaagaggcuggugcugug

SEQ ID NO: 898351 - RNA, 23 nt, Homo sapiens
agaagauuacguuuuacaaugua

SEQ ID NO: 898352 - RNA, 18 nt, Homo sapiens
agaagcaaaaucuaccag

SEQ ID NO: 898353 - RNA, 16 nt, Homo sapiens
agaagcacauaugaac

SEQ ID NO: 898354 - RNA, 16 nt, Homo sapiens
agaagcagaaacuggc

SEQ ID NO: 898355 - RNA, 18 nt, Homo sapiens
agaagccaaaauacuucu

SEQ ID NO: 898356 - RNA, 22 nt, Homo sapiens
agaagccggcucuucaaagaca

SEQ ID NO: 898357 - RNA, 15 nt, Homo sapiens
agaagcggcggguca

SEQ ID NO: 898358 - RNA, 22 nt, Homo sapiens
agaaggauggcauuuuuugcaa

SEQ ID NO: 898359 - RNA, 14 nt, Homo sapiens
agaaggcaagcacc

SEQ ID NO: 898360 - RNA, 17 nt, Homo sapiens
agaaggcuggggccagu

SEQ ID NO: 898361 - RNA, 22 nt, Homo sapiens
agaaggguaccuugaacacugg

SEQ ID NO: 898362 - RNA, 16 nt, Homo sapiens
agaagguggacagauu

SEQ ID NO: 898363 - RNA, 21 nt, Homo sapiens
agaaguaggggaagacaugca

SEQ ID NO: 898364 - RNA, 22 nt, Homo sapiens
agaaguauccaauuaugugaca

SEQ ID NO: 898365 - RNA, 20 nt, Homo sapiens
agaagucccucccaucucua

SEQ ID NO: 898366 - RNA, 13 nt, Homo sapiens
agaagucuugucu

SEQ ID NO: 898367 - RNA, 13 nt, Homo sapiens
agaaguuccucaa

SEQ ID NO: 898368 - RNA, 22 nt, Homo sapiens
agaaguucuggcugaacacugg

SEQ ID NO: 898369 - RNA, 19 nt, Homo sapiens
agaauauacaaauagcaaa

SEQ ID NO: 898370 - RNA, 12 nt, Homo sapiens
agaaucaauaaa

SEQ ID NO: 898371 - RNA, 13 nt, Homo sapiens
agaaucagucuug

SEQ ID NO: 898372 - RNA, 19 nt, Homo sapiens
agaaucauugaaguauuuu

SEQ ID NO: 898373 - RNA, 14 nt, Homo sapiens
agaaucugcagcua

SEQ ID NO: 898374 - RNA, 21 nt, Homo sapiens
agaaucugcagcuaacuuauu

SEQ ID NO: 898375 - RNA, 15 nt, Homo sapiens
agaaugaagacuguu

SEQ ID NO: 898376 - RNA, 20 nt, Homo sapiens
agaaugcaagaguggacuga

SEQ ID NO: 898377 - RNA, 21 nt, Homo sapiens
agaaugccucugcugugggcu

SEQ ID NO: 898378 - RNA, 22 nt, Homo sapiens
agaauggaugugcucacugggg

SEQ ID NO: 898379 - RNA, 15 nt, Homo sapiens
agaaugguagcacua

SEQ ID NO: 898380 - RNA, 17 nt, Homo sapiens
agaaugugauauuugaa

SEQ ID NO: 898381 - RNA, 22 nt, Homo sapiens
agaauuccugaagccagaucca

SEQ ID NO: 898382 - RNA, 14 nt, Homo sapiens
agaauuguaucauu

SEQ ID NO: 898383 - RNA, 18 nt, Homo sapiens
agaauuuggauacacucu

SEQ ID NO: 898384 - RNA, 13 nt, Homo sapiens
agacaaaggcucu

SEQ ID NO: 898385 - RNA, 21 nt, Homo sapiens
agacaaaggcucuacacauac

SEQ ID NO: 898386 - RNA, 15 nt, Homo sapiens
agacaacauuucuca

SEQ ID NO: 898387 - RNA, 18 nt, Homo sapiens
agacaaguaaucacuaac

SEQ ID NO: 898388 - RNA, 12 nt, Homo sapiens
agacaauggcca

SEQ ID NO: 898389 - RNA, 18 nt, Homo sapiens
agacaccgcgcaucucuu

SEQ ID NO: 898390 - RNA, 15 nt, Homo sapiens
agacaccugccuuaa

SEQ ID NO: 898391 - RNA, 14 nt, Homo sapiens
agaggcgcccuccc

SEQ ID NO: 898392 - RNA, 11 nt, Homo sapiens
agaggcucagc

SEQ ID NO: 898393 - RNA, 16 nt, Homo sapiens
agaggcugcaaggauu

SEQ ID NO: 898394 - RNA, 16 nt, Homo sapiens
agaggcugugguggcu

SEQ ID NO: 898395 - RNA, 20 nt, Homo sapiens
agaggcuuccuucauuuccu

SEQ ID NO: 898396 - RNA, 14 nt, Homo sapiens
agagggcccaggca

SEQ ID NO: 898397 - RNA, 13 nt, Homo sapiens
agaggggaaaaug

SEQ ID NO: 898398 - RNA, 23 nt, Homo sapiens
agagguaauuuuuuuguguagca

SEQ ID NO: 898399 - RNA, 14 nt, Homo sapiens
agagguuaucugcc

SEQ ID NO: 898400 - RNA, 13 nt, Homo sapiens
agagguuucuuga

SEQ ID NO: 898401 - RNA, 14 nt, Homo sapiens
agagguuucuugaa

SEQ ID NO: 898402 - RNA, 15 nt, Homo sapiens
agagguuucuugaau

SEQ ID NO: 898403 - RNA, 15 nt, Homo sapiens
agagucauuguuaca

SEQ ID NO: 898404 - RNA, 13 nt, Homo sapiens
agaguccucugga

SEQ ID NO: 898405 - RNA, 16 nt, Homo sapiens
agagucuuaauauaua

SEQ ID NO: 898406 - RNA, 16 nt, Homo sapiens
agagugagagggcaug

SEQ ID NO: 898407 - RNA, 21 nt, Homo sapiens
agagugccguaacaacugugg

SEQ ID NO: 898408 - RNA, 17 nt, Homo sapiens
agagugugaaacuuccu

SEQ ID NO: 898409 - RNA, 22 nt, Homo sapiens
agagugugcuugucaucugcca

SEQ ID NO: 898410 - RNA, 19 nt, Homo sapiens
agaguuaagugaaugucua

SEQ ID NO: 898411 - RNA, 20 nt, Homo sapiens
agaguuauucaaaugaaggu

SEQ ID NO: 898412 - RNA, 12 nt, Homo sapiens
agaguuugcaaa

SEQ ID NO: 898413 - RNA, 19 nt, Homo sapiens
agauaaauagaguuccaaa

SEQ ID NO: 898414 - RNA, 23 nt, Homo sapiens
agauaacaagaucuuucaggaaa

SEQ ID NO: 898415 - RNA, 16 nt, Homo sapiens
agauaauaucugugag

SEQ ID NO: 898416 - RNA, 21 nt, Homo sapiens
agauacuggcgccagggccaa

SEQ ID NO: 898417 - RNA, 17 nt, Homo sapiens
agauacuguugaucuuu

SEQ ID NO: 898418 - RNA, 19 nt, Homo sapiens
agauacuuugucagcaaua

SEQ ID NO: 898419 - RNA, 18 nt, Homo sapiens
agauagguacuauuaucc

SEQ ID NO: 898420 - RNA, 20 nt, Homo sapiens
agauaguagcauacauuuau

SEQ ID NO: 898421 - RNA, 15 nt, Homo sapiens
agauauacacaugga

SEQ ID NO: 898422 - RNA, 16 nt, Homo sapiens
agauauacacauggau

SEQ ID NO: 898423 - RNA, 18 nt, Homo sapiens
agauaucacuuacucagu

SEQ ID NO: 898424 - RNA, 20 nt, Homo sapiens
agauaucacuuacucaguua

SEQ ID NO: 898425 - RNA, 15 nt, Homo sapiens
agauaucucaucucu

SEQ ID NO: 898426 - RNA, 12 nt, Homo sapiens
agauaugcacac

SEQ ID NO: 898427 - RNA, 20 nt, Homo sapiens
agauaugcacacacacggau

SEQ ID NO: 898428 - RNA, 20 nt, Homo sapiens
agauaugcacacacauggau

SEQ ID NO: 898429 - RNA, 15 nt, Homo sapiens
agaucacgccacugc

SEQ ID NO: 898430 - RNA, 20 nt, Homo sapiens
agaucauccagaaguuccuc

SEQ ID NO: 898431 - RNA, 22 nt, Homo sapiens
agaucccgugaaauugaugcca

SEQ ID NO: 898432 - RNA, 16 nt, Homo sapiens
agauccuacucuuccu

SEQ ID NO: 898433 - RNA, 15 nt, Homo sapiens
agaucuaauaccauc

SEQ ID NO: 898434 - RNA, 23 nt, Homo sapiens
agaucugcuucuucaucuugaca

SEQ ID NO: 898435 - RNA, 18 nt, Homo sapiens
agaugaaauuuauuucca

SEQ ID NO: 898436 - RNA, 13 nt, Homo sapiens
agaugaccugcug

SEQ ID NO: 898437 - RNA, 13 nt, Homo sapiens
agaugagauuccc

SEQ ID NO: 898438 - RNA, 20 nt, Homo sapiens
agaugcugacuguacuccuc

SEQ ID NO: 898439 - RNA, 21 nt, Homo sapiens
aauucuuuucuuuuccauuua

SEQ ID NO: 898440 - RNA, 14 nt, Homo sapiens
aauugaacuaacaa

SEQ ID NO: 898441 - RNA, 14 nt, Homo sapiens
aauugaacuacuug

SEQ ID NO: 898442 - RNA, 18 nt, Homo sapiens
aauugacugagacuggaa

SEQ ID NO: 898443 - RNA, 23 nt, Homo sapiens
aauugauguugcuggacugucau

SEQ ID NO: 898444 - RNA, 13 nt, Homo sapiens
aauugauuauucu

SEQ ID NO: 898445 - RNA, 11 nt, Homo sapiens
aauugauucaa

SEQ ID NO: 898446 - RNA, 19 nt, Homo sapiens
aauugcauacuacucucaa

SEQ ID NO: 898447 - RNA, 15 nt, Homo sapiens
aauugcucaaugcau

SEQ ID NO: 898448 - RNA, 14 nt, Homo sapiens
aauuggguuuuaaa

SEQ ID NO: 898449 - RNA, 15 nt, Homo sapiens
aauugucaaauguca

SEQ ID NO: 898450 - RNA, 16 nt, Homo sapiens
aauugucuuuugucau

SEQ ID NO: 898451 - RNA, 20 nt, Homo sapiens
aauugucuuuugucaugugg

SEQ ID NO: 898452 - RNA, 15 nt, Homo sapiens
aauuguuuggggaug

SEQ ID NO: 898453 - RNA, 17 nt, Homo sapiens
aauuuaaaccagcagaa

SEQ ID NO: 898454 - RNA, 13 nt, Homo sapiens
aauuuaaccuacu

SEQ ID NO: 898455 - RNA, 15 nt, Homo sapiens
aauuuaauauagcua

SEQ ID NO: 898456 - RNA, 17 nt, Homo sapiens
aauuuagaaaacauuca

SEQ ID NO: 898457 - RNA, 15 nt, Homo sapiens
aauuuagucacacca

SEQ ID NO: 898458 - RNA, 14 nt, Homo sapiens
aauuuauauuuucc

SEQ ID NO: 898459 - RNA, 14 nt, Homo sapiens
aauuuaucaucucg

SEQ ID NO: 898460 - RNA, 20 nt, Homo sapiens
aauuuaucuugucucugggc

SEQ ID NO: 898461 - RNA, 18 nt, Homo sapiens
aauuuauuaaaaugauug

SEQ ID NO: 898462 - RNA, 23 nt, Homo sapiens
aauuucacauuaauauuugcuga

SEQ ID NO: 898463 - RNA, 15 nt, Homo sapiens
aauuucaguaaacaa

SEQ ID NO: 898464 - RNA, 20 nt, Homo sapiens
aauuucaguaaacaaugaau

SEQ ID NO: 898465 - RNA, 16 nt, Homo sapiens
aauuucauaccuauca

SEQ ID NO: 898466 - RNA, 20 nt, Homo sapiens
aauuucauaccuaucaucuu

SEQ ID NO: 898467 - RNA, 21 nt, Homo sapiens
aauuucauaccuaucaucuua

SEQ ID NO: 898468 - RNA, 15 nt, Homo sapiens
aauuuccaguaccuu

SEQ ID NO: 898469 - RNA, 23 nt, Homo sapiens
aauuucugaacaccauagguaga

SEQ ID NO: 898470 - RNA, 14 nt, Homo sapiens
aauuucuuugucau

SEQ ID NO: 898471 - RNA, 22 nt, Homo sapiens
aauuugaaaacauaaucugcaa

SEQ ID NO: 898472 - RNA, 19 nt, Homo sapiens
aauuugacucaugaacuau

SEQ ID NO: 898473 - RNA, 20 nt, Homo sapiens
aauuugauacaaaaugcuga

SEQ ID NO: 898474 - RNA, 17 nt, Homo sapiens
aauuugauacugaccuu

SEQ ID NO: 898475 - RNA, 21 nt, Homo sapiens
aauuugauguuuacaggugga

SEQ ID NO: 898476 - RNA, 18 nt, Homo sapiens
aauuuggagacucugugg

SEQ ID NO: 898477 - RNA, 23 nt, Homo sapiens
aauuuggauuuacgacugaagaa

SEQ ID NO: 898478 - RNA, 18 nt, Homo sapiens
aauuugggggacuuacau

SEQ ID NO: 898479 - RNA, 14 nt, Homo sapiens
aauuuuaaauguuc

SEQ ID NO: 898480 - RNA, 14 nt, Homo sapiens
aauuuuaacauuuu

SEQ ID NO: 898481 - RNA, 15 nt, Homo sapiens
aauuuuaaguuauuu

SEQ ID NO: 898482 - RNA, 13 nt, Homo sapiens
aauuuuaauugaa

SEQ ID NO: 898483 - RNA, 14 nt, Homo sapiens
aauuuuauaaucau

SEQ ID NO: 898484 - RNA, 20 nt, Homo sapiens
aauuuuccagggcucaaaaa

SEQ ID NO: 898485 - RNA, 15 nt, Homo sapiens
aauuuucuaugcuua

SEQ ID NO: 898486 - RNA, 14 nt, Homo sapiens
aauuuugcauugug

SEQ ID NO: 898487 - RNA, 14 nt, Homo sapiens
aauuuuuccaugaa

SEQ ID NO: 898488 - RNA, 13 nt, Homo sapiens
aauuuuuccugca

SEQ ID NO: 898489 - RNA, 14 nt, Homo sapiens
acaaaaaaaccaca

SEQ ID NO: 898490 - RNA, 21 nt, Homo sapiens
acaaaaaauuugagaaagccu

SEQ ID NO: 898491 - RNA, 17 nt, Homo sapiens
acaaaaaggcauaugca

SEQ ID NO: 898492 - RNA, 14 nt, Homo sapiens
acaaaacacugugu

SEQ ID NO: 898493 - RNA, 15 nt, Homo sapiens
acaaaagcccaaugu

SEQ ID NO: 898494 - RNA, 12 nt, Homo sapiens
acaaaauaauuu

SEQ ID NO: 898495 - RNA, 18 nt, Homo sapiens
acaaaaugucacacuugu

SEQ ID NO: 898496 - RNA, 23 nt, Homo sapiens
acaaaauuagcugaagaaguuau

SEQ ID NO: 898497 - RNA, 14 nt, Homo sapiens
acaaacaagcacag

SEQ ID NO: 898498 - RNA, 22 nt, Homo sapiens
acaaacauaucaaacauaugua

SEQ ID NO: 898499 - RNA, 23 nt, Homo sapiens
acaaaccacaacugacacaggaa

SEQ ID NO: 898500 - RNA, 11 nt, Homo sapiens
acaaaccaccc

SEQ ID NO: 898501 - RNA, 14 nt, Homo sapiens
acaaaccacuguac

SEQ ID NO: 898502 - RNA, 17 nt, Homo sapiens
acaaaccacuguacaua

SEQ ID NO: 898503 - RNA, 14 nt, Homo sapiens
acaaagaaauauua

SEQ ID NO: 898504 - RNA, 17 nt, Homo sapiens
acaaagaugaccugcug

SEQ ID NO: 898505 - RNA, 21 nt, Homo sapiens
acaaagcaaagccacauuuug

SEQ ID NO: 898506 - RNA, 15 nt, Homo sapiens
acaaagcccuuccau

SEQ ID NO: 898507 - RNA, 23 nt, Homo sapiens
acaaagggaaggcugcuguguag

SEQ ID NO: 898508 - RNA, 12 nt, Homo sapiens
acaaagugagac

SEQ ID NO: 898509 - RNA, 16 nt, Homo sapiens
acaaauaaaaaauuca

SEQ ID NO: 898510 - RNA, 20 nt, Homo sapiens
acaaauacugccuaguguau

SEQ ID NO: 898511 - RNA, 22 nt, Homo sapiens
acaaaucaccauguaacaacca

SEQ ID NO: 898512 - RNA, 16 nt, Homo sapiens
acaaauucaagccuua

SEQ ID NO: 898513 - RNA, 15 nt, Homo sapiens
acaaauucuacagca

SEQ ID NO: 898514 - RNA, 13 nt, Homo sapiens
acaacaaaccaaa

SEQ ID NO: 898515 - RNA, 14 nt, Homo sapiens
acaacagaagucau

SEQ ID NO: 898516 - RNA, 23 nt, Homo sapiens
acaacagcaaaacuccaucucaa

SEQ ID NO: 898517 - RNA, 19 nt, Homo sapiens
acaacaugcgaccgugacc

SEQ ID NO: 898518 - RNA, 13 nt, Homo sapiens
acaaccaugccag

SEQ ID NO: 898519 - RNA, 13 nt, Homo sapiens
acaacuaccuccu

SEQ ID NO: 898520 - RNA, 18 nt, Homo sapiens
acaacuguggucaauccg

SEQ ID NO: 898521 - RNA, 13 nt, Homo sapiens
acaacuucuuugu

SEQ ID NO: 898522 - RNA, 18 nt, Homo sapiens
acaacuugucuauuaccu

SEQ ID NO: 898523 - RNA, 14 nt, Homo sapiens
acaagaaccugcua

SEQ ID NO: 898524 - RNA, 19 nt, Homo sapiens
acaagaaccugcuaaggcu

SEQ ID NO: 898525 - RNA, 12 nt, Homo sapiens
acaagaagccac

SEQ ID NO: 898526 - RNA, 19 nt, Homo sapiens
acaagaaggccacugguag

SEQ ID NO: 898527 - RNA, 16 nt, Homo sapiens
acaagaaucaccucaa

SEQ ID NO: 898528 - RNA, 19 nt, Homo sapiens
acaagagcugcuguccuuu

SEQ ID NO: 898529 - RNA, 18 nt, Homo sapiens
acaagaguugucuugucc

SEQ ID NO: 898530 - RNA, 17 nt, Homo sapiens
acaagauaacugagaau

SEQ ID NO: 898531 - RNA, 20 nt, Homo sapiens
acaagauuaccccaccuugc

SEQ ID NO: 898532 - RNA, 20 nt, Homo sapiens
acaagcaagggcugugcuga

SEQ ID NO: 898533 - RNA, 11 nt, Homo sapiens
acaagcacaga

SEQ ID NO: 898534 - RNA, 21 nt, Homo sapiens
acaagcauuugcccuguggau

SEQ ID NO: 898535 - RNA, 17 nt, Homo sapiens
acaagccaacuuguaaa

SEQ ID NO: 898536 - RNA, 20 nt, Homo sapiens
acaagcgugagccacugcac

SEQ ID NO: 898537 - RNA, 14 nt, Homo sapiens
acaaggaaccaccg

SEQ ID NO: 898538 - RNA, 18 nt, Homo sapiens
acaaggaucagaauggaa

SEQ ID NO: 898539 - RNA, 20 nt, Homo sapiens
acaagguucccucugagaau

SEQ ID NO: 898540 - RNA, 22 nt, Homo sapiens
acaaguauucauuuuuucuacc

SEQ ID NO: 898541 - RNA, 16 nt, Homo sapiens
acaagugcacuugaac

SEQ ID NO: 898542 - RNA, 22 nt, Homo sapiens
acaauaaaugcugaaugaaucc

SEQ ID NO: 898543 - RNA, 12 nt, Homo sapiens
acaauacaacaa

SEQ ID NO: 898544 - RNA, 18 nt, Homo sapiens
acaauagugauugauaga

SEQ ID NO: 898545 - RNA, 20 nt, Homo sapiens
acaauaucuucauacaauga

SEQ ID NO: 898546 - RNA, 13 nt, Homo sapiens
acaaucacacuca

SEQ ID NO: 898547 - RNA, 17 nt, Homo sapiens
acaaugccuugggagag

SEQ ID NO: 898548 - RNA, 17 nt, Homo sapiens
acaauggagugggagau

SEQ ID NO: 898549 - RNA, 21 nt, Homo sapiens
acaauggcuaauucccagagu

SEQ ID NO: 898550 - RNA, 15 nt, Homo sapiens
acaauguauuuguca

SEQ ID NO: 898551 - RNA, 15 nt, Homo sapiens
acaauuucauucagu

SEQ ID NO: 898552 - RNA, 13 nt, Homo sapiens
acacaaggcacgu

SEQ ID NO: 898553 - RNA, 15 nt, Homo sapiens
acacacacagaugca

SEQ ID NO: 898554 - RNA, 19 nt, Homo sapiens
acacacagagauaugcaca

SEQ ID NO: 898555 - RNA, 14 nt, Homo sapiens
aaucgugucuucaa

SEQ ID NO: 898556 - RNA, 23 nt, Homo sapiens
aaucuauauuggaaucuguauca

SEQ ID NO: 898557 - RNA, 16 nt, Homo sapiens
aaucucaucucaguga

SEQ ID NO: 898558 - RNA, 14 nt, Homo sapiens
aaucucauucccag

SEQ ID NO: 898559 - RNA, 16 nt, Homo sapiens
aaucucucuccuguau

SEQ ID NO: 898560 - RNA, 12 nt, Homo sapiens
aaucucuugucu

SEQ ID NO: 898561 - RNA, 16 nt, Homo sapiens
aaucucuugucucaca

SEQ ID NO: 898562 - RNA, 13 nt, Homo sapiens
aaucugcacugug

SEQ ID NO: 898563 - RNA, 18 nt, Homo sapiens
aaucugccauaaagccau

SEQ ID NO: 898564 - RNA, 23 nt, Homo sapiens
aaucugccuaggguccuguccau

SEQ ID NO: 898565 - RNA, 19 nt, Homo sapiens
aaucuuaauucaacuagua

SEQ ID NO: 898566 - RNA, 15 nt, Homo sapiens
aaucuuacuuuguau

SEQ ID NO: 898567 - RNA, 16 nt, Homo sapiens
aaucuuccagcaugca

SEQ ID NO: 898568 - RNA, 16 nt, Homo sapiens
aaucuucuuaugcaau

SEQ ID NO: 898569 - RNA, 19 nt, Homo sapiens
aaucuuguuaaauugcuua

SEQ ID NO: 898570 - RNA, 20 nt, Homo sapiens
aaucuuguuaaauugcuuau

SEQ ID NO: 898571 - RNA, 19 nt, Homo sapiens
aaucuuuggguaacuucaa

SEQ ID NO: 898572 - RNA, 20 nt, Homo sapiens
aaucuuuggguaacuucaaa

SEQ ID NO: 898573 - RNA, 16 nt, Homo sapiens
aaugaagacccagugu

SEQ ID NO: 898574 - RNA, 19 nt, Homo sapiens
aaugaagacccaguguaaa

SEQ ID NO: 898575 - RNA, 21 nt, Homo sapiens
aaugaagguuaggauuuaaca

SEQ ID NO: 898576 - RNA, 17 nt, Homo sapiens
aaugaaucuuacuccuu

SEQ ID NO: 898577 - RNA, 16 nt, Homo sapiens
aaugaaugcuauugaa

SEQ ID NO: 898578 - RNA, 11 nt, Homo sapiens
aaugaauuuau

SEQ ID NO: 898579 - RNA, 12 nt, Homo sapiens
aaugacauauuu

SEQ ID NO: 898580 - RNA, 17 nt, Homo sapiens
aaugacaugcacugacc

SEQ ID NO: 898581 - RNA, 18 nt, Homo sapiens
aaugacaugcacugaccc

SEQ ID NO: 898582 - RNA, 19 nt, Homo sapiens
aaugacauucaguauauaa

SEQ ID NO: 898583 - RNA, 16 nt, Homo sapiens
aaugacccaaagacca

SEQ ID NO: 898584 - RNA, 12 nt, Homo sapiens
aaugaccucagc

SEQ ID NO: 898585 - RNA, 20 nt, Homo sapiens
aaugacuuugaaaaccuggc

SEQ ID NO: 898586 - RNA, 16 nt, Homo sapiens
aaugagacuugcucuc

SEQ ID NO: 898587 - RNA, 16 nt, Homo sapiens
aaugagggccaagaaa

SEQ ID NO: 898588 - RNA, 17 nt, Homo sapiens
aaugaguuuauauggaa

SEQ ID NO: 898589 - RNA, 16 nt, Homo sapiens
aaugaucauaagucua

SEQ ID NO: 898590 - RNA, 15 nt, Homo sapiens
aaugaugggacaaua

SEQ ID NO: 898591 - RNA, 14 nt, Homo sapiens
aaugauuaucuccu

SEQ ID NO: 898592 - RNA, 19 nt, Homo sapiens
aaugauuuagguacgucaa

SEQ ID NO: 898593 - RNA, 14 nt, Homo sapiens
aaugcaaaaaaucu

SEQ ID NO: 898594 - RNA, 18 nt, Homo sapiens
aaugcacgcacacaucag

SEQ ID NO: 898595 - RNA, 11 nt, Homo sapiens
aaugcacugug

SEQ ID NO: 898596 - RNA, 12 nt, Homo sapiens
aaugcacuguga

SEQ ID NO: 898597 - RNA, 20 nt, Homo sapiens
aaugcaguagccagcacguu

SEQ ID NO: 898598 - RNA, 16 nt, Homo sapiens
aaugcauauacuuuaa

SEQ ID NO: 898599 - RNA, 24 nt, Homo sapiens
aaugcaugauuuuauacauaguca

SEQ ID NO: 898600 - RNA, 14 nt, Homo sapiens
aaugcauggugcag

SEQ ID NO: 898601 - RNA, 14 nt, Homo sapiens
aaugcauguccuca

SEQ ID NO: 898602 - RNA, 22 nt, Homo sapiens
aaugccagagacggaagccuuu

SEQ ID NO: 898603 - RNA, 15 nt, Homo sapiens
aaugccaucacugga

SEQ ID NO: 898604 - RNA, 18 nt, Homo sapiens
aaugccuauaaaaugccc

SEQ ID NO: 898605 - RNA, 18 nt, Homo sapiens
aaugccucuucuuuaugu

SEQ ID NO: 898606 - RNA, 19 nt, Homo sapiens
aagagaacauuucuagaaa

SEQ ID NO: 898607 - RNA, 18 nt, Homo sapiens
aagagaccaagacucuga

SEQ ID NO: 898608 - RNA, 21 nt, Homo sapiens
aagagagaaagaaguaggcau

SEQ ID NO: 898609 - RNA, 14 nt, Homo sapiens
aagagaucaggaag

SEQ ID NO: 898610 - RNA, 20 nt, Homo sapiens
aagagaugggauuucaucau

SEQ ID NO: 898611 - RNA, 17 nt, Homo sapiens
aagagcauagaacucaa

SEQ ID NO: 898612 - RNA, 16 nt, Homo sapiens
aagagcccugagcuca

SEQ ID NO: 898613 - RNA, 20 nt, Homo sapiens
aagagcccugagcucaggcu

SEQ ID NO: 898614 - RNA, 14 nt, Homo sapiens
aagagcccugucag

SEQ ID NO: 898615 - RNA, 22 nt, Homo sapiens
aagagcuaaguucuaaguucau

SEQ ID NO: 898616 - RNA, 22 nt, Homo sapiens
aagagcuggcaaagguggcucu

SEQ ID NO: 898617 - RNA, 16 nt, Homo sapiens
aagaggaaaaaaagcc

SEQ ID NO: 898618 - RNA, 23 nt, Homo sapiens
aagaggaggaagguuggaccuuc

SEQ ID NO: 898619 - RNA, 20 nt, Homo sapiens
aagaggaggugguucugaaa

SEQ ID NO: 898620 - RNA, 13 nt, Homo sapiens
aagaggcagugau

SEQ ID NO: 898621 - RNA, 18 nt, Homo sapiens
aagagggccugugggagc

SEQ ID NO: 898622 - RNA, 12 nt, Homo sapiens
aagaggggaaaa

SEQ ID NO: 898623 - RNA, 15 nt, Homo sapiens
aagaggucuccauca

SEQ ID NO: 898624 - RNA, 21 nt, Homo sapiens
aagagugagacuccgucucaa

SEQ ID NO: 898625 - RNA, 15 nt, Homo sapiens
aagagugagagggca

SEQ ID NO: 898626 - RNA, 14 nt, Homo sapiens
aagaguggaaccaa

SEQ ID NO: 898627 - RNA, 16 nt, Homo sapiens
aagauaaaaccagagc

SEQ ID NO: 898628 - RNA, 19 nt, Homo sapiens
aagauaaaauauccucagg

SEQ ID NO: 898629 - RNA, 13 nt, Homo sapiens
aagauacauuuca

SEQ ID NO: 898630 - RNA, 17 nt, Homo sapiens
aagauacauuucaucug

SEQ ID NO: 898631 - RNA, 20 nt, Homo sapiens
aagauacgguugucuagagg

SEQ ID NO: 898632 - RNA, 15 nt, Homo sapiens
aagauccacccucaa

SEQ ID NO: 898633 - RNA, 13 nt, Homo sapiens
aagaucuuugccc

SEQ ID NO: 898634 - RNA, 15 nt, Homo sapiens
aagaucuuugcccuc

SEQ ID NO: 898635 - RNA, 18 nt, Homo sapiens
aagaugagagaacuggag

SEQ ID NO: 898636 - RNA, 16 nt, Homo sapiens
aagaugaugaugaucu

SEQ ID NO: 898637 - RNA, 21 nt, Homo sapiens
aagauggcugugccucugccu

SEQ ID NO: 898638 - RNA, 18 nt, Homo sapiens
aagauggcuuuuucuccu

SEQ ID NO: 898639 - RNA, 22 nt, Homo sapiens
aagauguguugcuauccugaaa

SEQ ID NO: 898640 - RNA, 17 nt, Homo sapiens
aagauuaaaaaguaaaa

SEQ ID NO: 898641 - RNA, 15 nt, Homo sapiens
aagauuauuugcacg

SEQ ID NO: 898642 - RNA, 23 nt, Homo sapiens
aagauuccugguuaaauuugaau

SEQ ID NO: 898643 - RNA, 17 nt, Homo sapiens
aagauucuccugugcua

SEQ ID NO: 898644 - RNA, 19 nt, Homo sapiens
aagauucuguaagaauuaa

SEQ ID NO: 898645 - RNA, 20 nt, Homo sapiens
aagauuuaccauaagggacu

SEQ ID NO: 898646 - RNA, 21 nt, Homo sapiens
aagauuuagcacccuucugcu

SEQ ID NO: 898647 - RNA, 14 nt, Homo sapiens
aagauuuuaccugg

SEQ ID NO: 898648 - RNA, 17 nt, Homo sapiens
aagauuuugccacauuu

SEQ ID NO: 898649 - RNA, 18 nt, Homo sapiens
aagcaaaaccacugagcu

SEQ ID NO: 898650 - RNA, 21 nt, Homo sapiens
aagcaaauagacacagucaua

SEQ ID NO: 898651 - RNA, 17 nt, Homo sapiens
aagcaacagauggauag

SEQ ID NO: 898652 - RNA, 20 nt, Homo sapiens
aagcaacauaaaacaaugaa

SEQ ID NO: 898653 - RNA, 15 nt, Homo sapiens
aagcaacuugcuucu

SEQ ID NO: 898654 - RNA, 18 nt, Homo sapiens
aagcaagacguccuggaa

SEQ ID NO: 898655 - RNA, 22 nt, Homo sapiens
aagcaaucugagagauuugaau

SEQ ID NO: 898656 - RNA, 12 nt, Homo sapiens
aagcacccuguu

SEQ ID NO: 898657 - RNA, 19 nt, Homo sapiens
aacaacuguggucaauccg

SEQ ID NO: 898658 - RNA, 18 nt, Homo sapiens
aacaagaaauuguuucuu

SEQ ID NO: 898659 - RNA, 14 nt, Homo sapiens
aacaagaauuggaa

SEQ ID NO: 898660 - RNA, 16 nt, Homo sapiens
aacaagacacccaagu

SEQ ID NO: 898661 - RNA, 19 nt, Homo sapiens
aacaagaguugucuugucc

SEQ ID NO: 898662 - RNA, 12 nt, Homo sapiens
aacaagaucugc

SEQ ID NO: 898663 - RNA, 22 nt, Homo sapiens
aacaagcauuucccccagggaa

SEQ ID NO: 898664 - RNA, 16 nt, Homo sapiens
aacaagggcagugaga

SEQ ID NO: 898665 - RNA, 19 nt, Homo sapiens
aacaaggugucuuuuccac

SEQ ID NO: 898666 - RNA, 21 nt, Homo sapiens
aacaaguauuuguuaauuuag

SEQ ID NO: 898667 - RNA, 18 nt, Homo sapiens
aacaauaaagacugagac

SEQ ID NO: 898668 - RNA, 11 nt, Homo sapiens
aacaaugccau

SEQ ID NO: 898669 - RNA, 18 nt, Homo sapiens
aacaaugccaucacugga

SEQ ID NO: 898670 - RNA, 22 nt, Homo sapiens
aacaauguaugugaaaguguaa

SEQ ID NO: 898671 - RNA, 21 nt, Homo sapiens
aacaauuguccauggucucaa

SEQ ID NO: 898672 - RNA, 17 nt, Homo sapiens
aacaauuuuuuccccaa

SEQ ID NO: 898673 - RNA, 14 nt, Homo sapiens
aacacaauaugaau

SEQ ID NO: 898674 - RNA, 19 nt, Homo sapiens
aacacacauggaugcacac

SEQ ID NO: 898675 - RNA, 16 nt, Homo sapiens
aacacaccacacuggc

SEQ ID NO: 898676 - RNA, 16 nt, Homo sapiens
aacacaccgaugcaca

SEQ ID NO: 898677 - RNA, 17 nt, Homo sapiens
aacacaccgaugcacac

SEQ ID NO: 898678 - RNA, 16 nt, Homo sapiens
aacacagagcugcuau

SEQ ID NO: 898679 - RNA, 12 nt, Homo sapiens
aacacagccugg

SEQ ID NO: 898680 - RNA, 15 nt, Homo sapiens
aacacauacuagaaa

SEQ ID NO: 898681 - RNA, 22 nt, Homo sapiens
aacaccacuuugucucugagaa

SEQ ID NO: 898682 - RNA, 19 nt, Homo sapiens
aacacccaaagcauggacu

SEQ ID NO: 898683 - RNA, 12 nt, Homo sapiens
aacacccaugaa

SEQ ID NO: 898684 - RNA, 15 nt, Homo sapiens
aacacccaugaauca

SEQ ID NO: 898685 - RNA, 19 nt, Homo sapiens
aacacccgacuccucaaaa

SEQ ID NO: 898686 - RNA, 13 nt, Homo sapiens
aacaccuccuagc

SEQ ID NO: 898687 - RNA, 21 nt, Homo sapiens
aacaccuuuguuuugcacuga

SEQ ID NO: 898688 - RNA, 17 nt, Homo sapiens
aacacggccuacugagc

SEQ ID NO: 898689 - RNA, 19 nt, Homo sapiens
aacacuagaaaacauucca

SEQ ID NO: 898690 - RNA, 22 nt, Homo sapiens
aacacucaacaauaaagacuga

SEQ ID NO: 898691 - RNA, 17 nt, Homo sapiens
aacacucagaagccugg

SEQ ID NO: 898692 - RNA, 22 nt, Homo sapiens
aacacugcaagaagucuugaga

SEQ ID NO: 898693 - RNA, 12 nt, Homo sapiens
aacacugggcug

SEQ ID NO: 898694 - RNA, 17 nt, Homo sapiens
aacagaaagcauccuaa

SEQ ID NO: 898695 - RNA, 20 nt, Homo sapiens
aacagaacauagacagaaga

SEQ ID NO: 898696 - RNA, 14 nt, Homo sapiens
aacagaagcaguug

SEQ ID NO: 898697 - RNA, 15 nt, Homo sapiens
aacagagacucugga

SEQ ID NO: 898698 - RNA, 11 nt, Homo sapiens
aacagagccuu

SEQ ID NO: 898699 - RNA, 15 nt, Homo sapiens
aacagagccuucaca

SEQ ID NO: 898700 - RNA, 20 nt, Homo sapiens
aacagaggaaucuaccugug

SEQ ID NO: 898701 - RNA, 20 nt, Homo sapiens
aacagaggcaggaguggcag

SEQ ID NO: 898702 - RNA, 16 nt, Homo sapiens
aacagcauaacuaaau

SEQ ID NO: 898703 - RNA, 23 nt, Homo sapiens
aacagccaaaacuccacagucaa

SEQ ID NO: 898704 - RNA, 17 nt, Homo sapiens
aacagccaacagguggc

SEQ ID NO: 898705 - RNA, 23 nt, Homo sapiens
aacagcccauuuuaucuuugaau

SEQ ID NO: 898706 - RNA, 16 nt, Homo sapiens
aacaggaaaccacuua

SEQ ID NO: 898707 - RNA, 22 nt, Homo sapiens
aacaggagcucuuaacuacagu

SEQ ID NO: 898708 - RNA, 15 nt, Homo sapiens
aacaggggccaaacu

SEQ ID NO: 898709 - RNA, 22 nt, Homo sapiens
aacaggggccaaacugguggga

SEQ ID NO: 898710 - RNA, 15 nt, Homo sapiens
aacaguaacugccau

SEQ ID NO: 898711 - RNA, 20 nt, Homo sapiens
aacagucacccuucugggca

SEQ ID NO: 898712 - RNA, 12 nt, Homo sapiens
aaguuugaacuu

SEQ ID NO: 898713 - RNA, 21 nt, Homo sapiens
aaguuuuguggaggagcucag

SEQ ID NO: 898714 - RNA, 18 nt, Homo sapiens
aauaaaaaaguaacaagg

SEQ ID NO: 898715 - RNA, 15 nt, Homo sapiens
aauaaaaacccugua

SEQ ID NO: 898716 - RNA, 13 nt, Homo sapiens
aauaaaaagcaug

SEQ ID NO: 898717 - RNA, 13 nt, Homo sapiens
aauaaaaauaccu

SEQ ID NO: 898718 - RNA, 24 nt, Homo sapiens
aauaaaacccaacagauacuggaa

SEQ ID NO: 898719 - RNA, 14 nt, Homo sapiens
aauaaaaccucagg

SEQ ID NO: 898720 - RNA, 16 nt, Homo sapiens
aauaaaagccucuggu

SEQ ID NO: 898721 - RNA, 18 nt, Homo sapiens
aauaaaauuuaggaccaa

SEQ ID NO: 898722 - RNA, 21 nt, Homo sapiens
aauaaaccaagauagauccau

SEQ ID NO: 898723 - RNA, 22 nt, Homo sapiens
aauaaacuaguuuccaguggau

SEQ ID NO: 898724 - RNA, 20 nt, Homo sapiens
aauaaagacagaucauuuca

SEQ ID NO: 898725 - RNA, 15 nt, Homo sapiens
aauaaagaccugaga

SEQ ID NO: 898726 - RNA, 13 nt, Homo sapiens
aauaaagcccuug

SEQ ID NO: 898727 - RNA, 17 nt, Homo sapiens
aauaaauaaaaauauuc

SEQ ID NO: 898728 - RNA, 20 nt, Homo sapiens
aauaaaucaacuccagcucc

SEQ ID NO: 898729 - RNA, 16 nt, Homo sapiens
aauaaauccuccaguc

SEQ ID NO: 898730 - RNA, 17 nt, Homo sapiens
aauaaaugaaucuuacu

SEQ ID NO: 898731 - RNA, 15 nt, Homo sapiens
aauaaauucauacau

SEQ ID NO: 898732 - RNA, 14 nt, Homo sapiens
aauaaccacuuaaa

SEQ ID NO: 898733 - RNA, 20 nt, Homo sapiens
aauaaccuuuauaugauaua

SEQ ID NO: 898734 - RNA, 14 nt, Homo sapiens
aauaagaaacacaa

SEQ ID NO: 898735 - RNA, 15 nt, Homo sapiens
aauaagcccaacaga

SEQ ID NO: 898736 - RNA, 15 nt, Homo sapiens
aauaaguacugugua

SEQ ID NO: 898737 - RNA, 17 nt, Homo sapiens
aauaaguccacaucuuc

SEQ ID NO: 898738 - RNA, 20 nt, Homo sapiens
aauaaguuugcuccuucaua

SEQ ID NO: 898739 - RNA, 15 nt, Homo sapiens
aauaauaaauccuca

SEQ ID NO: 898740 - RNA, 20 nt, Homo sapiens
aauaauuagguuaacauugu

SEQ ID NO: 898741 - RNA, 14 nt, Homo sapiens
aauaauuaugugcc

SEQ ID NO: 898742 - RNA, 15 nt, Homo sapiens
aauaauucuaugaga

SEQ ID NO: 898743 - RNA, 15 nt, Homo sapiens
aauaauugauuucaa

SEQ ID NO: 898744 - RNA, 15 nt, Homo sapiens
aauaauuguuccaaa

SEQ ID NO: 898745 - RNA, 13 nt, Homo sapiens
aauacaacaugua

SEQ ID NO: 898746 - RNA, 19 nt, Homo sapiens
aauacaauuaaagcuguua

SEQ ID NO: 898747 - RNA, 17 nt, Homo sapiens
aauacacacucaaauca

SEQ ID NO: 898748 - RNA, 23 nt, Homo sapiens
aauacacagaugauaauaugcua

SEQ ID NO: 898749 - RNA, 16 nt, Homo sapiens
aauacacuaauuccuu

SEQ ID NO: 898750 - RNA, 17 nt, Homo sapiens
aauacagggcaugcauu

SEQ ID NO: 898751 - RNA, 21 nt, Homo sapiens
aauacaugaaaugucuggucu

SEQ ID NO: 898752 - RNA, 17 nt, Homo sapiens
aauaccagaucacucaa

SEQ ID NO: 898753 - RNA, 17 nt, Homo sapiens
aauaccagugaaccaaa

SEQ ID NO: 898754 - RNA, 18 nt, Homo sapiens
aauaccauccugcccauu

SEQ ID NO: 898755 - RNA, 15 nt, Homo sapiens
aauacccccagagac

SEQ ID NO: 898756 - RNA, 19 nt, Homo sapiens
aauaccuccuccagaucag

SEQ ID NO: 898757 - RNA, 22 nt, Homo sapiens
aauacgugaaagaugcaagcac

SEQ ID NO: 898758 - RNA, 16 nt, Homo sapiens
aauacucaaaagagag

SEQ ID NO: 898759 - RNA, 20 nt, Homo sapiens
aauacugauguuccuaguga

SEQ ID NO: 898760 - RNA, 22 nt, Homo sapiens
aauacugauguuccuagugaaa

SEQ ID NO: 898761 - RNA, 17 nt, Homo sapiens
aauacugcguguucuca

SEQ ID NO: 898762 - RNA, 20 nt, Homo sapiens
aauagaagaacauccaagga

SEQ ID NO: 898763 - RNA, 21 nt, Homo sapiens
aauagaauauaauuaucggaa

SEQ ID NO: 898764 - RNA, 17 nt, Homo sapiens
aauagagacacagagau

SEQ ID NO: 898765 - RNA, 14 nt, Homo sapiens
aauagaucuuuuca

SEQ ID NO: 898766 - RNA, 15 nt, Homo sapiens
aauagauuucucaag

SEQ ID NO: 898767 - RNA, 17 nt, Homo sapiens
aauagcuaaauaccuca

SEQ ID NO: 898768 - RNA, 17 nt, Homo sapiens
aauagguuaauaucaau

SEQ ID NO: 898769 - RNA, 19 nt, Homo sapiens
aauaguaggaccaauguug

SEQ ID NO: 898770 - RNA, 22 nt, Homo sapiens
aauaguguuggaaaaugugcaa

SEQ ID NO: 898771 - RNA, 19 nt, Homo sapiens
aauaguuuuaaauaugaac

SEQ ID NO: 898772 - RNA, 21 nt, Homo sapiens
aauauaaacugaaaaauguca

SEQ ID NO: 898773 - RNA, 16 nt, Homo sapiens
aauauaagaacuugau

SEQ ID NO: 898774 - RNA, 14 nt, Homo sapiens
aauauaagaucuga

SEQ ID NO: 898775 - RNA, 15 nt, Homo sapiens
aauauaguagcagga

SEQ ID NO: 898776 - RNA, 22 nt, Homo sapiens
aauaucacaucacuuaacugau

SEQ ID NO: 898777 - RNA, 17 nt, Homo sapiens
aauauccuaaacaucau

SEQ ID NO: 898778 - RNA, 18 nt, Homo sapiens
aauaucugagaaguguau

SEQ ID NO: 898779 - RNA, 16 nt, Homo sapiens
aauaucugcuuuaaua

SEQ ID NO: 898780 - RNA, 18 nt, Homo sapiens
aauaugaaggacuauuaa

SEQ ID NO: 898781 - RNA, 14 nt, Homo sapiens
aauaugaauugaca

SEQ ID NO: 898782 - RNA, 23 nt, Homo sapiens
aauaugaucauguaaaugauuau

SEQ ID NO: 898783 - RNA, 14 nt, Homo sapiens
aauaugcuacagua

SEQ ID NO: 898784 - RNA, 19 nt, Homo sapiens
aauaugggcucaagucacu

SEQ ID NO: 898785 - RNA, 17 nt, Homo sapiens
aauauguuugugccuua

SEQ ID NO: 898786 - RNA, 15 nt, Homo sapiens
aauauuagcaaagaa

SEQ ID NO: 898787 - RNA, 16 nt, Homo sapiens
aauauucaacaauuau

SEQ ID NO: 898788 - RNA, 21 nt, Homo sapiens
aauauucccugacgacacuga

SEQ ID NO: 898789 - RNA, 23 nt, Homo sapiens
aauauuguucuauuuguauauau

SEQ ID NO: 898790 - RNA, 14 nt, Homo sapiens
aauauuuguagaag

SEQ ID NO: 898791 - RNA, 18 nt, Homo sapiens
aauauuuuaagacuauaa

SEQ ID NO: 898792 - RNA, 17 nt, Homo sapiens
aauauuuuacaguuuuu

SEQ ID NO: 898793 - RNA, 15 nt, Homo sapiens
aauauuuuagccuua

SEQ ID NO: 898794 - RNA, 20 nt, Homo sapiens
aauauuuuguaacuauuaca

SEQ ID NO: 898795 - RNA, 14 nt, Homo sapiens
aaucaaacuguaaa

SEQ ID NO: 898796 - RNA, 15 nt, Homo sapiens
aaucaaagcugagga

SEQ ID NO: 898797 - RNA, 21 nt, Homo sapiens
aaucaagacccuuuucuguau

SEQ ID NO: 898798 - RNA, 20 nt, Homo sapiens
aaucacaaggcaacugugag

SEQ ID NO: 898799 - RNA, 16 nt, Homo sapiens
aaucacaccucugggc

SEQ ID NO: 898800 - RNA, 13 nt, Homo sapiens
aaucaccaaagua

SEQ ID NO: 898801 - RNA, 21 nt, Homo sapiens
aaucacuaucuuucugauaac

SEQ ID NO: 898802 - RNA, 14 nt, Homo sapiens
aaucacucuguccu

SEQ ID NO: 898803 - RNA, 14 nt, Homo sapiens
aaucacuugcacuc

SEQ ID NO: 898804 - RNA, 18 nt, Homo sapiens
aaucagaugggggacuga

SEQ ID NO: 898805 - RNA, 14 nt, Homo sapiens
aaucagcauucuca

SEQ ID NO: 898806 - RNA, 22 nt, Homo sapiens
aaucaggcugaggugucuuaag

SEQ ID NO: 898807 - RNA, 22 nt, Homo sapiens
aaucagucuuggaauacuugaa

SEQ ID NO: 898808 - RNA, 19 nt, Homo sapiens
aaucauaaauauaaucuaa

SEQ ID NO: 898809 - RNA, 16 nt, Homo sapiens
aaucauacuuagcaaa

SEQ ID NO: 898810 - RNA, 13 nt, Homo sapiens
aaucaugagauaa

SEQ ID NO: 898811 - RNA, 16 nt, Homo sapiens
aaucaugaguaccuca

SEQ ID NO: 898812 - RNA, 21 nt, Homo sapiens
aaucauguuggauagucagcu

SEQ ID NO: 898813 - RNA, 17 nt, Homo sapiens
aaucauuuuaauuauua

SEQ ID NO: 898814 - RNA, 20 nt, Homo sapiens
aauccaacccaugaugagcu

SEQ ID NO: 898815 - RNA, 23 nt, Homo sapiens
aauccacagccaacaaacauaga

SEQ ID NO: 898816 - RNA, 20 nt, Homo sapiens
aaucccagcaugcugagauu

SEQ ID NO: 898817 - RNA, 17 nt, Homo sapiens
aaucccagcuacucaag

SEQ ID NO: 898818 - RNA, 14 nt, Homo sapiens
aaucccauugucac

SEQ ID NO: 898819 - RNA, 14 nt, Homo sapiens
aaucccggcuguca

SEQ ID NO: 898820 - RNA, 22 nt, Homo sapiens
aauccucagguaguacugggaa

SEQ ID NO: 898821 - RNA, 18 nt, Homo sapiens
aauccugcccccagccau

SEQ ID NO: 898822 - RNA, 23 nt, Homo sapiens
aauccugcuccugacucggucaa

SEQ ID NO: 898823 - RNA, 21 nt, Homo sapiens
aauccugucgauuagacugga

SEQ ID NO: 898824 - RNA, 15 nt, Homo sapiens
aauccuuuacuguua

SEQ ID NO: 898825 - RNA, 19 nt, Homo sapiens
aauccuuuacuguuaguca

SEQ ID NO: 898826 - RNA, 17 nt, Homo sapiens
aaucgagucuaccucuu

SEQ ID NO: 898827 - RNA, 20 nt, Homo sapiens
aaggauauuuacuacuuuug

SEQ ID NO: 898828 - RNA, 15 nt, Homo sapiens
aaggaucucucagga

SEQ ID NO: 898829 - RNA, 23 nt, Homo sapiens
aaggauggagccagcucugcauu

SEQ ID NO: 898830 - RNA, 18 nt, Homo sapiens
aaggcaaagagaccacuc

SEQ ID NO: 898831 - RNA, 14 nt, Homo sapiens
aaggcaacugugag

SEQ ID NO: 898832 - RNA, 13 nt, Homo sapiens
aaggcacaggugu

SEQ ID NO: 898833 - RNA, 14 nt, Homo sapiens
aaggcacaggugua

SEQ ID NO: 898834 - RNA, 20 nt, Homo sapiens
aaggcacuugucacuaugcu

SEQ ID NO: 898835 - RNA, 21 nt, Homo sapiens
aaggcaguguuccucaccaau

SEQ ID NO: 898836 - RNA, 22 nt, Homo sapiens
aaggcauaugcuggcccauaaa

SEQ ID NO: 898837 - RNA, 18 nt, Homo sapiens
aaggccagaaacuccuuu

SEQ ID NO: 898838 - RNA, 20 nt, Homo sapiens
aaggcccagacaggcucagg

SEQ ID NO: 898839 - RNA, 17 nt, Homo sapiens
aaggccugcccucccau

SEQ ID NO: 898840 - RNA, 14 nt, Homo sapiens
aaggccuucaaccc

SEQ ID NO: 898841 - RNA, 19 nt, Homo sapiens
aaggcuauauuucugggau

SEQ ID NO: 898842 - RNA, 13 nt, Homo sapiens
aaggcucagucuc

SEQ ID NO: 898843 - RNA, 12 nt, Homo sapiens
aaggcugccuca

SEQ ID NO: 898844 - RNA, 22 nt, Homo sapiens
aaggcuggcugaaaaucacuau

SEQ ID NO: 898845 - RNA, 18 nt, Homo sapiens
aaggcuggggccagugua

SEQ ID NO: 898846 - RNA, 15 nt, Homo sapiens
aaggcuuugccaugg

SEQ ID NO: 898847 - RNA, 13 nt, Homo sapiens
aagggaaacuauu

SEQ ID NO: 898848 - RNA, 14 nt, Homo sapiens
aagggaacuaugga

SEQ ID NO: 898849 - RNA, 13 nt, Homo sapiens
aagggaacuucca

SEQ ID NO: 898850 - RNA, 20 nt, Homo sapiens
aagggaaggcugcuguguag

SEQ ID NO: 898851 - RNA, 18 nt, Homo sapiens
aagggagaagaaauccau

SEQ ID NO: 898852 - RNA, 18 nt, Homo sapiens
aagggaguugcucacuca

SEQ ID NO: 898853 - RNA, 21 nt, Homo sapiens
aagggauaaucaucucuguca

SEQ ID NO: 898854 - RNA, 15 nt, Homo sapiens
aagggauaguccaaa

SEQ ID NO: 898855 - RNA, 16 nt, Homo sapiens
aagggauaguccaaag

SEQ ID NO: 898856 - RNA, 18 nt, Homo sapiens
aagggauaguccaaagac

SEQ ID NO: 898857 - RNA, 17 nt, Homo sapiens
aagggcaacccaccauc

SEQ ID NO: 898858 - RNA, 23 nt, Homo sapiens
aagggcacgagagagucuuccag

SEQ ID NO: 898859 - RNA, 16 nt, Homo sapiens
aagggcagaaggggaa

SEQ ID NO: 898860 - RNA, 16 nt, Homo sapiens
aagggcaggugcuuca

SEQ ID NO: 898861 - RNA, 13 nt, Homo sapiens
aagggcagugaga

SEQ ID NO: 898862 - RNA, 14 nt, Homo sapiens
aagggcagugagaa

SEQ ID NO: 898863 - RNA, 17 nt, Homo sapiens
aaggggcaccugggaaa

SEQ ID NO: 898864 - RNA, 12 nt, Homo sapiens
aagggucuuccu

SEQ ID NO: 898865 - RNA, 21 nt, Homo sapiens
aaggguuauagacugccaugc

SEQ ID NO: 898866 - RNA, 20 nt, Homo sapiens
aaggguucagagacucaggg

SEQ ID NO: 898867 - RNA, 15 nt, Homo sapiens
aagguacuuaaagcu

SEQ ID NO: 898868 - RNA, 13 nt, Homo sapiens
aagguagagaugu

SEQ ID NO: 898869 - RNA, 17 nt, Homo sapiens
aagguaguaacuuucca

SEQ ID NO: 898870 - RNA, 14 nt, Homo sapiens
aagguaugggagag

SEQ ID NO: 898871 - RNA, 16 nt, Homo sapiens
aaggucugcuuuucau

SEQ ID NO: 898872 - RNA, 22 nt, Homo sapiens
aaggucuugccugaauccauca

SEQ ID NO: 898873 - RNA, 16 nt, Homo sapiens
aaggugaagagaccaa

SEQ ID NO: 898874 - RNA, 16 nt, Homo sapiens
aaggugaugugauuca

SEQ ID NO: 898875 - RNA, 14 nt, Homo sapiens
aaggugcuugccug

SEQ ID NO: 898876 - RNA, 23 nt, Homo sapiens
aagguguaaaauaucuaccugcc

SEQ ID NO: 898877 - RNA, 22 nt, Homo sapiens
aagguguugguguauuugccag

SEQ ID NO: 898878 - RNA, 15 nt, Homo sapiens
aagguuaccucuauu

SEQ ID NO: 898879 - RNA, 20 nt, Homo sapiens
aagguugugcccuccaccua

SEQ ID NO: 898880 - RNA, 17 nt, Homo sapiens
aagguuucauguagauu

SEQ ID NO: 898881 - RNA, 15 nt, Homo sapiens
aaguaaaccaaaaag

SEQ ID NO: 898882 - RNA, 16 nt, Homo sapiens
aaguacccugugcuca

SEQ ID NO: 898883 - RNA, 18 nt, Homo sapiens
aaguacuucuccacccug

SEQ ID NO: 898884 - RNA, 20 nt, Homo sapiens
aaguagaauuauaucuaauu

SEQ ID NO: 898885 - RNA, 18 nt, Homo sapiens
aaguagggacuucugucu

SEQ ID NO: 898886 - RNA, 17 nt, Homo sapiens
aaguagguuuacauuca

SEQ ID NO: 898887 - RNA, 16 nt, Homo sapiens
aaguaguagugucuuc

SEQ ID NO: 898888 - RNA, 21 nt, Homo sapiens
aaguagugauauucuacuucu

SEQ ID NO: 898889 - RNA, 17 nt, Homo sapiens
aaguauauauucuacac

SEQ ID NO: 898890 - RNA, 19 nt, Homo sapiens
aaguauaucuuuaauucug

SEQ ID NO: 898891 - RNA, 13 nt, Homo sapiens
aaguaugagggaa

SEQ ID NO: 898892 - RNA, 12 nt, Homo sapiens
aaguauuagcca

SEQ ID NO: 898893 - RNA, 19 nt, Homo sapiens
aaguauugcgaaugugcag

SEQ ID NO: 898894 - RNA, 18 nt, Homo sapiens
aaguauugcugaguccaa

SEQ ID NO: 898895 - RNA, 13 nt, Homo sapiens
aagucaaggagaa

SEQ ID NO: 898896 - RNA, 14 nt, Homo sapiens
aagucacacagaca

SEQ ID NO: 898897 - RNA, 18 nt, Homo sapiens
aagucauuuuaacuuuau

SEQ ID NO: 898898 - RNA, 17 nt, Homo sapiens
aaguccuuucuaaguau

SEQ ID NO: 898899 - RNA, 13 nt, Homo sapiens
aagucuacuucac

SEQ ID NO: 898900 - RNA, 16 nt, Homo sapiens
aagucuacuucacuaa

SEQ ID NO: 898901 - RNA, 13 nt, Homo sapiens
aagucuccaguca

SEQ ID NO: 898902 - RNA, 20 nt, Homo sapiens
aagucuccagucaccuacaa

SEQ ID NO: 898903 - RNA, 19 nt, Homo sapiens
aagucucugacucuugccu

SEQ ID NO: 898904 - RNA, 18 nt, Homo sapiens
aagucugggauguagaac

SEQ ID NO: 898905 - RNA, 11 nt, Homo sapiens
aagucuuccau

SEQ ID NO: 898906 - RNA, 17 nt, Homo sapiens
aagucuuuguugcacca

SEQ ID NO: 898907 - RNA, 14 nt, Homo sapiens
aagugacaugccau

SEQ ID NO: 898908 - RNA, 15 nt, Homo sapiens
aagugagacaaucac

SEQ ID NO: 898909 - RNA, 20 nt, Homo sapiens
aagugagacccccaucucua

SEQ ID NO: 898910 - RNA, 23 nt, Homo sapiens
aagugagacccccaucucuacaa

SEQ ID NO: 898911 - RNA, 16 nt, Homo sapiens
aagugauaucaccucu

SEQ ID NO: 898912 - RNA, 19 nt, Homo sapiens
aagugauccacccaccuca

SEQ ID NO: 898913 - RNA, 20 nt, Homo sapiens
aagugauccacccaccucag

SEQ ID NO: 898914 - RNA, 19 nt, Homo sapiens
aagugauccucccaccuca

SEQ ID NO: 898915 - RNA, 24 nt, Homo sapiens
aagugcaauuuccccucugugucc

SEQ ID NO: 898916 - RNA, 15 nt, Homo sapiens
aagugccaguuugcu

SEQ ID NO: 898917 - RNA, 19 nt, Homo sapiens
aagugcgccuugcaaaaaa

SEQ ID NO: 898918 - RNA, 20 nt, Homo sapiens
aagugcugggauuacaggca

SEQ ID NO: 898919 - RNA, 22 nt, Homo sapiens
aagugcugggauuacaggugua

SEQ ID NO: 898920 - RNA, 23 nt, Homo sapiens
aagugcugggauuacaguuguga

SEQ ID NO: 898921 - RNA, 14 nt, Homo sapiens
aaguggccaugcca

SEQ ID NO: 898922 - RNA, 17 nt, Homo sapiens
aaguggcuaauucaauu

SEQ ID NO: 898923 - RNA, 15 nt, Homo sapiens
aagugggcauugcaa

SEQ ID NO: 898924 - RNA, 21 nt, Homo sapiens
aagugguucuggauaucuuuu

SEQ ID NO: 898925 - RNA, 18 nt, Homo sapiens
aaguguugcucuuggaaa

SEQ ID NO: 898926 - RNA, 21 nt, Homo sapiens
aaguguuuuaauuucuacaca

SEQ ID NO: 898927 - RNA, 23 nt, Homo sapiens
aaguuaaaaguguugauuacaua

SEQ ID NO: 898928 - RNA, 15 nt, Homo sapiens
aaguuaaagugaaua

SEQ ID NO: 898929 - RNA, 14 nt, Homo sapiens
aaguuaauuuuccc

SEQ ID NO: 898930 - RNA, 16 nt, Homo sapiens
aaguuauucucuucac

SEQ ID NO: 898931 - RNA, 15 nt, Homo sapiens
aaguuauucuugaca

SEQ ID NO: 898932 - RNA, 17 nt, Homo sapiens
aaguucaacuuccagaa

SEQ ID NO: 898933 - RNA, 11 nt, Homo sapiens
aaguucaggga

SEQ ID NO: 898934 - RNA, 14 nt, Homo sapiens
aaguucauaggguc

SEQ ID NO: 898935 - RNA, 18 nt, Homo sapiens
aaguuccaguguucucuc

SEQ ID NO: 898936 - RNA, 14 nt, Homo sapiens
aaguugcagucuca

SEQ ID NO: 898937 - RNA, 17 nt, Homo sapiens
aaguugcugaugaacuc

SEQ ID NO: 898938 - RNA, 17 nt, Homo sapiens
aaguugcuucucaugga

SEQ ID NO: 898939 - RNA, 16 nt, Homo sapiens
aaguuuaaaaaaccau

SEQ ID NO: 898940 - RNA, 14 nt, Homo sapiens
aaguuuaucuuuca

SEQ ID NO: 898941 - RNA, 20 nt, Homo sapiens
aaguuuauuuuuucuacaca

SEQ ID NO: 898942 - RNA, 19 nt, Homo sapiens
guuacuaaagucacauaua

SEQ ID NO: 898943 - RNA, 19 nt, Homo sapiens
guuacuguggccaguauuu

SEQ ID NO: 898944 - RNA, 20 nt, Homo sapiens
guuacuguggccaguauuuu

SEQ ID NO: 898945 - RNA, 21 nt, Homo sapiens
guuacuuaagaggcagagaag

SEQ ID NO: 898946 - RNA, 17 nt, Homo sapiens
guuacuugaaauaccag

SEQ ID NO: 898947 - RNA, 20 nt, Homo sapiens
guuacuugaaauaccaguga

SEQ ID NO: 898948 - RNA, 13 nt, Homo sapiens
guuagcaggaaau

SEQ ID NO: 898949 - RNA, 14 nt, Homo sapiens
guuagcaucuggcu

SEQ ID NO: 898950 - RNA, 17 nt, Homo sapiens
guuaggaaaauuucaca

SEQ ID NO: 898951 - RNA, 15 nt, Homo sapiens
guuaggauagcauuu

SEQ ID NO: 898952 - RNA, 16 nt, Homo sapiens
guuaggugugccaaac

SEQ ID NO: 898953 - RNA, 20 nt, Homo sapiens
guuaguguguugucugugca

SEQ ID NO: 898954 - RNA, 18 nt, Homo sapiens
guuauaaaucaaugucac

SEQ ID NO: 898955 - RNA, 19 nt, Homo sapiens
guuauaaaucaaugucacu

SEQ ID NO: 898956 - RNA, 16 nt, Homo sapiens
guuauaagaaacagag

SEQ ID NO: 898957 - RNA, 14 nt, Homo sapiens
guuaucaguuaaca

SEQ ID NO: 898958 - RNA, 22 nt, Homo sapiens
guuaugccguauaggaugucag

SEQ ID NO: 898959 - RNA, 13 nt, Homo sapiens
guuaugccucaug

SEQ ID NO: 898960 - RNA, 18 nt, Homo sapiens
guuauguuugcacuuugu

SEQ ID NO: 898961 - RNA, 13 nt, Homo sapiens
guuauucucuuca

SEQ ID NO: 898962 - RNA, 16 nt, Homo sapiens
guuauugaaucuuaau

SEQ ID NO: 898963 - RNA, 19 nt, Homo sapiens
guuauugccucugaaaugc

SEQ ID NO: 898964 - RNA, 19 nt, Homo sapiens
guuauuuaugccucuguau

SEQ ID NO: 898965 - RNA, 21 nt, Homo sapiens
guuauuucucccuuguguuag

SEQ ID NO: 898966 - RNA, 22 nt, Homo sapiens
guucaaaugaguucaacuuuga

SEQ ID NO: 898967 - RNA, 16 nt, Homo sapiens
guucaaguuaggagcu

SEQ ID NO: 898968 - RNA, 18 nt, Homo sapiens
guucacaugcaucauaac

SEQ ID NO: 898969 - RNA, 19 nt, Homo sapiens
guucagagaucguuccuau

SEQ ID NO: 898970 - RNA, 13 nt, Homo sapiens
guucaguucuguu

SEQ ID NO: 898971 - RNA, 15 nt, Homo sapiens
guucaugcuuuguac

SEQ ID NO: 898972 - RNA, 19 nt, Homo sapiens
guuccaagaaagauccacc

SEQ ID NO: 898973 - RNA, 15 nt, Homo sapiens
guuccaguugcuuga

SEQ ID NO: 898974 - RNA, 17 nt, Homo sapiens
guuccaugaagaccaca

SEQ ID NO: 898975 - RNA, 13 nt, Homo sapiens
guuccauguuaaa

SEQ ID NO: 898976 - RNA, 14 nt, Homo sapiens
guucccccagacag

SEQ ID NO: 898977 - RNA, 12 nt, Homo sapiens
guuccucaaaag

SEQ ID NO: 898978 - RNA, 20 nt, Homo sapiens
guuccuuuauuuuauguaaa

SEQ ID NO: 898979 - RNA, 13 nt, Homo sapiens
guucgaagcuccg

SEQ ID NO: 898980 - RNA, 20 nt, Homo sapiens
guucgagaccagccuggcca

SEQ ID NO: 898981 - RNA, 15 nt, Homo sapiens
guucuauuuguauau

SEQ ID NO: 898982 - RNA, 22 nt, Homo sapiens
guucucaaauauuugcuaugaa

SEQ ID NO: 898983 - RNA, 16 nt, Homo sapiens
guucucuauugcugcu

SEQ ID NO: 898984 - RNA, 22 nt, Homo sapiens
guucucuauugcugcucucuca

SEQ ID NO: 898985 - RNA, 14 nt, Homo sapiens
guucugaacuggaa

SEQ ID NO: 898986 - RNA, 14 nt, Homo sapiens
guucugauaaugaa

SEQ ID NO: 898987 - RNA, 15 nt, Homo sapiens
guucugcacugaaaa

SEQ ID NO: 898988 - RNA, 16 nt, Homo sapiens
guucuuagugucacuu

SEQ ID NO: 898989 - RNA, 18 nt, Homo sapiens
guucuuccuaccaaauau

SEQ ID NO: 898990 - RNA, 21 nt, Homo sapiens
guucuuuaauguuguccagga

SEQ ID NO: 898991 - RNA, 19 nt, Homo sapiens
guugaacaucucacuuugc

SEQ ID NO: 898992 - RNA, 16 nt, Homo sapiens
guugaccacuccagag

SEQ ID NO: 898993 - RNA, 14 nt, Homo sapiens
guugagaacaaaaa

SEQ ID NO: 898994 - RNA, 16 nt, Homo sapiens
guugagacuuagauaa

SEQ ID NO: 898995 - RNA, 19 nt, Homo sapiens
guugagaguugcuggugua

SEQ ID NO: 898996 - RNA, 20 nt, Homo sapiens
guugcagagauuuccuccau

SEQ ID NO: 898997 - RNA, 15 nt, Homo sapiens
guugcaugauguauu

SEQ ID NO: 898998 - RNA, 20 nt, Homo sapiens
guugcauuaaaaaugcauau

SEQ ID NO: 898999 - RNA, 18 nt, Homo sapiens
guugcucaaaucuauuca

SEQ ID NO: 899000 - RNA, 15 nt, Homo sapiens
guugcugaaacacac

SEQ ID NO: 899001 - RNA, 20 nt, Homo sapiens
guugcuguuguuccuucaca

SEQ ID NO: 899002 - RNA, 24 nt, Homo sapiens
guugcuuauuucccucaucuugcc

SEQ ID NO: 899003 - RNA, 14 nt, Homo sapiens
guuggaaauauuca

SEQ ID NO: 899004 - RNA, 19 nt, Homo sapiens
guuggaaccguguccagca

SEQ ID NO: 899005 - RNA, 21 nt, Homo sapiens
guuggagagcuagaaccugga

SEQ ID NO: 899006 - RNA, 16 nt, Homo sapiens
guuggagcuacugcaa

SEQ ID NO: 899007 - RNA, 16 nt, Homo sapiens
guuggaggauggcacu

SEQ ID NO: 899008 - RNA, 19 nt, Homo sapiens
guuggaugcggaacccaaa

SEQ ID NO: 899009 - RNA, 20 nt, Homo sapiens
augacuuuaucauuuuguua

SEQ ID NO: 899010 - RNA, 13 nt, Homo sapiens
augacuuuuccau

SEQ ID NO: 899011 - RNA, 22 nt, Homo sapiens
augagaaacuuugaucucugcu

SEQ ID NO: 899012 - RNA, 16 nt, Homo sapiens
augagaccacuguuau

SEQ ID NO: 899013 - RNA, 20 nt, Homo sapiens
augagaguagagggcacugg

SEQ ID NO: 899014 - RNA, 20 nt, Homo sapiens
augagcaaggacaaccugcc

SEQ ID NO: 899015 - RNA, 16 nt, Homo sapiens
augagcacacacacac

SEQ ID NO: 899016 - RNA, 14 nt, Homo sapiens
augagcaccuacuu

SEQ ID NO: 899017 - RNA, 13 nt, Homo sapiens
augagcagucaca

SEQ ID NO: 899018 - RNA, 16 nt, Homo sapiens
augagccgcugugagc

SEQ ID NO: 899019 - RNA, 22 nt, Homo sapiens
augaggccuuuccccagugugg

SEQ ID NO: 899020 - RNA, 20 nt, Homo sapiens
augaggcuuggggcuggaga

SEQ ID NO: 899021 - RNA, 14 nt, Homo sapiens
augagggcagagag

SEQ ID NO: 899022 - RNA, 17 nt, Homo sapiens
augaggguccccgggag

SEQ ID NO: 899023 - RNA, 22 nt, Homo sapiens
augagucugcauaaacuucauc

SEQ ID NO: 899024 - RNA, 17 nt, Homo sapiens
augaguuuaucauguca

SEQ ID NO: 899025 - RNA, 21 nt, Homo sapiens
augaguuuuugauagcuuuau

SEQ ID NO: 899026 - RNA, 13 nt, Homo sapiens
augauaaaagcac

SEQ ID NO: 899027 - RNA, 15 nt, Homo sapiens
augauaaagagggau

SEQ ID NO: 899028 - RNA, 23 nt, Homo sapiens
augauaaauucacauaggcaaua

SEQ ID NO: 899029 - RNA, 16 nt, Homo sapiens
augauaacugcaauuu

SEQ ID NO: 899030 - RNA, 20 nt, Homo sapiens
augauacaccuacuacucaa

SEQ ID NO: 899031 - RNA, 14 nt, Homo sapiens
augauauacuauga

SEQ ID NO: 899032 - RNA, 18 nt, Homo sapiens
augauauugcauaugcau

SEQ ID NO: 899033 - RNA, 20 nt, Homo sapiens
augaucagcuguuugucaua

SEQ ID NO: 899034 - RNA, 13 nt, Homo sapiens
augaucuuuucaa

SEQ ID NO: 899035 - RNA, 14 nt, Homo sapiens
augaugccaaaaua

SEQ ID NO: 899036 - RNA, 18 nt, Homo sapiens
augauuacuauaugcaaa

SEQ ID NO: 899037 - RNA, 21 nt, Homo sapiens
augauucacaacuaggaccuc

SEQ ID NO: 899038 - RNA, 22 nt, Homo sapiens
augauucauuuuaacaucugag

SEQ ID NO: 899039 - RNA, 21 nt, Homo sapiens
augauuguuuuugcucaaggc

SEQ ID NO: 899040 - RNA, 19 nt, Homo sapiens
augauuucaugcuaucucu

SEQ ID NO: 899041 - RNA, 18 nt, Homo sapiens
augauuuuaagaggcuuu

SEQ ID NO: 899042 - RNA, 20 nt, Homo sapiens
augauuuuuaaaaguugcua

SEQ ID NO: 899043 - RNA, 12 nt, Homo sapiens
augauuuuuaca

SEQ ID NO: 899044 - RNA, 15 nt, Homo sapiens
augcaaaguaaaaaa

SEQ ID NO: 899045 - RNA, 22 nt, Homo sapiens
augcaaaguaaaaaaauaugaa

SEQ ID NO: 899046 - RNA, 13 nt, Homo sapiens
augcaaaugccuc

SEQ ID NO: 899047 - RNA, 20 nt, Homo sapiens
augcaaaugccuccaagcca

SEQ ID NO: 899048 - RNA, 15 nt, Homo sapiens
augcaacaacaugua

SEQ ID NO: 899049 - RNA, 16 nt, Homo sapiens
augcaagcgacaggaa

SEQ ID NO: 899050 - RNA, 22 nt, Homo sapiens
augcaaggaaggaaagaaagaa

SEQ ID NO: 899051 - RNA, 16 nt, Homo sapiens
augcaauaaugugcaa

SEQ ID NO: 899052 - RNA, 19 nt, Homo sapiens
augcacacaaacaccuccu

SEQ ID NO: 899053 - RNA, 15 nt, Homo sapiens
augcacacacagaug

SEQ ID NO: 899054 - RNA, 16 nt, Homo sapiens
augcacacacagaugc

SEQ ID NO: 899055 - RNA, 18 nt, Homo sapiens
augcacacacagaugcac

SEQ ID NO: 899056 - RNA, 17 nt, Homo sapiens
augcacacacauggaug

SEQ ID NO: 899057 - RNA, 15 nt, Homo sapiens
uaaauuucaucucag

SEQ ID NO: 899058 - RNA, 17 nt, Homo sapiens
uaaauuugguucuaggc

SEQ ID NO: 899059 - RNA, 20 nt, Homo sapiens
uaaauuuguguucucaaaua

SEQ ID NO: 899060 - RNA, 15 nt, Homo sapiens
uaacaaaagaagauu

SEQ ID NO: 899061 - RNA, 13 nt, Homo sapiens
uaacaacuguggu

SEQ ID NO: 899062 - RNA, 20 nt, Homo sapiens
uaacaaguagcacccuggau

SEQ ID NO: 899063 - RNA, 14 nt, Homo sapiens
uaacacaagccaca

SEQ ID NO: 899064 - RNA, 17 nt, Homo sapiens
uaacacaagccacagaa

SEQ ID NO: 899065 - RNA, 19 nt, Homo sapiens
uaacacaaguccugugaau

SEQ ID NO: 899066 - RNA, 13 nt, Homo sapiens
uaacacaucuuua

SEQ ID NO: 899067 - RNA, 17 nt, Homo sapiens
uaacacucagaagccug

SEQ ID NO: 899068 - RNA, 18 nt, Homo sapiens
uaacacucagaagccugg

SEQ ID NO: 899069 - RNA, 15 nt, Homo sapiens
uaacagaccacugua

SEQ ID NO: 899070 - RNA, 23 nt, Homo sapiens
uaacagaccacuguauguuuacu

SEQ ID NO: 899071 - RNA, 18 nt, Homo sapiens
uaacaggucuccucuuaa

SEQ ID NO: 899072 - RNA, 22 nt, Homo sapiens
uaacauaauuuguacauaugua

SEQ ID NO: 899073 - RNA, 15 nt, Homo sapiens
uaacauaugauacug

SEQ ID NO: 899074 - RNA, 20 nt, Homo sapiens
uaacaugucuuucagcauua

SEQ ID NO: 899075 - RNA, 13 nt, Homo sapiens
uaacauugauuua

SEQ ID NO: 899076 - RNA, 14 nt, Homo sapiens
uaacauuuuccaaa

SEQ ID NO: 899077 - RNA, 14 nt, Homo sapiens
uaaccaaaugcugu

SEQ ID NO: 899078 - RNA, 13 nt, Homo sapiens
uaaccaaauuauu

SEQ ID NO: 899079 - RNA, 17 nt, Homo sapiens
uaaccguuuuucaagaa

SEQ ID NO: 899080 - RNA, 21 nt, Homo sapiens
uaaccuucuggcuuccuucuc

SEQ ID NO: 899081 - RNA, 16 nt, Homo sapiens
uaacgggcauguauua

SEQ ID NO: 899082 - RNA, 22 nt, Homo sapiens
uaacuacaaauuaucauacuac

SEQ ID NO: 899083 - RNA, 14 nt, Homo sapiens
uaacuacacuaaua

SEQ ID NO: 899084 - RNA, 12 nt, Homo sapiens
uaacuagaauuu

SEQ ID NO: 899085 - RNA, 19 nt, Homo sapiens
uaacuaguauuguccauau

SEQ ID NO: 899086 - RNA, 17 nt, Homo sapiens
uaacucaauauuuucca

SEQ ID NO: 899087 - RNA, 16 nt, Homo sapiens
uaacucagacauucca

SEQ ID NO: 899088 - RNA, 14 nt, Homo sapiens
uaacucauggguac

SEQ ID NO: 899089 - RNA, 17 nt, Homo sapiens
uaacugagaauuuucua

SEQ ID NO: 899090 - RNA, 13 nt, Homo sapiens
uaacuuauaucau

SEQ ID NO: 899091 - RNA, 13 nt, Homo sapiens
uaacuucaaauau

SEQ ID NO: 899092 - RNA, 12 nt, Homo sapiens
uaacuugagggu

SEQ ID NO: 899093 - RNA, 16 nt, Homo sapiens
uaacuuggaguuucau

SEQ ID NO: 899094 - RNA, 17 nt, Homo sapiens
uaacuuuuguaagacaa

SEQ ID NO: 899095 - RNA, 14 nt, Homo sapiens
uaagaaaacuaaga

SEQ ID NO: 899096 - RNA, 14 nt, Homo sapiens
uaagaaaauuuacu

SEQ ID NO: 899097 - RNA, 16 nt, Homo sapiens
uaagaaagcaagccaa

SEQ ID NO: 899098 - RNA, 20 nt, Homo sapiens
uaagaagcaaauaaauauca

SEQ ID NO: 899099 - RNA, 15 nt, Homo sapiens
uaagaauuaaucuua

SEQ ID NO: 899100 - RNA, 21 nt, Homo sapiens
uaagacaauaggccauguuaa

SEQ ID NO: 899101 - RNA, 19 nt, Homo sapiens
uaagaccugaucuauagau

SEQ ID NO: 899102 - RNA, 15 nt, Homo sapiens
uaagagaaugaauua

SEQ ID NO: 899103 - RNA, 16 nt, Homo sapiens
uaagaggcgacuuccu

SEQ ID NO: 899104 - RNA, 24 nt, Homo sapiens
uaagaguagcaaguucuagagaag

SEQ ID NO: 899105 - RNA, 22 nt, Homo sapiens
uaagagugccguaacaacugug

SEQ ID NO: 899106 - RNA, 22 nt, Homo sapiens
uaagauacuggacuccucuucc

SEQ ID NO: 899107 - RNA, 23 nt, Homo sapiens
uaagauuguccagugcaaccaca

SEQ ID NO: 899108 - RNA, 18 nt, Homo sapiens
uaagcaacuugcuucuaa

SEQ ID NO: 899109 - RNA, 15 nt, Homo sapiens
uaagcaucuguguaa

SEQ ID NO: 899110 - RNA, 22 nt, Homo sapiens
uaagccacauggcugggauuua

SEQ ID NO: 899111 - RNA, 14 nt, Homo sapiens
uaagccacucuucc

SEQ ID NO: 899112 - RNA, 14 nt, Homo sapiens
uaagcuaagccuua

SEQ ID NO: 899113 - RNA, 16 nt, Homo sapiens
uaagcuaggaaugaaa

SEQ ID NO: 899114 - RNA, 12 nt, Homo sapiens
uaagcucuggcu

SEQ ID NO: 899115 - RNA, 17 nt, Homo sapiens
uaagcucuuuaugacug

SEQ ID NO: 899116 - RNA, 12 nt, Homo sapiens
uaagcugggaua

SEQ ID NO: 899117 - RNA, 16 nt, Homo sapiens
uaaggaagaaucuucu

SEQ ID NO: 899118 - RNA, 18 nt, Homo sapiens
uaaggcaaaauaaucuaa

SEQ ID NO: 899119 - RNA, 15 nt, Homo sapiens
uaaggcauauacaaa

SEQ ID NO: 899120 - RNA, 16 nt, Homo sapiens
uaaggcuuaggugcca

SEQ ID NO: 899121 - RNA, 16 nt, Homo sapiens
uaagguggguccagga

SEQ ID NO: 899122 - RNA, 14 nt, Homo sapiens
uaaguaaaaccaca

SEQ ID NO: 899123 - RNA, 19 nt, Homo sapiens
uaaguccuguauauguaug

SEQ ID NO: 899124 - RNA, 16 nt, Homo sapiens
uacauacauacauaca

SEQ ID NO: 899125 - RNA, 12 nt, Homo sapiens
uacauacauaua

SEQ ID NO: 899126 - RNA, 13 nt, Homo sapiens
uacauacauauau

SEQ ID NO: 899127 - RNA, 16 nt, Homo sapiens
uacauaccuacugacu

SEQ ID NO: 899128 - RNA, 22 nt, Homo sapiens
uacauagauggaccaguagaca

SEQ ID NO: 899129 - RNA, 15 nt, Homo sapiens
uacauaguacauaca

SEQ ID NO: 899130 - RNA, 16 nt, Homo sapiens
uacauaguacauacaa

SEQ ID NO: 899131 - RNA, 23 nt, Homo sapiens
uacauauauauauacacauacau

SEQ ID NO: 899132 - RNA, 17 nt, Homo sapiens
uacauauauaugucagg

SEQ ID NO: 899133 - RNA, 17 nt, Homo sapiens
uacauccagaaagaagg

SEQ ID NO: 899134 - RNA, 13 nt, Homo sapiens
uacaucuauguau

SEQ ID NO: 899135 - RNA, 18 nt, Homo sapiens
uacaugaaacuacucaua

SEQ ID NO: 899136 - RNA, 20 nt, Homo sapiens
uacaugacucagcauaccug

SEQ ID NO: 899137 - RNA, 19 nt, Homo sapiens
uacaugcugugcucuuuga

SEQ ID NO: 899138 - RNA, 17 nt, Homo sapiens
uacaugggguuuucaau

SEQ ID NO: 899139 - RNA, 13 nt, Homo sapiens
uacauguaaucca

SEQ ID NO: 899140 - RNA, 15 nt, Homo sapiens
uacauguaauccauc

SEQ ID NO: 899141 - RNA, 21 nt, Homo sapiens
uacauguaucuaaacaaugua

SEQ ID NO: 899142 - RNA, 14 nt, Homo sapiens
uacauguguguaua

SEQ ID NO: 899143 - RNA, 15 nt, Homo sapiens
uacauuaauuaccuu

SEQ ID NO: 899144 - RNA, 13 nt, Homo sapiens
uacauuaguacac

SEQ ID NO: 899145 - RNA, 13 nt, Homo sapiens
uacauuaucauuc

SEQ ID NO: 899146 - RNA, 15 nt, Homo sapiens
uacauuccucagcug

SEQ ID NO: 899147 - RNA, 15 nt, Homo sapiens
uacauuuaauacagc

SEQ ID NO: 899148 - RNA, 21 nt, Homo sapiens
uacauuucauaaggccugccc

SEQ ID NO: 899149 - RNA, 17 nt, Homo sapiens
uacauuucccugugcug

SEQ ID NO: 899150 - RNA, 15 nt, Homo sapiens
uacauuuuccaaauc

SEQ ID NO: 899151 - RNA, 15 nt, Homo sapiens
uacauuuuuguacac

SEQ ID NO: 899152 - RNA, 14 nt, Homo sapiens
uaccaaucauuuua

SEQ ID NO: 899153 - RNA, 16 nt, Homo sapiens
uaccacaaacacauua

SEQ ID NO: 899154 - RNA, 12 nt, Homo sapiens
uaccacaguguc

SEQ ID NO: 899155 - RNA, 18 nt, Homo sapiens
uaccaccccuuccugucc

SEQ ID NO: 899156 - RNA, 15 nt, Homo sapiens
uaccacuaugcaaua

SEQ ID NO: 899157 - RNA, 15 nt, Homo sapiens
uaccagcuaacucca

SEQ ID NO: 899158 - RNA, 12 nt, Homo sapiens
uaccagcucacu

SEQ ID NO: 899159 - RNA, 15 nt, Homo sapiens
uaccagcucacuccc

SEQ ID NO: 899160 - RNA, 17 nt, Homo sapiens
uaccagggauguagauu

SEQ ID NO: 899161 - RNA, 13 nt, Homo sapiens
uaccagugugcuu

SEQ ID NO: 899162 - RNA, 15 nt, Homo sapiens
uaccauacauuauca

SEQ ID NO: 899163 - RNA, 18 nt, Homo sapiens
uaccaucuaaucuaugca

SEQ ID NO: 899164 - RNA, 23 nt, Homo sapiens
uaccaucuaaucuaugcauguau

SEQ ID NO: 899165 - RNA, 14 nt, Homo sapiens
uaccaucuguagag

SEQ ID NO: 899166 - RNA, 22 nt, Homo sapiens
uacccauauaucuuauguuaaa

SEQ ID NO: 899167 - RNA, 23 nt, Homo sapiens
uaccccaccacgauguggcccug

SEQ ID NO: 899168 - RNA, 17 nt, Homo sapiens
uaccccugauaagcaaa

SEQ ID NO: 899169 - RNA, 16 nt, Homo sapiens
uacccggcccagagac

SEQ ID NO: 899170 - RNA, 18 nt, Homo sapiens
uacccugcgauuuugccu

SEQ ID NO: 899171 - RNA, 23 nt, Homo sapiens
uacccuuccuacagauagucaaa

SEQ ID NO: 899172 - RNA, 16 nt, Homo sapiens
uacccuuguaccccau

SEQ ID NO: 899173 - RNA, 23 nt, Homo sapiens
uaccggcgugcaccaccaugcca

SEQ ID NO: 899174 - RNA, 14 nt, Homo sapiens
augucagacuggcu

SEQ ID NO: 899175 - RNA, 16 nt, Homo sapiens
augucauguacuuccu

SEQ ID NO: 899176 - RNA, 22 nt, Homo sapiens
auguccaauggaguucagagau

SEQ ID NO: 899177 - RNA, 22 nt, Homo sapiens
auguccagaagaauauucagga

SEQ ID NO: 899178 - RNA, 22 nt, Homo sapiens
auguccaugauggaauauuccc

SEQ ID NO: 899179 - RNA, 22 nt, Homo sapiens
auguccgcccaccuagugcuuc

SEQ ID NO: 899180 - RNA, 23 nt, Homo sapiens
auguccggagagacagugacagc

SEQ ID NO: 899181 - RNA, 19 nt, Homo sapiens
auguccuaaggacacacua

SEQ ID NO: 899182 - RNA, 22 nt, Homo sapiens
auguccuucuuuaucugugaua

SEQ ID NO: 899183 - RNA, 15 nt, Homo sapiens
augucucgcuaguga

SEQ ID NO: 899184 - RNA, 16 nt, Homo sapiens
augucuguuaacuuaa

SEQ ID NO: 899185 - RNA, 20 nt, Homo sapiens
augucuucucguuaaggaga

SEQ ID NO: 899186 - RNA, 20 nt, Homo sapiens
augucuuggacacuguacaa

SEQ ID NO: 899187 - RNA, 17 nt, Homo sapiens
augucuuguacaugugu

SEQ ID NO: 899188 - RNA, 16 nt, Homo sapiens
augugaguguguguga

SEQ ID NO: 899189 - RNA, 15 nt, Homo sapiens
augugauccuuuuau

SEQ ID NO: 899190 - RNA, 14 nt, Homo sapiens
augugcacaugcac

SEQ ID NO: 899191 - RNA, 15 nt, Homo sapiens
augugcgucucucuu

SEQ ID NO: 899192 - RNA, 23 nt, Homo sapiens
augugcuauugaacugagccaaa

SEQ ID NO: 899193 - RNA, 14 nt, Homo sapiens
auguggcauguuca

SEQ ID NO: 899194 - RNA, 21 nt, Homo sapiens
auguguccccucacucuguca

SEQ ID NO: 899195 - RNA, 22 nt, Homo sapiens
auguguccccucacucugucag

SEQ ID NO: 899196 - RNA, 15 nt, Homo sapiens
augugucuugucucc

SEQ ID NO: 899197 - RNA, 17 nt, Homo sapiens
augugugacuccagccu

SEQ ID NO: 899198 - RNA, 22 nt, Homo sapiens
auguguguguaugcuacuacaa

SEQ ID NO: 899199 - RNA, 16 nt, Homo sapiens
auguguuaagugcagg

SEQ ID NO: 899200 - RNA, 21 nt, Homo sapiens
auguguucauuaaagcaugaa

SEQ ID NO: 899201 - RNA, 11 nt, Homo sapiens
auguguugccu

SEQ ID NO: 899202 - RNA, 15 nt, Homo sapiens
auguguugcuauccu

SEQ ID NO: 899203 - RNA, 15 nt, Homo sapiens
auguguuguacaaua

SEQ ID NO: 899204 - RNA, 14 nt, Homo sapiens
auguuaagacuuga

SEQ ID NO: 899205 - RNA, 16 nt, Homo sapiens
auguuacuacaugcac

SEQ ID NO: 899206 - RNA, 21 nt, Homo sapiens
auguuagaauuuggagggaau

SEQ ID NO: 899207 - RNA, 12 nt, Homo sapiens
auguuagccuca

SEQ ID NO: 899208 - RNA, 22 nt, Homo sapiens
auguuauccacaagcaauggac

SEQ ID NO: 899209 - RNA, 14 nt, Homo sapiens
auguuaugugacua

SEQ ID NO: 899210 - RNA, 14 nt, Homo sapiens
auguucaacuggag

SEQ ID NO: 899211 - RNA, 19 nt, Homo sapiens
auguuccucugucaaugaa

SEQ ID NO: 899212 - RNA, 16 nt, Homo sapiens
auguucugggacacag

SEQ ID NO: 899213 - RNA, 14 nt, Homo sapiens
auguugcccaggca

SEQ ID NO: 899214 - RNA, 23 nt, Homo sapiens
auguuguuaugcuauuaaaguga

SEQ ID NO: 899215 - RNA, 17 nt, Homo sapiens
auguuuaaaaacauucc

SEQ ID NO: 899216 - RNA, 18 nt, Homo sapiens
auguuuacagacugugag

SEQ ID NO: 899217 - RNA, 20 nt, Homo sapiens
auguuuacuuuucagggcau

SEQ ID NO: 899218 - RNA, 15 nt, Homo sapiens
auguuuagauuccag

SEQ ID NO: 899219 - RNA, 14 nt, Homo sapiens
auguuuccagaaaa

SEQ ID NO: 899220 - RNA, 14 nt, Homo sapiens
auguuugaaugagu

SEQ ID NO: 899221 - RNA, 22 nt, Homo sapiens
auguuuguaaauuaauacuuca

SEQ ID NO: 899222 - RNA, 13 nt, Homo sapiens
auguuugucagau

SEQ ID NO: 899223 - RNA, 17 nt, Homo sapiens
auguuuuuaugauaucc

SEQ ID NO: 899224 - RNA, 15 nt, Homo sapiens
auuaaaaaccacuga

SEQ ID NO: 899225 - RNA, 19 nt, Homo sapiens
auuaaacaccugacacauc

SEQ ID NO: 899226 - RNA, 13 nt, Homo sapiens
auuaaacagccaa

SEQ ID NO: 899227 - RNA, 13 nt, Homo sapiens
auuaaagcuguua

SEQ ID NO: 899228 - RNA, 13 nt, Homo sapiens
auuaaaugcaugu

SEQ ID NO: 899229 - RNA, 15 nt, Homo sapiens
auuaaaugcaugucc

SEQ ID NO: 899230 - RNA, 13 nt, Homo sapiens
auuaaauucacau

SEQ ID NO: 899231 - RNA, 19 nt, Homo sapiens
auuaaccacuucugcgaua

SEQ ID NO: 899232 - RNA, 15 nt, Homo sapiens
auuaagacaugcacu

SEQ ID NO: 899233 - RNA, 14 nt, Homo sapiens
auuaaguggcuuuu

SEQ ID NO: 899234 - RNA, 17 nt, Homo sapiens
auuaauaaauuuuaaca

SEQ ID NO: 899235 - RNA, 15 nt, Homo sapiens
auuaaugaacuguga

SEQ ID NO: 899236 - RNA, 23 nt, Homo sapiens
auuaauguuaauucagcacugau

SEQ ID NO: 899237 - RNA, 14 nt, Homo sapiens
auuaauucuacuaa

SEQ ID NO: 899238 - RNA, 15 nt, Homo sapiens
auuacauccagaaag

SEQ ID NO: 899239 - RNA, 21 nt, Homo sapiens
auuacccccucauuguuuauu

SEQ ID NO: 899240 - RNA, 23 nt, Homo sapiens
auugcauuuaaaaauauauagcu

SEQ ID NO: 899241 - RNA, 16 nt, Homo sapiens
auugcauuucugcucu

SEQ ID NO: 899242 - RNA, 14 nt, Homo sapiens
auugccauucugau

SEQ ID NO: 899243 - RNA, 13 nt, Homo sapiens
auugcccugugag

SEQ ID NO: 899244 - RNA, 19 nt, Homo sapiens
auugccuccuuauuuauca

SEQ ID NO: 899245 - RNA, 13 nt, Homo sapiens
auugccugccaga

SEQ ID NO: 899246 - RNA, 13 nt, Homo sapiens
auugcuagugauu

SEQ ID NO: 899247 - RNA, 17 nt, Homo sapiens
auugcuaugaaugauac

SEQ ID NO: 899248 - RNA, 16 nt, Homo sapiens
auugcuguuguugcag

SEQ ID NO: 899249 - RNA, 18 nt, Homo sapiens
auugcuucaauaauauua

SEQ ID NO: 899250 - RNA, 21 nt, Homo sapiens
auuggaaguguucaagaaaua

SEQ ID NO: 899251 - RNA, 18 nt, Homo sapiens
auuggggaagacuguggc

SEQ ID NO: 899252 - RNA, 13 nt, Homo sapiens
auugggugggggg

SEQ ID NO: 899253 - RNA, 12 nt, Homo sapiens
auuggugcauuu

SEQ ID NO: 899254 - RNA, 15 nt, Homo sapiens
auugguuucuaggca

SEQ ID NO: 899255 - RNA, 15 nt, Homo sapiens
auuguaaguaccccu

SEQ ID NO: 899256 - RNA, 15 nt, Homo sapiens
auuguacacuaucua

SEQ ID NO: 899257 - RNA, 17 nt, Homo sapiens
auuguaggcaaccuucc

SEQ ID NO: 899258 - RNA, 18 nt, Homo sapiens
auuguaggcaaccuuccc

SEQ ID NO: 899259 - RNA, 16 nt, Homo sapiens
auuguaguguucaaaa

SEQ ID NO: 899260 - RNA, 15 nt, Homo sapiens
auuguccagugcaac

SEQ ID NO: 899261 - RNA, 14 nt, Homo sapiens
auuguccaugccua

SEQ ID NO: 899262 - RNA, 15 nt, Homo sapiens
auuguccccagggac

SEQ ID NO: 899263 - RNA, 17 nt, Homo sapiens
auugucgcucagcaaua

SEQ ID NO: 899264 - RNA, 18 nt, Homo sapiens
auugugauauuuuuacuu

SEQ ID NO: 899265 - RNA, 21 nt, Homo sapiens
auuguguugggaccugugauc

SEQ ID NO: 899266 - RNA, 14 nt, Homo sapiens
auuguguuugacuu

SEQ ID NO: 899267 - RNA, 21 nt, Homo sapiens
auuguuacagguguacuaugg

SEQ ID NO: 899268 - RNA, 14 nt, Homo sapiens
auuguuaccaugaa

SEQ ID NO: 899269 - RNA, 14 nt, Homo sapiens
auuguugcauuaaa

SEQ ID NO: 899270 - RNA, 16 nt, Homo sapiens
auuguuuggcuuccuc

SEQ ID NO: 899271 - RNA, 22 nt, Homo sapiens
auuuaaaaauaaagcuacugaa

SEQ ID NO: 899272 - RNA, 18 nt, Homo sapiens
auuuaaaagcaucucagc

SEQ ID NO: 899273 - RNA, 13 nt, Homo sapiens
auuuaaaauggaa

SEQ ID NO: 899274 - RNA, 19 nt, Homo sapiens
auuuaaaauuaaaugcaug

SEQ ID NO: 899275 - RNA, 20 nt, Homo sapiens
auuuaagaauaaagucuugu

SEQ ID NO: 899276 - RNA, 15 nt, Homo sapiens
auuuaagguacuuaa

SEQ ID NO: 899277 - RNA, 17 nt, Homo sapiens
auuuaaguaauuuugcc

SEQ ID NO: 899278 - RNA, 13 nt, Homo sapiens
auuuaaguauaua

SEQ ID NO: 899279 - RNA, 20 nt, Homo sapiens
auuuaaugaagacccagugu

SEQ ID NO: 899280 - RNA, 20 nt, Homo sapiens
auuuaauuuuuacaugacca

SEQ ID NO: 899281 - RNA, 16 nt, Homo sapiens
auuuaauuuuugcaau

SEQ ID NO: 899282 - RNA, 14 nt, Homo sapiens
auuuacagagccug

SEQ ID NO: 899283 - RNA, 21 nt, Homo sapiens
auuuacaugaauugcauuuua

SEQ ID NO: 899284 - RNA, 20 nt, Homo sapiens
auuuacauuuuuaauuuagu

SEQ ID NO: 899285 - RNA, 16 nt, Homo sapiens
auuuagauaugcaaaa

SEQ ID NO: 899286 - RNA, 19 nt, Homo sapiens
auuuaggcaagagaaaaua

SEQ ID NO: 899287 - RNA, 13 nt, Homo sapiens
auuuaguuucaua

SEQ ID NO: 899288 - RNA, 14 nt, Homo sapiens
auuuauauaucagu

SEQ ID NO: 899289 - RNA, 12 nt, Homo sapiens
auuuauauaugu

SEQ ID NO: 899290 - RNA, 13 nt, Homo sapiens
uagaguguuauca

SEQ ID NO: 899291 - RNA, 23 nt, Homo sapiens
uagauaaaagaaccgagcaauuu

SEQ ID NO: 899292 - RNA, 20 nt, Homo sapiens
uagauaaugaaugauaagca

SEQ ID NO: 899293 - RNA, 19 nt, Homo sapiens
uagaucaaggagcccagaa

SEQ ID NO: 899294 - RNA, 15 nt, Homo sapiens
uagauccauuuggac

SEQ ID NO: 899295 - RNA, 19 nt, Homo sapiens
uagaucccaugucaccuca

SEQ ID NO: 899296 - RNA, 22 nt, Homo sapiens
uagaucuaguucucaaucacug

SEQ ID NO: 899297 - RNA, 18 nt, Homo sapiens
uagauggguuauuucaac

SEQ ID NO: 899298 - RNA, 14 nt, Homo sapiens
uagauuaaacaaac

SEQ ID NO: 899299 - RNA, 15 nt, Homo sapiens
uagauuaaacaaaca

SEQ ID NO: 899300 - RNA, 17 nt, Homo sapiens
uagauuaguauuuucca

SEQ ID NO: 899301 - RNA, 23 nt, Homo sapiens
uagauuccucuugccucucucag

SEQ ID NO: 899302 - RNA, 22 nt, Homo sapiens
uagauugagaaguuuuguacag

SEQ ID NO: 899303 - RNA, 22 nt, Homo sapiens
uagcaagaacucugcacagcaa

SEQ ID NO: 899304 - RNA, 20 nt, Homo sapiens
uagcaauguaacauuaauuc

SEQ ID NO: 899305 - RNA, 13 nt, Homo sapiens
uagcaauuccagg

SEQ ID NO: 899306 - RNA, 18 nt, Homo sapiens
uagcagaaggcaagcacc

SEQ ID NO: 899307 - RNA, 16 nt, Homo sapiens
uagcaggcacaggaca

SEQ ID NO: 899308 - RNA, 21 nt, Homo sapiens
uagcaugccuccaaaaauuca

SEQ ID NO: 899309 - RNA, 21 nt, Homo sapiens
uagcauuuucuugaaccaaua

SEQ ID NO: 899310 - RNA, 16 nt, Homo sapiens
uagccaggauccacaa

SEQ ID NO: 899311 - RNA, 12 nt, Homo sapiens
uagcccagcacu

SEQ ID NO: 899312 - RNA, 16 nt, Homo sapiens
uagcccagcacuguga

SEQ ID NO: 899313 - RNA, 14 nt, Homo sapiens
uagcccagugcuuc

SEQ ID NO: 899314 - RNA, 14 nt, Homo sapiens
uagccgaccucagc

SEQ ID NO: 899315 - RNA, 18 nt, Homo sapiens
uagccggggguggugaca

SEQ ID NO: 899316 - RNA, 19 nt, Homo sapiens
uagccugaauucuuuucaa

SEQ ID NO: 899317 - RNA, 16 nt, Homo sapiens
uagcgaaucaucucaa

SEQ ID NO: 899318 - RNA, 21 nt, Homo sapiens
uagcguaacaaacaaaaucau

SEQ ID NO: 899319 - RNA, 22 nt, Homo sapiens
uagcguucccaacaacauccau

SEQ ID NO: 899320 - RNA, 16 nt, Homo sapiens
uagcuagaaugcacac

SEQ ID NO: 899321 - RNA, 19 nt, Homo sapiens
uagcuauuuucuuacagug

SEQ ID NO: 899322 - RNA, 21 nt, Homo sapiens
uagcuauuuucuuacagugga

SEQ ID NO: 899323 - RNA, 23 nt, Homo sapiens
uagcugaagaaguuauucucaag

SEQ ID NO: 899324 - RNA, 14 nt, Homo sapiens
uagcugacaaugca

SEQ ID NO: 899325 - RNA, 19 nt, Homo sapiens
uagcugagccuucugauga

SEQ ID NO: 899326 - RNA, 20 nt, Homo sapiens
uagcugcccaggaugcugcu

SEQ ID NO: 899327 - RNA, 23 nt, Homo sapiens
uagcugccuuuuuuaacacuaga

SEQ ID NO: 899328 - RNA, 17 nt, Homo sapiens
uagcuggccacagugag

SEQ ID NO: 899329 - RNA, 18 nt, Homo sapiens
uagcugguucacacugac

SEQ ID NO: 899330 - RNA, 15 nt, Homo sapiens
uagcugucugcucag

SEQ ID NO: 899331 - RNA, 18 nt, Homo sapiens
uagcuguuuuuuucauua

SEQ ID NO: 899332 - RNA, 23 nt, Homo sapiens
uagcuuuaaaaccugugugccau

SEQ ID NO: 899333 - RNA, 14 nt, Homo sapiens
uaggaaaauuucac

SEQ ID NO: 899334 - RNA, 14 nt, Homo sapiens
uaggaaauuccuuc

SEQ ID NO: 899335 - RNA, 17 nt, Homo sapiens
uaggaaggcagcauucc

SEQ ID NO: 899336 - RNA, 20 nt, Homo sapiens
uaggaaguauggcaugaaca

SEQ ID NO: 899337 - RNA, 13 nt, Homo sapiens
uaggaauugcauu

SEQ ID NO: 899338 - RNA, 15 nt, Homo sapiens
uaggacaauucacuu

SEQ ID NO: 899339 - RNA, 16 nt, Homo sapiens
uaggacaauucacuuc

SEQ ID NO: 899340 - RNA, 17 nt, Homo sapiens
uaggaccaauaccuccu

SEQ ID NO: 899341 - RNA, 14 nt, Homo sapiens
uaggaccucaggcg

SEQ ID NO: 899342 - RNA, 21 nt, Homo sapiens
uaggacuauggguacauucca

SEQ ID NO: 899343 - RNA, 23 nt, Homo sapiens
uaggacuccacaguuuugccuua

SEQ ID NO: 899344 - RNA, 17 nt, Homo sapiens
uaggagacagucucaag

SEQ ID NO: 899345 - RNA, 21 nt, Homo sapiens
uaggagacagucucaagcacu

SEQ ID NO: 899346 - RNA, 23 nt, Homo sapiens
uaggagacagucucaagcacuaa

SEQ ID NO: 899347 - RNA, 15 nt, Homo sapiens
uaggagcaaagccug

SEQ ID NO: 899348 - RNA, 22 nt, Homo sapiens
uaggagguuccggugucuggaa

SEQ ID NO: 899349 - RNA, 15 nt, Homo sapiens
uaggcagggauuuga

SEQ ID NO: 899350 - RNA, 19 nt, Homo sapiens
uaggcauccugugugcuga

SEQ ID NO: 899351 - RNA, 21 nt, Homo sapiens
uaggcggucaugugugcaugu

SEQ ID NO: 899352 - RNA, 22 nt, Homo sapiens
uaggcuguguauuucuuuucag

SEQ ID NO: 899353 - RNA, 16 nt, Homo sapiens
uaggcuuaaaugcaau

SEQ ID NO: 899354 - RNA, 14 nt, Homo sapiens
uagggagaaaccaa

SEQ ID NO: 899355 - RNA, 14 nt, Homo sapiens
auuuuauucccaag

SEQ ID NO: 899356 - RNA, 19 nt, Homo sapiens
auuuuauucccaagcucua

SEQ ID NO: 899357 - RNA, 19 nt, Homo sapiens
auuuucaagauacauuuca

SEQ ID NO: 899358 - RNA, 16 nt, Homo sapiens
auuuucacucugggcu

SEQ ID NO: 899359 - RNA, 20 nt, Homo sapiens
auuuucauuuaacuacaaau

SEQ ID NO: 899360 - RNA, 23 nt, Homo sapiens
auuuuccaaaucuuaauucaacu

SEQ ID NO: 899361 - RNA, 20 nt, Homo sapiens
auuuuccaauaaaauuuuca

SEQ ID NO: 899362 - RNA, 22 nt, Homo sapiens
auuuuccuaaaaauaagcuuua

SEQ ID NO: 899363 - RNA, 14 nt, Homo sapiens
auuuucuaguccau

SEQ ID NO: 899364 - RNA, 12 nt, Homo sapiens
auuuucuaugcu

SEQ ID NO: 899365 - RNA, 21 nt, Homo sapiens
auuuucucuaaaauuucaaca

SEQ ID NO: 899366 - RNA, 19 nt, Homo sapiens
auuuucuuggcaguauucc

SEQ ID NO: 899367 - RNA, 22 nt, Homo sapiens
auuuugaggccagaggugcugu

SEQ ID NO: 899368 - RNA, 17 nt, Homo sapiens
auuuugcauaguaccaa

SEQ ID NO: 899369 - RNA, 12 nt, Homo sapiens
auuuugcauuag

SEQ ID NO: 899370 - RNA, 20 nt, Homo sapiens
auuuugccauaaagucaaau

SEQ ID NO: 899371 - RNA, 23 nt, Homo sapiens
auuuugggggguaaucagcauua

SEQ ID NO: 899372 - RNA, 24 nt, Homo sapiens
auuuuguaugaaaaaucaauguca

SEQ ID NO: 899373 - RNA, 15 nt, Homo sapiens
auuuugucacugucu

SEQ ID NO: 899374 - RNA, 22 nt, Homo sapiens
auuuugugcaguuaauacuuaa

SEQ ID NO: 899375 - RNA, 16 nt, Homo sapiens
auuuuguggucauuaa

SEQ ID NO: 899376 - RNA, 21 nt, Homo sapiens
auuuuguguguaccugugacu

SEQ ID NO: 899377 - RNA, 20 nt, Homo sapiens
auuuuguguucaguacaauu

SEQ ID NO: 899378 - RNA, 19 nt, Homo sapiens
auuuuuacuaaagcagugu

SEQ ID NO: 899379 - RNA, 15 nt, Homo sapiens
auuuuuauacaccau

SEQ ID NO: 899380 - RNA, 15 nt, Homo sapiens
auuuuuauacauauc

SEQ ID NO: 899381 - RNA, 17 nt, Homo sapiens
auuuuuauagacaaaua

SEQ ID NO: 899382 - RNA, 16 nt, Homo sapiens
auuuuuaugugcaaua

SEQ ID NO: 899383 - RNA, 22 nt, Homo sapiens
auuuuugaaacccauuaggcau

SEQ ID NO: 899384 - RNA, 12 nt, Homo sapiens
auuuuugcaaug

SEQ ID NO: 899385 - RNA, 20 nt, Homo sapiens
auuuuuguuucuuccaaagc

SEQ ID NO: 899386 - RNA, 22 nt, Homo sapiens
auuuuuguuuucauuaucucaa

SEQ ID NO: 899387 - RNA, 22 nt, Homo sapiens
auuuuuuaaaugacugcugaau

SEQ ID NO: 899388 - RNA, 20 nt, Homo sapiens
auuuuuuaguauaaguacau

SEQ ID NO: 899389 - RNA, 16 nt, Homo sapiens
auuuuuuauuuccaca

SEQ ID NO: 899390 - RNA, 19 nt, Homo sapiens
auuuuuuuuguaacuucaa

SEQ ID NO: 899391 - RNA, 18 nt, Homo sapiens
caaaaaaaaaccaugcau

SEQ ID NO: 899392 - RNA, 15 nt, Homo sapiens
caaaaagacagugug

SEQ ID NO: 899393 - RNA, 20 nt, Homo sapiens
caaaaauaaacuaguuucca

SEQ ID NO: 899394 - RNA, 13 nt, Homo sapiens
caaaaauguaaug

SEQ ID NO: 899395 - RNA, 19 nt, Homo sapiens
caaaaauguaaugaucaua

SEQ ID NO: 899396 - RNA, 11 nt, Homo sapiens
caaaacaacca

SEQ ID NO: 899397 - RNA, 21 nt, Homo sapiens
caaaacauugugccaugucaa

SEQ ID NO: 899398 - RNA, 18 nt, Homo sapiens
caaaaccacuagaacucu

SEQ ID NO: 899399 - RNA, 15 nt, Homo sapiens
caaaaccucaugaca

SEQ ID NO: 899400 - RNA, 12 nt, Homo sapiens
caaaacucuccu

SEQ ID NO: 899401 - RNA, 17 nt, Homo sapiens
caaaacugcacugucaa

SEQ ID NO: 899402 - RNA, 22 nt, Homo sapiens
caaaagaagacaacauuucuca

SEQ ID NO: 899403 - RNA, 14 nt, Homo sapiens
caaaagaugccauu

SEQ ID NO: 899404 - RNA, 19 nt, Homo sapiens
uaguuucauucauccauca

SEQ ID NO: 899405 - RNA, 23 nt, Homo sapiens
uaguuucuuucuguuauugcacu

SEQ ID NO: 899406 - RNA, 17 nt, Homo sapiens
uaguuuugaaacuagaa

SEQ ID NO: 899407 - RNA, 23 nt, Homo sapiens
uaguuuugauccuaaaucugccu

SEQ ID NO: 899408 - RNA, 22 nt, Homo sapiens
uaguuuuuaccuaccacagugu

SEQ ID NO: 899409 - RNA, 15 nt, Homo sapiens
uauaaaaacaaaaac

SEQ ID NO: 899410 - RNA, 12 nt, Homo sapiens
uauaaaacacau

SEQ ID NO: 899411 - RNA, 14 nt, Homo sapiens
uauaaaaucuagau

SEQ ID NO: 899412 - RNA, 13 nt, Homo sapiens
uauaaacauuggu

SEQ ID NO: 899413 - RNA, 22 nt, Homo sapiens
uauaaacauugguauauuucca

SEQ ID NO: 899414 - RNA, 15 nt, Homo sapiens
uauaaagauggcuga

SEQ ID NO: 899415 - RNA, 13 nt, Homo sapiens
uauaaagugauca

SEQ ID NO: 899416 - RNA, 20 nt, Homo sapiens
uauaaauguauauacacaua

SEQ ID NO: 899417 - RNA, 19 nt, Homo sapiens
uauaaauguguggugcuaa

SEQ ID NO: 899418 - RNA, 13 nt, Homo sapiens
uauaaauguuugu

SEQ ID NO: 899419 - RNA, 19 nt, Homo sapiens
uauaaauuuguguucucaa

SEQ ID NO: 899420 - RNA, 22 nt, Homo sapiens
uauaacuaagacauaugcauuu

SEQ ID NO: 899421 - RNA, 19 nt, Homo sapiens
uauaacuguggcuaauuca

SEQ ID NO: 899422 - RNA, 13 nt, Homo sapiens
uauaagacuacua

SEQ ID NO: 899423 - RNA, 15 nt, Homo sapiens
uauaagacuacuaua

SEQ ID NO: 899424 - RNA, 21 nt, Homo sapiens
uauaagcaagaaggcaaaaau

SEQ ID NO: 899425 - RNA, 17 nt, Homo sapiens
uauaagcagaagcacau

SEQ ID NO: 899426 - RNA, 17 nt, Homo sapiens
uauaauaaacuuuucaa

SEQ ID NO: 899427 - RNA, 14 nt, Homo sapiens
uauaaugguugacu

SEQ ID NO: 899428 - RNA, 17 nt, Homo sapiens
uauacacacauauacau

SEQ ID NO: 899429 - RNA, 20 nt, Homo sapiens
uauacacacauauacauaua

SEQ ID NO: 899430 - RNA, 21 nt, Homo sapiens
uauacacacauauacauauau

SEQ ID NO: 899431 - RNA, 13 nt, Homo sapiens
uauacacauacau

SEQ ID NO: 899432 - RNA, 19 nt, Homo sapiens
uauacagauucuagccaaa

SEQ ID NO: 899433 - RNA, 11 nt, Homo sapiens
uauacauauca

SEQ ID NO: 899434 - RNA, 23 nt, Homo sapiens
uauacauguguguauauaugugu

SEQ ID NO: 899435 - RNA, 22 nt, Homo sapiens
uauaccauaugucugcuucugu

SEQ ID NO: 899436 - RNA, 19 nt, Homo sapiens
uauacuguagcugaugaaa

SEQ ID NO: 899437 - RNA, 13 nt, Homo sapiens
uauacuucacuca

SEQ ID NO: 899438 - RNA, 21 nt, Homo sapiens
uauagaaggguaccuugaaca

SEQ ID NO: 899439 - RNA, 13 nt, Homo sapiens
uauagcugggaac

SEQ ID NO: 899440 - RNA, 14 nt, Homo sapiens
uauagguuuccacu

SEQ ID NO: 899441 - RNA, 19 nt, Homo sapiens
uauagguuuccacugccaa

SEQ ID NO: 899442 - RNA, 21 nt, Homo sapiens
uauaguggccaaauagcacau

SEQ ID NO: 899443 - RNA, 21 nt, Homo sapiens
uauaguuuauugacaauaauu

SEQ ID NO: 899444 - RNA, 17 nt, Homo sapiens
uauauaaagccucacau

SEQ ID NO: 899445 - RNA, 15 nt, Homo sapiens
uauauacacauacau

SEQ ID NO: 899446 - RNA, 20 nt, Homo sapiens
uauauaguaaugcacucuca

SEQ ID NO: 899447 - RNA, 23 nt, Homo sapiens
uauauaguaaugcacucucagua

SEQ ID NO: 899448 - RNA, 17 nt, Homo sapiens
uauauaguagcauuuca

SEQ ID NO: 899449 - RNA, 19 nt, Homo sapiens
uauauaguauaccauacau

SEQ ID NO: 899450 - RNA, 19 nt, Homo sapiens
uauauauaguagcauuuca

SEQ ID NO: 899451 - RNA, 14 nt, Homo sapiens
uauauauguauaua

SEQ ID NO: 899452 - RNA, 18 nt, Homo sapiens
uauauaugugcaguauuu

SEQ ID NO: 899453 - RNA, 16 nt, Homo sapiens
uauauauguguauaua

SEQ ID NO: 899454 - RNA, 13 nt, Homo sapiens
uauauauuacuug

SEQ ID NO: 899455 - RNA, 20 nt, Homo sapiens
uauauauugguaacauccuu

SEQ ID NO: 899456 - RNA, 13 nt, Homo sapiens
uauaucaucagca

SEQ ID NO: 899457 - RNA, 18 nt, Homo sapiens
uauauccacaucuaagaa

SEQ ID NO: 899458 - RNA, 14 nt, Homo sapiens
uauaugcacauaua

SEQ ID NO: 899459 - RNA, 14 nt, Homo sapiens
uauauguaacugaa

SEQ ID NO: 899460 - RNA, 14 nt, Homo sapiens
uauauguauauuaa

SEQ ID NO: 899461 - RNA, 15 nt, Homo sapiens
uauauuaaaguguua

SEQ ID NO: 899462 - RNA, 18 nt, Homo sapiens
uauauuaaaguguuauac

SEQ ID NO: 899463 - RNA, 16 nt, Homo sapiens
uauauugaauauauca

SEQ ID NO: 899464 - RNA, 19 nt, Homo sapiens
uauauuguauuaagggcau

SEQ ID NO: 899465 - RNA, 17 nt, Homo sapiens
uauauuuguguaugugu

SEQ ID NO: 899466 - RNA, 19 nt, Homo sapiens
uaucaaaaaguacaauaau

SEQ ID NO: 899467 - RNA, 13 nt, Homo sapiens
uaucaauagucaa

SEQ ID NO: 899468 - RNA, 14 nt, Homo sapiens
uaucaauagucaag

SEQ ID NO: 899469 - RNA, 18 nt, Homo sapiens
caaaucccacagggccag

SEQ ID NO: 899470 - RNA, 16 nt, Homo sapiens
caaaucccauugucac

SEQ ID NO: 899471 - RNA, 17 nt, Homo sapiens
caaauccucuaauugca

SEQ ID NO: 899472 - RNA, 21 nt, Homo sapiens
caaaucuugguugaugccaaa

SEQ ID NO: 899473 - RNA, 18 nt, Homo sapiens
caaaugacaugcacugac

SEQ ID NO: 899474 - RNA, 11 nt, Homo sapiens
caaaugagauc

SEQ ID NO: 899475 - RNA, 14 nt, Homo sapiens
caaaugcacaucuc

SEQ ID NO: 899476 - RNA, 16 nt, Homo sapiens
caaaugcuaaaugcaa

SEQ ID NO: 899477 - RNA, 21 nt, Homo sapiens
caaaugucagagcuauguucc

SEQ ID NO: 899478 - RNA, 15 nt, Homo sapiens
caaauuaaggcauaa

SEQ ID NO: 899479 - RNA, 16 nt, Homo sapiens
caaauucauggugcac

SEQ ID NO: 899480 - RNA, 21 nt, Homo sapiens
caaauucauggugcacugagc

SEQ ID NO: 899481 - RNA, 11 nt, Homo sapiens
caaauucccug

SEQ ID NO: 899482 - RNA, 21 nt, Homo sapiens
caaauucuacugaacacuuca

SEQ ID NO: 899483 - RNA, 14 nt, Homo sapiens
caaauugcuucuag

SEQ ID NO: 899484 - RNA, 16 nt, Homo sapiens
caaauuguaacuacac

SEQ ID NO: 899485 - RNA, 13 nt, Homo sapiens
caacaaaccaaaa

SEQ ID NO: 899486 - RNA, 19 nt, Homo sapiens
caacaaagccaacagucaa

SEQ ID NO: 899487 - RNA, 21 nt, Homo sapiens
caacaaauuagguuuuguaca

SEQ ID NO: 899488 - RNA, 18 nt, Homo sapiens
caacaacauccauguccu

SEQ ID NO: 899489 - RNA, 17 nt, Homo sapiens
caacaauacaugcugcu

SEQ ID NO: 899490 - RNA, 19 nt, Homo sapiens
caacaauggggugggccca

SEQ ID NO: 899491 - RNA, 22 nt, Homo sapiens
caacacgagcaggcuacuguca

SEQ ID NO: 899492 - RNA, 24 nt, Homo sapiens
caacacucacauuuauucugcuca

SEQ ID NO: 899493 - RNA, 23 nt, Homo sapiens
caacagcaccaauuguacauucc

SEQ ID NO: 899494 - RNA, 16 nt, Homo sapiens
caacagcauaacuaaa

SEQ ID NO: 899495 - RNA, 18 nt, Homo sapiens
caacagcucagagaugaa

SEQ ID NO: 899496 - RNA, 16 nt, Homo sapiens
caacaggaaucucaga

SEQ ID NO: 899497 - RNA, 20 nt, Homo sapiens
caacaggaaucucagagaca

SEQ ID NO: 899498 - RNA, 21 nt, Homo sapiens
caacaggcuguucugcacuga

SEQ ID NO: 899499 - RNA, 22 nt, Homo sapiens
caacaggcuguucugcacugaa

SEQ ID NO: 899500 - RNA, 18 nt, Homo sapiens
caacagugagucugucag

SEQ ID NO: 899501 - RNA, 15 nt, Homo sapiens
caacaguucaaagaa

SEQ ID NO: 899502 - RNA, 12 nt, Homo sapiens
caacaguuccuu

SEQ ID NO: 899503 - RNA, 21 nt, Homo sapiens
caacauaaggagaauguaucu

SEQ ID NO: 899504 - RNA, 14 nt, Homo sapiens
caacauaccagacc

SEQ ID NO: 899505 - RNA, 14 nt, Homo sapiens
caacaucccauugc

SEQ ID NO: 899506 - RNA, 12 nt, Homo sapiens
caacaugacugu

SEQ ID NO: 899507 - RNA, 23 nt, Homo sapiens
caacauuacuccauuacuaaaga

SEQ ID NO: 899508 - RNA, 17 nt, Homo sapiens
caacauucccccaacau

SEQ ID NO: 899509 - RNA, 17 nt, Homo sapiens
caaccaaagacacuguc

SEQ ID NO: 899510 - RNA, 20 nt, Homo sapiens
caaccaauuccaaguuuuaa

SEQ ID NO: 899511 - RNA, 20 nt, Homo sapiens
caaccagagaugacugaaac

SEQ ID NO: 899512 - RNA, 16 nt, Homo sapiens
caaccagccacacaga

SEQ ID NO: 899513 - RNA, 17 nt, Homo sapiens
caacccucacuguguug

SEQ ID NO: 899514 - RNA, 15 nt, Homo sapiens
caacccuguuuccug

SEQ ID NO: 899515 - RNA, 17 nt, Homo sapiens
caaccuaaccccuuucc

SEQ ID NO: 899516 - RNA, 13 nt, Homo sapiens
caaccuaugguau

SEQ ID NO: 899517 - RNA, 19 nt, Homo sapiens
caaccucaaugcccugcca

SEQ ID NO: 899518 - RNA, 22 nt, Homo sapiens
caaccugaugccccuuccccaa

SEQ ID NO: 899519 - RNA, 18 nt, Homo sapiens
uauggaaccuucccucca

SEQ ID NO: 899520 - RNA, 16 nt, Homo sapiens
uauggaacucucucca

SEQ ID NO: 899521 - RNA, 19 nt, Homo sapiens
uauggaagaaaugggagaa

SEQ ID NO: 899522 - RNA, 16 nt, Homo sapiens
uauggaauacaguguu

SEQ ID NO: 899523 - RNA, 16 nt, Homo sapiens
uauggacucaguuuuc

SEQ ID NO: 899524 - RNA, 14 nt, Homo sapiens
uauggacucugcac

SEQ ID NO: 899525 - RNA, 15 nt, Homo sapiens
uauggagagcccugg

SEQ ID NO: 899526 - RNA, 15 nt, Homo sapiens
uauggcaugauuuau

SEQ ID NO: 899527 - RNA, 21 nt, Homo sapiens
uauggcccugggagagccaga

SEQ ID NO: 899528 - RNA, 17 nt, Homo sapiens
uauggcugccugcaucu

SEQ ID NO: 899529 - RNA, 13 nt, Homo sapiens
uaugggaagccau

SEQ ID NO: 899530 - RNA, 14 nt, Homo sapiens
uaugggaagccaua

SEQ ID NO: 899531 - RNA, 14 nt, Homo sapiens
uauggguacauucc

SEQ ID NO: 899532 - RNA, 12 nt, Homo sapiens
uaugggugcugg

SEQ ID NO: 899533 - RNA, 20 nt, Homo sapiens
uaugguaaaaguuacuuauu

SEQ ID NO: 899534 - RNA, 16 nt, Homo sapiens
uauguacuaagcagua

SEQ ID NO: 899535 - RNA, 18 nt, Homo sapiens
uauguagacuauauacau

SEQ ID NO: 899536 - RNA, 20 nt, Homo sapiens
uauguaggcaauacauguau

SEQ ID NO: 899537 - RNA, 20 nt, Homo sapiens
uauguaguccguuaacacua

SEQ ID NO: 899538 - RNA, 13 nt, Homo sapiens
uauguauggaaua

SEQ ID NO: 899539 - RNA, 22 nt, Homo sapiens
uaugucaggcaaagugcugcug

SEQ ID NO: 899540 - RNA, 12 nt, Homo sapiens
uaugucugccua

SEQ ID NO: 899541 - RNA, 14 nt, Homo sapiens
uaugucuuggacac

SEQ ID NO: 899542 - RNA, 18 nt, Homo sapiens
uaugucuuggacacugua

SEQ ID NO: 899543 - RNA, 14 nt, Homo sapiens
uaugugauguggca

SEQ ID NO: 899544 - RNA, 10 nt, Homo sapiens
uaugugcaau

SEQ ID NO: 899545 - RNA, 11 nt, Homo sapiens
uaugugcaaua

SEQ ID NO: 899546 - RNA, 21 nt, Homo sapiens
uaugugugcauguguguauaa

SEQ ID NO: 899547 - RNA, 19 nt, Homo sapiens
uauguuaaagcaucagaga

SEQ ID NO: 899548 - RNA, 19 nt, Homo sapiens
uauguuacuacaugcacuu

SEQ ID NO: 899549 - RNA, 22 nt, Homo sapiens
uauguucaacuggagacacuau

SEQ ID NO: 899550 - RNA, 20 nt, Homo sapiens
uauguucaaugcaaaguaaa

SEQ ID NO: 899551 - RNA, 12 nt, Homo sapiens
uauguugcccag

SEQ ID NO: 899552 - RNA, 15 nt, Homo sapiens
uauguuuacauauca

SEQ ID NO: 899553 - RNA, 21 nt, Homo sapiens
uauguuuuuagaggcuuuucc

SEQ ID NO: 899554 - RNA, 12 nt, Homo sapiens
uauuaagggaaa

SEQ ID NO: 899555 - RNA, 21 nt, Homo sapiens
uauuaaucaacuuuccuuaaa

SEQ ID NO: 899556 - RNA, 13 nt, Homo sapiens
uauuaccaugaga

SEQ ID NO: 899557 - RNA, 15 nt, Homo sapiens
uauuacgugcaauac

SEQ ID NO: 899558 - RNA, 18 nt, Homo sapiens
uauuagcaacugugcuac

SEQ ID NO: 899559 - RNA, 24 nt, Homo sapiens
uauuagcuguaaauacaugugugg

SEQ ID NO: 899560 - RNA, 15 nt, Homo sapiens
uauuaguuaggugug

SEQ ID NO: 899561 - RNA, 21 nt, Homo sapiens
uauuaguuaggugugccaaac

SEQ ID NO: 899562 - RNA, 12 nt, Homo sapiens
uauuauggauga

SEQ ID NO: 899563 - RNA, 23 nt, Homo sapiens
uauuauggcaagugauaucaccu

SEQ ID NO: 899564 - RNA, 17 nt, Homo sapiens
uauuauucuucauaaca

SEQ ID NO: 899565 - RNA, 15 nt, Homo sapiens
uauuauuuugcacug

SEQ ID NO: 899566 - RNA, 19 nt, Homo sapiens
uauucaauggaaagcugcu

SEQ ID NO: 899567 - RNA, 20 nt, Homo sapiens
uauucaauggaaagcugcuu

SEQ ID NO: 899568 - RNA, 23 nt, Homo sapiens
uauucauaauaaacuagauacug

SEQ ID NO: 899569 - RNA, 15 nt, Homo sapiens
uauucauucauucau

SEQ ID NO: 899570 - RNA, 19 nt, Homo sapiens
uauuccaugggauguuaag

SEQ ID NO: 899571 - RNA, 23 nt, Homo sapiens
uauuccaugggauguuaagcaaa

SEQ ID NO: 899572 - RNA, 17 nt, Homo sapiens
uauuccauuuuuacuaa

SEQ ID NO: 899573 - RNA, 17 nt, Homo sapiens
uauucccacagcacuaa

SEQ ID NO: 899574 - RNA, 14 nt, Homo sapiens
uauucccuguuaaa

SEQ ID NO: 899575 - RNA, 20 nt, Homo sapiens
uauuccugacccucccuacc

SEQ ID NO: 899576 - RNA, 21 nt, Homo sapiens
uauuccugguauuauuuacaa

SEQ ID NO: 899577 - RNA, 19 nt, Homo sapiens
uauucucacuccaccaccc

SEQ ID NO: 899578 - RNA, 17 nt, Homo sapiens
uauucucuucacuccca

SEQ ID NO: 899579 - RNA, 18 nt, Homo sapiens
uauugauguuuccagaaa

SEQ ID NO: 899580 - RNA, 16 nt, Homo sapiens
uauugcauaauuuaua

SEQ ID NO: 899581 - RNA, 17 nt, Homo sapiens
uauugcugaaugacuac

SEQ ID NO: 899582 - RNA, 12 nt, Homo sapiens
uauugcugugaa

SEQ ID NO: 899583 - RNA, 13 nt, Homo sapiens
uauugcugugaau

SEQ ID NO: 899584 - RNA, 18 nt, Homo sapiens
aacacguggguauuuaau

SEQ ID NO: 899585 - RNA, 17 nt, Homo sapiens
aacacuacauuacuuua

SEQ ID NO: 899586 - RNA, 11 nt, Homo sapiens
aacacuacuua

SEQ ID NO: 899587 - RNA, 19 nt, Homo sapiens
aacacuaguuuugugccag

SEQ ID NO: 899588 - RNA, 16 nt, Homo sapiens
aacacucaacaauaaa

SEQ ID NO: 899589 - RNA, 23 nt, Homo sapiens
aacacucacauuuauucugcuca

SEQ ID NO: 899590 - RNA, 14 nt, Homo sapiens
aacacucucugaga

SEQ ID NO: 899591 - RNA, 15 nt, Homo sapiens
aacacucuucuugag

SEQ ID NO: 899592 - RNA, 17 nt, Homo sapiens
aacacucuucuugagca

SEQ ID NO: 899593 - RNA, 16 nt, Homo sapiens
aacacugugaagacaa

SEQ ID NO: 899594 - RNA, 18 nt, Homo sapiens
aacagaaagcauccuaaa

SEQ ID NO: 899595 - RNA, 15 nt, Homo sapiens
aacagacaacagaag

SEQ ID NO: 899596 - RNA, 16 nt, Homo sapiens
aacagagaacccugug

SEQ ID NO: 899597 - RNA, 15 nt, Homo sapiens
aacagagcugggcua

SEQ ID NO: 899598 - RNA, 16 nt, Homo sapiens
aacagaggcauuuaaa

SEQ ID NO: 899599 - RNA, 13 nt, Homo sapiens
aacagaggccaug

SEQ ID NO: 899600 - RNA, 19 nt, Homo sapiens
aacagagugaaaugccauu

SEQ ID NO: 899601 - RNA, 22 nt, Homo sapiens
aacagauggauagucuguccaa

SEQ ID NO: 899602 - RNA, 21 nt, Homo sapiens
aacagcaaaacuccaucucaa

SEQ ID NO: 899603 - RNA, 13 nt, Homo sapiens
aacagcauaacua

SEQ ID NO: 899604 - RNA, 18 nt, Homo sapiens
aacagccccaaagucaau

SEQ ID NO: 899605 - RNA, 22 nt, Homo sapiens
aacagcguguucuaaguauuug

SEQ ID NO: 899606 - RNA, 14 nt, Homo sapiens
aacagcucucaccu

SEQ ID NO: 899607 - RNA, 14 nt, Homo sapiens
aacaggcauuccag

SEQ ID NO: 899608 - RNA, 20 nt, Homo sapiens
aacaggcuguucugcacuga

SEQ ID NO: 899609 - RNA, 21 nt, Homo sapiens
aacaggcuguucugcacugaa

SEQ ID NO: 899610 - RNA, 14 nt, Homo sapiens
aacagggacaaaga

SEQ ID NO: 899611 - RNA, 14 nt, Homo sapiens
aacaguuacaugaa

SEQ ID NO: 899612 - RNA, 20 nt, Homo sapiens
aacauaaaaucugugaauua

SEQ ID NO: 899613 - RNA, 20 nt, Homo sapiens
aacauaaauuuaucaucucg

SEQ ID NO: 899614 - RNA, 21 nt, Homo sapiens
aacauaaauuucuuuaaucau

SEQ ID NO: 899615 - RNA, 23 nt, Homo sapiens
aacauaucaaacauauguauaca

SEQ ID NO: 899616 - RNA, 15 nt, Homo sapiens
aacauaucaauucaa

SEQ ID NO: 899617 - RNA, 22 nt, Homo sapiens
aacaucaucaggcuuggaauga

SEQ ID NO: 899618 - RNA, 16 nt, Homo sapiens
aacaucaugcauucac

SEQ ID NO: 899619 - RNA, 18 nt, Homo sapiens
aacaucaugcauucacaa

SEQ ID NO: 899620 - RNA, 18 nt, Homo sapiens
aacaugagcgcugaugau

SEQ ID NO: 899621 - RNA, 12 nt, Homo sapiens
aacaugccugau

SEQ ID NO: 899622 - RNA, 16 nt, Homo sapiens
aacauggagaggacuu

SEQ ID NO: 899623 - RNA, 16 nt, Homo sapiens
aacaugguaaaacccc

SEQ ID NO: 899624 - RNA, 24 nt, Homo sapiens
aacauggugaaaccucaucucuac

SEQ ID NO: 899625 - RNA, 21 nt, Homo sapiens
aacaugugguuaaugccaugg

SEQ ID NO: 899626 - RNA, 14 nt, Homo sapiens
aacauuaugccuua

SEQ ID NO: 899627 - RNA, 18 nt, Homo sapiens
aacauuauuuauucagcu

SEQ ID NO: 899628 - RNA, 15 nt, Homo sapiens
aacauucaucaagcu

SEQ ID NO: 899629 - RNA, 22 nt, Homo sapiens
aacauugugccaugucaaacaa

SEQ ID NO: 899630 - RNA, 18 nt, Homo sapiens
aacauuuacacauucuca

SEQ ID NO: 899631 - RNA, 19 nt, Homo sapiens
aacauuuacacauucucac

SEQ ID NO: 899632 - RNA, 21 nt, Homo sapiens
aacauuuggauuggugaaugg

SEQ ID NO: 899633 - RNA, 16 nt, Homo sapiens
aaccaaauaagcaucu

SEQ ID NO: 899634 - RNA, 17 nt, Homo sapiens
aaccaaccaaccaacca

SEQ ID NO: 899635 - RNA, 17 nt, Homo sapiens
aaccaagucuacuucac

SEQ ID NO: 899636 - RNA, 12 nt, Homo sapiens
aaccaaugagcu

SEQ ID NO: 899637 - RNA, 21 nt, Homo sapiens
cagcuaugcacuguaaaugca

SEQ ID NO: 899638 - RNA, 21 nt, Homo sapiens
cagcucugcauuaucugaggu

SEQ ID NO: 899639 - RNA, 17 nt, Homo sapiens
cagcucuguccugggag

SEQ ID NO: 899640 - RNA, 23 nt, Homo sapiens
cagcugacagcugcucaaaucau

SEQ ID NO: 899641 - RNA, 15 nt, Homo sapiens
cagcugcaccugcca

SEQ ID NO: 899642 - RNA, 18 nt, Homo sapiens
cagcugcagaugccacac

SEQ ID NO: 899643 - RNA, 15 nt, Homo sapiens
cagcuggaacccugg

SEQ ID NO: 899644 - RNA, 17 nt, Homo sapiens
cagcugucgcaucucag

SEQ ID NO: 899645 - RNA, 23 nt, Homo sapiens
cagcuucauuaugcagcugaggu

SEQ ID NO: 899646 - RNA, 22 nt, Homo sapiens
cagcuuguaaauagcucaggug

SEQ ID NO: 899647 - RNA, 20 nt, Homo sapiens
cagcuuguugguugucacuc

SEQ ID NO: 899648 - RNA, 19 nt, Homo sapiens
cagcuuugcuaccaaagca

SEQ ID NO: 899649 - RNA, 17 nt, Homo sapiens
cagcuuuucccaggaga

SEQ ID NO: 899650 - RNA, 23 nt, Homo sapiens
cagcuuuucccaggagaccauuu

SEQ ID NO: 899651 - RNA, 21 nt, Homo sapiens
caggaaaagguagcuuaccug

SEQ ID NO: 899652 - RNA, 14 nt, Homo sapiens
caggaaaaugccag

SEQ ID NO: 899653 - RNA, 15 nt, Homo sapiens
caggaagagaaggag

SEQ ID NO: 899654 - RNA, 18 nt, Homo sapiens
caggaagggaaagccaga

SEQ ID NO: 899655 - RNA, 18 nt, Homo sapiens
caggaagugucuagagga

SEQ ID NO: 899656 - RNA, 21 nt, Homo sapiens
caggaauaggcauuugccuaa

SEQ ID NO: 899657 - RNA, 14 nt, Homo sapiens
caggaccucuggac

SEQ ID NO: 899658 - RNA, 20 nt, Homo sapiens
caggacucacccucauacca

SEQ ID NO: 899659 - RNA, 16 nt, Homo sapiens
caggacucugccccuu

SEQ ID NO: 899660 - RNA, 22 nt, Homo sapiens
caggacucugccuccucuucaa

SEQ ID NO: 899661 - RNA, 19 nt, Homo sapiens
caggagaauggugugaacc

SEQ ID NO: 899662 - RNA, 23 nt, Homo sapiens
caggagcaaauguuucugcagua

SEQ ID NO: 899663 - RNA, 17 nt, Homo sapiens
caggagccgcugcugag

SEQ ID NO: 899664 - RNA, 21 nt, Homo sapiens
caggagcuaccuguguggaca

SEQ ID NO: 899665 - RNA, 16 nt, Homo sapiens
caggagcuugauccag

SEQ ID NO: 899666 - RNA, 14 nt, Homo sapiens
caggaggaucacag

SEQ ID NO: 899667 - RNA, 21 nt, Homo sapiens
caggagggguuaaagcugccg

SEQ ID NO: 899668 - RNA, 22 nt, Homo sapiens
caggagguggagguugcaguga

SEQ ID NO: 899669 - RNA, 18 nt, Homo sapiens
caggaguagcugagcuca

SEQ ID NO: 899670 - RNA, 22 nt, Homo sapiens
caggaguuugaggcugcagcga

SEQ ID NO: 899671 - RNA, 18 nt, Homo sapiens
caggaguuugugugucuu

SEQ ID NO: 899672 - RNA, 14 nt, Homo sapiens
caggauaccauaua

SEQ ID NO: 899673 - RNA, 11 nt, Homo sapiens
caggaucucag

SEQ ID NO: 899674 - RNA, 15 nt, Homo sapiens
caggaucuguacaau

SEQ ID NO: 899675 - RNA, 23 nt, Homo sapiens
caggaucuguacaauaauaauua

SEQ ID NO: 899676 - RNA, 13 nt, Homo sapiens
caggaugaguuac

SEQ ID NO: 899677 - RNA, 18 nt, Homo sapiens
caggaugaguuacuugaa

SEQ ID NO: 899678 - RNA, 22 nt, Homo sapiens
caggauuucaucugagugugga

SEQ ID NO: 899679 - RNA, 15 nt, Homo sapiens
caggcaaaauugaua

SEQ ID NO: 899680 - RNA, 17 nt, Homo sapiens
caggcaaagugcugcug

SEQ ID NO: 899681 - RNA, 14 nt, Homo sapiens
caggcaacugaggc

SEQ ID NO: 899682 - RNA, 13 nt, Homo sapiens
caggcaagcaccu

SEQ ID NO: 899683 - RNA, 16 nt, Homo sapiens
caggcaagcaccuccu

SEQ ID NO: 899684 - RNA, 15 nt, Homo sapiens
caggcacugcugccc

SEQ ID NO: 899685 - RNA, 19 nt, Homo sapiens
caggcaggcccugccuuca

SEQ ID NO: 899686 - RNA, 18 nt, Homo sapiens
caggcagguuugccagug

SEQ ID NO: 899687 - RNA, 19 nt, Homo sapiens
caggcagguuugccaguga

SEQ ID NO: 899688 - RNA, 18 nt, Homo sapiens
caggccagagugcugcca

SEQ ID NO: 899689 - RNA, 17 nt, Homo sapiens
caggccagugccaggac

SEQ ID NO: 899690 - RNA, 17 nt, Homo sapiens
caggccccgcuugucca

SEQ ID NO: 899691 - RNA, 18 nt, Homo sapiens
caggcccuuccucuccac

SEQ ID NO: 899692 - RNA, 15 nt, Homo sapiens
caggccggguggcca

SEQ ID NO: 899693 - RNA, 16 nt, Homo sapiens
caggccggguggccaa

SEQ ID NO: 899694 - RNA, 20 nt, Homo sapiens
caggccuaggaccucaggcg

SEQ ID NO: 899695 - RNA, 14 nt, Homo sapiens
caggccucccucaa

SEQ ID NO: 899696 - RNA, 16 nt, Homo sapiens
caggccugggacccag

SEQ ID NO: 899697 - RNA, 15 nt, Homo sapiens
caggcgcaugugcca

SEQ ID NO: 899698 - RNA, 17 nt, Homo sapiens
aacuagaauuuauucaa

SEQ ID NO: 899699 - RNA, 18 nt, Homo sapiens
aacuagcuuggaaacugg

SEQ ID NO: 899700 - RNA, 13 nt, Homo sapiens
aacuaggaccuca

SEQ ID NO: 899701 - RNA, 20 nt, Homo sapiens
aacuaggaccucauaucuuc

SEQ ID NO: 899702 - RNA, 11 nt, Homo sapiens
aacuauggaaa

SEQ ID NO: 899703 - RNA, 19 nt, Homo sapiens
aacuaugguucccaauaaa

SEQ ID NO: 899704 - RNA, 17 nt, Homo sapiens
aacuaugugauguuaac

SEQ ID NO: 899705 - RNA, 19 nt, Homo sapiens
aacuauugauaugugaaua

SEQ ID NO: 899706 - RNA, 18 nt, Homo sapiens
aacuauuuacauuuucca

SEQ ID NO: 899707 - RNA, 21 nt, Homo sapiens
aacucaaggaaaucuguguca

SEQ ID NO: 899708 - RNA, 11 nt, Homo sapiens
aacucaauauu

SEQ ID NO: 899709 - RNA, 15 nt, Homo sapiens
aacucacugcucaag

SEQ ID NO: 899710 - RNA, 21 nt, Homo sapiens
aacucagaaugcucuacuucu

SEQ ID NO: 899711 - RNA, 15 nt, Homo sapiens
aacucaucugucacc

SEQ ID NO: 899712 - RNA, 13 nt, Homo sapiens
aacuccagucucc

SEQ ID NO: 899713 - RNA, 18 nt, Homo sapiens
aacuccccuuguacucuu

SEQ ID NO: 899714 - RNA, 22 nt, Homo sapiens
aacuccugauuuuguaguuaau

SEQ ID NO: 899715 - RNA, 19 nt, Homo sapiens
aacuccuuuagcagguggu

SEQ ID NO: 899716 - RNA, 22 nt, Homo sapiens
aacucucuccuguauaaucucu

SEQ ID NO: 899717 - RNA, 18 nt, Homo sapiens
aacucugacaagggcuga

SEQ ID NO: 899718 - RNA, 16 nt, Homo sapiens
aacucugccagccaca

SEQ ID NO: 899719 - RNA, 13 nt, Homo sapiens
aacucuuaagcaa

SEQ ID NO: 899720 - RNA, 20 nt, Homo sapiens
aacugaccagccuccaugcu

SEQ ID NO: 899721 - RNA, 22 nt, Homo sapiens
aacugacuagugagauggccug

SEQ ID NO: 899722 - RNA, 18 nt, Homo sapiens
aacugacuuaaguggcau

SEQ ID NO: 899723 - RNA, 13 nt, Homo sapiens
aacugagagcaga

SEQ ID NO: 899724 - RNA, 15 nt, Homo sapiens
aacugagccaaacac

SEQ ID NO: 899725 - RNA, 18 nt, Homo sapiens
aacugaggaguagcugag

SEQ ID NO: 899726 - RNA, 22 nt, Homo sapiens
aacugaugcgaaaacuugaauc

SEQ ID NO: 899727 - RNA, 18 nt, Homo sapiens
aacugauuuaugaucacu

SEQ ID NO: 899728 - RNA, 18 nt, Homo sapiens
aacugauuuuuagcuuua

SEQ ID NO: 899729 - RNA, 13 nt, Homo sapiens
aacugcaguaugg

SEQ ID NO: 899730 - RNA, 12 nt, Homo sapiens
aacugccagcaa

SEQ ID NO: 899731 - RNA, 15 nt, Homo sapiens
aacugccccaucucc

SEQ ID NO: 899732 - RNA, 17 nt, Homo sapiens
aacuggaauccuuucag

SEQ ID NO: 899733 - RNA, 20 nt, Homo sapiens
aacuggaggaguuccuugau

SEQ ID NO: 899734 - RNA, 21 nt, Homo sapiens
aacuggaggaguuccuugauc

SEQ ID NO: 899735 - RNA, 18 nt, Homo sapiens
aacuguagauaaaguggu

SEQ ID NO: 899736 - RNA, 13 nt, Homo sapiens
aacuguguguaca

SEQ ID NO: 899737 - RNA, 22 nt, Homo sapiens
aacuguucuggccucagaccaa

SEQ ID NO: 899738 - RNA, 17 nt, Homo sapiens
aacuuaaaaauauccau

SEQ ID NO: 899739 - RNA, 14 nt, Homo sapiens
aacuuaaaagauuc

SEQ ID NO: 899740 - RNA, 16 nt, Homo sapiens
aacuuaaacauauucu

SEQ ID NO: 899741 - RNA, 16 nt, Homo sapiens
aacuuaaaucacugag

SEQ ID NO: 899742 - RNA, 14 nt, Homo sapiens
aacuuauaucauca

SEQ ID NO: 899743 - RNA, 19 nt, Homo sapiens
aacuuauaucaucagcaua

SEQ ID NO: 899744 - RNA, 13 nt, Homo sapiens
aacuucauuugau

SEQ ID NO: 899745 - RNA, 12 nt, Homo sapiens
aacuuccacucc

SEQ ID NO: 899746 - RNA, 14 nt, Homo sapiens
aacuucucugaguc

SEQ ID NO: 899747 - RNA, 19 nt, Homo sapiens
aacuugacaguaaaucaca

SEQ ID NO: 899748 - RNA, 19 nt, Homo sapiens
aacuugaggacacaugucc

SEQ ID NO: 899749 - RNA, 20 nt, Homo sapiens
aacuugaggacacaugucca

SEQ ID NO: 899750 - RNA, 20 nt, Homo sapiens
aacuugcacgacgccugcca

SEQ ID NO: 899751 - RNA, 19 nt, Homo sapiens
aacuugcuucuaaaugccc

SEQ ID NO: 899752 - RNA, 16 nt, Homo sapiens
caguccauagcagaga

SEQ ID NO: 899753 - RNA, 15 nt, Homo sapiens
caguccccagcccuu

SEQ ID NO: 899754 - RNA, 23 nt, Homo sapiens
cagucccuaaagaaaaaaaauca

SEQ ID NO: 899755 - RNA, 20 nt, Homo sapiens
caguccgccaaacacuccac

SEQ ID NO: 899756 - RNA, 23 nt, Homo sapiens
caguccugggagaaccucaggcu

SEQ ID NO: 899757 - RNA, 18 nt, Homo sapiens
cagucuacguucuccagc

SEQ ID NO: 899758 - RNA, 16 nt, Homo sapiens
cagucucagaaagccu

SEQ ID NO: 899759 - RNA, 22 nt, Homo sapiens
cagucucggguggcuagucaga

SEQ ID NO: 899760 - RNA, 14 nt, Homo sapiens
cagucucuucugau

SEQ ID NO: 899761 - RNA, 13 nt, Homo sapiens
cagucugagcugu

SEQ ID NO: 899762 - RNA, 19 nt, Homo sapiens
cagucuucucucacuuuga

SEQ ID NO: 899763 - RNA, 13 nt, Homo sapiens
cagucuuggaaua

SEQ ID NO: 899764 - RNA, 15 nt, Homo sapiens
cagugaaccaaagag

SEQ ID NO: 899765 - RNA, 16 nt, Homo sapiens
cagugacaaauuguaa

SEQ ID NO: 899766 - RNA, 17 nt, Homo sapiens
cagugacgugcaccugu

SEQ ID NO: 899767 - RNA, 20 nt, Homo sapiens
cagugacugucguguuuaca

SEQ ID NO: 899768 - RNA, 20 nt, Homo sapiens
cagugagccgagauggcgcu

SEQ ID NO: 899769 - RNA, 19 nt, Homo sapiens
cagugauuugccaaaguga

SEQ ID NO: 899770 - RNA, 14 nt, Homo sapiens
cagugcaaccacac

SEQ ID NO: 899771 - RNA, 17 nt, Homo sapiens
cagugcaaccacacacc

SEQ ID NO: 899772 - RNA, 19 nt, Homo sapiens
cagugcacacggaugcaca

SEQ ID NO: 899773 - RNA, 20 nt, Homo sapiens
cagugcacacggaugcacag

SEQ ID NO: 899774 - RNA, 16 nt, Homo sapiens
cagugcacuguauaua

SEQ ID NO: 899775 - RNA, 14 nt, Homo sapiens
cagugcauguugcc

SEQ ID NO: 899776 - RNA, 15 nt, Homo sapiens
cagugcauguugcca

SEQ ID NO: 899777 - RNA, 16 nt, Homo sapiens
cagugccuggcaaggc

SEQ ID NO: 899778 - RNA, 16 nt, Homo sapiens
cagugccuuccauaau

SEQ ID NO: 899779 - RNA, 23 nt, Homo sapiens
cagugcucggcuguaaacagcuc

SEQ ID NO: 899780 - RNA, 14 nt, Homo sapiens
caguggacaccagg

SEQ ID NO: 899781 - RNA, 20 nt, Homo sapiens
caguggcauucacaucucau

SEQ ID NO: 899782 - RNA, 23 nt, Homo sapiens
caguggcccauaaguguaaaaua

SEQ ID NO: 899783 - RNA, 23 nt, Homo sapiens
caguggcugaauagcuucuccaa

SEQ ID NO: 899784 - RNA, 23 nt, Homo sapiens
caguggggacggaaggcaaagag

SEQ ID NO: 899785 - RNA, 18 nt, Homo sapiens
caguggugcgaucuuggc

SEQ ID NO: 899786 - RNA, 20 nt, Homo sapiens
caguguaaagaauaaaugaa

SEQ ID NO: 899787 - RNA, 21 nt, Homo sapiens
caguguauguacuaagcagua

SEQ ID NO: 899788 - RNA, 20 nt, Homo sapiens
caguguccccuccacuguca

SEQ ID NO: 899789 - RNA, 14 nt, Homo sapiens
caguguccucaggg

SEQ ID NO: 899790 - RNA, 20 nt, Homo sapiens
caguguuauuaaugacaaag

SEQ ID NO: 899791 - RNA, 12 nt, Homo sapiens
caguguuuagaa

SEQ ID NO: 899792 - RNA, 14 nt, Homo sapiens
caguuaacucuccc

SEQ ID NO: 899793 - RNA, 12 nt, Homo sapiens
caguuacagggc

SEQ ID NO: 899794 - RNA, 23 nt, Homo sapiens
caguuacugguuucaguugacaa

SEQ ID NO: 899795 - RNA, 16 nt, Homo sapiens
caguuagguagcuuua

SEQ ID NO: 899796 - RNA, 22 nt, Homo sapiens
caguuauaauuauuccacucaa

SEQ ID NO: 899797 - RNA, 16 nt, Homo sapiens
caguuauacauaccuc

SEQ ID NO: 899798 - RNA, 17 nt, Homo sapiens
caguuauagaaaaucua

SEQ ID NO: 899799 - RNA, 19 nt, Homo sapiens
caguuaugcagaauccaaa

SEQ ID NO: 899800 - RNA, 15 nt, Homo sapiens
caguucaaauccuca

SEQ ID NO: 899801 - RNA, 11 nt, Homo sapiens
caguucacagg

SEQ ID NO: 899802 - RNA, 21 nt, Homo sapiens
caguucaggagucccaaggaa

SEQ ID NO: 899803 - RNA, 19 nt, Homo sapiens
caguucgcagccacccuga

SEQ ID NO: 899804 - RNA, 14 nt, Homo sapiens
caguucugacacac

SEQ ID NO: 899805 - RNA, 13 nt, Homo sapiens
caguugacuuacu

SEQ ID NO: 899806 - RNA, 23 nt, Homo sapiens
caguugacuuacuguuucuuacc

SEQ ID NO: 899807 - RNA, 14 nt, Homo sapiens
caguugcuuugcag

SEQ ID NO: 899808 - RNA, 16 nt, Homo sapiens
caguugggcuaugugu

SEQ ID NO: 899809 - RNA, 18 nt, Homo sapiens
caguuguauggagccucu

SEQ ID NO: 899810 - RNA, 16 nt, Homo sapiens
caguuguuccuacuca

SEQ ID NO: 899811 - RNA, 20 nt, Homo sapiens
caguuucagguguuuaguug

SEQ ID NO: 899812 - RNA, 19 nt, Homo sapiens
caguuucuaucauucugcu

SEQ ID NO: 899813 - RNA, 17 nt, Homo sapiens
aagagaucacaauacuc

SEQ ID NO: 899814 - RNA, 16 nt, Homo sapiens
aagagcuuacaagacc

SEQ ID NO: 899815 - RNA, 23 nt, Homo sapiens
aagaggcagcuugaaacugagau

SEQ ID NO: 899816 - RNA, 23 nt, Homo sapiens
aagaggcccugucuguaccuaac

SEQ ID NO: 899817 - RNA, 16 nt, Homo sapiens
aagaggcgacuuccuc

SEQ ID NO: 899818 - RNA, 21 nt, Homo sapiens
aagaggcuauuuaaaaguaua

SEQ ID NO: 899819 - RNA, 17 nt, Homo sapiens
aagagggagaagggaug

SEQ ID NO: 899820 - RNA, 21 nt, Homo sapiens
aagagugagugaacaacuauu

SEQ ID NO: 899821 - RNA, 19 nt, Homo sapiens
aagagugccguaacaacug

SEQ ID NO: 899822 - RNA, 15 nt, Homo sapiens
aagaguggacugaau

SEQ ID NO: 899823 - RNA, 14 nt, Homo sapiens
aagaguuacuuaau

SEQ ID NO: 899824 - RNA, 20 nt, Homo sapiens
aagauaauuuguugggccau

SEQ ID NO: 899825 - RNA, 14 nt, Homo sapiens
aagauacauuucau

SEQ ID NO: 899826 - RNA, 14 nt, Homo sapiens
aagaucccgugaaa

SEQ ID NO: 899827 - RNA, 14 nt, Homo sapiens
aagaucccuauuau

SEQ ID NO: 899828 - RNA, 17 nt, Homo sapiens
aagaugaugaugaucuu

SEQ ID NO: 899829 - RNA, 21 nt, Homo sapiens
aagaugccagugaaacuucaa

SEQ ID NO: 899830 - RNA, 20 nt, Homo sapiens
aagauggaggggcugacuca

SEQ ID NO: 899831 - RNA, 22 nt, Homo sapiens
aagauuguccagugcaaccaca

SEQ ID NO: 899832 - RNA, 13 nt, Homo sapiens
aagauuuaaguaa

SEQ ID NO: 899833 - RNA, 20 nt, Homo sapiens
aagauuucuccugacuccag

SEQ ID NO: 899834 - RNA, 16 nt, Homo sapiens
aagauuuuuaauuaca

SEQ ID NO: 899835 - RNA, 18 nt, Homo sapiens
aagcaaauuaguaauugu

SEQ ID NO: 899836 - RNA, 23 nt, Homo sapiens
aagcaacacccacccacuucuca

SEQ ID NO: 899837 - RNA, 23 nt, Homo sapiens
aagcaacagauggauagucuguc

SEQ ID NO: 899838 - RNA, 20 nt, Homo sapiens
aagcaagacuguugcucaaa

SEQ ID NO: 899839 - RNA, 14 nt, Homo sapiens
aagcaagggcucca

SEQ ID NO: 899840 - RNA, 20 nt, Homo sapiens
aagcaauuauugugccucag

SEQ ID NO: 899841 - RNA, 19 nt, Homo sapiens
aagcacauaugaacuggac

SEQ ID NO: 899842 - RNA, 23 nt, Homo sapiens
aagcaccuagccucgcucuuggc

SEQ ID NO: 899843 - RNA, 17 nt, Homo sapiens
aagcaccugccgaccuc

SEQ ID NO: 899844 - RNA, 17 nt, Homo sapiens
aagcagcauucagcaca

SEQ ID NO: 899845 - RNA, 13 nt, Homo sapiens
aagcaguccuccu

SEQ ID NO: 899846 - RNA, 19 nt, Homo sapiens
aagcaucaaagcacuguuu

SEQ ID NO: 899847 - RNA, 20 nt, Homo sapiens
aagcaucauuauuugcagag

SEQ ID NO: 899848 - RNA, 24 nt, Homo sapiens
aagcaucucagccuaccaugagaa

SEQ ID NO: 899849 - RNA, 21 nt, Homo sapiens
aagccaccuuccagugagcuc

SEQ ID NO: 899850 - RNA, 11 nt, Homo sapiens
aagccacugaa

SEQ ID NO: 899851 - RNA, 19 nt, Homo sapiens
aagccaggguccugagugg

SEQ ID NO: 899852 - RNA, 22 nt, Homo sapiens
aagccauaguggagagaacuga

SEQ ID NO: 899853 - RNA, 19 nt, Homo sapiens
aagcccccacuucucucca

SEQ ID NO: 899854 - RNA, 22 nt, Homo sapiens
aagccccuuacuaugaucucag

SEQ ID NO: 899855 - RNA, 23 nt, Homo sapiens
aagccccuuacuaugaucucagg

SEQ ID NO: 899856 - RNA, 23 nt, Homo sapiens
aagccccuuggcccucucccaug

SEQ ID NO: 899857 - RNA, 20 nt, Homo sapiens
aagccgguugcagagaaucu

SEQ ID NO: 899858 - RNA, 15 nt, Homo sapiens
aagccuaccaaugua

SEQ ID NO: 899859 - RNA, 22 nt, Homo sapiens
aagccucccuccucguccccug

SEQ ID NO: 899860 - RNA, 20 nt, Homo sapiens
aagccuuggggauucuucca

SEQ ID NO: 899861 - RNA, 21 nt, Homo sapiens
aagccuuuagagccagcccau

SEQ ID NO: 899862 - RNA, 22 nt, Homo sapiens
aagcgaaaaaaaaaaaugcacu

SEQ ID NO: 899863 - RNA, 15 nt, Homo sapiens
aagcguuugcacaga

SEQ ID NO: 899864 - RNA, 14 nt, Homo sapiens
aagcuacaguuuug

SEQ ID NO: 899865 - RNA, 16 nt, Homo sapiens
aagcuacugaauuuau

SEQ ID NO: 899866 - RNA, 23 nt, Homo sapiens
cauauucuuuaaauuucaucuca

SEQ ID NO: 899867 - RNA, 18 nt, Homo sapiens
cauauuguauguaaguaa

SEQ ID NO: 899868 - RNA, 18 nt, Homo sapiens
cauauugugccaauaugu

SEQ ID NO: 899869 - RNA, 15 nt, Homo sapiens
cauauuuauauugua

SEQ ID NO: 899870 - RNA, 13 nt, Homo sapiens
cauauuucuuugg

SEQ ID NO: 899871 - RNA, 14 nt, Homo sapiens
cauauuugcacaau

SEQ ID NO: 899872 - RNA, 14 nt, Homo sapiens
caucaaagcacugu

SEQ ID NO: 899873 - RNA, 22 nt, Homo sapiens
caucaagaugagagaacuggag

SEQ ID NO: 899874 - RNA, 13 nt, Homo sapiens
caucaagcuguac

SEQ ID NO: 899875 - RNA, 16 nt, Homo sapiens
caucacagcagugcau

SEQ ID NO: 899876 - RNA, 14 nt, Homo sapiens
caucacuacaguac

SEQ ID NO: 899877 - RNA, 20 nt, Homo sapiens
caucacuagccaugauaacu

SEQ ID NO: 899878 - RNA, 18 nt, Homo sapiens
caucacuuaacugauguu

SEQ ID NO: 899879 - RNA, 10 nt, Homo sapiens
caucagaaag

SEQ ID NO: 899880 - RNA, 22 nt, Homo sapiens
caucagacagguaaaugggcag

SEQ ID NO: 899881 - RNA, 15 nt, Homo sapiens
caucaggguuugcaa

SEQ ID NO: 899882 - RNA, 21 nt, Homo sapiens
caucagguuccaguugcuuga

SEQ ID NO: 899883 - RNA, 21 nt, Homo sapiens
caucagugcacacggaugcac

SEQ ID NO: 899884 - RNA, 22 nt, Homo sapiens
caucaguguccucuugcucaaa

SEQ ID NO: 899885 - RNA, 18 nt, Homo sapiens
caucaguuacugguuuca

SEQ ID NO: 899886 - RNA, 16 nt, Homo sapiens
caucauaaccauuccc

SEQ ID NO: 899887 - RNA, 18 nt, Homo sapiens
caucauaugaauguucuu

SEQ ID NO: 899888 - RNA, 14 nt, Homo sapiens
caucaugucuggcu

SEQ ID NO: 899889 - RNA, 18 nt, Homo sapiens
caucauguuggccaggcu

SEQ ID NO: 899890 - RNA, 14 nt, Homo sapiens
cauccacugugcca

SEQ ID NO: 899891 - RNA, 16 nt, Homo sapiens
cauccacugugccaug

SEQ ID NO: 899892 - RNA, 17 nt, Homo sapiens
cauccagaaguuccuca

SEQ ID NO: 899893 - RNA, 14 nt, Homo sapiens
caucccaagccaga

SEQ ID NO: 899894 - RNA, 13 nt, Homo sapiens
caucccagagccc

SEQ ID NO: 899895 - RNA, 14 nt, Homo sapiens
caucccauguauuu

SEQ ID NO: 899896 - RNA, 16 nt, Homo sapiens
cauccccagcgauucc

SEQ ID NO: 899897 - RNA, 17 nt, Homo sapiens
cauccccuggacuggga

SEQ ID NO: 899898 - RNA, 18 nt, Homo sapiens
caucccugaugucugucu

SEQ ID NO: 899899 - RNA, 21 nt, Homo sapiens
caucccugggccugcugcuga

SEQ ID NO: 899900 - RNA, 16 nt, Homo sapiens
cauccggcuccuguca

SEQ ID NO: 899901 - RNA, 17 nt, Homo sapiens
cauccugcucauaacau

SEQ ID NO: 899902 - RNA, 13 nt, Homo sapiens
cauccuucaucug

SEQ ID NO: 899903 - RNA, 22 nt, Homo sapiens
cauccuuuacuauuaagggaaa

SEQ ID NO: 899904 - RNA, 22 nt, Homo sapiens
caucguggugugucaaugccac

SEQ ID NO: 899905 - RNA, 12 nt, Homo sapiens
caucuaaucuau

SEQ ID NO: 899906 - RNA, 13 nt, Homo sapiens
caucuacaagcau

SEQ ID NO: 899907 - RNA, 20 nt, Homo sapiens
caucuaccgaccugucuccc

SEQ ID NO: 899908 - RNA, 20 nt, Homo sapiens
caucuagaggcuuccuucau

SEQ ID NO: 899909 - RNA, 18 nt, Homo sapiens
caucuauuauaaaaccau

SEQ ID NO: 899910 - RNA, 14 nt, Homo sapiens
caucucacuuugcc

SEQ ID NO: 899911 - RNA, 21 nt, Homo sapiens
caucucacuuugccccaguua

SEQ ID NO: 899912 - RNA, 14 nt, Homo sapiens
caucucgaccacuu

SEQ ID NO: 899913 - RNA, 23 nt, Homo sapiens
caucucuaacauaugauacugau

SEQ ID NO: 899914 - RNA, 15 nt, Homo sapiens
caucucugucucaaa

SEQ ID NO: 899915 - RNA, 22 nt, Homo sapiens
caucugacaugcaucaucucau

SEQ ID NO: 899916 - RNA, 13 nt, Homo sapiens
caucugauuguga

SEQ ID NO: 899917 - RNA, 19 nt, Homo sapiens
caucugcuuguauuuucca

SEQ ID NO: 899918 - RNA, 19 nt, Homo sapiens
caucuguggaaaugacagc

SEQ ID NO: 899919 - RNA, 20 nt, Homo sapiens
caucuuagauagaugguacu

SEQ ID NO: 899920 - RNA, 19 nt, Homo sapiens
caucuucaaagcuugaaga

SEQ ID NO: 899921 - RNA, 16 nt, Homo sapiens
caucuugguccuguca

SEQ ID NO: 899922 - RNA, 20 nt, Homo sapiens
caucuugucaagaaauaucc

SEQ ID NO: 899923 - RNA, 17 nt, Homo sapiens
caucuuguugccaugga

SEQ ID NO: 899924 - RNA, 19 nt, Homo sapiens
caucuuucaacaaugacua

SEQ ID NO: 899925 - RNA, 21 nt, Homo sapiens
caucuuucuucuauuuuauuc

SEQ ID NO: 899926 - RNA, 15 nt, Homo sapiens
caugaaacacuucuc

SEQ ID NO: 899927 - RNA, 13 nt, Homo sapiens
cuaugacaugcaa

SEQ ID NO: 899928 - RNA, 17 nt, Homo sapiens
cuaugacugcagaucau

SEQ ID NO: 899929 - RNA, 14 nt, Homo sapiens
cuaugauaaauuca

SEQ ID NO: 899930 - RNA, 16 nt, Homo sapiens
cuaugauccacaaaaa

SEQ ID NO: 899931 - RNA, 15 nt, Homo sapiens
cuaugcccacucuaa

SEQ ID NO: 899932 - RNA, 13 nt, Homo sapiens
cuaugcugaagag

SEQ ID NO: 899933 - RNA, 15 nt, Homo sapiens
cuauggaaggguaau

SEQ ID NO: 899934 - RNA, 17 nt, Homo sapiens
cuauggcugccugcauc

SEQ ID NO: 899935 - RNA, 16 nt, Homo sapiens
cuauguaugcaucuau

SEQ ID NO: 899936 - RNA, 11 nt, Homo sapiens
cuauguucccu

SEQ ID NO: 899937 - RNA, 20 nt, Homo sapiens
cuauuaaaacagccaaaacu

SEQ ID NO: 899938 - RNA, 20 nt, Homo sapiens
cuauuaaagugauuucauuc

SEQ ID NO: 899939 - RNA, 14 nt, Homo sapiens
cuauuaccaugaga

SEQ ID NO: 899940 - RNA, 15 nt, Homo sapiens
cuauuacgugcaaua

SEQ ID NO: 899941 - RNA, 12 nt, Homo sapiens
cuauucaaugau

SEQ ID NO: 899942 - RNA, 16 nt, Homo sapiens
cuauucaauuuaauuc

SEQ ID NO: 899943 - RNA, 16 nt, Homo sapiens
cuauucagacaagcaa

SEQ ID NO: 899944 - RNA, 13 nt, Homo sapiens
cuauucucaccag

SEQ ID NO: 899945 - RNA, 21 nt, Homo sapiens
cuauucucggggcccugugua

SEQ ID NO: 899946 - RNA, 16 nt, Homo sapiens
cuauugaaauuacuga

SEQ ID NO: 899947 - RNA, 14 nt, Homo sapiens
cuauugaacugagc

SEQ ID NO: 899948 - RNA, 12 nt, Homo sapiens
cuauugcugcuc

SEQ ID NO: 899949 - RNA, 15 nt, Homo sapiens
cuauuuaacuugagg

SEQ ID NO: 899950 - RNA, 17 nt, Homo sapiens
cuauuuaacuugagggu

SEQ ID NO: 899951 - RNA, 20 nt, Homo sapiens
cuauuucauuuuuugcauca

SEQ ID NO: 899952 - RNA, 17 nt, Homo sapiens
cuauuucuacacagugg

SEQ ID NO: 899953 - RNA, 23 nt, Homo sapiens
cuauuuggggcuugcaugccaaa

SEQ ID NO: 899954 - RNA, 15 nt, Homo sapiens
cuauuuguucagaga

SEQ ID NO: 899955 - RNA, 18 nt, Homo sapiens
cuauuuguuuacaugcag

SEQ ID NO: 899956 - RNA, 14 nt, Homo sapiens
cuauuuguuuucau

SEQ ID NO: 899957 - RNA, 21 nt, Homo sapiens
cuauuuucaacauaacugaag

SEQ ID NO: 899958 - RNA, 22 nt, Homo sapiens
cuauuuuuauuuguuugugcau

SEQ ID NO: 899959 - RNA, 15 nt, Homo sapiens
cuauuuuuguagaag

SEQ ID NO: 899960 - RNA, 16 nt, Homo sapiens
cucaaaaaaagggcaa

SEQ ID NO: 899961 - RNA, 20 nt, Homo sapiens
cucaaacucuugaccucagg

SEQ ID NO: 899962 - RNA, 22 nt, Homo sapiens
cucaaacucuugaccucaggug

SEQ ID NO: 899963 - RNA, 14 nt, Homo sapiens
cucaaaucuauuca

SEQ ID NO: 899964 - RNA, 17 nt, Homo sapiens
cucaaaugacccaaaga

SEQ ID NO: 899965 - RNA, 17 nt, Homo sapiens
cucaaaugcacaucuca

SEQ ID NO: 899966 - RNA, 12 nt, Homo sapiens
cucaaaugucag

SEQ ID NO: 899967 - RNA, 19 nt, Homo sapiens
cucaacaauaaaacauuau

SEQ ID NO: 899968 - RNA, 18 nt, Homo sapiens
cucaacguugcuccccau

SEQ ID NO: 899969 - RNA, 12 nt, Homo sapiens
cucaagacugaa

SEQ ID NO: 899970 - RNA, 16 nt, Homo sapiens
cucaagaugaaggcaa

SEQ ID NO: 899971 - RNA, 17 nt, Homo sapiens
cucaaggaauuugcauu

SEQ ID NO: 899972 - RNA, 17 nt, Homo sapiens
cucaagucuucccugau

SEQ ID NO: 899973 - RNA, 19 nt, Homo sapiens
cucaaguuuuuguuuugua

SEQ ID NO: 899974 - RNA, 14 nt, Homo sapiens
cucaauaugugauu

SEQ ID NO: 899975 - RNA, 20 nt, Homo sapiens
cucaaucaugaguaccucaa

SEQ ID NO: 899976 - RNA, 15 nt, Homo sapiens
cucaaugcacugaca

SEQ ID NO: 899977 - RNA, 18 nt, Homo sapiens
cucaaugcaugaaucugu

SEQ ID NO: 899978 - RNA, 18 nt, Homo sapiens
cucaaugcuuuucuagca

SEQ ID NO: 899979 - RNA, 17 nt, Homo sapiens
cucacaacuguuuuuga

SEQ ID NO: 899980 - RNA, 15 nt, Homo sapiens
cucacaagaagacca

SEQ ID NO: 899981 - RNA, 18 nt, Homo sapiens
cucacacuuggagcuaau

SEQ ID NO: 899982 - RNA, 20 nt, Homo sapiens
cucacauagcuacccaaaag

SEQ ID NO: 899983 - RNA, 18 nt, Homo sapiens
cucacccuguaccacaaa

SEQ ID NO: 899984 - RNA, 19 nt, Homo sapiens
cucaccgggcuacuaccug

SEQ ID NO: 899985 - RNA, 23 nt, Homo sapiens
cucaccguuggcuacccggucac

SEQ ID NO: 899986 - RNA, 11 nt, Homo sapiens
cucaccucucu

SEQ ID NO: 899987 - RNA, 17 nt, Homo sapiens
cucaccugguugaccca

SEQ ID NO: 899988 - RNA, 17 nt, Homo sapiens
cucaccuguuacugaaa

SEQ ID NO: 899989 - RNA, 23 nt, Homo sapiens
cucaccuguuacuugaaauacca

SEQ ID NO: 899990 - RNA, 14 nt, Homo sapiens
cucacuacagccuc

SEQ ID NO: 899991 - RNA, 14 nt, Homo sapiens
cucacuaugcugcu

SEQ ID NO: 899992 - RNA, 17 nt, Homo sapiens
cucacuccacacuggca

SEQ ID NO: 899993 - RNA, 15 nt, Homo sapiens
cucacuccaccaccc

SEQ ID NO: 899994 - RNA, 16 nt, Homo sapiens
cucacucccauaagcu

SEQ ID NO: 899995 - RNA, 15 nt, Homo sapiens
cucacucuuaugaaa

SEQ ID NO: 899996 - RNA, 19 nt, Homo sapiens
cucacuggggucugugugg

SEQ ID NO: 899997 - RNA, 18 nt, Homo sapiens
cucacuugugcaguguug

SEQ ID NO: 899998 - RNA, 17 nt, Homo sapiens
cucagaacaauccgauu

SEQ ID NO: 899999 - RNA, 20 nt, Homo sapiens
cucagaauccaaagaucaca

SEQ ID NO: 900000 - RNA, 23 nt, Homo sapiens
cucagacagaaccccuacaugaa

SEQ ID NO: 900001 - RNA, 14 nt, Homo sapiens
cucagacauuccaa

SEQ ID NO: 900002 - RNA, 23 nt, Homo sapiens
cucagagaauuucuaccauuuca

SEQ ID NO: 900003 - RNA, 14 nt, Homo sapiens
cucagagacauaca

SEQ ID NO: 900004 - RNA, 13 nt, Homo sapiens
cucagaugaucuc

SEQ ID NO: 900005 - RNA, 18 nt, Homo sapiens
cucagcaaggugugaaug

SEQ ID NO: 900006 - RNA, 17 nt, Homo sapiens
cucagcaauagggugca

SEQ ID NO: 900007 - RNA, 21 nt, Homo sapiens
cucagccauaaagugccaguu

SEQ ID NO: 900008 - RNA, 23 nt, Homo sapiens
cucagcccugggccccaccaccu

SEQ ID NO: 900009 - RNA, 20 nt, Homo sapiens
cucagccucccgaguagcug

SEQ ID NO: 900010 - RNA, 17 nt, Homo sapiens
cucagccuccucaguag

SEQ ID NO: 900011 - RNA, 16 nt, Homo sapiens
cucagcugcacauucc

SEQ ID NO: 900012 - RNA, 17 nt, Homo sapiens
cucagcugcacauuccu

SEQ ID NO: 900013 - RNA, 13 nt, Homo sapiens
cucaggagacaau

SEQ ID NO: 900014 - RNA, 15 nt, Homo sapiens
cucaggcuugaaaug

SEQ ID NO: 900015 - RNA, 15 nt, Homo sapiens
cucagggaaacuugc

SEQ ID NO: 900016 - RNA, 20 nt, Homo sapiens
cucaggguccagacccugaa

SEQ ID NO: 900017 - RNA, 18 nt, Homo sapiens
cucagguaguacugggaa

SEQ ID NO: 900018 - RNA, 14 nt, Homo sapiens
cucaggucccugca

SEQ ID NO: 900019 - RNA, 14 nt, Homo sapiens
cucagucucaggag

SEQ ID NO: 900020 - RNA, 11 nt, Homo sapiens
cucagugccac

SEQ ID NO: 900021 - RNA, 12 nt, Homo sapiens
cucagugccacu

SEQ ID NO: 900022 - RNA, 22 nt, Homo sapiens
cucagugccacuugacauuccu

SEQ ID NO: 900023 - RNA, 13 nt, Homo sapiens
cucaguguaguua

SEQ ID NO: 900024 - RNA, 17 nt, Homo sapiens
cucauaacaucuuugaa

SEQ ID NO: 900025 - RNA, 10 nt, Homo sapiens
cucauaauag

SEQ ID NO: 900026 - RNA, 13 nt, Homo sapiens
cucauaguauggu

SEQ ID NO: 900027 - RNA, 15 nt, Homo sapiens
cucauaucuuccuca

SEQ ID NO: 900028 - RNA, 21 nt, Homo sapiens
cucauauuuaaagacagggaa

SEQ ID NO: 900029 - RNA, 17 nt, Homo sapiens
cucaucagaaaugucau

SEQ ID NO: 900030 - RNA, 23 nt, Homo sapiens
cucaucaguguccucuugcucaa

SEQ ID NO: 900031 - RNA, 22 nt, Homo sapiens
cucaucauaaaauaaaguauau

SEQ ID NO: 900032 - RNA, 22 nt, Homo sapiens
cucaugaacuauuuacauuuuc

SEQ ID NO: 900033 - RNA, 15 nt, Homo sapiens
cucaugaccuugaaa

SEQ ID NO: 900034 - RNA, 19 nt, Homo sapiens
cucaugagugccaagcaaa

SEQ ID NO: 900035 - RNA, 20 nt, Homo sapiens
cucauggcagcuaagccaca

SEQ ID NO: 900036 - RNA, 21 nt, Homo sapiens
cucauggcagcuaagccacau

SEQ ID NO: 900037 - RNA, 23 nt, Homo sapiens
cucauguugaagccacugccuuc

SEQ ID NO: 900038 - RNA, 15 nt, Homo sapiens
cucauguuguuccca

SEQ ID NO: 900039 - RNA, 23 nt, Homo sapiens
cucauguuguucccacacacaaa

SEQ ID NO: 900040 - RNA, 13 nt, Homo sapiens
cucauuagacugg

SEQ ID NO: 900041 - RNA, 21 nt, Homo sapiens
cucauucauuuauucauucau

SEQ ID NO: 900042 - RNA, 10 nt, Homo sapiens
cucauuccac

SEQ ID NO: 900043 - RNA, 22 nt, Homo sapiens
cugccaagagagggccaugcaa

SEQ ID NO: 900044 - RNA, 13 nt, Homo sapiens
cugccaagcccuc

SEQ ID NO: 900045 - RNA, 16 nt, Homo sapiens
cugccacugaccucac

SEQ ID NO: 900046 - RNA, 22 nt, Homo sapiens
cugccagagcccaagugccauc

SEQ ID NO: 900047 - RNA, 15 nt, Homo sapiens
cugccagucacgagc

SEQ ID NO: 900048 - RNA, 23 nt, Homo sapiens
cugccauuaaauccgcaaacagc

SEQ ID NO: 900049 - RNA, 23 nt, Homo sapiens
cugcccaaugccuugacaacaga

SEQ ID NO: 900050 - RNA, 13 nt, Homo sapiens
cugcccacuccca

SEQ ID NO: 900051 - RNA, 13 nt, Homo sapiens
cugcccauacccc

SEQ ID NO: 900052 - RNA, 15 nt, Homo sapiens
cugccccacccucaa

SEQ ID NO: 900053 - RNA, 19 nt, Homo sapiens
cugcccccagccaugguga

SEQ ID NO: 900054 - RNA, 19 nt, Homo sapiens
cugcccccaucccacauga

SEQ ID NO: 900055 - RNA, 12 nt, Homo sapiens
cugccuacaucc

SEQ ID NO: 900056 - RNA, 14 nt, Homo sapiens
cugccucuauucaa

SEQ ID NO: 900057 - RNA, 17 nt, Homo sapiens
cugccucuccagcacuu

SEQ ID NO: 900058 - RNA, 15 nt, Homo sapiens
cugccucugacacac

SEQ ID NO: 900059 - RNA, 19 nt, Homo sapiens
cugccucugucucacugaa

SEQ ID NO: 900060 - RNA, 16 nt, Homo sapiens
cugccugaagucacac

SEQ ID NO: 900061 - RNA, 14 nt, Homo sapiens
cugccuguagcccc

SEQ ID NO: 900062 - RNA, 20 nt, Homo sapiens
cugccugugugggacugaga

SEQ ID NO: 900063 - RNA, 19 nt, Homo sapiens
cugccuuggacaacuuuuc

SEQ ID NO: 900064 - RNA, 14 nt, Homo sapiens
cugccuuguguaca

SEQ ID NO: 900065 - RNA, 16 nt, Homo sapiens
cugcgggacagaggac

SEQ ID NO: 900066 - RNA, 16 nt, Homo sapiens
cugcguugugagcucu

SEQ ID NO: 900067 - RNA, 14 nt, Homo sapiens
cugcuaaggcugcc

SEQ ID NO: 900068 - RNA, 16 nt, Homo sapiens
cugcuaauagcugcua

SEQ ID NO: 900069 - RNA, 14 nt, Homo sapiens
cugcuacacaaaag

SEQ ID NO: 900070 - RNA, 17 nt, Homo sapiens
cugcuacacaaaagcca

SEQ ID NO: 900071 - RNA, 12 nt, Homo sapiens
cugcuaccucac

SEQ ID NO: 900072 - RNA, 22 nt, Homo sapiens
cugcuauaugccuuaagccaau

SEQ ID NO: 900073 - RNA, 24 nt, Homo sapiens
cugcuauaugccuuaagccaauau

SEQ ID NO: 900074 - RNA, 20 nt, Homo sapiens
cugcuauuugaaguguaauu

SEQ ID NO: 900075 - RNA, 16 nt, Homo sapiens
cugcucaagaagacau

SEQ ID NO: 900076 - RNA, 19 nt, Homo sapiens
cugcucacuguucuaucuc

SEQ ID NO: 900077 - RNA, 20 nt, Homo sapiens
cugcucauaacaucuuugaa

SEQ ID NO: 900078 - RNA, 20 nt, Homo sapiens
cugcucgucuaucaccagga

SEQ ID NO: 900079 - RNA, 14 nt, Homo sapiens
cugcucucuucagg

SEQ ID NO: 900080 - RNA, 23 nt, Homo sapiens
cugcucugaauauuuuguaauaa

SEQ ID NO: 900081 - RNA, 21 nt, Homo sapiens
cugcucugaggcuuccagaga

SEQ ID NO: 900082 - RNA, 19 nt, Homo sapiens
cugcucugaugcaucagaa

SEQ ID NO: 900083 - RNA, 13 nt, Homo sapiens
cugcucugcuaua

SEQ ID NO: 900084 - RNA, 21 nt, Homo sapiens
cugcucuggauaacaagacuu

SEQ ID NO: 900085 - RNA, 11 nt, Homo sapiens
cugcucuugcc

SEQ ID NO: 900086 - RNA, 23 nt, Homo sapiens
cugcucuuugauucaaagcacug

SEQ ID NO: 900087 - RNA, 15 nt, Homo sapiens
cugcugaaacugugu

SEQ ID NO: 900088 - RNA, 11 nt, Homo sapiens
cugcugaagag

SEQ ID NO: 900089 - RNA, 23 nt, Homo sapiens
cugcugcaggagccgcugcugag

SEQ ID NO: 900090 - RNA, 16 nt, Homo sapiens
cugcuguauacuguac

SEQ ID NO: 900091 - RNA, 19 nt, Homo sapiens
cugcugugcuagugccuga

SEQ ID NO: 900092 - RNA, 20 nt, Homo sapiens
cugcuuccaauuuucuggaa

SEQ ID NO: 900093 - RNA, 15 nt, Homo sapiens
cugcuucugaacuca

SEQ ID NO: 900094 - RNA, 17 nt, Homo sapiens
cugcuucuuuucacuuc

SEQ ID NO: 900095 - RNA, 21 nt, Homo sapiens
cugcuuguccugcucucuuca

SEQ ID NO: 900096 - RNA, 17 nt, Homo sapiens
cugcuuuuuaaguguua

SEQ ID NO: 900097 - RNA, 14 nt, Homo sapiens
cuggaaaagcacuu

SEQ ID NO: 900098 - RNA, 15 nt, Homo sapiens
cuggaaaagcacuuu

SEQ ID NO: 900099 - RNA, 15 nt, Homo sapiens
cuggaaaaugugacc

SEQ ID NO: 900100 - RNA, 20 nt, Homo sapiens
cuggaaaggcucagucucag

SEQ ID NO: 900101 - RNA, 12 nt, Homo sapiens
cuggacugggag

SEQ ID NO: 900102 - RNA, 21 nt, Homo sapiens
cuggacuggguuuugucucug

SEQ ID NO: 900103 - RNA, 21 nt, Homo sapiens
cuggagaaagggaaguggaag

SEQ ID NO: 900104 - RNA, 20 nt, Homo sapiens
cuggagaccgcuucaccccu

SEQ ID NO: 900105 - RNA, 17 nt, Homo sapiens
cuggagagacugugcug

SEQ ID NO: 900106 - RNA, 13 nt, Homo sapiens
cuggagaggacaa

SEQ ID NO: 900107 - RNA, 20 nt, Homo sapiens
cuggagaggggccugggaaa

SEQ ID NO: 900108 - RNA, 19 nt, Homo sapiens
cuggagccagagagacaga

SEQ ID NO: 900109 - RNA, 15 nt, Homo sapiens
cuggagggacaggga

SEQ ID NO: 900110 - RNA, 12 nt, Homo sapiens
cuggagggcuag

SEQ ID NO: 900111 - RNA, 17 nt, Homo sapiens
cuggaucagcguggccu

SEQ ID NO: 900112 - RNA, 13 nt, Homo sapiens
cuggauccaucag

SEQ ID NO: 900113 - RNA, 20 nt, Homo sapiens
cuggaucguuugacgggacu

SEQ ID NO: 900114 - RNA, 14 nt, Homo sapiens
cuggaugucuccau

SEQ ID NO: 900115 - RNA, 20 nt, Homo sapiens
aaucagucuaccaaggggcu

SEQ ID NO: 900116 - RNA, 23 nt, Homo sapiens
aaucauaaauauaaucuaauaca

SEQ ID NO: 900117 - RNA, 22 nt, Homo sapiens
aaucaugagauccuuuaaaucc

SEQ ID NO: 900118 - RNA, 20 nt, Homo sapiens
aaucaugguuguagugaugu

SEQ ID NO: 900119 - RNA, 16 nt, Homo sapiens
aaucauuaauacucuu

SEQ ID NO: 900120 - RNA, 12 nt, Homo sapiens
aaucauucaaua

SEQ ID NO: 900121 - RNA, 21 nt, Homo sapiens
aaucauucuuuccccucagag

SEQ ID NO: 900122 - RNA, 16 nt, Homo sapiens
aauccagacccggcug

SEQ ID NO: 900123 - RNA, 17 nt, Homo sapiens
aaucccacccacaugug

SEQ ID NO: 900124 - RNA, 14 nt, Homo sapiens
aaucccagcacuuu

SEQ ID NO: 900125 - RNA, 17 nt, Homo sapiens
aaucccagcccuacccu

SEQ ID NO: 900126 - RNA, 16 nt, Homo sapiens
aaucccagcuacucaa

SEQ ID NO: 900127 - RNA, 20 nt, Homo sapiens
aaucccuguuuaauauuuaa

SEQ ID NO: 900128 - RNA, 14 nt, Homo sapiens
aauccgaaguauga

SEQ ID NO: 900129 - RNA, 17 nt, Homo sapiens
aauccuaaauaauguua

SEQ ID NO: 900130 - RNA, 17 nt, Homo sapiens
aauccuauuaaaacaca

SEQ ID NO: 900131 - RNA, 22 nt, Homo sapiens
aauccucaacaacaaaccaaaa

SEQ ID NO: 900132 - RNA, 23 nt, Homo sapiens
aauccucaacaacaaaccaaaac

SEQ ID NO: 900133 - RNA, 23 nt, Homo sapiens
aauccucagguaguacugggaau

SEQ ID NO: 900134 - RNA, 18 nt, Homo sapiens
aauccugccucuccccaa

SEQ ID NO: 900135 - RNA, 12 nt, Homo sapiens
aauccuuuccac

SEQ ID NO: 900136 - RNA, 17 nt, Homo sapiens
aaucuaacuacaaggac

SEQ ID NO: 900137 - RNA, 19 nt, Homo sapiens
aaucuaacuacaaggacaa

SEQ ID NO: 900138 - RNA, 23 nt, Homo sapiens
aaucuauuuccuuuccagucauu

SEQ ID NO: 900139 - RNA, 17 nt, Homo sapiens
aaucuccccuccucaca

SEQ ID NO: 900140 - RNA, 21 nt, Homo sapiens
aaucugaagaagaaaugaaua

SEQ ID NO: 900141 - RNA, 19 nt, Homo sapiens
aaucugagaagacaauaug

SEQ ID NO: 900142 - RNA, 17 nt, Homo sapiens
aaucugaggaaggugcu

SEQ ID NO: 900143 - RNA, 13 nt, Homo sapiens
aaucugccauaaa

SEQ ID NO: 900144 - RNA, 15 nt, Homo sapiens
aaucugggagaauuu

SEQ ID NO: 900145 - RNA, 13 nt, Homo sapiens
aaucuuacuccuu

SEQ ID NO: 900146 - RNA, 17 nt, Homo sapiens
aaucuucagaccuagaa

SEQ ID NO: 900147 - RNA, 19 nt, Homo sapiens
aaucuuccagcaugcaucc

SEQ ID NO: 900148 - RNA, 19 nt, Homo sapiens
aaucuuuccuugucucuca

SEQ ID NO: 900149 - RNA, 19 nt, Homo sapiens
aaucuuucuuuaccugaga

SEQ ID NO: 900150 - RNA, 13 nt, Homo sapiens
aaugaaaccaaag

SEQ ID NO: 900151 - RNA, 14 nt, Homo sapiens
aaugaaagccaaau

SEQ ID NO: 900152 - RNA, 13 nt, Homo sapiens
aaugaaccacgug

SEQ ID NO: 900153 - RNA, 21 nt, Homo sapiens
aaugaacgcguguucuguaau

SEQ ID NO: 900154 - RNA, 15 nt, Homo sapiens
aaugaagaaagggag

SEQ ID NO: 900155 - RNA, 22 nt, Homo sapiens
aaugaagaccuaaaugaccuca

SEQ ID NO: 900156 - RNA, 15 nt, Homo sapiens
aaugaagaugucuaa

SEQ ID NO: 900157 - RNA, 20 nt, Homo sapiens
aaugaaggaaaaccucacuu

SEQ ID NO: 900158 - RNA, 14 nt, Homo sapiens
aaugaauguuuaca

SEQ ID NO: 900159 - RNA, 16 nt, Homo sapiens
aaugaauuuaucugaa

SEQ ID NO: 900160 - RNA, 18 nt, Homo sapiens
aaugacauauuuuaucuu

SEQ ID NO: 900161 - RNA, 16 nt, Homo sapiens
aaugacaucauguuag

SEQ ID NO: 900162 - RNA, 22 nt, Homo sapiens
aaugacaucauguuagucuuug

SEQ ID NO: 900163 - RNA, 15 nt, Homo sapiens
aaugacaugcacuga

SEQ ID NO: 900164 - RNA, 13 nt, Homo sapiens
aaugacccaaaga

SEQ ID NO: 900165 - RNA, 14 nt, Homo sapiens
aaugacccaaagac

SEQ ID NO: 900166 - RNA, 12 nt, Homo sapiens
aaugacuauaaa

SEQ ID NO: 900167 - RNA, 15 nt, Homo sapiens
aaugaggacauguuu

SEQ ID NO: 900168 - RNA, 22 nt, Homo sapiens
aaugagucugcauaaacuucau

SEQ ID NO: 900169 - RNA, 18 nt, Homo sapiens
aaugaguucaacuuugag

SEQ ID NO: 900170 - RNA, 20 nt, Homo sapiens
aaugaugugaguacccagga

SEQ ID NO: 900171 - RNA, 21 nt, Homo sapiens
aaugauguuuuagaaugauuc

SEQ ID NO: 900172 - RNA, 19 nt, Homo sapiens
aaugauuauuuucauuaca

SEQ ID NO: 900173 - RNA, 22 nt, Homo sapiens
aaugauuuagguacgucaaagc

SEQ ID NO: 900174 - RNA, 22 nt, Homo sapiens
aaugcaaggugaacaccacuuu

SEQ ID NO: 900175 - RNA, 16 nt, Homo sapiens
aaugcacacacacaga

SEQ ID NO: 900176 - RNA, 19 nt, Homo sapiens
aaugcacacacacagagau

SEQ ID NO: 900177 - RNA, 16 nt, Homo sapiens
aaugcacaccaaaaaa

SEQ ID NO: 900178 - RNA, 17 nt, Homo sapiens
aaugcacauccauuccc

SEQ ID NO: 900179 - RNA, 19 nt, Homo sapiens
aaugcacgcacacaucagu

SEQ ID NO: 900180 - RNA, 22 nt, Homo sapiens
aaugcacugacauuguuggcca

SEQ ID NO: 900181 - RNA, 18 nt, Homo sapiens
aaugcagaauucuugagu

SEQ ID NO: 900182 - RNA, 19 nt, Homo sapiens
aaugcaguagccagcacgu

SEQ ID NO: 900183 - RNA, 16 nt, Homo sapiens
aaugcauguccucaaa

SEQ ID NO: 900184 - RNA, 17 nt, Homo sapiens
aaugcauguccucaaaa

SEQ ID NO: 900185 - RNA, 12 nt, Homo sapiens
aaugccacaaaa

SEQ ID NO: 900186 - RNA, 14 nt, Homo sapiens
aaugccacagugaa

SEQ ID NO: 900187 - RNA, 19 nt, Homo sapiens
aaugccucugcugugggcu

SEQ ID NO: 900188 - RNA, 17 nt, Homo sapiens
aaugcuaguuucauuca

SEQ ID NO: 900189 - RNA, 14 nt, Homo sapiens
aaugcuccaugaaa

SEQ ID NO: 900190 - RNA, 13 nt, Homo sapiens
aaugcuucaauca

SEQ ID NO: 900191 - RNA, 13 nt, Homo sapiens
aauggaagguugg

SEQ ID NO: 900192 - RNA, 21 nt, Homo sapiens
aauggagaaguucaggaaggu

SEQ ID NO: 900193 - RNA, 18 nt, Homo sapiens
aauggaugugcucacugg

SEQ ID NO: 900194 - RNA, 19 nt, Homo sapiens
aauggaugugcucacuggg

SEQ ID NO: 900195 - RNA, 13 nt, Homo sapiens
aauggcucuguga

SEQ ID NO: 900196 - RNA, 15 nt, Homo sapiens
aaugggagaagagag

SEQ ID NO: 900197 - RNA, 14 nt, Homo sapiens
aauggggccuguua

SEQ ID NO: 900198 - RNA, 23 nt, Homo sapiens
aauggggguggggaggcaagaac

SEQ ID NO: 900199 - RNA, 15 nt, Homo sapiens
aauggggugcaugaa

SEQ ID NO: 900200 - RNA, 23 nt, Homo sapiens
aauggguuugcuagaaugugaua

SEQ ID NO: 900201 - RNA, 16 nt, Homo sapiens
aaugguaauuguugcu

SEQ ID NO: 900202 - RNA, 22 nt, Homo sapiens
aauggugcaaauccuacugaau

SEQ ID NO: 900203 - RNA, 15 nt, Homo sapiens
aauggugggaacccu

SEQ ID NO: 900204 - RNA, 22 nt, Homo sapiens
aauguaagggaaacugccagca

SEQ ID NO: 900205 - RNA, 23 nt, Homo sapiens
aauguaauacuccuaagacuuau

SEQ ID NO: 900206 - RNA, 11 nt, Homo sapiens
aauguauauau

SEQ ID NO: 900207 - RNA, 13 nt, Homo sapiens
aauguaugugaaa

SEQ ID NO: 900208 - RNA, 17 nt, Homo sapiens
aauguauuuguuugcaa

SEQ ID NO: 900209 - RNA, 14 nt, Homo sapiens
aaugucaccaccuu

SEQ ID NO: 900210 - RNA, 14 nt, Homo sapiens
aaugucacuuaaag

SEQ ID NO: 900211 - RNA, 17 nt, Homo sapiens
aaugucaggaacagaag

SEQ ID NO: 900212 - RNA, 12 nt, Homo sapiens
aaugucaucaaa

SEQ ID NO: 900213 - RNA, 17 nt, Homo sapiens
aaugucuggucugucca

SEQ ID NO: 900214 - RNA, 21 nt, Homo sapiens
aaugucuuaaaaauauauuua

SEQ ID NO: 900215 - RNA, 14 nt, Homo sapiens
aaugucuuaaucau

SEQ ID NO: 900216 - RNA, 19 nt, Homo sapiens
aaugucuuaaucaugagau

SEQ ID NO: 900217 - RNA, 21 nt, Homo sapiens
agcggucauucuacacugagg

SEQ ID NO: 900218 - RNA, 17 nt, Homo sapiens
agcguagcuaagugaaa

SEQ ID NO: 900219 - RNA, 16 nt, Homo sapiens
agcgucccuagcagug

SEQ ID NO: 900220 - RNA, 16 nt, Homo sapiens
agcgugcucacugacc

SEQ ID NO: 900221 - RNA, 12 nt, Homo sapiens
agcguucccaac

SEQ ID NO: 900222 - RNA, 16 nt, Homo sapiens
agcuaacuuauuuucc

SEQ ID NO: 900223 - RNA, 19 nt, Homo sapiens
agcuaagugaaaaggucau

SEQ ID NO: 900224 - RNA, 22 nt, Homo sapiens
agcuacaaggaggacuugcagg

SEQ ID NO: 900225 - RNA, 12 nt, Homo sapiens
agcuacauuccu

SEQ ID NO: 900226 - RNA, 18 nt, Homo sapiens
agcuacucgggaggcuga

SEQ ID NO: 900227 - RNA, 17 nt, Homo sapiens
agcuacucucuugccag

SEQ ID NO: 900228 - RNA, 14 nt, Homo sapiens
agcuacugacuaug

SEQ ID NO: 900229 - RNA, 21 nt, Homo sapiens
agcuagaagugggccaggaca

SEQ ID NO: 900230 - RNA, 19 nt, Homo sapiens
agcuagagugcaguggugc

SEQ ID NO: 900231 - RNA, 17 nt, Homo sapiens
agcuaguggcuucaaaa

SEQ ID NO: 900232 - RNA, 19 nt, Homo sapiens
agcuaucugucaucucucu

SEQ ID NO: 900233 - RNA, 12 nt, Homo sapiens
agcuaugaaggc

SEQ ID NO: 900234 - RNA, 18 nt, Homo sapiens
agcuaugaaggcuguaca

SEQ ID NO: 900235 - RNA, 19 nt, Homo sapiens
agcuaugacugcagaucau

SEQ ID NO: 900236 - RNA, 20 nt, Homo sapiens
agcuaugaucgcgccacuac

SEQ ID NO: 900237 - RNA, 20 nt, Homo sapiens
agcuaugauuaugccacugc

SEQ ID NO: 900238 - RNA, 22 nt, Homo sapiens
agcuaugauuaugccacugcuu

SEQ ID NO: 900239 - RNA, 15 nt, Homo sapiens
agcucaagaugacag

SEQ ID NO: 900240 - RNA, 21 nt, Homo sapiens
agcucaagucuucccugauca

SEQ ID NO: 900241 - RNA, 14 nt, Homo sapiens
agcucacaguacaa

SEQ ID NO: 900242 - RNA, 13 nt, Homo sapiens
agcucacagucua

SEQ ID NO: 900243 - RNA, 16 nt, Homo sapiens
agcucaggcacacuuc

SEQ ID NO: 900244 - RNA, 17 nt, Homo sapiens
agcucagucccaucaga

SEQ ID NO: 900245 - RNA, 12 nt, Homo sapiens
agcucaguuuau

SEQ ID NO: 900246 - RNA, 18 nt, Homo sapiens
agcuccacuuucagugaa

SEQ ID NO: 900247 - RNA, 14 nt, Homo sapiens
agcuccaguuucca

SEQ ID NO: 900248 - RNA, 18 nt, Homo sapiens
agcucccuaggagaccaa

SEQ ID NO: 900249 - RNA, 18 nt, Homo sapiens
agcuccucuccuugggcu

SEQ ID NO: 900250 - RNA, 15 nt, Homo sapiens
agcucgguggaccca

SEQ ID NO: 900251 - RNA, 14 nt, Homo sapiens
agcucuaguucaaa

SEQ ID NO: 900252 - RNA, 13 nt, Homo sapiens
agcucugaaguca

SEQ ID NO: 900253 - RNA, 16 nt, Homo sapiens
agcucugacauucuga

SEQ ID NO: 900254 - RNA, 15 nt, Homo sapiens
agcucuggaccagcc

SEQ ID NO: 900255 - RNA, 17 nt, Homo sapiens
agcucuguagaaagaau

SEQ ID NO: 900256 - RNA, 20 nt, Homo sapiens
agcucuguuuauaaaaacaa

SEQ ID NO: 900257 - RNA, 20 nt, Homo sapiens
agcucuuacacuacauuaga

SEQ ID NO: 900258 - RNA, 20 nt, Homo sapiens
agcucuuucuucuuugaauu

SEQ ID NO: 900259 - RNA, 22 nt, Homo sapiens
agcugaagccuauuuauuugaa

SEQ ID NO: 900260 - RNA, 13 nt, Homo sapiens
agcugaagugaag

SEQ ID NO: 900261 - RNA, 14 nt, Homo sapiens
agcugaagugaagg

SEQ ID NO: 900262 - RNA, 18 nt, Homo sapiens
agcugacauagggguaag

SEQ ID NO: 900263 - RNA, 18 nt, Homo sapiens
agcugacaucuccucuau

SEQ ID NO: 900264 - RNA, 15 nt, Homo sapiens
agcugagagacuuuu

SEQ ID NO: 900265 - RNA, 19 nt, Homo sapiens
agcugagaggaagaugaag

SEQ ID NO: 900266 - RNA, 15 nt, Homo sapiens
agcugagauuccugg

SEQ ID NO: 900267 - RNA, 20 nt, Homo sapiens
agcugagauugcgccacugc

SEQ ID NO: 900268 - RNA, 23 nt, Homo sapiens
agcugagauugcgccacugcacu

SEQ ID NO: 900269 - RNA, 13 nt, Homo sapiens
agcugagccuucu

SEQ ID NO: 900270 - RNA, 18 nt, Homo sapiens
agcugagccuucugauga

SEQ ID NO: 900271 - RNA, 14 nt, Homo sapiens
agcugagugaaaaa

SEQ ID NO: 900272 - RNA, 14 nt, Homo sapiens
agcugaguguagug

SEQ ID NO: 900273 - RNA, 22 nt, Homo sapiens
agcugauauuauggcaagugau

SEQ ID NO: 900274 - RNA, 15 nt, Homo sapiens
agcugcacauuccug

SEQ ID NO: 900275 - RNA, 22 nt, Homo sapiens
agcugcagucaacaguucaaag

SEQ ID NO: 900276 - RNA, 13 nt, Homo sapiens
agcugcaucuacu

SEQ ID NO: 900277 - RNA, 15 nt, Homo sapiens
agcugcaucuacuca

SEQ ID NO: 900278 - RNA, 11 nt, Homo sapiens
agcugccaaaa

SEQ ID NO: 900279 - RNA, 14 nt, Homo sapiens
agcugccaagcacu

SEQ ID NO: 900280 - RNA, 13 nt, Homo sapiens
agcugcgugccac

SEQ ID NO: 900281 - RNA, 18 nt, Homo sapiens
agcugcucgcacagauua

SEQ ID NO: 900282 - RNA, 21 nt, Homo sapiens
agcugcugaaacaacaaauag

SEQ ID NO: 900283 - RNA, 21 nt, Homo sapiens
agcuggaacacucucugagau

SEQ ID NO: 900284 - RNA, 14 nt, Homo sapiens
agcuggaagcacau

SEQ ID NO: 900285 - RNA, 23 nt, Homo sapiens
agcuggaauuuaaggagggacaa

SEQ ID NO: 900286 - RNA, 17 nt, Homo sapiens
agcuggagcucuuggaa

SEQ ID NO: 900287 - RNA, 18 nt, Homo sapiens
agcugggccccaccuacu

SEQ ID NO: 900288 - RNA, 14 nt, Homo sapiens
agcuggguggugua

SEQ ID NO: 900289 - RNA, 20 nt, Homo sapiens
agcuggugccccacugaauu

SEQ ID NO: 900290 - RNA, 17 nt, Homo sapiens
agcuggugcugcaagga

SEQ ID NO: 900291 - RNA, 20 nt, Homo sapiens
agcuggugguaucugaguug

SEQ ID NO: 900292 - RNA, 14 nt, Homo sapiens
agcuguagccaugg

SEQ ID NO: 900293 - RNA, 14 nt, Homo sapiens
agcuguaucuguaa

SEQ ID NO: 900294 - RNA, 17 nt, Homo sapiens
agcugucaggcugauua

SEQ ID NO: 900295 - RNA, 18 nt, Homo sapiens
agcugucaggcugauuau

SEQ ID NO: 900296 - RNA, 14 nt, Homo sapiens
agcugucuccagga

SEQ ID NO: 900297 - RNA, 12 nt, Homo sapiens
agcugucugcuc

SEQ ID NO: 900298 - RNA, 17 nt, Homo sapiens
agcuguuccacuucucu

SEQ ID NO: 900299 - RNA, 13 nt, Homo sapiens
agcuuacaagacc

SEQ ID NO: 900300 - RNA, 15 nt, Homo sapiens
agcuuaccugacaca

SEQ ID NO: 900301 - RNA, 18 nt, Homo sapiens
agcuuauauauuacuugu

SEQ ID NO: 900302 - RNA, 14 nt, Homo sapiens
agcuucaaacugca

SEQ ID NO: 900303 - RNA, 23 nt, Homo sapiens
agcuucaacccucagccuugaaa

SEQ ID NO: 900304 - RNA, 14 nt, Homo sapiens
agcuucagacuuuu

SEQ ID NO: 900305 - RNA, 21 nt, Homo sapiens
agcuuccagugcauguugcca

SEQ ID NO: 900306 - RNA, 15 nt, Homo sapiens
agcuuccugucaaca

SEQ ID NO: 900307 - RNA, 14 nt, Homo sapiens
agcuucucugugaa

SEQ ID NO: 900308 - RNA, 18 nt, Homo sapiens
agcuucugcccaccuacu

SEQ ID NO: 900309 - RNA, 14 nt, Homo sapiens
agcuuggaaacugg

SEQ ID NO: 900310 - RNA, 17 nt, Homo sapiens
agcuuguaaauagcuca

SEQ ID NO: 900311 - RNA, 22 nt, Homo sapiens
agcuuguauauacuucacucac

SEQ ID NO: 900312 - RNA, 18 nt, Homo sapiens
agcuuuacaaauauguca

SEQ ID NO: 900313 - RNA, 19 nt, Homo sapiens
agcuuucagagccagugaa

SEQ ID NO: 900314 - RNA, 18 nt, Homo sapiens
auagcaguugaaacaaga

SEQ ID NO: 900315 - RNA, 23 nt, Homo sapiens
auagccaacugcuguucauguua

SEQ ID NO: 900316 - RNA, 12 nt, Homo sapiens
auagccacuuac

SEQ ID NO: 900317 - RNA, 17 nt, Homo sapiens
auagccauguacuauaa

SEQ ID NO: 900318 - RNA, 16 nt, Homo sapiens
auagcgaaucaucuca

SEQ ID NO: 900319 - RNA, 18 nt, Homo sapiens
auagcgaaucaucucaaa

SEQ ID NO: 900320 - RNA, 16 nt, Homo sapiens
auagcuacccaaaaga

SEQ ID NO: 900321 - RNA, 16 nt, Homo sapiens
auagcuauugcaugua

SEQ ID NO: 900322 - RNA, 23 nt, Homo sapiens
auagcugggaacccgacugugaa

SEQ ID NO: 900323 - RNA, 22 nt, Homo sapiens
auaggcccuggaugugcccaca

SEQ ID NO: 900324 - RNA, 21 nt, Homo sapiens
auagggguaagguaugggaga

SEQ ID NO: 900325 - RNA, 20 nt, Homo sapiens
auaggugcuacaaaaacaca

SEQ ID NO: 900326 - RNA, 12 nt, Homo sapiens
auagguuuccac

SEQ ID NO: 900327 - RNA, 14 nt, Homo sapiens
auaguaaaugcuuu

SEQ ID NO: 900328 - RNA, 18 nt, Homo sapiens
auaguaagccucccuccu

SEQ ID NO: 900329 - RNA, 11 nt, Homo sapiens
auaguacuggc

SEQ ID NO: 900330 - RNA, 16 nt, Homo sapiens
auaguauucauuuucc

SEQ ID NO: 900331 - RNA, 22 nt, Homo sapiens
auagucaaaccauaaacuucau

SEQ ID NO: 900332 - RNA, 14 nt, Homo sapiens
auagucacaagagc

SEQ ID NO: 900333 - RNA, 15 nt, Homo sapiens
auagucacauggccu

SEQ ID NO: 900334 - RNA, 13 nt, Homo sapiens
auagucuguccaa

SEQ ID NO: 900335 - RNA, 10 nt, Homo sapiens
auagugucuu

SEQ ID NO: 900336 - RNA, 16 nt, Homo sapiens
auaguguuggaaaaug

SEQ ID NO: 900337 - RNA, 17 nt, Homo sapiens
auaguuaauuauuucaa

SEQ ID NO: 900338 - RNA, 22 nt, Homo sapiens
auaguuauuguuuuauguucua

SEQ ID NO: 900339 - RNA, 16 nt, Homo sapiens
auaguuauuuacuuga

SEQ ID NO: 900340 - RNA, 19 nt, Homo sapiens
auaguuuuucauuguacca

SEQ ID NO: 900341 - RNA, 15 nt, Homo sapiens
auauaaaaugcuuua

SEQ ID NO: 900342 - RNA, 16 nt, Homo sapiens
auauaaugcaaaccau

SEQ ID NO: 900343 - RNA, 23 nt, Homo sapiens
auauaauggaagagaaaucucau

SEQ ID NO: 900344 - RNA, 20 nt, Homo sapiens
auauacaaaagcaagacuuc

SEQ ID NO: 900345 - RNA, 17 nt, Homo sapiens
auauacaauaacauaau

SEQ ID NO: 900346 - RNA, 17 nt, Homo sapiens
auauacacauacauaca

SEQ ID NO: 900347 - RNA, 16 nt, Homo sapiens
auauacauaugacaua

SEQ ID NO: 900348 - RNA, 17 nt, Homo sapiens
auauaccuauaaugugu

SEQ ID NO: 900349 - RNA, 12 nt, Homo sapiens
agaucauuucag

SEQ ID NO: 900350 - RNA, 23 nt, Homo sapiens
agaucccauccaucagcucccuu

SEQ ID NO: 900351 - RNA, 23 nt, Homo sapiens
agauccuuuuuuacgcuuugcag

SEQ ID NO: 900352 - RNA, 19 nt, Homo sapiens
agaucgcgccacugcacuc

SEQ ID NO: 900353 - RNA, 20 nt, Homo sapiens
agaucuaagccuuuccauaa

SEQ ID NO: 900354 - RNA, 19 nt, Homo sapiens
agaucugagauugaauauu

SEQ ID NO: 900355 - RNA, 13 nt, Homo sapiens
agaucugcacugg

SEQ ID NO: 900356 - RNA, 15 nt, Homo sapiens
agaucugcacugggu

SEQ ID NO: 900357 - RNA, 13 nt, Homo sapiens
agaucugucuuga

SEQ ID NO: 900358 - RNA, 20 nt, Homo sapiens
agaucugugggcccagucau

SEQ ID NO: 900359 - RNA, 14 nt, Homo sapiens
agaucuuacaggua

SEQ ID NO: 900360 - RNA, 18 nt, Homo sapiens
agaugaagacaacagcau

SEQ ID NO: 900361 - RNA, 19 nt, Homo sapiens
agaugaaucauugauugaa

SEQ ID NO: 900362 - RNA, 19 nt, Homo sapiens
agaugagauucccucuccu

SEQ ID NO: 900363 - RNA, 19 nt, Homo sapiens
agaugagcagucacacugu

SEQ ID NO: 900364 - RNA, 19 nt, Homo sapiens
agaugaucgugccuauaaa

SEQ ID NO: 900365 - RNA, 13 nt, Homo sapiens
agaugaucucucc

SEQ ID NO: 900366 - RNA, 18 nt, Homo sapiens
agaugauucggauuugac

SEQ ID NO: 900367 - RNA, 22 nt, Homo sapiens
agaugcaaucucuugucucaca

SEQ ID NO: 900368 - RNA, 15 nt, Homo sapiens
agaugcacacacacc

SEQ ID NO: 900369 - RNA, 21 nt, Homo sapiens
agauggaguucuugugccaua

SEQ ID NO: 900370 - RNA, 16 nt, Homo sapiens
agauggauguuuguca

SEQ ID NO: 900371 - RNA, 18 nt, Homo sapiens
agauggauguuugucaaa

SEQ ID NO: 900372 - RNA, 15 nt, Homo sapiens
agauggccgggacau

SEQ ID NO: 900373 - RNA, 22 nt, Homo sapiens
agauggcugugccucugccugu

SEQ ID NO: 900374 - RNA, 14 nt, Homo sapiens
agaugggacauucc

SEQ ID NO: 900375 - RNA, 20 nt, Homo sapiens
agaugggcaaagcugugcac

SEQ ID NO: 900376 - RNA, 12 nt, Homo sapiens
agauggggacag

SEQ ID NO: 900377 - RNA, 17 nt, Homo sapiens
agauggggacaggugaa

SEQ ID NO: 900378 - RNA, 15 nt, Homo sapiens
agaugggugucacuu

SEQ ID NO: 900379 - RNA, 17 nt, Homo sapiens
agaugguacgaugcauc

SEQ ID NO: 900380 - RNA, 17 nt, Homo sapiens
agauguaccauguuaaa

SEQ ID NO: 900381 - RNA, 13 nt, Homo sapiens
agaugugauuuau

SEQ ID NO: 900382 - RNA, 14 nt, Homo sapiens
agaugugauuuauu

SEQ ID NO: 900383 - RNA, 19 nt, Homo sapiens
agaugugggcagugauguc

SEQ ID NO: 900384 - RNA, 16 nt, Homo sapiens
agauuaaacaaacaaa

SEQ ID NO: 900385 - RNA, 13 nt, Homo sapiens
agauuaauggcac

SEQ ID NO: 900386 - RNA, 20 nt, Homo sapiens
agauuacuucagggcuggaa

SEQ ID NO: 900387 - RNA, 17 nt, Homo sapiens
agauuagguacuaucug

SEQ ID NO: 900388 - RNA, 20 nt, Homo sapiens
agauucccucuuccugccaa

SEQ ID NO: 900389 - RNA, 19 nt, Homo sapiens
agauugcaccauugcgcuc

SEQ ID NO: 900390 - RNA, 16 nt, Homo sapiens
agauugcgccacugca

SEQ ID NO: 900391 - RNA, 24 nt, Homo sapiens
agauugcgccacugcacuccaguc

SEQ ID NO: 900392 - RNA, 23 nt, Homo sapiens
agauugcguggaccccgacaaag

SEQ ID NO: 900393 - RNA, 13 nt, Homo sapiens
agauugugcccag

SEQ ID NO: 900394 - RNA, 16 nt, Homo sapiens
agauuguuaaaauaac

SEQ ID NO: 900395 - RNA, 16 nt, Homo sapiens
agauuucaacauauca

SEQ ID NO: 900396 - RNA, 18 nt, Homo sapiens
agauuuccaaaagacuug

SEQ ID NO: 900397 - RNA, 15 nt, Homo sapiens
agauuuccuaacucu

SEQ ID NO: 900398 - RNA, 19 nt, Homo sapiens
agauuuucauguucuugca

SEQ ID NO: 900399 - RNA, 20 nt, Homo sapiens
agauuuuuacacauguaucu

SEQ ID NO: 900400 - RNA, 17 nt, Homo sapiens
agcaaaacuccaucuca

SEQ ID NO: 900401 - RNA, 18 nt, Homo sapiens
agcaaaacuccaucucaa

SEQ ID NO: 900402 - RNA, 17 nt, Homo sapiens
agcaaaagucagucuua

SEQ ID NO: 900403 - RNA, 14 nt, Homo sapiens
agcaaagagugggc

SEQ ID NO: 900404 - RNA, 17 nt, Homo sapiens
agcaaaggaaaccaaag

SEQ ID NO: 900405 - RNA, 15 nt, Homo sapiens
agcaaaugcuuaaaa

SEQ ID NO: 900406 - RNA, 16 nt, Homo sapiens
agcaaauguggcuccu

SEQ ID NO: 900407 - RNA, 20 nt, Homo sapiens
agcaaauguuucugcaguag

SEQ ID NO: 900408 - RNA, 19 nt, Homo sapiens
agcaaauuagaaacaccau

SEQ ID NO: 900409 - RNA, 14 nt, Homo sapiens
agcaaauuaguaau

SEQ ID NO: 900410 - RNA, 16 nt, Homo sapiens
agcaaauuaguaauug

SEQ ID NO: 900411 - RNA, 13 nt, Homo sapiens
agcaacacagagc

SEQ ID NO: 900412 - RNA, 21 nt, Homo sapiens
agcaacacucuauauuuagau

SEQ ID NO: 900413 - RNA, 17 nt, Homo sapiens
agcaacaggaaucucag

SEQ ID NO: 900414 - RNA, 22 nt, Homo sapiens
agcaacaguuaugggacacuga

SEQ ID NO: 900415 - RNA, 20 nt, Homo sapiens
agcaacucagaaugcucuac

SEQ ID NO: 900416 - RNA, 16 nt, Homo sapiens
agcaacucugacucuu

SEQ ID NO: 900417 - RNA, 14 nt, Homo sapiens
agcaacugugcuac

SEQ ID NO: 900418 - RNA, 18 nt, Homo sapiens
agcaagacuuccagguag

SEQ ID NO: 900419 - RNA, 18 nt, Homo sapiens
agcaaggacaaccugccc

SEQ ID NO: 900420 - RNA, 15 nt, Homo sapiens
agcaagggcugugcu

SEQ ID NO: 900421 - RNA, 18 nt, Homo sapiens
agcaagggcugugcugag

SEQ ID NO: 900422 - RNA, 16 nt, Homo sapiens
agcaagugacaugcca

SEQ ID NO: 900423 - RNA, 18 nt, Homo sapiens
agcaaucucgcaguacau

SEQ ID NO: 900424 - RNA, 14 nt, Homo sapiens
agcaaugaugucca

SEQ ID NO: 900425 - RNA, 16 nt, Homo sapiens
agcaaugggcacuggu

SEQ ID NO: 900426 - RNA, 21 nt, Homo sapiens
agcaaugggcacugguauuug

SEQ ID NO: 900427 - RNA, 20 nt, Homo sapiens
agcaaugguaauugugaaua

SEQ ID NO: 900428 - RNA, 20 nt, Homo sapiens
agcaauuagauuaguauuuu

SEQ ID NO: 900429 - RNA, 12 nt, Homo sapiens
agcacaccucau

SEQ ID NO: 900430 - RNA, 17 nt, Homo sapiens
agcacacuuaugggcca

SEQ ID NO: 900431 - RNA, 16 nt, Homo sapiens
agcacauagcacuggg

SEQ ID NO: 900432 - RNA, 23 nt, Homo sapiens
agcacaugaaaaccauuaccuga

SEQ ID NO: 900433 - RNA, 11 nt, Homo sapiens
agcacaugugu

SEQ ID NO: 900434 - RNA, 17 nt, Homo sapiens
agcacuaaagcagugga

SEQ ID NO: 900435 - RNA, 19 nt, Homo sapiens
agcacuaaggugugcucug

SEQ ID NO: 900436 - RNA, 23 nt, Homo sapiens
agcacuaauucaacauauaccuu

SEQ ID NO: 900437 - RNA, 20 nt, Homo sapiens
agcacucccuuaggcauuau

SEQ ID NO: 900438 - RNA, 17 nt, Homo sapiens
agcacuucucucuucaa

SEQ ID NO: 900439 - RNA, 13 nt, Homo sapiens
agcacuugaaaau

SEQ ID NO: 900440 - RNA, 22 nt, Homo sapiens
agcacuuuaacccucucuuccc

SEQ ID NO: 900441 - RNA, 13 nt, Homo sapiens
agcagaacaugug

SEQ ID NO: 900442 - RNA, 15 nt, Homo sapiens
agcagaagcacauau

SEQ ID NO: 900443 - RNA, 15 nt, Homo sapiens
agcagaccgugauuu

SEQ ID NO: 900444 - RNA, 21 nt, Homo sapiens
agcagacucagcucugacauu

SEQ ID NO: 900445 - RNA, 20 nt, Homo sapiens
agcagagacgggguuucacc

SEQ ID NO: 900446 - RNA, 15 nt, Homo sapiens
agcagagggccuagg

SEQ ID NO: 900447 - RNA, 14 nt, Homo sapiens
agcagagugauuca

SEQ ID NO: 900448 - RNA, 13 nt, Homo sapiens
agcagaucugaaa

SEQ ID NO: 900449 - RNA, 23 nt, Homo sapiens
agcagaucuucuuuauaacuauu

SEQ ID NO: 900450 - RNA, 17 nt, Homo sapiens
agccugggccagagaag

SEQ ID NO: 900451 - RNA, 12 nt, Homo sapiens
agccuggugggc

SEQ ID NO: 900452 - RNA, 23 nt, Homo sapiens
agccuguucauggcagauguagg

SEQ ID NO: 900453 - RNA, 14 nt, Homo sapiens
agccuuaugugagc

SEQ ID NO: 900454 - RNA, 15 nt, Homo sapiens
agccuugcacugugg

SEQ ID NO: 900455 - RNA, 19 nt, Homo sapiens
agccuuggggauucuucca

SEQ ID NO: 900456 - RNA, 16 nt, Homo sapiens
agccuuugcccuguca

SEQ ID NO: 900457 - RNA, 21 nt, Homo sapiens
agcgaaauauuacaguagugc

SEQ ID NO: 900458 - RNA, 15 nt, Homo sapiens
agcgaaaucaugguu

SEQ ID NO: 900459 - RNA, 13 nt, Homo sapiens
agcgaacaugccu

SEQ ID NO: 900460 - RNA, 14 nt, Homo sapiens
agcgaaucaucuca

SEQ ID NO: 900461 - RNA, 15 nt, Homo sapiens
agcgaaucaucucaa

SEQ ID NO: 900462 - RNA, 19 nt, Homo sapiens
agcgaauguguacaaagug

SEQ ID NO: 900463 - RNA, 13 nt, Homo sapiens
agcgcgugcacag

SEQ ID NO: 900464 - RNA, 12 nt, Homo sapiens
agcgcuguguua

SEQ ID NO: 900465 - RNA, 21 nt, Homo sapiens
agcggacagaaugaugccaaa

SEQ ID NO: 900466 - RNA, 18 nt, Homo sapiens
agcggaucucacucagcc

SEQ ID NO: 900467 - RNA, 20 nt, Homo sapiens
agaacaauuaaacagccaaa

SEQ ID NO: 900468 - RNA, 15 nt, Homo sapiens
agaacaggcaaguga

SEQ ID NO: 900469 - RNA, 17 nt, Homo sapiens
agaacaguaacugccau

SEQ ID NO: 900470 - RNA, 19 nt, Homo sapiens
agaacaugaccuccgugua

SEQ ID NO: 900471 - RNA, 21 nt, Homo sapiens
agaaccacuuggcugcucauu

SEQ ID NO: 900472 - RNA, 19 nt, Homo sapiens
agaaccaugguaugaaggu

SEQ ID NO: 900473 - RNA, 15 nt, Homo sapiens
agaaccuaaaguagc

SEQ ID NO: 900474 - RNA, 21 nt, Homo sapiens
agaaccugcuaaggcugccuc

SEQ ID NO: 900475 - RNA, 23 nt, Homo sapiens
agaaccuggagagcuagaaccua

SEQ ID NO: 900476 - RNA, 23 nt, Homo sapiens
agaaccuggagggcuagaaccua

SEQ ID NO: 900477 - RNA, 16 nt, Homo sapiens
agaacuauguacuuua

SEQ ID NO: 900478 - RNA, 17 nt, Homo sapiens
agaacugccccaucucc

SEQ ID NO: 900479 - RNA, 18 nt, Homo sapiens
agaacugccccaucuccu

SEQ ID NO: 900480 - RNA, 14 nt, Homo sapiens
agaacuucaagaag

SEQ ID NO: 900481 - RNA, 19 nt, Homo sapiens
agaagaaaaucaaccagca

SEQ ID NO: 900482 - RNA, 17 nt, Homo sapiens
agaagaacauccaagga

SEQ ID NO: 900483 - RNA, 13 nt, Homo sapiens
agaagaccagacu

SEQ ID NO: 900484 - RNA, 19 nt, Homo sapiens
agaagacuauauuguacac

SEQ ID NO: 900485 - RNA, 16 nt, Homo sapiens
agaagaugugauuuau

SEQ ID NO: 900486 - RNA, 18 nt, Homo sapiens
agaagauuuuaugcugcu

SEQ ID NO: 900487 - RNA, 17 nt, Homo sapiens
agaagcaucaccaugca

SEQ ID NO: 900488 - RNA, 19 nt, Homo sapiens
agaagcaucaccaugcaug

SEQ ID NO: 900489 - RNA, 20 nt, Homo sapiens
agaagccacgcuguccucuc

SEQ ID NO: 900490 - RNA, 11 nt, Homo sapiens
agaagccagac

SEQ ID NO: 900491 - RNA, 23 nt, Homo sapiens
agaagcuaaauccuuuacuguua

SEQ ID NO: 900492 - RNA, 13 nt, Homo sapiens
agaaggaaggcag

SEQ ID NO: 900493 - RNA, 14 nt, Homo sapiens
agaaggacaccucc

SEQ ID NO: 900494 - RNA, 19 nt, Homo sapiens
agaaggacauuuuacugca

SEQ ID NO: 900495 - RNA, 22 nt, Homo sapiens
agaaggcaugaaauugucuagc

SEQ ID NO: 900496 - RNA, 23 nt, Homo sapiens
agaaggggacagcgccaccucuu

SEQ ID NO: 900497 - RNA, 23 nt, Homo sapiens
agaaguccccaggucaugcugcu

SEQ ID NO: 900498 - RNA, 20 nt, Homo sapiens
agaagucucuuccaguuugc

SEQ ID NO: 900499 - RNA, 18 nt, Homo sapiens
agaaguggggcucuggga

SEQ ID NO: 900500 - RNA, 16 nt, Homo sapiens
agaagugucuaaaaac

SEQ ID NO: 900501 - RNA, 19 nt, Homo sapiens
agaaguguuccuucauuaa

SEQ ID NO: 900502 - RNA, 17 nt, Homo sapiens
agaaguuaacuacagug

SEQ ID NO: 900503 - RNA, 19 nt, Homo sapiens
agaaguuuaaaaaaccaug

SEQ ID NO: 900504 - RNA, 20 nt, Homo sapiens
agaaguuuaaaaaaccaugc

SEQ ID NO: 900505 - RNA, 17 nt, Homo sapiens
agaaguuuuguacagag

SEQ ID NO: 900506 - RNA, 15 nt, Homo sapiens
agaauaaagucuugu

SEQ ID NO: 900507 - RNA, 15 nt, Homo sapiens
agaauaaaugaaucu

SEQ ID NO: 900508 - RNA, 18 nt, Homo sapiens
agaauacaguaagcugcu

SEQ ID NO: 900509 - RNA, 14 nt, Homo sapiens
agaauagcuuugaa

SEQ ID NO: 900510 - RNA, 16 nt, Homo sapiens
agaaucaaauugcuac

SEQ ID NO: 900511 - RNA, 16 nt, Homo sapiens
agaauccaaagaucac

SEQ ID NO: 900512 - RNA, 21 nt, Homo sapiens
agaaucccggcugucaagggg

SEQ ID NO: 900513 - RNA, 22 nt, Homo sapiens
agaauccucugggguucaucua

SEQ ID NO: 900514 - RNA, 20 nt, Homo sapiens
agaauccugccucuccccaa

SEQ ID NO: 900515 - RNA, 19 nt, Homo sapiens
agaaucgcuuaaacccagg

SEQ ID NO: 900516 - RNA, 13 nt, Homo sapiens
agaaucuagccuc

SEQ ID NO: 900517 - RNA, 15 nt, Homo sapiens
agaaugaagaccuaa

SEQ ID NO: 900518 - RNA, 18 nt, Homo sapiens
agaaugaauaauaauuau

SEQ ID NO: 900519 - RNA, 13 nt, Homo sapiens
agaaugauggacu

SEQ ID NO: 900520 - RNA, 16 nt, Homo sapiens
agaaugcccaacucuu

SEQ ID NO: 900521 - RNA, 13 nt, Homo sapiens
agaauggaacuca

SEQ ID NO: 900522 - RNA, 14 nt, Homo sapiens
agaauggagcagua

SEQ ID NO: 900523 - RNA, 13 nt, Homo sapiens
agaaugugauucc

SEQ ID NO: 900524 - RNA, 13 nt, Homo sapiens
agaauuauucucu

SEQ ID NO: 900525 - RNA, 16 nt, Homo sapiens
agaauucacaccuuag

SEQ ID NO: 900526 - RNA, 23 nt, Homo sapiens
agaauucucgaacugcauguauu

SEQ ID NO: 900527 - RNA, 16 nt, Homo sapiens
agaauuuaacaugacu

SEQ ID NO: 900528 - RNA, 23 nt, Homo sapiens
agaauuugccuucucccugggaa

SEQ ID NO: 900529 - RNA, 19 nt, Homo sapiens
agacaaaaucuuaaaugcc

SEQ ID NO: 900530 - RNA, 17 nt, Homo sapiens
agacaaaguaauuccuc

SEQ ID NO: 900531 - RNA, 20 nt, Homo sapiens
agacaagaaggccacuggua

SEQ ID NO: 900532 - RNA, 21 nt, Homo sapiens
agacaagcuuguccauguaau

SEQ ID NO: 900533 - RNA, 16 nt, Homo sapiens
agacaauccacucuca

SEQ ID NO: 900534 - RNA, 17 nt, Homo sapiens
agacaauccacucucag

SEQ ID NO: 900535 - RNA, 17 nt, Homo sapiens
agacacaggcccggcuc

SEQ ID NO: 900536 - RNA, 22 nt, Homo sapiens
agacacauuaaaggguagccua

SEQ ID NO: 900537 - RNA, 16 nt, Homo sapiens
agacacugagaucugu

SEQ ID NO: 900538 - RNA, 14 nt, Homo sapiens
agacacugugcuau

SEQ ID NO: 900539 - RNA, 22 nt, Homo sapiens
agacagagcccugugaggcugg

SEQ ID NO: 900540 - RNA, 14 nt, Homo sapiens
agacagauugcuga

SEQ ID NO: 900541 - RNA, 21 nt, Homo sapiens
agacagcacuacagauaucau

SEQ ID NO: 900542 - RNA, 15 nt, Homo sapiens
agacaggcucagguu

SEQ ID NO: 900543 - RNA, 20 nt, Homo sapiens
agacagggcaaucuugucca

SEQ ID NO: 900544 - RNA, 15 nt, Homo sapiens
agacaguucaagaaa

SEQ ID NO: 900545 - RNA, 14 nt, Homo sapiens
agacaugaaugcac

SEQ ID NO: 900546 - RNA, 20 nt, Homo sapiens
agacaugcacuaugaggaau

SEQ ID NO: 900547 - RNA, 18 nt, Homo sapiens
agacauggaauuaccuua

SEQ ID NO: 900548 - RNA, 23 nt, Homo sapiens
agacaugucuagccacugaucau

SEQ ID NO: 900549 - RNA, 17 nt, Homo sapiens
agacauuaaaccuggau

SEQ ID NO: 900550 - RNA, 16 nt, Homo sapiens
agaccaaaauaugaaa

SEQ ID NO: 900551 - RNA, 19 nt, Homo sapiens
agaccaaaauaugaaagac

SEQ ID NO: 900552 - RNA, 18 nt, Homo sapiens
agaccaaagcauugccug

SEQ ID NO: 900553 - RNA, 19 nt, Homo sapiens
agaccacucccuuccccca

SEQ ID NO: 900554 - RNA, 13 nt, Homo sapiens
agaccacucugcu

SEQ ID NO: 900555 - RNA, 12 nt, Homo sapiens
agaccacugucc

SEQ ID NO: 900556 - RNA, 15 nt, Homo sapiens
agaccacuguuauca

SEQ ID NO: 900557 - RNA, 23 nt, Homo sapiens
agaccagacuguggagaaauaaa

SEQ ID NO: 900558 - RNA, 23 nt, Homo sapiens
agaccaggccugagcaacaaagc

SEQ ID NO: 900559 - RNA, 17 nt, Homo sapiens
agaccaguacugggaag

SEQ ID NO: 900560 - RNA, 13 nt, Homo sapiens
agaccaguccaug

SEQ ID NO: 900561 - RNA, 15 nt, Homo sapiens
agaccauuuguauua

SEQ ID NO: 900562 - RNA, 15 nt, Homo sapiens
agaccccaaggccca

SEQ ID NO: 900563 - RNA, 19 nt, Homo sapiens
agaccccaaggcccagaca

SEQ ID NO: 900564 - RNA, 19 nt, Homo sapiens
agaccccacccugaggucc

SEQ ID NO: 900565 - RNA, 23 nt, Homo sapiens
agaccccacccugagguccugca

SEQ ID NO: 900566 - RNA, 18 nt, Homo sapiens
agaccccccaucagugga

SEQ ID NO: 900567 - RNA, 12 nt, Homo sapiens
agacccggcugc

SEQ ID NO: 900568 - RNA, 12 nt, Homo sapiens
agacccuaugaa

SEQ ID NO: 900569 - RNA, 19 nt, Homo sapiens
agacccugagacuccagaa

SEQ ID NO: 900570 - RNA, 14 nt, Homo sapiens
agaccgaaucucac

SEQ ID NO: 900571 - RNA, 12 nt, Homo sapiens
agaccucuacaa

SEQ ID NO: 900572 - RNA, 16 nt, Homo sapiens
acaagcauuuguucca

SEQ ID NO: 900573 - RNA, 20 nt, Homo sapiens
acaagccaacgacaaagcca

SEQ ID NO: 900574 - RNA, 18 nt, Homo sapiens
acaaggcugaccaagaga

SEQ ID NO: 900575 - RNA, 20 nt, Homo sapiens
acaaggcugggcaccucuag

SEQ ID NO: 900576 - RNA, 21 nt, Homo sapiens
acaagguagacauggauuuga

SEQ ID NO: 900577 - RNA, 22 nt, Homo sapiens
acaaggugucuuuuccacuccu

SEQ ID NO: 900578 - RNA, 14 nt, Homo sapiens
acaauaaagacuga

SEQ ID NO: 900579 - RNA, 18 nt, Homo sapiens
acaauaaggucaaugcca

SEQ ID NO: 900580 - RNA, 16 nt, Homo sapiens
acaauaauuaaugugu

SEQ ID NO: 900581 - RNA, 16 nt, Homo sapiens
acaauaauucuaugag

SEQ ID NO: 900582 - RNA, 16 nt, Homo sapiens
acaauacgugaaagau

SEQ ID NO: 900583 - RNA, 23 nt, Homo sapiens
acaauauaaacugaaaaauguca

SEQ ID NO: 900584 - RNA, 13 nt, Homo sapiens
acaauaucuucau

SEQ ID NO: 900585 - RNA, 12 nt, Homo sapiens
acaaucugggac

SEQ ID NO: 900586 - RNA, 21 nt, Homo sapiens
acaaucuuuccuugucucuca

SEQ ID NO: 900587 - RNA, 16 nt, Homo sapiens
acaaugaaaugcucuc

SEQ ID NO: 900588 - RNA, 17 nt, Homo sapiens
acaaugccaucacugga

SEQ ID NO: 900589 - RNA, 17 nt, Homo sapiens
acaauggcuuacuccag

SEQ ID NO: 900590 - RNA, 23 nt, Homo sapiens
acaauguaugugaaaguguaaaa

SEQ ID NO: 900591 - RNA, 23 nt, Homo sapiens
acaauguauuugucaaugcauca

SEQ ID NO: 900592 - RNA, 20 nt, Homo sapiens
acaauguuucagaagcccca

SEQ ID NO: 900593 - RNA, 23 nt, Homo sapiens
acaauugggagauuaucuuucaa

SEQ ID NO: 900594 - RNA, 20 nt, Homo sapiens
acaauuuagaaaacauucau

SEQ ID NO: 900595 - RNA, 24 nt, Homo sapiens
acaauuugagcaauucauuucacu

SEQ ID NO: 900596 - RNA, 15 nt, Homo sapiens
acacaaaagccaaaa

SEQ ID NO: 900597 - RNA, 20 nt, Homo sapiens
acacaaaaugucacaauccu

SEQ ID NO: 900598 - RNA, 15 nt, Homo sapiens
acacaaauuuguaaa

SEQ ID NO: 900599 - RNA, 20 nt, Homo sapiens
acacaaggcugggcaccucu

SEQ ID NO: 900600 - RNA, 12 nt, Homo sapiens
acacaaggucau

SEQ ID NO: 900601 - RNA, 20 nt, Homo sapiens
acacaagugcgccuugcaaa

SEQ ID NO: 900602 - RNA, 23 nt, Homo sapiens
acacaaucuuuccuugucucuca

SEQ ID NO: 900603 - RNA, 22 nt, Homo sapiens
acacaaugcuauugaaauuacu

SEQ ID NO: 900604 - RNA, 17 nt, Homo sapiens
acacaauugauacuuca

SEQ ID NO: 900605 - RNA, 13 nt, Homo sapiens
acacacacaccaa

SEQ ID NO: 900606 - RNA, 21 nt, Homo sapiens
acacacaccucuaggacucca

SEQ ID NO: 900607 - RNA, 17 nt, Homo sapiens
acacacacgccaaugca

SEQ ID NO: 900608 - RNA, 16 nt, Homo sapiens
acacacagagauaugc

SEQ ID NO: 900609 - RNA, 18 nt, Homo sapiens
acacacagagauaugcac

SEQ ID NO: 900610 - RNA, 15 nt, Homo sapiens
acacacagauaugca

SEQ ID NO: 900611 - RNA, 13 nt, Homo sapiens
acacacagaugca

SEQ ID NO: 900612 - RNA, 12 nt, Homo sapiens
acacacagcucu

SEQ ID NO: 900613 - RNA, 17 nt, Homo sapiens
acacacauauacauaua

SEQ ID NO: 900614 - RNA, 18 nt, Homo sapiens
acacacauggaugcacac

SEQ ID NO: 900615 - RNA, 20 nt, Homo sapiens
acacaccgaugcugacucca

SEQ ID NO: 900616 - RNA, 22 nt, Homo sapiens
acacaccgauguacacacacag

SEQ ID NO: 900617 - RNA, 23 nt, Homo sapiens
acacaccgauguacacacacaga

SEQ ID NO: 900618 - RNA, 13 nt, Homo sapiens
acacaccugguga

SEQ ID NO: 900619 - RNA, 17 nt, Homo sapiens
acacacgccaaugcaca

SEQ ID NO: 900620 - RNA, 23 nt, Homo sapiens
acacagacacacaaaaugucaca

SEQ ID NO: 900621 - RNA, 15 nt, Homo sapiens
acacagacugcgauu

SEQ ID NO: 900622 - RNA, 18 nt, Homo sapiens
acacagagauaugcacac

SEQ ID NO: 900623 - RNA, 19 nt, Homo sapiens
acacagaugcacacacaga

SEQ ID NO: 900624 - RNA, 22 nt, Homo sapiens
acacagcaagggugaugggaaa

SEQ ID NO: 900625 - RNA, 23 nt, Homo sapiens
acacagcacucucuaaaucuucc

SEQ ID NO: 900626 - RNA, 16 nt, Homo sapiens
acacagccugggacca

SEQ ID NO: 900627 - RNA, 14 nt, Homo sapiens
acacaggaaaccaa

SEQ ID NO: 900628 - RNA, 17 nt, Homo sapiens
acacagggugcauguga

SEQ ID NO: 900629 - RNA, 16 nt, Homo sapiens
acacaguucaauucuc

SEQ ID NO: 900630 - RNA, 22 nt, Homo sapiens
acacauagauuaauggcacuga

SEQ ID NO: 900631 - RNA, 15 nt, Homo sapiens
acacaugguuuccaa

SEQ ID NO: 900632 - RNA, 17 nt, Homo sapiens
acacauucuuaacacau

SEQ ID NO: 900633 - RNA, 15 nt, Homo sapiens
acaccaaugcgcaca

SEQ ID NO: 900634 - RNA, 12 nt, Homo sapiens
acaccaccaucu

SEQ ID NO: 900635 - RNA, 16 nt, Homo sapiens
acaccacuuugucucu

SEQ ID NO: 900636 - RNA, 17 nt, Homo sapiens
acacccaaagcauggac

SEQ ID NO: 900637 - RNA, 14 nt, Homo sapiens
acacccaagaagaa

SEQ ID NO: 900638 - RNA, 21 nt, Homo sapiens
acaccgauguacacacacaga

SEQ ID NO: 900639 - RNA, 23 nt, Homo sapiens
acaccgaugugcgcacacacaga

SEQ ID NO: 900640 - RNA, 22 nt, Homo sapiens
acaccuaagagaaaaagaucga

SEQ ID NO: 900641 - RNA, 17 nt, Homo sapiens
acaccuaugucauuuca

SEQ ID NO: 900642 - RNA, 18 nt, Homo sapiens
acaccuaugucauuucau

SEQ ID NO: 900643 - RNA, 20 nt, Homo sapiens
acaccucaccagaauugugc

SEQ ID NO: 900644 - RNA, 21 nt, Homo sapiens
acaccucccuccccacaccuc

SEQ ID NO: 900645 - RNA, 20 nt, Homo sapiens
acaccugaaaauuaugaguc

SEQ ID NO: 900646 - RNA, 12 nt, Homo sapiens
acaccuguugca

SEQ ID NO: 900647 - RNA, 22 nt, Homo sapiens
acaccuucuuggcuucugggac

SEQ ID NO: 900648 - RNA, 15 nt, Homo sapiens
acaccuugacagggc

SEQ ID NO: 900649 - RNA, 16 nt, Homo sapiens
acaccuuuguuuugca

SEQ ID NO: 900650 - RNA, 14 nt, Homo sapiens
acacgcgugcacac

SEQ ID NO: 900651 - RNA, 17 nt, Homo sapiens
acacguaccucucauca

SEQ ID NO: 900652 - RNA, 14 nt, Homo sapiens
acacuaacauauaa

SEQ ID NO: 900653 - RNA, 15 nt, Homo sapiens
acacuaacauauaau

SEQ ID NO: 900654 - RNA, 22 nt, Homo sapiens
acacuaagcgaauguguacaaa

SEQ ID NO: 900655 - RNA, 15 nt, Homo sapiens
acacuaauacaccag

SEQ ID NO: 900656 - RNA, 22 nt, Homo sapiens
acacuacaaguuuauaagccca

SEQ ID NO: 900657 - RNA, 18 nt, Homo sapiens
acacucaacaauaaagac

SEQ ID NO: 900658 - RNA, 15 nt, Homo sapiens
acacucacauuuauu

SEQ ID NO: 900659 - RNA, 22 nt, Homo sapiens
acacucccagggacaagggaag

SEQ ID NO: 900660 - RNA, 15 nt, Homo sapiens
acacugaaguuaaca

SEQ ID NO: 900661 - RNA, 17 nt, Homo sapiens
acacugaaguuaacaga

SEQ ID NO: 900662 - RNA, 20 nt, Homo sapiens
acacugagcaagaucuuguc

SEQ ID NO: 900663 - RNA, 19 nt, Homo sapiens
acacugaggaggcugccuu

SEQ ID NO: 900664 - RNA, 23 nt, Homo sapiens
acacugguggaggagcugggcuu

SEQ ID NO: 900665 - RNA, 21 nt, Homo sapiens
acacuguaaucuuaaaagugu

SEQ ID NO: 900666 - RNA, 12 nt, Homo sapiens
acacuguacaag

SEQ ID NO: 900667 - RNA, 14 nt, Homo sapiens
acacugugcuauaa

SEQ ID NO: 900668 - RNA, 14 nt, Homo sapiens
acacuuacccaagg

SEQ ID NO: 900669 - RNA, 16 nt, Homo sapiens
acacuuaugggccaag

SEQ ID NO: 900670 - RNA, 16 nt, Homo sapiens
acacuuccauuaacuu

SEQ ID NO: 900671 - RNA, 20 nt, Homo sapiens
acacuucuaaaugaagugca

SEQ ID NO: 900672 - RNA, 15 nt, Homo sapiens
acagaaacauuuuca

SEQ ID NO: 900673 - RNA, 20 nt, Homo sapiens
acagaaauauauauacauau

SEQ ID NO: 900674 - RNA, 21 nt, Homo sapiens
acagaacacugucuugaagac

SEQ ID NO: 900675 - RNA, 22 nt, Homo sapiens
acagaacugcuaaauacuguac

SEQ ID NO: 900676 - RNA, 24 nt, Homo sapiens
acagaacugcuaaauacuguacau

SEQ ID NO: 900677 - RNA, 12 nt, Homo sapiens
acagaagccagg

SEQ ID NO: 900678 - RNA, 20 nt, Homo sapiens
acagaaggaaucugugcaga

SEQ ID NO: 900679 - RNA, 17 nt, Homo sapiens
ccuccggugugagauau

SEQ ID NO: 900680 - RNA, 20 nt, Homo sapiens
ccuccguguagugucuguaa

SEQ ID NO: 900681 - RNA, 18 nt, Homo sapiens
ccuccuaaccuagagauu

SEQ ID NO: 900682 - RNA, 16 nt, Homo sapiens
ccuccugccuccagca

SEQ ID NO: 900683 - RNA, 17 nt, Homo sapiens
ccuccugggaccaugga

SEQ ID NO: 900684 - RNA, 22 nt, Homo sapiens
ccuccugucuuagccucccaaa

SEQ ID NO: 900685 - RNA, 15 nt, Homo sapiens
ccuccuuuugcuuga

SEQ ID NO: 900686 - RNA, 18 nt, Homo sapiens
ccucuacuuaaugagaua

SEQ ID NO: 900687 - RNA, 13 nt, Homo sapiens
ccucuauucaauu

SEQ ID NO: 900688 - RNA, 21 nt, Homo sapiens
ccucucccgcgggccuggaca

SEQ ID NO: 900689 - RNA, 13 nt, Homo sapiens
ccucugcucugag

SEQ ID NO: 900690 - RNA, 21 nt, Homo sapiens
ccucuggcuggcuaacuggaa

SEQ ID NO: 900691 - RNA, 18 nt, Homo sapiens
ccucuguugccaggcuag

SEQ ID NO: 900692 - RNA, 17 nt, Homo sapiens
ccucuuaccuauguccc

SEQ ID NO: 900693 - RNA, 23 nt, Homo sapiens
ccucuuccugccaagccaccuuc

SEQ ID NO: 900694 - RNA, 13 nt, Homo sapiens
ccucuugcuauug

SEQ ID NO: 900695 - RNA, 13 nt, Homo sapiens
ccucuugcucaaa

SEQ ID NO: 900696 - RNA, 17 nt, Homo sapiens
ccucuuuccccaccucu

SEQ ID NO: 900697 - RNA, 15 nt, Homo sapiens
ccucuuuucucugug

SEQ ID NO: 900698 - RNA, 18 nt, Homo sapiens
ccucuuuucucugugcuu

SEQ ID NO: 900699 - RNA, 17 nt, Homo sapiens
ccugaaaauuaugaguc

SEQ ID NO: 900700 - RNA, 15 nt, Homo sapiens
ccugaaaauucugua

SEQ ID NO: 900701 - RNA, 14 nt, Homo sapiens
ccugaaccccaugg

SEQ ID NO: 900702 - RNA, 21 nt, Homo sapiens
ccugaagaacaguaacugcca

SEQ ID NO: 900703 - RNA, 21 nt, Homo sapiens
ccugaaggugcugacaaagau

SEQ ID NO: 900704 - RNA, 20 nt, Homo sapiens
ccugaagucacacagugagu

SEQ ID NO: 900705 - RNA, 17 nt, Homo sapiens
ccugaauuuuguugcug

SEQ ID NO: 900706 - RNA, 14 nt, Homo sapiens
ccugacaauggcag

SEQ ID NO: 900707 - RNA, 18 nt, Homo sapiens
ccugacagaaggacucag

SEQ ID NO: 900708 - RNA, 14 nt, Homo sapiens
ccugacaugucuca

SEQ ID NO: 900709 - RNA, 19 nt, Homo sapiens
ccugaccaacauggugaaa

SEQ ID NO: 900710 - RNA, 16 nt, Homo sapiens
ccugaccuugugaucu

SEQ ID NO: 900711 - RNA, 18 nt, Homo sapiens
ccugacggacguccugcu

SEQ ID NO: 900712 - RNA, 20 nt, Homo sapiens
ccugacuccucuaagccacu

SEQ ID NO: 900713 - RNA, 16 nt, Homo sapiens
ccugacuuugugaucc

SEQ ID NO: 900714 - RNA, 19 nt, Homo sapiens
ccugagaaacccaccagcc

SEQ ID NO: 900715 - RNA, 19 nt, Homo sapiens
ccugagcaacagagugaga

SEQ ID NO: 900716 - RNA, 22 nt, Homo sapiens
ccugagucggccccacauggga

SEQ ID NO: 900717 - RNA, 24 nt, Homo sapiens
ccugauaaacauuaaacacuguaa

SEQ ID NO: 900718 - RNA, 17 nt, Homo sapiens
ccugaugaaaaauaugu

SEQ ID NO: 900719 - RNA, 21 nt, Homo sapiens
ccugaugggguggaaggcaug

SEQ ID NO: 900720 - RNA, 12 nt, Homo sapiens
ccugauggugcu

SEQ ID NO: 900721 - RNA, 12 nt, Homo sapiens
ccugauguuaaa

SEQ ID NO: 900722 - RNA, 15 nt, Homo sapiens
ccugauuucagggaa

SEQ ID NO: 900723 - RNA, 14 nt, Homo sapiens
ccugauuucucuga

SEQ ID NO: 900724 - RNA, 21 nt, Homo sapiens
ccugcaaacucacugcucaag

SEQ ID NO: 900725 - RNA, 20 nt, Homo sapiens
ccugcaaagcuaaaauugaa

SEQ ID NO: 900726 - RNA, 13 nt, Homo sapiens
ccugcaagugccc

SEQ ID NO: 900727 - RNA, 22 nt, Homo sapiens
ccugcagccuccuccugaccac

SEQ ID NO: 900728 - RNA, 16 nt, Homo sapiens
ccugcagugggccauc

SEQ ID NO: 900729 - RNA, 15 nt, Homo sapiens
ccugcaguuggcaga

SEQ ID NO: 900730 - RNA, 23 nt, Homo sapiens
ccugcauguuggcccagaccuca

SEQ ID NO: 900731 - RNA, 18 nt, Homo sapiens
ccugccaccagucacugu

SEQ ID NO: 900732 - RNA, 22 nt, Homo sapiens
ccugccagagcccaagugccau

SEQ ID NO: 900733 - RNA, 23 nt, Homo sapiens
ccugccccacuucucuacucugg

SEQ ID NO: 900734 - RNA, 16 nt, Homo sapiens
ccugccccugccccaa

SEQ ID NO: 900735 - RNA, 17 nt, Homo sapiens
ccugccggacacagagg

SEQ ID NO: 900736 - RNA, 14 nt, Homo sapiens
ccugccuaggaauu

SEQ ID NO: 900737 - RNA, 16 nt, Homo sapiens
ccugccucucugcucc

SEQ ID NO: 900738 - RNA, 20 nt, Homo sapiens
ccugccugagcccaggagcu

SEQ ID NO: 900739 - RNA, 20 nt, Homo sapiens
ccugccugcgggcaccuaca

SEQ ID NO: 900740 - RNA, 23 nt, Homo sapiens
ccugccugcgggggaguggggga

SEQ ID NO: 900741 - RNA, 22 nt, Homo sapiens
ccugccuggguuuucuaacugu

SEQ ID NO: 900742 - RNA, 10 nt, Homo sapiens
ccugccugua

SEQ ID NO: 900743 - RNA, 21 nt, Homo sapiens
ccugccuugaugaagccugug

SEQ ID NO: 900744 - RNA, 15 nt, Homo sapiens
ccugcuccgagucuu

SEQ ID NO: 900745 - RNA, 15 nt, Homo sapiens
ccugcugagcucuga

SEQ ID NO: 900746 - RNA, 19 nt, Homo sapiens
ccugcugcugaccugauca

SEQ ID NO: 900747 - RNA, 21 nt, Homo sapiens
ccugcugcuguguuuuugcua

SEQ ID NO: 900748 - RNA, 16 nt, Homo sapiens
ccugcuggcaccucag

SEQ ID NO: 900749 - RNA, 22 nt, Homo sapiens
ccugcugugcccucccauagca

SEQ ID NO: 900750 - RNA, 12 nt, Homo sapiens
ccugcuucucag

SEQ ID NO: 900751 - RNA, 18 nt, Homo sapiens
ccugcuuugaggacaaag

SEQ ID NO: 900752 - RNA, 15 nt, Homo sapiens
ccugcuuuuugacau

SEQ ID NO: 900753 - RNA, 21 nt, Homo sapiens
ccuggaacugucucucaugaa

SEQ ID NO: 900754 - RNA, 15 nt, Homo sapiens
ccuggaagagggcaa

SEQ ID NO: 900755 - RNA, 18 nt, Homo sapiens
ccuggaagccaaacaaag

SEQ ID NO: 900756 - RNA, 19 nt, Homo sapiens
ccuggaagccggccggcug

SEQ ID NO: 900757 - RNA, 20 nt, Homo sapiens
ccuggaaggcagccaggcug

SEQ ID NO: 900758 - RNA, 20 nt, Homo sapiens
ccuggaaucaagaugucaga

SEQ ID NO: 900759 - RNA, 23 nt, Homo sapiens
ccuggaccgcuucccagaggcca

SEQ ID NO: 900760 - RNA, 20 nt, Homo sapiens
ccuggaccuuuugucucaca

SEQ ID NO: 900761 - RNA, 13 nt, Homo sapiens
ccuggacugggag

SEQ ID NO: 900762 - RNA, 14 nt, Homo sapiens
ccuggagugcaguu

SEQ ID NO: 900763 - RNA, 21 nt, Homo sapiens
ccuggaugugcccacagggac

SEQ ID NO: 900764 - RNA, 18 nt, Homo sapiens
ccuggcaagugggugaaa

SEQ ID NO: 900765 - RNA, 23 nt, Homo sapiens
ccuggccggcuccaguuucccca

SEQ ID NO: 900766 - RNA, 18 nt, Homo sapiens
ccuggccuggcacacauc

SEQ ID NO: 900767 - RNA, 14 nt, Homo sapiens
ccuggccuugucag

SEQ ID NO: 900768 - RNA, 22 nt, Homo sapiens
ccuggcugagagaggaagagcu

SEQ ID NO: 900769 - RNA, 20 nt, Homo sapiens
ccuggcuguccccagcaccu

SEQ ID NO: 900770 - RNA, 21 nt, Homo sapiens
ccugggaaggcuaaguucagu

SEQ ID NO: 900771 - RNA, 18 nt, Homo sapiens
ccugggcaacaaagugag

SEQ ID NO: 900772 - RNA, 14 nt, Homo sapiens
ccugggccuggacc

SEQ ID NO: 900773 - RNA, 16 nt, Homo sapiens
ccugggcuuaugcccu

SEQ ID NO: 900774 - RNA, 20 nt, Homo sapiens
ccuggguuuucuaacuguaa

SEQ ID NO: 900775 - RNA, 18 nt, Homo sapiens
ccuggucccuuggagaca

SEQ ID NO: 900776 - RNA, 19 nt, Homo sapiens
ccuggugaccuacuaaaaa

SEQ ID NO: 900777 - RNA, 14 nt, Homo sapiens
ccugguguguuucc

SEQ ID NO: 900778 - RNA, 17 nt, Homo sapiens
ccugguuggccgugguc

SEQ ID NO: 900779 - RNA, 16 nt, Homo sapiens
ccuguaaagucuaauc

SEQ ID NO: 900780 - RNA, 21 nt, Homo sapiens
ccuguaaucccagcuacaugg

SEQ ID NO: 900781 - RNA, 20 nt, Homo sapiens
ccuguaccccagcacuugug

SEQ ID NO: 900782 - RNA, 22 nt, Homo sapiens
ccuguacucuggagagacugug

SEQ ID NO: 900783 - RNA, 23 nt, Homo sapiens
ccuguacucuggagagacugugc

SEQ ID NO: 900784 - RNA, 18 nt, Homo sapiens
ccuguagccccagugaca

SEQ ID NO: 900785 - RNA, 15 nt, Homo sapiens
ccugucagagaucug

SEQ ID NO: 900786 - RNA, 15 nt, Homo sapiens
ccugucuuuaaggaa

SEQ ID NO: 900787 - RNA, 21 nt, Homo sapiens
ccugugaucuccacaccaaag

SEQ ID NO: 900788 - RNA, 13 nt, Homo sapiens
ccugugauugcuc

SEQ ID NO: 900789 - RNA, 13 nt, Homo sapiens
ccugugccagcuc

SEQ ID NO: 900790 - RNA, 12 nt, Homo sapiens
ccugugcugacg

SEQ ID NO: 900791 - RNA, 15 nt, Homo sapiens
ccuguggccuugccc

SEQ ID NO: 900792 - RNA, 18 nt, Homo sapiens
ccugugggugugucucuc

SEQ ID NO: 900793 - RNA, 16 nt, Homo sapiens
cagaccauccaccagg

SEQ ID NO: 900794 - RNA, 17 nt, Homo sapiens
cagaccauccaccaggc

SEQ ID NO: 900795 - RNA, 20 nt, Homo sapiens
cagacccccacucucauucc

SEQ ID NO: 900796 - RNA, 20 nt, Homo sapiens
cagaccgggguucaagccau

SEQ ID NO: 900797 - RNA, 22 nt, Homo sapiens
cagaccucuacaagcaaaugga

SEQ ID NO: 900798 - RNA, 15 nt, Homo sapiens
cagacgucucaagac

SEQ ID NO: 900799 - RNA, 22 nt, Homo sapiens
cagacuacagccagaagcccau

SEQ ID NO: 900800 - RNA, 21 nt, Homo sapiens
cagacuauuuaacuugagggu

SEQ ID NO: 900801 - RNA, 18 nt, Homo sapiens
cagacuccugugcaacuu

SEQ ID NO: 900802 - RNA, 15 nt, Homo sapiens
cagacucguucuucu

SEQ ID NO: 900803 - RNA, 16 nt, Homo sapiens
cagacuguaggauuug

SEQ ID NO: 900804 - RNA, 15 nt, Homo sapiens
cagacuguugcacuc

SEQ ID NO: 900805 - RNA, 14 nt, Homo sapiens
cagacuucuccaga

SEQ ID NO: 900806 - RNA, 21 nt, Homo sapiens
cagacuugccaggcucccuuu

SEQ ID NO: 900807 - RNA, 20 nt, Homo sapiens
cagagaaaauaaaagcacuu

SEQ ID NO: 900808 - RNA, 18 nt, Homo sapiens
cagagaaaugugaagggu

SEQ ID NO: 900809 - RNA, 15 nt, Homo sapiens
cagagaacccugugg

SEQ ID NO: 900810 - RNA, 21 nt, Homo sapiens
cagagaagaccaaagcauugc

SEQ ID NO: 900811 - RNA, 22 nt, Homo sapiens
cagagaagauaauguucuuuaa

SEQ ID NO: 900812 - RNA, 18 nt, Homo sapiens
cagagaagccccuaggca

SEQ ID NO: 900813 - RNA, 18 nt, Homo sapiens
cagagaaggcuuccucca

SEQ ID NO: 900814 - RNA, 20 nt, Homo sapiens
cagagacaauaaaacauucc

SEQ ID NO: 900815 - RNA, 16 nt, Homo sapiens
cagagacaggaaaauc

SEQ ID NO: 900816 - RNA, 20 nt, Homo sapiens
cagagacauacaccuauguc

SEQ ID NO: 900817 - RNA, 17 nt, Homo sapiens
cagagacccagaucuca

SEQ ID NO: 900818 - RNA, 18 nt, Homo sapiens
cagagacccagaucucau

SEQ ID NO: 900819 - RNA, 19 nt, Homo sapiens
cagagaccccaggauccca

SEQ ID NO: 900820 - RNA, 16 nt, Homo sapiens
cagagacuaucugauu

SEQ ID NO: 900821 - RNA, 16 nt, Homo sapiens
cagagauaauugccau

SEQ ID NO: 900822 - RNA, 15 nt, Homo sapiens
cagagauaugcacac

SEQ ID NO: 900823 - RNA, 17 nt, Homo sapiens
cagagaugaaacuaugg

SEQ ID NO: 900824 - RNA, 22 nt, Homo sapiens
cagagaugcaugcgcaggcuca

SEQ ID NO: 900825 - RNA, 13 nt, Homo sapiens
cagagaugggcaa

SEQ ID NO: 900826 - RNA, 14 nt, Homo sapiens
cagagccaccaggg

SEQ ID NO: 900827 - RNA, 16 nt, Homo sapiens
cagagccacuaccuuu

SEQ ID NO: 900828 - RNA, 20 nt, Homo sapiens
cagagcgagagucugucuca

SEQ ID NO: 900829 - RNA, 13 nt, Homo sapiens
cagagcuuccuua

SEQ ID NO: 900830 - RNA, 18 nt, Homo sapiens
cagaggcugcagaaggcc

SEQ ID NO: 900831 - RNA, 14 nt, Homo sapiens
cagaggcugcagga

SEQ ID NO: 900832 - RNA, 23 nt, Homo sapiens
cagagggaaaguaaauauuucag

SEQ ID NO: 900833 - RNA, 15 nt, Homo sapiens
cagagggcccaggca

SEQ ID NO: 900834 - RNA, 14 nt, Homo sapiens
cagaggggaaacca

SEQ ID NO: 900835 - RNA, 22 nt, Homo sapiens
cagagggguaggcagagccuuu

SEQ ID NO: 900836 - RNA, 12 nt, Homo sapiens
cagaguaaaaua

SEQ ID NO: 900837 - RNA, 20 nt, Homo sapiens
cagaguaaauagcauucucu

SEQ ID NO: 900838 - RNA, 19 nt, Homo sapiens
cagaguaacaugccagcuu

SEQ ID NO: 900839 - RNA, 18 nt, Homo sapiens
cagagucucacuguugcc

SEQ ID NO: 900840 - RNA, 17 nt, Homo sapiens
cagaguuguacacugug

SEQ ID NO: 900841 - RNA, 15 nt, Homo sapiens
cagauaaacaacaaa

SEQ ID NO: 900842 - RNA, 21 nt, Homo sapiens
cagauaacaaccccggacaaa

SEQ ID NO: 900843 - RNA, 22 nt, Homo sapiens
cagauagcaucuuauacgagua

SEQ ID NO: 900844 - RNA, 11 nt, Homo sapiens
cagauagucaa

SEQ ID NO: 900845 - RNA, 12 nt, Homo sapiens
cagauaguguaa

SEQ ID NO: 900846 - RNA, 23 nt, Homo sapiens
cagauaucagaaucauugaagua

SEQ ID NO: 900847 - RNA, 20 nt, Homo sapiens
cagauaugcacacacaugga

SEQ ID NO: 900848 - RNA, 23 nt, Homo sapiens
cagauaugcacacacauggauga

SEQ ID NO: 900849 - RNA, 18 nt, Homo sapiens
cagauauuugaaucuuuc

SEQ ID NO: 900850 - RNA, 20 nt, Homo sapiens
cagaucagauucuucucuua

SEQ ID NO: 900851 - RNA, 18 nt, Homo sapiens
cagaucccauccaucagc

SEQ ID NO: 900852 - RNA, 14 nt, Homo sapiens
cagauccucacaac

SEQ ID NO: 900853 - RNA, 19 nt, Homo sapiens
cagauccucacaaccaccu

SEQ ID NO: 900854 - RNA, 22 nt, Homo sapiens
cagaucgauccuggauucacuc

SEQ ID NO: 900855 - RNA, 16 nt, Homo sapiens
cagaugagcagucaca

SEQ ID NO: 900856 - RNA, 12 nt, Homo sapiens
cagaugaucucu

SEQ ID NO: 900857 - RNA, 12 nt, Homo sapiens
cagaugcaauac

SEQ ID NO: 900858 - RNA, 23 nt, Homo sapiens
cagaugcacacacagaugcacac

SEQ ID NO: 900859 - RNA, 16 nt, Homo sapiens
cagauggaguaccaug

SEQ ID NO: 900860 - RNA, 17 nt, Homo sapiens
cagauggucacacagag

SEQ ID NO: 900861 - RNA, 20 nt, Homo sapiens
cagauggucacacagagaua

SEQ ID NO: 900862 - RNA, 21 nt, Homo sapiens
cagauguaaaugccacaaaga

SEQ ID NO: 900863 - RNA, 21 nt, Homo sapiens
cagauuugcaaaguuuaaugg

SEQ ID NO: 900864 - RNA, 21 nt, Homo sapiens
cagcaaaagaagacaacauuu

SEQ ID NO: 900865 - RNA, 23 nt, Homo sapiens
cagcaauacuaagggaagaaaca

SEQ ID NO: 900866 - RNA, 18 nt, Homo sapiens
cagcaauagggugcaguu

SEQ ID NO: 900867 - RNA, 19 nt, Homo sapiens
cagcacccaggcuccaugg

SEQ ID NO: 900868 - RNA, 17 nt, Homo sapiens
cagcacuaauucaacau

SEQ ID NO: 900869 - RNA, 21 nt, Homo sapiens
cagcacuccaccuugggaccu

SEQ ID NO: 900870 - RNA, 20 nt, Homo sapiens
cagcacucccucccagagaa

SEQ ID NO: 900871 - RNA, 17 nt, Homo sapiens
cagcacucugaaacuga

SEQ ID NO: 900872 - RNA, 13 nt, Homo sapiens
cagcacugacaau

SEQ ID NO: 900873 - RNA, 21 nt, Homo sapiens
cagcacugccggcccagugac

SEQ ID NO: 900874 - RNA, 16 nt, Homo sapiens
cagcacuuguguuguc

SEQ ID NO: 900875 - RNA, 18 nt, Homo sapiens
cagcacuuguguugucug

SEQ ID NO: 900876 - RNA, 11 nt, Homo sapiens
cagcacuuugg

SEQ ID NO: 900877 - RNA, 22 nt, Homo sapiens
cagcagaaaggagaacuaucca

SEQ ID NO: 900878 - RNA, 14 nt, Homo sapiens
cagcagaacaugug

SEQ ID NO: 900879 - RNA, 17 nt, Homo sapiens
cagcagccagcucucag

SEQ ID NO: 900880 - RNA, 17 nt, Homo sapiens
cagcaggaggcuagcaa

SEQ ID NO: 900881 - RNA, 20 nt, Homo sapiens
cagcagguagugggugaaug

SEQ ID NO: 900882 - RNA, 20 nt, Homo sapiens
cagcagugagcuucuauuaa

SEQ ID NO: 900883 - RNA, 21 nt, Homo sapiens
cagcagugagcuucuauuaaa

SEQ ID NO: 900884 - RNA, 18 nt, Homo sapiens
cagcagugguauuaauac

SEQ ID NO: 900885 - RNA, 11 nt, Homo sapiens
cagcauaccuu

SEQ ID NO: 900886 - RNA, 12 nt, Homo sapiens
cagcaucugccu

SEQ ID NO: 900887 - RNA, 17 nt, Homo sapiens
cagcaugggaaugugcc

SEQ ID NO: 900888 - RNA, 19 nt, Homo sapiens
cagcauuauucuucagaag

SEQ ID NO: 900889 - RNA, 16 nt, Homo sapiens
cagcauuccaugacca

SEQ ID NO: 900890 - RNA, 18 nt, Homo sapiens
cagcauuccaugaccaga

SEQ ID NO: 900891 - RNA, 15 nt, Homo sapiens
cagccaacaaacaua

SEQ ID NO: 900892 - RNA, 14 nt, Homo sapiens
cagccacacuucuc

SEQ ID NO: 900893 - RNA, 13 nt, Homo sapiens
cagccaccuccca

SEQ ID NO: 900894 - RNA, 12 nt, Homo sapiens
cagccaccucuc

SEQ ID NO: 900895 - RNA, 18 nt, Homo sapiens
cagccaggcggcuggaau

SEQ ID NO: 900896 - RNA, 18 nt, Homo sapiens
cagccagguuagccuuug

SEQ ID NO: 900897 - RNA, 15 nt, Homo sapiens
cagccagucuugccu

SEQ ID NO: 900898 - RNA, 14 nt, Homo sapiens
cagccaugaaguca

SEQ ID NO: 900899 - RNA, 16 nt, Homo sapiens
cagccaugaccaguuc

SEQ ID NO: 900900 - RNA, 19 nt, Homo sapiens
cagcccaacgggaagcaac

SEQ ID NO: 900901 - RNA, 13 nt, Homo sapiens
cagcccucaggcc

SEQ ID NO: 900902 - RNA, 21 nt, Homo sapiens
cagcccucaggccagugccag

SEQ ID NO: 900903 - RNA, 16 nt, Homo sapiens
cagccgaaaagcuuuu

SEQ ID NO: 900904 - RNA, 19 nt, Homo sapiens
cagccuccaccuugcucuu

SEQ ID NO: 900905 - RNA, 18 nt, Homo sapiens
cagccucccgaguagcug

SEQ ID NO: 900906 - RNA, 20 nt, Homo sapiens
cagccucccgaguagcuggg

SEQ ID NO: 900907 - RNA, 14 nt, Homo sapiens
cagguuagccuuug

SEQ ID NO: 900908 - RNA, 23 nt, Homo sapiens
cagguugccugggccacggugcc

SEQ ID NO: 900909 - RNA, 15 nt, Homo sapiens
cagguuggaguguaa

SEQ ID NO: 900910 - RNA, 20 nt, Homo sapiens
caagugacaugccauccauu

SEQ ID NO: 900911 - RNA, 23 nt, Homo sapiens
caagugaccauaaaggcauggca

SEQ ID NO: 900912 - RNA, 18 nt, Homo sapiens
caagugauaucaccucuc

SEQ ID NO: 900913 - RNA, 18 nt, Homo sapiens
caaguguugaggggacca

SEQ ID NO: 900914 - RNA, 23 nt, Homo sapiens
caaguuaaagugaauaaccacuu

SEQ ID NO: 900915 - RNA, 14 nt, Homo sapiens
caaguuaggagcuu

SEQ ID NO: 900916 - RNA, 23 nt, Homo sapiens
caaguuauaaaucaaugucacuu

SEQ ID NO: 900917 - RNA, 18 nt, Homo sapiens
caaguuccugcacuccag

SEQ ID NO: 900918 - RNA, 21 nt, Homo sapiens
caaguugaaaucagaagccua

SEQ ID NO: 900919 - RNA, 15 nt, Homo sapiens
caaguugagaacaaa

SEQ ID NO: 900920 - RNA, 18 nt, Homo sapiens
caaguugcuucucaugga

SEQ ID NO: 900921 - RNA, 22 nt, Homo sapiens
caaguuggaaauauucaugcuu

SEQ ID NO: 900922 - RNA, 22 nt, Homo sapiens
caauaaaaaaaaaccuagcauc

SEQ ID NO: 900923 - RNA, 16 nt, Homo sapiens
caauaaaacauuccug

SEQ ID NO: 900924 - RNA, 21 nt, Homo sapiens
caauaaaacauuccugugaaa

SEQ ID NO: 900925 - RNA, 22 nt, Homo sapiens
caauaaagaguauuuacaauaa

SEQ ID NO: 900926 - RNA, 16 nt, Homo sapiens
caauaaaguaucuaca

SEQ ID NO: 900927 - RNA, 19 nt, Homo sapiens
caauaaauaagugcauuug

SEQ ID NO: 900928 - RNA, 17 nt, Homo sapiens
caauaaauaaucuguac

SEQ ID NO: 900929 - RNA, 22 nt, Homo sapiens
caauaacuucagagaagucagu

SEQ ID NO: 900930 - RNA, 12 nt, Homo sapiens
caauaagccagc

SEQ ID NO: 900931 - RNA, 14 nt, Homo sapiens
caauacauguaucu

SEQ ID NO: 900932 - RNA, 17 nt, Homo sapiens
caauaccagaucacuca

SEQ ID NO: 900933 - RNA, 22 nt, Homo sapiens
caauagacugaagagaccacag

SEQ ID NO: 900934 - RNA, 15 nt, Homo sapiens
caauaggcauuugau

SEQ ID NO: 900935 - RNA, 12 nt, Homo sapiens
caauaggccaug

SEQ ID NO: 900936 - RNA, 14 nt, Homo sapiens
caauaguaaaagau

SEQ ID NO: 900937 - RNA, 10 nt, Homo sapiens
caauagucaa

SEQ ID NO: 900938 - RNA, 17 nt, Homo sapiens
caauaucugacaguuac

SEQ ID NO: 900939 - RNA, 14 nt, Homo sapiens
caaucagcacugaa

SEQ ID NO: 900940 - RNA, 15 nt, Homo sapiens
caaucagcacugaaa

SEQ ID NO: 900941 - RNA, 16 nt, Homo sapiens
caauccccaagcuggc

SEQ ID NO: 900942 - RNA, 15 nt, Homo sapiens
caaucucaucugaua

SEQ ID NO: 900943 - RNA, 21 nt, Homo sapiens
caaucuuuccuugucucucau

SEQ ID NO: 900944 - RNA, 22 nt, Homo sapiens
caaugaaaaaaaguacauguau

SEQ ID NO: 900945 - RNA, 14 nt, Homo sapiens
caaugaaaccaaag

SEQ ID NO: 900946 - RNA, 15 nt, Homo sapiens
caaugaaaccaaagc

SEQ ID NO: 900947 - RNA, 22 nt, Homo sapiens
caaugaccuguauuuugccaga

SEQ ID NO: 900948 - RNA, 12 nt, Homo sapiens
caaugauucaua

SEQ ID NO: 900949 - RNA, 17 nt, Homo sapiens
caaugcacauccauucc

SEQ ID NO: 900950 - RNA, 18 nt, Homo sapiens
caaugcacauccauuccc

SEQ ID NO: 900951 - RNA, 20 nt, Homo sapiens
caaugcaccuaaagaaaaac

SEQ ID NO: 900952 - RNA, 14 nt, Homo sapiens
caaugcauugcuaa

SEQ ID NO: 900953 - RNA, 10 nt, Homo sapiens
caaugccauc

SEQ ID NO: 900954 - RNA, 23 nt, Homo sapiens
caaugccuugacaacagacugaa

SEQ ID NO: 900955 - RNA, 22 nt, Homo sapiens
caaugguuugcaaggaagccac

SEQ ID NO: 900956 - RNA, 19 nt, Homo sapiens
caaugucaggaacagaagg

SEQ ID NO: 900957 - RNA, 21 nt, Homo sapiens
caaugugauucuaaugucuuc

SEQ ID NO: 900958 - RNA, 21 nt, Homo sapiens
caauguuuaugcaaggaagga

SEQ ID NO: 900959 - RNA, 14 nt, Homo sapiens
caauuaaaggcaaa

SEQ ID NO: 900960 - RNA, 18 nt, Homo sapiens
caauuaaaggcaaaggca

SEQ ID NO: 900961 - RNA, 12 nt, Homo sapiens
caauuaaugaca

SEQ ID NO: 900962 - RNA, 12 nt, Homo sapiens
caauuaguacag

SEQ ID NO: 900963 - RNA, 13 nt, Homo sapiens
caauuaugugaca

SEQ ID NO: 900964 - RNA, 14 nt, Homo sapiens
caauuaugugacaa

SEQ ID NO: 900965 - RNA, 18 nt, Homo sapiens
caauuauuacauuuauac

SEQ ID NO: 900966 - RNA, 21 nt, Homo sapiens
caauucaaaacauugugccau

SEQ ID NO: 900967 - RNA, 20 nt, Homo sapiens
caauuccaaaggaaucucca

SEQ ID NO: 900968 - RNA, 20 nt, Homo sapiens
caauuccauuuccaguucau

SEQ ID NO: 900969 - RNA, 21 nt, Homo sapiens
caauucuauuacgugcaauac

SEQ ID NO: 900970 - RNA, 16 nt, Homo sapiens
caauucuccugccuca

SEQ ID NO: 900971 - RNA, 21 nt, Homo sapiens
caauugucauuuauaaaacca

SEQ ID NO: 900972 - RNA, 19 nt, Homo sapiens
caauuuaauuccauaauca

SEQ ID NO: 900973 - RNA, 20 nt, Homo sapiens
caauuuaccuacucuaugua

SEQ ID NO: 900974 - RNA, 18 nt, Homo sapiens
cacaaaaugauaaucaau

SEQ ID NO: 900975 - RNA, 17 nt, Homo sapiens
cacaaaaugcaagguga

SEQ ID NO: 900976 - RNA, 13 nt, Homo sapiens
cacaaacuuuaaa

SEQ ID NO: 900977 - RNA, 18 nt, Homo sapiens
cacaaauauccaccacuu

SEQ ID NO: 900978 - RNA, 14 nt, Homo sapiens
cacaaaucuuaacu

SEQ ID NO: 900979 - RNA, 17 nt, Homo sapiens
cacaaaugcaccuccca

SEQ ID NO: 900980 - RNA, 18 nt, Homo sapiens
cacaaauuuguaaacuuu

SEQ ID NO: 900981 - RNA, 15 nt, Homo sapiens
cacaacacacacacu

SEQ ID NO: 900982 - RNA, 17 nt, Homo sapiens
cacaacaggcauuccag

SEQ ID NO: 900983 - RNA, 17 nt, Homo sapiens
cacaaccagccacacag

SEQ ID NO: 900984 - RNA, 14 nt, Homo sapiens
cacaacccaagaau

SEQ ID NO: 900985 - RNA, 16 nt, Homo sapiens
cacaacccuguuuuau

SEQ ID NO: 900986 - RNA, 22 nt, Homo sapiens
cacaagaagaccagacugugga

SEQ ID NO: 900987 - RNA, 13 nt, Homo sapiens
cacaagcacaaag

SEQ ID NO: 900988 - RNA, 15 nt, Homo sapiens
cacaagccacagaag

SEQ ID NO: 900989 - RNA, 20 nt, Homo sapiens
cacaaggcugaccaagagag

SEQ ID NO: 900990 - RNA, 23 nt, Homo sapiens
cacaaggggaaggguacugaaaa

SEQ ID NO: 900991 - RNA, 22 nt, Homo sapiens
cacaaucuuuccuugucucuca

SEQ ID NO: 900992 - RNA, 16 nt, Homo sapiens
cacaaugcuauugaaa

SEQ ID NO: 900993 - RNA, 12 nt, Homo sapiens
cacaauucacua

SEQ ID NO: 900994 - RNA, 22 nt, Homo sapiens
cacaauuccauuuccaguucau

SEQ ID NO: 900995 - RNA, 20 nt, Homo sapiens
cacaauuuagaaaacauuca

SEQ ID NO: 900996 - RNA, 15 nt, Homo sapiens
cacacacaccgaugu

SEQ ID NO: 900997 - RNA, 12 nt, Homo sapiens
cacacacaugga

SEQ ID NO: 900998 - RNA, 21 nt, Homo sapiens
cacacaccccucaaaaaaagc

SEQ ID NO: 900999 - RNA, 22 nt, Homo sapiens
cacacaccgaugugcgcacaca

SEQ ID NO: 901000 - RNA, 19 nt, Homo sapiens
cacacacgccaaugcacac

SEQ ID NO: 901001 - RNA, 20 nt, Homo sapiens
cacacagauauacacaugga

SEQ ID NO: 901002 - RNA, 13 nt, Homo sapiens
cacacagcacucu

SEQ ID NO: 901003 - RNA, 18 nt, Homo sapiens
cacacagcagcacugcag

SEQ ID NO: 901004 - RNA, 20 nt, Homo sapiens
cacacagggugcaugugagg

SEQ ID NO: 901005 - RNA, 20 nt, Homo sapiens
cacacaguauuacuucugcu

SEQ ID NO: 901006 - RNA, 11 nt, Homo sapiens
cacacauggau

SEQ ID NO: 901007 - RNA, 15 nt, Homo sapiens
cacacauggaugcac

SEQ ID NO: 901008 - RNA, 17 nt, Homo sapiens
cacacccuccccauuca

SEQ ID NO: 901009 - RNA, 17 nt, Homo sapiens
cacaccuagcaucucau

SEQ ID NO: 901010 - RNA, 10 nt, Homo sapiens
cacaccucau

SEQ ID NO: 901011 - RNA, 21 nt, Homo sapiens
cacacggaugcacacacagau

SEQ ID NO: 901012 - RNA, 23 nt, Homo sapiens
cacacggaugcacagagauaugc

SEQ ID NO: 901013 - RNA, 14 nt, Homo sapiens
cacacugacauuau

SEQ ID NO: 901014 - RNA, 22 nt, Homo sapiens
cacacugauguagauaacagcu

SEQ ID NO: 901015 - RNA, 18 nt, Homo sapiens
cacacuggcgaaccaucu

SEQ ID NO: 901016 - RNA, 22 nt, Homo sapiens
cacacuguaaauauccacagac

SEQ ID NO: 901017 - RNA, 22 nt, Homo sapiens
cacagaaauguuaaacugagac

SEQ ID NO: 901018 - RNA, 16 nt, Homo sapiens
caccuugucauguacc

SEQ ID NO: 901019 - RNA, 19 nt, Homo sapiens
cacgaagcugugaacucag

SEQ ID NO: 901020 - RNA, 13 nt, Homo sapiens
cacgaauccugac

SEQ ID NO: 901021 - RNA, 22 nt, Homo sapiens
cacgaggagcuuccagugcaug

SEQ ID NO: 901022 - RNA, 21 nt, Homo sapiens
cacgaucucggcucacugcac

SEQ ID NO: 901023 - RNA, 21 nt, Homo sapiens
cacgaucuuggcucacugcaa

SEQ ID NO: 901024 - RNA, 16 nt, Homo sapiens
cacgccuguaauccca

SEQ ID NO: 901025 - RNA, 13 nt, Homo sapiens
cacgcgugcacac

SEQ ID NO: 901026 - RNA, 17 nt, Homo sapiens
cacgcuggagugcagug

SEQ ID NO: 901027 - RNA, 22 nt, Homo sapiens
cacggagcugaagcugggagcu

SEQ ID NO: 901028 - RNA, 18 nt, Homo sapiens
cacggaucaauagacugu

SEQ ID NO: 901029 - RNA, 17 nt, Homo sapiens
cacggauccauguagca

SEQ ID NO: 901030 - RNA, 15 nt, Homo sapiens
cacggaugcacacac

SEQ ID NO: 901031 - RNA, 14 nt, Homo sapiens
cacggaugcacaga

SEQ ID NO: 901032 - RNA, 15 nt, Homo sapiens
cacggaugcacagag

SEQ ID NO: 901033 - RNA, 15 nt, Homo sapiens
cacggugaaauccag

SEQ ID NO: 901034 - RNA, 15 nt, Homo sapiens
cacgucuugcuauuu

SEQ ID NO: 901035 - RNA, 17 nt, Homo sapiens
cacguguguguguuuca

SEQ ID NO: 901036 - RNA, 16 nt, Homo sapiens
cacuaaaauucacuua

SEQ ID NO: 901037 - RNA, 16 nt, Homo sapiens
cacuaagcuuucuccu

SEQ ID NO: 901038 - RNA, 16 nt, Homo sapiens
cacuaaggugugcucu

SEQ ID NO: 901039 - RNA, 19 nt, Homo sapiens
cacuacacuccagccugag

SEQ ID NO: 901040 - RNA, 19 nt, Homo sapiens
cacuaccuucugaccuccc

SEQ ID NO: 901041 - RNA, 18 nt, Homo sapiens
cacuacgugccaggcacu

SEQ ID NO: 901042 - RNA, 14 nt, Homo sapiens
cacuagacugugcc

SEQ ID NO: 901043 - RNA, 15 nt, Homo sapiens
cacuagccugugauu

SEQ ID NO: 901044 - RNA, 20 nt, Homo sapiens
cacuagcuaaggaagggaaa

SEQ ID NO: 901045 - RNA, 15 nt, Homo sapiens
cacuauaaccaucag

SEQ ID NO: 901046 - RNA, 23 nt, Homo sapiens
cacuauagccuaggugacagagu

SEQ ID NO: 901047 - RNA, 11 nt, Homo sapiens
cacuaucuuuc

SEQ ID NO: 901048 - RNA, 20 nt, Homo sapiens
cacucaacaauaaagacuga

SEQ ID NO: 901049 - RNA, 17 nt, Homo sapiens
cacucaauaugugauuu

SEQ ID NO: 901050 - RNA, 21 nt, Homo sapiens
cacucacuccacaacccaaga

SEQ ID NO: 901051 - RNA, 12 nt, Homo sapiens
cacucauuccuu

SEQ ID NO: 901052 - RNA, 17 nt, Homo sapiens
cacucauuccuucacuc

SEQ ID NO: 901053 - RNA, 21 nt, Homo sapiens
cacuccagaauccacaaagcc

SEQ ID NO: 901054 - RNA, 13 nt, Homo sapiens
cacuccauuccca

SEQ ID NO: 901055 - RNA, 12 nt, Homo sapiens
cacucccaaagc

SEQ ID NO: 901056 - RNA, 14 nt, Homo sapiens
cacucccacuggaa

SEQ ID NO: 901057 - RNA, 18 nt, Homo sapiens
cacucccuccuaaccuag

SEQ ID NO: 901058 - RNA, 16 nt, Homo sapiens
cacucccuggcucuca

SEQ ID NO: 901059 - RNA, 17 nt, Homo sapiens
cacucggcuuccaggga

SEQ ID NO: 901060 - RNA, 22 nt, Homo sapiens
cacucucuaaaucuuccuugug

SEQ ID NO: 901061 - RNA, 16 nt, Homo sapiens
cacucugaaauaauga

SEQ ID NO: 901062 - RNA, 13 nt, Homo sapiens
cacucuuaugaaa

SEQ ID NO: 901063 - RNA, 23 nt, Homo sapiens
cacucuuauucccaaacuacaga

SEQ ID NO: 901064 - RNA, 17 nt, Homo sapiens
cacucuucccaccucag

SEQ ID NO: 901065 - RNA, 21 nt, Homo sapiens
cacucuucugaauugacugua

SEQ ID NO: 901066 - RNA, 20 nt, Homo sapiens
cacugaauuuuguguguacc

SEQ ID NO: 901067 - RNA, 21 nt, Homo sapiens
cacugaccuuggagagacaca

SEQ ID NO: 901068 - RNA, 18 nt, Homo sapiens
cacugauaauauguuuga

SEQ ID NO: 901069 - RNA, 13 nt, Homo sapiens
cacugcaagaagu

SEQ ID NO: 901070 - RNA, 22 nt, Homo sapiens
cacugcagauagccagacacau

SEQ ID NO: 901071 - RNA, 17 nt, Homo sapiens
cacugccagucacgagc

SEQ ID NO: 901072 - RNA, 15 nt, Homo sapiens
cacugccuucaccuu

SEQ ID NO: 901073 - RNA, 17 nt, Homo sapiens
cacuggcuccacaucca

SEQ ID NO: 901074 - RNA, 21 nt, Homo sapiens
cacugggcugcagagacugga

SEQ ID NO: 901075 - RNA, 17 nt, Homo sapiens
cacugggucucacuccu

SEQ ID NO: 901076 - RNA, 22 nt, Homo sapiens
cacuguaaucuuaaaaguguaa

SEQ ID NO: 901077 - RNA, 16 nt, Homo sapiens
cacugugaaaccacua

SEQ ID NO: 901078 - RNA, 19 nt, Homo sapiens
cacugugccaugugccagg

SEQ ID NO: 901079 - RNA, 17 nt, Homo sapiens
cacuguugcccaggcug

SEQ ID NO: 901080 - RNA, 15 nt, Homo sapiens
cacuguuucucucac

SEQ ID NO: 901081 - RNA, 12 nt, Homo sapiens
cacuuaauaauu

SEQ ID NO: 901082 - RNA, 16 nt, Homo sapiens
cacuuagcccaagagg

SEQ ID NO: 901083 - RNA, 16 nt, Homo sapiens
cacuucauggaccaag

SEQ ID NO: 901084 - RNA, 21 nt, Homo sapiens
cacuucgaugacuggauacag

SEQ ID NO: 901085 - RNA, 12 nt, Homo sapiens
cacuucucagga

SEQ ID NO: 901086 - RNA, 20 nt, Homo sapiens
cacuucucaucauauuguau

SEQ ID NO: 901087 - RNA, 20 nt, Homo sapiens
cacuucuuugcagagccuuu

SEQ ID NO: 901088 - RNA, 18 nt, Homo sapiens
cacuugaaugugucacua

SEQ ID NO: 901089 - RNA, 20 nt, Homo sapiens
cacuugccuucuucacccag

SEQ ID NO: 901090 - RNA, 19 nt, Homo sapiens
cacuugggucuucccugua

SEQ ID NO: 901091 - RNA, 17 nt, Homo sapiens
cacuuuaacugacuuaa

SEQ ID NO: 901092 - RNA, 18 nt, Homo sapiens
cacuuugagaaccugugc

SEQ ID NO: 901093 - RNA, 16 nt, Homo sapiens
cagaaaaacucuggga

SEQ ID NO: 901094 - RNA, 20 nt, Homo sapiens
cagaaaaacucugggaaaua

SEQ ID NO: 901095 - RNA, 16 nt, Homo sapiens
cagaaaagcaccugcc

SEQ ID NO: 901096 - RNA, 21 nt, Homo sapiens
cagaaaccaagucuacuucac

SEQ ID NO: 901097 - RNA, 20 nt, Homo sapiens
cagaaaccaguuaugugaau

SEQ ID NO: 901098 - RNA, 21 nt, Homo sapiens
cagaaagaaggacacuuguau

SEQ ID NO: 901099 - RNA, 16 nt, Homo sapiens
cagaaagcauccuaaa

SEQ ID NO: 901100 - RNA, 18 nt, Homo sapiens
cagaaaguggccaugcca

SEQ ID NO: 901101 - RNA, 20 nt, Homo sapiens
cagaaauaaaaugaaauguc

SEQ ID NO: 901102 - RNA, 11 nt, Homo sapiens
cagaaaugcaa

SEQ ID NO: 901103 - RNA, 23 nt, Homo sapiens
cagaaauuccuucccacucaugu

SEQ ID NO: 901104 - RNA, 16 nt, Homo sapiens
cagaacacugucuuga

SEQ ID NO: 901105 - RNA, 17 nt, Homo sapiens
cagaacccagauuuccu

SEQ ID NO: 901106 - RNA, 17 nt, Homo sapiens
cagaaccccuacaugaa

SEQ ID NO: 901107 - RNA, 18 nt, Homo sapiens
cagaaccccuacaugaaa

SEQ ID NO: 901108 - RNA, 19 nt, Homo sapiens
cagaacccuuccugagacc

SEQ ID NO: 901109 - RNA, 18 nt, Homo sapiens
cagaacuguuguuuacuu

SEQ ID NO: 901110 - RNA, 16 nt, Homo sapiens
cagaaggcaaaaagac

SEQ ID NO: 901111 - RNA, 14 nt, Homo sapiens
cagaagguauuccu

SEQ ID NO: 901112 - RNA, 14 nt, Homo sapiens
cagaaguuccucaa

SEQ ID NO: 901113 - RNA, 19 nt, Homo sapiens
cagaaguuucuucuuuagg

SEQ ID NO: 901114 - RNA, 16 nt, Homo sapiens
cagaauacaagccacu

SEQ ID NO: 901115 - RNA, 23 nt, Homo sapiens
cagaauagcuuugaauguggccc

SEQ ID NO: 901116 - RNA, 18 nt, Homo sapiens
cagaaucugcuguugcca

SEQ ID NO: 901117 - RNA, 18 nt, Homo sapiens
cagaaugaugccaaaaua

SEQ ID NO: 901118 - RNA, 22 nt, Homo sapiens
cagaauguuuuuaaaauaugag

SEQ ID NO: 901119 - RNA, 19 nt, Homo sapiens
cagaauuaacuccauucca

SEQ ID NO: 901120 - RNA, 13 nt, Homo sapiens
cagaauucuucag

SEQ ID NO: 901121 - RNA, 18 nt, Homo sapiens
cagaauuuuuugaguaau

SEQ ID NO: 901122 - RNA, 21 nt, Homo sapiens
cagacaaaguaauuccucuca

SEQ ID NO: 901123 - RNA, 12 nt, Homo sapiens
cagacaacagaa

SEQ ID NO: 901124 - RNA, 18 nt, Homo sapiens
cagacacaggcccggcuc

SEQ ID NO: 901125 - RNA, 15 nt, Homo sapiens
cagacaccugccuua

SEQ ID NO: 901126 - RNA, 13 nt, Homo sapiens
cagacaccugugc

SEQ ID NO: 901127 - RNA, 23 nt, Homo sapiens
cagacacugccgggccucccucc

SEQ ID NO: 901128 - RNA, 11 nt, Homo sapiens
cagacacugug

SEQ ID NO: 901129 - RNA, 12 nt, Homo sapiens
cagacauuccaa

SEQ ID NO: 901130 - RNA, 23 nt, Homo sapiens
cagaccaccugccagccaucaca

SEQ ID NO: 901131 - RNA, 22 nt, Homo sapiens
cagaccacuauucuuaacuauu

SEQ ID NO: 901132 - RNA, 14 nt, Homo sapiens
cagaccacucccuu

SEQ ID NO: 901133 - RNA, 12 nt, Homo sapiens
cacagaaguagc

SEQ ID NO: 901134 - RNA, 22 nt, Homo sapiens
cacagagaggcugcucugccau

SEQ ID NO: 901135 - RNA, 15 nt, Homo sapiens
cacagagauaugcac

SEQ ID NO: 901136 - RNA, 20 nt, Homo sapiens
cacagagggggccuucacag

SEQ ID NO: 901137 - RNA, 14 nt, Homo sapiens
cacagauaugcaca

SEQ ID NO: 901138 - RNA, 16 nt, Homo sapiens
cacagauaugcacaca

SEQ ID NO: 901139 - RNA, 14 nt, Homo sapiens
cacagauauuucca

SEQ ID NO: 901140 - RNA, 14 nt, Homo sapiens
cacagaugcacaca

SEQ ID NO: 901141 - RNA, 18 nt, Homo sapiens
cacagaugcacacacaga

SEQ ID NO: 901142 - RNA, 20 nt, Homo sapiens
cacagauggucacacagaga

SEQ ID NO: 901143 - RNA, 19 nt, Homo sapiens
cacagauuuuugggcucca

SEQ ID NO: 901144 - RNA, 15 nt, Homo sapiens
cacagccaucaaggg

SEQ ID NO: 901145 - RNA, 23 nt, Homo sapiens
cacagccgcagccucccucugac

SEQ ID NO: 901146 - RNA, 17 nt, Homo sapiens
cacagcgcuaugcaauu

SEQ ID NO: 901147 - RNA, 20 nt, Homo sapiens
cacagcggaggagaccagcu

SEQ ID NO: 901148 - RNA, 24 nt, Homo sapiens
cacagcuaugaaggcuguacacug

SEQ ID NO: 901149 - RNA, 20 nt, Homo sapiens
cacagcuucauuuccugugu

SEQ ID NO: 901150 - RNA, 23 nt, Homo sapiens
cacagcuucugcagcagacuguc

SEQ ID NO: 901151 - RNA, 22 nt, Homo sapiens
cacaggcagcuggaugagacuu

SEQ ID NO: 901152 - RNA, 23 nt, Homo sapiens
cacaggcugggauggagcacuuc

SEQ ID NO: 901153 - RNA, 14 nt, Homo sapiens
cacaguagcauuuc

SEQ ID NO: 901154 - RNA, 13 nt, Homo sapiens
cacagucucaguc

SEQ ID NO: 901155 - RNA, 15 nt, Homo sapiens
cacagucucugggag

SEQ ID NO: 901156 - RNA, 22 nt, Homo sapiens
cacagucucuuuaaucuucagu

SEQ ID NO: 901157 - RNA, 22 nt, Homo sapiens
cacagugagucgaggacaggga

SEQ ID NO: 901158 - RNA, 13 nt, Homo sapiens
cacagugggaacu

SEQ ID NO: 901159 - RNA, 21 nt, Homo sapiens
cacauaaacacauacauugcc

SEQ ID NO: 901160 - RNA, 16 nt, Homo sapiens
cacauaacaugcuuua

SEQ ID NO: 901161 - RNA, 22 nt, Homo sapiens
cacauaaugaaugcuauugaaa

SEQ ID NO: 901162 - RNA, 20 nt, Homo sapiens
cacauaauuugaauggugca

SEQ ID NO: 901163 - RNA, 15 nt, Homo sapiens
cacauacaauuugca

SEQ ID NO: 901164 - RNA, 16 nt, Homo sapiens
cacauacaauuugcac

SEQ ID NO: 901165 - RNA, 17 nt, Homo sapiens
cacauacauacacauac

SEQ ID NO: 901166 - RNA, 13 nt, Homo sapiens
cacauacuagaaa

SEQ ID NO: 901167 - RNA, 16 nt, Homo sapiens
cacauacugcaugcuc

SEQ ID NO: 901168 - RNA, 17 nt, Homo sapiens
cacauagagauaugcac

SEQ ID NO: 901169 - RNA, 18 nt, Homo sapiens
cacauauggacucugcac

SEQ ID NO: 901170 - RNA, 22 nt, Homo sapiens
cacauauggacucugcacauga

SEQ ID NO: 901171 - RNA, 22 nt, Homo sapiens
cacaucacuacaguacagugag

SEQ ID NO: 901172 - RNA, 18 nt, Homo sapiens
cacauccauucccaagaa

SEQ ID NO: 901173 - RNA, 20 nt, Homo sapiens
cacaucgcuacgcccaggag

SEQ ID NO: 901174 - RNA, 14 nt, Homo sapiens
cacaucuaaugucu

SEQ ID NO: 901175 - RNA, 17 nt, Homo sapiens
cacaugcaucaucagcc

SEQ ID NO: 901176 - RNA, 23 nt, Homo sapiens
cacaugcuagcaacauaccagac

SEQ ID NO: 901177 - RNA, 15 nt, Homo sapiens
cacauggacacagac

SEQ ID NO: 901178 - RNA, 16 nt, Homo sapiens
cacauggccuaugcac

SEQ ID NO: 901179 - RNA, 21 nt, Homo sapiens
cacauggccuaugcacauaug

SEQ ID NO: 901180 - RNA, 16 nt, Homo sapiens
cacaugguuuccaagg

SEQ ID NO: 901181 - RNA, 20 nt, Homo sapiens
cacaugugacacauaugcac

SEQ ID NO: 901182 - RNA, 14 nt, Homo sapiens
cacaugugcacaug

SEQ ID NO: 901183 - RNA, 23 nt, Homo sapiens
cacauguguucucuauuuugccu

SEQ ID NO: 901184 - RNA, 23 nt, Homo sapiens
cacauucuuaacacauguccuug

SEQ ID NO: 901185 - RNA, 15 nt, Homo sapiens
cacauuggcagugug

SEQ ID NO: 901186 - RNA, 19 nt, Homo sapiens
cacauuuauucugcucaca

SEQ ID NO: 901187 - RNA, 19 nt, Homo sapiens
cacauuucuccuguuuaca

SEQ ID NO: 901188 - RNA, 15 nt, Homo sapiens
cacauuugauguaca

SEQ ID NO: 901189 - RNA, 23 nt, Homo sapiens
cacauuuugcauuagacagauga

SEQ ID NO: 901190 - RNA, 18 nt, Homo sapiens
caccaaaucaucucucau

SEQ ID NO: 901191 - RNA, 20 nt, Homo sapiens
caccaaaucaucucucauca

SEQ ID NO: 901192 - RNA, 18 nt, Homo sapiens
caccaacuggagcacuga

SEQ ID NO: 901193 - RNA, 21 nt, Homo sapiens
caccacccucccaccaugcgc

SEQ ID NO: 901194 - RNA, 13 nt, Homo sapiens
caccacgaauuug

SEQ ID NO: 901195 - RNA, 15 nt, Homo sapiens
caccacuuugucucu

SEQ ID NO: 901196 - RNA, 20 nt, Homo sapiens
caccacuuugucucugagaa

SEQ ID NO: 901197 - RNA, 16 nt, Homo sapiens
caccagaaugcuaaag

SEQ ID NO: 901198 - RNA, 16 nt, Homo sapiens
caccagaauugugcaa

SEQ ID NO: 901199 - RNA, 18 nt, Homo sapiens
caccagaggcugcagaag

SEQ ID NO: 901200 - RNA, 21 nt, Homo sapiens
caccagaggcugcagaaggcc

SEQ ID NO: 901201 - RNA, 23 nt, Homo sapiens
caccagaggcugcagaaggccaa

SEQ ID NO: 901202 - RNA, 17 nt, Homo sapiens
caccagccuaagaagcu

SEQ ID NO: 901203 - RNA, 21 nt, Homo sapiens
caccagugccgccugugccca

SEQ ID NO: 901204 - RNA, 17 nt, Homo sapiens
caccaucaaaugcugua

SEQ ID NO: 901205 - RNA, 13 nt, Homo sapiens
caccaugaaucuu

SEQ ID NO: 901206 - RNA, 23 nt, Homo sapiens
caccauggcaccuuuugcacaua

SEQ ID NO: 901207 - RNA, 18 nt, Homo sapiens
caccauguuugagcucag

SEQ ID NO: 901208 - RNA, 20 nt, Homo sapiens
caccauucacauuugaugua

SEQ ID NO: 901209 - RNA, 21 nt, Homo sapiens
caccauuguuccuuaccuuua

SEQ ID NO: 901210 - RNA, 13 nt, Homo sapiens
cacccaaagcaug

SEQ ID NO: 901211 - RNA, 17 nt, Homo sapiens
cacccaaagcauggacu

SEQ ID NO: 901212 - RNA, 14 nt, Homo sapiens
cacccacaacaucu

SEQ ID NO: 901213 - RNA, 13 nt, Homo sapiens
cacccaccuccac

SEQ ID NO: 901214 - RNA, 11 nt, Homo sapiens
cacccacguga

SEQ ID NO: 901215 - RNA, 15 nt, Homo sapiens
cacccaugaaucaaa

SEQ ID NO: 901216 - RNA, 13 nt, Homo sapiens
caccccaacaucu

SEQ ID NO: 901217 - RNA, 12 nt, Homo sapiens
caccccgugcca

SEQ ID NO: 901218 - RNA, 21 nt, Homo sapiens
caccccuaugcccacucuaau

SEQ ID NO: 901219 - RNA, 13 nt, Homo sapiens
caccccucaaaaa

SEQ ID NO: 901220 - RNA, 16 nt, Homo sapiens
caccccucacucuggc

SEQ ID NO: 901221 - RNA, 16 nt, Homo sapiens
cacccgacuccucaaa

SEQ ID NO: 901222 - RNA, 22 nt, Homo sapiens
cacccuaucccuguacagagua

SEQ ID NO: 901223 - RNA, 20 nt, Homo sapiens
cacccuccccugucuucucu

SEQ ID NO: 901224 - RNA, 23 nt, Homo sapiens
cacccuggaaucaagaugucaga

SEQ ID NO: 901225 - RNA, 15 nt, Homo sapiens
caccgacaacaugcu

SEQ ID NO: 901226 - RNA, 18 nt, Homo sapiens
caccgucccucagugaua

SEQ ID NO: 901227 - RNA, 21 nt, Homo sapiens
caccgugaccccuguccccac

SEQ ID NO: 901228 - RNA, 12 nt, Homo sapiens
caccgugaucaa

SEQ ID NO: 901229 - RNA, 19 nt, Homo sapiens
caccuacgcgagucuuacu

SEQ ID NO: 901230 - RNA, 15 nt, Homo sapiens
caccuagcaucucau

SEQ ID NO: 901231 - RNA, 19 nt, Homo sapiens
caccucaaauacauaccua

SEQ ID NO: 901232 - RNA, 20 nt, Homo sapiens
caccucagagacauacaccu

SEQ ID NO: 901233 - RNA, 20 nt, Homo sapiens
caccucccaccccacuccag

SEQ ID NO: 901234 - RNA, 20 nt, Homo sapiens
caccuccgccccagacacac

SEQ ID NO: 901235 - RNA, 15 nt, Homo sapiens
caccuccuccacuca

SEQ ID NO: 901236 - RNA, 20 nt, Homo sapiens
caccucugccucaaugugaa

SEQ ID NO: 901237 - RNA, 13 nt, Homo sapiens
caccucuuccuuc

SEQ ID NO: 901238 - RNA, 22 nt, Homo sapiens
caccucuucucuuccuguaaca

SEQ ID NO: 901239 - RNA, 18 nt, Homo sapiens
caccucuugucagugcuc

SEQ ID NO: 901240 - RNA, 21 nt, Homo sapiens
caccugaauuucuguuugaau

SEQ ID NO: 901241 - RNA, 16 nt, Homo sapiens
caccugcuucugaacu

SEQ ID NO: 901242 - RNA, 23 nt, Homo sapiens
caccuggauugcagacucaugaa

SEQ ID NO: 901243 - RNA, 17 nt, Homo sapiens
caccugggguauggcau

SEQ ID NO: 901244 - RNA, 16 nt, Homo sapiens
caccuguugcaccuca

SEQ ID NO: 901245 - RNA, 16 nt, Homo sapiens
caccuuaguggcuuuu

SEQ ID NO: 901246 - RNA, 14 nt, Homo sapiens
caccuucuucagcc

SEQ ID NO: 901247 - RNA, 12 nt, Homo sapiens
caaaugcuauau

SEQ ID NO: 901248 - RNA, 23 nt, Homo sapiens
caaauggagaaguucaggaaggu

SEQ ID NO: 901249 - RNA, 13 nt, Homo sapiens
caaaugucuaagg

SEQ ID NO: 901250 - RNA, 22 nt, Homo sapiens
caaauucauuuuuuucacugga

SEQ ID NO: 901251 - RNA, 23 nt, Homo sapiens
caaauucauuuuuuucacuggag

SEQ ID NO: 901252 - RNA, 13 nt, Homo sapiens
caaauuccccucc

SEQ ID NO: 901253 - RNA, 16 nt, Homo sapiens
caaauucuuuuucaca

SEQ ID NO: 901254 - RNA, 20 nt, Homo sapiens
caaauucuuuuucacacuga

SEQ ID NO: 901255 - RNA, 16 nt, Homo sapiens
caaauuggauacugcu

SEQ ID NO: 901256 - RNA, 19 nt, Homo sapiens
caaauuguaguucuugucu

SEQ ID NO: 901257 - RNA, 12 nt, Homo sapiens
caacaacaugua

SEQ ID NO: 901258 - RNA, 15 nt, Homo sapiens
caacaagaauauugu

SEQ ID NO: 901259 - RNA, 15 nt, Homo sapiens
caacaagucuugaaa

SEQ ID NO: 901260 - RNA, 15 nt, Homo sapiens
caacaauaaagacug

SEQ ID NO: 901261 - RNA, 24 nt, Homo sapiens
caacacugcgccggguaccaugga

SEQ ID NO: 901262 - RNA, 11 nt, Homo sapiens
caacacuuaag

SEQ ID NO: 901263 - RNA, 13 nt, Homo sapiens
caacaggcauucc

SEQ ID NO: 901264 - RNA, 12 nt, Homo sapiens
caacauaacuga

SEQ ID NO: 901265 - RNA, 16 nt, Homo sapiens
caacaugcgaccguga

SEQ ID NO: 901266 - RNA, 17 nt, Homo sapiens
caacaugcgaccgugac

SEQ ID NO: 901267 - RNA, 19 nt, Homo sapiens
caacaugguccuuguccca

SEQ ID NO: 901268 - RNA, 16 nt, Homo sapiens
caacauucaaagcagc

SEQ ID NO: 901269 - RNA, 16 nt, Homo sapiens
caacauuuuuggugua

SEQ ID NO: 901270 - RNA, 18 nt, Homo sapiens
caaccaaagacacugucc

SEQ ID NO: 901271 - RNA, 12 nt, Homo sapiens
caaccaauucca

SEQ ID NO: 901272 - RNA, 20 nt, Homo sapiens
caaccacacaccucaccaga

SEQ ID NO: 901273 - RNA, 17 nt, Homo sapiens
caaccagagaugacuga

SEQ ID NO: 901274 - RNA, 14 nt, Homo sapiens
caaccagcauucau

SEQ ID NO: 901275 - RNA, 18 nt, Homo sapiens
caaccaggaacauguaac

SEQ ID NO: 901276 - RNA, 21 nt, Homo sapiens
caacccgugccaaguccaggu

SEQ ID NO: 901277 - RNA, 14 nt, Homo sapiens
caacccucacugug

SEQ ID NO: 901278 - RNA, 21 nt, Homo sapiens
caacccugcccacuucagccc

SEQ ID NO: 901279 - RNA, 16 nt, Homo sapiens
caaccgcuugccauau

SEQ ID NO: 901280 - RNA, 20 nt, Homo sapiens
caaccucaaugcccugccau

SEQ ID NO: 901281 - RNA, 20 nt, Homo sapiens
caaccuccccgcagagcucc

SEQ ID NO: 901282 - RNA, 16 nt, Homo sapiens
caaccugccugugcau

SEQ ID NO: 901283 - RNA, 20 nt, Homo sapiens
caaccugggauguagcggug

SEQ ID NO: 901284 - RNA, 21 nt, Homo sapiens
caaccuguaguuuuacauaua

SEQ ID NO: 901285 - RNA, 23 nt, Homo sapiens
caaccuguucuuccuaccaaaua

SEQ ID NO: 901286 - RNA, 14 nt, Homo sapiens
caaccuugcaucca

SEQ ID NO: 901287 - RNA, 14 nt, Homo sapiens
caaccuuuguguaa

SEQ ID NO: 901288 - RNA, 18 nt, Homo sapiens
caacgagagcacuugaaa

SEQ ID NO: 901289 - RNA, 16 nt, Homo sapiens
caacggcuuagacuuc

SEQ ID NO: 901290 - RNA, 15 nt, Homo sapiens
caacuacugugauca

SEQ ID NO: 901291 - RNA, 23 nt, Homo sapiens
caacugcccaggaaggacugugc

SEQ ID NO: 901292 - RNA, 15 nt, Homo sapiens
caacugcucugccca

SEQ ID NO: 901293 - RNA, 15 nt, Homo sapiens
caacuggagcacuga

SEQ ID NO: 901294 - RNA, 22 nt, Homo sapiens
caacuggugauuguuucagaga

SEQ ID NO: 901295 - RNA, 12 nt, Homo sapiens
caacugugcuac

SEQ ID NO: 901296 - RNA, 22 nt, Homo sapiens
caacuuaaaucacugaggcauu

SEQ ID NO: 901297 - RNA, 19 nt, Homo sapiens
caacuugaaauuauaucug

SEQ ID NO: 901298 - RNA, 22 nt, Homo sapiens
caacuugaaauuauaucugugg

SEQ ID NO: 901299 - RNA, 23 nt, Homo sapiens
caacuuuaauugcuuaaaagaca

SEQ ID NO: 901300 - RNA, 12 nt, Homo sapiens
caacuuucugua

SEQ ID NO: 901301 - RNA, 14 nt, Homo sapiens
caacuuuugugcuc

SEQ ID NO: 901302 - RNA, 17 nt, Homo sapiens
caagaaaguauuuggua

SEQ ID NO: 901303 - RNA, 19 nt, Homo sapiens
caagaaauccaguuuccca

SEQ ID NO: 901304 - RNA, 22 nt, Homo sapiens
caagaagaaaacgaacugggaa

SEQ ID NO: 901305 - RNA, 20 nt, Homo sapiens
caagaagaaugggagcugca

SEQ ID NO: 901306 - RNA, 11 nt, Homo sapiens
caagaaugaga

SEQ ID NO: 901307 - RNA, 13 nt, Homo sapiens
caagaaugagcug

SEQ ID NO: 901308 - RNA, 22 nt, Homo sapiens
caagacaauucuucuucuucca

SEQ ID NO: 901309 - RNA, 22 nt, Homo sapiens
caagacaccuuuuguauuuaaa

SEQ ID NO: 901310 - RNA, 14 nt, Homo sapiens
caagacccuaugaa

SEQ ID NO: 901311 - RNA, 16 nt, Homo sapiens
caagaccuucucccca

SEQ ID NO: 901312 - RNA, 22 nt, Homo sapiens
caagaccuucuccccauucugc

SEQ ID NO: 901313 - RNA, 19 nt, Homo sapiens
caagacucugucucaaaaa

SEQ ID NO: 901314 - RNA, 13 nt, Homo sapiens
caagacugaaaca

SEQ ID NO: 901315 - RNA, 22 nt, Homo sapiens
caagagagggccaugcaauuca

SEQ ID NO: 901316 - RNA, 23 nt, Homo sapiens
caagagccauguaccaguguacu

SEQ ID NO: 901317 - RNA, 22 nt, Homo sapiens
caagaggacugagacuggcacu

SEQ ID NO: 901318 - RNA, 15 nt, Homo sapiens
caagaguggacugaa

SEQ ID NO: 901319 - RNA, 13 nt, Homo sapiens
caagaucuuucag

SEQ ID NO: 901320 - RNA, 17 nt, Homo sapiens
caagaucuuucaggaaa

SEQ ID NO: 901321 - RNA, 17 nt, Homo sapiens
caagaugaucacaugga

SEQ ID NO: 901322 - RNA, 13 nt, Homo sapiens
caagaugggcaca

SEQ ID NO: 901323 - RNA, 15 nt, Homo sapiens
caagcaacauaaaac

SEQ ID NO: 901324 - RNA, 14 nt, Homo sapiens
caagcaaggccaaa

SEQ ID NO: 901325 - RNA, 18 nt, Homo sapiens
caagcaagggcugugcug

SEQ ID NO: 901326 - RNA, 23 nt, Homo sapiens
caagcacuaccaggcuguggguc

SEQ ID NO: 901327 - RNA, 20 nt, Homo sapiens
caagcauaccaacacgagca

SEQ ID NO: 901328 - RNA, 21 nt, Homo sapiens
caagcaugcaauaaugugcaa

SEQ ID NO: 901329 - RNA, 21 nt, Homo sapiens
caagcauucagaagaaaaaga

SEQ ID NO: 901330 - RNA, 13 nt, Homo sapiens
caagccaccuucc

SEQ ID NO: 901331 - RNA, 14 nt, Homo sapiens
caagccacuauguc

SEQ ID NO: 901332 - RNA, 16 nt, Homo sapiens
caagccugccuaggaa

SEQ ID NO: 901333 - RNA, 14 nt, Homo sapiens
caagccuuacucac

SEQ ID NO: 901334 - RNA, 13 nt, Homo sapiens
caagcgacaggaa

SEQ ID NO: 901335 - RNA, 22 nt, Homo sapiens
caagcuagaaggccacauguca

SEQ ID NO: 901336 - RNA, 23 nt, Homo sapiens
caagcuagaaggccacaugucac

SEQ ID NO: 901337 - RNA, 12 nt, Homo sapiens
caagcuauucaa

SEQ ID NO: 901338 - RNA, 20 nt, Homo sapiens
caagcugagugacuguaggc

SEQ ID NO: 901339 - RNA, 21 nt, Homo sapiens
caagcugcuuuggacaacuga

SEQ ID NO: 901340 - RNA, 16 nt, Homo sapiens
caagcuggaagcacau

SEQ ID NO: 901341 - RNA, 17 nt, Homo sapiens
caaggacuagagcucag

SEQ ID NO: 901342 - RNA, 17 nt, Homo sapiens
caaggaguaaguacaaa

SEQ ID NO: 901343 - RNA, 16 nt, Homo sapiens
caaggaucucaaagaa

SEQ ID NO: 901344 - RNA, 16 nt, Homo sapiens
caaggaugacacugcc

SEQ ID NO: 901345 - RNA, 23 nt, Homo sapiens
caaggauucagcauuauuccucc

SEQ ID NO: 901346 - RNA, 16 nt, Homo sapiens
caaggcacaaaccuua

SEQ ID NO: 901347 - RNA, 19 nt, Homo sapiens
caaggcaguguuccucacc

SEQ ID NO: 901348 - RNA, 17 nt, Homo sapiens
caaggcugaccaagaga

SEQ ID NO: 901349 - RNA, 15 nt, Homo sapiens
caaggucauuugcua

SEQ ID NO: 901350 - RNA, 19 nt, Homo sapiens
caagguguuuccauuucuc

SEQ ID NO: 901351 - RNA, 19 nt, Homo sapiens
caaguagaggcaaugcaaa

SEQ ID NO: 901352 - RNA, 15 nt, Homo sapiens
caaguagcacccugg

SEQ ID NO: 901353 - RNA, 23 nt, Homo sapiens
caaguauucauuuuuucuacccu

SEQ ID NO: 901354 - RNA, 18 nt, Homo sapiens
cucauuccccaaccacuu

SEQ ID NO: 901355 - RNA, 13 nt, Homo sapiens
cucauuccuguag

SEQ ID NO: 901356 - RNA, 14 nt, Homo sapiens
cucauuguagaaaa

SEQ ID NO: 901357 - RNA, 15 nt, Homo sapiens
cucauuuaagggaaa

SEQ ID NO: 901358 - RNA, 14 nt, Homo sapiens
cucauuucaucuca

SEQ ID NO: 901359 - RNA, 14 nt, Homo sapiens
cucauuuuaggccu

SEQ ID NO: 901360 - RNA, 13 nt, Homo sapiens
cuccaaaugagau

SEQ ID NO: 901361 - RNA, 13 nt, Homo sapiens
cuccaagcuccau

SEQ ID NO: 901362 - RNA, 17 nt, Homo sapiens
cuccacagucaauauua

SEQ ID NO: 901363 - RNA, 16 nt, Homo sapiens
cuccacagugcugcuu

SEQ ID NO: 901364 - RNA, 18 nt, Homo sapiens
cuccaccuugcucuucuu

SEQ ID NO: 901365 - RNA, 13 nt, Homo sapiens
cuccacuccagau

SEQ ID NO: 901366 - RNA, 16 nt, Homo sapiens
cuccacugccuucgau

SEQ ID NO: 901367 - RNA, 12 nt, Homo sapiens
cuccacugucac

SEQ ID NO: 901368 - RNA, 20 nt, Homo sapiens
cuccagaacaaaccucuaua

SEQ ID NO: 901369 - RNA, 17 nt, Homo sapiens
cuccagaaucugcuguu

SEQ ID NO: 901370 - RNA, 15 nt, Homo sapiens
cuccagagacaggaa

SEQ ID NO: 901371 - RNA, 15 nt, Homo sapiens
cuccagcacucccuc

SEQ ID NO: 901372 - RNA, 14 nt, Homo sapiens
cuccaggaaugccu

SEQ ID NO: 901373 - RNA, 18 nt, Homo sapiens
cuccauacauaacuugau

SEQ ID NO: 901374 - RNA, 21 nt, Homo sapiens
cuccauacuuucccacagcac

SEQ ID NO: 901375 - RNA, 14 nt, Homo sapiens
cuccaucauggcag

SEQ ID NO: 901376 - RNA, 19 nt, Homo sapiens
cuccauccaauucuuugaa

SEQ ID NO: 901377 - RNA, 17 nt, Homo sapiens
cuccaucuccacuccag

SEQ ID NO: 901378 - RNA, 19 nt, Homo sapiens
cuccaugcugccuccagaa

SEQ ID NO: 901379 - RNA, 14 nt, Homo sapiens
cuccauucugacca

SEQ ID NO: 901380 - RNA, 14 nt, Homo sapiens
cucccaaaauacua

SEQ ID NO: 901381 - RNA, 19 nt, Homo sapiens
cucccaaagugcugggauu

SEQ ID NO: 901382 - RNA, 19 nt, Homo sapiens
cucccaaauugcugggauu

SEQ ID NO: 901383 - RNA, 19 nt, Homo sapiens
cucccaaggcucugagcaa

SEQ ID NO: 901384 - RNA, 18 nt, Homo sapiens
cucccaccccacccccuu

SEQ ID NO: 901385 - RNA, 13 nt, Homo sapiens
cucccaggaccaa

SEQ ID NO: 901386 - RNA, 15 nt, Homo sapiens
cucccaggaccaaga

SEQ ID NO: 901387 - RNA, 15 nt, Homo sapiens
cucccagucauuuaa

SEQ ID NO: 901388 - RNA, 21 nt, Homo sapiens
cucccauccccuggacuggga

SEQ ID NO: 901389 - RNA, 13 nt, Homo sapiens
cucccaugcacac

SEQ ID NO: 901390 - RNA, 13 nt, Homo sapiens
cuccccaccuuca

SEQ ID NO: 901391 - RNA, 15 nt, Homo sapiens
cuccccacucuaggg

SEQ ID NO: 901392 - RNA, 22 nt, Homo sapiens
cuccccauucacagagccuuuu

SEQ ID NO: 901393 - RNA, 14 nt, Homo sapiens
cucccccacucuau

SEQ ID NO: 901394 - RNA, 13 nt, Homo sapiens
cuccccuuugccu

SEQ ID NO: 901395 - RNA, 20 nt, Homo sapiens
cucccgggagaggagaucag

SEQ ID NO: 901396 - RNA, 13 nt, Homo sapiens
cucccucaugagc

SEQ ID NO: 901397 - RNA, 15 nt, Homo sapiens
cucccucccagagaa

SEQ ID NO: 901398 - RNA, 14 nt, Homo sapiens
cucccugcuaccaa

SEQ ID NO: 901399 - RNA, 14 nt, Homo sapiens
cucccuguccuccu

SEQ ID NO: 901400 - RNA, 15 nt, Homo sapiens
cuccguguagugucu

SEQ ID NO: 901401 - RNA, 20 nt, Homo sapiens
auuugagagaagccacgcug

SEQ ID NO: 901402 - RNA, 18 nt, Homo sapiens
auuugagugucuuugacu

SEQ ID NO: 901403 - RNA, 15 nt, Homo sapiens
auuugauguacaugu

SEQ ID NO: 901404 - RNA, 14 nt, Homo sapiens
auuugcaagacaua

SEQ ID NO: 901405 - RNA, 15 nt, Homo sapiens
auuugcaagacauag

SEQ ID NO: 901406 - RNA, 17 nt, Homo sapiens
auuugccaauuuacuuu

SEQ ID NO: 901407 - RNA, 13 nt, Homo sapiens
auuugcuaucaaa

SEQ ID NO: 901408 - RNA, 12 nt, Homo sapiens
auuuggacaaaa

SEQ ID NO: 901409 - RNA, 21 nt, Homo sapiens
auuugggaggccccuccugcc

SEQ ID NO: 901410 - RNA, 22 nt, Homo sapiens
auuugggauauguuacauuaga

SEQ ID NO: 901411 - RNA, 20 nt, Homo sapiens
auuugggggacuuacaugau

SEQ ID NO: 901412 - RNA, 14 nt, Homo sapiens
auuuguaaguuuau

SEQ ID NO: 901413 - RNA, 21 nt, Homo sapiens
auuuguaauuccuuacuguaa

SEQ ID NO: 901414 - RNA, 17 nt, Homo sapiens
auuuguauuuugcuuaa

SEQ ID NO: 901415 - RNA, 21 nt, Homo sapiens
auuuguuguuuuuaacaacua

SEQ ID NO: 901416 - RNA, 16 nt, Homo sapiens
auuuguuugcaauuuu

SEQ ID NO: 901417 - RNA, 17 nt, Homo sapiens
auuuuaaauguuuuaca

SEQ ID NO: 901418 - RNA, 14 nt, Homo sapiens
auuuuaauuugaua

SEQ ID NO: 901419 - RNA, 19 nt, Homo sapiens
auuuuaggagacagucuca

SEQ ID NO: 901420 - RNA, 19 nt, Homo sapiens
auuuuauacauagucacaa

SEQ ID NO: 901421 - RNA, 22 nt, Homo sapiens
auuuuauauauuaugucauuca

SEQ ID NO: 901422 - RNA, 21 nt, Homo sapiens
auuuuaugcugcuguuuacaa

SEQ ID NO: 901423 - RNA, 12 nt, Homo sapiens
auuuuauuaaau

SEQ ID NO: 901424 - RNA, 14 nt, Homo sapiens
auuuucaguauaau

SEQ ID NO: 901425 - RNA, 16 nt, Homo sapiens
auuuucauguauaugu

SEQ ID NO: 901426 - RNA, 22 nt, Homo sapiens
auuuucccuucgauauaugacu

SEQ ID NO: 901427 - RNA, 23 nt, Homo sapiens
auuuuccuaaaaauaagcuuuau

SEQ ID NO: 901428 - RNA, 13 nt, Homo sapiens
auuuuccuacauu

SEQ ID NO: 901429 - RNA, 21 nt, Homo sapiens
auuuucuauuauuaacacuga

SEQ ID NO: 901430 - RNA, 13 nt, Homo sapiens
auuuucuauucac

SEQ ID NO: 901431 - RNA, 16 nt, Homo sapiens
auuuucuauuuaugua

SEQ ID NO: 901432 - RNA, 19 nt, Homo sapiens
auuuucuggaauacaugaa

SEQ ID NO: 901433 - RNA, 12 nt, Homo sapiens
auuuucuuccaa

SEQ ID NO: 901434 - RNA, 21 nt, Homo sapiens
auuuucuuuaaagaaugcugg

SEQ ID NO: 901435 - RNA, 17 nt, Homo sapiens
auuuucuuuacagguau

SEQ ID NO: 901436 - RNA, 14 nt, Homo sapiens
auuuugcagcagaa

SEQ ID NO: 901437 - RNA, 15 nt, Homo sapiens
auuuugcagcaguga

SEQ ID NO: 901438 - RNA, 20 nt, Homo sapiens
auuuuguaauaaacucucua

SEQ ID NO: 901439 - RNA, 14 nt, Homo sapiens
auuuuguaugaaaa

SEQ ID NO: 901440 - RNA, 16 nt, Homo sapiens
auuuuuagacagaguc

SEQ ID NO: 901441 - RNA, 15 nt, Homo sapiens
auuuuuaugugcaau

SEQ ID NO: 901442 - RNA, 23 nt, Homo sapiens
auuuuuccccaaaaagaauggga

SEQ ID NO: 901443 - RNA, 19 nt, Homo sapiens
auuuuugaauugacugaga

SEQ ID NO: 901444 - RNA, 13 nt, Homo sapiens
auuuuuggaagag

SEQ ID NO: 901445 - RNA, 17 nt, Homo sapiens
auuuuugucauauguau

SEQ ID NO: 901446 - RNA, 19 nt, Homo sapiens
auuuuugugaaaaugucaa

SEQ ID NO: 901447 - RNA, 15 nt, Homo sapiens
auuuuuuaaagcuac

SEQ ID NO: 901448 - RNA, 21 nt, Homo sapiens
auuuuuuacagcugccugcag

SEQ ID NO: 901449 - RNA, 20 nt, Homo sapiens
auuuuuuguuauguuugcac

SEQ ID NO: 901450 - RNA, 16 nt, Homo sapiens
auuuuuuuaaaacaca

SEQ ID NO: 901451 - RNA, 20 nt, Homo sapiens
auuuuuuuuaacauuccaau

SEQ ID NO: 901452 - RNA, 16 nt, Homo sapiens
caaaaaaguauagaaa

SEQ ID NO: 901453 - RNA, 13 nt, Homo sapiens
caaaaaccucacc

SEQ ID NO: 901454 - RNA, 22 nt, Homo sapiens
caaaaagaauuccaaccgacca

SEQ ID NO: 901455 - RNA, 13 nt, Homo sapiens
caaaaagacauua

SEQ ID NO: 901456 - RNA, 17 nt, Homo sapiens
caaaaauagacaacugu

SEQ ID NO: 901457 - RNA, 14 nt, Homo sapiens
caaaaauaguauuc

SEQ ID NO: 901458 - RNA, 14 nt, Homo sapiens
caaaaauauuccau

SEQ ID NO: 901459 - RNA, 22 nt, Homo sapiens
caaaaauugaagagagauauau

SEQ ID NO: 901460 - RNA, 12 nt, Homo sapiens
caaaacacugug

SEQ ID NO: 901461 - RNA, 16 nt, Homo sapiens
caaaacauacccagug

SEQ ID NO: 901462 - RNA, 17 nt, Homo sapiens
caaaacauuuuacuuua

SEQ ID NO: 901463 - RNA, 17 nt, Homo sapiens
caaaacccaacaugacu

SEQ ID NO: 901464 - RNA, 23 nt, Homo sapiens
caaaacuuccuguuuguggaaca

SEQ ID NO: 901465 - RNA, 20 nt, Homo sapiens
caaaagaagacaacauuucu

SEQ ID NO: 901466 - RNA, 17 nt, Homo sapiens
caaaagaugccauucau

SEQ ID NO: 901467 - RNA, 22 nt, Homo sapiens
caaaagcaagacuguugcucaa

SEQ ID NO: 901468 - RNA, 13 nt, Homo sapiens
caaaagcccaaug

SEQ ID NO: 901469 - RNA, 14 nt, Homo sapiens
caaaagugaucugu

SEQ ID NO: 901470 - RNA, 11 nt, Homo sapiens
caaaaguggau

SEQ ID NO: 901471 - RNA, 22 nt, Homo sapiens
caaaaguggggcuaaaugaagu

SEQ ID NO: 901472 - RNA, 14 nt, Homo sapiens
caaaaguuacaugu

SEQ ID NO: 901473 - RNA, 19 nt, Homo sapiens
caaaauacuacacauccaa

SEQ ID NO: 901474 - RNA, 11 nt, Homo sapiens
caaaauaugaa

SEQ ID NO: 901475 - RNA, 17 nt, Homo sapiens
caaaaucccuauuuaau

SEQ ID NO: 901476 - RNA, 21 nt, Homo sapiens
caaaauggacguacugguuua

SEQ ID NO: 901477 - RNA, 12 nt, Homo sapiens
caaaauuacuuc

SEQ ID NO: 901478 - RNA, 20 nt, Homo sapiens
caaaauucuaaaaauuugca

SEQ ID NO: 901479 - RNA, 22 nt, Homo sapiens
caaacacaagugcgccuugcaa

SEQ ID NO: 901480 - RNA, 19 nt, Homo sapiens
caaacacaccgaugcacac

SEQ ID NO: 901481 - RNA, 15 nt, Homo sapiens
caaacacacuguaaa

SEQ ID NO: 901482 - RNA, 18 nt, Homo sapiens
caaacacaggauuuguaa

SEQ ID NO: 901483 - RNA, 12 nt, Homo sapiens
caaacacccaug

SEQ ID NO: 901484 - RNA, 16 nt, Homo sapiens
caaaccacaacugaca

SEQ ID NO: 901485 - RNA, 14 nt, Homo sapiens
caaacuacaaagcu

SEQ ID NO: 901486 - RNA, 18 nt, Homo sapiens
caaacuacagaauaaugu

SEQ ID NO: 901487 - RNA, 15 nt, Homo sapiens
caaacuacauguaau

SEQ ID NO: 901488 - RNA, 14 nt, Homo sapiens
caaacuaugaucac

SEQ ID NO: 901489 - RNA, 21 nt, Homo sapiens
caaacucucccccaaauguau

SEQ ID NO: 901490 - RNA, 15 nt, Homo sapiens
caaagaaaagccaga

SEQ ID NO: 901491 - RNA, 21 nt, Homo sapiens
caaagaacugccccaucuccu

SEQ ID NO: 901492 - RNA, 21 nt, Homo sapiens
caaagaauacuagaaugguag

SEQ ID NO: 901493 - RNA, 20 nt, Homo sapiens
caaagaauuuuuuuuaacau

SEQ ID NO: 901494 - RNA, 15 nt, Homo sapiens
caaagacuuaacugg

SEQ ID NO: 901495 - RNA, 15 nt, Homo sapiens
caaagaugaccugcu

SEQ ID NO: 901496 - RNA, 18 nt, Homo sapiens
caaagcagcacauggugu

SEQ ID NO: 901497 - RNA, 19 nt, Homo sapiens
caaagcaguagucaaggag

SEQ ID NO: 901498 - RNA, 18 nt, Homo sapiens
caaagccaaacucugcca

SEQ ID NO: 901499 - RNA, 20 nt, Homo sapiens
caaagcgagaucccaucucu

SEQ ID NO: 901500 - RNA, 14 nt, Homo sapiens
caaagcuaccugug

SEQ ID NO: 901501 - RNA, 23 nt, Homo sapiens
caaagcucaagaugacagcucuu

SEQ ID NO: 901502 - RNA, 21 nt, Homo sapiens
caaaggcauccauagugcacu

SEQ ID NO: 901503 - RNA, 14 nt, Homo sapiens
caaaggugcuaaau

SEQ ID NO: 901504 - RNA, 12 nt, Homo sapiens
caaaguaaaaaa

SEQ ID NO: 901505 - RNA, 23 nt, Homo sapiens
caaagucaauuaaaggcuuucag

SEQ ID NO: 901506 - RNA, 21 nt, Homo sapiens
caaagugcugcuggaaguaga

SEQ ID NO: 901507 - RNA, 16 nt, Homo sapiens
caaaguguuaaucuua

SEQ ID NO: 901508 - RNA, 13 nt, Homo sapiens
caaauaaacucca

SEQ ID NO: 901509 - RNA, 15 nt, Homo sapiens
caaauaaagaccuga

SEQ ID NO: 901510 - RNA, 15 nt, Homo sapiens
caaauaaauaucauc

SEQ ID NO: 901511 - RNA, 18 nt, Homo sapiens
caaauaagcaucugugua

SEQ ID NO: 901512 - RNA, 15 nt, Homo sapiens
caaauagucuaucaa

SEQ ID NO: 901513 - RNA, 21 nt, Homo sapiens
caaauaugcaaagcacugacu

SEQ ID NO: 901514 - RNA, 14 nt, Homo sapiens
caaaucaaccccag

SEQ ID NO: 901515 - RNA, 12 nt, Homo sapiens
caaaucaucucu

SEQ ID NO: 901516 - RNA, 21 nt, Homo sapiens
auacgccuguaguccuagcca

SEQ ID NO: 901517 - RNA, 18 nt, Homo sapiens
auacuaagggaagaaaca

SEQ ID NO: 901518 - RNA, 12 nt, Homo sapiens
auacuacuguaa

SEQ ID NO: 901519 - RNA, 12 nt, Homo sapiens
auacuaucucuu

SEQ ID NO: 901520 - RNA, 18 nt, Homo sapiens
auacuccauacauaacuu

SEQ ID NO: 901521 - RNA, 22 nt, Homo sapiens
auacuccauacauaacuugaua

SEQ ID NO: 901522 - RNA, 12 nt, Homo sapiens
auacugcaugcu

SEQ ID NO: 901523 - RNA, 19 nt, Homo sapiens
auacugcucaucauuccuu

SEQ ID NO: 901524 - RNA, 13 nt, Homo sapiens
auacuguacugag

SEQ ID NO: 901525 - RNA, 18 nt, Homo sapiens
auacuuuggggacuugua

SEQ ID NO: 901526 - RNA, 12 nt, Homo sapiens
auagaaacugau

SEQ ID NO: 901527 - RNA, 14 nt, Homo sapiens
auagaaagcaauaa

SEQ ID NO: 901528 - RNA, 19 nt, Homo sapiens
auagaaagugccagaaagu

SEQ ID NO: 901529 - RNA, 22 nt, Homo sapiens
auagaauacauggaaacgcaaa

SEQ ID NO: 901530 - RNA, 16 nt, Homo sapiens
auagaauuuccaauau

SEQ ID NO: 901531 - RNA, 14 nt, Homo sapiens
auagacagugcugc

SEQ ID NO: 901532 - RNA, 23 nt, Homo sapiens
auagaccucucaauuucuggaaa

SEQ ID NO: 901533 - RNA, 21 nt, Homo sapiens
auagacuguacuuauuuucca

SEQ ID NO: 901534 - RNA, 19 nt, Homo sapiens
auauuuuuaugugcaauaa

SEQ ID NO: 901535 - RNA, 18 nt, Homo sapiens
aucaaaagcuuauucauc

SEQ ID NO: 901536 - RNA, 21 nt, Homo sapiens
aucaaagacauggaauuaccu

SEQ ID NO: 901537 - RNA, 19 nt, Homo sapiens
aucaaaguuccuguucacc

SEQ ID NO: 901538 - RNA, 20 nt, Homo sapiens
aucaaauaugcaaagcacug

SEQ ID NO: 901539 - RNA, 18 nt, Homo sapiens
aucaaauauuaccaaaaa

SEQ ID NO: 901540 - RNA, 13 nt, Homo sapiens
aucaaaugcugua

SEQ ID NO: 901541 - RNA, 18 nt, Homo sapiens
aucaaauuugccaccacu

SEQ ID NO: 901542 - RNA, 22 nt, Homo sapiens
aucaacauucccccaacauuac

SEQ ID NO: 901543 - RNA, 11 nt, Homo sapiens
aucaaccagca

SEQ ID NO: 901544 - RNA, 20 nt, Homo sapiens
aucaacuuguguacugauaa

SEQ ID NO: 901545 - RNA, 15 nt, Homo sapiens
aucaagaauauucaa

SEQ ID NO: 901546 - RNA, 22 nt, Homo sapiens
aucaagagugagugaacaacua

SEQ ID NO: 901547 - RNA, 15 nt, Homo sapiens
aucaaugucaaguac

SEQ ID NO: 901548 - RNA, 12 nt, Homo sapiens
aucaauguuucu

SEQ ID NO: 901549 - RNA, 22 nt, Homo sapiens
aucaauucuauuacgugcaaua

SEQ ID NO: 901550 - RNA, 19 nt, Homo sapiens
aucaauuuuuauacauauc

SEQ ID NO: 901551 - RNA, 19 nt, Homo sapiens
aucacaacauuuacuuaac

SEQ ID NO: 901552 - RNA, 17 nt, Homo sapiens
aucacaguguuugcaau

SEQ ID NO: 901553 - RNA, 21 nt, Homo sapiens
aucacaguguuugcaauggug

SEQ ID NO: 901554 - RNA, 17 nt, Homo sapiens
aucacauauucuagugu

SEQ ID NO: 901555 - RNA, 18 nt, Homo sapiens
aucacauuaucaucugaa

SEQ ID NO: 901556 - RNA, 20 nt, Homo sapiens
aucaccagcagacacugccg

SEQ ID NO: 901557 - RNA, 20 nt, Homo sapiens
aucaccagcauauuguguuc

SEQ ID NO: 901558 - RNA, 15 nt, Homo sapiens
aucacccccuacccc

SEQ ID NO: 901559 - RNA, 15 nt, Homo sapiens
aucaccuacucacac

SEQ ID NO: 901560 - RNA, 23 nt, Homo sapiens
aucaccuacucacacaggcauuu

SEQ ID NO: 901561 - RNA, 15 nt, Homo sapiens
aucacguuaccccaa

SEQ ID NO: 901562 - RNA, 17 nt, Homo sapiens
aucacuagccaugauaa

SEQ ID NO: 901563 - RNA, 21 nt, Homo sapiens
aucacugaggcauuuuuacua

SEQ ID NO: 901564 - RNA, 15 nt, Homo sapiens
aucacuuggagccag

SEQ ID NO: 901565 - RNA, 16 nt, Homo sapiens
aucacuuggagccagg

SEQ ID NO: 901566 - RNA, 16 nt, Homo sapiens
aucagaaaugucauca

SEQ ID NO: 901567 - RNA, 16 nt, Homo sapiens
aucagaccacucccuu

SEQ ID NO: 901568 - RNA, 16 nt, Homo sapiens
aucagaccauaauguu

SEQ ID NO: 901569 - RNA, 13 nt, Homo sapiens
aucagacuaguga

SEQ ID NO: 901570 - RNA, 14 nt, Homo sapiens
aucagacucaucua

SEQ ID NO: 901571 - RNA, 12 nt, Homo sapiens
aucagcacugaa

SEQ ID NO: 901572 - RNA, 20 nt, Homo sapiens
aucagccacaccuuuuccag

SEQ ID NO: 901573 - RNA, 19 nt, Homo sapiens
aucagccccgcuccucccc

SEQ ID NO: 901574 - RNA, 19 nt, Homo sapiens
aucagccuccgccauucca

SEQ ID NO: 901575 - RNA, 23 nt, Homo sapiens
aucaggacuugggaaacagagaa

SEQ ID NO: 901576 - RNA, 12 nt, Homo sapiens
aucaggucuccc

SEQ ID NO: 901577 - RNA, 11 nt, Homo sapiens
aucagugaugg

SEQ ID NO: 901578 - RNA, 13 nt, Homo sapiens
aucaguggcugcc

SEQ ID NO: 901579 - RNA, 12 nt, Homo sapiens
aucaguuugacu

SEQ ID NO: 901580 - RNA, 15 nt, Homo sapiens
aucauaaccauguga

SEQ ID NO: 901581 - RNA, 19 nt, Homo sapiens
aucauaaccaugugaaaag

SEQ ID NO: 901582 - RNA, 12 nt, Homo sapiens
aucauaaggaag

SEQ ID NO: 901583 - RNA, 16 nt, Homo sapiens
aucauacaugacucag

SEQ ID NO: 901584 - RNA, 21 nt, Homo sapiens
aucauacaugacucagcauac

SEQ ID NO: 901585 - RNA, 23 nt, Homo sapiens
aucauauaauaaauguacauuaa

SEQ ID NO: 901586 - RNA, 21 nt, Homo sapiens
aucauauugguauucacuaau

SEQ ID NO: 901587 - RNA, 22 nt, Homo sapiens
aucaucccagcugcucccaaau

SEQ ID NO: 901588 - RNA, 20 nt, Homo sapiens
aucaugccccuguacuccag

SEQ ID NO: 901589 - RNA, 13 nt, Homo sapiens
aucauguauuuau

SEQ ID NO: 901590 - RNA, 18 nt, Homo sapiens
aucauguuggccaggcug

SEQ ID NO: 901591 - RNA, 14 nt, Homo sapiens
aucauuccuugaga

SEQ ID NO: 901592 - RNA, 19 nt, Homo sapiens
aucauuguagaaacacagu

SEQ ID NO: 901593 - RNA, 18 nt, Homo sapiens
auccaaguuauuaaucuu

SEQ ID NO: 901594 - RNA, 21 nt, Homo sapiens
auccaauauguuuccaucacu

SEQ ID NO: 901595 - RNA, 21 nt, Homo sapiens
auccaauucuuugaauuuccc

SEQ ID NO: 901596 - RNA, 21 nt, Homo sapiens
auccacagccaacaaacauag

SEQ ID NO: 901597 - RNA, 16 nt, Homo sapiens
auccacccaccucagc

SEQ ID NO: 901598 - RNA, 20 nt, Homo sapiens
auccacucuucuagggauau

SEQ ID NO: 901599 - RNA, 17 nt, Homo sapiens
auccagagauaauugcc

SEQ ID NO: 901600 - RNA, 19 nt, Homo sapiens
auccagaggguugugauuu

SEQ ID NO: 901601 - RNA, 22 nt, Homo sapiens
auccaucacuagccaugauaac

SEQ ID NO: 901602 - RNA, 22 nt, Homo sapiens
auccaucaggguuugcaaagua

SEQ ID NO: 901603 - RNA, 21 nt, Homo sapiens
auccauguuaguuuuuacuuu

SEQ ID NO: 901604 - RNA, 23 nt, Homo sapiens
auccauuccucagggacagagac

SEQ ID NO: 901605 - RNA, 20 nt, Homo sapiens
auccauuucuaauguaugca

SEQ ID NO: 901606 - RNA, 13 nt, Homo sapiens
aucccaagccaac

SEQ ID NO: 901607 - RNA, 23 nt, Homo sapiens
aucccagagcccagggcauccca

SEQ ID NO: 901608 - RNA, 18 nt, Homo sapiens
aucccagagcuucccagg

SEQ ID NO: 901609 - RNA, 14 nt, Homo sapiens
aucccagcacuuug

SEQ ID NO: 901610 - RNA, 21 nt, Homo sapiens
aucccagcaugcugagauuac

SEQ ID NO: 901611 - RNA, 14 nt, Homo sapiens
aucccagcuacuca

SEQ ID NO: 901612 - RNA, 21 nt, Homo sapiens
aucccaggggaccacaccucc

SEQ ID NO: 901613 - RNA, 19 nt, Homo sapiens
aucccauugucaccuaacu

SEQ ID NO: 901614 - RNA, 20 nt, Homo sapiens
auccccagaggugacccaau

SEQ ID NO: 901615 - RNA, 18 nt, Homo sapiens
aucccccaaaaugcauuu

SEQ ID NO: 901616 - RNA, 16 nt, Homo sapiens
auccccuggacuggga

SEQ ID NO: 901617 - RNA, 13 nt, Homo sapiens
auccccuuuauua

SEQ ID NO: 901618 - RNA, 19 nt, Homo sapiens
aucccggaagggacuuacu

SEQ ID NO: 901619 - RNA, 22 nt, Homo sapiens
aucccgucuucuccaacaccac

SEQ ID NO: 901620 - RNA, 14 nt, Homo sapiens
aucccuaacaucau

SEQ ID NO: 901621 - RNA, 16 nt, Homo sapiens
aucccuccucacuugc

SEQ ID NO: 901622 - RNA, 21 nt, Homo sapiens
aucccugaaggccuucaaccc

SEQ ID NO: 901623 - RNA, 14 nt, Homo sapiens
aucccuucccuguc

SEQ ID NO: 901624 - RNA, 17 nt, Homo sapiens
auccgggacgcuuccag

SEQ ID NO: 901625 - RNA, 13 nt, Homo sapiens
auccguacauuca

SEQ ID NO: 901626 - RNA, 15 nt, Homo sapiens
auccuacaacuucca

SEQ ID NO: 901627 - RNA, 21 nt, Homo sapiens
auccuacaacuuccacuccaa

SEQ ID NO: 901628 - RNA, 15 nt, Homo sapiens
auccuacuacuuugu

SEQ ID NO: 901629 - RNA, 14 nt, Homo sapiens
auccuaggugcugg

SEQ ID NO: 901630 - RNA, 21 nt, Homo sapiens
auccuaugguuucuccaucca

SEQ ID NO: 901631 - RNA, 16 nt, Homo sapiens
auccuauuauguguuc

SEQ ID NO: 901632 - RNA, 15 nt, Homo sapiens
uccacucagcaguaa

SEQ ID NO: 901633 - RNA, 23 nt, Homo sapiens
uccacugcaauacuaauugagaa

SEQ ID NO: 901634 - RNA, 11 nt, Homo sapiens
uccacuuagaa

SEQ ID NO: 901635 - RNA, 16 nt, Homo sapiens
uccagaaggcaaaaag

SEQ ID NO: 901636 - RNA, 14 nt, Homo sapiens
uccagaauccacaa

SEQ ID NO: 901637 - RNA, 15 nt, Homo sapiens
uccagacauacgaaa

SEQ ID NO: 901638 - RNA, 13 nt, Homo sapiens
uccagaccaccug

SEQ ID NO: 901639 - RNA, 19 nt, Homo sapiens
uccagacgucaaccaggaa

SEQ ID NO: 901640 - RNA, 17 nt, Homo sapiens
uccagagacaggaaaga

SEQ ID NO: 901641 - RNA, 16 nt, Homo sapiens
uccagaggguugugau

SEQ ID NO: 901642 - RNA, 14 nt, Homo sapiens
uccagaucagauuc

SEQ ID NO: 901643 - RNA, 13 nt, Homo sapiens
uccagaucugcac

SEQ ID NO: 901644 - RNA, 13 nt, Homo sapiens
uccagaugccuuc

SEQ ID NO: 901645 - RNA, 13 nt, Homo sapiens
uccagauucuucc

SEQ ID NO: 901646 - RNA, 12 nt, Homo sapiens
uccagcauuugc

SEQ ID NO: 901647 - RNA, 22 nt, Homo sapiens
uccagccaacauuuaaugagca

SEQ ID NO: 901648 - RNA, 22 nt, Homo sapiens
uccagccaauaaaucaacucca

SEQ ID NO: 901649 - RNA, 15 nt, Homo sapiens
uccagcccacacccc

SEQ ID NO: 901650 - RNA, 15 nt, Homo sapiens
uccagccugggcaac

SEQ ID NO: 901651 - RNA, 20 nt, Homo sapiens
uccagccugggcaacagagc

SEQ ID NO: 901652 - RNA, 22 nt, Homo sapiens
uccaggaauaggcauuugccua

SEQ ID NO: 901653 - RNA, 17 nt, Homo sapiens
uccaguauccacuuugc

SEQ ID NO: 901654 - RNA, 15 nt, Homo sapiens
uccagucauuucaau

SEQ ID NO: 901655 - RNA, 16 nt, Homo sapiens
uccagucugaucugug

SEQ ID NO: 901656 - RNA, 18 nt, Homo sapiens
uccaguuucccaccaccu

SEQ ID NO: 901657 - RNA, 19 nt, Homo sapiens
uccauaaacacccaugaau

SEQ ID NO: 901658 - RNA, 16 nt, Homo sapiens
uccauaaggugcagua

SEQ ID NO: 901659 - RNA, 13 nt, Homo sapiens
uccauaucuucca

SEQ ID NO: 901660 - RNA, 19 nt, Homo sapiens
uccauauggaggccucaca

SEQ ID NO: 901661 - RNA, 18 nt, Homo sapiens
uccauauuuauuuaaaca

SEQ ID NO: 901662 - RNA, 22 nt, Homo sapiens
uccaucagguuccaucccgaaa

SEQ ID NO: 901663 - RNA, 18 nt, Homo sapiens
uccauccccaaacugugc

SEQ ID NO: 901664 - RNA, 18 nt, Homo sapiens
uccaucccgcccuuccca

SEQ ID NO: 901665 - RNA, 18 nt, Homo sapiens
uccauccggcuccuguca

SEQ ID NO: 901666 - RNA, 21 nt, Homo sapiens
uccaucugcuuguauuuucca

SEQ ID NO: 901667 - RNA, 14 nt, Homo sapiens
uccaugccugggaa

SEQ ID NO: 901668 - RNA, 17 nt, Homo sapiens
uccauggcagcuggucu

SEQ ID NO: 901669 - RNA, 22 nt, Homo sapiens
uccauggccaccccgugccacc

SEQ ID NO: 901670 - RNA, 21 nt, Homo sapiens
uccauguagaauaaaugaaga

SEQ ID NO: 901671 - RNA, 16 nt, Homo sapiens
uccauucaacugaaaa

SEQ ID NO: 901672 - RNA, 15 nt, Homo sapiens
uccauucacagccag

SEQ ID NO: 901673 - RNA, 15 nt, Homo sapiens
uccauugcuguuguu

SEQ ID NO: 901674 - RNA, 19 nt, Homo sapiens
uccauuuggacaaaaugga

SEQ ID NO: 901675 - RNA, 21 nt, Homo sapiens
ucccaaaagucaccacuccau

SEQ ID NO: 901676 - RNA, 15 nt, Homo sapiens
ucccaaacuacagaa

SEQ ID NO: 901677 - RNA, 10 nt, Homo sapiens
ucccaaagaa

SEQ ID NO: 901678 - RNA, 23 nt, Homo sapiens
ucccaaaggacagccgccuggag

SEQ ID NO: 901679 - RNA, 15 nt, Homo sapiens
ucccaaauaaacucc

SEQ ID NO: 901680 - RNA, 18 nt, Homo sapiens
ucccaaauaaacuccaga

SEQ ID NO: 901681 - RNA, 16 nt, Homo sapiens
ucccaacaacauccau

SEQ ID NO: 901682 - RNA, 22 nt, Homo sapiens
ucccaacaacauccauguccua

SEQ ID NO: 901683 - RNA, 12 nt, Homo sapiens
ucccaacucgau

SEQ ID NO: 901684 - RNA, 18 nt, Homo sapiens
ucccaacucgaugggcac

SEQ ID NO: 901685 - RNA, 12 nt, Homo sapiens
ucccaagccaga

SEQ ID NO: 901686 - RNA, 21 nt, Homo sapiens
ucccaaugcacauccauuccc

SEQ ID NO: 901687 - RNA, 22 nt, Homo sapiens
ucccaccaacucugcacuccau

SEQ ID NO: 901688 - RNA, 16 nt, Homo sapiens
ucccacccacauguga

SEQ ID NO: 901689 - RNA, 17 nt, Homo sapiens
ucccacccacaugugac

SEQ ID NO: 901690 - RNA, 17 nt, Homo sapiens
ucccaccccggccucca

SEQ ID NO: 901691 - RNA, 16 nt, Homo sapiens
ucccacccuaccacag

SEQ ID NO: 901692 - RNA, 23 nt, Homo sapiens
ucccaccucuucucuuccuguaa

SEQ ID NO: 901693 - RNA, 20 nt, Homo sapiens
ucccacgacuguuguacaag

SEQ ID NO: 901694 - RNA, 18 nt, Homo sapiens
ucccacgaugucaaggac

SEQ ID NO: 901695 - RNA, 12 nt, Homo sapiens
ucccacucaugu

SEQ ID NO: 901696 - RNA, 20 nt, Homo sapiens
ucccacucauguuguuccca

SEQ ID NO: 901697 - RNA, 13 nt, Homo sapiens
ucccagcacuuug

SEQ ID NO: 901698 - RNA, 15 nt, Homo sapiens
ucccaggaacugggc

SEQ ID NO: 901699 - RNA, 14 nt, Homo sapiens
ucccauagcacugc

SEQ ID NO: 901700 - RNA, 16 nt, Homo sapiens
ucccauagccaggaaa

SEQ ID NO: 901701 - RNA, 13 nt, Homo sapiens
ucccauguuaaau

SEQ ID NO: 901702 - RNA, 15 nt, Homo sapiens
ucccauucuugcaug

SEQ ID NO: 901703 - RNA, 23 nt, Homo sapiens
ucccauugucaccuaacucugaa

SEQ ID NO: 901704 - RNA, 18 nt, Homo sapiens
uccccaagugaccuauac

SEQ ID NO: 901705 - RNA, 15 nt, Homo sapiens
uccccacaccucccu

SEQ ID NO: 901706 - RNA, 14 nt, Homo sapiens
uccccacacugacc

SEQ ID NO: 901707 - RNA, 18 nt, Homo sapiens
uccccacagaacugcuua

SEQ ID NO: 901708 - RNA, 14 nt, Homo sapiens
uccccaucauccca

SEQ ID NO: 901709 - RNA, 20 nt, Homo sapiens
ucccccucccugugugaaau

SEQ ID NO: 901710 - RNA, 22 nt, Homo sapiens
uccccgggguauuagcaccucu

SEQ ID NO: 901711 - RNA, 22 nt, Homo sapiens
uccccuccacugucacauugua

SEQ ID NO: 901712 - RNA, 18 nt, Homo sapiens
uccccucccccacucuau

SEQ ID NO: 901713 - RNA, 20 nt, Homo sapiens
uccccugaaaaacugaucaa

SEQ ID NO: 901714 - RNA, 23 nt, Homo sapiens
uccccugaaaaacugaucaaaaa

SEQ ID NO: 901715 - RNA, 20 nt, Homo sapiens
uccccuggaacugucucuca

SEQ ID NO: 901716 - RNA, 15 nt, Homo sapiens
uccccuggacuggga

SEQ ID NO: 901717 - RNA, 22 nt, Homo sapiens
uccccuggggucucugcugcau

SEQ ID NO: 901718 - RNA, 13 nt, Homo sapiens
uccccuuccugcc

SEQ ID NO: 901719 - RNA, 19 nt, Homo sapiens
ucccgagcuacucucuugc

SEQ ID NO: 901720 - RNA, 19 nt, Homo sapiens
ucccgcgugaagaugucac

SEQ ID NO: 901721 - RNA, 20 nt, Homo sapiens
ucccggauuuuuguuaauau

SEQ ID NO: 901722 - RNA, 16 nt, Homo sapiens
ucccgguucaccuugc

SEQ ID NO: 901723 - RNA, 18 nt, Homo sapiens
ucccgucuucuccaacac

SEQ ID NO: 901724 - RNA, 11 nt, Homo sapiens
ucccuaauccu

SEQ ID NO: 901725 - RNA, 22 nt, Homo sapiens
ucccuaauccuccaagucuuca

SEQ ID NO: 901726 - RNA, 21 nt, Homo sapiens
ucccuaccccauuugugguca

SEQ ID NO: 901727 - RNA, 14 nt, Homo sapiens
ucccuagcagugaa

SEQ ID NO: 901728 - RNA, 20 nt, Homo sapiens
ucccucaaaugacccaaaga

SEQ ID NO: 901729 - RNA, 19 nt, Homo sapiens
ucccuccccaaacccauca

SEQ ID NO: 901730 - RNA, 21 nt, Homo sapiens
ucccuccccaaacccaucaga

SEQ ID NO: 901731 - RNA, 20 nt, Homo sapiens
ucccucgcccccacacccca

SEQ ID NO: 901732 - RNA, 16 nt, Homo sapiens
ucccucggagcugcca

SEQ ID NO: 901733 - RNA, 14 nt, Homo sapiens
ucccucucuugccu

SEQ ID NO: 901734 - RNA, 21 nt, Homo sapiens
ucccucugagaauuccaagga

SEQ ID NO: 901735 - RNA, 19 nt, Homo sapiens
ucccugaaaacccagagag

SEQ ID NO: 901736 - RNA, 17 nt, Homo sapiens
ucccugaaggccuucaa

SEQ ID NO: 901737 - RNA, 13 nt, Homo sapiens
ucccugccagugu

SEQ ID NO: 901738 - RNA, 19 nt, Homo sapiens
ucccugggggaagcccugg

SEQ ID NO: 901739 - RNA, 23 nt, Homo sapiens
ucccuucccuguccaccucacca

SEQ ID NO: 901740 - RNA, 19 nt, Homo sapiens
ucccuucgauauaugacuu

SEQ ID NO: 901741 - RNA, 12 nt, Homo sapiens
ucccuugaccau

SEQ ID NO: 901742 - RNA, 18 nt, Homo sapiens
ucccuuuguggacaaguu

SEQ ID NO: 901743 - RNA, 15 nt, Homo sapiens
uccgaagucuuccau

SEQ ID NO: 901744 - RNA, 16 nt, Homo sapiens
uccgcuuucaugaaca

SEQ ID NO: 901745 - RNA, 15 nt, Homo sapiens
uccgggacgcuucca

SEQ ID NO: 901746 - RNA, 18 nt, Homo sapiens
uccguccaggagccugug

SEQ ID NO: 901747 - RNA, 23 nt, Homo sapiens
ucugacccaagagguggggacca

SEQ ID NO: 901748 - RNA, 19 nt, Homo sapiens
ucugacucuugccuuucca

SEQ ID NO: 901749 - RNA, 19 nt, Homo sapiens
ucugagaaagacuauucaa

SEQ ID NO: 901750 - RNA, 15 nt, Homo sapiens
ucugagauugaauau

SEQ ID NO: 901751 - RNA, 18 nt, Homo sapiens
ucugaggaagaagggaua

SEQ ID NO: 901752 - RNA, 13 nt, Homo sapiens
ucugagugacaug

SEQ ID NO: 901753 - RNA, 18 nt, Homo sapiens
ucugaguuccugcaugcc

SEQ ID NO: 901754 - RNA, 15 nt, Homo sapiens
ucugauaacagaauu

SEQ ID NO: 901755 - RNA, 21 nt, Homo sapiens
ucugaugaccuaaccuaagca

SEQ ID NO: 901756 - RNA, 21 nt, Homo sapiens
ucugauucgaaugacacuguu

SEQ ID NO: 901757 - RNA, 14 nt, Homo sapiens
ucugauuggcucac

SEQ ID NO: 901758 - RNA, 18 nt, Homo sapiens
ucugauuuccuaauguca

SEQ ID NO: 901759 - RNA, 17 nt, Homo sapiens
ucugcaaagacuagauc

SEQ ID NO: 901760 - RNA, 15 nt, Homo sapiens
ucugcacaugucuug

SEQ ID NO: 901761 - RNA, 20 nt, Homo sapiens
ucugcacuaauugacccaaa

SEQ ID NO: 901762 - RNA, 13 nt, Homo sapiens
ucugcacugaaaa

SEQ ID NO: 901763 - RNA, 23 nt, Homo sapiens
ucugcagcccggcgccaccaucc

SEQ ID NO: 901764 - RNA, 15 nt, Homo sapiens
ucugcaguagucucu

SEQ ID NO: 901765 - RNA, 15 nt, Homo sapiens
ucugcauguguguug

SEQ ID NO: 901766 - RNA, 14 nt, Homo sapiens
ucugcccacuguga

SEQ ID NO: 901767 - RNA, 22 nt, Homo sapiens
ucugcccacugugaaaccacua

SEQ ID NO: 901768 - RNA, 16 nt, Homo sapiens
ucugccccagcuuuau

SEQ ID NO: 901769 - RNA, 22 nt, Homo sapiens
ucugcccccgucuucucuccau

SEQ ID NO: 901770 - RNA, 14 nt, Homo sapiens
ucugcccugccucc

SEQ ID NO: 901771 - RNA, 14 nt, Homo sapiens
ucugcccuguauau

SEQ ID NO: 901772 - RNA, 14 nt, Homo sapiens
ucugccucugacac

SEQ ID NO: 901773 - RNA, 15 nt, Homo sapiens
ucugccugaaccugg

SEQ ID NO: 901774 - RNA, 13 nt, Homo sapiens
ucugccugggcuu

SEQ ID NO: 901775 - RNA, 18 nt, Homo sapiens
ucugcuaccucacugggg

SEQ ID NO: 901776 - RNA, 13 nt, Homo sapiens
ucugcucaggaau

SEQ ID NO: 901777 - RNA, 14 nt, Homo sapiens
ucugcuccagagag

SEQ ID NO: 901778 - RNA, 18 nt, Homo sapiens
ucugcuccucuccaggca

SEQ ID NO: 901779 - RNA, 16 nt, Homo sapiens
ucugcugcugaaacug

SEQ ID NO: 901780 - RNA, 16 nt, Homo sapiens
ucugcuguauacugua

SEQ ID NO: 901781 - RNA, 21 nt, Homo sapiens
ucugcuguauacuguacugag

SEQ ID NO: 901782 - RNA, 20 nt, Homo sapiens
ucugcuuccccaucuguuaa

SEQ ID NO: 901783 - RNA, 22 nt, Homo sapiens
ucugcuugcaucacuugggguc

SEQ ID NO: 901784 - RNA, 14 nt, Homo sapiens
ucuggaaaagcaaa

SEQ ID NO: 901785 - RNA, 16 nt, Homo sapiens
ucuggaagccuggacu

SEQ ID NO: 901786 - RNA, 21 nt, Homo sapiens
ucuggaaggccccucccagca

SEQ ID NO: 901787 - RNA, 23 nt, Homo sapiens
ucugggagaaaugagauaaaaga

SEQ ID NO: 901788 - RNA, 22 nt, Homo sapiens
ucugggagggauguucuagccc

SEQ ID NO: 901789 - RNA, 21 nt, Homo sapiens
ucugggcaaugaaaccaaagc

SEQ ID NO: 901790 - RNA, 15 nt, Homo sapiens
ucugggcagcuguca

SEQ ID NO: 901791 - RNA, 23 nt, Homo sapiens
ucugggcaguaaauccacagcca

SEQ ID NO: 901792 - RNA, 17 nt, Homo sapiens
ucugggcccccacuuuc

SEQ ID NO: 901793 - RNA, 23 nt, Homo sapiens
ucugggucuuucugacaucagca

SEQ ID NO: 901794 - RNA, 12 nt, Homo sapiens
ucuggucugucc

SEQ ID NO: 901795 - RNA, 23 nt, Homo sapiens
ucuggucuucacugccaugccuc

SEQ ID NO: 901796 - RNA, 17 nt, Homo sapiens
ucugguuugagcaauuu

SEQ ID NO: 901797 - RNA, 14 nt, Homo sapiens
ucuguaaacucaaa

SEQ ID NO: 901798 - RNA, 14 nt, Homo sapiens
ucuguaaggaacug

SEQ ID NO: 901799 - RNA, 18 nt, Homo sapiens
ucuguaaggaacuggaac

SEQ ID NO: 901800 - RNA, 10 nt, Homo sapiens
ucuguacaau

SEQ ID NO: 901801 - RNA, 18 nt, Homo sapiens
ucuguacgucugacaggc

SEQ ID NO: 901802 - RNA, 14 nt, Homo sapiens
ucuguccacucuga

SEQ ID NO: 901803 - RNA, 21 nt, Homo sapiens
ucuguccagaggcugcaagga

SEQ ID NO: 901804 - RNA, 23 nt, Homo sapiens
ucugucuugaugugucaucuaau

SEQ ID NO: 901805 - RNA, 14 nt, Homo sapiens
ucugugacugccaa

SEQ ID NO: 901806 - RNA, 22 nt, Homo sapiens
ucugugcaaauccuugauacug

SEQ ID NO: 901807 - RNA, 11 nt, Homo sapiens
ucugugcagcu

SEQ ID NO: 901808 - RNA, 16 nt, Homo sapiens
ucugugcuuugacuca

SEQ ID NO: 901809 - RNA, 18 nt, Homo sapiens
ucuguguaaccuccacag

SEQ ID NO: 901810 - RNA, 13 nt, Homo sapiens
ucuguguggugcc

SEQ ID NO: 901811 - RNA, 14 nt, Homo sapiens
ucuguuaaaaucag

SEQ ID NO: 901812 - RNA, 18 nt, Homo sapiens
ucuguucauucacugcac

SEQ ID NO: 901813 - RNA, 19 nt, Homo sapiens
ucuguucauuuccucaaaa

SEQ ID NO: 901814 - RNA, 21 nt, Homo sapiens
ucuguucuguugaucccacuu

SEQ ID NO: 901815 - RNA, 19 nt, Homo sapiens
ucuguuuuguuuugcugaa

SEQ ID NO: 901816 - RNA, 15 nt, Homo sapiens
ucuuaaaauucuugg

SEQ ID NO: 901817 - RNA, 15 nt, Homo sapiens
ucuuaauaggcuuua

SEQ ID NO: 901818 - RNA, 21 nt, Homo sapiens
ucuuacaaccaagaacauuau

SEQ ID NO: 901819 - RNA, 14 nt, Homo sapiens
ucuuacacuacauu

SEQ ID NO: 901820 - RNA, 22 nt, Homo sapiens
ucuuacauaauuuuuuauucaa

SEQ ID NO: 901821 - RNA, 15 nt, Homo sapiens
ucuuacauuagcagu

SEQ ID NO: 901822 - RNA, 19 nt, Homo sapiens
ucuuaccuguaugucucca

SEQ ID NO: 901823 - RNA, 16 nt, Homo sapiens
ucuuacuuaucaaaag

SEQ ID NO: 901824 - RNA, 22 nt, Homo sapiens
ucuuacuuugaguuagugccau

SEQ ID NO: 901825 - RNA, 17 nt, Homo sapiens
ucuuagcugucugcuca

SEQ ID NO: 901826 - RNA, 11 nt, Homo sapiens
ucuuauacuuc

SEQ ID NO: 901827 - RNA, 17 nt, Homo sapiens
ucuuauagaaaguucaa

SEQ ID NO: 901828 - RNA, 20 nt, Homo sapiens
ucuuaugaaaugggcuuuaa

SEQ ID NO: 901829 - RNA, 20 nt, Homo sapiens
ucuuauggaagaaaugggag

SEQ ID NO: 901830 - RNA, 18 nt, Homo sapiens
ucuuauucaugcuuucuc

SEQ ID NO: 901831 - RNA, 19 nt, Homo sapiens
ucuuauucccaaacuacag

SEQ ID NO: 901832 - RNA, 17 nt, Homo sapiens
ucuuauuuaauuuuugc

SEQ ID NO: 901833 - RNA, 20 nt, Homo sapiens
ucuuauuucauuucuuugag

SEQ ID NO: 901834 - RNA, 13 nt, Homo sapiens
ucuuauuugcuca

SEQ ID NO: 901835 - RNA, 21 nt, Homo sapiens
ucuucaacccccugacauuau

SEQ ID NO: 901836 - RNA, 13 nt, Homo sapiens
ucuucaaggugua

SEQ ID NO: 901837 - RNA, 15 nt, Homo sapiens
ucuucaauaugaagg

SEQ ID NO: 901838 - RNA, 13 nt, Homo sapiens
ucuucacaacaga

SEQ ID NO: 901839 - RNA, 12 nt, Homo sapiens
ucuucacugcca

SEQ ID NO: 901840 - RNA, 20 nt, Homo sapiens
ucuucacuucagacaauuca

SEQ ID NO: 901841 - RNA, 16 nt, Homo sapiens
ucuucagaagacacug

SEQ ID NO: 901842 - RNA, 21 nt, Homo sapiens
ucuucagagagcuaaauuaca

SEQ ID NO: 901843 - RNA, 11 nt, Homo sapiens
ucuucagccau

SEQ ID NO: 901844 - RNA, 12 nt, Homo sapiens
ucuucaugcaau

SEQ ID NO: 901845 - RNA, 11 nt, Homo sapiens
ucuucauggcc

SEQ ID NO: 901846 - RNA, 17 nt, Homo sapiens
ucuucauuucauuguau

SEQ ID NO: 901847 - RNA, 22 nt, Homo sapiens
ucuuccacuggcuccacaucca

SEQ ID NO: 901848 - RNA, 20 nt, Homo sapiens
ucuuccagaaggcaaaaaga

SEQ ID NO: 901849 - RNA, 21 nt, Homo sapiens
ucuucccaccucagugcccac

SEQ ID NO: 901850 - RNA, 18 nt, Homo sapiens
ucuucccgggaucacuua

SEQ ID NO: 901851 - RNA, 21 nt, Homo sapiens
ucuuccucccucauuccaccu

SEQ ID NO: 901852 - RNA, 13 nt, Homo sapiens
ucuuccugcaaag

SEQ ID NO: 901853 - RNA, 23 nt, Homo sapiens
ucuucuaaaaugcuuuuaauuaa

SEQ ID NO: 901854 - RNA, 13 nt, Homo sapiens
ucuucuaaccuca

SEQ ID NO: 901855 - RNA, 16 nt, Homo sapiens
ucuucuacaaccagag

SEQ ID NO: 901856 - RNA, 12 nt, Homo sapiens
ucuucuaugcaa

SEQ ID NO: 901857 - RNA, 23 nt, Homo sapiens
ucuucuccaggcuguaucccaug

SEQ ID NO: 901858 - RNA, 19 nt, Homo sapiens
ucuucuuuuuuugugaugu

SEQ ID NO: 901859 - RNA, 14 nt, Homo sapiens
ucuugaaacaagca

SEQ ID NO: 901860 - RNA, 21 nt, Homo sapiens
ucuugaacugguugugaauaa

SEQ ID NO: 901861 - RNA, 22 nt, Homo sapiens
ucuugaguucuggaagggacuu

SEQ ID NO: 901862 - RNA, 16 nt, Homo sapiens
ugaggcuccugugcua

SEQ ID NO: 901863 - RNA, 23 nt, Homo sapiens
ugaggcugucgugagcuaugauu

SEQ ID NO: 901864 - RNA, 20 nt, Homo sapiens
ugagggacuggaaccaggga

SEQ ID NO: 901865 - RNA, 18 nt, Homo sapiens
ugaggggaccaaagccac

SEQ ID NO: 901866 - RNA, 18 nt, Homo sapiens
ugaggggcugacuucaau

SEQ ID NO: 901867 - RNA, 16 nt, Homo sapiens
ugaggucaccuggaau

SEQ ID NO: 901868 - RNA, 14 nt, Homo sapiens
ugaggucacugggu

SEQ ID NO: 901869 - RNA, 21 nt, Homo sapiens
ugaggucacuggguucuagaa

SEQ ID NO: 901870 - RNA, 19 nt, Homo sapiens
ugagguuuucugugcuuug

SEQ ID NO: 901871 - RNA, 13 nt, Homo sapiens
ugaguaaaaucua

SEQ ID NO: 901872 - RNA, 20 nt, Homo sapiens
ugagucaugaucucccugcc

SEQ ID NO: 901873 - RNA, 22 nt, Homo sapiens
ugagucucuaugaucuuggcac

SEQ ID NO: 901874 - RNA, 18 nt, Homo sapiens
ugagucugcagaugagga

SEQ ID NO: 901875 - RNA, 22 nt, Homo sapiens
ugagucuuccagagccuaagaa

SEQ ID NO: 901876 - RNA, 14 nt, Homo sapiens
ugagugaacaacua

SEQ ID NO: 901877 - RNA, 22 nt, Homo sapiens
ugagugaccccagccuccugcc

SEQ ID NO: 901878 - RNA, 22 nt, Homo sapiens
ugaguuacuuccuaucaagcca

SEQ ID NO: 901879 - RNA, 21 nt, Homo sapiens
ugaguuauaguuugcuuugcu

SEQ ID NO: 901880 - RNA, 22 nt, Homo sapiens
ugaguucuggaagggacuuuag

SEQ ID NO: 901881 - RNA, 19 nt, Homo sapiens
ugaguugcacagcuaugaa

SEQ ID NO: 901882 - RNA, 22 nt, Homo sapiens
ugaguugcacagcuaugaaggc

SEQ ID NO: 901883 - RNA, 15 nt, Homo sapiens
ugaguuucucuccac

SEQ ID NO: 901884 - RNA, 21 nt, Homo sapiens
ugaguuuuugauagcuuuauu

SEQ ID NO: 901885 - RNA, 18 nt, Homo sapiens
ugauaaagcaguauuugg

SEQ ID NO: 901886 - RNA, 22 nt, Homo sapiens
ugauaagcaggaaggauggcaa

SEQ ID NO: 901887 - RNA, 20 nt, Homo sapiens
ugauaaucugggcaucucgu

SEQ ID NO: 901888 - RNA, 18 nt, Homo sapiens
ugauacuucaggugcuuu

SEQ ID NO: 901889 - RNA, 16 nt, Homo sapiens
ugauagaguguuauca

SEQ ID NO: 901890 - RNA, 15 nt, Homo sapiens
ugauauacuaugacu

SEQ ID NO: 901891 - RNA, 14 nt, Homo sapiens
ugauauauuuucca

SEQ ID NO: 901892 - RNA, 13 nt, Homo sapiens
ugauaucaccucu

SEQ ID NO: 901893 - RNA, 18 nt, Homo sapiens
ugauaucccccagccuca

SEQ ID NO: 901894 - RNA, 18 nt, Homo sapiens
ugauauguaaacauaauu

SEQ ID NO: 901895 - RNA, 22 nt, Homo sapiens
ugaucaaaaauaaacuaguuuc

SEQ ID NO: 901896 - RNA, 17 nt, Homo sapiens
ugaucaauccuucuuau

SEQ ID NO: 901897 - RNA, 18 nt, Homo sapiens
ugaucacggcucacugca

SEQ ID NO: 901898 - RNA, 19 nt, Homo sapiens
ugaucacggcucacugcag

SEQ ID NO: 901899 - RNA, 20 nt, Homo sapiens
ugaucagaauuuuaccaaaa

SEQ ID NO: 901900 - RNA, 19 nt, Homo sapiens
ugaucagugcaauugaccu

SEQ ID NO: 901901 - RNA, 22 nt, Homo sapiens
ugauccacaaaaacaacuuauu

SEQ ID NO: 901902 - RNA, 17 nt, Homo sapiens
ugauccacccaccucag

SEQ ID NO: 901903 - RNA, 17 nt, Homo sapiens
ugaucccuagcugugac

SEQ ID NO: 901904 - RNA, 15 nt, Homo sapiens
ugaucgugccuauaa

SEQ ID NO: 901905 - RNA, 19 nt, Homo sapiens
ugaugaaaaauaugugcuu

SEQ ID NO: 901906 - RNA, 14 nt, Homo sapiens
ugaugaccaagaau

SEQ ID NO: 901907 - RNA, 18 nt, Homo sapiens
ugaugaggccucuuggac

SEQ ID NO: 901908 - RNA, 13 nt, Homo sapiens
ugaugaugucucu

SEQ ID NO: 901909 - RNA, 18 nt, Homo sapiens
ugauggcguggcaacccu

SEQ ID NO: 901910 - RNA, 15 nt, Homo sapiens
ugaugggacaucaaa

SEQ ID NO: 901911 - RNA, 15 nt, Homo sapiens
ugaugggaucuguaa

SEQ ID NO: 901912 - RNA, 19 nt, Homo sapiens
ugaugguaacugcacacau

SEQ ID NO: 901913 - RNA, 16 nt, Homo sapiens
ugaugguaagacugua

SEQ ID NO: 901914 - RNA, 13 nt, Homo sapiens
ugauggugcugac

SEQ ID NO: 901915 - RNA, 16 nt, Homo sapiens
ugauguacuacauuaa

SEQ ID NO: 901916 - RNA, 11 nt, Homo sapiens
ugauguugcug

SEQ ID NO: 901917 - RNA, 17 nt, Homo sapiens
ugauguuucacauaaaa

SEQ ID NO: 901918 - RNA, 18 nt, Homo sapiens
ugauuaaaaucuggcaaa

SEQ ID NO: 901919 - RNA, 13 nt, Homo sapiens
ugauuagcacuua

SEQ ID NO: 901920 - RNA, 15 nt, Homo sapiens
ugauuauuaaagucc

SEQ ID NO: 901921 - RNA, 21 nt, Homo sapiens
ugauucacaaugaaaugcucu

SEQ ID NO: 901922 - RNA, 20 nt, Homo sapiens
ugauugaaucugauuggaca

SEQ ID NO: 901923 - RNA, 16 nt, Homo sapiens
ugauugacacacagca

SEQ ID NO: 901924 - RNA, 21 nt, Homo sapiens
ugauuggacauuuucuucaga

SEQ ID NO: 901925 - RNA, 16 nt, Homo sapiens
ugauuuaugaucacuu

SEQ ID NO: 901926 - RNA, 13 nt, Homo sapiens
ugauuucaagacc

SEQ ID NO: 901927 - RNA, 13 nt, Homo sapiens
ugauuucaggaua

SEQ ID NO: 901928 - RNA, 13 nt, Homo sapiens
ugauuucagggaa

SEQ ID NO: 901929 - RNA, 12 nt, Homo sapiens
ugauuugaccca

SEQ ID NO: 901930 - RNA, 21 nt, Homo sapiens
ugauuuuuguaauaaaaggua

SEQ ID NO: 901931 - RNA, 17 nt, Homo sapiens
ugauuuuuuaaagcgua

SEQ ID NO: 901932 - RNA, 19 nt, Homo sapiens
ugcaaacucacugcucaag

SEQ ID NO: 901933 - RNA, 18 nt, Homo sapiens
ugcaaacuuguaucugaa

SEQ ID NO: 901934 - RNA, 15 nt, Homo sapiens
ugcaaaugccuccaa

SEQ ID NO: 901935 - RNA, 18 nt, Homo sapiens
ugcaaaugcuauauugca

SEQ ID NO: 901936 - RNA, 16 nt, Homo sapiens
ugcaaccucacuaugg

SEQ ID NO: 901937 - RNA, 17 nt, Homo sapiens
ugcaagagacucuggcc

SEQ ID NO: 901938 - RNA, 22 nt, Homo sapiens
ugcaaggugaacaccacuuugu

SEQ ID NO: 901939 - RNA, 16 nt, Homo sapiens
ugcaagucauacuuag

SEQ ID NO: 901940 - RNA, 23 nt, Homo sapiens
ugcaagugcuaugccaagccaug

SEQ ID NO: 901941 - RNA, 18 nt, Homo sapiens
ugcaauaaauuauggcuc

SEQ ID NO: 901942 - RNA, 15 nt, Homo sapiens
ugcaauaaugugcaa

SEQ ID NO: 901943 - RNA, 17 nt, Homo sapiens
ugcaauauuuacauuuu

SEQ ID NO: 901944 - RNA, 17 nt, Homo sapiens
ugcaauucaucccagag

SEQ ID NO: 901945 - RNA, 17 nt, Homo sapiens
ugcacaaagcccuucca

SEQ ID NO: 901946 - RNA, 14 nt, Homo sapiens
ugcacaaugggcaa

SEQ ID NO: 901947 - RNA, 12 nt, Homo sapiens
ugcacaauuuga

SEQ ID NO: 901948 - RNA, 18 nt, Homo sapiens
ugcacacaaacaccuccu

SEQ ID NO: 901949 - RNA, 23 nt, Homo sapiens
ugcacacacacagagauaugcac

SEQ ID NO: 901950 - RNA, 14 nt, Homo sapiens
ugcacacacagaug

SEQ ID NO: 901951 - RNA, 23 nt, Homo sapiens
ugcacaccaaaaaaauacuugag

SEQ ID NO: 901952 - RNA, 16 nt, Homo sapiens
ugcacagagauaugca

SEQ ID NO: 901953 - RNA, 22 nt, Homo sapiens
ugcacauauggacucugcacau

SEQ ID NO: 901954 - RNA, 13 nt, Homo sapiens
ugcacaugaaucc

SEQ ID NO: 901955 - RNA, 17 nt, Homo sapiens
ugcaccaaaucaucucu

SEQ ID NO: 901956 - RNA, 14 nt, Homo sapiens
ugcaccaccaugcc

SEQ ID NO: 901957 - RNA, 16 nt, Homo sapiens
ugcaccaccaugccag

SEQ ID NO: 901958 - RNA, 17 nt, Homo sapiens
ugcaccacuucaaguga

SEQ ID NO: 901959 - RNA, 18 nt, Homo sapiens
ugcaccaucacacaugca

SEQ ID NO: 901960 - RNA, 17 nt, Homo sapiens
ugcaccccuccccauuc

SEQ ID NO: 901961 - RNA, 22 nt, Homo sapiens
ugcaccccuccccauucacaga

SEQ ID NO: 901962 - RNA, 22 nt, Homo sapiens
ugcaccuugugucuguacacgu

SEQ ID NO: 901963 - RNA, 18 nt, Homo sapiens
ugcacuagccugugauua

SEQ ID NO: 901964 - RNA, 20 nt, Homo sapiens
ugcacuccagccugggcaac

SEQ ID NO: 901965 - RNA, 15 nt, Homo sapiens
ugcacuugcuggaag

SEQ ID NO: 901966 - RNA, 10 nt, Homo sapiens
ugcacuuugu

SEQ ID NO: 901967 - RNA, 11 nt, Homo sapiens
ugcacuuuuaa

SEQ ID NO: 901968 - RNA, 18 nt, Homo sapiens
ugcagaagcaguguuucu

SEQ ID NO: 901969 - RNA, 21 nt, Homo sapiens
ugcagaauacaguaagcugcu

SEQ ID NO: 901970 - RNA, 15 nt, Homo sapiens
ugcagacucacugug

SEQ ID NO: 901971 - RNA, 17 nt, Homo sapiens
ugcagacucacuguggg

SEQ ID NO: 901972 - RNA, 23 nt, Homo sapiens
ugcagcaacucccacgacuguug

SEQ ID NO: 901973 - RNA, 18 nt, Homo sapiens
ugcagccacugugcugaa

SEQ ID NO: 901974 - RNA, 23 nt, Homo sapiens
ugcagcugggccccaugcucugc

SEQ ID NO: 901975 - RNA, 19 nt, Homo sapiens
ugcaggagccgcugcugag

SEQ ID NO: 901976 - RNA, 13 nt, Homo sapiens
aaaaaaaauacuu

SEQ ID NO: 901977 - RNA, 18 nt, Homo sapiens
aaaaaaccuucagugaaa

SEQ ID NO: 901978 - RNA, 20 nt, Homo sapiens
aaaaaaguaaguaccacuca

SEQ ID NO: 901979 - RNA, 15 nt, Homo sapiens
aaaaaaugcauuuaa

SEQ ID NO: 901980 - RNA, 16 nt, Homo sapiens
aaaaaccaaauaagca

SEQ ID NO: 901981 - RNA, 11 nt, Homo sapiens
aaaaaccaaug

SEQ ID NO: 901982 - RNA, 23 nt, Homo sapiens
aaaaagaaguguuccuucauuaa

SEQ ID NO: 901983 - RNA, 22 nt, Homo sapiens
aaaaagggauccguacauucaa

SEQ ID NO: 901984 - RNA, 23 nt, Homo sapiens
aaaaaguccuugauuuagcacua

SEQ ID NO: 901985 - RNA, 12 nt, Homo sapiens
aaaaaguguuua

SEQ ID NO: 901986 - RNA, 22 nt, Homo sapiens
aaaaaguuucuaguaucacaua

SEQ ID NO: 901987 - RNA, 17 nt, Homo sapiens
aaaaaugaugggacaau

SEQ ID NO: 901988 - RNA, 16 nt, Homo sapiens
aaaaaugcacaccuca

SEQ ID NO: 901989 - RNA, 22 nt, Homo sapiens
aaaaaugcacaccucaugaguc

SEQ ID NO: 901990 - RNA, 23 nt, Homo sapiens
aaaaauucacauccaaugcauag

SEQ ID NO: 901991 - RNA, 20 nt, Homo sapiens
aaaaauugguacuuguuuca

SEQ ID NO: 901992 - RNA, 23 nt, Homo sapiens
aaaacacagagaugcugcaaaua

SEQ ID NO: 901993 - RNA, 15 nt, Homo sapiens
aaaacacaucuuucc

SEQ ID NO: 901994 - RNA, 20 nt, Homo sapiens
aaaacacccuuuccaaagca

SEQ ID NO: 901995 - RNA, 14 nt, Homo sapiens
aaaacauuccccaa

SEQ ID NO: 901996 - RNA, 20 nt, Homo sapiens
aaaacauugugccaugucaa

SEQ ID NO: 901997 - RNA, 14 nt, Homo sapiens
aaaacauuuguaca

SEQ ID NO: 901998 - RNA, 13 nt, Homo sapiens
aaaacauuuuacu

SEQ ID NO: 901999 - RNA, 22 nt, Homo sapiens
aaaaccaaaagaacaagaauuu

SEQ ID NO: 902000 - RNA, 11 nt, Homo sapiens
aaaaccaauga

SEQ ID NO: 902001 - RNA, 17 nt, Homo sapiens
aaaaccacuagaacucu

SEQ ID NO: 902002 - RNA, 18 nt, Homo sapiens
aaaaccccaucucuacua

SEQ ID NO: 902003 - RNA, 13 nt, Homo sapiens
aaaaccuccagua

SEQ ID NO: 902004 - RNA, 14 nt, Homo sapiens
aaaaccuuacuuaa

SEQ ID NO: 902005 - RNA, 16 nt, Homo sapiens
aaaaccuugauuuaaa

SEQ ID NO: 902006 - RNA, 22 nt, Homo sapiens
aaaaccuugauuuaaaauauca

SEQ ID NO: 902007 - RNA, 18 nt, Homo sapiens
aaaaccuuucaaauuuca

SEQ ID NO: 902008 - RNA, 14 nt, Homo sapiens
aaaacuaauaauca

SEQ ID NO: 902009 - RNA, 15 nt, Homo sapiens
aaaacuauauucuca

SEQ ID NO: 902010 - RNA, 18 nt, Homo sapiens
aaaacucuucuacuuuca

SEQ ID NO: 902011 - RNA, 11 nt, Homo sapiens
aaaacugagug

SEQ ID NO: 902012 - RNA, 21 nt, Homo sapiens
aaaagaagacaacauuucuca

SEQ ID NO: 902013 - RNA, 19 nt, Homo sapiens
aaaagaaguguuccuucau

SEQ ID NO: 902014 - RNA, 16 nt, Homo sapiens
aaaagaauacagaaag

SEQ ID NO: 902015 - RNA, 21 nt, Homo sapiens
aaaagacagcacuacagauau

SEQ ID NO: 902016 - RNA, 15 nt, Homo sapiens
aaaagagagaucuug

SEQ ID NO: 902017 - RNA, 16 nt, Homo sapiens
aaaagauaacaagauc

SEQ ID NO: 902018 - RNA, 13 nt, Homo sapiens
aaaagcaccugcc

SEQ ID NO: 902019 - RNA, 11 nt, Homo sapiens
aaaagcacuua

SEQ ID NO: 902020 - RNA, 10 nt, Homo sapiens
aaaagcuuuu

SEQ ID NO: 902021 - RNA, 18 nt, Homo sapiens
aaaagggaaguugugccu

SEQ ID NO: 902022 - RNA, 22 nt, Homo sapiens
aaaagguagcuuaccugacaca

SEQ ID NO: 902023 - RNA, 22 nt, Homo sapiens
aaaaguaaguaccacucaggcc

SEQ ID NO: 902024 - RNA, 18 nt, Homo sapiens
aaaagucacacagacaca

SEQ ID NO: 902025 - RNA, 14 nt, Homo sapiens
aaaagucagucuua

SEQ ID NO: 902026 - RNA, 21 nt, Homo sapiens
aaaaguggcuaauucaauuua

SEQ ID NO: 902027 - RNA, 16 nt, Homo sapiens
aaaagugugagcagug

SEQ ID NO: 902028 - RNA, 19 nt, Homo sapiens
aaaaguuacauguuugcac

SEQ ID NO: 902029 - RNA, 13 nt, Homo sapiens
aaaaguuacuuau

SEQ ID NO: 902030 - RNA, 16 nt, Homo sapiens
aaaaguugcagucuca

SEQ ID NO: 902031 - RNA, 16 nt, Homo sapiens
aaaauaagaaaauaac

SEQ ID NO: 902032 - RNA, 16 nt, Homo sapiens
aaaauaaguauuucca

SEQ ID NO: 902033 - RNA, 17 nt, Homo sapiens
aaaauaauagauaauua

SEQ ID NO: 902034 - RNA, 13 nt, Homo sapiens
aaaauacaauuca

SEQ ID NO: 902035 - RNA, 14 nt, Homo sapiens
aaaauaccaugcca

SEQ ID NO: 902036 - RNA, 19 nt, Homo sapiens
aaaauagaauguuacuuug

SEQ ID NO: 902037 - RNA, 22 nt, Homo sapiens
aaagccaggguccugaguggcu

SEQ ID NO: 902038 - RNA, 14 nt, Homo sapiens
aaagcccauccuug

SEQ ID NO: 902039 - RNA, 21 nt, Homo sapiens
aaagccccuggaaaugugcua

SEQ ID NO: 902040 - RNA, 15 nt, Homo sapiens
aaagcccuuccaugu

SEQ ID NO: 902041 - RNA, 15 nt, Homo sapiens
aaagcccuugaacca

SEQ ID NO: 902042 - RNA, 14 nt, Homo sapiens
aaagcgagauccca

SEQ ID NO: 902043 - RNA, 20 nt, Homo sapiens
aaagcgagaucccaucucua

SEQ ID NO: 902044 - RNA, 12 nt, Homo sapiens
aaagcuaccugu

SEQ ID NO: 902045 - RNA, 20 nt, Homo sapiens
aaagcucuauuaagauuucc

SEQ ID NO: 902046 - RNA, 17 nt, Homo sapiens
aaagcucugaacaaaag

SEQ ID NO: 902047 - RNA, 13 nt, Homo sapiens
aaagcugccugua

SEQ ID NO: 902048 - RNA, 17 nt, Homo sapiens
aaagcugcugacagugu

SEQ ID NO: 902049 - RNA, 18 nt, Homo sapiens
aaagcugugcacuugcag

SEQ ID NO: 902050 - RNA, 21 nt, Homo sapiens
aaagcuguguguuuggaagac

SEQ ID NO: 902051 - RNA, 23 nt, Homo sapiens
aaagcuguuuauuuauucacugu

SEQ ID NO: 902052 - RNA, 22 nt, Homo sapiens
aaagcuguuuuuauuagcagua

SEQ ID NO: 902053 - RNA, 23 nt, Homo sapiens
aaagcuugucugaucguucaaag

SEQ ID NO: 902054 - RNA, 14 nt, Homo sapiens
aaaggaacacugga

SEQ ID NO: 902055 - RNA, 16 nt, Homo sapiens
aaaggaagacuugaag

SEQ ID NO: 902056 - RNA, 19 nt, Homo sapiens
aaaggaagcuccacuguca

SEQ ID NO: 902057 - RNA, 21 nt, Homo sapiens
aaaggaagcuccacugucacc

SEQ ID NO: 902058 - RNA, 22 nt, Homo sapiens
aaaggaccugcauuuuccuaca

SEQ ID NO: 902059 - RNA, 18 nt, Homo sapiens
aaaggagaacuauccaaa

SEQ ID NO: 902060 - RNA, 13 nt, Homo sapiens
aaaggaggggaua

SEQ ID NO: 902061 - RNA, 13 nt, Homo sapiens
aaaggcauaugca

SEQ ID NO: 902062 - RNA, 14 nt, Homo sapiens
aaaggcccucugcu

SEQ ID NO: 902063 - RNA, 18 nt, Homo sapiens
aaagggugcccacaaaau

SEQ ID NO: 902064 - RNA, 22 nt, Homo sapiens
aaaggugugucaaagauuuuac

SEQ ID NO: 902065 - RNA, 18 nt, Homo sapiens
aaagguucuucaucccuu

SEQ ID NO: 902066 - RNA, 16 nt, Homo sapiens
aaagguugaagcacca

SEQ ID NO: 902067 - RNA, 20 nt, Homo sapiens
aaagguuuggauuucuccaa

SEQ ID NO: 902068 - RNA, 16 nt, Homo sapiens
aaaguaaugcuucaau

SEQ ID NO: 902069 - RNA, 16 nt, Homo sapiens
aaaguacaaccugaau

SEQ ID NO: 902070 - RNA, 13 nt, Homo sapiens
aaaguacauaaca

SEQ ID NO: 902071 - RNA, 13 nt, Homo sapiens
aaaguacauguau

SEQ ID NO: 902072 - RNA, 14 nt, Homo sapiens
aaaguacuucucca

SEQ ID NO: 902073 - RNA, 19 nt, Homo sapiens
aaaguagguuuacauucau

SEQ ID NO: 902074 - RNA, 21 nt, Homo sapiens
aaagucaccacuccauuccca

SEQ ID NO: 902075 - RNA, 19 nt, Homo sapiens
aaagucagggagccuggaa

SEQ ID NO: 902076 - RNA, 14 nt, Homo sapiens
aaagugaacuugau

SEQ ID NO: 902077 - RNA, 22 nt, Homo sapiens
cagaaucccggcugucaagggg

SEQ ID NO: 902078 - RNA, 15 nt, Homo sapiens
cagaauguacggaaa

SEQ ID NO: 902079 - RNA, 17 nt, Homo sapiens
cagaauucuaagcuggu

SEQ ID NO: 902080 - RNA, 21 nt, Homo sapiens
cagaauuggccucaguguagu

SEQ ID NO: 902081 - RNA, 16 nt, Homo sapiens
cagaauugugcaaaug

SEQ ID NO: 902082 - RNA, 17 nt, Homo sapiens
cagacaaaguaauuccu

SEQ ID NO: 902083 - RNA, 16 nt, Homo sapiens
cagacaaguaaucacu

SEQ ID NO: 902084 - RNA, 14 nt, Homo sapiens
cagacaauccacuc

SEQ ID NO: 902085 - RNA, 12 nt, Homo sapiens
cagacacauucu

SEQ ID NO: 902086 - RNA, 16 nt, Homo sapiens
cagacacuaaguuaua

SEQ ID NO: 902087 - RNA, 15 nt, Homo sapiens
cagacagauugcuga

SEQ ID NO: 902088 - RNA, 22 nt, Homo sapiens
cagacaggaggaaucaugucag

SEQ ID NO: 902089 - RNA, 16 nt, Homo sapiens
cagacaggcucagguu

SEQ ID NO: 902090 - RNA, 17 nt, Homo sapiens
cagacauguggugggac

SEQ ID NO: 902091 - RNA, 13 nt, Homo sapiens
cagaccaccugcc

SEQ ID NO: 902092 - RNA, 24 nt, Homo sapiens
cagaccaccugccagccaucacaa

SEQ ID NO: 902093 - RNA, 14 nt, Homo sapiens
cagaccaguacugg

SEQ ID NO: 902094 - RNA, 16 nt, Homo sapiens
cagaccaguacuggga

SEQ ID NO: 902095 - RNA, 17 nt, Homo sapiens
cagaccauugucuucca

SEQ ID NO: 902096 - RNA, 17 nt, Homo sapiens
cagaccucuacaagcaa

SEQ ID NO: 902097 - RNA, 19 nt, Homo sapiens
cagacgucucaagacugaa

SEQ ID NO: 902098 - RNA, 16 nt, Homo sapiens
cagacuacagccagaa

SEQ ID NO: 902099 - RNA, 18 nt, Homo sapiens
cagacucaauaaaaucau

SEQ ID NO: 902100 - RNA, 16 nt, Homo sapiens
cagacucacuguggga

SEQ ID NO: 902101 - RNA, 16 nt, Homo sapiens
cagacucccgcgugaa

SEQ ID NO: 902102 - RNA, 15 nt, Homo sapiens
cagacuccugugcaa

SEQ ID NO: 902103 - RNA, 18 nt, Homo sapiens
cagacuguaggauuugaa

SEQ ID NO: 902104 - RNA, 16 nt, Homo sapiens
cagacuguggcugcag

SEQ ID NO: 902105 - RNA, 17 nt, Homo sapiens
cagacuuucuacaccug

SEQ ID NO: 902106 - RNA, 18 nt, Homo sapiens
cagagaaagaaagggaaa

SEQ ID NO: 902107 - RNA, 17 nt, Homo sapiens
cagagaaagaagagaca

SEQ ID NO: 902108 - RNA, 20 nt, Homo sapiens
cagagaacuggaaagacaua

SEQ ID NO: 902109 - RNA, 21 nt, Homo sapiens
cagagaaguucuggcugaaca

SEQ ID NO: 902110 - RNA, 18 nt, Homo sapiens
cagagaauauauacauuc

SEQ ID NO: 902111 - RNA, 19 nt, Homo sapiens
cagagacaggcccaagaga

SEQ ID NO: 902112 - RNA, 20 nt, Homo sapiens
cagagaccccaggaucccag

SEQ ID NO: 902113 - RNA, 21 nt, Homo sapiens
cagagaccccaggaucccaga

SEQ ID NO: 902114 - RNA, 20 nt, Homo sapiens
cagagacuaucugauuuccu

SEQ ID NO: 902115 - RNA, 20 nt, Homo sapiens
cagagaggccuuuuguuuaa

SEQ ID NO: 902116 - RNA, 22 nt, Homo sapiens
cagagaggcugcucugccauac

SEQ ID NO: 902117 - RNA, 13 nt, Homo sapiens
cagagagggccca

SEQ ID NO: 902118 - RNA, 20 nt, Homo sapiens
cagagaggggacauuucccu

SEQ ID NO: 902119 - RNA, 18 nt, Homo sapiens
cagagaugaaacuauggc

SEQ ID NO: 902120 - RNA, 23 nt, Homo sapiens
cagagauggaggccgagccaaua

SEQ ID NO: 902121 - RNA, 23 nt, Homo sapiens
cagagaugggcaaagcugugcac

SEQ ID NO: 902122 - RNA, 20 nt, Homo sapiens
cagagcaagacucugucuca

SEQ ID NO: 902123 - RNA, 19 nt, Homo sapiens
cagagcacugcuccagugg

SEQ ID NO: 902124 - RNA, 14 nt, Homo sapiens
cagagcagaaccaa

SEQ ID NO: 902125 - RNA, 17 nt, Homo sapiens
cagagcaggaaugggaa

SEQ ID NO: 902126 - RNA, 18 nt, Homo sapiens
cagagcccaagugccauc

SEQ ID NO: 902127 - RNA, 20 nt, Homo sapiens
cagagcccagggcaucccau

SEQ ID NO: 902128 - RNA, 15 nt, Homo sapiens
cagagccccacuccc

SEQ ID NO: 902129 - RNA, 22 nt, Homo sapiens
aaaggcauaagacccuaagccu

SEQ ID NO: 902130 - RNA, 16 nt, Homo sapiens
aaaggccucaucuccu

SEQ ID NO: 902131 - RNA, 17 nt, Homo sapiens
aaagggagcacuggguu

SEQ ID NO: 902132 - RNA, 10 nt, Homo sapiens
aaagggaugg

SEQ ID NO: 902133 - RNA, 23 nt, Homo sapiens
aaagguauuaaauugauguugcu

SEQ ID NO: 902134 - RNA, 14 nt, Homo sapiens
aaaggucauugugg

SEQ ID NO: 902135 - RNA, 16 nt, Homo sapiens
aaagguuacccuguaa

SEQ ID NO: 902136 - RNA, 13 nt, Homo sapiens
aaagguucuucau

SEQ ID NO: 902137 - RNA, 14 nt, Homo sapiens
aaagguugacucaa

SEQ ID NO: 902138 - RNA, 19 nt, Homo sapiens
aaagguuucaagacuugau

SEQ ID NO: 902139 - RNA, 21 nt, Homo sapiens
aaaguaaaggccucaucuccu

SEQ ID NO: 902140 - RNA, 15 nt, Homo sapiens
aaaguacagaugcag

SEQ ID NO: 902141 - RNA, 18 nt, Homo sapiens
aaaguacccugugcucaa

SEQ ID NO: 902142 - RNA, 12 nt, Homo sapiens
aaaguaucuaca

SEQ ID NO: 902143 - RNA, 12 nt, Homo sapiens
aaagucagucuu

SEQ ID NO: 902144 - RNA, 21 nt, Homo sapiens
aaagucuggcuaugcucacag

SEQ ID NO: 902145 - RNA, 19 nt, Homo sapiens
aaagugaucaguaugcugu

SEQ ID NO: 902146 - RNA, 20 nt, Homo sapiens
aaagugccagaaaguguuua

SEQ ID NO: 902147 - RNA, 12 nt, Homo sapiens
aaagugcugcug

SEQ ID NO: 902148 - RNA, 21 nt, Homo sapiens
aaaguggcucuucuaaccuca

SEQ ID NO: 902149 - RNA, 17 nt, Homo sapiens
aaaguggggaguaguca

SEQ ID NO: 902150 - RNA, 17 nt, Homo sapiens
aaagugguucuggauau

SEQ ID NO: 902151 - RNA, 17 nt, Homo sapiens
aaaguguaauaauauga

SEQ ID NO: 902152 - RNA, 13 nt, Homo sapiens
aaaguguggaagc

SEQ ID NO: 902153 - RNA, 17 nt, Homo sapiens
aaaguguugaccacaga

SEQ ID NO: 902154 - RNA, 18 nt, Homo sapiens
aaaguuagguuauaagaa

SEQ ID NO: 902155 - RNA, 20 nt, Homo sapiens
aaaguuauauuuacuuuaaa

SEQ ID NO: 902156 - RNA, 22 nt, Homo sapiens
aaaguuguaguucuugugcaug

SEQ ID NO: 902157 - RNA, 23 nt, Homo sapiens
aaaguuguucgccgcguggaaug

SEQ ID NO: 902158 - RNA, 14 nt, Homo sapiens
aaaguuucagagaa

SEQ ID NO: 902159 - RNA, 17 nt, Homo sapiens
aaaguuucucuuuucaa

SEQ ID NO: 902160 - RNA, 13 nt, Homo sapiens
aaauaaaaauucc

SEQ ID NO: 902161 - RNA, 14 nt, Homo sapiens
aaauaaaagcacuu

SEQ ID NO: 902162 - RNA, 15 nt, Homo sapiens
aaauaaaagcacuua

SEQ ID NO: 902163 - RNA, 12 nt, Homo sapiens
aaauaaaagccu

SEQ ID NO: 902164 - RNA, 13 nt, Homo sapiens
aaauaaaguacca

SEQ ID NO: 902165 - RNA, 14 nt, Homo sapiens
aaauaaauagauuu

SEQ ID NO: 902166 - RNA, 16 nt, Homo sapiens
aaauaaauguguaaau

SEQ ID NO: 902167 - RNA, 11 nt, Homo sapiens
aaauaaauuca

SEQ ID NO: 902168 - RNA, 12 nt, Homo sapiens
aaauaaauucaa

SEQ ID NO: 902169 - RNA, 13 nt, Homo sapiens
aaauaauacagga

SEQ ID NO: 902170 - RNA, 13 nt, Homo sapiens
aaauaaugaacag

SEQ ID NO: 902171 - RNA, 14 nt, Homo sapiens
aaauacacaacaca

SEQ ID NO: 902172 - RNA, 23 nt, Homo sapiens
aaauacacagaugauaauaugcu

SEQ ID NO: 902173 - RNA, 20 nt, Homo sapiens
aaauacacuuccugcuuaaa

SEQ ID NO: 902174 - RNA, 19 nt, Homo sapiens
aaauacccacuaacaaaga

SEQ ID NO: 902175 - RNA, 16 nt, Homo sapiens
aaauaccucauucgcc

SEQ ID NO: 902176 - RNA, 18 nt, Homo sapiens
aaauagacaacucuucca

SEQ ID NO: 902177 - RNA, 15 nt, Homo sapiens
aaauagagaauccca

SEQ ID NO: 902178 - RNA, 14 nt, Homo sapiens
aaauagcauucucu

SEQ ID NO: 902179 - RNA, 23 nt, Homo sapiens
aaauagcccuuggaucaguaugg

SEQ ID NO: 902180 - RNA, 19 nt, Homo sapiens
aaauaguaagccucccucc

SEQ ID NO: 902181 - RNA, 14 nt, Homo sapiens
aaauagucuaucaa

SEQ ID NO: 902182 - RNA, 16 nt, Homo sapiens
aaauauaaacuugugu

SEQ ID NO: 902183 - RNA, 23 nt, Homo sapiens
aaauauauaaugguuuacugcug

SEQ ID NO: 902184 - RNA, 17 nt, Homo sapiens
aaauauauagcuugaaa

SEQ ID NO: 902185 - RNA, 19 nt, Homo sapiens
aaauauauauagugcuaua

SEQ ID NO: 902186 - RNA, 14 nt, Homo sapiens
aaauauauuucaga

SEQ ID NO: 902187 - RNA, 17 nt, Homo sapiens
aaauaucacaucacuua

SEQ ID NO: 902188 - RNA, 16 nt, Homo sapiens
aaauaugaaagacuua

SEQ ID NO: 902189 - RNA, 22 nt, Homo sapiens
aaauaugcaccaaaucaucucu

SEQ ID NO: 902190 - RNA, 19 nt, Homo sapiens
aaauauguugaguguucau

SEQ ID NO: 902191 - RNA, 20 nt, Homo sapiens
aaauauuauugguguuuacc

SEQ ID NO: 902192 - RNA, 23 nt, Homo sapiens
ccgaagagcccugagcucaggcu

SEQ ID NO: 902193 - RNA, 12 nt, Homo sapiens
ccgaagcccagu

SEQ ID NO: 902194 - RNA, 13 nt, Homo sapiens
ccgaagcccaguu

SEQ ID NO: 902195 - RNA, 16 nt, Homo sapiens
ccgaaguaugagggaa

SEQ ID NO: 902196 - RNA, 18 nt, Homo sapiens
ccgaauuuagucacacca

SEQ ID NO: 902197 - RNA, 14 nt, Homo sapiens
ccgaccccaucuca

SEQ ID NO: 902198 - RNA, 23 nt, Homo sapiens
ccgacggauuccuuuaugaguca

SEQ ID NO: 902199 - RNA, 16 nt, Homo sapiens
ccgagugagguguaca

SEQ ID NO: 902200 - RNA, 18 nt, Homo sapiens
ccgauguacacacacaga

SEQ ID NO: 902201 - RNA, 16 nt, Homo sapiens
ccgcaccuugucaugu

SEQ ID NO: 902202 - RNA, 17 nt, Homo sapiens
ccgcagcacccugcaga

SEQ ID NO: 902203 - RNA, 12 nt, Homo sapiens
ccgccuggagau

SEQ ID NO: 902204 - RNA, 18 nt, Homo sapiens
ccggaagaaaaagagcca

SEQ ID NO: 902205 - RNA, 17 nt, Homo sapiens
ccggagagacagugaca

SEQ ID NO: 902206 - RNA, 18 nt, Homo sapiens
ccggcaccuacaucccca

SEQ ID NO: 902207 - RNA, 14 nt, Homo sapiens
ccggcuccugucau

SEQ ID NO: 902208 - RNA, 15 nt, Homo sapiens
ccggcugacaccugg

SEQ ID NO: 902209 - RNA, 15 nt, Homo sapiens
ccgggccacuccuuc

SEQ ID NO: 902210 - RNA, 13 nt, Homo sapiens
ccggugaagugca

SEQ ID NO: 902211 - RNA, 16 nt, Homo sapiens
ccgucaaaagagucuu

SEQ ID NO: 902212 - RNA, 23 nt, Homo sapiens
ccgucagccaaauguaauugaau

SEQ ID NO: 902213 - RNA, 21 nt, Homo sapiens
ccgugagugaaccaucauuau

SEQ ID NO: 902214 - RNA, 16 nt, Homo sapiens
ccgugcaguacaggca

SEQ ID NO: 902215 - RNA, 19 nt, Homo sapiens
ccguuuuaaggacauuaaa

SEQ ID NO: 902216 - RNA, 15 nt, Homo sapiens
ccuaaaauacaaaca

SEQ ID NO: 902217 - RNA, 19 nt, Homo sapiens
ccuaaauaauguuaucugu

SEQ ID NO: 902218 - RNA, 14 nt, Homo sapiens
ccuaaaugaccuca

SEQ ID NO: 902219 - RNA, 21 nt, Homo sapiens
ccuaaauguggacaucaugaa

SEQ ID NO: 902220 - RNA, 16 nt, Homo sapiens
ccuaaccaaaugcugu

SEQ ID NO: 902221 - RNA, 15 nt, Homo sapiens
ccuaaccucauuccc

SEQ ID NO: 902222 - RNA, 14 nt, Homo sapiens
ccuaagaaaaucau

SEQ ID NO: 902223 - RNA, 16 nt, Homo sapiens
ccuaagaggcagugag

SEQ ID NO: 902224 - RNA, 22 nt, Homo sapiens
ccuaagcaacagaaauaaucug

SEQ ID NO: 902225 - RNA, 18 nt, Homo sapiens
ccuaaggaucucucagga

SEQ ID NO: 902226 - RNA, 20 nt, Homo sapiens
ccuaaguauaaaugguuguc

SEQ ID NO: 902227 - RNA, 14 nt, Homo sapiens
ccuaauaaacaauu

SEQ ID NO: 902228 - RNA, 20 nt, Homo sapiens
ccuaaucaggcugagguguc

SEQ ID NO: 902229 - RNA, 12 nt, Homo sapiens
ccuaaugaaguu

SEQ ID NO: 902230 - RNA, 15 nt, Homo sapiens
ccuacaaaauggagg

SEQ ID NO: 902231 - RNA, 18 nt, Homo sapiens
ccuacaaaauggagggag

SEQ ID NO: 902232 - RNA, 16 nt, Homo sapiens
ccuacaguggcuguca

SEQ ID NO: 902233 - RNA, 13 nt, Homo sapiens
ccuacccccugaa

SEQ ID NO: 902234 - RNA, 19 nt, Homo sapiens
ccuacucuauguaugcauc

SEQ ID NO: 902235 - RNA, 14 nt, Homo sapiens
ccuacucuguguca

SEQ ID NO: 902236 - RNA, 18 nt, Homo sapiens
ccuacugccucuccagca

SEQ ID NO: 902237 - RNA, 19 nt, Homo sapiens
ccuacuuccugcacugacc

SEQ ID NO: 902238 - RNA, 13 nt, Homo sapiens
ccuacuuuagcca

SEQ ID NO: 902239 - RNA, 23 nt, Homo sapiens
ccuacuuuauguauggagcucua

SEQ ID NO: 902240 - RNA, 16 nt, Homo sapiens
ccuagaacugugccua

SEQ ID NO: 902241 - RNA, 15 nt, Homo sapiens
ccuagagcacacugu

SEQ ID NO: 902242 - RNA, 21 nt, Homo sapiens
ccuagcauagguaugagccag

SEQ ID NO: 902243 - RNA, 22 nt, Homo sapiens
ccuagcaucucaugagugccaa

SEQ ID NO: 902244 - RNA, 15 nt, Homo sapiens
ccuagccgaccucag

SEQ ID NO: 902245 - RNA, 21 nt, Homo sapiens
ccuagcuaccuucucuaccca

SEQ ID NO: 902246 - RNA, 12 nt, Homo sapiens
ccuagugcuguu

SEQ ID NO: 902247 - RNA, 12 nt, Homo sapiens
ccuauaccauau

SEQ ID NO: 902248 - RNA, 22 nt, Homo sapiens
ccuauaugaauaugagaucuga

SEQ ID NO: 902249 - RNA, 16 nt, Homo sapiens
ccuauuaaaacacagc

SEQ ID NO: 902250 - RNA, 22 nt, Homo sapiens
acacuuguuucuuguucaucca

SEQ ID NO: 902251 - RNA, 19 nt, Homo sapiens
acagaaauacugcucugaa

SEQ ID NO: 902252 - RNA, 13 nt, Homo sapiens
acagaacuaugga

SEQ ID NO: 902253 - RNA, 19 nt, Homo sapiens
acagaacugcuaaauacug

SEQ ID NO: 902254 - RNA, 23 nt, Homo sapiens
acagaacugcuaaauacuguaca

SEQ ID NO: 902255 - RNA, 18 nt, Homo sapiens
acagaagaucuauauugu

SEQ ID NO: 902256 - RNA, 16 nt, Homo sapiens
acagaagccaggagca

SEQ ID NO: 902257 - RNA, 23 nt, Homo sapiens
acagaagcuucugcccaccuacu

SEQ ID NO: 902258 - RNA, 20 nt, Homo sapiens
acagaccuaggauuucauga

SEQ ID NO: 902259 - RNA, 19 nt, Homo sapiens
acagacgucucaagacuga

SEQ ID NO: 902260 - RNA, 16 nt, Homo sapiens
acagacuggaagcaca

SEQ ID NO: 902261 - RNA, 17 nt, Homo sapiens
acagacuucuccagacc

SEQ ID NO: 902262 - RNA, 17 nt, Homo sapiens
acagagacaggcccaag

SEQ ID NO: 902263 - RNA, 15 nt, Homo sapiens
acagagacucuggaa

SEQ ID NO: 902264 - RNA, 16 nt, Homo sapiens
acagagauaugcacac

SEQ ID NO: 902265 - RNA, 22 nt, Homo sapiens
acagagcacuagguucaauucc

SEQ ID NO: 902266 - RNA, 16 nt, Homo sapiens
acagagcccugugagg

SEQ ID NO: 902267 - RNA, 18 nt, Homo sapiens
acagagcgggccucuucc

SEQ ID NO: 902268 - RNA, 22 nt, Homo sapiens
acagaggagagaggcucagcca

SEQ ID NO: 902269 - RNA, 19 nt, Homo sapiens
acagaggauuguauugcaa

SEQ ID NO: 902270 - RNA, 20 nt, Homo sapiens
acagagguggcugcugugcu

SEQ ID NO: 902271 - RNA, 21 nt, Homo sapiens
acagaguaaauagcauucucu

SEQ ID NO: 902272 - RNA, 17 nt, Homo sapiens
acagauagucaaaccau

SEQ ID NO: 902273 - RNA, 14 nt, Homo sapiens
acagauaugcacac

SEQ ID NO: 902274 - RNA, 22 nt, Homo sapiens
acagauaugcacacacauggau

SEQ ID NO: 902275 - RNA, 14 nt, Homo sapiens
acagcaaaacucca

SEQ ID NO: 902276 - RNA, 18 nt, Homo sapiens
acagcaaaacuccaucuc

SEQ ID NO: 902277 - RNA, 20 nt, Homo sapiens
acagcaagggugaugggaaa

SEQ ID NO: 902278 - RNA, 18 nt, Homo sapiens
acagcacccaggcuccau

SEQ ID NO: 902279 - RNA, 18 nt, Homo sapiens
acagcacuuggcuccuua

SEQ ID NO: 902280 - RNA, 18 nt, Homo sapiens
acagcagcugaacagcca

SEQ ID NO: 902281 - RNA, 20 nt, Homo sapiens
acagcagcugaacagccaaa

SEQ ID NO: 902282 - RNA, 12 nt, Homo sapiens
acagcagguggg

SEQ ID NO: 902283 - RNA, 13 nt, Homo sapiens
acagcagugcaua

SEQ ID NO: 902284 - RNA, 20 nt, Homo sapiens
acagcaguggagaguguucc

SEQ ID NO: 902285 - RNA, 18 nt, Homo sapiens
acagccaaaaaggaccaa

SEQ ID NO: 902286 - RNA, 18 nt, Homo sapiens
acagcccauaaagcaaga

SEQ ID NO: 902287 - RNA, 20 nt, Homo sapiens
acagccgcuccugucugcca

SEQ ID NO: 902288 - RNA, 14 nt, Homo sapiens
acagccuggcacag

SEQ ID NO: 902289 - RNA, 14 nt, Homo sapiens
acagcuaugaaggc

SEQ ID NO: 902290 - RNA, 21 nt, Homo sapiens
acagcucaagucuucccugau

SEQ ID NO: 902291 - RNA, 18 nt, Homo sapiens
acagcucuucuccaggcu

SEQ ID NO: 902292 - RNA, 19 nt, Homo sapiens
acagcugaacaguguuaau

SEQ ID NO: 902293 - RNA, 22 nt, Homo sapiens
acagcugaacaguguuaauaau

SEQ ID NO: 902294 - RNA, 21 nt, Homo sapiens
acagcugccugugugggacug

SEQ ID NO: 902295 - RNA, 15 nt, Homo sapiens
acaggaaaccacuua

SEQ ID NO: 902296 - RNA, 15 nt, Homo sapiens
acaggaacuaggaua

SEQ ID NO: 902297 - RNA, 21 nt, Homo sapiens
acaggaauacuuaacucaaua

SEQ ID NO: 902298 - RNA, 18 nt, Homo sapiens
acaggacuaacacucaga

SEQ ID NO: 902299 - RNA, 18 nt, Homo sapiens
acaggaggaaucauguca

SEQ ID NO: 902300 - RNA, 22 nt, Homo sapiens
acaggagguuguggaugcucca

SEQ ID NO: 902301 - RNA, 14 nt, Homo sapiens
acaggcaagugaag

SEQ ID NO: 902302 - RNA, 17 nt, Homo sapiens
acaggcaugcaccagug

SEQ ID NO: 902303 - RNA, 15 nt, Homo sapiens
acaggccauacuuua

SEQ ID NO: 902304 - RNA, 16 nt, Homo sapiens
acaggcccuuccucuc

SEQ ID NO: 902305 - RNA, 22 nt, Homo sapiens
acaggcccuuccucuccacugc

SEQ ID NO: 902306 - RNA, 19 nt, Homo sapiens
acaggcuguucugcacuga

SEQ ID NO: 902307 - RNA, 19 nt, Homo sapiens
acauuuguacauuccugau

SEQ ID NO: 902308 - RNA, 18 nt, Homo sapiens
acauuuucaauaauguga

SEQ ID NO: 902309 - RNA, 16 nt, Homo sapiens
accaaaaguuacaugu

SEQ ID NO: 902310 - RNA, 21 nt, Homo sapiens
accaaaauguauaaauguuau

SEQ ID NO: 902311 - RNA, 19 nt, Homo sapiens
accaaacucauucaccaaa

SEQ ID NO: 902312 - RNA, 14 nt, Homo sapiens
accaaagagacugg

SEQ ID NO: 902313 - RNA, 21 nt, Homo sapiens
accaaagagacuggagcaucu

SEQ ID NO: 902314 - RNA, 19 nt, Homo sapiens
accaaagccaccaagacag

SEQ ID NO: 902315 - RNA, 20 nt, Homo sapiens
accaaagggaaaacucuuca

SEQ ID NO: 902316 - RNA, 23 nt, Homo sapiens
accaaaucuucuccuaugcauuu

SEQ ID NO: 902317 - RNA, 16 nt, Homo sapiens
accaaaugacaaguca

SEQ ID NO: 902318 - RNA, 13 nt, Homo sapiens
accaaaugcuguc

SEQ ID NO: 902319 - RNA, 12 nt, Homo sapiens
accaaauugcuu

SEQ ID NO: 902320 - RNA, 14 nt, Homo sapiens
accaaauugcuucu

SEQ ID NO: 902321 - RNA, 14 nt, Homo sapiens
accaacauggagaa

SEQ ID NO: 902322 - RNA, 21 nt, Homo sapiens
accaacccuguuuccugaguu

SEQ ID NO: 902323 - RNA, 16 nt, Homo sapiens
accaagaguauuccau

SEQ ID NO: 902324 - RNA, 14 nt, Homo sapiens
accaaggcagccuc

SEQ ID NO: 902325 - RNA, 21 nt, Homo sapiens
accaaggcgggagcaucucuu

SEQ ID NO: 902326 - RNA, 14 nt, Homo sapiens
accaaguccuggga

SEQ ID NO: 902327 - RNA, 22 nt, Homo sapiens
accaagucuacuucacuaauga

SEQ ID NO: 902328 - RNA, 17 nt, Homo sapiens
accaaguguguugggaa

SEQ ID NO: 902329 - RNA, 20 nt, Homo sapiens
accaaguucuggaaaccacg

SEQ ID NO: 902330 - RNA, 14 nt, Homo sapiens
accaauaacuucag

SEQ ID NO: 902331 - RNA, 13 nt, Homo sapiens
accaauaccuccu

SEQ ID NO: 902332 - RNA, 15 nt, Homo sapiens
accaauacuacugua

SEQ ID NO: 902333 - RNA, 14 nt, Homo sapiens
accaaucucuguga

SEQ ID NO: 902334 - RNA, 19 nt, Homo sapiens
accaauguacccaccgggc

SEQ ID NO: 902335 - RNA, 19 nt, Homo sapiens
accaauuguacauucccug

SEQ ID NO: 902336 - RNA, 20 nt, Homo sapiens
accacaaaaauugacucaaa

SEQ ID NO: 902337 - RNA, 13 nt, Homo sapiens
accacaacugaca

SEQ ID NO: 902338 - RNA, 21 nt, Homo sapiens
accacaacugacacaggaaac

SEQ ID NO: 902339 - RNA, 14 nt, Homo sapiens
accacacuucuuga

SEQ ID NO: 902340 - RNA, 23 nt, Homo sapiens
accacagcggaggagcuccgcua

SEQ ID NO: 902341 - RNA, 13 nt, Homo sapiens
accacagcugcag

SEQ ID NO: 902342 - RNA, 14 nt, Homo sapiens
accacaggcaucua

SEQ ID NO: 902343 - RNA, 19 nt, Homo sapiens
accacuaugcaauauauca

SEQ ID NO: 902344 - RNA, 20 nt, Homo sapiens
accacuauucuuaacuauuc

SEQ ID NO: 902345 - RNA, 15 nt, Homo sapiens
accacugagccugag

SEQ ID NO: 902346 - RNA, 23 nt, Homo sapiens
accacugguuaaaauaaagccua

SEQ ID NO: 902347 - RNA, 16 nt, Homo sapiens
accacuuugccucuga

SEQ ID NO: 902348 - RNA, 23 nt, Homo sapiens
accacuuuucaguucaguggcau

SEQ ID NO: 902349 - RNA, 16 nt, Homo sapiens
accagaauugugcaaa

SEQ ID NO: 902350 - RNA, 15 nt, Homo sapiens
accagagcaggaaag

SEQ ID NO: 902351 - RNA, 12 nt, Homo sapiens
accagaggucag

SEQ ID NO: 902352 - RNA, 16 nt, Homo sapiens
accagaggucaggugu

SEQ ID NO: 902353 - RNA, 18 nt, Homo sapiens
accagauauuugaaucuu

SEQ ID NO: 902354 - RNA, 14 nt, Homo sapiens
accagcagacacug

SEQ ID NO: 902355 - RNA, 16 nt, Homo sapiens
accagcagacacugcc

SEQ ID NO: 902356 - RNA, 19 nt, Homo sapiens
accagcuuguuugugaaac

SEQ ID NO: 902357 - RNA, 17 nt, Homo sapiens
accaggaucgcuuugua

SEQ ID NO: 902358 - RNA, 21 nt, Homo sapiens
accaggcaccaggcagggucu

SEQ ID NO: 902359 - RNA, 22 nt, Homo sapiens
accagguagaacacaaggucau

SEQ ID NO: 902360 - RNA, 15 nt, Homo sapiens
accaggucaucuccu

SEQ ID NO: 902361 - RNA, 14 nt, Homo sapiens
accaggucauucuu

SEQ ID NO: 902362 - RNA, 16 nt, Homo sapiens
accaguacucaguaua

SEQ ID NO: 902363 - RNA, 14 nt, Homo sapiens
accaguacugggaa

SEQ ID NO: 902364 - RNA, 16 nt, Homo sapiens
ccuggcacaggacuga

SEQ ID NO: 902365 - RNA, 13 nt, Homo sapiens
ccuggcaugucag

SEQ ID NO: 902366 - RNA, 14 nt, Homo sapiens
ccuggccucaagug

SEQ ID NO: 902367 - RNA, 14 nt, Homo sapiens
ccuggccucacugg

SEQ ID NO: 902368 - RNA, 18 nt, Homo sapiens
ccuggccuguggagagaa

SEQ ID NO: 902369 - RNA, 21 nt, Homo sapiens
ccuggccuuugaggcaaaggc

SEQ ID NO: 902370 - RNA, 16 nt, Homo sapiens
ccuggcucugcaaugg

SEQ ID NO: 902371 - RNA, 17 nt, Homo sapiens
ccuggcucugcaauggg

SEQ ID NO: 902372 - RNA, 16 nt, Homo sapiens
ccuggcuggcugaggg

SEQ ID NO: 902373 - RNA, 17 nt, Homo sapiens
ccugggaaaggacccac

SEQ ID NO: 902374 - RNA, 18 nt, Homo sapiens
ccugggaaccaugaagcu

SEQ ID NO: 902375 - RNA, 19 nt, Homo sapiens
ccugggaauuuacagagcc

SEQ ID NO: 902376 - RNA, 19 nt, Homo sapiens
ccugggaggcggagaguac

SEQ ID NO: 902377 - RNA, 23 nt, Homo sapiens
ccugggcugucugucaccagcua

SEQ ID NO: 902378 - RNA, 20 nt, Homo sapiens
ccugggcuugugaacaccuc

SEQ ID NO: 902379 - RNA, 21 nt, Homo sapiens
ccugggggcagugacuggcag

SEQ ID NO: 902380 - RNA, 15 nt, Homo sapiens
ccugggggccagcug

SEQ ID NO: 902381 - RNA, 15 nt, Homo sapiens
ccuggggguggcagg

SEQ ID NO: 902382 - RNA, 20 nt, Homo sapiens
ccuggggguggcaggcacac

SEQ ID NO: 902383 - RNA, 19 nt, Homo sapiens
ccuggucaacauggugaaa

SEQ ID NO: 902384 - RNA, 19 nt, Homo sapiens
ccuggucccuuggagacaa

SEQ ID NO: 902385 - RNA, 17 nt, Homo sapiens
ccugguggcaccagaug

SEQ ID NO: 902386 - RNA, 21 nt, Homo sapiens
ccugguuaaauuugaauuuca

SEQ ID NO: 902387 - RNA, 13 nt, Homo sapiens
ccuguaacacaag

SEQ ID NO: 902388 - RNA, 23 nt, Homo sapiens
ccuguaccacaaacacauuacau

SEQ ID NO: 902389 - RNA, 17 nt, Homo sapiens
ccuguagagucacugac

SEQ ID NO: 902390 - RNA, 23 nt, Homo sapiens
ccuguagcaaccuucugcauuca

SEQ ID NO: 902391 - RNA, 23 nt, Homo sapiens
ccuguccagcagguaguggguga

SEQ ID NO: 902392 - RNA, 15 nt, Homo sapiens
ccuguccauaaagua

SEQ ID NO: 902393 - RNA, 23 nt, Homo sapiens
ccugucccagagguuaucugccu

SEQ ID NO: 902394 - RNA, 17 nt, Homo sapiens
ccugucccccugagauc

SEQ ID NO: 902395 - RNA, 13 nt, Homo sapiens
ccuguccucaaaa

SEQ ID NO: 902396 - RNA, 17 nt, Homo sapiens
ccugucucuagccacuu

SEQ ID NO: 902397 - RNA, 22 nt, Homo sapiens
ccugucugccagccagcagcca

SEQ ID NO: 902398 - RNA, 16 nt, Homo sapiens
ccugucuuucagcauu

SEQ ID NO: 902399 - RNA, 18 nt, Homo sapiens
ccugucuuucagcauuca

SEQ ID NO: 902400 - RNA, 12 nt, Homo sapiens
ccugugagauaa

SEQ ID NO: 902401 - RNA, 22 nt, Homo sapiens
ccugugccaaccugaugccccu

SEQ ID NO: 902402 - RNA, 15 nt, Homo sapiens
ccugugccaccugca

SEQ ID NO: 902403 - RNA, 14 nt, Homo sapiens
ccugugcuaaagaa

SEQ ID NO: 902404 - RNA, 22 nt, Homo sapiens
ccugugcucuaagugaauacuu

SEQ ID NO: 902405 - RNA, 16 nt, Homo sapiens
ccugugcuggacuguu

SEQ ID NO: 902406 - RNA, 21 nt, Homo sapiens
ccuguggggccugauggugcu

SEQ ID NO: 902407 - RNA, 22 nt, Homo sapiens
ccugugugcugacaggagaccc

SEQ ID NO: 902408 - RNA, 16 nt, Homo sapiens
ccuguguuucaagcua

SEQ ID NO: 902409 - RNA, 17 nt, Homo sapiens
ccuguguuucuugccuc

SEQ ID NO: 902410 - RNA, 22 nt, Homo sapiens
ccuguuacuugaaauaccagug

SEQ ID NO: 902411 - RNA, 15 nt, Homo sapiens
ccuguugcaccucag

SEQ ID NO: 902412 - RNA, 18 nt, Homo sapiens
ccuguuguaacugcccaa

SEQ ID NO: 902413 - RNA, 20 nt, Homo sapiens
ccuguuuaaaaaaaguauau

SEQ ID NO: 902414 - RNA, 17 nt, Homo sapiens
ccuguuuagagaagccg

SEQ ID NO: 902415 - RNA, 19 nt, Homo sapiens
ccuguuuauauugguauaa

SEQ ID NO: 902416 - RNA, 16 nt, Homo sapiens
ccuguuuccauggguc

SEQ ID NO: 902417 - RNA, 23 nt, Homo sapiens
ccuuaaacucagggagcauuuau

SEQ ID NO: 902418 - RNA, 20 nt, Homo sapiens
ccuuaaccucucuaagccac

SEQ ID NO: 902419 - RNA, 20 nt, Homo sapiens
ccuuaacucaucuguuaucc

SEQ ID NO: 902420 - RNA, 19 nt, Homo sapiens
ccuuaagaggccuccacuc

SEQ ID NO: 902421 - RNA, 13 nt, Homo sapiens
ucaauaugugauu

SEQ ID NO: 902422 - RNA, 19 nt, Homo sapiens
ucaaucaucugugugaaaa

SEQ ID NO: 902423 - RNA, 19 nt, Homo sapiens
ucaaugaaaacugaaucaa

SEQ ID NO: 902424 - RNA, 14 nt, Homo sapiens
ucaaugaccuguau

SEQ ID NO: 902425 - RNA, 16 nt, Homo sapiens
ucaauuauuacauuua

SEQ ID NO: 902426 - RNA, 17 nt, Homo sapiens
ucaauucagugcuguac

SEQ ID NO: 902427 - RNA, 15 nt, Homo sapiens
ucaauuucaguguau

SEQ ID NO: 902428 - RNA, 17 nt, Homo sapiens
ucaauuucccugacucc

SEQ ID NO: 902429 - RNA, 22 nt, Homo sapiens
ucaauuucuggaaaacugccuu

SEQ ID NO: 902430 - RNA, 19 nt, Homo sapiens
ucaauuuucacuugcuuaa

SEQ ID NO: 902431 - RNA, 19 nt, Homo sapiens
ucaauuuuuauacauauca

SEQ ID NO: 902432 - RNA, 17 nt, Homo sapiens
ucaauuuuuugcuaaac

SEQ ID NO: 902433 - RNA, 16 nt, Homo sapiens
ucacaaaccaugcaaa

SEQ ID NO: 902434 - RNA, 16 nt, Homo sapiens
ucacaaacuacaaagc

SEQ ID NO: 902435 - RNA, 19 nt, Homo sapiens
ucacaaaucuuaacuugaa

SEQ ID NO: 902436 - RNA, 20 nt, Homo sapiens
ucacaacagaaaacccaaaa

SEQ ID NO: 902437 - RNA, 18 nt, Homo sapiens
ucacaacaggcauuccag

SEQ ID NO: 902438 - RNA, 17 nt, Homo sapiens
ucacaacauuuacuuaa

SEQ ID NO: 902439 - RNA, 16 nt, Homo sapiens
ucacaagaagaccaga

SEQ ID NO: 902440 - RNA, 18 nt, Homo sapiens
ucacacagggcucuuuga

SEQ ID NO: 902441 - RNA, 14 nt, Homo sapiens
ucacaccaccugac

SEQ ID NO: 902442 - RNA, 17 nt, Homo sapiens
ucacacgggaagaucau

SEQ ID NO: 902443 - RNA, 17 nt, Homo sapiens
ucacacucauaacucau

SEQ ID NO: 902444 - RNA, 21 nt, Homo sapiens
ucacauacaauuugcacuguu

SEQ ID NO: 902445 - RNA, 15 nt, Homo sapiens
ucacauagcacagaa

SEQ ID NO: 902446 - RNA, 23 nt, Homo sapiens
ucacaucacugauugggugccau

SEQ ID NO: 902447 - RNA, 17 nt, Homo sapiens
ucacauccaaugcauag

SEQ ID NO: 902448 - RNA, 19 nt, Homo sapiens
ucacaugcuuuguuuccau

SEQ ID NO: 902449 - RNA, 20 nt, Homo sapiens
ucacauggccuaugcacaua

SEQ ID NO: 902450 - RNA, 22 nt, Homo sapiens
ucacauggccuaugcacauaug

SEQ ID NO: 902451 - RNA, 18 nt, Homo sapiens
ucacauuaauauuugcug

SEQ ID NO: 902452 - RNA, 18 nt, Homo sapiens
ucacauuuauucugcuca

SEQ ID NO: 902453 - RNA, 10 nt, Homo sapiens
ucaccaaaau

SEQ ID NO: 902454 - RNA, 20 nt, Homo sapiens
ucaccaaaguauuaauguac

SEQ ID NO: 902455 - RNA, 18 nt, Homo sapiens
ucaccagaauugugcaaa

SEQ ID NO: 902456 - RNA, 19 nt, Homo sapiens
ucaccaggaucgcuuugua

SEQ ID NO: 902457 - RNA, 23 nt, Homo sapiens
ucaccaguuucugcggccuucca

SEQ ID NO: 902458 - RNA, 22 nt, Homo sapiens
ucacccacaucuaaugucucuu

SEQ ID NO: 902459 - RNA, 14 nt, Homo sapiens
ucaccccugcacuu

SEQ ID NO: 902460 - RNA, 22 nt, Homo sapiens
ucacccggaucccuccucacuu

SEQ ID NO: 902461 - RNA, 18 nt, Homo sapiens
ucacccucauaccaucug

SEQ ID NO: 902462 - RNA, 18 nt, Homo sapiens
ucaccgggcuacuaccug

SEQ ID NO: 902463 - RNA, 14 nt, Homo sapiens
ucaccgugagcagc

SEQ ID NO: 902464 - RNA, 13 nt, Homo sapiens
ucaccguggaccu

SEQ ID NO: 902465 - RNA, 12 nt, Homo sapiens
ucaccuugcuca

SEQ ID NO: 902466 - RNA, 20 nt, Homo sapiens
ucaccuuuuugacuuuucca

SEQ ID NO: 902467 - RNA, 19 nt, Homo sapiens
ucacgaaguuuguucauca

SEQ ID NO: 902468 - RNA, 20 nt, Homo sapiens
ucacguacaccauaugcaag

SEQ ID NO: 902469 - RNA, 20 nt, Homo sapiens
ucacgucgucuucuguauac

SEQ ID NO: 902470 - RNA, 17 nt, Homo sapiens
ucacuaauacuaauuca

SEQ ID NO: 902471 - RNA, 21 nt, Homo sapiens
ucacuacagacgauuaacaca

SEQ ID NO: 902472 - RNA, 13 nt, Homo sapiens
ucacuacagccuc

SEQ ID NO: 902473 - RNA, 16 nt, Homo sapiens
ucacuacaguacagug

SEQ ID NO: 902474 - RNA, 13 nt, Homo sapiens
ucacuagcagcug

SEQ ID NO: 902475 - RNA, 15 nt, Homo sapiens
ucacuauuacuugaa

SEQ ID NO: 902476 - RNA, 19 nt, Homo sapiens
ucacucacuuuucuuuauu

SEQ ID NO: 902477 - RNA, 11 nt, Homo sapiens
ucacucaggcu

SEQ ID NO: 902478 - RNA, 22 nt, Homo sapiens
accuggagaacuagaaccugga

SEQ ID NO: 902479 - RNA, 21 nt, Homo sapiens
accuggagagcuagaaccuag

SEQ ID NO: 902480 - RNA, 23 nt, Homo sapiens
accuggagggcuggaaucuggag

SEQ ID NO: 902481 - RNA, 21 nt, Homo sapiens
accuggaggggcuagaaccua

SEQ ID NO: 902482 - RNA, 18 nt, Homo sapiens
accuggccgccuccagga

SEQ ID NO: 902483 - RNA, 19 nt, Homo sapiens
accugguuccuguccucaa

SEQ ID NO: 902484 - RNA, 13 nt, Homo sapiens
accuguacucugg

SEQ ID NO: 902485 - RNA, 16 nt, Homo sapiens
accuguaguuuuacau

SEQ ID NO: 902486 - RNA, 18 nt, Homo sapiens
accuguccauaaaguaau

SEQ ID NO: 902487 - RNA, 17 nt, Homo sapiens
accugugcaccccauga

SEQ ID NO: 902488 - RNA, 20 nt, Homo sapiens
accuguguucuugcugagca

SEQ ID NO: 902489 - RNA, 21 nt, Homo sapiens
accuguguuucaagcuaccuu

SEQ ID NO: 902490 - RNA, 13 nt, Homo sapiens
accuguuacuuga

SEQ ID NO: 902491 - RNA, 20 nt, Homo sapiens
accuguuacuugaaauacca

SEQ ID NO: 902492 - RNA, 18 nt, Homo sapiens
accuuaccaacuuucugu

SEQ ID NO: 902493 - RNA, 14 nt, Homo sapiens
accuuagaaaucau

SEQ ID NO: 902494 - RNA, 22 nt, Homo sapiens
accuuauagguuacucauaagg

SEQ ID NO: 902495 - RNA, 21 nt, Homo sapiens
accuuauaguguuaauaucuu

SEQ ID NO: 902496 - RNA, 14 nt, Homo sapiens
accuucaacuucca

SEQ ID NO: 902497 - RNA, 17 nt, Homo sapiens
accuucaagcacccugu

SEQ ID NO: 902498 - RNA, 22 nt, Homo sapiens
accuucaauaaaguaucuacau

SEQ ID NO: 902499 - RNA, 18 nt, Homo sapiens
accuucaauacuucauga

SEQ ID NO: 902500 - RNA, 17 nt, Homo sapiens
accuucaccuucaucca

SEQ ID NO: 902501 - RNA, 14 nt, Homo sapiens
accuucagugaaag

SEQ ID NO: 902502 - RNA, 21 nt, Homo sapiens
accuucaucagaccacucccu

SEQ ID NO: 902503 - RNA, 21 nt, Homo sapiens
accuucuaggaagcuccaguu

SEQ ID NO: 902504 - RNA, 15 nt, Homo sapiens
accuucugaccuccc

SEQ ID NO: 902505 - RNA, 12 nt, Homo sapiens
accuucuuggcu

SEQ ID NO: 902506 - RNA, 13 nt, Homo sapiens
accuugcaucuca

SEQ ID NO: 902507 - RNA, 15 nt, Homo sapiens
accuugugucuguac

SEQ ID NO: 902508 - RNA, 20 nt, Homo sapiens
accuuuaaaguaaaggccuc

SEQ ID NO: 902509 - RNA, 13 nt, Homo sapiens
accuuucccucac

SEQ ID NO: 902510 - RNA, 14 nt, Homo sapiens
accuuucugaguga

SEQ ID NO: 902511 - RNA, 13 nt, Homo sapiens
accuuuguuccca

SEQ ID NO: 902512 - RNA, 19 nt, Homo sapiens
accuuuuugacuuuuccaa

SEQ ID NO: 902513 - RNA, 18 nt, Homo sapiens
acgaaacacaaaccacaa

SEQ ID NO: 902514 - RNA, 19 nt, Homo sapiens
acgaacaggggccaaacug

SEQ ID NO: 902515 - RNA, 15 nt, Homo sapiens
acgaacccaccugcu

SEQ ID NO: 902516 - RNA, 22 nt, Homo sapiens
acgaacgcucuuagcuuucuca

SEQ ID NO: 902517 - RNA, 14 nt, Homo sapiens
acgaaucagacuca

SEQ ID NO: 902518 - RNA, 17 nt, Homo sapiens
acgaaucguacuucuuu

SEQ ID NO: 902519 - RNA, 22 nt, Homo sapiens
acgacaaagccaaacucugcca

SEQ ID NO: 902520 - RNA, 20 nt, Homo sapiens
acgaccgggagguccaccug

SEQ ID NO: 902521 - RNA, 11 nt, Homo sapiens
acgacucuucc

SEQ ID NO: 902522 - RNA, 22 nt, Homo sapiens
acgagcaggcuacugucagcuc

SEQ ID NO: 902523 - RNA, 19 nt, Homo sapiens
acgagggaugggauuucau

SEQ ID NO: 902524 - RNA, 20 nt, Homo sapiens
acgagucaccugcaagcccc

SEQ ID NO: 902525 - RNA, 14 nt, Homo sapiens
acgaucgcugugaa

SEQ ID NO: 902526 - RNA, 18 nt, Homo sapiens
acgaugucaaggacuccu

SEQ ID NO: 902527 - RNA, 22 nt, Homo sapiens
acgcaaacacaccgaugcacac

SEQ ID NO: 902528 - RNA, 13 nt, Homo sapiens
acgcacaggaaaa

SEQ ID NO: 902529 - RNA, 15 nt, Homo sapiens
acgcacccccacugc

SEQ ID NO: 902530 - RNA, 17 nt, Homo sapiens
acgcagacacugagauc

SEQ ID NO: 902531 - RNA, 22 nt, Homo sapiens
acgcagaggcggaaaccuugca

SEQ ID NO: 902532 - RNA, 19 nt, Homo sapiens
acgcagcccugggggccag

SEQ ID NO: 902533 - RNA, 17 nt, Homo sapiens
acgcagguguaccuccc

SEQ ID NO: 902534 - RNA, 11 nt, Homo sapiens
acgccacugca

SEQ ID NO: 902535 - RNA, 21 nt, Homo sapiens
ugauuuuauacauagucacaa

SEQ ID NO: 902536 - RNA, 21 nt, Homo sapiens
ugcaaaaaaaaacuuugacaa

SEQ ID NO: 902537 - RNA, 13 nt, Homo sapiens
ugcaaaauuucca

SEQ ID NO: 902538 - RNA, 17 nt, Homo sapiens
ugcaaacaguucuugga

SEQ ID NO: 902539 - RNA, 22 nt, Homo sapiens
ugcaaacccugguugcuguauu

SEQ ID NO: 902540 - RNA, 16 nt, Homo sapiens
ugcaaaggugugcaaa

SEQ ID NO: 902541 - RNA, 20 nt, Homo sapiens
ugcaaaguucccuacuuccu

SEQ ID NO: 902542 - RNA, 20 nt, Homo sapiens
ugcaaaugccuccaagccau

SEQ ID NO: 902543 - RNA, 17 nt, Homo sapiens
ugcaaaugcuauauugc

SEQ ID NO: 902544 - RNA, 19 nt, Homo sapiens
ugcaaauuuugcauuuagu

SEQ ID NO: 902545 - RNA, 21 nt, Homo sapiens
ugcaagacauagaauaguguu

SEQ ID NO: 902546 - RNA, 17 nt, Homo sapiens
ugcaagaguggacugaa

SEQ ID NO: 902547 - RNA, 18 nt, Homo sapiens
ugcaagaguggacugaau

SEQ ID NO: 902548 - RNA, 18 nt, Homo sapiens
ugcaagcagggcucugcc

SEQ ID NO: 902549 - RNA, 22 nt, Homo sapiens
ugcaaggauucagcauuauucc

SEQ ID NO: 902550 - RNA, 20 nt, Homo sapiens
ugcaaggcccucuauuucuc

SEQ ID NO: 902551 - RNA, 16 nt, Homo sapiens
ugcaagugacaucucu

SEQ ID NO: 902552 - RNA, 22 nt, Homo sapiens
ugcaagugcuaugccaagccau

SEQ ID NO: 902553 - RNA, 18 nt, Homo sapiens
ugcaauaaaauaguauug

SEQ ID NO: 902554 - RNA, 16 nt, Homo sapiens
ugcaauacuaauugag

SEQ ID NO: 902555 - RNA, 18 nt, Homo sapiens
ugcaaugggcacugggau

SEQ ID NO: 902556 - RNA, 23 nt, Homo sapiens
ugcaauuuccccucuguguccuc

SEQ ID NO: 902557 - RNA, 18 nt, Homo sapiens
ugcacaaugggcaauucu

SEQ ID NO: 902558 - RNA, 9 nt, Homo sapiens
ugcacaauu

SEQ ID NO: 902559 - RNA, 12 nt, Homo sapiens
ugcacacacaga

SEQ ID NO: 902560 - RNA, 19 nt, Homo sapiens
ugcacacacagaugcacac

SEQ ID NO: 902561 - RNA, 13 nt, Homo sapiens
ugcacacaccaga

SEQ ID NO: 902562 - RNA, 12 nt, Homo sapiens
ugcacaccaaaa

SEQ ID NO: 902563 - RNA, 14 nt, Homo sapiens
ugcacaccaaaaaa

SEQ ID NO: 902564 - RNA, 12 nt, Homo sapiens
ugcacacgcaca

SEQ ID NO: 902565 - RNA, 23 nt, Homo sapiens
ugcacacgcacauagagauaugc

SEQ ID NO: 902566 - RNA, 19 nt, Homo sapiens
ugcacacuuguauauugaa

SEQ ID NO: 902567 - RNA, 15 nt, Homo sapiens
ugcacagagauaugc

SEQ ID NO: 902568 - RNA, 21 nt, Homo sapiens
ugcacagagauaugcacacac

SEQ ID NO: 902569 - RNA, 13 nt, Homo sapiens
ugcacagcugcuu

SEQ ID NO: 902570 - RNA, 22 nt, Homo sapiens
ugcacagguuuucagcaacuca

SEQ ID NO: 902571 - RNA, 20 nt, Homo sapiens
ugcacauccauucccaagaa

SEQ ID NO: 902572 - RNA, 21 nt, Homo sapiens
ugcacauccauucccaagaaa

SEQ ID NO: 902573 - RNA, 14 nt, Homo sapiens
ugcaccccaugagu

SEQ ID NO: 902574 - RNA, 20 nt, Homo sapiens
ugcaccgagagagauggaau

SEQ ID NO: 902575 - RNA, 16 nt, Homo sapiens
ugcaccugccagccug

SEQ ID NO: 902576 - RNA, 20 nt, Homo sapiens
ugcaccuuaccaacuuucug

SEQ ID NO: 902577 - RNA, 20 nt, Homo sapiens
ugcacgcacaugccaaugca

SEQ ID NO: 902578 - RNA, 14 nt, Homo sapiens
ugcacgcacugcgu

SEQ ID NO: 902579 - RNA, 19 nt, Homo sapiens
ugcacgggagaauauacaa

SEQ ID NO: 902580 - RNA, 17 nt, Homo sapiens
ugcacgucuugcuauuu

SEQ ID NO: 902581 - RNA, 22 nt, Homo sapiens
ugcacguucuauauugugccaa

SEQ ID NO: 902582 - RNA, 19 nt, Homo sapiens
ugcacuaauugacccaaaa

SEQ ID NO: 902583 - RNA, 15 nt, Homo sapiens
ugcacuagccuguga

SEQ ID NO: 902584 - RNA, 10 nt, Homo sapiens
ugcacuccau

SEQ ID NO: 902585 - RNA, 16 nt, Homo sapiens
ugcacucccuaagaaa

SEQ ID NO: 902586 - RNA, 17 nt, Homo sapiens
ugcacugacaagaugga

SEQ ID NO: 902587 - RNA, 11 nt, Homo sapiens
ugcacugugac

SEQ ID NO: 902588 - RNA, 17 nt, Homo sapiens
ugcagaauccaaaguaa

SEQ ID NO: 902589 - RNA, 18 nt, Homo sapiens
ugcagaauccaaaguaaa

SEQ ID NO: 902590 - RNA, 16 nt, Homo sapiens
ugcagacucacugugg

SEQ ID NO: 902591 - RNA, 12 nt, Homo sapiens
ugcagacugugg

SEQ ID NO: 902592 - RNA, 19 nt, Homo sapiens
ugcagagaaucuguaguca

SEQ ID NO: 902593 - RNA, 22 nt, Homo sapiens
aggcaguauuauugagcucuau

SEQ ID NO: 902594 - RNA, 21 nt, Homo sapiens
aggcagugauuugccaaagug

SEQ ID NO: 902595 - RNA, 20 nt, Homo sapiens
aggcaguguuccucaccaau

SEQ ID NO: 902596 - RNA, 18 nt, Homo sapiens
aggcaguucaaagcagga

SEQ ID NO: 902597 - RNA, 19 nt, Homo sapiens
aggcauaagaaaacuaaga

SEQ ID NO: 902598 - RNA, 19 nt, Homo sapiens
aggcauccugugugcugac

SEQ ID NO: 902599 - RNA, 12 nt, Homo sapiens
aggcaugaacac

SEQ ID NO: 902600 - RNA, 19 nt, Homo sapiens
aggcaugaacacacaugga

SEQ ID NO: 902601 - RNA, 16 nt, Homo sapiens
aggcaugagaaucacu

SEQ ID NO: 902602 - RNA, 21 nt, Homo sapiens
aggcauggcuggggugggggu

SEQ ID NO: 902603 - RNA, 22 nt, Homo sapiens
aggcauuaaauuuuagcaaaga

SEQ ID NO: 902604 - RNA, 21 nt, Homo sapiens
aggccacacacucugcauccg

SEQ ID NO: 902605 - RNA, 20 nt, Homo sapiens
aggccacuugaugaccccca

SEQ ID NO: 902606 - RNA, 21 nt, Homo sapiens
aggccagagggagugacagag

SEQ ID NO: 902607 - RNA, 14 nt, Homo sapiens
aggccagagugcug

SEQ ID NO: 902608 - RNA, 21 nt, Homo sapiens
aggccauggcagaauaaucuu

SEQ ID NO: 902609 - RNA, 17 nt, Homo sapiens
aggcccaaggaguaagu

SEQ ID NO: 902610 - RNA, 19 nt, Homo sapiens
aggcccagggaggugaccc

SEQ ID NO: 902611 - RNA, 16 nt, Homo sapiens
aggccccaugaccucc

SEQ ID NO: 902612 - RNA, 21 nt, Homo sapiens
aggcccgacagagagaugaag

SEQ ID NO: 902613 - RNA, 17 nt, Homo sapiens
aggcccgagcagcugag

SEQ ID NO: 902614 - RNA, 10 nt, Homo sapiens
aggcccuccc

SEQ ID NO: 902615 - RNA, 20 nt, Homo sapiens
aggcccugccuucagcccug

SEQ ID NO: 902616 - RNA, 22 nt, Homo sapiens
aggcccuuccucuccacugccu

SEQ ID NO: 902617 - RNA, 15 nt, Homo sapiens
aggccgggcccgggc

SEQ ID NO: 902618 - RNA, 19 nt, Homo sapiens
aggccgggcgcaguggcuc

SEQ ID NO: 902619 - RNA, 22 nt, Homo sapiens
aggccuauaaccccagcucccu

SEQ ID NO: 902620 - RNA, 13 nt, Homo sapiens
aggccucccucaa

SEQ ID NO: 902621 - RNA, 18 nt, Homo sapiens
aggccucuuggaccucug

SEQ ID NO: 902622 - RNA, 18 nt, Homo sapiens
aggccuggccagaugcac

SEQ ID NO: 902623 - RNA, 21 nt, Homo sapiens
aggcgccccuucccccuccaa

SEQ ID NO: 902624 - RNA, 16 nt, Homo sapiens
aggcgcgguggcucuu

SEQ ID NO: 902625 - RNA, 22 nt, Homo sapiens
aggcggaaaccuugcagcauuu

SEQ ID NO: 902626 - RNA, 22 nt, Homo sapiens
aggcggcacauuggcagugugu

SEQ ID NO: 902627 - RNA, 15 nt, Homo sapiens
aggcggcuccagguc

SEQ ID NO: 902628 - RNA, 22 nt, Homo sapiens
aggcggucaugugugcauguga

SEQ ID NO: 902629 - RNA, 16 nt, Homo sapiens
aggcuagcaaagcuua

SEQ ID NO: 902630 - RNA, 20 nt, Homo sapiens
aggcuauauuucugggauga

SEQ ID NO: 902631 - RNA, 15 nt, Homo sapiens
aggcucacaacuguu

SEQ ID NO: 902632 - RNA, 12 nt, Homo sapiens
aggcucugggaa

SEQ ID NO: 902633 - RNA, 19 nt, Homo sapiens
aggcucugggcucagggcu

SEQ ID NO: 902634 - RNA, 12 nt, Homo sapiens
aggcucuuccau

SEQ ID NO: 902635 - RNA, 14 nt, Homo sapiens
aggcugaggacuua

SEQ ID NO: 902636 - RNA, 19 nt, Homo sapiens
aggcugagugagccacaga

SEQ ID NO: 902637 - RNA, 15 nt, Homo sapiens
aggcugcacugcagu

SEQ ID NO: 902638 - RNA, 15 nt, Homo sapiens
aggcugccucagacc

SEQ ID NO: 902639 - RNA, 23 nt, Homo sapiens
aggcuggcacuccccugaccuca

SEQ ID NO: 902640 - RNA, 14 nt, Homo sapiens
aggcuggcagauuu

SEQ ID NO: 902641 - RNA, 15 nt, Homo sapiens
aggcuggcugaaaau

SEQ ID NO: 902642 - RNA, 14 nt, Homo sapiens
aggcuggggccagu

SEQ ID NO: 902643 - RNA, 23 nt, Homo sapiens
aggcugucgugagcuaugauuau

SEQ ID NO: 902644 - RNA, 19 nt, Homo sapiens
aggcuuaaggagaggagaa

SEQ ID NO: 902645 - RNA, 13 nt, Homo sapiens
aggcuuaucaaaa

SEQ ID NO: 902646 - RNA, 19 nt, Homo sapiens
aggcuugaaguaaccuuau

SEQ ID NO: 902647 - RNA, 20 nt, Homo sapiens
aggcuuuuaagaaacacagg

SEQ ID NO: 902648 - RNA, 21 nt, Homo sapiens
aggcuuuuccguaaacauaua

SEQ ID NO: 902649 - RNA, 18 nt, Homo sapiens
aguaccacagaaguucaa

SEQ ID NO: 902650 - RNA, 15 nt, Homo sapiens
aguacccaggaugau

SEQ ID NO: 902651 - RNA, 19 nt, Homo sapiens
aguaccccugauaagcaaa

SEQ ID NO: 902652 - RNA, 14 nt, Homo sapiens
aguaccuguaguga

SEQ ID NO: 902653 - RNA, 11 nt, Homo sapiens
aguacugaaga

SEQ ID NO: 902654 - RNA, 14 nt, Homo sapiens
aguacuggcauggu

SEQ ID NO: 902655 - RNA, 17 nt, Homo sapiens
aguacuggcaugguacg

SEQ ID NO: 902656 - RNA, 19 nt, Homo sapiens
aguacuuacccuaaaacau

SEQ ID NO: 902657 - RNA, 14 nt, Homo sapiens
aguagaauccuaaa

SEQ ID NO: 902658 - RNA, 18 nt, Homo sapiens
aguagauaugaggcauuu

SEQ ID NO: 902659 - RNA, 12 nt, Homo sapiens
aguagcaauuuc

SEQ ID NO: 902660 - RNA, 14 nt, Homo sapiens
aguagcuaaugaaa

SEQ ID NO: 902661 - RNA, 20 nt, Homo sapiens
aguagcugggacuacaggca

SEQ ID NO: 902662 - RNA, 13 nt, Homo sapiens
aguagguuuacau

SEQ ID NO: 902663 - RNA, 17 nt, Homo sapiens
aguaguugacagugcua

SEQ ID NO: 902664 - RNA, 14 nt, Homo sapiens
aguauaauuuaacu

SEQ ID NO: 902665 - RNA, 21 nt, Homo sapiens
aguauauuuuccucccaguuc

SEQ ID NO: 902666 - RNA, 13 nt, Homo sapiens
aguaucuuaccug

SEQ ID NO: 902667 - RNA, 14 nt, Homo sapiens
aguaugagggaaaa

SEQ ID NO: 902668 - RNA, 20 nt, Homo sapiens
aguauuauuguugcauuaaa

SEQ ID NO: 902669 - RNA, 22 nt, Homo sapiens
aguauugccacaaugccucucc

SEQ ID NO: 902670 - RNA, 16 nt, Homo sapiens
aguauuguccauauca

SEQ ID NO: 902671 - RNA, 12 nt, Homo sapiens
aguauugugcau

SEQ ID NO: 902672 - RNA, 17 nt, Homo sapiens
aguauuuggggucauau

SEQ ID NO: 902673 - RNA, 12 nt, Homo sapiens
agucaacaacca

SEQ ID NO: 902674 - RNA, 17 nt, Homo sapiens
agucaacaguucaaaga

SEQ ID NO: 902675 - RNA, 20 nt, Homo sapiens
agucaauuaaaggcuuucag

SEQ ID NO: 902676 - RNA, 17 nt, Homo sapiens
agucacccuucugggca

SEQ ID NO: 902677 - RNA, 14 nt, Homo sapiens
agucaccgggauga

SEQ ID NO: 902678 - RNA, 20 nt, Homo sapiens
agucacgagcccgcucugca

SEQ ID NO: 902679 - RNA, 21 nt, Homo sapiens
agucacugucccucaaaugac

SEQ ID NO: 902680 - RNA, 17 nt, Homo sapiens
agucagcuguaccaagc

SEQ ID NO: 902681 - RNA, 16 nt, Homo sapiens
agucagcuuucagagc

SEQ ID NO: 902682 - RNA, 16 nt, Homo sapiens
agucaguaguauucua

SEQ ID NO: 902683 - RNA, 21 nt, Homo sapiens
agucauugaaauuuacuguga

SEQ ID NO: 902684 - RNA, 22 nt, Homo sapiens
agucauugucgcucagcaauag

SEQ ID NO: 902685 - RNA, 16 nt, Homo sapiens
aguccaaaugugauca

SEQ ID NO: 902686 - RNA, 15 nt, Homo sapiens
aguccaaccugccug

SEQ ID NO: 902687 - RNA, 22 nt, Homo sapiens
aguccaaccugccugugcauga

SEQ ID NO: 902688 - RNA, 16 nt, Homo sapiens
aguccacaucuucuca

SEQ ID NO: 902689 - RNA, 15 nt, Homo sapiens
agucccagcuacuca

SEQ ID NO: 902690 - RNA, 13 nt, Homo sapiens
agucccugacucu

SEQ ID NO: 902691 - RNA, 18 nt, Homo sapiens
aguccgcaaguucaggga

SEQ ID NO: 902692 - RNA, 20 nt, Homo sapiens
aguccguuaacacuacuuaa

SEQ ID NO: 902693 - RNA, 20 nt, Homo sapiens
aguccuaucgacuuuauaca

SEQ ID NO: 902694 - RNA, 14 nt, Homo sapiens
aguccuauuugcac

SEQ ID NO: 902695 - RNA, 15 nt, Homo sapiens
aguccuccucuuccu

SEQ ID NO: 902696 - RNA, 19 nt, Homo sapiens
aguccugcccaaugccuug

SEQ ID NO: 902697 - RNA, 14 nt, Homo sapiens
aguccuuucaggaa

SEQ ID NO: 902698 - RNA, 20 nt, Homo sapiens
agucgaauguuagauuccuc

SEQ ID NO: 902699 - RNA, 17 nt, Homo sapiens
agucgaucaagggaugu

SEQ ID NO: 902700 - RNA, 16 nt, Homo sapiens
agucguuucaggacau

SEQ ID NO: 902701 - RNA, 14 nt, Homo sapiens
agucuaaaguuuac

SEQ ID NO: 902702 - RNA, 12 nt, Homo sapiens
agucuaccucuu

SEQ ID NO: 902703 - RNA, 18 nt, Homo sapiens
agucuacuucacuaauga

SEQ ID NO: 902704 - RNA, 12 nt, Homo sapiens
agucuagcuuuu

SEQ ID NO: 902705 - RNA, 17 nt, Homo sapiens
agucuaggagcugggag

SEQ ID NO: 902706 - RNA, 22 nt, Homo sapiens
agucuaucaaccccagacacug

SEQ ID NO: 902707 - RNA, 21 nt, Homo sapiens
ccuuuuacagcucuuggcauu

SEQ ID NO: 902708 - RNA, 18 nt, Homo sapiens
ccuuuuaccccugcacag

SEQ ID NO: 902709 - RNA, 16 nt, Homo sapiens
ccuuuuauaccagaga

SEQ ID NO: 902710 - RNA, 20 nt, Homo sapiens
ccuuuuccaggaguucugaa

SEQ ID NO: 902711 - RNA, 17 nt, Homo sapiens
ccuuuuccgucuuugua

SEQ ID NO: 902712 - RNA, 21 nt, Homo sapiens
ccuuuucuuuuucccuugaac

SEQ ID NO: 902713 - RNA, 13 nt, Homo sapiens
ccuuuugaccaaa

SEQ ID NO: 902714 - RNA, 16 nt, Homo sapiens
ccuuuugaccaaauaa

SEQ ID NO: 902715 - RNA, 18 nt, Homo sapiens
ccuuuugaccaaauaaag

SEQ ID NO: 902716 - RNA, 15 nt, Homo sapiens
ccuuuuucuaccuuu

SEQ ID NO: 902717 - RNA, 11 nt, Homo sapiens
ccuuuuugccc

SEQ ID NO: 902718 - RNA, 21 nt, Homo sapiens
cgaaaccaguuaagaauggaa

SEQ ID NO: 902719 - RNA, 21 nt, Homo sapiens
cgaaauauuacaguagugcau

SEQ ID NO: 902720 - RNA, 22 nt, Homo sapiens
cgaacucaucccuguuccucaa

SEQ ID NO: 902721 - RNA, 17 nt, Homo sapiens
cgaagcccuuccagugg

SEQ ID NO: 902722 - RNA, 23 nt, Homo sapiens
cgaaggggaaaacccgcucucuc

SEQ ID NO: 902723 - RNA, 13 nt, Homo sapiens
cgaagucuuccau

SEQ ID NO: 902724 - RNA, 13 nt, Homo sapiens
cgacaaagccaaa

SEQ ID NO: 902725 - RNA, 13 nt, Homo sapiens
cgacgcaggugua

SEQ ID NO: 902726 - RNA, 19 nt, Homo sapiens
cgacgcagguguaccuccc

SEQ ID NO: 902727 - RNA, 19 nt, Homo sapiens
cgacugcgacgcaggugua

SEQ ID NO: 902728 - RNA, 15 nt, Homo sapiens
cgacuuuuaagcaaa

SEQ ID NO: 902729 - RNA, 18 nt, Homo sapiens
cgagaaaacaaacccagg

SEQ ID NO: 902730 - RNA, 17 nt, Homo sapiens
cgagaucacgccacugc

SEQ ID NO: 902731 - RNA, 21 nt, Homo sapiens
cgagauggcgcuauugcacuc

SEQ ID NO: 902732 - RNA, 19 nt, Homo sapiens
cgaggacagggaggugacc

SEQ ID NO: 902733 - RNA, 22 nt, Homo sapiens
cgaggcugcccacuauggucau

SEQ ID NO: 902734 - RNA, 18 nt, Homo sapiens
cgagggaugggauuucau

SEQ ID NO: 902735 - RNA, 14 nt, Homo sapiens
cgagucaugcacuc

SEQ ID NO: 902736 - RNA, 17 nt, Homo sapiens
cgaguuguuggcugcuc

SEQ ID NO: 902737 - RNA, 16 nt, Homo sapiens
cgaguuuacuucauga

SEQ ID NO: 902738 - RNA, 18 nt, Homo sapiens
cgauccuggauucacuca

SEQ ID NO: 902739 - RNA, 13 nt, Homo sapiens
cgaucgcugugaa

SEQ ID NO: 902740 - RNA, 12 nt, Homo sapiens
cgaucuggguuc

SEQ ID NO: 902741 - RNA, 20 nt, Homo sapiens
cgaucuggguucacugcaac

SEQ ID NO: 902742 - RNA, 11 nt, Homo sapiens
cgaucuuggcu

SEQ ID NO: 902743 - RNA, 14 nt, Homo sapiens
cgcaaaugaguauu

SEQ ID NO: 902744 - RNA, 16 nt, Homo sapiens
cgcaagagaacauuuc

SEQ ID NO: 902745 - RNA, 14 nt, Homo sapiens
cgcaaguucaggga

SEQ ID NO: 902746 - RNA, 20 nt, Homo sapiens
cgcacaaggcugaccaagag

SEQ ID NO: 902747 - RNA, 16 nt, Homo sapiens
cgcaccacuguguauu

SEQ ID NO: 902748 - RNA, 22 nt, Homo sapiens
cgcaccgggcccuccuugccug

SEQ ID NO: 902749 - RNA, 20 nt, Homo sapiens
cgcagcgcgugcacagcgcg

SEQ ID NO: 902750 - RNA, 18 nt, Homo sapiens
cgcagggaggaugccaca

SEQ ID NO: 902751 - RNA, 14 nt, Homo sapiens
cgcauauuuaacuc

SEQ ID NO: 902752 - RNA, 20 nt, Homo sapiens
cgcaugcccucaaucccagc

SEQ ID NO: 902753 - RNA, 18 nt, Homo sapiens
cgccaacugcugaucaau

SEQ ID NO: 902754 - RNA, 21 nt, Homo sapiens
cgccaccucuugucagugcuc

SEQ ID NO: 902755 - RNA, 20 nt, Homo sapiens
cgccagacagauugcugaua

SEQ ID NO: 902756 - RNA, 23 nt, Homo sapiens
cgccauuccaagucaacacucuu

SEQ ID NO: 902757 - RNA, 16 nt, Homo sapiens
cgccuggccccugggc

SEQ ID NO: 902758 - RNA, 20 nt, Homo sapiens
cgcgaagugggcauugcaaa

SEQ ID NO: 902759 - RNA, 17 nt, Homo sapiens
cgcgcagcgcgugcaca

SEQ ID NO: 902760 - RNA, 11 nt, Homo sapiens
cgcgugcacac

SEQ ID NO: 902761 - RNA, 16 nt, Homo sapiens
cgcuacaccacucugg

SEQ ID NO: 902762 - RNA, 17 nt, Homo sapiens
cgcuagagcagcccaaa

SEQ ID NO: 902763 - RNA, 15 nt, Homo sapiens
cgcuggagugcagug

SEQ ID NO: 902764 - RNA, 21 nt, Homo sapiens
aguggaugacgugaagccaca

SEQ ID NO: 902765 - RNA, 18 nt, Homo sapiens
aguggauggaagugucug

SEQ ID NO: 902766 - RNA, 22 nt, Homo sapiens
aguggcacggagagaaggccca

SEQ ID NO: 902767 - RNA, 14 nt, Homo sapiens
aguggcagccaugc

SEQ ID NO: 902768 - RNA, 17 nt, Homo sapiens
aguggcaguguaugcuc

SEQ ID NO: 902769 - RNA, 16 nt, Homo sapiens
aguggcauucacaucu

SEQ ID NO: 902770 - RNA, 18 nt, Homo sapiens
aguggcauucacaucuca

SEQ ID NO: 902771 - RNA, 21 nt, Homo sapiens
aguggcucacgccuaugaucc

SEQ ID NO: 902772 - RNA, 21 nt, Homo sapiens
aguggcugaaauaaaagccuc

SEQ ID NO: 902773 - RNA, 13 nt, Homo sapiens
agugggacccaua

SEQ ID NO: 902774 - RNA, 17 nt, Homo sapiens
agugggugaauguguga

SEQ ID NO: 902775 - RNA, 13 nt, Homo sapiens
aguggguggugga

SEQ ID NO: 902776 - RNA, 19 nt, Homo sapiens
agugguauagaguacugca

SEQ ID NO: 902777 - RNA, 20 nt, Homo sapiens
aguggugcagucuuggcuca

SEQ ID NO: 902778 - RNA, 21 nt, Homo sapiens
aguggugcgaucuggguucac

SEQ ID NO: 902779 - RNA, 17 nt, Homo sapiens
aguggugcgaucuuggc

SEQ ID NO: 902780 - RNA, 20 nt, Homo sapiens
agugguuguuuugucaugaa

SEQ ID NO: 902781 - RNA, 14 nt, Homo sapiens
aguguaagcacuuc

SEQ ID NO: 902782 - RNA, 16 nt, Homo sapiens
aguguagccuugcccg

SEQ ID NO: 902783 - RNA, 18 nt, Homo sapiens
aguguagggcaacaauac

SEQ ID NO: 902784 - RNA, 20 nt, Homo sapiens
agugucaccagcugccaaaa

SEQ ID NO: 902785 - RNA, 12 nt, Homo sapiens
agugucacuuac

SEQ ID NO: 902786 - RNA, 21 nt, Homo sapiens
agugucacuuaccuagauuua

SEQ ID NO: 902787 - RNA, 20 nt, Homo sapiens
aguguccccuccacugucac

SEQ ID NO: 902788 - RNA, 21 nt, Homo sapiens
aguguccccuccacugucaca

SEQ ID NO: 902789 - RNA, 14 nt, Homo sapiens
aguguccucuugcu

SEQ ID NO: 902790 - RNA, 18 nt, Homo sapiens
aguguccucuugcucaaa

SEQ ID NO: 902791 - RNA, 17 nt, Homo sapiens
agugugaauaaaguuag

SEQ ID NO: 902792 - RNA, 14 nt, Homo sapiens
agugugaucccaag

SEQ ID NO: 902793 - RNA, 16 nt, Homo sapiens
agugugggcauagcau

SEQ ID NO: 902794 - RNA, 17 nt, Homo sapiens
agugugggcauagcauu

SEQ ID NO: 902795 - RNA, 20 nt, Homo sapiens
aguguguugggaauugcaug

SEQ ID NO: 902796 - RNA, 16 nt, Homo sapiens
aguguguuuccuucag

SEQ ID NO: 902797 - RNA, 22 nt, Homo sapiens
aguguucaugcuuuguaccaaa

SEQ ID NO: 902798 - RNA, 16 nt, Homo sapiens
aguguuccuucauuaa

SEQ ID NO: 902799 - RNA, 22 nt, Homo sapiens
aguguucuguauuuuaaggugu

SEQ ID NO: 902800 - RNA, 16 nt, Homo sapiens
aguguuugcaauggug

SEQ ID NO: 902801 - RNA, 13 nt, Homo sapiens
aguguuugucaua

SEQ ID NO: 902802 - RNA, 18 nt, Homo sapiens
aguuaaaaguguugauua

SEQ ID NO: 902803 - RNA, 20 nt, Homo sapiens
aguuaaagugaauaaccacu

SEQ ID NO: 902804 - RNA, 14 nt, Homo sapiens
aguuaacuacagug

SEQ ID NO: 902805 - RNA, 22 nt, Homo sapiens
aguuaagcagccuuucugugga

SEQ ID NO: 902806 - RNA, 21 nt, Homo sapiens
aguuaaggggagcaacagagg

SEQ ID NO: 902807 - RNA, 18 nt, Homo sapiens
aguuacaaauucaaggag

SEQ ID NO: 902808 - RNA, 13 nt, Homo sapiens
aguuagugccaua

SEQ ID NO: 902809 - RNA, 16 nt, Homo sapiens
aguuauauugaauaua

SEQ ID NO: 902810 - RNA, 17 nt, Homo sapiens
aguuauuaaacaguguu

SEQ ID NO: 902811 - RNA, 20 nt, Homo sapiens
aguucaaauuuugcauugug

SEQ ID NO: 902812 - RNA, 19 nt, Homo sapiens
aguucaauaaaugucuguu

SEQ ID NO: 902813 - RNA, 21 nt, Homo sapiens
aguucacaggccagaaaacau

SEQ ID NO: 902814 - RNA, 11 nt, Homo sapiens
aguucagggaa

SEQ ID NO: 902815 - RNA, 23 nt, Homo sapiens
aguucaguggcauucacaucuca

SEQ ID NO: 902816 - RNA, 19 nt, Homo sapiens
aguuccaugaagaccacau

SEQ ID NO: 902817 - RNA, 14 nt, Homo sapiens
aguuccauguuaaa

SEQ ID NO: 902818 - RNA, 18 nt, Homo sapiens
aguuccccucuacuccau

SEQ ID NO: 902819 - RNA, 20 nt, Homo sapiens
aguuccuacuuuagccacug

SEQ ID NO: 902820 - RNA, 20 nt, Homo sapiens
aguuccuccaagaggucucc

SEQ ID NO: 902821 - RNA, 23 nt, Homo sapiens
cguuaguguauuuuauguguggc

SEQ ID NO: 902822 - RNA, 23 nt, Homo sapiens
cguuccuguuagcauaaugugag

SEQ ID NO: 902823 - RNA, 14 nt, Homo sapiens
cguuuuaaggacau

SEQ ID NO: 902824 - RNA, 19 nt, Homo sapiens
cguuuuacaauguaacuau

SEQ ID NO: 902825 - RNA, 17 nt, Homo sapiens
cuaaaaauaagcuuuau

SEQ ID NO: 902826 - RNA, 22 nt, Homo sapiens
cuaaaagugguuuuuauuuccu

SEQ ID NO: 902827 - RNA, 19 nt, Homo sapiens
cuaaaauaaaaaccagaau

SEQ ID NO: 902828 - RNA, 22 nt, Homo sapiens
cuaaaauacaaacaagcacaga

SEQ ID NO: 902829 - RNA, 17 nt, Homo sapiens
cuaaacaacuaccuccu

SEQ ID NO: 902830 - RNA, 13 nt, Homo sapiens
cuaaagagcuuua

SEQ ID NO: 902831 - RNA, 22 nt, Homo sapiens
cuaaagaguuauucaaaugaag

SEQ ID NO: 902832 - RNA, 23 nt, Homo sapiens
cuaaagcaguguuuucaccucau

SEQ ID NO: 902833 - RNA, 18 nt, Homo sapiens
cuaaagcuuucugacaag

SEQ ID NO: 902834 - RNA, 14 nt, Homo sapiens
cuaaaggacuaaca

SEQ ID NO: 902835 - RNA, 21 nt, Homo sapiens
cuaaagguagaucaucuugaa

SEQ ID NO: 902836 - RNA, 19 nt, Homo sapiens
cuaaagguuguauugcaua

SEQ ID NO: 902837 - RNA, 15 nt, Homo sapiens
cuaaagucacauaua

SEQ ID NO: 902838 - RNA, 16 nt, Homo sapiens
cuaaagucacauauaa

SEQ ID NO: 902839 - RNA, 13 nt, Homo sapiens
cuaaagugucuau

SEQ ID NO: 902840 - RNA, 16 nt, Homo sapiens
cuaaauaccucaauca

SEQ ID NO: 902841 - RNA, 16 nt, Homo sapiens
cuaaauacuguacaua

SEQ ID NO: 902842 - RNA, 11 nt, Homo sapiens
cuaaauaugau

SEQ ID NO: 902843 - RNA, 17 nt, Homo sapiens
cuaaaucaauucuauua

SEQ ID NO: 902844 - RNA, 13 nt, Homo sapiens
cuaaauccaaaga

SEQ ID NO: 902845 - RNA, 14 nt, Homo sapiens
cuaaauccaaagaa

SEQ ID NO: 902846 - RNA, 16 nt, Homo sapiens
cuaaauccaaaugagg

SEQ ID NO: 902847 - RNA, 18 nt, Homo sapiens
cuaaaucugccuuuucau

SEQ ID NO: 902848 - RNA, 21 nt, Homo sapiens
cuaaaugaaaaucgugacaac

SEQ ID NO: 902849 - RNA, 15 nt, Homo sapiens
cuaaaugaagugcaa

SEQ ID NO: 902850 - RNA, 21 nt, Homo sapiens
cuaaaugcuggucuaggagcu

SEQ ID NO: 902851 - RNA, 23 nt, Homo sapiens
cuaacacccagucuguuccccau

SEQ ID NO: 902852 - RNA, 17 nt, Homo sapiens
cuaacaucaugcauuca

SEQ ID NO: 902853 - RNA, 16 nt, Homo sapiens
cuaaccagccugguca

SEQ ID NO: 902854 - RNA, 13 nt, Homo sapiens
cuaacuagcuugg

SEQ ID NO: 902855 - RNA, 14 nt, Homo sapiens
cuaacucuggugcu

SEQ ID NO: 902856 - RNA, 11 nt, Homo sapiens
cuaacuguaaa

SEQ ID NO: 902857 - RNA, 21 nt, Homo sapiens
cuaacuuuuuugcuauccagc

SEQ ID NO: 902858 - RNA, 12 nt, Homo sapiens
cuaagagaucug

SEQ ID NO: 902859 - RNA, 15 nt, Homo sapiens
cuaagaggcagugag

SEQ ID NO: 902860 - RNA, 16 nt, Homo sapiens
cuaagccuguugcuga

SEQ ID NO: 902861 - RNA, 12 nt, Homo sapiens
cuaagcuuucuc

SEQ ID NO: 902862 - RNA, 14 nt, Homo sapiens
cuaaggaucucuca

SEQ ID NO: 902863 - RNA, 17 nt, Homo sapiens
cuaagggccacauccca

SEQ ID NO: 902864 - RNA, 22 nt, Homo sapiens
cuaagggccacaucccacugcc

SEQ ID NO: 902865 - RNA, 21 nt, Homo sapiens
cuaagguaguaacuuuccaua

SEQ ID NO: 902866 - RNA, 23 nt, Homo sapiens
cuaagugauccucccaccucagc

SEQ ID NO: 902867 - RNA, 19 nt, Homo sapiens
cuaaguuugguuagccuua

SEQ ID NO: 902868 - RNA, 16 nt, Homo sapiens
cuaauacaacauguag

SEQ ID NO: 902869 - RNA, 15 nt, Homo sapiens
cuaauaccucugugu

SEQ ID NO: 902870 - RNA, 19 nt, Homo sapiens
cuaauagagacacagagau

SEQ ID NO: 902871 - RNA, 19 nt, Homo sapiens
cuaauauuuuuagcucugu

SEQ ID NO: 902872 - RNA, 16 nt, Homo sapiens
cuaaucagcauucuca

SEQ ID NO: 902873 - RNA, 17 nt, Homo sapiens
cuaaucagcauucucac

SEQ ID NO: 902874 - RNA, 15 nt, Homo sapiens
cuaauccuccaaguc

SEQ ID NO: 902875 - RNA, 15 nt, Homo sapiens
cuaaucuaugcaugu

SEQ ID NO: 902876 - RNA, 21 nt, Homo sapiens
cuaaucuaugcauguauguag

SEQ ID NO: 902877 - RNA, 14 nt, Homo sapiens
cuaaugaaauugag

SEQ ID NO: 902878 - RNA, 12 nt, Homo sapiens
gguggcacgugc

SEQ ID NO: 902879 - RNA, 18 nt, Homo sapiens
gguggcccccugugccag

SEQ ID NO: 902880 - RNA, 15 nt, Homo sapiens
gguggcgggcaccug

SEQ ID NO: 902881 - RNA, 17 nt, Homo sapiens
gguggcucacgccugua

SEQ ID NO: 902882 - RNA, 14 nt, Homo sapiens
gguggcucuugccu

SEQ ID NO: 902883 - RNA, 15 nt, Homo sapiens
ggugguagaaccacu

SEQ ID NO: 902884 - RNA, 14 nt, Homo sapiens
gguguauuugccag

SEQ ID NO: 902885 - RNA, 18 nt, Homo sapiens
ggugucuggaaaagcacu

SEQ ID NO: 902886 - RNA, 14 nt, Homo sapiens
gguguggcaguuac

SEQ ID NO: 902887 - RNA, 16 nt, Homo sapiens
gguguggccugcacug

SEQ ID NO: 902888 - RNA, 14 nt, Homo sapiens
ggugugucaaugcc

SEQ ID NO: 902889 - RNA, 17 nt, Homo sapiens
gguguuacuaaagucac

SEQ ID NO: 902890 - RNA, 14 nt, Homo sapiens
gguuaaauuugaau

SEQ ID NO: 902891 - RNA, 12 nt, Homo sapiens
gguuaacagcug

SEQ ID NO: 902892 - RNA, 19 nt, Homo sapiens
gguuaccuuuguucccaaa

SEQ ID NO: 902893 - RNA, 14 nt, Homo sapiens
gguucccagcagcu

SEQ ID NO: 902894 - RNA, 19 nt, Homo sapiens
gguuccugagcucacugaa

SEQ ID NO: 902895 - RNA, 19 nt, Homo sapiens
gguugcgggggagcuggaa

SEQ ID NO: 902896 - RNA, 22 nt, Homo sapiens
gguuuaagaacgaaggagaaaa

SEQ ID NO: 902897 - RNA, 13 nt, Homo sapiens
gguuuacugcugu

SEQ ID NO: 902898 - RNA, 14 nt, Homo sapiens
gguuuccaggccac

SEQ ID NO: 902899 - RNA, 18 nt, Homo sapiens
gguuuuuguuaccuuuau

SEQ ID NO: 902900 - RNA, 16 nt, Homo sapiens
guaaaacuauauucuc

SEQ ID NO: 902901 - RNA, 15 nt, Homo sapiens
guaaaauaacaucag

SEQ ID NO: 902902 - RNA, 21 nt, Homo sapiens
guaaaauagaauguuacuuug

SEQ ID NO: 902903 - RNA, 15 nt, Homo sapiens
guaaacagcucugug

SEQ ID NO: 902904 - RNA, 17 nt, Homo sapiens
guaaacauauaucuuac

SEQ ID NO: 902905 - RNA, 22 nt, Homo sapiens
guaaacuauaaacuacuguaau

SEQ ID NO: 902906 - RNA, 20 nt, Homo sapiens
guaaagaauaaaugaaucuu

SEQ ID NO: 902907 - RNA, 13 nt, Homo sapiens
guaaagaugucaa

SEQ ID NO: 902908 - RNA, 15 nt, Homo sapiens
guaaaggccuuuaau

SEQ ID NO: 902909 - RNA, 17 nt, Homo sapiens
guaaauagcauucucua

SEQ ID NO: 902910 - RNA, 15 nt, Homo sapiens
guaaauaugacuccu

SEQ ID NO: 902911 - RNA, 21 nt, Homo sapiens
guaaauccuauuauguguuca

SEQ ID NO: 902912 - RNA, 14 nt, Homo sapiens
guaaaugccacaaa

SEQ ID NO: 902913 - RNA, 11 nt, Homo sapiens
guaaaugugau

SEQ ID NO: 902914 - RNA, 20 nt, Homo sapiens
guaaauuuaaagaagucaua

SEQ ID NO: 902915 - RNA, 20 nt, Homo sapiens
guaacaaggugucuuuucca

SEQ ID NO: 902916 - RNA, 18 nt, Homo sapiens
guaacacaagccacagaa

SEQ ID NO: 902917 - RNA, 16 nt, Homo sapiens
guaacauccuuucuau

SEQ ID NO: 902918 - RNA, 17 nt, Homo sapiens
guaacaugccagcuucc

SEQ ID NO: 902919 - RNA, 19 nt, Homo sapiens
guaacuauuacaccaaaua

SEQ ID NO: 902920 - RNA, 21 nt, Homo sapiens
guaacucagacauuccaaggg

SEQ ID NO: 902921 - RNA, 13 nt, Homo sapiens
guaacuccagcuc

SEQ ID NO: 902922 - RNA, 21 nt, Homo sapiens
guaacugggaucgcaccuuuu

SEQ ID NO: 902923 - RNA, 10 nt, Homo sapiens
guaacugugu

SEQ ID NO: 902924 - RNA, 17 nt, Homo sapiens
guaacuuuuacaaaaca

SEQ ID NO: 902925 - RNA, 15 nt, Homo sapiens
guaagacgaaugauu

SEQ ID NO: 902926 - RNA, 15 nt, Homo sapiens
guaagacucauuccc

SEQ ID NO: 902927 - RNA, 18 nt, Homo sapiens
guaagguuauaacugugg

SEQ ID NO: 902928 - RNA, 20 nt, Homo sapiens
guaaguaccacucaggccaa

SEQ ID NO: 902929 - RNA, 22 nt, Homo sapiens
guaaguaccccugauaagcaaa

SEQ ID NO: 902930 - RNA, 23 nt, Homo sapiens
guaaguugaauggccugccuuga

SEQ ID NO: 902931 - RNA, 15 nt, Homo sapiens
guaauaaacucucua

SEQ ID NO: 902932 - RNA, 13 nt, Homo sapiens
guaauauaaugga

SEQ ID NO: 902933 - RNA, 18 nt, Homo sapiens
guaaucccagcacuuugg

SEQ ID NO: 902934 - RNA, 20 nt, Homo sapiens
guaaucccagcuacauggga

SEQ ID NO: 902935 - RNA, 18 nt, Homo sapiens
guaaucccagcuacucag

SEQ ID NO: 902936 - RNA, 12 nt, Homo sapiens
guaaugcacaau

SEQ ID NO: 902937 - RNA, 15 nt, Homo sapiens
guaaugucaccaccu

SEQ ID NO: 902938 - RNA, 18 nt, Homo sapiens
guaauugcauuucugcuc

SEQ ID NO: 902939 - RNA, 15 nt, Homo sapiens
guacaaauauuccug

SEQ ID NO: 902940 - RNA, 20 nt, Homo sapiens
guacacacacagaugcacac

SEQ ID NO: 902941 - RNA, 17 nt, Homo sapiens
guacacguguccuguag

SEQ ID NO: 902942 - RNA, 15 nt, Homo sapiens
guacagacgucucaa

SEQ ID NO: 902943 - RNA, 19 nt, Homo sapiens
guacagcagggucuugcug

SEQ ID NO: 902944 - RNA, 21 nt, Homo sapiens
guacauauggaaauccuguua

SEQ ID NO: 902945 - RNA, 21 nt, Homo sapiens
guacaugaagagcagcugguc

SEQ ID NO: 902946 - RNA, 18 nt, Homo sapiens
guacauuucccugugcug

SEQ ID NO: 902947 - RNA, 20 nt, Homo sapiens
guacauuucccugugcugac

SEQ ID NO: 902948 - RNA, 14 nt, Homo sapiens
guacauuuggugca

SEQ ID NO: 902949 - RNA, 21 nt, Homo sapiens
guaccacucaggccaacaagc

SEQ ID NO: 902950 - RNA, 12 nt, Homo sapiens
guaccagccagg

SEQ ID NO: 902951 - RNA, 14 nt, Homo sapiens
guacccaccgggcc

SEQ ID NO: 902952 - RNA, 18 nt, Homo sapiens
guaccccugauaagcaaa

SEQ ID NO: 902953 - RNA, 16 nt, Homo sapiens
guaccgcgucuacccu

SEQ ID NO: 902954 - RNA, 18 nt, Homo sapiens
guaccuuccuuaagccag

SEQ ID NO: 902955 - RNA, 19 nt, Homo sapiens
guacuaagaggcuauuuaa

SEQ ID NO: 902956 - RNA, 24 nt, Homo sapiens
guacuaagcaguaagcuaucuuca

SEQ ID NO: 902957 - RNA, 17 nt, Homo sapiens
guacuccuuaaauuuau

SEQ ID NO: 902958 - RNA, 18 nt, Homo sapiens
guacuuccuguguacucu

SEQ ID NO: 902959 - RNA, 23 nt, Homo sapiens
guagaaaagugcuguuugaggga

SEQ ID NO: 902960 - RNA, 21 nt, Homo sapiens
guagaaccacuuggcugcuca

SEQ ID NO: 902961 - RNA, 13 nt, Homo sapiens
guagaacugagaa

SEQ ID NO: 902962 - RNA, 16 nt, Homo sapiens
guagaauaaaugaaga

SEQ ID NO: 902963 - RNA, 16 nt, Homo sapiens
guagagggcacugggu

SEQ ID NO: 902964 - RNA, 18 nt, Homo sapiens
guagcaaguucuagagaa

SEQ ID NO: 902965 - RNA, 20 nt, Homo sapiens
guagccaaagguucacucuc

SEQ ID NO: 902966 - RNA, 14 nt, Homo sapiens
guagcccagcacug

SEQ ID NO: 902967 - RNA, 17 nt, Homo sapiens
guagccugugcauguau

SEQ ID NO: 902968 - RNA, 18 nt, Homo sapiens
guagcguaacaaacaaaa

SEQ ID NO: 902969 - RNA, 15 nt, Homo sapiens
guaggggcagugaug

SEQ ID NO: 902970 - RNA, 13 nt, Homo sapiens
guagguaagggcc

SEQ ID NO: 902971 - RNA, 20 nt, Homo sapiens
guagguacuucacauugcaa

SEQ ID NO: 902972 - RNA, 14 nt, Homo sapiens
guaguagugucuuc

SEQ ID NO: 902973 - RNA, 16 nt, Homo sapiens
guagucccagccacuc

SEQ ID NO: 902974 - RNA, 22 nt, Homo sapiens
guaguuaggaaauaaaaccuuu

SEQ ID NO: 902975 - RNA, 13 nt, Homo sapiens
guaguucuugucu

SEQ ID NO: 902976 - RNA, 15 nt, Homo sapiens
guauaaacuaucagu

SEQ ID NO: 902977 - RNA, 17 nt, Homo sapiens
guauaaagucacuucca

SEQ ID NO: 902978 - RNA, 21 nt, Homo sapiens
guauaaccuucaugaugaauu

SEQ ID NO: 902979 - RNA, 10 nt, Homo sapiens
guauaaucuc

SEQ ID NO: 902980 - RNA, 15 nt, Homo sapiens
guauaguacuggcau

SEQ ID NO: 902981 - RNA, 14 nt, Homo sapiens
guauauaauacuaa

SEQ ID NO: 902982 - RNA, 21 nt, Homo sapiens
guauauaauacuaaagugucu

SEQ ID NO: 902983 - RNA, 23 nt, Homo sapiens
guauauaauacuaaagugucuau

SEQ ID NO: 902984 - RNA, 13 nt, Homo sapiens
guauauacauauu

SEQ ID NO: 902985 - RNA, 19 nt, Homo sapiens
guauauauaguagcauuuc

SEQ ID NO: 902986 - RNA, 18 nt, Homo sapiens
guauauauguauaugugc

SEQ ID NO: 902987 - RNA, 16 nt, Homo sapiens
guauaugcuauucaau

SEQ ID NO: 902988 - RNA, 18 nt, Homo sapiens
guauauuaaagcaccaaa

SEQ ID NO: 902989 - RNA, 14 nt, Homo sapiens
guauauugucagau

SEQ ID NO: 902990 - RNA, 14 nt, Homo sapiens
guaucaaaaucacu

SEQ ID NO: 902991 - RNA, 19 nt, Homo sapiens
guauccaauuaugugacaa

SEQ ID NO: 902992 - RNA, 23 nt, Homo sapiens
guaucuaccaucuaaucuaugca

SEQ ID NO: 902993 - RNA, 23 nt, Homo sapiens
gucugcccccgucuucucuccau

SEQ ID NO: 902994 - RNA, 14 nt, Homo sapiens
gucugcgugacuau

SEQ ID NO: 902995 - RNA, 19 nt, Homo sapiens
gucugcuucuguccaggac

SEQ ID NO: 902996 - RNA, 16 nt, Homo sapiens
gucuggaaugcagugg

SEQ ID NO: 902997 - RNA, 17 nt, Homo sapiens
gucuguaagagaauucu

SEQ ID NO: 902998 - RNA, 14 nt, Homo sapiens
gucugucccaaaga

SEQ ID NO: 902999 - RNA, 14 nt, Homo sapiens
gucuuacugugauc

SEQ ID NO: 903000 - RNA, 21 nt, Homo sapiens
gucuucacaaccuccgugcug

SEQ ID NO: 903001 - RNA, 15 nt, Homo sapiens
gucuugaaaagccua

SEQ ID NO: 903002 - RNA, 16 nt, Homo sapiens
gucuugccagccagaa

SEQ ID NO: 903003 - RNA, 19 nt, Homo sapiens
gucuugggucgcccuaccc

SEQ ID NO: 903004 - RNA, 16 nt, Homo sapiens
gucuugucuccauuug

SEQ ID NO: 903005 - RNA, 13 nt, Homo sapiens
gucuuucugacau

SEQ ID NO: 903006 - RNA, 21 nt, Homo sapiens
gucuuuguaaugucaccaccu

SEQ ID NO: 903007 - RNA, 19 nt, Homo sapiens
gugaaacuggggcuugcaa

SEQ ID NO: 903008 - RNA, 20 nt, Homo sapiens
gugaaauaaaaguagaauaa

SEQ ID NO: 903009 - RNA, 21 nt, Homo sapiens
gugaacaccuccuagccacau

SEQ ID NO: 903010 - RNA, 16 nt, Homo sapiens
gugaacugcgugccag

SEQ ID NO: 903011 - RNA, 13 nt, Homo sapiens
gugaagaacaucc

SEQ ID NO: 903012 - RNA, 18 nt, Homo sapiens
gugaauugccugcagaga

SEQ ID NO: 903013 - RNA, 15 nt, Homo sapiens
gugacacacagcagc

SEQ ID NO: 903014 - RNA, 17 nt, Homo sapiens
gugacagaaucuuguau

SEQ ID NO: 903015 - RNA, 18 nt, Homo sapiens
gugacaggcccaguggaa

SEQ ID NO: 903016 - RNA, 15 nt, Homo sapiens
gugacaugccaucca

SEQ ID NO: 903017 - RNA, 19 nt, Homo sapiens
gugacaugggugugccagg

SEQ ID NO: 903018 - RNA, 20 nt, Homo sapiens
gugacccuucagggccagaa

SEQ ID NO: 903019 - RNA, 17 nt, Homo sapiens
gugacugaacgagggau

SEQ ID NO: 903020 - RNA, 17 nt, Homo sapiens
gugagaaggagauucaa

SEQ ID NO: 903021 - RNA, 17 nt, Homo sapiens
gugagacuccgucucaa

SEQ ID NO: 903022 - RNA, 22 nt, Homo sapiens
gugagcagacugcaaaucugcc

SEQ ID NO: 903023 - RNA, 18 nt, Homo sapiens
gugaggugcugaugagug

SEQ ID NO: 903024 - RNA, 19 nt, Homo sapiens
gugaguccgggaaucucuu

SEQ ID NO: 903025 - RNA, 15 nt, Homo sapiens
gugaguuaucacuuc

SEQ ID NO: 903026 - RNA, 15 nt, Homo sapiens
gugauauaugcaugu

SEQ ID NO: 903027 - RNA, 14 nt, Homo sapiens
gugauaucaccucu

SEQ ID NO: 903028 - RNA, 23 nt, Homo sapiens
gugaucagaaggcuggggccagu

SEQ ID NO: 903029 - RNA, 13 nt, Homo sapiens
gugaucaucccau

SEQ ID NO: 903030 - RNA, 22 nt, Homo sapiens
gugaucccuagcugugaccucu

SEQ ID NO: 903031 - RNA, 18 nt, Homo sapiens
gugauccucccaccucag

SEQ ID NO: 903032 - RNA, 23 nt, Homo sapiens
gugauccuucaucgaacaaacug

SEQ ID NO: 903033 - RNA, 14 nt, Homo sapiens
gugaugcccaaaga

SEQ ID NO: 903034 - RNA, 21 nt, Homo sapiens
gugauugacacacagcacucu

SEQ ID NO: 903035 - RNA, 19 nt, Homo sapiens
gugauuucagagagggcag

SEQ ID NO: 903036 - RNA, 14 nt, Homo sapiens
gugauuuuugaaca

SEQ ID NO: 903037 - RNA, 23 nt, Homo sapiens
gugcaagccacuauguccagcua

SEQ ID NO: 903038 - RNA, 18 nt, Homo sapiens
gugcacuagccugugauu

SEQ ID NO: 903039 - RNA, 23 nt, Homo sapiens
gugcagaugagcagucacacugu

SEQ ID NO: 903040 - RNA, 12 nt, Homo sapiens
gugcaguauuuu

SEQ ID NO: 903041 - RNA, 18 nt, Homo sapiens
gugcauagagccacguau

SEQ ID NO: 903042 - RNA, 14 nt, Homo sapiens
gugcaugugcaguc

SEQ ID NO: 903043 - RNA, 12 nt, Homo sapiens
gugcauguguau

SEQ ID NO: 903044 - RNA, 17 nt, Homo sapiens
gugcauuuaugagcucu

SEQ ID NO: 903045 - RNA, 15 nt, Homo sapiens
gugcauuucugucuc

SEQ ID NO: 903046 - RNA, 20 nt, Homo sapiens
gugccaauauguauuguaaa

SEQ ID NO: 903047 - RNA, 17 nt, Homo sapiens
gugccauagaugguucu

SEQ ID NO: 903048 - RNA, 19 nt, Homo sapiens
gugccauucccacuaagcu

SEQ ID NO: 903049 - RNA, 13 nt, Homo sapiens
gugcccacaaaau

SEQ ID NO: 903050 - RNA, 18 nt, Homo sapiens
gugccguaacaacugugg

SEQ ID NO: 903051 - RNA, 12 nt, Homo sapiens
gugccugagaca

SEQ ID NO: 903052 - RNA, 15 nt, Homo sapiens
gugccuggacauuug

SEQ ID NO: 903053 - RNA, 18 nt, Homo sapiens
gugccuggccuggcacac

SEQ ID NO: 903054 - RNA, 19 nt, Homo sapiens
gugccuucauuugggaugc

SEQ ID NO: 903055 - RNA, 14 nt, Homo sapiens
gugccuuccauaau

SEQ ID NO: 903056 - RNA, 18 nt, Homo sapiens
gugcuacaaaaacacagc

SEQ ID NO: 903057 - RNA, 12 nt, Homo sapiens
gugcuaccucuc

SEQ ID NO: 903058 - RNA, 23 nt, Homo sapiens
gugcuacuuugccuuuugcaaac

SEQ ID NO: 903059 - RNA, 15 nt, Homo sapiens
gugcuagaugugcaa

SEQ ID NO: 903060 - RNA, 18 nt, Homo sapiens
gugcuauaggcuggagaa

SEQ ID NO: 903061 - RNA, 17 nt, Homo sapiens
gugcuaucgcaccacug

SEQ ID NO: 903062 - RNA, 20 nt, Homo sapiens
gugcuaucgcaccacugugu

SEQ ID NO: 903063 - RNA, 15 nt, Homo sapiens
gugcucacugaccug

SEQ ID NO: 903064 - RNA, 22 nt, Homo sapiens
gugcucauucauuuaacagagc

SEQ ID NO: 903065 - RNA, 15 nt, Homo sapiens
gugcucggcuguaaa

SEQ ID NO: 903066 - RNA, 19 nt, Homo sapiens
gugcucggcuguaaacagc

SEQ ID NO: 903067 - RNA, 19 nt, Homo sapiens
gugcuggagcaaaagucau

SEQ ID NO: 903068 - RNA, 18 nt, Homo sapiens
gugcugugggcagcaccc

SEQ ID NO: 903069 - RNA, 19 nt, Homo sapiens
gugcuuagccuccugaccu

SEQ ID NO: 903070 - RNA, 15 nt, Homo sapiens
gugcuucagccugag

SEQ ID NO: 903071 - RNA, 19 nt, Homo sapiens
gugcuugccaccaccagau

SEQ ID NO: 903072 - RNA, 19 nt, Homo sapiens
gugcuugccugggaccagu

SEQ ID NO: 903073 - RNA, 15 nt, Homo sapiens
gugcuugucauggaa

SEQ ID NO: 903074 - RNA, 18 nt, Homo sapiens
guggaaccaacacuaaca

SEQ ID NO: 903075 - RNA, 15 nt, Homo sapiens
guggaauugugcuga

SEQ ID NO: 903076 - RNA, 12 nt, Homo sapiens
guggacaccugc

SEQ ID NO: 903077 - RNA, 20 nt, Homo sapiens
guggagaaauuccuugauuc

SEQ ID NO: 903078 - RNA, 14 nt, Homo sapiens
guggaggacuuuga

SEQ ID NO: 903079 - RNA, 17 nt, Homo sapiens
guggagguugcagugag

SEQ ID NO: 903080 - RNA, 16 nt, Homo sapiens
guggauaucuguguau

SEQ ID NO: 903081 - RNA, 21 nt, Homo sapiens
guggcagcugcuuuugucuau

SEQ ID NO: 903082 - RNA, 18 nt, Homo sapiens
guggcauucacaucucau

SEQ ID NO: 903083 - RNA, 13 nt, Homo sapiens
guggccaguauuu

SEQ ID NO: 903084 - RNA, 18 nt, Homo sapiens
guggccaugcuucuugcc

SEQ ID NO: 903085 - RNA, 14 nt, Homo sapiens
guggcccaagacaa

SEQ ID NO: 903086 - RNA, 18 nt, Homo sapiens
guggcccagggaagccaa

SEQ ID NO: 903087 - RNA, 19 nt, Homo sapiens
guggcccagggaagccaaa

SEQ ID NO: 903088 - RNA, 21 nt, Homo sapiens
guggcccccugugccagcuca

SEQ ID NO: 903089 - RNA, 23 nt, Homo sapiens
guggcuccugccacugaccucac

SEQ ID NO: 903090 - RNA, 22 nt, Homo sapiens
guggcucuugccuguaauccca

SEQ ID NO: 903091 - RNA, 23 nt, Homo sapiens
guggcuuuggcagaccaucucca

SEQ ID NO: 903092 - RNA, 13 nt, Homo sapiens
gugggaacucuga

SEQ ID NO: 903093 - RNA, 21 nt, Homo sapiens
gugggaaggucccuuguuucc

SEQ ID NO: 903094 - RNA, 16 nt, Homo sapiens
gugggacugacauuuc

SEQ ID NO: 903095 - RNA, 16 nt, Homo sapiens
gugggagagacacucc

SEQ ID NO: 903096 - RNA, 15 nt, Homo sapiens
gugggcagcagcuca

SEQ ID NO: 903097 - RNA, 19 nt, Homo sapiens
gugggccacguguucucac

SEQ ID NO: 903098 - RNA, 20 nt, Homo sapiens
guggggaccgggcucugaca

SEQ ID NO: 903099 - RNA, 12 nt, Homo sapiens
gugggugccugu

SEQ ID NO: 903100 - RNA, 12 nt, Homo sapiens
guggguggugga

SEQ ID NO: 903101 - RNA, 12 nt, Homo sapiens
gugguaccagcu

SEQ ID NO: 903102 - RNA, 18 nt, Homo sapiens
gugguauauuuguguaug

SEQ ID NO: 903103 - RNA, 17 nt, Homo sapiens
guggucuccuugcacuu

SEQ ID NO: 903104 - RNA, 21 nt, Homo sapiens
guggugagccgagauugcacc

SEQ ID NO: 903105 - RNA, 13 nt, Homo sapiens
guggugugucaau

SEQ ID NO: 903106 - RNA, 13 nt, Homo sapiens
gugguugcuguug

SEQ ID NO: 903107 - RNA, 15 nt, Homo sapiens
gugguuguuuuguca

SEQ ID NO: 903108 - RNA, 13 nt, Homo sapiens
caaggaauccuga

SEQ ID NO: 903109 - RNA, 16 nt, Homo sapiens
caaggacaaccugccc

SEQ ID NO: 903110 - RNA, 19 nt, Homo sapiens
caaggaguaaguacaaaua

SEQ ID NO: 903111 - RNA, 19 nt, Homo sapiens
caaggauguucuggcuuua

SEQ ID NO: 903112 - RNA, 15 nt, Homo sapiens
caaggcuaguuccuu

SEQ ID NO: 903113 - RNA, 22 nt, Homo sapiens
caaggggcugaaaagaucugaa

SEQ ID NO: 903114 - RNA, 14 nt, Homo sapiens
caaggggcuuuguc

SEQ ID NO: 903115 - RNA, 16 nt, Homo sapiens
caaggggucuguauau

SEQ ID NO: 903116 - RNA, 19 nt, Homo sapiens
caagguggguggaucaccu

SEQ ID NO: 903117 - RNA, 19 nt, Homo sapiens
caaguacauggcuagcuuu

SEQ ID NO: 903118 - RNA, 21 nt, Homo sapiens
caaguauguugagaguugcug

SEQ ID NO: 903119 - RNA, 20 nt, Homo sapiens
caaguauugcgaaugugcag

SEQ ID NO: 903120 - RNA, 15 nt, Homo sapiens
caagucaacacucuu

SEQ ID NO: 903121 - RNA, 17 nt, Homo sapiens
caagucaccggagcuuu

SEQ ID NO: 903122 - RNA, 21 nt, Homo sapiens
caagucaggcccuuauuuuca

SEQ ID NO: 903123 - RNA, 12 nt, Homo sapiens
caaguccagagc

SEQ ID NO: 903124 - RNA, 23 nt, Homo sapiens
caagucccauugaaaaugaaugc

SEQ ID NO: 903125 - RNA, 24 nt, Homo sapiens
caaguccugggaauaugcuaguga

SEQ ID NO: 903126 - RNA, 13 nt, Homo sapiens
caagucuacuuca

SEQ ID NO: 903127 - RNA, 15 nt, Homo sapiens
caagucuacuucacu

SEQ ID NO: 903128 - RNA, 19 nt, Homo sapiens
caagucuucccugaucaag

SEQ ID NO: 903129 - RNA, 19 nt, Homo sapiens
caagucuugaaacaagcaa

SEQ ID NO: 903130 - RNA, 18 nt, Homo sapiens
caagugaguuugguguuu

SEQ ID NO: 903131 - RNA, 14 nt, Homo sapiens
caagugcacuugaa

SEQ ID NO: 903132 - RNA, 23 nt, Homo sapiens
caaguuaaaaccugcaaagcuaa

SEQ ID NO: 903133 - RNA, 16 nt, Homo sapiens
caaguuagcucaggag

SEQ ID NO: 903134 - RNA, 13 nt, Homo sapiens
caaguuauauuga

SEQ ID NO: 903135 - RNA, 16 nt, Homo sapiens
caaguuauucucuuca

SEQ ID NO: 903136 - RNA, 21 nt, Homo sapiens
caaguuuuucagaaagcauua

SEQ ID NO: 903137 - RNA, 16 nt, Homo sapiens
caauaaaucaacucca

SEQ ID NO: 903138 - RNA, 17 nt, Homo sapiens
caauaacuucagagaag

SEQ ID NO: 903139 - RNA, 19 nt, Homo sapiens
caauaaguuccauguuaaa

SEQ ID NO: 903140 - RNA, 22 nt, Homo sapiens
caauaaguuccauguuaaaaua

SEQ ID NO: 903141 - RNA, 17 nt, Homo sapiens
caauaaugaguucacua

SEQ ID NO: 903142 - RNA, 19 nt, Homo sapiens
caauaauucuaugagauag

SEQ ID NO: 903143 - RNA, 14 nt, Homo sapiens
caauaauuucaggu

SEQ ID NO: 903144 - RNA, 18 nt, Homo sapiens
caauacaugcugcuaauu

SEQ ID NO: 903145 - RNA, 21 nt, Homo sapiens
caauacaugcugcuaauucaa

SEQ ID NO: 903146 - RNA, 12 nt, Homo sapiens
caauacauguau

SEQ ID NO: 903147 - RNA, 13 nt, Homo sapiens
caauacauguauc

SEQ ID NO: 903148 - RNA, 15 nt, Homo sapiens
caauacauguaucua

SEQ ID NO: 903149 - RNA, 15 nt, Homo sapiens
caauaccaaauagcu

SEQ ID NO: 903150 - RNA, 14 nt, Homo sapiens
caauagaguucucc

SEQ ID NO: 903151 - RNA, 19 nt, Homo sapiens
caauaugaaggacuauuaa

SEQ ID NO: 903152 - RNA, 18 nt, Homo sapiens
caauaugggcucaaguca

SEQ ID NO: 903153 - RNA, 16 nt, Homo sapiens
caauauuucugauaua

SEQ ID NO: 903154 - RNA, 12 nt, Homo sapiens
caaucacacuca

SEQ ID NO: 903155 - RNA, 12 nt, Homo sapiens
caaucccaaaag

SEQ ID NO: 903156 - RNA, 18 nt, Homo sapiens
caauccgaaguaugaggg

SEQ ID NO: 903157 - RNA, 21 nt, Homo sapiens
caauccugcccccagccaugg

SEQ ID NO: 903158 - RNA, 12 nt, Homo sapiens
caauccuuaaca

SEQ ID NO: 903159 - RNA, 19 nt, Homo sapiens
gggagagcgaaggggguca

SEQ ID NO: 903160 - RNA, 16 nt, Homo sapiens
gggagccucuccuugc

SEQ ID NO: 903161 - RNA, 14 nt, Homo sapiens
gggagcuacagggg

SEQ ID NO: 903162 - RNA, 17 nt, Homo sapiens
gggaggaagcagguuga

SEQ ID NO: 903163 - RNA, 20 nt, Homo sapiens
gggaggcggagguuccagug

SEQ ID NO: 903164 - RNA, 14 nt, Homo sapiens
gggaggucccugcc

SEQ ID NO: 903165 - RNA, 17 nt, Homo sapiens
gggagguuccucgcagg

SEQ ID NO: 903166 - RNA, 13 nt, Homo sapiens
gggaguggcagaa

SEQ ID NO: 903167 - RNA, 23 nt, Homo sapiens
gggauaaguaaguuugauuucau

SEQ ID NO: 903168 - RNA, 22 nt, Homo sapiens
gggaucuguaaggaacuggaac

SEQ ID NO: 903169 - RNA, 23 nt, Homo sapiens
gggaucuuccuugggaugaucuu

SEQ ID NO: 903170 - RNA, 22 nt, Homo sapiens
gggaugcacggcggcagggugg

SEQ ID NO: 903171 - RNA, 18 nt, Homo sapiens
gggaugccacccagcaac

SEQ ID NO: 903172 - RNA, 15 nt, Homo sapiens
gggaugggauuucau

SEQ ID NO: 903173 - RNA, 23 nt, Homo sapiens
gggauuucuucgcugcucuagcu

SEQ ID NO: 903174 - RNA, 18 nt, Homo sapiens
gggcaaagaaaagccaga

SEQ ID NO: 903175 - RNA, 14 nt, Homo sapiens
gggcaacaacagca

SEQ ID NO: 903176 - RNA, 21 nt, Homo sapiens
gggcaacaauacaugcugcua

SEQ ID NO: 903177 - RNA, 18 nt, Homo sapiens
gggcaagaaccuaaagua

SEQ ID NO: 903178 - RNA, 13 nt, Homo sapiens
gggcaagaaggaa

SEQ ID NO: 903179 - RNA, 12 nt, Homo sapiens
gggcacugccug

SEQ ID NO: 903180 - RNA, 16 nt, Homo sapiens
gggcagcccagccucu

SEQ ID NO: 903181 - RNA, 13 nt, Homo sapiens
gggccacugccag

SEQ ID NO: 903182 - RNA, 11 nt, Homo sapiens
gggccaucuca

SEQ ID NO: 903183 - RNA, 13 nt, Homo sapiens
gggccaucucaga

SEQ ID NO: 903184 - RNA, 21 nt, Homo sapiens
gggcccacagggaacccugcu

SEQ ID NO: 903185 - RNA, 13 nt, Homo sapiens
gggccccagagag

SEQ ID NO: 903186 - RNA, 20 nt, Homo sapiens
gggccgcuguguuuggagac

SEQ ID NO: 903187 - RNA, 15 nt, Homo sapiens
gggccuaggaggacc

SEQ ID NO: 903188 - RNA, 12 nt, Homo sapiens
gggccucugaaa

SEQ ID NO: 903189 - RNA, 17 nt, Homo sapiens
gggccugauggugcuca

SEQ ID NO: 903190 - RNA, 14 nt, Homo sapiens
gggccugcccagug

SEQ ID NO: 903191 - RNA, 23 nt, Homo sapiens
gggccuucacagugaccaucgca

SEQ ID NO: 903192 - RNA, 18 nt, Homo sapiens
gggcuaccccacccaagu

SEQ ID NO: 903193 - RNA, 22 nt, Homo sapiens
gggcuagggagaaugcagagag

SEQ ID NO: 903194 - RNA, 12 nt, Homo sapiens
gggcuagggagg

SEQ ID NO: 903195 - RNA, 19 nt, Homo sapiens
gggcucagcagccagagga

SEQ ID NO: 903196 - RNA, 14 nt, Homo sapiens
gggcucagccuggu

SEQ ID NO: 903197 - RNA, 13 nt, Homo sapiens
gggcugcuuccca

SEQ ID NO: 903198 - RNA, 11 nt, Homo sapiens
gggcuguagac

SEQ ID NO: 903199 - RNA, 16 nt, Homo sapiens
gggcuuggaaggaaaa

SEQ ID NO: 903200 - RNA, 22 nt, Homo sapiens
gggcuuguagaccacuguccug

SEQ ID NO: 903201 - RNA, 22 nt, Homo sapiens
ggggaccucauuccugggacua

SEQ ID NO: 903202 - RNA, 22 nt, Homo sapiens
ggggagcccccucuuccacuca

SEQ ID NO: 903203 - RNA, 13 nt, Homo sapiens
ggggcaucccaga

SEQ ID NO: 903204 - RNA, 19 nt, Homo sapiens
ggggccucuuucugugcuu

SEQ ID NO: 903205 - RNA, 20 nt, Homo sapiens
agugcugcuggaaguagaau

SEQ ID NO: 903206 - RNA, 15 nt, Homo sapiens
agugcuuccacuucu

SEQ ID NO: 903207 - RNA, 16 nt, Homo sapiens
agugcuuggguggugg

SEQ ID NO: 903208 - RNA, 15 nt, Homo sapiens
agugcuugucaugga

SEQ ID NO: 903209 - RNA, 22 nt, Homo sapiens
aguggagaguguuccuguugaa

SEQ ID NO: 903210 - RNA, 15 nt, Homo sapiens
aguggcauccauuuc

SEQ ID NO: 903211 - RNA, 14 nt, Homo sapiens
aguggccaugccac

SEQ ID NO: 903212 - RNA, 23 nt, Homo sapiens
aguggcucacgccuaugauccca

SEQ ID NO: 903213 - RNA, 20 nt, Homo sapiens
aguggcucuucuaaccucag

SEQ ID NO: 903214 - RNA, 13 nt, Homo sapiens
aguggcuuuuuaa

SEQ ID NO: 903215 - RNA, 21 nt, Homo sapiens
agugggaggguaccagcagaa

SEQ ID NO: 903216 - RNA, 24 nt, Homo sapiens
agugggugguggaucuguccaagg

SEQ ID NO: 903217 - RNA, 16 nt, Homo sapiens
agugguauauacauau

SEQ ID NO: 903218 - RNA, 13 nt, Homo sapiens
aguguaacacugc

SEQ ID NO: 903219 - RNA, 19 nt, Homo sapiens
aguguaaccuugcaucuca

SEQ ID NO: 903220 - RNA, 23 nt, Homo sapiens
aguguauuuuauguguggcccaa

SEQ ID NO: 903221 - RNA, 23 nt, Homo sapiens
aguguccagaccauugucuucca

SEQ ID NO: 903222 - RNA, 14 nt, Homo sapiens
agugucuugaaugu

SEQ ID NO: 903223 - RNA, 12 nt, Homo sapiens
agugugauccca

SEQ ID NO: 903224 - RNA, 14 nt, Homo sapiens
aguguggaagcaga

SEQ ID NO: 903225 - RNA, 12 nt, Homo sapiens
aguguggcccag

SEQ ID NO: 903226 - RNA, 23 nt, Homo sapiens
aguguggcccagggaagccaaaa

SEQ ID NO: 903227 - RNA, 18 nt, Homo sapiens
agugugggcauagcauua

SEQ ID NO: 903228 - RNA, 19 nt, Homo sapiens
aguguguugggaauugcau

SEQ ID NO: 903229 - RNA, 13 nt, Homo sapiens
aguguucaagaaa

SEQ ID NO: 903230 - RNA, 19 nt, Homo sapiens
aguguuccccaucuggguc

SEQ ID NO: 903231 - RNA, 21 nt, Homo sapiens
aguguuggaaaaugugcaaua

SEQ ID NO: 903232 - RNA, 21 nt, Homo sapiens
aguuaaaagacugcagcugcu

SEQ ID NO: 903233 - RNA, 19 nt, Homo sapiens
aguuaaggauuguuuuaaa

SEQ ID NO: 903234 - RNA, 13 nt, Homo sapiens
aguuaaguauuua

SEQ ID NO: 903235 - RNA, 15 nt, Homo sapiens
aguuaauacuuaaca

SEQ ID NO: 903236 - RNA, 12 nt, Homo sapiens
aguuacauauua

SEQ ID NO: 903237 - RNA, 23 nt, Homo sapiens
aguuacccugcauguuggcccag

SEQ ID NO: 903238 - RNA, 15 nt, Homo sapiens
aguuagguagcuuua

SEQ ID NO: 903239 - RNA, 16 nt, Homo sapiens
aguuagguagcuuuag

SEQ ID NO: 903240 - RNA, 23 nt, Homo sapiens
aguuaggucauuacuaaccauag

SEQ ID NO: 903241 - RNA, 11 nt, Homo sapiens
aguuaggugug

SEQ ID NO: 903242 - RNA, 18 nt, Homo sapiens
aguuauuccccaucuucc

SEQ ID NO: 903243 - RNA, 19 nt, Homo sapiens
aguuauuccccaucuucca

SEQ ID NO: 903244 - RNA, 21 nt, Homo sapiens
aguucaaaaaacucuugauau

SEQ ID NO: 903245 - RNA, 22 nt, Homo sapiens
aguucacuuuuuacagugcuau

SEQ ID NO: 903246 - RNA, 23 nt, Homo sapiens
aguucagaguuguacacugugua

SEQ ID NO: 903247 - RNA, 16 nt, Homo sapiens
aguucauauguaccau

SEQ ID NO: 903248 - RNA, 17 nt, Homo sapiens
aguucauauguaccaug

SEQ ID NO: 903249 - RNA, 18 nt, Homo sapiens
aguucauauguaccaugu

SEQ ID NO: 903250 - RNA, 12 nt, Homo sapiens
aguuccaaauaa

SEQ ID NO: 903251 - RNA, 21 nt, Homo sapiens
aguuccagauuguucugucca

SEQ ID NO: 903252 - RNA, 16 nt, Homo sapiens
aguuccugcacuccag

SEQ ID NO: 903253 - RNA, 18 nt, Homo sapiens
aguuccugcacuccagaa

SEQ ID NO: 903254 - RNA, 21 nt, Homo sapiens
aguuccugugggugugucucu

SEQ ID NO: 903255 - RNA, 19 nt, Homo sapiens
aguuccuuauaagaauuaa

SEQ ID NO: 903256 - RNA, 16 nt, Homo sapiens
aguuccuuucaauggu

SEQ ID NO: 903257 - RNA, 13 nt, Homo sapiens
aguucuaauuccc

SEQ ID NO: 903258 - RNA, 14 nt, Homo sapiens
aguucuaggcauag

SEQ ID NO: 903259 - RNA, 16 nt, Homo sapiens
aguucugaaaacuguu

SEQ ID NO: 903260 - RNA, 16 nt, Homo sapiens
aguucuuuuacuguaa

SEQ ID NO: 903261 - RNA, 13 nt, Homo sapiens
aguugaaacaaga

SEQ ID NO: 903262 - RNA, 14 nt, Homo sapiens
aguugaacaucuca

SEQ ID NO: 903263 - RNA, 15 nt, Homo sapiens
aguugacuugacaga

SEQ ID NO: 903264 - RNA, 22 nt, Homo sapiens
aguugacuugacagaacacugu

SEQ ID NO: 903265 - RNA, 13 nt, Homo sapiens
aguugagaacaaa

SEQ ID NO: 903266 - RNA, 15 nt, Homo sapiens
aguugagucuccucu

SEQ ID NO: 903267 - RNA, 22 nt, Homo sapiens
aguugagucuccucucugagac

SEQ ID NO: 903268 - RNA, 17 nt, Homo sapiens
aguugcugaugaacucu

SEQ ID NO: 903269 - RNA, 16 nt, Homo sapiens
aguugcuucucaugga

SEQ ID NO: 903270 - RNA, 18 nt, Homo sapiens
aguuggccaugaugucuu

SEQ ID NO: 903271 - RNA, 14 nt, Homo sapiens
aguuggcucaggca

SEQ ID NO: 903272 - RNA, 16 nt, Homo sapiens
aguugggagcacugga

SEQ ID NO: 903273 - RNA, 21 nt, Homo sapiens
aguuguaacuuugccuucaca

SEQ ID NO: 903274 - RNA, 14 nt, Homo sapiens
aguuguacacugug

SEQ ID NO: 903275 - RNA, 20 nt, Homo sapiens
aguuguuuucccgagcaaag

SEQ ID NO: 903276 - RNA, 15 nt, Homo sapiens
aguuuaaaaaaccau

SEQ ID NO: 903277 - RNA, 20 nt, Homo sapiens
aguuuaacuuugggcccaga

SEQ ID NO: 903278 - RNA, 15 nt, Homo sapiens
aguuuaagucucuga

SEQ ID NO: 903279 - RNA, 19 nt, Homo sapiens
aguuuagugcccucaucca

SEQ ID NO: 903280 - RNA, 14 nt, Homo sapiens
aguuuaucauguca

SEQ ID NO: 903281 - RNA, 19 nt, Homo sapiens
aguuuaucauugggagaag

SEQ ID NO: 903282 - RNA, 13 nt, Homo sapiens
aguuuaucuuuca

SEQ ID NO: 903283 - RNA, 16 nt, Homo sapiens
aguuucccaaauuccc

SEQ ID NO: 903284 - RNA, 11 nt, Homo sapiens
aguuuccccac

SEQ ID NO: 903285 - RNA, 20 nt, Homo sapiens
aguuucuccuuuugaccaaa

SEQ ID NO: 903286 - RNA, 22 nt, Homo sapiens
aguuucuucuuuaggcauuaaa

SEQ ID NO: 903287 - RNA, 13 nt, Homo sapiens
aguuugagaccag

SEQ ID NO: 903288 - RNA, 14 nt, Homo sapiens
aguuugaucaaauc

SEQ ID NO: 903289 - RNA, 21 nt, Homo sapiens
aguuugcuuauguaaucucac

SEQ ID NO: 903290 - RNA, 18 nt, Homo sapiens
aguuuuauuuuuguagag

SEQ ID NO: 903291 - RNA, 13 nt, Homo sapiens
aguuuucaaagau

SEQ ID NO: 903292 - RNA, 13 nt, Homo sapiens
auaaaugccucau

SEQ ID NO: 903293 - RNA, 20 nt, Homo sapiens
auaaauguaaauauguacac

SEQ ID NO: 903294 - RNA, 18 nt, Homo sapiens
auaaauguguggugcuaa

SEQ ID NO: 903295 - RNA, 18 nt, Homo sapiens
auaaauuuaucaucucga

SEQ ID NO: 903296 - RNA, 14 nt, Homo sapiens
auaaauuugguucu

SEQ ID NO: 903297 - RNA, 17 nt, Homo sapiens
auaaauuuuauaaucau

SEQ ID NO: 903298 - RNA, 20 nt, Homo sapiens
auaacaagaucuuucaggaa

SEQ ID NO: 903299 - RNA, 16 nt, Homo sapiens
auaaccccaccuugcc

SEQ ID NO: 903300 - RNA, 14 nt, Homo sapiens
auaaccuagccuua

SEQ ID NO: 903301 - RNA, 15 nt, Homo sapiens
auaacuucucugagu

SEQ ID NO: 903302 - RNA, 20 nt, Homo sapiens
auaagaaacaugaugugaga

SEQ ID NO: 903303 - RNA, 16 nt, Homo sapiens
auaagaaaguauaaag

SEQ ID NO: 903304 - RNA, 14 nt, Homo sapiens
auaagacaagaaua

SEQ ID NO: 903305 - RNA, 18 nt, Homo sapiens
auaagagugccguaacaa

SEQ ID NO: 903306 - RNA, 21 nt, Homo sapiens
auaagcaucuguguaaccucc

SEQ ID NO: 903307 - RNA, 12 nt, Homo sapiens
auaagcaugauc

SEQ ID NO: 903308 - RNA, 14 nt, Homo sapiens
auaagcauucaaua

SEQ ID NO: 903309 - RNA, 19 nt, Homo sapiens
auaaggaucagaacagcag

SEQ ID NO: 903310 - RNA, 19 nt, Homo sapiens
auaaggccagaaacuccuu

SEQ ID NO: 903311 - RNA, 16 nt, Homo sapiens
auaaguuccauguuaa

SEQ ID NO: 903312 - RNA, 13 nt, Homo sapiens
auaauaagaagga

SEQ ID NO: 903313 - RNA, 15 nt, Homo sapiens
auaauaauugaucaa

SEQ ID NO: 903314 - RNA, 14 nt, Homo sapiens
auaauaauuuuccu

SEQ ID NO: 903315 - RNA, 22 nt, Homo sapiens
auaaucaaaacccaacaugacu

SEQ ID NO: 903316 - RNA, 15 nt, Homo sapiens
auaaucacauuauca

SEQ ID NO: 903317 - RNA, 18 nt, Homo sapiens
auaaucgagucuaccucu

SEQ ID NO: 903318 - RNA, 22 nt, Homo sapiens
auaaucucuuuaaauggcuuua

SEQ ID NO: 903319 - RNA, 18 nt, Homo sapiens
auaauggggccuguuaca

SEQ ID NO: 903320 - RNA, 18 nt, Homo sapiens
auaaugguugacuggguu

SEQ ID NO: 903321 - RNA, 17 nt, Homo sapiens
auaaugguuuacugcug

SEQ ID NO: 903322 - RNA, 22 nt, Homo sapiens
auaauguaagggucuguuguaa

SEQ ID NO: 903323 - RNA, 18 nt, Homo sapiens
auaaugucgaacucugaa

SEQ ID NO: 903324 - RNA, 13 nt, Homo sapiens
auaaugugcaaau

SEQ ID NO: 903325 - RNA, 17 nt, Homo sapiens
auaauguuacauuauua

SEQ ID NO: 903326 - RNA, 22 nt, Homo sapiens
auaauguuaucuguguagcaag

SEQ ID NO: 903327 - RNA, 15 nt, Homo sapiens
auacaaaacuguuca

SEQ ID NO: 903328 - RNA, 20 nt, Homo sapiens
auacaaacuacagaguuuau

SEQ ID NO: 903329 - RNA, 13 nt, Homo sapiens
auacaacauguag

SEQ ID NO: 903330 - RNA, 23 nt, Homo sapiens
auacaauucaaguugcuucucau

SEQ ID NO: 903331 - RNA, 22 nt, Homo sapiens
auacacacacacgcgugcacac

SEQ ID NO: 903332 - RNA, 19 nt, Homo sapiens
auacacacauauacauaua

SEQ ID NO: 903333 - RNA, 20 nt, Homo sapiens
auacacagaugauaauaugc

SEQ ID NO: 903334 - RNA, 16 nt, Homo sapiens
auacacauacauacac

SEQ ID NO: 903335 - RNA, 20 nt, Homo sapiens
auacacauccccagccagaa

SEQ ID NO: 903336 - RNA, 16 nt, Homo sapiens
auacauacacuuguau

SEQ ID NO: 903337 - RNA, 14 nt, Homo sapiens
auacauacauacau

SEQ ID NO: 903338 - RNA, 11 nt, Homo sapiens
auacauaucag

SEQ ID NO: 903339 - RNA, 15 nt, Homo sapiens
auacauguacuccag

SEQ ID NO: 903340 - RNA, 12 nt, Homo sapiens
auacauugccaa

SEQ ID NO: 903341 - RNA, 13 nt, Homo sapiens
auaccaagcuugu

SEQ ID NO: 903342 - RNA, 23 nt, Homo sapiens
auaccacaauaaaaaaaaaccua

SEQ ID NO: 903343 - RNA, 19 nt, Homo sapiens
auaccagugaaccaaagag

SEQ ID NO: 903344 - RNA, 15 nt, Homo sapiens
auaccaucuguagag

SEQ ID NO: 903345 - RNA, 14 nt, Homo sapiens
auacccagucccag

SEQ ID NO: 903346 - RNA, 20 nt, Homo sapiens
auaccgcuggggaacagagc

SEQ ID NO: 903347 - RNA, 22 nt, Homo sapiens
auaccuguguuucuugccucau

SEQ ID NO: 903348 - RNA, 18 nt, Homo sapiens
auacgaccgggaggucca

SEQ ID NO: 903349 - RNA, 23 nt, Homo sapiens
auacgugaaagaugcaagcaccu

SEQ ID NO: 903350 - RNA, 20 nt, Homo sapiens
auacguuugaaauaguugau

SEQ ID NO: 903351 - RNA, 12 nt, Homo sapiens
auacuaccaagu

SEQ ID NO: 903352 - RNA, 19 nt, Homo sapiens
auacuaccggcuacaucaa

SEQ ID NO: 903353 - RNA, 18 nt, Homo sapiens
auacucauuucuaaaaga

SEQ ID NO: 903354 - RNA, 19 nt, Homo sapiens
auacugacacuuugccaga

SEQ ID NO: 903355 - RNA, 13 nt, Homo sapiens
auacuguacauag

SEQ ID NO: 903356 - RNA, 22 nt, Homo sapiens
auacuguacugagacauuacag

SEQ ID NO: 903357 - RNA, 17 nt, Homo sapiens
auacuucaauacuucau

SEQ ID NO: 903358 - RNA, 14 nt, Homo sapiens
auagaaaacugaaa

SEQ ID NO: 903359 - RNA, 15 nt, Homo sapiens
auagaaacugaggag

SEQ ID NO: 903360 - RNA, 19 nt, Homo sapiens
auagaagaugaaucauuga

SEQ ID NO: 903361 - RNA, 15 nt, Homo sapiens
auagaauauuuacaa

SEQ ID NO: 903362 - RNA, 20 nt, Homo sapiens
auagacaauuugcccuauca

SEQ ID NO: 903363 - RNA, 20 nt, Homo sapiens
auagacugccaugcuagaca

SEQ ID NO: 903364 - RNA, 23 nt, Homo sapiens
auagagaagaucuaauaccaucc

SEQ ID NO: 903365 - RNA, 13 nt, Homo sapiens
auagagauaugca

SEQ ID NO: 903366 - RNA, 13 nt, Homo sapiens
auagaguuccaaa

SEQ ID NO: 903367 - RNA, 21 nt, Homo sapiens
auagauccauuuggacaaaau

SEQ ID NO: 903368 - RNA, 12 nt, Homo sapiens
auagaugugcaa

SEQ ID NO: 903369 - RNA, 21 nt, Homo sapiens
auagauuuucugcuacuuugc

SEQ ID NO: 903370 - RNA, 15 nt, Homo sapiens
auagcaauguaacau

SEQ ID NO: 903371 - RNA, 23 nt, Homo sapiens
auagcagcaaacagagugaaaug

SEQ ID NO: 903372 - RNA, 17 nt, Homo sapiens
cuugucuuacauaauca

SEQ ID NO: 903373 - RNA, 21 nt, Homo sapiens
cuugugauuuuugaacaauac

SEQ ID NO: 903374 - RNA, 15 nt, Homo sapiens
cuuguguguuuugag

SEQ ID NO: 903375 - RNA, 22 nt, Homo sapiens
cuuguuggauuccagugcaggu

SEQ ID NO: 903376 - RNA, 17 nt, Homo sapiens
cuuguugguugucacuc

SEQ ID NO: 903377 - RNA, 23 nt, Homo sapiens
cuuguuucacacuagucacauuc

SEQ ID NO: 903378 - RNA, 18 nt, Homo sapiens
cuuguuuuaagauuguaa

SEQ ID NO: 903379 - RNA, 18 nt, Homo sapiens
cuuuaaaaagcaguccuc

SEQ ID NO: 903380 - RNA, 22 nt, Homo sapiens
cuuuaaaaauaugcaccaaauc

SEQ ID NO: 903381 - RNA, 22 nt, Homo sapiens
cuuuaaaauaaaauaauuuuau

SEQ ID NO: 903382 - RNA, 20 nt, Homo sapiens
cuuuaaagcguuugcacaga

SEQ ID NO: 903383 - RNA, 20 nt, Homo sapiens
cuuuaaagggauggcaagau

SEQ ID NO: 903384 - RNA, 12 nt, Homo sapiens
cuuuaaauucaa

SEQ ID NO: 903385 - RNA, 13 nt, Homo sapiens
cuuuaacaaaaca

SEQ ID NO: 903386 - RNA, 13 nt, Homo sapiens
cuuuaaccucauc

SEQ ID NO: 903387 - RNA, 14 nt, Homo sapiens
cuuuaacugacuua

SEQ ID NO: 903388 - RNA, 13 nt, Homo sapiens
cuuuaccuaccac

SEQ ID NO: 903389 - RNA, 19 nt, Homo sapiens
cuuuacuguuagucauuug

SEQ ID NO: 903390 - RNA, 22 nt, Homo sapiens
cuuuagagccagcccauggcuu

SEQ ID NO: 903391 - RNA, 23 nt, Homo sapiens
cuuuagaguagcaugagagaauu

SEQ ID NO: 903392 - RNA, 22 nt, Homo sapiens
cuuuaggaggaggugggggcua

SEQ ID NO: 903393 - RNA, 16 nt, Homo sapiens
cuuuaguuccuacuuu

SEQ ID NO: 903394 - RNA, 17 nt, Homo sapiens
cuuuauagccuguaacc

SEQ ID NO: 903395 - RNA, 17 nt, Homo sapiens
cuuuauccaauccucag

SEQ ID NO: 903396 - RNA, 13 nt, Homo sapiens
cuuuaucugugac

SEQ ID NO: 903397 - RNA, 17 nt, Homo sapiens
cuuuaucugugaccaca

SEQ ID NO: 903398 - RNA, 21 nt, Homo sapiens
cuuuaugcuaguuugaccuca

SEQ ID NO: 903399 - RNA, 17 nt, Homo sapiens
cuuuaugguuucuccag

SEQ ID NO: 903400 - RNA, 18 nt, Homo sapiens
cuuuauguauggagcucu

SEQ ID NO: 903401 - RNA, 20 nt, Homo sapiens
cuuuauguuacuacaugcac

SEQ ID NO: 903402 - RNA, 17 nt, Homo sapiens
cuuuauuaaugaacugu

SEQ ID NO: 903403 - RNA, 14 nt, Homo sapiens
cuuuauugcuccug

SEQ ID NO: 903404 - RNA, 18 nt, Homo sapiens
aguacaaacacaggauuu

SEQ ID NO: 903405 - RNA, 19 nt, Homo sapiens
aguacagacgucucaagac

SEQ ID NO: 903406 - RNA, 16 nt, Homo sapiens
aguacaguagcuuaaa

SEQ ID NO: 903407 - RNA, 11 nt, Homo sapiens
aguacagugag

SEQ ID NO: 903408 - RNA, 17 nt, Homo sapiens
aguaccuuaaucugcca

SEQ ID NO: 903409 - RNA, 20 nt, Homo sapiens
aguacucaguauagcauuga

SEQ ID NO: 903410 - RNA, 12 nt, Homo sapiens
aguacugggaag

SEQ ID NO: 903411 - RNA, 14 nt, Homo sapiens
aguagaaaagugcu

SEQ ID NO: 903412 - RNA, 15 nt, Homo sapiens
aguagaaauuguucc

SEQ ID NO: 903413 - RNA, 18 nt, Homo sapiens
aguagagggcacuggguc

SEQ ID NO: 903414 - RNA, 19 nt, Homo sapiens
aguagauagaaagcaauaa

SEQ ID NO: 903415 - RNA, 17 nt, Homo sapiens
aguagaugauuuccuua

SEQ ID NO: 903416 - RNA, 16 nt, Homo sapiens
aguagcauacauuuau

SEQ ID NO: 903417 - RNA, 10 nt, Homo sapiens
aguagcucuu

SEQ ID NO: 903418 - RNA, 13 nt, Homo sapiens
aguagcugagcuc

SEQ ID NO: 903419 - RNA, 16 nt, Homo sapiens
aguaguuuuucagcua

SEQ ID NO: 903420 - RNA, 19 nt, Homo sapiens
aguauaaagucacuuccag

SEQ ID NO: 903421 - RNA, 14 nt, Homo sapiens
aguauauauagaau

SEQ ID NO: 903422 - RNA, 12 nt, Homo sapiens
aguaugcauuaa

SEQ ID NO: 903423 - RNA, 15 nt, Homo sapiens
aguauggaaucagcu

SEQ ID NO: 903424 - RNA, 23 nt, Homo sapiens
aguaugguucucagaucuugaca

SEQ ID NO: 903425 - RNA, 13 nt, Homo sapiens
aguaugugaauau

SEQ ID NO: 903426 - RNA, 17 nt, Homo sapiens
aguauguuaagcucuuu

SEQ ID NO: 903427 - RNA, 12 nt, Homo sapiens
aguauuccauuu

SEQ ID NO: 903428 - RNA, 16 nt, Homo sapiens
aguauucuugucaaaa

SEQ ID NO: 903429 - RNA, 20 nt, Homo sapiens
aguauuuuaucugccuuaga

SEQ ID NO: 903430 - RNA, 21 nt, Homo sapiens
aguauuuuccuccaggcaaaa

SEQ ID NO: 903431 - RNA, 15 nt, Homo sapiens
agucaaaacagagau

SEQ ID NO: 903432 - RNA, 15 nt, Homo sapiens
agucaacacucuucu

SEQ ID NO: 903433 - RNA, 17 nt, Homo sapiens
agucaaccaauguagaa

SEQ ID NO: 903434 - RNA, 16 nt, Homo sapiens
agucaaugaaaacuga

SEQ ID NO: 903435 - RNA, 14 nt, Homo sapiens
agucaauuuuacaa

SEQ ID NO: 903436 - RNA, 18 nt, Homo sapiens
agucaauuuuacaauuau

SEQ ID NO: 903437 - RNA, 15 nt, Homo sapiens
agucacacagacaca

SEQ ID NO: 903438 - RNA, 22 nt, Homo sapiens
agucacauggccuaugcacaua

SEQ ID NO: 903439 - RNA, 13 nt, Homo sapiens
agucaccaaaauu

SEQ ID NO: 903440 - RNA, 23 nt, Homo sapiens
agucacugcacagugcaucucag

SEQ ID NO: 903441 - RNA, 20 nt, Homo sapiens
agucagcuguaccaagcccc

SEQ ID NO: 903442 - RNA, 14 nt, Homo sapiens
agucaggaccuccg

SEQ ID NO: 903443 - RNA, 21 nt, Homo sapiens
agucaggacuugaacccaggu

SEQ ID NO: 903444 - RNA, 22 nt, Homo sapiens
agucauccacagcccaagggcg

SEQ ID NO: 903445 - RNA, 20 nt, Homo sapiens
agucaugaagcccaagugaa

SEQ ID NO: 903446 - RNA, 15 nt, Homo sapiens
agucaugcacucagg

SEQ ID NO: 903447 - RNA, 20 nt, Homo sapiens
aguccagaauaagugcuguu

SEQ ID NO: 903448 - RNA, 18 nt, Homo sapiens
aguccagaugccuuccug

SEQ ID NO: 903449 - RNA, 18 nt, Homo sapiens
agucccaccuuggcugca

SEQ ID NO: 903450 - RNA, 22 nt, Homo sapiens
aguccccuccguaggagcucac

SEQ ID NO: 903451 - RNA, 19 nt, Homo sapiens
agucccgucccugcccaga

SEQ ID NO: 903452 - RNA, 17 nt, Homo sapiens
agucccguggaggguag

SEQ ID NO: 903453 - RNA, 17 nt, Homo sapiens
aguccuauucuauugca

SEQ ID NO: 903454 - RNA, 12 nt, Homo sapiens
aguccucugcau

SEQ ID NO: 903455 - RNA, 23 nt, Homo sapiens
aguccucuggauggcaccagagg

SEQ ID NO: 903456 - RNA, 24 nt, Homo sapiens
aguccugggaauaugcuagugaug

SEQ ID NO: 903457 - RNA, 17 nt, Homo sapiens
aguccuuugauuccauu

SEQ ID NO: 903458 - RNA, 23 nt, Homo sapiens
agucgagcccugcagccaaacag

SEQ ID NO: 903459 - RNA, 21 nt, Homo sapiens
agucgcaggauccgcugccac

SEQ ID NO: 903460 - RNA, 13 nt, Homo sapiens
agucuaaaguuua

SEQ ID NO: 903461 - RNA, 21 nt, Homo sapiens
agucuaauuuugucaaaucau

SEQ ID NO: 903462 - RNA, 19 nt, Homo sapiens
agucuaccccugcuaagga

SEQ ID NO: 903463 - RNA, 19 nt, Homo sapiens
agucuaguaguuucucugu

SEQ ID NO: 903464 - RNA, 19 nt, Homo sapiens
agucuaucaaccccagaca

SEQ ID NO: 903465 - RNA, 12 nt, Homo sapiens
agucucuaugau

SEQ ID NO: 903466 - RNA, 14 nt, Homo sapiens
agucucuaugaucu

SEQ ID NO: 903467 - RNA, 18 nt, Homo sapiens
agucucuaugaucuuggc

SEQ ID NO: 903468 - RNA, 18 nt, Homo sapiens
agucucugacucuugccu

SEQ ID NO: 903469 - RNA, 18 nt, Homo sapiens
agucucugcccaaacaua

SEQ ID NO: 903470 - RNA, 14 nt, Homo sapiens
agucucugcugcua

SEQ ID NO: 903471 - RNA, 18 nt, Homo sapiens
agucucugugcuuugacu

SEQ ID NO: 903472 - RNA, 22 nt, Homo sapiens
agucucuuuaaucuucaguuuu

SEQ ID NO: 903473 - RNA, 23 nt, Homo sapiens
agucugaaagacagaaugucacc

SEQ ID NO: 903474 - RNA, 22 nt, Homo sapiens
agucugagaaugcccaacucuu

SEQ ID NO: 903475 - RNA, 18 nt, Homo sapiens
agucugagguccugagca

SEQ ID NO: 903476 - RNA, 21 nt, Homo sapiens
agucugggauguagaacuuca

SEQ ID NO: 903477 - RNA, 17 nt, Homo sapiens
agucugggcaaugaaac

SEQ ID NO: 903478 - RNA, 17 nt, Homo sapiens
agucuuauuuccucaac

SEQ ID NO: 903479 - RNA, 13 nt, Homo sapiens
agucuucccugau

SEQ ID NO: 903480 - RNA, 13 nt, Homo sapiens
agucuugcauucu

SEQ ID NO: 903481 - RNA, 22 nt, Homo sapiens
agucuugguuccucuacuacuu

SEQ ID NO: 903482 - RNA, 15 nt, Homo sapiens
agucuugucucaaga

SEQ ID NO: 903483 - RNA, 20 nt, Homo sapiens
agucuuuauuguguaucaua

SEQ ID NO: 903484 - RNA, 16 nt, Homo sapiens
agugaaaaacuauuaa

SEQ ID NO: 903485 - RNA, 22 nt, Homo sapiens
agugaaaaaucuguggaaugua

SEQ ID NO: 903486 - RNA, 21 nt, Homo sapiens
agugaaauaauuaaaaaccac

SEQ ID NO: 903487 - RNA, 13 nt, Homo sapiens
agugaaccaaaga

SEQ ID NO: 903488 - RNA, 14 nt, Homo sapiens
agugaaccaaagag

SEQ ID NO: 903489 - RNA, 15 nt, Homo sapiens
agugaagacuucuug

SEQ ID NO: 903490 - RNA, 16 nt, Homo sapiens
agugaaggagccagug

SEQ ID NO: 903491 - RNA, 21 nt, Homo sapiens
agugacaucucuuugauguca

SEQ ID NO: 903492 - RNA, 16 nt, Homo sapiens
agugacccacaugcca

SEQ ID NO: 903493 - RNA, 17 nt, Homo sapiens
agugacgggagccuccu

SEQ ID NO: 903494 - RNA, 16 nt, Homo sapiens
agugacuccaagaaca

SEQ ID NO: 903495 - RNA, 16 nt, Homo sapiens
agugacuuccugguga

SEQ ID NO: 903496 - RNA, 13 nt, Homo sapiens
agugagagggcau

SEQ ID NO: 903497 - RNA, 19 nt, Homo sapiens
agugagaucuuacagguau

SEQ ID NO: 903498 - RNA, 13 nt, Homo sapiens
agugagucucuuc

SEQ ID NO: 903499 - RNA, 16 nt, Homo sapiens
agugaguuacagcgag

SEQ ID NO: 903500 - RNA, 19 nt, Homo sapiens
agugauacauguacuccag

SEQ ID NO: 903501 - RNA, 21 nt, Homo sapiens
agugauaucccccagccucaa

SEQ ID NO: 903502 - RNA, 17 nt, Homo sapiens
agugauauuguggguaa

SEQ ID NO: 903503 - RNA, 19 nt, Homo sapiens
agugauccacccaccucag

SEQ ID NO: 903504 - RNA, 19 nt, Homo sapiens
agugauccucccaccucag

SEQ ID NO: 903505 - RNA, 20 nt, Homo sapiens
agugauguuguuugggagag

SEQ ID NO: 903506 - RNA, 22 nt, Homo sapiens
agugauuuccuguauaauuuaa

SEQ ID NO: 903507 - RNA, 15 nt, Homo sapiens
agugcaaagugcccu

SEQ ID NO: 903508 - RNA, 19 nt, Homo sapiens
agugcaagagacucuggcc

SEQ ID NO: 903509 - RNA, 12 nt, Homo sapiens
agugcaccacuu

SEQ ID NO: 903510 - RNA, 17 nt, Homo sapiens
agugcauguugccauga

SEQ ID NO: 903511 - RNA, 20 nt, Homo sapiens
agugccacuugacauuccuu

SEQ ID NO: 903512 - RNA, 23 nt, Homo sapiens
agugccaguuugcuuaguucuca

SEQ ID NO: 903513 - RNA, 18 nt, Homo sapiens
agugccgccugugcccac

SEQ ID NO: 903514 - RNA, 18 nt, Homo sapiens
agugccuccugggaccau

SEQ ID NO: 903515 - RNA, 15 nt, Homo sapiens
agugcgccuugcaaa

SEQ ID NO: 903516 - RNA, 18 nt, Homo sapiens
agugcgccuugcaaaaaa

SEQ ID NO: 903517 - RNA, 18 nt, Homo sapiens
agugcggacaaguuuuaa

SEQ ID NO: 903518 - RNA, 16 nt, Homo sapiens
agugcuccugugugcu

SEQ ID NO: 903519 - RNA, 21 nt, Homo sapiens
acucaaguuuuuacaaaauac

SEQ ID NO: 903520 - RNA, 12 nt, Homo sapiens
acucacaugccg

SEQ ID NO: 903521 - RNA, 12 nt, Homo sapiens
acucacccaagc

SEQ ID NO: 903522 - RNA, 15 nt, Homo sapiens
acucaccucucucua

SEQ ID NO: 903523 - RNA, 17 nt, Homo sapiens
acucacucauuccuuca

SEQ ID NO: 903524 - RNA, 16 nt, Homo sapiens
acucagcagcagagag

SEQ ID NO: 903525 - RNA, 18 nt, Homo sapiens
acucaguauagcauugaa

SEQ ID NO: 903526 - RNA, 17 nt, Homo sapiens
acucagucuagugaaga

SEQ ID NO: 903527 - RNA, 22 nt, Homo sapiens
acucagucuagugaagauguug

SEQ ID NO: 903528 - RNA, 17 nt, Homo sapiens
acucaguuguuccuacu

SEQ ID NO: 903529 - RNA, 14 nt, Homo sapiens
acucaucugucacc

SEQ ID NO: 903530 - RNA, 13 nt, Homo sapiens
acucaugaacuau

SEQ ID NO: 903531 - RNA, 23 nt, Homo sapiens
acuccacagcggaggagaccagc

SEQ ID NO: 903532 - RNA, 17 nt, Homo sapiens
acuccacagucaauauu

SEQ ID NO: 903533 - RNA, 18 nt, Homo sapiens
acuccagaaguggggcuc

SEQ ID NO: 903534 - RNA, 18 nt, Homo sapiens
acuccagccugggcaaca

SEQ ID NO: 903535 - RNA, 13 nt, Homo sapiens
acuccagugguga

SEQ ID NO: 903536 - RNA, 15 nt, Homo sapiens
acuccaguggugaag

SEQ ID NO: 903537 - RNA, 19 nt, Homo sapiens
acuccauauggaggccuca

SEQ ID NO: 903538 - RNA, 22 nt, Homo sapiens
acucccacuggaacagcccauu

SEQ ID NO: 903539 - RNA, 14 nt, Homo sapiens
acucccuccaugug

SEQ ID NO: 903540 - RNA, 19 nt, Homo sapiens
acuccggccaccuccucca

SEQ ID NO: 903541 - RNA, 20 nt, Homo sapiens
acuccgggaccauugaccuc

SEQ ID NO: 903542 - RNA, 19 nt, Homo sapiens
acuccucuguccaggcacu

SEQ ID NO: 903543 - RNA, 13 nt, Homo sapiens
acuccugcaaaau

SEQ ID NO: 903544 - RNA, 17 nt, Homo sapiens
acuccuggagauuucag

SEQ ID NO: 903545 - RNA, 14 nt, Homo sapiens
acuccuuccagcua

SEQ ID NO: 903546 - RNA, 23 nt, Homo sapiens
acuccuuucucuaaaacugccuu

SEQ ID NO: 903547 - RNA, 20 nt, Homo sapiens
acucgaagcccuuccagugg

SEQ ID NO: 903548 - RNA, 22 nt, Homo sapiens
acucguucuucugggaacccug

SEQ ID NO: 903549 - RNA, 18 nt, Homo sapiens
acucuaagcuggagcucu

SEQ ID NO: 903550 - RNA, 20 nt, Homo sapiens
acucuaccugcaagauuuca

SEQ ID NO: 903551 - RNA, 16 nt, Homo sapiens
acucuacugcaagacu

SEQ ID NO: 903552 - RNA, 20 nt, Homo sapiens
acucuacuuccucuuaccua

SEQ ID NO: 903553 - RNA, 22 nt, Homo sapiens
acucucaccgacuuauucugau

SEQ ID NO: 903554 - RNA, 22 nt, Homo sapiens
acucuccccucccucuuccuuc

SEQ ID NO: 903555 - RNA, 23 nt, Homo sapiens
acucucuagcuuuaggggaccau

SEQ ID NO: 903556 - RNA, 11 nt, Homo sapiens
acucucuaggg

SEQ ID NO: 903557 - RNA, 13 nt, Homo sapiens
acucucugcucua

SEQ ID NO: 903558 - RNA, 19 nt, Homo sapiens
acucucuugccagcauuuu

SEQ ID NO: 903559 - RNA, 18 nt, Homo sapiens
acucugaaaucucagaau

SEQ ID NO: 903560 - RNA, 14 nt, Homo sapiens
acucugaauaccaa

SEQ ID NO: 903561 - RNA, 17 nt, Homo sapiens
acucugaauaccaagug

SEQ ID NO: 903562 - RNA, 12 nt, Homo sapiens
acucugcacaug

SEQ ID NO: 903563 - RNA, 20 nt, Homo sapiens
acucugcacaugucuuguac

SEQ ID NO: 903564 - RNA, 22 nt, Homo sapiens
acucugccccuucuguuuccau

SEQ ID NO: 903565 - RNA, 17 nt, Homo sapiens
acucuggagagacugug

SEQ ID NO: 903566 - RNA, 23 nt, Homo sapiens
acucuggggagccugagccacaa

SEQ ID NO: 903567 - RNA, 22 nt, Homo sapiens
acucuggguuucauauccagcu

SEQ ID NO: 903568 - RNA, 17 nt, Homo sapiens
acucuguccaggccacu

SEQ ID NO: 903569 - RNA, 19 nt, Homo sapiens
acucuuaacuccuagccca

SEQ ID NO: 903570 - RNA, 14 nt, Homo sapiens
acucuuaugaaaug

SEQ ID NO: 903571 - RNA, 21 nt, Homo sapiens
acucuuaugaaaugggcuuua

SEQ ID NO: 903572 - RNA, 17 nt, Homo sapiens
acucuuauuugguauaa

SEQ ID NO: 903573 - RNA, 22 nt, Homo sapiens
acucuucaaggucugcuuuuca

SEQ ID NO: 903574 - RNA, 15 nt, Homo sapiens
acucuucugaauuga

SEQ ID NO: 903575 - RNA, 16 nt, Homo sapiens
acucuugccuuuccac

SEQ ID NO: 903576 - RNA, 13 nt, Homo sapiens
acucuuugcuaca

SEQ ID NO: 903577 - RNA, 23 nt, Homo sapiens
acugaaaaaugguaauuguugcu

SEQ ID NO: 903578 - RNA, 16 nt, Homo sapiens
acugaaaaaugucagu

SEQ ID NO: 903579 - RNA, 15 nt, Homo sapiens
acugaaacauucaca

SEQ ID NO: 903580 - RNA, 22 nt, Homo sapiens
acugaauauuaucaguggcugc

SEQ ID NO: 903581 - RNA, 14 nt, Homo sapiens
acugacaaccugug

SEQ ID NO: 903582 - RNA, 14 nt, Homo sapiens
acugacacaggaaa

SEQ ID NO: 903583 - RNA, 15 nt, Homo sapiens
acugaccagccucca

SEQ ID NO: 903584 - RNA, 16 nt, Homo sapiens
acugaccagccuccau

SEQ ID NO: 903585 - RNA, 18 nt, Homo sapiens
acugaccuuguagcuaua

SEQ ID NO: 903586 - RNA, 16 nt, Homo sapiens
acugagaaugauagua

SEQ ID NO: 903587 - RNA, 14 nt, Homo sapiens
acugagacauuaca

SEQ ID NO: 903588 - RNA, 12 nt, Homo sapiens
acugagagcaga

SEQ ID NO: 903589 - RNA, 20 nt, Homo sapiens
acugagagcagaugguccuc

SEQ ID NO: 903590 - RNA, 13 nt, Homo sapiens
acugagaucuguu

SEQ ID NO: 903591 - RNA, 15 nt, Homo sapiens
acugagccugagaug

SEQ ID NO: 903592 - RNA, 14 nt, Homo sapiens
acugaggaccagcc

SEQ ID NO: 903593 - RNA, 18 nt, Homo sapiens
acugaguccucguagcca

SEQ ID NO: 903594 - RNA, 23 nt, Homo sapiens
acugaguccucguagccaucucu

SEQ ID NO: 903595 - RNA, 17 nt, Homo sapiens
acugaguggcuugugau

SEQ ID NO: 903596 - RNA, 23 nt, Homo sapiens
acugagugugggagugcagagaa

SEQ ID NO: 903597 - RNA, 19 nt, Homo sapiens
acugaugacaaacccagga

SEQ ID NO: 903598 - RNA, 22 nt, Homo sapiens
acugaugccauguuuagauucc

SEQ ID NO: 903599 - RNA, 22 nt, Homo sapiens
acugauuaccuccuguguggaa

SEQ ID NO: 903600 - RNA, 22 nt, Homo sapiens
acugauuuaugaucacuuggaa

SEQ ID NO: 903601 - RNA, 20 nt, Homo sapiens
acugauuuuuagcuuuacaa

SEQ ID NO: 903602 - RNA, 20 nt, Homo sapiens
acugcacuccagccugggug

SEQ ID NO: 903603 - RNA, 15 nt, Homo sapiens
acugcagcuuuacau

SEQ ID NO: 903604 - RNA, 17 nt, Homo sapiens
acugcauaauagccuaa

SEQ ID NO: 903605 - RNA, 13 nt, Homo sapiens
acugcaucucaaa

SEQ ID NO: 903606 - RNA, 18 nt, Homo sapiens
acugcaugcacuucuuac

SEQ ID NO: 903607 - RNA, 18 nt, Homo sapiens
acugccaugccucaagaa

SEQ ID NO: 903608 - RNA, 17 nt, Homo sapiens
acugcucaucauuccuu

SEQ ID NO: 903609 - RNA, 15 nt, Homo sapiens
acugcugaucaauga

SEQ ID NO: 903610 - RNA, 20 nt, Homo sapiens
acugcuuuccagccugggca

SEQ ID NO: 903611 - RNA, 15 nt, Homo sapiens
acugcuuuuggucug

SEQ ID NO: 903612 - RNA, 21 nt, Homo sapiens
acuggaauaagaagcaaauaa

SEQ ID NO: 903613 - RNA, 13 nt, Homo sapiens
acuggacgcccag

SEQ ID NO: 903614 - RNA, 13 nt, Homo sapiens
acuggacugugug

SEQ ID NO: 903615 - RNA, 22 nt, Homo sapiens
acuggagcacugaucaauccuu

SEQ ID NO: 903616 - RNA, 14 nt, Homo sapiens
acuggauauguugu

SEQ ID NO: 903617 - RNA, 12 nt, Homo sapiens
acuggcauuaaa

SEQ ID NO: 903618 - RNA, 14 nt, Homo sapiens
acuggcugcaaagg

SEQ ID NO: 903619 - RNA, 22 nt, Homo sapiens
acuggcuucucuuucucugagu

SEQ ID NO: 903620 - RNA, 14 nt, Homo sapiens
acugggaccaggca

SEQ ID NO: 903621 - RNA, 22 nt, Homo sapiens
acugggaugagccgcugugagc

SEQ ID NO: 903622 - RNA, 20 nt, Homo sapiens
acuggggucuguguggugcc

SEQ ID NO: 903623 - RNA, 22 nt, Homo sapiens
acugguagaacguaaccacgga

SEQ ID NO: 903624 - RNA, 13 nt, Homo sapiens
acuguaaacauuc

SEQ ID NO: 903625 - RNA, 12 nt, Homo sapiens
acuguaaaucac

SEQ ID NO: 903626 - RNA, 22 nt, Homo sapiens
acuguaauuggugacaauguca

SEQ ID NO: 903627 - RNA, 22 nt, Homo sapiens
acuguauguuuacuucucacca

SEQ ID NO: 903628 - RNA, 12 nt, Homo sapiens
acugucaaguca

SEQ ID NO: 903629 - RNA, 14 nt, Homo sapiens
acugucauagaaau

SEQ ID NO: 903630 - RNA, 12 nt, Homo sapiens
acugucgagucc

SEQ ID NO: 903631 - RNA, 18 nt, Homo sapiens
agguugucugaagucacu

SEQ ID NO: 903632 - RNA, 17 nt, Homo sapiens
agguuucaagacuugau

SEQ ID NO: 903633 - RNA, 21 nt, Homo sapiens
agguuucuugaauaucugccc

SEQ ID NO: 903634 - RNA, 15 nt, Homo sapiens
agguuugcaccccuc

SEQ ID NO: 903635 - RNA, 16 nt, Homo sapiens
agguuuuuggucugac

SEQ ID NO: 903636 - RNA, 21 nt, Homo sapiens
aguaaaaaauuaaagcccaua

SEQ ID NO: 903637 - RNA, 18 nt, Homo sapiens
aguaaaaccacagcaguu

SEQ ID NO: 903638 - RNA, 13 nt, Homo sapiens
aguaaaccaaaaa

SEQ ID NO: 903639 - RNA, 14 nt, Homo sapiens
aguaaaccaaaaag

SEQ ID NO: 903640 - RNA, 13 nt, Homo sapiens
aguaaaguuuaaa

SEQ ID NO: 903641 - RNA, 15 nt, Homo sapiens
aguaaauuacauuaa

SEQ ID NO: 903642 - RNA, 19 nt, Homo sapiens
aguaacaggaaaccacuua

SEQ ID NO: 903643 - RNA, 14 nt, Homo sapiens
aguaacaguuguga

SEQ ID NO: 903644 - RNA, 18 nt, Homo sapiens
aguaacucaucugucacc

SEQ ID NO: 903645 - RNA, 20 nt, Homo sapiens
aguaagaaaacaucacugaa

SEQ ID NO: 903646 - RNA, 15 nt, Homo sapiens
aguaaguacaaauau

SEQ ID NO: 903647 - RNA, 19 nt, Homo sapiens
aguaaucccccuugccaaa

SEQ ID NO: 903648 - RNA, 20 nt, Homo sapiens
aguaaucccccuugccaaau

SEQ ID NO: 903649 - RNA, 15 nt, Homo sapiens
aguaaugagcaugau

SEQ ID NO: 903650 - RNA, 16 nt, Homo sapiens
aguaaugccacacauu

SEQ ID NO: 903651 - RNA, 13 nt, Homo sapiens
aguaauugucaau

SEQ ID NO: 903652 - RNA, 19 nt, Homo sapiens
aguaauugucaauaccccu

SEQ ID NO: 903653 - RNA, 20 nt, Homo sapiens
aguaauuuugugaaagaagg

SEQ ID NO: 903654 - RNA, 18 nt, Homo sapiens
accaucaaaaauauucca

SEQ ID NO: 903655 - RNA, 14 nt, Homo sapiens
accaucaguuacug

SEQ ID NO: 903656 - RNA, 16 nt, Homo sapiens
accauccaccaggccu

SEQ ID NO: 903657 - RNA, 23 nt, Homo sapiens
accaucuaaucuaugcauguaug

SEQ ID NO: 903658 - RNA, 14 nt, Homo sapiens
accaucugucuugc

SEQ ID NO: 903659 - RNA, 16 nt, Homo sapiens
accaucugucuugcca

SEQ ID NO: 903660 - RNA, 19 nt, Homo sapiens
accaugagaccacuguuau

SEQ ID NO: 903661 - RNA, 15 nt, Homo sapiens
accaugccaggcuaa

SEQ ID NO: 903662 - RNA, 15 nt, Homo sapiens
accaugccagggauu

SEQ ID NO: 903663 - RNA, 15 nt, Homo sapiens
accaugccucuccaa

SEQ ID NO: 903664 - RNA, 24 nt, Homo sapiens
accaugccucuccaacaucuucaa

SEQ ID NO: 903665 - RNA, 15 nt, Homo sapiens
accauuacauguuua

SEQ ID NO: 903666 - RNA, 19 nt, Homo sapiens
accauugaccucagcugca

SEQ ID NO: 903667 - RNA, 19 nt, Homo sapiens
accauuuugggguacccac

SEQ ID NO: 903668 - RNA, 13 nt, Homo sapiens
acccaacaugacu

SEQ ID NO: 903669 - RNA, 22 nt, Homo sapiens
acccaauucaaaacauugugcc

SEQ ID NO: 903670 - RNA, 23 nt, Homo sapiens
acccacaugugacacauaugcac

SEQ ID NO: 903671 - RNA, 14 nt, Homo sapiens
acccaccucagccu

SEQ ID NO: 903672 - RNA, 12 nt, Homo sapiens
acccacuggcca

SEQ ID NO: 903673 - RNA, 11 nt, Homo sapiens
acccacugugg

SEQ ID NO: 903674 - RNA, 21 nt, Homo sapiens
acccacuucuaaauagcaauu

SEQ ID NO: 903675 - RNA, 19 nt, Homo sapiens
acccagaaaucauuuuacc

SEQ ID NO: 903676 - RNA, 16 nt, Homo sapiens
acccagaaauuccuuc

SEQ ID NO: 903677 - RNA, 22 nt, Homo sapiens
acccagacacaucgcacugugg

SEQ ID NO: 903678 - RNA, 14 nt, Homo sapiens
acccagcauguaca

SEQ ID NO: 903679 - RNA, 22 nt, Homo sapiens
acccaguguaaagaauaaauga

SEQ ID NO: 903680 - RNA, 19 nt, Homo sapiens
acccauagugcacacuugu

SEQ ID NO: 903681 - RNA, 15 nt, Homo sapiens
acccaugaggcaaug

SEQ ID NO: 903682 - RNA, 15 nt, Homo sapiens
accccaaaucccaca

SEQ ID NO: 903683 - RNA, 20 nt, Homo sapiens
accccaacacccccaagaca

SEQ ID NO: 903684 - RNA, 14 nt, Homo sapiens
accccaagggacaa

SEQ ID NO: 903685 - RNA, 21 nt, Homo sapiens
accccagaaauaggacaauuc

SEQ ID NO: 903686 - RNA, 15 nt, Homo sapiens
accccagacacuggu

SEQ ID NO: 903687 - RNA, 12 nt, Homo sapiens
accccagaguug

SEQ ID NO: 903688 - RNA, 18 nt, Homo sapiens
accccagcgccugugcug

SEQ ID NO: 903689 - RNA, 17 nt, Homo sapiens
accccagcucccuagga

SEQ ID NO: 903690 - RNA, 23 nt, Homo sapiens
accccaggacgccacucauuuca

SEQ ID NO: 903691 - RNA, 15 nt, Homo sapiens
accccaggaucccag

SEQ ID NO: 903692 - RNA, 12 nt, Homo sapiens
accccaucccuu

SEQ ID NO: 903693 - RNA, 12 nt, Homo sapiens
acccccagugug

SEQ ID NO: 903694 - RNA, 17 nt, Homo sapiens
acccccgccacggccac

SEQ ID NO: 903695 - RNA, 14 nt, Homo sapiens
acccccuucagugc

SEQ ID NO: 903696 - RNA, 14 nt, Homo sapiens
accccucagugcuc

SEQ ID NO: 903697 - RNA, 15 nt, Homo sapiens
accccugcuaaggag

SEQ ID NO: 903698 - RNA, 17 nt, Homo sapiens
accccugcuauauacua

SEQ ID NO: 903699 - RNA, 20 nt, Homo sapiens
accccuggccucaagcaauc

SEQ ID NO: 903700 - RNA, 22 nt, Homo sapiens
accccuuggcuuuugcuuggca

SEQ ID NO: 903701 - RNA, 20 nt, Homo sapiens
accccuuuccacgagcuaua

SEQ ID NO: 903702 - RNA, 14 nt, Homo sapiens
acccgacugugaaa

SEQ ID NO: 903703 - RNA, 22 nt, Homo sapiens
acccgagcccagcuacauuccu

SEQ ID NO: 903704 - RNA, 16 nt, Homo sapiens
acccgcucuggaccaa

SEQ ID NO: 903705 - RNA, 17 nt, Homo sapiens
acccguucaacuuuucc

SEQ ID NO: 903706 - RNA, 16 nt, Homo sapiens
acccuaaaacaugugu

SEQ ID NO: 903707 - RNA, 18 nt, Homo sapiens
acccuauacaacuggaca

SEQ ID NO: 903708 - RNA, 16 nt, Homo sapiens
acccuaucugugauuc

SEQ ID NO: 903709 - RNA, 14 nt, Homo sapiens
acccucaaauguca

SEQ ID NO: 903710 - RNA, 18 nt, Homo sapiens
acccucaccaggaugaag

SEQ ID NO: 903711 - RNA, 15 nt, Homo sapiens
acccucacuguguug

SEQ ID NO: 903712 - RNA, 14 nt, Homo sapiens
acccucgaugaagc

SEQ ID NO: 903713 - RNA, 18 nt, Homo sapiens
acccugaccugcugugca

SEQ ID NO: 903714 - RNA, 16 nt, Homo sapiens
acccugcauguuggcc

SEQ ID NO: 903715 - RNA, 19 nt, Homo sapiens
acccuguggggccugaugg

SEQ ID NO: 903716 - RNA, 21 nt, Homo sapiens
acccuucugcuguauacugua

SEQ ID NO: 903717 - RNA, 13 nt, Homo sapiens
acccuucugggca

SEQ ID NO: 903718 - RNA, 14 nt, Homo sapiens
acccuugcauuaga

SEQ ID NO: 903719 - RNA, 19 nt, Homo sapiens
acccuuggagccaauggag

SEQ ID NO: 903720 - RNA, 18 nt, Homo sapiens
acccuuuuccuccagaca

SEQ ID NO: 903721 - RNA, 18 nt, Homo sapiens
accgagagagauggaaua

SEQ ID NO: 903722 - RNA, 19 nt, Homo sapiens
accgagagagauggaauaa

SEQ ID NO: 903723 - RNA, 21 nt, Homo sapiens
accgagucucuucuccacugg

SEQ ID NO: 903724 - RNA, 12 nt, Homo sapiens
accgaugcacac

SEQ ID NO: 903725 - RNA, 22 nt, Homo sapiens
accggcgugcaccaccaugcca

SEQ ID NO: 903726 - RNA, 18 nt, Homo sapiens
accgggacuucaaagccg

SEQ ID NO: 903727 - RNA, 21 nt, Homo sapiens
accgggcacucagaagacacu

SEQ ID NO: 903728 - RNA, 21 nt, Homo sapiens
accgggccacuccuuccugcc

SEQ ID NO: 903729 - RNA, 17 nt, Homo sapiens
accgggcuacuaccugg

SEQ ID NO: 903730 - RNA, 20 nt, Homo sapiens
accuacuuuucuuuccucag

SEQ ID NO: 903731 - RNA, 21 nt, Homo sapiens
accuagccuuagaagucacac

SEQ ID NO: 903732 - RNA, 15 nt, Homo sapiens
accucaagcugcauc

SEQ ID NO: 903733 - RNA, 12 nt, Homo sapiens
accucacaguga

SEQ ID NO: 903734 - RNA, 21 nt, Homo sapiens
accucacgcucuggacaugau

SEQ ID NO: 903735 - RNA, 14 nt, Homo sapiens
accucacuauucaa

SEQ ID NO: 903736 - RNA, 16 nt, Homo sapiens
accucacuccuguuac

SEQ ID NO: 903737 - RNA, 15 nt, Homo sapiens
accucaucucuacua

SEQ ID NO: 903738 - RNA, 19 nt, Homo sapiens
accucaugagucuaccuga

SEQ ID NO: 903739 - RNA, 19 nt, Homo sapiens
accucccaccccacuccag

SEQ ID NO: 903740 - RNA, 15 nt, Homo sapiens
accucccagcccuau

SEQ ID NO: 903741 - RNA, 19 nt, Homo sapiens
accucccccugccuuccaa

SEQ ID NO: 903742 - RNA, 18 nt, Homo sapiens
accuccgccccagacaca

SEQ ID NO: 903743 - RNA, 17 nt, Homo sapiens
accuccuguguggaaga

SEQ ID NO: 903744 - RNA, 14 nt, Homo sapiens
accucuacugccuu

SEQ ID NO: 903745 - RNA, 20 nt, Homo sapiens
accucuagugcuacugcuag

SEQ ID NO: 903746 - RNA, 14 nt, Homo sapiens
accucucaauuucu

SEQ ID NO: 903747 - RNA, 21 nt, Homo sapiens
accucuccccuggaacugucu

SEQ ID NO: 903748 - RNA, 22 nt, Homo sapiens
accucugccugaagucacacag

SEQ ID NO: 903749 - RNA, 21 nt, Homo sapiens
accucugcucugaggcuucca

SEQ ID NO: 903750 - RNA, 16 nt, Homo sapiens
accucuggcuuugucu

SEQ ID NO: 903751 - RNA, 20 nt, Homo sapiens
accucugugaggaaagcaca

SEQ ID NO: 903752 - RNA, 20 nt, Homo sapiens
accucuugggcaugcucagc

SEQ ID NO: 903753 - RNA, 13 nt, Homo sapiens
accugaaccuggg

SEQ ID NO: 903754 - RNA, 20 nt, Homo sapiens
accugaaggacgagggaugg

SEQ ID NO: 903755 - RNA, 13 nt, Homo sapiens
accugcaguuccu

SEQ ID NO: 903756 - RNA, 18 nt, Homo sapiens
accugcaguuccugagua

SEQ ID NO: 903757 - RNA, 17 nt, Homo sapiens
accugccagccaucaca

SEQ ID NO: 903758 - RNA, 18 nt, Homo sapiens
accugcccacccacuccu

SEQ ID NO: 903759 - RNA, 17 nt, Homo sapiens
accugcggcugcugugu

SEQ ID NO: 903760 - RNA, 18 nt, Homo sapiens
accugcguugugagcucu

SEQ ID NO: 903761 - RNA, 22 nt, Homo sapiens
accuggagagcuagaaccuaga

SEQ ID NO: 903762 - RNA, 22 nt, Homo sapiens
accuggagggaaugaaccugga

SEQ ID NO: 903763 - RNA, 22 nt, Homo sapiens
accuggagggcuagaaccugga

SEQ ID NO: 903764 - RNA, 22 nt, Homo sapiens
accuggaugaucacuaauacua

SEQ ID NO: 903765 - RNA, 16 nt, Homo sapiens
accuggcacaauggcu

SEQ ID NO: 903766 - RNA, 21 nt, Homo sapiens
accuggcagguuagaaccuag

SEQ ID NO: 903767 - RNA, 23 nt, Homo sapiens
accuggcauggugcuuucagguc

SEQ ID NO: 903768 - RNA, 16 nt, Homo sapiens
accuggccuucagugu

SEQ ID NO: 903769 - RNA, 13 nt, Homo sapiens
acaucuaaugucu

SEQ ID NO: 903770 - RNA, 14 nt, Homo sapiens
acaucucacuuugc

SEQ ID NO: 903771 - RNA, 16 nt, Homo sapiens
acaucucccucccaca

SEQ ID NO: 903772 - RNA, 14 nt, Homo sapiens
acaucuucagcucc

SEQ ID NO: 903773 - RNA, 19 nt, Homo sapiens
acaugaacagaaacaauaa

SEQ ID NO: 903774 - RNA, 18 nt, Homo sapiens
acaugaaucccacccaca

SEQ ID NO: 903775 - RNA, 23 nt, Homo sapiens
acaugaauugcauuuuacuuuaa

SEQ ID NO: 903776 - RNA, 14 nt, Homo sapiens
acaugacacugacc

SEQ ID NO: 903777 - RNA, 23 nt, Homo sapiens
acaugaccuccguguagugucug

SEQ ID NO: 903778 - RNA, 15 nt, Homo sapiens
acaugccagcuuccu

SEQ ID NO: 903779 - RNA, 15 nt, Homo sapiens
acaugcugugcucuu

SEQ ID NO: 903780 - RNA, 20 nt, Homo sapiens
acauggccagugugauccca

SEQ ID NO: 903781 - RNA, 18 nt, Homo sapiens
acauggcuggcacugagc

SEQ ID NO: 903782 - RNA, 20 nt, Homo sapiens
acauggugaaaccucaucuc

SEQ ID NO: 903783 - RNA, 19 nt, Homo sapiens
acaugucuuguacaugugu

SEQ ID NO: 903784 - RNA, 13 nt, Homo sapiens
acaugucuuucag

SEQ ID NO: 903785 - RNA, 15 nt, Homo sapiens
acaugugacacauau

SEQ ID NO: 903786 - RNA, 12 nt, Homo sapiens
acaugugcacau

SEQ ID NO: 903787 - RNA, 13 nt, Homo sapiens
acaugugcacaug

SEQ ID NO: 903788 - RNA, 16 nt, Homo sapiens
acaugugcuauugaac

SEQ ID NO: 903789 - RNA, 13 nt, Homo sapiens
acaugugguggga

SEQ ID NO: 903790 - RNA, 19 nt, Homo sapiens
acauguguagccugugcau

SEQ ID NO: 903791 - RNA, 22 nt, Homo sapiens
acauguguucucuauuuugccu

SEQ ID NO: 903792 - RNA, 17 nt, Homo sapiens
acauuaaucaccaaagu

SEQ ID NO: 903793 - RNA, 15 nt, Homo sapiens
acauuauacauuuga

SEQ ID NO: 903794 - RNA, 23 nt, Homo sapiens
acauuauagauuuucauguucuu

SEQ ID NO: 903795 - RNA, 15 nt, Homo sapiens
acauuaucaucugaa

SEQ ID NO: 903796 - RNA, 22 nt, Homo sapiens
acauuaucgggagcagugucuu

SEQ ID NO: 903797 - RNA, 14 nt, Homo sapiens
acauuaucuuggau

SEQ ID NO: 903798 - RNA, 15 nt, Homo sapiens
acauuaugugugcau

SEQ ID NO: 903799 - RNA, 14 nt, Homo sapiens
acauucacacaggg

SEQ ID NO: 903800 - RNA, 17 nt, Homo sapiens
acauucaucaagcugua

SEQ ID NO: 903801 - RNA, 19 nt, Homo sapiens
acauucaucaagcuguaca

SEQ ID NO: 903802 - RNA, 17 nt, Homo sapiens
acauucccuaucaaaac

SEQ ID NO: 903803 - RNA, 23 nt, Homo sapiens
acauucccuuggauguagucuga

SEQ ID NO: 903804 - RNA, 12 nt, Homo sapiens
acauuccuggcc

SEQ ID NO: 903805 - RNA, 23 nt, Homo sapiens
acauucuuguuuuaagugccuuu

SEQ ID NO: 903806 - RNA, 19 nt, Homo sapiens
acauugaaagagaaccagu

SEQ ID NO: 903807 - RNA, 15 nt, Homo sapiens
acauuggcagugugu

SEQ ID NO: 903808 - RNA, 17 nt, Homo sapiens
acauuguauguaucuau

SEQ ID NO: 903809 - RNA, 21 nt, Homo sapiens
acauugucuggauaccagaua

SEQ ID NO: 903810 - RNA, 20 nt, Homo sapiens
acauuguuugucugucuuca

SEQ ID NO: 903811 - RNA, 18 nt, Homo sapiens
acauuuacacauucucac

SEQ ID NO: 903812 - RNA, 21 nt, Homo sapiens
acauuucuuaaaauguuucau

SEQ ID NO: 903813 - RNA, 23 nt, Homo sapiens
acauuugaguauccgauucgcca

SEQ ID NO: 903814 - RNA, 15 nt, Homo sapiens
acauuuugcauuaga

SEQ ID NO: 903815 - RNA, 14 nt, Homo sapiens
acauuuuguuauag

SEQ ID NO: 903816 - RNA, 20 nt, Homo sapiens
acauuuuuauuuaguugaaa

SEQ ID NO: 903817 - RNA, 16 nt, Homo sapiens
acauuuuuuguuugcu

SEQ ID NO: 903818 - RNA, 22 nt, Homo sapiens
accaaacuggacuugucuuccu

SEQ ID NO: 903819 - RNA, 19 nt, Homo sapiens
accaaagagaagcaaaauc

SEQ ID NO: 903820 - RNA, 13 nt, Homo sapiens
accaaagagacug

SEQ ID NO: 903821 - RNA, 15 nt, Homo sapiens
accaaagagacugga

SEQ ID NO: 903822 - RNA, 21 nt, Homo sapiens
accaaaggacauuaugugugc

SEQ ID NO: 903823 - RNA, 17 nt, Homo sapiens
accaaauaaaguaccau

SEQ ID NO: 903824 - RNA, 18 nt, Homo sapiens
accaaauaaaguaccauu

SEQ ID NO: 903825 - RNA, 23 nt, Homo sapiens
accaaaucuugguugaugccaaa

SEQ ID NO: 903826 - RNA, 17 nt, Homo sapiens
accaacaguuccuucag

SEQ ID NO: 903827 - RNA, 15 nt, Homo sapiens
accaacauggugaaa

SEQ ID NO: 903828 - RNA, 19 nt, Homo sapiens
accaacccuguuuccugag

SEQ ID NO: 903829 - RNA, 17 nt, Homo sapiens
accaacuggagcacuga

SEQ ID NO: 903830 - RNA, 23 nt, Homo sapiens
accaagaagggcuagaaccugga

SEQ ID NO: 903831 - RNA, 20 nt, Homo sapiens
accaagaugaucacauggaa

SEQ ID NO: 903832 - RNA, 13 nt, Homo sapiens
accaaggucuuca

SEQ ID NO: 903833 - RNA, 15 nt, Homo sapiens
accaagucuacuuca

SEQ ID NO: 903834 - RNA, 15 nt, Homo sapiens
accaaguggcuccca

SEQ ID NO: 903835 - RNA, 16 nt, Homo sapiens
accaauaccuccucca

SEQ ID NO: 903836 - RNA, 17 nt, Homo sapiens
accaaugagcuguaucu

SEQ ID NO: 903837 - RNA, 12 nt, Homo sapiens
accaauguagaa

SEQ ID NO: 903838 - RNA, 18 nt, Homo sapiens
accaauuccaaguuuuaa

SEQ ID NO: 903839 - RNA, 18 nt, Homo sapiens
accaauuguacauucccu

SEQ ID NO: 903840 - RNA, 20 nt, Homo sapiens
accacaacugacacaggaaa

SEQ ID NO: 903841 - RNA, 13 nt, Homo sapiens
accacacaccuca

SEQ ID NO: 903842 - RNA, 15 nt, Homo sapiens
accacaccaaaccuc

SEQ ID NO: 903843 - RNA, 16 nt, Homo sapiens
accacaccucccugaa

SEQ ID NO: 903844 - RNA, 16 nt, Homo sapiens
accacaggcugccuca

SEQ ID NO: 903845 - RNA, 15 nt, Homo sapiens
accacauaacauaaa

SEQ ID NO: 903846 - RNA, 18 nt, Homo sapiens
accacaucuugcucugcu

SEQ ID NO: 903847 - RNA, 18 nt, Homo sapiens
accacaugugcacaugca

SEQ ID NO: 903848 - RNA, 20 nt, Homo sapiens
accaccgaagaggaagcaag

SEQ ID NO: 903849 - RNA, 15 nt, Homo sapiens
accaccgugucauga

SEQ ID NO: 903850 - RNA, 15 nt, Homo sapiens
accaccugcuucuga

SEQ ID NO: 903851 - RNA, 20 nt, Homo sapiens
accaccuucccagcucuccc

SEQ ID NO: 903852 - RNA, 17 nt, Homo sapiens
accacuagaacucucca

SEQ ID NO: 903853 - RNA, 18 nt, Homo sapiens
accacuagaacucuccau

SEQ ID NO: 903854 - RNA, 14 nt, Homo sapiens
accacuaggguccu

SEQ ID NO: 903855 - RNA, 21 nt, Homo sapiens
accacuauucuuaacuauuca

SEQ ID NO: 903856 - RNA, 22 nt, Homo sapiens
accacugguuaaaauaaagccu

SEQ ID NO: 903857 - RNA, 14 nt, Homo sapiens
accacuguacauau

SEQ ID NO: 903858 - RNA, 16 nt, Homo sapiens
accacuguguauuuaa

SEQ ID NO: 903859 - RNA, 19 nt, Homo sapiens
accacuuugucucugagaa

SEQ ID NO: 903860 - RNA, 14 nt, Homo sapiens
accagaaguccuau

SEQ ID NO: 903861 - RNA, 16 nt, Homo sapiens
accagaccacucugcu

SEQ ID NO: 903862 - RNA, 14 nt, Homo sapiens
accagaggugacag

SEQ ID NO: 903863 - RNA, 13 nt, Homo sapiens
accagauauuuga

SEQ ID NO: 903864 - RNA, 20 nt, Homo sapiens
accagaugaaauaauguucu

SEQ ID NO: 903865 - RNA, 21 nt, Homo sapiens
accagauuuuuacacauguau

SEQ ID NO: 903866 - RNA, 14 nt, Homo sapiens
accagcacauuucu

SEQ ID NO: 903867 - RNA, 13 nt, Homo sapiens
accagcaggaaag

SEQ ID NO: 903868 - RNA, 16 nt, Homo sapiens
accagcauucaugccg

SEQ ID NO: 903869 - RNA, 22 nt, Homo sapiens
accagccuggccaacaugguga

SEQ ID NO: 903870 - RNA, 19 nt, Homo sapiens
accaggaucgcuuuguacu

SEQ ID NO: 903871 - RNA, 15 nt, Homo sapiens
accaggucaaaauag

SEQ ID NO: 903872 - RNA, 16 nt, Homo sapiens
accaggucaucuccuu

SEQ ID NO: 903873 - RNA, 15 nt, Homo sapiens
accaguacugggaag

SEQ ID NO: 903874 - RNA, 23 nt, Homo sapiens
accaguccuagccgcgugugaca

SEQ ID NO: 903875 - RNA, 22 nt, Homo sapiens
accaguguccccuccacuguca

SEQ ID NO: 903876 - RNA, 21 nt, Homo sapiens
accaguguuauuaaugacaaa

SEQ ID NO: 903877 - RNA, 13 nt, Homo sapiens
accauaacagcca

SEQ ID NO: 903878 - RNA, 14 nt, Homo sapiens
accauaacagccaa

SEQ ID NO: 903879 - RNA, 19 nt, Homo sapiens
accauaagggacugugcca

SEQ ID NO: 903880 - RNA, 17 nt, Homo sapiens
accauagcacaggcuaa

SEQ ID NO: 903881 - RNA, 20 nt, Homo sapiens
accauagccaaccuguaguu

SEQ ID NO: 903882 - RNA, 17 nt, Homo sapiens
accauauacagcucaga

SEQ ID NO: 903883 - RNA, 21 nt, Homo sapiens
accauaugaauuuacuacuuu

SEQ ID NO: 903884 - RNA, 15 nt, Homo sapiens
uguagaagauggacu

SEQ ID NO: 903885 - RNA, 15 nt, Homo sapiens
uguagaauaaaugaa

SEQ ID NO: 903886 - RNA, 12 nt, Homo sapiens
uguagaauuaua

SEQ ID NO: 903887 - RNA, 11 nt, Homo sapiens
uuucaccacau

SEQ ID NO: 903888 - RNA, 17 nt, Homo sapiens
uuucaccacaugugcac

SEQ ID NO: 903889 - RNA, 14 nt, Homo sapiens
uuucaccaguuucu

SEQ ID NO: 903890 - RNA, 14 nt, Homo sapiens
uuucaccauuuccg

SEQ ID NO: 903891 - RNA, 21 nt, Homo sapiens
uuucaccuguuuuuaagcugu

SEQ ID NO: 903892 - RNA, 23 nt, Homo sapiens
uuucagaagccccauuugcacag

SEQ ID NO: 903893 - RNA, 17 nt, Homo sapiens
uuucagauaaacaacaa

SEQ ID NO: 903894 - RNA, 18 nt, Homo sapiens
uuucagauuccacacaaa

SEQ ID NO: 903895 - RNA, 19 nt, Homo sapiens
uuucauaccuaucaucuua

SEQ ID NO: 903896 - RNA, 21 nt, Homo sapiens
uuucaugauaaugaacagaac

SEQ ID NO: 903897 - RNA, 19 nt, Homo sapiens
uuucauguuuugugacuau

SEQ ID NO: 903898 - RNA, 17 nt, Homo sapiens
uuuccaagggucuuccu

SEQ ID NO: 903899 - RNA, 22 nt, Homo sapiens
uuuccaagggucuuccuccuaa

SEQ ID NO: 903900 - RNA, 21 nt, Homo sapiens
uuuccacauaaagguauuuag

SEQ ID NO: 903901 - RNA, 15 nt, Homo sapiens
uuuccacgagcuaua

SEQ ID NO: 903902 - RNA, 21 nt, Homo sapiens
uuuccacugccaaaacaaugc

SEQ ID NO: 903903 - RNA, 16 nt, Homo sapiens
uuuccagucauuucaa

SEQ ID NO: 903904 - RNA, 14 nt, Homo sapiens
uuuccauagucaca

SEQ ID NO: 903905 - RNA, 12 nt, Homo sapiens
uuucccaccacc

SEQ ID NO: 903906 - RNA, 21 nt, Homo sapiens
uuucccaccgcuuugugagcc

SEQ ID NO: 903907 - RNA, 18 nt, Homo sapiens
uuucccaggaauauccca

SEQ ID NO: 903908 - RNA, 14 nt, Homo sapiens
uuuccccagugugg

SEQ ID NO: 903909 - RNA, 14 nt, Homo sapiens
uuucccccaaagau

SEQ ID NO: 903910 - RNA, 15 nt, Homo sapiens
uuucccuugaacugu

SEQ ID NO: 903911 - RNA, 18 nt, Homo sapiens
uuuccguaaaaaugauuu

SEQ ID NO: 903912 - RNA, 19 nt, Homo sapiens
uuuccuaccuauauuacac

SEQ ID NO: 903913 - RNA, 22 nt, Homo sapiens
uuuccuaucuguaugucugccu

SEQ ID NO: 903914 - RNA, 16 nt, Homo sapiens
uuuccuccaaacuccu

SEQ ID NO: 903915 - RNA, 19 nt, Homo sapiens
uuuccucccuuucccugag

SEQ ID NO: 903916 - RNA, 14 nt, Homo sapiens
uuuccucugcagca

SEQ ID NO: 903917 - RNA, 13 nt, Homo sapiens
uuuccuugucucu

SEQ ID NO: 903918 - RNA, 15 nt, Homo sapiens
uuuccuugucucuca

SEQ ID NO: 903919 - RNA, 16 nt, Homo sapiens
uuuccuugucucucau

SEQ ID NO: 903920 - RNA, 13 nt, Homo sapiens
uuuccuuuugcca

SEQ ID NO: 903921 - RNA, 19 nt, Homo sapiens
uuucuaaagcucugaacaa

SEQ ID NO: 903922 - RNA, 21 nt, Homo sapiens
uuucuaaagcucugaacaaaa

SEQ ID NO: 903923 - RNA, 22 nt, Homo sapiens
uuucuaaagcucugaacaaaag

SEQ ID NO: 903924 - RNA, 17 nt, Homo sapiens
uuucuaacucaggggug

SEQ ID NO: 903925 - RNA, 18 nt, Homo sapiens
uuucuaacuccagugaag

SEQ ID NO: 903926 - RNA, 14 nt, Homo sapiens
uuucuaacuguaaa

SEQ ID NO: 903927 - RNA, 18 nt, Homo sapiens
uuucuaauuggcaugaag

SEQ ID NO: 903928 - RNA, 21 nt, Homo sapiens
uuucuacaccuguugcaccuc

SEQ ID NO: 903929 - RNA, 13 nt, Homo sapiens
uuucuagacuguc

SEQ ID NO: 903930 - RNA, 15 nt, Homo sapiens
uuucuauagccaaaa

SEQ ID NO: 903931 - RNA, 16 nt, Homo sapiens
uuucucccacauauuc

SEQ ID NO: 903932 - RNA, 13 nt, Homo sapiens
uuucuccuuuuga

SEQ ID NO: 903933 - RNA, 18 nt, Homo sapiens
uuucucuggcuccagaau

SEQ ID NO: 903934 - RNA, 19 nt, Homo sapiens
uuucucuugaagaacugac

SEQ ID NO: 903935 - RNA, 13 nt, Homo sapiens
uuucucuuugaga

SEQ ID NO: 903936 - RNA, 22 nt, Homo sapiens
uuucugucacaucagcuccacu

SEQ ID NO: 903937 - RNA, 20 nt, Homo sapiens
uuucuuaaauauuaugugaa

SEQ ID NO: 903938 - RNA, 14 nt, Homo sapiens
uuucuuacauuagc

SEQ ID NO: 903939 - RNA, 17 nt, Homo sapiens
uuucuugcagaucaaau

SEQ ID NO: 903940 - RNA, 13 nt, Homo sapiens
uuucuugccucau

SEQ ID NO: 903941 - RNA, 18 nt, Homo sapiens
uuucuuucuaacuccagu

SEQ ID NO: 903942 - RNA, 17 nt, Homo sapiens
uuugaaacugaauguuu

SEQ ID NO: 903943 - RNA, 21 nt, Homo sapiens
uuugaaugaguuuauauggaa

SEQ ID NO: 903944 - RNA, 23 nt, Homo sapiens
uuugacaaauugaagauggaugu

SEQ ID NO: 903945 - RNA, 22 nt, Homo sapiens
uuugaccaaauaaaguaccauu

SEQ ID NO: 903946 - RNA, 22 nt, Homo sapiens
uuugacucaugaacuauuuaca

SEQ ID NO: 903947 - RNA, 13 nt, Homo sapiens
uuugacuuuucca

SEQ ID NO: 903948 - RNA, 21 nt, Homo sapiens
uuugagacgguguaccagcag

SEQ ID NO: 903949 - RNA, 17 nt, Homo sapiens
uuugagauaaugucaaa

SEQ ID NO: 903950 - RNA, 19 nt, Homo sapiens
uuugagcaauucauuucac

SEQ ID NO: 903951 - RNA, 17 nt, Homo sapiens
uuugagcccucccagca

SEQ ID NO: 903952 - RNA, 18 nt, Homo sapiens
uuugagcuggaaagcagc

SEQ ID NO: 903953 - RNA, 14 nt, Homo sapiens
uuugauaaagcagu

SEQ ID NO: 903954 - RNA, 20 nt, Homo sapiens
uuugauacucccagucuugu

SEQ ID NO: 903955 - RNA, 17 nt, Homo sapiens
uuugaugguaagacugu

SEQ ID NO: 903956 - RNA, 13 nt, Homo sapiens
uuugcaagacaua

SEQ ID NO: 903957 - RNA, 12 nt, Homo sapiens
uuugcacugagg

SEQ ID NO: 903958 - RNA, 20 nt, Homo sapiens
uuugccccuuccacuuugag

SEQ ID NO: 903959 - RNA, 17 nt, Homo sapiens
uuugcuaucacacagug

SEQ ID NO: 903960 - RNA, 13 nt, Homo sapiens
uuugcucauggca

SEQ ID NO: 903961 - RNA, 22 nt, Homo sapiens
uuugcucuuagcugucugcuca

SEQ ID NO: 903962 - RNA, 14 nt, Homo sapiens
uuugcugccaaaca

SEQ ID NO: 903963 - RNA, 20 nt, Homo sapiens
uuugcugccaaacacccaug

SEQ ID NO: 903964 - RNA, 18 nt, Homo sapiens
uuuggcugguuaauucca

SEQ ID NO: 903965 - RNA, 15 nt, Homo sapiens
uuuggggcaggagua

SEQ ID NO: 903966 - RNA, 14 nt, Homo sapiens
uuuggggcugcgaa

SEQ ID NO: 903967 - RNA, 17 nt, Homo sapiens
uuugguuaccaauuuaa

SEQ ID NO: 903968 - RNA, 17 nt, Homo sapiens
uuuguaaaggucagagu

SEQ ID NO: 903969 - RNA, 12 nt, Homo sapiens
uuuguacagaga

SEQ ID NO: 903970 - RNA, 15 nt, Homo sapiens
uuuguaccaguguga

SEQ ID NO: 903971 - RNA, 22 nt, Homo sapiens
uuuguauagaguucaucccagc

SEQ ID NO: 903972 - RNA, 20 nt, Homo sapiens
uuuguguguaccugugacua

SEQ ID NO: 903973 - RNA, 15 nt, Homo sapiens
uuuguugcagccaaa

SEQ ID NO: 903974 - RNA, 17 nt, Homo sapiens
uuuuaaaaaguugcaca

SEQ ID NO: 903975 - RNA, 21 nt, Homo sapiens
uuuuaaaaguuucaaugugau

SEQ ID NO: 903976 - RNA, 18 nt, Homo sapiens
uuuuaaagagcauggaaa

SEQ ID NO: 903977 - RNA, 19 nt, Homo sapiens
uuuuaacaacugugcuuuu

SEQ ID NO: 903978 - RNA, 15 nt, Homo sapiens
uuuuaacacauaacu

SEQ ID NO: 903979 - RNA, 14 nt, Homo sapiens
uuuuaagaaagugc

SEQ ID NO: 903980 - RNA, 14 nt, Homo sapiens
uuuuaagacuauaa

SEQ ID NO: 903981 - RNA, 15 nt, Homo sapiens
uuuuaagugccuuua

SEQ ID NO: 903982 - RNA, 11 nt, Homo sapiens
uuuuaauuucu

SEQ ID NO: 903983 - RNA, 16 nt, Homo sapiens
uuuuaauuucuaugga

SEQ ID NO: 903984 - RNA, 16 nt, Homo sapiens
uuuuaauuugauacaa

SEQ ID NO: 903985 - RNA, 17 nt, Homo sapiens
uuuuacagugcuauuua

SEQ ID NO: 903986 - RNA, 17 nt, Homo sapiens
uuuuacgcuuugcagac

SEQ ID NO: 903987 - RNA, 21 nt, Homo sapiens
uuuuaggaugugggaguaaaa

SEQ ID NO: 903988 - RNA, 17 nt, Homo sapiens
uuuuaguaaauccuuau

SEQ ID NO: 903989 - RNA, 16 nt, Homo sapiens
uuuuagugacuguaau

SEQ ID NO: 903990 - RNA, 20 nt, Homo sapiens
uuuuagugacuguaauuaau

SEQ ID NO: 903991 - RNA, 20 nt, Homo sapiens
uuuuauaagacuacuauaca

SEQ ID NO: 903992 - RNA, 15 nt, Homo sapiens
uuuuauagucugaaa

SEQ ID NO: 903993 - RNA, 12 nt, Homo sapiens
uuuuauauccac

SEQ ID NO: 903994 - RNA, 19 nt, Homo sapiens
uuuuauccacuuaccuaga

SEQ ID NO: 903995 - RNA, 20 nt, Homo sapiens
uuuuauggaggcuuugcaua

SEQ ID NO: 903996 - RNA, 23 nt, Homo sapiens
uuuuauggaggcuuugcauagau

SEQ ID NO: 903997 - RNA, 23 nt, Homo sapiens
uuuuauguguggcccaagacaau

SEQ ID NO: 903998 - RNA, 19 nt, Homo sapiens
uuuuauucaaagacagaga

SEQ ID NO: 903999 - RNA, 22 nt, Homo sapiens
gaauccgccugcagaggacaga

SEQ ID NO: 904000 - RNA, 17 nt, Homo sapiens
gaaucgccccagacucc

SEQ ID NO: 904001 - RNA, 20 nt, Homo sapiens
gaaucggagcgaagcagaga

SEQ ID NO: 904002 - RNA, 14 nt, Homo sapiens
gaaucuacagaaca

SEQ ID NO: 904003 - RNA, 21 nt, Homo sapiens
gaaugaaguggaggaaguaac

SEQ ID NO: 904004 - RNA, 21 nt, Homo sapiens
gaaugaccacgggccucaguu

SEQ ID NO: 904005 - RNA, 20 nt, Homo sapiens
gaaugauucccucuugcuau

SEQ ID NO: 904006 - RNA, 21 nt, Homo sapiens
gaaugauucccucuugcuauu

SEQ ID NO: 904007 - RNA, 17 nt, Homo sapiens
gaaugcacaccaaaaaa

SEQ ID NO: 904008 - RNA, 12 nt, Homo sapiens
gaaugcagggaa

SEQ ID NO: 904009 - RNA, 15 nt, Homo sapiens
gaaugccacagugaa

SEQ ID NO: 904010 - RNA, 16 nt, Homo sapiens
gaaugccacagugaag

SEQ ID NO: 904011 - RNA, 14 nt, Homo sapiens
gaaugccggggaca

SEQ ID NO: 904012 - RNA, 15 nt, Homo sapiens
gaaugcggaaccaua

SEQ ID NO: 904013 - RNA, 20 nt, Homo sapiens
gaaugcggccgcauucccug

SEQ ID NO: 904014 - RNA, 14 nt, Homo sapiens
gaaugcuccaugaa

SEQ ID NO: 904015 - RNA, 14 nt, Homo sapiens
gaauggaaccaaaa

SEQ ID NO: 904016 - RNA, 18 nt, Homo sapiens
gaauggguuuacucucaa

SEQ ID NO: 904017 - RNA, 15 nt, Homo sapiens
gaaugguccaggguu

SEQ ID NO: 904018 - RNA, 12 nt, Homo sapiens
gaaugucucagc

SEQ ID NO: 904019 - RNA, 19 nt, Homo sapiens
gaaugugguccagacguca

SEQ ID NO: 904020 - RNA, 21 nt, Homo sapiens
gaaugugugaaggucuugccu

SEQ ID NO: 904021 - RNA, 17 nt, Homo sapiens
gaauguuuauguucuca

SEQ ID NO: 904022 - RNA, 17 nt, Homo sapiens
gaauuaggaagaccaag

SEQ ID NO: 904023 - RNA, 15 nt, Homo sapiens
gaauuauaaaggcca

SEQ ID NO: 904024 - RNA, 14 nt, Homo sapiens
gaauuauaucuaau

SEQ ID NO: 904025 - RNA, 20 nt, Homo sapiens
gaauuaucaugggaaaagac

SEQ ID NO: 904026 - RNA, 20 nt, Homo sapiens
gaauuccugacccacaggaa

SEQ ID NO: 904027 - RNA, 19 nt, Homo sapiens
gaauucuaagcuggugccc

SEQ ID NO: 904028 - RNA, 23 nt, Homo sapiens
gaauugagauaauaucugugagg

SEQ ID NO: 904029 - RNA, 17 nt, Homo sapiens
gaauuuauucaauuccu

SEQ ID NO: 904030 - RNA, 16 nt, Homo sapiens
gaauuugggccucuug

SEQ ID NO: 904031 - RNA, 13 nt, Homo sapiens
gaauuuuguugcu

SEQ ID NO: 904032 - RNA, 14 nt, Homo sapiens
gacaaaacacugug

SEQ ID NO: 904033 - RNA, 21 nt, Homo sapiens
gacaaagccaaacucugccag

SEQ ID NO: 904034 - RNA, 22 nt, Homo sapiens
gacaaauauuguuaccaugaag

SEQ ID NO: 904035 - RNA, 12 nt, Homo sapiens
gacaacauuucu

SEQ ID NO: 904036 - RNA, 21 nt, Homo sapiens
gacaagcaagggcugugcuga

SEQ ID NO: 904037 - RNA, 23 nt, Homo sapiens
gacaauaaaacauuccugugaaa

SEQ ID NO: 904038 - RNA, 23 nt, Homo sapiens
gacaaugaaaguuugcacuguau

SEQ ID NO: 904039 - RNA, 22 nt, Homo sapiens
gacaaugcaaugaaacagauga

SEQ ID NO: 904040 - RNA, 14 nt, Homo sapiens
gacacacagucuca

SEQ ID NO: 904041 - RNA, 11 nt, Homo sapiens
gacacacugua

SEQ ID NO: 904042 - RNA, 21 nt, Homo sapiens
gacacagagggggccuucaca

SEQ ID NO: 904043 - RNA, 13 nt, Homo sapiens
gacaccaccaucu

SEQ ID NO: 904044 - RNA, 23 nt, Homo sapiens
gacaccagccaucaugugccugg

SEQ ID NO: 904045 - RNA, 15 nt, Homo sapiens
gacaccugccuuaac

SEQ ID NO: 904046 - RNA, 20 nt, Homo sapiens
gacacuauuuaucugugcaa

SEQ ID NO: 904047 - RNA, 14 nt, Homo sapiens
gacacugugcuaua

SEQ ID NO: 904048 - RNA, 20 nt, Homo sapiens
gacacuugccuucuucaccc

SEQ ID NO: 904049 - RNA, 13 nt, Homo sapiens
gacagaacacugu

SEQ ID NO: 904050 - RNA, 13 nt, Homo sapiens
gacagaaugucac

SEQ ID NO: 904051 - RNA, 21 nt, Homo sapiens
gacagagaggggcagguugac

SEQ ID NO: 904052 - RNA, 14 nt, Homo sapiens
gacagagcugggau

SEQ ID NO: 904053 - RNA, 16 nt, Homo sapiens
gacagcgccaccucuu

SEQ ID NO: 904054 - RNA, 16 nt, Homo sapiens
gacaggaauacuuaac

SEQ ID NO: 904055 - RNA, 18 nt, Homo sapiens
gacaggacuaacacucag

SEQ ID NO: 904056 - RNA, 22 nt, Homo sapiens
gacaggauguggcacugcuuga

SEQ ID NO: 904057 - RNA, 14 nt, Homo sapiens
gacaggcaugcacc

SEQ ID NO: 904058 - RNA, 20 nt, Homo sapiens
gacagucucaagcacuaaaa

SEQ ID NO: 904059 - RNA, 19 nt, Homo sapiens
gacagugcccaugcaaugg

SEQ ID NO: 904060 - RNA, 14 nt, Homo sapiens
gacagugcugcccu

SEQ ID NO: 904061 - RNA, 21 nt, Homo sapiens
gacauaaaugaggaaacucca

SEQ ID NO: 904062 - RNA, 23 nt, Homo sapiens
gacauacaccuaugucauuucau

SEQ ID NO: 904063 - RNA, 16 nt, Homo sapiens
gacauauaccuucuca

SEQ ID NO: 904064 - RNA, 16 nt, Homo sapiens
gacaugcagcucugau

SEQ ID NO: 904065 - RNA, 16 nt, Homo sapiens
gacauggaauuaccuu

SEQ ID NO: 904066 - RNA, 13 nt, Homo sapiens
gacaugucucaca

SEQ ID NO: 904067 - RNA, 15 nt, Homo sapiens
gacauuaaaccugga

SEQ ID NO: 904068 - RNA, 21 nt, Homo sapiens
gacauuaugugugcaugugug

SEQ ID NO: 904069 - RNA, 20 nt, Homo sapiens
gacauuccaaagaacagccu

SEQ ID NO: 904070 - RNA, 19 nt, Homo sapiens
gacauugcuucugcuaaau

SEQ ID NO: 904071 - RNA, 18 nt, Homo sapiens
gacauuucuaacauaugu

SEQ ID NO: 904072 - RNA, 23 nt, Homo sapiens
gacauuucuaucuugaauuucau

SEQ ID NO: 904073 - RNA, 19 nt, Homo sapiens
gacauuuucaauaauguga

SEQ ID NO: 904074 - RNA, 15 nt, Homo sapiens
uccaucccgaaaauc

SEQ ID NO: 904075 - RNA, 23 nt, Homo sapiens
uccaucuagagauuuucuuggca

SEQ ID NO: 904076 - RNA, 15 nt, Homo sapiens
uccaucucaaaaaau

SEQ ID NO: 904077 - RNA, 15 nt, Homo sapiens
uccaucuccacucca

SEQ ID NO: 904078 - RNA, 16 nt, Homo sapiens
uccaugcugccuccag

SEQ ID NO: 904079 - RNA, 22 nt, Homo sapiens
uccaugucgccucugcauucag

SEQ ID NO: 904080 - RNA, 12 nt, Homo sapiens
uccauugcaugu

SEQ ID NO: 904081 - RNA, 23 nt, Homo sapiens
uccauuuggauaaaaggaaccaa

SEQ ID NO: 904082 - RNA, 14 nt, Homo sapiens
uccauuugggauau

SEQ ID NO: 904083 - RNA, 15 nt, Homo sapiens
ucccaaagugcuagu

SEQ ID NO: 904084 - RNA, 21 nt, Homo sapiens
ucccaaauuucauaccuauca

SEQ ID NO: 904085 - RNA, 12 nt, Homo sapiens
ucccaaccugau

SEQ ID NO: 904086 - RNA, 17 nt, Homo sapiens
ucccaaggaaaauggac

SEQ ID NO: 904087 - RNA, 20 nt, Homo sapiens
ucccaaggugcuaggauuac

SEQ ID NO: 904088 - RNA, 17 nt, Homo sapiens
ucccaaucagcacugaa

SEQ ID NO: 904089 - RNA, 18 nt, Homo sapiens
ucccaaucagcacugaaa

SEQ ID NO: 904090 - RNA, 20 nt, Homo sapiens
ucccacacacaaaccaagag

SEQ ID NO: 904091 - RNA, 14 nt, Homo sapiens
ucccacagcacuaa

SEQ ID NO: 904092 - RNA, 17 nt, Homo sapiens
ucccacagccuggcuau

SEQ ID NO: 904093 - RNA, 18 nt, Homo sapiens
ucccacaugaucuugaga

SEQ ID NO: 904094 - RNA, 20 nt, Homo sapiens
ucccacccacaugugacaca

SEQ ID NO: 904095 - RNA, 15 nt, Homo sapiens
ucccaccgcuuugug

SEQ ID NO: 904096 - RNA, 15 nt, Homo sapiens
ucccacgacuguugu

SEQ ID NO: 904097 - RNA, 16 nt, Homo sapiens
ucccacgacuguugua

SEQ ID NO: 904098 - RNA, 18 nt, Homo sapiens
ucccacuaagcuuucucc

SEQ ID NO: 904099 - RNA, 12 nt, Homo sapiens
ucccacuggaac

SEQ ID NO: 904100 - RNA, 15 nt, Homo sapiens
ucccacuugucaugu

SEQ ID NO: 904101 - RNA, 13 nt, Homo sapiens
ucccagaaccaca

SEQ ID NO: 904102 - RNA, 14 nt, Homo sapiens
ucccagaaccacac

SEQ ID NO: 904103 - RNA, 14 nt, Homo sapiens
ucccagagcuuccc

SEQ ID NO: 904104 - RNA, 12 nt, Homo sapiens
ucccagcacuuu

SEQ ID NO: 904105 - RNA, 11 nt, Homo sapiens
ucccagcauug

SEQ ID NO: 904106 - RNA, 17 nt, Homo sapiens
ucccagccacucgggag

SEQ ID NO: 904107 - RNA, 13 nt, Homo sapiens
ucccagcuacuca

SEQ ID NO: 904108 - RNA, 20 nt, Homo sapiens
ucccagcugcagaugccaca

SEQ ID NO: 904109 - RNA, 18 nt, Homo sapiens
ucccauagcgcuggcuca

SEQ ID NO: 904110 - RNA, 18 nt, Homo sapiens
ucccaucugucaccaauu

SEQ ID NO: 904111 - RNA, 23 nt, Homo sapiens
ucccaugugcauggaaauguccu

SEQ ID NO: 904112 - RNA, 16 nt, Homo sapiens
ucccauucucauaugu

SEQ ID NO: 904113 - RNA, 18 nt, Homo sapiens
ucccauugcaucaccucu

SEQ ID NO: 904114 - RNA, 16 nt, Homo sapiens
uguaagacucauuccc

SEQ ID NO: 904115 - RNA, 12 nt, Homo sapiens
uguaagcacuuc

SEQ ID NO: 904116 - RNA, 16 nt, Homo sapiens
uguaaggaacuggaac

SEQ ID NO: 904117 - RNA, 22 nt, Homo sapiens
uguaaucccagcaugcugagau

SEQ ID NO: 904118 - RNA, 19 nt, Homo sapiens
uguaaucccagcuacuugg

SEQ ID NO: 904119 - RNA, 12 nt, Homo sapiens
uguaaugaucau

SEQ ID NO: 904120 - RNA, 12 nt, Homo sapiens
uguaaugcauag

SEQ ID NO: 904121 - RNA, 21 nt, Homo sapiens
uguaauuaaguaaaccaaaaa

SEQ ID NO: 904122 - RNA, 22 nt, Homo sapiens
uguaauuaaguaaaccaaaaag

SEQ ID NO: 904123 - RNA, 21 nt, Homo sapiens
uguaauuaguaauaaaaccca

SEQ ID NO: 904124 - RNA, 17 nt, Homo sapiens
uguacacacacagaugc

SEQ ID NO: 904125 - RNA, 12 nt, Homo sapiens
uguacacugugu

SEQ ID NO: 904126 - RNA, 20 nt, Homo sapiens
uguacaguuauacauaccuc

SEQ ID NO: 904127 - RNA, 19 nt, Homo sapiens
uguacauuccugauacugg

SEQ ID NO: 904128 - RNA, 10 nt, Homo sapiens
uguacauuuc

SEQ ID NO: 904129 - RNA, 21 nt, Homo sapiens
uguaccucccccugccuucca

SEQ ID NO: 904130 - RNA, 18 nt, Homo sapiens
uguacgucugacaggcaa

SEQ ID NO: 904131 - RNA, 13 nt, Homo sapiens
uguacuccucuga

SEQ ID NO: 904132 - RNA, 21 nt, Homo sapiens
uguacuguaauagugugauua

SEQ ID NO: 904133 - RNA, 18 nt, Homo sapiens
uguacuuuuuauucaauu

SEQ ID NO: 904134 - RNA, 20 nt, Homo sapiens
uguagaaugauuucaugcua

SEQ ID NO: 904135 - RNA, 16 nt, Homo sapiens
uguagcagaaaccaag

SEQ ID NO: 904136 - RNA, 20 nt, Homo sapiens
uguagcauuucuugauguug

SEQ ID NO: 904137 - RNA, 23 nt, Homo sapiens
uguagcccucaugauaaucuggg

SEQ ID NO: 904138 - RNA, 14 nt, Homo sapiens
uguaggcaaccuuc

SEQ ID NO: 904139 - RNA, 19 nt, Homo sapiens
uguagguaauauuguucua

SEQ ID NO: 904140 - RNA, 22 nt, Homo sapiens
uguaguaaaccaggccucccag

SEQ ID NO: 904141 - RNA, 22 nt, Homo sapiens
uguaguccguuaacacuacuua

SEQ ID NO: 904142 - RNA, 19 nt, Homo sapiens
uguaguggcauccauuucu

SEQ ID NO: 904143 - RNA, 23 nt, Homo sapiens
uguauaaccccaccuugccaagc

SEQ ID NO: 904144 - RNA, 17 nt, Homo sapiens
uguauacacacauauac

SEQ ID NO: 904145 - RNA, 17 nt, Homo sapiens
uguauauacacauauac

SEQ ID NO: 904146 - RNA, 16 nt, Homo sapiens
uguauauacauauuau

SEQ ID NO: 904147 - RNA, 17 nt, Homo sapiens
uguauauacauuucaua

SEQ ID NO: 904148 - RNA, 21 nt, Homo sapiens
uguauauuaagguguggcuuu

SEQ ID NO: 904149 - RNA, 18 nt, Homo sapiens
uguaucauuaauguaggu

SEQ ID NO: 904150 - RNA, 20 nt, Homo sapiens
uguauccccgugaaaucugg

SEQ ID NO: 904151 - RNA, 20 nt, Homo sapiens
uguaucuaccaucuaaucua

SEQ ID NO: 904152 - RNA, 18 nt, Homo sapiens
uguaucucuauguggauc

SEQ ID NO: 904153 - RNA, 20 nt, Homo sapiens
uguaucugaagaccuaccag

SEQ ID NO: 904154 - RNA, 16 nt, Homo sapiens
uguaucuuauucacau

SEQ ID NO: 904155 - RNA, 14 nt, Homo sapiens
uguaugauguguug

SEQ ID NO: 904156 - RNA, 22 nt, Homo sapiens
uguauuacaucuaaugcuucaa

SEQ ID NO: 904157 - RNA, 15 nt, Homo sapiens
uguauuauguaugcg

SEQ ID NO: 904158 - RNA, 12 nt, Homo sapiens
uguauuugccau

SEQ ID NO: 904159 - RNA, 16 nt, Homo sapiens
uguauuugucaaugca

SEQ ID NO: 904160 - RNA, 22 nt, Homo sapiens
uguauuuuuuccuguaagacaa

SEQ ID NO: 904161 - RNA, 14 nt, Homo sapiens
ugucaaauaucuca

SEQ ID NO: 904162 - RNA, 21 nt, Homo sapiens
ugucaagaugaugaugaucuu

SEQ ID NO: 904163 - RNA, 14 nt, Homo sapiens
ugucacaccugaaa

SEQ ID NO: 904164 - RNA, 22 nt, Homo sapiens
ugucacuacucacagucucuuu

SEQ ID NO: 904165 - RNA, 15 nt, Homo sapiens
ugucagcccacagca

SEQ ID NO: 904166 - RNA, 20 nt, Homo sapiens
ugucaggaaucaugaucuga

SEQ ID NO: 904167 - RNA, 21 nt, Homo sapiens
ugucauauggaagaguuaaaa

SEQ ID NO: 904168 - RNA, 22 nt, Homo sapiens
ugucaucaaauauuaccaaaaa

SEQ ID NO: 904169 - RNA, 23 nt, Homo sapiens
ugucaucaaauauuaccaaaaaa

SEQ ID NO: 904170 - RNA, 22 nt, Homo sapiens
ugucaucuuccuggaagcagag

SEQ ID NO: 904171 - RNA, 19 nt, Homo sapiens
ugucaugauuucaaugauu

SEQ ID NO: 904172 - RNA, 23 nt, Homo sapiens
ugucauuaaauggggcucacaaa

SEQ ID NO: 904173 - RNA, 19 nt, Homo sapiens
ugucauucaagccugugaa

SEQ ID NO: 904174 - RNA, 20 nt, Homo sapiens
uguccaugccuacagauaau

SEQ ID NO: 904175 - RNA, 16 nt, Homo sapiens
ugucccagaaaaagca

SEQ ID NO: 904176 - RNA, 12 nt, Homo sapiens
ugucccauuucc

SEQ ID NO: 904177 - RNA, 22 nt, Homo sapiens
uguccccucuccccucauggag

SEQ ID NO: 904178 - RNA, 17 nt, Homo sapiens
ugucccucacugccuuc

SEQ ID NO: 904179 - RNA, 16 nt, Homo sapiens
ugucccugcacuugca

SEQ ID NO: 904180 - RNA, 18 nt, Homo sapiens
ugucccuugcuguuuuca

SEQ ID NO: 904181 - RNA, 18 nt, Homo sapiens
uguccuaaaauacaaaca

SEQ ID NO: 904182 - RNA, 17 nt, Homo sapiens
uguccuacucuguguca

SEQ ID NO: 904183 - RNA, 15 nt, Homo sapiens
uguccucuugcucaa

SEQ ID NO: 904184 - RNA, 13 nt, Homo sapiens
uguccugccuuga

SEQ ID NO: 904185 - RNA, 17 nt, Homo sapiens
uguccugccuugaugaa

SEQ ID NO: 904186 - RNA, 17 nt, Homo sapiens
ugucgaguuuacuucau

SEQ ID NO: 904187 - RNA, 13 nt, Homo sapiens
ugucgcaucucag

SEQ ID NO: 904188 - RNA, 16 nt, Homo sapiens
ugucgccucugcauuc

SEQ ID NO: 904189 - RNA, 23 nt, Homo sapiens
ugucguuucccucccaacagagc

SEQ ID NO: 904190 - RNA, 16 nt, Homo sapiens
ugucuaauaguuauuc

SEQ ID NO: 904191 - RNA, 16 nt, Homo sapiens
ugucucaaauucaugg

SEQ ID NO: 904192 - RNA, 14 nt, Homo sapiens
ugucucacacagca

SEQ ID NO: 904193 - RNA, 21 nt, Homo sapiens
ugucucggagggauuccccua

SEQ ID NO: 904194 - RNA, 16 nt, Homo sapiens
ugucucugcucuugcc

SEQ ID NO: 904195 - RNA, 13 nt, Homo sapiens
ugucucuugagaa

SEQ ID NO: 904196 - RNA, 10 nt, Homo sapiens
ugucuguccu

SEQ ID NO: 904197 - RNA, 17 nt, Homo sapiens
ggcaguuggaggacaca

SEQ ID NO: 904198 - RNA, 17 nt, Homo sapiens
ggcauagggaauaugua

SEQ ID NO: 904199 - RNA, 17 nt, Homo sapiens
ggcaucgggccaucuca

SEQ ID NO: 904200 - RNA, 22 nt, Homo sapiens
ggcaucugacaugcaucaucuc

SEQ ID NO: 904201 - RNA, 21 nt, Homo sapiens
ggcaucuuucaacaaugacua

SEQ ID NO: 904202 - RNA, 20 nt, Homo sapiens
ggcaugagggaucacagggc

SEQ ID NO: 904203 - RNA, 15 nt, Homo sapiens
ggcaugcaccagugc

SEQ ID NO: 904204 - RNA, 20 nt, Homo sapiens
ggcauggcccugggguccca

SEQ ID NO: 904205 - RNA, 16 nt, Homo sapiens
ggcaugugaugugcaa

SEQ ID NO: 904206 - RNA, 13 nt, Homo sapiens
ggcaugugugccu

SEQ ID NO: 904207 - RNA, 13 nt, Homo sapiens
ggccaacaugaug

SEQ ID NO: 904208 - RNA, 21 nt, Homo sapiens
ggccaagaaagagucaggccu

SEQ ID NO: 904209 - RNA, 22 nt, Homo sapiens
ggccaagcccagcuuaauggcu

SEQ ID NO: 904210 - RNA, 15 nt, Homo sapiens
ggccacaccaucucc

SEQ ID NO: 904211 - RNA, 17 nt, Homo sapiens
ggccaccccgugccacc

SEQ ID NO: 904212 - RNA, 16 nt, Homo sapiens
ggccacucuguuggug

SEQ ID NO: 904213 - RNA, 20 nt, Homo sapiens
ggccacucuguugguggccu

SEQ ID NO: 904214 - RNA, 16 nt, Homo sapiens
ggccagcagcagauaa

SEQ ID NO: 904215 - RNA, 11 nt, Homo sapiens
ggccagcucac

SEQ ID NO: 904216 - RNA, 17 nt, Homo sapiens
ggccagggaaagcccgu

SEQ ID NO: 904217 - RNA, 23 nt, Homo sapiens
ggccaguauuuuuauuucuuuaa

SEQ ID NO: 904218 - RNA, 23 nt, Homo sapiens
ggccauuccaacagcucaagucu

SEQ ID NO: 904219 - RNA, 11 nt, Homo sapiens
ggcccagaccu

SEQ ID NO: 904220 - RNA, 23 nt, Homo sapiens
ggcccagugacaccgaguuccac

SEQ ID NO: 904221 - RNA, 17 nt, Homo sapiens
ggccgaaggcagugcaa

SEQ ID NO: 904222 - RNA, 18 nt, Homo sapiens
ggccgcuguguuuggaga

SEQ ID NO: 904223 - RNA, 22 nt, Homo sapiens
ggccggggcccugcaccugugc

SEQ ID NO: 904224 - RNA, 15 nt, Homo sapiens
ggccuaacacugggc

SEQ ID NO: 904225 - RNA, 18 nt, Homo sapiens
ggccuaaucucauaccuc

SEQ ID NO: 904226 - RNA, 13 nt, Homo sapiens
ggccuaugcacau

SEQ ID NO: 904227 - RNA, 16 nt, Homo sapiens
ggccucagaccaacuc

SEQ ID NO: 904228 - RNA, 20 nt, Homo sapiens
uacuggaccccgccucccag

SEQ ID NO: 904229 - RNA, 17 nt, Homo sapiens
uacugggaaauuacuua

SEQ ID NO: 904230 - RNA, 14 nt, Homo sapiens
uacugggaagacaa

SEQ ID NO: 904231 - RNA, 18 nt, Homo sapiens
uacuguaaauguauuugg

SEQ ID NO: 904232 - RNA, 14 nt, Homo sapiens
uacugugagacugu

SEQ ID NO: 904233 - RNA, 13 nt, Homo sapiens
uacuuaaacccag

SEQ ID NO: 904234 - RNA, 13 nt, Homo sapiens
uacuuaacugugu

SEQ ID NO: 904235 - RNA, 23 nt, Homo sapiens
uacuuaagcaaaagucagucuua

SEQ ID NO: 904236 - RNA, 14 nt, Homo sapiens
uacuuaagugcugc

SEQ ID NO: 904237 - RNA, 16 nt, Homo sapiens
uacuuacaugcauuac

SEQ ID NO: 904238 - RNA, 20 nt, Homo sapiens
uacuuauauguaaaguauua

SEQ ID NO: 904239 - RNA, 19 nt, Homo sapiens
uacuuccuguguacucuuu

SEQ ID NO: 904240 - RNA, 22 nt, Homo sapiens
uacuucugucuuccuucauuau

SEQ ID NO: 904241 - RNA, 18 nt, Homo sapiens
uacuugaaaaaauguucu

SEQ ID NO: 904242 - RNA, 19 nt, Homo sapiens
uacuugggagaccuguaau

SEQ ID NO: 904243 - RNA, 20 nt, Homo sapiens
uacuugggaggcugaggcag

SEQ ID NO: 904244 - RNA, 21 nt, Homo sapiens
uacuuucaucuauucuuuccc

SEQ ID NO: 904245 - RNA, 18 nt, Homo sapiens
uacuuucccacagcacua

SEQ ID NO: 904246 - RNA, 22 nt, Homo sapiens
uacuuuugaaaaucaacuguau

SEQ ID NO: 904247 - RNA, 22 nt, Homo sapiens
uacuuuuuucuuauuuaacuua

SEQ ID NO: 904248 - RNA, 13 nt, Homo sapiens
uagaaacaugaca

SEQ ID NO: 904249 - RNA, 21 nt, Homo sapiens
uagaaauaagcccaacagaca

SEQ ID NO: 904250 - RNA, 19 nt, Homo sapiens
uagaaauguauccugauaa

SEQ ID NO: 904251 - RNA, 17 nt, Homo sapiens
uagaacacugcauuaga

SEQ ID NO: 904252 - RNA, 18 nt, Homo sapiens
uagaaccaagcuucagag

SEQ ID NO: 904253 - RNA, 22 nt, Homo sapiens
uaguccguuaacacuacuuaaa

SEQ ID NO: 904254 - RNA, 18 nt, Homo sapiens
uaguccuauucuauugca

SEQ ID NO: 904255 - RNA, 23 nt, Homo sapiens
uagugaaguucuuuuacuguaau

SEQ ID NO: 904256 - RNA, 17 nt, Homo sapiens
uagugacuguaauuaau

SEQ ID NO: 904257 - RNA, 17 nt, Homo sapiens
uagugauuuccuguaua

SEQ ID NO: 904258 - RNA, 15 nt, Homo sapiens
uagugcccucaucca

SEQ ID NO: 904259 - RNA, 23 nt, Homo sapiens
uaguggcuuccuccgucugcaau

SEQ ID NO: 904260 - RNA, 18 nt, Homo sapiens
uaguguuaauaucuugaa

SEQ ID NO: 904261 - RNA, 23 nt, Homo sapiens
uaguguuggaaaaugugcaauau

SEQ ID NO: 904262 - RNA, 13 nt, Homo sapiens
uaguuaaaguaau

SEQ ID NO: 904263 - RNA, 17 nt, Homo sapiens
uaguuaauuauuucaac

SEQ ID NO: 904264 - RNA, 15 nt, Homo sapiens
uaguuauauuugcug

SEQ ID NO: 904265 - RNA, 16 nt, Homo sapiens
uaguuauuuacuugaa

SEQ ID NO: 904266 - RNA, 19 nt, Homo sapiens
uaguucuuacuacuugcca

SEQ ID NO: 904267 - RNA, 20 nt, Homo sapiens
uaguugagaaagaagagaag

SEQ ID NO: 904268 - RNA, 21 nt, Homo sapiens
uaguugaucuacaaaggccau

SEQ ID NO: 904269 - RNA, 13 nt, Homo sapiens
uaguuuauuucaa

SEQ ID NO: 904270 - RNA, 22 nt, Homo sapiens
uaguuuauuuuguuacacuaaa

SEQ ID NO: 904271 - RNA, 18 nt, Homo sapiens
uaguuuuaagacugaaga

SEQ ID NO: 904272 - RNA, 16 nt, Homo sapiens
uaguuuuaguugcaga

SEQ ID NO: 904273 - RNA, 19 nt, Homo sapiens
uauaaaggccagcgccaga

SEQ ID NO: 904274 - RNA, 16 nt, Homo sapiens
uauaaaucaaugucac

SEQ ID NO: 904275 - RNA, 18 nt, Homo sapiens
uauaaauguguggugcua

SEQ ID NO: 904276 - RNA, 15 nt, Homo sapiens
uauaacaaacuacau

SEQ ID NO: 904277 - RNA, 15 nt, Homo sapiens
uaugguugauuccca

SEQ ID NO: 904278 - RNA, 17 nt, Homo sapiens
uaugguuucuccaucca

SEQ ID NO: 904279 - RNA, 16 nt, Homo sapiens
uauguaaaguauguaa

SEQ ID NO: 904280 - RNA, 22 nt, Homo sapiens
uauguaaucucaccucaccugg

SEQ ID NO: 904281 - RNA, 12 nt, Homo sapiens
uauguagauaac

SEQ ID NO: 904282 - RNA, 20 nt, Homo sapiens
uauguauacacacauauaca

SEQ ID NO: 904283 - RNA, 17 nt, Homo sapiens
uauguauauagaugugc

SEQ ID NO: 904284 - RNA, 19 nt, Homo sapiens
uauguauauguauaucuau

SEQ ID NO: 904285 - RNA, 13 nt, Homo sapiens
uauguaugcaucu

SEQ ID NO: 904286 - RNA, 16 nt, Homo sapiens
uauguauuaagccaaa

SEQ ID NO: 904287 - RNA, 20 nt, Homo sapiens
uauguauuuuugucauagca

SEQ ID NO: 904288 - RNA, 13 nt, Homo sapiens
uaugucaucauac

SEQ ID NO: 904289 - RNA, 19 nt, Homo sapiens
uaugucuuggacacuguac

SEQ ID NO: 904290 - RNA, 9 nt, Homo sapiens
uaugugcaa

SEQ ID NO: 904291 - RNA, 17 nt, Homo sapiens
uaugugcgucucucuuu

SEQ ID NO: 904292 - RNA, 17 nt, Homo sapiens
uaugugcgugcaugugu

SEQ ID NO: 904293 - RNA, 20 nt, Homo sapiens
uauguggacguaaucuccac

SEQ ID NO: 904294 - RNA, 12 nt, Homo sapiens
uaugugggacac

SEQ ID NO: 904295 - RNA, 18 nt, Homo sapiens
uauguuaauaacuugucc

SEQ ID NO: 904296 - RNA, 18 nt, Homo sapiens
uauguuacuacaugcacu

SEQ ID NO: 904297 - RNA, 22 nt, Homo sapiens
uauguucuaacagcaucugccu

SEQ ID NO: 904298 - RNA, 15 nt, Homo sapiens
uauguugaguguuca

SEQ ID NO: 904299 - RNA, 20 nt, Homo sapiens
uauguuuaaaaacauucccc

SEQ ID NO: 904300 - RNA, 20 nt, Homo sapiens
uauguuuacauaucaccuca

SEQ ID NO: 904301 - RNA, 14 nt, Homo sapiens
uauuaaagaugugu

SEQ ID NO: 904302 - RNA, 14 nt, Homo sapiens
uauuaaagcaccaa

SEQ ID NO: 904303 - RNA, 15 nt, Homo sapiens
uauuaagauuuccaa

SEQ ID NO: 904304 - RNA, 19 nt, Homo sapiens
uauuaagugccugagacac

SEQ ID NO: 904305 - RNA, 18 nt, Homo sapiens
uauuaaugaacugugaca

SEQ ID NO: 904306 - RNA, 19 nt, Homo sapiens
uauuaaugaacugugacag

SEQ ID NO: 904307 - RNA, 21 nt, Homo sapiens
uauuacaauuuuugaacaacu

SEQ ID NO: 904308 - RNA, 21 nt, Homo sapiens
uauuacacaaaaaaguauaga

SEQ ID NO: 904309 - RNA, 16 nt, Homo sapiens
uauuacgugcaauacu

SEQ ID NO: 904310 - RNA, 22 nt, Homo sapiens
uauuacuuauuuuugacagugu

SEQ ID NO: 904311 - RNA, 14 nt, Homo sapiens
uauuagacaugaaa

SEQ ID NO: 904312 - RNA, 17 nt, Homo sapiens
uauuagcaacugugcua

SEQ ID NO: 904313 - RNA, 20 nt, Homo sapiens
uauuagcaacugugcuacac

SEQ ID NO: 904314 - RNA, 16 nt, Homo sapiens
uauuagcuuauauauu

SEQ ID NO: 904315 - RNA, 14 nt, Homo sapiens
uauuaugucucaaa

SEQ ID NO: 904316 - RNA, 18 nt, Homo sapiens
uauuauucuucauaacaa

SEQ ID NO: 904317 - RNA, 16 nt, Homo sapiens
uauuauugagcucuau

SEQ ID NO: 904318 - RNA, 18 nt, Homo sapiens
uauuauuguugcauuaaa

SEQ ID NO: 904319 - RNA, 20 nt, Homo sapiens
uauuauuuggcaugcuuaaa

SEQ ID NO: 904320 - RNA, 15 nt, Homo sapiens
uauucaaggaucuca

SEQ ID NO: 904321 - RNA, 13 nt, Homo sapiens
uauucaaguauua

SEQ ID NO: 904322 - RNA, 13 nt, Homo sapiens
uauucaauggaaa

SEQ ID NO: 904323 - RNA, 15 nt, Homo sapiens
uauucagcacuaaaa

SEQ ID NO: 904324 - RNA, 18 nt, Homo sapiens
uauucauuagcugugauu

SEQ ID NO: 904325 - RNA, 22 nt, Homo sapiens
uauuccauggcuaacuggcgag

SEQ ID NO: 904326 - RNA, 16 nt, Homo sapiens
uauucccaacugcucu

SEQ ID NO: 904327 - RNA, 15 nt, Homo sapiens
uauucuaaagcuuuc

SEQ ID NO: 904328 - RNA, 15 nt, Homo sapiens
uauucuaggucugua

SEQ ID NO: 904329 - RNA, 23 nt, Homo sapiens
uauucucaguguagggcagagag

SEQ ID NO: 904330 - RNA, 13 nt, Homo sapiens
uauucucuccuca

SEQ ID NO: 904331 - RNA, 17 nt, Homo sapiens
uauucucuuaaaagaca

SEQ ID NO: 904332 - RNA, 17 nt, Homo sapiens
uauucugguuacugugg

SEQ ID NO: 904333 - RNA, 16 nt, Homo sapiens
uauucuuaacuauuca

SEQ ID NO: 904334 - RNA, 23 nt, Homo sapiens
uauucuuaagggaacuuccacau

SEQ ID NO: 904335 - RNA, 16 nt, Homo sapiens
uauucuuuaaauuuca

SEQ ID NO: 904336 - RNA, 18 nt, Homo sapiens
uauugacgcauauuuaac

SEQ ID NO: 904337 - RNA, 18 nt, Homo sapiens
uauugaggauuaauuuau

SEQ ID NO: 904338 - RNA, 14 nt, Homo sapiens
uauugauaugugaa

SEQ ID NO: 904339 - RNA, 12 nt, Homo sapiens
uauugcaagaca

SEQ ID NO: 904340 - RNA, 16 nt, Homo sapiens
uauugcgaaugugcag

SEQ ID NO: 904341 - RNA, 11 nt, Homo sapiens
uauugcugcuc

SEQ ID NO: 904342 - RNA, 20 nt, Homo sapiens
uauuggaaaggucauugugg

SEQ ID NO: 904343 - RNA, 21 nt, Homo sapiens
uauuggaaaggucauuguggc

SEQ ID NO: 904344 - RNA, 18 nt, Homo sapiens
uauugggccauagccuau

SEQ ID NO: 904345 - RNA, 14 nt, Homo sapiens
uauugguguuuacc

SEQ ID NO: 904346 - RNA, 20 nt, Homo sapiens
uauugucggaagacuugcca

SEQ ID NO: 904347 - RNA, 13 nt, Homo sapiens
uauugugcauaga

SEQ ID NO: 904348 - RNA, 13 nt, Homo sapiens
uauugugccucag

SEQ ID NO: 904349 - RNA, 13 nt, Homo sapiens
uauuuaaacaauu

SEQ ID NO: 904350 - RNA, 14 nt, Homo sapiens
uauuuaauuagcca

SEQ ID NO: 904351 - RNA, 15 nt, Homo sapiens
uauuuacauaugaaa

SEQ ID NO: 904352 - RNA, 22 nt, Homo sapiens
uauuuacuugaaagaugggucu

SEQ ID NO: 904353 - RNA, 12 nt, Homo sapiens
uauuuauacucu

SEQ ID NO: 904354 - RNA, 19 nt, Homo sapiens
uauuuaucagugacagagu

SEQ ID NO: 904355 - RNA, 16 nt, Homo sapiens
uauuuaucugugcaaa

SEQ ID NO: 904356 - RNA, 13 nt, Homo sapiens
uauuuaugaaggc

SEQ ID NO: 904357 - RNA, 17 nt, Homo sapiens
uauuuaugccucuguau

SEQ ID NO: 904358 - RNA, 13 nt, Homo sapiens
uauuuauucacug

SEQ ID NO: 904359 - RNA, 21 nt, Homo sapiens
uauuucaacuaauauaucuau

SEQ ID NO: 904360 - RNA, 11 nt, Homo sapiens
uauuucaugau

SEQ ID NO: 904361 - RNA, 17 nt, Homo sapiens
uauuuccaucuaggacu

SEQ ID NO: 904362 - RNA, 22 nt, Homo sapiens
uauuuccccaccccacuauccu

SEQ ID NO: 904363 - RNA, 19 nt, Homo sapiens
uauuucccucuacugagua

SEQ ID NO: 904364 - RNA, 16 nt, Homo sapiens
uauuucugucauucaa

SEQ ID NO: 904365 - RNA, 21 nt, Homo sapiens
uauuugaagcaucacauaaaa

SEQ ID NO: 904366 - RNA, 13 nt, Homo sapiens
uauuugaaucuuu

SEQ ID NO: 904367 - RNA, 19 nt, Homo sapiens
uauuuggagcaagugacau

SEQ ID NO: 904368 - RNA, 18 nt, Homo sapiens
uauuugguauaaaggguu

SEQ ID NO: 904369 - RNA, 20 nt, Homo sapiens
uauuuguaauagugacauau

SEQ ID NO: 904370 - RNA, 14 nt, Homo sapiens
uauuuguaucacaa

SEQ ID NO: 904371 - RNA, 16 nt, Homo sapiens
uauuuguauuugccau

SEQ ID NO: 904372 - RNA, 16 nt, Homo sapiens
uauuuuaaaacauaag

SEQ ID NO: 904373 - RNA, 17 nt, Homo sapiens
uauuuuaaaacauaaga

SEQ ID NO: 904374 - RNA, 20 nt, Homo sapiens
uauuuuauauauuaugucau

SEQ ID NO: 904375 - RNA, 23 nt, Homo sapiens
uauuuuauguaaacccucaaggg

SEQ ID NO: 904376 - RNA, 19 nt, Homo sapiens
uauuuuauucccuuucaca

SEQ ID NO: 904377 - RNA, 13 nt, Homo sapiens
uauuuucacauga

SEQ ID NO: 904378 - RNA, 18 nt, Homo sapiens
uauuuucccucucuugcc

SEQ ID NO: 904379 - RNA, 21 nt, Homo sapiens
uauuuuuagacagagucucac

SEQ ID NO: 904380 - RNA, 15 nt, Homo sapiens
uauuuuuaugugcaa

SEQ ID NO: 904381 - RNA, 21 nt, Homo sapiens
uauuuuuuaaagucuauuguu

SEQ ID NO: 904382 - RNA, 15 nt, Homo sapiens
uauuuuuucuacaca

SEQ ID NO: 904383 - RNA, 17 nt, Homo sapiens
ucaaaacaauuggcaaa

SEQ ID NO: 904384 - RNA, 13 nt, Homo sapiens
ucaaaacauauca

SEQ ID NO: 904385 - RNA, 21 nt, Homo sapiens
ucaaaacccaacaugacuguu

SEQ ID NO: 904386 - RNA, 13 nt, Homo sapiens
ucaaaagcacuug

SEQ ID NO: 904387 - RNA, 20 nt, Homo sapiens
ucaaaagccugggugagaau

SEQ ID NO: 904388 - RNA, 22 nt, Homo sapiens
ucaaaauaccaugccauuuaaa

SEQ ID NO: 904389 - RNA, 20 nt, Homo sapiens
ucaaaaucuuucagcacuca

SEQ ID NO: 904390 - RNA, 20 nt, Homo sapiens
ucaaaauggacguacugguu

SEQ ID NO: 904391 - RNA, 20 nt, Homo sapiens
ucaaacaaauagucuaucaa

SEQ ID NO: 904392 - RNA, 14 nt, Homo sapiens
ucaaaccaggauuu

SEQ ID NO: 904393 - RNA, 18 nt, Homo sapiens
ucaaaccauaaacuucau

SEQ ID NO: 904394 - RNA, 18 nt, Homo sapiens
ucaaaccccgaccaccug

SEQ ID NO: 904395 - RNA, 19 nt, Homo sapiens
ucaaacucuugaccucagg

SEQ ID NO: 904396 - RNA, 22 nt, Homo sapiens
ucaaacugcaaauauugucaua

SEQ ID NO: 904397 - RNA, 13 nt, Homo sapiens
ucaaagacagaga

SEQ ID NO: 904398 - RNA, 21 nt, Homo sapiens
ucaaagagggagugcauuuau

SEQ ID NO: 904399 - RNA, 18 nt, Homo sapiens
ucaaagauccagugcagu

SEQ ID NO: 904400 - RNA, 12 nt, Homo sapiens
ucaaagcaguag

SEQ ID NO: 904401 - RNA, 21 nt, Homo sapiens
ucaaagcuuuuuccagaggcu

SEQ ID NO: 904402 - RNA, 15 nt, Homo sapiens
ucaaaggaagacuug

SEQ ID NO: 904403 - RNA, 18 nt, Homo sapiens
ucaaaguguaagcacuuc

SEQ ID NO: 904404 - RNA, 14 nt, Homo sapiens
ucaaauagcauaag

SEQ ID NO: 904405 - RNA, 16 nt, Homo sapiens
ucaaauauuaccaaaa

SEQ ID NO: 904406 - RNA, 14 nt, Homo sapiens
ucaaauauuucaac

SEQ ID NO: 904407 - RNA, 23 nt, Homo sapiens
ucaaaucaguccuuugauuccau

SEQ ID NO: 904408 - RNA, 15 nt, Homo sapiens
ucaaauccugaugcu

SEQ ID NO: 904409 - RNA, 22 nt, Homo sapiens
ucaaaugacccaaagaccaaua

SEQ ID NO: 904410 - RNA, 23 nt, Homo sapiens
ucaaauugucuuuugucaugugg

SEQ ID NO: 904411 - RNA, 18 nt, Homo sapiens
ucaaauuuuuacugagaa

SEQ ID NO: 904412 - RNA, 16 nt, Homo sapiens
ucaacaauaaagacug

SEQ ID NO: 904413 - RNA, 18 nt, Homo sapiens
ucaacaauaaagacugag

SEQ ID NO: 904414 - RNA, 20 nt, Homo sapiens
ucaacaauaaagacugagac

SEQ ID NO: 904415 - RNA, 12 nt, Homo sapiens
ucaacacuuaag

SEQ ID NO: 904416 - RNA, 19 nt, Homo sapiens
ucaacaugccauaucucau

SEQ ID NO: 904417 - RNA, 11 nt, Homo sapiens
ucaaccagcag

SEQ ID NO: 904418 - RNA, 17 nt, Homo sapiens
ucaaccaggaacaugua

SEQ ID NO: 904419 - RNA, 18 nt, Homo sapiens
ucaaccuaagcaacagaa

SEQ ID NO: 904420 - RNA, 23 nt, Homo sapiens
ucaacuggagacacuauuuaucu

SEQ ID NO: 904421 - RNA, 20 nt, Homo sapiens
ucaacuguugauugcaggaa

SEQ ID NO: 904422 - RNA, 12 nt, Homo sapiens
ucaacuuugaca

SEQ ID NO: 904423 - RNA, 13 nt, Homo sapiens
ucaagacaccaaa

SEQ ID NO: 904424 - RNA, 20 nt, Homo sapiens
ucaagacccuuuucuguaug

SEQ ID NO: 904425 - RNA, 12 nt, Homo sapiens
ucaagacuugau

SEQ ID NO: 904426 - RNA, 19 nt, Homo sapiens
ucaagagaagcacaugaaa

SEQ ID NO: 904427 - RNA, 18 nt, Homo sapiens
ucaagaugagagaacugg

SEQ ID NO: 904428 - RNA, 18 nt, Homo sapiens
ucaagcaauugucugccu

SEQ ID NO: 904429 - RNA, 21 nt, Homo sapiens
ucaagcaugcaauaaugugca

SEQ ID NO: 904430 - RNA, 11 nt, Homo sapiens
ucaagccaugg

SEQ ID NO: 904431 - RNA, 15 nt, Homo sapiens
ucaagcuaccuucau

SEQ ID NO: 904432 - RNA, 20 nt, Homo sapiens
ucaagcuaccuucaugucac

SEQ ID NO: 904433 - RNA, 15 nt, Homo sapiens
ucaagcuagaaggcc

SEQ ID NO: 904434 - RNA, 17 nt, Homo sapiens
ucaagcuagaaggccac

SEQ ID NO: 904435 - RNA, 15 nt, Homo sapiens
ucaagcuagccagag

SEQ ID NO: 904436 - RNA, 15 nt, Homo sapiens
ucaaggagcccagaa

SEQ ID NO: 904437 - RNA, 22 nt, Homo sapiens
ucaagguguuuugaaaugcaga

SEQ ID NO: 904438 - RNA, 23 nt, Homo sapiens
ucaagucuucccugaucaaguca

SEQ ID NO: 904439 - RNA, 19 nt, Homo sapiens
ucaaguugagaacaaaaau

SEQ ID NO: 904440 - RNA, 20 nt, Homo sapiens
ucaaguuuuucagaaagcau

SEQ ID NO: 904441 - RNA, 15 nt, Homo sapiens
ucaauaagccagcaa

SEQ ID NO: 904442 - RNA, 17 nt, Homo sapiens
ucaauauuaaauacaga

SEQ ID NO: 904443 - RNA, 19 nt, Homo sapiens
ucaaucagugcagugauac

SEQ ID NO: 904444 - RNA, 18 nt, Homo sapiens
ucaaucccagcuacucaa

SEQ ID NO: 904445 - RNA, 22 nt, Homo sapiens
ucaaucugagaagacaauaugu

SEQ ID NO: 904446 - RNA, 23 nt, Homo sapiens
ucaaugaaaaaaaguacauguau

SEQ ID NO: 904447 - RNA, 12 nt, Homo sapiens
ucaaugaccugu

SEQ ID NO: 904448 - RNA, 16 nt, Homo sapiens
ucaauggaaagcugcu

SEQ ID NO: 904449 - RNA, 15 nt, Homo sapiens
ucaaugucacuuaaa

SEQ ID NO: 904450 - RNA, 12 nt, Homo sapiens
ucaaugugaaaa

SEQ ID NO: 904451 - RNA, 21 nt, Homo sapiens
ucaauguuucuuuuaucacga

SEQ ID NO: 904452 - RNA, 13 nt, Homo sapiens
ucaauuaguacag

SEQ ID NO: 904453 - RNA, 17 nt, Homo sapiens
ucaauuuaauucuuauu

SEQ ID NO: 904454 - RNA, 21 nt, Homo sapiens
ucaauuuaccuacucuaugua

SEQ ID NO: 904455 - RNA, 20 nt, Homo sapiens
ucacaaaaaggcauaugcaa

SEQ ID NO: 904456 - RNA, 20 nt, Homo sapiens
ucacaacacagagcugcuau

SEQ ID NO: 904457 - RNA, 23 nt, Homo sapiens
ucacaacagauuauuaccuuaca

SEQ ID NO: 904458 - RNA, 20 nt, Homo sapiens
ucacaacauuuacuuaacag

SEQ ID NO: 904459 - RNA, 17 nt, Homo sapiens
ucacaacuaggaccuca

SEQ ID NO: 904460 - RNA, 16 nt, Homo sapiens
ucacaagcaauaauua

SEQ ID NO: 904461 - RNA, 13 nt, Homo sapiens
ucacaagcacuuu

SEQ ID NO: 904462 - RNA, 18 nt, Homo sapiens
ucacaauagauuucucaa

SEQ ID NO: 904463 - RNA, 13 nt, Homo sapiens
ucacaaugaaaug

SEQ ID NO: 904464 - RNA, 11 nt, Homo sapiens
ucacacacagg

SEQ ID NO: 904465 - RNA, 19 nt, Homo sapiens
ucacacagacacacaaaau

SEQ ID NO: 904466 - RNA, 22 nt, Homo sapiens
ucacacagcccauaaagcaaga

SEQ ID NO: 904467 - RNA, 16 nt, Homo sapiens
ucacaccaccugacag

SEQ ID NO: 904468 - RNA, 14 nt, Homo sapiens
ucacacccuaauaa

SEQ ID NO: 904469 - RNA, 15 nt, Homo sapiens
ucacacgggguauuu

SEQ ID NO: 904470 - RNA, 16 nt, Homo sapiens
ucacacucauaacuca

SEQ ID NO: 904471 - RNA, 18 nt, Homo sapiens
ucacagaaauguuaaacu

SEQ ID NO: 904472 - RNA, 15 nt, Homo sapiens
ucacagguugaccaa

SEQ ID NO: 904473 - RNA, 19 nt, Homo sapiens
ucacagugacccuucccaa

SEQ ID NO: 904474 - RNA, 19 nt, Homo sapiens
ucacauaacuucucugagu

SEQ ID NO: 904475 - RNA, 19 nt, Homo sapiens
ucacauaguuuauuucaac

SEQ ID NO: 904476 - RNA, 23 nt, Homo sapiens
ucacaucuuaugcuaacuguaga

SEQ ID NO: 904477 - RNA, 23 nt, Homo sapiens
ucacaucuugguauguggccaua

SEQ ID NO: 904478 - RNA, 14 nt, Homo sapiens
ucacauugugccuu

SEQ ID NO: 904479 - RNA, 19 nt, Homo sapiens
ucacauuuauucugcucac

SEQ ID NO: 904480 - RNA, 11 nt, Homo sapiens
ucaccaaaauu

SEQ ID NO: 904481 - RNA, 15 nt, Homo sapiens
ucaccaauaacuuca

SEQ ID NO: 904482 - RNA, 17 nt, Homo sapiens
ucaccacaccaaaccuc

SEQ ID NO: 904483 - RNA, 18 nt, Homo sapiens
ucaccacaccaaaccucu

SEQ ID NO: 904484 - RNA, 16 nt, Homo sapiens
ucaccacaugugcaca

SEQ ID NO: 904485 - RNA, 15 nt, Homo sapiens
ucaccagauuugcua

SEQ ID NO: 904486 - RNA, 22 nt, Homo sapiens
ucaccaggggugcuaugacaug

SEQ ID NO: 904487 - RNA, 21 nt, Homo sapiens
ucacccagcuaaucuguaggg

SEQ ID NO: 904488 - RNA, 16 nt, Homo sapiens
ucaccgacaacaugcu

SEQ ID NO: 904489 - RNA, 21 nt, Homo sapiens
ucaccucagagacauacaccu

SEQ ID NO: 904490 - RNA, 16 nt, Homo sapiens
ucaccucagcugauau

SEQ ID NO: 904491 - RNA, 12 nt, Homo sapiens
ucaccucaggcc

SEQ ID NO: 904492 - RNA, 16 nt, Homo sapiens
ucaccucauaugcuau

SEQ ID NO: 904493 - RNA, 15 nt, Homo sapiens
ucaccucugccucaa

SEQ ID NO: 904494 - RNA, 16 nt, Homo sapiens
ucaccuguuacugaaa

SEQ ID NO: 904495 - RNA, 14 nt, Homo sapiens
ucaccuuccagugu

SEQ ID NO: 904496 - RNA, 14 nt, Homo sapiens
ucacgacucuuccu

SEQ ID NO: 904497 - RNA, 16 nt, Homo sapiens
ucacgggaacucucca

SEQ ID NO: 904498 - RNA, 14 nt, Homo sapiens
ucacguggucaagg

SEQ ID NO: 904499 - RNA, 14 nt, Homo sapiens
ucacuaauacuaau

SEQ ID NO: 904500 - RNA, 15 nt, Homo sapiens
ucacuacagacgauu

SEQ ID NO: 904501 - RNA, 16 nt, Homo sapiens
ucacuacagccucgaa

SEQ ID NO: 904502 - RNA, 14 nt, Homo sapiens
ucacuagacugugc

SEQ ID NO: 904503 - RNA, 16 nt, Homo sapiens
ucacuauaaccaucag

SEQ ID NO: 904504 - RNA, 17 nt, Homo sapiens
ucacuaugacacugagc

SEQ ID NO: 904505 - RNA, 20 nt, Homo sapiens
ucacucauuccuucacucau

SEQ ID NO: 904506 - RNA, 12 nt, Homo sapiens
ucacucugucag

SEQ ID NO: 904507 - RNA, 17 nt, Homo sapiens
ucacucugucagccagc

SEQ ID NO: 904508 - RNA, 18 nt, Homo sapiens
ugccaacaccuucuuggc

SEQ ID NO: 904509 - RNA, 16 nt, Homo sapiens
ugccaagaaaguauuu

SEQ ID NO: 904510 - RNA, 19 nt, Homo sapiens
ugccacacccuccccauuc

SEQ ID NO: 904511 - RNA, 19 nt, Homo sapiens
ugccacaucugugucucug

SEQ ID NO: 904512 - RNA, 17 nt, Homo sapiens
ugccacuccugcuucuc

SEQ ID NO: 904513 - RNA, 17 nt, Homo sapiens
ugccacuugacauuccu

SEQ ID NO: 904514 - RNA, 22 nt, Homo sapiens
ugccacuuuucaugucauuuga

SEQ ID NO: 904515 - RNA, 14 nt, Homo sapiens
ugccagccaucaca

SEQ ID NO: 904516 - RNA, 12 nt, Homo sapiens
ugccagcuuuau

SEQ ID NO: 904517 - RNA, 19 nt, Homo sapiens
ugccaguggaauacaguga

SEQ ID NO: 904518 - RNA, 19 nt, Homo sapiens
ugccauaccgcuggggaac

SEQ ID NO: 904519 - RNA, 22 nt, Homo sapiens
ugccauccuaggcuuaaaugca

SEQ ID NO: 904520 - RNA, 23 nt, Homo sapiens
ugccaucuccacccugagccuga

SEQ ID NO: 904521 - RNA, 14 nt, Homo sapiens
ugccauguuuagau

SEQ ID NO: 904522 - RNA, 22 nt, Homo sapiens
ugccauucagucuagcuuuuaa

SEQ ID NO: 904523 - RNA, 22 nt, Homo sapiens
ugcccaauuagggccuagccuu

SEQ ID NO: 904524 - RNA, 15 nt, Homo sapiens
ugcccaccacagcga

SEQ ID NO: 904525 - RNA, 13 nt, Homo sapiens
ugcccaccagauc

SEQ ID NO: 904526 - RNA, 13 nt, Homo sapiens
ugcccacuauggc

SEQ ID NO: 904527 - RNA, 19 nt, Homo sapiens
ugcccacucuaauauucaa

SEQ ID NO: 904528 - RNA, 21 nt, Homo sapiens
ugcccagaauucccagcuguc

SEQ ID NO: 904529 - RNA, 15 nt, Homo sapiens
ugcccaucauacgca

SEQ ID NO: 904530 - RNA, 19 nt, Homo sapiens
ugccccaacuccuuccagc

SEQ ID NO: 904531 - RNA, 15 nt, Homo sapiens
ugccccgaauuuagu

SEQ ID NO: 904532 - RNA, 18 nt, Homo sapiens
ugccccgccuccccgaaa

SEQ ID NO: 904533 - RNA, 23 nt, Homo sapiens
ugcccugaguggaucuccaagga

SEQ ID NO: 904534 - RNA, 17 nt, Homo sapiens
ugcccugcccaugggag

SEQ ID NO: 904535 - RNA, 18 nt, Homo sapiens
ugcccugccccucuggcc

SEQ ID NO: 904536 - RNA, 24 nt, Homo sapiens
ugcccuggagggaggcucuucagu

SEQ ID NO: 904537 - RNA, 15 nt, Homo sapiens
ugcccuguccuccag

SEQ ID NO: 904538 - RNA, 16 nt, Homo sapiens
ugccgagccuaaugaa

SEQ ID NO: 904539 - RNA, 16 nt, Homo sapiens
ugccggcccagugaca

SEQ ID NO: 904540 - RNA, 15 nt, Homo sapiens
ugccuacauucccug

SEQ ID NO: 904541 - RNA, 13 nt, Homo sapiens
ugccuaccccagc

SEQ ID NO: 904542 - RNA, 22 nt, Homo sapiens
ugccuaguaagggaacuaugga

SEQ ID NO: 904543 - RNA, 17 nt, Homo sapiens
ugccucaaugugaccag

SEQ ID NO: 904544 - RNA, 15 nt, Homo sapiens
ugccuccagcacucc

SEQ ID NO: 904545 - RNA, 15 nt, Homo sapiens
ugccuccugggacca

SEQ ID NO: 904546 - RNA, 20 nt, Homo sapiens
ugccucgcuccccacucugc

SEQ ID NO: 904547 - RNA, 14 nt, Homo sapiens
ugccucucucagga

SEQ ID NO: 904548 - RNA, 20 nt, Homo sapiens
ugccucugacacacagcucu

SEQ ID NO: 904549 - RNA, 17 nt, Homo sapiens
ugccucugccucugaca

SEQ ID NO: 904550 - RNA, 15 nt, Homo sapiens
ugccugaagucacac

SEQ ID NO: 904551 - RNA, 17 nt, Homo sapiens
ugccugaauccaucagg

SEQ ID NO: 904552 - RNA, 16 nt, Homo sapiens
ugccugaggcucaaga

SEQ ID NO: 904553 - RNA, 16 nt, Homo sapiens
ugccugcuccaagaaa

SEQ ID NO: 904554 - RNA, 18 nt, Homo sapiens
ugccugggaccaguggca

SEQ ID NO: 904555 - RNA, 23 nt, Homo sapiens
ugccuggguuuucuaacuguaaa

SEQ ID NO: 904556 - RNA, 11 nt, Homo sapiens
ugccuggucua

SEQ ID NO: 904557 - RNA, 16 nt, Homo sapiens
ugccugguggcagcug

SEQ ID NO: 904558 - RNA, 16 nt, Homo sapiens
ugccugugaucccagc

SEQ ID NO: 904559 - RNA, 19 nt, Homo sapiens
ugccuguggggguccauuu

SEQ ID NO: 904560 - RNA, 20 nt, Homo sapiens
ugccuguucccauucuugca

SEQ ID NO: 904561 - RNA, 19 nt, Homo sapiens
ugccuguuuuucaaucuca

SEQ ID NO: 904562 - RNA, 14 nt, Homo sapiens
ugccuuauguaauu

SEQ ID NO: 904563 - RNA, 21 nt, Homo sapiens
ugccuuccaaccccuuuccac

SEQ ID NO: 904564 - RNA, 12 nt, Homo sapiens
ugccuuccucau

SEQ ID NO: 904565 - RNA, 20 nt, Homo sapiens
ugccuucgguuuguauuuag

SEQ ID NO: 904566 - RNA, 12 nt, Homo sapiens
ugccuugaugaa

SEQ ID NO: 904567 - RNA, 13 nt, Homo sapiens
ugccuugaugaag

SEQ ID NO: 904568 - RNA, 23 nt, Homo sapiens
ugccuugaugaagccugugccac

SEQ ID NO: 904569 - RNA, 20 nt, Homo sapiens
ugccuuuucaucuaauguga

SEQ ID NO: 904570 - RNA, 13 nt, Homo sapiens
ugcgaaugugcag

SEQ ID NO: 904571 - RNA, 21 nt, Homo sapiens
ugcgaucuggguucacugcaa

SEQ ID NO: 904572 - RNA, 15 nt, Homo sapiens
ugcgcaauguggcau

SEQ ID NO: 904573 - RNA, 15 nt, Homo sapiens
ugcgcacacacagau

SEQ ID NO: 904574 - RNA, 19 nt, Homo sapiens
ugcgcacacacagauaugc

SEQ ID NO: 904575 - RNA, 20 nt, Homo sapiens
ugcgcacacacagauaugca

SEQ ID NO: 904576 - RNA, 14 nt, Homo sapiens
ugcgccuugcaaaa

SEQ ID NO: 904577 - RNA, 13 nt, Homo sapiens
ugcgcguccugcc

SEQ ID NO: 904578 - RNA, 20 nt, Homo sapiens
ugcggaaugaaccacaucuu

SEQ ID NO: 904579 - RNA, 23 nt, Homo sapiens
ugcggcaggagcaggaacagaga

SEQ ID NO: 904580 - RNA, 18 nt, Homo sapiens
ugcgggcaccuacaaggu

SEQ ID NO: 904581 - RNA, 17 nt, Homo sapiens
ugcgggggagcuggaaa

SEQ ID NO: 904582 - RNA, 21 nt, Homo sapiens
ugcgucagaccaguacuggga

SEQ ID NO: 904583 - RNA, 16 nt, Homo sapiens
ugcguggacucugcac

SEQ ID NO: 904584 - RNA, 13 nt, Homo sapiens
ugcuaaaugcaaa

SEQ ID NO: 904585 - RNA, 22 nt, Homo sapiens
ugcuaaauggucgcccaggaga

SEQ ID NO: 904586 - RNA, 22 nt, Homo sapiens
ugcuaagaagcgagcacugacc

SEQ ID NO: 904587 - RNA, 15 nt, Homo sapiens
ugcuaauucaaagcu

SEQ ID NO: 904588 - RNA, 17 nt, Homo sapiens
ugcuaauucaaagcucu

SEQ ID NO: 904589 - RNA, 18 nt, Homo sapiens
ugcuaauucaaagcucua

SEQ ID NO: 904590 - RNA, 20 nt, Homo sapiens
ugcuacaaauacucuuagga

SEQ ID NO: 904591 - RNA, 18 nt, Homo sapiens
ugcuacaagaaugcaaaa

SEQ ID NO: 904592 - RNA, 18 nt, Homo sapiens
ugcuacacaaaagccaaa

SEQ ID NO: 904593 - RNA, 16 nt, Homo sapiens
ugcuacaguacuaugu

SEQ ID NO: 904594 - RNA, 12 nt, Homo sapiens
ugcuaccaaggc

SEQ ID NO: 904595 - RNA, 17 nt, Homo sapiens
ugcuaccucacuggggu

SEQ ID NO: 904596 - RNA, 20 nt, Homo sapiens
ugcuagaugugcaaaugcaa

SEQ ID NO: 904597 - RNA, 19 nt, Homo sapiens
ugcuauaauauauaaugaa

SEQ ID NO: 904598 - RNA, 16 nt, Homo sapiens
ugcuaugccaagccau

SEQ ID NO: 904599 - RNA, 20 nt, Homo sapiens
ugcuauuuuauuuguauuca

SEQ ID NO: 904600 - RNA, 23 nt, Homo sapiens
ugcucaccaagcuguuccacuuc

SEQ ID NO: 904601 - RNA, 20 nt, Homo sapiens
ugcucaggcuugaaaugcau

SEQ ID NO: 904602 - RNA, 13 nt, Homo sapiens
ugcucagugccuc

SEQ ID NO: 904603 - RNA, 16 nt, Homo sapiens
ugcucaucacccaguc

SEQ ID NO: 904604 - RNA, 21 nt, Homo sapiens
ugcucauucauuuaacagagc

SEQ ID NO: 904605 - RNA, 19 nt, Homo sapiens
ugcuccaucaugcuugauu

SEQ ID NO: 904606 - RNA, 20 nt, Homo sapiens
ugcuccccagugcuaccucu

SEQ ID NO: 904607 - RNA, 17 nt, Homo sapiens
ugcuccccuuccugcca

SEQ ID NO: 904608 - RNA, 16 nt, Homo sapiens
ugcuccugugugcugg

SEQ ID NO: 904609 - RNA, 20 nt, Homo sapiens
ugcucgcacagauuacuuca

SEQ ID NO: 904610 - RNA, 16 nt, Homo sapiens
ugcucggggugcacag

SEQ ID NO: 904611 - RNA, 19 nt, Homo sapiens
ugcucugcccacugugaaa

SEQ ID NO: 904612 - RNA, 19 nt, Homo sapiens
ugcucugguuugagcaauu

SEQ ID NO: 904613 - RNA, 16 nt, Homo sapiens
ugcucuugcauugcaa

SEQ ID NO: 904614 - RNA, 23 nt, Homo sapiens
ugcucuuugauucaaagcacugu

SEQ ID NO: 904615 - RNA, 18 nt, Homo sapiens
ugcugaacucaaugugca

SEQ ID NO: 904616 - RNA, 13 nt, Homo sapiens
ugcugaccucugg

SEQ ID NO: 904617 - RNA, 15 nt, Homo sapiens
ugcugagcacccucu

SEQ ID NO: 904618 - RNA, 23 nt, Homo sapiens
ugcugauacuaucucuugucaua

SEQ ID NO: 904619 - RNA, 12 nt, Homo sapiens
ugcugccaaaca

SEQ ID NO: 904620 - RNA, 10 nt, Homo sapiens
ugcugccuaa

SEQ ID NO: 904621 - RNA, 18 nt, Homo sapiens
ugcugccuaauaaagaga

SEQ ID NO: 904622 - RNA, 21 nt, Homo sapiens
ugcugcggccagccugacuag

SEQ ID NO: 904623 - RNA, 17 nt, Homo sapiens
ugcugcucccaucugca

SEQ ID NO: 904624 - RNA, 19 nt, Homo sapiens
ugcugcugagugcaccacu

SEQ ID NO: 904625 - RNA, 18 nt, Homo sapiens
ugcugcugcccccaccuc

SEQ ID NO: 904626 - RNA, 17 nt, Homo sapiens
ugcugcuggaaguagaa

SEQ ID NO: 904627 - RNA, 14 nt, Homo sapiens
ugcuggacugagga

SEQ ID NO: 904628 - RNA, 15 nt, Homo sapiens
ugcuggacugaggac

SEQ ID NO: 904629 - RNA, 15 nt, Homo sapiens
ugcuggugucauugc

SEQ ID NO: 904630 - RNA, 22 nt, Homo sapiens
ugcuguaacucagacauuccaa

SEQ ID NO: 904631 - RNA, 15 nt, Homo sapiens
ugcuguauacuguac

SEQ ID NO: 904632 - RNA, 19 nt, Homo sapiens
ugcuguauacuguacugag

SEQ ID NO: 904633 - RNA, 15 nt, Homo sapiens
ugcugucaccuugcu

SEQ ID NO: 904634 - RNA, 14 nt, Homo sapiens
ugcugucagcucag

SEQ ID NO: 904635 - RNA, 10 nt, Homo sapiens
ugcugugaau

SEQ ID NO: 904636 - RNA, 21 nt, Homo sapiens
ugcuguugauaauaucucuca

SEQ ID NO: 904637 - RNA, 17 nt, Homo sapiens
ugcuguugggaaaaccg

SEQ ID NO: 904638 - RNA, 14 nt, Homo sapiens
ugcuuaaaauagca

SEQ ID NO: 904639 - RNA, 13 nt, Homo sapiens
ugcuuaacuggcu

SEQ ID NO: 904640 - RNA, 14 nt, Homo sapiens
ugcuuaguaucuca

SEQ ID NO: 904641 - RNA, 15 nt, Homo sapiens
ugcuuauucuugagc

SEQ ID NO: 904642 - RNA, 12 nt, Homo sapiens
ugcuucacauaa

SEQ ID NO: 904643 - RNA, 12 nt, Homo sapiens
ugcuucagccug

SEQ ID NO: 904644 - RNA, 19 nt, Homo sapiens
ugcuucaggauaccauaua

SEQ ID NO: 904645 - RNA, 15 nt, Homo sapiens
ugcuucuugugaaac

SEQ ID NO: 904646 - RNA, 13 nt, Homo sapiens
ugcuugacuauca

SEQ ID NO: 904647 - RNA, 17 nt, Homo sapiens
ugcuugcccccaugugg

SEQ ID NO: 904648 - RNA, 14 nt, Homo sapiens
ugcuugucaucugc

SEQ ID NO: 904649 - RNA, 20 nt, Homo sapiens
ugcuuuaauuuucacucugg

SEQ ID NO: 904650 - RNA, 20 nt, Homo sapiens
ugcuuucaacuuaaaucacu

SEQ ID NO: 904651 - RNA, 14 nt, Homo sapiens
ugcuuugaagcagu

SEQ ID NO: 904652 - RNA, 13 nt, Homo sapiens
ugcuuugcaggaa

SEQ ID NO: 904653 - RNA, 22 nt, Homo sapiens
ugcuuugcaggaagugucuaga

SEQ ID NO: 904654 - RNA, 21 nt, Homo sapiens
ugcuuuucuucccagcaaagg

SEQ ID NO: 904655 - RNA, 13 nt, Homo sapiens
ugcuuuugaggac

SEQ ID NO: 904656 - RNA, 14 nt, Homo sapiens
ugcuuuugccacuu

SEQ ID NO: 904657 - RNA, 22 nt, Homo sapiens
uggaaaagcacuuuacagauga

SEQ ID NO: 904658 - RNA, 14 nt, Homo sapiens
uggaaacaggacca

SEQ ID NO: 904659 - RNA, 13 nt, Homo sapiens
uggaaacuggcca

SEQ ID NO: 904660 - RNA, 22 nt, Homo sapiens
uggaaagcaucaccucaggcca

SEQ ID NO: 904661 - RNA, 22 nt, Homo sapiens
uggaaaggcucagucucaggag

SEQ ID NO: 904662 - RNA, 13 nt, Homo sapiens
uggaaagguuuca

SEQ ID NO: 904663 - RNA, 19 nt, Homo sapiens
uggaaauaaaauacuucua

SEQ ID NO: 904664 - RNA, 14 nt, Homo sapiens
uggaaauaaaccug

SEQ ID NO: 904665 - RNA, 16 nt, Homo sapiens
uggaaaugucuuucua

SEQ ID NO: 904666 - RNA, 12 nt, Homo sapiens
uggaacagugca

SEQ ID NO: 904667 - RNA, 22 nt, Homo sapiens
uggaacccuggugucuccucca

SEQ ID NO: 904668 - RNA, 16 nt, Homo sapiens
uggaacucaaggaaau

SEQ ID NO: 904669 - RNA, 18 nt, Homo sapiens
uggaacucagcugucugu

SEQ ID NO: 904670 - RNA, 18 nt, Homo sapiens
uggaacugucucucauga

SEQ ID NO: 904671 - RNA, 18 nt, Homo sapiens
uggaacuugaacugauuc

SEQ ID NO: 904672 - RNA, 17 nt, Homo sapiens
uggaagaaaugggagaa

SEQ ID NO: 904673 - RNA, 14 nt, Homo sapiens
uggaagaaauuccu

SEQ ID NO: 904674 - RNA, 21 nt, Homo sapiens
uggaagaaggaagaagccaga

SEQ ID NO: 904675 - RNA, 19 nt, Homo sapiens
uggaagagggcgaguucag

SEQ ID NO: 904676 - RNA, 12 nt, Homo sapiens
uggaagauuugu

SEQ ID NO: 904677 - RNA, 14 nt, Homo sapiens
uggaagcacagcuu

SEQ ID NO: 904678 - RNA, 15 nt, Homo sapiens
uggaagcacagcuuc

SEQ ID NO: 904679 - RNA, 15 nt, Homo sapiens
uggaagcacaugugu

SEQ ID NO: 904680 - RNA, 14 nt, Homo sapiens
uggaagcacauguu

SEQ ID NO: 904681 - RNA, 15 nt, Homo sapiens
uggaagcagaaagga

SEQ ID NO: 904682 - RNA, 16 nt, Homo sapiens
uggaagcccuccuucc

SEQ ID NO: 904683 - RNA, 15 nt, Homo sapiens
uggaagcucugaagu

SEQ ID NO: 904684 - RNA, 18 nt, Homo sapiens
uggaagcuguguccuugc

SEQ ID NO: 904685 - RNA, 14 nt, Homo sapiens
uggaaggcucccua

SEQ ID NO: 904686 - RNA, 17 nt, Homo sapiens
uggaaggcucccuaaca

SEQ ID NO: 904687 - RNA, 19 nt, Homo sapiens
uggaaguguucaagaaaua

SEQ ID NO: 904688 - RNA, 17 nt, Homo sapiens
uggaauaaagcccuuga

SEQ ID NO: 904689 - RNA, 19 nt, Homo sapiens
uggaauaaagcccuugaac

SEQ ID NO: 904690 - RNA, 12 nt, Homo sapiens
uggaaucuggag

SEQ ID NO: 904691 - RNA, 14 nt, Homo sapiens
uggacagcugcuug

SEQ ID NO: 904692 - RNA, 15 nt, Homo sapiens
uggaccaacccuguu

SEQ ID NO: 904693 - RNA, 14 nt, Homo sapiens
uggacgaacagggg

SEQ ID NO: 904694 - RNA, 15 nt, Homo sapiens
uggacgaacaggggc

SEQ ID NO: 904695 - RNA, 22 nt, Homo sapiens
uggacguacugguuuaaccucc

SEQ ID NO: 904696 - RNA, 15 nt, Homo sapiens
uggacucugcacaug

SEQ ID NO: 904697 - RNA, 16 nt, Homo sapiens
uggacugauaaucucu

SEQ ID NO: 904698 - RNA, 19 nt, Homo sapiens
uggagaaagggaaguggaa

SEQ ID NO: 904699 - RNA, 22 nt, Homo sapiens
uggagaaauuccuugauucaca

SEQ ID NO: 904700 - RNA, 21 nt, Homo sapiens
uggagaaggaaggcuccaucu

SEQ ID NO: 904701 - RNA, 14 nt, Homo sapiens
uggagaaggcccac

SEQ ID NO: 904702 - RNA, 19 nt, Homo sapiens
uggagaagugucguuuuca

SEQ ID NO: 904703 - RNA, 13 nt, Homo sapiens
uggagaaguucag

SEQ ID NO: 904704 - RNA, 19 nt, Homo sapiens
uggagagcuagaaccugga

SEQ ID NO: 904705 - RNA, 19 nt, Homo sapiens
uggagcaagugacaugcca

SEQ ID NO: 904706 - RNA, 17 nt, Homo sapiens
uggagcaucugacucac

SEQ ID NO: 904707 - RNA, 23 nt, Homo sapiens
uggagcccaggaguuugaggcug

SEQ ID NO: 904708 - RNA, 16 nt, Homo sapiens
uggagcccgugcagua

SEQ ID NO: 904709 - RNA, 18 nt, Homo sapiens
uggaggaaagugauaucc

SEQ ID NO: 904710 - RNA, 19 nt, Homo sapiens
uggaggacacacagucuca

SEQ ID NO: 904711 - RNA, 12 nt, Homo sapiens
uggaggcugcuc

SEQ ID NO: 904712 - RNA, 14 nt, Homo sapiens
uggagggacaggga

SEQ ID NO: 904713 - RNA, 14 nt, Homo sapiens
uggagggaugccac

SEQ ID NO: 904714 - RNA, 20 nt, Homo sapiens
uggagggcuagaaccuggca

SEQ ID NO: 904715 - RNA, 19 nt, Homo sapiens
uggagggucgccacacccg

SEQ ID NO: 904716 - RNA, 13 nt, Homo sapiens
uggaggugagaaa

SEQ ID NO: 904717 - RNA, 18 nt, Homo sapiens
uggagugcaguggugcga

SEQ ID NO: 904718 - RNA, 16 nt, Homo sapiens
uggaguggacauucaa

SEQ ID NO: 904719 - RNA, 18 nt, Homo sapiens
uggaguguaagugcuuca

SEQ ID NO: 904720 - RNA, 23 nt, Homo sapiens
uggagugucaccagcugccaaaa

SEQ ID NO: 904721 - RNA, 14 nt, Homo sapiens
uggauacacucucu

SEQ ID NO: 904722 - RNA, 23 nt, Homo sapiens
uggauaccagauauuugaaucuu

SEQ ID NO: 904723 - RNA, 14 nt, Homo sapiens
uggauagucugucc

SEQ ID NO: 904724 - RNA, 15 nt, Homo sapiens
uggauagucugucca

SEQ ID NO: 904725 - RNA, 20 nt, Homo sapiens
uggauccagggaaaagcagu

SEQ ID NO: 904726 - RNA, 16 nt, Homo sapiens
uggaucuguccaagga

SEQ ID NO: 904727 - RNA, 19 nt, Homo sapiens
uggaucuucagaaggcuag

SEQ ID NO: 904728 - RNA, 15 nt, Homo sapiens
uggaugagcacacac

SEQ ID NO: 904729 - RNA, 23 nt, Homo sapiens
ugauaauaaauuagguaagauaa

SEQ ID NO: 904730 - RNA, 14 nt, Homo sapiens
ugauacccugaauu

SEQ ID NO: 904731 - RNA, 21 nt, Homo sapiens
ugauacuaucucuugucauau

SEQ ID NO: 904732 - RNA, 13 nt, Homo sapiens
ugauacugcaaua

SEQ ID NO: 904733 - RNA, 14 nt, Homo sapiens
ugauauaugcaugu

SEQ ID NO: 904734 - RNA, 13 nt, Homo sapiens
ugauaugacuguu

SEQ ID NO: 904735 - RNA, 14 nt, Homo sapiens
ugauaugggacuga

SEQ ID NO: 904736 - RNA, 18 nt, Homo sapiens
ugauauuauggcaaguga

SEQ ID NO: 904737 - RNA, 16 nt, Homo sapiens
ugaucaaauauuucaa

SEQ ID NO: 904738 - RNA, 17 nt, Homo sapiens
ugaucaaauauuucaac

SEQ ID NO: 904739 - RNA, 12 nt, Homo sapiens
ugaucacacagc

SEQ ID NO: 904740 - RNA, 17 nt, Homo sapiens
ugaucauuacauggcug

SEQ ID NO: 904741 - RNA, 16 nt, Homo sapiens
ugauccguuccauugc

SEQ ID NO: 904742 - RNA, 17 nt, Homo sapiens
ugauccguuccauugca

SEQ ID NO: 904743 - RNA, 23 nt, Homo sapiens
ugaucggagccuccucucucaaa

SEQ ID NO: 904744 - RNA, 17 nt, Homo sapiens
ugaucuaucaauaguca

SEQ ID NO: 904745 - RNA, 16 nt, Homo sapiens
ugaucuuggcacaaau

SEQ ID NO: 904746 - RNA, 14 nt, Homo sapiens
ugaugaauuacuuc

SEQ ID NO: 904747 - RNA, 17 nt, Homo sapiens
ugaugauuugcuaucaa

SEQ ID NO: 904748 - RNA, 18 nt, Homo sapiens
ugaugccccuuccccaag

SEQ ID NO: 904749 - RNA, 17 nt, Homo sapiens
ugaugcgaaaacuugaa

SEQ ID NO: 904750 - RNA, 15 nt, Homo sapiens
ugauggcaccacugc

SEQ ID NO: 904751 - RNA, 21 nt, Homo sapiens
ugauggcaccacugcacucca

SEQ ID NO: 904752 - RNA, 15 nt, Homo sapiens
ugauggcgauucccu

SEQ ID NO: 904753 - RNA, 15 nt, Homo sapiens
ugaugugaaacauua

SEQ ID NO: 904754 - RNA, 15 nt, Homo sapiens
ugaugugaguugcac

SEQ ID NO: 904755 - RNA, 19 nt, Homo sapiens
ugaugugucaucuaauuaa

SEQ ID NO: 904756 - RNA, 17 nt, Homo sapiens
ugauuaaacagacuuua

SEQ ID NO: 904757 - RNA, 16 nt, Homo sapiens
ugauuauccuauaggc

SEQ ID NO: 904758 - RNA, 14 nt, Homo sapiens
ugauuaugccacug

SEQ ID NO: 904759 - RNA, 22 nt, Homo sapiens
ugauucacaacuaggaccucau

SEQ ID NO: 904760 - RNA, 13 nt, Homo sapiens
ugauucacaauga

SEQ ID NO: 904761 - RNA, 14 nt, Homo sapiens
ugauucagacagcu

SEQ ID NO: 904762 - RNA, 19 nt, Homo sapiens
ugauugacacacagcacuc

SEQ ID NO: 904763 - RNA, 21 nt, Homo sapiens
ugauugacacacagcacucuc

SEQ ID NO: 904764 - RNA, 19 nt, Homo sapiens
ugauuggacauuuucuuca

SEQ ID NO: 904765 - RNA, 18 nt, Homo sapiens
ugauuggccccacugacg

SEQ ID NO: 904766 - RNA, 18 nt, Homo sapiens
ugauuucacaacagauca

SEQ ID NO: 904767 - RNA, 14 nt, Homo sapiens
ugauuucauuucaa

SEQ ID NO: 904768 - RNA, 19 nt, Homo sapiens
ugauuuggaagagaggcac

SEQ ID NO: 904769 - RNA, 18 nt, Homo sapiens
ugcaaaccauagcacagg

SEQ ID NO: 904770 - RNA, 13 nt, Homo sapiens
ugcaaacuuuauu

SEQ ID NO: 904771 - RNA, 21 nt, Homo sapiens
ugcaaaggcgcagugcuucuc

SEQ ID NO: 904772 - RNA, 19 nt, Homo sapiens
ugcaaaggcgucugaaugu

SEQ ID NO: 904773 - RNA, 17 nt, Homo sapiens
ugcaaaguuacagaugc

SEQ ID NO: 904774 - RNA, 21 nt, Homo sapiens
ugcaaauccuugauacugcuc

SEQ ID NO: 904775 - RNA, 17 nt, Homo sapiens
ugcaaauggaagacaaa

SEQ ID NO: 904776 - RNA, 13 nt, Homo sapiens
ugcaacaacaugu

SEQ ID NO: 904777 - RNA, 17 nt, Homo sapiens
ugcaaccacacaccuca

SEQ ID NO: 904778 - RNA, 17 nt, Homo sapiens
ugcaaccucuuccuccu

SEQ ID NO: 904779 - RNA, 16 nt, Homo sapiens
ugcaacuucuaccucc

SEQ ID NO: 904780 - RNA, 21 nt, Homo sapiens
ugcaacuucuuacuucccuaa

SEQ ID NO: 904781 - RNA, 20 nt, Homo sapiens
ugcaagaaguacaugaagag

SEQ ID NO: 904782 - RNA, 12 nt, Homo sapiens
ugcaagacauag

SEQ ID NO: 904783 - RNA, 23 nt, Homo sapiens
ugcaauaaaagguauugagccau

SEQ ID NO: 904784 - RNA, 15 nt, Homo sapiens
ugcaaucucuugucu

SEQ ID NO: 904785 - RNA, 14 nt, Homo sapiens
ugcaauugaccucu

SEQ ID NO: 904786 - RNA, 15 nt, Homo sapiens
ugcacaaagcccuuc

SEQ ID NO: 904787 - RNA, 16 nt, Homo sapiens
ugcacaaagcccuucc

SEQ ID NO: 904788 - RNA, 15 nt, Homo sapiens
ugcacacacagaugc

SEQ ID NO: 904789 - RNA, 15 nt, Homo sapiens
ugcacaccucaugag

SEQ ID NO: 904790 - RNA, 17 nt, Homo sapiens
ugcacacggaugcacag

SEQ ID NO: 904791 - RNA, 21 nt, Homo sapiens
ugcacacggaugcacagagau

SEQ ID NO: 904792 - RNA, 12 nt, Homo sapiens
ugcacacuugua

SEQ ID NO: 904793 - RNA, 17 nt, Homo sapiens
ugcacagagauaugcac

SEQ ID NO: 904794 - RNA, 18 nt, Homo sapiens
ugcacagagauaugcaca

SEQ ID NO: 904795 - RNA, 19 nt, Homo sapiens
ugcacagagauaugcacac

SEQ ID NO: 904796 - RNA, 20 nt, Homo sapiens
ugcacagcuaaaauaauaga

SEQ ID NO: 904797 - RNA, 15 nt, Homo sapiens
ugcacagcuaugaag

SEQ ID NO: 904798 - RNA, 13 nt, Homo sapiens
ugcacauauuuga

SEQ ID NO: 904799 - RNA, 15 nt, Homo sapiens
ugcacaucacaacau

SEQ ID NO: 904800 - RNA, 15 nt, Homo sapiens
ugcacauccauuccc

SEQ ID NO: 904801 - RNA, 19 nt, Homo sapiens
ugcacauuuuguacaaaga

SEQ ID NO: 904802 - RNA, 13 nt, Homo sapiens
ugcaccaaaucau

SEQ ID NO: 904803 - RNA, 20 nt, Homo sapiens
ugcaccaaaucaucucucau

SEQ ID NO: 904804 - RNA, 15 nt, Homo sapiens
ugcaccaccaugcca

SEQ ID NO: 904805 - RNA, 22 nt, Homo sapiens
ugcaccagugccgccugugccc

SEQ ID NO: 904806 - RNA, 18 nt, Homo sapiens
ugcaccccaacauugaga

SEQ ID NO: 904807 - RNA, 13 nt, Homo sapiens
ugcacgcacacau

SEQ ID NO: 904808 - RNA, 13 nt, Homo sapiens
ugcacggcagcuu

SEQ ID NO: 904809 - RNA, 15 nt, Homo sapiens
ugcacgucuugcuau

SEQ ID NO: 904810 - RNA, 14 nt, Homo sapiens
ugcacgugugugca

SEQ ID NO: 904811 - RNA, 19 nt, Homo sapiens
ugcacguguguguguuuca

SEQ ID NO: 904812 - RNA, 14 nt, Homo sapiens
ugcacuagccugug

SEQ ID NO: 904813 - RNA, 13 nt, Homo sapiens
ugcacugugacac

SEQ ID NO: 904814 - RNA, 17 nt, Homo sapiens
ugcacuuuuaaaccucu

SEQ ID NO: 904815 - RNA, 18 nt, Homo sapiens
ugcacuuuuaaaccucuc

SEQ ID NO: 904816 - RNA, 13 nt, Homo sapiens
ugcagaaggccaa

SEQ ID NO: 904817 - RNA, 17 nt, Homo sapiens
ugcagacaccugccuua

SEQ ID NO: 904818 - RNA, 18 nt, Homo sapiens
ugcagacaccugccuuaa

SEQ ID NO: 904819 - RNA, 19 nt, Homo sapiens
ugcagagguaaaaguguga

SEQ ID NO: 904820 - RNA, 16 nt, Homo sapiens
ugcagccgugcaggag

SEQ ID NO: 904821 - RNA, 16 nt, Homo sapiens
ugcagccucaaccucc

SEQ ID NO: 904822 - RNA, 22 nt, Homo sapiens
ugcagcugcuuguugucaagua

SEQ ID NO: 904823 - RNA, 15 nt, Homo sapiens
ugcagcugugccaua

SEQ ID NO: 904824 - RNA, 15 nt, Homo sapiens
ugcagcuuccuguca

SEQ ID NO: 904825 - RNA, 23 nt, Homo sapiens
ugcaguauauuucugaaaugaca

SEQ ID NO: 904826 - RNA, 20 nt, Homo sapiens
ugcaguggugcgaucuuggc

SEQ ID NO: 904827 - RNA, 16 nt, Homo sapiens
ugcaguugacagcagg

SEQ ID NO: 904828 - RNA, 19 nt, Homo sapiens
ugcauaaacuucaucuuca

SEQ ID NO: 904829 - RNA, 18 nt, Homo sapiens
ugcauaaaugugguacaa

SEQ ID NO: 904830 - RNA, 14 nt, Homo sapiens
ugcauaagauuaaa

SEQ ID NO: 904831 - RNA, 21 nt, Homo sapiens
ugcaucaauuuaccuacucua

SEQ ID NO: 904832 - RNA, 15 nt, Homo sapiens
ugcaucagcugcuga

SEQ ID NO: 904833 - RNA, 19 nt, Homo sapiens
ugcauccccuuggcuguga

SEQ ID NO: 904834 - RNA, 16 nt, Homo sapiens
uggauggacagaauga

SEQ ID NO: 904835 - RNA, 15 nt, Homo sapiens
uggaugugggguccc

SEQ ID NO: 904836 - RNA, 13 nt, Homo sapiens
uggauguuuguca

SEQ ID NO: 904837 - RNA, 14 nt, Homo sapiens
uggauuauucauuu

SEQ ID NO: 904838 - RNA, 14 nt, Homo sapiens
uggauuauuuagau

SEQ ID NO: 904839 - RNA, 13 nt, Homo sapiens
uggauuauuucau

SEQ ID NO: 904840 - RNA, 12 nt, Homo sapiens
uggauugagggu

SEQ ID NO: 904841 - RNA, 13 nt, Homo sapiens
uggcaagugaauu

SEQ ID NO: 904842 - RNA, 19 nt, Homo sapiens
uggcaauuguccccaggga

SEQ ID NO: 904843 - RNA, 15 nt, Homo sapiens
uggcaccacugcacu

SEQ ID NO: 904844 - RNA, 14 nt, Homo sapiens
uggcaccgagacca

SEQ ID NO: 904845 - RNA, 19 nt, Homo sapiens
uggcaccucagacaaucca

SEQ ID NO: 904846 - RNA, 19 nt, Homo sapiens
uggcacgugccugugaucc

SEQ ID NO: 904847 - RNA, 14 nt, Homo sapiens
uggcacugguugua

SEQ ID NO: 904848 - RNA, 16 nt, Homo sapiens
uggcagccgugccuuc

SEQ ID NO: 904849 - RNA, 17 nt, Homo sapiens
uggcaguccagccagcu

SEQ ID NO: 904850 - RNA, 18 nt, Homo sapiens
uggcaguguaugcucaua

SEQ ID NO: 904851 - RNA, 23 nt, Homo sapiens
uggcaguuacagggcccagguga

SEQ ID NO: 904852 - RNA, 18 nt, Homo sapiens
uggcauccccuuuauuaa

SEQ ID NO: 904853 - RNA, 16 nt, Homo sapiens
uggcaucuccauguag

SEQ ID NO: 904854 - RNA, 21 nt, Homo sapiens
uggcauucacacagcccauaa

SEQ ID NO: 904855 - RNA, 17 nt, Homo sapiens
uggcauucacaucucau

SEQ ID NO: 904856 - RNA, 22 nt, Homo sapiens
uggcauuuuccucgccuaggcc

SEQ ID NO: 904857 - RNA, 18 nt, Homo sapiens
uggccaaccaaagacacu

SEQ ID NO: 904858 - RNA, 12 nt, Homo sapiens
uggccaagcuga

SEQ ID NO: 904859 - RNA, 17 nt, Homo sapiens
uggccaggggacacugu

SEQ ID NO: 904860 - RNA, 17 nt, Homo sapiens
uggccagugugauccca

SEQ ID NO: 904861 - RNA, 19 nt, Homo sapiens
uggccaugcuucuugcccc

SEQ ID NO: 904862 - RNA, 15 nt, Homo sapiens
uggccauuguguugg

SEQ ID NO: 904863 - RNA, 15 nt, Homo sapiens
uggcccaaauccagu

SEQ ID NO: 904864 - RNA, 17 nt, Homo sapiens
uggcccagggaagccaa

SEQ ID NO: 904865 - RNA, 15 nt, Homo sapiens
uggccccaggguuga

SEQ ID NO: 904866 - RNA, 17 nt, Homo sapiens
uggccccugcccggcug

SEQ ID NO: 904867 - RNA, 19 nt, Homo sapiens
uggcccugggagagccaga

SEQ ID NO: 904868 - RNA, 14 nt, Homo sapiens
uggccuaugcacau

SEQ ID NO: 904869 - RNA, 16 nt, Homo sapiens
uggccuaugcacauau

SEQ ID NO: 904870 - RNA, 15 nt, Homo sapiens
uggccucaagugauu

SEQ ID NO: 904871 - RNA, 23 nt, Homo sapiens
uggccuugugucagagcugggag

SEQ ID NO: 904872 - RNA, 16 nt, Homo sapiens
uggcgcaucauaugca

SEQ ID NO: 904873 - RNA, 14 nt, Homo sapiens
uggcgccagggcca

SEQ ID NO: 904874 - RNA, 17 nt, Homo sapiens
uggcucacuacagccuc

SEQ ID NO: 904875 - RNA, 17 nt, Homo sapiens
uggcuccaggacagacc

SEQ ID NO: 904876 - RNA, 15 nt, Homo sapiens
uggcuccugccuuga

SEQ ID NO: 904877 - RNA, 16 nt, Homo sapiens
uggcugaggauuucaa

SEQ ID NO: 904878 - RNA, 14 nt, Homo sapiens
uggcugccuuagaa

SEQ ID NO: 904879 - RNA, 11 nt, Homo sapiens
uggcuguaaac

SEQ ID NO: 904880 - RNA, 18 nt, Homo sapiens
uggcuguccccagcaccu

SEQ ID NO: 904881 - RNA, 21 nt, Homo sapiens
uggcuuaauguuuauuccuga

SEQ ID NO: 904882 - RNA, 17 nt, Homo sapiens
uggcuuagaaaucuuua

SEQ ID NO: 904883 - RNA, 18 nt, Homo sapiens
uggcuucgucauuugcaa

SEQ ID NO: 904884 - RNA, 18 nt, Homo sapiens
uggcuucugggaccugug

SEQ ID NO: 904885 - RNA, 20 nt, Homo sapiens
uggcuugagaugauaagaga

SEQ ID NO: 904886 - RNA, 18 nt, Homo sapiens
uggcuuuagcuaccucac

SEQ ID NO: 904887 - RNA, 16 nt, Homo sapiens
uggcuuucccuuccag

SEQ ID NO: 904888 - RNA, 21 nt, Homo sapiens
ugggaaaaaaguuuugaugaa

SEQ ID NO: 904889 - RNA, 22 nt, Homo sapiens
ugggaaaggaaaaccagggaua

SEQ ID NO: 904890 - RNA, 19 nt, Homo sapiens
ugggaagaaagaaugcaag

SEQ ID NO: 904891 - RNA, 12 nt, Homo sapiens
ugggaagccaua

SEQ ID NO: 904892 - RNA, 19 nt, Homo sapiens
ugggaaggcuaaguucagu

SEQ ID NO: 904893 - RNA, 12 nt, Homo sapiens
ugggacacaguu

SEQ ID NO: 904894 - RNA, 14 nt, Homo sapiens
ugggacccuugaga

SEQ ID NO: 904895 - RNA, 14 nt, Homo sapiens
ugggaccugugauc

SEQ ID NO: 904896 - RNA, 16 nt, Homo sapiens
ugggagagacacuccc

SEQ ID NO: 904897 - RNA, 15 nt, Homo sapiens
ugggaggaaccugaa

SEQ ID NO: 904898 - RNA, 19 nt, Homo sapiens
ugggaggguaccagcagaa

SEQ ID NO: 904899 - RNA, 22 nt, Homo sapiens
ugggagucaggaccuccgggga

SEQ ID NO: 904900 - RNA, 22 nt, Homo sapiens
ugggaugcggggcagagccacc

SEQ ID NO: 904901 - RNA, 13 nt, Homo sapiens
ugggaugggaucc

SEQ ID NO: 904902 - RNA, 12 nt, Homo sapiens
ugggauucccac

SEQ ID NO: 904903 - RNA, 16 nt, Homo sapiens
ugggcaaugaaaccaa

SEQ ID NO: 904904 - RNA, 13 nt, Homo sapiens
ugggcaccucuag

SEQ ID NO: 904905 - RNA, 21 nt, Homo sapiens
ugggcaccuuccuaauaugcu

SEQ ID NO: 904906 - RNA, 18 nt, Homo sapiens
ugggcauuuucccagaug

SEQ ID NO: 904907 - RNA, 14 nt, Homo sapiens
ugggccacugccag

SEQ ID NO: 904908 - RNA, 16 nt, Homo sapiens
ugggccaguuccucca

SEQ ID NO: 904909 - RNA, 18 nt, Homo sapiens
ugggcccuggccuggauu

SEQ ID NO: 904910 - RNA, 16 nt, Homo sapiens
ugggccuccaaagccc

SEQ ID NO: 904911 - RNA, 19 nt, Homo sapiens
ugggccugcugcugagaac

SEQ ID NO: 904912 - RNA, 19 nt, Homo sapiens
ugggcuaugugucacagcu

SEQ ID NO: 904913 - RNA, 21 nt, Homo sapiens
ugggcucaucagccuuccuga

SEQ ID NO: 904914 - RNA, 19 nt, Homo sapiens
ugggcuggugucaccugaa

SEQ ID NO: 904915 - RNA, 15 nt, Homo sapiens
ugggcugucugucac

SEQ ID NO: 904916 - RNA, 16 nt, Homo sapiens
uggggaagcugugaaa

SEQ ID NO: 904917 - RNA, 21 nt, Homo sapiens
uggggagaccucuacugccuu

SEQ ID NO: 904918 - RNA, 20 nt, Homo sapiens
uggggaguuauaaaaauaca

SEQ ID NO: 904919 - RNA, 19 nt, Homo sapiens
uggggcacagucauucaca

SEQ ID NO: 904920 - RNA, 19 nt, Homo sapiens
uggggcagucucugcccaa

SEQ ID NO: 904921 - RNA, 12 nt, Homo sapiens
uggggccagugc

SEQ ID NO: 904922 - RNA, 11 nt, Homo sapiens
uggggccugua

SEQ ID NO: 904923 - RNA, 18 nt, Homo sapiens
uggggcuuuuacaccagu

SEQ ID NO: 904924 - RNA, 24 nt, Homo sapiens
ugggggaggcggcacauuggcagu

SEQ ID NO: 904925 - RNA, 14 nt, Homo sapiens
ugggggucaggggc

SEQ ID NO: 904926 - RNA, 18 nt, Homo sapiens
ugggguucccccagacag

SEQ ID NO: 904927 - RNA, 22 nt, Homo sapiens
ugggguugaaaauucaaaaagu

SEQ ID NO: 904928 - RNA, 16 nt, Homo sapiens
ugggguuucaccaucu

SEQ ID NO: 904929 - RNA, 19 nt, Homo sapiens
uggguacaauguacauuau

SEQ ID NO: 904930 - RNA, 16 nt, Homo sapiens
uggguauuuaauaaga

SEQ ID NO: 904931 - RNA, 17 nt, Homo sapiens
ugggucaagggccaguc

SEQ ID NO: 904932 - RNA, 21 nt, Homo sapiens
ugggugaacaccaacuuuuau

SEQ ID NO: 904933 - RNA, 20 nt, Homo sapiens
ugggugccgggcugcacaga

SEQ ID NO: 904934 - RNA, 13 nt, Homo sapiens
uggguuauuucaa

SEQ ID NO: 904935 - RNA, 16 nt, Homo sapiens
uggguuauuuuugucc

SEQ ID NO: 904936 - RNA, 18 nt, Homo sapiens
ugguaaaaccccaucucu

SEQ ID NO: 904937 - RNA, 23 nt, Homo sapiens
ugguaacacaaauuuucaccugc

SEQ ID NO: 904938 - RNA, 16 nt, Homo sapiens
ugguaauuuguaucug

SEQ ID NO: 904939 - RNA, 20 nt, Homo sapiens
ugguacaaucucaaauucuc

SEQ ID NO: 904940 - RNA, 19 nt, Homo sapiens
ugguaccacuggaaucgau

SEQ ID NO: 904941 - RNA, 22 nt, Homo sapiens
ugguacugcacauuuuguacaa

SEQ ID NO: 904942 - RNA, 15 nt, Homo sapiens
ugguagccucacuuu

SEQ ID NO: 904943 - RNA, 17 nt, Homo sapiens
ugguagccucacuuuua

SEQ ID NO: 904944 - RNA, 21 nt, Homo sapiens
ugguagguuugaaugacgugu

SEQ ID NO: 904945 - RNA, 22 nt, Homo sapiens
ugguagguuugaaugacguguc

SEQ ID NO: 904946 - RNA, 14 nt, Homo sapiens
ugguauauuuccau

SEQ ID NO: 904947 - RNA, 12 nt, Homo sapiens
ugguaugaaggu

SEQ ID NO: 904948 - RNA, 13 nt, Homo sapiens
ugguccagcucuu

SEQ ID NO: 904949 - RNA, 14 nt, Homo sapiens
ugguccaggguuga

SEQ ID NO: 904950 - RNA, 12 nt, Homo sapiens
aaacaguucuug

SEQ ID NO: 904951 - RNA, 15 nt, Homo sapiens
aaacaguucuuggac

SEQ ID NO: 904952 - RNA, 14 nt, Homo sapiens
aaacauaugcauua

SEQ ID NO: 904953 - RNA, 12 nt, Homo sapiens
aaacaugaauua

SEQ ID NO: 904954 - RNA, 22 nt, Homo sapiens
aaacauguggcaaccuguucuu

SEQ ID NO: 904955 - RNA, 20 nt, Homo sapiens
aaacaugugguuaaugccau

SEQ ID NO: 904956 - RNA, 15 nt, Homo sapiens
aaacauuccugugaa

SEQ ID NO: 904957 - RNA, 23 nt, Homo sapiens
aaacauugauuauaagcauguau

SEQ ID NO: 904958 - RNA, 19 nt, Homo sapiens
aaacauugguauauuucca

SEQ ID NO: 904959 - RNA, 19 nt, Homo sapiens
aaaccaaugagcuguaucu

SEQ ID NO: 904960 - RNA, 16 nt, Homo sapiens
aaaccacuagaacucu

SEQ ID NO: 904961 - RNA, 21 nt, Homo sapiens
aaaccacuagaacucuccauc

SEQ ID NO: 904962 - RNA, 17 nt, Homo sapiens
aaaccacuguacauaua

SEQ ID NO: 904963 - RNA, 13 nt, Homo sapiens
aaaccacuguaua

SEQ ID NO: 904964 - RNA, 15 nt, Homo sapiens
aaaccagcgcaagga

SEQ ID NO: 904965 - RNA, 23 nt, Homo sapiens
aaaccauguaguuuuaacagaac

SEQ ID NO: 904966 - RNA, 12 nt, Homo sapiens
aaacccaaauaa

SEQ ID NO: 904967 - RNA, 15 nt, Homo sapiens
aaacccccgcuccag

SEQ ID NO: 904968 - RNA, 13 nt, Homo sapiens
aaacccucaaggg

SEQ ID NO: 904969 - RNA, 14 nt, Homo sapiens
aaacccugucucua

SEQ ID NO: 904970 - RNA, 17 nt, Homo sapiens
aaacccuucucuucucc

SEQ ID NO: 904971 - RNA, 18 nt, Homo sapiens
aaacccuucuuuacuaga

SEQ ID NO: 904972 - RNA, 16 nt, Homo sapiens
aaaccgcacucaccca

SEQ ID NO: 904973 - RNA, 17 nt, Homo sapiens
aaaccguaauuuuauua

SEQ ID NO: 904974 - RNA, 22 nt, Homo sapiens
aaaccucccccaagcagagcuu

SEQ ID NO: 904975 - RNA, 22 nt, Homo sapiens
aaaccugauguuaaaauuccau

SEQ ID NO: 904976 - RNA, 14 nt, Homo sapiens
aaaccugugugcca

SEQ ID NO: 904977 - RNA, 13 nt, Homo sapiens
aaaccuguuggcu

SEQ ID NO: 904978 - RNA, 13 nt, Homo sapiens
aaacgacaaauca

SEQ ID NO: 904979 - RNA, 18 nt, Homo sapiens
aaacgguaauacgugaaa

SEQ ID NO: 904980 - RNA, 15 nt, Homo sapiens
aaacuaaaaagccau

SEQ ID NO: 904981 - RNA, 16 nt, Homo sapiens
aaacuaacacccaguc

SEQ ID NO: 904982 - RNA, 16 nt, Homo sapiens
aaacuacaaagcugaa

SEQ ID NO: 904983 - RNA, 14 nt, Homo sapiens
aaacuauauucuca

SEQ ID NO: 904984 - RNA, 16 nt, Homo sapiens
aaacuauggcuuuaaa

SEQ ID NO: 904985 - RNA, 17 nt, Homo sapiens
aaacuaugguucccaau

SEQ ID NO: 904986 - RNA, 20 nt, Homo sapiens
aaacucacagaacuauguac

SEQ ID NO: 904987 - RNA, 19 nt, Homo sapiens
aaacucauuacuuuuccau

SEQ ID NO: 904988 - RNA, 14 nt, Homo sapiens
aaacucucuagggc

SEQ ID NO: 904989 - RNA, 20 nt, Homo sapiens
aaacucuugaccucagguga

SEQ ID NO: 904990 - RNA, 17 nt, Homo sapiens
aaacugaaaaucuaaua

SEQ ID NO: 904991 - RNA, 16 nt, Homo sapiens
aaacugaaucaagaaa

SEQ ID NO: 904992 - RNA, 19 nt, Homo sapiens
aaacugaggcccuugggca

SEQ ID NO: 904993 - RNA, 20 nt, Homo sapiens
aaacugauuuuuagcuuuac

SEQ ID NO: 904994 - RNA, 14 nt, Homo sapiens
aaacugcacugcca

SEQ ID NO: 904995 - RNA, 17 nt, Homo sapiens
aaacugccuuccacaau

SEQ ID NO: 904996 - RNA, 19 nt, Homo sapiens
aaacugguugucaguuaca

SEQ ID NO: 904997 - RNA, 15 nt, Homo sapiens
aaacuucaucuucaa

SEQ ID NO: 904998 - RNA, 21 nt, Homo sapiens
aaacuuccuaaugauuagcac

SEQ ID NO: 904999 - RNA, 17 nt, Homo sapiens
aaacuuguacuauguua

SEQ ID NO: 905000 - RNA, 19 nt, Homo sapiens
aaacuuuacucuaagucuc

SEQ ID NO: 905001 - RNA, 12 nt, Homo sapiens
aaagaaaaccau

SEQ ID NO: 905002 - RNA, 14 nt, Homo sapiens
aaagaaaauuagua

SEQ ID NO: 905003 - RNA, 22 nt, Homo sapiens
aaagaaacguacuuaacugugu

SEQ ID NO: 905004 - RNA, 18 nt, Homo sapiens
aaagaaaucuucauuuau

SEQ ID NO: 905005 - RNA, 12 nt, Homo sapiens
aaagaaaugcau

SEQ ID NO: 905006 - RNA, 14 nt, Homo sapiens
aaagaagacuggaa

SEQ ID NO: 905007 - RNA, 16 nt, Homo sapiens
aaagaagacuggaagc

SEQ ID NO: 905008 - RNA, 14 nt, Homo sapiens
aaagaagauuuugc

SEQ ID NO: 905009 - RNA, 15 nt, Homo sapiens
aaagaaggacacuug

SEQ ID NO: 905010 - RNA, 19 nt, Homo sapiens
aaagaagucauggcccaaa

SEQ ID NO: 905011 - RNA, 14 nt, Homo sapiens
aaagaauacagaaa

SEQ ID NO: 905012 - RNA, 20 nt, Homo sapiens
aaagaccaauauucaaaugc

SEQ ID NO: 905013 - RNA, 20 nt, Homo sapiens
aaagaccagggcuuuuccca

SEQ ID NO: 905014 - RNA, 15 nt, Homo sapiens
aaagacuacacuguu

SEQ ID NO: 905015 - RNA, 14 nt, Homo sapiens
aaagacuauugcaa

SEQ ID NO: 905016 - RNA, 21 nt, Homo sapiens
aaagagaagcaaaaucuacca

SEQ ID NO: 905017 - RNA, 19 nt, Homo sapiens
aaagaggaaaagugcaaug

SEQ ID NO: 905018 - RNA, 22 nt, Homo sapiens
aaagaguccuauuugcacugua

SEQ ID NO: 905019 - RNA, 20 nt, Homo sapiens
aaagauaacaagaucuuuca

SEQ ID NO: 905020 - RNA, 15 nt, Homo sapiens
aaagauccacccuca

SEQ ID NO: 905021 - RNA, 22 nt, Homo sapiens
aaagauccacccucaaauguca

SEQ ID NO: 905022 - RNA, 15 nt, Homo sapiens
aaagauggaugugcu

SEQ ID NO: 905023 - RNA, 18 nt, Homo sapiens
aaagauguaaaaccuaac

SEQ ID NO: 905024 - RNA, 19 nt, Homo sapiens
aaagauguuugucagauau

SEQ ID NO: 905025 - RNA, 23 nt, Homo sapiens
aaagauuggacaccccugcuaua

SEQ ID NO: 905026 - RNA, 22 nt, Homo sapiens
aaagauuguuuuauauguagua

SEQ ID NO: 905027 - RNA, 17 nt, Homo sapiens
aaagauuuguuuuguca

SEQ ID NO: 905028 - RNA, 13 nt, Homo sapiens
aaagcaacaguua

SEQ ID NO: 905029 - RNA, 16 nt, Homo sapiens
aaagcaagacagauua

SEQ ID NO: 905030 - RNA, 20 nt, Homo sapiens
aaagcaagacuguugcucaa

SEQ ID NO: 905031 - RNA, 20 nt, Homo sapiens
aaagcaagcauucagaagaa

SEQ ID NO: 905032 - RNA, 22 nt, Homo sapiens
aaagcaauuauauuguccuccc

SEQ ID NO: 905033 - RNA, 14 nt, Homo sapiens
aaagcacaccucau

SEQ ID NO: 905034 - RNA, 12 nt, Homo sapiens
aaagcacagugu

SEQ ID NO: 905035 - RNA, 12 nt, Homo sapiens
aaagcaccugcc

SEQ ID NO: 905036 - RNA, 15 nt, Homo sapiens
aaagcacugacuucu

SEQ ID NO: 905037 - RNA, 19 nt, Homo sapiens
aaagcagguggcaucucua

SEQ ID NO: 905038 - RNA, 19 nt, Homo sapiens
aaagcaguggacaccagga

SEQ ID NO: 905039 - RNA, 16 nt, Homo sapiens
aaagcaucaccucagg

SEQ ID NO: 905040 - RNA, 20 nt, Homo sapiens
aaagcauggacuaaccccaa

SEQ ID NO: 905041 - RNA, 15 nt, Homo sapiens
aaagcauuugcugug

SEQ ID NO: 905042 - RNA, 13 nt, Homo sapiens
aaagcccuuccau

SEQ ID NO: 905043 - RNA, 17 nt, Homo sapiens
aaagcccuugaaccagc

SEQ ID NO: 905044 - RNA, 19 nt, Homo sapiens
aaagcccuuuuauaccucc

SEQ ID NO: 905045 - RNA, 19 nt, Homo sapiens
aaagcgagaucccaucucu

SEQ ID NO: 905046 - RNA, 17 nt, Homo sapiens
aaagcugaggacagggu

SEQ ID NO: 905047 - RNA, 13 nt, Homo sapiens
aaagcugcugaca

SEQ ID NO: 905048 - RNA, 22 nt, Homo sapiens
aaagcugcugagaaucuagccu

SEQ ID NO: 905049 - RNA, 20 nt, Homo sapiens
aaagcuuaccaaggggaaug

SEQ ID NO: 905050 - RNA, 14 nt, Homo sapiens
aaagcuuugaaccc

SEQ ID NO: 905051 - RNA, 20 nt, Homo sapiens
aaaggaaccaaccaacaaac

SEQ ID NO: 905052 - RNA, 17 nt, Homo sapiens
aaaggaagucaccaaaa

SEQ ID NO: 905053 - RNA, 13 nt, Homo sapiens
aaaggaccuuccc

SEQ ID NO: 905054 - RNA, 12 nt, Homo sapiens
aaaggagccugu

SEQ ID NO: 905055 - RNA, 13 nt, Homo sapiens
aaaggagugaaug

SEQ ID NO: 905056 - RNA, 21 nt, Homo sapiens
aaaggauguuuugucccauuu

SEQ ID NO: 905057 - RNA, 24 nt, Homo sapiens
aaaggcaaaaagcauguguuugca

SEQ ID NO: 905058 - RNA, 15 nt, Homo sapiens
aaaggcucagucuca

SEQ ID NO: 905059 - RNA, 15 nt, Homo sapiens
aaagggaaacuggcu

SEQ ID NO: 905060 - RNA, 16 nt, Homo sapiens
aaagggauaguccaaa

SEQ ID NO: 905061 - RNA, 22 nt, Homo sapiens
aaagguugacaauaaaugugcu

SEQ ID NO: 905062 - RNA, 16 nt, Homo sapiens
aaagguugagauguaa

SEQ ID NO: 905063 - RNA, 17 nt, Homo sapiens
aaagguuucaagacuug

SEQ ID NO: 905064 - RNA, 23 nt, Homo sapiens
aaaguacucuuuaagagugaaau

SEQ ID NO: 905065 - RNA, 20 nt, Homo sapiens
aacgccugagcccagggagg

SEQ ID NO: 905066 - RNA, 21 nt, Homo sapiens
aacggaguacagacgucucaa

SEQ ID NO: 905067 - RNA, 15 nt, Homo sapiens
aacgucaucucaggg

SEQ ID NO: 905068 - RNA, 17 nt, Homo sapiens
aacguuuugaacuaaua

SEQ ID NO: 905069 - RNA, 16 nt, Homo sapiens
aacuaagacauaugca

SEQ ID NO: 905070 - RNA, 12 nt, Homo sapiens
aacuacauguaa

SEQ ID NO: 905071 - RNA, 16 nt, Homo sapiens
aacuacauguaaucca

SEQ ID NO: 905072 - RNA, 17 nt, Homo sapiens
aacuacuaaagugccua

SEQ ID NO: 905073 - RNA, 23 nt, Homo sapiens
aacuacuuuuguaccagugugaa

SEQ ID NO: 905074 - RNA, 14 nt, Homo sapiens
aacuagaaccugga

SEQ ID NO: 905075 - RNA, 20 nt, Homo sapiens
aacuagacauuaccaaagug

SEQ ID NO: 905076 - RNA, 21 nt, Homo sapiens
aacuaguauuguccauaucag

SEQ ID NO: 905077 - RNA, 16 nt, Homo sapiens
aacuaguguugcuugg

SEQ ID NO: 905078 - RNA, 13 nt, Homo sapiens
aacuauaagcaag

SEQ ID NO: 905079 - RNA, 14 nt, Homo sapiens
aacuauaagcaaga

SEQ ID NO: 905080 - RNA, 13 nt, Homo sapiens
aacuauccaaaac

SEQ ID NO: 905081 - RNA, 14 nt, Homo sapiens
aacuaucuuuuugc

SEQ ID NO: 905082 - RNA, 21 nt, Homo sapiens
aacuaugaucacagugacuuu

SEQ ID NO: 905083 - RNA, 15 nt, Homo sapiens
aacuaugcugaagag

SEQ ID NO: 905084 - RNA, 16 nt, Homo sapiens
aacuauguacuuuaaa

SEQ ID NO: 905085 - RNA, 13 nt, Homo sapiens
aacuaugugaugu

SEQ ID NO: 905086 - RNA, 19 nt, Homo sapiens
aacuauuucuacacagugg

SEQ ID NO: 905087 - RNA, 19 nt, Homo sapiens
aacucaauauuuuccauga

SEQ ID NO: 905088 - RNA, 16 nt, Homo sapiens
aacucagacauuccaa

SEQ ID NO: 905089 - RNA, 13 nt, Homo sapiens
aacucagcugucu

SEQ ID NO: 905090 - RNA, 14 nt, Homo sapiens
aacucaucuguuau

SEQ ID NO: 905091 - RNA, 18 nt, Homo sapiens
aacucauuacuuuuccau

SEQ ID NO: 905092 - RNA, 18 nt, Homo sapiens
aacuccaggaaaacuguu

SEQ ID NO: 905093 - RNA, 15 nt, Homo sapiens
aacuccuccuugccu

SEQ ID NO: 905094 - RNA, 18 nt, Homo sapiens
aacuccugguucagccau

SEQ ID NO: 905095 - RNA, 15 nt, Homo sapiens
aacucuccacuccau

SEQ ID NO: 905096 - RNA, 12 nt, Homo sapiens
aacucucuaggg

SEQ ID NO: 905097 - RNA, 21 nt, Homo sapiens
aacucugccugagacuuucag

SEQ ID NO: 905098 - RNA, 16 nt, Homo sapiens
aacugaaaaaugucag

SEQ ID NO: 905099 - RNA, 23 nt, Homo sapiens
aacugaaucaagaaaugaaugcu

SEQ ID NO: 905100 - RNA, 15 nt, Homo sapiens
aacugacaaccugug

SEQ ID NO: 905101 - RNA, 18 nt, Homo sapiens
aacugauucacaucucau

SEQ ID NO: 905102 - RNA, 17 nt, Homo sapiens
aacugcccaaggcaugu

SEQ ID NO: 905103 - RNA, 20 nt, Homo sapiens
aacugcucugcccacuguga

SEQ ID NO: 905104 - RNA, 17 nt, Homo sapiens
aacugcugaucaaugaa

SEQ ID NO: 905105 - RNA, 19 nt, Homo sapiens
aacuggaggaguuccuuga

SEQ ID NO: 905106 - RNA, 11 nt, Homo sapiens
aacuggcugca

SEQ ID NO: 905107 - RNA, 15 nt, Homo sapiens
aacuggggcuugcaa

SEQ ID NO: 905108 - RNA, 16 nt, Homo sapiens
aacuguaaaucacuug

SEQ ID NO: 905109 - RNA, 23 nt, Homo sapiens
aacuguccuuccauuugggauau

SEQ ID NO: 905110 - RNA, 22 nt, Homo sapiens
aacugucucucaugaaccucaa

SEQ ID NO: 905111 - RNA, 14 nt, Homo sapiens
aacuguuguuuacu

SEQ ID NO: 905112 - RNA, 17 nt, Homo sapiens
aacuuaaaaaaaugaca

SEQ ID NO: 905113 - RNA, 15 nt, Homo sapiens
aacuuaaaucacuga

SEQ ID NO: 905114 - RNA, 22 nt, Homo sapiens
aacuuaagcugggauaaucaca

SEQ ID NO: 905115 - RNA, 24 nt, Homo sapiens
aacuuagaaggauggcaucuccau

SEQ ID NO: 905116 - RNA, 18 nt, Homo sapiens
aacuuauugucuaggcca

SEQ ID NO: 905117 - RNA, 12 nt, Homo sapiens
aacuucucugag

SEQ ID NO: 905118 - RNA, 12 nt, Homo sapiens
aacuucuuguug

SEQ ID NO: 905119 - RNA, 15 nt, Homo sapiens
aacuugcauauguca

SEQ ID NO: 905120 - RNA, 18 nt, Homo sapiens
aacuugggggaggaggaa

SEQ ID NO: 905121 - RNA, 13 nt, Homo sapiens
aacuuguccuaug

SEQ ID NO: 905122 - RNA, 14 nt, Homo sapiens
aacuugugcugaga

SEQ ID NO: 905123 - RNA, 12 nt, Homo sapiens
aacuuuguacca

SEQ ID NO: 905124 - RNA, 12 nt, Homo sapiens
aagaaaaccauu

SEQ ID NO: 905125 - RNA, 12 nt, Homo sapiens
aagaaaacugga

SEQ ID NO: 905126 - RNA, 13 nt, Homo sapiens
aagaaaacuggaa

SEQ ID NO: 905127 - RNA, 14 nt, Homo sapiens
aagaaaacuggaaa

SEQ ID NO: 905128 - RNA, 13 nt, Homo sapiens
aagaaaaugaagc

SEQ ID NO: 905129 - RNA, 15 nt, Homo sapiens
aagaaaauuaguaau

SEQ ID NO: 905130 - RNA, 16 nt, Homo sapiens
aagaaaauuauguauu

SEQ ID NO: 905131 - RNA, 12 nt, Homo sapiens
aagaaacaugau

SEQ ID NO: 905132 - RNA, 23 nt, Homo sapiens
aagaaagaaacacucaacaauaa

SEQ ID NO: 905133 - RNA, 22 nt, Homo sapiens
aagaaagcaaugccaaucuuca

SEQ ID NO: 905134 - RNA, 14 nt, Homo sapiens
aagaaaugggagaa

SEQ ID NO: 905135 - RNA, 20 nt, Homo sapiens
aagaacaguaacugccauca

SEQ ID NO: 905136 - RNA, 15 nt, Homo sapiens
aagaaccaguguuua

SEQ ID NO: 905137 - RNA, 16 nt, Homo sapiens
aagaaccuaaaguagc

SEQ ID NO: 905138 - RNA, 19 nt, Homo sapiens
aagaacucugcacagcaac

SEQ ID NO: 905139 - RNA, 21 nt, Homo sapiens
aagaagaauauucuaugaagu

SEQ ID NO: 905140 - RNA, 13 nt, Homo sapiens
aagaagaccagac

SEQ ID NO: 905141 - RNA, 16 nt, Homo sapiens
aagaagagaucaggaa

SEQ ID NO: 905142 - RNA, 16 nt, Homo sapiens
aagaagaguuucuccu

SEQ ID NO: 905143 - RNA, 16 nt, Homo sapiens
aagaagaguuugcaaa

SEQ ID NO: 905144 - RNA, 15 nt, Homo sapiens
aagaagccacagacc

SEQ ID NO: 905145 - RNA, 18 nt, Homo sapiens
aagaagcuucaugccagg

SEQ ID NO: 905146 - RNA, 21 nt, Homo sapiens
aagaaggaauucuaggcaucc

SEQ ID NO: 905147 - RNA, 15 nt, Homo sapiens
aagaaggccacuggu

SEQ ID NO: 905148 - RNA, 13 nt, Homo sapiens
aagaaguggagac

SEQ ID NO: 905149 - RNA, 22 nt, Homo sapiens
aagaaguguuccuucauuaacu

SEQ ID NO: 905150 - RNA, 21 nt, Homo sapiens
aagaauaaaauugcacuuuua

SEQ ID NO: 905151 - RNA, 16 nt, Homo sapiens
aagaauaaaugaaucu

SEQ ID NO: 905152 - RNA, 13 nt, Homo sapiens
aagaauacagaaa

SEQ ID NO: 905153 - RNA, 15 nt, Homo sapiens
aagaauacuucucau

SEQ ID NO: 905154 - RNA, 15 nt, Homo sapiens
aagaaucaagcuaga

SEQ ID NO: 905155 - RNA, 14 nt, Homo sapiens
aagaaucagucuug

SEQ ID NO: 905156 - RNA, 16 nt, Homo sapiens
aagaaugacuaugcaa

SEQ ID NO: 905157 - RNA, 13 nt, Homo sapiens
aagaauggaagaa

SEQ ID NO: 905158 - RNA, 17 nt, Homo sapiens
aagaauuccaaccgacc

SEQ ID NO: 905159 - RNA, 23 nt, Homo sapiens
aagaauuuguaguaaaccaggcc

SEQ ID NO: 905160 - RNA, 22 nt, Homo sapiens
aagaauuuuuuuuaacauucca

SEQ ID NO: 905161 - RNA, 17 nt, Homo sapiens
aagacaaagcaaagcca

SEQ ID NO: 905162 - RNA, 16 nt, Homo sapiens
aagacaacauuucuca

SEQ ID NO: 905163 - RNA, 22 nt, Homo sapiens
aagacacaccucuggaucccug

SEQ ID NO: 905164 - RNA, 14 nt, Homo sapiens
aagacagaauguca

SEQ ID NO: 905165 - RNA, 21 nt, Homo sapiens
aagacagagaagaccaaagca

SEQ ID NO: 905166 - RNA, 21 nt, Homo sapiens
aagacauuaccaugaguaaua

SEQ ID NO: 905167 - RNA, 12 nt, Homo sapiens
aagaccaagaca

SEQ ID NO: 905168 - RNA, 21 nt, Homo sapiens
aagacccaguguaaagaauaa

SEQ ID NO: 905169 - RNA, 20 nt, Homo sapiens
aagacuauuaagagcaauaa

SEQ ID NO: 905170 - RNA, 13 nt, Homo sapiens
aagacuccaaaga

SEQ ID NO: 905171 - RNA, 15 nt, Homo sapiens
aagacuggacgggga

SEQ ID NO: 905172 - RNA, 22 nt, Homo sapiens
aagacuguggcugcuagcacuu

SEQ ID NO: 905173 - RNA, 23 nt, Homo sapiens
aagacuguuaaaugaaaccagaa

SEQ ID NO: 905174 - RNA, 14 nt, Homo sapiens
aagacuuaacuggu

SEQ ID NO: 905175 - RNA, 15 nt, Homo sapiens
aagacuuaacugguu

SEQ ID NO: 905176 - RNA, 13 nt, Homo sapiens
aagacuugacagu

SEQ ID NO: 905177 - RNA, 18 nt, Homo sapiens
aagacuugccacuuuuca

SEQ ID NO: 905178 - RNA, 19 nt, Homo sapiens
aagagaaaauaaaccaaga

SEQ ID NO: 905179 - RNA, 15 nt, Homo sapiens
aagagaagcugagaa

SEQ ID NO: 905180 - RNA, 15 nt, Homo sapiens
aagagacucuggccu

SEQ ID NO: 905181 - RNA, 20 nt, Homo sapiens
aaucuguauauguuguaaua

SEQ ID NO: 905182 - RNA, 20 nt, Homo sapiens
aaucuucaagguguaaaaua

SEQ ID NO: 905183 - RNA, 16 nt, Homo sapiens
aaucuuccugccucag

SEQ ID NO: 905184 - RNA, 17 nt, Homo sapiens
aaucuuucagcacucag

SEQ ID NO: 905185 - RNA, 21 nt, Homo sapiens
aaugaaaaaaaguacauguau

SEQ ID NO: 905186 - RNA, 20 nt, Homo sapiens
aaugaaaauaagugaauaau

SEQ ID NO: 905187 - RNA, 14 nt, Homo sapiens
aaugaaaccaaagc

SEQ ID NO: 905188 - RNA, 16 nt, Homo sapiens
aaugaaaccaaagcca

SEQ ID NO: 905189 - RNA, 19 nt, Homo sapiens
aaugaaaccaaagccagga

SEQ ID NO: 905190 - RNA, 24 nt, Homo sapiens
aaugaaagcauguggcauguucau

SEQ ID NO: 905191 - RNA, 12 nt, Homo sapiens
aaugaacuguga

SEQ ID NO: 905192 - RNA, 15 nt, Homo sapiens
aaugaacugugacag

SEQ ID NO: 905193 - RNA, 12 nt, Homo sapiens
aaugaagaccua

SEQ ID NO: 905194 - RNA, 13 nt, Homo sapiens
aaugaagacuguu

SEQ ID NO: 905195 - RNA, 17 nt, Homo sapiens
aaugaagcccuauuacu

SEQ ID NO: 905196 - RNA, 18 nt, Homo sapiens
aaugaaugcuccaugaaa

SEQ ID NO: 905197 - RNA, 14 nt, Homo sapiens
aaugacaucuucaa

SEQ ID NO: 905198 - RNA, 17 nt, Homo sapiens
aaugacccaaagaccaa

SEQ ID NO: 905199 - RNA, 12 nt, Homo sapiens
aaugaccuguau

SEQ ID NO: 905200 - RNA, 15 nt, Homo sapiens
aaugagaacauuuac

SEQ ID NO: 905201 - RNA, 14 nt, Homo sapiens
aaugagaacuucaa

SEQ ID NO: 905202 - RNA, 23 nt, Homo sapiens
aaugagaagccaagcucuucaag

SEQ ID NO: 905203 - RNA, 19 nt, Homo sapiens
aaugagcugguuugucaaa

SEQ ID NO: 905204 - RNA, 15 nt, Homo sapiens
aaugaugccacuucc

SEQ ID NO: 905205 - RNA, 16 nt, Homo sapiens
aaugaugggacaauaa

SEQ ID NO: 905206 - RNA, 22 nt, Homo sapiens
aaugauuuaaauuuauaauuaa

SEQ ID NO: 905207 - RNA, 11 nt, Homo sapiens
aaugcaacuuc

SEQ ID NO: 905208 - RNA, 15 nt, Homo sapiens
aaugcacacacacag

SEQ ID NO: 905209 - RNA, 13 nt, Homo sapiens
aaugcacaucuca

SEQ ID NO: 905210 - RNA, 13 nt, Homo sapiens
aaugcacugugac

SEQ ID NO: 905211 - RNA, 22 nt, Homo sapiens
aaugcaguccagaauaagugcu

SEQ ID NO: 905212 - RNA, 18 nt, Homo sapiens
aaugcaugauuuuauaca

SEQ ID NO: 905213 - RNA, 21 nt, Homo sapiens
aaugcauuauaggaucauuug

SEQ ID NO: 905214 - RNA, 16 nt, Homo sapiens
aaugcauugcuaaaau

SEQ ID NO: 905215 - RNA, 15 nt, Homo sapiens
aaugcauuuucaaga

SEQ ID NO: 905216 - RNA, 20 nt, Homo sapiens
aaugccaaucuucaguauuu

SEQ ID NO: 905217 - RNA, 12 nt, Homo sapiens
aaugccacagug

SEQ ID NO: 905218 - RNA, 17 nt, Homo sapiens
aaugccaucacuggaau

SEQ ID NO: 905219 - RNA, 17 nt, Homo sapiens
aaugccuugacaacaga

SEQ ID NO: 905220 - RNA, 15 nt, Homo sapiens
aaugcuaaaugcaaa

SEQ ID NO: 905221 - RNA, 19 nt, Homo sapiens
aaugcuaagaaaugcugaa

SEQ ID NO: 905222 - RNA, 19 nt, Homo sapiens
aaugcuacaaacauaucaa

SEQ ID NO: 905223 - RNA, 21 nt, Homo sapiens
aaugcuagcugcaagugacau

SEQ ID NO: 905224 - RNA, 15 nt, Homo sapiens
aaugcuuaccuguga

SEQ ID NO: 905225 - RNA, 15 nt, Homo sapiens
aauggaauacugaaa

SEQ ID NO: 905226 - RNA, 19 nt, Homo sapiens
aauggacuauuuguuccac

SEQ ID NO: 905227 - RNA, 17 nt, Homo sapiens
aauggagaaguucagga

SEQ ID NO: 905228 - RNA, 20 nt, Homo sapiens
aauggcaaguuuugauauga

SEQ ID NO: 905229 - RNA, 19 nt, Homo sapiens
aauggccauuguguuggga

SEQ ID NO: 905230 - RNA, 14 nt, Homo sapiens
aaugggcacuggga

SEQ ID NO: 905231 - RNA, 23 nt, Homo sapiens
aauggggccuguuacacaugaca

SEQ ID NO: 905232 - RNA, 17 nt, Homo sapiens
aauggggugcaugaagg

SEQ ID NO: 905233 - RNA, 22 nt, Homo sapiens
aaugguauggaacucucuccac

SEQ ID NO: 905234 - RNA, 17 nt, Homo sapiens
aauggucgcccaggaga

SEQ ID NO: 905235 - RNA, 16 nt, Homo sapiens
aaugguuuacugcugu

SEQ ID NO: 905236 - RNA, 17 nt, Homo sapiens
aauguaacuauaaucuc

SEQ ID NO: 905237 - RNA, 15 nt, Homo sapiens
aauguauaugucauu

SEQ ID NO: 905238 - RNA, 16 nt, Homo sapiens
aauguaucauagaaau

SEQ ID NO: 905239 - RNA, 23 nt, Homo sapiens
aauguaucuuauuuauauaugaa

SEQ ID NO: 905240 - RNA, 15 nt, Homo sapiens
aauguaugauuacau

SEQ ID NO: 905241 - RNA, 12 nt, Homo sapiens
aauguaugcauu

SEQ ID NO: 905242 - RNA, 15 nt, Homo sapiens
aauguaugcauucau

SEQ ID NO: 905243 - RNA, 13 nt, Homo sapiens
aauguauugaacu

SEQ ID NO: 905244 - RNA, 20 nt, Homo sapiens
aauguauuuguuugcaauuu

SEQ ID NO: 905245 - RNA, 21 nt, Homo sapiens
aauguauuuguuugcaauuuu

SEQ ID NO: 905246 - RNA, 12 nt, Homo sapiens
aaugucacuuaa

SEQ ID NO: 905247 - RNA, 12 nt, Homo sapiens
aaugucauucac

SEQ ID NO: 905248 - RNA, 12 nt, Homo sapiens
aauguccuccaa

SEQ ID NO: 905249 - RNA, 22 nt, Homo sapiens
aauguccuucuuuaucugugau

SEQ ID NO: 905250 - RNA, 23 nt, Homo sapiens
aauguccuucuuuaucugugaua

SEQ ID NO: 905251 - RNA, 18 nt, Homo sapiens
aaugucuggucuguccac

SEQ ID NO: 905252 - RNA, 16 nt, Homo sapiens
aaugucuguuaacuua

SEQ ID NO: 905253 - RNA, 13 nt, Homo sapiens
aaugucuguuuca

SEQ ID NO: 905254 - RNA, 16 nt, Homo sapiens
aaugucuuucuauuca

SEQ ID NO: 905255 - RNA, 18 nt, Homo sapiens
aaugucuuuuuaagcuua

SEQ ID NO: 905256 - RNA, 19 nt, Homo sapiens
aaugucuuuuuaagcuuau

SEQ ID NO: 905257 - RNA, 14 nt, Homo sapiens
aaugugaguuauca

SEQ ID NO: 905258 - RNA, 12 nt, Homo sapiens
aaugugccccau

SEQ ID NO: 905259 - RNA, 14 nt, Homo sapiens
aauguguggugcua

SEQ ID NO: 905260 - RNA, 21 nt, Homo sapiens
aauguguggugcuaacuguau

SEQ ID NO: 905261 - RNA, 17 nt, Homo sapiens
aauguguuaagugcagg

SEQ ID NO: 905262 - RNA, 16 nt, Homo sapiens
aauguuacauuauuau

SEQ ID NO: 905263 - RNA, 21 nt, Homo sapiens
aauguuauuuuuuaauuauua

SEQ ID NO: 905264 - RNA, 16 nt, Homo sapiens
aauguuguccaggaaa

SEQ ID NO: 905265 - RNA, 13 nt, Homo sapiens
aauguuguucucu

SEQ ID NO: 905266 - RNA, 16 nt, Homo sapiens
aauguuuauguucuca

SEQ ID NO: 905267 - RNA, 12 nt, Homo sapiens
aauguuucacua

SEQ ID NO: 905268 - RNA, 19 nt, Homo sapiens
aauuaaaaaguuaaucuuc

SEQ ID NO: 905269 - RNA, 21 nt, Homo sapiens
aauuaaaaaguuaaucuucau

SEQ ID NO: 905270 - RNA, 21 nt, Homo sapiens
aauuaaacaagugcacuugaa

SEQ ID NO: 905271 - RNA, 20 nt, Homo sapiens
aauuaaagucuuccauugca

SEQ ID NO: 905272 - RNA, 13 nt, Homo sapiens
aauuaaaugcaug

SEQ ID NO: 905273 - RNA, 18 nt, Homo sapiens
aauuaaguaaaccaaaaa

SEQ ID NO: 905274 - RNA, 21 nt, Homo sapiens
aauuagcugugugaaauacca

SEQ ID NO: 905275 - RNA, 21 nt, Homo sapiens
aauuaggagaggcagagauag

SEQ ID NO: 905276 - RNA, 19 nt, Homo sapiens
aauuagggcauccugcccc

SEQ ID NO: 905277 - RNA, 19 nt, Homo sapiens
aauuagguuuuguacaauu

SEQ ID NO: 905278 - RNA, 16 nt, Homo sapiens
aauuaguaauugucaa

SEQ ID NO: 905279 - RNA, 13 nt, Homo sapiens
aauuaguauuuau

SEQ ID NO: 905280 - RNA, 18 nt, Homo sapiens
aauuaguuaacaguuuuu

SEQ ID NO: 905281 - RNA, 22 nt, Homo sapiens
aauuauacuguagcugaugaaa

SEQ ID NO: 905282 - RNA, 18 nt, Homo sapiens
aauuauuauauguaacug

SEQ ID NO: 905283 - RNA, 21 nt, Homo sapiens
aauuauuaugucucaaaauaa

SEQ ID NO: 905284 - RNA, 19 nt, Homo sapiens
aauuauugugccucagccu

SEQ ID NO: 905285 - RNA, 21 nt, Homo sapiens
aauucacauaacuucucugag

SEQ ID NO: 905286 - RNA, 21 nt, Homo sapiens
aauucauacauaguacauaca

SEQ ID NO: 905287 - RNA, 21 nt, Homo sapiens
aauucauuucaucuacuacag

SEQ ID NO: 905288 - RNA, 21 nt, Homo sapiens
aauuccuaauaaguuugauca

SEQ ID NO: 905289 - RNA, 21 nt, Homo sapiens
aauuccuagaaguugagagag

SEQ ID NO: 905290 - RNA, 16 nt, Homo sapiens
aauuccuagucacaau

SEQ ID NO: 905291 - RNA, 13 nt, Homo sapiens
aauuccucuggga

SEQ ID NO: 905292 - RNA, 15 nt, Homo sapiens
aauuccuguauucua

SEQ ID NO: 905293 - RNA, 15 nt, Homo sapiens
aauuccuuuuugcag

SEQ ID NO: 905294 - RNA, 15 nt, Homo sapiens
aauucuaugagauag

SEQ ID NO: 905295 - RNA, 19 nt, Homo sapiens
aauucuauuacgugcaaua

SEQ ID NO: 905296 - RNA, 12 nt, Homo sapiens
accaaucucuaa

SEQ ID NO: 905297 - RNA, 17 nt, Homo sapiens
accaaugauucauaaca

SEQ ID NO: 905298 - RNA, 22 nt, Homo sapiens
accaauguugugauuaacauca

SEQ ID NO: 905299 - RNA, 15 nt, Homo sapiens
accacacuucuugaa

SEQ ID NO: 905300 - RNA, 11 nt, Homo sapiens
accacagcagc

SEQ ID NO: 905301 - RNA, 13 nt, Homo sapiens
accacagugucug

SEQ ID NO: 905302 - RNA, 12 nt, Homo sapiens
accaccaugcca

SEQ ID NO: 905303 - RNA, 16 nt, Homo sapiens
accaccccuuccuguc

SEQ ID NO: 905304 - RNA, 17 nt, Homo sapiens
accacggcuggauacuc

SEQ ID NO: 905305 - RNA, 15 nt, Homo sapiens
accacuagguucuag

SEQ ID NO: 905306 - RNA, 21 nt, Homo sapiens
accacucaggccaacaagcca

SEQ ID NO: 905307 - RNA, 23 nt, Homo sapiens
accacucaggccaacaagccaac

SEQ ID NO: 905308 - RNA, 17 nt, Homo sapiens
accacuguacauauaua

SEQ ID NO: 905309 - RNA, 22 nt, Homo sapiens
accacuguccuggcugcucuca

SEQ ID NO: 905310 - RNA, 14 nt, Homo sapiens
accacuuaucacau

SEQ ID NO: 905311 - RNA, 21 nt, Homo sapiens
accagaaaaaugggaacaagg

SEQ ID NO: 905312 - RNA, 21 nt, Homo sapiens
accagaaagugaggaagccua

SEQ ID NO: 905313 - RNA, 15 nt, Homo sapiens
accagaagccaaaga

SEQ ID NO: 905314 - RNA, 17 nt, Homo sapiens
accagaggaaacuugca

SEQ ID NO: 905315 - RNA, 17 nt, Homo sapiens
accagaggcugcagaag

SEQ ID NO: 905316 - RNA, 17 nt, Homo sapiens
accagagucaaauuuga

SEQ ID NO: 905317 - RNA, 12 nt, Homo sapiens
accagauuugcu

SEQ ID NO: 905318 - RNA, 16 nt, Homo sapiens
accagccacacagagc

SEQ ID NO: 905319 - RNA, 22 nt, Homo sapiens
accagccuggucaacaugguga

SEQ ID NO: 905320 - RNA, 20 nt, Homo sapiens
accagcuaacuccagucucc

SEQ ID NO: 905321 - RNA, 21 nt, Homo sapiens
accagcuaucugucaucucuc

SEQ ID NO: 905322 - RNA, 22 nt, Homo sapiens
accaggacuaaugcauguggua

SEQ ID NO: 905323 - RNA, 21 nt, Homo sapiens
accaggacucugccccuucug

SEQ ID NO: 905324 - RNA, 21 nt, Homo sapiens
accaggaugaaggcgugcaag

SEQ ID NO: 905325 - RNA, 22 nt, Homo sapiens
accaggauugacaggccaucca

SEQ ID NO: 905326 - RNA, 17 nt, Homo sapiens
accaggccugagcaaca

SEQ ID NO: 905327 - RNA, 11 nt, Homo sapiens
accagggaugg

SEQ ID NO: 905328 - RNA, 13 nt, Homo sapiens
accagggugcaug

SEQ ID NO: 905329 - RNA, 13 nt, Homo sapiens
accagucacuguc

SEQ ID NO: 905330 - RNA, 21 nt, Homo sapiens
accagugaaagaguagugcau

SEQ ID NO: 905331 - RNA, 17 nt, Homo sapiens
accagugaaccaaagag

SEQ ID NO: 905332 - RNA, 15 nt, Homo sapiens
accaguguacugcuu

SEQ ID NO: 905333 - RNA, 14 nt, Homo sapiens
accaguucuggcca

SEQ ID NO: 905334 - RNA, 13 nt, Homo sapiens
accauauacagcu

SEQ ID NO: 905335 - RNA, 15 nt, Homo sapiens
accaucaaaugcugu

SEQ ID NO: 905336 - RNA, 18 nt, Homo sapiens
accauccuuuacuauuaa

SEQ ID NO: 905337 - RNA, 22 nt, Homo sapiens
accaucuaaucuaugcauguau

SEQ ID NO: 905338 - RNA, 12 nt, Homo sapiens
accaugcauggu

SEQ ID NO: 905339 - RNA, 16 nt, Homo sapiens
accaugcgcugcucaa

SEQ ID NO: 905340 - RNA, 13 nt, Homo sapiens
accauuacuguaa

SEQ ID NO: 905341 - RNA, 17 nt, Homo sapiens
accauugaccucagcug

SEQ ID NO: 905342 - RNA, 21 nt, Homo sapiens
accauuuugggguacccacug

SEQ ID NO: 905343 - RNA, 20 nt, Homo sapiens
acccaaauaaauguguaaau

SEQ ID NO: 905344 - RNA, 14 nt, Homo sapiens
acccaaguccaggc

SEQ ID NO: 905345 - RNA, 21 nt, Homo sapiens
acccacaugugacacauaugc

SEQ ID NO: 905346 - RNA, 11 nt, Homo sapiens
acccaccaucu

SEQ ID NO: 905347 - RNA, 18 nt, Homo sapiens
acccacugugcuuacagu

SEQ ID NO: 905348 - RNA, 15 nt, Homo sapiens
acccagaaaucauuu

SEQ ID NO: 905349 - RNA, 13 nt, Homo sapiens
acccagaucucau

SEQ ID NO: 905350 - RNA, 18 nt, Homo sapiens
acccagcaacacagagcu

SEQ ID NO: 905351 - RNA, 15 nt, Homo sapiens
acccagcuacucugu

SEQ ID NO: 905352 - RNA, 12 nt, Homo sapiens
acccaggaugau

SEQ ID NO: 905353 - RNA, 23 nt, Homo sapiens
acccagguuggcgacugcaacag

SEQ ID NO: 905354 - RNA, 19 nt, Homo sapiens
acccaguaacucaucuguc

SEQ ID NO: 905355 - RNA, 22 nt, Homo sapiens
acccaguaacucaucugucacc

SEQ ID NO: 905356 - RNA, 14 nt, Homo sapiens
acccaguauuccau

SEQ ID NO: 905357 - RNA, 20 nt, Homo sapiens
acccaguccuggccauuuuc

SEQ ID NO: 905358 - RNA, 20 nt, Homo sapiens
acccagugcugccaugccac

SEQ ID NO: 905359 - RNA, 13 nt, Homo sapiens
acccaguguaaag

SEQ ID NO: 905360 - RNA, 14 nt, Homo sapiens
acccaguguagcau

SEQ ID NO: 905361 - RNA, 22 nt, Homo sapiens
acccauccuaccaaugcaugca

SEQ ID NO: 905362 - RNA, 17 nt, Homo sapiens
acccaugaaucaaagac

SEQ ID NO: 905363 - RNA, 17 nt, Homo sapiens
acccaugcccagcugua

SEQ ID NO: 905364 - RNA, 20 nt, Homo sapiens
acccauucguggugaucaau

SEQ ID NO: 905365 - RNA, 13 nt, Homo sapiens
accccaacauuga

SEQ ID NO: 905366 - RNA, 21 nt, Homo sapiens
accccacauuggacuuccuug

SEQ ID NO: 905367 - RNA, 17 nt, Homo sapiens
accccaccuugccaagc

SEQ ID NO: 905368 - RNA, 15 nt, Homo sapiens
accccaggcauccca

SEQ ID NO: 905369 - RNA, 21 nt, Homo sapiens
accccaggcaucccaucccuu

SEQ ID NO: 905370 - RNA, 11 nt, Homo sapiens
accccaucuca

SEQ ID NO: 905371 - RNA, 12 nt, Homo sapiens
accccaucucau

SEQ ID NO: 905372 - RNA, 20 nt, Homo sapiens
acccccccuccugcugccua

SEQ ID NO: 905373 - RNA, 11 nt, Homo sapiens
acccccggggc

SEQ ID NO: 905374 - RNA, 17 nt, Homo sapiens
accccgcggugcucugg

SEQ ID NO: 905375 - RNA, 12 nt, Homo sapiens
accccgugccac

SEQ ID NO: 905376 - RNA, 17 nt, Homo sapiens
accccuguuaagcaauu

SEQ ID NO: 905377 - RNA, 12 nt, Homo sapiens
accccuuuccac

SEQ ID NO: 905378 - RNA, 21 nt, Homo sapiens
acccgagaaaacaaacccagg

SEQ ID NO: 905379 - RNA, 13 nt, Homo sapiens
acccgcucucuca

SEQ ID NO: 905380 - RNA, 19 nt, Homo sapiens
acccguuuuauucuauucc

SEQ ID NO: 905381 - RNA, 20 nt, Homo sapiens
acccuaauaaguccacaucu

SEQ ID NO: 905382 - RNA, 18 nt, Homo sapiens
acccuaaugcuaguuuca

SEQ ID NO: 905383 - RNA, 20 nt, Homo sapiens
acccuacuucuuuugcucuu

SEQ ID NO: 905384 - RNA, 15 nt, Homo sapiens
acccucacaucagag

SEQ ID NO: 905385 - RNA, 22 nt, Homo sapiens
acccuccccugucuucucucaa

SEQ ID NO: 905386 - RNA, 22 nt, Homo sapiens
acccuccuggggcucucagugu

SEQ ID NO: 905387 - RNA, 17 nt, Homo sapiens
acccugagguccugcau

SEQ ID NO: 905388 - RNA, 18 nt, Homo sapiens
acccugccccugccuuga

SEQ ID NO: 905389 - RNA, 15 nt, Homo sapiens
acccugcgauuuugc

SEQ ID NO: 905390 - RNA, 16 nt, Homo sapiens
acccugcgauuuugcc

SEQ ID NO: 905391 - RNA, 17 nt, Homo sapiens
acccugcucuccgacca

SEQ ID NO: 905392 - RNA, 14 nt, Homo sapiens
acccugggugccau

SEQ ID NO: 905393 - RNA, 20 nt, Homo sapiens
acccugucucuacuaaaaau

SEQ ID NO: 905394 - RNA, 13 nt, Homo sapiens
acccugugcucaa

SEQ ID NO: 905395 - RNA, 14 nt, Homo sapiens
acccuguuuuacaa

SEQ ID NO: 905396 - RNA, 21 nt, Homo sapiens
acccuucccaaucagcacuga

SEQ ID NO: 905397 - RNA, 22 nt, Homo sapiens
acccuucugcuguauacuguac

SEQ ID NO: 905398 - RNA, 19 nt, Homo sapiens
accgcuggggaacagagcg

SEQ ID NO: 905399 - RNA, 14 nt, Homo sapiens
accgcuugccauau

SEQ ID NO: 905400 - RNA, 15 nt, Homo sapiens
accggcuacaucaaa

SEQ ID NO: 905401 - RNA, 12 nt, Homo sapiens
accggggaaccc

SEQ ID NO: 905402 - RNA, 15 nt, Homo sapiens
accgugaccaggaac

SEQ ID NO: 905403 - RNA, 17 nt, Homo sapiens
accgugcaugugcaguc

SEQ ID NO: 905404 - RNA, 14 nt, Homo sapiens
accguggaccuucc

SEQ ID NO: 905405 - RNA, 22 nt, Homo sapiens
accuaaaaacauuuacugacca

SEQ ID NO: 905406 - RNA, 21 nt, Homo sapiens
accuaagacuauguugguacu

SEQ ID NO: 905407 - RNA, 17 nt, Homo sapiens
accuaagcaaaaccacu

SEQ ID NO: 905408 - RNA, 18 nt, Homo sapiens
accuacaagguugugccc

SEQ ID NO: 905409 - RNA, 15 nt, Homo sapiens
accuaccacaguguc

SEQ ID NO: 905410 - RNA, 18 nt, Homo sapiens
accuaccaccuucccucu

SEQ ID NO: 905411 - RNA, 21 nt, Homo sapiens
aguaucaggucucccacgugg

SEQ ID NO: 905412 - RNA, 19 nt, Homo sapiens
aguaucuaaagccaguggc

SEQ ID NO: 905413 - RNA, 21 nt, Homo sapiens
aguaucuaaagccaguggcag

SEQ ID NO: 905414 - RNA, 17 nt, Homo sapiens
aguaucucucugccuau

SEQ ID NO: 905415 - RNA, 18 nt, Homo sapiens
aguauggcaugaacaucu

SEQ ID NO: 905416 - RNA, 20 nt, Homo sapiens
aguauuaagugacagugcua

SEQ ID NO: 905417 - RNA, 18 nt, Homo sapiens
aguauuauugagcucuau

SEQ ID NO: 905418 - RNA, 22 nt, Homo sapiens
aguauucuaaagcuuucugaca

SEQ ID NO: 905419 - RNA, 22 nt, Homo sapiens
aguauugcgaaugugcagaaag

SEQ ID NO: 905420 - RNA, 14 nt, Homo sapiens
aguauuggggcccu

SEQ ID NO: 905421 - RNA, 11 nt, Homo sapiens
aguauuuccau

SEQ ID NO: 905422 - RNA, 22 nt, Homo sapiens
agucaaaacagagaugugauaa

SEQ ID NO: 905423 - RNA, 17 nt, Homo sapiens
agucaaaaggugccugu

SEQ ID NO: 905424 - RNA, 17 nt, Homo sapiens
agucaacaaccaugcca

SEQ ID NO: 905425 - RNA, 23 nt, Homo sapiens
agucaauccccucauucaggaaa

SEQ ID NO: 905426 - RNA, 13 nt, Homo sapiens
agucacaccaucu

SEQ ID NO: 905427 - RNA, 19 nt, Homo sapiens
agucacauggccuaugcac

SEQ ID NO: 905428 - RNA, 21 nt, Homo sapiens
agucaccacuccauucccaac

SEQ ID NO: 905429 - RNA, 13 nt, Homo sapiens
agucaccaggaau

SEQ ID NO: 905430 - RNA, 16 nt, Homo sapiens
agucacccuucugggc

SEQ ID NO: 905431 - RNA, 23 nt, Homo sapiens
agucaccuccuccacucacucca

SEQ ID NO: 905432 - RNA, 20 nt, Homo sapiens
agucagacuuacuuacuccc

SEQ ID NO: 905433 - RNA, 15 nt, Homo sapiens
agucaguaguauucu

SEQ ID NO: 905434 - RNA, 20 nt, Homo sapiens
agucauggcccaaauccagu

SEQ ID NO: 905435 - RNA, 14 nt, Homo sapiens
agucauucugggaa

SEQ ID NO: 905436 - RNA, 21 nt, Homo sapiens
agucauuggguuuuaucagug

SEQ ID NO: 905437 - RNA, 19 nt, Homo sapiens
agucauuugcugagcaugu

SEQ ID NO: 905438 - RNA, 21 nt, Homo sapiens
agucauuugcugagcauguac

SEQ ID NO: 905439 - RNA, 15 nt, Homo sapiens
aguccaacaauguug

SEQ ID NO: 905440 - RNA, 20 nt, Homo sapiens
aguccacaucuucucagugu

SEQ ID NO: 905441 - RNA, 14 nt, Homo sapiens
aguccauauuucaa

SEQ ID NO: 905442 - RNA, 12 nt, Homo sapiens
aguccauuuuaa

SEQ ID NO: 905443 - RNA, 19 nt, Homo sapiens
aguccgccaaacacuccac

SEQ ID NO: 905444 - RNA, 17 nt, Homo sapiens
aguccuacaagcuaaaa

SEQ ID NO: 905445 - RNA, 11 nt, Homo sapiens
aguccuggaag

SEQ ID NO: 905446 - RNA, 22 nt, Homo sapiens
aguccuuuacuaauccaaccca

SEQ ID NO: 905447 - RNA, 20 nt, Homo sapiens
aguccuuugggauucuagga

SEQ ID NO: 905448 - RNA, 23 nt, Homo sapiens
agucgaggacagggaggugaccc

SEQ ID NO: 905449 - RNA, 13 nt, Homo sapiens
agucguaaggguu

SEQ ID NO: 905450 - RNA, 13 nt, Homo sapiens
agucuaaaacaca

SEQ ID NO: 905451 - RNA, 23 nt, Homo sapiens
agucuaucaaccccagacacugg

SEQ ID NO: 905452 - RNA, 16 nt, Homo sapiens
agucucacucugucac

SEQ ID NO: 905453 - RNA, 22 nt, Homo sapiens
agucucagagacuauuuagaca

SEQ ID NO: 905454 - RNA, 16 nt, Homo sapiens
agucucaggaaaucaa

SEQ ID NO: 905455 - RNA, 12 nt, Homo sapiens
agucuccagugg

SEQ ID NO: 905456 - RNA, 16 nt, Homo sapiens
agucuccccuauguaa

SEQ ID NO: 905457 - RNA, 17 nt, Homo sapiens
agucuccuuugcacuga

SEQ ID NO: 905458 - RNA, 21 nt, Homo sapiens
agucucugugcuuugacucac

SEQ ID NO: 905459 - RNA, 21 nt, Homo sapiens
agucugaaagacagaauguca

SEQ ID NO: 905460 - RNA, 15 nt, Homo sapiens
agucugaguaaaauc

SEQ ID NO: 905461 - RNA, 14 nt, Homo sapiens
agucugaugacaca

SEQ ID NO: 905462 - RNA, 17 nt, Homo sapiens
agucugcauaaacuuca

SEQ ID NO: 905463 - RNA, 17 nt, Homo sapiens
agucuugaaacaagcaa

SEQ ID NO: 905464 - RNA, 14 nt, Homo sapiens
agucuuggcucacu

SEQ ID NO: 905465 - RNA, 12 nt, Homo sapiens
agucuugucuca

SEQ ID NO: 905466 - RNA, 22 nt, Homo sapiens
agucuuuccgucucccuaaaau

SEQ ID NO: 905467 - RNA, 20 nt, Homo sapiens
agugaaagcaucacuuggga

SEQ ID NO: 905468 - RNA, 13 nt, Homo sapiens
agugaacacacuc

SEQ ID NO: 905469 - RNA, 20 nt, Homo sapiens
agugaagaugccagugaaac

SEQ ID NO: 905470 - RNA, 15 nt, Homo sapiens
agugaaggagccagu

SEQ ID NO: 905471 - RNA, 21 nt, Homo sapiens
agugaaguucuuuuacuguaa

SEQ ID NO: 905472 - RNA, 18 nt, Homo sapiens
agugaauaguaacaauaa

SEQ ID NO: 905473 - RNA, 22 nt, Homo sapiens
agugacagagacccagaucuca

SEQ ID NO: 905474 - RNA, 22 nt, Homo sapiens
agugacauauauauguauauac

SEQ ID NO: 905475 - RNA, 20 nt, Homo sapiens
agugaccccagccuccugcc

SEQ ID NO: 905476 - RNA, 17 nt, Homo sapiens
agugagaaaaagcuccu

SEQ ID NO: 905477 - RNA, 13 nt, Homo sapiens
agugagaaacuga

SEQ ID NO: 905478 - RNA, 20 nt, Homo sapiens
agugagacccccaucucuac

SEQ ID NO: 905479 - RNA, 22 nt, Homo sapiens
agugagacccccaucucuacaa

SEQ ID NO: 905480 - RNA, 18 nt, Homo sapiens
agugagacuccgucucaa

SEQ ID NO: 905481 - RNA, 20 nt, Homo sapiens
agugagagagagaauaagga

SEQ ID NO: 905482 - RNA, 15 nt, Homo sapiens
agugagaucuuacag

SEQ ID NO: 905483 - RNA, 22 nt, Homo sapiens
agugagccugaauuuuguugcu

SEQ ID NO: 905484 - RNA, 15 nt, Homo sapiens
agugagcugauauca

SEQ ID NO: 905485 - RNA, 19 nt, Homo sapiens
agugagucgaggacaggga

SEQ ID NO: 905486 - RNA, 21 nt, Homo sapiens
agugauugacacacagcacuc

SEQ ID NO: 905487 - RNA, 23 nt, Homo sapiens
agugauugugucugcauuguuau

SEQ ID NO: 905488 - RNA, 19 nt, Homo sapiens
agugcaaccacacaccuca

SEQ ID NO: 905489 - RNA, 20 nt, Homo sapiens
agugcacacggaugcacaga

SEQ ID NO: 905490 - RNA, 23 nt, Homo sapiens
agugcacacggaugcacagagau

SEQ ID NO: 905491 - RNA, 19 nt, Homo sapiens
agugcacuugcuggaagac

SEQ ID NO: 905492 - RNA, 14 nt, Homo sapiens
agugcaguggugca

SEQ ID NO: 905493 - RNA, 17 nt, Homo sapiens
agugcauccuugaacug

SEQ ID NO: 905494 - RNA, 20 nt, Homo sapiens
agugccaauauuucugauau

SEQ ID NO: 905495 - RNA, 12 nt, Homo sapiens
agugccaggacu

SEQ ID NO: 905496 - RNA, 15 nt, Homo sapiens
agugcccagcaugaa

SEQ ID NO: 905497 - RNA, 16 nt, Homo sapiens
agugccguaacaacug

SEQ ID NO: 905498 - RNA, 21 nt, Homo sapiens
agugccguaacaacugugguc

SEQ ID NO: 905499 - RNA, 18 nt, Homo sapiens
agugccuggcaaggccuc

SEQ ID NO: 905500 - RNA, 13 nt, Homo sapiens
agugcuaccucuc

SEQ ID NO: 905501 - RNA, 16 nt, Homo sapiens
agugcuuccacuucua

SEQ ID NO: 905502 - RNA, 18 nt, Homo sapiens
agugcuugccaccaccag

SEQ ID NO: 905503 - RNA, 22 nt, Homo sapiens
agugcuugccaccaccagauga

SEQ ID NO: 905504 - RNA, 14 nt, Homo sapiens
aguggaacagucac

SEQ ID NO: 905505 - RNA, 17 nt, Homo sapiens
aguggaugcauuccuga

SEQ ID NO: 905506 - RNA, 19 nt, Homo sapiens
aguggcauucacaucucau

SEQ ID NO: 905507 - RNA, 23 nt, Homo sapiens
aguggcucacgccuguaauccca

SEQ ID NO: 905508 - RNA, 17 nt, Homo sapiens
aguggcuucugggagau

SEQ ID NO: 905509 - RNA, 21 nt, Homo sapiens
aguggcuugugauucugggau

SEQ ID NO: 905510 - RNA, 15 nt, Homo sapiens
agugggaacucugac

SEQ ID NO: 905511 - RNA, 14 nt, Homo sapiens
agugggacccauag

SEQ ID NO: 905512 - RNA, 19 nt, Homo sapiens
agugggaggugagaccacc

SEQ ID NO: 905513 - RNA, 22 nt, Homo sapiens
aguggggacggaaggcaaagag

SEQ ID NO: 905514 - RNA, 15 nt, Homo sapiens
agugguaccagcuca

SEQ ID NO: 905515 - RNA, 15 nt, Homo sapiens
aguggucgcuuacuu

SEQ ID NO: 905516 - RNA, 18 nt, Homo sapiens
aguguaauugagaaggaa

SEQ ID NO: 905517 - RNA, 22 nt, Homo sapiens
aguguaccgcgucuacccuggg

SEQ ID NO: 905518 - RNA, 22 nt, Homo sapiens
aguguauuuuuguuuaaucaaa

SEQ ID NO: 905519 - RNA, 19 nt, Homo sapiens
aguguccccuccacuguca

SEQ ID NO: 905520 - RNA, 15 nt, Homo sapiens
agugugcuugucauc

SEQ ID NO: 905521 - RNA, 16 nt, Homo sapiens
agugugucacacugag

SEQ ID NO: 905522 - RNA, 17 nt, Homo sapiens
aguguuaucagucauaa

SEQ ID NO: 905523 - RNA, 17 nt, Homo sapiens
aguguuccucaccaaua

SEQ ID NO: 905524 - RNA, 20 nt, Homo sapiens
aguguuggaaaaugugcaau

SEQ ID NO: 905525 - RNA, 19 nt, Homo sapiens
auaucugagaaguguauau

SEQ ID NO: 905526 - RNA, 15 nt, Homo sapiens
auaucuguggucuuc

SEQ ID NO: 905527 - RNA, 15 nt, Homo sapiens
auaucuugaaacaua

SEQ ID NO: 905528 - RNA, 15 nt, Homo sapiens
auaugaaacauuuaa

SEQ ID NO: 905529 - RNA, 18 nt, Homo sapiens
auaugaauuuacuacuuu

SEQ ID NO: 905530 - RNA, 14 nt, Homo sapiens
auaugaguauacaa

SEQ ID NO: 905531 - RNA, 16 nt, Homo sapiens
auaugaucuaauacaa

SEQ ID NO: 905532 - RNA, 14 nt, Homo sapiens
auaugcagugauau

SEQ ID NO: 905533 - RNA, 15 nt, Homo sapiens
auaugcagugauaua

SEQ ID NO: 905534 - RNA, 19 nt, Homo sapiens
auaugcuacaguacuaugu

SEQ ID NO: 905535 - RNA, 16 nt, Homo sapiens
auaugcuuuacaaucu

SEQ ID NO: 905536 - RNA, 21 nt, Homo sapiens
auauggacucugcacaugaau

SEQ ID NO: 905537 - RNA, 18 nt, Homo sapiens
auaugggacugagccugg

SEQ ID NO: 905538 - RNA, 21 nt, Homo sapiens
auaugguagcaacacugugaa

SEQ ID NO: 905539 - RNA, 16 nt, Homo sapiens
auauggugggcacaga

SEQ ID NO: 905540 - RNA, 22 nt, Homo sapiens
auauguaggugucugcacccag

SEQ ID NO: 905541 - RNA, 17 nt, Homo sapiens
auauguauuuugucaua

SEQ ID NO: 905542 - RNA, 16 nt, Homo sapiens
auauguauuuuuguca

SEQ ID NO: 905543 - RNA, 17 nt, Homo sapiens
auauguguauauauaca

SEQ ID NO: 905544 - RNA, 23 nt, Homo sapiens
auauuaauuuguuuuucuuaucc

SEQ ID NO: 905545 - RNA, 12 nt, Homo sapiens
auauuacuuguu

SEQ ID NO: 905546 - RNA, 21 nt, Homo sapiens
auauuacuuguuuucacuuua

SEQ ID NO: 905547 - RNA, 23 nt, Homo sapiens
auauuacuuguuuucacuuuauc

SEQ ID NO: 905548 - RNA, 16 nt, Homo sapiens
auauucaaggaucuca

SEQ ID NO: 905549 - RNA, 20 nt, Homo sapiens
auauucaaggaucucaaaga

SEQ ID NO: 905550 - RNA, 17 nt, Homo sapiens
auauuccaccauucaca

SEQ ID NO: 905551 - RNA, 18 nt, Homo sapiens
auauuccugcauuuguga

SEQ ID NO: 905552 - RNA, 21 nt, Homo sapiens
auauucuacauauauguauau

SEQ ID NO: 905553 - RNA, 22 nt, Homo sapiens
auauucuuuaaauuucaucuca

SEQ ID NO: 905554 - RNA, 15 nt, Homo sapiens
auauugcugugagau

SEQ ID NO: 905555 - RNA, 18 nt, Homo sapiens
auauugcugugagauugc

SEQ ID NO: 905556 - RNA, 18 nt, Homo sapiens
auauuuaauugugucaua

SEQ ID NO: 905557 - RNA, 16 nt, Homo sapiens
auauuuauaacucauc

SEQ ID NO: 905558 - RNA, 19 nt, Homo sapiens
auauuuauggggggagaac

SEQ ID NO: 905559 - RNA, 17 nt, Homo sapiens
auauuuauucaucuggg

SEQ ID NO: 905560 - RNA, 22 nt, Homo sapiens
auauuucagauaucagaaucau

SEQ ID NO: 905561 - RNA, 13 nt, Homo sapiens
auauuucaggcau

SEQ ID NO: 905562 - RNA, 14 nt, Homo sapiens
auauuucaggcaua

SEQ ID NO: 905563 - RNA, 20 nt, Homo sapiens
auauuucaggcauacugaca

SEQ ID NO: 905564 - RNA, 16 nt, Homo sapiens
auauuucccaauacau

SEQ ID NO: 905565 - RNA, 17 nt, Homo sapiens
auauuuguguaugugua

SEQ ID NO: 905566 - RNA, 16 nt, Homo sapiens
auauuuucacaggugu

SEQ ID NO: 905567 - RNA, 13 nt, Homo sapiens
auauuuucacaug

SEQ ID NO: 905568 - RNA, 15 nt, Homo sapiens
auauuuuguguauaa

SEQ ID NO: 905569 - RNA, 19 nt, Homo sapiens
auauuuuugguugucaaua

SEQ ID NO: 905570 - RNA, 19 nt, Homo sapiens
aucaaaaauauuccaucca

SEQ ID NO: 905571 - RNA, 14 nt, Homo sapiens
aucaaaacucuccu

SEQ ID NO: 905572 - RNA, 17 nt, Homo sapiens
aucaaaaucacuaucuu

SEQ ID NO: 905573 - RNA, 20 nt, Homo sapiens
aucaaaaucuuucagcacuc

SEQ ID NO: 905574 - RNA, 17 nt, Homo sapiens
aucaaaucagucuugga

SEQ ID NO: 905575 - RNA, 12 nt, Homo sapiens
aucaaauuucac

SEQ ID NO: 905576 - RNA, 18 nt, Homo sapiens
aucaaccccagacacugg

SEQ ID NO: 905577 - RNA, 14 nt, Homo sapiens
aucaaguccuacaa

SEQ ID NO: 905578 - RNA, 23 nt, Homo sapiens
aucaauccugcccccagccaugg

SEQ ID NO: 905579 - RNA, 21 nt, Homo sapiens
aucaaugaagauuuuuaauua

SEQ ID NO: 905580 - RNA, 20 nt, Homo sapiens
aucaaugggugguauuugcu

SEQ ID NO: 905581 - RNA, 16 nt, Homo sapiens
aucaaugucacuuaaa

SEQ ID NO: 905582 - RNA, 23 nt, Homo sapiens
aucaauucuauuacgugcaauac

SEQ ID NO: 905583 - RNA, 20 nt, Homo sapiens
aucaauuuuuauacauauca

SEQ ID NO: 905584 - RNA, 22 nt, Homo sapiens
aucacacucauaacucauuguc

SEQ ID NO: 905585 - RNA, 16 nt, Homo sapiens
aucacagcagugcaua

SEQ ID NO: 905586 - RNA, 15 nt, Homo sapiens
aucacauuaucaucu

SEQ ID NO: 905587 - RNA, 21 nt, Homo sapiens
aucacauuauuugcauguuac

SEQ ID NO: 905588 - RNA, 18 nt, Homo sapiens
aucaccaggaugucacau

SEQ ID NO: 905589 - RNA, 17 nt, Homo sapiens
aucacgcagaucacuaa

SEQ ID NO: 905590 - RNA, 17 nt, Homo sapiens
aucacuauaaccaucag

SEQ ID NO: 905591 - RNA, 21 nt, Homo sapiens
aucacuaucuuucugauaaca

SEQ ID NO: 905592 - RNA, 21 nt, Homo sapiens
aucacuggcaauauuuguucu

SEQ ID NO: 905593 - RNA, 16 nt, Homo sapiens
aucacuuuucucugag

SEQ ID NO: 905594 - RNA, 20 nt, Homo sapiens
aucagaccacucccuucccc

SEQ ID NO: 905595 - RNA, 14 nt, Homo sapiens
aucagcacugaaaa

SEQ ID NO: 905596 - RNA, 13 nt, Homo sapiens
aucagcacugccg

SEQ ID NO: 905597 - RNA, 13 nt, Homo sapiens
aucagccacggag

SEQ ID NO: 905598 - RNA, 20 nt, Homo sapiens
aucaggaaaacaaaucacug

SEQ ID NO: 905599 - RNA, 17 nt, Homo sapiens
aucagggaggucauuuu

SEQ ID NO: 905600 - RNA, 16 nt, Homo sapiens
aucagucauaacuaaa

SEQ ID NO: 905601 - RNA, 17 nt, Homo sapiens
aucagugaagaugccag

SEQ ID NO: 905602 - RNA, 22 nt, Homo sapiens
aucagugcacacggaugcacag

SEQ ID NO: 905603 - RNA, 20 nt, Homo sapiens
aucaguguccucuugcucaa

SEQ ID NO: 905604 - RNA, 21 nt, Homo sapiens
aucaguuaacauuaacaucua

SEQ ID NO: 905605 - RNA, 23 nt, Homo sapiens
aucauacuaccggcuacaucaaa

SEQ ID NO: 905606 - RNA, 19 nt, Homo sapiens
aucaucagcauaccuuuau

SEQ ID NO: 905607 - RNA, 15 nt, Homo sapiens
aucaucuuuccuguu

SEQ ID NO: 905608 - RNA, 17 nt, Homo sapiens
aucaugaaaagugcugu

SEQ ID NO: 905609 - RNA, 18 nt, Homo sapiens
aucaugaaaagugcuguu

SEQ ID NO: 905610 - RNA, 12 nt, Homo sapiens
aucaugaauauu

SEQ ID NO: 905611 - RNA, 23 nt, Homo sapiens
aucaugacccacccagugucuuu

SEQ ID NO: 905612 - RNA, 12 nt, Homo sapiens
aucaugagauaa

SEQ ID NO: 905613 - RNA, 20 nt, Homo sapiens
aucaugaguaccucaaagga

SEQ ID NO: 905614 - RNA, 16 nt, Homo sapiens
aucaugcugucuuuac

SEQ ID NO: 905615 - RNA, 15 nt, Homo sapiens
aucauggcuaucugu

SEQ ID NO: 905616 - RNA, 20 nt, Homo sapiens
aucaugggauuuuacuagaa

SEQ ID NO: 905617 - RNA, 13 nt, Homo sapiens
aucaugugccugg

SEQ ID NO: 905618 - RNA, 17 nt, Homo sapiens
aucauguuaauagacag

SEQ ID NO: 905619 - RNA, 21 nt, Homo sapiens
aucauguuuucccuaugagca

SEQ ID NO: 905620 - RNA, 18 nt, Homo sapiens
aucauuucugcaucagcu

SEQ ID NO: 905621 - RNA, 19 nt, Homo sapiens
aucauuuuuaaauauaggu

SEQ ID NO: 905622 - RNA, 16 nt, Homo sapiens
auccaauuaugugaca

SEQ ID NO: 905623 - RNA, 12 nt, Homo sapiens
auccacaagcaa

SEQ ID NO: 905624 - RNA, 18 nt, Homo sapiens
auccacagccaacaaaca

SEQ ID NO: 905625 - RNA, 12 nt, Homo sapiens
auccacaucuaa

SEQ ID NO: 905626 - RNA, 14 nt, Homo sapiens
auccacccaccuca

SEQ ID NO: 905627 - RNA, 18 nt, Homo sapiens
auccacccaccuuggccu

SEQ ID NO: 905628 - RNA, 19 nt, Homo sapiens
auccacgcacacauggaca

SEQ ID NO: 905629 - RNA, 16 nt, Homo sapiens
auccacggagcugaag

SEQ ID NO: 905630 - RNA, 15 nt, Homo sapiens
auccagacccggcug

SEQ ID NO: 905631 - RNA, 21 nt, Homo sapiens
auccaguuucccaccaccuug

SEQ ID NO: 905632 - RNA, 23 nt, Homo sapiens
auccauaacacccccaccccaac

SEQ ID NO: 905633 - RNA, 20 nt, Homo sapiens
auccaugcuuggguguaaca

SEQ ID NO: 905634 - RNA, 16 nt, Homo sapiens
aucccacccaacagcu

SEQ ID NO: 905635 - RNA, 17 nt, Homo sapiens
aucccacccacauguga

SEQ ID NO: 905636 - RNA, 18 nt, Homo sapiens
aucccacuucacugugag

SEQ ID NO: 905637 - RNA, 12 nt, Homo sapiens
aucccagcacuu

SEQ ID NO: 905638 - RNA, 15 nt, Homo sapiens
aucccagcacuuugg

SEQ ID NO: 905639 - RNA, 10 nt, Homo sapiens
augugcaaua

SEQ ID NO: 905640 - RNA, 11 nt, Homo sapiens
augugcaauaa

SEQ ID NO: 905641 - RNA, 11 nt, Homo sapiens
augugcaauau

SEQ ID NO: 905642 - RNA, 13 nt, Homo sapiens
augugccuggaaa

SEQ ID NO: 905643 - RNA, 17 nt, Homo sapiens
augugcgcacacacaga

SEQ ID NO: 905644 - RNA, 23 nt, Homo sapiens
augugcgcacacacagauaugca

SEQ ID NO: 905645 - RNA, 19 nt, Homo sapiens
augugcgugcauguguaua

SEQ ID NO: 905646 - RNA, 17 nt, Homo sapiens
auguggauuagcuagaa

SEQ ID NO: 905647 - RNA, 22 nt, Homo sapiens
auguggccuaaaaaugcaacuu

SEQ ID NO: 905648 - RNA, 13 nt, Homo sapiens
augugggacaccu

SEQ ID NO: 905649 - RNA, 15 nt, Homo sapiens
augugggcguuugua

SEQ ID NO: 905650 - RNA, 19 nt, Homo sapiens
augugggucaaggaauuaa

SEQ ID NO: 905651 - RNA, 14 nt, Homo sapiens
augugguagccuca

SEQ ID NO: 905652 - RNA, 15 nt, Homo sapiens
augugguagccucac

SEQ ID NO: 905653 - RNA, 19 nt, Homo sapiens
auguguaagcauuguauac

SEQ ID NO: 905654 - RNA, 16 nt, Homo sapiens
augugugucugaagac

SEQ ID NO: 905655 - RNA, 20 nt, Homo sapiens
auguguguuguccuucagca

SEQ ID NO: 905656 - RNA, 14 nt, Homo sapiens
auguguugugauag

SEQ ID NO: 905657 - RNA, 12 nt, Homo sapiens
auguguuuacuu

SEQ ID NO: 905658 - RNA, 22 nt, Homo sapiens
auguuaaaaaaauaagaagaau

SEQ ID NO: 905659 - RNA, 16 nt, Homo sapiens
auguuaaagcaucaga

SEQ ID NO: 905660 - RNA, 18 nt, Homo sapiens
auguuaagcucuuuauga

SEQ ID NO: 905661 - RNA, 18 nt, Homo sapiens
auguuacuacaugcacuu

SEQ ID NO: 905662 - RNA, 21 nt, Homo sapiens
auguuacucaugacuccuuuc

SEQ ID NO: 905663 - RNA, 23 nt, Homo sapiens
auguuaugugacuaucuuuauga

SEQ ID NO: 905664 - RNA, 14 nt, Homo sapiens
auguucauuaaauu

SEQ ID NO: 905665 - RNA, 14 nt, Homo sapiens
auguucuagugauu

SEQ ID NO: 905666 - RNA, 17 nt, Homo sapiens
auguucucugaggacac

SEQ ID NO: 905667 - RNA, 16 nt, Homo sapiens
auguugagcugaguuc

SEQ ID NO: 905668 - RNA, 19 nt, Homo sapiens
auguugccaccuguuaaaa

SEQ ID NO: 905669 - RNA, 12 nt, Homo sapiens
auguugcuuaga

SEQ ID NO: 905670 - RNA, 21 nt, Homo sapiens
auguuguuccuuuugaaagaa

SEQ ID NO: 905671 - RNA, 16 nt, Homo sapiens
auguuguuugggagag

SEQ ID NO: 905672 - RNA, 12 nt, Homo sapiens
auguuuacuucu

SEQ ID NO: 905673 - RNA, 20 nt, Homo sapiens
auguuucacauaaaaccuca

SEQ ID NO: 905674 - RNA, 22 nt, Homo sapiens
auguuucauguuuugugacuau

SEQ ID NO: 905675 - RNA, 15 nt, Homo sapiens
auguuucauuuucau

SEQ ID NO: 905676 - RNA, 19 nt, Homo sapiens
auguuugaucacacagcca

SEQ ID NO: 905677 - RNA, 11 nt, Homo sapiens
auguuugcacu

SEQ ID NO: 905678 - RNA, 15 nt, Homo sapiens
auguuugcacuuugu

SEQ ID NO: 905679 - RNA, 13 nt, Homo sapiens
auguuuugcccac

SEQ ID NO: 905680 - RNA, 22 nt, Homo sapiens
auguuuugucccauuuccuugg

SEQ ID NO: 905681 - RNA, 19 nt, Homo sapiens
auguuuuuaugauaucccu

SEQ ID NO: 905682 - RNA, 21 nt, Homo sapiens
auguuuuuuauccccaaacac

SEQ ID NO: 905683 - RNA, 21 nt, Homo sapiens
auuaaacaagugcacuugaac

SEQ ID NO: 905684 - RNA, 12 nt, Homo sapiens
auuaaacacugu

SEQ ID NO: 905685 - RNA, 20 nt, Homo sapiens
auuaaacagacuuuagcuua

SEQ ID NO: 905686 - RNA, 15 nt, Homo sapiens
auuaaacagccaaau

SEQ ID NO: 905687 - RNA, 13 nt, Homo sapiens
auuaaagugccau

SEQ ID NO: 905688 - RNA, 14 nt, Homo sapiens
auuaaaguguuaua

SEQ ID NO: 905689 - RNA, 17 nt, Homo sapiens
auuaaauacagacacua

SEQ ID NO: 905690 - RNA, 19 nt, Homo sapiens
auuaaaugcauguccucaa

SEQ ID NO: 905691 - RNA, 21 nt, Homo sapiens
auuaacaaaauauucuguaag

SEQ ID NO: 905692 - RNA, 20 nt, Homo sapiens
auuaaccugaauuauuccaa

SEQ ID NO: 905693 - RNA, 17 nt, Homo sapiens
auuaacgggcauguauu

SEQ ID NO: 905694 - RNA, 18 nt, Homo sapiens
auuaacuuugaccagagu

SEQ ID NO: 905695 - RNA, 13 nt, Homo sapiens
auuaagacuuuaa

SEQ ID NO: 905696 - RNA, 19 nt, Homo sapiens
auuaagggaauaagccaug

SEQ ID NO: 905697 - RNA, 11 nt, Homo sapiens
auuaauaugcu

SEQ ID NO: 905698 - RNA, 18 nt, Homo sapiens
auuaauaugcuacaguac

SEQ ID NO: 905699 - RNA, 24 nt, Homo sapiens
auuaauaugcuacaguacuaugua

SEQ ID NO: 905700 - RNA, 20 nt, Homo sapiens
auuaauauggggaugcagca

SEQ ID NO: 905701 - RNA, 13 nt, Homo sapiens
auuaauauuugcu

SEQ ID NO: 905702 - RNA, 22 nt, Homo sapiens
auuaaugacaaaggcacugagg

SEQ ID NO: 905703 - RNA, 20 nt, Homo sapiens
auuaauuagauuuucuugca

SEQ ID NO: 905704 - RNA, 16 nt, Homo sapiens
auuacaacuagaucaa

SEQ ID NO: 905705 - RNA, 17 nt, Homo sapiens
auuacaacuagaucaag

SEQ ID NO: 905706 - RNA, 17 nt, Homo sapiens
auuacacuuugaaguau

SEQ ID NO: 905707 - RNA, 15 nt, Homo sapiens
auuacaguagugcau

SEQ ID NO: 905708 - RNA, 17 nt, Homo sapiens
auuacauggcugugguu

SEQ ID NO: 905709 - RNA, 19 nt, Homo sapiens
auuacgugcaauacuucaa

SEQ ID NO: 905710 - RNA, 20 nt, Homo sapiens
auuacugcaugcacuucuua

SEQ ID NO: 905711 - RNA, 15 nt, Homo sapiens
auuacuucagggcug

SEQ ID NO: 905712 - RNA, 21 nt, Homo sapiens
auuagaggaagaaaaccagcg

SEQ ID NO: 905713 - RNA, 18 nt, Homo sapiens
auuagaggucuccaaaau

SEQ ID NO: 905714 - RNA, 21 nt, Homo sapiens
auuagcuagaaugcacaccaa

SEQ ID NO: 905715 - RNA, 15 nt, Homo sapiens
auuagcucuggacca

SEQ ID NO: 905716 - RNA, 20 nt, Homo sapiens
auuaggaucuaugcaauuuu

SEQ ID NO: 905717 - RNA, 14 nt, Homo sapiens
auuaggcaugccua

SEQ ID NO: 905718 - RNA, 23 nt, Homo sapiens
auuaggcuuuuaagaaacacagg

SEQ ID NO: 905719 - RNA, 14 nt, Homo sapiens
auuaguauccuguu

SEQ ID NO: 905720 - RNA, 18 nt, Homo sapiens
auuauaaauaaaugccaa

SEQ ID NO: 905721 - RNA, 19 nt, Homo sapiens
auuauagauuuucauguuc

SEQ ID NO: 905722 - RNA, 20 nt, Homo sapiens
auuauauauuccgcacucaa

SEQ ID NO: 905723 - RNA, 16 nt, Homo sapiens
auuauaucauggcauu

SEQ ID NO: 905724 - RNA, 16 nt, Homo sapiens
auuauaucuucaggac

SEQ ID NO: 905725 - RNA, 17 nt, Homo sapiens
auuaucacaucaagcau

SEQ ID NO: 905726 - RNA, 16 nt, Homo sapiens
auuaucacgcagauca

SEQ ID NO: 905727 - RNA, 18 nt, Homo sapiens
auuaucgggaacaguguu

SEQ ID NO: 905728 - RNA, 14 nt, Homo sapiens
auuaugacaguuau

SEQ ID NO: 905729 - RNA, 20 nt, Homo sapiens
auuaugcacuggccacccaa

SEQ ID NO: 905730 - RNA, 12 nt, Homo sapiens
auuauguacaaa

SEQ ID NO: 905731 - RNA, 15 nt, Homo sapiens
auuauucccauucua

SEQ ID NO: 905732 - RNA, 15 nt, Homo sapiens
auuauuccuccagga

SEQ ID NO: 905733 - RNA, 21 nt, Homo sapiens
auuauucugauuccacuuuua

SEQ ID NO: 905734 - RNA, 15 nt, Homo sapiens
auuauugugccucag

SEQ ID NO: 905735 - RNA, 17 nt, Homo sapiens
auuauuguugcauuaaa

SEQ ID NO: 905736 - RNA, 17 nt, Homo sapiens
auuauuuuagucuguca

SEQ ID NO: 905737 - RNA, 20 nt, Homo sapiens
auucaaaagguuauauacca

SEQ ID NO: 905738 - RNA, 19 nt, Homo sapiens
auucaaaguuuguggcaua

SEQ ID NO: 905739 - RNA, 19 nt, Homo sapiens
auucaaccugugucuuaua

SEQ ID NO: 905740 - RNA, 22 nt, Homo sapiens
auucaaguugcuucucauggau

SEQ ID NO: 905741 - RNA, 21 nt, Homo sapiens
auucacaauagaaacucacca

SEQ ID NO: 905742 - RNA, 20 nt, Homo sapiens
auucacacaccccucaaaaa

SEQ ID NO: 905743 - RNA, 13 nt, Homo sapiens
auucacaccucac

SEQ ID NO: 905744 - RNA, 14 nt, Homo sapiens
auucacagccagga

SEQ ID NO: 905745 - RNA, 13 nt, Homo sapiens
auucacaucucau

SEQ ID NO: 905746 - RNA, 15 nt, Homo sapiens
auucacaucucaugu

SEQ ID NO: 905747 - RNA, 18 nt, Homo sapiens
auucacuagaccagaagu

SEQ ID NO: 905748 - RNA, 11 nt, Homo sapiens
auucacuuccc

SEQ ID NO: 905749 - RNA, 15 nt, Homo sapiens
auucagaccagugaa

SEQ ID NO: 905750 - RNA, 17 nt, Homo sapiens
auucagcauuauuccuc

SEQ ID NO: 905751 - RNA, 21 nt, Homo sapiens
auucaggacuuaacggcucca

SEQ ID NO: 905752 - RNA, 21 nt, Homo sapiens
auucaggcagcacugacaaua

SEQ ID NO: 905753 - RNA, 14 nt, Homo sapiens
auucagugguccug

SEQ ID NO: 905754 - RNA, 15 nt, Homo sapiens
caacauuuauuucaa

SEQ ID NO: 905755 - RNA, 15 nt, Homo sapiens
caaccacacaccuca

SEQ ID NO: 905756 - RNA, 14 nt, Homo sapiens
caacccaaccucau

SEQ ID NO: 905757 - RNA, 14 nt, Homo sapiens
caaccccaccacuu

SEQ ID NO: 905758 - RNA, 16 nt, Homo sapiens
caaccccagacacugg

SEQ ID NO: 905759 - RNA, 17 nt, Homo sapiens
caaccccccaccugcca

SEQ ID NO: 905760 - RNA, 18 nt, Homo sapiens
caacccccgacuucaucc

SEQ ID NO: 905761 - RNA, 22 nt, Homo sapiens
caaccccuguacccagcuccuu

SEQ ID NO: 905762 - RNA, 20 nt, Homo sapiens
caaccccuucgcuccugugu

SEQ ID NO: 905763 - RNA, 14 nt, Homo sapiens
caaccccuuuccac

SEQ ID NO: 905764 - RNA, 17 nt, Homo sapiens
caaccccuuuccacgag

SEQ ID NO: 905765 - RNA, 23 nt, Homo sapiens
caacccgagaaaacaaacccagg

SEQ ID NO: 905766 - RNA, 17 nt, Homo sapiens
caaccucccaacccaga

SEQ ID NO: 905767 - RNA, 18 nt, Homo sapiens
caaccugccugugcauga

SEQ ID NO: 905768 - RNA, 13 nt, Homo sapiens
caaccugggaugu

SEQ ID NO: 905769 - RNA, 22 nt, Homo sapiens
caaccugggauguagcggugaa

SEQ ID NO: 905770 - RNA, 23 nt, Homo sapiens
caaccuggucacaggacucugcc

SEQ ID NO: 905771 - RNA, 14 nt, Homo sapiens
caaccuuucccuca

SEQ ID NO: 905772 - RNA, 14 nt, Homo sapiens
caacgagagcacuu

SEQ ID NO: 905773 - RNA, 17 nt, Homo sapiens
caacuaccuagacugga

SEQ ID NO: 905774 - RNA, 15 nt, Homo sapiens
caacuaggaccucau

SEQ ID NO: 905775 - RNA, 16 nt, Homo sapiens
caacuccuccuugccu

SEQ ID NO: 905776 - RNA, 18 nt, Homo sapiens
caacuccuggagauuuca

SEQ ID NO: 905777 - RNA, 16 nt, Homo sapiens
caacucugcacuccau

SEQ ID NO: 905778 - RNA, 15 nt, Homo sapiens
caacugacaauauga

SEQ ID NO: 905779 - RNA, 10 nt, Homo sapiens
caacugacca

SEQ ID NO: 905780 - RNA, 21 nt, Homo sapiens
caacugcaucuccaaacauua

SEQ ID NO: 905781 - RNA, 19 nt, Homo sapiens
caacugcugaucaaugaaa

SEQ ID NO: 905782 - RNA, 22 nt, Homo sapiens
caacugcuguucauguuacuca

SEQ ID NO: 905783 - RNA, 14 nt, Homo sapiens
caacuuaacaugaa

SEQ ID NO: 905784 - RNA, 16 nt, Homo sapiens
caacuuaagcugggau

SEQ ID NO: 905785 - RNA, 21 nt, Homo sapiens
caacuucauuugaugcuaaau

SEQ ID NO: 905786 - RNA, 22 nt, Homo sapiens
caacuuccaaauuggauacugc

SEQ ID NO: 905787 - RNA, 21 nt, Homo sapiens
caacuugaaauuauaucugug

SEQ ID NO: 905788 - RNA, 19 nt, Homo sapiens
caacuuggaaaaagaaaga

SEQ ID NO: 905789 - RNA, 22 nt, Homo sapiens
caagaaaaagaaaaaaaaagca

SEQ ID NO: 905790 - RNA, 14 nt, Homo sapiens
caagaaaacuggaa

SEQ ID NO: 905791 - RNA, 22 nt, Homo sapiens
caagaaaagaggaaaaaaagcc

SEQ ID NO: 905792 - RNA, 17 nt, Homo sapiens
caagaaauugccuccuu

SEQ ID NO: 905793 - RNA, 21 nt, Homo sapiens
caagaacuuuucccccaaaga

SEQ ID NO: 905794 - RNA, 14 nt, Homo sapiens
caagaaggggacag

SEQ ID NO: 905795 - RNA, 20 nt, Homo sapiens
caagaauauuguauguuaaa

SEQ ID NO: 905796 - RNA, 18 nt, Homo sapiens
caagaauuguccaugugc

SEQ ID NO: 905797 - RNA, 18 nt, Homo sapiens
caagacacaucccuacaa

SEQ ID NO: 905798 - RNA, 10 nt, Homo sapiens
caagacauag

SEQ ID NO: 905799 - RNA, 20 nt, Homo sapiens
caagacuuggcaacagaagc

SEQ ID NO: 905800 - RNA, 11 nt, Homo sapiens
caagagccaug

SEQ ID NO: 905801 - RNA, 16 nt, Homo sapiens
caagaggacugagacu

SEQ ID NO: 905802 - RNA, 15 nt, Homo sapiens
caagaggucuccauc

SEQ ID NO: 905803 - RNA, 16 nt, Homo sapiens
caagaggucuccauca

SEQ ID NO: 905804 - RNA, 13 nt, Homo sapiens
caagaguauucca

SEQ ID NO: 905805 - RNA, 18 nt, Homo sapiens
caagagugagacuccguc

SEQ ID NO: 905806 - RNA, 19 nt, Homo sapiens
caagaucugaaauaaauga

SEQ ID NO: 905807 - RNA, 16 nt, Homo sapiens
caagauuucacaucag

SEQ ID NO: 905808 - RNA, 21 nt, Homo sapiens
caagcaaaaacaaaugggaaa

SEQ ID NO: 905809 - RNA, 14 nt, Homo sapiens
caagcaaauggaga

SEQ ID NO: 905810 - RNA, 13 nt, Homo sapiens
caagcacaaagcu

SEQ ID NO: 905811 - RNA, 17 nt, Homo sapiens
caagcacaaagcucaag

SEQ ID NO: 905812 - RNA, 18 nt, Homo sapiens
caagcacuaaaaaguggc

SEQ ID NO: 905813 - RNA, 21 nt, Homo sapiens
caagcagagugauucaggggc

SEQ ID NO: 905814 - RNA, 18 nt, Homo sapiens
caagcagcauucagcaca

SEQ ID NO: 905815 - RNA, 20 nt, Homo sapiens
caagcauugcuucagaauga

SEQ ID NO: 905816 - RNA, 15 nt, Homo sapiens
caagcauuuguucca

SEQ ID NO: 905817 - RNA, 15 nt, Homo sapiens
caagccuauugugcc

SEQ ID NO: 905818 - RNA, 21 nt, Homo sapiens
caagccuggucuccucccaaa

SEQ ID NO: 905819 - RNA, 22 nt, Homo sapiens
caagcuaaaauuagaugaacuc

SEQ ID NO: 905820 - RNA, 14 nt, Homo sapiens
caagcuagaaggcc

SEQ ID NO: 905821 - RNA, 16 nt, Homo sapiens
caagcuccucgugaua

SEQ ID NO: 905822 - RNA, 16 nt, Homo sapiens
caagcugaggugccca

SEQ ID NO: 905823 - RNA, 17 nt, Homo sapiens
caagcugagugacugua

SEQ ID NO: 905824 - RNA, 21 nt, Homo sapiens
caagcuggucccacucagucc

SEQ ID NO: 905825 - RNA, 20 nt, Homo sapiens
caagcuuuguauauaaauga

SEQ ID NO: 905826 - RNA, 14 nt, Homo sapiens
caaggaaaauggac

SEQ ID NO: 905827 - RNA, 16 nt, Homo sapiens
caaggaaaauggacau

SEQ ID NO: 905828 - RNA, 21 nt, Homo sapiens
caaggaggucgggauggggcu

SEQ ID NO: 905829 - RNA, 23 nt, Homo sapiens
caaggaguaaguacaaauauucc

SEQ ID NO: 905830 - RNA, 21 nt, Homo sapiens
caagggaaggaagggacacac

SEQ ID NO: 905831 - RNA, 13 nt, Homo sapiens
caagggcagugag

SEQ ID NO: 905832 - RNA, 15 nt, Homo sapiens
caaggggcuuugucc

SEQ ID NO: 905833 - RNA, 19 nt, Homo sapiens
caaggguaugggaagccau

SEQ ID NO: 905834 - RNA, 14 nt, Homo sapiens
caaggucuuugguu

SEQ ID NO: 905835 - RNA, 17 nt, Homo sapiens
caaggugaacaccacuu

SEQ ID NO: 905836 - RNA, 18 nt, Homo sapiens
caagguggggggaucaca

SEQ ID NO: 905837 - RNA, 13 nt, Homo sapiens
caaggugugaaug

SEQ ID NO: 905838 - RNA, 15 nt, Homo sapiens
caagguuauaugcac

SEQ ID NO: 905839 - RNA, 19 nt, Homo sapiens
caaguauguugagaguugc

SEQ ID NO: 905840 - RNA, 18 nt, Homo sapiens
caaguccaagcauaccaa

SEQ ID NO: 905841 - RNA, 16 nt, Homo sapiens
caagugaaaucaaagg

SEQ ID NO: 905842 - RNA, 15 nt, Homo sapiens
caagugccaucccac

SEQ ID NO: 905843 - RNA, 12 nt, Homo sapiens
caaguguuccca

SEQ ID NO: 905844 - RNA, 15 nt, Homo sapiens
caaguuauauugaau

SEQ ID NO: 905845 - RNA, 22 nt, Homo sapiens
caaguuauauugaauauaucag

SEQ ID NO: 905846 - RNA, 16 nt, Homo sapiens
caauaaaaaaaaaccu

SEQ ID NO: 905847 - RNA, 15 nt, Homo sapiens
caauaaaacauuccu

SEQ ID NO: 905848 - RNA, 19 nt, Homo sapiens
caauaaaagugacucucag

SEQ ID NO: 905849 - RNA, 18 nt, Homo sapiens
caauaaacauagcuugua

SEQ ID NO: 905850 - RNA, 22 nt, Homo sapiens
caauaaagaauauuuacaauaa

SEQ ID NO: 905851 - RNA, 15 nt, Homo sapiens
caauaaaucaacucc

SEQ ID NO: 905852 - RNA, 13 nt, Homo sapiens
caauaaauuauuc

SEQ ID NO: 905853 - RNA, 15 nt, Homo sapiens
caauaaauuuugcca

SEQ ID NO: 905854 - RNA, 22 nt, Homo sapiens
caauaauauauccacaucuaag

SEQ ID NO: 905855 - RNA, 21 nt, Homo sapiens
caauaaugugcaaauuuugca

SEQ ID NO: 905856 - RNA, 17 nt, Homo sapiens
caauacaugcugcuaau

SEQ ID NO: 905857 - RNA, 14 nt, Homo sapiens
caauaccaaauagc

SEQ ID NO: 905858 - RNA, 14 nt, Homo sapiens
caauaccagaucac

SEQ ID NO: 905859 - RNA, 18 nt, Homo sapiens
caauaccagaucacucaa

SEQ ID NO: 905860 - RNA, 16 nt, Homo sapiens
caauacuaauugagaa

SEQ ID NO: 905861 - RNA, 15 nt, Homo sapiens
caauacuacuguaaa

SEQ ID NO: 905862 - RNA, 18 nt, Homo sapiens
caauacucaaaagagaga

SEQ ID NO: 905863 - RNA, 20 nt, Homo sapiens
caauagggugcaguuuucca

SEQ ID NO: 905864 - RNA, 16 nt, Homo sapiens
caauauaucaauguaa

SEQ ID NO: 905865 - RNA, 14 nt, Homo sapiens
caauaucuucauac

SEQ ID NO: 905866 - RNA, 22 nt, Homo sapiens
caauaucuuuaauagguuaaua

SEQ ID NO: 905867 - RNA, 21 nt, Homo sapiens
caauaugcuuauucuauccac

SEQ ID NO: 905868 - RNA, 15 nt, Homo sapiens
caauauuuacauuuu

SEQ ID NO: 905869 - RNA, 18 nt, Homo sapiens
cacagaugauaauaugcu

SEQ ID NO: 905870 - RNA, 22 nt, Homo sapiens
cacagaugauuaaacagacuuu

SEQ ID NO: 905871 - RNA, 18 nt, Homo sapiens
cacagauggucacacaga

SEQ ID NO: 905872 - RNA, 15 nt, Homo sapiens
cacagcaguucugca

SEQ ID NO: 905873 - RNA, 13 nt, Homo sapiens
cacagcccaagag

SEQ ID NO: 905874 - RNA, 14 nt, Homo sapiens
cacagcccaagagg

SEQ ID NO: 905875 - RNA, 15 nt, Homo sapiens
cacagccugggacca

SEQ ID NO: 905876 - RNA, 21 nt, Homo sapiens
cacagcggaggagaccagcuc

SEQ ID NO: 905877 - RNA, 15 nt, Homo sapiens
cacagcuaugaaggc

SEQ ID NO: 905878 - RNA, 21 nt, Homo sapiens
cacagcuaugaaggcuguaca

SEQ ID NO: 905879 - RNA, 16 nt, Homo sapiens
cacagcugaacuauuu

SEQ ID NO: 905880 - RNA, 23 nt, Homo sapiens
cacagcugagagacuuuuaauca

SEQ ID NO: 905881 - RNA, 22 nt, Homo sapiens
cacaggaaaccaacacccaaag

SEQ ID NO: 905882 - RNA, 19 nt, Homo sapiens
cacaggaacugggagauaa

SEQ ID NO: 905883 - RNA, 22 nt, Homo sapiens
cacaggagacacugugcuauaa

SEQ ID NO: 905884 - RNA, 14 nt, Homo sapiens
cacaggauuuguaa

SEQ ID NO: 905885 - RNA, 21 nt, Homo sapiens
cacaggauuuguaauuccuua

SEQ ID NO: 905886 - RNA, 23 nt, Homo sapiens
cacaggccuguguagcugugacc

SEQ ID NO: 905887 - RNA, 13 nt, Homo sapiens
cacaggggagcag

SEQ ID NO: 905888 - RNA, 17 nt, Homo sapiens
cacaguacaauguuuca

SEQ ID NO: 905889 - RNA, 20 nt, Homo sapiens
cacaguacaauguuucagaa

SEQ ID NO: 905890 - RNA, 12 nt, Homo sapiens
cacagucauuca

SEQ ID NO: 905891 - RNA, 21 nt, Homo sapiens
cacaguccuaccucaguucaa

SEQ ID NO: 905892 - RNA, 17 nt, Homo sapiens
cacagucucugggagac

SEQ ID NO: 905893 - RNA, 21 nt, Homo sapiens
cacagucucugggagacuuuc

SEQ ID NO: 905894 - RNA, 13 nt, Homo sapiens
cacagugcaucuc

SEQ ID NO: 905895 - RNA, 15 nt, Homo sapiens
cacagugcaucucag

SEQ ID NO: 905896 - RNA, 11 nt, Homo sapiens
cacagugucug

SEQ ID NO: 905897 - RNA, 18 nt, Homo sapiens
cacaguuggcuggaugaa

SEQ ID NO: 905898 - RNA, 20 nt, Homo sapiens
cacauacgugucugugugua

SEQ ID NO: 905899 - RNA, 20 nt, Homo sapiens
cacauacugcaugcucagga

SEQ ID NO: 905900 - RNA, 22 nt, Homo sapiens
cacauaggcaauaucuuuaaua

SEQ ID NO: 905901 - RNA, 14 nt, Homo sapiens
cacauauacauaua

SEQ ID NO: 905902 - RNA, 17 nt, Homo sapiens
cacauauggacucugca

SEQ ID NO: 905903 - RNA, 21 nt, Homo sapiens
cacaucacuacaguacaguga

SEQ ID NO: 905904 - RNA, 14 nt, Homo sapiens
cacaucagugcaca

SEQ ID NO: 905905 - RNA, 22 nt, Homo sapiens
cacauccaaccccccaccugcc

SEQ ID NO: 905906 - RNA, 18 nt, Homo sapiens
cacauccaccccacugga

SEQ ID NO: 905907 - RNA, 13 nt, Homo sapiens
cacauccauuccc

SEQ ID NO: 905908 - RNA, 14 nt, Homo sapiens
cacauccauuccca

SEQ ID NO: 905909 - RNA, 17 nt, Homo sapiens
cacaucccuaacaucau

SEQ ID NO: 905910 - RNA, 16 nt, Homo sapiens
cacauggaugcacaca

SEQ ID NO: 905911 - RNA, 19 nt, Homo sapiens
cacauggccuaugcacaua

SEQ ID NO: 905912 - RNA, 15 nt, Homo sapiens
cacauguaucuaugc

SEQ ID NO: 905913 - RNA, 19 nt, Homo sapiens
cacaugugacacauaugca

SEQ ID NO: 905914 - RNA, 16 nt, Homo sapiens
cacaugugcacaugca

SEQ ID NO: 905915 - RNA, 17 nt, Homo sapiens
cacauuaaguggcuuuu

SEQ ID NO: 905916 - RNA, 13 nt, Homo sapiens
cacauuacaucau

SEQ ID NO: 905917 - RNA, 16 nt, Homo sapiens
cacauuacuugcacaa

SEQ ID NO: 905918 - RNA, 20 nt, Homo sapiens
cacauuaucgggagcagugu

SEQ ID NO: 905919 - RNA, 15 nt, Homo sapiens
cacauugugccuuuu

SEQ ID NO: 905920 - RNA, 24 nt, Homo sapiens
cacauuugauuauauacuauguau

SEQ ID NO: 905921 - RNA, 21 nt, Homo sapiens
caccaaacugcacacacagcu

SEQ ID NO: 905922 - RNA, 13 nt, Homo sapiens
caccaaagcuggc

SEQ ID NO: 905923 - RNA, 20 nt, Homo sapiens
caccaaaugaugccacuucc

SEQ ID NO: 905924 - RNA, 22 nt, Homo sapiens
caccaaguucuggaaaccacgu

SEQ ID NO: 905925 - RNA, 21 nt, Homo sapiens
caccaauguacccaccgggcc

SEQ ID NO: 905926 - RNA, 14 nt, Homo sapiens
caccaccaugccag

SEQ ID NO: 905927 - RNA, 15 nt, Homo sapiens
caccagaaugcuaaa

SEQ ID NO: 905928 - RNA, 16 nt, Homo sapiens
caccagcuaucuguca

SEQ ID NO: 905929 - RNA, 15 nt, Homo sapiens
caccagcugccaaaa

SEQ ID NO: 905930 - RNA, 22 nt, Homo sapiens
caccaggaugaaggcgugcaag

SEQ ID NO: 905931 - RNA, 18 nt, Homo sapiens
caccauccugcagccucc

SEQ ID NO: 905932 - RNA, 15 nt, Homo sapiens
caccaugaaacuuua

SEQ ID NO: 905933 - RNA, 14 nt, Homo sapiens
caccaugccaggcu

SEQ ID NO: 905934 - RNA, 19 nt, Homo sapiens
caccauucacauuugaugu

SEQ ID NO: 905935 - RNA, 21 nt, Homo sapiens
caccauuuuguuuagacaauu

SEQ ID NO: 905936 - RNA, 14 nt, Homo sapiens
cacccaaaagucaa

SEQ ID NO: 905937 - RNA, 23 nt, Homo sapiens
cacccaaaagucaaaaggugccu

SEQ ID NO: 905938 - RNA, 13 nt, Homo sapiens
cacccacauguga

SEQ ID NO: 905939 - RNA, 13 nt, Homo sapiens
cacccagcaaaga

SEQ ID NO: 905940 - RNA, 22 nt, Homo sapiens
cacccauagugcacacuuguau

SEQ ID NO: 905941 - RNA, 17 nt, Homo sapiens
cacccaugaaucaaaga

SEQ ID NO: 905942 - RNA, 13 nt, Homo sapiens
cacccaugccaua

SEQ ID NO: 905943 - RNA, 13 nt, Homo sapiens
cacccccagucuc

SEQ ID NO: 905944 - RNA, 15 nt, Homo sapiens
caccccuaaagagau

SEQ ID NO: 905945 - RNA, 20 nt, Homo sapiens
cacccgagcuagagugcagu

SEQ ID NO: 905946 - RNA, 17 nt, Homo sapiens
cacccuucugcuguaua

SEQ ID NO: 905947 - RNA, 12 nt, Homo sapiens
caccgagaccaa

SEQ ID NO: 905948 - RNA, 13 nt, Homo sapiens
caccgaugcacac

SEQ ID NO: 905949 - RNA, 17 nt, Homo sapiens
caccgcucuccugccua

SEQ ID NO: 905950 - RNA, 18 nt, Homo sapiens
caccuacucacacaggca

SEQ ID NO: 905951 - RNA, 23 nt, Homo sapiens
caccuagcaucucaugagugcca

SEQ ID NO: 905952 - RNA, 21 nt, Homo sapiens
caccuagugcuuccacuucua

SEQ ID NO: 905953 - RNA, 18 nt, Homo sapiens
caccuauauauccaagaa

SEQ ID NO: 905954 - RNA, 16 nt, Homo sapiens
caccuaugucauuuca

SEQ ID NO: 905955 - RNA, 17 nt, Homo sapiens
caccucaaauacauacc

SEQ ID NO: 905956 - RNA, 13 nt, Homo sapiens
caccuccauuugc

SEQ ID NO: 905957 - RNA, 15 nt, Homo sapiens
caccuccuacgucaa

SEQ ID NO: 905958 - RNA, 22 nt, Homo sapiens
caccuccuagaggugggcagcu

SEQ ID NO: 905959 - RNA, 18 nt, Homo sapiens
caccugcuucugaacuca

SEQ ID NO: 905960 - RNA, 16 nt, Homo sapiens
caccuggcucaccuug

SEQ ID NO: 905961 - RNA, 19 nt, Homo sapiens
caccugggcgccaacugcu

SEQ ID NO: 905962 - RNA, 14 nt, Homo sapiens
caccuguaauccca

SEQ ID NO: 905963 - RNA, 13 nt, Homo sapiens
caccuucaccuuc

SEQ ID NO: 905964 - RNA, 13 nt, Homo sapiens
caccuuccaguga

SEQ ID NO: 905965 - RNA, 20 nt, Homo sapiens
caccuuccuaauaugcuuua

SEQ ID NO: 905966 - RNA, 14 nt, Homo sapiens
caccuucucggcaa

SEQ ID NO: 905967 - RNA, 14 nt, Homo sapiens
caccuugacagggc

SEQ ID NO: 905968 - RNA, 15 nt, Homo sapiens
caccuugccaagcuu

SEQ ID NO: 905969 - RNA, 14 nt, Homo sapiens
caccuugucaugua

SEQ ID NO: 905970 - RNA, 17 nt, Homo sapiens
caccuugugucuguaca

SEQ ID NO: 905971 - RNA, 20 nt, Homo sapiens
cacgacuguuguacaagcuc

SEQ ID NO: 905972 - RNA, 12 nt, Homo sapiens
cacgagcuauau

SEQ ID NO: 905973 - RNA, 16 nt, Homo sapiens
cacgaucguuaugcug

SEQ ID NO: 905974 - RNA, 15 nt, Homo sapiens
cacgaugucaaggac

SEQ ID NO: 905975 - RNA, 15 nt, Homo sapiens
cacgauuuugcacaa

SEQ ID NO: 905976 - RNA, 14 nt, Homo sapiens
cacgccaacagccc

SEQ ID NO: 905977 - RNA, 14 nt, Homo sapiens
cacgccaaugcaca

SEQ ID NO: 905978 - RNA, 18 nt, Homo sapiens
cacgcuuuuugaaaaagc

SEQ ID NO: 905979 - RNA, 16 nt, Homo sapiens
cacggcccugccccau

SEQ ID NO: 905980 - RNA, 14 nt, Homo sapiens
cacggcggcagggu

SEQ ID NO: 905981 - RNA, 17 nt, Homo sapiens
cacggcguuuuuuuaca

SEQ ID NO: 905982 - RNA, 20 nt, Homo sapiens
cacgggguauuuuaggcagg

SEQ ID NO: 905983 - RNA, 18 nt, Homo sapiens
cacguacacacacauaca

SEQ ID NO: 905984 - RNA, 17 nt, Homo sapiens
ccuggccccugggccug

SEQ ID NO: 905985 - RNA, 17 nt, Homo sapiens
ccuggccgccuccagga

SEQ ID NO: 905986 - RNA, 15 nt, Homo sapiens
ccuggccggcaaccc

SEQ ID NO: 905987 - RNA, 16 nt, Homo sapiens
ccugggaaccaugaag

SEQ ID NO: 905988 - RNA, 21 nt, Homo sapiens
ccugggaccaguggcagggac

SEQ ID NO: 905989 - RNA, 15 nt, Homo sapiens
ccugggauucaggaa

SEQ ID NO: 905990 - RNA, 18 nt, Homo sapiens
ccugggccccaccaccua

SEQ ID NO: 905991 - RNA, 17 nt, Homo sapiens
ccugggcugucugucac

SEQ ID NO: 905992 - RNA, 18 nt, Homo sapiens
ccuggggaagcugugaaa

SEQ ID NO: 905993 - RNA, 14 nt, Homo sapiens
ccuggggcauccca

SEQ ID NO: 905994 - RNA, 17 nt, Homo sapiens
ccugggggaugugcacg

SEQ ID NO: 905995 - RNA, 13 nt, Homo sapiens
ccuggggugaccc

SEQ ID NO: 905996 - RNA, 17 nt, Homo sapiens
ccuggguggggcugcuc

SEQ ID NO: 905997 - RNA, 17 nt, Homo sapiens
ccuggucaacaugguga

SEQ ID NO: 905998 - RNA, 13 nt, Homo sapiens
ccuggucccccac

SEQ ID NO: 905999 - RNA, 21 nt, Homo sapiens
ccuggucccccacgugugaag

SEQ ID NO: 906000 - RNA, 16 nt, Homo sapiens
ccuggucugcucagga

SEQ ID NO: 906001 - RNA, 18 nt, Homo sapiens
ccuguaaucccagcacuu

SEQ ID NO: 906002 - RNA, 19 nt, Homo sapiens
ccuguaaucccagcacuuu

SEQ ID NO: 906003 - RNA, 23 nt, Homo sapiens
ccuguaaucccagcuacauggga

SEQ ID NO: 906004 - RNA, 15 nt, Homo sapiens
ccuguacgaaccccu

SEQ ID NO: 906005 - RNA, 21 nt, Homo sapiens
ccuguacucuggagagacugu

SEQ ID NO: 906006 - RNA, 17 nt, Homo sapiens
ccuguagguucuugaua

SEQ ID NO: 906007 - RNA, 20 nt, Homo sapiens
ccuguauucuacagcagaua

SEQ ID NO: 906008 - RNA, 17 nt, Homo sapiens
ccugucgauuagacugg

SEQ ID NO: 906009 - RNA, 23 nt, Homo sapiens
ccugucuuagccucccaaagugc

SEQ ID NO: 906010 - RNA, 14 nt, Homo sapiens
ccugucuucucuca

SEQ ID NO: 906011 - RNA, 13 nt, Homo sapiens
ccugugacuaugg

SEQ ID NO: 906012 - RNA, 18 nt, Homo sapiens
ccugugcaacuuucccaa

SEQ ID NO: 906013 - RNA, 14 nt, Homo sapiens
ccugugggaguaga

SEQ ID NO: 906014 - RNA, 19 nt, Homo sapiens
ccugugggggcggcugugg

SEQ ID NO: 906015 - RNA, 18 nt, Homo sapiens
ccugugugggacugagau

SEQ ID NO: 906016 - RNA, 22 nt, Homo sapiens
ccuguuaucuguguuugcugag

SEQ ID NO: 906017 - RNA, 14 nt, Homo sapiens
ccuguucacucuac

SEQ ID NO: 906018 - RNA, 21 nt, Homo sapiens
ccuguucuuccuaccaaauau

SEQ ID NO: 906019 - RNA, 22 nt, Homo sapiens
ccuguuuauauugguauaauua

SEQ ID NO: 906020 - RNA, 13 nt, Homo sapiens
ccuuaaacucagg

SEQ ID NO: 906021 - RNA, 23 nt, Homo sapiens
ccuuaacacacacaccucuagga

SEQ ID NO: 906022 - RNA, 15 nt, Homo sapiens
ccuuaauauguuaac

SEQ ID NO: 906023 - RNA, 15 nt, Homo sapiens
ccuuacuaugaucuc

SEQ ID NO: 906024 - RNA, 21 nt, Homo sapiens
ccuuacuauggaaagcagcca

SEQ ID NO: 906025 - RNA, 16 nt, Homo sapiens
ccuuacucaccucucu

SEQ ID NO: 906026 - RNA, 19 nt, Homo sapiens
ccuuagagauugccccaga

SEQ ID NO: 906027 - RNA, 17 nt, Homo sapiens
ccuuagagcuuggacag

SEQ ID NO: 906028 - RNA, 23 nt, Homo sapiens
ccuuagagcuuggacagucugag

SEQ ID NO: 906029 - RNA, 12 nt, Homo sapiens
ccuuagcagcuc

SEQ ID NO: 906030 - RNA, 15 nt, Homo sapiens
ccuuagcuggcauua

SEQ ID NO: 906031 - RNA, 17 nt, Homo sapiens
ccuuaggaacagcucuu

SEQ ID NO: 906032 - RNA, 22 nt, Homo sapiens
ccuuaguccgcaaguucaggga

SEQ ID NO: 906033 - RNA, 16 nt, Homo sapiens
ccuuauuguaccucuc

SEQ ID NO: 906034 - RNA, 20 nt, Homo sapiens
ccuucaaguuagcucaggag

SEQ ID NO: 906035 - RNA, 12 nt, Homo sapiens
ccuucaugauga

SEQ ID NO: 906036 - RNA, 19 nt, Homo sapiens
ccuucauugcuggagacag

SEQ ID NO: 906037 - RNA, 16 nt, Homo sapiens
ccuuccacacagggug

SEQ ID NO: 906038 - RNA, 19 nt, Homo sapiens
ccuuccacggauccaugua

SEQ ID NO: 906039 - RNA, 11 nt, Homo sapiens
ccuuccagugg

SEQ ID NO: 906040 - RNA, 17 nt, Homo sapiens
ccuucccaguagcucuu

SEQ ID NO: 906041 - RNA, 18 nt, Homo sapiens
ccuuccucaguccuggaa

SEQ ID NO: 906042 - RNA, 21 nt, Homo sapiens
ccuuccuuuaggucugguugu

SEQ ID NO: 906043 - RNA, 13 nt, Homo sapiens
ccuucgcagcuuu

SEQ ID NO: 906044 - RNA, 14 nt, Homo sapiens
ccuucgguuuguau

SEQ ID NO: 906045 - RNA, 19 nt, Homo sapiens
ccuucugguacaauccuuu

SEQ ID NO: 906046 - RNA, 19 nt, Homo sapiens
ccuucuuucucuucccucc

SEQ ID NO: 906047 - RNA, 19 nt, Homo sapiens
ccuugaaggucacucuucc

SEQ ID NO: 906048 - RNA, 23 nt, Homo sapiens
ccuugacauuguagagcuucugg

SEQ ID NO: 906049 - RNA, 11 nt, Homo sapiens
ccuugagaaac

SEQ ID NO: 906050 - RNA, 20 nt, Homo sapiens
ccuugagcuguccuauggaa

SEQ ID NO: 906051 - RNA, 11 nt, Homo sapiens
ccuugaugaag

SEQ ID NO: 906052 - RNA, 22 nt, Homo sapiens
ccuugauggagauauuuacaug

SEQ ID NO: 906053 - RNA, 17 nt, Homo sapiens
ccuugcaaaaaaaaacu

SEQ ID NO: 906054 - RNA, 15 nt, Homo sapiens
ccuugccagacaugu

SEQ ID NO: 906055 - RNA, 16 nt, Homo sapiens
ccuugcucagugccuc

SEQ ID NO: 906056 - RNA, 23 nt, Homo sapiens
ccuugcuguuuucaucucugcca

SEQ ID NO: 906057 - RNA, 18 nt, Homo sapiens
ccuuggaaaguucagcca

SEQ ID NO: 906058 - RNA, 13 nt, Homo sapiens
ccuuggccgugag

SEQ ID NO: 906059 - RNA, 13 nt, Homo sapiens
ccuuggcugugag

SEQ ID NO: 906060 - RNA, 17 nt, Homo sapiens
ccuuguccugccagcug

SEQ ID NO: 906061 - RNA, 17 nt, Homo sapiens
ccuugugguuuauguca

SEQ ID NO: 906062 - RNA, 15 nt, Homo sapiens
ccuuuaugagucagu

SEQ ID NO: 906063 - RNA, 20 nt, Homo sapiens
ccuuucaccacaugugcaca

SEQ ID NO: 906064 - RNA, 22 nt, Homo sapiens
ccuuuccaagcuccucgugaua

SEQ ID NO: 906065 - RNA, 20 nt, Homo sapiens
ccuuuccagucauuucaaua

SEQ ID NO: 906066 - RNA, 18 nt, Homo sapiens
ccuuucccccaccccaga

SEQ ID NO: 906067 - RNA, 19 nt, Homo sapiens
ccuuuccuccccaccuucc

SEQ ID NO: 906068 - RNA, 22 nt, Homo sapiens
ccuuucucgugguagaagccag

SEQ ID NO: 906069 - RNA, 19 nt, Homo sapiens
ccuuucucuaaaacugccu

SEQ ID NO: 906070 - RNA, 15 nt, Homo sapiens
ccuuucuuacauuag

SEQ ID NO: 906071 - RNA, 16 nt, Homo sapiens
ccuuugagacuauuga

SEQ ID NO: 906072 - RNA, 13 nt, Homo sapiens
ccuuugagggcag

SEQ ID NO: 906073 - RNA, 21 nt, Homo sapiens
ccuuugauaaauguauauaug

SEQ ID NO: 906074 - RNA, 18 nt, Homo sapiens
ccuuuggaugcacuuuau

SEQ ID NO: 906075 - RNA, 21 nt, Homo sapiens
ccuuuggcuaucuacugagac

SEQ ID NO: 906076 - RNA, 18 nt, Homo sapiens
ccuuugggaggcugaggc

SEQ ID NO: 906077 - RNA, 18 nt, Homo sapiens
ccuuuucaucuccagugu

SEQ ID NO: 906078 - RNA, 23 nt, Homo sapiens
ccuuuuguauuuaaaaccuugau

SEQ ID NO: 906079 - RNA, 18 nt, Homo sapiens
ccuuuuucaacuuggaaa

SEQ ID NO: 906080 - RNA, 16 nt, Homo sapiens
ccuuuuuuguuauuau

SEQ ID NO: 906081 - RNA, 15 nt, Homo sapiens
cgaacauucuuugcc

SEQ ID NO: 906082 - RNA, 14 nt, Homo sapiens
cgaaucaucucaaa

SEQ ID NO: 906083 - RNA, 12 nt, Homo sapiens
cgaauccugaca

SEQ ID NO: 906084 - RNA, 13 nt, Homo sapiens
cgaaugacacugu

SEQ ID NO: 906085 - RNA, 22 nt, Homo sapiens
cgaauggaagaggcaccugucc

SEQ ID NO: 906086 - RNA, 15 nt, Homo sapiens
cgacccacucucaaa

SEQ ID NO: 906087 - RNA, 22 nt, Homo sapiens
cgacggcggcggcccucaaaag

SEQ ID NO: 906088 - RNA, 17 nt, Homo sapiens
cgagaaaacaaacccag

SEQ ID NO: 906089 - RNA, 15 nt, Homo sapiens
cgagagaggugggca

SEQ ID NO: 906090 - RNA, 21 nt, Homo sapiens
cgagauugcaccauugcgcuc

SEQ ID NO: 906091 - RNA, 17 nt, Homo sapiens
cgagcaggcuacuguca

SEQ ID NO: 906092 - RNA, 18 nt, Homo sapiens
cgagcuacucucuugcca

SEQ ID NO: 906093 - RNA, 20 nt, Homo sapiens
cgaggagcuuccagugcaug

SEQ ID NO: 906094 - RNA, 22 nt, Homo sapiens
cgagggaugggauuucauguaa

SEQ ID NO: 906095 - RNA, 18 nt, Homo sapiens
cgagggucaggacuguga

SEQ ID NO: 906096 - RNA, 22 nt, Homo sapiens
cgagucaauccccucauucagg

SEQ ID NO: 906097 - RNA, 19 nt, Homo sapiens
cgagucucuucuccacugg

SEQ ID NO: 906098 - RNA, 21 nt, Homo sapiens
cuccccagcccuuugcaggcc

SEQ ID NO: 906099 - RNA, 17 nt, Homo sapiens
cucccccugccagugcc

SEQ ID NO: 906100 - RNA, 16 nt, Homo sapiens
cucccccugcuucuca

SEQ ID NO: 906101 - RNA, 14 nt, Homo sapiens
cuccccucauggag

SEQ ID NO: 906102 - RNA, 16 nt, Homo sapiens
cucccgggagcacaga

SEQ ID NO: 906103 - RNA, 21 nt, Homo sapiens
cucccuaaccaaaugcugucu

SEQ ID NO: 906104 - RNA, 19 nt, Homo sapiens
cucccuaaggaaucugaaa

SEQ ID NO: 906105 - RNA, 22 nt, Homo sapiens
cucccuauccuaaaggcccacu

SEQ ID NO: 906106 - RNA, 13 nt, Homo sapiens
cucccucauucca

SEQ ID NO: 906107 - RNA, 14 nt, Homo sapiens
cucccuccagggaa

SEQ ID NO: 906108 - RNA, 17 nt, Homo sapiens
cucccucuccauaucuc

SEQ ID NO: 906109 - RNA, 16 nt, Homo sapiens
cucccucugaccugca

SEQ ID NO: 906110 - RNA, 15 nt, Homo sapiens
cucccuggccucacg

SEQ ID NO: 906111 - RNA, 20 nt, Homo sapiens
cucccuguagcucugccucc

SEQ ID NO: 906112 - RNA, 19 nt, Homo sapiens
cucccuguguggcugcuga

SEQ ID NO: 906113 - RNA, 18 nt, Homo sapiens
cucccuguuaucugcuag

SEQ ID NO: 906114 - RNA, 21 nt, Homo sapiens
cuccgaauaaacgugcucccc

SEQ ID NO: 906115 - RNA, 14 nt, Homo sapiens
cuccgcacuuggaa

SEQ ID NO: 906116 - RNA, 22 nt, Homo sapiens
cuccgcugggaggaaccugaac

SEQ ID NO: 906117 - RNA, 16 nt, Homo sapiens
cuccggccugaugaca

SEQ ID NO: 906118 - RNA, 19 nt, Homo sapiens
cuccggggucugugcugug

SEQ ID NO: 906119 - RNA, 15 nt, Homo sapiens
cuccuaaaacaugaa

SEQ ID NO: 906120 - RNA, 12 nt, Homo sapiens
cuccuaaccuag

SEQ ID NO: 906121 - RNA, 15 nt, Homo sapiens
cuccuaagacaccug

SEQ ID NO: 906122 - RNA, 20 nt, Homo sapiens
cuccuagaggugggcagcug

SEQ ID NO: 906123 - RNA, 15 nt, Homo sapiens
cuccuagcaagaccu

SEQ ID NO: 906124 - RNA, 21 nt, Homo sapiens
cuccuauuuaugaaaaccaua

SEQ ID NO: 906125 - RNA, 12 nt, Homo sapiens
cuccucaaaagc

SEQ ID NO: 906126 - RNA, 19 nt, Homo sapiens
cuccucccaacucuagccu

SEQ ID NO: 906127 - RNA, 15 nt, Homo sapiens
cuccucccacagccu

SEQ ID NO: 906128 - RNA, 17 nt, Homo sapiens
cuccucguaugcaugga

SEQ ID NO: 906129 - RNA, 13 nt, Homo sapiens
cuccucuaucaca

SEQ ID NO: 906130 - RNA, 18 nt, Homo sapiens
cuccucucucuacuugaa

SEQ ID NO: 906131 - RNA, 15 nt, Homo sapiens
cuccucucugagacu

SEQ ID NO: 906132 - RNA, 16 nt, Homo sapiens
cuccugaccugaggcu

SEQ ID NO: 906133 - RNA, 20 nt, Homo sapiens
cuccugagcucaagugaucc

SEQ ID NO: 906134 - RNA, 12 nt, Homo sapiens
cuccugcaaaau

SEQ ID NO: 906135 - RNA, 20 nt, Homo sapiens
cuccugcaggugucuaucca

SEQ ID NO: 906136 - RNA, 16 nt, Homo sapiens
cuccugccuacauucc

SEQ ID NO: 906137 - RNA, 14 nt, Homo sapiens
cuccugccuacuca

SEQ ID NO: 906138 - RNA, 13 nt, Homo sapiens
cuccugccuugau

SEQ ID NO: 906139 - RNA, 15 nt, Homo sapiens
cuccugccuugauga

SEQ ID NO: 906140 - RNA, 13 nt, Homo sapiens
cuccugcuggaug

SEQ ID NO: 906141 - RNA, 23 nt, Homo sapiens
cuccugggagagaaggagaucag

SEQ ID NO: 906142 - RNA, 18 nt, Homo sapiens
cuccugggcuaagugauc

SEQ ID NO: 906143 - RNA, 18 nt, Homo sapiens
cuccuggucugugcugcc

SEQ ID NO: 906144 - RNA, 16 nt, Homo sapiens
cuccuggucuugagau

SEQ ID NO: 906145 - RNA, 19 nt, Homo sapiens
cuccugugaccccaccuug

SEQ ID NO: 906146 - RNA, 17 nt, Homo sapiens
cuccugugcuacuuugc

SEQ ID NO: 906147 - RNA, 18 nt, Homo sapiens
cuccugugucuugcaaug

SEQ ID NO: 906148 - RNA, 13 nt, Homo sapiens
cuccuguuuccau

SEQ ID NO: 906149 - RNA, 15 nt, Homo sapiens
cuccuguuuccaugg

SEQ ID NO: 906150 - RNA, 20 nt, Homo sapiens
cuccuuaauagccauaugca

SEQ ID NO: 906151 - RNA, 21 nt, Homo sapiens
cuccuuaauagccauaugcaa

SEQ ID NO: 906152 - RNA, 17 nt, Homo sapiens
cuccuuuauugcuccug

SEQ ID NO: 906153 - RNA, 24 nt, Homo sapiens
cuccuuucaccacaugugcacaug

SEQ ID NO: 906154 - RNA, 18 nt, Homo sapiens
cuccuuuugaccaaauaa

SEQ ID NO: 906155 - RNA, 19 nt, Homo sapiens
cuccuuuugcuugaaacca

SEQ ID NO: 906156 - RNA, 18 nt, Homo sapiens
cuccuuuuucuaccuuuu

SEQ ID NO: 906157 - RNA, 13 nt, Homo sapiens
cuccuuuuugccc

SEQ ID NO: 906158 - RNA, 16 nt, Homo sapiens
cucgaggcucuuccau

SEQ ID NO: 906159 - RNA, 12 nt, Homo sapiens
cucgccuaggcc

SEQ ID NO: 906160 - RNA, 18 nt, Homo sapiens
cucggcaccuccccggcc

SEQ ID NO: 906161 - RNA, 22 nt, Homo sapiens
cucggccuccaaggggcuuugu

SEQ ID NO: 906162 - RNA, 16 nt, Homo sapiens
cucggccucccaaagu

SEQ ID NO: 906163 - RNA, 15 nt, Homo sapiens
cucggggugcacagg

SEQ ID NO: 906164 - RNA, 22 nt, Homo sapiens
cucggugaugcggacaucucag

SEQ ID NO: 906165 - RNA, 16 nt, Homo sapiens
cucgguguaaaaccau

SEQ ID NO: 906166 - RNA, 14 nt, Homo sapiens
cucguccacagggg

SEQ ID NO: 906167 - RNA, 15 nt, Homo sapiens
cucguccccaaguga

SEQ ID NO: 906168 - RNA, 11 nt, Homo sapiens
cucguccuccc

SEQ ID NO: 906169 - RNA, 13 nt, Homo sapiens
cucgucucaaaaa

SEQ ID NO: 906170 - RNA, 15 nt, Homo sapiens
cucgucucucugcaa

SEQ ID NO: 906171 - RNA, 15 nt, Homo sapiens
cucuacccuauacaa

SEQ ID NO: 906172 - RNA, 11 nt, Homo sapiens
cucuacuacuu

SEQ ID NO: 906173 - RNA, 21 nt, Homo sapiens
cucuagaacacccacuggcca

SEQ ID NO: 906174 - RNA, 15 nt, Homo sapiens
cucuagagaacaugc

SEQ ID NO: 906175 - RNA, 17 nt, Homo sapiens
cucuaggccuguugccu

SEQ ID NO: 906176 - RNA, 20 nt, Homo sapiens
cucuagugacuuccugguga

SEQ ID NO: 906177 - RNA, 20 nt, Homo sapiens
cucuaugaaaauuauaucuc

SEQ ID NO: 906178 - RNA, 17 nt, Homo sapiens
cucuaugaucuuggcac

SEQ ID NO: 906179 - RNA, 13 nt, Homo sapiens
cucuauguaugca

SEQ ID NO: 906180 - RNA, 15 nt, Homo sapiens
cucuauguaugcauc

SEQ ID NO: 906181 - RNA, 20 nt, Homo sapiens
cucucaaauccugaugcugu

SEQ ID NO: 906182 - RNA, 16 nt, Homo sapiens
cucucaagcuagccag

SEQ ID NO: 906183 - RNA, 22 nt, Homo sapiens
cucucaccgggcuacuaccugg

SEQ ID NO: 906184 - RNA, 23 nt, Homo sapiens
cucucaggaucaagaaaguguug

SEQ ID NO: 906185 - RNA, 13 nt, Homo sapiens
cucuccacuccau

SEQ ID NO: 906186 - RNA, 17 nt, Homo sapiens
cucuccccagcaaguga

SEQ ID NO: 906187 - RNA, 19 nt, Homo sapiens
cucuccuuccuuacccaaa

SEQ ID NO: 906188 - RNA, 21 nt, Homo sapiens
cucuccuugccuggugaccua

SEQ ID NO: 906189 - RNA, 22 nt, Homo sapiens
cucuccuuggugaagaacaucc

SEQ ID NO: 906190 - RNA, 16 nt, Homo sapiens
cucuccuuuggccauu

SEQ ID NO: 906191 - RNA, 15 nt, Homo sapiens
cucucuccacccuau

SEQ ID NO: 906192 - RNA, 11 nt, Homo sapiens
cucucuugccu

SEQ ID NO: 906193 - RNA, 19 nt, Homo sapiens
cucugaaacaaaaguauuu

SEQ ID NO: 906194 - RNA, 20 nt, Homo sapiens
cucugaaacaaaaguauuua

SEQ ID NO: 906195 - RNA, 19 nt, Homo sapiens
cucugaaaucucagaauuc

SEQ ID NO: 906196 - RNA, 14 nt, Homo sapiens
cucugaacaaaagc

SEQ ID NO: 906197 - RNA, 18 nt, Homo sapiens
cucugaagcauguuucau

SEQ ID NO: 906198 - RNA, 20 nt, Homo sapiens
cucugacuggagucuaggaa

SEQ ID NO: 906199 - RNA, 15 nt, Homo sapiens
cucugauaugggacu

SEQ ID NO: 906200 - RNA, 23 nt, Homo sapiens
cucugcaaugggcacugggauga

SEQ ID NO: 906201 - RNA, 14 nt, Homo sapiens
cucugcagcacuuu

SEQ ID NO: 906202 - RNA, 15 nt, Homo sapiens
cucugcagcacuuua

SEQ ID NO: 906203 - RNA, 23 nt, Homo sapiens
cucugcauguguguuguccuuca

SEQ ID NO: 906204 - RNA, 14 nt, Homo sapiens
cucugccuauuuau

SEQ ID NO: 906205 - RNA, 18 nt, Homo sapiens
cucugccucccuagcuuu

SEQ ID NO: 906206 - RNA, 17 nt, Homo sapiens
cucugccuccucuucaa

SEQ ID NO: 906207 - RNA, 14 nt, Homo sapiens
cucugcucuugccu

SEQ ID NO: 906208 - RNA, 16 nt, Homo sapiens
cucuggacaugauuua

SEQ ID NO: 906209 - RNA, 11 nt, Homo sapiens
cucuggaccag

SEQ ID NO: 906210 - RNA, 18 nt, Homo sapiens
cucuggagugaggggaau

SEQ ID NO: 906211 - RNA, 14 nt, Homo sapiens
cucuggcuccagaa

SEQ ID NO: 906212 - RNA, 21 nt, Homo sapiens
cucugggcagcugucauggaa

SEQ ID NO: 906213 - RNA, 16 nt, Homo sapiens
cugucugucaccagcu

SEQ ID NO: 906214 - RNA, 14 nt, Homo sapiens
cugucugucugucu

SEQ ID NO: 906215 - RNA, 21 nt, Homo sapiens
cugugaauaaaaacccuguau

SEQ ID NO: 906216 - RNA, 15 nt, Homo sapiens
cugugaccugcugag

SEQ ID NO: 906217 - RNA, 23 nt, Homo sapiens
cugugaccugcugagcucugaga

SEQ ID NO: 906218 - RNA, 22 nt, Homo sapiens
cugugaggccccuggacaagca

SEQ ID NO: 906219 - RNA, 18 nt, Homo sapiens
cugugcaaauccuugaua

SEQ ID NO: 906220 - RNA, 15 nt, Homo sapiens
cugugcaccccauga

SEQ ID NO: 906221 - RNA, 21 nt, Homo sapiens
cugugcacggccagcugcauc

SEQ ID NO: 906222 - RNA, 18 nt, Homo sapiens
cugugcuucucuuugucc

SEQ ID NO: 906223 - RNA, 15 nt, Homo sapiens
cugugcuuugacuca

SEQ ID NO: 906224 - RNA, 21 nt, Homo sapiens
cuguggaggccugaugcugcc

SEQ ID NO: 906225 - RNA, 16 nt, Homo sapiens
cuguggcggugccugg

SEQ ID NO: 906226 - RNA, 18 nt, Homo sapiens
cuguggcuccugccuuga

SEQ ID NO: 906227 - RNA, 23 nt, Homo sapiens
cuguggcuccugccuugaugaag

SEQ ID NO: 906228 - RNA, 19 nt, Homo sapiens
cugugggaagagaagggaa

SEQ ID NO: 906229 - RNA, 15 nt, Homo sapiens
cugugggcccaguca

SEQ ID NO: 906230 - RNA, 16 nt, Homo sapiens
cuguggggccugaugg

SEQ ID NO: 906231 - RNA, 17 nt, Homo sapiens
cugugggugcuaagggu

SEQ ID NO: 906232 - RNA, 16 nt, Homo sapiens
cuguggugauguugcc

SEQ ID NO: 906233 - RNA, 17 nt, Homo sapiens
cuguguaaccuccacag

SEQ ID NO: 906234 - RNA, 22 nt, Homo sapiens
cuguguacagaauucugcuacc

SEQ ID NO: 906235 - RNA, 23 nt, Homo sapiens
cuguguagcucuguccacucuga

SEQ ID NO: 906236 - RNA, 20 nt, Homo sapiens
cuguguccaauuaugcacug

SEQ ID NO: 906237 - RNA, 15 nt, Homo sapiens
cugugucguagccaa

SEQ ID NO: 906238 - RNA, 20 nt, Homo sapiens
cugugucuuuuuucacuaca

SEQ ID NO: 906239 - RNA, 15 nt, Homo sapiens
cugugugagcaucuc

SEQ ID NO: 906240 - RNA, 13 nt, Homo sapiens
cugugugaugaug

SEQ ID NO: 906241 - RNA, 22 nt, Homo sapiens
cugugugugaaaggaagcucca

SEQ ID NO: 906242 - RNA, 22 nt, Homo sapiens
cuguuaaaauguacacuggaua

SEQ ID NO: 906243 - RNA, 17 nt, Homo sapiens
cuguuaacgucaucuca

SEQ ID NO: 906244 - RNA, 12 nt, Homo sapiens
cuguuaagcaau

SEQ ID NO: 906245 - RNA, 13 nt, Homo sapiens
cuguuaagcaauu

SEQ ID NO: 906246 - RNA, 15 nt, Homo sapiens
cuguuacacaugaca

SEQ ID NO: 906247 - RNA, 23 nt, Homo sapiens
cuguuacauaacaagaaaaucaa

SEQ ID NO: 906248 - RNA, 17 nt, Homo sapiens
cuguuacuuaccuaaac

SEQ ID NO: 906249 - RNA, 19 nt, Homo sapiens
cuguuaucugcuagaucua

SEQ ID NO: 906250 - RNA, 17 nt, Homo sapiens
cuguucauguuacucau

SEQ ID NO: 906251 - RNA, 15 nt, Homo sapiens
cuguucugcacugaa

SEQ ID NO: 906252 - RNA, 19 nt, Homo sapiens
cuguucuggccucagacca

SEQ ID NO: 906253 - RNA, 19 nt, Homo sapiens
cuguucuuccuaccaaaua

SEQ ID NO: 906254 - RNA, 22 nt, Homo sapiens
cuguugaaaauuauuuuaaaca

SEQ ID NO: 906255 - RNA, 21 nt, Homo sapiens
cuguugaucccacuucacugu

SEQ ID NO: 906256 - RNA, 14 nt, Homo sapiens
cuguugcaccucag

SEQ ID NO: 906257 - RNA, 11 nt, Homo sapiens
cuguugcacug

SEQ ID NO: 906258 - RNA, 12 nt, Homo sapiens
cuguugcucaaa

SEQ ID NO: 906259 - RNA, 22 nt, Homo sapiens
cuguugggaaaaccgauaaaga

SEQ ID NO: 906260 - RNA, 19 nt, Homo sapiens
cuguuguaaaugaccaaga

SEQ ID NO: 906261 - RNA, 13 nt, Homo sapiens
cuguuucuauucu

SEQ ID NO: 906262 - RNA, 15 nt, Homo sapiens
cuguuuuaauaauua

SEQ ID NO: 906263 - RNA, 22 nt, Homo sapiens
cuguuuuaauaauuaugugcca

SEQ ID NO: 906264 - RNA, 15 nt, Homo sapiens
cuuaaauauugaaua

SEQ ID NO: 906265 - RNA, 20 nt, Homo sapiens
cuuaaccucucuaagccaca

SEQ ID NO: 906266 - RNA, 18 nt, Homo sapiens
cuuaacuacaguggcuga

SEQ ID NO: 906267 - RNA, 19 nt, Homo sapiens
cuuaagacuuuugggacau

SEQ ID NO: 906268 - RNA, 23 nt, Homo sapiens
cuuaaggcuugaaguaaccuuau

SEQ ID NO: 906269 - RNA, 14 nt, Homo sapiens
cuuaauggguacaa

SEQ ID NO: 906270 - RNA, 16 nt, Homo sapiens
cuuaauucacucccac

SEQ ID NO: 906271 - RNA, 21 nt, Homo sapiens
cuuaauuucauagauuguguu

SEQ ID NO: 906272 - RNA, 19 nt, Homo sapiens
cuuacaagacccuaugaaa

SEQ ID NO: 906273 - RNA, 23 nt, Homo sapiens
cuuacaguggagugagaucuuac

SEQ ID NO: 906274 - RNA, 17 nt, Homo sapiens
cuuaccaggcaccaaaa

SEQ ID NO: 906275 - RNA, 16 nt, Homo sapiens
cuuaccucacagugau

SEQ ID NO: 906276 - RNA, 15 nt, Homo sapiens
cuuaccugugagaua

SEQ ID NO: 906277 - RNA, 13 nt, Homo sapiens
cuuaccuuuacau

SEQ ID NO: 906278 - RNA, 17 nt, Homo sapiens
cuuacgaaauccuuugu

SEQ ID NO: 906279 - RNA, 21 nt, Homo sapiens
cuuagacuaguugaacaucuc

SEQ ID NO: 906280 - RNA, 23 nt, Homo sapiens
cuuagauuagcucuggaccagcc

SEQ ID NO: 906281 - RNA, 16 nt, Homo sapiens
cuuagcaccacaaaua

SEQ ID NO: 906282 - RNA, 18 nt, Homo sapiens
cuuagcccaagaggucug

SEQ ID NO: 906283 - RNA, 17 nt, Homo sapiens
cuuagccucccaaagug

SEQ ID NO: 906284 - RNA, 18 nt, Homo sapiens
cuuagccucccaaagugc

SEQ ID NO: 906285 - RNA, 17 nt, Homo sapiens
cuuagcuuagaccucag

SEQ ID NO: 906286 - RNA, 20 nt, Homo sapiens
cuuaggacuuuccacuccug

SEQ ID NO: 906287 - RNA, 23 nt, Homo sapiens
cuuagggcagucaguaguauucu

SEQ ID NO: 906288 - RNA, 16 nt, Homo sapiens
cuuaguaauagaucac

SEQ ID NO: 906289 - RNA, 17 nt, Homo sapiens
cuuagucacuuauuuca

SEQ ID NO: 906290 - RNA, 15 nt, Homo sapiens
cuuagugucacuuac

SEQ ID NO: 906291 - RNA, 20 nt, Homo sapiens
cuuauaagaauuaaucuuaa

SEQ ID NO: 906292 - RNA, 21 nt, Homo sapiens
cuuauacgaguaauaugccug

SEQ ID NO: 906293 - RNA, 15 nt, Homo sapiens
cuuauaucaucagca

SEQ ID NO: 906294 - RNA, 17 nt, Homo sapiens
cuuauaucaucagcaua

SEQ ID NO: 906295 - RNA, 19 nt, Homo sapiens
cuuauauggaaauucugcu

SEQ ID NO: 906296 - RNA, 20 nt, Homo sapiens
cuuaugaaaugggcuuuaac

SEQ ID NO: 906297 - RNA, 22 nt, Homo sapiens
cuuaugggguauuuuaagcauu

SEQ ID NO: 906298 - RNA, 18 nt, Homo sapiens
cuuaugucucuacauggu

SEQ ID NO: 906299 - RNA, 17 nt, Homo sapiens
cuuauucccaacugcuc

SEQ ID NO: 906300 - RNA, 22 nt, Homo sapiens
cuuauucuugagcacaaaauga

SEQ ID NO: 906301 - RNA, 16 nt, Homo sapiens
cuuauuuaacuuaaca

SEQ ID NO: 906302 - RNA, 18 nt, Homo sapiens
cuuauuuacuuguagaaa

SEQ ID NO: 906303 - RNA, 14 nt, Homo sapiens
cuuauuugguauaa

SEQ ID NO: 906304 - RNA, 14 nt, Homo sapiens
cuuauuuuugaauu

SEQ ID NO: 906305 - RNA, 21 nt, Homo sapiens
cuucaaaacggggcagccaaa

SEQ ID NO: 906306 - RNA, 16 nt, Homo sapiens
cuucaaagacaaugga

SEQ ID NO: 906307 - RNA, 14 nt, Homo sapiens
cuucaaaucagaag

SEQ ID NO: 906308 - RNA, 16 nt, Homo sapiens
cuucaagaacucuggg

SEQ ID NO: 906309 - RNA, 14 nt, Homo sapiens
cuucaauacuucau

SEQ ID NO: 906310 - RNA, 15 nt, Homo sapiens
cuucaaugcuuccuc

SEQ ID NO: 906311 - RNA, 14 nt, Homo sapiens
cuucacaguguuuc

SEQ ID NO: 906312 - RNA, 12 nt, Homo sapiens
cuucacauuuaa

SEQ ID NO: 906313 - RNA, 13 nt, Homo sapiens
cuucacuuuacaa

SEQ ID NO: 906314 - RNA, 16 nt, Homo sapiens
cuucagaagacacugc

SEQ ID NO: 906315 - RNA, 20 nt, Homo sapiens
cuucagaagacacugcaaag

SEQ ID NO: 906316 - RNA, 16 nt, Homo sapiens
cuucagccaaacacaa

SEQ ID NO: 906317 - RNA, 22 nt, Homo sapiens
cuucagccuagccgaccucagc

SEQ ID NO: 906318 - RNA, 22 nt, Homo sapiens
cuucaguauuuuuaaauuguaa

SEQ ID NO: 906319 - RNA, 22 nt, Homo sapiens
cuucaucaauuuuuauacauau

SEQ ID NO: 906320 - RNA, 14 nt, Homo sapiens
cuucauccaugucc

SEQ ID NO: 906321 - RNA, 22 nt, Homo sapiens
cuucauccucugagugugacca

SEQ ID NO: 906322 - RNA, 20 nt, Homo sapiens
cuucaucgaacaaacugaug

SEQ ID NO: 906323 - RNA, 14 nt, Homo sapiens
cuucauuuguguca

SEQ ID NO: 906324 - RNA, 14 nt, Homo sapiens
cuuccaaaccugac

SEQ ID NO: 906325 - RNA, 14 nt, Homo sapiens
cuuccaaccccuuu

SEQ ID NO: 906326 - RNA, 23 nt, Homo sapiens
cuuccaaccccuuuccacgagcu

SEQ ID NO: 906327 - RNA, 12 nt, Homo sapiens
gaacugugacag

SEQ ID NO: 906328 - RNA, 16 nt, Homo sapiens
gaagaaaaagagccau

SEQ ID NO: 906329 - RNA, 14 nt, Homo sapiens
gaagaaaacaugac

SEQ ID NO: 906330 - RNA, 14 nt, Homo sapiens
gaagaaaaccagcg

SEQ ID NO: 906331 - RNA, 17 nt, Homo sapiens
gaagaaaaucaaccagc

SEQ ID NO: 906332 - RNA, 19 nt, Homo sapiens
gaagaaauuccaggaaaau

SEQ ID NO: 906333 - RNA, 13 nt, Homo sapiens
gaagaacaguaac

SEQ ID NO: 906334 - RNA, 19 nt, Homo sapiens
gaagaacaguaacugccau

SEQ ID NO: 906335 - RNA, 20 nt, Homo sapiens
gaagaacaguaacugccauc

SEQ ID NO: 906336 - RNA, 20 nt, Homo sapiens
gaagaacaucccaagccaga

SEQ ID NO: 906337 - RNA, 11 nt, Homo sapiens
gaagaacugac

SEQ ID NO: 906338 - RNA, 17 nt, Homo sapiens
gaagaacugacuaguga

SEQ ID NO: 906339 - RNA, 21 nt, Homo sapiens
gaagaaguuuaaaaaaccaug

SEQ ID NO: 906340 - RNA, 12 nt, Homo sapiens
gaagacacugca

SEQ ID NO: 906341 - RNA, 12 nt, Homo sapiens
gaagaccaaaaa

SEQ ID NO: 906342 - RNA, 14 nt, Homo sapiens
gaagacccagugua

SEQ ID NO: 906343 - RNA, 15 nt, Homo sapiens
gaagacccaguguaa

SEQ ID NO: 906344 - RNA, 21 nt, Homo sapiens
gaagacccaguguaaagaaua

SEQ ID NO: 906345 - RNA, 20 nt, Homo sapiens
gaagaccuucugaagaucuc

SEQ ID NO: 906346 - RNA, 21 nt, Homo sapiens
gaagacgccuuucuccuccaa

SEQ ID NO: 906347 - RNA, 14 nt, Homo sapiens
gaagagaccaagac

SEQ ID NO: 906348 - RNA, 13 nt, Homo sapiens
gaagagcauugca

SEQ ID NO: 906349 - RNA, 19 nt, Homo sapiens
gaagagccugacuguguuc

SEQ ID NO: 906350 - RNA, 20 nt, Homo sapiens
gaagagccugacuguguuca

SEQ ID NO: 906351 - RNA, 14 nt, Homo sapiens
gaagaggaagcaag

SEQ ID NO: 906352 - RNA, 20 nt, Homo sapiens
gaagauacugacuagucaua

SEQ ID NO: 906353 - RNA, 21 nt, Homo sapiens
gaagauaggagagauaccuug

SEQ ID NO: 906354 - RNA, 17 nt, Homo sapiens
gaagaugaagagaagcu

SEQ ID NO: 906355 - RNA, 14 nt, Homo sapiens
gaagauguugucau

SEQ ID NO: 906356 - RNA, 17 nt, Homo sapiens
gaagcaaauaaauauca

SEQ ID NO: 906357 - RNA, 13 nt, Homo sapiens
gaagcacugcugu

SEQ ID NO: 906358 - RNA, 18 nt, Homo sapiens
gaagcaucaaagcacugu

SEQ ID NO: 906359 - RNA, 15 nt, Homo sapiens
gaagcauuuacuuug

SEQ ID NO: 906360 - RNA, 18 nt, Homo sapiens
gaagccaaacaaaggccc

SEQ ID NO: 906361 - RNA, 16 nt, Homo sapiens
gaagccaacuuggcuu

SEQ ID NO: 906362 - RNA, 13 nt, Homo sapiens
gaagccacugccu

SEQ ID NO: 906363 - RNA, 18 nt, Homo sapiens
gaagcccaugcuuuccca

SEQ ID NO: 906364 - RNA, 15 nt, Homo sapiens
gaagccccaagccau

SEQ ID NO: 906365 - RNA, 19 nt, Homo sapiens
gaagccuggacucuaagcu

SEQ ID NO: 906366 - RNA, 19 nt, Homo sapiens
gaagcggagcuugcaguga

SEQ ID NO: 906367 - RNA, 22 nt, Homo sapiens
gaagcuauugauguuuccagaa

SEQ ID NO: 906368 - RNA, 15 nt, Homo sapiens
gaagcuccacuguca

SEQ ID NO: 906369 - RNA, 16 nt, Homo sapiens
gaagcuccacugucac

SEQ ID NO: 906370 - RNA, 19 nt, Homo sapiens
gaagcucuggccaaccaaa

SEQ ID NO: 906371 - RNA, 22 nt, Homo sapiens
gaagcugaggauccucacagga

SEQ ID NO: 906372 - RNA, 16 nt, Homo sapiens
gaagcuggaagcacug

SEQ ID NO: 906373 - RNA, 14 nt, Homo sapiens
gaagcuucaugcca

SEQ ID NO: 906374 - RNA, 17 nt, Homo sapiens
gaaggaagaagccagac

SEQ ID NO: 906375 - RNA, 13 nt, Homo sapiens
gaaggacauuuua

SEQ ID NO: 906376 - RNA, 18 nt, Homo sapiens
gaaggacgugucucagga

SEQ ID NO: 906377 - RNA, 21 nt, Homo sapiens
gaaggacuaugaaaagcuaga

SEQ ID NO: 906378 - RNA, 18 nt, Homo sapiens
gaaggagcaagagaacau

SEQ ID NO: 906379 - RNA, 13 nt, Homo sapiens
gaaggcaaaaaga

SEQ ID NO: 906380 - RNA, 15 nt, Homo sapiens
gaaggccacauguca

SEQ ID NO: 906381 - RNA, 17 nt, Homo sapiens
gaaggcccacuguccag

SEQ ID NO: 906382 - RNA, 13 nt, Homo sapiens
gaaggcuguggug

SEQ ID NO: 906383 - RNA, 10 nt, Homo sapiens
gaagggccag

SEQ ID NO: 906384 - RNA, 11 nt, Homo sapiens
gaagggccagg

SEQ ID NO: 906385 - RNA, 12 nt, Homo sapiens
gaagggccaguc

SEQ ID NO: 906386 - RNA, 23 nt, Homo sapiens
gaaggggcaaagaaaagccagag

SEQ ID NO: 906387 - RNA, 23 nt, Homo sapiens
gaaggguaccuugaacacugggg

SEQ ID NO: 906388 - RNA, 14 nt, Homo sapiens
gaagguacaaacac

SEQ ID NO: 906389 - RNA, 22 nt, Homo sapiens
gaagguagcccagcacugugaa

SEQ ID NO: 906390 - RNA, 20 nt, Homo sapiens
gaaggucccaccuccauuug

SEQ ID NO: 906391 - RNA, 13 nt, Homo sapiens
gaagguugcucua

SEQ ID NO: 906392 - RNA, 19 nt, Homo sapiens
gaagguuuguauauuguca

SEQ ID NO: 906393 - RNA, 13 nt, Homo sapiens
gaaguaaccuuau

SEQ ID NO: 906394 - RNA, 22 nt, Homo sapiens
gaaguagaauuuguccaauaac

SEQ ID NO: 906395 - RNA, 21 nt, Homo sapiens
gaaguagcucuggugaccuug

SEQ ID NO: 906396 - RNA, 16 nt, Homo sapiens
gaaguauaaagugauc

SEQ ID NO: 906397 - RNA, 14 nt, Homo sapiens
gaaguaugagggaa

SEQ ID NO: 906398 - RNA, 23 nt, Homo sapiens
gaaguccccaggucaugcugcug

SEQ ID NO: 906399 - RNA, 17 nt, Homo sapiens
gaagucuugucucaaga

SEQ ID NO: 906400 - RNA, 16 nt, Homo sapiens
gaagugagaaguucau

SEQ ID NO: 906401 - RNA, 19 nt, Homo sapiens
gaaguguaguggcauccau

SEQ ID NO: 906402 - RNA, 17 nt, Homo sapiens
gaaguuaacuacagugu

SEQ ID NO: 906403 - RNA, 15 nt, Homo sapiens
gaaguuaagaaccug

SEQ ID NO: 906404 - RNA, 21 nt, Homo sapiens
gaaguuagggaugacugugau

SEQ ID NO: 906405 - RNA, 16 nt, Homo sapiens
gaaguuccaguguucu

SEQ ID NO: 906406 - RNA, 22 nt, Homo sapiens
gaaguuuugaguuucucuccac

SEQ ID NO: 906407 - RNA, 14 nt, Homo sapiens
gaauaaaaauugac

SEQ ID NO: 906408 - RNA, 19 nt, Homo sapiens
gaauaaaauugcacuuuua

SEQ ID NO: 906409 - RNA, 18 nt, Homo sapiens
gaauaaagccugcuuuuu

SEQ ID NO: 906410 - RNA, 15 nt, Homo sapiens
gaauaauuguguaca

SEQ ID NO: 906411 - RNA, 21 nt, Homo sapiens
gaauaccaaguguguugggaa

SEQ ID NO: 906412 - RNA, 23 nt, Homo sapiens
gaauaccaguguuauuaaugaca

SEQ ID NO: 906413 - RNA, 18 nt, Homo sapiens
gaauacccuuuucugacc

SEQ ID NO: 906414 - RNA, 21 nt, Homo sapiens
gaauacuagaaugguagcacu

SEQ ID NO: 906415 - RNA, 14 nt, Homo sapiens
gaauacuuaacuca

SEQ ID NO: 906416 - RNA, 20 nt, Homo sapiens
gaauagauggguuauuucaa

SEQ ID NO: 906417 - RNA, 13 nt, Homo sapiens
gaauaggcauuug

SEQ ID NO: 906418 - RNA, 17 nt, Homo sapiens
gaauauaaacacuauau

SEQ ID NO: 906419 - RNA, 21 nt, Homo sapiens
gaauauagaggagcacuauua

SEQ ID NO: 906420 - RNA, 20 nt, Homo sapiens
gaauauauuauaaucuucca

SEQ ID NO: 906421 - RNA, 15 nt, Homo sapiens
gaaucaaauugcuac

SEQ ID NO: 906422 - RNA, 16 nt, Homo sapiens
gaauccaaagaucaca

SEQ ID NO: 906423 - RNA, 16 nt, Homo sapiens
gaauccagacccggcu

SEQ ID NO: 906424 - RNA, 12 nt, Homo sapiens
gaauccaugcuu

SEQ ID NO: 906425 - RNA, 13 nt, Homo sapiens
gaaucuacagaac

SEQ ID NO: 906426 - RNA, 17 nt, Homo sapiens
gaaucugcuguugccau

SEQ ID NO: 906427 - RNA, 14 nt, Homo sapiens
gaaucuuacuccuu

SEQ ID NO: 906428 - RNA, 17 nt, Homo sapiens
gaaugaacaaugugggc

SEQ ID NO: 906429 - RNA, 17 nt, Homo sapiens
gaaugaggcaauuucaa

SEQ ID NO: 906430 - RNA, 20 nt, Homo sapiens
gaaugcaaaaaaucuuccaa

SEQ ID NO: 906431 - RNA, 17 nt, Homo sapiens
gaaugcaaaccauagca

SEQ ID NO: 906432 - RNA, 24 nt, Homo sapiens
gaaugcacacuagccucuccagga

SEQ ID NO: 906433 - RNA, 11 nt, Homo sapiens
gaaugccacag

SEQ ID NO: 906434 - RNA, 18 nt, Homo sapiens
gaaugccugucaguuuca

SEQ ID NO: 906435 - RNA, 16 nt, Homo sapiens
gaaugcggaaccauag

SEQ ID NO: 906436 - RNA, 18 nt, Homo sapiens
gaauggaaggcuuugcca

SEQ ID NO: 906437 - RNA, 17 nt, Homo sapiens
gaauguuuacacucuuu

SEQ ID NO: 906438 - RNA, 17 nt, Homo sapiens
gaauuaaaucacggaug

SEQ ID NO: 906439 - RNA, 23 nt, Homo sapiens
gaauuaucccccaaaaugcauuu

SEQ ID NO: 906440 - RNA, 15 nt, Homo sapiens
gaauucacaccuuag

SEQ ID NO: 906441 - RNA, 12 nt, Homo sapiens
gaauucauguga

SEQ ID NO: 906442 - RNA, 13 nt, Homo sapiens
gggauauguuaac

SEQ ID NO: 906443 - RNA, 17 nt, Homo sapiens
gggauccguacauucaa

SEQ ID NO: 906444 - RNA, 19 nt, Homo sapiens
gggaugagaaugaaagcuu

SEQ ID NO: 906445 - RNA, 22 nt, Homo sapiens
gggaugcugccugagucaccca

SEQ ID NO: 906446 - RNA, 11 nt, Homo sapiens
gggaugugcac

SEQ ID NO: 906447 - RNA, 17 nt, Homo sapiens
gggauguuucugucaca

SEQ ID NO: 906448 - RNA, 19 nt, Homo sapiens
gggauuggagggaagacag

SEQ ID NO: 906449 - RNA, 17 nt, Homo sapiens
gggauuggggaagacug

SEQ ID NO: 906450 - RNA, 20 nt, Homo sapiens
gggcaaacccuucucuucuc

SEQ ID NO: 906451 - RNA, 17 nt, Homo sapiens
gggcaacgacgguuuca

SEQ ID NO: 906452 - RNA, 16 nt, Homo sapiens
gggcaagucccugacu

SEQ ID NO: 906453 - RNA, 13 nt, Homo sapiens
gggcacugguggc

SEQ ID NO: 906454 - RNA, 15 nt, Homo sapiens
gggcagaucaccaga

SEQ ID NO: 906455 - RNA, 17 nt, Homo sapiens
gggcagcauagcaagac

SEQ ID NO: 906456 - RNA, 16 nt, Homo sapiens
gggcaggaucucagcc

SEQ ID NO: 906457 - RNA, 14 nt, Homo sapiens
gggccacaucccac

SEQ ID NO: 906458 - RNA, 16 nt, Homo sapiens
gggccagggcccugca

SEQ ID NO: 906459 - RNA, 23 nt, Homo sapiens
gggcccacaauggagugggagau

SEQ ID NO: 906460 - RNA, 14 nt, Homo sapiens
gggcccuccuugcc

SEQ ID NO: 906461 - RNA, 16 nt, Homo sapiens
gggcccugggccucag

SEQ ID NO: 906462 - RNA, 23 nt, Homo sapiens
gggccgaguaccuuaaucugcca

SEQ ID NO: 906463 - RNA, 14 nt, Homo sapiens
gggccuacacccgu

SEQ ID NO: 906464 - RNA, 21 nt, Homo sapiens
gggcgugaaccaccaugccca

SEQ ID NO: 906465 - RNA, 16 nt, Homo sapiens
gggcugcagauuuccu

SEQ ID NO: 906466 - RNA, 14 nt, Homo sapiens
gggcugcccugcca

SEQ ID NO: 906467 - RNA, 16 nt, Homo sapiens
gggcuuauccaugccu

SEQ ID NO: 906468 - RNA, 12 nt, Homo sapiens
ggggaacagagc

SEQ ID NO: 906469 - RNA, 14 nt, Homo sapiens
ggggaaugaucucu

SEQ ID NO: 906470 - RNA, 23 nt, Homo sapiens
ggggagcugggguacagguuugg

SEQ ID NO: 906471 - RNA, 20 nt, Homo sapiens
ggggcccugcaccugugcag

SEQ ID NO: 906472 - RNA, 21 nt, Homo sapiens
ggggcugacuucaauccaugu

SEQ ID NO: 906473 - RNA, 17 nt, Homo sapiens
gggggaauaaagacaga

SEQ ID NO: 906474 - RNA, 13 nt, Homo sapiens
ggggguuccguga

SEQ ID NO: 906475 - RNA, 23 nt, Homo sapiens
gggguccuguuaacgucaucuca

SEQ ID NO: 906476 - RNA, 16 nt, Homo sapiens
gggucaaccugggaug

SEQ ID NO: 906477 - RNA, 14 nt, Homo sapiens
gggucaguaaggaa

SEQ ID NO: 906478 - RNA, 14 nt, Homo sapiens
gggucccagggaag

SEQ ID NO: 906479 - RNA, 15 nt, Homo sapiens
ggguccccaccuggg

SEQ ID NO: 906480 - RNA, 18 nt, Homo sapiens
ggguccuccacaauaagg

SEQ ID NO: 906481 - RNA, 16 nt, Homo sapiens
ggguccuguccaugcc

SEQ ID NO: 906482 - RNA, 16 nt, Homo sapiens
gggugauuucagagag

SEQ ID NO: 906483 - RNA, 11 nt, Homo sapiens
gggugccauuc

SEQ ID NO: 906484 - RNA, 11 nt, Homo sapiens
gggugccugua

SEQ ID NO: 906485 - RNA, 16 nt, Homo sapiens
gggugcgguggcucac

SEQ ID NO: 906486 - RNA, 11 nt, Homo sapiens
gggugugauga

SEQ ID NO: 906487 - RNA, 17 nt, Homo sapiens
ggguguguguagccaag

SEQ ID NO: 906488 - RNA, 22 nt, Homo sapiens
ggguugcggcgugaugucuuca

SEQ ID NO: 906489 - RNA, 21 nt, Homo sapiens
ggguuuugucucugcaucuca

SEQ ID NO: 906490 - RNA, 23 nt, Homo sapiens
ggguuuuuaaucuuugugacagg

SEQ ID NO: 906491 - RNA, 20 nt, Homo sapiens
gguaaccgaacuggugcuuu

SEQ ID NO: 906492 - RNA, 14 nt, Homo sapiens
gguaaucagcauua

SEQ ID NO: 906493 - RNA, 18 nt, Homo sapiens
gguaauuuguaucugaag

SEQ ID NO: 906494 - RNA, 13 nt, Homo sapiens
gguacagcagggu

SEQ ID NO: 906495 - RNA, 15 nt, Homo sapiens
gguacuacaaccaau

SEQ ID NO: 906496 - RNA, 16 nt, Homo sapiens
gguacuacaaccaauu

SEQ ID NO: 906497 - RNA, 14 nt, Homo sapiens
gguacuuaaagcuu

SEQ ID NO: 906498 - RNA, 20 nt, Homo sapiens
gguagaaaaggcuagguaca

SEQ ID NO: 906499 - RNA, 24 nt, Homo sapiens
gguagaauucuggcugguagagca

SEQ ID NO: 906500 - RNA, 21 nt, Homo sapiens
gguagcuuaccugacacaaga

SEQ ID NO: 906501 - RNA, 21 nt, Homo sapiens
gguauaaugguugacuggguu

SEQ ID NO: 906502 - RNA, 22 nt, Homo sapiens
gguauauuuccauucaugccaa

SEQ ID NO: 906503 - RNA, 18 nt, Homo sapiens
gguaugaucacggcucac

SEQ ID NO: 906504 - RNA, 17 nt, Homo sapiens
gguauuuaccacagcag

SEQ ID NO: 906505 - RNA, 23 nt, Homo sapiens
gguauuucaaaacacaucuuucc

SEQ ID NO: 906506 - RNA, 13 nt, Homo sapiens
ggucaagggccag

SEQ ID NO: 906507 - RNA, 16 nt, Homo sapiens
ggucaagggccaguca

SEQ ID NO: 906508 - RNA, 17 nt, Homo sapiens
ggucacauugugccuuu

SEQ ID NO: 906509 - RNA, 15 nt, Homo sapiens
ggucacggcaaagga

SEQ ID NO: 906510 - RNA, 14 nt, Homo sapiens
ggucagucacuuga

SEQ ID NO: 906511 - RNA, 15 nt, Homo sapiens
ggucagucacuugaa

SEQ ID NO: 906512 - RNA, 18 nt, Homo sapiens
ggucauuauuuuuuacaa

SEQ ID NO: 906513 - RNA, 17 nt, Homo sapiens
gguccacucagggcugc

SEQ ID NO: 906514 - RNA, 15 nt, Homo sapiens
gguccaggaaggcag

SEQ ID NO: 906515 - RNA, 15 nt, Homo sapiens
ggucccugccagugu

SEQ ID NO: 906516 - RNA, 18 nt, Homo sapiens
gguccugaguggcugaaa

SEQ ID NO: 906517 - RNA, 19 nt, Homo sapiens
gguccugaguggcugaaau

SEQ ID NO: 906518 - RNA, 13 nt, Homo sapiens
gguccugcauuuc

SEQ ID NO: 906519 - RNA, 21 nt, Homo sapiens
gguccuguuaacgucaucuca

SEQ ID NO: 906520 - RNA, 17 nt, Homo sapiens
gguccuguucccuaccc

SEQ ID NO: 906521 - RNA, 21 nt, Homo sapiens
ggucucuggcccuucuugccu

SEQ ID NO: 906522 - RNA, 18 nt, Homo sapiens
ggucugguuguugcacca

SEQ ID NO: 906523 - RNA, 14 nt, Homo sapiens
ggucugugugauga

SEQ ID NO: 906524 - RNA, 12 nt, Homo sapiens
ggucuugcaagc

SEQ ID NO: 906525 - RNA, 13 nt, Homo sapiens
ggucuugccugaa

SEQ ID NO: 906526 - RNA, 17 nt, Homo sapiens
ggugaaauccaggucuc

SEQ ID NO: 906527 - RNA, 17 nt, Homo sapiens
ggugaagaacaucccaa

SEQ ID NO: 906528 - RNA, 14 nt, Homo sapiens
ggugacagagcaag

SEQ ID NO: 906529 - RNA, 16 nt, Homo sapiens
ggugacuucaggugga

SEQ ID NO: 906530 - RNA, 15 nt, Homo sapiens
ggugagaccaaagga

SEQ ID NO: 906531 - RNA, 19 nt, Homo sapiens
ggugagccgagauugcacc

SEQ ID NO: 906532 - RNA, 15 nt, Homo sapiens
ggugagugcuuguca

SEQ ID NO: 906533 - RNA, 19 nt, Homo sapiens
ggugagugcuugucaugga

SEQ ID NO: 906534 - RNA, 14 nt, Homo sapiens
ggugauacccaagu

SEQ ID NO: 906535 - RNA, 20 nt, Homo sapiens
ggugcacuuuucugugucau

SEQ ID NO: 906536 - RNA, 18 nt, Homo sapiens
ggugcaguugacagcagg

SEQ ID NO: 906537 - RNA, 19 nt, Homo sapiens
ggugccacucccugagcuu

SEQ ID NO: 906538 - RNA, 21 nt, Homo sapiens
ggugccaggcuguaagcauuc

SEQ ID NO: 906539 - RNA, 15 nt, Homo sapiens
ggugccucagagcag

SEQ ID NO: 906540 - RNA, 12 nt, Homo sapiens
ggugcguggcug

SEQ ID NO: 906541 - RNA, 20 nt, Homo sapiens
ggugcuaucgcaccacugug

SEQ ID NO: 906542 - RNA, 17 nt, Homo sapiens
ggugcucuuucccuuua

SEQ ID NO: 906543 - RNA, 12 nt, Homo sapiens
ggugcugagcuu

SEQ ID NO: 906544 - RNA, 13 nt, Homo sapiens
ggugcugcagcca

SEQ ID NO: 906545 - RNA, 17 nt, Homo sapiens
gguggauccacugugca

SEQ ID NO: 906546 - RNA, 21 nt, Homo sapiens
gguggaugccugguggcagcu

SEQ ID NO: 906547 - RNA, 21 nt, Homo sapiens
gguggauuuuguggaggugag

SEQ ID NO: 906548 - RNA, 15 nt, Homo sapiens
gguggcgcgcaccug

SEQ ID NO: 906549 - RNA, 15 nt, Homo sapiens
ggugggauggaugcu

SEQ ID NO: 906550 - RNA, 20 nt, Homo sapiens
gguggguacuugggugagga

SEQ ID NO: 906551 - RNA, 15 nt, Homo sapiens
ggugugaaagucaga

SEQ ID NO: 906552 - RNA, 20 nt, Homo sapiens
ggugugaaccaccacaccca

SEQ ID NO: 906553 - RNA, 13 nt, Homo sapiens
gguguggccucag

SEQ ID NO: 906554 - RNA, 13 nt, Homo sapiens
gguguugacaugu

SEQ ID NO: 906555 - RNA, 19 nt, Homo sapiens
gguguugguguauuugcca

SEQ ID NO: 906556 - RNA, 15 nt, Homo sapiens
gguuagauaaugaau

SEQ ID NO: 906557 - RNA, 17 nt, Homo sapiens
gguuagccuuugcccug

SEQ ID NO: 906558 - RNA, 12 nt, Homo sapiens
gugaaccaaaga

SEQ ID NO: 906559 - RNA, 23 nt, Homo sapiens
gugaaccaccacacccagcccac

SEQ ID NO: 906560 - RNA, 23 nt, Homo sapiens
gugaagaacaucccaagccagaa

SEQ ID NO: 906561 - RNA, 19 nt, Homo sapiens
gugaaggauaagagaaaca

SEQ ID NO: 906562 - RNA, 16 nt, Homo sapiens
gugaauaaccacuuaa

SEQ ID NO: 906563 - RNA, 13 nt, Homo sapiens
gugaaugaucucu

SEQ ID NO: 906564 - RNA, 20 nt, Homo sapiens
gugaaugcuuaccugugaga

SEQ ID NO: 906565 - RNA, 15 nt, Homo sapiens
gugaauuucuucacu

SEQ ID NO: 906566 - RNA, 22 nt, Homo sapiens
gugacacacagcagcacugcag

SEQ ID NO: 906567 - RNA, 14 nt, Homo sapiens
gugacagucuugca

SEQ ID NO: 906568 - RNA, 20 nt, Homo sapiens
gugacaucucuuugauguca

SEQ ID NO: 906569 - RNA, 17 nt, Homo sapiens
gugacaugggugugcca

SEQ ID NO: 906570 - RNA, 21 nt, Homo sapiens
gugacucuauauagcugauca

SEQ ID NO: 906571 - RNA, 16 nt, Homo sapiens
gugagaagaaaugaca

SEQ ID NO: 906572 - RNA, 14 nt, Homo sapiens
gugagaccaaagga

SEQ ID NO: 906573 - RNA, 23 nt, Homo sapiens
gugagaccaccucucaauauuca

SEQ ID NO: 906574 - RNA, 18 nt, Homo sapiens
gugagaugggacauucca

SEQ ID NO: 906575 - RNA, 15 nt, Homo sapiens
gugagcacuaaggug

SEQ ID NO: 906576 - RNA, 21 nt, Homo sapiens
gugagcacuaaggugugcucu

SEQ ID NO: 906577 - RNA, 21 nt, Homo sapiens
gugaguuacagcgagaggcag

SEQ ID NO: 906578 - RNA, 17 nt, Homo sapiens
gugaguugcacagcuau

SEQ ID NO: 906579 - RNA, 15 nt, Homo sapiens
gugauaaugcagacu

SEQ ID NO: 906580 - RNA, 23 nt, Homo sapiens
gugauacaacuucaagugcaugc

SEQ ID NO: 906581 - RNA, 16 nt, Homo sapiens
gugauacguacagcca

SEQ ID NO: 906582 - RNA, 13 nt, Homo sapiens
gugauauaugcau

SEQ ID NO: 906583 - RNA, 18 nt, Homo sapiens
gugauccacccaccucag

SEQ ID NO: 906584 - RNA, 13 nt, Homo sapiens
gugauccucccac

SEQ ID NO: 906585 - RNA, 19 nt, Homo sapiens
gugaucuccacaccaaagu

SEQ ID NO: 906586 - RNA, 21 nt, Homo sapiens
gugaugaugaaaugaggucag

SEQ ID NO: 906587 - RNA, 23 nt, Homo sapiens
gugauggcgcgggaggcaccagc

SEQ ID NO: 906588 - RNA, 16 nt, Homo sapiens
gugaugggaucuguaa

SEQ ID NO: 906589 - RNA, 16 nt, Homo sapiens
gugauugacacacagc

SEQ ID NO: 906590 - RNA, 19 nt, Homo sapiens
gugcaaauggaagacaaaa

SEQ ID NO: 906591 - RNA, 16 nt, Homo sapiens
gugcaccaccaugcca

SEQ ID NO: 906592 - RNA, 18 nt, Homo sapiens
gugcaccacuucaaguga

SEQ ID NO: 906593 - RNA, 18 nt, Homo sapiens
gugcacuugcuggaagac

SEQ ID NO: 906594 - RNA, 19 nt, Homo sapiens
gugcagacugaugggacau

SEQ ID NO: 906595 - RNA, 16 nt, Homo sapiens
gugcagaugggcuguu

SEQ ID NO: 906596 - RNA, 23 nt, Homo sapiens
gugcagguaccugcgauguuuac

SEQ ID NO: 906597 - RNA, 17 nt, Homo sapiens
gugcagucuuggcucac

SEQ ID NO: 906598 - RNA, 20 nt, Homo sapiens
gugcagugagccgagaucac

SEQ ID NO: 906599 - RNA, 13 nt, Homo sapiens
gugcagugauaca

SEQ ID NO: 906600 - RNA, 12 nt, Homo sapiens
gugcaugcucuc

SEQ ID NO: 906601 - RNA, 22 nt, Homo sapiens
gugcauuaacuuaaaagauuca

SEQ ID NO: 906602 - RNA, 15 nt, Homo sapiens
gugcauuucuaggac

SEQ ID NO: 906603 - RNA, 21 nt, Homo sapiens
gugccagcccugcauugcuga

SEQ ID NO: 906604 - RNA, 24 nt, Homo sapiens
gugccagcucaggugacuggagcc

SEQ ID NO: 906605 - RNA, 13 nt, Homo sapiens
gugccaugaucug

SEQ ID NO: 906606 - RNA, 15 nt, Homo sapiens
gugcccaccaacauc

SEQ ID NO: 906607 - RNA, 21 nt, Homo sapiens
gugcccaggggcccacaggga

SEQ ID NO: 906608 - RNA, 13 nt, Homo sapiens
gugcccugcaaau

SEQ ID NO: 906609 - RNA, 13 nt, Homo sapiens
gugccugcugcug

SEQ ID NO: 906610 - RNA, 22 nt, Homo sapiens
gugccuguaaucccagcuacau

SEQ ID NO: 906611 - RNA, 18 nt, Homo sapiens
gugccuuugaccaucucu

SEQ ID NO: 906612 - RNA, 17 nt, Homo sapiens
gugcgugcauguguaua

SEQ ID NO: 906613 - RNA, 18 nt, Homo sapiens
gugcuaacuguguguaca

SEQ ID NO: 906614 - RNA, 23 nt, Homo sapiens
gugcucggcagucauacuggggu

SEQ ID NO: 906615 - RNA, 17 nt, Homo sapiens
gugcucugaucauccac

SEQ ID NO: 906616 - RNA, 16 nt, Homo sapiens
gugcucuucuguucuc

SEQ ID NO: 906617 - RNA, 18 nt, Homo sapiens
gugcugcagccaggagga

SEQ ID NO: 906618 - RNA, 15 nt, Homo sapiens
gugcugggauuacag

SEQ ID NO: 906619 - RNA, 17 nt, Homo sapiens
gugcuguggccugggca

SEQ ID NO: 906620 - RNA, 18 nt, Homo sapiens
gugcuguggccugggcaa

SEQ ID NO: 906621 - RNA, 15 nt, Homo sapiens
gugcugugucugcac

SEQ ID NO: 906622 - RNA, 14 nt, Homo sapiens
gugcuucuucacuu

SEQ ID NO: 906623 - RNA, 20 nt, Homo sapiens
gugcuuuuaaaaaaaaauac

SEQ ID NO: 906624 - RNA, 17 nt, Homo sapiens
guggaaggcagugaaca

SEQ ID NO: 906625 - RNA, 16 nt, Homo sapiens
guggacaggacuaaca

SEQ ID NO: 906626 - RNA, 13 nt, Homo sapiens
guggagguugcag

SEQ ID NO: 906627 - RNA, 17 nt, Homo sapiens
guggauaucuguguaua

SEQ ID NO: 906628 - RNA, 20 nt, Homo sapiens
guggauuccagcauuugcca

SEQ ID NO: 906629 - RNA, 16 nt, Homo sapiens
guggcagauuuaguga

SEQ ID NO: 906630 - RNA, 17 nt, Homo sapiens
guggcauucacaucuca

SEQ ID NO: 906631 - RNA, 22 nt, Homo sapiens
guggccuuccccuuuugccugg

SEQ ID NO: 906632 - RNA, 14 nt, Homo sapiens
guggcgacucuaua

SEQ ID NO: 906633 - RNA, 14 nt, Homo sapiens
guggcuucugucug

SEQ ID NO: 906634 - RNA, 18 nt, Homo sapiens
guggcuuuuuaacaugaa

SEQ ID NO: 906635 - RNA, 18 nt, Homo sapiens
gugggacaaaccagagca

SEQ ID NO: 906636 - RNA, 20 nt, Homo sapiens
gugggaggguaccagcagaa

SEQ ID NO: 906637 - RNA, 15 nt, Homo sapiens
gugggcauugcaaag

SEQ ID NO: 906638 - RNA, 14 nt, Homo sapiens
gugggguacauuuc

SEQ ID NO: 906639 - RNA, 23 nt, Homo sapiens
guggguaacgugagaagauagaa

SEQ ID NO: 906640 - RNA, 19 nt, Homo sapiens
gugguaggaaagccucacu

SEQ ID NO: 906641 - RNA, 18 nt, Homo sapiens
guggucaaaccgcacuca

SEQ ID NO: 906642 - RNA, 12 nt, Homo sapiens
gugguccagcuc

SEQ ID NO: 906643 - RNA, 20 nt, Homo sapiens
guggugacaggcccagugga

SEQ ID NO: 906644 - RNA, 23 nt, Homo sapiens
guggugagccgagauugcaccau

SEQ ID NO: 906645 - RNA, 20 nt, Homo sapiens
guggugcccaugaggacaaa

SEQ ID NO: 906646 - RNA, 18 nt, Homo sapiens
guguaaagaauaaaugaa

SEQ ID NO: 906647 - RNA, 23 nt, Homo sapiens
guguaccucccccugccuuccaa

SEQ ID NO: 906648 - RNA, 14 nt, Homo sapiens
guguagauugcgug

SEQ ID NO: 906649 - RNA, 22 nt, Homo sapiens
guguagcucuguccacucugaa

SEQ ID NO: 906650 - RNA, 21 nt, Homo sapiens
guguagcugugaccugcugag

SEQ ID NO: 906651 - RNA, 21 nt, Homo sapiens
guguauauauaguagcauuuc

SEQ ID NO: 906652 - RNA, 14 nt, Homo sapiens
gugucacccugcag

SEQ ID NO: 906653 - RNA, 22 nt, Homo sapiens
gugucacuacucacagucucuu

SEQ ID NO: 906654 - RNA, 18 nt, Homo sapiens
gugucaugauuucaauga

SEQ ID NO: 906655 - RNA, 15 nt, Homo sapiens
guguccccaccucag

SEQ ID NO: 906656 - RNA, 19 nt, Homo sapiens
guguccccucacucuguca

SEQ ID NO: 906657 - RNA, 17 nt, Homo sapiens
guguccccuccacuguc

SEQ ID NO: 906658 - RNA, 18 nt, Homo sapiens
gugucucugaggacguca

SEQ ID NO: 906659 - RNA, 16 nt, Homo sapiens
gugucuggaagcugag

SEQ ID NO: 906660 - RNA, 17 nt, Homo sapiens
gugucuggcaguuuaua

SEQ ID NO: 906661 - RNA, 16 nt, Homo sapiens
gugugaaggucuugcc

SEQ ID NO: 906662 - RNA, 18 nt, Homo sapiens
gugugaugggaucuguaa

SEQ ID NO: 906663 - RNA, 18 nt, Homo sapiens
gugugauuuccuacagaa

SEQ ID NO: 906664 - RNA, 17 nt, Homo sapiens
gugugcauguguguaua

SEQ ID NO: 906665 - RNA, 20 nt, Homo sapiens
gugugccauagaguuuaaca

SEQ ID NO: 906666 - RNA, 22 nt, Homo sapiens
guguggcccagggaagccaaaa

SEQ ID NO: 906667 - RNA, 11 nt, Homo sapiens
guguggcugcu

SEQ ID NO: 906668 - RNA, 19 nt, Homo sapiens
guguguauauauguguaua

SEQ ID NO: 906669 - RNA, 22 nt, Homo sapiens
gugugucccccuaugcuccagu

SEQ ID NO: 906670 - RNA, 18 nt, Homo sapiens
guguguuuggaagacuau

SEQ ID NO: 906671 - RNA, 17 nt, Homo sapiens
guguuacuguugcacug

SEQ ID NO: 906672 - RNA, 13 nt, Homo sapiens
uaagguacuuaaa

SEQ ID NO: 906673 - RNA, 20 nt, Homo sapiens
uaagguacuuaaagcuucua

SEQ ID NO: 906674 - RNA, 20 nt, Homo sapiens
uaagguguugguguauuugc

SEQ ID NO: 906675 - RNA, 13 nt, Homo sapiens
uaaguaaaaccac

SEQ ID NO: 906676 - RNA, 16 nt, Homo sapiens
uaaguaaaccaaaaag

SEQ ID NO: 906677 - RNA, 20 nt, Homo sapiens
uaaguaccccugauaagcaa

SEQ ID NO: 906678 - RNA, 22 nt, Homo sapiens
uaaguagggacuucugucuuca

SEQ ID NO: 906679 - RNA, 15 nt, Homo sapiens
uaaguauguuugaau

SEQ ID NO: 906680 - RNA, 23 nt, Homo sapiens
uaaguauucuucaucagcauuua

SEQ ID NO: 906681 - RNA, 12 nt, Homo sapiens
uaaguauuucca

SEQ ID NO: 906682 - RNA, 23 nt, Homo sapiens
uaagucacuuugaggugucucaa

SEQ ID NO: 906683 - RNA, 18 nt, Homo sapiens
uaaguccacaucuucuca

SEQ ID NO: 906684 - RNA, 14 nt, Homo sapiens
uaagugccugagac

SEQ ID NO: 906685 - RNA, 19 nt, Homo sapiens
uaagugcuuuguaauggga

SEQ ID NO: 906686 - RNA, 16 nt, Homo sapiens
uaaguguuugucauau

SEQ ID NO: 906687 - RNA, 19 nt, Homo sapiens
uaaguuagggaauggcaca

SEQ ID NO: 906688 - RNA, 16 nt, Homo sapiens
uaaguuguuauuucag

SEQ ID NO: 906689 - RNA, 14 nt, Homo sapiens
uaaguuucugggac

SEQ ID NO: 906690 - RNA, 17 nt, Homo sapiens
uaauaaacauccuucaa

SEQ ID NO: 906691 - RNA, 13 nt, Homo sapiens
uaauaaaucugag

SEQ ID NO: 906692 - RNA, 21 nt, Homo sapiens
uaauaagcaaagggagcacug

SEQ ID NO: 906693 - RNA, 22 nt, Homo sapiens
uaauaaucauucuuuccccuca

SEQ ID NO: 906694 - RNA, 17 nt, Homo sapiens
uaauaauuaugugccau

SEQ ID NO: 906695 - RNA, 15 nt, Homo sapiens
uaauacagggcauuu

SEQ ID NO: 906696 - RNA, 16 nt, Homo sapiens
uaauacuaaagugucu

SEQ ID NO: 906697 - RNA, 16 nt, Homo sapiens
uaauagacacaucaaa

SEQ ID NO: 906698 - RNA, 22 nt, Homo sapiens
uaauagccuaauacaacaugua

SEQ ID NO: 906699 - RNA, 20 nt, Homo sapiens
uaauagggagaaaccaagag

SEQ ID NO: 906700 - RNA, 14 nt, Homo sapiens
uaauauaagccaua

SEQ ID NO: 906701 - RNA, 15 nt, Homo sapiens
uaauauaugcucaac

SEQ ID NO: 906702 - RNA, 12 nt, Homo sapiens
uaauauauugcu

SEQ ID NO: 906703 - RNA, 21 nt, Homo sapiens
uaauauccuaaacaucauuca

SEQ ID NO: 906704 - RNA, 12 nt, Homo sapiens
uaauaucuguga

SEQ ID NO: 906705 - RNA, 14 nt, Homo sapiens
uaauaucugugagg

SEQ ID NO: 906706 - RNA, 14 nt, Homo sapiens
uaaucaccaaagua

SEQ ID NO: 906707 - RNA, 21 nt, Homo sapiens
uaaucauguuaccauuacaaa

SEQ ID NO: 906708 - RNA, 20 nt, Homo sapiens
uaauccagagauaauugcca

SEQ ID NO: 906709 - RNA, 13 nt, Homo sapiens
uaaucccagcacu

SEQ ID NO: 906710 - RNA, 22 nt, Homo sapiens
uaaucccccuugccaaauucca

SEQ ID NO: 906711 - RNA, 19 nt, Homo sapiens
uaaucuuccauacuucuuc

SEQ ID NO: 906712 - RNA, 16 nt, Homo sapiens
uaaugaagacccagug

SEQ ID NO: 906713 - RNA, 18 nt, Homo sapiens
uaaugacaaaggcacuga

SEQ ID NO: 906714 - RNA, 22 nt, Homo sapiens
uaaugagaacuucaaucacugu

SEQ ID NO: 906715 - RNA, 15 nt, Homo sapiens
uaaugauagcuacug

SEQ ID NO: 906716 - RNA, 19 nt, Homo sapiens
uaaugcacucucaguaaug

SEQ ID NO: 906717 - RNA, 19 nt, Homo sapiens
uaauggcucaugaccugga

SEQ ID NO: 906718 - RNA, 18 nt, Homo sapiens
uaaugguuuuuaaugucu

SEQ ID NO: 906719 - RNA, 17 nt, Homo sapiens
uaauguaauaauagaaa

SEQ ID NO: 906720 - RNA, 19 nt, Homo sapiens
uaauguauuuguuugcaau

SEQ ID NO: 906721 - RNA, 21 nt, Homo sapiens
uaauguauuuguuugcaauuu

SEQ ID NO: 906722 - RNA, 14 nt, Homo sapiens
uaaugucaccaccu

SEQ ID NO: 906723 - RNA, 21 nt, Homo sapiens
uaaugucgaacucugaaacaa

SEQ ID NO: 906724 - RNA, 23 nt, Homo sapiens
uaaugugcaaauuuugcauuuag

SEQ ID NO: 906725 - RNA, 15 nt, Homo sapiens
uaauguuaauucagc

SEQ ID NO: 906726 - RNA, 13 nt, Homo sapiens
uaauguugcuuag

SEQ ID NO: 906727 - RNA, 21 nt, Homo sapiens
uaauuaaaaaguuaaucuuca

SEQ ID NO: 906728 - RNA, 23 nt, Homo sapiens
uaauuaaacaagugcacuugaac

SEQ ID NO: 906729 - RNA, 18 nt, Homo sapiens
uaauuaacuaugugaugu

SEQ ID NO: 906730 - RNA, 15 nt, Homo sapiens
uaauuaagggaaucc

SEQ ID NO: 906731 - RNA, 13 nt, Homo sapiens
uaauuaucugauc

SEQ ID NO: 906732 - RNA, 14 nt, Homo sapiens
uaauucaugauuca

SEQ ID NO: 906733 - RNA, 22 nt, Homo sapiens
uaauucggaagggaaaacaguc

SEQ ID NO: 906734 - RNA, 16 nt, Homo sapiens
uaauucucaugugauc

SEQ ID NO: 906735 - RNA, 15 nt, Homo sapiens
uaauugaacuaacaa

SEQ ID NO: 906736 - RNA, 22 nt, Homo sapiens
uaauugauuugacccacucaca

SEQ ID NO: 906737 - RNA, 23 nt, Homo sapiens
uaauuggcaugaaggugucauac

SEQ ID NO: 906738 - RNA, 15 nt, Homo sapiens
uaauuuaguuucaua

SEQ ID NO: 906739 - RNA, 16 nt, Homo sapiens
uaauuuauuucaucca

SEQ ID NO: 906740 - RNA, 13 nt, Homo sapiens
uaauuuuugcaau

SEQ ID NO: 906741 - RNA, 16 nt, Homo sapiens
uacaaagauaugcuaa

SEQ ID NO: 906742 - RNA, 18 nt, Homo sapiens
uacaaaguagagaaguau

SEQ ID NO: 906743 - RNA, 21 nt, Homo sapiens
uacaaagucagggcguucaua

SEQ ID NO: 906744 - RNA, 14 nt, Homo sapiens
uacaagaaccugcu

SEQ ID NO: 906745 - RNA, 15 nt, Homo sapiens
uacaagcauuugccc

SEQ ID NO: 906746 - RNA, 14 nt, Homo sapiens
uacaagcgugagcc

SEQ ID NO: 906747 - RNA, 21 nt, Homo sapiens
uacaauaccagaucacucaaa

SEQ ID NO: 906748 - RNA, 23 nt, Homo sapiens
uacaauccuuugaguuauaguuu

SEQ ID NO: 906749 - RNA, 14 nt, Homo sapiens
uacaaucucaaauu

SEQ ID NO: 906750 - RNA, 22 nt, Homo sapiens
uacaauuauggaaauauaguuc

SEQ ID NO: 906751 - RNA, 17 nt, Homo sapiens
uacacacauauacauau

SEQ ID NO: 906752 - RNA, 15 nt, Homo sapiens
uacacagcccaagag

SEQ ID NO: 906753 - RNA, 13 nt, Homo sapiens
uacacauacauac

SEQ ID NO: 906754 - RNA, 20 nt, Homo sapiens
uacacauggaugcacgcaca

SEQ ID NO: 906755 - RNA, 14 nt, Homo sapiens
uacacauguaucua

SEQ ID NO: 906756 - RNA, 21 nt, Homo sapiens
uacacauguaucuaugcauuu

SEQ ID NO: 906757 - RNA, 15 nt, Homo sapiens
uacaccuaugucauu

SEQ ID NO: 906758 - RNA, 16 nt, Homo sapiens
uacaccuaugucauuu

SEQ ID NO: 906759 - RNA, 20 nt, Homo sapiens
uacaccugaggcugaggcag

SEQ ID NO: 906760 - RNA, 15 nt, Homo sapiens
uacacguguccugua

SEQ ID NO: 906761 - RNA, 18 nt, Homo sapiens
uacacucucuagcuuuag

SEQ ID NO: 906762 - RNA, 13 nt, Homo sapiens
uacacuuguauaa

SEQ ID NO: 906763 - RNA, 13 nt, Homo sapiens
uacagaacaaaga

SEQ ID NO: 906764 - RNA, 20 nt, Homo sapiens
uacagacgucucaagacuga

SEQ ID NO: 906765 - RNA, 18 nt, Homo sapiens
uacagacuucuccagacc

SEQ ID NO: 906766 - RNA, 18 nt, Homo sapiens
uacagauagucaaaccau

SEQ ID NO: 906767 - RNA, 19 nt, Homo sapiens
uacagauguaaaugccaca

SEQ ID NO: 906768 - RNA, 21 nt, Homo sapiens
uacagcaacaggaaucucaga

SEQ ID NO: 906769 - RNA, 14 nt, Homo sapiens
uacagcucuuggca

SEQ ID NO: 906770 - RNA, 21 nt, Homo sapiens
uacagcucuuggcauuuuccu

SEQ ID NO: 906771 - RNA, 16 nt, Homo sapiens
uacaggugcaagccac

SEQ ID NO: 906772 - RNA, 13 nt, Homo sapiens
uacaggugugaac

SEQ ID NO: 906773 - RNA, 13 nt, Homo sapiens
uacagugacuguc

SEQ ID NO: 906774 - RNA, 16 nt, Homo sapiens
uacagugagccaagau

SEQ ID NO: 906775 - RNA, 13 nt, Homo sapiens
uacagugcuauuu

SEQ ID NO: 906776 - RNA, 14 nt, Homo sapiens
uacauaacaagaaa

SEQ ID NO: 906777 - RNA, 22 nt, Homo sapiens
uacauaaucaaagcuaccugug

SEQ ID NO: 906778 - RNA, 16 nt, Homo sapiens
uacauacuauggaauu

SEQ ID NO: 906779 - RNA, 15 nt, Homo sapiens
uacauauauauguca

SEQ ID NO: 906780 - RNA, 22 nt, Homo sapiens
uacauauguagacuauauacau

SEQ ID NO: 906781 - RNA, 15 nt, Homo sapiens
uacauaugugaauau

SEQ ID NO: 906782 - RNA, 21 nt, Homo sapiens
uacauauuucuuugccuuuau

SEQ ID NO: 906783 - RNA, 16 nt, Homo sapiens
uacaucuauguaucua

SEQ ID NO: 906784 - RNA, 16 nt, Homo sapiens
uacauguguagccugu

SEQ ID NO: 906785 - RNA, 14 nt, Homo sapiens
uacauuaaggagca

SEQ ID NO: 906786 - RNA, 16 nt, Homo sapiens
uacauucaacagauca

SEQ ID NO: 906787 - RNA, 14 nt, Homo sapiens
uaugcaaaugccuc

SEQ ID NO: 906788 - RNA, 21 nt, Homo sapiens
uaugcaagccuugcuagacag

SEQ ID NO: 906789 - RNA, 23 nt, Homo sapiens
uaugcacacacacggaugcacac

SEQ ID NO: 906790 - RNA, 16 nt, Homo sapiens
uaugcacacacagaug

SEQ ID NO: 906791 - RNA, 18 nt, Homo sapiens
uaugcacacacagaugca

SEQ ID NO: 906792 - RNA, 19 nt, Homo sapiens
uaugcacacacauggauga

SEQ ID NO: 906793 - RNA, 15 nt, Homo sapiens
uaugcaccaaaucau

SEQ ID NO: 906794 - RNA, 21 nt, Homo sapiens
uaugcaccuugugucuguaca

SEQ ID NO: 906795 - RNA, 16 nt, Homo sapiens
uaugcauucauccaac

SEQ ID NO: 906796 - RNA, 14 nt, Homo sapiens
uaugccuacuugua

SEQ ID NO: 906797 - RNA, 15 nt, Homo sapiens
uaugccuuaagccaa

SEQ ID NO: 906798 - RNA, 14 nt, Homo sapiens
uaugcuaacuguag

SEQ ID NO: 906799 - RNA, 19 nt, Homo sapiens
uaugcuacaguacuaugua

SEQ ID NO: 906800 - RNA, 20 nt, Homo sapiens
uaugcuacaguacuauguaa

SEQ ID NO: 906801 - RNA, 14 nt, Homo sapiens
uaugcuacuacaaa

SEQ ID NO: 906802 - RNA, 16 nt, Homo sapiens
uaugcuauuacauaca

SEQ ID NO: 906803 - RNA, 18 nt, Homo sapiens
uaugcuccaguauggaag

SEQ ID NO: 906804 - RNA, 19 nt, Homo sapiens
uaugcuguaaccaaauuau

SEQ ID NO: 906805 - RNA, 19 nt, Homo sapiens
uauggcagugucuuuccac

SEQ ID NO: 906806 - RNA, 21 nt, Homo sapiens
uauggcuauaggugcuacaaa

SEQ ID NO: 906807 - RNA, 19 nt, Homo sapiens
uauggcucuggcaccacua

SEQ ID NO: 906808 - RNA, 19 nt, Homo sapiens
uauggcugccugcaucuau

SEQ ID NO: 906809 - RNA, 14 nt, Homo sapiens
uauguaaugcuuua

SEQ ID NO: 906810 - RNA, 23 nt, Homo sapiens
uauguaauuuagcaguccaaaga

SEQ ID NO: 906811 - RNA, 19 nt, Homo sapiens
uauguaccauguacaugaa

SEQ ID NO: 906812 - RNA, 16 nt, Homo sapiens
uauguacuguuauuga

SEQ ID NO: 906813 - RNA, 18 nt, Homo sapiens
uauguauauagaugugca

SEQ ID NO: 906814 - RNA, 12 nt, Homo sapiens
uauguaucuacc

SEQ ID NO: 906815 - RNA, 23 nt, Homo sapiens
uauguaucuaccaucuaaucuau

SEQ ID NO: 906816 - RNA, 21 nt, Homo sapiens
uauguaucuggguucuaacca

SEQ ID NO: 906817 - RNA, 23 nt, Homo sapiens
uauguauggaugaaagcaaucug

SEQ ID NO: 906818 - RNA, 21 nt, Homo sapiens
uauguauggaugcguggauau

SEQ ID NO: 906819 - RNA, 22 nt, Homo sapiens
uauguauuaagccaaacaugag

SEQ ID NO: 906820 - RNA, 18 nt, Homo sapiens
uauguauuuuugucauag

SEQ ID NO: 906821 - RNA, 21 nt, Homo sapiens
uauguauuuuugucauaugua

SEQ ID NO: 906822 - RNA, 21 nt, Homo sapiens
uaugucaggcaaagugcugcu

SEQ ID NO: 906823 - RNA, 16 nt, Homo sapiens
uaugucaguuugcagu

SEQ ID NO: 906824 - RNA, 18 nt, Homo sapiens
uaugucucagaccacuau

SEQ ID NO: 906825 - RNA, 17 nt, Homo sapiens
uaugucuguaucuacuu

SEQ ID NO: 906826 - RNA, 15 nt, Homo sapiens
uaugugcuucacaua

SEQ ID NO: 906827 - RNA, 16 nt, Homo sapiens
uaugugcuucacauaa

SEQ ID NO: 906828 - RNA, 17 nt, Homo sapiens
uauguguauauauacau

SEQ ID NO: 906829 - RNA, 14 nt, Homo sapiens
uaugugucuuuauc

SEQ ID NO: 906830 - RNA, 17 nt, Homo sapiens
uauguugguacuuggac

SEQ ID NO: 906831 - RNA, 17 nt, Homo sapiens
uauguuuacuucucacc

SEQ ID NO: 906832 - RNA, 20 nt, Homo sapiens
uauguuucuaaaaauuggua

SEQ ID NO: 906833 - RNA, 13 nt, Homo sapiens
uauguuugcacuu

SEQ ID NO: 906834 - RNA, 14 nt, Homo sapiens
uauguuugcacuuu

SEQ ID NO: 906835 - RNA, 15 nt, Homo sapiens
uauuaaaacacagcu

SEQ ID NO: 906836 - RNA, 16 nt, Homo sapiens
uauuaaaacacagcuu

SEQ ID NO: 906837 - RNA, 18 nt, Homo sapiens
uauuaaaacugcacugcc

SEQ ID NO: 906838 - RNA, 21 nt, Homo sapiens
uauuaaaauuuuuugauguca

SEQ ID NO: 906839 - RNA, 16 nt, Homo sapiens
uauuaaacuugucaga

SEQ ID NO: 906840 - RNA, 14 nt, Homo sapiens
uauuaaagugccau

SEQ ID NO: 906841 - RNA, 13 nt, Homo sapiens
uauuaaccugaau

SEQ ID NO: 906842 - RNA, 17 nt, Homo sapiens
uauuaacgggcauguau

SEQ ID NO: 906843 - RNA, 15 nt, Homo sapiens
uauuaagauguauaa

SEQ ID NO: 906844 - RNA, 17 nt, Homo sapiens
uauuaagguguggcuuu

SEQ ID NO: 906845 - RNA, 22 nt, Homo sapiens
uauuaauacugccggucaccca

SEQ ID NO: 906846 - RNA, 14 nt, Homo sapiens
uauuaauucauuaa

SEQ ID NO: 906847 - RNA, 19 nt, Homo sapiens
uauuaauuuuugaaaccca

SEQ ID NO: 906848 - RNA, 12 nt, Homo sapiens
uauuaccaaaaa

SEQ ID NO: 906849 - RNA, 13 nt, Homo sapiens
uauuaccaaaaaa

SEQ ID NO: 906850 - RNA, 16 nt, Homo sapiens
uauuaccauuacuugu

SEQ ID NO: 906851 - RNA, 23 nt, Homo sapiens
uauuaccuugguauaucauacug

SEQ ID NO: 906852 - RNA, 14 nt, Homo sapiens
uauuacgugcaaua

SEQ ID NO: 906853 - RNA, 14 nt, Homo sapiens
uauuagaaugcaug

SEQ ID NO: 906854 - RNA, 12 nt, Homo sapiens
uauuagcaguag

SEQ ID NO: 906855 - RNA, 14 nt, Homo sapiens
uauuaucaccagca

SEQ ID NO: 906856 - RNA, 15 nt, Homo sapiens
uauuauggcaaguga

SEQ ID NO: 906857 - RNA, 15 nt, Homo sapiens
uauuauugagcucua

SEQ ID NO: 906858 - RNA, 17 nt, Homo sapiens
uauuauuuugcacuguu

SEQ ID NO: 906859 - RNA, 16 nt, Homo sapiens
uauuauuuuuuccaca

SEQ ID NO: 906860 - RNA, 14 nt, Homo sapiens
uauucaaaugaagg

SEQ ID NO: 906861 - RNA, 22 nt, Homo sapiens
uauucaaggaucucaaagaaag

SEQ ID NO: 906862 - RNA, 17 nt, Homo sapiens
uauucaauaaagcugcu

SEQ ID NO: 906863 - RNA, 23 nt, Homo sapiens
uauucaauggugagcagacugca

SEQ ID NO: 906864 - RNA, 14 nt, Homo sapiens
uauucagacaagca

SEQ ID NO: 906865 - RNA, 21 nt, Homo sapiens
uauucagauauaaaacaguuu

SEQ ID NO: 906866 - RNA, 23 nt, Homo sapiens
uauucagauauaaaacaguuuug

SEQ ID NO: 906867 - RNA, 15 nt, Homo sapiens
uauucaggcacugag

SEQ ID NO: 906868 - RNA, 12 nt, Homo sapiens
uauucaugccau

SEQ ID NO: 906869 - RNA, 17 nt, Homo sapiens
uauuccaccauucacau

SEQ ID NO: 906870 - RNA, 21 nt, Homo sapiens
uauuccacuggcgcaucauau

SEQ ID NO: 906871 - RNA, 23 nt, Homo sapiens
uauuccgggugccauucccacua

SEQ ID NO: 906872 - RNA, 12 nt, Homo sapiens
uauuccuaucug

SEQ ID NO: 906873 - RNA, 14 nt, Homo sapiens
uauucuauuuacaa

SEQ ID NO: 906874 - RNA, 17 nt, Homo sapiens
uauucucuaagauauau

SEQ ID NO: 906875 - RNA, 15 nt, Homo sapiens
uauucugauuccacu

SEQ ID NO: 906876 - RNA, 17 nt, Homo sapiens
uauucugauuccacuuu

SEQ ID NO: 906877 - RNA, 21 nt, Homo sapiens
uauucuggcugcaagggccag

SEQ ID NO: 906878 - RNA, 22 nt, Homo sapiens
uauucuguuggccagugugaca

SEQ ID NO: 906879 - RNA, 16 nt, Homo sapiens
uauucuugacaugaga

SEQ ID NO: 906880 - RNA, 12 nt, Homo sapiens
uauucuugucaa

SEQ ID NO: 906881 - RNA, 14 nt, Homo sapiens
uauucuugucaaaa

SEQ ID NO: 906882 - RNA, 14 nt, Homo sapiens
uauugaaucuuaau

SEQ ID NO: 906883 - RNA, 18 nt, Homo sapiens
uauugacaauaauuucag

SEQ ID NO: 906884 - RNA, 21 nt, Homo sapiens
uauugagauaauuuauuuaau

SEQ ID NO: 906885 - RNA, 15 nt, Homo sapiens
uauugcauaugcaua

SEQ ID NO: 906886 - RNA, 20 nt, Homo sapiens
uauugccucugaaaugccuc

SEQ ID NO: 906887 - RNA, 15 nt, Homo sapiens
uauugcugcugguaa

SEQ ID NO: 906888 - RNA, 20 nt, Homo sapiens
uauuggucauugccuugcca

SEQ ID NO: 906889 - RNA, 15 nt, Homo sapiens
uauuguaaacaugug

SEQ ID NO: 906890 - RNA, 21 nt, Homo sapiens
uauugucggaagacuugccac

SEQ ID NO: 906891 - RNA, 16 nt, Homo sapiens
uauugucuaggccaga

SEQ ID NO: 906892 - RNA, 16 nt, Homo sapiens
uauugugccaauaugu

SEQ ID NO: 906893 - RNA, 16 nt, Homo sapiens
uauugugccucuggcu

SEQ ID NO: 906894 - RNA, 22 nt, Homo sapiens
uauuguuaaaaccuuacuuaaa

SEQ ID NO: 906895 - RNA, 16 nt, Homo sapiens
uauuuaaaaguauaaa

SEQ ID NO: 906896 - RNA, 19 nt, Homo sapiens
uauuuaacuggcuucagcc

SEQ ID NO: 906897 - RNA, 14 nt, Homo sapiens
uauuuaagccuuuu

SEQ ID NO: 906898 - RNA, 17 nt, Homo sapiens
uauuuaaguauauagua

SEQ ID NO: 906899 - RNA, 14 nt, Homo sapiens
uauuuacauuuucc

SEQ ID NO: 906900 - RNA, 21 nt, Homo sapiens
uauuuauauauuuauaacuca

SEQ ID NO: 906901 - RNA, 21 nt, Homo sapiens
uauuuaugaccuuauaguguu

SEQ ID NO: 906902 - RNA, 13 nt, Homo sapiens
ugcuagcuguaga

SEQ ID NO: 906903 - RNA, 23 nt, Homo sapiens
ugcuauaggcuggagaagcucac

SEQ ID NO: 906904 - RNA, 19 nt, Homo sapiens
ugcuauauaaacuuuaaca

SEQ ID NO: 906905 - RNA, 18 nt, Homo sapiens
ugcuauauugcacuguga

SEQ ID NO: 906906 - RNA, 19 nt, Homo sapiens
ugcuaugaagcguugaugg

SEQ ID NO: 906907 - RNA, 16 nt, Homo sapiens
ugcuaugaaugauacc

SEQ ID NO: 906908 - RNA, 16 nt, Homo sapiens
ugcucaaccacugugg

SEQ ID NO: 906909 - RNA, 19 nt, Homo sapiens
ugcucaaggcaaccagagg

SEQ ID NO: 906910 - RNA, 18 nt, Homo sapiens
ugcucagauagaaugaca

SEQ ID NO: 906911 - RNA, 13 nt, Homo sapiens
ugcuccaguaugg

SEQ ID NO: 906912 - RNA, 16 nt, Homo sapiens
ugcucccuccacagcu

SEQ ID NO: 906913 - RNA, 14 nt, Homo sapiens
ugcucgugugauuu

SEQ ID NO: 906914 - RNA, 18 nt, Homo sapiens
ugcucugagugcuagcua

SEQ ID NO: 906915 - RNA, 21 nt, Homo sapiens
ugcucuuugauucaaagcacu

SEQ ID NO: 906916 - RNA, 19 nt, Homo sapiens
ugcugaauuucaggcauuu

SEQ ID NO: 906917 - RNA, 11 nt, Homo sapiens
ugcugaccucu

SEQ ID NO: 906918 - RNA, 15 nt, Homo sapiens
ugcugagaaccuggc

SEQ ID NO: 906919 - RNA, 22 nt, Homo sapiens
ugcugaggagaguggaacagaa

SEQ ID NO: 906920 - RNA, 17 nt, Homo sapiens
ugcugccaaacacccau

SEQ ID NO: 906921 - RNA, 15 nt, Homo sapiens
ugcugcgucagacca

SEQ ID NO: 906922 - RNA, 21 nt, Homo sapiens
ugcugcugaccugaucaccuc

SEQ ID NO: 906923 - RNA, 14 nt, Homo sapiens
ugcugcuguuuaca

SEQ ID NO: 906924 - RNA, 22 nt, Homo sapiens
ugcuggaaguagaauuugucca

SEQ ID NO: 906925 - RNA, 13 nt, Homo sapiens
ugcuggacuguca

SEQ ID NO: 906926 - RNA, 14 nt, Homo sapiens
ugcuggagacacuc

SEQ ID NO: 906927 - RNA, 22 nt, Homo sapiens
ugcuggcaccucagacaaucca

SEQ ID NO: 906928 - RNA, 19 nt, Homo sapiens
ugcuggcccauaaacaccc

SEQ ID NO: 906929 - RNA, 18 nt, Homo sapiens
ugcugggcucuccaccuc

SEQ ID NO: 906930 - RNA, 20 nt, Homo sapiens
ugcuggggacagguccucag

SEQ ID NO: 906931 - RNA, 21 nt, Homo sapiens
ugcuggggagucccugccaca

SEQ ID NO: 906932 - RNA, 17 nt, Homo sapiens
ugcuggguguugcauuu

SEQ ID NO: 906933 - RNA, 17 nt, Homo sapiens
ugcuguaacucagacau

SEQ ID NO: 906934 - RNA, 16 nt, Homo sapiens
ugcuguacuugaugac

SEQ ID NO: 906935 - RNA, 18 nt, Homo sapiens
ugcuguauauccccucaa

SEQ ID NO: 906936 - RNA, 23 nt, Homo sapiens
ugcugucauuguccaugccuaca

SEQ ID NO: 906937 - RNA, 13 nt, Homo sapiens
ugcuguuguugca

SEQ ID NO: 906938 - RNA, 21 nt, Homo sapiens
ugcuuaaauuauuuuuauaca

SEQ ID NO: 906939 - RNA, 16 nt, Homo sapiens
ugcuuaccugugagau

SEQ ID NO: 906940 - RNA, 18 nt, Homo sapiens
ugcuuaguaucucaucaa

SEQ ID NO: 906941 - RNA, 15 nt, Homo sapiens
ugcuucaggauacca

SEQ ID NO: 906942 - RNA, 20 nt, Homo sapiens
ugcuucauuugggaaauuca

SEQ ID NO: 906943 - RNA, 21 nt, Homo sapiens
ugcuuccgugcugaacuuuag

SEQ ID NO: 906944 - RNA, 13 nt, Homo sapiens
ugcuucucugggg

SEQ ID NO: 906945 - RNA, 15 nt, Homo sapiens
ugcuucuguccagga

SEQ ID NO: 906946 - RNA, 17 nt, Homo sapiens
ugcuugaaaccaaagau

SEQ ID NO: 906947 - RNA, 19 nt, Homo sapiens
ugcuugaauugcaaggcua

SEQ ID NO: 906948 - RNA, 15 nt, Homo sapiens
ugcuugacuaucaca

SEQ ID NO: 906949 - RNA, 14 nt, Homo sapiens
ugcuuuguauccau

SEQ ID NO: 906950 - RNA, 17 nt, Homo sapiens
ugcuuuuguccuguuau

SEQ ID NO: 906951 - RNA, 16 nt, Homo sapiens
uggaaaaaaaggaaga

SEQ ID NO: 906952 - RNA, 23 nt, Homo sapiens
uggaaaaaagagaaaaaccaaug

SEQ ID NO: 906953 - RNA, 17 nt, Homo sapiens
uggaaaaauacugccua

SEQ ID NO: 906954 - RNA, 16 nt, Homo sapiens
uggaaaacucaggauu

SEQ ID NO: 906955 - RNA, 22 nt, Homo sapiens
uggaaaagcaaaacuguagggg

SEQ ID NO: 906956 - RNA, 13 nt, Homo sapiens
uggaaaagcacuu

SEQ ID NO: 906957 - RNA, 12 nt, Homo sapiens
uggaaacagggc

SEQ ID NO: 906958 - RNA, 20 nt, Homo sapiens
uggaaacgcaaaugaguauu

SEQ ID NO: 906959 - RNA, 15 nt, Homo sapiens
uggaaagcagcagcu

SEQ ID NO: 906960 - RNA, 21 nt, Homo sapiens
uggaaagcagguggcaucucu

SEQ ID NO: 906961 - RNA, 18 nt, Homo sapiens
uggaaagcaucaccucag

SEQ ID NO: 906962 - RNA, 19 nt, Homo sapiens
uggaaagcaucaccucagg

SEQ ID NO: 906963 - RNA, 15 nt, Homo sapiens
uggaaauaaaccugg

SEQ ID NO: 906964 - RNA, 19 nt, Homo sapiens
uggaaauaaaccuggagau

SEQ ID NO: 906965 - RNA, 21 nt, Homo sapiens
uggaaauacuuuaucugugac

SEQ ID NO: 906966 - RNA, 18 nt, Homo sapiens
uggaaauccuguuacuua

SEQ ID NO: 906967 - RNA, 17 nt, Homo sapiens
uggaaauuuuguccauu

SEQ ID NO: 906968 - RNA, 19 nt, Homo sapiens
uggaacacucucugagaug

SEQ ID NO: 906969 - RNA, 13 nt, Homo sapiens
uggaacagcccau

SEQ ID NO: 906970 - RNA, 23 nt, Homo sapiens
uggaaccaacacuaacauauaau

SEQ ID NO: 906971 - RNA, 21 nt, Homo sapiens
uggaagccggccggcugggau

SEQ ID NO: 906972 - RNA, 18 nt, Homo sapiens
uggaaggcccacugucca

SEQ ID NO: 906973 - RNA, 16 nt, Homo sapiens
uggaaggggcaaagaa

SEQ ID NO: 906974 - RNA, 15 nt, Homo sapiens
uggaaucaaggaauc

SEQ ID NO: 906975 - RNA, 21 nt, Homo sapiens
uggaaucagucguuggcaccu

SEQ ID NO: 906976 - RNA, 17 nt, Homo sapiens
uggaauccuacagccuc

SEQ ID NO: 906977 - RNA, 13 nt, Homo sapiens
uggaauugugcug

SEQ ID NO: 906978 - RNA, 16 nt, Homo sapiens
uggacaugcuuuggca

SEQ ID NO: 906979 - RNA, 13 nt, Homo sapiens
uggaccagccugu

SEQ ID NO: 906980 - RNA, 14 nt, Homo sapiens
uggacccugcugaa

SEQ ID NO: 906981 - RNA, 17 nt, Homo sapiens
uggaccugcaccaaagc

SEQ ID NO: 906982 - RNA, 19 nt, Homo sapiens
uggacucaguuuucuugca

SEQ ID NO: 906983 - RNA, 14 nt, Homo sapiens
uggacucugcacau

SEQ ID NO: 906984 - RNA, 22 nt, Homo sapiens
uggacugguaaguaacuguggu

SEQ ID NO: 906985 - RNA, 15 nt, Homo sapiens
uggacugugugcaac

SEQ ID NO: 906986 - RNA, 18 nt, Homo sapiens
uggacuguuuccugagua

SEQ ID NO: 906987 - RNA, 20 nt, Homo sapiens
uggagaggaaaagcaucaga

SEQ ID NO: 906988 - RNA, 18 nt, Homo sapiens
uggagccuggcacaggac

SEQ ID NO: 906989 - RNA, 20 nt, Homo sapiens
uggagcgagcagaugcaauc

SEQ ID NO: 906990 - RNA, 18 nt, Homo sapiens
uggagcuccugcuggaug

SEQ ID NO: 906991 - RNA, 13 nt, Homo sapiens
uggaggaccugag

SEQ ID NO: 906992 - RNA, 15 nt, Homo sapiens
uggaggccaaggugg

SEQ ID NO: 906993 - RNA, 18 nt, Homo sapiens
uggagggaggcucuucag

SEQ ID NO: 906994 - RNA, 19 nt, Homo sapiens
uggagggcuagaaccugga

SEQ ID NO: 906995 - RNA, 13 nt, Homo sapiens
uggaguucagaga

SEQ ID NO: 906996 - RNA, 15 nt, Homo sapiens
uggaguugugaucau

SEQ ID NO: 906997 - RNA, 19 nt, Homo sapiens
uggaguugugaucauccca

SEQ ID NO: 906998 - RNA, 21 nt, Homo sapiens
uggauacacucucuagcuuua

SEQ ID NO: 906999 - RNA, 22 nt, Homo sapiens
uggauacuagaucuuacaucug

SEQ ID NO: 907000 - RNA, 13 nt, Homo sapiens
uggaugcacacac

SEQ ID NO: 907001 - RNA, 22 nt, Homo sapiens
uggaugugcccacagggaccaa

SEQ ID NO: 907002 - RNA, 15 nt, Homo sapiens
uggauucacucacuc

SEQ ID NO: 907003 - RNA, 18 nt, Homo sapiens
uggauuccagcauuugcc

SEQ ID NO: 907004 - RNA, 19 nt, Homo sapiens
uggauuccagcauuugcca

SEQ ID NO: 907005 - RNA, 13 nt, Homo sapiens
uggauucucuggg

SEQ ID NO: 907006 - RNA, 16 nt, Homo sapiens
uggauugcagacucau

SEQ ID NO: 907007 - RNA, 22 nt, Homo sapiens
uggauugcagacucaugaaaga

SEQ ID NO: 907008 - RNA, 14 nt, Homo sapiens
uggcaaagugcugu

SEQ ID NO: 907009 - RNA, 15 nt, Homo sapiens
uggcaaagugcugua

SEQ ID NO: 907010 - RNA, 21 nt, Homo sapiens
uggcaagugaauuugccugua

SEQ ID NO: 907011 - RNA, 20 nt, Homo sapiens
uggcaaugaaaaauucucag

SEQ ID NO: 907012 - RNA, 22 nt, Homo sapiens
uggcaauuuuuuuauacuacca

SEQ ID NO: 907013 - RNA, 19 nt, Homo sapiens
uggcacaguuuucugagaa

SEQ ID NO: 907014 - RNA, 19 nt, Homo sapiens
uggcacucccuaaccaaau

SEQ ID NO: 907015 - RNA, 14 nt, Homo sapiens
uggcagaccaucuc

SEQ ID NO: 907016 - RNA, 11 nt, Homo sapiens
uggcagccacc

SEQ ID NO: 907017 - RNA, 20 nt, Homo sapiens
uguuguguauagaugcaaga

SEQ ID NO: 907018 - RNA, 23 nt, Homo sapiens
uguuuacauaucaccucauggcc

SEQ ID NO: 907019 - RNA, 20 nt, Homo sapiens
uguuuaccucuucuaugcaa

SEQ ID NO: 907020 - RNA, 21 nt, Homo sapiens
uguuucacaacaggcauucca

SEQ ID NO: 907021 - RNA, 15 nt, Homo sapiens
uguuucaccauacuu

SEQ ID NO: 907022 - RNA, 16 nt, Homo sapiens
uguuuccacgggucuc

SEQ ID NO: 907023 - RNA, 15 nt, Homo sapiens
uguuucccauuacuu

SEQ ID NO: 907024 - RNA, 14 nt, Homo sapiens
uguuucccguauug

SEQ ID NO: 907025 - RNA, 20 nt, Homo sapiens
uguuucuaaagguagaucau

SEQ ID NO: 907026 - RNA, 16 nt, Homo sapiens
uguuucugaaccauua

SEQ ID NO: 907027 - RNA, 18 nt, Homo sapiens
uguuucuggggacaccag

SEQ ID NO: 907028 - RNA, 19 nt, Homo sapiens
uguuugauaugaaguguua

SEQ ID NO: 907029 - RNA, 23 nt, Homo sapiens
uguuugucauagggcaguuggaa

SEQ ID NO: 907030 - RNA, 20 nt, Homo sapiens
uguuugugaaacaaaaaagu

SEQ ID NO: 907031 - RNA, 16 nt, Homo sapiens
uguuuguggaacaaaa

SEQ ID NO: 907032 - RNA, 17 nt, Homo sapiens
uguuuuaaguugcuuua

SEQ ID NO: 907033 - RNA, 13 nt, Homo sapiens
uguuuuaaguuua

SEQ ID NO: 907034 - RNA, 13 nt, Homo sapiens
uguuuuagcuccu

SEQ ID NO: 907035 - RNA, 16 nt, Homo sapiens
uguuuuccacugugcu

SEQ ID NO: 907036 - RNA, 19 nt, Homo sapiens
uguuuuccuuugucaucau

SEQ ID NO: 907037 - RNA, 15 nt, Homo sapiens
uguuuuuugccuaaa

SEQ ID NO: 907038 - RNA, 20 nt, Homo sapiens
uguuuuuugccuaaauccaa

SEQ ID NO: 907039 - RNA, 13 nt, Homo sapiens
uguuuuuuuccaa

SEQ ID NO: 907040 - RNA, 12 nt, Homo sapiens
uuaaaaacuaaa

SEQ ID NO: 907041 - RNA, 13 nt, Homo sapiens
uuaaaaaguaaaa

SEQ ID NO: 907042 - RNA, 20 nt, Homo sapiens
uuaaaaauaaagcuacugaa

SEQ ID NO: 907043 - RNA, 20 nt, Homo sapiens
uuaaaaauauuuucugaauu

SEQ ID NO: 907044 - RNA, 17 nt, Homo sapiens
uuaaaaaugaaagccaa

SEQ ID NO: 907045 - RNA, 24 nt, Homo sapiens
uuaaaacuaaaaaggaccagagaa

SEQ ID NO: 907046 - RNA, 19 nt, Homo sapiens
uuaaaauagcaaaagaaga

SEQ ID NO: 907047 - RNA, 21 nt, Homo sapiens
uuaaaaucauucaauaucuga

SEQ ID NO: 907048 - RNA, 21 nt, Homo sapiens
uuaaaaucuggcaaaguuaua

SEQ ID NO: 907049 - RNA, 17 nt, Homo sapiens
uuaaacaaauguaugau

SEQ ID NO: 907050 - RNA, 15 nt, Homo sapiens
uuaaacaagugcacu

SEQ ID NO: 907051 - RNA, 13 nt, Homo sapiens
uuaaacaccugac

SEQ ID NO: 907052 - RNA, 17 nt, Homo sapiens
uuaaacaccugacacau

SEQ ID NO: 907053 - RNA, 11 nt, Homo sapiens
uuaaaccugga

SEQ ID NO: 907054 - RNA, 14 nt, Homo sapiens
uuaaagaaccaaaa

SEQ ID NO: 907055 - RNA, 13 nt, Homo sapiens
uuaaaggaccuuc

SEQ ID NO: 907056 - RNA, 18 nt, Homo sapiens
uuaaagucaacaaccaug

SEQ ID NO: 907057 - RNA, 21 nt, Homo sapiens
uuaaagucaacaaccaugcca

SEQ ID NO: 907058 - RNA, 17 nt, Homo sapiens
uuaaagugguucuggau

SEQ ID NO: 907059 - RNA, 17 nt, Homo sapiens
uuaaaguguaauaauau

SEQ ID NO: 907060 - RNA, 18 nt, Homo sapiens
uuaaaguuuuauaugcau

SEQ ID NO: 907061 - RNA, 21 nt, Homo sapiens
uuaaaugacugcugaaugaca

SEQ ID NO: 907062 - RNA, 18 nt, Homo sapiens
uuaaaugcauguccucaa

SEQ ID NO: 907063 - RNA, 21 nt, Homo sapiens
uuaaaugguguuuuauuacaa

SEQ ID NO: 907064 - RNA, 15 nt, Homo sapiens
uuaaauguuucucaa

SEQ ID NO: 907065 - RNA, 14 nt, Homo sapiens
uuaaauguuuuaca

SEQ ID NO: 907066 - RNA, 17 nt, Homo sapiens
uuaaauucaagcugcuu

SEQ ID NO: 907067 - RNA, 11 nt, Homo sapiens
uuaaauugcag

SEQ ID NO: 907068 - RNA, 19 nt, Homo sapiens
uuaaauugcagaugguuaa

SEQ ID NO: 907069 - RNA, 15 nt, Homo sapiens
uuaaauuucaucuca

SEQ ID NO: 907070 - RNA, 15 nt, Homo sapiens
uuaacaaaauuagcu

SEQ ID NO: 907071 - RNA, 14 nt, Homo sapiens
uuaacaaugcagua

SEQ ID NO: 907072 - RNA, 15 nt, Homo sapiens
uuaacagaaccagag

SEQ ID NO: 907073 - RNA, 14 nt, Homo sapiens
uuaacauauuugca

SEQ ID NO: 907074 - RNA, 13 nt, Homo sapiens
uuaacauuuucca

SEQ ID NO: 907075 - RNA, 16 nt, Homo sapiens
uuaacgucaucucagg

SEQ ID NO: 907076 - RNA, 17 nt, Homo sapiens
uuaacuaugugauguua

SEQ ID NO: 907077 - RNA, 15 nt, Homo sapiens
uuaacugauguuacu

SEQ ID NO: 907078 - RNA, 20 nt, Homo sapiens
uuaacugcauaauagccuaa

SEQ ID NO: 907079 - RNA, 22 nt, Homo sapiens
uuaacuggcuucagccucccca

SEQ ID NO: 907080 - RNA, 17 nt, Homo sapiens
uuaacugugaaccugga

SEQ ID NO: 907081 - RNA, 12 nt, Homo sapiens
uuaagacuuuaa

SEQ ID NO: 907082 - RNA, 17 nt, Homo sapiens
uuaagcaaaggaaacca

SEQ ID NO: 907083 - RNA, 19 nt, Homo sapiens
uuaagcugggauaaucaca

SEQ ID NO: 907084 - RNA, 21 nt, Homo sapiens
uuaaggagguagcucccagca

SEQ ID NO: 907085 - RNA, 15 nt, Homo sapiens
uuaaggauugugaua

SEQ ID NO: 907086 - RNA, 22 nt, Homo sapiens
uuaagguuugcccugccugcag

SEQ ID NO: 907087 - RNA, 16 nt, Homo sapiens
uuaaguaaaccaaaaa

SEQ ID NO: 907088 - RNA, 20 nt, Homo sapiens
uuaaguuauugauguuuuaa

SEQ ID NO: 907089 - RNA, 13 nt, Homo sapiens
uuaauaaagaagu

SEQ ID NO: 907090 - RNA, 14 nt, Homo sapiens
uuaauauaucccag

SEQ ID NO: 907091 - RNA, 23 nt, Homo sapiens
uuaauaugcuguggggcauagaa

SEQ ID NO: 907092 - RNA, 13 nt, Homo sapiens
uuaauauguucau

SEQ ID NO: 907093 - RNA, 22 nt, Homo sapiens
uuaauauuuaaacagcaguguu

SEQ ID NO: 907094 - RNA, 11 nt, Homo sapiens
uuaaucccagu

SEQ ID NO: 907095 - RNA, 19 nt, Homo sapiens
uuaaucugccauaaagcca

SEQ ID NO: 907096 - RNA, 21 nt, Homo sapiens
uuaaucugccauaaagccauu

SEQ ID NO: 907097 - RNA, 20 nt, Homo sapiens
uuaaucuuucuuuaccugag

SEQ ID NO: 907098 - RNA, 22 nt, Homo sapiens
uuaaugaagacccaguguaaag

SEQ ID NO: 907099 - RNA, 20 nt, Homo sapiens
uuaauggcucaugaccugga

SEQ ID NO: 907100 - RNA, 18 nt, Homo sapiens
uuaauggguacaauguac

SEQ ID NO: 907101 - RNA, 12 nt, Homo sapiens
uuaauggugccu

SEQ ID NO: 907102 - RNA, 19 nt, Homo sapiens
uuaauguguuaagugcagg

SEQ ID NO: 907103 - RNA, 17 nt, Homo sapiens
uuaauucucaugugauc

SEQ ID NO: 907104 - RNA, 23 nt, Homo sapiens
uuaauuugaaaacauaaucugca

SEQ ID NO: 907105 - RNA, 18 nt, Homo sapiens
uuaauuugauaguauugu

SEQ ID NO: 907106 - RNA, 17 nt, Homo sapiens
uuaauuuucaguauaau

SEQ ID NO: 907107 - RNA, 14 nt, Homo sapiens
uuacaaauuuaauu

SEQ ID NO: 907108 - RNA, 20 nt, Homo sapiens
uuacaauaauucuaugagau

SEQ ID NO: 907109 - RNA, 15 nt, Homo sapiens
uuacaaugcagaauu

SEQ ID NO: 907110 - RNA, 22 nt, Homo sapiens
uuacacauguaucuaugcauuu

SEQ ID NO: 907111 - RNA, 13 nt, Homo sapiens
uuacacauucuca

SEQ ID NO: 907112 - RNA, 11 nt, Homo sapiens
uuacagcugcc

SEQ ID NO: 907113 - RNA, 19 nt, Homo sapiens
uuacagguaucaggcacag

SEQ ID NO: 907114 - RNA, 14 nt, Homo sapiens
uuacauaucaccuc

SEQ ID NO: 907115 - RNA, 14 nt, Homo sapiens
uuacaugauucauu

SEQ ID NO: 907116 - RNA, 12 nt, Homo sapiens
uuacaugcauua

SEQ ID NO: 907117 - RNA, 14 nt, Homo sapiens
uuacauucaucuca

SEQ ID NO: 907118 - RNA, 14 nt, Homo sapiens
uuacauuuauacau

SEQ ID NO: 907119 - RNA, 15 nt, Homo sapiens
uuacauuuccaaaug

SEQ ID NO: 907120 - RNA, 21 nt, Homo sapiens
uuacauuuccaaaugaaugac

SEQ ID NO: 907121 - RNA, 22 nt, Homo sapiens
uuacauuuccaaaugaaugacc

SEQ ID NO: 907122 - RNA, 19 nt, Homo sapiens
uuaccaacuuucuguaaac

SEQ ID NO: 907123 - RNA, 14 nt, Homo sapiens
uuaccccugcacag

SEQ ID NO: 907124 - RNA, 14 nt, Homo sapiens
uuaccuaaacagau

SEQ ID NO: 907125 - RNA, 19 nt, Homo sapiens
uuaccuaccaccuucccuc

SEQ ID NO: 907126 - RNA, 21 nt, Homo sapiens
uuaccuagauuuacagccuca

SEQ ID NO: 907127 - RNA, 15 nt, Homo sapiens
uuaccucacagugau

SEQ ID NO: 907128 - RNA, 23 nt, Homo sapiens
uuaccuguguuucaagcuaccuu

SEQ ID NO: 907129 - RNA, 16 nt, Homo sapiens
uuaccuuuguucccaa

SEQ ID NO: 907130 - RNA, 22 nt, Homo sapiens
uuacguccacaccgagcccagu

SEQ ID NO: 907131 - RNA, 22 nt, Homo sapiens
uuacuaacacgcauuguacacu

SEQ ID NO: 907132 - RNA, 16 nt, Homo sapiens
uugaguuuucaaagau

SEQ ID NO: 907133 - RNA, 16 nt, Homo sapiens
uugauaaaugccucau

SEQ ID NO: 907134 - RNA, 14 nt, Homo sapiens
uugauaaugggaug

SEQ ID NO: 907135 - RNA, 16 nt, Homo sapiens
uugauaguauugugca

SEQ ID NO: 907136 - RNA, 16 nt, Homo sapiens
uugaucaaauauuuca

SEQ ID NO: 907137 - RNA, 17 nt, Homo sapiens
uugaucaaauauuucaa

SEQ ID NO: 907138 - RNA, 17 nt, Homo sapiens
uugaucaaaucuaaugu

SEQ ID NO: 907139 - RNA, 20 nt, Homo sapiens
uugaucccuguuacccagag

SEQ ID NO: 907140 - RNA, 16 nt, Homo sapiens
uugaugaaagugcaaa

SEQ ID NO: 907141 - RNA, 23 nt, Homo sapiens
uugauuauucugauuccacuuuu

SEQ ID NO: 907142 - RNA, 22 nt, Homo sapiens
uugauucacaaugaaaugcucu

SEQ ID NO: 907143 - RNA, 20 nt, Homo sapiens
uugauugcguggaauugugc

SEQ ID NO: 907144 - RNA, 19 nt, Homo sapiens
uugcaaaagaaguugcugg

SEQ ID NO: 907145 - RNA, 15 nt, Homo sapiens
uugcaagaaucauua

SEQ ID NO: 907146 - RNA, 15 nt, Homo sapiens
uugcaagacauagaa

SEQ ID NO: 907147 - RNA, 19 nt, Homo sapiens
uugcaagauuuaacacuaa

SEQ ID NO: 907148 - RNA, 19 nt, Homo sapiens
uugcaauuuuuccaugaag

SEQ ID NO: 907149 - RNA, 20 nt, Homo sapiens
uugcacaagcuuguauauac

SEQ ID NO: 907150 - RNA, 14 nt, Homo sapiens
uugcaccuuucuag

SEQ ID NO: 907151 - RNA, 22 nt, Homo sapiens
uugcacgugcucuucuguucuc

SEQ ID NO: 907152 - RNA, 19 nt, Homo sapiens
uugcagcugagugaaaaau

SEQ ID NO: 907153 - RNA, 20 nt, Homo sapiens
uugcauaguaccaaucauuu

SEQ ID NO: 907154 - RNA, 20 nt, Homo sapiens
uugcauuugucaaagcauug

SEQ ID NO: 907155 - RNA, 12 nt, Homo sapiens
uugccaaaguga

SEQ ID NO: 907156 - RNA, 14 nt, Homo sapiens
uugcccaccacagc

SEQ ID NO: 907157 - RNA, 16 nt, Homo sapiens
uugcccaccagaucau

SEQ ID NO: 907158 - RNA, 17 nt, Homo sapiens
uugcccagagaugccuc

SEQ ID NO: 907159 - RNA, 19 nt, Homo sapiens
uugccccacccaacaagcc

SEQ ID NO: 907160 - RNA, 17 nt, Homo sapiens
uugcccugccacuuugc

SEQ ID NO: 907161 - RNA, 19 nt, Homo sapiens
uugcccuggauuguugaca

SEQ ID NO: 907162 - RNA, 17 nt, Homo sapiens
uugcccuucacaguguu

SEQ ID NO: 907163 - RNA, 19 nt, Homo sapiens
uugcccuugcccugaccuc

SEQ ID NO: 907164 - RNA, 16 nt, Homo sapiens
uugccuggaagcacau

SEQ ID NO: 907165 - RNA, 16 nt, Homo sapiens
uugccugugugagcau

SEQ ID NO: 907166 - RNA, 17 nt, Homo sapiens
uugcguggacucugcac

SEQ ID NO: 907167 - RNA, 15 nt, Homo sapiens
uugcucacucaggac

SEQ ID NO: 907168 - RNA, 15 nt, Homo sapiens
uugcucugagugcua

SEQ ID NO: 907169 - RNA, 13 nt, Homo sapiens
uugcucuuuggua

SEQ ID NO: 907170 - RNA, 23 nt, Homo sapiens
uugcuggaaggcccacuguccag

SEQ ID NO: 907171 - RNA, 15 nt, Homo sapiens
uugcugguacuaaga

SEQ ID NO: 907172 - RNA, 18 nt, Homo sapiens
uugcuguaacucagacau

SEQ ID NO: 907173 - RNA, 13 nt, Homo sapiens
uugcugugagcaa

SEQ ID NO: 907174 - RNA, 13 nt, Homo sapiens
uugcuguuuccuu

SEQ ID NO: 907175 - RNA, 15 nt, Homo sapiens
uugcuguuugcaauu

SEQ ID NO: 907176 - RNA, 20 nt, Homo sapiens
uugcuucucauccccagucc

SEQ ID NO: 907177 - RNA, 17 nt, Homo sapiens
uuggaaaaugugcaaua

SEQ ID NO: 907178 - RNA, 16 nt, Homo sapiens
uuggaaaguucagcca

SEQ ID NO: 907179 - RNA, 23 nt, Homo sapiens
uuggaaaugcuacaaacauauca

SEQ ID NO: 907180 - RNA, 18 nt, Homo sapiens
uuggaaguguucccugag

SEQ ID NO: 907181 - RNA, 19 nt, Homo sapiens
uuggaauacuugaaaaccu

SEQ ID NO: 907182 - RNA, 15 nt, Homo sapiens
uuggaaugaauucuc

SEQ ID NO: 907183 - RNA, 13 nt, Homo sapiens
uuggacagcugcu

SEQ ID NO: 907184 - RNA, 16 nt, Homo sapiens
uuggaccauccuauuu

SEQ ID NO: 907185 - RNA, 17 nt, Homo sapiens
uuggacccgcucuggac

SEQ ID NO: 907186 - RNA, 21 nt, Homo sapiens
uuggacccgcucuggaccaac

SEQ ID NO: 907187 - RNA, 16 nt, Homo sapiens
uuggacuugaggauuu

SEQ ID NO: 907188 - RNA, 24 nt, Homo sapiens
uuggagccaggaguuugagaccag

SEQ ID NO: 907189 - RNA, 15 nt, Homo sapiens
uuggagcuacugcaa

SEQ ID NO: 907190 - RNA, 22 nt, Homo sapiens
uuggaguaucuaaagccagugg

SEQ ID NO: 907191 - RNA, 21 nt, Homo sapiens
uuggauaauaacuagaucucc

SEQ ID NO: 907192 - RNA, 16 nt, Homo sapiens
uuggauaauauccacu

SEQ ID NO: 907193 - RNA, 16 nt, Homo sapiens
uuggauacacucucua

SEQ ID NO: 907194 - RNA, 16 nt, Homo sapiens
uuggaugcacuuuaua

SEQ ID NO: 907195 - RNA, 20 nt, Homo sapiens
uuggauuuguuuaaaaacca

SEQ ID NO: 907196 - RNA, 18 nt, Homo sapiens
uuggcaugaaggugucau

SEQ ID NO: 907197 - RNA, 18 nt, Homo sapiens
uuggcauggauuucuguc

SEQ ID NO: 907198 - RNA, 15 nt, Homo sapiens
uuggcccucucccau

SEQ ID NO: 907199 - RNA, 16 nt, Homo sapiens
uuggccgugaggacac

SEQ ID NO: 907200 - RNA, 14 nt, Homo sapiens
uuggccugaggcug

SEQ ID NO: 907201 - RNA, 17 nt, Homo sapiens
uuggcgggcagcccagc

SEQ ID NO: 907202 - RNA, 22 nt, Homo sapiens
uugggaaacagagaacccugug

SEQ ID NO: 907203 - RNA, 17 nt, Homo sapiens
uugggaauugcaugcca

SEQ ID NO: 907204 - RNA, 14 nt, Homo sapiens
uugggccacugcca

SEQ ID NO: 907205 - RNA, 15 nt, Homo sapiens
uugggccucuuguac

SEQ ID NO: 907206 - RNA, 16 nt, Homo sapiens
uugguaacauccuuuc

SEQ ID NO: 907207 - RNA, 14 nt, Homo sapiens
uugguauauuucca

SEQ ID NO: 907208 - RNA, 13 nt, Homo sapiens
uuggucaugcuuc

SEQ ID NO: 907209 - RNA, 15 nt, Homo sapiens
uuguaagcacugacu

SEQ ID NO: 907210 - RNA, 23 nt, Homo sapiens
uuguaaguggucgcuuacuuuga

SEQ ID NO: 907211 - RNA, 17 nt, Homo sapiens
uuguaauaugucugcca

SEQ ID NO: 907212 - RNA, 23 nt, Homo sapiens
uuguaaucauguuaccauuacaa

SEQ ID NO: 907213 - RNA, 15 nt, Homo sapiens
uuguaauuccuuacu

SEQ ID NO: 907214 - RNA, 23 nt, Homo sapiens
uuguacccuuccuacagauaguc

SEQ ID NO: 907215 - RNA, 14 nt, Homo sapiens
uuguacugacccca

SEQ ID NO: 907216 - RNA, 19 nt, Homo sapiens
uuguagaaaugagccagaa

SEQ ID NO: 907217 - RNA, 21 nt, Homo sapiens
uuguagaguggcccagaauug

SEQ ID NO: 907218 - RNA, 21 nt, Homo sapiens
uuguagugguauagaguacug

SEQ ID NO: 907219 - RNA, 16 nt, Homo sapiens
uuguauacauugauca

SEQ ID NO: 907220 - RNA, 23 nt, Homo sapiens
uuguauauauauuuuguguauaa

SEQ ID NO: 907221 - RNA, 14 nt, Homo sapiens
uuguaucugaagac

SEQ ID NO: 907222 - RNA, 15 nt, Homo sapiens
uuguauugcauauau

SEQ ID NO: 907223 - RNA, 17 nt, Homo sapiens
uuguauuugcauaugua

SEQ ID NO: 907224 - RNA, 12 nt, Homo sapiens
uuguauuugcca

SEQ ID NO: 907225 - RNA, 16 nt, Homo sapiens
uugucaaaugucauua

SEQ ID NO: 907226 - RNA, 21 nt, Homo sapiens
uugucaauauuaaauacagac

SEQ ID NO: 907227 - RNA, 13 nt, Homo sapiens
uugucaaugcauc

SEQ ID NO: 907228 - RNA, 15 nt, Homo sapiens
uugucaccagcaaca

SEQ ID NO: 907229 - RNA, 19 nt, Homo sapiens
uugucagaguucugcucua

SEQ ID NO: 907230 - RNA, 11 nt, Homo sapiens
uugucaugaau

SEQ ID NO: 907231 - RNA, 22 nt, Homo sapiens
uugucauguggcuaaaugccua

SEQ ID NO: 907232 - RNA, 14 nt, Homo sapiens
uuguccuaugucaa

SEQ ID NO: 907233 - RNA, 22 nt, Homo sapiens
uugucuagaggugagaccaaag

SEQ ID NO: 907234 - RNA, 22 nt, Homo sapiens
uugucucucuaaacccaaauaa

SEQ ID NO: 907235 - RNA, 23 nt, Homo sapiens
uugucucucuaaacccaaauaaa

SEQ ID NO: 907236 - RNA, 20 nt, Homo sapiens
uugucuguuuuuguaacuua

SEQ ID NO: 907237 - RNA, 23 nt, Homo sapiens
uugugaacaccuccuagccacau

SEQ ID NO: 907238 - RNA, 20 nt, Homo sapiens
uugugagcacucuacugcaa

SEQ ID NO: 907239 - RNA, 14 nt, Homo sapiens
uugugaucauccca

SEQ ID NO: 907240 - RNA, 18 nt, Homo sapiens
uugugauuuuugaacaau

SEQ ID NO: 907241 - RNA, 17 nt, Homo sapiens
uugugccagcagaacau

SEQ ID NO: 907242 - RNA, 16 nt, Homo sapiens
uugugcccuccaccua

SEQ ID NO: 907243 - RNA, 16 nt, Homo sapiens
uugugccucuggcugc

SEQ ID NO: 907244 - RNA, 20 nt, Homo sapiens
uugugguuuaugucaucaua

SEQ ID NO: 907245 - RNA, 23 nt, Homo sapiens
uuguguaaauacaguggaucuca

SEQ ID NO: 907246 - RNA, 13 nt, Homo sapiens
ggaagacuugaag

SEQ ID NO: 907247 - RNA, 18 nt, Homo sapiens
ggaagcaagaaagccgua

SEQ ID NO: 907248 - RNA, 16 nt, Homo sapiens
ggaagcacauguuuau

SEQ ID NO: 907249 - RNA, 19 nt, Homo sapiens
ggaagcggagcuugcagug

SEQ ID NO: 907250 - RNA, 19 nt, Homo sapiens
ggaagcucugaagucacau

SEQ ID NO: 907251 - RNA, 12 nt, Homo sapiens
ggaaggggcaaa

SEQ ID NO: 907252 - RNA, 22 nt, Homo sapiens
ggaagucguccuuacuccugug

SEQ ID NO: 907253 - RNA, 21 nt, Homo sapiens
ggaaguuuuguggaggagcuc

SEQ ID NO: 907254 - RNA, 15 nt, Homo sapiens
ggaauaaggccuuaa

SEQ ID NO: 907255 - RNA, 16 nt, Homo sapiens
ggaaugccacagugaa

SEQ ID NO: 907256 - RNA, 13 nt, Homo sapiens
ggaauucaucucu

SEQ ID NO: 907257 - RNA, 18 nt, Homo sapiens
ggaauucuuuacaauaaa

SEQ ID NO: 907258 - RNA, 23 nt, Homo sapiens
ggaauucuuuacaauaaacauag

SEQ ID NO: 907259 - RNA, 15 nt, Homo sapiens
ggaauuuucuuccaa

SEQ ID NO: 907260 - RNA, 23 nt, Homo sapiens
ggacaaaauggaagguuggagac

SEQ ID NO: 907261 - RNA, 19 nt, Homo sapiens
ggacaaugccuugggagag

SEQ ID NO: 907262 - RNA, 20 nt, Homo sapiens
ggacaccccuuauccaggac

SEQ ID NO: 907263 - RNA, 12 nt, Homo sapiens
ggacacuuguau

SEQ ID NO: 907264 - RNA, 15 nt, Homo sapiens
ggacaggcauguucu

SEQ ID NO: 907265 - RNA, 17 nt, Homo sapiens
ggacaguccugggagaa

SEQ ID NO: 907266 - RNA, 17 nt, Homo sapiens
ggacaucaaauuugcca

SEQ ID NO: 907267 - RNA, 12 nt, Homo sapiens
ggaccagggaug

SEQ ID NO: 907268 - RNA, 18 nt, Homo sapiens
ggaccuuccacacagggu

SEQ ID NO: 907269 - RNA, 22 nt, Homo sapiens
ggacgauagcuuggagggaugg

SEQ ID NO: 907270 - RNA, 23 nt, Homo sapiens
ggacgcuuccagaccaccugcca

SEQ ID NO: 907271 - RNA, 22 nt, Homo sapiens
ggacuaaccccaacgcacagga

SEQ ID NO: 907272 - RNA, 23 nt, Homo sapiens
ggacuaaccccaacgcacaggaa

SEQ ID NO: 907273 - RNA, 17 nt, Homo sapiens
ggacuacaggcacccac

SEQ ID NO: 907274 - RNA, 21 nt, Homo sapiens
ggacuacaggugcaagccacu

SEQ ID NO: 907275 - RNA, 16 nt, Homo sapiens
ggacuaugaaaagcua

SEQ ID NO: 907276 - RNA, 10 nt, Homo sapiens
ggacuauuau

SEQ ID NO: 907277 - RNA, 23 nt, Homo sapiens
ggacucagguugucugaagucac

SEQ ID NO: 907278 - RNA, 20 nt, Homo sapiens
ggacucauauauuuaagccu

SEQ ID NO: 907279 - RNA, 13 nt, Homo sapiens
ggacucugcacau

SEQ ID NO: 907280 - RNA, 17 nt, Homo sapiens
ggacugaaugugccuaa

SEQ ID NO: 907281 - RNA, 11 nt, Homo sapiens
ggacugagaug

SEQ ID NO: 907282 - RNA, 22 nt, Homo sapiens
ggacugagccuggcccauagaa

SEQ ID NO: 907283 - RNA, 14 nt, Homo sapiens
ggacugauaaucuc

SEQ ID NO: 907284 - RNA, 17 nt, Homo sapiens
ggacuggaaccagggag

SEQ ID NO: 907285 - RNA, 16 nt, Homo sapiens
ggacuucugcagcuau

SEQ ID NO: 907286 - RNA, 15 nt, Homo sapiens
ggacuucugccugaa

SEQ ID NO: 907287 - RNA, 16 nt, Homo sapiens
ggagaaaacuucucac

SEQ ID NO: 907288 - RNA, 13 nt, Homo sapiens
ggagaacuagaga

SEQ ID NO: 907289 - RNA, 18 nt, Homo sapiens
ggagaagcucacccaaua

SEQ ID NO: 907290 - RNA, 16 nt, Homo sapiens
ggagaaucgcuuaaac

SEQ ID NO: 907291 - RNA, 17 nt, Homo sapiens
ggagaaugaagacuguu

SEQ ID NO: 907292 - RNA, 19 nt, Homo sapiens
uacaauaccagaucacuca

SEQ ID NO: 907293 - RNA, 23 nt, Homo sapiens
uacaauaccagaucacucaaaaa

SEQ ID NO: 907294 - RNA, 18 nt, Homo sapiens
uacaaucucaaauucuca

SEQ ID NO: 907295 - RNA, 19 nt, Homo sapiens
uacaaugaaguuaagguua

SEQ ID NO: 907296 - RNA, 15 nt, Homo sapiens
uacacacacagaugc

SEQ ID NO: 907297 - RNA, 19 nt, Homo sapiens
uacacacccauagugcaca

SEQ ID NO: 907298 - RNA, 20 nt, Homo sapiens
uacacagugggaacucugac

SEQ ID NO: 907299 - RNA, 11 nt, Homo sapiens
uacacaugaca

SEQ ID NO: 907300 - RNA, 19 nt, Homo sapiens
uacacauguaucuaugcau

SEQ ID NO: 907301 - RNA, 12 nt, Homo sapiens
uacacuaauaaa

SEQ ID NO: 907302 - RNA, 18 nt, Homo sapiens
uacacuaauaaaugccaa

SEQ ID NO: 907303 - RNA, 20 nt, Homo sapiens
uacacuccagccugagcaac

SEQ ID NO: 907304 - RNA, 23 nt, Homo sapiens
uacacucuuauagaaaguucaaa

SEQ ID NO: 907305 - RNA, 21 nt, Homo sapiens
uacacuuggagcccgugcagu

SEQ ID NO: 907306 - RNA, 14 nt, Homo sapiens
uacagaagcauuuu

SEQ ID NO: 907307 - RNA, 19 nt, Homo sapiens
uacagaaugaaucccauaa

SEQ ID NO: 907308 - RNA, 15 nt, Homo sapiens
uacagacgucucaag

SEQ ID NO: 907309 - RNA, 13 nt, Homo sapiens
uacagacugugag

SEQ ID NO: 907310 - RNA, 17 nt, Homo sapiens
uacagagaagugaauaa

SEQ ID NO: 907311 - RNA, 15 nt, Homo sapiens
uacagagaaucugaa

SEQ ID NO: 907312 - RNA, 17 nt, Homo sapiens
uacagauguaaaugcca

SEQ ID NO: 907313 - RNA, 19 nt, Homo sapiens
uacagauuuuagacaagga

SEQ ID NO: 907314 - RNA, 20 nt, Homo sapiens
uacagcagaaaggagaacua

SEQ ID NO: 907315 - RNA, 22 nt, Homo sapiens
uacagcuaaucagcauucucac

SEQ ID NO: 907316 - RNA, 18 nt, Homo sapiens
uacagcucuuggcauuuu

SEQ ID NO: 907317 - RNA, 19 nt, Homo sapiens
uacaggccauacuuuacaa

SEQ ID NO: 907318 - RNA, 23 nt, Homo sapiens
uaaaugaaauuguaaaaccuguc

SEQ ID NO: 907319 - RNA, 13 nt, Homo sapiens
uaaaugaccaaga

SEQ ID NO: 907320 - RNA, 22 nt, Homo sapiens
uaaaugacugcugaaugacaua

SEQ ID NO: 907321 - RNA, 17 nt, Homo sapiens
uaaaugcaaacacugug

SEQ ID NO: 907322 - RNA, 13 nt, Homo sapiens
uaaaugcagguau

SEQ ID NO: 907323 - RNA, 14 nt, Homo sapiens
uaaaugcauguccu

SEQ ID NO: 907324 - RNA, 20 nt, Homo sapiens
uaaaugcauguccucaaaac

SEQ ID NO: 907325 - RNA, 16 nt, Homo sapiens
uaaaugccaacauacc

SEQ ID NO: 907326 - RNA, 14 nt, Homo sapiens
uaaaugccacaaag

SEQ ID NO: 907327 - RNA, 16 nt, Homo sapiens
uaaaugcccucucuga

SEQ ID NO: 907328 - RNA, 24 nt, Homo sapiens
uaaaugcucgugugauuuccuaca

SEQ ID NO: 907329 - RNA, 21 nt, Homo sapiens
uaaaugcugucaacuaugaua

SEQ ID NO: 907330 - RNA, 12 nt, Homo sapiens
uaaauggagcuu

SEQ ID NO: 907331 - RNA, 18 nt, Homo sapiens
uaaauggcuggggggcca

SEQ ID NO: 907332 - RNA, 12 nt, Homo sapiens
uaaaugguggga

SEQ ID NO: 907333 - RNA, 21 nt, Homo sapiens
uaaauguaaauauguacacaa

SEQ ID NO: 907334 - RNA, 14 nt, Homo sapiens
uaaauguacauuaa

SEQ ID NO: 907335 - RNA, 16 nt, Homo sapiens
uaaauguauaugucau

SEQ ID NO: 907336 - RNA, 16 nt, Homo sapiens
uaaauguaucauagaa

SEQ ID NO: 907337 - RNA, 17 nt, Homo sapiens
uaaauguaucauagaaa

SEQ ID NO: 907338 - RNA, 19 nt, Homo sapiens
uaaauguaucuuauucaca

SEQ ID NO: 907339 - RNA, 22 nt, Homo sapiens
uaaaugucucuuuaaugucaca

SEQ ID NO: 907340 - RNA, 17 nt, Homo sapiens
uaaaugugguacaagca

SEQ ID NO: 907341 - RNA, 17 nt, Homo sapiens
uaaauguuuuacaagaa

SEQ ID NO: 907342 - RNA, 22 nt, Homo sapiens
uaaauuauuuuaaaaacuaaaa

SEQ ID NO: 907343 - RNA, 21 nt, Homo sapiens
uaaauucaagcugcuuuggac

SEQ ID NO: 907344 - RNA, 21 nt, Homo sapiens
uaaauucacagcgcuaugcaa

SEQ ID NO: 907345 - RNA, 18 nt, Homo sapiens
uaaauucagaaagucaua

SEQ ID NO: 907346 - RNA, 11 nt, Homo sapiens
uaaauucauuu

SEQ ID NO: 907347 - RNA, 22 nt, Homo sapiens
uaaauucuggaaaugucuuucu

SEQ ID NO: 907348 - RNA, 15 nt, Homo sapiens
uaaauugauguugcu

SEQ ID NO: 907349 - RNA, 14 nt, Homo sapiens
uaaauuggcuuauu

SEQ ID NO: 907350 - RNA, 20 nt, Homo sapiens
uaaauuggugauaaguggaa

SEQ ID NO: 907351 - RNA, 15 nt, Homo sapiens
uaaauuuaucaucuc

SEQ ID NO: 907352 - RNA, 20 nt, Homo sapiens
uaaauuugggggacuuacau

SEQ ID NO: 907353 - RNA, 14 nt, Homo sapiens
uaaauuuguguucu

SEQ ID NO: 907354 - RNA, 23 nt, Homo sapiens
uaaauuuguuauuguguauuaug

SEQ ID NO: 907355 - RNA, 15 nt, Homo sapiens
uaacaaaacaagaaa

SEQ ID NO: 907356 - RNA, 19 nt, Homo sapiens
uaacaaacuacauguaauc

SEQ ID NO: 907357 - RNA, 16 nt, Homo sapiens
uaacaaagaacaagca

SEQ ID NO: 907358 - RNA, 17 nt, Homo sapiens
uaacaaccccggacaaa

SEQ ID NO: 907359 - RNA, 16 nt, Homo sapiens
uaacacacacaccucu

SEQ ID NO: 907360 - RNA, 12 nt, Homo sapiens
uaacacaccaca

SEQ ID NO: 907361 - RNA, 16 nt, Homo sapiens
uaacacagcugaacua

SEQ ID NO: 907362 - RNA, 23 nt, Homo sapiens
uaacacauuaucgggagcagugu

SEQ ID NO: 907363 - RNA, 16 nt, Homo sapiens
uaacacucaccaucag

SEQ ID NO: 907364 - RNA, 16 nt, Homo sapiens
uaacaggcagauacag

SEQ ID NO: 907365 - RNA, 22 nt, Homo sapiens
uaacaggcucaauauuccugaa

SEQ ID NO: 907366 - RNA, 18 nt, Homo sapiens
uaacaguugugaugacua

SEQ ID NO: 907367 - RNA, 20 nt, Homo sapiens
uaacaguugugaugacuaug

SEQ ID NO: 907368 - RNA, 22 nt, Homo sapiens
uaacauaaauuuaucaucucga

SEQ ID NO: 907369 - RNA, 21 nt, Homo sapiens
uaacauauuugcacaauuuua

SEQ ID NO: 907370 - RNA, 21 nt, Homo sapiens
uaacaucuauuauaaaaccau

SEQ ID NO: 907371 - RNA, 23 nt, Homo sapiens
uaacauuuggaguguguauucaa

SEQ ID NO: 907372 - RNA, 12 nt, Homo sapiens
uaaccaguacuu

SEQ ID NO: 907373 - RNA, 23 nt, Homo sapiens
uaaccauaguuauuuacuugaaa

SEQ ID NO: 907374 - RNA, 15 nt, Homo sapiens
uaaccccaccuugcc

SEQ ID NO: 907375 - RNA, 15 nt, Homo sapiens
uaacccucucuuccc

SEQ ID NO: 907376 - RNA, 19 nt, Homo sapiens
uaaccgaacuggugcuuua

SEQ ID NO: 907377 - RNA, 14 nt, Homo sapiens
uaaccuacuagaca

SEQ ID NO: 907378 - RNA, 18 nt, Homo sapiens
uaaccucaucuacaagca

SEQ ID NO: 907379 - RNA, 23 nt, Homo sapiens
uaaccuguuuauauaauuuugca

SEQ ID NO: 907380 - RNA, 18 nt, Homo sapiens
uaacgaaugguacuacaa

SEQ ID NO: 907381 - RNA, 22 nt, Homo sapiens
uaacuacaaggacaaugccuug

SEQ ID NO: 907382 - RNA, 19 nt, Homo sapiens
uaacuacuuuuuauacucc

SEQ ID NO: 907383 - RNA, 21 nt, Homo sapiens
uaacuacuuuuuauacuccau

SEQ ID NO: 907384 - RNA, 18 nt, Homo sapiens
uaacuagaaaucugccaa

SEQ ID NO: 907385 - RNA, 13 nt, Homo sapiens
uaacuagaucucc

SEQ ID NO: 907386 - RNA, 22 nt, Homo sapiens
uaacuaguccuuuacuaaucca

SEQ ID NO: 907387 - RNA, 18 nt, Homo sapiens
uaacuauaucauccuuua

SEQ ID NO: 907388 - RNA, 17 nt, Homo sapiens
uaacucagacauuccaa

SEQ ID NO: 907389 - RNA, 16 nt, Homo sapiens
uaacucaucugucacc

SEQ ID NO: 907390 - RNA, 14 nt, Homo sapiens
uaacuccagucucc

SEQ ID NO: 907391 - RNA, 15 nt, Homo sapiens
uaacucuuuggucau

SEQ ID NO: 907392 - RNA, 21 nt, Homo sapiens
uaacugcacacaugguuucca

SEQ ID NO: 907393 - RNA, 17 nt, Homo sapiens
uaacugccuuguguaca

SEQ ID NO: 907394 - RNA, 20 nt, Homo sapiens
uaacuguaaaucacuuguaa

SEQ ID NO: 907395 - RNA, 22 nt, Homo sapiens
uaacuguagauaaagugguuug

SEQ ID NO: 907396 - RNA, 17 nt, Homo sapiens
uaacuuauaucaucagc

SEQ ID NO: 907397 - RNA, 13 nt, Homo sapiens
uaacuuauuuucc

SEQ ID NO: 907398 - RNA, 15 nt, Homo sapiens
uaacuucuuaaucua

SEQ ID NO: 907399 - RNA, 16 nt, Homo sapiens
uaacuugauauagaaa

SEQ ID NO: 907400 - RNA, 16 nt, Homo sapiens
uaagaaaacaaucaca

SEQ ID NO: 907401 - RNA, 17 nt, Homo sapiens
uaagaaaacaucacuga

SEQ ID NO: 907402 - RNA, 18 nt, Homo sapiens
uaagaaaacaucacugaa

SEQ ID NO: 907403 - RNA, 13 nt, Homo sapiens
uaagaaacauaac

SEQ ID NO: 907404 - RNA, 22 nt, Homo sapiens
uaagaaaucauggcauucacac

SEQ ID NO: 907405 - RNA, 22 nt, Homo sapiens
uuugccauucagucuagcuuuu

SEQ ID NO: 907406 - RNA, 17 nt, Homo sapiens
uuugcccuguggauucc

SEQ ID NO: 907407 - RNA, 13 nt, Homo sapiens
uuugccucaaaua

SEQ ID NO: 907408 - RNA, 14 nt, Homo sapiens
uuugcuaucaaaau

SEQ ID NO: 907409 - RNA, 17 nt, Homo sapiens
uuugcuuaaaauugcua

SEQ ID NO: 907410 - RNA, 19 nt, Homo sapiens
uuugcuuuguguaaauaca

SEQ ID NO: 907411 - RNA, 20 nt, Homo sapiens
uuuggagacggccaagugaa

SEQ ID NO: 907412 - RNA, 21 nt, Homo sapiens
uuuggauaauauccacugcaa

SEQ ID NO: 907413 - RNA, 17 nt, Homo sapiens
uuuggaugaccagaaca

SEQ ID NO: 907414 - RNA, 14 nt, Homo sapiens
uuuggauguuucca

SEQ ID NO: 907415 - RNA, 16 nt, Homo sapiens
uuuggauguuuccacg

SEQ ID NO: 907416 - RNA, 22 nt, Homo sapiens
uuuggggagaaauaaauuuugu

SEQ ID NO: 907417 - RNA, 15 nt, Homo sapiens
uuuggguaacuucaa

SEQ ID NO: 907418 - RNA, 22 nt, Homo sapiens
uuuggugaccaauacuacugua

SEQ ID NO: 907419 - RNA, 18 nt, Homo sapiens
uuugguguuacacagccc

SEQ ID NO: 907420 - RNA, 18 nt, Homo sapiens
uuugguucucuccaggaa

SEQ ID NO: 907421 - RNA, 19 nt, Homo sapiens
uuugguucucuccaggaag

SEQ ID NO: 907422 - RNA, 13 nt, Homo sapiens
uuuguaaagguca

SEQ ID NO: 907423 - RNA, 20 nt, Homo sapiens
uuuguaauaaacucucuagg

SEQ ID NO: 907424 - RNA, 14 nt, Homo sapiens
uuuguaauugcuua

SEQ ID NO: 907425 - RNA, 18 nt, Homo sapiens
uuuguacaauuacuaaau

SEQ ID NO: 907426 - RNA, 20 nt, Homo sapiens
uuuguauuuaaaaccuugau

SEQ ID NO: 907427 - RNA, 13 nt, Homo sapiens
uuuguauuugcca

SEQ ID NO: 907428 - RNA, 14 nt, Homo sapiens
uuuguauuugccau

SEQ ID NO: 907429 - RNA, 17 nt, Homo sapiens
uuugucucugcaucuca

SEQ ID NO: 907430 - RNA, 15 nt, Homo sapiens
uuugugcagcacagu

SEQ ID NO: 907431 - RNA, 16 nt, Homo sapiens
uuuguggucacagcca

SEQ ID NO: 907432 - RNA, 16 nt, Homo sapiens
ucacugaaaagacuau

SEQ ID NO: 907433 - RNA, 14 nt, Homo sapiens
ucacugcaaccucc

SEQ ID NO: 907434 - RNA, 14 nt, Homo sapiens
ucacugcaaccucu

SEQ ID NO: 907435 - RNA, 15 nt, Homo sapiens
ucacugcagccucaa

SEQ ID NO: 907436 - RNA, 19 nt, Homo sapiens
ucacugcucuggacugugu

SEQ ID NO: 907437 - RNA, 15 nt, Homo sapiens
ucacuguguaaccag

SEQ ID NO: 907438 - RNA, 15 nt, Homo sapiens
ucacuguucuaucuc

SEQ ID NO: 907439 - RNA, 20 nt, Homo sapiens
ucacuuauaccaaagggaaa

SEQ ID NO: 907440 - RNA, 14 nt, Homo sapiens
ucacuuauuucaua

SEQ ID NO: 907441 - RNA, 20 nt, Homo sapiens
ucacuuauuucauaaacaac

SEQ ID NO: 907442 - RNA, 20 nt, Homo sapiens
ucacuuggaagauuuguaua

SEQ ID NO: 907443 - RNA, 13 nt, Homo sapiens
ucacuuguacaaa

SEQ ID NO: 907444 - RNA, 17 nt, Homo sapiens
ucacuuuuaaugaacaa

SEQ ID NO: 907445 - RNA, 17 nt, Homo sapiens
ucacuuuucuuuauugc

SEQ ID NO: 907446 - RNA, 19 nt, Homo sapiens
ucacuuuuuacagugcuau

SEQ ID NO: 907447 - RNA, 18 nt, Homo sapiens
ucacuuuuuauuuugcca

SEQ ID NO: 907448 - RNA, 21 nt, Homo sapiens
ucagaaagggagggcucugag

SEQ ID NO: 907449 - RNA, 13 nt, Homo sapiens
ucagaaagucaua

SEQ ID NO: 907450 - RNA, 15 nt, Homo sapiens
ucagaacauccucca

SEQ ID NO: 907451 - RNA, 15 nt, Homo sapiens
ucagaaccgagugag

SEQ ID NO: 907452 - RNA, 22 nt, Homo sapiens
ucagaacucuguguugugaaug

SEQ ID NO: 907453 - RNA, 14 nt, Homo sapiens
ucauuagcugugau

SEQ ID NO: 907454 - RNA, 19 nt, Homo sapiens
ucauuaucucaaaacugca

SEQ ID NO: 907455 - RNA, 16 nt, Homo sapiens
ucauuaugacucuuaa

SEQ ID NO: 907456 - RNA, 15 nt, Homo sapiens
ucauuauuugcagag

SEQ ID NO: 907457 - RNA, 16 nt, Homo sapiens
ucauuccaccuuccca

SEQ ID NO: 907458 - RNA, 21 nt, Homo sapiens
ucauuccugaaagaaacaguu

SEQ ID NO: 907459 - RNA, 15 nt, Homo sapiens
ucauugaaguauuuu

SEQ ID NO: 907460 - RNA, 17 nt, Homo sapiens
ucauugcuuugaagcag

SEQ ID NO: 907461 - RNA, 17 nt, Homo sapiens
ucauuggccuucuuaaa

SEQ ID NO: 907462 - RNA, 17 nt, Homo sapiens
ucauuguagaaacacag

SEQ ID NO: 907463 - RNA, 15 nt, Homo sapiens
ucauuuaauccuccc

SEQ ID NO: 907464 - RNA, 13 nt, Homo sapiens
ucauuuaccauaa

SEQ ID NO: 907465 - RNA, 23 nt, Homo sapiens
ucauuucauuguaugauguguug

SEQ ID NO: 907466 - RNA, 15 nt, Homo sapiens
ucauuucuacuguga

SEQ ID NO: 907467 - RNA, 17 nt, Homo sapiens
ucauuuuuuucacugga

SEQ ID NO: 907468 - RNA, 18 nt, Homo sapiens
ucauuuuuuucacuggag

SEQ ID NO: 907469 - RNA, 21 nt, Homo sapiens
uccaaaaaggaacacuggaaa

SEQ ID NO: 907470 - RNA, 14 nt, Homo sapiens
uccaaaacuuuaag

SEQ ID NO: 907471 - RNA, 18 nt, Homo sapiens
uccaaaccgcaggcaaac

SEQ ID NO: 907472 - RNA, 17 nt, Homo sapiens
uccaaaggaaucuccag

SEQ ID NO: 907473 - RNA, 14 nt, Homo sapiens
uccaaaguuaucca

SEQ ID NO: 907474 - RNA, 23 nt, Homo sapiens
uccaacagaguuauuuauuggcu

SEQ ID NO: 907475 - RNA, 19 nt, Homo sapiens
uccaacagugagucuguca

SEQ ID NO: 907476 - RNA, 16 nt, Homo sapiens
uccaacccaaccucau

SEQ ID NO: 907477 - RNA, 16 nt, Homo sapiens
uccaaccuaaccccuu

SEQ ID NO: 907478 - RNA, 23 nt, Homo sapiens
uccaacuaacguacauucaacag

SEQ ID NO: 907479 - RNA, 16 nt, Homo sapiens
uccaagaauacagaaa

SEQ ID NO: 907480 - RNA, 14 nt, Homo sapiens
uccaagcauaccaa

SEQ ID NO: 907481 - RNA, 23 nt, Homo sapiens
uccaagccugaccacgcuuucua

SEQ ID NO: 907482 - RNA, 18 nt, Homo sapiens
uccaaggaguuccaugaa

SEQ ID NO: 907483 - RNA, 20 nt, Homo sapiens
uccaaguuccugcacuccag

SEQ ID NO: 907484 - RNA, 19 nt, Homo sapiens
uccaauccucaggauuuca

SEQ ID NO: 907485 - RNA, 24 nt, Homo sapiens
uccaauccucaggauuucauugac

SEQ ID NO: 907486 - RNA, 16 nt, Homo sapiens
uccaauggcuguaaac

SEQ ID NO: 907487 - RNA, 22 nt, Homo sapiens
uccaauuaugugacaaccuuug

SEQ ID NO: 907488 - RNA, 20 nt, Homo sapiens
uccaauugaacuuucacaua

SEQ ID NO: 907489 - RNA, 22 nt, Homo sapiens
uccaauugaacuuucacauagc

SEQ ID NO: 907490 - RNA, 14 nt, Homo sapiens
uccacagaaauaca

SEQ ID NO: 907491 - RNA, 19 nt, Homo sapiens
uccacagaauacaagccac

SEQ ID NO: 907492 - RNA, 17 nt, Homo sapiens
uccacaguuuugccuua

SEQ ID NO: 907493 - RNA, 14 nt, Homo sapiens
uccacaucuucuca

SEQ ID NO: 907494 - RNA, 14 nt, Homo sapiens
uccacauuauacau

SEQ ID NO: 907495 - RNA, 18 nt, Homo sapiens
uccacauuauacauuuga

SEQ ID NO: 907496 - RNA, 17 nt, Homo sapiens
uccacccacaacaucua

SEQ ID NO: 907497 - RNA, 15 nt, Homo sapiens
uccacccagugcugc

SEQ ID NO: 907498 - RNA, 20 nt, Homo sapiens
uccaccccacuggaucuuca

SEQ ID NO: 907499 - RNA, 14 nt, Homo sapiens
uccacccuaucccu

SEQ ID NO: 907500 - RNA, 22 nt, Homo sapiens
uccaccgggccugaaccacagc

SEQ ID NO: 907501 - RNA, 20 nt, Homo sapiens
uccacgggaagccuccguca

SEQ ID NO: 907502 - RNA, 20 nt, Homo sapiens
uccacgggucucacuuauac

SEQ ID NO: 907503 - RNA, 13 nt, Homo sapiens
uccacucacucca

SEQ ID NO: 907504 - RNA, 21 nt, Homo sapiens
uccacuccagauuuuuuacag

SEQ ID NO: 907505 - RNA, 22 nt, Homo sapiens
uccacugaggaugugagccuga

SEQ ID NO: 907506 - RNA, 15 nt, Homo sapiens
uccacugcucucagc

SEQ ID NO: 907507 - RNA, 16 nt, Homo sapiens
uccacuggcuccacau

SEQ ID NO: 907508 - RNA, 15 nt, Homo sapiens
uccacugugccaugu

SEQ ID NO: 907509 - RNA, 16 nt, Homo sapiens
uccacuucaaucugag

SEQ ID NO: 907510 - RNA, 14 nt, Homo sapiens
uccagaacugaggu

SEQ ID NO: 907511 - RNA, 16 nt, Homo sapiens
uccagaauaaaacgca

SEQ ID NO: 907512 - RNA, 17 nt, Homo sapiens
uccagacagagcccugu

SEQ ID NO: 907513 - RNA, 19 nt, Homo sapiens
uccagaccauugucuucca

SEQ ID NO: 907514 - RNA, 16 nt, Homo sapiens
uccagaggugauggua

SEQ ID NO: 907515 - RNA, 18 nt, Homo sapiens
uccagcacagaaggaauc

SEQ ID NO: 907516 - RNA, 16 nt, Homo sapiens
uccagccaacauuuaa

SEQ ID NO: 907517 - RNA, 21 nt, Homo sapiens
uccagccugcccucagcacag

SEQ ID NO: 907518 - RNA, 14 nt, Homo sapiens
uccaggaaggcagc

SEQ ID NO: 907519 - RNA, 16 nt, Homo sapiens
uccaggaaggcagcug

SEQ ID NO: 907520 - RNA, 21 nt, Homo sapiens
uccaggagcaauuugcacaug

SEQ ID NO: 907521 - RNA, 13 nt, Homo sapiens
uccagggcccaaa

SEQ ID NO: 907522 - RNA, 14 nt, Homo sapiens
uccagguacugauc

SEQ ID NO: 907523 - RNA, 13 nt, Homo sapiens
uccagucuggauc

SEQ ID NO: 907524 - RNA, 20 nt, Homo sapiens
uccagugagcucuggaugaa

SEQ ID NO: 907525 - RNA, 14 nt, Homo sapiens
uccaguuccgggag

SEQ ID NO: 907526 - RNA, 15 nt, Homo sapiens
uccaguucugacaca

SEQ ID NO: 907527 - RNA, 18 nt, Homo sapiens
uccauaaacacccaugaa

SEQ ID NO: 907528 - RNA, 18 nt, Homo sapiens
uccauagugcacuagcau

SEQ ID NO: 907529 - RNA, 21 nt, Homo sapiens
uccauagugcacuagcauuuu

SEQ ID NO: 907530 - RNA, 18 nt, Homo sapiens
uccauauauuagcauuua

SEQ ID NO: 907531 - RNA, 22 nt, Homo sapiens
uccaucacccguacaggcaauu

SEQ ID NO: 907532 - RNA, 21 nt, Homo sapiens
uccaucacuagccaugauaac

SEQ ID NO: 907533 - RNA, 20 nt, Homo sapiens
uccaucauggcagugaugaa

SEQ ID NO: 907534 - RNA, 17 nt, Homo sapiens
uccauccggcuccuguc

SEQ ID NO: 907535 - RNA, 22 nt, Homo sapiens
uccauccggcuccugucauccc

SEQ ID NO: 907536 - RNA, 16 nt, Homo sapiens
uccauccuaaucugaa

SEQ ID NO: 907537 - RNA, 14 nt, Homo sapiens
uccaucuccagugg

SEQ ID NO: 907538 - RNA, 12 nt, Homo sapiens
uccaucucuggc

SEQ ID NO: 907539 - RNA, 14 nt, Homo sapiens
uccaugaagaccac

SEQ ID NO: 907540 - RNA, 20 nt, Homo sapiens
uccauucaugccaaagcaaa

SEQ ID NO: 907541 - RNA, 13 nt, Homo sapiens
uccauugucuuau

SEQ ID NO: 907542 - RNA, 22 nt, Homo sapiens
uccauuuauugcacucagcuuu

SEQ ID NO: 907543 - RNA, 14 nt, Homo sapiens
uccauuuggacaaa

SEQ ID NO: 907544 - RNA, 17 nt, Homo sapiens
ucccaaaagucaccacu

SEQ ID NO: 907545 - RNA, 13 nt, Homo sapiens
ucccaaaauacua

SEQ ID NO: 907546 - RNA, 22 nt, Homo sapiens
ucccaaaauacuacacauccaa

SEQ ID NO: 907547 - RNA, 21 nt, Homo sapiens
ucccaacuccucccuauccua

SEQ ID NO: 907548 - RNA, 15 nt, Homo sapiens
ucuacuaaaaauaca

SEQ ID NO: 907549 - RNA, 17 nt, Homo sapiens
ucuacugagacaugacu

SEQ ID NO: 907550 - RNA, 22 nt, Homo sapiens
ucuacugugacugauguuacau

SEQ ID NO: 907551 - RNA, 16 nt, Homo sapiens
ucuacuuaaugagaua

SEQ ID NO: 907552 - RNA, 18 nt, Homo sapiens
ucuacuugaauacucuca

SEQ ID NO: 907553 - RNA, 13 nt, Homo sapiens
ucuacuuugucua

SEQ ID NO: 907554 - RNA, 15 nt, Homo sapiens
ucuagaacaugcaca

SEQ ID NO: 907555 - RNA, 22 nt, Homo sapiens
ucuagacacugccacacagggu

SEQ ID NO: 907556 - RNA, 19 nt, Homo sapiens
ucuagccugggcaacaaca

SEQ ID NO: 907557 - RNA, 18 nt, Homo sapiens
ucuagcuucaugccucag

SEQ ID NO: 907558 - RNA, 16 nt, Homo sapiens
ucuaggacuccacagu

SEQ ID NO: 907559 - RNA, 18 nt, Homo sapiens
ucuaggcaucccagggga

SEQ ID NO: 907560 - RNA, 13 nt, Homo sapiens
ucuaguaucacau

SEQ ID NO: 907561 - RNA, 20 nt, Homo sapiens
ucuauaauggaaacauuuac

SEQ ID NO: 907562 - RNA, 21 nt, Homo sapiens
ucuauaauggaaacauuuaca

SEQ ID NO: 907563 - RNA, 13 nt, Homo sapiens
ucuauagcagauu

SEQ ID NO: 907564 - RNA, 15 nt, Homo sapiens
ucuauaguagucaau

SEQ ID NO: 907565 - RNA, 14 nt, Homo sapiens
ucuaucaauaguca

SEQ ID NO: 907566 - RNA, 17 nt, Homo sapiens
ucuaucaauagucaaga

SEQ ID NO: 907567 - RNA, 14 nt, Homo sapiens
ucuaucacauuaca

SEQ ID NO: 907568 - RNA, 14 nt, Homo sapiens
ucuaugaucuuggc

SEQ ID NO: 907569 - RNA, 12 nt, Homo sapiens
ucuaugcuuauu

SEQ ID NO: 907570 - RNA, 23 nt, Homo sapiens
ucuauggcaguccagccagcucc

SEQ ID NO: 907571 - RNA, 18 nt, Homo sapiens
ucuaugggacucaaugca

SEQ ID NO: 907572 - RNA, 14 nt, Homo sapiens
ucuaugguugacau

SEQ ID NO: 907573 - RNA, 14 nt, Homo sapiens
ucuauguaugcauc

SEQ ID NO: 907574 - RNA, 17 nt, Homo sapiens
ucuauuccuaucugugg

SEQ ID NO: 907575 - RNA, 13 nt, Homo sapiens
ucuauucuaagua

SEQ ID NO: 907576 - RNA, 17 nt, Homo sapiens
ucuauuuugccacaagc

SEQ ID NO: 907577 - RNA, 19 nt, Homo sapiens
ucucaaauccugaugcugu

SEQ ID NO: 907578 - RNA, 15 nt, Homo sapiens
ucucaacuacucagc

SEQ ID NO: 907579 - RNA, 14 nt, Homo sapiens
ucucaauaguaaaa

SEQ ID NO: 907580 - RNA, 21 nt, Homo sapiens
ucucaauaugcuuacaaaguc

SEQ ID NO: 907581 - RNA, 16 nt, Homo sapiens
ucucaaucagugcagu

SEQ ID NO: 907582 - RNA, 13 nt, Homo sapiens
ucucacacacaua

SEQ ID NO: 907583 - RNA, 21 nt, Homo sapiens
ucucaccgggcuacuaccugg

SEQ ID NO: 907584 - RNA, 18 nt, Homo sapiens
ucucacuauguugcccag

SEQ ID NO: 907585 - RNA, 20 nt, Homo sapiens
ucucacuauguugcccaggc

SEQ ID NO: 907586 - RNA, 10 nt, Homo sapiens
ucucagccau

SEQ ID NO: 907587 - RNA, 21 nt, Homo sapiens
ucucagcccgggacagggucu

SEQ ID NO: 907588 - RNA, 22 nt, Homo sapiens
ucucagcccgggacagggucuu

SEQ ID NO: 907589 - RNA, 16 nt, Homo sapiens
ucucagccuaccauga

SEQ ID NO: 907590 - RNA, 18 nt, Homo sapiens
ucucagcgagguguaaag

SEQ ID NO: 907591 - RNA, 20 nt, Homo sapiens
ucucagucaguaauugccaa

SEQ ID NO: 907592 - RNA, 15 nt, Homo sapiens
ucucauuuaagggaa

SEQ ID NO: 907593 - RNA, 13 nt, Homo sapiens
ucuccaaacauua

SEQ ID NO: 907594 - RNA, 22 nt, Homo sapiens
ucuccaaaugagacacauuaaa

SEQ ID NO: 907595 - RNA, 22 nt, Homo sapiens
ucuccaccaacuggagcacuga

SEQ ID NO: 907596 - RNA, 12 nt, Homo sapiens
ucuccacugcuc

SEQ ID NO: 907597 - RNA, 12 nt, Homo sapiens
ucuccagcacuu

SEQ ID NO: 907598 - RNA, 16 nt, Homo sapiens
ucuccccaggccucca

SEQ ID NO: 907599 - RNA, 19 nt, Homo sapiens
ucucccuggaucagaacag

SEQ ID NO: 907600 - RNA, 16 nt, Homo sapiens
ucuccucccauggccu

SEQ ID NO: 907601 - RNA, 15 nt, Homo sapiens
ucuccuggcuuccca

SEQ ID NO: 907602 - RNA, 22 nt, Homo sapiens
ucuccugggcccgcuuugccug

SEQ ID NO: 907603 - RNA, 16 nt, Homo sapiens
ucuccuguauaaucuc

SEQ ID NO: 907604 - RNA, 18 nt, Homo sapiens
ucuccuguauaaucucuc

SEQ ID NO: 907605 - RNA, 20 nt, Homo sapiens
ucuccuuggaaauacuuuau

SEQ ID NO: 907606 - RNA, 16 nt, Homo sapiens
ucuccuuggaggacag

SEQ ID NO: 907607 - RNA, 18 nt, Homo sapiens
ucuccuuuugaccaaaua

SEQ ID NO: 907608 - RNA, 19 nt, Homo sapiens
ucucgaacuccugaccuca

SEQ ID NO: 907609 - RNA, 16 nt, Homo sapiens
ucucgcagauguuacc

SEQ ID NO: 907610 - RNA, 16 nt, Homo sapiens
ucucgggugcauuuga

SEQ ID NO: 907611 - RNA, 13 nt, Homo sapiens
ucucuaaaacugc

SEQ ID NO: 907612 - RNA, 18 nt, Homo sapiens
ucucuaaacugcuguuaa

SEQ ID NO: 907613 - RNA, 16 nt, Homo sapiens
ucucuaaaucaaguau

SEQ ID NO: 907614 - RNA, 23 nt, Homo sapiens
ucucuaugccagcucagucccau

SEQ ID NO: 907615 - RNA, 14 nt, Homo sapiens
ucucucaugaaccu

SEQ ID NO: 907616 - RNA, 20 nt, Homo sapiens
ucucuccaccgugacacaau

SEQ ID NO: 907617 - RNA, 23 nt, Homo sapiens
ucucuccuaagacaccugcaaua

SEQ ID NO: 907618 - RNA, 18 nt, Homo sapiens
ucucuccuuguucugaua

SEQ ID NO: 907619 - RNA, 9 nt, Homo sapiens
ucucucuuu

SEQ ID NO: 907620 - RNA, 17 nt, Homo sapiens
ucucugaagcauguuuc

SEQ ID NO: 907621 - RNA, 15 nt, Homo sapiens
ucucugacucuugcc

SEQ ID NO: 907622 - RNA, 22 nt, Homo sapiens
ucucugagauguguucagauag

SEQ ID NO: 907623 - RNA, 17 nt, Homo sapiens
ucucugcaaagacuaga

SEQ ID NO: 907624 - RNA, 15 nt, Homo sapiens
ucucugcucuugccu

SEQ ID NO: 907625 - RNA, 12 nt, Homo sapiens
ucucugcugcua

SEQ ID NO: 907626 - RNA, 15 nt, Homo sapiens
ucucugggagacuuu

SEQ ID NO: 907627 - RNA, 15 nt, Homo sapiens
ucucugucucaaauu

SEQ ID NO: 907628 - RNA, 16 nt, Homo sapiens
ucucugucuggcugua

SEQ ID NO: 907629 - RNA, 16 nt, Homo sapiens
ucucuuauagaauauu

SEQ ID NO: 907630 - RNA, 17 nt, Homo sapiens
ucucuuauauaguauuc

SEQ ID NO: 907631 - RNA, 15 nt, Homo sapiens
ucucuucacucccaa

SEQ ID NO: 907632 - RNA, 14 nt, Homo sapiens
ucucuucuuuaaag

SEQ ID NO: 907633 - RNA, 13 nt, Homo sapiens
ucucuuugagaga

SEQ ID NO: 907634 - RNA, 19 nt, Homo sapiens
ucugaaaauuaacacugcu

SEQ ID NO: 907635 - RNA, 14 nt, Homo sapiens
ucugaaacuuaauu

SEQ ID NO: 907636 - RNA, 12 nt, Homo sapiens
ucugaaaugccu

SEQ ID NO: 907637 - RNA, 15 nt, Homo sapiens
ucugaaccauuacug

SEQ ID NO: 907638 - RNA, 14 nt, Homo sapiens
ucugaaggagauuu

SEQ ID NO: 907639 - RNA, 20 nt, Homo sapiens
ucugaagucacaucacagga

SEQ ID NO: 907640 - RNA, 15 nt, Homo sapiens
ucugaaugacaucaa

SEQ ID NO: 907641 - RNA, 13 nt, Homo sapiens
ucugacacacagc

SEQ ID NO: 907642 - RNA, 15 nt, Homo sapiens
ucugacccacugcuu

SEQ ID NO: 907643 - RNA, 11 nt, Homo sapiens
ucugacugcug

SEQ ID NO: 907644 - RNA, 17 nt, Homo sapiens
ucugagaauuccaagga

SEQ ID NO: 907645 - RNA, 16 nt, Homo sapiens
ucugagacuauaacug

SEQ ID NO: 907646 - RNA, 19 nt, Homo sapiens
ucugagacuauaacuguca

SEQ ID NO: 907647 - RNA, 12 nt, Homo sapiens
ucugagaucucc

SEQ ID NO: 907648 - RNA, 20 nt, Homo sapiens
ucugagcaagagcuggcaaa

SEQ ID NO: 907649 - RNA, 15 nt, Homo sapiens
ucugagcuagugauu

SEQ ID NO: 907650 - RNA, 22 nt, Homo sapiens
ucugagcuagugauuugccuca

SEQ ID NO: 907651 - RNA, 21 nt, Homo sapiens
ucugaggaaggugcuugccug

SEQ ID NO: 907652 - RNA, 22 nt, Homo sapiens
ucugaugaccuaaccuaagcaa

SEQ ID NO: 907653 - RNA, 20 nt, Homo sapiens
ucugcaaugggcacugggau

SEQ ID NO: 907654 - RNA, 21 nt, Homo sapiens
ucugcacccagaaauuccuuc

SEQ ID NO: 907655 - RNA, 15 nt, Homo sapiens
ucugcagugugcacg

SEQ ID NO: 907656 - RNA, 21 nt, Homo sapiens
ucugcauuaucugaggucaca

SEQ ID NO: 907657 - RNA, 21 nt, Homo sapiens
ucugcauuccccgcugcccaa

SEQ ID NO: 907658 - RNA, 18 nt, Homo sapiens
ucugccagccagcagcca

SEQ ID NO: 907659 - RNA, 18 nt, Homo sapiens
ucugccauaaagccauuc

SEQ ID NO: 907660 - RNA, 13 nt, Homo sapiens
ucugcccaccuac

SEQ ID NO: 907661 - RNA, 16 nt, Homo sapiens
ucugcccagaauucua

SEQ ID NO: 907662 - RNA, 16 nt, Homo sapiens
ucugccccacccucaa

SEQ ID NO: 907663 - RNA, 23 nt, Homo sapiens
ucugcccuagcgcucucuuccag

SEQ ID NO: 907664 - RNA, 14 nt, Homo sapiens
ggagaaugaugucc

SEQ ID NO: 907665 - RNA, 24 nt, Homo sapiens
ggagaauuauauagguugugcaaa

SEQ ID NO: 907666 - RNA, 18 nt, Homo sapiens
ggagaccucuacugccuu

SEQ ID NO: 907667 - RNA, 14 nt, Homo sapiens
ggagagaacugaau

SEQ ID NO: 907668 - RNA, 13 nt, Homo sapiens
ggagagagaucua

SEQ ID NO: 907669 - RNA, 11 nt, Homo sapiens
ggagagccaga

SEQ ID NO: 907670 - RNA, 15 nt, Homo sapiens
ggagagcccagccau

SEQ ID NO: 907671 - RNA, 17 nt, Homo sapiens
ggagauaaucuagaaca

SEQ ID NO: 907672 - RNA, 15 nt, Homo sapiens
ggagcaaauguuucu

SEQ ID NO: 907673 - RNA, 13 nt, Homo sapiens
ggagcaacagagg

SEQ ID NO: 907674 - RNA, 12 nt, Homo sapiens
ggagcacugggu

SEQ ID NO: 907675 - RNA, 15 nt, Homo sapiens
ggagcaucugacuca

SEQ ID NO: 907676 - RNA, 19 nt, Homo sapiens
ggagcccccucuuccacuc

SEQ ID NO: 907677 - RNA, 15 nt, Homo sapiens
ggagccgcugcugag

SEQ ID NO: 907678 - RNA, 19 nt, Homo sapiens
ggagcucacucccacugga

SEQ ID NO: 907679 - RNA, 20 nt, Homo sapiens
ggagcugaggaggugccuug

SEQ ID NO: 907680 - RNA, 15 nt, Homo sapiens
ggagcuggaaauaaa

SEQ ID NO: 907681 - RNA, 13 nt, Homo sapiens
ggagcuuccagug

SEQ ID NO: 907682 - RNA, 14 nt, Homo sapiens
ggagcuugcaguga

SEQ ID NO: 907683 - RNA, 22 nt, Homo sapiens
ggagcuuguauauacuucacuc

SEQ ID NO: 907684 - RNA, 23 nt, Homo sapiens
ggagcuuuagcuucucugccaag

SEQ ID NO: 907685 - RNA, 15 nt, Homo sapiens
ggaggaccagagcua

SEQ ID NO: 907686 - RNA, 18 nt, Homo sapiens
ggaggacuccgggaccau

SEQ ID NO: 907687 - RNA, 22 nt, Homo sapiens
ggaggagcugccgcaaggcccu

SEQ ID NO: 907688 - RNA, 20 nt, Homo sapiens
ggaggauguucugggacaca

SEQ ID NO: 907689 - RNA, 13 nt, Homo sapiens
ggaggccucaguu

SEQ ID NO: 907690 - RNA, 14 nt, Homo sapiens
ggaggccugaugcu

SEQ ID NO: 907691 - RNA, 16 nt, Homo sapiens
ggaggcggcuccaggu

SEQ ID NO: 907692 - RNA, 21 nt, Homo sapiens
ggaggcuugccccacccaaca

SEQ ID NO: 907693 - RNA, 21 nt, Homo sapiens
ggagggccccucaugugugcu

SEQ ID NO: 907694 - RNA, 17 nt, Homo sapiens
ggagguagcucccagca

SEQ ID NO: 907695 - RNA, 23 nt, Homo sapiens
ggaggucgggauggggcuuguag

SEQ ID NO: 907696 - RNA, 14 nt, Homo sapiens
ggagguugcaguga

SEQ ID NO: 907697 - RNA, 24 nt, Homo sapiens
ggaguagcugagaggaagaugaag

SEQ ID NO: 907698 - RNA, 19 nt, Homo sapiens
ggagucagaaacuguuucu

SEQ ID NO: 907699 - RNA, 12 nt, Homo sapiens
ggagugcaguuu

SEQ ID NO: 907700 - RNA, 20 nt, Homo sapiens
ggaguucguggcugcaaaag

SEQ ID NO: 907701 - RNA, 18 nt, Homo sapiens
ggauaauaacuagaucuc

SEQ ID NO: 907702 - RNA, 19 nt, Homo sapiens
ggauaauaacuagaucucc

SEQ ID NO: 907703 - RNA, 20 nt, Homo sapiens
ggauaauauccacugcaaua

SEQ ID NO: 907704 - RNA, 23 nt, Homo sapiens
ggauacagucuucuuacuuggaa

SEQ ID NO: 907705 - RNA, 17 nt, Homo sapiens
ggauaccagauauuuga

SEQ ID NO: 907706 - RNA, 13 nt, Homo sapiens
ggauagaugaaua

SEQ ID NO: 907707 - RNA, 20 nt, Homo sapiens
ggauaucaauuaauuugaaa

SEQ ID NO: 907708 - RNA, 21 nt, Homo sapiens
ggauccccagccuacugccuc

SEQ ID NO: 907709 - RNA, 15 nt, Homo sapiens
ggaucuaucuguauu

SEQ ID NO: 907710 - RNA, 17 nt, Homo sapiens
ggaucucacaagcacuu

SEQ ID NO: 907711 - RNA, 17 nt, Homo sapiens
ggaugaaagcaaucuga

SEQ ID NO: 907712 - RNA, 20 nt, Homo sapiens
ggaugaagauucuccugugc

SEQ ID NO: 907713 - RNA, 13 nt, Homo sapiens
ggaugccacccag

SEQ ID NO: 907714 - RNA, 13 nt, Homo sapiens
ggauggagcacuu

SEQ ID NO: 907715 - RNA, 21 nt, Homo sapiens
ggauggggcagucucugccca

SEQ ID NO: 907716 - RNA, 20 nt, Homo sapiens
ggaugggggucaggggcuag

SEQ ID NO: 907717 - RNA, 21 nt, Homo sapiens
ggaugugcccacagggaccaa

SEQ ID NO: 907718 - RNA, 14 nt, Homo sapiens
ggaugugugucuca

SEQ ID NO: 907719 - RNA, 16 nt, Homo sapiens
ggauguguuuugcacg

SEQ ID NO: 907720 - RNA, 16 nt, Homo sapiens
ggauguucugggacac

SEQ ID NO: 907721 - RNA, 20 nt, Homo sapiens
ggauguuuugucccauuucc

SEQ ID NO: 907722 - RNA, 20 nt, Homo sapiens
ggauuacagguguaagccac

SEQ ID NO: 907723 - RNA, 22 nt, Homo sapiens
ggauuccagagcacugcuccag

SEQ ID NO: 907724 - RNA, 17 nt, Homo sapiens
ggauucuuccaucugau

SEQ ID NO: 907725 - RNA, 15 nt, Homo sapiens
ggauugacaggccau

SEQ ID NO: 907726 - RNA, 21 nt, Homo sapiens
ggauugcuacuguccuaccca

SEQ ID NO: 907727 - RNA, 18 nt, Homo sapiens
ggauuuuagugcuugcca

SEQ ID NO: 907728 - RNA, 23 nt, Homo sapiens
ggcaaacccaaaaccucaugaca

SEQ ID NO: 907729 - RNA, 19 nt, Homo sapiens
ggcaaagguggcucuccag

SEQ ID NO: 907730 - RNA, 14 nt, Homo sapiens
ggcaaagugcugua

SEQ ID NO: 907731 - RNA, 22 nt, Homo sapiens
ggcaaaugacaugcacugaccc

SEQ ID NO: 907732 - RNA, 22 nt, Homo sapiens
ggcaaggacggccuucaacuga

SEQ ID NO: 907733 - RNA, 16 nt, Homo sapiens
gcugcaggaaucaaaa

SEQ ID NO: 907734 - RNA, 18 nt, Homo sapiens
gcugcauuugugucaucu

SEQ ID NO: 907735 - RNA, 16 nt, Homo sapiens
gcugccaggacaccug

SEQ ID NO: 907736 - RNA, 18 nt, Homo sapiens
gcugcccaaucauuugca

SEQ ID NO: 907737 - RNA, 21 nt, Homo sapiens
gcugcccaaucauuugcaaug

SEQ ID NO: 907738 - RNA, 19 nt, Homo sapiens
gcugccccugcaguuggca

SEQ ID NO: 907739 - RNA, 13 nt, Homo sapiens
gcugccucaugac

SEQ ID NO: 907740 - RNA, 23 nt, Homo sapiens
gcugcgucagaccaguacuggga

SEQ ID NO: 907741 - RNA, 18 nt, Homo sapiens
gcugcucagaggggcccc

SEQ ID NO: 907742 - RNA, 13 nt, Homo sapiens
gcugcucugcuau

SEQ ID NO: 907743 - RNA, 14 nt, Homo sapiens
gcugcucugugguc

SEQ ID NO: 907744 - RNA, 15 nt, Homo sapiens
gcugcugagaaccug

SEQ ID NO: 907745 - RNA, 12 nt, Homo sapiens
gcugcuguguag

SEQ ID NO: 907746 - RNA, 22 nt, Homo sapiens
gcugcuugacuaucacauacaa

SEQ ID NO: 907747 - RNA, 12 nt, Homo sapiens
gcuggaagcaca

SEQ ID NO: 907748 - RNA, 13 nt, Homo sapiens
gcuggacugagga

SEQ ID NO: 907749 - RNA, 21 nt, Homo sapiens
gcuggagcaaaagucauuaca

SEQ ID NO: 907750 - RNA, 14 nt, Homo sapiens
gcuggagugcagug

SEQ ID NO: 907751 - RNA, 15 nt, Homo sapiens
gcuggagugcaguga

SEQ ID NO: 907752 - RNA, 21 nt, Homo sapiens
gcuggcaccgcgugccaugca

SEQ ID NO: 907753 - RNA, 13 nt, Homo sapiens
gcuggcacugagc

SEQ ID NO: 907754 - RNA, 20 nt, Homo sapiens
gcuggcgccagggccugccg

SEQ ID NO: 907755 - RNA, 20 nt, Homo sapiens
gcuggcgugcaguggugcga

SEQ ID NO: 907756 - RNA, 14 nt, Homo sapiens
gcuggcugcaguga

SEQ ID NO: 907757 - RNA, 23 nt, Homo sapiens
gcugggaaaaaaguuuugaugaa

SEQ ID NO: 907758 - RNA, 20 nt, Homo sapiens
gcugggaacauguaccacug

SEQ ID NO: 907759 - RNA, 16 nt, Homo sapiens
gcugggacuacaggug

SEQ ID NO: 907760 - RNA, 15 nt, Homo sapiens
gcugggacuggccag

SEQ ID NO: 907761 - RNA, 20 nt, Homo sapiens
gcugggaguagcauggacuc

SEQ ID NO: 907762 - RNA, 13 nt, Homo sapiens
gcuggguggugua

SEQ ID NO: 907763 - RNA, 20 nt, Homo sapiens
gcugguuuuccuaaaugcag

SEQ ID NO: 907764 - RNA, 14 nt, Homo sapiens
gcuguacacugcac

SEQ ID NO: 907765 - RNA, 16 nt, Homo sapiens
gcuguacuugaugaca

SEQ ID NO: 907766 - RNA, 22 nt, Homo sapiens
gcuguauguuugaucacacagc

SEQ ID NO: 907767 - RNA, 18 nt, Homo sapiens
gcugucaggacaccagcc

SEQ ID NO: 907768 - RNA, 19 nt, Homo sapiens
gcugugaggccccuggaca

SEQ ID NO: 907769 - RNA, 16 nt, Homo sapiens
gcugugcuagugccug

SEQ ID NO: 907770 - RNA, 11 nt, Homo sapiens
gcugugcucuc

SEQ ID NO: 907771 - RNA, 11 nt, Homo sapiens
gcugugcugag

SEQ ID NO: 907772 - RNA, 18 nt, Homo sapiens
gcuguggccucacuuccc

SEQ ID NO: 907773 - RNA, 15 nt, Homo sapiens
gcuguggugagggaa

SEQ ID NO: 907774 - RNA, 13 nt, Homo sapiens
gcuguugccucau

SEQ ID NO: 907775 - RNA, 20 nt, Homo sapiens
gcuguuuccauagggugaca

SEQ ID NO: 907776 - RNA, 16 nt, Homo sapiens
gcuguuucuggaaaug

SEQ ID NO: 907777 - RNA, 17 nt, Homo sapiens
gcuuaaauauugaauaa

SEQ ID NO: 907778 - RNA, 13 nt, Homo sapiens
gcuuaaaugcaau

SEQ ID NO: 907779 - RNA, 12 nt, Homo sapiens
gcuuacccuuca

SEQ ID NO: 907780 - RNA, 15 nt, Homo sapiens
agacucacuguggga

SEQ ID NO: 907781 - RNA, 16 nt, Homo sapiens
agacucagcucugaca

SEQ ID NO: 907782 - RNA, 19 nt, Homo sapiens
agacucguucuucugggaa

SEQ ID NO: 907783 - RNA, 18 nt, Homo sapiens
agacugaaagcagcagcu

SEQ ID NO: 907784 - RNA, 16 nt, Homo sapiens
agacugaagauggaaa

SEQ ID NO: 907785 - RNA, 19 nt, Homo sapiens
agacugaagauggaaaaag

SEQ ID NO: 907786 - RNA, 12 nt, Homo sapiens
agacugagcucc

SEQ ID NO: 907787 - RNA, 23 nt, Homo sapiens
agacugcagccccagcugacacc

SEQ ID NO: 907788 - RNA, 23 nt, Homo sapiens
agacugcagccccggcugacacc

SEQ ID NO: 907789 - RNA, 18 nt, Homo sapiens
agacuggagcaucugacu

SEQ ID NO: 907790 - RNA, 16 nt, Homo sapiens
agacugggacuauggc

SEQ ID NO: 907791 - RNA, 21 nt, Homo sapiens
agacugggacuauggcuuauu

SEQ ID NO: 907792 - RNA, 20 nt, Homo sapiens
agacugggugaaagugacua

SEQ ID NO: 907793 - RNA, 14 nt, Homo sapiens
agacuguugcucaa

SEQ ID NO: 907794 - RNA, 17 nt, Homo sapiens
agacuuacuuacuccca

SEQ ID NO: 907795 - RNA, 17 nt, Homo sapiens
agacuuauguauuagcu

SEQ ID NO: 907796 - RNA, 19 nt, Homo sapiens
agacuucagaacaugcugg

SEQ ID NO: 907797 - RNA, 15 nt, Homo sapiens
agacuugauacugca

SEQ ID NO: 907798 - RNA, 21 nt, Homo sapiens
agagaaaaaaaauuaagacaa

SEQ ID NO: 907799 - RNA, 15 nt, Homo sapiens
agagaaaaaccaaug

SEQ ID NO: 907800 - RNA, 21 nt, Homo sapiens
agagaaaaacuuucauuuuug

SEQ ID NO: 907801 - RNA, 15 nt, Homo sapiens
agagaaaagaaacca

SEQ ID NO: 907802 - RNA, 15 nt, Homo sapiens
agagaaaagucuacc

SEQ ID NO: 907803 - RNA, 14 nt, Homo sapiens
agagaaauuugcca

SEQ ID NO: 907804 - RNA, 12 nt, Homo sapiens
agagaaccauga

SEQ ID NO: 907805 - RNA, 16 nt, Homo sapiens
agagaagcaaguggcu

SEQ ID NO: 907806 - RNA, 15 nt, Homo sapiens
agagaauaccagugu

SEQ ID NO: 907807 - RNA, 14 nt, Homo sapiens
agagaaucauacuu

SEQ ID NO: 907808 - RNA, 12 nt, Homo sapiens
agagacacugcu

SEQ ID NO: 907809 - RNA, 19 nt, Homo sapiens
agagacagauaacucuccu

SEQ ID NO: 907810 - RNA, 12 nt, Homo sapiens
agagacaucaaa

SEQ ID NO: 907811 - RNA, 12 nt, Homo sapiens
agagacccaagg

SEQ ID NO: 907812 - RNA, 15 nt, Homo sapiens
agagacccagaucuc

SEQ ID NO: 907813 - RNA, 21 nt, Homo sapiens
agagacuaauagagacacaga

SEQ ID NO: 907814 - RNA, 18 nt, Homo sapiens
agagacuaucugauuucc

SEQ ID NO: 907815 - RNA, 15 nt, Homo sapiens
agagacuauggagcc

SEQ ID NO: 907816 - RNA, 12 nt, Homo sapiens
agagacugugcu

SEQ ID NO: 907817 - RNA, 22 nt, Homo sapiens
agagagauggaauaaagcccuu

SEQ ID NO: 907818 - RNA, 19 nt, Homo sapiens
agagagcaccuggugauca

SEQ ID NO: 907819 - RNA, 13 nt, Homo sapiens
agagaggaagagc

SEQ ID NO: 907820 - RNA, 15 nt, Homo sapiens
agagagggccugcug

SEQ ID NO: 907821 - RNA, 16 nt, Homo sapiens
agagagggcuuucuca

SEQ ID NO: 907822 - RNA, 19 nt, Homo sapiens
agagaggugggcagcagcu

SEQ ID NO: 907823 - RNA, 13 nt, Homo sapiens
agagaguggcucc

SEQ ID NO: 907824 - RNA, 14 nt, Homo sapiens
agagaguuaaguga

SEQ ID NO: 907825 - RNA, 17 nt, Homo sapiens
agagaguuaagugaaug

SEQ ID NO: 907826 - RNA, 15 nt, Homo sapiens
agagauauaucugaa

SEQ ID NO: 907827 - RNA, 19 nt, Homo sapiens
agagauaugcacacacaga

SEQ ID NO: 907828 - RNA, 20 nt, Homo sapiens
agagaucaggaagagaagga

SEQ ID NO: 907829 - RNA, 15 nt, Homo sapiens
agagaucuauguacu

SEQ ID NO: 907830 - RNA, 20 nt, Homo sapiens
agagaugggguuucacugug

SEQ ID NO: 907831 - RNA, 23 nt, Homo sapiens
agagauguguguguguguaggua

SEQ ID NO: 907832 - RNA, 17 nt, Homo sapiens
agagauuguuacagaag

SEQ ID NO: 907833 - RNA, 19 nt, Homo sapiens
agagcacacuguagcauua

SEQ ID NO: 907834 - RNA, 15 nt, Homo sapiens
agagcagcuggucaa

SEQ ID NO: 907835 - RNA, 12 nt, Homo sapiens
agagcaggcuca

SEQ ID NO: 907836 - RNA, 21 nt, Homo sapiens
agagccaccagggcacugucu

SEQ ID NO: 907837 - RNA, 16 nt, Homo sapiens
agagccagggcugaug

SEQ ID NO: 907838 - RNA, 12 nt, Homo sapiens
agagccagugaa

SEQ ID NO: 907839 - RNA, 22 nt, Homo sapiens
agagcccuucaugcauuugcac

SEQ ID NO: 907840 - RNA, 21 nt, Homo sapiens
agagccgcaaaucaaccccag

SEQ ID NO: 907841 - RNA, 18 nt, Homo sapiens
agagccucuggcaucucu

SEQ ID NO: 907842 - RNA, 19 nt, Homo sapiens
agagccucuggcaucucuu

SEQ ID NO: 907843 - RNA, 14 nt, Homo sapiens
agagccuggagaag

SEQ ID NO: 907844 - RNA, 19 nt, Homo sapiens
agagcgagacuccgucuca

SEQ ID NO: 907845 - RNA, 20 nt, Homo sapiens
agagcuccugucccuaccca

SEQ ID NO: 907846 - RNA, 18 nt, Homo sapiens
agagcugggaguagcaug

SEQ ID NO: 907847 - RNA, 17 nt, Homo sapiens
agagcuucccaggaucc

SEQ ID NO: 907848 - RNA, 17 nt, Homo sapiens
agagcuuuuuuacauaa

SEQ ID NO: 907849 - RNA, 16 nt, Homo sapiens
agaggaagaaaaccag

SEQ ID NO: 907850 - RNA, 19 nt, Homo sapiens
agaggaagagcugcaacgg

SEQ ID NO: 907851 - RNA, 14 nt, Homo sapiens
agaggacuccuuaa

SEQ ID NO: 907852 - RNA, 16 nt, Homo sapiens
agaggagagaggcuca

SEQ ID NO: 907853 - RNA, 19 nt, Homo sapiens
agaggauuuaacugugaac

SEQ ID NO: 907854 - RNA, 13 nt, Homo sapiens
agaggcagagaaa

SEQ ID NO: 907855 - RNA, 13 nt, Homo sapiens
agaggcagugaga

SEQ ID NO: 907856 - RNA, 13 nt, Homo sapiens
agaggcagugauu

SEQ ID NO: 907857 - RNA, 20 nt, Homo sapiens
agaggccaggaaucugccau

SEQ ID NO: 907858 - RNA, 21 nt, Homo sapiens
agaggcgcccucccuuccuga

SEQ ID NO: 907859 - RNA, 22 nt, Homo sapiens
agagggaccaaauugcuucuag

SEQ ID NO: 907860 - RNA, 22 nt, Homo sapiens
agagggcuguuggacagcugcu

SEQ ID NO: 907861 - RNA, 17 nt, Homo sapiens
agagggcuuucucagga

SEQ ID NO: 907862 - RNA, 20 nt, Homo sapiens
agaggggaaaccaguguagc

SEQ ID NO: 907863 - RNA, 20 nt, Homo sapiens
agaggggaacagacuggaag

SEQ ID NO: 907864 - RNA, 18 nt, Homo sapiens
agagggggccuucacagu

SEQ ID NO: 907865 - RNA, 22 nt, Homo sapiens
agaggucuccaucauggcagug

SEQ ID NO: 907866 - RNA, 21 nt, Homo sapiens
agagguggcugcugugcuagu

SEQ ID NO: 907867 - RNA, 19 nt, Homo sapiens
agaggugggcagcagcuca

SEQ ID NO: 907868 - RNA, 16 nt, Homo sapiens
agaguaaaaacugaau

SEQ ID NO: 907869 - RNA, 22 nt, Homo sapiens
agagucaggaagggaaagccag

SEQ ID NO: 907870 - RNA, 23 nt, Homo sapiens
agagugaaauaauuaaaaaccac

SEQ ID NO: 907871 - RNA, 23 nt, Homo sapiens
agagugccguaacaacugugguc

SEQ ID NO: 907872 - RNA, 16 nt, Homo sapiens
agaguggagucugagu

SEQ ID NO: 907873 - RNA, 19 nt, Homo sapiens
agaguugcuuuucuaaucu

SEQ ID NO: 907874 - RNA, 20 nt, Homo sapiens
agaguugggaugcggggcag

SEQ ID NO: 907875 - RNA, 22 nt, Homo sapiens
agaguuucuccuuuugaccaaa

SEQ ID NO: 907876 - RNA, 14 nt, Homo sapiens
agauaaaaccagag

SEQ ID NO: 907877 - RNA, 17 nt, Homo sapiens
agauaaaagauguacuu

SEQ ID NO: 907878 - RNA, 21 nt, Homo sapiens
agauaaaggaagucaccaaaa

SEQ ID NO: 907879 - RNA, 18 nt, Homo sapiens
agauaaccuguacuucaa

SEQ ID NO: 907880 - RNA, 21 nt, Homo sapiens
agauaacuugagcaccgucau

SEQ ID NO: 907881 - RNA, 15 nt, Homo sapiens
agauaauaucuguga

SEQ ID NO: 907882 - RNA, 17 nt, Homo sapiens
ccacaucuugcucugcu

SEQ ID NO: 907883 - RNA, 20 nt, Homo sapiens
ccacaugugacacauaugca

SEQ ID NO: 907884 - RNA, 13 nt, Homo sapiens
ccacauuggacuu

SEQ ID NO: 907885 - RNA, 12 nt, Homo sapiens
ccaccaggcuag

SEQ ID NO: 907886 - RNA, 16 nt, Homo sapiens
ccaccagggcacuguc

SEQ ID NO: 907887 - RNA, 16 nt, Homo sapiens
ccacccaaaagucaaa

SEQ ID NO: 907888 - RNA, 15 nt, Homo sapiens
ccacccaacaagcca

SEQ ID NO: 907889 - RNA, 13 nt, Homo sapiens
ccacccacaugug

SEQ ID NO: 907890 - RNA, 20 nt, Homo sapiens
ccaccccuaaccuggcuuau

SEQ ID NO: 907891 - RNA, 17 nt, Homo sapiens
ccacccucaaaugucag

SEQ ID NO: 907892 - RNA, 20 nt, Homo sapiens
ccacccuccuuucaccacau

SEQ ID NO: 907893 - RNA, 16 nt, Homo sapiens
ccaccugacaauggca

SEQ ID NO: 907894 - RNA, 15 nt, Homo sapiens
ccaccugcaagugcc

SEQ ID NO: 907895 - RNA, 21 nt, Homo sapiens
ccacggcaggccccugcagga

SEQ ID NO: 907896 - RNA, 15 nt, Homo sapiens
ccacggccaggccag

SEQ ID NO: 907897 - RNA, 13 nt, Homo sapiens
ccacgugugcaga

SEQ ID NO: 907898 - RNA, 14 nt, Homo sapiens
ccacguuaagucca

SEQ ID NO: 907899 - RNA, 13 nt, Homo sapiens
ccacucacuccag

SEQ ID NO: 907900 - RNA, 17 nt, Homo sapiens
ccacucaguuguuccua

SEQ ID NO: 907901 - RNA, 23 nt, Homo sapiens
ccacucccuccuaaccuagagau

SEQ ID NO: 907902 - RNA, 14 nt, Homo sapiens
ccacucugcucuga

SEQ ID NO: 907903 - RNA, 15 nt, Homo sapiens
ccacugcaaauuuca

SEQ ID NO: 907904 - RNA, 14 nt, Homo sapiens
ccacuggacuugag

SEQ ID NO: 907905 - RNA, 23 nt, Homo sapiens
ccacuggaucuucagaaggcuag

SEQ ID NO: 907906 - RNA, 12 nt, Homo sapiens
ccacuggcauua

SEQ ID NO: 907907 - RNA, 15 nt, Homo sapiens
ccacuggcuccacau

SEQ ID NO: 907908 - RNA, 18 nt, Homo sapiens
ccacugggucucacuccu

SEQ ID NO: 907909 - RNA, 19 nt, Homo sapiens
ccacugugcugaauucugc

SEQ ID NO: 907910 - RNA, 18 nt, Homo sapiens
ccacuucuuaaugcuuuc

SEQ ID NO: 907911 - RNA, 12 nt, Homo sapiens
ccacuugggagc

SEQ ID NO: 907912 - RNA, 18 nt, Homo sapiens
ccacuuucaccaguuucu

SEQ ID NO: 907913 - RNA, 21 nt, Homo sapiens
ccagaaagaaggacacuugua

SEQ ID NO: 907914 - RNA, 22 nt, Homo sapiens
ccagaacaaaccucuauauguu

SEQ ID NO: 907915 - RNA, 14 nt, Homo sapiens
ccagaacccuuccu

SEQ ID NO: 907916 - RNA, 16 nt, Homo sapiens
ccagaagaauauucag

SEQ ID NO: 907917 - RNA, 22 nt, Homo sapiens
ccagaaggcagggaaaggcucu

SEQ ID NO: 907918 - RNA, 19 nt, Homo sapiens
ccagaaguaaaguuuauuu

SEQ ID NO: 907919 - RNA, 15 nt, Homo sapiens
ccagaaguuccucaa

SEQ ID NO: 907920 - RNA, 15 nt, Homo sapiens
ccagacacauucucc

SEQ ID NO: 907921 - RNA, 12 nt, Homo sapiens
ccagacagagcc

SEQ ID NO: 907922 - RNA, 20 nt, Homo sapiens
ccagacauacgaaacacaaa

SEQ ID NO: 907923 - RNA, 14 nt, Homo sapiens
ccagaccaccugcc

SEQ ID NO: 907924 - RNA, 19 nt, Homo sapiens
ccagacccaccacaccgca

SEQ ID NO: 907925 - RNA, 13 nt, Homo sapiens
ccagacccggcug

SEQ ID NO: 907926 - RNA, 23 nt, Homo sapiens
ccagacuucucuuucuuauuuug

SEQ ID NO: 907927 - RNA, 18 nt, Homo sapiens
ccagagacggaagccuuu

SEQ ID NO: 907928 - RNA, 13 nt, Homo sapiens
ccagagagacaga

SEQ ID NO: 907929 - RNA, 19 nt, Homo sapiens
ccagagaggguggugaccu

SEQ ID NO: 907930 - RNA, 19 nt, Homo sapiens
ccagagcaggaaagaugau

SEQ ID NO: 907931 - RNA, 17 nt, Homo sapiens
ccagagccacuaccuuu

SEQ ID NO: 907932 - RNA, 17 nt, Homo sapiens
ccagagcccaagugcca

SEQ ID NO: 907933 - RNA, 20 nt, Homo sapiens
ccagagccccccacaaugau

SEQ ID NO: 907934 - RNA, 21 nt, Homo sapiens
ccagagccccccacaaugaug

SEQ ID NO: 907935 - RNA, 17 nt, Homo sapiens
ccagaggaaacuugcau

SEQ ID NO: 907936 - RNA, 21 nt, Homo sapiens
ccagaggguagggcagcagau

SEQ ID NO: 907937 - RNA, 17 nt, Homo sapiens
ccagaggguugugauuu

SEQ ID NO: 907938 - RNA, 23 nt, Homo sapiens
aaucauaugguugacaguaugca

SEQ ID NO: 907939 - RNA, 14 nt, Homo sapiens
aaucaucucaaauc

SEQ ID NO: 907940 - RNA, 15 nt, Homo sapiens
aaucaucucucauca

SEQ ID NO: 907941 - RNA, 12 nt, Homo sapiens
aaucauggagcu

SEQ ID NO: 907942 - RNA, 17 nt, Homo sapiens
aaucauggagcugagga

SEQ ID NO: 907943 - RNA, 14 nt, Homo sapiens
aaucauggcauuca

SEQ ID NO: 907944 - RNA, 16 nt, Homo sapiens
aaucauggcauucaca

SEQ ID NO: 907945 - RNA, 21 nt, Homo sapiens
aaucaugggauuuuacuagaa

SEQ ID NO: 907946 - RNA, 16 nt, Homo sapiens
aaucauuuaaauauua

SEQ ID NO: 907947 - RNA, 16 nt, Homo sapiens
aaucauuucugcauca

SEQ ID NO: 907948 - RNA, 20 nt, Homo sapiens
aaucauuucugcaucagcug

SEQ ID NO: 907949 - RNA, 16 nt, Homo sapiens
aaucauuuugccucuu

SEQ ID NO: 907950 - RNA, 20 nt, Homo sapiens
aauccaaguuauuaaucuua

SEQ ID NO: 907951 - RNA, 19 nt, Homo sapiens
aauccagagauaauugcca

SEQ ID NO: 907952 - RNA, 23 nt, Homo sapiens
aauccaucacuagccaugauaac

SEQ ID NO: 907953 - RNA, 16 nt, Homo sapiens
aauccaucaggacuug

SEQ ID NO: 907954 - RNA, 22 nt, Homo sapiens
aaucccagcaugcugagauuac

SEQ ID NO: 907955 - RNA, 15 nt, Homo sapiens
aaucccagcuacuug

SEQ ID NO: 907956 - RNA, 17 nt, Homo sapiens
aauccccggcugcuucc

SEQ ID NO: 907957 - RNA, 22 nt, Homo sapiens
aaucccggucaugcuuuugcca

SEQ ID NO: 907958 - RNA, 14 nt, Homo sapiens
aaucccgugaaaga

SEQ ID NO: 907959 - RNA, 16 nt, Homo sapiens
aauccucaggauuuca

SEQ ID NO: 907960 - RNA, 17 nt, Homo sapiens
aauccucaggauuucau

SEQ ID NO: 907961 - RNA, 15 nt, Homo sapiens
aauccuuaacauauu

SEQ ID NO: 907962 - RNA, 16 nt, Homo sapiens
aauccuuaacauauuu

SEQ ID NO: 907963 - RNA, 20 nt, Homo sapiens
aauccuuaacauauuugcac

SEQ ID NO: 907964 - RNA, 16 nt, Homo sapiens
aaucgagucuaccucu

SEQ ID NO: 907965 - RNA, 14 nt, Homo sapiens
aaucguagguguug

SEQ ID NO: 907966 - RNA, 22 nt, Homo sapiens
aaucuaccuguggugacugaac

SEQ ID NO: 907967 - RNA, 16 nt, Homo sapiens
aaucuaucuauauaau

SEQ ID NO: 907968 - RNA, 13 nt, Homo sapiens
aaucuaugcaugu

SEQ ID NO: 907969 - RNA, 14 nt, Homo sapiens
aaucuccaguuuuc

SEQ ID NO: 907970 - RNA, 14 nt, Homo sapiens
aaucucuaagccaa

SEQ ID NO: 907971 - RNA, 15 nt, Homo sapiens
aaucugaauggugcu

SEQ ID NO: 907972 - RNA, 17 nt, Homo sapiens
aaucugagagauuugaa

SEQ ID NO: 907973 - RNA, 17 nt, Homo sapiens
aaucugauuggacauuu

SEQ ID NO: 907974 - RNA, 23 nt, Homo sapiens
aaucugccugauaggacccauau

SEQ ID NO: 907975 - RNA, 20 nt, Homo sapiens
aaucuggcuccuguuuccau

SEQ ID NO: 907976 - RNA, 20 nt, Homo sapiens
aaucugggcaucucgugcca

SEQ ID NO: 907977 - RNA, 14 nt, Homo sapiens
aaucuguagucacu

SEQ ID NO: 907978 - RNA, 15 nt, Homo sapiens
aaucuguagucacuu

SEQ ID NO: 907979 - RNA, 13 nt, Homo sapiens
aaucuuacuuugu

SEQ ID NO: 907980 - RNA, 19 nt, Homo sapiens
aaucuucggggugugauga

SEQ ID NO: 907981 - RNA, 19 nt, Homo sapiens
aaucuucuccuaugcauuu

SEQ ID NO: 907982 - RNA, 20 nt, Homo sapiens
aaucuuucagcacucagaaa

SEQ ID NO: 907983 - RNA, 14 nt, Homo sapiens
aaucuuugugacag

SEQ ID NO: 907984 - RNA, 13 nt, Homo sapiens
aaugaaagccaaa

SEQ ID NO: 907985 - RNA, 23 nt, Homo sapiens
aaugaagacccaguguaaagaau

SEQ ID NO: 907986 - RNA, 13 nt, Homo sapiens
aaugaagugcaaa

SEQ ID NO: 907987 - RNA, 14 nt, Homo sapiens
aaugaauacaauua

SEQ ID NO: 907988 - RNA, 15 nt, Homo sapiens
aaugaauacaauuaa

SEQ ID NO: 907989 - RNA, 23 nt, Homo sapiens
aaugaaugaccuuguugcaugau

SEQ ID NO: 907990 - RNA, 20 nt, Homo sapiens
aaugacaauaaaaauuccaa

SEQ ID NO: 907991 - RNA, 22 nt, Homo sapiens
aaugacagaaugcuguuuuaaa

SEQ ID NO: 907992 - RNA, 16 nt, Homo sapiens
aaugacagcggggaag

SEQ ID NO: 907993 - RNA, 23 nt, Homo sapiens
aaugacaucuucaaagcuugaag

SEQ ID NO: 907994 - RNA, 14 nt, Homo sapiens
aaugaccucaagau

SEQ ID NO: 907995 - RNA, 22 nt, Homo sapiens
aaugaccucagcaaauccucuu

SEQ ID NO: 907996 - RNA, 13 nt, Homo sapiens
aaugacugucuaa

SEQ ID NO: 907997 - RNA, 17 nt, Homo sapiens
uggucuccucccaaaau

SEQ ID NO: 907998 - RNA, 18 nt, Homo sapiens
uggucuugagaugucuuc

SEQ ID NO: 907999 - RNA, 20 nt, Homo sapiens
uggucuuuccuaucauggag

SEQ ID NO: 908000 - RNA, 21 nt, Homo sapiens
uggugaagaguaguuuacuag

SEQ ID NO: 908001 - RNA, 12 nt, Homo sapiens
uggugacugucc

SEQ ID NO: 908002 - RNA, 13 nt, Homo sapiens
uggugcacugagc

SEQ ID NO: 908003 - RNA, 22 nt, Homo sapiens
uggugcacuuuucugugucaua

SEQ ID NO: 908004 - RNA, 12 nt, Homo sapiens
uucaacuccaga

SEQ ID NO: 908005 - RNA, 22 nt, Homo sapiens
uugaccaaauaaaguaccauua

SEQ ID NO: 908006 - RNA, 16 nt, Homo sapiens
ugccuucacuuuacaa

SEQ ID NO: 908007 - RNA, 15 nt, Homo sapiens
ugccuuccuguuuaa

SEQ ID NO: 908008 - RNA, 15 nt, Homo sapiens
ugccuugaagccacu

SEQ ID NO: 908009 - RNA, 20 nt, Homo sapiens
ugccuuucucuggcuccaga

SEQ ID NO: 908010 - RNA, 18 nt, Homo sapiens
ugccuuuugcaaacuuua

SEQ ID NO: 908011 - RNA, 14 nt, Homo sapiens
ugcgaacagcaaac

SEQ ID NO: 908012 - RNA, 21 nt, Homo sapiens
ugcgacgcagguguaccuccc

SEQ ID NO: 908013 - RNA, 21 nt, Homo sapiens
ugcgacuucacaaaaugcaag

SEQ ID NO: 908014 - RNA, 14 nt, Homo sapiens
ugcgagcauuuccc

SEQ ID NO: 908015 - RNA, 22 nt, Homo sapiens
ugcgcaacaacaaggacccugu

SEQ ID NO: 908016 - RNA, 11 nt, Homo sapiens
ugcgcacacac

SEQ ID NO: 908017 - RNA, 16 nt, Homo sapiens
ugcgcacacacagaua

SEQ ID NO: 908018 - RNA, 23 nt, Homo sapiens
ugcgcacacacagauaugcacac

SEQ ID NO: 908019 - RNA, 16 nt, Homo sapiens
ugcgggggagcuggaa

SEQ ID NO: 908020 - RNA, 15 nt, Homo sapiens
ugcggugucacuggg

SEQ ID NO: 908021 - RNA, 22 nt, Homo sapiens
ugcgucagaccaguacugggaa

SEQ ID NO: 908022 - RNA, 21 nt, Homo sapiens
ugcguuuuagaguaugcaaga

SEQ ID NO: 908023 - RNA, 23 nt, Homo sapiens
ugcuaaauggucgcccaggagac

SEQ ID NO: 908024 - RNA, 20 nt, Homo sapiens
ugcuaacuguguguacauau

SEQ ID NO: 908025 - RNA, 20 nt, Homo sapiens
ugcuaaucuucuuaugcaau

SEQ ID NO: 908026 - RNA, 16 nt, Homo sapiens
ugcuacaaacauauca

SEQ ID NO: 908027 - RNA, 17 nt, Homo sapiens
ugcuacaaacauaucaa

SEQ ID NO: 908028 - RNA, 13 nt, Homo sapiens
ugcuacacaaaag

SEQ ID NO: 908029 - RNA, 19 nt, Homo sapiens
ugcuacaccuuagcagcuc

SEQ ID NO: 908030 - RNA, 16 nt, Homo sapiens
ugcuaccucacugggg

SEQ ID NO: 908031 - RNA, 22 nt, Homo sapiens
ugcuacuaauuauauaguauac

SEQ ID NO: 908032 - RNA, 14 nt, Homo sapiens
ugcuagacagccag

SEQ ID NO: 908033 - RNA, 21 nt, Homo sapiens
ugcuauaugccuuaagccaau

SEQ ID NO: 908034 - RNA, 13 nt, Homo sapiens
ugcuauauugccc

SEQ ID NO: 908035 - RNA, 16 nt, Homo sapiens
ugcuauugacaaguca

SEQ ID NO: 908036 - RNA, 12 nt, Homo sapiens
ugcuauuugccu

SEQ ID NO: 908037 - RNA, 13 nt, Homo sapiens
ugcucacucagga

SEQ ID NO: 908038 - RNA, 20 nt, Homo sapiens
ugcucacugaccugccugua

SEQ ID NO: 908039 - RNA, 21 nt, Homo sapiens
ugcucccagcagcccuaagga

SEQ ID NO: 908040 - RNA, 18 nt, Homo sapiens
ugcuccccagugcuaccu

SEQ ID NO: 908041 - RNA, 21 nt, Homo sapiens
ugcuccccagugcuaccucuc

SEQ ID NO: 908042 - RNA, 20 nt, Homo sapiens
ugcuccguaugccaagagga

SEQ ID NO: 908043 - RNA, 20 nt, Homo sapiens
ugcucggcuguaaacagcuc

SEQ ID NO: 908044 - RNA, 21 nt, Homo sapiens
ugcucggcuguaaacagcucu

SEQ ID NO: 908045 - RNA, 14 nt, Homo sapiens
ugcucucaugccug

SEQ ID NO: 908046 - RNA, 14 nt, Homo sapiens
ugcucugucuucca

SEQ ID NO: 908047 - RNA, 15 nt, Homo sapiens
ugcucuuagcugucu

SEQ ID NO: 908048 - RNA, 11 nt, Homo sapiens
ugcucuugccu

SEQ ID NO: 908049 - RNA, 15 nt, Homo sapiens
ugcucuuucuugacu

SEQ ID NO: 908050 - RNA, 15 nt, Homo sapiens
ugcugaaacaacaaa

SEQ ID NO: 908051 - RNA, 19 nt, Homo sapiens
ugcugaagagggaaaguga

SEQ ID NO: 908052 - RNA, 20 nt, Homo sapiens
ugcugaccugaucaccucug

SEQ ID NO: 908053 - RNA, 23 nt, Homo sapiens
ugcugacggaagccaacuuggcu

SEQ ID NO: 908054 - RNA, 15 nt, Homo sapiens
ugcugagaaggacac

SEQ ID NO: 908055 - RNA, 15 nt, Homo sapiens
ugcugagcauguacu

SEQ ID NO: 908056 - RNA, 17 nt, Homo sapiens
ugcugaggcucugaccc

SEQ ID NO: 908057 - RNA, 15 nt, Homo sapiens
ugcugaucgugcuaa

SEQ ID NO: 908058 - RNA, 19 nt, Homo sapiens
ugcugcccugcucugggga

SEQ ID NO: 908059 - RNA, 13 nt, Homo sapiens
ugcugcucaucca

SEQ ID NO: 908060 - RNA, 17 nt, Homo sapiens
ugcuggacugaggacca

SEQ ID NO: 908061 - RNA, 14 nt, Homo sapiens
ugcuggcugccuua

SEQ ID NO: 908062 - RNA, 18 nt, Homo sapiens
ugcuggggguuucuguag

SEQ ID NO: 908063 - RNA, 16 nt, Homo sapiens
ugcuggucuauuuuga

SEQ ID NO: 908064 - RNA, 13 nt, Homo sapiens
ugcuguauacugu

SEQ ID NO: 908065 - RNA, 18 nt, Homo sapiens
ugcuguggacaccaccua

SEQ ID NO: 908066 - RNA, 17 nt, Homo sapiens
ugcuguggccucacuuc

SEQ ID NO: 908067 - RNA, 16 nt, Homo sapiens
ugcuguguagcucugu

SEQ ID NO: 908068 - RNA, 14 nt, Homo sapiens
ugcuuaaaauugcu

SEQ ID NO: 908069 - RNA, 12 nt, Homo sapiens
ugcuuacauuuu

SEQ ID NO: 908070 - RNA, 22 nt, Homo sapiens
ugcuuagaugagggugacuguc

SEQ ID NO: 908071 - RNA, 20 nt, Homo sapiens
ugcuuccuccccuccuggca

SEQ ID NO: 908072 - RNA, 22 nt, Homo sapiens
ugcuucuucuacuucagucuuc

SEQ ID NO: 908073 - RNA, 14 nt, Homo sapiens
ugcuugaauugcaa

SEQ ID NO: 908074 - RNA, 18 nt, Homo sapiens
ugcuugauugagugcucc

SEQ ID NO: 908075 - RNA, 19 nt, Homo sapiens
ugcuuuaaaguaccuguag

SEQ ID NO: 908076 - RNA, 14 nt, Homo sapiens
ugcuuugaggacaa

SEQ ID NO: 908077 - RNA, 17 nt, Homo sapiens
ugcuuuguaugcacuuu

SEQ ID NO: 908078 - RNA, 14 nt, Homo sapiens
ugcuuuuaaaugca

SEQ ID NO: 908079 - RNA, 19 nt, Homo sapiens
ugcuuuucuaaucuuguua

SEQ ID NO: 908080 - RNA, 16 nt, Homo sapiens
uggaaaaugugcaaua

SEQ ID NO: 908081 - RNA, 19 nt, Homo sapiens
uggaaacagggcagugaca

SEQ ID NO: 908082 - RNA, 15 nt, Homo sapiens
uggaaacauuuacaa

SEQ ID NO: 908083 - RNA, 18 nt, Homo sapiens
uggaaacuguaccauaca

SEQ ID NO: 908084 - RNA, 17 nt, Homo sapiens
uggaaagacauagccaa

SEQ ID NO: 908085 - RNA, 16 nt, Homo sapiens
uggaaagacugauugu

SEQ ID NO: 908086 - RNA, 14 nt, Homo sapiens
uggaaagcagccau

SEQ ID NO: 908087 - RNA, 14 nt, Homo sapiens
uggaaagcugauga

SEQ ID NO: 908088 - RNA, 14 nt, Homo sapiens
uggaaagcugcuuc

SEQ ID NO: 908089 - RNA, 13 nt, Homo sapiens
uggaaauacuuua

SEQ ID NO: 908090 - RNA, 17 nt, Homo sapiens
uggaacacacauguccu

SEQ ID NO: 908091 - RNA, 21 nt, Homo sapiens
uggaaccaaucccgugaaaga

SEQ ID NO: 908092 - RNA, 15 nt, Homo sapiens
uggaacuucuaauau

SEQ ID NO: 908093 - RNA, 14 nt, Homo sapiens
uggaagaaauggga

SEQ ID NO: 908094 - RNA, 17 nt, Homo sapiens
uggaagaggcaccuguc

SEQ ID NO: 908095 - RNA, 19 nt, Homo sapiens
uggaagcauuuguuucuac

SEQ ID NO: 908096 - RNA, 21 nt, Homo sapiens
uggaagggaagugagaaacca

SEQ ID NO: 908097 - RNA, 14 nt, Homo sapiens
uggaauaaagcccu

SEQ ID NO: 908098 - RNA, 19 nt, Homo sapiens
uggaaucaaggaauccuga

SEQ ID NO: 908099 - RNA, 23 nt, Homo sapiens
uggaaugcagggaagagggcagu

SEQ ID NO: 908100 - RNA, 13 nt, Homo sapiens
uggaauguaauca

SEQ ID NO: 908101 - RNA, 23 nt, Homo sapiens
uggaauuuucuuacccauauauc

SEQ ID NO: 908102 - RNA, 16 nt, Homo sapiens
uggaauuuuucauuga

SEQ ID NO: 908103 - RNA, 14 nt, Homo sapiens
uggacaaaauggaa

SEQ ID NO: 908104 - RNA, 12 nt, Homo sapiens
uggacacagcuc

SEQ ID NO: 908105 - RNA, 19 nt, Homo sapiens
uggacaccccugcuauaua

SEQ ID NO: 908106 - RNA, 22 nt, Homo sapiens
uggacacuuauggggacagcau

SEQ ID NO: 908107 - RNA, 17 nt, Homo sapiens
uggaccucugcuucccc

SEQ ID NO: 908108 - RNA, 18 nt, Homo sapiens
uggacgaacaggggccaa

SEQ ID NO: 908109 - RNA, 16 nt, Homo sapiens
uggacucaguuuucuu

SEQ ID NO: 908110 - RNA, 16 nt, Homo sapiens
uggacugaggaccaca

SEQ ID NO: 908111 - RNA, 15 nt, Homo sapiens
uggacugucauagaa

SEQ ID NO: 908112 - RNA, 18 nt, Homo sapiens
uggacuugaggauuuuga

SEQ ID NO: 908113 - RNA, 13 nt, Homo sapiens
uggacuugucuuc

SEQ ID NO: 908114 - RNA, 20 nt, Homo sapiens
uggacuuuugaaaagcuuuu

SEQ ID NO: 908115 - RNA, 22 nt, Homo sapiens
uggagaaauaaaaauaccucuu

SEQ ID NO: 908116 - RNA, 19 nt, Homo sapiens
uggagacggccaagugaag

SEQ ID NO: 908117 - RNA, 22 nt, Homo sapiens
uggagagaucauagcucacugu

SEQ ID NO: 908118 - RNA, 15 nt, Homo sapiens
uggagaugaugauga

SEQ ID NO: 908119 - RNA, 17 nt, Homo sapiens
uggagauuucaguuacu

SEQ ID NO: 908120 - RNA, 22 nt, Homo sapiens
uggggacaccagccaucaugug

SEQ ID NO: 908121 - RNA, 16 nt, Homo sapiens
uuguaccagugugaau

SEQ ID NO: 908122 - RNA, 13 nt, Homo sapiens
uuguacucuugcu

SEQ ID NO: 908123 - RNA, 23 nt, Homo sapiens
uuguagaaaucuguaauucuauu

SEQ ID NO: 908124 - RNA, 13 nt, Homo sapiens
uuguauauacuuc

SEQ ID NO: 908125 - RNA, 16 nt, Homo sapiens
uuguauauuauggaag

SEQ ID NO: 908126 - RNA, 21 nt, Homo sapiens
uuguauggagccucuucugcc

SEQ ID NO: 908127 - RNA, 15 nt, Homo sapiens
uuguauuaccauuac

SEQ ID NO: 908128 - RNA, 12 nt, Homo sapiens
uuguauugcaag

SEQ ID NO: 908129 - RNA, 15 nt, Homo sapiens
uugucauagcagcaa

SEQ ID NO: 908130 - RNA, 20 nt, Homo sapiens
uugucauuuuaaaaucugau

SEQ ID NO: 908131 - RNA, 15 nt, Homo sapiens
uuguccugcucucuu

SEQ ID NO: 908132 - RNA, 16 nt, Homo sapiens
uugucgggacagagag

SEQ ID NO: 908133 - RNA, 16 nt, Homo sapiens
uugugaacaccuccua

SEQ ID NO: 908134 - RNA, 20 nt, Homo sapiens
uugugacaggaaagcccucc

SEQ ID NO: 908135 - RNA, 19 nt, Homo sapiens
uugugagcacucuacugca

SEQ ID NO: 908136 - RNA, 20 nt, Homo sapiens
uugugcugugggcagcaccc

SEQ ID NO: 908137 - RNA, 20 nt, Homo sapiens
uuguggguuuuuucacauaa

SEQ ID NO: 908138 - RNA, 15 nt, Homo sapiens
uuguggugucuagca

SEQ ID NO: 908139 - RNA, 14 nt, Homo sapiens
uuguguacugauaa

SEQ ID NO: 908140 - RNA, 20 nt, Homo sapiens
uuguuacagguguacuaugg

SEQ ID NO: 908141 - RNA, 18 nt, Homo sapiens
uuguuaccuuuaugguuu

SEQ ID NO: 908142 - RNA, 13 nt, Homo sapiens
uuguuaugcuauu

SEQ ID NO: 908143 - RNA, 18 nt, Homo sapiens
uuguucacuagacugugc

SEQ ID NO: 908144 - RNA, 16 nt, Homo sapiens
uuguucagaagacaca

SEQ ID NO: 908145 - RNA, 23 nt, Homo sapiens
uuguucaucagacuccugugcaa

SEQ ID NO: 908146 - RNA, 18 nt, Homo sapiens
uuguuccuuaagucagaa

SEQ ID NO: 908147 - RNA, 12 nt, Homo sapiens
uuguucugauaa

SEQ ID NO: 908148 - RNA, 15 nt, Homo sapiens
uuguugagaguguga

SEQ ID NO: 908149 - RNA, 15 nt, Homo sapiens
uuguuucaaucuuug

SEQ ID NO: 908150 - RNA, 15 nt, Homo sapiens
uuguuuuagcuccuu

SEQ ID NO: 908151 - RNA, 20 nt, Homo sapiens
uuguuuuauauguaguacua

SEQ ID NO: 908152 - RNA, 14 nt, Homo sapiens
uuguuuuauauucu

SEQ ID NO: 908153 - RNA, 15 nt, Homo sapiens
uuuaaaaaacuaaaa

SEQ ID NO: 908154 - RNA, 15 nt, Homo sapiens
uuuaaaaacaggaaa

SEQ ID NO: 908155 - RNA, 19 nt, Homo sapiens
uuuaaaaagcuaguucuau

SEQ ID NO: 908156 - RNA, 12 nt, Homo sapiens
uuuaaaacacaa

SEQ ID NO: 908157 - RNA, 20 nt, Homo sapiens
uuuaaaaccugugugccauu

SEQ ID NO: 908158 - RNA, 17 nt, Homo sapiens
uuuaaaauaaggauaau

SEQ ID NO: 908159 - RNA, 14 nt, Homo sapiens
uuuaaaauagcaaa

SEQ ID NO: 908160 - RNA, 22 nt, Homo sapiens
uuuaaaaucauucccuuuccca

SEQ ID NO: 908161 - RNA, 17 nt, Homo sapiens
uuuaaacuguucugugu

SEQ ID NO: 908162 - RNA, 21 nt, Homo sapiens
uuuaaagcuuauuaaaacuca

SEQ ID NO: 908163 - RNA, 22 nt, Homo sapiens
uuuaaagguagagaugugugug

SEQ ID NO: 908164 - RNA, 18 nt, Homo sapiens
uuuaaagugguucuggau

SEQ ID NO: 908165 - RNA, 18 nt, Homo sapiens
uuuaaauaaaguaucaug

SEQ ID NO: 908166 - RNA, 14 nt, Homo sapiens
uuuaaaugacugcu

SEQ ID NO: 908167 - RNA, 20 nt, Homo sapiens
uuuaaaugugcaguacacau

SEQ ID NO: 908168 - RNA, 14 nt, Homo sapiens
uuuaaauguucaca

SEQ ID NO: 908169 - RNA, 12 nt, Homo sapiens
uuuaaauucucu

SEQ ID NO: 908170 - RNA, 16 nt, Homo sapiens
uuuaacauuuaucuaa

SEQ ID NO: 908171 - RNA, 17 nt, Homo sapiens
uuuaacauuuuccaaaa

SEQ ID NO: 908172 - RNA, 21 nt, Homo sapiens
uuuaacuagaauuuauucaau

SEQ ID NO: 908173 - RNA, 18 nt, Homo sapiens
uuuaacugugaaccugga

SEQ ID NO: 908174 - RNA, 17 nt, Homo sapiens
uuuaacuuaacauucug

SEQ ID NO: 908175 - RNA, 11 nt, Homo sapiens
uuuaagaacga

SEQ ID NO: 908176 - RNA, 14 nt, Homo sapiens
uuuaagaacgaagg

SEQ ID NO: 908177 - RNA, 14 nt, Homo sapiens
uuuaagaacuguau

SEQ ID NO: 908178 - RNA, 22 nt, Homo sapiens
uuuaagaagaaauacccacuaa

SEQ ID NO: 908179 - RNA, 16 nt, Homo sapiens
uuuaagaaucuauuuc

SEQ ID NO: 908180 - RNA, 13 nt, Homo sapiens
uuuaagguacuua

SEQ ID NO: 908181 - RNA, 20 nt, Homo sapiens
uuuaagucucugacucuugc

SEQ ID NO: 908182 - RNA, 20 nt, Homo sapiens
uuuaaguggcuuucagcaaa

SEQ ID NO: 908183 - RNA, 18 nt, Homo sapiens
uuuaauaauuaugugcca

SEQ ID NO: 908184 - RNA, 15 nt, Homo sapiens
uuuaauacaggguag

SEQ ID NO: 908185 - RNA, 19 nt, Homo sapiens
uuuaauacaggguagauaa

SEQ ID NO: 908186 - RNA, 22 nt, Homo sapiens
uuuaaugaagacccaguguaaa

SEQ ID NO: 908187 - RNA, 19 nt, Homo sapiens
uuuaauuaacuaugugaug

SEQ ID NO: 908188 - RNA, 12 nt, Homo sapiens
uuuaauuaucuu

SEQ ID NO: 908189 - RNA, 17 nt, Homo sapiens
uuuacaaguguauauca

SEQ ID NO: 908190 - RNA, 12 nt, Homo sapiens
uuuacaccaguu

SEQ ID NO: 908191 - RNA, 16 nt, Homo sapiens
uuuacagaacuguugu

SEQ ID NO: 908192 - RNA, 20 nt, Homo sapiens
uuuaccaaaauucagaacau

SEQ ID NO: 908193 - RNA, 14 nt, Homo sapiens
uuuaccacagcagc

SEQ ID NO: 908194 - RNA, 14 nt, Homo sapiens
uuuaccacuaugca

SEQ ID NO: 908195 - RNA, 23 nt, Homo sapiens
uuuaccauaagggacugugccag

SEQ ID NO: 908196 - RNA, 17 nt, Homo sapiens
uuuaccuacucuaugua

SEQ ID NO: 908197 - RNA, 17 nt, Homo sapiens
uuuaccugagaccaguu

SEQ ID NO: 908198 - RNA, 20 nt, Homo sapiens
uuuacuaauccaacccauga

SEQ ID NO: 908199 - RNA, 11 nt, Homo sapiens
uuuacuuuguu

SEQ ID NO: 908200 - RNA, 14 nt, Homo sapiens
uuuagaagagccug

SEQ ID NO: 908201 - RNA, 20 nt, Homo sapiens
uuuagaucccaugucaccuc

SEQ ID NO: 908202 - RNA, 13 nt, Homo sapiens
uuuagauuguuaa

SEQ ID NO: 908203 - RNA, 18 nt, Homo sapiens
uuuagcaggguacauauu

SEQ ID NO: 908204 - RNA, 19 nt, Homo sapiens
uuuagcgugcucacugacc

SEQ ID NO: 908205 - RNA, 13 nt, Homo sapiens
uuuaggaagcaag

SEQ ID NO: 908206 - RNA, 19 nt, Homo sapiens
uuuaggaagcaagcuuaau

SEQ ID NO: 908207 - RNA, 21 nt, Homo sapiens
uuuaggagacagucucaagca

SEQ ID NO: 908208 - RNA, 16 nt, Homo sapiens
uuuagucuguauugau

SEQ ID NO: 908209 - RNA, 14 nt, Homo sapiens
uuuagugucuugaa

SEQ ID NO: 908210 - RNA, 22 nt, Homo sapiens
uuuauacucuagaacaugcaca

SEQ ID NO: 908211 - RNA, 15 nt, Homo sapiens
uuuauaucuauagua

SEQ ID NO: 908212 - RNA, 12 nt, Homo sapiens
uuuaucaucucg

SEQ ID NO: 908213 - RNA, 22 nt, Homo sapiens
uuuauccacagaaacauuuuca

SEQ ID NO: 908214 - RNA, 13 nt, Homo sapiens
uuuaucugugcaa

SEQ ID NO: 908215 - RNA, 22 nt, Homo sapiens
uuuaugagacccauuccuauuu

SEQ ID NO: 908216 - RNA, 11 nt, Homo sapiens
uuuaugugcaa

SEQ ID NO: 908217 - RNA, 15 nt, Homo sapiens
uuuauguucuaguga

SEQ ID NO: 908218 - RNA, 15 nt, Homo sapiens
uuuauuaaugaacug

SEQ ID NO: 908219 - RNA, 18 nt, Homo sapiens
uuuauuaaugaacuguga

SEQ ID NO: 908220 - RNA, 16 nt, Homo sapiens
uuuauuaauucauuaa

SEQ ID NO: 908221 - RNA, 16 nt, Homo sapiens
uuuauuaccucugaua

SEQ ID NO: 908222 - RNA, 18 nt, Homo sapiens
uuuauuggggugccuauu

SEQ ID NO: 908223 - RNA, 13 nt, Homo sapiens
uuuauugugaucu

SEQ ID NO: 908224 - RNA, 17 nt, Homo sapiens
uuuauuuacaucuaugu

SEQ ID NO: 908225 - RNA, 21 nt, Homo sapiens
uuuauuuacaucuauguaucu

SEQ ID NO: 908226 - RNA, 12 nt, Homo sapiens
uuuauuuccaca

SEQ ID NO: 908227 - RNA, 19 nt, Homo sapiens
uuuauuuuuguagagccag

SEQ ID NO: 908228 - RNA, 22 nt, Homo sapiens
uuuauuuuuuuaaaacacaaau

SEQ ID NO: 908229 - RNA, 20 nt, Homo sapiens
uuucaaaaauuacacuacaa

SEQ ID NO: 908230 - RNA, 23 nt, Homo sapiens
uuucaaacugaguaaauuggaaa

SEQ ID NO: 908231 - RNA, 20 nt, Homo sapiens
uuucaaauuuuuacugagaa

SEQ ID NO: 908232 - RNA, 13 nt, Homo sapiens
uuucaacauauca

SEQ ID NO: 908233 - RNA, 14 nt, Homo sapiens
uuucaacauaucau

SEQ ID NO: 908234 - RNA, 18 nt, Homo sapiens
uuucaagaaaacuggaaa

SEQ ID NO: 908235 - RNA, 18 nt, Homo sapiens
uucagcgaacaugccuga

SEQ ID NO: 908236 - RNA, 19 nt, Homo sapiens
uucagcgagacccuugcau

SEQ ID NO: 908237 - RNA, 16 nt, Homo sapiens
uucagcucuguuuuac

SEQ ID NO: 908238 - RNA, 20 nt, Homo sapiens
uucaggacuuaacggcucca

SEQ ID NO: 908239 - RNA, 18 nt, Homo sapiens
uucaggagcugaagccca

SEQ ID NO: 908240 - RNA, 17 nt, Homo sapiens
uucagugcuguacuuga

SEQ ID NO: 908241 - RNA, 23 nt, Homo sapiens
uucaguuccucuuugcauggaau

SEQ ID NO: 908242 - RNA, 16 nt, Homo sapiens
uucauacccuguuacc

SEQ ID NO: 908243 - RNA, 11 nt, Homo sapiens
ucuuuuccacu

SEQ ID NO: 908244 - RNA, 10 nt, Homo sapiens
ucuuuuccau

SEQ ID NO: 908245 - RNA, 17 nt, Homo sapiens
ucuuuucgaauguggcu

SEQ ID NO: 908246 - RNA, 21 nt, Homo sapiens
ucuuuucuggaauguaaucaa

SEQ ID NO: 908247 - RNA, 21 nt, Homo sapiens
ucuuuuuagagaaauuugcca

SEQ ID NO: 908248 - RNA, 17 nt, Homo sapiens
ucuuuuuccuuuugcca

SEQ ID NO: 908249 - RNA, 16 nt, Homo sapiens
ugaaaaaaaugcauuu

SEQ ID NO: 908250 - RNA, 18 nt, Homo sapiens
ugaaaaacaaaaauaaca

SEQ ID NO: 908251 - RNA, 22 nt, Homo sapiens
ugaaaaacagaaagcauccuaa

SEQ ID NO: 908252 - RNA, 12 nt, Homo sapiens
ugaaaaacauuc

SEQ ID NO: 908253 - RNA, 19 nt, Homo sapiens
ugaaaaacauuccaggaaa

SEQ ID NO: 908254 - RNA, 21 nt, Homo sapiens
ugaaaaacuauuaacaacuug

SEQ ID NO: 908255 - RNA, 12 nt, Homo sapiens
ugaaaaauacuu

SEQ ID NO: 908256 - RNA, 16 nt, Homo sapiens
uucucuccuucuuccc

SEQ ID NO: 908257 - RNA, 18 nt, Homo sapiens
uucugaaacuucauaaau

SEQ ID NO: 908258 - RNA, 22 nt, Homo sapiens
uucugaauuauuaugucucaaa

SEQ ID NO: 908259 - RNA, 23 nt, Homo sapiens
uucugacaagauaaaggaaguca

SEQ ID NO: 908260 - RNA, 18 nt, Homo sapiens
uucugacaucagcagaga

SEQ ID NO: 908261 - RNA, 19 nt, Homo sapiens
uucugacuucucccaucua

SEQ ID NO: 908262 - RNA, 23 nt, Homo sapiens
uucugagcaccuacuuacaugca

SEQ ID NO: 908263 - RNA, 18 nt, Homo sapiens
uucugaugagacugcagc

SEQ ID NO: 908264 - RNA, 16 nt, Homo sapiens
uucugauuucagaaau

SEQ ID NO: 908265 - RNA, 22 nt, Homo sapiens
uaaucagggaggucauuuuggu

SEQ ID NO: 908266 - RNA, 22 nt, Homo sapiens
uaaucagguccucagagaauuu

SEQ ID NO: 908267 - RNA, 22 nt, Homo sapiens
uaaucaguuuuauccacagaaa

SEQ ID NO: 908268 - RNA, 20 nt, Homo sapiens
uaaucaucaccacaccguga

SEQ ID NO: 908269 - RNA, 23 nt, Homo sapiens
uaauccucaacaacaaaccaaaa

SEQ ID NO: 908270 - RNA, 17 nt, Homo sapiens
uaaucgagucuaccucu

SEQ ID NO: 908271 - RNA, 15 nt, Homo sapiens
uaaucuaauacacuu

SEQ ID NO: 908272 - RNA, 14 nt, Homo sapiens
uaaucuccacuguu

SEQ ID NO: 908273 - RNA, 16 nt, Homo sapiens
uaaucuggacuccucu

SEQ ID NO: 908274 - RNA, 22 nt, Homo sapiens
uaaucuggacuccucuguccag

SEQ ID NO: 908275 - RNA, 20 nt, Homo sapiens
uaaucuuugaaagcugaaua

SEQ ID NO: 908276 - RNA, 14 nt, Homo sapiens
uaaugaaacaaaga

SEQ ID NO: 908277 - RNA, 18 nt, Homo sapiens
uaaugaacagaacauaga

SEQ ID NO: 908278 - RNA, 14 nt, Homo sapiens
uaaugaacagcaga

SEQ ID NO: 908279 - RNA, 18 nt, Homo sapiens
uaaugaagacccagugua

SEQ ID NO: 908280 - RNA, 21 nt, Homo sapiens
uaaugagccguugugcuccag

SEQ ID NO: 908281 - RNA, 11 nt, Homo sapiens
uaaugagggac

SEQ ID NO: 908282 - RNA, 15 nt, Homo sapiens
uaauguaugcauuca

SEQ ID NO: 908283 - RNA, 17 nt, Homo sapiens
uaaugucgaacucugaa

SEQ ID NO: 908284 - RNA, 14 nt, Homo sapiens
uaaugucugagcua

SEQ ID NO: 908285 - RNA, 20 nt, Homo sapiens
uaauguuaauucagcacuga

SEQ ID NO: 908286 - RNA, 20 nt, Homo sapiens
uaauguuguaauucaugcca

SEQ ID NO: 908287 - RNA, 22 nt, Homo sapiens
uaauuaaacaagugcacuugaa

SEQ ID NO: 908288 - RNA, 17 nt, Homo sapiens
uaauuaaguaaaccaaa

SEQ ID NO: 908289 - RNA, 21 nt, Homo sapiens
uaauuacauccagaaagaagg

SEQ ID NO: 908290 - RNA, 15 nt, Homo sapiens
uaauuaggaucuaug

SEQ ID NO: 908291 - RNA, 17 nt, Homo sapiens
uaauuaguuaacaguuu

SEQ ID NO: 908292 - RNA, 12 nt, Homo sapiens
uaauuauauagu

SEQ ID NO: 908293 - RNA, 13 nt, Homo sapiens
uaauucuacagga

SEQ ID NO: 908294 - RNA, 13 nt, Homo sapiens
uaauugcauuuaa

SEQ ID NO: 908295 - RNA, 22 nt, Homo sapiens
uaauugcauuucugcucuucca

SEQ ID NO: 908296 - RNA, 21 nt, Homo sapiens
uaauuggaagaaauuccugua

SEQ ID NO: 908297 - RNA, 15 nt, Homo sapiens
uaauuggcaugaagg

SEQ ID NO: 908298 - RNA, 12 nt, Homo sapiens
uaauuguguaca

SEQ ID NO: 908299 - RNA, 21 nt, Homo sapiens
uaauugugugacuuuuucaga

SEQ ID NO: 908300 - RNA, 19 nt, Homo sapiens
uaauuuaaaaaauaacuac

SEQ ID NO: 908301 - RNA, 14 nt, Homo sapiens
uaauuuaaugcaug

SEQ ID NO: 908302 - RNA, 21 nt, Homo sapiens
uaauuuauuuaauauacuuua

SEQ ID NO: 908303 - RNA, 17 nt, Homo sapiens
uaauuucuuacuaaaca

SEQ ID NO: 908304 - RNA, 18 nt, Homo sapiens
uaauuugaaaacauaauc

SEQ ID NO: 908305 - RNA, 19 nt, Homo sapiens
uaauuugaaauuugacuca

SEQ ID NO: 908306 - RNA, 14 nt, Homo sapiens
uaauuuguaucuga

SEQ ID NO: 908307 - RNA, 22 nt, Homo sapiens
uaauuuugcagcagaagccaaa

SEQ ID NO: 908308 - RNA, 13 nt, Homo sapiens
uaauuuuguagua

SEQ ID NO: 908309 - RNA, 19 nt, Homo sapiens
uaauuuugugaaagaagga

SEQ ID NO: 908310 - RNA, 14 nt, Homo sapiens
uaauuuuugcaauu

SEQ ID NO: 908311 - RNA, 16 nt, Homo sapiens
uacaaaaacacagcaa

SEQ ID NO: 908312 - RNA, 17 nt, Homo sapiens
uacaaaaacacagcaag

SEQ ID NO: 908313 - RNA, 20 nt, Homo sapiens
uacaaaaauaguagaacaag

SEQ ID NO: 908314 - RNA, 20 nt, Homo sapiens
uacaaaaaugagcuaggcau

SEQ ID NO: 908315 - RNA, 13 nt, Homo sapiens
uacaaacaagcac

SEQ ID NO: 908316 - RNA, 16 nt, Homo sapiens
uacaaacaagcacaga

SEQ ID NO: 908317 - RNA, 12 nt, Homo sapiens
uacaaacaugug

SEQ ID NO: 908318 - RNA, 17 nt, Homo sapiens
uacaaacucccacuugu

SEQ ID NO: 908319 - RNA, 21 nt, Homo sapiens
uacaaauuguucauguuacca

SEQ ID NO: 908320 - RNA, 21 nt, Homo sapiens
uacaaauuguuucuggaauug

SEQ ID NO: 908321 - RNA, 16 nt, Homo sapiens
uacaaauuuuuccugc

SEQ ID NO: 908322 - RNA, 12 nt, Homo sapiens
uacaacauguag

SEQ ID NO: 908323 - RNA, 16 nt, Homo sapiens
uacaacuuccacucca

SEQ ID NO: 908324 - RNA, 14 nt, Homo sapiens
uacaagaaagcaau

SEQ ID NO: 908325 - RNA, 15 nt, Homo sapiens
uacaagaaccugcua

SEQ ID NO: 908326 - RNA, 19 nt, Homo sapiens
uacaagcauucugucuuga

SEQ ID NO: 908327 - RNA, 13 nt, Homo sapiens
uacaagcauuugc

SEQ ID NO: 908328 - RNA, 14 nt, Homo sapiens
uacaagcauuugcc

SEQ ID NO: 908329 - RNA, 16 nt, Homo sapiens
uacaagguugugcccu

SEQ ID NO: 908330 - RNA, 18 nt, Homo sapiens
uacaauaaagucuuaccu

SEQ ID NO: 908331 - RNA, 23 nt, Homo sapiens
uacaauaacauaauuuguacaua

SEQ ID NO: 908332 - RNA, 20 nt, Homo sapiens
uacaauaauucuaugagaua

SEQ ID NO: 908333 - RNA, 16 nt, Homo sapiens
uacaaucucaaauucu

SEQ ID NO: 908334 - RNA, 20 nt, Homo sapiens
uacaaugacaaguaugauga

SEQ ID NO: 908335 - RNA, 21 nt, Homo sapiens
uacacacaaaaauuaacaaaa

SEQ ID NO: 908336 - RNA, 21 nt, Homo sapiens
uacacacacacgcgugcacac

SEQ ID NO: 908337 - RNA, 13 nt, Homo sapiens
cugaaaaauguca

SEQ ID NO: 908338 - RNA, 14 nt, Homo sapiens
cugaaaaaugucag

SEQ ID NO: 908339 - RNA, 15 nt, Homo sapiens
cugaaaacuggaaua

SEQ ID NO: 908340 - RNA, 22 nt, Homo sapiens
cugaaaagaucugaagguccca

SEQ ID NO: 908341 - RNA, 13 nt, Homo sapiens
cugaaaaucacua

SEQ ID NO: 908342 - RNA, 15 nt, Homo sapiens
cugaaaaucuaauau

SEQ ID NO: 908343 - RNA, 17 nt, Homo sapiens
cugaaaauuaacacugc

SEQ ID NO: 908344 - RNA, 15 nt, Homo sapiens
cugaaagcaguguau

SEQ ID NO: 908345 - RNA, 16 nt, Homo sapiens
cugaaaggcacacuuu

SEQ ID NO: 908346 - RNA, 17 nt, Homo sapiens
cugaaagugacagagac

SEQ ID NO: 908347 - RNA, 15 nt, Homo sapiens
cugaaagugguuuga

SEQ ID NO: 908348 - RNA, 12 nt, Homo sapiens
cugaacagccaa

SEQ ID NO: 908349 - RNA, 19 nt, Homo sapiens
cugaacaguguuaauaaua

SEQ ID NO: 908350 - RNA, 15 nt, Homo sapiens
cugaaccacuuugcc

SEQ ID NO: 908351 - RNA, 18 nt, Homo sapiens
cugaaccaucccugaugu

SEQ ID NO: 908352 - RNA, 17 nt, Homo sapiens
cugaaccauuacuguaa

SEQ ID NO: 908353 - RNA, 18 nt, Homo sapiens
cugaaccauuacuguaau

SEQ ID NO: 908354 - RNA, 13 nt, Homo sapiens
cugaaccccaugg

SEQ ID NO: 908355 - RNA, 18 nt, Homo sapiens
cugaacugagccuagcua

SEQ ID NO: 908356 - RNA, 21 nt, Homo sapiens
cugaagaaaccuucagauuug

SEQ ID NO: 908357 - RNA, 18 nt, Homo sapiens
cugaagaaucacaauaau

SEQ ID NO: 908358 - RNA, 13 nt, Homo sapiens
cugaagaccucca

SEQ ID NO: 908359 - RNA, 21 nt, Homo sapiens
cugaagcugacagcacuacaa

SEQ ID NO: 908360 - RNA, 17 nt, Homo sapiens
cugaaggagauuuuccu

SEQ ID NO: 908361 - RNA, 14 nt, Homo sapiens
cugaagucacauca

SEQ ID NO: 908362 - RNA, 19 nt, Homo sapiens
cugaauaccaaguguguug

SEQ ID NO: 908363 - RNA, 21 nt, Homo sapiens
cugaauagcuucuccaaaggc

SEQ ID NO: 908364 - RNA, 14 nt, Homo sapiens
cugaauccaucagg

SEQ ID NO: 908365 - RNA, 18 nt, Homo sapiens
cugaaugucuuacuguga

SEQ ID NO: 908366 - RNA, 18 nt, Homo sapiens
cugaaugugccuaaugga

SEQ ID NO: 908367 - RNA, 19 nt, Homo sapiens
cugaauuuggccugcacua

SEQ ID NO: 908368 - RNA, 20 nt, Homo sapiens
cugaauuuggccugcacuaa

SEQ ID NO: 908369 - RNA, 19 nt, Homo sapiens
cugacaaagaugaccugcu

SEQ ID NO: 908370 - RNA, 11 nt, Homo sapiens
cugacacaaga

SEQ ID NO: 908371 - RNA, 15 nt, Homo sapiens
cugacacaagaggaa

SEQ ID NO: 908372 - RNA, 12 nt, Homo sapiens
cugacacaggaa

SEQ ID NO: 908373 - RNA, 17 nt, Homo sapiens
cugacacaggaaaccaa

SEQ ID NO: 908374 - RNA, 12 nt, Homo sapiens
cugacaccuacc

SEQ ID NO: 908375 - RNA, 17 nt, Homo sapiens
cugacagaaaugcaauc

SEQ ID NO: 908376 - RNA, 18 nt, Homo sapiens
cugacagaaggacucagg

SEQ ID NO: 908377 - RNA, 19 nt, Homo sapiens
cugaccaaagagaagcaaa

SEQ ID NO: 908378 - RNA, 17 nt, Homo sapiens
cugaccaagauacuuaa

SEQ ID NO: 908379 - RNA, 13 nt, Homo sapiens
cugacccacugcu

SEQ ID NO: 908380 - RNA, 15 nt, Homo sapiens
cuguacuaaggagca

SEQ ID NO: 908381 - RNA, 19 nt, Homo sapiens
cuguacuaaggagcaugau

SEQ ID NO: 908382 - RNA, 13 nt, Homo sapiens
cuguacucaggag

SEQ ID NO: 908383 - RNA, 17 nt, Homo sapiens
cuguagagucacugacc

SEQ ID NO: 908384 - RNA, 16 nt, Homo sapiens
cuguagauaaaguggu

SEQ ID NO: 908385 - RNA, 18 nt, Homo sapiens
cuguagcauuacaguggg

SEQ ID NO: 908386 - RNA, 15 nt, Homo sapiens
cuguaguagcccuuu

SEQ ID NO: 908387 - RNA, 21 nt, Homo sapiens
cuguagucccagccacucggg

SEQ ID NO: 908388 - RNA, 21 nt, Homo sapiens
cuguagucccagcuacucggg

SEQ ID NO: 908389 - RNA, 23 nt, Homo sapiens
cuguaguugcguggacucugcac

SEQ ID NO: 908390 - RNA, 20 nt, Homo sapiens
cuguauaaccccaccuugcc

SEQ ID NO: 908391 - RNA, 13 nt, Homo sapiens
cuguauacuguac

SEQ ID NO: 908392 - RNA, 16 nt, Homo sapiens
cuguauaguacuggca

SEQ ID NO: 908393 - RNA, 17 nt, Homo sapiens
cuguauauaauacuaaa

SEQ ID NO: 908394 - RNA, 13 nt, Homo sapiens
cuguauauguugu

SEQ ID NO: 908395 - RNA, 19 nt, Homo sapiens
cuguauucagaucguauua

SEQ ID NO: 908396 - RNA, 23 nt, Homo sapiens
cuguauuuguaucucugaagcau

SEQ ID NO: 908397 - RNA, 16 nt, Homo sapiens
cugucagaggcuaaga

SEQ ID NO: 908398 - RNA, 18 nt, Homo sapiens
cugucauggaaaagccca

SEQ ID NO: 908399 - RNA, 19 nt, Homo sapiens
cugucauggaaaagcccag

SEQ ID NO: 908400 - RNA, 18 nt, Homo sapiens
cugucauucaaaugggug

SEQ ID NO: 908401 - RNA, 21 nt, Homo sapiens
cuguccaaggcacaaaccuua

SEQ ID NO: 908402 - RNA, 21 nt, Homo sapiens
cuguccaggccacuguggcca

SEQ ID NO: 908403 - RNA, 18 nt, Homo sapiens
cuguccaguuuccaaagg

SEQ ID NO: 908404 - RNA, 12 nt, Homo sapiens
cugucccaaaga

SEQ ID NO: 908405 - RNA, 23 nt, Homo sapiens
cugucccccugagaucagagucc

SEQ ID NO: 908406 - RNA, 23 nt, Homo sapiens
cuguccccucuccccucauggag

SEQ ID NO: 908407 - RNA, 21 nt, Homo sapiens
cuguccccugaaaaacugauc

SEQ ID NO: 908408 - RNA, 22 nt, Homo sapiens
cugucgcugcuucgugggauac

SEQ ID NO: 908409 - RNA, 17 nt, Homo sapiens
cugucuccuuucucagc

SEQ ID NO: 908410 - RNA, 15 nt, Homo sapiens
cugucucucaugaac

SEQ ID NO: 908411 - RNA, 17 nt, Homo sapiens
cugucucugcucuugcc

SEQ ID NO: 908412 - RNA, 16 nt, Homo sapiens
cugucuggcugaggau

SEQ ID NO: 908413 - RNA, 17 nt, Homo sapiens
cugucugucaccagcua

SEQ ID NO: 908414 - RNA, 18 nt, Homo sapiens
cugucuuaaggcaucuga

SEQ ID NO: 908415 - RNA, 16 nt, Homo sapiens
cugucuuccacuguac

SEQ ID NO: 908416 - RNA, 14 nt, Homo sapiens
cugugaggugcuga

SEQ ID NO: 908417 - RNA, 22 nt, Homo sapiens
cugugaucccagcuacuuggga

SEQ ID NO: 908418 - RNA, 18 nt, Homo sapiens
cugugauuaacuugcuua

SEQ ID NO: 908419 - RNA, 24 nt, Homo sapiens
cugugauuuuuuuuaaaugugcag

SEQ ID NO: 908420 - RNA, 22 nt, Homo sapiens
cugugcacugacauguuucaca

SEQ ID NO: 908421 - RNA, 20 nt, Homo sapiens
cugugcccacgugugcagac

SEQ ID NO: 908422 - RNA, 14 nt, Homo sapiens
cugugcguuacuaa

SEQ ID NO: 908423 - RNA, 21 nt, Homo sapiens
cugugcguuuuagaguaugca

SEQ ID NO: 908424 - RNA, 16 nt, Homo sapiens
cugugcugugucugca

SEQ ID NO: 908425 - RNA, 11 nt, Homo sapiens
cuguggcacag

SEQ ID NO: 908426 - RNA, 15 nt, Homo sapiens
cuguggcugcuagca

SEQ ID NO: 908427 - RNA, 15 nt, Homo sapiens
cugugggcagcaccc

SEQ ID NO: 908428 - RNA, 22 nt, Homo sapiens
cugugggcuuuggguuugucag

SEQ ID NO: 908429 - RNA, 19 nt, Homo sapiens
cugugggugcuaaggguaa

SEQ ID NO: 908430 - RNA, 17 nt, Homo sapiens
cuguguacccacuccuc

SEQ ID NO: 908431 - RNA, 18 nt, Homo sapiens
cuguguagcucuguccac

SEQ ID NO: 908432 - RNA, 17 nt, Homo sapiens
cuguguccgcuuucaug

SEQ ID NO: 908433 - RNA, 15 nt, Homo sapiens
cuguguggugcccau

SEQ ID NO: 908434 - RNA, 19 nt, Homo sapiens
cuguguguuuuaguuucau

SEQ ID NO: 908435 - RNA, 24 nt, Homo sapiens
cuguguuacccaguaacucaucug

SEQ ID NO: 908436 - RNA, 17 nt, Homo sapiens
cuguguucauucuuacc

SEQ ID NO: 908437 - RNA, 21 nt, Homo sapiens
cuguguucucaccgugaucaa

SEQ ID NO: 908438 - RNA, 18 nt, Homo sapiens
cuguguuucuggggacac

SEQ ID NO: 908439 - RNA, 21 nt, Homo sapiens
cuguuaacgucaucucagggu

SEQ ID NO: 908440 - RNA, 14 nt, Homo sapiens
cuguuacccagaga

SEQ ID NO: 908441 - RNA, 22 nt, Homo sapiens
cuguuacuugaaauaccaguga

SEQ ID NO: 908442 - RNA, 16 nt, Homo sapiens
cuguuagucauuugcu

SEQ ID NO: 908443 - RNA, 18 nt, Homo sapiens
cuguuauuuaauuagcca

SEQ ID NO: 908444 - RNA, 14 nt, Homo sapiens
cuguucugcacuga

SEQ ID NO: 908445 - RNA, 16 nt, Homo sapiens
cuguucugcacugaaa

SEQ ID NO: 908446 - RNA, 18 nt, Homo sapiens
cuguucugccuuccgcag

SEQ ID NO: 908447 - RNA, 18 nt, Homo sapiens
cuguugaucccacuucac

SEQ ID NO: 908448 - RNA, 19 nt, Homo sapiens
cuguuggccagugugacaa

SEQ ID NO: 908449 - RNA, 21 nt, Homo sapiens
cuguuggccagugugacaagg

SEQ ID NO: 908450 - RNA, 14 nt, Homo sapiens
cuguuggucugucc

SEQ ID NO: 908451 - RNA, 15 nt, Homo sapiens
cuguuucaaacugag

SEQ ID NO: 908452 - RNA, 23 nt, Homo sapiens
uaggccauguuaauuaaacugaa

SEQ ID NO: 908453 - RNA, 21 nt, Homo sapiens
uagggcuguagacuuacuuuc

SEQ ID NO: 908454 - RNA, 20 nt, Homo sapiens
uagguacuucacauugcaaa

SEQ ID NO: 908455 - RNA, 20 nt, Homo sapiens
uaggucauuacuaaccauag

SEQ ID NO: 908456 - RNA, 17 nt, Homo sapiens
uagguccaagggccaua

SEQ ID NO: 908457 - RNA, 19 nt, Homo sapiens
uagguccuggcuucuagau

SEQ ID NO: 908458 - RNA, 19 nt, Homo sapiens
uaggucuguaauuuauuaa

SEQ ID NO: 908459 - RNA, 14 nt, Homo sapiens
uaggugugccaaac

SEQ ID NO: 908460 - RNA, 14 nt, Homo sapiens
uagguuuuguacaa

SEQ ID NO: 908461 - RNA, 19 nt, Homo sapiens
uaguaaagugauaauuucu

SEQ ID NO: 908462 - RNA, 16 nt, Homo sapiens
uaguaauugauuugac

SEQ ID NO: 908463 - RNA, 23 nt, Homo sapiens
uaguacuugggagaccuguaauc

SEQ ID NO: 908464 - RNA, 13 nt, Homo sapiens
uaguauuuaugaa

SEQ ID NO: 908465 - RNA, 22 nt, Homo sapiens
uagucacauggccuaugcacau

SEQ ID NO: 908466 - RNA, 21 nt, Homo sapiens
uagucacugucucaacuacuc

SEQ ID NO: 908467 - RNA, 15 nt, Homo sapiens
uaguccccaucagca

SEQ ID NO: 908468 - RNA, 20 nt, Homo sapiens
uagucugcgucucugcuuua

SEQ ID NO: 908469 - RNA, 17 nt, Homo sapiens
uagugacuuccugguga

SEQ ID NO: 908470 - RNA, 22 nt, Homo sapiens
uagugauuugccucaacaacgu

SEQ ID NO: 908471 - RNA, 17 nt, Homo sapiens
uagugcacacuuguaua

SEQ ID NO: 908472 - RNA, 16 nt, Homo sapiens
uagugcagaaucucau

SEQ ID NO: 908473 - RNA, 16 nt, Homo sapiens
uaguggcauccauuuc

SEQ ID NO: 908474 - RNA, 19 nt, Homo sapiens
uaguguaacacugcaagaa

SEQ ID NO: 908475 - RNA, 21 nt, Homo sapiens
uaguguuggaaaaugugcaau

SEQ ID NO: 908476 - RNA, 22 nt, Homo sapiens
uaguguuggaaaaugugcaaua

SEQ ID NO: 908477 - RNA, 16 nt, Homo sapiens
uaguuccucuucuuaa

SEQ ID NO: 908478 - RNA, 15 nt, Homo sapiens
uaguucucacugucu

SEQ ID NO: 908479 - RNA, 23 nt, Homo sapiens
uaguugaucuacaaaggccaugg

SEQ ID NO: 908480 - RNA, 15 nt, Homo sapiens
uaguuguaucucuuu

SEQ ID NO: 908481 - RNA, 20 nt, Homo sapiens
uaguuuuauaaaacucaguu

SEQ ID NO: 908482 - RNA, 15 nt, Homo sapiens
uaguuuucagccuug

SEQ ID NO: 908483 - RNA, 12 nt, Homo sapiens
uauaaaauacug

SEQ ID NO: 908484 - RNA, 16 nt, Homo sapiens
uauaaagucaggaccu

SEQ ID NO: 908485 - RNA, 22 nt, Homo sapiens
uauaaagugaucaguaugcugu

SEQ ID NO: 908486 - RNA, 18 nt, Homo sapiens
uauaaauacacuuccugc

SEQ ID NO: 908487 - RNA, 21 nt, Homo sapiens
uauaaauacacuuccugcuua

SEQ ID NO: 908488 - RNA, 18 nt, Homo sapiens
uauaaauuuguguucuca

SEQ ID NO: 908489 - RNA, 17 nt, Homo sapiens
uauaaccauuacauguu

SEQ ID NO: 908490 - RNA, 19 nt, Homo sapiens
uauaaccccaccuugccaa

SEQ ID NO: 908491 - RNA, 20 nt, Homo sapiens
uauaacuaguccuuuacuaa

SEQ ID NO: 908492 - RNA, 21 nt, Homo sapiens
uauaacuaguccuuuacuaau

SEQ ID NO: 908493 - RNA, 21 nt, Homo sapiens
cuuaggugcuucuucacuuca

SEQ ID NO: 908494 - RNA, 18 nt, Homo sapiens
cuuaguaaucccccuugc

SEQ ID NO: 908495 - RNA, 16 nt, Homo sapiens
cuuauaaaaaucuuaa

SEQ ID NO: 908496 - RNA, 15 nt, Homo sapiens
cuuauaagaauuaau

SEQ ID NO: 908497 - RNA, 13 nt, Homo sapiens
cuuauaccaaagg

SEQ ID NO: 908498 - RNA, 16 nt, Homo sapiens
cuuauagaaaguucaa

SEQ ID NO: 908499 - RNA, 15 nt, Homo sapiens
cuuauagguuuccac

SEQ ID NO: 908500 - RNA, 21 nt, Homo sapiens
cuuauagguuuccacugccaa

SEQ ID NO: 908501 - RNA, 20 nt, Homo sapiens
cuuauccaggacucugucaa

SEQ ID NO: 908502 - RNA, 14 nt, Homo sapiens
cuuauucuauccac

SEQ ID NO: 908503 - RNA, 14 nt, Homo sapiens
cuuauuguacuugu

SEQ ID NO: 908504 - RNA, 16 nt, Homo sapiens
cuuauugucuaggcca

SEQ ID NO: 908505 - RNA, 12 nt, Homo sapiens
cuuauuugcaau

SEQ ID NO: 908506 - RNA, 13 nt, Homo sapiens
cuuauuugguaua

SEQ ID NO: 908507 - RNA, 19 nt, Homo sapiens
cuuauuuguauaauggugu

SEQ ID NO: 908508 - RNA, 24 nt, Homo sapiens
cuuauuuuguaauaaacucucuag

SEQ ID NO: 908509 - RNA, 22 nt, Homo sapiens
cuucaaaugucuaagguaguaa

SEQ ID NO: 908510 - RNA, 21 nt, Homo sapiens
cuucaacugaccagccuccau

SEQ ID NO: 908511 - RNA, 21 nt, Homo sapiens
cuucaagcaccugcagauucu

SEQ ID NO: 908512 - RNA, 19 nt, Homo sapiens
cuucaaguuagcucaggag

SEQ ID NO: 908513 - RNA, 22 nt, Homo sapiens
cuucaauaugaaggacuauuaa

SEQ ID NO: 908514 - RNA, 21 nt, Homo sapiens
cuucacuucaguugcuuugca

SEQ ID NO: 908515 - RNA, 17 nt, Homo sapiens
cuucagaagacacugca

SEQ ID NO: 908516 - RNA, 23 nt, Homo sapiens
cuucagaagacacugcaaaggcg

SEQ ID NO: 908517 - RNA, 19 nt, Homo sapiens
cuucagccaucaacaagag

SEQ ID NO: 908518 - RNA, 14 nt, Homo sapiens
cuucagguggaaaa

SEQ ID NO: 908519 - RNA, 22 nt, Homo sapiens
cuucagucuugaauuucuaaaa

SEQ ID NO: 908520 - RNA, 16 nt, Homo sapiens
cuucagugggagaaaa

SEQ ID NO: 908521 - RNA, 15 nt, Homo sapiens
cuucaucccaaagga

SEQ ID NO: 908522 - RNA, 12 nt, Homo sapiens
cuucaucuguga

SEQ ID NO: 908523 - RNA, 20 nt, Homo sapiens
cuucaucuugacauguaaug

SEQ ID NO: 908524 - RNA, 16 nt, Homo sapiens
cuucaugcauuugcac

SEQ ID NO: 908525 - RNA, 22 nt, Homo sapiens
cuucauugaccaagaugaucac

SEQ ID NO: 908526 - RNA, 14 nt, Homo sapiens
cuucauuuccguga

SEQ ID NO: 908527 - RNA, 20 nt, Homo sapiens
cuucauuugggaaauucagc

SEQ ID NO: 908528 - RNA, 17 nt, Homo sapiens
cuuccaaagacaagaaa

SEQ ID NO: 908529 - RNA, 17 nt, Homo sapiens
cuuccacaccuagcauc

SEQ ID NO: 908530 - RNA, 20 nt, Homo sapiens
cuuccacagaauacaagcca

SEQ ID NO: 908531 - RNA, 17 nt, Homo sapiens
cuuccacuucuaugcaa

SEQ ID NO: 908532 - RNA, 22 nt, Homo sapiens
cuuccagagccuaagaaaauca

SEQ ID NO: 908533 - RNA, 15 nt, Homo sapiens
cuuccagguacugau

SEQ ID NO: 908534 - RNA, 22 nt, Homo sapiens
cuuccagugguaccagcucacu

SEQ ID NO: 908535 - RNA, 16 nt, Homo sapiens
cuuccaguuugcuuug

SEQ ID NO: 908536 - RNA, 16 nt, Homo sapiens
cuuccauaucuuccag

SEQ ID NO: 908537 - RNA, 16 nt, Homo sapiens
cuucccccauccucca

SEQ ID NO: 908538 - RNA, 13 nt, Homo sapiens
cuuccccuugccc

SEQ ID NO: 908539 - RNA, 19 nt, Homo sapiens
cuuccccuugcccuugccc

SEQ ID NO: 908540 - RNA, 14 nt, Homo sapiens
cuuccggcucccuu

SEQ ID NO: 908541 - RNA, 14 nt, Homo sapiens
cuuccgugcugaac

SEQ ID NO: 908542 - RNA, 20 nt, Homo sapiens
cuuccuaauaugcuuuacaa

SEQ ID NO: 908543 - RNA, 13 nt, Homo sapiens
cuuccuaccaaau

SEQ ID NO: 908544 - RNA, 22 nt, Homo sapiens
cuuccucucaagcuagccagag

SEQ ID NO: 908545 - RNA, 22 nt, Homo sapiens
cuuccugacccuccgcugcaga

SEQ ID NO: 908546 - RNA, 22 nt, Homo sapiens
cuuccugcaaagggaacugaag

SEQ ID NO: 908547 - RNA, 16 nt, Homo sapiens
cuuccugccaccaguc

SEQ ID NO: 908548 - RNA, 15 nt, Homo sapiens
cuuccuggaagcaga

SEQ ID NO: 908549 - RNA, 12 nt, Homo sapiens
cuuccuguaaca

SEQ ID NO: 908550 - RNA, 20 nt, Homo sapiens
cuuccuguaacacaagccac

SEQ ID NO: 908551 - RNA, 15 nt, Homo sapiens
cuuccuguccacucu

SEQ ID NO: 908552 - RNA, 16 nt, Homo sapiens
cuuccugugacuucag

SEQ ID NO: 908553 - RNA, 15 nt, Homo sapiens
cuuccuuacccaaac

SEQ ID NO: 908554 - RNA, 19 nt, Homo sapiens
cuuccuuagccuugcucag

SEQ ID NO: 908555 - RNA, 19 nt, Homo sapiens
cuuccuucgcagcuuuuag

SEQ ID NO: 908556 - RNA, 18 nt, Homo sapiens
cuucgacccuuucucuga

SEQ ID NO: 908557 - RNA, 23 nt, Homo sapiens
cuucgauacaccgggccuggaga

SEQ ID NO: 908558 - RNA, 20 nt, Homo sapiens
cuucuaaaugaagugcaaau

SEQ ID NO: 908559 - RNA, 19 nt, Homo sapiens
cuucuaugguugacauugu

SEQ ID NO: 908560 - RNA, 20 nt, Homo sapiens
cuucuaugguugacauugua

SEQ ID NO: 908561 - RNA, 16 nt, Homo sapiens
cuucuccaaaugagau

SEQ ID NO: 908562 - RNA, 17 nt, Homo sapiens
cuucucccaucuagugg

SEQ ID NO: 908563 - RNA, 15 nt, Homo sapiens
cuucuccccauucug

SEQ ID NO: 908564 - RNA, 16 nt, Homo sapiens
cuucuccuaugcauuu

SEQ ID NO: 908565 - RNA, 12 nt, Homo sapiens
cuucuccugacc

SEQ ID NO: 908566 - RNA, 14 nt, Homo sapiens
uaucuucauacaau

SEQ ID NO: 908567 - RNA, 21 nt, Homo sapiens
uaucuuguucuuuaaaaucac

SEQ ID NO: 908568 - RNA, 17 nt, Homo sapiens
uaucuuuuugcuuacag

SEQ ID NO: 908569 - RNA, 23 nt, Homo sapiens
uaugaaaaaauuaguugagaaag

SEQ ID NO: 908570 - RNA, 19 nt, Homo sapiens
uaugaaaaaucaaugucaa

SEQ ID NO: 908571 - RNA, 16 nt, Homo sapiens
uaugaaaugggcuuua

SEQ ID NO: 908572 - RNA, 14 nt, Homo sapiens
uaugaacuacaaag

SEQ ID NO: 908573 - RNA, 19 nt, Homo sapiens
uaugaaggcuguacacugc

SEQ ID NO: 908574 - RNA, 22 nt, Homo sapiens
uaugaaggcuguacacugcacg

SEQ ID NO: 908575 - RNA, 22 nt, Homo sapiens
uaugaaguugcaaugcuucaca

SEQ ID NO: 908576 - RNA, 23 nt, Homo sapiens
uaugaguuuuugauagcuuuauu

SEQ ID NO: 908577 - RNA, 19 nt, Homo sapiens
uaugauauuuugucuccua

SEQ ID NO: 908578 - RNA, 17 nt, Homo sapiens
uaugaucacggcucacu

SEQ ID NO: 908579 - RNA, 20 nt, Homo sapiens
uaugauggguguuuuuagca

SEQ ID NO: 908580 - RNA, 18 nt, Homo sapiens
uaugauguguugugauag

SEQ ID NO: 908581 - RNA, 23 nt, Homo sapiens
uaugcaaccuuuggaugcacuuu

SEQ ID NO: 908582 - RNA, 21 nt, Homo sapiens
uaugcaauuuuuaaacuagua

SEQ ID NO: 908583 - RNA, 11 nt, Homo sapiens
uaugcacacac

SEQ ID NO: 908584 - RNA, 19 nt, Homo sapiens
uaugcaccaaaucaucucu

SEQ ID NO: 908585 - RNA, 19 nt, Homo sapiens
uaugcaguauugccacaau

SEQ ID NO: 908586 - RNA, 12 nt, Homo sapiens
uaugccauagca

SEQ ID NO: 908587 - RNA, 16 nt, Homo sapiens
uaugccuuaagccaau

SEQ ID NO: 908588 - RNA, 14 nt, Homo sapiens
uaugccuucacuuu

SEQ ID NO: 908589 - RNA, 17 nt, Homo sapiens
uaugcgcaauguggcau

SEQ ID NO: 908590 - RNA, 12 nt, Homo sapiens
uaugcuagugau

SEQ ID NO: 908591 - RNA, 23 nt, Homo sapiens
uauggaaaagggucuucuuggca

SEQ ID NO: 908592 - RNA, 22 nt, Homo sapiens
uauggaaauccuguuacuuaaa

SEQ ID NO: 908593 - RNA, 12 nt, Homo sapiens
uauggacucugc

SEQ ID NO: 908594 - RNA, 19 nt, Homo sapiens
uauggaucccaauucauuu

SEQ ID NO: 908595 - RNA, 14 nt, Homo sapiens
uauggcaagugaua

SEQ ID NO: 908596 - RNA, 13 nt, Homo sapiens
uauggcagccauc

SEQ ID NO: 908597 - RNA, 19 nt, Homo sapiens
uauggccaggggacacugu

SEQ ID NO: 908598 - RNA, 14 nt, Homo sapiens
uaugggacacugaa

SEQ ID NO: 908599 - RNA, 16 nt, Homo sapiens
uaugggcgugaaccac

SEQ ID NO: 908600 - RNA, 14 nt, Homo sapiens
uauguaaucucacc

SEQ ID NO: 908601 - RNA, 13 nt, Homo sapiens
uauguacuaagca

SEQ ID NO: 908602 - RNA, 22 nt, Homo sapiens
uauguaugaguggcuucuggga

SEQ ID NO: 908603 - RNA, 23 nt, Homo sapiens
uauguaugcaucuauauguguau

SEQ ID NO: 908604 - RNA, 14 nt, Homo sapiens
uauguaugcgugca

SEQ ID NO: 908605 - RNA, 17 nt, Homo sapiens
uauguauuuuugucaua

SEQ ID NO: 908606 - RNA, 20 nt, Homo sapiens
uaugucaauuuguauaucau

SEQ ID NO: 908607 - RNA, 13 nt, Homo sapiens
gaccuucuaggaa

SEQ ID NO: 908608 - RNA, 17 nt, Homo sapiens
gaccuuuuauccacuua

SEQ ID NO: 908609 - RNA, 17 nt, Homo sapiens
gaccuuuucucucccau

SEQ ID NO: 908610 - RNA, 22 nt, Homo sapiens
gaccuuuuuuaggaagcaagcu

SEQ ID NO: 908611 - RNA, 20 nt, Homo sapiens
gacgcagcccugggggccag

SEQ ID NO: 908612 - RNA, 23 nt, Homo sapiens
gacgcagcccugggggccagcug

SEQ ID NO: 908613 - RNA, 21 nt, Homo sapiens
gacgccacucauuucaucuca

SEQ ID NO: 908614 - RNA, 18 nt, Homo sapiens
gacgcuuccagaccaccu

SEQ ID NO: 908615 - RNA, 19 nt, Homo sapiens
gacgcuuccagaccaccug

SEQ ID NO: 908616 - RNA, 15 nt, Homo sapiens
gacggcggcggcccu

SEQ ID NO: 908617 - RNA, 21 nt, Homo sapiens
gacggcugcucgaagaacaau

SEQ ID NO: 908618 - RNA, 16 nt, Homo sapiens
gacgggaggcuggaag

SEQ ID NO: 908619 - RNA, 15 nt, Homo sapiens
gacggggacugggga

SEQ ID NO: 908620 - RNA, 16 nt, Homo sapiens
gacggucccacacugg

SEQ ID NO: 908621 - RNA, 21 nt, Homo sapiens
gacguuggccuaacacugggc

SEQ ID NO: 908622 - RNA, 14 nt, Homo sapiens
gacuacagccagaa

SEQ ID NO: 908623 - RNA, 12 nt, Homo sapiens
gacuacaggugu

SEQ ID NO: 908624 - RNA, 13 nt, Homo sapiens
gacuacuauacaa

SEQ ID NO: 908625 - RNA, 17 nt, Homo sapiens
gacuauauacaugugug

SEQ ID NO: 908626 - RNA, 14 nt, Homo sapiens
gacuaucacauaca

SEQ ID NO: 908627 - RNA, 20 nt, Homo sapiens
gacuaucuuacuauuucaca

SEQ ID NO: 908628 - RNA, 12 nt, Homo sapiens
gacuauggagcc

SEQ ID NO: 908629 - RNA, 16 nt, Homo sapiens
gacuauuuaacuugag

SEQ ID NO: 908630 - RNA, 13 nt, Homo sapiens
gacuauuuagaca

SEQ ID NO: 908631 - RNA, 18 nt, Homo sapiens
gacucaacgagagcacuu

SEQ ID NO: 908632 - RNA, 17 nt, Homo sapiens
gacucaaugcacugaca

SEQ ID NO: 908633 - RNA, 21 nt, Homo sapiens
gacucacccucauaccaucug

SEQ ID NO: 908634 - RNA, 22 nt, Homo sapiens
gacucaguuuucuugcagauca

SEQ ID NO: 908635 - RNA, 21 nt, Homo sapiens
gacucauuuuaaaaaauggaa

SEQ ID NO: 908636 - RNA, 12 nt, Homo sapiens
gacuccaagaac

SEQ ID NO: 908637 - RNA, 15 nt, Homo sapiens
gacuccucaaaagca

SEQ ID NO: 908638 - RNA, 16 nt, Homo sapiens
gacuccucuaagccac

SEQ ID NO: 908639 - RNA, 23 nt, Homo sapiens
gacucuaaauauuucaugauuca

SEQ ID NO: 908640 - RNA, 17 nt, Homo sapiens
gacucucccccuuucaa

SEQ ID NO: 908641 - RNA, 20 nt, Homo sapiens
gacucugcacaugucuugua

SEQ ID NO: 908642 - RNA, 18 nt, Homo sapiens
gacucuucccccacuccu

SEQ ID NO: 908643 - RNA, 17 nt, Homo sapiens
gacucuugccuuuccac

SEQ ID NO: 908644 - RNA, 23 nt, Homo sapiens
gacugauggcgauucccucucac

SEQ ID NO: 908645 - RNA, 23 nt, Homo sapiens
gacugauguuacaucacaguguu

SEQ ID NO: 908646 - RNA, 18 nt, Homo sapiens
gacugccaugcuagacaa

SEQ ID NO: 908647 - RNA, 17 nt, Homo sapiens
gacuggauucgugacaa

SEQ ID NO: 908648 - RNA, 16 nt, Homo sapiens
gacugguaaguaacug

SEQ ID NO: 908649 - RNA, 13 nt, Homo sapiens
gacugguuagaca

SEQ ID NO: 908650 - RNA, 17 nt, Homo sapiens
gacuguaggauuugaag

SEQ ID NO: 908651 - RNA, 20 nt, Homo sapiens
gacuguggcugcuagcacuu

SEQ ID NO: 908652 - RNA, 15 nt, Homo sapiens
gacugugugcaacgc

SEQ ID NO: 908653 - RNA, 14 nt, Homo sapiens
gacuguugcucaaa

SEQ ID NO: 908654 - RNA, 22 nt, Homo sapiens
gacuuaaaauauuccugcauuu

SEQ ID NO: 908655 - RNA, 18 nt, Homo sapiens
gacuuaggaaccuaccag

SEQ ID NO: 908656 - RNA, 14 nt, Homo sapiens
gacuucacagcagc

SEQ ID NO: 908657 - RNA, 17 nt, Homo sapiens
gacuucaucccaaagga

SEQ ID NO: 908658 - RNA, 16 nt, Homo sapiens
gacuugaggauuuuga

SEQ ID NO: 908659 - RNA, 15 nt, Homo sapiens
gacuugauacugcaa

SEQ ID NO: 908660 - RNA, 23 nt, Homo sapiens
gacuuucuacaccuguugcaccu

SEQ ID NO: 908661 - RNA, 20 nt, Homo sapiens
gacuuuuuagccagugacuu

SEQ ID NO: 908662 - RNA, 20 nt, Homo sapiens
gagaaaacuuauuugaguga

SEQ ID NO: 908663 - RNA, 22 nt, Homo sapiens
gagaaaacuuauuugagugauu

SEQ ID NO: 908664 - RNA, 17 nt, Homo sapiens
gagaaaagaaaccagag

SEQ ID NO: 908665 - RNA, 23 nt, Homo sapiens
gagaaacagagacaggcccaaga

SEQ ID NO: 908666 - RNA, 21 nt, Homo sapiens
gagaaacuuugaucucugcuu

SEQ ID NO: 908667 - RNA, 12 nt, Homo sapiens
gagaaagugacc

SEQ ID NO: 908668 - RNA, 20 nt, Homo sapiens
gagaaauugaacuucaggga

SEQ ID NO: 908669 - RNA, 21 nt, Homo sapiens
gagaaauuuaaacuauaagca

SEQ ID NO: 908670 - RNA, 13 nt, Homo sapiens
gagaaccucaggc

SEQ ID NO: 908671 - RNA, 16 nt, Homo sapiens
gagaacuauccaaaac

SEQ ID NO: 908672 - RNA, 17 nt, Homo sapiens
gagaagaaagaggugac

SEQ ID NO: 908673 - RNA, 14 nt, Homo sapiens
gagaagaugugauu

SEQ ID NO: 908674 - RNA, 15 nt, Homo sapiens
gagaagcucacccaa

SEQ ID NO: 908675 - RNA, 11 nt, Homo sapiens
gagaagcugag

SEQ ID NO: 908676 - RNA, 16 nt, Homo sapiens
gagaaggcccacugag

SEQ ID NO: 908677 - RNA, 19 nt, Homo sapiens
gagaaguucaggaagguac

SEQ ID NO: 908678 - RNA, 21 nt, Homo sapiens
gagaaguuucgagggguccuc

SEQ ID NO: 908679 - RNA, 22 nt, Homo sapiens
gagaaucagggcaggcuugcca

SEQ ID NO: 908680 - RNA, 19 nt, Homo sapiens
gagaauucucgaacugcau

SEQ ID NO: 908681 - RNA, 22 nt, Homo sapiens
gagacacuauuuaucugugcaa

SEQ ID NO: 908682 - RNA, 13 nt, Homo sapiens
uccuaaccuagag

SEQ ID NO: 908683 - RNA, 13 nt, Homo sapiens
uccuaacugagaa

SEQ ID NO: 908684 - RNA, 17 nt, Homo sapiens
uccuaaugauuagcacu

SEQ ID NO: 908685 - RNA, 12 nt, Homo sapiens
uccuacagccuc

SEQ ID NO: 908686 - RNA, 11 nt, Homo sapiens
uccuacugaug

SEQ ID NO: 908687 - RNA, 14 nt, Homo sapiens
uccuagacauaguu

SEQ ID NO: 908688 - RNA, 19 nt, Homo sapiens
uccuaggggccgagggaaa

SEQ ID NO: 908689 - RNA, 14 nt, Homo sapiens
uccuaguuugaccu

SEQ ID NO: 908690 - RNA, 21 nt, Homo sapiens
uccuauccuuggagagcagcu

SEQ ID NO: 908691 - RNA, 21 nt, Homo sapiens
uccuauggaaggguaauuuga

SEQ ID NO: 908692 - RNA, 22 nt, Homo sapiens
uccuauuuauaagagugccgua

SEQ ID NO: 908693 - RNA, 20 nt, Homo sapiens
uccuauuucuuauagucaau

SEQ ID NO: 908694 - RNA, 19 nt, Homo sapiens
uccucaacaacaaaccaaa

SEQ ID NO: 908695 - RNA, 13 nt, Homo sapiens
uccucacuugccc

SEQ ID NO: 908696 - RNA, 13 nt, Homo sapiens
uccucagcugaca

SEQ ID NO: 908697 - RNA, 21 nt, Homo sapiens
uccucagcugccaagcacucg

SEQ ID NO: 908698 - RNA, 20 nt, Homo sapiens
uccucagguaguacugggaa

SEQ ID NO: 908699 - RNA, 15 nt, Homo sapiens
uccucaguguccuca

SEQ ID NO: 908700 - RNA, 22 nt, Homo sapiens
uccucauuuauaaaauaaugaa

SEQ ID NO: 908701 - RNA, 16 nt, Homo sapiens
uccuccacagugcugc

SEQ ID NO: 908702 - RNA, 15 nt, Homo sapiens
uccuccaucuagaga

SEQ ID NO: 908703 - RNA, 22 nt, Homo sapiens
uccucccccaccuucaagcacc

SEQ ID NO: 908704 - RNA, 20 nt, Homo sapiens
uccucccuccccgcccucac

SEQ ID NO: 908705 - RNA, 19 nt, Homo sapiens
uccuccuuguucuacucau

SEQ ID NO: 908706 - RNA, 13 nt, Homo sapiens
uccucguagccau

SEQ ID NO: 908707 - RNA, 21 nt, Homo sapiens
uccucuacuacuuuuacuaca

SEQ ID NO: 908708 - RNA, 20 nt, Homo sapiens
uccucuaguuuuaagacuga

SEQ ID NO: 908709 - RNA, 19 nt, Homo sapiens
uccucucgagcccagaugg

SEQ ID NO: 908710 - RNA, 19 nt, Homo sapiens
uccucucucuacuugaaua

SEQ ID NO: 908711 - RNA, 14 nt, Homo sapiens
uccucugcuugcau

SEQ ID NO: 908712 - RNA, 19 nt, Homo sapiens
uccucuggauggcaccaga

SEQ ID NO: 908713 - RNA, 22 nt, Homo sapiens
uccucuguucuaucccacccaa

SEQ ID NO: 908714 - RNA, 18 nt, Homo sapiens
uccugaagccucugcccu

SEQ ID NO: 908715 - RNA, 13 nt, Homo sapiens
uccugagcacugc

SEQ ID NO: 908716 - RNA, 19 nt, Homo sapiens
uccugagucugggcaauga

SEQ ID NO: 908717 - RNA, 23 nt, Homo sapiens
uccugauaaacauuaaacacugu

SEQ ID NO: 908718 - RNA, 19 nt, Homo sapiens
uccugcaaaaguggaauca

SEQ ID NO: 908719 - RNA, 15 nt, Homo sapiens
uccugcaccgagaga

SEQ ID NO: 908720 - RNA, 19 nt, Homo sapiens
uccugcaggugucuaucca

SEQ ID NO: 908721 - RNA, 15 nt, Homo sapiens
gaguucugacauuca

SEQ ID NO: 908722 - RNA, 14 nt, Homo sapiens
gaguucugggugga

SEQ ID NO: 908723 - RNA, 22 nt, Homo sapiens
gaguugagucuccucucugaga

SEQ ID NO: 908724 - RNA, 13 nt, Homo sapiens
gaguugugaucau

SEQ ID NO: 908725 - RNA, 17 nt, Homo sapiens
gaguugugaucauccca

SEQ ID NO: 908726 - RNA, 21 nt, Homo sapiens
gaguuucuccuuuugaccaaa

SEQ ID NO: 908727 - RNA, 19 nt, Homo sapiens
gauaaacacagagguuuua

SEQ ID NO: 908728 - RNA, 19 nt, Homo sapiens
gauaaauagaguuccaaau

SEQ ID NO: 908729 - RNA, 14 nt, Homo sapiens
gauaacugcaauuu

SEQ ID NO: 908730 - RNA, 19 nt, Homo sapiens
gauaaugcuguugccucau

SEQ ID NO: 908731 - RNA, 12 nt, Homo sapiens
gauacauuucau

SEQ ID NO: 908732 - RNA, 17 nt, Homo sapiens
gauacccagagcauuac

SEQ ID NO: 908733 - RNA, 21 nt, Homo sapiens
gauacccauagcuuccaugag

SEQ ID NO: 908734 - RNA, 19 nt, Homo sapiens
gauacgcaaacacaccgau

SEQ ID NO: 908735 - RNA, 14 nt, Homo sapiens
gauacugcugccaa

SEQ ID NO: 908736 - RNA, 20 nt, Homo sapiens
gauagaacaaugcuauaaua

SEQ ID NO: 908737 - RNA, 13 nt, Homo sapiens
gauagaaccugga

SEQ ID NO: 908738 - RNA, 23 nt, Homo sapiens
gauagcaucuuauacgaguaaua

SEQ ID NO: 908739 - RNA, 18 nt, Homo sapiens
gauagcuuggagggaugg

SEQ ID NO: 908740 - RNA, 12 nt, Homo sapiens
gauagggacuga

SEQ ID NO: 908741 - RNA, 14 nt, Homo sapiens
gauaguccaaagac

SEQ ID NO: 908742 - RNA, 19 nt, Homo sapiens
gauauaugacuuuuucuca

SEQ ID NO: 908743 - RNA, 12 nt, Homo sapiens
gauaucaccucu

SEQ ID NO: 908744 - RNA, 17 nt, Homo sapiens
gauaucaccucucuuca

SEQ ID NO: 908745 - RNA, 16 nt, Homo sapiens
gauaucacuuacucag

SEQ ID NO: 908746 - RNA, 15 nt, Homo sapiens
gauaucaugccccug

SEQ ID NO: 908747 - RNA, 11 nt, Homo sapiens
gauaugcacac

SEQ ID NO: 908748 - RNA, 14 nt, Homo sapiens
gauaugcacacaca

SEQ ID NO: 908749 - RNA, 17 nt, Homo sapiens
gauauguucaacuggag

SEQ ID NO: 908750 - RNA, 13 nt, Homo sapiens
gauauuaaaggag

SEQ ID NO: 908751 - RNA, 13 nt, Homo sapiens
gauauugcacuag

SEQ ID NO: 908752 - RNA, 22 nt, Homo sapiens
gauauuucccaauacauaccac

SEQ ID NO: 908753 - RNA, 21 nt, Homo sapiens
gaucaagucaccggagcuuuc

SEQ ID NO: 908754 - RNA, 20 nt, Homo sapiens
gaucagaaggcuggggccag

SEQ ID NO: 908755 - RNA, 18 nt, Homo sapiens
gaucaguaugcuguuuua

SEQ ID NO: 908756 - RNA, 18 nt, Homo sapiens
gaucauagguauuucaaa

SEQ ID NO: 908757 - RNA, 18 nt, Homo sapiens
gaucauccacugugccau

SEQ ID NO: 908758 - RNA, 14 nt, Homo sapiens
gauccaagcugguc

SEQ ID NO: 908759 - RNA, 14 nt, Homo sapiens
gauccaccugccuu

SEQ ID NO: 908760 - RNA, 18 nt, Homo sapiens
gaucccaagacaaugaaa

SEQ ID NO: 908761 - RNA, 17 nt, Homo sapiens
gaucccagagcuuccca

SEQ ID NO: 908762 - RNA, 16 nt, Homo sapiens
gauccucccaccucag

SEQ ID NO: 908763 - RNA, 18 nt, Homo sapiens
gaucgagccacugcacuc

SEQ ID NO: 908764 - RNA, 20 nt, Homo sapiens
gaucgcgccacugcacuccg

SEQ ID NO: 908765 - RNA, 12 nt, Homo sapiens
gaucgcuuugua

SEQ ID NO: 908766 - RNA, 20 nt, Homo sapiens
gaucggagccuccucucuca

SEQ ID NO: 908767 - RNA, 20 nt, Homo sapiens
gaucguauuaauuaucugau

SEQ ID NO: 908768 - RNA, 14 nt, Homo sapiens
gaucuaauuuacau

SEQ ID NO: 908769 - RNA, 22 nt, Homo sapiens
gaucuaguucucaaucacugcu

SEQ ID NO: 908770 - RNA, 11 nt, Homo sapiens
gaucuaucugu

SEQ ID NO: 908771 - RNA, 18 nt, Homo sapiens
gaucucacacaccagggc

SEQ ID NO: 908772 - RNA, 19 nt, Homo sapiens
gaucucagccucugaucag

SEQ ID NO: 908773 - RNA, 19 nt, Homo sapiens
gaucuccaaggaccagguu

SEQ ID NO: 908774 - RNA, 20 nt, Homo sapiens
gaucuguaaggaacuggaac

SEQ ID NO: 908775 - RNA, 16 nt, Homo sapiens
gaucuugcauucccag

SEQ ID NO: 908776 - RNA, 21 nt, Homo sapiens
gaugaagacccuauuucagaa

SEQ ID NO: 908777 - RNA, 20 nt, Homo sapiens
gaugaauagaugugaucacu

SEQ ID NO: 908778 - RNA, 14 nt, Homo sapiens
gaugagcacacaca

SEQ ID NO: 908779 - RNA, 15 nt, Homo sapiens
gaugaguuacuugaa

SEQ ID NO: 908780 - RNA, 14 nt, Homo sapiens
gaugcaagcaccug

SEQ ID NO: 908781 - RNA, 22 nt, Homo sapiens
gaugcaaucucuugucucacau

SEQ ID NO: 908782 - RNA, 21 nt, Homo sapiens
gaugcauuccugagucuucca

SEQ ID NO: 908783 - RNA, 13 nt, Homo sapiens
gaugccacuuccc

SEQ ID NO: 908784 - RNA, 21 nt, Homo sapiens
gaugcccccacccaccuguac

SEQ ID NO: 908785 - RNA, 18 nt, Homo sapiens
gaugccggcaggccuucc

SEQ ID NO: 908786 - RNA, 15 nt, Homo sapiens
gaugcuaccaugccu

SEQ ID NO: 908787 - RNA, 19 nt, Homo sapiens
gaugcuacucuaguauucc

SEQ ID NO: 908788 - RNA, 20 nt, Homo sapiens
gauggaaaaucacaccaccu

SEQ ID NO: 908789 - RNA, 16 nt, Homo sapiens
gauggaauaaagcccu

SEQ ID NO: 908790 - RNA, 16 nt, Homo sapiens
gauggauagucugucc

SEQ ID NO: 908791 - RNA, 15 nt, Homo sapiens
gauggauguuuguca

SEQ ID NO: 908792 - RNA, 18 nt, Homo sapiens
gauggcaccacugcacuc

SEQ ID NO: 908793 - RNA, 14 nt, Homo sapiens
gauggcaccagagg

SEQ ID NO: 908794 - RNA, 21 nt, Homo sapiens
gauggcugacuuugcucuuuc

SEQ ID NO: 908795 - RNA, 22 nt, Homo sapiens
gaugggaucccaggccagggaa

SEQ ID NO: 908796 - RNA, 13 nt, Homo sapiens
gaugggauuucau

SEQ ID NO: 908797 - RNA, 22 nt, Homo sapiens
gauggguauuaaacuugucaga

SEQ ID NO: 908798 - RNA, 15 nt, Homo sapiens
gauggugacuuccuc

SEQ ID NO: 908799 - RNA, 15 nt, Homo sapiens
ucugagcacccccuc

SEQ ID NO: 908800 - RNA, 24 nt, Homo sapiens
ucugagcaccuacuuacaugcauu

SEQ ID NO: 908801 - RNA, 16 nt, Homo sapiens
ucugagcuagugauuu

SEQ ID NO: 908802 - RNA, 20 nt, Homo sapiens
ucugagcuagugauuugccu

SEQ ID NO: 908803 - RNA, 22 nt, Homo sapiens
ucugaggcgccccaacccgugg

SEQ ID NO: 908804 - RNA, 18 nt, Homo sapiens
ucugaggcuuccagagag

SEQ ID NO: 908805 - RNA, 20 nt, Homo sapiens
ucugauaaugaaaauuauga

SEQ ID NO: 908806 - RNA, 15 nt, Homo sapiens
ucugaucugugaauu

SEQ ID NO: 908807 - RNA, 16 nt, Homo sapiens
ucugaugggucccaaa

SEQ ID NO: 908808 - RNA, 21 nt, Homo sapiens
ucugcaaaggcgucugaaugu

SEQ ID NO: 908809 - RNA, 18 nt, Homo sapiens
ucugcaaggucuuugguu

SEQ ID NO: 908810 - RNA, 16 nt, Homo sapiens
ucugcagcuaacuuau

SEQ ID NO: 908811 - RNA, 21 nt, Homo sapiens
ucugcagggggugugucugcu

SEQ ID NO: 908812 - RNA, 12 nt, Homo sapiens
ucugcaucucau

SEQ ID NO: 908813 - RNA, 20 nt, Homo sapiens
ucugcccacugugaaaccac

SEQ ID NO: 908814 - RNA, 16 nt, Homo sapiens
ucugcccugggcucau

SEQ ID NO: 908815 - RNA, 17 nt, Homo sapiens
ucugccucuauucaauu

SEQ ID NO: 908816 - RNA, 16 nt, Homo sapiens
ucugccugaagucaca

SEQ ID NO: 908817 - RNA, 17 nt, Homo sapiens
ucugccugaagucacac

SEQ ID NO: 908818 - RNA, 23 nt, Homo sapiens
ucugccuguggccuugcccgcca

SEQ ID NO: 908819 - RNA, 16 nt, Homo sapiens
ucugcuauaugccuua

SEQ ID NO: 908820 - RNA, 16 nt, Homo sapiens
ucugcuauauuuucau

SEQ ID NO: 908821 - RNA, 23 nt, Homo sapiens
ucugcuccccagugcuaccucuc

SEQ ID NO: 908822 - RNA, 19 nt, Homo sapiens
ucugcuggccuggaucucc

SEQ ID NO: 908823 - RNA, 19 nt, Homo sapiens
ucuggaaaacucaggauuc

SEQ ID NO: 908824 - RNA, 15 nt, Homo sapiens
ucuggaaaagcacuu

SEQ ID NO: 908825 - RNA, 13 nt, Homo sapiens
ucuggaaaccacg

SEQ ID NO: 908826 - RNA, 22 nt, Homo sapiens
ucuggaaaugucuuucuauuca

SEQ ID NO: 908827 - RNA, 15 nt, Homo sapiens
ucuggaccagccugu

SEQ ID NO: 908828 - RNA, 15 nt, Homo sapiens
ucuggagagacugug

SEQ ID NO: 908829 - RNA, 14 nt, Homo sapiens
ucuggagccagaga

SEQ ID NO: 908830 - RNA, 17 nt, Homo sapiens
ucuggaucuaucuguau

SEQ ID NO: 908831 - RNA, 21 nt, Homo sapiens
ucuggauggauuugaagcaaa

SEQ ID NO: 908832 - RNA, 17 nt, Homo sapiens
ucuggauggcaccagag

SEQ ID NO: 908833 - RNA, 22 nt, Homo sapiens
ucuggcaucucuuucugcaaag

SEQ ID NO: 908834 - RNA, 14 nt, Homo sapiens
ucuggccaggcaug

SEQ ID NO: 908835 - RNA, 16 nt, Homo sapiens
ucuggcccagccuacc

SEQ ID NO: 908836 - RNA, 11 nt, Homo sapiens
ugaaaccaaag

SEQ ID NO: 908837 - RNA, 16 nt, Homo sapiens
ugaaacccuguaucua

SEQ ID NO: 908838 - RNA, 18 nt, Homo sapiens
ugaaacuggggcuugcaa

SEQ ID NO: 908839 - RNA, 22 nt, Homo sapiens
ugaaacuguguacgacaaagca

SEQ ID NO: 908840 - RNA, 15 nt, Homo sapiens
ugaaacuuaauuaca

SEQ ID NO: 908841 - RNA, 20 nt, Homo sapiens
ugaaacuucauaaauguuca

SEQ ID NO: 908842 - RNA, 23 nt, Homo sapiens
ugaaacuuguuuauuauguacaa

SEQ ID NO: 908843 - RNA, 23 nt, Homo sapiens
ugaaagaaaaauaccaugucucu

SEQ ID NO: 908844 - RNA, 17 nt, Homo sapiens
ugaaagaguagugcauu

SEQ ID NO: 908845 - RNA, 20 nt, Homo sapiens
ugaaagaguagugcauuuaa

SEQ ID NO: 908846 - RNA, 12 nt, Homo sapiens
ugaaagccaaau

SEQ ID NO: 908847 - RNA, 16 nt, Homo sapiens
ugaaagugacagagac

SEQ ID NO: 908848 - RNA, 13 nt, Homo sapiens
ugaaaguguaaaa

SEQ ID NO: 908849 - RNA, 14 nt, Homo sapiens
ugaaauaccaguga

SEQ ID NO: 908850 - RNA, 22 nt, Homo sapiens
ugaaauaccagugaaccaaaga

SEQ ID NO: 908851 - RNA, 20 nt, Homo sapiens
ugaaaucgccguguuacugu

SEQ ID NO: 908852 - RNA, 20 nt, Homo sapiens
ugaaaucugaggaaggugcu

SEQ ID NO: 908853 - RNA, 18 nt, Homo sapiens
ugaacacaauugauacuu

SEQ ID NO: 908854 - RNA, 15 nt, Homo sapiens
ugaacacacauggau

SEQ ID NO: 908855 - RNA, 17 nt, Homo sapiens
ugaacacacauggaugc

SEQ ID NO: 908856 - RNA, 12 nt, Homo sapiens
ugaacacugggg

SEQ ID NO: 908857 - RNA, 16 nt, Homo sapiens
ugaacagccaaaugca

SEQ ID NO: 908858 - RNA, 18 nt, Homo sapiens
ugaacaucucacuuugcc

SEQ ID NO: 908859 - RNA, 18 nt, Homo sapiens
ugaacauugucuggauac

SEQ ID NO: 908860 - RNA, 18 nt, Homo sapiens
ugaaccauuacuguaauu

SEQ ID NO: 908861 - RNA, 15 nt, Homo sapiens
ugaacccuugugcuu

SEQ ID NO: 908862 - RNA, 18 nt, Homo sapiens
ugaaccuaaacauagaaa

SEQ ID NO: 908863 - RNA, 21 nt, Homo sapiens
ugaacuaaguuuuuuacuucc

SEQ ID NO: 908864 - RNA, 19 nt, Homo sapiens
ugaacuauuagacaugaaa

SEQ ID NO: 908865 - RNA, 21 nt, Homo sapiens
ugaacuccuggccucaaguga

SEQ ID NO: 908866 - RNA, 21 nt, Homo sapiens
ugaacuuggaaagaaaugccc

SEQ ID NO: 908867 - RNA, 18 nt, Homo sapiens
ugaacuuggcuguaauca

SEQ ID NO: 908868 - RNA, 21 nt, Homo sapiens
ugaacuuuuuaagaugaggca

SEQ ID NO: 908869 - RNA, 16 nt, Homo sapiens
ugaagaaaggaacuga

SEQ ID NO: 908870 - RNA, 22 nt, Homo sapiens
ugaagaacaguaacugccauca

SEQ ID NO: 908871 - RNA, 16 nt, Homo sapiens
ugaagaauauuguuaa

SEQ ID NO: 908872 - RNA, 15 nt, Homo sapiens
ugaagacaacagcau

SEQ ID NO: 908873 - RNA, 23 nt, Homo sapiens
ugaagacccaguguaaagaauaa

SEQ ID NO: 908874 - RNA, 17 nt, Homo sapiens
ugaagacggauuacuaa

SEQ ID NO: 908875 - RNA, 18 nt, Homo sapiens
ugaagagaccaagacucu

SEQ ID NO: 908876 - RNA, 22 nt, Homo sapiens
ugaagagauuucaacaagaaua

SEQ ID NO: 908877 - RNA, 12 nt, Homo sapiens
ugaagaucucag

SEQ ID NO: 908878 - RNA, 20 nt, Homo sapiens
ugaagauucuccugugcuag

SEQ ID NO: 908879 - RNA, 13 nt, Homo sapiens
ugaagccacugaa

SEQ ID NO: 908880 - RNA, 16 nt, Homo sapiens
ugaagccccuuguccu

SEQ ID NO: 908881 - RNA, 10 nt, Homo sapiens
ugaagccuau

SEQ ID NO: 908882 - RNA, 22 nt, Homo sapiens
ugaagccucugcccugccuccc

SEQ ID NO: 908883 - RNA, 14 nt, Homo sapiens
ugaagcucuggcca

SEQ ID NO: 908884 - RNA, 17 nt, Homo sapiens
ugaagcuggaagcacug

SEQ ID NO: 908885 - RNA, 17 nt, Homo sapiens
ugaaggagaaaaugcau

SEQ ID NO: 908886 - RNA, 16 nt, Homo sapiens
ugaagguaacugagag

SEQ ID NO: 908887 - RNA, 18 nt, Homo sapiens
ugaagguaacugagagca

SEQ ID NO: 908888 - RNA, 11 nt, Homo sapiens
ugaaggugcug

SEQ ID NO: 908889 - RNA, 13 nt, Homo sapiens
ugaaguaaccuua

SEQ ID NO: 908890 - RNA, 14 nt, Homo sapiens
ugaagucacacagu

SEQ ID NO: 908891 - RNA, 16 nt, Homo sapiens
ugaaguguaauugaga

SEQ ID NO: 908892 - RNA, 20 nt, Homo sapiens
ugaaguguaguggcauccau

SEQ ID NO: 908893 - RNA, 17 nt, Homo sapiens
ugaaguucuuuuacugu

SEQ ID NO: 908894 - RNA, 18 nt, Homo sapiens
ugaaguucuuuuacugua

SEQ ID NO: 908895 - RNA, 20 nt, Homo sapiens
ugaaguucuuuuacuguaau

SEQ ID NO: 908896 - RNA, 15 nt, Homo sapiens
ugaauaaaaacccug

SEQ ID NO: 908897 - RNA, 22 nt, Homo sapiens
ugaauaacauuugugugguggg

SEQ ID NO: 908898 - RNA, 13 nt, Homo sapiens
ugaauaaccacuu

SEQ ID NO: 908899 - RNA, 16 nt, Homo sapiens
ugaauaaccacuuaaa

SEQ ID NO: 908900 - RNA, 22 nt, Homo sapiens
ugaauagauggguuauuucaac

SEQ ID NO: 908901 - RNA, 17 nt, Homo sapiens
ugaauauaaacacuaua

SEQ ID NO: 908902 - RNA, 20 nt, Homo sapiens
ugaauauaggaagcauaugc

SEQ ID NO: 908903 - RNA, 15 nt, Homo sapiens
ugaauauauggucug

SEQ ID NO: 908904 - RNA, 14 nt, Homo sapiens
ugaauccaucagga

SEQ ID NO: 908905 - RNA, 11 nt, Homo sapiens
ugaaucuacaa

SEQ ID NO: 908906 - RNA, 17 nt, Homo sapiens
ugaaucuguuacugaaa

SEQ ID NO: 908907 - RNA, 15 nt, Homo sapiens
ugaaucuuacuccuu

SEQ ID NO: 908908 - RNA, 14 nt, Homo sapiens
ugaaugcaaaguag

SEQ ID NO: 908909 - RNA, 19 nt, Homo sapiens
ugaaugccggggacagaga

SEQ ID NO: 908910 - RNA, 11 nt, Homo sapiens
ugaaugcucaa

SEQ ID NO: 908911 - RNA, 19 nt, Homo sapiens
ugaaugcuuaccugugaga

SEQ ID NO: 908912 - RNA, 16 nt, Homo sapiens
ugaaugguuccaugcc

SEQ ID NO: 908913 - RNA, 17 nt, Homo sapiens
ugaauguauaaagacac

SEQ ID NO: 908914 - RNA, 21 nt, Homo sapiens
ugaauucuaccuuuaaggguu

SEQ ID NO: 908915 - RNA, 19 nt, Homo sapiens
gcacagcccacacaugaac

SEQ ID NO: 908916 - RNA, 15 nt, Homo sapiens
gcacaggcugggaug

SEQ ID NO: 908917 - RNA, 18 nt, Homo sapiens
gcacagggaacaagcauu

SEQ ID NO: 908918 - RNA, 16 nt, Homo sapiens
gcacagucugaugaca

SEQ ID NO: 908919 - RNA, 20 nt, Homo sapiens
gcacauagagauaugcacac

SEQ ID NO: 908920 - RNA, 13 nt, Homo sapiens
gcacauauuugaa

SEQ ID NO: 908921 - RNA, 20 nt, Homo sapiens
gcacauccauucccaagaaa

SEQ ID NO: 908922 - RNA, 15 nt, Homo sapiens
gcacaugucuuguac

SEQ ID NO: 908923 - RNA, 22 nt, Homo sapiens
gcacauugaaagagaaccaguu

SEQ ID NO: 908924 - RNA, 22 nt, Homo sapiens
gcacauuggcagugugucacac

SEQ ID NO: 908925 - RNA, 20 nt, Homo sapiens
gcaccacugcacuccagccu

SEQ ID NO: 908926 - RNA, 19 nt, Homo sapiens
gcaccacuguguauuuaac

SEQ ID NO: 908927 - RNA, 16 nt, Homo sapiens
gcaccaucacacaugc

SEQ ID NO: 908928 - RNA, 13 nt, Homo sapiens
gcaccaucucuga

SEQ ID NO: 908929 - RNA, 15 nt, Homo sapiens
gcaccauugcgcucu

SEQ ID NO: 908930 - RNA, 16 nt, Homo sapiens
gcacccaggcuccaug

SEQ ID NO: 908931 - RNA, 21 nt, Homo sapiens
gcacccuggauugaucggagc

SEQ ID NO: 908932 - RNA, 17 nt, Homo sapiens
gcacccuucuuuccucu

SEQ ID NO: 908933 - RNA, 14 nt, Homo sapiens
gcaccgagaccaaa

SEQ ID NO: 908934 - RNA, 15 nt, Homo sapiens
gcaccuggugaucac

SEQ ID NO: 908935 - RNA, 18 nt, Homo sapiens
gcaccuuaccaacuuucu

SEQ ID NO: 908936 - RNA, 22 nt, Homo sapiens
gcaccuugucauguaccaucaa

SEQ ID NO: 908937 - RNA, 24 nt, Homo sapiens
gcaccuugugucuguacacguguc

SEQ ID NO: 908938 - RNA, 15 nt, Homo sapiens
gcaccuuuugcacau

SEQ ID NO: 908939 - RNA, 15 nt, Homo sapiens
gcacgaauggaagag

SEQ ID NO: 908940 - RNA, 12 nt, Homo sapiens
gcacggcagcuu

SEQ ID NO: 908941 - RNA, 20 nt, Homo sapiens
gcacuaccacgccaagcuaa

SEQ ID NO: 908942 - RNA, 19 nt, Homo sapiens
gcacuaccaggcugugggu

SEQ ID NO: 908943 - RNA, 16 nt, Homo sapiens
gcacuccauggccacc

SEQ ID NO: 908944 - RNA, 19 nt, Homo sapiens
gcacucccuuaggcauuau

SEQ ID NO: 908945 - RNA, 21 nt, Homo sapiens
gcacugacauuguuggccaaa

SEQ ID NO: 908946 - RNA, 17 nt, Homo sapiens
gcacugacugggaccag

SEQ ID NO: 908947 - RNA, 14 nt, Homo sapiens
gcacugagggccac

SEQ ID NO: 908948 - RNA, 21 nt, Homo sapiens
gcacugcagauagccagacac

SEQ ID NO: 908949 - RNA, 14 nt, Homo sapiens
gcacugccggccca

SEQ ID NO: 908950 - RNA, 21 nt, Homo sapiens
gcacugccggcccagugacac

SEQ ID NO: 908951 - RNA, 13 nt, Homo sapiens
gcauuuuacuacu

SEQ ID NO: 908952 - RNA, 20 nt, Homo sapiens
gcauuuuacugucuguaaga

SEQ ID NO: 908953 - RNA, 15 nt, Homo sapiens
gcauuuuuaaauaca

SEQ ID NO: 908954 - RNA, 21 nt, Homo sapiens
gccaaacaaaggcccagcagc

SEQ ID NO: 908955 - RNA, 13 nt, Homo sapiens
gccaaauguaauu

SEQ ID NO: 908956 - RNA, 17 nt, Homo sapiens
gccaacaccuucuuggc

SEQ ID NO: 908957 - RNA, 14 nt, Homo sapiens
gccaacauggugaa

SEQ ID NO: 908958 - RNA, 20 nt, Homo sapiens
gccaaccaagagcacauucu

SEQ ID NO: 908959 - RNA, 18 nt, Homo sapiens
gccaagaaguugcucuga

SEQ ID NO: 908960 - RNA, 16 nt, Homo sapiens
gccaagagaauauccg

SEQ ID NO: 908961 - RNA, 23 nt, Homo sapiens
gccaagcuuucuucuacaaccag

SEQ ID NO: 908962 - RNA, 14 nt, Homo sapiens
gccaaggaugacac

SEQ ID NO: 908963 - RNA, 18 nt, Homo sapiens
gccaauggagacugucuc

SEQ ID NO: 908964 - RNA, 12 nt, Homo sapiens
gccacaccuguc

SEQ ID NO: 908965 - RNA, 21 nt, Homo sapiens
gccacagaccuaggauuucau

SEQ ID NO: 908966 - RNA, 16 nt, Homo sapiens
gccacaucccuuugaa

SEQ ID NO: 908967 - RNA, 18 nt, Homo sapiens
gccaccagggcacugucu

SEQ ID NO: 908968 - RNA, 17 nt, Homo sapiens
gccaccagucacugucc

SEQ ID NO: 908969 - RNA, 24 nt, Homo sapiens
gccaccgggacagaccuggacacu

SEQ ID NO: 908970 - RNA, 14 nt, Homo sapiens
gccaccucuugggc

SEQ ID NO: 908971 - RNA, 13 nt, Homo sapiens
gccacuaugucca

SEQ ID NO: 908972 - RNA, 21 nt, Homo sapiens
gccacucaggaggcugaggca

SEQ ID NO: 908973 - RNA, 17 nt, Homo sapiens
gccacuccugcuucucu

SEQ ID NO: 908974 - RNA, 19 nt, Homo sapiens
gccagaaaacauaugcauu

SEQ ID NO: 908975 - RNA, 20 nt, Homo sapiens
gccagaaucuucguccugcc

SEQ ID NO: 908976 - RNA, 22 nt, Homo sapiens
gccagaguuccauguuuguacu

SEQ ID NO: 908977 - RNA, 15 nt, Homo sapiens
gccagccaucacaag

SEQ ID NO: 908978 - RNA, 15 nt, Homo sapiens
gccaggaaucugcca

SEQ ID NO: 908979 - RNA, 19 nt, Homo sapiens
gccaggagucugugcucuu

SEQ ID NO: 908980 - RNA, 19 nt, Homo sapiens
gccaggcuagagugcagug

SEQ ID NO: 908981 - RNA, 16 nt, Homo sapiens
gccagggauccuuucc

SEQ ID NO: 908982 - RNA, 16 nt, Homo sapiens
gccagggccaagugaa

SEQ ID NO: 908983 - RNA, 16 nt, Homo sapiens
gccaggggaguuccug

SEQ ID NO: 908984 - RNA, 11 nt, Homo sapiens
gccagugacuu

SEQ ID NO: 908985 - RNA, 23 nt, Homo sapiens
gccaguguuuagaagagccugac

SEQ ID NO: 908986 - RNA, 15 nt, Homo sapiens
gccaguuauggcuau

SEQ ID NO: 908987 - RNA, 19 nt, Homo sapiens
gccaguuugcuuaguucuc

SEQ ID NO: 908988 - RNA, 13 nt, Homo sapiens
gccauaaagccau

SEQ ID NO: 908989 - RNA, 14 nt, Homo sapiens
gccauacuuuacaa

SEQ ID NO: 908990 - RNA, 14 nt, Homo sapiens
gccauagccccaua

SEQ ID NO: 908991 - RNA, 14 nt, Homo sapiens
gccaucaugugccu

SEQ ID NO: 908992 - RNA, 19 nt, Homo sapiens
gccaucaugugccuggaaa

SEQ ID NO: 908993 - RNA, 15 nt, Homo sapiens
gccaucuuucuuugg

SEQ ID NO: 908994 - RNA, 22 nt, Homo sapiens
gccaugaggccuuuccccagug

SEQ ID NO: 908995 - RNA, 10 nt, Homo sapiens
gccaugccuc

SEQ ID NO: 908996 - RNA, 16 nt, Homo sapiens
gccauggaauaaacca

SEQ ID NO: 908997 - RNA, 19 nt, Homo sapiens
gccauguaccaguguacug

SEQ ID NO: 908998 - RNA, 19 nt, Homo sapiens
gccauguacuauaauguga

SEQ ID NO: 908999 - RNA, 17 nt, Homo sapiens
gccauguuuagauucca

SEQ ID NO: 909000 - RNA, 18 nt, Homo sapiens
gcccaagaggacugagac

SEQ ID NO: 909001 - RNA, 14 nt, Homo sapiens
gcccacaauggagu

SEQ ID NO: 909002 - RNA, 12 nt, Homo sapiens
gcccacagccaa

SEQ ID NO: 909003 - RNA, 14 nt, Homo sapiens
gcccacagggacca

SEQ ID NO: 909004 - RNA, 13 nt, Homo sapiens
gcccacaucccag

SEQ ID NO: 909005 - RNA, 20 nt, Homo sapiens
gcccacccacuccuuauauu

SEQ ID NO: 909006 - RNA, 16 nt, Homo sapiens
gcccaccugcacguga

SEQ ID NO: 909007 - RNA, 18 nt, Homo sapiens
gcccacuguccagcagcc

SEQ ID NO: 909008 - RNA, 11 nt, Homo sapiens
gcccagaauug

SEQ ID NO: 909009 - RNA, 14 nt, Homo sapiens
gcccagaauugcau

SEQ ID NO: 909010 - RNA, 21 nt, Homo sapiens
gcccagccuccaagcuccauc

SEQ ID NO: 909011 - RNA, 14 nt, Homo sapiens
gcccagcucuuugu

SEQ ID NO: 909012 - RNA, 16 nt, Homo sapiens
gcccaggcucugggaa

SEQ ID NO: 909013 - RNA, 19 nt, Homo sapiens
gcccaggcuggagugcagu

SEQ ID NO: 909014 - RNA, 20 nt, Homo sapiens
gcccaggcuggagugcagug

SEQ ID NO: 909015 - RNA, 13 nt, Homo sapiens
gcccagggagcaa

SEQ ID NO: 909016 - RNA, 19 nt, Homo sapiens
gcccaggucaacaucuaag

SEQ ID NO: 909017 - RNA, 16 nt, Homo sapiens
gcccauagaaacauga

SEQ ID NO: 909018 - RNA, 23 nt, Homo sapiens
gcccauggcuuuagcuaccucac

SEQ ID NO: 909019 - RNA, 22 nt, Homo sapiens
gcccauuggcucccaucugaac

SEQ ID NO: 909020 - RNA, 20 nt, Homo sapiens
gcccauuuuucuagacuguc

SEQ ID NO: 909021 - RNA, 21 nt, Homo sapiens
gccccaugaccuccagcuuuc

SEQ ID NO: 909022 - RNA, 21 nt, Homo sapiens
gcccccagcagauggaaagaa

SEQ ID NO: 909023 - RNA, 18 nt, Homo sapiens
gcccccccagcugucauc

SEQ ID NO: 909024 - RNA, 20 nt, Homo sapiens
gccccccuugccagacaugu

SEQ ID NO: 909025 - RNA, 13 nt, Homo sapiens
gccccucauuuau

SEQ ID NO: 909026 - RNA, 18 nt, Homo sapiens
gccccucgcugcugcuac

SEQ ID NO: 909027 - RNA, 21 nt, Homo sapiens
gccccucgcugcugcuacuac

SEQ ID NO: 909028 - RNA, 15 nt, Homo sapiens
gccccugcccggcug

SEQ ID NO: 909029 - RNA, 18 nt, Homo sapiens
gccccuucuccucugggg

SEQ ID NO: 909030 - RNA, 15 nt, Homo sapiens
ugaguugcccaucau

SEQ ID NO: 909031 - RNA, 21 nt, Homo sapiens
ugaguugcccaucauacgcau

SEQ ID NO: 909032 - RNA, 18 nt, Homo sapiens
ugaguuuccccacuuuag

SEQ ID NO: 909033 - RNA, 19 nt, Homo sapiens
ugaguuugggauuguggua

SEQ ID NO: 909034 - RNA, 15 nt, Homo sapiens
ugaguuuucaaagau

SEQ ID NO: 909035 - RNA, 20 nt, Homo sapiens
ugaguuuuugauagcuuuau

SEQ ID NO: 909036 - RNA, 13 nt, Homo sapiens
ugauaaacauuaa

SEQ ID NO: 909037 - RNA, 14 nt, Homo sapiens
ugauaaacauuaaa

SEQ ID NO: 909038 - RNA, 21 nt, Homo sapiens
ugauaaacauuaaacacugua

SEQ ID NO: 909039 - RNA, 16 nt, Homo sapiens
ugauaauaauugauca

SEQ ID NO: 909040 - RNA, 16 nt, Homo sapiens
ugauaaugcagacuuc

SEQ ID NO: 909041 - RNA, 15 nt, Homo sapiens
ugauacauaugugaa

SEQ ID NO: 909042 - RNA, 22 nt, Homo sapiens
ugauacccaaguuauugggaug

SEQ ID NO: 909043 - RNA, 13 nt, Homo sapiens
ugauagcuuuauu

SEQ ID NO: 909044 - RNA, 14 nt, Homo sapiens
ugauaugaguauac

SEQ ID NO: 909045 - RNA, 19 nt, Homo sapiens
ugauauguucaacuggaga

SEQ ID NO: 909046 - RNA, 21 nt, Homo sapiens
ugauauuauggcaagugauau

SEQ ID NO: 909047 - RNA, 15 nt, Homo sapiens
ugauauugcauaugc

SEQ ID NO: 909048 - RNA, 17 nt, Homo sapiens
ugauauugcauaugcau

SEQ ID NO: 909049 - RNA, 12 nt, Homo sapiens
ugaucaacuguu

SEQ ID NO: 909050 - RNA, 11 nt, Homo sapiens
ugaucaaguca

SEQ ID NO: 909051 - RNA, 15 nt, Homo sapiens
ugaucacacucuggg

SEQ ID NO: 909052 - RNA, 12 nt, Homo sapiens
ugaucaugguca

SEQ ID NO: 909053 - RNA, 17 nt, Homo sapiens
ugaucauggucagcuca

SEQ ID NO: 909054 - RNA, 21 nt, Homo sapiens
ugauccacagaaauacaugaa

SEQ ID NO: 909055 - RNA, 17 nt, Homo sapiens
ugauccuuuuauguuau

SEQ ID NO: 909056 - RNA, 14 nt, Homo sapiens
ugaucuaauuuaca

SEQ ID NO: 909057 - RNA, 14 nt, Homo sapiens
ugaucuuugcagac

SEQ ID NO: 909058 - RNA, 22 nt, Homo sapiens
ugaugaauagcgaaucaucuca

SEQ ID NO: 909059 - RNA, 19 nt, Homo sapiens
ugaugacagacacuucuaa

SEQ ID NO: 909060 - RNA, 23 nt, Homo sapiens
ugaugaggccucuuggaccucug

SEQ ID NO: 909061 - RNA, 13 nt, Homo sapiens
ugaugccaagaaa

SEQ ID NO: 909062 - RNA, 16 nt, Homo sapiens
ugaugggucccaaaag

SEQ ID NO: 909063 - RNA, 18 nt, Homo sapiens
ugauggugagcugggaag

SEQ ID NO: 909064 - RNA, 14 nt, Homo sapiens
ugaugguugcaaaa

SEQ ID NO: 909065 - RNA, 14 nt, Homo sapiens
ugaugguugccagg

SEQ ID NO: 909066 - RNA, 13 nt, Homo sapiens
ugcccagugcacu

SEQ ID NO: 909067 - RNA, 14 nt, Homo sapiens
ugccccacugaauu

SEQ ID NO: 909068 - RNA, 19 nt, Homo sapiens
ugcccccacccaccuguac

SEQ ID NO: 909069 - RNA, 17 nt, Homo sapiens
ugccccccuugccagac

SEQ ID NO: 909070 - RNA, 21 nt, Homo sapiens
ugccccucgcucgguccggcu

SEQ ID NO: 909071 - RNA, 19 nt, Homo sapiens
ugccccugcaguuggcaga

SEQ ID NO: 909072 - RNA, 18 nt, Homo sapiens
ugccccuuccacuuugag

SEQ ID NO: 909073 - RNA, 12 nt, Homo sapiens
ugcccuaauuag

SEQ ID NO: 909074 - RNA, 20 nt, Homo sapiens
ugcccucauuuguggcccaa

SEQ ID NO: 909075 - RNA, 20 nt, Homo sapiens
ugcccuccaauccuuuccac

SEQ ID NO: 909076 - RNA, 22 nt, Homo sapiens
ugcccucccauguugcaugccu

SEQ ID NO: 909077 - RNA, 22 nt, Homo sapiens
ugcccucuccuuccuuacccaa

SEQ ID NO: 909078 - RNA, 13 nt, Homo sapiens
ugcccucucucag

SEQ ID NO: 909079 - RNA, 23 nt, Homo sapiens
ugcccugcgaaguggcucucagg

SEQ ID NO: 909080 - RNA, 18 nt, Homo sapiens
ugcccugugagggcucac

SEQ ID NO: 909081 - RNA, 22 nt, Homo sapiens
ugcccuuggccugaagucccag

SEQ ID NO: 909082 - RNA, 13 nt, Homo sapiens
ugccggacacaga

SEQ ID NO: 909083 - RNA, 21 nt, Homo sapiens
ugccguaacaacuguggucaa

SEQ ID NO: 909084 - RNA, 14 nt, Homo sapiens
ugccuaccccaaga

SEQ ID NO: 909085 - RNA, 16 nt, Homo sapiens
ugccuaggaggccuuc

SEQ ID NO: 909086 - RNA, 19 nt, Homo sapiens
ugccuaggguccuguccau

SEQ ID NO: 909087 - RNA, 14 nt, Homo sapiens
ugccucagccuccc

SEQ ID NO: 909088 - RNA, 22 nt, Homo sapiens
ugccucagcugcucgcacagau

SEQ ID NO: 909089 - RNA, 16 nt, Homo sapiens
ugccuccaagauuuca

SEQ ID NO: 909090 - RNA, 15 nt, Homo sapiens
ugccuccaagccauu

SEQ ID NO: 909091 - RNA, 22 nt, Homo sapiens
ugccuccauucugaccauuuca

SEQ ID NO: 909092 - RNA, 18 nt, Homo sapiens
ugccucccuuucugggag

SEQ ID NO: 909093 - RNA, 18 nt, Homo sapiens
ugccucgaacuggcugca

SEQ ID NO: 909094 - RNA, 17 nt, Homo sapiens
ugccucuccagcacuuc

SEQ ID NO: 909095 - RNA, 14 nt, Homo sapiens
ugccucuccccaaa

SEQ ID NO: 909096 - RNA, 17 nt, Homo sapiens
ugccucugaaaugccuc

SEQ ID NO: 909097 - RNA, 18 nt, Homo sapiens
ugccucugacacacagcu

SEQ ID NO: 909098 - RNA, 23 nt, Homo sapiens
ugccucugaggccagccuggccu

SEQ ID NO: 909099 - RNA, 15 nt, Homo sapiens
ugccucuguauuuaa

SEQ ID NO: 909100 - RNA, 14 nt, Homo sapiens
ugccugagcccagg

SEQ ID NO: 909101 - RNA, 13 nt, Homo sapiens
ugccugauuagau

SEQ ID NO: 909102 - RNA, 22 nt, Homo sapiens
ugccuggaucucacaagcacuu

SEQ ID NO: 909103 - RNA, 15 nt, Homo sapiens
ugccuggcaaggccu

SEQ ID NO: 909104 - RNA, 15 nt, Homo sapiens
ugccuggccuggcac

SEQ ID NO: 909105 - RNA, 16 nt, Homo sapiens
ugccuggccuggcaca

SEQ ID NO: 909106 - RNA, 20 nt, Homo sapiens
ugccuuaaaggaccuuccca

SEQ ID NO: 909107 - RNA, 16 nt, Homo sapiens
ugccuuccacaauuca

SEQ ID NO: 909108 - RNA, 19 nt, Homo sapiens
ugccuuugugggcccagcu

SEQ ID NO: 909109 - RNA, 17 nt, Homo sapiens
ugccuuuuuaaugaaca

SEQ ID NO: 909110 - RNA, 17 nt, Homo sapiens
ugcgaucuggguucacu

SEQ ID NO: 909111 - RNA, 18 nt, Homo sapiens
ugcggaaaugugucuugu

SEQ ID NO: 909112 - RNA, 20 nt, Homo sapiens
ugcggaaaugugucuugucu

SEQ ID NO: 909113 - RNA, 15 nt, Homo sapiens
ugcggagacccugag

SEQ ID NO: 909114 - RNA, 14 nt, Homo sapiens
ugcguggacucugc

SEQ ID NO: 909115 - RNA, 13 nt, Homo sapiens
ugcguuacuaauu

SEQ ID NO: 909116 - RNA, 17 nt, Homo sapiens
ugcuaacuguguguaca

SEQ ID NO: 909117 - RNA, 19 nt, Homo sapiens
ugcuaacuguguguacaua

SEQ ID NO: 909118 - RNA, 14 nt, Homo sapiens
ugcuaaggcugccu

SEQ ID NO: 909119 - RNA, 17 nt, Homo sapiens
ugcuacaaaaacacagc

SEQ ID NO: 909120 - RNA, 23 nt, Homo sapiens
ugcuagugauuucauuaccaagu

SEQ ID NO: 909121 - RNA, 21 nt, Homo sapiens
ugcuagugccugagaugcacg

SEQ ID NO: 909122 - RNA, 15 nt, Homo sapiens
ugcuaucgcaccacu

SEQ ID NO: 909123 - RNA, 14 nt, Homo sapiens
ugcuaugacaugca

SEQ ID NO: 909124 - RNA, 20 nt, Homo sapiens
ugcuaugccaagccaugucu

SEQ ID NO: 909125 - RNA, 23 nt, Homo sapiens
ugcuaugguuuucuccaagagcu

SEQ ID NO: 909126 - RNA, 23 nt, Homo sapiens
ugcuauuauguaacauccagaag

SEQ ID NO: 909127 - RNA, 15 nt, Homo sapiens
ugcuauugaacugag

SEQ ID NO: 909128 - RNA, 19 nt, Homo sapiens
ugcucacauaucugucauu

SEQ ID NO: 909129 - RNA, 14 nt, Homo sapiens
ugcucacucaggac

SEQ ID NO: 909130 - RNA, 16 nt, Homo sapiens
ugcuccccagugcuac

SEQ ID NO: 909131 - RNA, 22 nt, Homo sapiens
ugcucgauuauucccuguacaa

SEQ ID NO: 909132 - RNA, 21 nt, Homo sapiens
ugcucucucacucccccauga

SEQ ID NO: 909133 - RNA, 12 nt, Homo sapiens
ugcucucuucag

SEQ ID NO: 909134 - RNA, 20 nt, Homo sapiens
ugcucugaggcuuccagaga

SEQ ID NO: 909135 - RNA, 22 nt, Homo sapiens
ugcucugagugcuagcuagcca

SEQ ID NO: 909136 - RNA, 11 nt, Homo sapiens
ugcucugcuau

SEQ ID NO: 909137 - RNA, 18 nt, Homo sapiens
ugcucuggaaaaugugac

SEQ ID NO: 909138 - RNA, 19 nt, Homo sapiens
ugcugacaggauguggcac

SEQ ID NO: 909139 - RNA, 21 nt, Homo sapiens
ugcugacggaagccaacuugg

SEQ ID NO: 909140 - RNA, 20 nt, Homo sapiens
ugcugagaccccccaccacc

SEQ ID NO: 909141 - RNA, 20 nt, Homo sapiens
ugcugaguauguuaagcucu

SEQ ID NO: 909142 - RNA, 23 nt, Homo sapiens
ugcugagugcaccacuucaagug

SEQ ID NO: 909143 - RNA, 22 nt, Homo sapiens
ugcugcaggagccgcugcugag

SEQ ID NO: 909144 - RNA, 21 nt, Homo sapiens
ugcugccaaacacccaugccc

SEQ ID NO: 909145 - RNA, 19 nt, Homo sapiens
ugcugccaguccucugcau

SEQ ID NO: 909146 - RNA, 12 nt, Homo sapiens
gcuaaaugcaaa

SEQ ID NO: 909147 - RNA, 16 nt, Homo sapiens
gcuaacuccagucucc

SEQ ID NO: 909148 - RNA, 19 nt, Homo sapiens
gcuaacuguguguacauau

SEQ ID NO: 909149 - RNA, 18 nt, Homo sapiens
gcuaagaaagcaagccaa

SEQ ID NO: 909150 - RNA, 16 nt, Homo sapiens
gcuacaaacauaucaa

SEQ ID NO: 909151 - RNA, 18 nt, Homo sapiens
gcuacacaaaagccaaaa

SEQ ID NO: 909152 - RNA, 15 nt, Homo sapiens
gcuacacuugcaccu

SEQ ID NO: 909153 - RNA, 22 nt, Homo sapiens
gcuacucucuugccagcauuuu

SEQ ID NO: 909154 - RNA, 22 nt, Homo sapiens
gcuacucugugccagagccugg

SEQ ID NO: 909155 - RNA, 14 nt, Homo sapiens
gcuacuggcagcuc

SEQ ID NO: 909156 - RNA, 13 nt, Homo sapiens
gcuagaaccugga

SEQ ID NO: 909157 - RNA, 13 nt, Homo sapiens
gcuagaaugcaca

SEQ ID NO: 909158 - RNA, 22 nt, Homo sapiens
gcuagacaagcuuguccaugua

SEQ ID NO: 909159 - RNA, 20 nt, Homo sapiens
gcuagagggcgacucuggug

SEQ ID NO: 909160 - RNA, 15 nt, Homo sapiens
gcuagagugcagugg

SEQ ID NO: 909161 - RNA, 19 nt, Homo sapiens
gcuagagugcaguggugca

SEQ ID NO: 909162 - RNA, 18 nt, Homo sapiens
gcuagaucuaguucucaa

SEQ ID NO: 909163 - RNA, 15 nt, Homo sapiens
gcuagcaaauuugag

SEQ ID NO: 909164 - RNA, 13 nt, Homo sapiens
gcuagcaacauac

SEQ ID NO: 909165 - RNA, 17 nt, Homo sapiens
gcuagcagaaguauaaa

SEQ ID NO: 909166 - RNA, 13 nt, Homo sapiens
gcuaggagcaaag

SEQ ID NO: 909167 - RNA, 14 nt, Homo sapiens
gcuagggagugguc

SEQ ID NO: 909168 - RNA, 20 nt, Homo sapiens
gcuauaugccuuaagccaau

SEQ ID NO: 909169 - RNA, 21 nt, Homo sapiens
gcuaucugcauuuauaaaugu

SEQ ID NO: 909170 - RNA, 23 nt, Homo sapiens
gcuaugaggguccccgggagcac

SEQ ID NO: 909171 - RNA, 20 nt, Homo sapiens
gcuauugaacugagccaaac

SEQ ID NO: 909172 - RNA, 18 nt, Homo sapiens
gcuauugugauaugacaa

SEQ ID NO: 909173 - RNA, 17 nt, Homo sapiens
gcuauuuguucagagag

SEQ ID NO: 909174 - RNA, 15 nt, Homo sapiens
gcucaauauuccuga

SEQ ID NO: 909175 - RNA, 23 nt, Homo sapiens
gcucaauauuccugaaugaaaua

SEQ ID NO: 909176 - RNA, 19 nt, Homo sapiens
gcucacaaaccaugcaaau

SEQ ID NO: 909177 - RNA, 16 nt, Homo sapiens
gcucacgugucuuuag

SEQ ID NO: 909178 - RNA, 16 nt, Homo sapiens
gcucacucggcuucca

SEQ ID NO: 909179 - RNA, 14 nt, Homo sapiens
gcucacugcagccu

SEQ ID NO: 909180 - RNA, 21 nt, Homo sapiens
uuaggaccaauaccuccucca

SEQ ID NO: 909181 - RNA, 13 nt, Homo sapiens
uuaggacuuucca

SEQ ID NO: 909182 - RNA, 23 nt, Homo sapiens
uuaggaggcugcaugcucuggaa

SEQ ID NO: 909183 - RNA, 22 nt, Homo sapiens
uuaggauaaagaauauuuacaa

SEQ ID NO: 909184 - RNA, 23 nt, Homo sapiens
uuaggauuuaacagucauuuaaa

SEQ ID NO: 909185 - RNA, 16 nt, Homo sapiens
uuagggaugacuguga

SEQ ID NO: 909186 - RNA, 18 nt, Homo sapiens
uuaggugugccaaacuac

SEQ ID NO: 909187 - RNA, 14 nt, Homo sapiens
uuaguaaauccuua

SEQ ID NO: 909188 - RNA, 19 nt, Homo sapiens
uuaguacacagcaccagaa

SEQ ID NO: 909189 - RNA, 20 nt, Homo sapiens
uuaguacacagcaccagaau

SEQ ID NO: 909190 - RNA, 20 nt, Homo sapiens
uuaguauuauuguugcauua

SEQ ID NO: 909191 - RNA, 11 nt, Homo sapiens
uuaguauuuau

SEQ ID NO: 909192 - RNA, 21 nt, Homo sapiens
uuagugucuugaauguaagaa

SEQ ID NO: 909193 - RNA, 19 nt, Homo sapiens
uuaguucucacugucuccu

SEQ ID NO: 909194 - RNA, 15 nt, Homo sapiens
uuaguuuguuuuaca

SEQ ID NO: 909195 - RNA, 20 nt, Homo sapiens
uuaguuuugggaauaggcau

SEQ ID NO: 909196 - RNA, 17 nt, Homo sapiens
uuauaagacuacuauac

SEQ ID NO: 909197 - RNA, 23 nt, Homo sapiens
uuauaagagugccguaacaacug

SEQ ID NO: 909198 - RNA, 21 nt, Homo sapiens
uuauacaucacagcagugcau

SEQ ID NO: 909199 - RNA, 13 nt, Homo sapiens
uuauacauuugau

SEQ ID NO: 909200 - RNA, 20 nt, Homo sapiens
uuauacgacuuuuaagcaaa

SEQ ID NO: 909201 - RNA, 14 nt, Homo sapiens
uuauacuaccaagu

SEQ ID NO: 909202 - RNA, 19 nt, Homo sapiens
uuauacuguagcugaugaa

SEQ ID NO: 909203 - RNA, 21 nt, Homo sapiens
uuauagaauauuuauuaccuc

SEQ ID NO: 909204 - RNA, 21 nt, Homo sapiens
uuauagcaauguaacauuaau

SEQ ID NO: 909205 - RNA, 22 nt, Homo sapiens
uuauaguuucagauauauauca

SEQ ID NO: 909206 - RNA, 14 nt, Homo sapiens
uuauauaauuuugc

SEQ ID NO: 909207 - RNA, 21 nt, Homo sapiens
uuauauaauuuugcagcagaa

SEQ ID NO: 909208 - RNA, 19 nt, Homo sapiens
uuauauaguauaccauaca

SEQ ID NO: 909209 - RNA, 14 nt, Homo sapiens
uuauauauggcaua

SEQ ID NO: 909210 - RNA, 14 nt, Homo sapiens
uuauaucagccuga

SEQ ID NO: 909211 - RNA, 15 nt, Homo sapiens
uuauaucagccugag

SEQ ID NO: 909212 - RNA, 20 nt, Homo sapiens
uuauaucaucagcauaccuu

SEQ ID NO: 909213 - RNA, 11 nt, Homo sapiens
uuauauggaaa

SEQ ID NO: 909214 - RNA, 16 nt, Homo sapiens
uuauauuacacuacac

SEQ ID NO: 909215 - RNA, 18 nt, Homo sapiens
uuaucaauuaaugacaau

SEQ ID NO: 909216 - RNA, 16 nt, Homo sapiens
uuaucagugauggucu

SEQ ID NO: 909217 - RNA, 12 nt, Homo sapiens
uuaucaucugaa

SEQ ID NO: 909218 - RNA, 13 nt, Homo sapiens
uuaucauuuauca

SEQ ID NO: 909219 - RNA, 13 nt, Homo sapiens
uuauccugcauuu

SEQ ID NO: 909220 - RNA, 21 nt, Homo sapiens
uuauccuuaggaaaaugcuuc

SEQ ID NO: 909221 - RNA, 16 nt, Homo sapiens
uuaucucaaaacugca

SEQ ID NO: 909222 - RNA, 20 nt, Homo sapiens
uuaucugaucgggauaacaa

SEQ ID NO: 909223 - RNA, 15 nt, Homo sapiens
uuaugaaaaagaaga

SEQ ID NO: 909224 - RNA, 13 nt, Homo sapiens
uuaugaaugugca

SEQ ID NO: 909225 - RNA, 15 nt, Homo sapiens
uuaugaggcuauuaa

SEQ ID NO: 909226 - RNA, 17 nt, Homo sapiens
uuaugccuucacuuuac

SEQ ID NO: 909227 - RNA, 11 nt, Homo sapiens
uuaugcugcug

SEQ ID NO: 909228 - RNA, 20 nt, Homo sapiens
uuauggcaugauuuauauau

SEQ ID NO: 909229 - RNA, 19 nt, Homo sapiens
uuaugggaagacaaaacaa

SEQ ID NO: 909230 - RNA, 19 nt, Homo sapiens
uuauguauuuuugucauau

SEQ ID NO: 909231 - RNA, 15 nt, Homo sapiens
uuaugucaucauaca

SEQ ID NO: 909232 - RNA, 21 nt, Homo sapiens
uuaugucuauuuaagccucau

SEQ ID NO: 909233 - RNA, 14 nt, Homo sapiens
uuaugucucaaaau

SEQ ID NO: 909234 - RNA, 16 nt, Homo sapiens
uuaugucucagaccac

SEQ ID NO: 909235 - RNA, 14 nt, Homo sapiens
uuauguuugcuaaa

SEQ ID NO: 909236 - RNA, 13 nt, Homo sapiens
uuauuaaaaacug

SEQ ID NO: 909237 - RNA, 22 nt, Homo sapiens
uuauuaagugccugagacaccc

SEQ ID NO: 909238 - RNA, 15 nt, Homo sapiens
uuauuaauauugugc

SEQ ID NO: 909239 - RNA, 14 nt, Homo sapiens
uuauuaauucauua

SEQ ID NO: 909240 - RNA, 12 nt, Homo sapiens
uuauuaccucug

SEQ ID NO: 909241 - RNA, 21 nt, Homo sapiens
uuauuagguacguaacuauuu

SEQ ID NO: 909242 - RNA, 13 nt, Homo sapiens
uuauucacuguaa

SEQ ID NO: 909243 - RNA, 13 nt, Homo sapiens
uuauuccaacucc

SEQ ID NO: 909244 - RNA, 15 nt, Homo sapiens
uuauucccuuucaca

SEQ ID NO: 909245 - RNA, 14 nt, Homo sapiens
uuauucugauucca

SEQ ID NO: 909246 - RNA, 13 nt, Homo sapiens
uuauugugccuca

SEQ ID NO: 909247 - RNA, 14 nt, Homo sapiens
uuauugugccucag

SEQ ID NO: 909248 - RNA, 23 nt, Homo sapiens
uuauuguuuauuuaucagugaca

SEQ ID NO: 909249 - RNA, 17 nt, Homo sapiens
uuauuuuuuuacuuccu

SEQ ID NO: 909250 - RNA, 19 nt, Homo sapiens
uucaaaagaugccauucau

SEQ ID NO: 909251 - RNA, 12 nt, Homo sapiens
uucaaaagugga

SEQ ID NO: 909252 - RNA, 21 nt, Homo sapiens
uucaaaauaagaaaauaaccu

SEQ ID NO: 909253 - RNA, 22 nt, Homo sapiens
uucaaagacagagaagaccaaa

SEQ ID NO: 909254 - RNA, 22 nt, Homo sapiens
uucaaagcacuguuucucucac

SEQ ID NO: 909255 - RNA, 14 nt, Homo sapiens
uucaaauggacuca

SEQ ID NO: 909256 - RNA, 14 nt, Homo sapiens
uucaacaaugacua

SEQ ID NO: 909257 - RNA, 20 nt, Homo sapiens
uucaaccugguggcaccaga

SEQ ID NO: 909258 - RNA, 17 nt, Homo sapiens
uucaacuaguaccacag

SEQ ID NO: 909259 - RNA, 16 nt, Homo sapiens
uucaagagauucuugu

SEQ ID NO: 909260 - RNA, 15 nt, Homo sapiens
uucaagagugcaguu

SEQ ID NO: 909261 - RNA, 22 nt, Homo sapiens
uucaagugauauauguauuuau

SEQ ID NO: 909262 - RNA, 22 nt, Homo sapiens
uucaaguuaaagugaauaacca

SEQ ID NO: 909263 - RNA, 18 nt, Homo sapiens
uucaaguuagcucaggag

SEQ ID NO: 909264 - RNA, 15 nt, Homo sapiens
uucaauucucaaaag

SEQ ID NO: 909265 - RNA, 22 nt, Homo sapiens
guauuaauguguuaagugcagg

SEQ ID NO: 909266 - RNA, 14 nt, Homo sapiens
guauuacacuguau

SEQ ID NO: 909267 - RNA, 15 nt, Homo sapiens
guauuaucaccagca

SEQ ID NO: 909268 - RNA, 21 nt, Homo sapiens
guauucacacaccccucaaaa

SEQ ID NO: 909269 - RNA, 22 nt, Homo sapiens
guauucacacaccccucaaaaa

SEQ ID NO: 909270 - RNA, 22 nt, Homo sapiens
guauucaggcacugagaaugau

SEQ ID NO: 909271 - RNA, 16 nt, Homo sapiens
guauucuacagcagau

SEQ ID NO: 909272 - RNA, 14 nt, Homo sapiens
guauucuauucaaa

SEQ ID NO: 909273 - RNA, 18 nt, Homo sapiens
guauugcuaaucauuaag

SEQ ID NO: 909274 - RNA, 13 nt, Homo sapiens
guauugugcauag

SEQ ID NO: 909275 - RNA, 16 nt, Homo sapiens
guauuuagugucuuga

SEQ ID NO: 909276 - RNA, 21 nt, Homo sapiens
guauuuauauuagagugcccu

SEQ ID NO: 909277 - RNA, 15 nt, Homo sapiens
guauuuucauuuaac

SEQ ID NO: 909278 - RNA, 12 nt, Homo sapiens
guauuuugccag

SEQ ID NO: 909279 - RNA, 23 nt, Homo sapiens
gucaaaacagauuguuugcaaag

SEQ ID NO: 909280 - RNA, 12 nt, Homo sapiens
gucaaagcagua

SEQ ID NO: 909281 - RNA, 13 nt, Homo sapiens
gucaaauaucuca

SEQ ID NO: 909282 - RNA, 16 nt, Homo sapiens
gucaacaaccaugcca

SEQ ID NO: 909283 - RNA, 17 nt, Homo sapiens
gucaacaaccaugccag

SEQ ID NO: 909284 - RNA, 12 nt, Homo sapiens
gucaacaucuaa

SEQ ID NO: 909285 - RNA, 14 nt, Homo sapiens
gucaacuaugauau

SEQ ID NO: 909286 - RNA, 13 nt, Homo sapiens
gucaagauugcaa

SEQ ID NO: 909287 - RNA, 22 nt, Homo sapiens
gucaaggcccggccccaucaga

SEQ ID NO: 909288 - RNA, 20 nt, Homo sapiens
gucaaucccaaaagucacca

SEQ ID NO: 909289 - RNA, 18 nt, Homo sapiens
gucaauccgaaguaugag

SEQ ID NO: 909290 - RNA, 21 nt, Homo sapiens
gucaauuuguauaucaugaaa

SEQ ID NO: 909291 - RNA, 22 nt, Homo sapiens
gucacaagggauuggcaauugu

SEQ ID NO: 909292 - RNA, 20 nt, Homo sapiens
gucacaauccugucccucac

SEQ ID NO: 909293 - RNA, 18 nt, Homo sapiens
gucacacacuuuggcuau

SEQ ID NO: 909294 - RNA, 15 nt, Homo sapiens
gucacaccaucuuaa

SEQ ID NO: 909295 - RNA, 22 nt, Homo sapiens
uucugauuugaagguauaaccu

SEQ ID NO: 909296 - RNA, 21 nt, Homo sapiens
uucugccuccauucugaccau

SEQ ID NO: 909297 - RNA, 21 nt, Homo sapiens
uucuggaaaaaaaauauauau

SEQ ID NO: 909298 - RNA, 13 nt, Homo sapiens
uucuggaaaccac

SEQ ID NO: 909299 - RNA, 18 nt, Homo sapiens
uucuggaggaagaagaca

SEQ ID NO: 909300 - RNA, 15 nt, Homo sapiens
uucuggcacugguug

SEQ ID NO: 909301 - RNA, 19 nt, Homo sapiens
uucuggguggcuccugcca

SEQ ID NO: 909302 - RNA, 21 nt, Homo sapiens
uucuggguggcuccugccacu

SEQ ID NO: 909303 - RNA, 18 nt, Homo sapiens
uucuggguguugaccacu

SEQ ID NO: 909304 - RNA, 22 nt, Homo sapiens
uucuguagcuuguucccugucu

SEQ ID NO: 909305 - RNA, 22 nt, Homo sapiens
uucugugggcuuggccuugugu

SEQ ID NO: 909306 - RNA, 19 nt, Homo sapiens
uucuguugcgccacugaga

SEQ ID NO: 909307 - RNA, 22 nt, Homo sapiens
uucuguuguaauaguccaugga

SEQ ID NO: 909308 - RNA, 22 nt, Homo sapiens
uucuuaaaaguugugauuccag

SEQ ID NO: 909309 - RNA, 21 nt, Homo sapiens
uucuuaaacaaauguaugauu

SEQ ID NO: 909310 - RNA, 14 nt, Homo sapiens
uucuuaauaggcuu

SEQ ID NO: 909311 - RNA, 18 nt, Homo sapiens
uucuuaaucuccacuguu

SEQ ID NO: 909312 - RNA, 19 nt, Homo sapiens
uucuuaaugcuuuccuccc

SEQ ID NO: 909313 - RNA, 18 nt, Homo sapiens
uucuuacagacugcaugu

SEQ ID NO: 909314 - RNA, 14 nt, Homo sapiens
uucuuauaauauua

SEQ ID NO: 909315 - RNA, 21 nt, Homo sapiens
uucuuauggaagaaaugggag

SEQ ID NO: 909316 - RNA, 19 nt, Homo sapiens
uucuucaucugugacuccu

SEQ ID NO: 909317 - RNA, 23 nt, Homo sapiens
uucuuggcagcuuaacauugacu

SEQ ID NO: 909318 - RNA, 19 nt, Homo sapiens
uucuuuaaauuucaucuca

SEQ ID NO: 909319 - RNA, 17 nt, Homo sapiens
uucuuuagcugucacuu

SEQ ID NO: 909320 - RNA, 15 nt, Homo sapiens
uucuuuaucuugaca

SEQ ID NO: 909321 - RNA, 22 nt, Homo sapiens
uucuuucccuagaggcaaacau

SEQ ID NO: 909322 - RNA, 22 nt, Homo sapiens
uucuuugaaggauuuacugcaa

SEQ ID NO: 909323 - RNA, 13 nt, Homo sapiens
uucuuugaaguuu

SEQ ID NO: 909324 - RNA, 20 nt, Homo sapiens
uucuuugggauugcuaugaa

SEQ ID NO: 909325 - RNA, 16 nt, Homo sapiens
uucuuuuaaaccauuu

SEQ ID NO: 909326 - RNA, 14 nt, Homo sapiens
uucuuuuacuguaa

SEQ ID NO: 909327 - RNA, 13 nt, Homo sapiens
uucuuuugcucuu

SEQ ID NO: 909328 - RNA, 17 nt, Homo sapiens
uugaaaagacuccaaag

SEQ ID NO: 909329 - RNA, 11 nt, Homo sapiens
uugaaaagccu

SEQ ID NO: 909330 - RNA, 14 nt, Homo sapiens
uugaaaauguucag

SEQ ID NO: 909331 - RNA, 18 nt, Homo sapiens
uugaaacauagagaucua

SEQ ID NO: 909332 - RNA, 14 nt, Homo sapiens
uugaaacugaaugu

SEQ ID NO: 909333 - RNA, 15 nt, Homo sapiens
uugaaacugagaugu

SEQ ID NO: 909334 - RNA, 23 nt, Homo sapiens
uugaaauaccagugaaccaaaga

SEQ ID NO: 909335 - RNA, 15 nt, Homo sapiens
uugaaauauaaugca

SEQ ID NO: 909336 - RNA, 20 nt, Homo sapiens
uugaaaugagaaacuuugau

SEQ ID NO: 909337 - RNA, 19 nt, Homo sapiens
uugaaauuuuauuuaguuc

SEQ ID NO: 909338 - RNA, 15 nt, Homo sapiens
uugaacccaggagau

SEQ ID NO: 909339 - RNA, 14 nt, Homo sapiens
uugaaccuaaacau

SEQ ID NO: 909340 - RNA, 15 nt, Homo sapiens
uugaacuacuuggga

SEQ ID NO: 909341 - RNA, 20 nt, Homo sapiens
uugaacugauucacaucuca

SEQ ID NO: 909342 - RNA, 14 nt, Homo sapiens
uugaagaaaagcac

SEQ ID NO: 909343 - RNA, 18 nt, Homo sapiens
uugaagagcauugcaugg

SEQ ID NO: 909344 - RNA, 21 nt, Homo sapiens
uugaaggagaaaaugcauuau

SEQ ID NO: 909345 - RNA, 20 nt, Homo sapiens
uugaaggaguccuugcauca

SEQ ID NO: 909346 - RNA, 23 nt, Homo sapiens
uugaaggcccaggucaacaucua

SEQ ID NO: 909347 - RNA, 18 nt, Homo sapiens
uugaauagaaaaaguaau

SEQ ID NO: 909348 - RNA, 12 nt, Homo sapiens
uugaauaucauu

SEQ ID NO: 909349 - RNA, 17 nt, Homo sapiens
uugaaugacguguccua

SEQ ID NO: 909350 - RNA, 15 nt, Homo sapiens
uugaauggguuugcu

SEQ ID NO: 909351 - RNA, 17 nt, Homo sapiens
uugaauggucuucugcc

SEQ ID NO: 909352 - RNA, 15 nt, Homo sapiens
uugacagaacacugu

SEQ ID NO: 909353 - RNA, 14 nt, Homo sapiens
uugacaucagcauu

SEQ ID NO: 909354 - RNA, 15 nt, Homo sapiens
uugacaucagcauua

SEQ ID NO: 909355 - RNA, 15 nt, Homo sapiens
uugaccucagcugca

SEQ ID NO: 909356 - RNA, 15 nt, Homo sapiens
uugacucuacugauc

SEQ ID NO: 909357 - RNA, 21 nt, Homo sapiens
uugacucuuguuuucaguuuc

SEQ ID NO: 909358 - RNA, 22 nt, Homo sapiens
uugacuggguuucucuguauag

SEQ ID NO: 909359 - RNA, 14 nt, Homo sapiens
uugagaaacaugaa

SEQ ID NO: 909360 - RNA, 20 nt, Homo sapiens
uugagaauaugaucauguaa

SEQ ID NO: 909361 - RNA, 13 nt, Homo sapiens
uugagacagaguu

SEQ ID NO: 909362 - RNA, 18 nt, Homo sapiens
uugagacuauaaagcagu

SEQ ID NO: 909363 - RNA, 18 nt, Homo sapiens
uugagacuauugagauau

SEQ ID NO: 909364 - RNA, 23 nt, Homo sapiens
uugagaguauauuauguauuuau

SEQ ID NO: 909365 - RNA, 20 nt, Homo sapiens
uugagauaaugucaaaauca

SEQ ID NO: 909366 - RNA, 18 nt, Homo sapiens
uugagcaccgucauggcu

SEQ ID NO: 909367 - RNA, 22 nt, Homo sapiens
uugagcuuucaugaguuuccca

SEQ ID NO: 909368 - RNA, 19 nt, Homo sapiens
uugaggcggauggcuguga

SEQ ID NO: 909369 - RNA, 15 nt, Homo sapiens
uugaguaauucuagc

SEQ ID NO: 909370 - RNA, 14 nt, Homo sapiens
uugaguagaucugc

SEQ ID NO: 909371 - RNA, 22 nt, Homo sapiens
uugauacugaccuuguagcuau

SEQ ID NO: 909372 - RNA, 20 nt, Homo sapiens
uugauaguuaauuauuucaa

SEQ ID NO: 909373 - RNA, 23 nt, Homo sapiens
uugauauuucaauguuagccuca

SEQ ID NO: 909374 - RNA, 11 nt, Homo sapiens
uugauggaccc

SEQ ID NO: 909375 - RNA, 18 nt, Homo sapiens
uugauggagcuacuuuaa

SEQ ID NO: 909376 - RNA, 17 nt, Homo sapiens
uugaugugaaacauuau

SEQ ID NO: 909377 - RNA, 14 nt, Homo sapiens
uugauuaaaacauu

SEQ ID NO: 909378 - RNA, 15 nt, Homo sapiens
uugauuagacuccua

SEQ ID NO: 909379 - RNA, 19 nt, Homo sapiens
uugauuuaauaucugagaa

SEQ ID NO: 909380 - RNA, 19 nt, Homo sapiens
guggcacgugccugugauc

SEQ ID NO: 909381 - RNA, 21 nt, Homo sapiens
guggcagauaaucagccucuu

SEQ ID NO: 909382 - RNA, 21 nt, Homo sapiens
guggcaggccuaggaccucag

SEQ ID NO: 909383 - RNA, 22 nt, Homo sapiens
guggcauucacaucucauguaa

SEQ ID NO: 909384 - RNA, 19 nt, Homo sapiens
guggccucagcccucagaa

SEQ ID NO: 909385 - RNA, 14 nt, Homo sapiens
guggccuuccccuu

SEQ ID NO: 909386 - RNA, 13 nt, Homo sapiens
guggcucuugccu

SEQ ID NO: 909387 - RNA, 20 nt, Homo sapiens
guggcuuuuuuccuccugug

SEQ ID NO: 909388 - RNA, 13 nt, Homo sapiens
gugggacugagau

SEQ ID NO: 909389 - RNA, 21 nt, Homo sapiens
gugggaggggaaugccacagu

SEQ ID NO: 909390 - RNA, 11 nt, Homo sapiens
guggguggugg

SEQ ID NO: 909391 - RNA, 23 nt, Homo sapiens
gugguagaagccaguacagagaa

SEQ ID NO: 909392 - RNA, 16 nt, Homo sapiens
guggucuccuugcacu

SEQ ID NO: 909393 - RNA, 20 nt, Homo sapiens
guggucuuugaauaaagucu

SEQ ID NO: 909394 - RNA, 18 nt, Homo sapiens
gugguggagaaccacagc

SEQ ID NO: 909395 - RNA, 18 nt, Homo sapiens
guguaaaauacguuugaa

SEQ ID NO: 909396 - RNA, 19 nt, Homo sapiens
guguaaagaauaaaugaau

SEQ ID NO: 909397 - RNA, 14 nt, Homo sapiens
guguaacaggucuc

SEQ ID NO: 909398 - RNA, 14 nt, Homo sapiens
guguaagcauugua

SEQ ID NO: 909399 - RNA, 17 nt, Homo sapiens
guguacauguuggguau

SEQ ID NO: 909400 - RNA, 19 nt, Homo sapiens
guguagaggguguuugcag

SEQ ID NO: 909401 - RNA, 14 nt, Homo sapiens
guguagccugugca

SEQ ID NO: 909402 - RNA, 13 nt, Homo sapiens
guguagugucugu

SEQ ID NO: 909403 - RNA, 18 nt, Homo sapiens
guguauaaauaguaacuu

SEQ ID NO: 909404 - RNA, 16 nt, Homo sapiens
guguauauauguguau

SEQ ID NO: 909405 - RNA, 18 nt, Homo sapiens
gugucaaagauuuuaccu

SEQ ID NO: 909406 - RNA, 21 nt, Homo sapiens
gugucacuacucacagucucu

SEQ ID NO: 909407 - RNA, 19 nt, Homo sapiens
gugucacucagcaguggga

SEQ ID NO: 909408 - RNA, 16 nt, Homo sapiens
gugucccaagcuuuga

SEQ ID NO: 909409 - RNA, 22 nt, Homo sapiens
uuggcugcauaaaugugguaca

SEQ ID NO: 909410 - RNA, 15 nt, Homo sapiens
uuggcugugugacag

SEQ ID NO: 909411 - RNA, 18 nt, Homo sapiens
uuggcuuuugcuuggcag

SEQ ID NO: 909412 - RNA, 21 nt, Homo sapiens
uugggaaaaaggccucugucc

SEQ ID NO: 909413 - RNA, 14 nt, Homo sapiens
uugggaaaacuggg

SEQ ID NO: 909414 - RNA, 15 nt, Homo sapiens
uugggaauugcaugc

SEQ ID NO: 909415 - RNA, 15 nt, Homo sapiens
uugggagagugcagu

SEQ ID NO: 909416 - RNA, 16 nt, Homo sapiens
uugggagagugcagua

SEQ ID NO: 909417 - RNA, 22 nt, Homo sapiens
uugggaggcugaggcaagagaa

SEQ ID NO: 909418 - RNA, 21 nt, Homo sapiens
uugggcaccucgacuugugaa

SEQ ID NO: 909419 - RNA, 15 nt, Homo sapiens
uugggcugucaacau

SEQ ID NO: 909420 - RNA, 20 nt, Homo sapiens
uuggggcacagucauucaca

SEQ ID NO: 909421 - RNA, 13 nt, Homo sapiens
uuggggcuuuuac

SEQ ID NO: 909422 - RNA, 13 nt, Homo sapiens
uugguauauuucc

SEQ ID NO: 909423 - RNA, 14 nt, Homo sapiens
uuggugggucucaa

SEQ ID NO: 909424 - RNA, 15 nt, Homo sapiens
uugguguauuugcca

SEQ ID NO: 909425 - RNA, 23 nt, Homo sapiens
uugguuaaaggaaguuuguucac

SEQ ID NO: 909426 - RNA, 21 nt, Homo sapiens
uuguaaaccaucgcgugcaau

SEQ ID NO: 909427 - RNA, 12 nt, Homo sapiens
uuguaaagagug

SEQ ID NO: 909428 - RNA, 16 nt, Homo sapiens
uuguaaaugaccaaga

SEQ ID NO: 909429 - RNA, 19 nt, Homo sapiens
uuguaaauuuuagagcaua

SEQ ID NO: 909430 - RNA, 17 nt, Homo sapiens
uuguaacaauagcacaa

SEQ ID NO: 909431 - RNA, 13 nt, Homo sapiens
uuguaacuccacc

SEQ ID NO: 909432 - RNA, 13 nt, Homo sapiens
uuguaagcacuga

SEQ ID NO: 909433 - RNA, 22 nt, Homo sapiens
uuguaauaaaggucuuugcaca

SEQ ID NO: 909434 - RNA, 16 nt, Homo sapiens
uuguaaugucaccacc

SEQ ID NO: 909435 - RNA, 14 nt, Homo sapiens
uuguacacugugua

SEQ ID NO: 909436 - RNA, 12 nt, Homo sapiens
uuguacauauug

SEQ ID NO: 909437 - RNA, 14 nt, Homo sapiens
uuguaccaguguga

SEQ ID NO: 909438 - RNA, 17 nt, Homo sapiens
uuguaccagugugaaua

SEQ ID NO: 909439 - RNA, 14 nt, Homo sapiens
uuguauaucaugaa

SEQ ID NO: 909440 - RNA, 19 nt, Homo sapiens
uuguauauugucagauauu

SEQ ID NO: 909441 - RNA, 15 nt, Homo sapiens
uuguaugagguuuga

SEQ ID NO: 909442 - RNA, 15 nt, Homo sapiens
uuguauguaucuauu

SEQ ID NO: 909443 - RNA, 20 nt, Homo sapiens
uugucagaauuucuuuguca

SEQ ID NO: 909444 - RNA, 18 nt, Homo sapiens
uugucauauaaaccugau

SEQ ID NO: 909445 - RNA, 12 nt, Homo sapiens
uugucauucaag

SEQ ID NO: 909446 - RNA, 17 nt, Homo sapiens
uuguccugccagcugcc

SEQ ID NO: 909447 - RNA, 16 nt, Homo sapiens
uuguccuucagccaaa

SEQ ID NO: 909448 - RNA, 20 nt, Homo sapiens
uugucuauaugucuagcuca

SEQ ID NO: 909449 - RNA, 11 nt, Homo sapiens
uugucucaaga

SEQ ID NO: 909450 - RNA, 15 nt, Homo sapiens
uugucucacacagca

SEQ ID NO: 909451 - RNA, 14 nt, Homo sapiens
uugucugugcagcu

SEQ ID NO: 909452 - RNA, 23 nt, Homo sapiens
uugugaaagaaggagcaagagaa

SEQ ID NO: 909453 - RNA, 20 nt, Homo sapiens
uugugaccuucucuauauca

SEQ ID NO: 909454 - RNA, 11 nt, Homo sapiens
uugugagcucu

SEQ ID NO: 909455 - RNA, 18 nt, Homo sapiens
uuguggacaaguuuccca

SEQ ID NO: 909456 - RNA, 14 nt, Homo sapiens
uuguguacaaagua

SEQ ID NO: 909457 - RNA, 21 nt, Homo sapiens
uuguguauguguauuuguaug

SEQ ID NO: 909458 - RNA, 12 nt, Homo sapiens
uugugucagaga

SEQ ID NO: 909459 - RNA, 17 nt, Homo sapiens
uuguguccccaccucag

SEQ ID NO: 909460 - RNA, 17 nt, Homo sapiens
uugugucuggcaguuua

SEQ ID NO: 909461 - RNA, 19 nt, Homo sapiens
uuguuaaaaccuuacuuaa

SEQ ID NO: 909462 - RNA, 19 nt, Homo sapiens
uuguuaccuuucccaugcu

SEQ ID NO: 909463 - RNA, 22 nt, Homo sapiens
uuguucauccaaggaaccuaau

SEQ ID NO: 909464 - RNA, 22 nt, Homo sapiens
uuguucgccgcguggaauguga

SEQ ID NO: 909465 - RNA, 23 nt, Homo sapiens
uuguucgccgcguggaaugugag

SEQ ID NO: 909466 - RNA, 16 nt, Homo sapiens
uuguugcugucaagau

SEQ ID NO: 909467 - RNA, 18 nt, Homo sapiens
uuguuuccauucuugucc

SEQ ID NO: 909468 - RNA, 13 nt, Homo sapiens
uuguuucuacuuu

SEQ ID NO: 909469 - RNA, 12 nt, Homo sapiens
uuguuugggcca

SEQ ID NO: 909470 - RNA, 19 nt, Homo sapiens
uuguuugggccacugccag

SEQ ID NO: 909471 - RNA, 21 nt, Homo sapiens
uuuaaaaaaaaauacugaugu

SEQ ID NO: 909472 - RNA, 15 nt, Homo sapiens
uuuaaaaaaaguaua

SEQ ID NO: 909473 - RNA, 14 nt, Homo sapiens
uuuaaaacaugcac

SEQ ID NO: 909474 - RNA, 14 nt, Homo sapiens
uuuaaaacuaucca

SEQ ID NO: 909475 - RNA, 18 nt, Homo sapiens
uuuaaaauacacacucaa

SEQ ID NO: 909476 - RNA, 13 nt, Homo sapiens
uuuaaaauaucac

SEQ ID NO: 909477 - RNA, 18 nt, Homo sapiens
uuuaaaaucacaacacag

SEQ ID NO: 909478 - RNA, 24 nt, Homo sapiens
uuuaaaauuaaaugcauguccuca

SEQ ID NO: 909479 - RNA, 18 nt, Homo sapiens
uuuaaacuauaagcaaga

SEQ ID NO: 909480 - RNA, 11 nt, Homo sapiens
uuuaaaguaaa

SEQ ID NO: 909481 - RNA, 21 nt, Homo sapiens
uuuaaaguauguuauugcaua

SEQ ID NO: 909482 - RNA, 23 nt, Homo sapiens
uuuaaagugguucuggauaucuu

SEQ ID NO: 909483 - RNA, 15 nt, Homo sapiens
uuuaaaguguggaag

SEQ ID NO: 909484 - RNA, 17 nt, Homo sapiens
uuuaaaucaaacuguaa

SEQ ID NO: 909485 - RNA, 21 nt, Homo sapiens
uuuaaauggcuuuaugcuagu

SEQ ID NO: 909486 - RNA, 14 nt, Homo sapiens
uuuaaauuagauaa

SEQ ID NO: 909487 - RNA, 15 nt, Homo sapiens
uuuaacagaaccaga

SEQ ID NO: 909488 - RNA, 15 nt, Homo sapiens
uuuaacaucugagaa

SEQ ID NO: 909489 - RNA, 14 nt, Homo sapiens
uuuaacugcauaau

SEQ ID NO: 909490 - RNA, 22 nt, Homo sapiens
uuuaagaggcuuuggcccaaug

SEQ ID NO: 909491 - RNA, 17 nt, Homo sapiens
uuuaagaguuacuuaau

SEQ ID NO: 909492 - RNA, 16 nt, Homo sapiens
uuuaagauaaacagaa

SEQ ID NO: 909493 - RNA, 13 nt, Homo sapiens
uuuaagcuguaaa

SEQ ID NO: 909494 - RNA, 22 nt, Homo sapiens
uuuaauacaggguagauaaccu

SEQ ID NO: 909495 - RNA, 16 nt, Homo sapiens
uuuaauagaauauaau

SEQ ID NO: 909496 - RNA, 12 nt, Homo sapiens
uuuaauagcaaa

SEQ ID NO: 909497 - RNA, 15 nt, Homo sapiens
uuuaauaucugagaa

SEQ ID NO: 909498 - RNA, 20 nt, Homo sapiens
uuuaauucucaugugauccu

SEQ ID NO: 909499 - RNA, 16 nt, Homo sapiens
uuuaauugauuauucu

SEQ ID NO: 909500 - RNA, 15 nt, Homo sapiens
uuuaauugcauuuaa

SEQ ID NO: 909501 - RNA, 15 nt, Homo sapiens
uuuaauuuugcagau

SEQ ID NO: 909502 - RNA, 12 nt, Homo sapiens
uuuacaaaguau

SEQ ID NO: 909503 - RNA, 14 nt, Homo sapiens
uuuacagacuguga

SEQ ID NO: 909504 - RNA, 18 nt, Homo sapiens
uuuacagugcuauuuacu

SEQ ID NO: 909505 - RNA, 20 nt, Homo sapiens
uuuacauaucaccucauggc

SEQ ID NO: 909506 - RNA, 14 nt, Homo sapiens
uuuacaucuaugua

SEQ ID NO: 909507 - RNA, 11 nt, Homo sapiens
uuuacauucau

SEQ ID NO: 909508 - RNA, 17 nt, Homo sapiens
uuuaccuaccaccuucc

SEQ ID NO: 909509 - RNA, 17 nt, Homo sapiens
uuuaccucuucuaugca

SEQ ID NO: 909510 - RNA, 16 nt, Homo sapiens
uuuacuacuauucugu

SEQ ID NO: 909511 - RNA, 17 nt, Homo sapiens
uuuacucaucaggucau

SEQ ID NO: 909512 - RNA, 16 nt, Homo sapiens
uuuacugaugauguag

SEQ ID NO: 909513 - RNA, 18 nt, Homo sapiens
gccugugugagcaucucu

SEQ ID NO: 909514 - RNA, 17 nt, Homo sapiens
gccuguuacacaugaca

SEQ ID NO: 909515 - RNA, 18 nt, Homo sapiens
gccuguuuuucaaucuca

SEQ ID NO: 909516 - RNA, 22 nt, Homo sapiens
gccuuaaauuuuugucauuuua

SEQ ID NO: 909517 - RNA, 22 nt, Homo sapiens
gccuucaccuucaccuucaucc

SEQ ID NO: 909518 - RNA, 21 nt, Homo sapiens
gccuucacuccggugugccug

SEQ ID NO: 909519 - RNA, 14 nt, Homo sapiens
gccuucauaagccu

SEQ ID NO: 909520 - RNA, 23 nt, Homo sapiens
gccuucauggaacucagcugucu

SEQ ID NO: 909521 - RNA, 16 nt, Homo sapiens
gccuucucccugggaa

SEQ ID NO: 909522 - RNA, 21 nt, Homo sapiens
gccuuucuaguccuauucuau

SEQ ID NO: 909523 - RNA, 18 nt, Homo sapiens
gccuuucuguaaccaaaa

SEQ ID NO: 909524 - RNA, 17 nt, Homo sapiens
gccuuucuuauuugcaa

SEQ ID NO: 909525 - RNA, 19 nt, Homo sapiens
gccuuucuuauuugcaaua

SEQ ID NO: 909526 - RNA, 15 nt, Homo sapiens
gccuuugaccaucuc

SEQ ID NO: 909527 - RNA, 21 nt, Homo sapiens
gcgacagaagucuugucucaa

SEQ ID NO: 909528 - RNA, 17 nt, Homo sapiens
gcgagcugcucugcuau

SEQ ID NO: 909529 - RNA, 23 nt, Homo sapiens
gcgagcugcucugcuauaugccu

SEQ ID NO: 909530 - RNA, 17 nt, Homo sapiens
gcgaguucagcaaagag

SEQ ID NO: 909531 - RNA, 14 nt, Homo sapiens
gcgaguugcgcugg

SEQ ID NO: 909532 - RNA, 21 nt, Homo sapiens
gcgcaacaacaaggacccugu

SEQ ID NO: 909533 - RNA, 17 nt, Homo sapiens
gcgcagcgcgugcacag

SEQ ID NO: 909534 - RNA, 19 nt, Homo sapiens
gcgccagaacccagauuuc

SEQ ID NO: 909535 - RNA, 13 nt, Homo sapiens
gcgccagggccaa

SEQ ID NO: 909536 - RNA, 17 nt, Homo sapiens
gcgccaggggaguuccu

SEQ ID NO: 909537 - RNA, 19 nt, Homo sapiens
gcgcuauugcacuccaguc

SEQ ID NO: 909538 - RNA, 16 nt, Homo sapiens
gcggagcuugcaguga

SEQ ID NO: 909539 - RNA, 17 nt, Homo sapiens
gcggcacauuggcagug

SEQ ID NO: 909540 - RNA, 13 nt, Homo sapiens
gcggcuccagguc

SEQ ID NO: 909541 - RNA, 23 nt, Homo sapiens
gcgggagugggggcugugccgug

SEQ ID NO: 909542 - RNA, 15 nt, Homo sapiens
gcggucaauuugccu

SEQ ID NO: 909543 - RNA, 16 nt, Homo sapiens
gcgguuuccaggccac

SEQ ID NO: 909544 - RNA, 21 nt, Homo sapiens
gcgucagaccaguacugggaa

SEQ ID NO: 909545 - RNA, 20 nt, Homo sapiens
gcgucgcuggacaacccaga

SEQ ID NO: 909546 - RNA, 17 nt, Homo sapiens
gcgugacucacccaagc

SEQ ID NO: 909547 - RNA, 13 nt, Homo sapiens
gcguggaccaccc

SEQ ID NO: 909548 - RNA, 16 nt, Homo sapiens
gcguggacucugcaca

SEQ ID NO: 909549 - RNA, 22 nt, Homo sapiens
gcuaaauucacagcgcuaugca

SEQ ID NO: 909550 - RNA, 13 nt, Homo sapiens
gcuaaggcucuau

SEQ ID NO: 909551 - RNA, 16 nt, Homo sapiens
gcuacaaaaacacagc

SEQ ID NO: 909552 - RNA, 21 nt, Homo sapiens
gcuacaaucuguucaauguuu

SEQ ID NO: 909553 - RNA, 15 nt, Homo sapiens
gcuacaguacuaugu

SEQ ID NO: 909554 - RNA, 17 nt, Homo sapiens
gcuacauuccucagcug

SEQ ID NO: 909555 - RNA, 16 nt, Homo sapiens
gcuaccucacuggggu

SEQ ID NO: 909556 - RNA, 22 nt, Homo sapiens
gcuaccuucucuacccaucucc

SEQ ID NO: 909557 - RNA, 12 nt, Homo sapiens
gcuacuaccugg

SEQ ID NO: 909558 - RNA, 15 nt, Homo sapiens
gcuacucucuugcca

SEQ ID NO: 909559 - RNA, 22 nt, Homo sapiens
aacaauugggagauuaucuuuc

SEQ ID NO: 909560 - RNA, 13 nt, Homo sapiens
aacacaagccaca

SEQ ID NO: 909561 - RNA, 20 nt, Homo sapiens
aacacaagugcgccuugcaa

SEQ ID NO: 909562 - RNA, 13 nt, Homo sapiens
aacacacauggau

SEQ ID NO: 909563 - RNA, 17 nt, Homo sapiens
aacaccaaaaagggauc

SEQ ID NO: 909564 - RNA, 16 nt, Homo sapiens
aacaccaccucuccag

SEQ ID NO: 909565 - RNA, 15 nt, Homo sapiens
aacaccaugaaucuu

SEQ ID NO: 909566 - RNA, 18 nt, Homo sapiens
aacacccaugaaucaaag

SEQ ID NO: 909567 - RNA, 20 nt, Homo sapiens
aacacccaugaaucaaagac

SEQ ID NO: 909568 - RNA, 13 nt, Homo sapiens
aacacccaugccc

SEQ ID NO: 909569 - RNA, 14 nt, Homo sapiens
aacacccuuuccaa

SEQ ID NO: 909570 - RNA, 23 nt, Homo sapiens
aacacgaauugcucaaugcauga

SEQ ID NO: 909571 - RNA, 18 nt, Homo sapiens
aacacuagagucugucau

SEQ ID NO: 909572 - RNA, 20 nt, Homo sapiens
aacacuccacccccuccagc

SEQ ID NO: 909573 - RNA, 15 nt, Homo sapiens
aacacugaagugcuu

SEQ ID NO: 909574 - RNA, 19 nt, Homo sapiens
aacacuuauacugacuuuc

SEQ ID NO: 909575 - RNA, 14 nt, Homo sapiens
aacacuucucauca

SEQ ID NO: 909576 - RNA, 14 nt, Homo sapiens
aacagaacuaugga

SEQ ID NO: 909577 - RNA, 20 nt, Homo sapiens
aacagaagccaaaauacuuc

SEQ ID NO: 909578 - RNA, 13 nt, Homo sapiens
aacagacaacaga

SEQ ID NO: 909579 - RNA, 19 nt, Homo sapiens
aacagagccuucacaacca

SEQ ID NO: 909580 - RNA, 16 nt, Homo sapiens
aacagaucuugaaauc

SEQ ID NO: 909581 - RNA, 21 nt, Homo sapiens
aacagauggauagucugucca

SEQ ID NO: 909582 - RNA, 15 nt, Homo sapiens
aacagccaaaugcau

SEQ ID NO: 909583 - RNA, 16 nt, Homo sapiens
aacagccugacaacau

SEQ ID NO: 909584 - RNA, 15 nt, Homo sapiens
aacaggaaucucaga

SEQ ID NO: 909585 - RNA, 18 nt, Homo sapiens
aacaggcucaauauuccu

SEQ ID NO: 909586 - RNA, 23 nt, Homo sapiens
aacaggguggcccccugugccag

SEQ ID NO: 909587 - RNA, 16 nt, Homo sapiens
aacaguaacugccauc

SEQ ID NO: 909588 - RNA, 19 nt, Homo sapiens
aacauaaaacaaugaagga

SEQ ID NO: 909589 - RNA, 16 nt, Homo sapiens
aacauaauucacuuuc

SEQ ID NO: 909590 - RNA, 20 nt, Homo sapiens
aacauaugcauuaugaaguu

SEQ ID NO: 909591 - RNA, 23 nt, Homo sapiens
aacauauguauacaaauuguuuc

SEQ ID NO: 909592 - RNA, 20 nt, Homo sapiens
aacaucacugaaaugcuagc

SEQ ID NO: 909593 - RNA, 21 nt, Homo sapiens
aacaucacugaaaugcuagcu

SEQ ID NO: 909594 - RNA, 20 nt, Homo sapiens
aacauccagaagguuugcac

SEQ ID NO: 909595 - RNA, 16 nt, Homo sapiens
aacaucccaagccaga

SEQ ID NO: 909596 - RNA, 22 nt, Homo sapiens
aacauccuaagugggaagugaa

SEQ ID NO: 909597 - RNA, 20 nt, Homo sapiens
aacauccuccaauuccacag

SEQ ID NO: 909598 - RNA, 16 nt, Homo sapiens
aacaugaaacuuguca

SEQ ID NO: 909599 - RNA, 15 nt, Homo sapiens
aacaugaauuauuuc

SEQ ID NO: 909600 - RNA, 18 nt, Homo sapiens
aacaugagaaaugugaac

SEQ ID NO: 909601 - RNA, 15 nt, Homo sapiens
aacaugcacauuuau

SEQ ID NO: 909602 - RNA, 21 nt, Homo sapiens
aacauucaucaagcuguacau

SEQ ID NO: 909603 - RNA, 16 nt, Homo sapiens
aacauuccaaugcauu

SEQ ID NO: 909604 - RNA, 15 nt, Homo sapiens
aacauugacuucuug

SEQ ID NO: 909605 - RNA, 18 nt, Homo sapiens
aacauugauuauaagcau

SEQ ID NO: 909606 - RNA, 20 nt, Homo sapiens
aacauuucucaaaugcacau

SEQ ID NO: 909607 - RNA, 20 nt, Homo sapiens
aacauuuuguuauugggcaa

SEQ ID NO: 909608 - RNA, 13 nt, Homo sapiens
aaccaaaugcugu

SEQ ID NO: 909609 - RNA, 14 nt, Homo sapiens
aaccaacacuaaca

SEQ ID NO: 909610 - RNA, 15 nt, Homo sapiens
aaccacacuucuuga

SEQ ID NO: 909611 - RNA, 21 nt, Homo sapiens
aaccacguguuuugacaucau

SEQ ID NO: 909612 - RNA, 13 nt, Homo sapiens
aaccacuguacau

SEQ ID NO: 909613 - RNA, 14 nt, Homo sapiens
aaccacuguacaua

SEQ ID NO: 909614 - RNA, 15 nt, Homo sapiens
aaccagccacacaga

SEQ ID NO: 909615 - RNA, 15 nt, Homo sapiens
aaccaggaacaugua

SEQ ID NO: 909616 - RNA, 16 nt, Homo sapiens
aaccaggacucugccc

SEQ ID NO: 909617 - RNA, 18 nt, Homo sapiens
aaccaguuaagaauggaa

SEQ ID NO: 909618 - RNA, 14 nt, Homo sapiens
aaccauagcacagg

SEQ ID NO: 909619 - RNA, 13 nt, Homo sapiens
aaccaucccugau

SEQ ID NO: 909620 - RNA, 22 nt, Homo sapiens
aaccaugcauggugcaucagca

SEQ ID NO: 909621 - RNA, 15 nt, Homo sapiens
aaccaugccagggau

SEQ ID NO: 909622 - RNA, 15 nt, Homo sapiens
aaccaugcccaagaa

SEQ ID NO: 909623 - RNA, 14 nt, Homo sapiens
aaccauuacuguaa

SEQ ID NO: 909624 - RNA, 15 nt, Homo sapiens
aaccauuacuguaau

SEQ ID NO: 909625 - RNA, 19 nt, Homo sapiens
aacccaaggaacaagagaa

SEQ ID NO: 909626 - RNA, 14 nt, Homo sapiens
aacccagcauguac

SEQ ID NO: 909627 - RNA, 13 nt, Homo sapiens
aacccaggacaag

SEQ ID NO: 909628 - RNA, 20 nt, Homo sapiens
aacccaggagauggaaguug

SEQ ID NO: 909629 - RNA, 20 nt, Homo sapiens
aacccaggaggcggagguug

SEQ ID NO: 909630 - RNA, 15 nt, Homo sapiens
aacccaucagacagg

SEQ ID NO: 909631 - RNA, 13 nt, Homo sapiens
aaccccaugggcu

SEQ ID NO: 909632 - RNA, 22 nt, Homo sapiens
aacccccagcccacagagccug

SEQ ID NO: 909633 - RNA, 17 nt, Homo sapiens
aacccccgcuccagauc

SEQ ID NO: 909634 - RNA, 23 nt, Homo sapiens
aacccccugacauuaucuuggau

SEQ ID NO: 909635 - RNA, 17 nt, Homo sapiens
aacccccuuacugugcg

SEQ ID NO: 909636 - RNA, 12 nt, Homo sapiens
cugauaccucaa

SEQ ID NO: 909637 - RNA, 18 nt, Homo sapiens
cugauacuuauuuaccua

SEQ ID NO: 909638 - RNA, 16 nt, Homo sapiens
cugauaggacccauau

SEQ ID NO: 909639 - RNA, 19 nt, Homo sapiens
cugauaugcagaguauuuc

SEQ ID NO: 909640 - RNA, 17 nt, Homo sapiens
cugauaugggacugagc

SEQ ID NO: 909641 - RNA, 16 nt, Homo sapiens
cugauccuaacugaag

SEQ ID NO: 909642 - RNA, 20 nt, Homo sapiens
cugaucgugcuaaauuuuca

SEQ ID NO: 909643 - RNA, 17 nt, Homo sapiens
cugaugacacauuuggc

SEQ ID NO: 909644 - RNA, 13 nt, Homo sapiens
cugauggccaagg

SEQ ID NO: 909645 - RNA, 23 nt, Homo sapiens
cugauuuuaaaagguugacucaa

SEQ ID NO: 909646 - RNA, 22 nt, Homo sapiens
cugcaaaggcgucugaaugugu

SEQ ID NO: 909647 - RNA, 14 nt, Homo sapiens
cugcaaauuucaaa

SEQ ID NO: 909648 - RNA, 14 nt, Homo sapiens
cugcaagacuuaaa

SEQ ID NO: 909649 - RNA, 18 nt, Homo sapiens
cugcaaugggcacuggga

SEQ ID NO: 909650 - RNA, 17 nt, Homo sapiens
cugcacagugcaucuca

SEQ ID NO: 909651 - RNA, 18 nt, Homo sapiens
cugcacagugcaucucag

SEQ ID NO: 909652 - RNA, 17 nt, Homo sapiens
cugcacaugucuuguac

SEQ ID NO: 909653 - RNA, 18 nt, Homo sapiens
cugcacaugucuuguaca

SEQ ID NO: 909654 - RNA, 23 nt, Homo sapiens
cugcacaugucuuguacaugugu

SEQ ID NO: 909655 - RNA, 24 nt, Homo sapiens
cugcaccgagagagauggaauaaa

SEQ ID NO: 909656 - RNA, 17 nt, Homo sapiens
cugcacuaaaacccauc

SEQ ID NO: 909657 - RNA, 23 nt, Homo sapiens
cugcacuauagccuaggugacag

SEQ ID NO: 909658 - RNA, 14 nt, Homo sapiens
cugcacuccagaau

SEQ ID NO: 909659 - RNA, 14 nt, Homo sapiens
cugcagacucacug

SEQ ID NO: 909660 - RNA, 20 nt, Homo sapiens
cugcagaguaggcagcugcc

SEQ ID NO: 909661 - RNA, 13 nt, Homo sapiens
cugcagcacuuua

SEQ ID NO: 909662 - RNA, 19 nt, Homo sapiens
cugcagccccggcugacac

SEQ ID NO: 909663 - RNA, 15 nt, Homo sapiens
cugcagcugcugaag

SEQ ID NO: 909664 - RNA, 20 nt, Homo sapiens
cugcagcugcuuguugucaa

SEQ ID NO: 909665 - RNA, 21 nt, Homo sapiens
cugcagcuuaaaacaagcaaa

SEQ ID NO: 909666 - RNA, 20 nt, Homo sapiens
cugcaggggccgagccauuu

SEQ ID NO: 909667 - RNA, 22 nt, Homo sapiens
cugcagggggugugucugcuca

SEQ ID NO: 909668 - RNA, 13 nt, Homo sapiens
cugcaguauggcc

SEQ ID NO: 909669 - RNA, 23 nt, Homo sapiens
cugcagugggccauccagagcau

SEQ ID NO: 909670 - RNA, 15 nt, Homo sapiens
cugcauaaauguggu

SEQ ID NO: 909671 - RNA, 13 nt, Homo sapiens
cugcaucucaaaa

SEQ ID NO: 909672 - RNA, 11 nt, Homo sapiens
cugcaucucau

SEQ ID NO: 909673 - RNA, 15 nt, Homo sapiens
cugcaugcucuggaa

SEQ ID NO: 909674 - RNA, 19 nt, Homo sapiens
cugcauggagugagcagua

SEQ ID NO: 909675 - RNA, 22 nt, Homo sapiens
cugcauguguuguacaauacca

SEQ ID NO: 909676 - RNA, 23 nt, Homo sapiens
cugcauuagagcccauuucaauu

SEQ ID NO: 909677 - RNA, 19 nt, Homo sapiens
cugcauuuauaaaugugug

SEQ ID NO: 909678 - RNA, 22 nt, Homo sapiens
cugccaaccagcuuguccaaca

SEQ ID NO: 909679 - RNA, 16 nt, Homo sapiens
gagugagaucuuacag

SEQ ID NO: 909680 - RNA, 23 nt, Homo sapiens
gagugcaguaguaauugauuuga

SEQ ID NO: 909681 - RNA, 21 nt, Homo sapiens
gagugccguaacaacuguggu

SEQ ID NO: 909682 - RNA, 15 nt, Homo sapiens
gagugcuaggauuac

SEQ ID NO: 909683 - RNA, 15 nt, Homo sapiens
gaguggagcccucag

SEQ ID NO: 909684 - RNA, 21 nt, Homo sapiens
gaguggcugaaauaaaagccu

SEQ ID NO: 909685 - RNA, 13 nt, Homo sapiens
gagugggggaccg

SEQ ID NO: 909686 - RNA, 20 nt, Homo sapiens
gagugucaccagcugccaaa

SEQ ID NO: 909687 - RNA, 17 nt, Homo sapiens
gagugugggugaucaga

SEQ ID NO: 909688 - RNA, 20 nt, Homo sapiens
gaguuauucaaaugaaggug

SEQ ID NO: 909689 - RNA, 15 nt, Homo sapiens
gaguucagcaaagag

SEQ ID NO: 909690 - RNA, 12 nt, Homo sapiens
gaguucauccca

SEQ ID NO: 909691 - RNA, 19 nt, Homo sapiens
gaguuccauguuuguacuc

SEQ ID NO: 909692 - RNA, 16 nt, Homo sapiens
gaguucugaagcugac

SEQ ID NO: 909693 - RNA, 17 nt, Homo sapiens
gaguugccagggaagaa

SEQ ID NO: 909694 - RNA, 18 nt, Homo sapiens
gaguuguggaaagccucu

SEQ ID NO: 909695 - RNA, 22 nt, Homo sapiens
gaguuguuuuggugccugccuc

SEQ ID NO: 909696 - RNA, 15 nt, Homo sapiens
gaguuuaacaugugu

SEQ ID NO: 909697 - RNA, 22 nt, Homo sapiens
gaguuucuccuuuugaccaaau

SEQ ID NO: 909698 - RNA, 14 nt, Homo sapiens
gaguuucugcaguu

SEQ ID NO: 909699 - RNA, 23 nt, Homo sapiens
gaguuugaaggaggugagggaug

SEQ ID NO: 909700 - RNA, 14 nt, Homo sapiens
gaguuuucaaagau

SEQ ID NO: 909701 - RNA, 15 nt, Homo sapiens
gauaaaaggaaccaa

SEQ ID NO: 909702 - RNA, 15 nt, Homo sapiens
gauaaagaauauuua

SEQ ID NO: 909703 - RNA, 21 nt, Homo sapiens
gauaaaggaagucaccaaaau

SEQ ID NO: 909704 - RNA, 14 nt, Homo sapiens
gauaacaaccugga

SEQ ID NO: 909705 - RNA, 17 nt, Homo sapiens
gauaacaagacuuugac

SEQ ID NO: 909706 - RNA, 17 nt, Homo sapiens
gauaacuugagcaccgu

SEQ ID NO: 909707 - RNA, 15 nt, Homo sapiens
gauaaucagccucuu

SEQ ID NO: 909708 - RNA, 17 nt, Homo sapiens
gauaaucaucucuguca

SEQ ID NO: 909709 - RNA, 21 nt, Homo sapiens
gauaaucucuuuaaauggcuu

SEQ ID NO: 909710 - RNA, 16 nt, Homo sapiens
gauacagaaugaaucc

SEQ ID NO: 909711 - RNA, 18 nt, Homo sapiens
gauacaggaaaagcugcu

SEQ ID NO: 909712 - RNA, 15 nt, Homo sapiens
gauacuguugaucuu

SEQ ID NO: 909713 - RNA, 18 nt, Homo sapiens
gauagauccauuuggaca

SEQ ID NO: 909714 - RNA, 13 nt, Homo sapiens
gauaguuuugcca

SEQ ID NO: 909715 - RNA, 16 nt, Homo sapiens
gauauauacacaggau

SEQ ID NO: 909716 - RNA, 17 nt, Homo sapiens
gauauauaccacuuucc

SEQ ID NO: 909717 - RNA, 19 nt, Homo sapiens
gauaucaaaaagacugugg

SEQ ID NO: 909718 - RNA, 16 nt, Homo sapiens
gauaucaccucucuuc

SEQ ID NO: 909719 - RNA, 20 nt, Homo sapiens
gauaucaguuaucaauguua

SEQ ID NO: 909720 - RNA, 21 nt, Homo sapiens
gauaucaugccccuguacucc

SEQ ID NO: 909721 - RNA, 19 nt, Homo sapiens
gauaugcacacacauggau

SEQ ID NO: 909722 - RNA, 14 nt, Homo sapiens
gauaugggacugag

SEQ ID NO: 909723 - RNA, 21 nt, Homo sapiens
gauauuguggguaacgugaga

SEQ ID NO: 909724 - RNA, 19 nt, Homo sapiens
gauauuuauugagugccca

SEQ ID NO: 909725 - RNA, 15 nt, Homo sapiens
gaucaaauauuucaa

SEQ ID NO: 909726 - RNA, 17 nt, Homo sapiens
gaucacgccacugcacu

SEQ ID NO: 909727 - RNA, 15 nt, Homo sapiens
gaucacuuuguuaaa

SEQ ID NO: 909728 - RNA, 19 nt, Homo sapiens
gaucagaauuuuaccaaaa

SEQ ID NO: 909729 - RNA, 23 nt, Homo sapiens
gaucagcaugggaaugugccucg

SEQ ID NO: 909730 - RNA, 16 nt, Homo sapiens
gaucaucuuuccuguu

SEQ ID NO: 909731 - RNA, 21 nt, Homo sapiens
gaucauuacauggcugugguu

SEQ ID NO: 909732 - RNA, 21 nt, Homo sapiens
gaucauuuguuggaaugaauu

SEQ ID NO: 909733 - RNA, 21 nt, Homo sapiens
gauccaauggaauacugaaaa

SEQ ID NO: 909734 - RNA, 19 nt, Homo sapiens
gauccacaaaaacaacuua

SEQ ID NO: 909735 - RNA, 14 nt, Homo sapiens
gauccuacucuucc

SEQ ID NO: 909736 - RNA, 17 nt, Homo sapiens
gaucucacaagcacuuu

SEQ ID NO: 909737 - RNA, 14 nt, Homo sapiens
gaucucagccucug

SEQ ID NO: 909738 - RNA, 17 nt, Homo sapiens
gaucuccauauguuaca

SEQ ID NO: 909739 - RNA, 14 nt, Homo sapiens
gaucugaacacagu

SEQ ID NO: 909740 - RNA, 14 nt, Homo sapiens
gaucugcacugggu

SEQ ID NO: 909741 - RNA, 13 nt, Homo sapiens
gaucuuacaggua

SEQ ID NO: 909742 - RNA, 12 nt, Homo sapiens
gaucuucagagc

SEQ ID NO: 909743 - RNA, 17 nt, Homo sapiens
gaucuuguuaaugcauu

SEQ ID NO: 909744 - RNA, 21 nt, Homo sapiens
gaugaaaaccuaacagggugg

SEQ ID NO: 909745 - RNA, 14 nt, Homo sapiens
gaugaaacuccuga

SEQ ID NO: 909746 - RNA, 15 nt, Homo sapiens
gaugaagacaacagc

SEQ ID NO: 909747 - RNA, 21 nt, Homo sapiens
gaugaagauucuccugugcua

SEQ ID NO: 909748 - RNA, 16 nt, Homo sapiens
gaugaagcucuggcca

SEQ ID NO: 909749 - RNA, 21 nt, Homo sapiens
gaugaagcucuggccaaccaa

SEQ ID NO: 909750 - RNA, 19 nt, Homo sapiens
gaugaaggacgugucucag

SEQ ID NO: 909751 - RNA, 22 nt, Homo sapiens
gaugaauagcgaaucaucucaa

SEQ ID NO: 909752 - RNA, 15 nt, Homo sapiens
gaugacaaacccagg

SEQ ID NO: 909753 - RNA, 18 nt, Homo sapiens
gaugaccagaacaagguu

SEQ ID NO: 909754 - RNA, 20 nt, Homo sapiens
gaugacgugaagccacagga

SEQ ID NO: 909755 - RNA, 16 nt, Homo sapiens
gaugagagagugcuga

SEQ ID NO: 909756 - RNA, 18 nt, Homo sapiens
gaugagcacacacacacc

SEQ ID NO: 909757 - RNA, 18 nt, Homo sapiens
gaugagcagucacacugu

SEQ ID NO: 909758 - RNA, 16 nt, Homo sapiens
gaugagccgcugugag

SEQ ID NO: 909759 - RNA, 18 nt, Homo sapiens
gaugaguuuaucauguca

SEQ ID NO: 909760 - RNA, 19 nt, Homo sapiens
gaugauaauggaaagcagc

SEQ ID NO: 909761 - RNA, 13 nt, Homo sapiens
gaugaucuacuca

SEQ ID NO: 909762 - RNA, 22 nt, Homo sapiens
gaugaucuuuaaaauacacacu

SEQ ID NO: 909763 - RNA, 12 nt, Homo sapiens
gaugcacacaca

SEQ ID NO: 909764 - RNA, 24 nt, Homo sapiens
gaugccacccagcaacacagagcu

SEQ ID NO: 909765 - RNA, 18 nt, Homo sapiens
gauggaauaaagcccuug

SEQ ID NO: 909766 - RNA, 20 nt, Homo sapiens
gauggaauaaagcccuugaa

SEQ ID NO: 909767 - RNA, 21 nt, Homo sapiens
gauggaauaaagcccuugaac

SEQ ID NO: 909768 - RNA, 14 nt, Homo sapiens
gauggacucugaaa

SEQ ID NO: 909769 - RNA, 19 nt, Homo sapiens
gauggagauauuuacauga

SEQ ID NO: 909770 - RNA, 18 nt, Homo sapiens
gauggauagucuguccaa

SEQ ID NO: 909771 - RNA, 13 nt, Homo sapiens
gauggcacugcuu

SEQ ID NO: 909772 - RNA, 18 nt, Homo sapiens
gauggcaucuccauguag

SEQ ID NO: 909773 - RNA, 17 nt, Homo sapiens
gauggccgggacaugca

SEQ ID NO: 909774 - RNA, 20 nt, Homo sapiens
gauggcgcuauugcacucca

SEQ ID NO: 909775 - RNA, 14 nt, Homo sapiens
gagcaauuugcaca

SEQ ID NO: 909776 - RNA, 19 nt, Homo sapiens
gagcacaaaaugauaauca

SEQ ID NO: 909777 - RNA, 14 nt, Homo sapiens
gagcacaaguucca

SEQ ID NO: 909778 - RNA, 18 nt, Homo sapiens
gagcacacuuaugggcca

SEQ ID NO: 909779 - RNA, 15 nt, Homo sapiens
gagcacaucugggag

SEQ ID NO: 909780 - RNA, 17 nt, Homo sapiens
gagcacuggagugcagg

SEQ ID NO: 909781 - RNA, 18 nt, Homo sapiens
gagcacuugcguccugca

SEQ ID NO: 909782 - RNA, 23 nt, Homo sapiens
gagcagagcugauggagaaggaa

SEQ ID NO: 909783 - RNA, 21 nt, Homo sapiens
gagcagaugcaaucucuuguc

SEQ ID NO: 909784 - RNA, 22 nt, Homo sapiens
gagcagaugcaaucucuugucu

SEQ ID NO: 909785 - RNA, 14 nt, Homo sapiens
gagcaggcuacugu

SEQ ID NO: 909786 - RNA, 17 nt, Homo sapiens
gagcaggcuacugucag

SEQ ID NO: 909787 - RNA, 22 nt, Homo sapiens
gagcauaauaaauuauauuaaa

SEQ ID NO: 909788 - RNA, 22 nt, Homo sapiens
gagcauaucaaaaaguauuaaa

SEQ ID NO: 909789 - RNA, 13 nt, Homo sapiens
gagcaucaugccu

SEQ ID NO: 909790 - RNA, 19 nt, Homo sapiens
gagcaucucuugaggccag

SEQ ID NO: 909791 - RNA, 17 nt, Homo sapiens
gagccaccccuaaagag

SEQ ID NO: 909792 - RNA, 23 nt, Homo sapiens
gagccagcucucucuacccggcc

SEQ ID NO: 909793 - RNA, 20 nt, Homo sapiens
gagcccagaaaaccuccagu

SEQ ID NO: 909794 - RNA, 18 nt, Homo sapiens
gagcccagcauucagggg

SEQ ID NO: 909795 - RNA, 17 nt, Homo sapiens
gagccccccacaaugau

SEQ ID NO: 909796 - RNA, 14 nt, Homo sapiens
gagcccgagggccu

SEQ ID NO: 909797 - RNA, 15 nt, Homo sapiens
gagcccugguccuag

SEQ ID NO: 909798 - RNA, 23 nt, Homo sapiens
gagcccugugaggcuggguccaa

SEQ ID NO: 909799 - RNA, 14 nt, Homo sapiens
gagccgcugugagc

SEQ ID NO: 909800 - RNA, 14 nt, Homo sapiens
gagccuagccaccu

SEQ ID NO: 909801 - RNA, 19 nt, Homo sapiens
gagccucgcaacccgugcc

SEQ ID NO: 909802 - RNA, 15 nt, Homo sapiens
gagccugaccuuucu

SEQ ID NO: 909803 - RNA, 23 nt, Homo sapiens
gagccugacuguguucagugccu

SEQ ID NO: 909804 - RNA, 16 nt, Homo sapiens
gagccuggaagccaaa

SEQ ID NO: 909805 - RNA, 17 nt, Homo sapiens
gagccuggggcauccca

SEQ ID NO: 909806 - RNA, 17 nt, Homo sapiens
gagccugugcuaaagaa

SEQ ID NO: 909807 - RNA, 22 nt, Homo sapiens
gagccuucacaaccagccacac

SEQ ID NO: 909808 - RNA, 14 nt, Homo sapiens
gagccuucugauga

SEQ ID NO: 909809 - RNA, 16 nt, Homo sapiens
gagcuagaaccuggag

SEQ ID NO: 909810 - RNA, 11 nt, Homo sapiens
gagcuagaagc

SEQ ID NO: 909811 - RNA, 17 nt, Homo sapiens
gagcuauggugaggugu

SEQ ID NO: 909812 - RNA, 23 nt, Homo sapiens
gagcucacaguacaauguuucag

SEQ ID NO: 909813 - RNA, 19 nt, Homo sapiens
gagcucacucccacuggaa

SEQ ID NO: 909814 - RNA, 23 nt, Homo sapiens
gagcuccugucccagcuccagga

SEQ ID NO: 909815 - RNA, 22 nt, Homo sapiens
gagcucgcucuugggagucagg

SEQ ID NO: 909816 - RNA, 21 nt, Homo sapiens
gagcucgguggacccagggau

SEQ ID NO: 909817 - RNA, 21 nt, Homo sapiens
gagcucuucgguuucugagca

SEQ ID NO: 909818 - RNA, 23 nt, Homo sapiens
gagcuggaaauaaaccuggagau

SEQ ID NO: 909819 - RNA, 16 nt, Homo sapiens
gagcuggaacacucuc

SEQ ID NO: 909820 - RNA, 15 nt, Homo sapiens
gagcuggaucacuug

SEQ ID NO: 909821 - RNA, 16 nt, Homo sapiens
gagcugggauguuucu

SEQ ID NO: 909822 - RNA, 20 nt, Homo sapiens
gagcuuacaagacccuauga

SEQ ID NO: 909823 - RNA, 22 nt, Homo sapiens
gagcuuccagugcauguugcca

SEQ ID NO: 909824 - RNA, 23 nt, Homo sapiens
gagcuuccagugcauguugccau

SEQ ID NO: 909825 - RNA, 13 nt, Homo sapiens
gaggaaacuugca

SEQ ID NO: 909826 - RNA, 16 nt, Homo sapiens
gaggaagaaaaccagc

SEQ ID NO: 909827 - RNA, 23 nt, Homo sapiens
gaggaagggcaaaaccacuagaa

SEQ ID NO: 909828 - RNA, 17 nt, Homo sapiens
gaggaauaagcucccag

SEQ ID NO: 909829 - RNA, 19 nt, Homo sapiens
gaggaauucugaagccauu

SEQ ID NO: 909830 - RNA, 16 nt, Homo sapiens
gaggacacaguuucua

SEQ ID NO: 909831 - RNA, 17 nt, Homo sapiens
gaggacacaguuucuau

SEQ ID NO: 909832 - RNA, 14 nt, Homo sapiens
gaggaccgggcugg

SEQ ID NO: 909833 - RNA, 23 nt, Homo sapiens
gaggacuacuauuugaagcaaug

SEQ ID NO: 909834 - RNA, 13 nt, Homo sapiens
gaggacuccuuaa

SEQ ID NO: 909835 - RNA, 17 nt, Homo sapiens
gaggacugagacuggca

SEQ ID NO: 909836 - RNA, 19 nt, Homo sapiens
gaggacuugugucucugug

SEQ ID NO: 909837 - RNA, 17 nt, Homo sapiens
gaggacuuuucuuugug

SEQ ID NO: 909838 - RNA, 16 nt, Homo sapiens
gaggagacccuggaau

SEQ ID NO: 909839 - RNA, 23 nt, Homo sapiens
gaggagcaagguuuaaauuuguu

SEQ ID NO: 909840 - RNA, 13 nt, Homo sapiens
gaggaucacugga

SEQ ID NO: 909841 - RNA, 14 nt, Homo sapiens
gaggaucccuccau

SEQ ID NO: 909842 - RNA, 12 nt, Homo sapiens
gaggaugaccag

SEQ ID NO: 909843 - RNA, 22 nt, Homo sapiens
gaggaugcagaggggugcugcu

SEQ ID NO: 909844 - RNA, 15 nt, Homo sapiens
gaggcaaaggccagc

SEQ ID NO: 909845 - RNA, 19 nt, Homo sapiens
gaggcagaccauccaccag

SEQ ID NO: 909846 - RNA, 19 nt, Homo sapiens
gaggcaugugaugugcaag

SEQ ID NO: 909847 - RNA, 23 nt, Homo sapiens
gaggcggaaaccuugcagcauuu

SEQ ID NO: 909848 - RNA, 14 nt, Homo sapiens
gaggcggcacauug

SEQ ID NO: 909849 - RNA, 12 nt, Homo sapiens
gaggcuauuaaa

SEQ ID NO: 909850 - RNA, 18 nt, Homo sapiens
gaggcugaggcgggugga

SEQ ID NO: 909851 - RNA, 14 nt, Homo sapiens
gaggcugcaugcuc

SEQ ID NO: 909852 - RNA, 15 nt, Homo sapiens
gaggcuuccagagag

SEQ ID NO: 909853 - RNA, 20 nt, Homo sapiens
gagggaauuugaagaaagga

SEQ ID NO: 909854 - RNA, 19 nt, Homo sapiens
gagggacaaaggagccugu

SEQ ID NO: 909855 - RNA, 18 nt, Homo sapiens
gagggagguuccucgcag

SEQ ID NO: 909856 - RNA, 21 nt, Homo sapiens
gagggauucuggucuucacug

SEQ ID NO: 909857 - RNA, 16 nt, Homo sapiens
gagggcagcagccagc

SEQ ID NO: 909858 - RNA, 19 nt, Homo sapiens
gagggcgaguucagcaaag

SEQ ID NO: 909859 - RNA, 14 nt, Homo sapiens
gagggcuguaggaa

SEQ ID NO: 909860 - RNA, 14 nt, Homo sapiens
gaggggaccaaagc

SEQ ID NO: 909861 - RNA, 23 nt, Homo sapiens
gaggggagcccccucuuccacuc

SEQ ID NO: 909862 - RNA, 11 nt, Homo sapiens
gagggggcucc

SEQ ID NO: 909863 - RNA, 16 nt, Homo sapiens
gagggguugcggggga

SEQ ID NO: 909864 - RNA, 12 nt, Homo sapiens
gagggugacugu

SEQ ID NO: 909865 - RNA, 12 nt, Homo sapiens
gaggguugcuau

SEQ ID NO: 909866 - RNA, 13 nt, Homo sapiens
gagguacacucuu

SEQ ID NO: 909867 - RNA, 16 nt, Homo sapiens
gaggucacauucagga

SEQ ID NO: 909868 - RNA, 16 nt, Homo sapiens
gaggucccugccagug

SEQ ID NO: 909869 - RNA, 15 nt, Homo sapiens
cuggauucgugacaa

SEQ ID NO: 909870 - RNA, 18 nt, Homo sapiens
cuggauuguugacaugag

SEQ ID NO: 909871 - RNA, 21 nt, Homo sapiens
cuggcaaugaaaaauucucag

SEQ ID NO: 909872 - RNA, 22 nt, Homo sapiens
cuggcaccgcgugccaugcaua

SEQ ID NO: 909873 - RNA, 11 nt, Homo sapiens
cuggcacugag

SEQ ID NO: 909874 - RNA, 19 nt, Homo sapiens
cuggcacuuagcccaagag

SEQ ID NO: 909875 - RNA, 19 nt, Homo sapiens
cuggcagccgugccuucag

SEQ ID NO: 909876 - RNA, 16 nt, Homo sapiens
cuggcaugacacucua

SEQ ID NO: 909877 - RNA, 14 nt, Homo sapiens
cuggccacagugag

SEQ ID NO: 909878 - RNA, 17 nt, Homo sapiens
cuggccugauugcagag

SEQ ID NO: 909879 - RNA, 23 nt, Homo sapiens
cuggccuggaucuccccacucua

SEQ ID NO: 909880 - RNA, 22 nt, Homo sapiens
cuggcgaaccaucucaauguaa

SEQ ID NO: 909881 - RNA, 18 nt, Homo sapiens
cuggcgcaucauaugcag

SEQ ID NO: 909882 - RNA, 13 nt, Homo sapiens
cuggcgugcagug

SEQ ID NO: 909883 - RNA, 19 nt, Homo sapiens
cuggcugaccccaaagagc

SEQ ID NO: 909884 - RNA, 14 nt, Homo sapiens
cuggcugaggggcu

SEQ ID NO: 909885 - RNA, 23 nt, Homo sapiens
cuggcugcaaaggguaucaggug

SEQ ID NO: 909886 - RNA, 12 nt, Homo sapiens
cuggcugccagg

SEQ ID NO: 909887 - RNA, 23 nt, Homo sapiens
cuggcuucuguugcgccacugag

SEQ ID NO: 909888 - RNA, 14 nt, Homo sapiens
cuggcuuugucucu

SEQ ID NO: 909889 - RNA, 13 nt, Homo sapiens
cugggaacaugua

SEQ ID NO: 909890 - RNA, 22 nt, Homo sapiens
cugggaacugguucaagagaca

SEQ ID NO: 909891 - RNA, 17 nt, Homo sapiens
cugggacuacaggugug

SEQ ID NO: 909892 - RNA, 17 nt, Homo sapiens
cugggagaaccucaggc

SEQ ID NO: 909893 - RNA, 12 nt, Homo sapiens
cugggagagcca

SEQ ID NO: 909894 - RNA, 19 nt, Homo sapiens
cugggaggucuccacugag

SEQ ID NO: 909895 - RNA, 22 nt, Homo sapiens
cugggagugauaugauguguag

SEQ ID NO: 909896 - RNA, 22 nt, Homo sapiens
cugggaguucccugaacaucug

SEQ ID NO: 909897 - RNA, 14 nt, Homo sapiens
cugggauguagaac

SEQ ID NO: 909898 - RNA, 15 nt, Homo sapiens
cugggauguuuugag

SEQ ID NO: 909899 - RNA, 21 nt, Homo sapiens
cugggauguuuugagggucuu

SEQ ID NO: 909900 - RNA, 19 nt, Homo sapiens
cugggauucccaccaaggu

SEQ ID NO: 909901 - RNA, 21 nt, Homo sapiens
cugggcagcugauuuugucac

SEQ ID NO: 909902 - RNA, 22 nt, Homo sapiens
cugggccccaccaccuaggcca

SEQ ID NO: 909903 - RNA, 19 nt, Homo sapiens
cugggccccaugcucugcc

SEQ ID NO: 909904 - RNA, 17 nt, Homo sapiens
gacuacaggcacccacc

SEQ ID NO: 909905 - RNA, 20 nt, Homo sapiens
gacuaccagcuaacuccagu

SEQ ID NO: 909906 - RNA, 16 nt, Homo sapiens
gacuagaggcagggag

SEQ ID NO: 909907 - RNA, 19 nt, Homo sapiens
gacuagggcuuauccaugc

SEQ ID NO: 909908 - RNA, 16 nt, Homo sapiens
gacuaggugcuugcuu

SEQ ID NO: 909909 - RNA, 14 nt, Homo sapiens
gacuagugcuuuac

SEQ ID NO: 909910 - RNA, 19 nt, Homo sapiens
gacuaguugaacaucucac

SEQ ID NO: 909911 - RNA, 14 nt, Homo sapiens
gacuauggguacau

SEQ ID NO: 909912 - RNA, 18 nt, Homo sapiens
gacuauguuucuauucua

SEQ ID NO: 909913 - RNA, 18 nt, Homo sapiens
gacuauuaaaacuaauaa

SEQ ID NO: 909914 - RNA, 20 nt, Homo sapiens
gacuauuauagaauggaacu

SEQ ID NO: 909915 - RNA, 15 nt, Homo sapiens
gacuauuuagacaaa

SEQ ID NO: 909916 - RNA, 16 nt, Homo sapiens
gacuauuuaugaaggc

SEQ ID NO: 909917 - RNA, 14 nt, Homo sapiens
gacucacaagaaga

SEQ ID NO: 909918 - RNA, 15 nt, Homo sapiens
gacucaguccagcca

SEQ ID NO: 909919 - RNA, 21 nt, Homo sapiens
gacuccacaguuuugccuuaa

SEQ ID NO: 909920 - RNA, 23 nt, Homo sapiens
gacuccagaaucugcuguugcca

SEQ ID NO: 909921 - RNA, 20 nt, Homo sapiens
gacuccauauggaggccuca

SEQ ID NO: 909922 - RNA, 20 nt, Homo sapiens
gacuccgucucaaaaacaaa

SEQ ID NO: 909923 - RNA, 13 nt, Homo sapiens
gacuccucaaaag

SEQ ID NO: 909924 - RNA, 17 nt, Homo sapiens
gacuccugugcaacuuu

SEQ ID NO: 909925 - RNA, 15 nt, Homo sapiens
gacucgucucaaaaa

SEQ ID NO: 909926 - RNA, 17 nt, Homo sapiens
gacucguucuucuggga

SEQ ID NO: 909927 - RNA, 18 nt, Homo sapiens
gacucguucuucugggaa

SEQ ID NO: 909928 - RNA, 16 nt, Homo sapiens
gacucugcacaugucu

SEQ ID NO: 909929 - RNA, 18 nt, Homo sapiens
gacucugcacaugucuug

SEQ ID NO: 909930 - RNA, 17 nt, Homo sapiens
gacucuuaacauuagag

SEQ ID NO: 909931 - RNA, 22 nt, Homo sapiens
gacugaaugugccuaauggaga

SEQ ID NO: 909932 - RNA, 13 nt, Homo sapiens
gacugaguccucg

SEQ ID NO: 909933 - RNA, 19 nt, Homo sapiens
gacugaugacaaacccagg

SEQ ID NO: 909934 - RNA, 16 nt, Homo sapiens
gacugcaucucaaaaa

SEQ ID NO: 909935 - RNA, 15 nt, Homo sapiens
gacugcucgucuauc

SEQ ID NO: 909936 - RNA, 15 nt, Homo sapiens
gacuggaaccaggga

SEQ ID NO: 909937 - RNA, 16 nt, Homo sapiens
gacuggaacuugaacu

SEQ ID NO: 909938 - RNA, 19 nt, Homo sapiens
gacuggaccccgcccagca

SEQ ID NO: 909939 - RNA, 16 nt, Homo sapiens
gacuggaucucagccu

SEQ ID NO: 909940 - RNA, 14 nt, Homo sapiens
gacuguacuccucc

SEQ ID NO: 909941 - RNA, 20 nt, Homo sapiens
gacugugaaaguaugugaua

SEQ ID NO: 909942 - RNA, 16 nt, Homo sapiens
gacuguggccuguuaa

SEQ ID NO: 909943 - RNA, 22 nt, Homo sapiens
gacuguugcucaaaucuauuca

SEQ ID NO: 909944 - RNA, 18 nt, Homo sapiens
gacuuaacugguucauau

SEQ ID NO: 909945 - RNA, 17 nt, Homo sapiens
gacuucacaaaaugcaa

SEQ ID NO: 909946 - RNA, 11 nt, Homo sapiens
gacuucauccc

SEQ ID NO: 909947 - RNA, 19 nt, Homo sapiens
gacuucugccccagcuuua

SEQ ID NO: 909948 - RNA, 20 nt, Homo sapiens
gacuucugucuucacaacag

SEQ ID NO: 909949 - RNA, 16 nt, Homo sapiens
gacuugaagcacagag

SEQ ID NO: 909950 - RNA, 18 nt, Homo sapiens
gacuugacagaacacugu

SEQ ID NO: 909951 - RNA, 16 nt, Homo sapiens
gacuugagcuuggcag

SEQ ID NO: 909952 - RNA, 16 nt, Homo sapiens
gacuuugaugcauuuc

SEQ ID NO: 909953 - RNA, 17 nt, Homo sapiens
gacuuugaugcauuucc

SEQ ID NO: 909954 - RNA, 17 nt, Homo sapiens
gacuuuguauagaaggu

SEQ ID NO: 909955 - RNA, 22 nt, Homo sapiens
gacuuuguucacuagacugugc

SEQ ID NO: 909956 - RNA, 18 nt, Homo sapiens
gacuuuuccaagcccuuu

SEQ ID NO: 909957 - RNA, 19 nt, Homo sapiens
gagaaaauaaaagcacuua

SEQ ID NO: 909958 - RNA, 23 nt, Homo sapiens
gagaaaccagggagccccuuuga

SEQ ID NO: 909959 - RNA, 13 nt, Homo sapiens
gagaaacuuccuu

SEQ ID NO: 909960 - RNA, 14 nt, Homo sapiens
gagaaagaaaggga

SEQ ID NO: 909961 - RNA, 15 nt, Homo sapiens
gagaaagacuauuca

SEQ ID NO: 909962 - RNA, 15 nt, Homo sapiens
gagaaaugacuuuga

SEQ ID NO: 909963 - RNA, 23 nt, Homo sapiens
gagaacuucaaucacuguagucu

SEQ ID NO: 909964 - RNA, 23 nt, Homo sapiens
gagaagaauuuucagaccccagc

SEQ ID NO: 909965 - RNA, 22 nt, Homo sapiens
gagaagagcuguucacagccag

SEQ ID NO: 909966 - RNA, 21 nt, Homo sapiens
gagaagcaaaaucuaccaggu

SEQ ID NO: 909967 - RNA, 14 nt, Homo sapiens
gagaagcagugagc

SEQ ID NO: 909968 - RNA, 17 nt, Homo sapiens
gagaagcucacccaaua

SEQ ID NO: 909969 - RNA, 14 nt, Homo sapiens
gagaaggaaggcuc

SEQ ID NO: 909970 - RNA, 19 nt, Homo sapiens
gagaagggaagccucuuca

SEQ ID NO: 909971 - RNA, 22 nt, Homo sapiens
gagaaguauccaauuaugugac

SEQ ID NO: 909972 - RNA, 17 nt, Homo sapiens
gagaaucacuugcacuc

SEQ ID NO: 909973 - RNA, 18 nt, Homo sapiens
gagaauccugccucuccc

SEQ ID NO: 909974 - RNA, 23 nt, Homo sapiens
gagacagauauacugggagaaau

SEQ ID NO: 909975 - RNA, 15 nt, Homo sapiens
gagacaggcccaaga

SEQ ID NO: 909976 - RNA, 22 nt, Homo sapiens
gagacagguggccuagcaggca

SEQ ID NO: 909977 - RNA, 19 nt, Homo sapiens
gagacauguaccuugacca

SEQ ID NO: 909978 - RNA, 15 nt, Homo sapiens
gagacccagaucuca

SEQ ID NO: 909979 - RNA, 15 nt, Homo sapiens
gagacccccaucucu

SEQ ID NO: 909980 - RNA, 17 nt, Homo sapiens
gagaccucuacugccuu

SEQ ID NO: 909981 - RNA, 21 nt, Homo sapiens
gagacuaugugucaugauuuc

SEQ ID NO: 909982 - RNA, 12 nt, Homo sapiens
gagacugaguca

SEQ ID NO: 909983 - RNA, 18 nt, Homo sapiens
gagacugcaucucaaaaa

SEQ ID NO: 909984 - RNA, 23 nt, Homo sapiens
gagacugugcugggaacauguac

SEQ ID NO: 909985 - RNA, 15 nt, Homo sapiens
gagacuuggggacca

SEQ ID NO: 909986 - RNA, 17 nt, Homo sapiens
gagacuuggggaccaga

SEQ ID NO: 909987 - RNA, 23 nt, Homo sapiens
gagagacgcagcccugggggcca

SEQ ID NO: 909988 - RNA, 16 nt, Homo sapiens
gagagauaccuugaaa

SEQ ID NO: 909989 - RNA, 14 nt, Homo sapiens
gagagauggaauaa

SEQ ID NO: 909990 - RNA, 20 nt, Homo sapiens
gagagcaaauaaagaccuga

SEQ ID NO: 909991 - RNA, 20 nt, Homo sapiens
gagagcagaugguccuccau

SEQ ID NO: 909992 - RNA, 23 nt, Homo sapiens
gagagcuuucuguccuuuuggca

SEQ ID NO: 909993 - RNA, 15 nt, Homo sapiens
gagaggcaugugaug

SEQ ID NO: 909994 - RNA, 22 nt, Homo sapiens
gagaggcccugggguucucccc

SEQ ID NO: 909995 - RNA, 16 nt, Homo sapiens
gagaggggcuguccau

SEQ ID NO: 909996 - RNA, 23 nt, Homo sapiens
aagucacugcacagugcaucuca

SEQ ID NO: 909997 - RNA, 21 nt, Homo sapiens
aagucauggcccaaauccagu

SEQ ID NO: 909998 - RNA, 18 nt, Homo sapiens
aaguccaagcauaccaac

SEQ ID NO: 909999 - RNA, 20 nt, Homo sapiens
aagucccugacucucuguga

SEQ ID NO: 910000 - RNA, 14 nt, Homo sapiens
aagucguuucagga

SEQ ID NO: 910001 - RNA, 23 nt, Homo sapiens
aagucuaaauaaaugaaguauuu

SEQ ID NO: 910002 - RNA, 20 nt, Homo sapiens
aagucuagaaaccaguaugg

SEQ ID NO: 910003 - RNA, 23 nt, Homo sapiens
aagucugggauguagaacuucaa

SEQ ID NO: 910004 - RNA, 17 nt, Homo sapiens
aagucuuauuuccucaa

SEQ ID NO: 910005 - RNA, 14 nt, Homo sapiens
aagucuuccauaga

SEQ ID NO: 910006 - RNA, 23 nt, Homo sapiens
aagucuuccauagagacuuugug

SEQ ID NO: 910007 - RNA, 14 nt, Homo sapiens
aagugagacugaca

SEQ ID NO: 910008 - RNA, 16 nt, Homo sapiens
aagugcaaauuugaua

SEQ ID NO: 910009 - RNA, 17 nt, Homo sapiens
aagugccacucauuccu

SEQ ID NO: 910010 - RNA, 14 nt, Homo sapiens
aagugccaucccac

SEQ ID NO: 910011 - RNA, 18 nt, Homo sapiens
aagugcuaugccaagcca

SEQ ID NO: 910012 - RNA, 20 nt, Homo sapiens
aaguggucgcuuacuuugag

SEQ ID NO: 910013 - RNA, 16 nt, Homo sapiens
aagugguuuuuauuuc

SEQ ID NO: 910014 - RNA, 20 nt, Homo sapiens
aaguguaguggcauccauuu

SEQ ID NO: 910015 - RNA, 16 nt, Homo sapiens
aaguguggaagcagaa

SEQ ID NO: 910016 - RNA, 16 nt, Homo sapiens
aaguguuccuucauua

SEQ ID NO: 910017 - RNA, 20 nt, Homo sapiens
aaguguuccuucauuaacuc

SEQ ID NO: 910018 - RNA, 16 nt, Homo sapiens
aaguuaacuacagugu

SEQ ID NO: 910019 - RNA, 15 nt, Homo sapiens
aaguuaagcagccuu

SEQ ID NO: 910020 - RNA, 17 nt, Homo sapiens
aaguuacauguuugcac

SEQ ID NO: 910021 - RNA, 14 nt, Homo sapiens
aaguuacuucacuu

SEQ ID NO: 910022 - RNA, 22 nt, Homo sapiens
aaguuauccagaggguugugau

SEQ ID NO: 910023 - RNA, 20 nt, Homo sapiens
aaguuauuccccaucuucca

SEQ ID NO: 910024 - RNA, 15 nt, Homo sapiens
aaguucaauacucau

SEQ ID NO: 910025 - RNA, 16 nt, Homo sapiens
aaguucaauacucauu

SEQ ID NO: 910026 - RNA, 12 nt, Homo sapiens
aaguucagggaa

SEQ ID NO: 910027 - RNA, 22 nt, Homo sapiens
aaguucccuacuuccugugacu

SEQ ID NO: 910028 - RNA, 15 nt, Homo sapiens
aaguuccucuagugc

SEQ ID NO: 910029 - RNA, 17 nt, Homo sapiens
aaguuccugcacuccag

SEQ ID NO: 910030 - RNA, 15 nt, Homo sapiens
aaguucuaaguucau

SEQ ID NO: 910031 - RNA, 15 nt, Homo sapiens
aaguucucaauguga

SEQ ID NO: 910032 - RNA, 16 nt, Homo sapiens
aagcuccacugucacc

SEQ ID NO: 910033 - RNA, 14 nt, Homo sapiens
aagcucugaaguca

SEQ ID NO: 910034 - RNA, 13 nt, Homo sapiens
aagcucuguguaa

SEQ ID NO: 910035 - RNA, 19 nt, Homo sapiens
aagcugaacuuacugcuua

SEQ ID NO: 910036 - RNA, 21 nt, Homo sapiens
aagcugaggugcccaggagaa

SEQ ID NO: 910037 - RNA, 16 nt, Homo sapiens
aagcugagugacugua

SEQ ID NO: 910038 - RNA, 21 nt, Homo sapiens
aagcugagugacuguaggcag

SEQ ID NO: 910039 - RNA, 21 nt, Homo sapiens
aagcugcugagaaucuagccu

SEQ ID NO: 910040 - RNA, 23 nt, Homo sapiens
aagcuggaggacuagaaccugga

SEQ ID NO: 910041 - RNA, 13 nt, Homo sapiens
aagcuggcuuccu

SEQ ID NO: 910042 - RNA, 20 nt, Homo sapiens
aagcugggcaugaacgcacu

SEQ ID NO: 910043 - RNA, 22 nt, Homo sapiens
aagcugguaaacuauuugucuu

SEQ ID NO: 910044 - RNA, 19 nt, Homo sapiens
aagcuguuuccauagggug

SEQ ID NO: 910045 - RNA, 17 nt, Homo sapiens
aaggaaaaccagggaua

SEQ ID NO: 910046 - RNA, 14 nt, Homo sapiens
aaggaaacuccuga

SEQ ID NO: 910047 - RNA, 22 nt, Homo sapiens
aaggaaacuugaaucaaagcag

SEQ ID NO: 910048 - RNA, 18 nt, Homo sapiens
aaggaagcuccacuguca

SEQ ID NO: 910049 - RNA, 19 nt, Homo sapiens
aaggaagcuccacugucac

SEQ ID NO: 910050 - RNA, 16 nt, Homo sapiens
aaggaagucaccaaaa

SEQ ID NO: 910051 - RNA, 13 nt, Homo sapiens
aaggacaaugccu

SEQ ID NO: 910052 - RNA, 14 nt, Homo sapiens
aaggacaugugcua

SEQ ID NO: 910053 - RNA, 13 nt, Homo sapiens
aaggaccagguua

SEQ ID NO: 910054 - RNA, 19 nt, Homo sapiens
aaggacgagggaugggauu

SEQ ID NO: 910055 - RNA, 21 nt, Homo sapiens
aaggacggccuucaacugaaa

SEQ ID NO: 910056 - RNA, 16 nt, Homo sapiens
aaggacgugucucagg

SEQ ID NO: 910057 - RNA, 16 nt, Homo sapiens
aaggacuagagcucag

SEQ ID NO: 910058 - RNA, 15 nt, Homo sapiens
aaggagaaaaugcau

SEQ ID NO: 910059 - RNA, 22 nt, Homo sapiens
aaggagauucaaacucaaugau

SEQ ID NO: 910060 - RNA, 12 nt, Homo sapiens
aaggagccagga

SEQ ID NO: 910061 - RNA, 19 nt, Homo sapiens
aaggagccugugaacccag

SEQ ID NO: 910062 - RNA, 23 nt, Homo sapiens
aaggagccuuucuuauggaagaa

SEQ ID NO: 910063 - RNA, 20 nt, Homo sapiens
aaggaggcaugccucugaua

SEQ ID NO: 910064 - RNA, 21 nt, Homo sapiens
aaggaggcuuaggacuuucca

SEQ ID NO: 910065 - RNA, 18 nt, Homo sapiens
aaggauccagagacuugg

SEQ ID NO: 910066 - RNA, 22 nt, Homo sapiens
aaggauguuuugucccauuucc

SEQ ID NO: 910067 - RNA, 13 nt, Homo sapiens
aaggcaaaaagca

SEQ ID NO: 910068 - RNA, 20 nt, Homo sapiens
aagaagcccugcugggccca

SEQ ID NO: 910069 - RNA, 16 nt, Homo sapiens
aagaagcuuuaauauu

SEQ ID NO: 910070 - RNA, 16 nt, Homo sapiens
aagaaggaaauagcca

SEQ ID NO: 910071 - RNA, 15 nt, Homo sapiens
aagaaggacacuugu

SEQ ID NO: 910072 - RNA, 20 nt, Homo sapiens
aagaaguguuccuucauuaa

SEQ ID NO: 910073 - RNA, 14 nt, Homo sapiens
aagaaguuaaauga

SEQ ID NO: 910074 - RNA, 13 nt, Homo sapiens
aagaauauuguau

SEQ ID NO: 910075 - RNA, 13 nt, Homo sapiens
aagaaucaccuca

SEQ ID NO: 910076 - RNA, 16 nt, Homo sapiens
aagaaucacuugaacc

SEQ ID NO: 910077 - RNA, 13 nt, Homo sapiens
aagaaucuaauag

SEQ ID NO: 910078 - RNA, 17 nt, Homo sapiens
aagaaugaauaauaauu

SEQ ID NO: 910079 - RNA, 21 nt, Homo sapiens
aagaaugagcauugagacggu

SEQ ID NO: 910080 - RNA, 17 nt, Homo sapiens
aagaauugaacccagga

SEQ ID NO: 910081 - RNA, 13 nt, Homo sapiens
aagacaaagcaaa

SEQ ID NO: 910082 - RNA, 13 nt, Homo sapiens
aagacaacauaac

SEQ ID NO: 910083 - RNA, 13 nt, Homo sapiens
aagacaauggcuu

SEQ ID NO: 910084 - RNA, 21 nt, Homo sapiens
aagacaggucuagacuuucuc

SEQ ID NO: 910085 - RNA, 15 nt, Homo sapiens
aagacauaugcauuu

SEQ ID NO: 910086 - RNA, 18 nt, Homo sapiens
aagacauggaauuaccuu

SEQ ID NO: 910087 - RNA, 18 nt, Homo sapiens
aagaccaagacacagauc

SEQ ID NO: 910088 - RNA, 22 nt, Homo sapiens
aagaccauaacagccaacaggu

SEQ ID NO: 910089 - RNA, 13 nt, Homo sapiens
aagacccagugua

SEQ ID NO: 910090 - RNA, 18 nt, Homo sapiens
aagaccccagcuucauua

SEQ ID NO: 910091 - RNA, 19 nt, Homo sapiens
aagaccuucugaagaucuc

SEQ ID NO: 910092 - RNA, 20 nt, Homo sapiens
aagacgcucaagaauccucu

SEQ ID NO: 910093 - RNA, 14 nt, Homo sapiens
aagacuaaacuggu

SEQ ID NO: 910094 - RNA, 22 nt, Homo sapiens
aagacuaaccugcccacccacu

SEQ ID NO: 910095 - RNA, 21 nt, Homo sapiens
aagacucauucccuagaucuu

SEQ ID NO: 910096 - RNA, 14 nt, Homo sapiens
aagacuccugggcu

SEQ ID NO: 910097 - RNA, 19 nt, Homo sapiens
aagacuguggccugcccag

SEQ ID NO: 910098 - RNA, 18 nt, Homo sapiens
aagacuugauacugcaau

SEQ ID NO: 910099 - RNA, 22 nt, Homo sapiens
aagacuuguguccccaccucag

SEQ ID NO: 910100 - RNA, 14 nt, Homo sapiens
aagagaacauuucu

SEQ ID NO: 910101 - RNA, 13 nt, Homo sapiens
aagagacagagcc

SEQ ID NO: 910102 - RNA, 23 nt, Homo sapiens
aagagacucucuuagggaaacca

SEQ ID NO: 910103 - RNA, 13 nt, Homo sapiens
aagagacugaguc

SEQ ID NO: 910104 - RNA, 19 nt, Homo sapiens
aagagacuggagcaucuga

SEQ ID NO: 910105 - RNA, 20 nt, Homo sapiens
aggccgggcacgguggcuca

SEQ ID NO: 910106 - RNA, 20 nt, Homo sapiens
aggccgggcgcgguggcuca

SEQ ID NO: 910107 - RNA, 23 nt, Homo sapiens
aggccuggccagaugcaccagcc

SEQ ID NO: 910108 - RNA, 17 nt, Homo sapiens
aggccuguguagcugug

SEQ ID NO: 910109 - RNA, 23 nt, Homo sapiens
aggcggccucgugccaugaucug

SEQ ID NO: 910110 - RNA, 18 nt, Homo sapiens
aggcggucaugugugcau

SEQ ID NO: 910111 - RNA, 14 nt, Homo sapiens
aggcguucuucgag

SEQ ID NO: 910112 - RNA, 18 nt, Homo sapiens
aggcuccaucuccagugg

SEQ ID NO: 910113 - RNA, 14 nt, Homo sapiens
aggcuccugugcua

SEQ ID NO: 910114 - RNA, 23 nt, Homo sapiens
aggcuccugugcuacuuugccuu

SEQ ID NO: 910115 - RNA, 11 nt, Homo sapiens
aggcucugaaa

SEQ ID NO: 910116 - RNA, 17 nt, Homo sapiens
aggcucuggagccagag

SEQ ID NO: 910117 - RNA, 22 nt, Homo sapiens
aggcugagcuggcauuggucug

SEQ ID NO: 910118 - RNA, 10 nt, Homo sapiens
aggcugcaaa

SEQ ID NO: 910119 - RNA, 20 nt, Homo sapiens
aggcuggaguggaguggcac

SEQ ID NO: 910120 - RNA, 22 nt, Homo sapiens
aggcugggggcgggggagccaa

SEQ ID NO: 910121 - RNA, 13 nt, Homo sapiens
aggcuguggugag

SEQ ID NO: 910122 - RNA, 17 nt, Homo sapiens
aggcuguucugcacuga

SEQ ID NO: 910123 - RNA, 17 nt, Homo sapiens
aggcuuccuucauuucc

SEQ ID NO: 910124 - RNA, 12 nt, Homo sapiens
aggcuucuucag

SEQ ID NO: 910125 - RNA, 22 nt, Homo sapiens
aggcuugccaccggggaaccca

SEQ ID NO: 910126 - RNA, 21 nt, Homo sapiens
agcauaccaguacucaguaua

SEQ ID NO: 910127 - RNA, 17 nt, Homo sapiens
agcauagggucuggaac

SEQ ID NO: 910128 - RNA, 13 nt, Homo sapiens
agcaucaugccuc

SEQ ID NO: 910129 - RNA, 22 nt, Homo sapiens
agcaucauuguaaauuauuuca

SEQ ID NO: 910130 - RNA, 14 nt, Homo sapiens
agcaucugacucac

SEQ ID NO: 910131 - RNA, 23 nt, Homo sapiens
agcaugaacuguccuuccauuug

SEQ ID NO: 910132 - RNA, 14 nt, Homo sapiens
agcauguggggaag

SEQ ID NO: 910133 - RNA, 18 nt, Homo sapiens
agcauuagcuacuuuuca

SEQ ID NO: 910134 - RNA, 17 nt, Homo sapiens
agcauuagucacuuuga

SEQ ID NO: 910135 - RNA, 18 nt, Homo sapiens
agcauuagucacuuugaa

SEQ ID NO: 910136 - RNA, 16 nt, Homo sapiens
agcauugagaucucca

SEQ ID NO: 910137 - RNA, 17 nt, Homo sapiens
agcauuguaaaugugcu

SEQ ID NO: 910138 - RNA, 18 nt, Homo sapiens
agcauuucccucccggga

SEQ ID NO: 910139 - RNA, 21 nt, Homo sapiens
agcauuuuacuacuuguuacc

SEQ ID NO: 910140 - RNA, 14 nt, Homo sapiens
agcauuuucuugaa

SEQ ID NO: 910141 - RNA, 14 nt, Homo sapiens
agccaaacccauga

SEQ ID NO: 910142 - RNA, 13 nt, Homo sapiens
agccaaauguaau

SEQ ID NO: 910143 - RNA, 20 nt, Homo sapiens
agccaacacccugucuaaaa

SEQ ID NO: 910144 - RNA, 16 nt, Homo sapiens
agccaacuuggcuuuc

SEQ ID NO: 910145 - RNA, 22 nt, Homo sapiens
agccaaguuauauugaauauau

SEQ ID NO: 910146 - RNA, 17 nt, Homo sapiens
agccacaccuuuuccag

SEQ ID NO: 910147 - RNA, 17 nt, Homo sapiens
agccacacuucucagga

SEQ ID NO: 910148 - RNA, 19 nt, Homo sapiens
agccacagcuucuucaucu

SEQ ID NO: 910149 - RNA, 12 nt, Homo sapiens
agccacaucacu

SEQ ID NO: 910150 - RNA, 19 nt, Homo sapiens
agccacaucccuuugaaac

SEQ ID NO: 910151 - RNA, 22 nt, Homo sapiens
agccaccucuugggcaugcuca

SEQ ID NO: 910152 - RNA, 14 nt, Homo sapiens
agccacuaccuucu

SEQ ID NO: 910153 - RNA, 18 nt, Homo sapiens
agccacuaccuucugacc

SEQ ID NO: 910154 - RNA, 14 nt, Homo sapiens
agccacugccuuca

SEQ ID NO: 910155 - RNA, 17 nt, Homo sapiens
agccacugguuucucag

SEQ ID NO: 910156 - RNA, 23 nt, Homo sapiens
agccagaaucuucguccugcccc

SEQ ID NO: 910157 - RNA, 22 nt, Homo sapiens
agccagagagugagagacauua

SEQ ID NO: 910158 - RNA, 22 nt, Homo sapiens
agccagauggaguaccaugagg

SEQ ID NO: 910159 - RNA, 16 nt, Homo sapiens
agccagccggugccug

SEQ ID NO: 910160 - RNA, 16 nt, Homo sapiens
agccaggagaugcugg

SEQ ID NO: 910161 - RNA, 13 nt, Homo sapiens
agccaggagcaaa

SEQ ID NO: 910162 - RNA, 20 nt, Homo sapiens
agccaggguccugaguggcu

SEQ ID NO: 910163 - RNA, 22 nt, Homo sapiens
agccauaguggagagaacugaa

SEQ ID NO: 910164 - RNA, 23 nt, Homo sapiens
agccauaguggagagaacugaau

SEQ ID NO: 910165 - RNA, 13 nt, Homo sapiens
agccauaugcaau

SEQ ID NO: 910166 - RNA, 19 nt, Homo sapiens
agccaucaagagacugagu

SEQ ID NO: 910167 - RNA, 20 nt, Homo sapiens
agccaucaagagacugaguc

SEQ ID NO: 910168 - RNA, 19 nt, Homo sapiens
agccaucaugugccuggaa

SEQ ID NO: 910169 - RNA, 12 nt, Homo sapiens
agccauccauga

SEQ ID NO: 910170 - RNA, 23 nt, Homo sapiens
agccauggcuucgucauuugcaa

SEQ ID NO: 910171 - RNA, 15 nt, Homo sapiens
agccauggugacaca

SEQ ID NO: 910172 - RNA, 22 nt, Homo sapiens
agccauuuguuggggcaguggu

SEQ ID NO: 910173 - RNA, 17 nt, Homo sapiens
agcccaauguaaugcau

SEQ ID NO: 910174 - RNA, 15 nt, Homo sapiens
agcccagauggaaag

SEQ ID NO: 910175 - RNA, 21 nt, Homo sapiens
agcccagccuagcgugcccug

SEQ ID NO: 910176 - RNA, 16 nt, Homo sapiens
agcccagggcacuuca

SEQ ID NO: 910177 - RNA, 18 nt, Homo sapiens
agcccagugugggacuga

SEQ ID NO: 910178 - RNA, 19 nt, Homo sapiens
agccccacagcacccaggc

SEQ ID NO: 910179 - RNA, 19 nt, Homo sapiens
agccccccacaaugaugau

SEQ ID NO: 910180 - RNA, 13 nt, Homo sapiens
agccccgacucca

SEQ ID NO: 910181 - RNA, 20 nt, Homo sapiens
agccccggcugacaccugga

SEQ ID NO: 910182 - RNA, 15 nt, Homo sapiens
agccccugguccuga

SEQ ID NO: 910183 - RNA, 20 nt, Homo sapiens
agccccuuacuaugaucuca

SEQ ID NO: 910184 - RNA, 22 nt, Homo sapiens
agccccuuacuaugaucucagg

SEQ ID NO: 910185 - RNA, 23 nt, Homo sapiens
agccccuuacuaugaucucagga

SEQ ID NO: 910186 - RNA, 14 nt, Homo sapiens
agcccgaagcccag

SEQ ID NO: 910187 - RNA, 21 nt, Homo sapiens
agcccgggacagggucuugca

SEQ ID NO: 910188 - RNA, 20 nt, Homo sapiens
agcccucaggccagugccag

SEQ ID NO: 910189 - RNA, 19 nt, Homo sapiens
agcccucccccagcaguug

SEQ ID NO: 910190 - RNA, 20 nt, Homo sapiens
agcccucgaaccaaggcagc

SEQ ID NO: 910191 - RNA, 13 nt, Homo sapiens
agcccugacuggu

SEQ ID NO: 910192 - RNA, 14 nt, Homo sapiens
agcccuuuacuuga

SEQ ID NO: 910193 - RNA, 21 nt, Homo sapiens
agccgagaucacgccacugca

SEQ ID NO: 910194 - RNA, 14 nt, Homo sapiens
agccgagauugcac

SEQ ID NO: 910195 - RNA, 21 nt, Homo sapiens
agccgagauugcaccacugca

SEQ ID NO: 910196 - RNA, 12 nt, Homo sapiens
agccgcugugag

SEQ ID NO: 910197 - RNA, 16 nt, Homo sapiens
agccgcuucugacugc

SEQ ID NO: 910198 - RNA, 14 nt, Homo sapiens
agccggccggcugg

SEQ ID NO: 910199 - RNA, 15 nt, Homo sapiens
agccguccauggcac

SEQ ID NO: 910200 - RNA, 15 nt, Homo sapiens
agccgugaugcucag

SEQ ID NO: 910201 - RNA, 13 nt, Homo sapiens
agccgugcacucc

SEQ ID NO: 910202 - RNA, 17 nt, Homo sapiens
agccgugucguaugacc

SEQ ID NO: 910203 - RNA, 13 nt, Homo sapiens
agccuacugccuc

SEQ ID NO: 910204 - RNA, 18 nt, Homo sapiens
agccuacugccucuccag

SEQ ID NO: 910205 - RNA, 17 nt, Homo sapiens
agccuagccgaccucag

SEQ ID NO: 910206 - RNA, 21 nt, Homo sapiens
agccucccccucagaugaucu

SEQ ID NO: 910207 - RNA, 19 nt, Homo sapiens
agccucccgaguagcugag

SEQ ID NO: 910208 - RNA, 18 nt, Homo sapiens
agccucccgaguagcugg

SEQ ID NO: 910209 - RNA, 20 nt, Homo sapiens
agccuccuaauuugaucaca

SEQ ID NO: 910210 - RNA, 14 nt, Homo sapiens
agccuccugaccug

SEQ ID NO: 910211 - RNA, 21 nt, Homo sapiens
agccucuccuugccuggugac

SEQ ID NO: 910212 - RNA, 23 nt, Homo sapiens
agccugaaugucuuacugugauc

SEQ ID NO: 910213 - RNA, 19 nt, Homo sapiens
agccugaauuuuguugcug

SEQ ID NO: 910214 - RNA, 16 nt, Homo sapiens
agccugacuguguuca

SEQ ID NO: 910215 - RNA, 16 nt, Homo sapiens
agccugagucacuggu

SEQ ID NO: 910216 - RNA, 22 nt, Homo sapiens
agccugauuauccuauaggcag

SEQ ID NO: 910217 - RNA, 23 nt, Homo sapiens
agccugcaaacucacugcucaag

SEQ ID NO: 910218 - RNA, 16 nt, Homo sapiens
agccugcagacucacu

SEQ ID NO: 910219 - RNA, 18 nt, Homo sapiens
agccuggaagccaaacaa

SEQ ID NO: 910220 - RNA, 22 nt, Homo sapiens
agccuggagggaugccacccag

SEQ ID NO: 910221 - RNA, 16 nt, Homo sapiens
agccuggccaacaugg

SEQ ID NO: 910222 - RNA, 20 nt, Homo sapiens
agccuggcuauacagugcau

SEQ ID NO: 910223 - RNA, 18 nt, Homo sapiens
agccugggcagcauagca

SEQ ID NO: 910224 - RNA, 22 nt, Homo sapiens
agcuuucagagccagugaagga

SEQ ID NO: 910225 - RNA, 21 nt, Homo sapiens
agcuuucuucuacaaccagag

SEQ ID NO: 910226 - RNA, 20 nt, Homo sapiens
agcuuuugaggggcugacuu

SEQ ID NO: 910227 - RNA, 17 nt, Homo sapiens
aggaaaaggccuggggu

SEQ ID NO: 910228 - RNA, 15 nt, Homo sapiens
aggaaaccuuuucau

SEQ ID NO: 910229 - RNA, 21 nt, Homo sapiens
aggaaaccuuuucaugccuuu

SEQ ID NO: 910230 - RNA, 18 nt, Homo sapiens
aggaaagcaccgcagcau

SEQ ID NO: 910231 - RNA, 14 nt, Homo sapiens
aggaaagcccuccc

SEQ ID NO: 910232 - RNA, 12 nt, Homo sapiens
aggaaagggauu

SEQ ID NO: 910233 - RNA, 18 nt, Homo sapiens
aggaaaggggcgagcacc

SEQ ID NO: 910234 - RNA, 19 nt, Homo sapiens
aggaaauggagaagcucug

SEQ ID NO: 910235 - RNA, 23 nt, Homo sapiens
aggaacacccggaaagacugaaa

SEQ ID NO: 910236 - RNA, 12 nt, Homo sapiens
aggaacaggugg

SEQ ID NO: 910237 - RNA, 22 nt, Homo sapiens
aggaaccaaccaacaaacaaug

SEQ ID NO: 910238 - RNA, 22 nt, Homo sapiens
aggaacccuuuuccuccagaca

SEQ ID NO: 910239 - RNA, 11 nt, Homo sapiens
aggaaccuaau

SEQ ID NO: 910240 - RNA, 16 nt, Homo sapiens
aggaagaaaaccagcg

SEQ ID NO: 910241 - RNA, 13 nt, Homo sapiens
aggaagaacaaau

SEQ ID NO: 910242 - RNA, 15 nt, Homo sapiens
aggaagaagccagac

SEQ ID NO: 910243 - RNA, 22 nt, Homo sapiens
acugugcugggaacauguacca

SEQ ID NO: 910244 - RNA, 14 nt, Homo sapiens
acuguggccuggca

SEQ ID NO: 910245 - RNA, 22 nt, Homo sapiens
acuguggcugcuagcacuugga

SEQ ID NO: 910246 - RNA, 19 nt, Homo sapiens
acugugugaagaaauggaa

SEQ ID NO: 910247 - RNA, 13 nt, Homo sapiens
acuguuccaaaaa

SEQ ID NO: 910248 - RNA, 20 nt, Homo sapiens
acuuaaaaaauguccaugau

SEQ ID NO: 910249 - RNA, 14 nt, Homo sapiens
acuuaaaagauuca

SEQ ID NO: 910250 - RNA, 13 nt, Homo sapiens
acuuaacauucug

SEQ ID NO: 910251 - RNA, 17 nt, Homo sapiens
acuuaacauugauuuau

SEQ ID NO: 910252 - RNA, 16 nt, Homo sapiens
acuuaaguggcauuaa

SEQ ID NO: 910253 - RNA, 18 nt, Homo sapiens
acuuaccuagauuuacag

SEQ ID NO: 910254 - RNA, 22 nt, Homo sapiens
acuuagaaauugcauuuccuga

SEQ ID NO: 910255 - RNA, 21 nt, Homo sapiens
acuuauuaugaggcuauuaaa

SEQ ID NO: 910256 - RNA, 19 nt, Homo sapiens
acuuauugucuaggccaga

SEQ ID NO: 910257 - RNA, 15 nt, Homo sapiens
acuuauuucauaaac

SEQ ID NO: 910258 - RNA, 19 nt, Homo sapiens
acuuauuucauaaacaacu

SEQ ID NO: 910259 - RNA, 17 nt, Homo sapiens
acuucacaaaaugcaag

SEQ ID NO: 910260 - RNA, 14 nt, Homo sapiens
acuucacacacagg

SEQ ID NO: 910261 - RNA, 18 nt, Homo sapiens
acuucacuuuaauucuca

SEQ ID NO: 910262 - RNA, 17 nt, Homo sapiens
acuucaguugcuuugca

SEQ ID NO: 910263 - RNA, 23 nt, Homo sapiens
acuucauucagaccagugaaaga

SEQ ID NO: 910264 - RNA, 13 nt, Homo sapiens
acuuccacauuau

SEQ ID NO: 910265 - RNA, 12 nt, Homo sapiens
acuuccauuccc

SEQ ID NO: 910266 - RNA, 14 nt, Homo sapiens
acuucccuaaugaa

SEQ ID NO: 910267 - RNA, 16 nt, Homo sapiens
acuucccuaaugaagu

SEQ ID NO: 910268 - RNA, 17 nt, Homo sapiens
acuucccuuuccuccac

SEQ ID NO: 910269 - RNA, 14 nt, Homo sapiens
acuuccuaaugauu

SEQ ID NO: 910270 - RNA, 21 nt, Homo sapiens
acuuccuuggacucauuuuaa

SEQ ID NO: 910271 - RNA, 18 nt, Homo sapiens
acuucgacucaggaucca

SEQ ID NO: 910272 - RNA, 23 nt, Homo sapiens
acuucuaacuagaaaucugccaa

SEQ ID NO: 910273 - RNA, 15 nt, Homo sapiens
acuucucuuucuuau

SEQ ID NO: 910274 - RNA, 17 nt, Homo sapiens
acuucugagaccuuguu

SEQ ID NO: 910275 - RNA, 23 nt, Homo sapiens
acuucuuaaaaguugugauucca

SEQ ID NO: 910276 - RNA, 18 nt, Homo sapiens
acuucuucugguccuuca

SEQ ID NO: 910277 - RNA, 17 nt, Homo sapiens
acuugaaauaccaguga

SEQ ID NO: 910278 - RNA, 22 nt, Homo sapiens
acuugaaauaccagugaaccaa

SEQ ID NO: 910279 - RNA, 23 nt, Homo sapiens
acuugaaauaccagugaaccaaa

SEQ ID NO: 910280 - RNA, 17 nt, Homo sapiens
acuugaaauuugccuug

SEQ ID NO: 910281 - RNA, 13 nt, Homo sapiens
acuugaacccagg

SEQ ID NO: 910282 - RNA, 22 nt, Homo sapiens
acuugaacugauucacaucuca

SEQ ID NO: 910283 - RNA, 12 nt, Homo sapiens
acuugacagugg

SEQ ID NO: 910284 - RNA, 23 nt, Homo sapiens
acuugaggacacauguccagugg

SEQ ID NO: 910285 - RNA, 21 nt, Homo sapiens
acuugaugacagacacuucua

SEQ ID NO: 910286 - RNA, 17 nt, Homo sapiens
acuugcagauacauuca

SEQ ID NO: 910287 - RNA, 16 nt, Homo sapiens
acuugccacacacugu

SEQ ID NO: 910288 - RNA, 13 nt, Homo sapiens
acuugcccugcca

SEQ ID NO: 910289 - RNA, 14 nt, Homo sapiens
acuugcguccugca

SEQ ID NO: 910290 - RNA, 20 nt, Homo sapiens
acuugcugaauuucaggcau

SEQ ID NO: 910291 - RNA, 23 nt, Homo sapiens
acuugcugcugagugcaccacuu

SEQ ID NO: 910292 - RNA, 13 nt, Homo sapiens
acuuggcugcuca

SEQ ID NO: 910293 - RNA, 18 nt, Homo sapiens
acuugguuuuuggcucuu

SEQ ID NO: 910294 - RNA, 18 nt, Homo sapiens
acuugucuuacauaauca

SEQ ID NO: 910295 - RNA, 22 nt, Homo sapiens
acuugugcugaucgugcuaaau

SEQ ID NO: 910296 - RNA, 22 nt, Homo sapiens
acuuguguccccaccucaggcu

SEQ ID NO: 910297 - RNA, 16 nt, Homo sapiens
acuugugucuguccaa

SEQ ID NO: 910298 - RNA, 19 nt, Homo sapiens
acuuuaaagcguuugcaca

SEQ ID NO: 910299 - RNA, 19 nt, Homo sapiens
acuuuaaauucaagcugcu

SEQ ID NO: 910300 - RNA, 14 nt, Homo sapiens
acuuuaauucucau

SEQ ID NO: 910301 - RNA, 21 nt, Homo sapiens
acuuuaucaaagagaaguuac

SEQ ID NO: 910302 - RNA, 18 nt, Homo sapiens
acuuuauguuacuacaug

SEQ ID NO: 910303 - RNA, 20 nt, Homo sapiens
acuuucagguacuaaauacc

SEQ ID NO: 910304 - RNA, 17 nt, Homo sapiens
acuuucccacagcacua

SEQ ID NO: 910305 - RNA, 22 nt, Homo sapiens
acuuuccuauuuucuuuuccau

SEQ ID NO: 910306 - RNA, 21 nt, Homo sapiens
acuuugccucugaaacuuaau

SEQ ID NO: 910307 - RNA, 19 nt, Homo sapiens
acuuuggcuucuccuguga

SEQ ID NO: 910308 - RNA, 14 nt, Homo sapiens
acuuuguguucacc

SEQ ID NO: 910309 - RNA, 18 nt, Homo sapiens
acuuuguguuuucaucuc

SEQ ID NO: 910310 - RNA, 17 nt, Homo sapiens
acuuuuaaguugcugau

SEQ ID NO: 910311 - RNA, 22 nt, Homo sapiens
acuuuuaaguugcugaugaacu

SEQ ID NO: 910312 - RNA, 20 nt, Homo sapiens
acuuuuaaugccuuccacau

SEQ ID NO: 910313 - RNA, 21 nt, Homo sapiens
acuuuucuuuccucagaucau

SEQ ID NO: 910314 - RNA, 20 nt, Homo sapiens
acuuuugugcuccccuuugc

SEQ ID NO: 910315 - RNA, 13 nt, Homo sapiens
acuuuuuauucaa

SEQ ID NO: 910316 - RNA, 22 nt, Homo sapiens
acuuuuuucuuauuuaacuuaa

SEQ ID NO: 910317 - RNA, 12 nt, Homo sapiens
agaaaaaagaga

SEQ ID NO: 910318 - RNA, 13 nt, Homo sapiens
agaaaaaccaaug

SEQ ID NO: 910319 - RNA, 19 nt, Homo sapiens
agaaaaaguugcagucuca

SEQ ID NO: 910320 - RNA, 14 nt, Homo sapiens
agaaaacaugacuu

SEQ ID NO: 910321 - RNA, 12 nt, Homo sapiens
agaaaaccagcg

SEQ ID NO: 910322 - RNA, 16 nt, Homo sapiens
agaaaacgaacuggga

SEQ ID NO: 910323 - RNA, 15 nt, Homo sapiens
agaaaaucaguaauu

SEQ ID NO: 910324 - RNA, 16 nt, Homo sapiens
agaaaaucaguaauug

SEQ ID NO: 910325 - RNA, 18 nt, Homo sapiens
agaaaaucaguaauugga

SEQ ID NO: 910326 - RNA, 16 nt, Homo sapiens
agaaaaugaagcccua

SEQ ID NO: 910327 - RNA, 22 nt, Homo sapiens
agaaaaugaagcccuauuacuu

SEQ ID NO: 910328 - RNA, 15 nt, Homo sapiens
agaaaauuaguaauu

SEQ ID NO: 910329 - RNA, 18 nt, Homo sapiens
agaaaauuaguaauugua

SEQ ID NO: 910330 - RNA, 16 nt, Homo sapiens
agaaaauuggauguuu

SEQ ID NO: 910331 - RNA, 21 nt, Homo sapiens
agaaacacaaauguaaaauaa

SEQ ID NO: 910332 - RNA, 12 nt, Homo sapiens
agaaacaugaca

SEQ ID NO: 910333 - RNA, 20 nt, Homo sapiens
agaaacaugacacugaccuu

SEQ ID NO: 910334 - RNA, 16 nt, Homo sapiens
agaaaccagagucaaa

SEQ ID NO: 910335 - RNA, 20 nt, Homo sapiens
agaaaccuuauuguaccucu

SEQ ID NO: 910336 - RNA, 13 nt, Homo sapiens
agaaacucaccau

SEQ ID NO: 910337 - RNA, 12 nt, Homo sapiens
agaaacuuccuu

SEQ ID NO: 910338 - RNA, 16 nt, Homo sapiens
agaaagaaacacucaa

SEQ ID NO: 910339 - RNA, 23 nt, Homo sapiens
agaaagacuauucaaacagucuc

SEQ ID NO: 910340 - RNA, 14 nt, Homo sapiens
agaaagaggcagug

SEQ ID NO: 910341 - RNA, 19 nt, Homo sapiens
agaaagccuucauaagccu

SEQ ID NO: 910342 - RNA, 22 nt, Homo sapiens
agaaaguacuucuccacccugc

SEQ ID NO: 910343 - RNA, 20 nt, Homo sapiens
agaaagucauagauuucuga

SEQ ID NO: 910344 - RNA, 15 nt, Homo sapiens
agaaauaaacuuugg

SEQ ID NO: 910345 - RNA, 14 nt, Homo sapiens
agaaauaggacaau

SEQ ID NO: 910346 - RNA, 20 nt, Homo sapiens
agaaauaggacaauucacuu

SEQ ID NO: 910347 - RNA, 22 nt, Homo sapiens
agaaauaggaccuuccacacag

SEQ ID NO: 910348 - RNA, 15 nt, Homo sapiens
agaaauauauauaca

SEQ ID NO: 910349 - RNA, 20 nt, Homo sapiens
agaaaucauggcauucacac

SEQ ID NO: 910350 - RNA, 13 nt, Homo sapiens
agaaauccauaac

SEQ ID NO: 910351 - RNA, 15 nt, Homo sapiens
acagaccaccugcuu

SEQ ID NO: 910352 - RNA, 13 nt, Homo sapiens
acagacgucucaa

SEQ ID NO: 910353 - RNA, 17 nt, Homo sapiens
acagacuacagccagaa

SEQ ID NO: 910354 - RNA, 22 nt, Homo sapiens
acagacuauuaaaacuaauaau

SEQ ID NO: 910355 - RNA, 22 nt, Homo sapiens
acagacuauuccccaccugcuu

SEQ ID NO: 910356 - RNA, 22 nt, Homo sapiens
acagacugugaguacagcagaa

SEQ ID NO: 910357 - RNA, 17 nt, Homo sapiens
acagagaaaagacauaa

SEQ ID NO: 910358 - RNA, 13 nt, Homo sapiens
acagagacagaga

SEQ ID NO: 910359 - RNA, 18 nt, Homo sapiens
acagagaggaguugccag

SEQ ID NO: 910360 - RNA, 14 nt, Homo sapiens
acagagauaugcac

SEQ ID NO: 910361 - RNA, 15 nt, Homo sapiens
acagagauaugcaca

SEQ ID NO: 910362 - RNA, 20 nt, Homo sapiens
acagagcaagacucugucuc

SEQ ID NO: 910363 - RNA, 21 nt, Homo sapiens
acagagcaaugguagcaaaac

SEQ ID NO: 910364 - RNA, 18 nt, Homo sapiens
acagaggaagagcaggca

SEQ ID NO: 910365 - RNA, 23 nt, Homo sapiens
acagagggggccuucacagugac

SEQ ID NO: 910366 - RNA, 24 nt, Homo sapiens
acagagguggcugcugugcuagug

SEQ ID NO: 910367 - RNA, 14 nt, Homo sapiens
acagaguucacuau

SEQ ID NO: 910368 - RNA, 12 nt, Homo sapiens
acagauaaaaca

SEQ ID NO: 910369 - RNA, 13 nt, Homo sapiens
acagauaccccac

SEQ ID NO: 910370 - RNA, 21 nt, Homo sapiens
acagauagacagugcugcccu

SEQ ID NO: 910371 - RNA, 12 nt, Homo sapiens
acagauaugcac

SEQ ID NO: 910372 - RNA, 19 nt, Homo sapiens
acagaugcacacacaccga

SEQ ID NO: 910373 - RNA, 17 nt, Homo sapiens
acagaugcccccgugaa

SEQ ID NO: 910374 - RNA, 20 nt, Homo sapiens
acagauggauagucugucca

SEQ ID NO: 910375 - RNA, 15 nt, Homo sapiens
acagauguaaaugcc

SEQ ID NO: 910376 - RNA, 17 nt, Homo sapiens
acagauguaaaugccac

SEQ ID NO: 910377 - RNA, 19 nt, Homo sapiens
acagcaaaacuccaucuca

SEQ ID NO: 910378 - RNA, 20 nt, Homo sapiens
acagcaaaacuccaucucaa

SEQ ID NO: 910379 - RNA, 14 nt, Homo sapiens
acagcaaaagaaga

SEQ ID NO: 910380 - RNA, 18 nt, Homo sapiens
acagcagauacuuuguca

SEQ ID NO: 910381 - RNA, 15 nt, Homo sapiens
acagcagcaucuuca

SEQ ID NO: 910382 - RNA, 18 nt, Homo sapiens
acagccaacaaacauaga

SEQ ID NO: 910383 - RNA, 20 nt, Homo sapiens
acagccagacuggcacaguu

SEQ ID NO: 910384 - RNA, 19 nt, Homo sapiens
acagccagguuagccuuug

SEQ ID NO: 910385 - RNA, 21 nt, Homo sapiens
acagccauuauaaaaaauuaa

SEQ ID NO: 910386 - RNA, 15 nt, Homo sapiens
acagccucagaggca

SEQ ID NO: 910387 - RNA, 17 nt, Homo sapiens
acagccugagccaaggc

SEQ ID NO: 910388 - RNA, 21 nt, Homo sapiens
acagcggaggagaccagcuca

SEQ ID NO: 910389 - RNA, 19 nt, Homo sapiens
acagcucagagaugaaacu

SEQ ID NO: 910390 - RNA, 13 nt, Homo sapiens
acagcucucaccu

SEQ ID NO: 910391 - RNA, 13 nt, Homo sapiens
acaggacucugcc

SEQ ID NO: 910392 - RNA, 16 nt, Homo sapiens
acaggagacccagaga

SEQ ID NO: 910393 - RNA, 21 nt, Homo sapiens
acaggcaacugaggcagacag

SEQ ID NO: 910394 - RNA, 14 nt, Homo sapiens
acaggcaagcaccu

SEQ ID NO: 910395 - RNA, 13 nt, Homo sapiens
acaggcacccacc

SEQ ID NO: 910396 - RNA, 18 nt, Homo sapiens
acaggccauacuuuacaa

SEQ ID NO: 910397 - RNA, 16 nt, Homo sapiens
acaggccauccauuca

SEQ ID NO: 910398 - RNA, 14 nt, Homo sapiens
acaggcccaagaga

SEQ ID NO: 910399 - RNA, 19 nt, Homo sapiens
acaggcccggcuccaggcu

SEQ ID NO: 910400 - RNA, 21 nt, Homo sapiens
acaggcccuuccucuccacug

SEQ ID NO: 910401 - RNA, 22 nt, Homo sapiens
acaggcuaguucuaauucccua

SEQ ID NO: 910402 - RNA, 21 nt, Homo sapiens
acaggcuguucugcacugaaa

SEQ ID NO: 910403 - RNA, 22 nt, Homo sapiens
acaggcuguucugcacugaaaa

SEQ ID NO: 910404 - RNA, 20 nt, Homo sapiens
acagggaacaagcauucucc

SEQ ID NO: 910405 - RNA, 15 nt, Homo sapiens
acagggaggugaccc

SEQ ID NO: 910406 - RNA, 18 nt, Homo sapiens
acaggguauuaauaugcu

SEQ ID NO: 910407 - RNA, 21 nt, Homo sapiens
acagggucuaccucugucacc

SEQ ID NO: 910408 - RNA, 18 nt, Homo sapiens
acagggucucacuauguu

SEQ ID NO: 910409 - RNA, 21 nt, Homo sapiens
acaggguuuuguauucuuuac

SEQ ID NO: 910410 - RNA, 15 nt, Homo sapiens
acagguacagcaaca

SEQ ID NO: 910411 - RNA, 13 nt, Homo sapiens
acaggugccucac

SEQ ID NO: 910412 - RNA, 19 nt, Homo sapiens
acagguuuucagcaacuca

SEQ ID NO: 910413 - RNA, 12 nt, Homo sapiens
acaguaaaucac

SEQ ID NO: 910414 - RNA, 13 nt, Homo sapiens
acaguacuaugua

SEQ ID NO: 910415 - RNA, 13 nt, Homo sapiens
acagucauucaca

SEQ ID NO: 910416 - RNA, 14 nt, Homo sapiens
acagucucaagcac

SEQ ID NO: 910417 - RNA, 13 nt, Homo sapiens
acagucucaggaa

SEQ ID NO: 910418 - RNA, 14 nt, Homo sapiens
acagucucugggag

SEQ ID NO: 910419 - RNA, 14 nt, Homo sapiens
acagucuugcauuc

SEQ ID NO: 910420 - RNA, 16 nt, Homo sapiens
acagugaccaucgcaa

SEQ ID NO: 910421 - RNA, 14 nt, Homo sapiens
acagugagcugaug

SEQ ID NO: 910422 - RNA, 21 nt, Homo sapiens
acagugagucgaggacaggga

SEQ ID NO: 910423 - RNA, 17 nt, Homo sapiens
acagugagugaccccag

SEQ ID NO: 910424 - RNA, 17 nt, Homo sapiens
acagugcccagcuaauu

SEQ ID NO: 910425 - RNA, 19 nt, Homo sapiens
acaguguauguacuaagca

SEQ ID NO: 910426 - RNA, 19 nt, Homo sapiens
acaguguugaaaauguuca

SEQ ID NO: 910427 - RNA, 13 nt, Homo sapiens
acaguugccaugu

SEQ ID NO: 910428 - RNA, 13 nt, Homo sapiens
acaguugugagau

SEQ ID NO: 910429 - RNA, 24 nt, Homo sapiens
acaguuuugaaagaaaaauaccau

SEQ ID NO: 910430 - RNA, 15 nt, Homo sapiens
acauaaacacauaca

SEQ ID NO: 910431 - RNA, 19 nt, Homo sapiens
acauaaacacauacauugc

SEQ ID NO: 910432 - RNA, 21 nt, Homo sapiens
acauaaauuuaucaucucgac

SEQ ID NO: 910433 - RNA, 22 nt, Homo sapiens
acauaacacuauaaagguugac

SEQ ID NO: 910434 - RNA, 21 nt, Homo sapiens
acauaagacagacagcaguuu

SEQ ID NO: 910435 - RNA, 19 nt, Homo sapiens
acauaagcaaagacuauga

SEQ ID NO: 910436 - RNA, 22 nt, Homo sapiens
acauaccucucucuauauauac

SEQ ID NO: 910437 - RNA, 19 nt, Homo sapiens
acauacgaaacacaaacca

SEQ ID NO: 910438 - RNA, 16 nt, Homo sapiens
acauagagauaugcac

SEQ ID NO: 910439 - RNA, 18 nt, Homo sapiens
acauagagauaugcacac

SEQ ID NO: 910440 - RNA, 13 nt, Homo sapiens
acauagagaucua

SEQ ID NO: 910441 - RNA, 19 nt, Homo sapiens
acauagauuaauggcacug

SEQ ID NO: 910442 - RNA, 21 nt, Homo sapiens
acauagauuaauggcacugau

SEQ ID NO: 910443 - RNA, 16 nt, Homo sapiens
acauauaggagcaaua

SEQ ID NO: 910444 - RNA, 13 nt, Homo sapiens
acauaucugucau

SEQ ID NO: 910445 - RNA, 16 nt, Homo sapiens
acauauggacucugca

SEQ ID NO: 910446 - RNA, 17 nt, Homo sapiens
acauauggacucugcac

SEQ ID NO: 910447 - RNA, 23 nt, Homo sapiens
acauauucuuggagaacuuucca

SEQ ID NO: 910448 - RNA, 15 nt, Homo sapiens
acauauuuguuaaau

SEQ ID NO: 910449 - RNA, 14 nt, Homo sapiens
acaucaaauuugcc

SEQ ID NO: 910450 - RNA, 21 nt, Homo sapiens
acaucacuacaguacagugag

SEQ ID NO: 910451 - RNA, 20 nt, Homo sapiens
acaucacuuguacaaaauaa

SEQ ID NO: 910452 - RNA, 14 nt, Homo sapiens
acaucagcagagaa

SEQ ID NO: 910453 - RNA, 15 nt, Homo sapiens
acaucaggaguucaa

SEQ ID NO: 910454 - RNA, 15 nt, Homo sapiens
acauccaaugcauag

SEQ ID NO: 910455 - RNA, 19 nt, Homo sapiens
acauccauguccuaugugu

SEQ ID NO: 910456 - RNA, 13 nt, Homo sapiens
acauccauuccca

SEQ ID NO: 910457 - RNA, 16 nt, Homo sapiens
acaucccaagccagaa

SEQ ID NO: 910458 - RNA, 13 nt, Homo sapiens
acaucccacagug

SEQ ID NO: 910459 - RNA, 14 nt, Homo sapiens
acaucccacagugg

SEQ ID NO: 910460 - RNA, 16 nt, Homo sapiens
acauccccagccagaa

SEQ ID NO: 910461 - RNA, 14 nt, Homo sapiens
aauauucauuguau

SEQ ID NO: 910462 - RNA, 17 nt, Homo sapiens
aauauuuaaacuucuug

SEQ ID NO: 910463 - RNA, 19 nt, Homo sapiens
aauauuuuuaugugcaaua

SEQ ID NO: 910464 - RNA, 13 nt, Homo sapiens
aaucaaacugcaa

SEQ ID NO: 910465 - RNA, 14 nt, Homo sapiens
aaucaagagugagu

SEQ ID NO: 910466 - RNA, 20 nt, Homo sapiens
aaucaagcuagaaggccaca

SEQ ID NO: 910467 - RNA, 12 nt, Homo sapiens
aaucaauguuca

SEQ ID NO: 910468 - RNA, 22 nt, Homo sapiens
aaucaccaauaaauaagugcau

SEQ ID NO: 910469 - RNA, 22 nt, Homo sapiens
aaucacuugcacuccggaggua

SEQ ID NO: 910470 - RNA, 20 nt, Homo sapiens
aaucagacuucacacugcaa

SEQ ID NO: 910471 - RNA, 19 nt, Homo sapiens
aaucagcacauuccuccua

SEQ ID NO: 910472 - RNA, 18 nt, Homo sapiens
aaucagcugcuacaagaa

SEQ ID NO: 910473 - RNA, 16 nt, Homo sapiens
aaucagucuaccaagg

SEQ ID NO: 910474 - RNA, 14 nt, Homo sapiens
aauguugggagaaa

SEQ ID NO: 910475 - RNA, 11 nt, Homo sapiens
aauuaaagccc

SEQ ID NO: 910476 - RNA, 15 nt, Homo sapiens
aauuaaagucuucca

SEQ ID NO: 910477 - RNA, 19 nt, Homo sapiens
aauuaaaugcauguccuca

SEQ ID NO: 910478 - RNA, 12 nt, Homo sapiens
aauuaacacugc

SEQ ID NO: 910479 - RNA, 13 nt, Homo sapiens
aauuaacuaugug

SEQ ID NO: 910480 - RNA, 17 nt, Homo sapiens
aauuaagagauacauuc

SEQ ID NO: 910481 - RNA, 14 nt, Homo sapiens
aauuaagguuugcc

SEQ ID NO: 910482 - RNA, 20 nt, Homo sapiens
aauuaaguaaauuacauuaa

SEQ ID NO: 910483 - RNA, 14 nt, Homo sapiens
aauuaagugcaauu

SEQ ID NO: 910484 - RNA, 22 nt, Homo sapiens
aauuacuucucucuaucuggaa

SEQ ID NO: 910485 - RNA, 14 nt, Homo sapiens
aauuagaugaacuc

SEQ ID NO: 910486 - RNA, 23 nt, Homo sapiens
aauuagcaauugacugucacugu

SEQ ID NO: 910487 - RNA, 18 nt, Homo sapiens
aauuagguuuuguacaau

SEQ ID NO: 910488 - RNA, 21 nt, Homo sapiens
aauuauacuguagcugaugaa

SEQ ID NO: 910489 - RNA, 15 nt, Homo sapiens
aauuaugagucucua

SEQ ID NO: 910490 - RNA, 18 nt, Homo sapiens
aauuauuaugucucaaaa

SEQ ID NO: 910491 - RNA, 12 nt, Homo sapiens
aauucaaccacu

SEQ ID NO: 910492 - RNA, 19 nt, Homo sapiens
aauucaacuaguaccacag

SEQ ID NO: 910493 - RNA, 14 nt, Homo sapiens
aauucaagccuuag

SEQ ID NO: 910494 - RNA, 23 nt, Homo sapiens
aauucaaugacagggaugccaac

SEQ ID NO: 910495 - RNA, 15 nt, Homo sapiens
aauucacuuaggguc

SEQ ID NO: 910496 - RNA, 16 nt, Homo sapiens
aauucagaacauccuc

SEQ ID NO: 910497 - RNA, 19 nt, Homo sapiens
aauucagcacugauuucac

SEQ ID NO: 910498 - RNA, 17 nt, Homo sapiens
aauucaucucucuuuaa

SEQ ID NO: 910499 - RNA, 23 nt, Homo sapiens
aauucauucucugugguauccaa

SEQ ID NO: 910500 - RNA, 20 nt, Homo sapiens
aauuccacagucucugggag

SEQ ID NO: 910501 - RNA, 15 nt, Homo sapiens
aauucccagcugucu

SEQ ID NO: 910502 - RNA, 14 nt, Homo sapiens
aauuccuggcauga

SEQ ID NO: 910503 - RNA, 18 nt, Homo sapiens
aauuccuguagcaucuuc

SEQ ID NO: 910504 - RNA, 23 nt, Homo sapiens
aauuccuuagcuuagaccucagc

SEQ ID NO: 910505 - RNA, 15 nt, Homo sapiens
aauucuacuaaauau

SEQ ID NO: 910506 - RNA, 22 nt, Homo sapiens
aauucucagucaguaauugcca

SEQ ID NO: 910507 - RNA, 21 nt, Homo sapiens
aauucuccugccucagccucc

SEQ ID NO: 910508 - RNA, 17 nt, Homo sapiens
aauucucucucuugcag

SEQ ID NO: 910509 - RNA, 22 nt, Homo sapiens
aauucugagcuggcccuuucca

SEQ ID NO: 910510 - RNA, 17 nt, Homo sapiens
aauucuggaaaugucuu

SEQ ID NO: 910511 - RNA, 22 nt, Homo sapiens
aauucuuauuuuuuaaaaagcu

SEQ ID NO: 910512 - RNA, 19 nt, Homo sapiens
aauugaagauguaaggaau

SEQ ID NO: 910513 - RNA, 22 nt, Homo sapiens
aauugacugagacuggaaauau

SEQ ID NO: 910514 - RNA, 17 nt, Homo sapiens
aauugagaaacaugaau

SEQ ID NO: 910515 - RNA, 14 nt, Homo sapiens
aauugauguugcug

SEQ ID NO: 910516 - RNA, 10 nt, Homo sapiens
aauugcacaa

SEQ ID NO: 910517 - RNA, 11 nt, Homo sapiens
aauugcacaau

SEQ ID NO: 910518 - RNA, 18 nt, Homo sapiens
aauugcggggcccaccuu

SEQ ID NO: 910519 - RNA, 22 nt, Homo sapiens
aauugcguucuaagaggugaag

SEQ ID NO: 910520 - RNA, 13 nt, Homo sapiens
aauugcuacauag

SEQ ID NO: 910521 - RNA, 17 nt, Homo sapiens
aauugcuacauagucca

SEQ ID NO: 910522 - RNA, 12 nt, Homo sapiens
aauugugcaaau

SEQ ID NO: 910523 - RNA, 14 nt, Homo sapiens
aauugugugucuuc

SEQ ID NO: 910524 - RNA, 11 nt, Homo sapiens
aauuguugcua

SEQ ID NO: 910525 - RNA, 15 nt, Homo sapiens
aauuuaaaaucauuc

SEQ ID NO: 910526 - RNA, 12 nt, Homo sapiens
aauuuaaccuac

SEQ ID NO: 910527 - RNA, 13 nt, Homo sapiens
aauuuacagagcc

SEQ ID NO: 910528 - RNA, 14 nt, Homo sapiens
aauuuaggaccaau

SEQ ID NO: 910529 - RNA, 18 nt, Homo sapiens
aauuuauucaauuccucu

SEQ ID NO: 910530 - RNA, 15 nt, Homo sapiens
aauuuauuucaaaaa

SEQ ID NO: 910531 - RNA, 20 nt, Homo sapiens
aauuuauuucaaaaagggaa

SEQ ID NO: 910532 - RNA, 17 nt, Homo sapiens
aauuucuaaaaaacaga

SEQ ID NO: 910533 - RNA, 19 nt, Homo sapiens
aauuucuaaaaaacagagg

SEQ ID NO: 910534 - RNA, 15 nt, Homo sapiens
aauuucucccaguca

SEQ ID NO: 910535 - RNA, 20 nt, Homo sapiens
aauuucucccagucauuuaa

SEQ ID NO: 910536 - RNA, 17 nt, Homo sapiens
aauuucuggaaaacugc

SEQ ID NO: 910537 - RNA, 15 nt, Homo sapiens
aauuucuuacuaaac

SEQ ID NO: 910538 - RNA, 14 nt, Homo sapiens
aauuugaaauuuag

SEQ ID NO: 910539 - RNA, 18 nt, Homo sapiens
aauuugacucaugaacua

SEQ ID NO: 910540 - RNA, 19 nt, Homo sapiens
aauuuguaauugcuuacau

SEQ ID NO: 910541 - RNA, 19 nt, Homo sapiens
aauuuguuuuauauucucu

SEQ ID NO: 910542 - RNA, 19 nt, Homo sapiens
aauuuuaaauuauaacuua

SEQ ID NO: 910543 - RNA, 13 nt, Homo sapiens
aauuuuaccaaaa

SEQ ID NO: 910544 - RNA, 18 nt, Homo sapiens
aauuuuaugugcuucaca

SEQ ID NO: 910545 - RNA, 15 nt, Homo sapiens
aauuuucaguauaau

SEQ ID NO: 910546 - RNA, 19 nt, Homo sapiens
aauuuucuuugcucugucu

SEQ ID NO: 910547 - RNA, 11 nt, Homo sapiens
aauuuuuccau

SEQ ID NO: 910548 - RNA, 21 nt, Homo sapiens
aauuuuuuaguauaaguacau

SEQ ID NO: 910549 - RNA, 23 nt, Homo sapiens
acaaaaaaguguucccuuuucaa

SEQ ID NO: 910550 - RNA, 20 nt, Homo sapiens
acaaaaaauaaaaacacuua

SEQ ID NO: 910551 - RNA, 14 nt, Homo sapiens
acaaaaacaacuua

SEQ ID NO: 910552 - RNA, 12 nt, Homo sapiens
acaaaaugcaag

SEQ ID NO: 910553 - RNA, 19 nt, Homo sapiens
acaaaauggagggagccau

SEQ ID NO: 910554 - RNA, 20 nt, Homo sapiens
acaaacacugaaucauguua

SEQ ID NO: 910555 - RNA, 12 nt, Homo sapiens
acaaacaugugg

SEQ ID NO: 910556 - RNA, 15 nt, Homo sapiens
acaaaccacuguaca

SEQ ID NO: 910557 - RNA, 11 nt, Homo sapiens
acaaacccagg

SEQ ID NO: 910558 - RNA, 18 nt, Homo sapiens
acaaaccugcuugucaau

SEQ ID NO: 910559 - RNA, 18 nt, Homo sapiens
acaaaccuuacuauggaa

SEQ ID NO: 910560 - RNA, 18 nt, Homo sapiens
acaaagccgugccuuucu

SEQ ID NO: 910561 - RNA, 16 nt, Homo sapiens
acaaagcgagauccca

SEQ ID NO: 910562 - RNA, 15 nt, Homo sapiens
acaaaggagccugug

SEQ ID NO: 910563 - RNA, 14 nt, Homo sapiens
acaaaggugaaaau

SEQ ID NO: 910564 - RNA, 12 nt, Homo sapiens
acaaauaaacuu

SEQ ID NO: 910565 - RNA, 23 nt, Homo sapiens
acaaauagucuaucaaccccaga

SEQ ID NO: 910566 - RNA, 15 nt, Homo sapiens
acaaauaugucaguu

SEQ ID NO: 910567 - RNA, 21 nt, Homo sapiens
acaaaucuucaagguguaaaa

SEQ ID NO: 910568 - RNA, 17 nt, Homo sapiens
acaaauuguacauuuga

SEQ ID NO: 910569 - RNA, 19 nt, Homo sapiens
acaaauuuuuuucuuguuu

SEQ ID NO: 910570 - RNA, 14 nt, Homo sapiens
acaacaaaccaaaa

SEQ ID NO: 910571 - RNA, 16 nt, Homo sapiens
acaacaggcauuccag

SEQ ID NO: 910572 - RNA, 14 nt, Homo sapiens
acaacauuuuauua

SEQ ID NO: 910573 - RNA, 22 nt, Homo sapiens
acaacauuuuugguguauuuga

SEQ ID NO: 910574 - RNA, 19 nt, Homo sapiens
acaaccaauuccaaguuuu

SEQ ID NO: 910575 - RNA, 22 nt, Homo sapiens
acaacguaaacuuccuaaugau

SEQ ID NO: 910576 - RNA, 17 nt, Homo sapiens
acaacuguuuuugaaga

SEQ ID NO: 910577 - RNA, 16 nt, Homo sapiens
acaacuuccacuccaa

SEQ ID NO: 910578 - RNA, 19 nt, Homo sapiens
acaacuugucuauuaccug

SEQ ID NO: 910579 - RNA, 18 nt, Homo sapiens
acaagaaggccacuggua

SEQ ID NO: 910580 - RNA, 13 nt, Homo sapiens
gaugggaucccag

SEQ ID NO: 910581 - RNA, 16 nt, Homo sapiens
gaugggcacaugagga

SEQ ID NO: 910582 - RNA, 14 nt, Homo sapiens
gauguaaaugccac

SEQ ID NO: 910583 - RNA, 12 nt, Homo sapiens
gauguacacaca

SEQ ID NO: 910584 - RNA, 14 nt, Homo sapiens
gauguacacacaca

SEQ ID NO: 910585 - RNA, 17 nt, Homo sapiens
gauguagaacuucaaga

SEQ ID NO: 910586 - RNA, 19 nt, Homo sapiens
gauguaggguaaggugccu

SEQ ID NO: 910587 - RNA, 23 nt, Homo sapiens
gaugucaaggacuccugucuguc

SEQ ID NO: 910588 - RNA, 18 nt, Homo sapiens
gaugucacaugucagaga

SEQ ID NO: 910589 - RNA, 19 nt, Homo sapiens
gaugucacgucuugaaaag

SEQ ID NO: 910590 - RNA, 13 nt, Homo sapiens
gaugucaucuucc

SEQ ID NO: 910591 - RNA, 16 nt, Homo sapiens
gaugugcgcacacaca

SEQ ID NO: 910592 - RNA, 14 nt, Homo sapiens
gaugugucaucuaa

SEQ ID NO: 910593 - RNA, 20 nt, Homo sapiens
gaugugugucucaccccuca

SEQ ID NO: 910594 - RNA, 22 nt, Homo sapiens
gauguguuuugcacgucuugcu

SEQ ID NO: 910595 - RNA, 17 nt, Homo sapiens
gauguuacaucacagug

SEQ ID NO: 910596 - RNA, 17 nt, Homo sapiens
guuuuuacuaaguaaaa

SEQ ID NO: 910597 - RNA, 21 nt, Homo sapiens
guuuuucaagaaaacuggaaa

SEQ ID NO: 910598 - RNA, 13 nt, Homo sapiens
guuuuuucacaua

SEQ ID NO: 910599 - RNA, 16 nt, Homo sapiens
uaaaaaaauacaguaa

SEQ ID NO: 910600 - RNA, 13 nt, Homo sapiens
uaaaaaaugucua

SEQ ID NO: 910601 - RNA, 16 nt, Homo sapiens
uaaaaacaaagaaaua

SEQ ID NO: 910602 - RNA, 23 nt, Homo sapiens
uaaaaaggaccagagaauucuua

SEQ ID NO: 910603 - RNA, 17 nt, Homo sapiens
uaaaaaguuaaucuuca

SEQ ID NO: 910604 - RNA, 12 nt, Homo sapiens
uaaaaaguugca

SEQ ID NO: 910605 - RNA, 16 nt, Homo sapiens
uaaaaauaaagcuacu

SEQ ID NO: 910606 - RNA, 14 nt, Homo sapiens
uaaaaauacaagca

SEQ ID NO: 910607 - RNA, 20 nt, Homo sapiens
uaaaaauagaagaauacaaa

SEQ ID NO: 910608 - RNA, 15 nt, Homo sapiens
uaaaacaaugaagga

SEQ ID NO: 910609 - RNA, 17 nt, Homo sapiens
uaaaacacagcuuuaca

SEQ ID NO: 910610 - RNA, 22 nt, Homo sapiens
uaaaacagccaaaacuccacag

SEQ ID NO: 910611 - RNA, 22 nt, Homo sapiens
uaaaacagguggagaaauuccu

SEQ ID NO: 910612 - RNA, 23 nt, Homo sapiens
uaaaacagguggagaaauuccuu

SEQ ID NO: 910613 - RNA, 14 nt, Homo sapiens
uaaaaccacagcag

SEQ ID NO: 910614 - RNA, 14 nt, Homo sapiens
uaaaaccuuacuua

SEQ ID NO: 910615 - RNA, 16 nt, Homo sapiens
uaaaacugcacugcca

SEQ ID NO: 910616 - RNA, 17 nt, Homo sapiens
uaaaacuuuauggacac

SEQ ID NO: 910617 - RNA, 23 nt, Homo sapiens
uaaaagaaaaaguaugugaauau

SEQ ID NO: 910618 - RNA, 23 nt, Homo sapiens
uaaaagaaccgagcaauuuucug

SEQ ID NO: 910619 - RNA, 21 nt, Homo sapiens
uaaaaguguauuuuuguuuaa

SEQ ID NO: 910620 - RNA, 13 nt, Homo sapiens
uaaaaguuacuua

SEQ ID NO: 910621 - RNA, 18 nt, Homo sapiens
uaaaauaaaguacauuau

SEQ ID NO: 910622 - RNA, 23 nt, Homo sapiens
uaaaauaaaguauauauagaauc

SEQ ID NO: 910623 - RNA, 17 nt, Homo sapiens
uaaaauaagaaugauuu

SEQ ID NO: 910624 - RNA, 15 nt, Homo sapiens
uaaaauacacacuca

SEQ ID NO: 910625 - RNA, 20 nt, Homo sapiens
uaaaauagacaacucuucca

SEQ ID NO: 910626 - RNA, 14 nt, Homo sapiens
uaaaauagccacuu

SEQ ID NO: 910627 - RNA, 19 nt, Homo sapiens
uaaaauauuuaugagaaag

SEQ ID NO: 910628 - RNA, 22 nt, Homo sapiens
uaaaauauuuuuaugugcaaua

SEQ ID NO: 910629 - RNA, 20 nt, Homo sapiens
uaaaauauuuuuugcuauau

SEQ ID NO: 910630 - RNA, 22 nt, Homo sapiens
uaaaaucaggauuuuagugcuu

SEQ ID NO: 910631 - RNA, 17 nt, Homo sapiens
uaaaaucauucaauauc

SEQ ID NO: 910632 - RNA, 19 nt, Homo sapiens
uaaaaucauuucugcauca

SEQ ID NO: 910633 - RNA, 14 nt, Homo sapiens
uaaaaugaaauguc

SEQ ID NO: 910634 - RNA, 20 nt, Homo sapiens
uaaaaugaaauuacuacaaa

SEQ ID NO: 910635 - RNA, 14 nt, Homo sapiens
uaaaaugacauuca

SEQ ID NO: 910636 - RNA, 22 nt, Homo sapiens
uaaaaugagaucguuguuuaca

SEQ ID NO: 910637 - RNA, 12 nt, Homo sapiens
uaaaaugaggcu

SEQ ID NO: 910638 - RNA, 20 nt, Homo sapiens
uaaaauuaaaugcauguccu

SEQ ID NO: 910639 - RNA, 18 nt, Homo sapiens
uaaaauuagaugaacuca

SEQ ID NO: 910640 - RNA, 14 nt, Homo sapiens
uaaaauucuuggga

SEQ ID NO: 910641 - RNA, 14 nt, Homo sapiens
uaaaauuguaaaau

SEQ ID NO: 910642 - RNA, 17 nt, Homo sapiens
uaaaauuuaaccuacua

SEQ ID NO: 910643 - RNA, 17 nt, Homo sapiens
uaaacaaaggaauuaug

SEQ ID NO: 910644 - RNA, 23 nt, Homo sapiens
uaaacaaauguaugauuacauca

SEQ ID NO: 910645 - RNA, 17 nt, Homo sapiens
uaaacaagggcagugag

SEQ ID NO: 910646 - RNA, 19 nt, Homo sapiens
uaaacaagggcagugagaa

SEQ ID NO: 910647 - RNA, 13 nt, Homo sapiens
uaaacaagugcac

SEQ ID NO: 910648 - RNA, 17 nt, Homo sapiens
uaaacaagugcacuuga

SEQ ID NO: 910649 - RNA, 21 nt, Homo sapiens
uaaacaagugcacuugaacau

SEQ ID NO: 910650 - RNA, 23 nt, Homo sapiens
uaaacacccaugaaucaaagaca

SEQ ID NO: 910651 - RNA, 15 nt, Homo sapiens
uaaacauagcuugua

SEQ ID NO: 910652 - RNA, 21 nt, Homo sapiens
uaaacauccuucaagaacucu

SEQ ID NO: 910653 - RNA, 22 nt, Homo sapiens
uaaacauugguaagaaugagcu

SEQ ID NO: 910654 - RNA, 22 nt, Homo sapiens
uaaaccaaugagcuguaucugu

SEQ ID NO: 910655 - RNA, 21 nt, Homo sapiens
uaaaccuagggagguugaaga

SEQ ID NO: 910656 - RNA, 16 nt, Homo sapiens
uaaacgagauaaugua

SEQ ID NO: 910657 - RNA, 14 nt, Homo sapiens
uaaacuacuguaau

SEQ ID NO: 910658 - RNA, 14 nt, Homo sapiens
uaaacuaguuucca

SEQ ID NO: 910659 - RNA, 15 nt, Homo sapiens
uaaacuaguuuccag

SEQ ID NO: 910660 - RNA, 14 nt, Homo sapiens
uaaacucucuaggg

SEQ ID NO: 910661 - RNA, 21 nt, Homo sapiens
uaaacuguaucaaaucuguau

SEQ ID NO: 910662 - RNA, 13 nt, Homo sapiens
uaagugcauuugu

SEQ ID NO: 910663 - RNA, 22 nt, Homo sapiens
uaaguggcuuuuuaacaugaaa

SEQ ID NO: 910664 - RNA, 14 nt, Homo sapiens
uaaguucuauugaa

SEQ ID NO: 910665 - RNA, 18 nt, Homo sapiens
uaauaaaaaucauggcaa

SEQ ID NO: 910666 - RNA, 15 nt, Homo sapiens
uaauaaacucucuag

SEQ ID NO: 910667 - RNA, 16 nt, Homo sapiens
uaauaacuagaucucc

SEQ ID NO: 910668 - RNA, 13 nt, Homo sapiens
uaauaauugauca

SEQ ID NO: 910669 - RNA, 13 nt, Homo sapiens
uaauaauuuuccu

SEQ ID NO: 910670 - RNA, 14 nt, Homo sapiens
uaauacagcagugu

SEQ ID NO: 910671 - RNA, 18 nt, Homo sapiens
uaauacuccuaagacuua

SEQ ID NO: 910672 - RNA, 16 nt, Homo sapiens
uaauagccauaugcaa

SEQ ID NO: 910673 - RNA, 14 nt, Homo sapiens
uaauaguccaauau

SEQ ID NO: 910674 - RNA, 17 nt, Homo sapiens
uaauauaaaguguaaua

SEQ ID NO: 910675 - RNA, 12 nt, Homo sapiens
uaauauacuuua

SEQ ID NO: 910676 - RNA, 13 nt, Homo sapiens
uaauauacuuuaa

SEQ ID NO: 910677 - RNA, 18 nt, Homo sapiens
uaauauauccacaucuaa

SEQ ID NO: 910678 - RNA, 13 nt, Homo sapiens
uaauaucaaugaa

SEQ ID NO: 910679 - RNA, 15 nt, Homo sapiens
uaauauccacugcaa

SEQ ID NO: 910680 - RNA, 15 nt, Homo sapiens
uaauaugacaaaaca

SEQ ID NO: 910681 - RNA, 13 nt, Homo sapiens
uaauauggcaaaa

SEQ ID NO: 910682 - RNA, 15 nt, Homo sapiens
uaauauuuaggcaag

SEQ ID NO: 910683 - RNA, 12 nt, Homo sapiens
uaaucagcauua

SEQ ID NO: 910684 - RNA, 20 nt, Homo sapiens
uaaucauuguaugugcuuca

SEQ ID NO: 910685 - RNA, 15 nt, Homo sapiens
uaaucccagcacuuu

SEQ ID NO: 910686 - RNA, 18 nt, Homo sapiens
uaaucgagucuaccucuu

SEQ ID NO: 910687 - RNA, 13 nt, Homo sapiens
uaaucgugucuuc

SEQ ID NO: 910688 - RNA, 11 nt, Homo sapiens
uaaucucagga

SEQ ID NO: 910689 - RNA, 17 nt, Homo sapiens
uaaucucauaccucuga

SEQ ID NO: 910690 - RNA, 21 nt, Homo sapiens
uaaucuuaaauuuauuagaua

SEQ ID NO: 910691 - RNA, 19 nt, Homo sapiens
uaaucuucuuaugcaauuu

SEQ ID NO: 910692 - RNA, 15 nt, Homo sapiens
uaaugaaaaugucag

SEQ ID NO: 910693 - RNA, 13 nt, Homo sapiens
uaaugaacaugug

SEQ ID NO: 910694 - RNA, 19 nt, Homo sapiens
uaaugaaggaguucacugu

SEQ ID NO: 910695 - RNA, 17 nt, Homo sapiens
uaaugacaaggugauau

SEQ ID NO: 910696 - RNA, 14 nt, Homo sapiens
uaaugaguucacua

SEQ ID NO: 910697 - RNA, 21 nt, Homo sapiens
uaaugcuuuccucccuggcau

SEQ ID NO: 910698 - RNA, 20 nt, Homo sapiens
uaauggaagagaaaucucau

SEQ ID NO: 910699 - RNA, 16 nt, Homo sapiens
uaaugguugacugggu

SEQ ID NO: 910700 - RNA, 17 nt, Homo sapiens
uaauguauacacaugga

SEQ ID NO: 910701 - RNA, 15 nt, Homo sapiens
uaaugucaccaccuu

SEQ ID NO: 910702 - RNA, 13 nt, Homo sapiens
uaauguuacauua

SEQ ID NO: 910703 - RNA, 22 nt, Homo sapiens
uaauguuguaauucaugccagg

SEQ ID NO: 910704 - RNA, 15 nt, Homo sapiens
uaauuaaacaugauc

SEQ ID NO: 910705 - RNA, 15 nt, Homo sapiens
uaauuaaacugaaga

SEQ ID NO: 910706 - RNA, 17 nt, Homo sapiens
uaauuaggaucuaugca

SEQ ID NO: 910707 - RNA, 17 nt, Homo sapiens
uaauuagggguugcuaa

SEQ ID NO: 910708 - RNA, 21 nt, Homo sapiens
uaauuauauaguaaugcacuc

SEQ ID NO: 910709 - RNA, 21 nt, Homo sapiens
uaauuaucggaagcagugccu

SEQ ID NO: 910710 - RNA, 20 nt, Homo sapiens
uaauuaucgggaacaguguu

SEQ ID NO: 910711 - RNA, 20 nt, Homo sapiens
uaauuaugaguuugcuuaug

SEQ ID NO: 910712 - RNA, 18 nt, Homo sapiens
augcacagagauaugcac

SEQ ID NO: 910713 - RNA, 19 nt, Homo sapiens
augcacagagauaugcaca

SEQ ID NO: 910714 - RNA, 14 nt, Homo sapiens
augcacauauggac

SEQ ID NO: 910715 - RNA, 23 nt, Homo sapiens
augcacgcacacaucagugcaca

SEQ ID NO: 910716 - RNA, 21 nt, Homo sapiens
augcacgcacaugccaaugca

SEQ ID NO: 910717 - RNA, 18 nt, Homo sapiens
augcacugacccuuccag

SEQ ID NO: 910718 - RNA, 19 nt, Homo sapiens
augcacuucuuacaauaau

SEQ ID NO: 910719 - RNA, 19 nt, Homo sapiens
augcacuuggcugcauaaa

SEQ ID NO: 910720 - RNA, 15 nt, Homo sapiens
augcagaggggugcu

SEQ ID NO: 910721 - RNA, 18 nt, Homo sapiens
augcagccuucuuuucaa

SEQ ID NO: 910722 - RNA, 13 nt, Homo sapiens
augcaucaucagc

SEQ ID NO: 910723 - RNA, 16 nt, Homo sapiens
augcauuugcacuauu

SEQ ID NO: 910724 - RNA, 21 nt, Homo sapiens
augccagagacggaagccuuu

SEQ ID NO: 910725 - RNA, 23 nt, Homo sapiens
augccauagcaagauugcuuaaa

SEQ ID NO: 910726 - RNA, 21 nt, Homo sapiens
augcccuccaauccuuuccac

SEQ ID NO: 910727 - RNA, 17 nt, Homo sapiens
augccgcccccagcagc

SEQ ID NO: 910728 - RNA, 15 nt, Homo sapiens
augccuauaccugaa

SEQ ID NO: 910729 - RNA, 23 nt, Homo sapiens
augccuauguacucuacgccaaa

SEQ ID NO: 910730 - RNA, 13 nt, Homo sapiens
augccucaagaac

SEQ ID NO: 910731 - RNA, 14 nt, Homo sapiens
augccuccaaaaau

SEQ ID NO: 910732 - RNA, 18 nt, Homo sapiens
augccuccaagccauuca

SEQ ID NO: 910733 - RNA, 17 nt, Homo sapiens
augccugguggcagcug

SEQ ID NO: 910734 - RNA, 17 nt, Homo sapiens
augccuucacuuuacaa

SEQ ID NO: 910735 - RNA, 22 nt, Homo sapiens
augccuugagucuuuaauccca

SEQ ID NO: 910736 - RNA, 22 nt, Homo sapiens
augccuuucuaguccuauucua

SEQ ID NO: 910737 - RNA, 22 nt, Homo sapiens
augccuuuucccaaaauguuga

SEQ ID NO: 910738 - RNA, 17 nt, Homo sapiens
augcgucccuguacaga

SEQ ID NO: 910739 - RNA, 13 nt, Homo sapiens
augcuauauugca

SEQ ID NO: 910740 - RNA, 17 nt, Homo sapiens
augcucaaccacugugg

SEQ ID NO: 910741 - RNA, 22 nt, Homo sapiens
augcucagcccugacuggugcu

SEQ ID NO: 910742 - RNA, 15 nt, Homo sapiens
augcugaaugaaucc

SEQ ID NO: 910743 - RNA, 17 nt, Homo sapiens
augcugagcgcuguguu

SEQ ID NO: 910744 - RNA, 20 nt, Homo sapiens
augcugccaaccagcuuguc

SEQ ID NO: 910745 - RNA, 20 nt, Homo sapiens
augcuucacaucucuucacu

SEQ ID NO: 910746 - RNA, 13 nt, Homo sapiens
augcuucuugccc

SEQ ID NO: 910747 - RNA, 13 nt, Homo sapiens
augcuugugauuu

SEQ ID NO: 910748 - RNA, 15 nt, Homo sapiens
augcuuuugccacuu

SEQ ID NO: 910749 - RNA, 17 nt, Homo sapiens
auggaaaaaaugaacuu

SEQ ID NO: 910750 - RNA, 20 nt, Homo sapiens
auggaaauccuguuacuuaa

SEQ ID NO: 910751 - RNA, 17 nt, Homo sapiens
auggaaguggcagugaa

SEQ ID NO: 910752 - RNA, 18 nt, Homo sapiens
auggaaguggcagugaaa

SEQ ID NO: 910753 - RNA, 23 nt, Homo sapiens
auggaaguugcagugagcugaua

SEQ ID NO: 910754 - RNA, 20 nt, Homo sapiens
auggaauauuccccuaucuc

SEQ ID NO: 910755 - RNA, 21 nt, Homo sapiens
auggacauauucuuuuuggaa

SEQ ID NO: 910756 - RNA, 13 nt, Homo sapiens
auggacucugcac

SEQ ID NO: 910757 - RNA, 14 nt, Homo sapiens
auggagcucuaacc

SEQ ID NO: 910758 - RNA, 23 nt, Homo sapiens
auggaggcaggcucccccugccu

SEQ ID NO: 910759 - RNA, 14 nt, Homo sapiens
auggaugagcacac

SEQ ID NO: 910760 - RNA, 17 nt, Homo sapiens
auggaugagcacacaca

SEQ ID NO: 910761 - RNA, 15 nt, Homo sapiens
auggaugcacacaca

SEQ ID NO: 910762 - RNA, 17 nt, Homo sapiens
auggaugugcucacugg

SEQ ID NO: 910763 - RNA, 17 nt, Homo sapiens
auggcaagugauaucac

SEQ ID NO: 910764 - RNA, 22 nt, Homo sapiens
auggcacagcccaaagaaggaa

SEQ ID NO: 910765 - RNA, 17 nt, Homo sapiens
auggcaucuaccgaccu

SEQ ID NO: 910766 - RNA, 18 nt, Homo sapiens
auggccaaaucgcaguga

SEQ ID NO: 910767 - RNA, 18 nt, Homo sapiens
auggccagugugauccca

SEQ ID NO: 910768 - RNA, 18 nt, Homo sapiens
auggcccaaauccagugu

SEQ ID NO: 910769 - RNA, 14 nt, Homo sapiens
auggccucuggcca

SEQ ID NO: 910770 - RNA, 18 nt, Homo sapiens
auggccucuggccaggca

SEQ ID NO: 910771 - RNA, 18 nt, Homo sapiens
auggcgugugugccguga

SEQ ID NO: 910772 - RNA, 16 nt, Homo sapiens
auggcuaccaaaaaga

SEQ ID NO: 910773 - RNA, 19 nt, Homo sapiens
auggcuuuagcuaccucac

SEQ ID NO: 910774 - RNA, 22 nt, Homo sapiens
augggaacaaggcaauggucua

SEQ ID NO: 910775 - RNA, 14 nt, Homo sapiens
augggaccagggau

SEQ ID NO: 910776 - RNA, 16 nt, Homo sapiens
augggacucaaugcac

SEQ ID NO: 910777 - RNA, 21 nt, Homo sapiens
auuaccucaaauuccuaauaa

SEQ ID NO: 910778 - RNA, 17 nt, Homo sapiens
auuaccucugauaccuc

SEQ ID NO: 910779 - RNA, 19 nt, Homo sapiens
auuacuccauuacuaaaga

SEQ ID NO: 910780 - RNA, 13 nt, Homo sapiens
auuacugcaugca

SEQ ID NO: 910781 - RNA, 15 nt, Homo sapiens
auuacugcaugcacu

SEQ ID NO: 910782 - RNA, 18 nt, Homo sapiens
auuacugcaugcacuucu

SEQ ID NO: 910783 - RNA, 14 nt, Homo sapiens
auuacuucugcuac

SEQ ID NO: 910784 - RNA, 15 nt, Homo sapiens
auuagaaugcaugua

SEQ ID NO: 910785 - RNA, 17 nt, Homo sapiens
auuagaaugcauguaag

SEQ ID NO: 910786 - RNA, 20 nt, Homo sapiens
auuagcauucugguuuugac

SEQ ID NO: 910787 - RNA, 23 nt, Homo sapiens
auuagcuguaaauacaugugugg

SEQ ID NO: 910788 - RNA, 15 nt, Homo sapiens
auuauaacugcauag

SEQ ID NO: 910789 - RNA, 13 nt, Homo sapiens
auuauagaaugga

SEQ ID NO: 910790 - RNA, 19 nt, Homo sapiens
auuauauacuauguaugga

SEQ ID NO: 910791 - RNA, 21 nt, Homo sapiens
auuauauaguauaccauacau

SEQ ID NO: 910792 - RNA, 14 nt, Homo sapiens
auuaucaccagcag

SEQ ID NO: 910793 - RNA, 17 nt, Homo sapiens
auuaucacgcagaucac

SEQ ID NO: 910794 - RNA, 13 nt, Homo sapiens
auuaucaucugaa

SEQ ID NO: 910795 - RNA, 23 nt, Homo sapiens
auuaucucaaaacugcacuguca

SEQ ID NO: 910796 - RNA, 20 nt, Homo sapiens
auuaucuuuaauaaaauguu

SEQ ID NO: 910797 - RNA, 18 nt, Homo sapiens
auuaugccauagcaagau

SEQ ID NO: 910798 - RNA, 18 nt, Homo sapiens
auuauggagugucaccag

SEQ ID NO: 910799 - RNA, 20 nt, Homo sapiens
auuaugggcgugaaccacca

SEQ ID NO: 910800 - RNA, 11 nt, Homo sapiens
auuauggugaa

SEQ ID NO: 910801 - RNA, 18 nt, Homo sapiens
auuaugguguaaugcaca

SEQ ID NO: 910802 - RNA, 15 nt, Homo sapiens
auuauguauguuuac

SEQ ID NO: 910803 - RNA, 18 nt, Homo sapiens
auuaugugaaaucaaagc

SEQ ID NO: 910804 - RNA, 15 nt, Homo sapiens
auuauuaacacugaa

SEQ ID NO: 910805 - RNA, 18 nt, Homo sapiens
auuauuauucuucauaac

SEQ ID NO: 910806 - RNA, 18 nt, Homo sapiens
auuauucaagugccucuu

SEQ ID NO: 910807 - RNA, 21 nt, Homo sapiens
auuauucccauucuacauacu

SEQ ID NO: 910808 - RNA, 11 nt, Homo sapiens
auuauucugau

SEQ ID NO: 910809 - RNA, 15 nt, Homo sapiens
auuauuguauuacau

SEQ ID NO: 910810 - RNA, 12 nt, Homo sapiens
auuauuguugca

SEQ ID NO: 910811 - RNA, 15 nt, Homo sapiens
auuauuuacaaugca

SEQ ID NO: 910812 - RNA, 23 nt, Homo sapiens
auuauuuauugucggaagacuug

SEQ ID NO: 910813 - RNA, 13 nt, Homo sapiens
auuauuuugcacu

SEQ ID NO: 910814 - RNA, 19 nt, Homo sapiens
auucaaaagaugccauuca

SEQ ID NO: 910815 - RNA, 16 nt, Homo sapiens
auucaaacugcuccaa

SEQ ID NO: 910816 - RNA, 15 nt, Homo sapiens
auucaaagcacuguu

SEQ ID NO: 910817 - RNA, 14 nt, Homo sapiens
auucaaagcagggu

SEQ ID NO: 910818 - RNA, 14 nt, Homo sapiens
auucaaccacugua

SEQ ID NO: 910819 - RNA, 19 nt, Homo sapiens
auucaagaaacagaaguag

SEQ ID NO: 910820 - RNA, 14 nt, Homo sapiens
auucaagccuguga

SEQ ID NO: 910821 - RNA, 15 nt, Homo sapiens
auucaaggaucucaa

SEQ ID NO: 910822 - RNA, 16 nt, Homo sapiens
auucaaugaucuuaga

SEQ ID NO: 910823 - RNA, 22 nt, Homo sapiens
auucacagccaggagaugcugg

SEQ ID NO: 910824 - RNA, 11 nt, Homo sapiens
auucacaucuc

SEQ ID NO: 910825 - RNA, 16 nt, Homo sapiens
auucagaaagucauag

SEQ ID NO: 910826 - RNA, 12 nt, Homo sapiens
auucagacacuu

SEQ ID NO: 910827 - RNA, 17 nt, Homo sapiens
uaccuaaaacugcugaa

SEQ ID NO: 910828 - RNA, 17 nt, Homo sapiens
uaccuaccacagugucu

SEQ ID NO: 910829 - RNA, 13 nt, Homo sapiens
uaccuaccaccuu

SEQ ID NO: 910830 - RNA, 17 nt, Homo sapiens
uaccucugauaccucaa

SEQ ID NO: 910831 - RNA, 16 nt, Homo sapiens
uaccugcccucucuca

SEQ ID NO: 910832 - RNA, 21 nt, Homo sapiens
uaccugggcauucuuguuuca

SEQ ID NO: 910833 - RNA, 15 nt, Homo sapiens
uaccugugagauaac

SEQ ID NO: 910834 - RNA, 18 nt, Homo sapiens
uaccuguguuucuugccu

SEQ ID NO: 910835 - RNA, 16 nt, Homo sapiens
uaccuguuaguauuau

SEQ ID NO: 910836 - RNA, 23 nt, Homo sapiens
uaccuguuaguauuauuguugca

SEQ ID NO: 910837 - RNA, 16 nt, Homo sapiens
uaccuuaaaucugccu

SEQ ID NO: 910838 - RNA, 23 nt, Homo sapiens
uaccuuagauuagcucuggacca

SEQ ID NO: 910839 - RNA, 23 nt, Homo sapiens
uaccuucaggguuggauguaguu

SEQ ID NO: 910840 - RNA, 23 nt, Homo sapiens
uacgaaacacaaaccacaacuga

SEQ ID NO: 910841 - RNA, 23 nt, Homo sapiens
uacgcaaacacaccgaugcacac

SEQ ID NO: 910842 - RNA, 23 nt, Homo sapiens
uacgguggcacgugccugugauc

SEQ ID NO: 910843 - RNA, 13 nt, Homo sapiens
uacguaucugcuc

SEQ ID NO: 910844 - RNA, 11 nt, Homo sapiens
uacgugcaaua

SEQ ID NO: 910845 - RNA, 19 nt, Homo sapiens
uacguuugaaauaguugau

SEQ ID NO: 910846 - RNA, 16 nt, Homo sapiens
uacuaaaaauacagaa

SEQ ID NO: 910847 - RNA, 12 nt, Homo sapiens
uacuaaagacag

SEQ ID NO: 910848 - RNA, 15 nt, Homo sapiens
uacuaaagugccuac

SEQ ID NO: 910849 - RNA, 14 nt, Homo sapiens
uacuacacauccaa

SEQ ID NO: 910850 - RNA, 14 nt, Homo sapiens
uacuacaugcacuu

SEQ ID NO: 910851 - RNA, 22 nt, Homo sapiens
uacuacccgagcccagcuacau

SEQ ID NO: 910852 - RNA, 15 nt, Homo sapiens
uacuacuauucuguu

SEQ ID NO: 910853 - RNA, 12 nt, Homo sapiens
uacuacuguaaa

SEQ ID NO: 910854 - RNA, 15 nt, Homo sapiens
uacuacuguaaaugu

SEQ ID NO: 910855 - RNA, 23 nt, Homo sapiens
uacuacuuuuacuacagugacaa

SEQ ID NO: 910856 - RNA, 14 nt, Homo sapiens
uacuagcaguguuu

SEQ ID NO: 910857 - RNA, 22 nt, Homo sapiens
uacuaguguguguguguauaua

SEQ ID NO: 910858 - RNA, 15 nt, Homo sapiens
uacuauuaagggaaa

SEQ ID NO: 910859 - RNA, 14 nt, Homo sapiens
uacuauuaccauag

SEQ ID NO: 910860 - RNA, 12 nt, Homo sapiens
uacucaaaagag

SEQ ID NO: 910861 - RNA, 21 nt, Homo sapiens
uacucacccagggacuccagu

SEQ ID NO: 910862 - RNA, 17 nt, Homo sapiens
uacuccaggagacccac

SEQ ID NO: 910863 - RNA, 16 nt, Homo sapiens
uacuccaugcacauag

SEQ ID NO: 910864 - RNA, 13 nt, Homo sapiens
uacucccaggcac

SEQ ID NO: 910865 - RNA, 15 nt, Homo sapiens
uacucccauuuuccc

SEQ ID NO: 910866 - RNA, 17 nt, Homo sapiens
uacuccucugacuggag

SEQ ID NO: 910867 - RNA, 14 nt, Homo sapiens
uacuccugugcugg

SEQ ID NO: 910868 - RNA, 17 nt, Homo sapiens
uacucuauguaugcauc

SEQ ID NO: 910869 - RNA, 18 nt, Homo sapiens
uacucuauguaugcaucu

SEQ ID NO: 910870 - RNA, 21 nt, Homo sapiens
uacucuauguaugcaucuaua

SEQ ID NO: 910871 - RNA, 18 nt, Homo sapiens
uacucuggagagacugug

SEQ ID NO: 910872 - RNA, 14 nt, Homo sapiens
uacucuguccaggc

SEQ ID NO: 910873 - RNA, 18 nt, Homo sapiens
uacucuuaacuccuagcc

SEQ ID NO: 910874 - RNA, 13 nt, Homo sapiens
uacugacugauga

SEQ ID NO: 910875 - RNA, 14 nt, Homo sapiens
uacugauauuucau

SEQ ID NO: 910876 - RNA, 11 nt, Homo sapiens
uacugauucuc

SEQ ID NO: 910877 - RNA, 17 nt, Homo sapiens
uacugauuuuugugauu

SEQ ID NO: 910878 - RNA, 20 nt, Homo sapiens
uacugcacauuuuguacaaa

SEQ ID NO: 910879 - RNA, 14 nt, Homo sapiens
uacugcuguaaaua

SEQ ID NO: 910880 - RNA, 23 nt, Homo sapiens
uacugcuuucaacuuaaaucacu

SEQ ID NO: 910881 - RNA, 18 nt, Homo sapiens
uacuggucuuguggaauu

SEQ ID NO: 910882 - RNA, 16 nt, Homo sapiens
uacuguacugagacau

SEQ ID NO: 910883 - RNA, 15 nt, Homo sapiens
uacuuaaagcuucua

SEQ ID NO: 910884 - RNA, 20 nt, Homo sapiens
uacuuaacugugugaagaaa

SEQ ID NO: 910885 - RNA, 17 nt, Homo sapiens
uacuuauuaaucuguau

SEQ ID NO: 910886 - RNA, 22 nt, Homo sapiens
uacuucaacacuucauguauug

SEQ ID NO: 910887 - RNA, 15 nt, Homo sapiens
uacuucagucuugga

SEQ ID NO: 910888 - RNA, 19 nt, Homo sapiens
uacuucauucagaccagug

SEQ ID NO: 910889 - RNA, 17 nt, Homo sapiens
uacuucggggcugggaa

SEQ ID NO: 910890 - RNA, 13 nt, Homo sapiens
uacuuggacaguu

SEQ ID NO: 910891 - RNA, 18 nt, Homo sapiens
uacuuguuuucacuuuau

SEQ ID NO: 910892 - RNA, 12 nt, Homo sapiens
uacuuuaccucc

SEQ ID NO: 910893 - RNA, 15 nt, Homo sapiens
uaucaauuacagucc

SEQ ID NO: 910894 - RNA, 14 nt, Homo sapiens
uaucacaucacuua

SEQ ID NO: 910895 - RNA, 14 nt, Homo sapiens
uaucacgauauuau

SEQ ID NO: 910896 - RNA, 20 nt, Homo sapiens
uaucagacuguaggauuuga

SEQ ID NO: 910897 - RNA, 16 nt, Homo sapiens
uaucagagcucuuaau

SEQ ID NO: 910898 - RNA, 22 nt, Homo sapiens
uaucauuuuuuuaacacauaac

SEQ ID NO: 910899 - RNA, 19 nt, Homo sapiens
uauccaagaaucagugaag

SEQ ID NO: 910900 - RNA, 19 nt, Homo sapiens
uauccaauaggcauuugau

SEQ ID NO: 910901 - RNA, 19 nt, Homo sapiens
uauccaauuaugugacaac

SEQ ID NO: 910902 - RNA, 19 nt, Homo sapiens
uauccagaggguugugauu

SEQ ID NO: 910903 - RNA, 15 nt, Homo sapiens
uaucccagaccccuc

SEQ ID NO: 910904 - RNA, 18 nt, Homo sapiens
uaucccauugaaacaaaa

SEQ ID NO: 910905 - RNA, 22 nt, Homo sapiens
uauccguagaguagucaugaca

SEQ ID NO: 910906 - RNA, 22 nt, Homo sapiens
uauccuguacauuucacaaaaa

SEQ ID NO: 910907 - RNA, 19 nt, Homo sapiens
uauccuucuagaucauaca

SEQ ID NO: 910908 - RNA, 17 nt, Homo sapiens
uaucgggagcagugucu

SEQ ID NO: 910909 - RNA, 21 nt, Homo sapiens
uaucgggagcagugucuucca

SEQ ID NO: 910910 - RNA, 23 nt, Homo sapiens
uaucuaauauguaacaagccacc

SEQ ID NO: 910911 - RNA, 14 nt, Homo sapiens
uaucuaccaucuaa

SEQ ID NO: 910912 - RNA, 18 nt, Homo sapiens
uaucuaccucacuauuca

SEQ ID NO: 910913 - RNA, 13 nt, Homo sapiens
uaucuaucuuaua

SEQ ID NO: 910914 - RNA, 20 nt, Homo sapiens
uaucuccaaaugagacacau

SEQ ID NO: 910915 - RNA, 12 nt, Homo sapiens
uaucucucugcc

SEQ ID NO: 910916 - RNA, 14 nt, Homo sapiens
uaucugaggucaca

SEQ ID NO: 910917 - RNA, 14 nt, Homo sapiens
uaucugauuuccua

SEQ ID NO: 910918 - RNA, 18 nt, Homo sapiens
uaucuguauuuucauuua

SEQ ID NO: 910919 - RNA, 17 nt, Homo sapiens
uaucuguguuugcugag

SEQ ID NO: 910920 - RNA, 20 nt, Homo sapiens
uaucuucauacaaugacaag

SEQ ID NO: 910921 - RNA, 18 nt, Homo sapiens
uaugaaaagaggggacca

SEQ ID NO: 910922 - RNA, 13 nt, Homo sapiens
uaugaacauggag

SEQ ID NO: 910923 - RNA, 13 nt, Homo sapiens
uaugaacuugagg

SEQ ID NO: 910924 - RNA, 20 nt, Homo sapiens
uaugaaggacuauuaauucc

SEQ ID NO: 910925 - RNA, 13 nt, Homo sapiens
uaugaaugugcau

SEQ ID NO: 910926 - RNA, 14 nt, Homo sapiens
uaugacaauccuga

SEQ ID NO: 910927 - RNA, 22 nt, Homo sapiens
uaugacuguuuuuguaguggua

SEQ ID NO: 910928 - RNA, 17 nt, Homo sapiens
uaugagaaaguucucau

SEQ ID NO: 910929 - RNA, 14 nt, Homo sapiens
uaugaggcuauuaa

SEQ ID NO: 910930 - RNA, 18 nt, Homo sapiens
uaugagggucagggcagu

SEQ ID NO: 910931 - RNA, 21 nt, Homo sapiens
uaugaguggcuucugggagau

SEQ ID NO: 910932 - RNA, 14 nt, Homo sapiens
uaugaucauguaaa

SEQ ID NO: 910933 - RNA, 20 nt, Homo sapiens
uaugaugauuugcuaucaaa

SEQ ID NO: 910934 - RNA, 20 nt, Homo sapiens
uaugcaauauaucaauguaa

SEQ ID NO: 910935 - RNA, 17 nt, Homo sapiens
uaugcacacacauggau

SEQ ID NO: 910936 - RNA, 14 nt, Homo sapiens
uaugcacauaugga

SEQ ID NO: 910937 - RNA, 14 nt, Homo sapiens
uaugcagaauguuu

SEQ ID NO: 910938 - RNA, 22 nt, Homo sapiens
uaugcagggagcugggcuucca

SEQ ID NO: 910939 - RNA, 18 nt, Homo sapiens
uaugccauagcaagauug

SEQ ID NO: 910940 - RNA, 14 nt, Homo sapiens
uaugccuuauguaa

SEQ ID NO: 910941 - RNA, 12 nt, Homo sapiens
uaugcuggccag

SEQ ID NO: 910942 - RNA, 19 nt, Homo sapiens
uauggaaaaaaugaacuuu

SEQ ID NO: 910943 - RNA, 16 nt, Homo sapiens
caaaagaugccauuca

SEQ ID NO: 910944 - RNA, 23 nt, Homo sapiens
caaaagucaccacuccauuccca

SEQ ID NO: 910945 - RNA, 20 nt, Homo sapiens
caaaaguggggcuaaaugaa

SEQ ID NO: 910946 - RNA, 21 nt, Homo sapiens
caaaaguggggcuaaaugaag

SEQ ID NO: 910947 - RNA, 18 nt, Homo sapiens
caaaaguuucuuacucaa

SEQ ID NO: 910948 - RNA, 21 nt, Homo sapiens
caaaaguuucuuacucaagga

SEQ ID NO: 910949 - RNA, 15 nt, Homo sapiens
caaaauaacauuuga

SEQ ID NO: 910950 - RNA, 17 nt, Homo sapiens
caaaauaaggggcaccu

SEQ ID NO: 910951 - RNA, 19 nt, Homo sapiens
caaaauaccaugccauuua

SEQ ID NO: 910952 - RNA, 14 nt, Homo sapiens
caaaauauucugua

SEQ ID NO: 910953 - RNA, 14 nt, Homo sapiens
caaaaucacaagca

SEQ ID NO: 910954 - RNA, 24 nt, Homo sapiens
caaaaucuaccaggucaaaauagu

SEQ ID NO: 910955 - RNA, 22 nt, Homo sapiens
caaaauggagggagccaucccu

SEQ ID NO: 910956 - RNA, 21 nt, Homo sapiens
caaaauguuuucuucaucugu

SEQ ID NO: 910957 - RNA, 15 nt, Homo sapiens
caaaauuuccaguac

SEQ ID NO: 910958 - RNA, 19 nt, Homo sapiens
caaaauuuuauaagcaaau

SEQ ID NO: 910959 - RNA, 11 nt, Homo sapiens
caaacaagcac

SEQ ID NO: 910960 - RNA, 23 nt, Homo sapiens
caaacacaagugcgccuugcaaa

SEQ ID NO: 910961 - RNA, 13 nt, Homo sapiens
caaacacacugua

SEQ ID NO: 910962 - RNA, 17 nt, Homo sapiens
caaacacccaugcccag

SEQ ID NO: 910963 - RNA, 12 nt, Homo sapiens
caaacacuccac

SEQ ID NO: 910964 - RNA, 13 nt, Homo sapiens
caaacacugugua

SEQ ID NO: 910965 - RNA, 20 nt, Homo sapiens
caaacaguagacuuauagua

SEQ ID NO: 910966 - RNA, 16 nt, Homo sapiens
caaacagucucaggaa

SEQ ID NO: 910967 - RNA, 15 nt, Homo sapiens
caaaccacuguacau

SEQ ID NO: 910968 - RNA, 13 nt, Homo sapiens
caaaccagagcag

SEQ ID NO: 910969 - RNA, 21 nt, Homo sapiens
caaaccccauggagcagccag

SEQ ID NO: 910970 - RNA, 14 nt, Homo sapiens
caaaccgcaggcaa

SEQ ID NO: 910971 - RNA, 14 nt, Homo sapiens
caaaccuacuguau

SEQ ID NO: 910972 - RNA, 19 nt, Homo sapiens
caaacgggcugcccugcca

SEQ ID NO: 910973 - RNA, 14 nt, Homo sapiens
caaacuacauguaa

SEQ ID NO: 910974 - RNA, 13 nt, Homo sapiens
caaacugcaaaua

SEQ ID NO: 910975 - RNA, 12 nt, Homo sapiens
caaagaaaaagg

SEQ ID NO: 910976 - RNA, 16 nt, Homo sapiens
caaagaaaagccagag

SEQ ID NO: 910977 - RNA, 14 nt, Homo sapiens
caaagaacaagauc

SEQ ID NO: 910978 - RNA, 24 nt, Homo sapiens
caaagaagauuuugccacauuuga

SEQ ID NO: 910979 - RNA, 22 nt, Homo sapiens
caaagaaggcacagguguaaau

SEQ ID NO: 910980 - RNA, 19 nt, Homo sapiens
caaagagaaaucacagggg

SEQ ID NO: 910981 - RNA, 19 nt, Homo sapiens
caaagagaauaaagacuuc

SEQ ID NO: 910982 - RNA, 17 nt, Homo sapiens
caaagauauauacacag

SEQ ID NO: 910983 - RNA, 22 nt, Homo sapiens
caaagauuuuggaggagaagga

SEQ ID NO: 910984 - RNA, 18 nt, Homo sapiens
caaagcacgaaauguuau

SEQ ID NO: 910985 - RNA, 19 nt, Homo sapiens
caaagcacuguuucucuca

SEQ ID NO: 910986 - RNA, 16 nt, Homo sapiens
caaagcaucauuguaa

SEQ ID NO: 910987 - RNA, 10 nt, Homo sapiens
caaagccaaa

SEQ ID NO: 910988 - RNA, 22 nt, Homo sapiens
caaagccccuggaaaugugcua

SEQ ID NO: 910989 - RNA, 15 nt, Homo sapiens
caaaggaaaccaaag

SEQ ID NO: 910990 - RNA, 16 nt, Homo sapiens
caaaggaagacuugaa

SEQ ID NO: 910991 - RNA, 15 nt, Homo sapiens
caaaggcacugaggc

SEQ ID NO: 910992 - RNA, 13 nt, Homo sapiens
caaaggcucccug

SEQ ID NO: 910993 - RNA, 21 nt, Homo sapiens
caaaggcucccuguguucuca

SEQ ID NO: 910994 - RNA, 23 nt, Homo sapiens
caaagggaacugaagaccuccac

SEQ ID NO: 910995 - RNA, 18 nt, Homo sapiens
caaagggcccacagugac

SEQ ID NO: 910996 - RNA, 16 nt, Homo sapiens
caaagguuaucaacca

SEQ ID NO: 910997 - RNA, 18 nt, Homo sapiens
caaagucugugugaugaa

SEQ ID NO: 910998 - RNA, 22 nt, Homo sapiens
caaagugacacagagcaauggu

SEQ ID NO: 910999 - RNA, 19 nt, Homo sapiens
caaaguuacaaauucaagg

SEQ ID NO: 911000 - RNA, 17 nt, Homo sapiens
caaauaaacucuaaaca

SEQ ID NO: 911001 - RNA, 15 nt, Homo sapiens
caaauaaaguaccau

SEQ ID NO: 911002 - RNA, 17 nt, Homo sapiens
caaauaaaguaccauua

SEQ ID NO: 911003 - RNA, 14 nt, Homo sapiens
caaauaaauggagu

SEQ ID NO: 911004 - RNA, 23 nt, Homo sapiens
caaauacauaccuacugacugau

SEQ ID NO: 911005 - RNA, 18 nt, Homo sapiens
caaauagaaaucagcaca

SEQ ID NO: 911006 - RNA, 15 nt, Homo sapiens
caaauaugcaaagca

SEQ ID NO: 911007 - RNA, 15 nt, Homo sapiens
caaaucaaccccaga

SEQ ID NO: 911008 - RNA, 14 nt, Homo sapiens
cagccaacauggca

SEQ ID NO: 911009 - RNA, 18 nt, Homo sapiens
cagccacuugacuaauac

SEQ ID NO: 911010 - RNA, 20 nt, Homo sapiens
cagccagaggaggccgguga

SEQ ID NO: 911011 - RNA, 19 nt, Homo sapiens
cagccagcgccucccucca

SEQ ID NO: 911012 - RNA, 18 nt, Homo sapiens
cagccaucaagagacuga

SEQ ID NO: 911013 - RNA, 15 nt, Homo sapiens
cagccaucaugugcc

SEQ ID NO: 911014 - RNA, 18 nt, Homo sapiens
cagccaugccucaugcca

SEQ ID NO: 911015 - RNA, 20 nt, Homo sapiens
cagcccacagagccugaauu

SEQ ID NO: 911016 - RNA, 16 nt, Homo sapiens
cagcccaggcagagau

SEQ ID NO: 911017 - RNA, 11 nt, Homo sapiens
cagcccauucu

SEQ ID NO: 911018 - RNA, 20 nt, Homo sapiens
cagcccauuuuaucuuugaa

SEQ ID NO: 911019 - RNA, 16 nt, Homo sapiens
cagccccagugcccac

SEQ ID NO: 911020 - RNA, 16 nt, Homo sapiens
cagccccgcccgccug

SEQ ID NO: 911021 - RNA, 23 nt, Homo sapiens
cagccccuccuccccuuccugca

SEQ ID NO: 911022 - RNA, 16 nt, Homo sapiens
cagcccugacuggugc

SEQ ID NO: 911023 - RNA, 19 nt, Homo sapiens
cagcccuucccugcuuuga

SEQ ID NO: 911024 - RNA, 22 nt, Homo sapiens
cagccgccuggagaugacuuga

SEQ ID NO: 911025 - RNA, 13 nt, Homo sapiens
cagccuacugccu

SEQ ID NO: 911026 - RNA, 14 nt, Homo sapiens
cagccuacugccuc

SEQ ID NO: 911027 - RNA, 13 nt, Homo sapiens
cagccucaagucu

SEQ ID NO: 911028 - RNA, 23 nt, Homo sapiens
cagccucacuugaaugugucacu

SEQ ID NO: 911029 - RNA, 15 nt, Homo sapiens
cagccucagugccac

SEQ ID NO: 911030 - RNA, 20 nt, Homo sapiens
cagccuccccaccuucuuca

SEQ ID NO: 911031 - RNA, 20 nt, Homo sapiens
cagccuccccccgcugggga

SEQ ID NO: 911032 - RNA, 19 nt, Homo sapiens
cagccucccgaauagcugg

SEQ ID NO: 911033 - RNA, 19 nt, Homo sapiens
cagccucccgaguagcuga

SEQ ID NO: 911034 - RNA, 15 nt, Homo sapiens
cagccucgcaugcca

SEQ ID NO: 911035 - RNA, 16 nt, Homo sapiens
cagccucgcaugccag

SEQ ID NO: 911036 - RNA, 21 nt, Homo sapiens
cagccugaccaacauggugaa

SEQ ID NO: 911037 - RNA, 22 nt, Homo sapiens
cagccugagcaacagagugaga

SEQ ID NO: 911038 - RNA, 19 nt, Homo sapiens
cagccugcccucagcacag

SEQ ID NO: 911039 - RNA, 21 nt, Homo sapiens
cagccuggcuauacagugcau

SEQ ID NO: 911040 - RNA, 20 nt, Homo sapiens
cagccugggcaacagagcaa

SEQ ID NO: 911041 - RNA, 19 nt, Homo sapiens
cagccugggcaacauagua

SEQ ID NO: 911042 - RNA, 16 nt, Homo sapiens
cagccuggguggcaga

SEQ ID NO: 911043 - RNA, 20 nt, Homo sapiens
cagccugguuuucacauaca

SEQ ID NO: 911044 - RNA, 19 nt, Homo sapiens
cagccuguuggacccgcuc

SEQ ID NO: 911045 - RNA, 17 nt, Homo sapiens
cagccuucugacaagca

SEQ ID NO: 911046 - RNA, 15 nt, Homo sapiens
cagccuucuuuucaa

SEQ ID NO: 911047 - RNA, 17 nt, Homo sapiens
cagccuugcaucaaggg

SEQ ID NO: 911048 - RNA, 14 nt, Homo sapiens
cagcgaacaugccu

SEQ ID NO: 911049 - RNA, 16 nt, Homo sapiens
cagcgaacaugccuga

SEQ ID NO: 911050 - RNA, 19 nt, Homo sapiens
cagcgaaccaauauuugua

SEQ ID NO: 911051 - RNA, 18 nt, Homo sapiens
cagcgaaugaaugcugua

SEQ ID NO: 911052 - RNA, 23 nt, Homo sapiens
cagcgagaggcagagaaagaaga

SEQ ID NO: 911053 - RNA, 14 nt, Homo sapiens
cagcgauccacgga

SEQ ID NO: 911054 - RNA, 19 nt, Homo sapiens
cagcggaggagaccagcuc

SEQ ID NO: 911055 - RNA, 18 nt, Homo sapiens
cagcuaacuccagucucc

SEQ ID NO: 911056 - RNA, 19 nt, Homo sapiens
cagcuaacuccagucuccu

SEQ ID NO: 911057 - RNA, 19 nt, Homo sapiens
cagcuagaaauaagcccaa

SEQ ID NO: 911058 - RNA, 19 nt, Homo sapiens
cagcuagggcuggacucug

SEQ ID NO: 911059 - RNA, 13 nt, Homo sapiens
cagcuaugaaggc

SEQ ID NO: 911060 - RNA, 17 nt, Homo sapiens
aaauuauguauguuuac

SEQ ID NO: 911061 - RNA, 16 nt, Homo sapiens
aaauuauuguauuaca

SEQ ID NO: 911062 - RNA, 14 nt, Homo sapiens
aaauucaaacugcc

SEQ ID NO: 911063 - RNA, 22 nt, Homo sapiens
aaauucaagcugcuuuggacaa

SEQ ID NO: 911064 - RNA, 22 nt, Homo sapiens
aaauucaggugaaaauguucau

SEQ ID NO: 911065 - RNA, 22 nt, Homo sapiens
aaauucauuuuuuucacuggag

SEQ ID NO: 911066 - RNA, 20 nt, Homo sapiens
aaauucccccacuugggagc

SEQ ID NO: 911067 - RNA, 18 nt, Homo sapiens
aaauuccuguugucugac

SEQ ID NO: 911068 - RNA, 21 nt, Homo sapiens
aaauucuacugaacacuucaa

SEQ ID NO: 911069 - RNA, 15 nt, Homo sapiens
aaauucuuuuucaca

SEQ ID NO: 911070 - RNA, 14 nt, Homo sapiens
aaauugaaccuggu

SEQ ID NO: 911071 - RNA, 17 nt, Homo sapiens
aaauugaacuucaggga

SEQ ID NO: 911072 - RNA, 20 nt, Homo sapiens
aaauugcacuuuuaaaccuc

SEQ ID NO: 911073 - RNA, 12 nt, Homo sapiens
aaauugccuccu

SEQ ID NO: 911074 - RNA, 19 nt, Homo sapiens
aaauugcuacauaguccaa

SEQ ID NO: 911075 - RNA, 15 nt, Homo sapiens
aaauugcuuauucua

SEQ ID NO: 911076 - RNA, 20 nt, Homo sapiens
aaauugcuuauucuaggucu

SEQ ID NO: 911077 - RNA, 15 nt, Homo sapiens
aaauuggauacugcu

SEQ ID NO: 911078 - RNA, 13 nt, Homo sapiens
aaauuguauagag

SEQ ID NO: 911079 - RNA, 16 nt, Homo sapiens
aaauuguuuuuacuga

SEQ ID NO: 911080 - RNA, 18 nt, Homo sapiens
aaauuuaauauagcuauu

SEQ ID NO: 911081 - RNA, 14 nt, Homo sapiens
aaauuuaccacaga

SEQ ID NO: 911082 - RNA, 13 nt, Homo sapiens
aaauuuauugcuu

SEQ ID NO: 911083 - RNA, 19 nt, Homo sapiens
aaauuucaaaagacauguu

SEQ ID NO: 911084 - RNA, 19 nt, Homo sapiens
aaauuuccagugagcuuau

SEQ ID NO: 911085 - RNA, 22 nt, Homo sapiens
aaauuugacucaugaacuauuu

SEQ ID NO: 911086 - RNA, 21 nt, Homo sapiens
aaauuuggauuuacgacugaa

SEQ ID NO: 911087 - RNA, 14 nt, Homo sapiens
aaauuuguccaaug

SEQ ID NO: 911088 - RNA, 16 nt, Homo sapiens
aaauuuucuaugcuua

SEQ ID NO: 911089 - RNA, 19 nt, Homo sapiens
aacaaaagcuuuucuuucc

SEQ ID NO: 911090 - RNA, 14 nt, Homo sapiens
aacaaacaaugcca

SEQ ID NO: 911091 - RNA, 17 nt, Homo sapiens
aacaaagaacaagcauu

SEQ ID NO: 911092 - RNA, 21 nt, Homo sapiens
aacaaauuagguuuuguacaa

SEQ ID NO: 911093 - RNA, 15 nt, Homo sapiens
aacaaauuauguuac

SEQ ID NO: 911094 - RNA, 15 nt, Homo sapiens
aacaaauugaugcaa

SEQ ID NO: 911095 - RNA, 19 nt, Homo sapiens
aacaaccuggucacaggac

SEQ ID NO: 911096 - RNA, 22 nt, Homo sapiens
aacaaccuggucacaggacucu

SEQ ID NO: 911097 - RNA, 14 nt, Homo sapiens
aacaacguaaacuu

SEQ ID NO: 911098 - RNA, 19 nt, Homo sapiens
aacaacuuaauguucugaa

SEQ ID NO: 911099 - RNA, 22 nt, Homo sapiens
aacaagagaaaaaacuagagcc

SEQ ID NO: 911100 - RNA, 21 nt, Homo sapiens
aacaaggacccuguuuuccac

SEQ ID NO: 911101 - RNA, 22 nt, Homo sapiens
aacaaggggcuguuacauaaca

SEQ ID NO: 911102 - RNA, 12 nt, Homo sapiens
aacaaguagcua

SEQ ID NO: 911103 - RNA, 15 nt, Homo sapiens
aacaagugcacuuga

SEQ ID NO: 911104 - RNA, 17 nt, Homo sapiens
aacaauaaagacugaga

SEQ ID NO: 911105 - RNA, 21 nt, Homo sapiens
aacaauacaugcugcuaauuc

SEQ ID NO: 911106 - RNA, 13 nt, Homo sapiens
aacaauagcacaa

SEQ ID NO: 911107 - RNA, 14 nt, Homo sapiens
aacaauucaaguga

SEQ ID NO: 911108 - RNA, 14 nt, Homo sapiens
aacaauucucucuu

SEQ ID NO: 911109 - RNA, 22 nt, Homo sapiens
aacacaaaccacaacugacaca

SEQ ID NO: 911110 - RNA, 14 nt, Homo sapiens
aacacaagccacag

SEQ ID NO: 911111 - RNA, 18 nt, Homo sapiens
aacacacauggaugcaca

SEQ ID NO: 911112 - RNA, 12 nt, Homo sapiens
aacacacuguaa

SEQ ID NO: 911113 - RNA, 14 nt, Homo sapiens
aacacagccugugu

SEQ ID NO: 911114 - RNA, 21 nt, Homo sapiens
aacacagcuuuacaacuucca

SEQ ID NO: 911115 - RNA, 12 nt, Homo sapiens
aacacagugcug

SEQ ID NO: 911116 - RNA, 16 nt, Homo sapiens
aacaccaccaaaugac

SEQ ID NO: 911117 - RNA, 21 nt, Homo sapiens
aacaccacuuugucucugaga

SEQ ID NO: 911118 - RNA, 23 nt, Homo sapiens
aacaccacuuugucucugagaac

SEQ ID NO: 911119 - RNA, 20 nt, Homo sapiens
aacacccgacuccucaaaag

SEQ ID NO: 911120 - RNA, 22 nt, Homo sapiens
aacaccuucuuggcuucuggga

SEQ ID NO: 911121 - RNA, 21 nt, Homo sapiens
aacacgagcaggcuacuguca

SEQ ID NO: 911122 - RNA, 23 nt, Homo sapiens
caguuucuccuuuauugcuccug

SEQ ID NO: 911123 - RNA, 17 nt, Homo sapiens
cauaaacacccaugaau

SEQ ID NO: 911124 - RNA, 22 nt, Homo sapiens
cauaaaucuuguaaucauguua

SEQ ID NO: 911125 - RNA, 21 nt, Homo sapiens
cauaaaugugguacaagcauu

SEQ ID NO: 911126 - RNA, 23 nt, Homo sapiens
cauaacauaaauuuaucaucucg

SEQ ID NO: 911127 - RNA, 21 nt, Homo sapiens
cauaacuucucugagucugaa

SEQ ID NO: 911128 - RNA, 14 nt, Homo sapiens
cauaacuugcugaa

SEQ ID NO: 911129 - RNA, 15 nt, Homo sapiens
cauaacuugcugaau

SEQ ID NO: 911130 - RNA, 15 nt, Homo sapiens
cauaaggcauauaca

SEQ ID NO: 911131 - RNA, 19 nt, Homo sapiens
cauaagggacugugccaga

SEQ ID NO: 911132 - RNA, 19 nt, Homo sapiens
cauaagucuaaauaaauga

SEQ ID NO: 911133 - RNA, 13 nt, Homo sapiens
cauaagugcaaua

SEQ ID NO: 911134 - RNA, 21 nt, Homo sapiens
cauaauccagagauaauugcc

SEQ ID NO: 911135 - RNA, 15 nt, Homo sapiens
cauaaucucauucaa

SEQ ID NO: 911136 - RNA, 16 nt, Homo sapiens
cauaaucucauucaaa

SEQ ID NO: 911137 - RNA, 20 nt, Homo sapiens
cauaaugaaugcuauugaaa

SEQ ID NO: 911138 - RNA, 18 nt, Homo sapiens
cauaauuugaauggugca

SEQ ID NO: 911139 - RNA, 22 nt, Homo sapiens
cauaauuuguacauauguaaaa

SEQ ID NO: 911140 - RNA, 20 nt, Homo sapiens
cauacaccuaugucauuuca

SEQ ID NO: 911141 - RNA, 17 nt, Homo sapiens
cauacacucaaacaauc

SEQ ID NO: 911142 - RNA, 19 nt, Homo sapiens
cauacagagacagauauac

SEQ ID NO: 911143 - RNA, 16 nt, Homo sapiens
cauacauacauauaua

SEQ ID NO: 911144 - RNA, 18 nt, Homo sapiens
cauacaugacucagcaua

SEQ ID NO: 911145 - RNA, 21 nt, Homo sapiens
cauacaugacucagcauaccu

SEQ ID NO: 911146 - RNA, 22 nt, Homo sapiens
cauaccagaccacucugcuuca

SEQ ID NO: 911147 - RNA, 15 nt, Homo sapiens
cauacccuguuacca

SEQ ID NO: 911148 - RNA, 15 nt, Homo sapiens
cauaccucugaccaa

SEQ ID NO: 911149 - RNA, 17 nt, Homo sapiens
cauaccucugaccaaca

SEQ ID NO: 911150 - RNA, 15 nt, Homo sapiens
cauacgcaugguccu

SEQ ID NO: 911151 - RNA, 18 nt, Homo sapiens
cauacugaucccuuuccc

SEQ ID NO: 911152 - RNA, 15 nt, Homo sapiens
cauacuuucccacag

SEQ ID NO: 911153 - RNA, 16 nt, Homo sapiens
cauagaaacaugacac

SEQ ID NO: 911154 - RNA, 17 nt, Homo sapiens
cauagaaacaugacacu

SEQ ID NO: 911155 - RNA, 13 nt, Homo sapiens
cauagagacuuug

SEQ ID NO: 911156 - RNA, 16 nt, Homo sapiens
cauagagauaugcaca

SEQ ID NO: 911157 - RNA, 21 nt, Homo sapiens
cauagaugaacuauuagacau

SEQ ID NO: 911158 - RNA, 17 nt, Homo sapiens
cauagauuaauggcacu

SEQ ID NO: 911159 - RNA, 19 nt, Homo sapiens
cauagauuaauggcacuga

SEQ ID NO: 911160 - RNA, 17 nt, Homo sapiens
cauagcaagauugcuua

SEQ ID NO: 911161 - RNA, 15 nt, Homo sapiens
cauagcagugcuuga

SEQ ID NO: 911162 - RNA, 12 nt, Homo sapiens
cauagccuauaa

SEQ ID NO: 911163 - RNA, 19 nt, Homo sapiens
cauaggaaguauggcauga

SEQ ID NO: 911164 - RNA, 16 nt, Homo sapiens
cauaguacauacaaaa

SEQ ID NO: 911165 - RNA, 21 nt, Homo sapiens
cauaguaugguggcuggguug

SEQ ID NO: 911166 - RNA, 12 nt, Homo sapiens
cauagugccaua

SEQ ID NO: 911167 - RNA, 13 nt, Homo sapiens
cauauaauguugu

SEQ ID NO: 911168 - RNA, 21 nt, Homo sapiens
cauauauauauacacauacau

SEQ ID NO: 911169 - RNA, 13 nt, Homo sapiens
cauauauauguau

SEQ ID NO: 911170 - RNA, 14 nt, Homo sapiens
cauauauaugucag

SEQ ID NO: 911171 - RNA, 20 nt, Homo sapiens
cauauauauugaaaugcaaa

SEQ ID NO: 911172 - RNA, 17 nt, Homo sapiens
cauauaucuuacauaua

SEQ ID NO: 911173 - RNA, 22 nt, Homo sapiens
cauauguauuuuguauuugcau

SEQ ID NO: 911174 - RNA, 20 nt, Homo sapiens
cauaugugaauauggacuca

SEQ ID NO: 911175 - RNA, 12 nt, Homo sapiens
aacuuguaaaua

SEQ ID NO: 911176 - RNA, 20 nt, Homo sapiens
aacuuguaucugaagaccua

SEQ ID NO: 911177 - RNA, 13 nt, Homo sapiens
aacuuuggcuuau

SEQ ID NO: 911178 - RNA, 15 nt, Homo sapiens
aacuuuugugcuccc

SEQ ID NO: 911179 - RNA, 17 nt, Homo sapiens
aagaaaaaguugcaguc

SEQ ID NO: 911180 - RNA, 22 nt, Homo sapiens
aagaaaacuaacaaccaaccaa

SEQ ID NO: 911181 - RNA, 22 nt, Homo sapiens
aagaaaaguagguuuacauuca

SEQ ID NO: 911182 - RNA, 14 nt, Homo sapiens
aagaaaaucaucuu

SEQ ID NO: 911183 - RNA, 19 nt, Homo sapiens
aagaaacacucaacaauaa

SEQ ID NO: 911184 - RNA, 12 nt, Homo sapiens
aagaaacauaac

SEQ ID NO: 911185 - RNA, 17 nt, Homo sapiens
aagaaaguguuggcuaa

SEQ ID NO: 911186 - RNA, 22 nt, Homo sapiens
aagaaaucauggcauucacaca

SEQ ID NO: 911187 - RNA, 22 nt, Homo sapiens
aagaaauggaaucagcuuuuaa

SEQ ID NO: 911188 - RNA, 22 nt, Homo sapiens
aagaaauuccuguagcaucuuc

SEQ ID NO: 911189 - RNA, 19 nt, Homo sapiens
aagaacaaaucugggcauu

SEQ ID NO: 911190 - RNA, 19 nt, Homo sapiens
aagaacaucccaagccaga

SEQ ID NO: 911191 - RNA, 17 nt, Homo sapiens
aagaaccaaaagagauc

SEQ ID NO: 911192 - RNA, 20 nt, Homo sapiens
aagaacugacuagugagaug

SEQ ID NO: 911193 - RNA, 14 nt, Homo sapiens
aagaagaaucucau

SEQ ID NO: 911194 - RNA, 11 nt, Homo sapiens
aagaagacugg

SEQ ID NO: 911195 - RNA, 18 nt, Homo sapiens
aagaagagaaccaugaaa

SEQ ID NO: 911196 - RNA, 20 nt, Homo sapiens
aagaagaguuucuccuuuug

SEQ ID NO: 911197 - RNA, 20 nt, Homo sapiens
aagaagaguuugcaaaugca

SEQ ID NO: 911198 - RNA, 23 nt, Homo sapiens
aagaagcaaccucaguaauuuag

SEQ ID NO: 911199 - RNA, 17 nt, Homo sapiens
aagaaggacacuuguau

SEQ ID NO: 911200 - RNA, 21 nt, Homo sapiens
aagaaggaguucugacauuca

SEQ ID NO: 911201 - RNA, 23 nt, Homo sapiens
aagaagggauaauagacacauca

SEQ ID NO: 911202 - RNA, 15 nt, Homo sapiens
aagaaguucauuuug

SEQ ID NO: 911203 - RNA, 23 nt, Homo sapiens
aagaauaggucauuuucuauuca

SEQ ID NO: 911204 - RNA, 13 nt, Homo sapiens
aagaaucagucuu

SEQ ID NO: 911205 - RNA, 16 nt, Homo sapiens
aagaaucagucuugca

SEQ ID NO: 911206 - RNA, 22 nt, Homo sapiens
aagaaucuucugccccagcuuu

SEQ ID NO: 911207 - RNA, 20 nt, Homo sapiens
aagaauuccugaagccagau

SEQ ID NO: 911208 - RNA, 18 nt, Homo sapiens
aagacaaaccacuguaca

SEQ ID NO: 911209 - RNA, 19 nt, Homo sapiens
aagacaauggccauugugu

SEQ ID NO: 911210 - RNA, 16 nt, Homo sapiens
aagacaccaaauucca

SEQ ID NO: 911211 - RNA, 16 nt, Homo sapiens
aagacagagcugggau

SEQ ID NO: 911212 - RNA, 14 nt, Homo sapiens
aagacagauuacca

SEQ ID NO: 911213 - RNA, 19 nt, Homo sapiens
aagacagauuaccaaagaa

SEQ ID NO: 911214 - RNA, 16 nt, Homo sapiens
aagacagcugacagau

SEQ ID NO: 911215 - RNA, 14 nt, Homo sapiens
aagaccaauauuca

SEQ ID NO: 911216 - RNA, 13 nt, Homo sapiens
aagaccagacugu

SEQ ID NO: 911217 - RNA, 11 nt, Homo sapiens
aagacccagug

SEQ ID NO: 911218 - RNA, 14 nt, Homo sapiens
aagaccccaucucu

SEQ ID NO: 911219 - RNA, 20 nt, Homo sapiens
aagaccuucugaagaucuca

SEQ ID NO: 911220 - RNA, 19 nt, Homo sapiens
aagacgcucaagaauccuc

SEQ ID NO: 911221 - RNA, 18 nt, Homo sapiens
aagacguccuggaaugaa

SEQ ID NO: 911222 - RNA, 15 nt, Homo sapiens
aagacuacacuguug

SEQ ID NO: 911223 - RNA, 15 nt, Homo sapiens
aagacuacuauacaa

SEQ ID NO: 911224 - RNA, 18 nt, Homo sapiens
aagacuacuauacaaacu

SEQ ID NO: 911225 - RNA, 23 nt, Homo sapiens
aagacuauaaaaaaaugcauuua

SEQ ID NO: 911226 - RNA, 14 nt, Homo sapiens
aagacuauucaaac

SEQ ID NO: 911227 - RNA, 17 nt, Homo sapiens
aagacuauugugccuua

SEQ ID NO: 911228 - RNA, 22 nt, Homo sapiens
aagacucuacccauauuacaga

SEQ ID NO: 911229 - RNA, 21 nt, Homo sapiens
aagacugggcuagggagaaug

SEQ ID NO: 911230 - RNA, 15 nt, Homo sapiens
aagacuguugcucaa

SEQ ID NO: 911231 - RNA, 21 nt, Homo sapiens
aagacuugauacugcaauaaa

SEQ ID NO: 911232 - RNA, 14 nt, Homo sapiens
aagagacacugcuu

SEQ ID NO: 911233 - RNA, 22 nt, Homo sapiens
aagagacuaauagagacacaga

SEQ ID NO: 911234 - RNA, 13 nt, Homo sapiens
aagagacugagcc

SEQ ID NO: 911235 - RNA, 18 nt, Homo sapiens
aagagagaaaucugaaaa

SEQ ID NO: 911236 - RNA, 13 nt, Homo sapiens
aaggcugccucag

SEQ ID NO: 911237 - RNA, 17 nt, Homo sapiens
aaggcugcuguguagcu

SEQ ID NO: 911238 - RNA, 20 nt, Homo sapiens
aaggcuugaaguaaccuuau

SEQ ID NO: 911239 - RNA, 14 nt, Homo sapiens
aagggaaagccaga

SEQ ID NO: 911240 - RNA, 15 nt, Homo sapiens
aagggaaagucagcu

SEQ ID NO: 911241 - RNA, 14 nt, Homo sapiens
aagggaagcuguuu

SEQ ID NO: 911242 - RNA, 14 nt, Homo sapiens
aagggaguugcuca

SEQ ID NO: 911243 - RNA, 16 nt, Homo sapiens
aagggaucuuccuugg

SEQ ID NO: 911244 - RNA, 17 nt, Homo sapiens
aagggcaauaaaugccc

SEQ ID NO: 911245 - RNA, 9 nt, Homo sapiens
aagggccag

SEQ ID NO: 911246 - RNA, 17 nt, Homo sapiens
aagggcuagaaccugga

SEQ ID NO: 911247 - RNA, 18 nt, Homo sapiens
aaggggcauuacugggaa

SEQ ID NO: 911248 - RNA, 14 nt, Homo sapiens
aaggggcuuugucc

SEQ ID NO: 911249 - RNA, 13 nt, Homo sapiens
aagguagcccagc

SEQ ID NO: 911250 - RNA, 20 nt, Homo sapiens
aaggucaauuucaguguaug

SEQ ID NO: 911251 - RNA, 15 nt, Homo sapiens
aaggucucugaacuc

SEQ ID NO: 911252 - RNA, 14 nt, Homo sapiens
aaggugagugcuug

SEQ ID NO: 911253 - RNA, 17 nt, Homo sapiens
aaggugugcaaacuugu

SEQ ID NO: 911254 - RNA, 18 nt, Homo sapiens
aagguuaaaaaguucaua

SEQ ID NO: 911255 - RNA, 12 nt, Homo sapiens
aagguuacugau

SEQ ID NO: 911256 - RNA, 21 nt, Homo sapiens
aagguuaguaucaucagauag

SEQ ID NO: 911257 - RNA, 15 nt, Homo sapiens
aagguucacucucaa

SEQ ID NO: 911258 - RNA, 18 nt, Homo sapiens
aagguucccucugagaau

SEQ ID NO: 911259 - RNA, 22 nt, Homo sapiens
aagguugcugaggcucugaccc

SEQ ID NO: 911260 - RNA, 15 nt, Homo sapiens
aaguaaaagaaccac

SEQ ID NO: 911261 - RNA, 19 nt, Homo sapiens
aaguaaaggccucaucucc

SEQ ID NO: 911262 - RNA, 19 nt, Homo sapiens
aaguaacuuuuacaaaaca

SEQ ID NO: 911263 - RNA, 13 nt, Homo sapiens
aaguaauuuugcc

SEQ ID NO: 911264 - RNA, 22 nt, Homo sapiens
aaguacaaccugaauacccuuu

SEQ ID NO: 911265 - RNA, 19 nt, Homo sapiens
aaguaccccugauaagcaa

SEQ ID NO: 911266 - RNA, 12 nt, Homo sapiens
aaguagcaauuu

SEQ ID NO: 911267 - RNA, 18 nt, Homo sapiens
aaguauauauucuacaca

SEQ ID NO: 911268 - RNA, 15 nt, Homo sapiens
aaguaucaugcauuc

SEQ ID NO: 911269 - RNA, 18 nt, Homo sapiens
aaguauguaaacaggaga

SEQ ID NO: 911270 - RNA, 19 nt, Homo sapiens
aaguauuauuuauuugaau

SEQ ID NO: 911271 - RNA, 12 nt, Homo sapiens
aagucacacaga

SEQ ID NO: 911272 - RNA, 12 nt, Homo sapiens
aagucacacagu

SEQ ID NO: 911273 - RNA, 13 nt, Homo sapiens
aagucaccaaaau

SEQ ID NO: 911274 - RNA, 20 nt, Homo sapiens
aagucaugaagcccaaguga

SEQ ID NO: 911275 - RNA, 14 nt, Homo sapiens
aagucccagcauug

SEQ ID NO: 911276 - RNA, 19 nt, Homo sapiens
aaguccuacaagcuaaaau

SEQ ID NO: 911277 - RNA, 17 nt, Homo sapiens
aagucuaaauaaaugaa

SEQ ID NO: 911278 - RNA, 17 nt, Homo sapiens
aagucuacuucacuaau

SEQ ID NO: 911279 - RNA, 19 nt, Homo sapiens
aagucuguuuuaaugacaa

SEQ ID NO: 911280 - RNA, 22 nt, Homo sapiens
aagucuuccauagagacuuugu

SEQ ID NO: 911281 - RNA, 16 nt, Homo sapiens
aagucuuccauugcau

SEQ ID NO: 911282 - RNA, 23 nt, Homo sapiens
aagucuuuccgucucccuaaaau

SEQ ID NO: 911283 - RNA, 23 nt, Homo sapiens
aagugaagaaaagugaaugcuca

SEQ ID NO: 911284 - RNA, 11 nt, Homo sapiens
aagugaccuau

SEQ ID NO: 911285 - RNA, 19 nt, Homo sapiens
aagugaccuauaccugugu

SEQ ID NO: 911286 - RNA, 14 nt, Homo sapiens
aagugagagagcaa

SEQ ID NO: 911287 - RNA, 20 nt, Homo sapiens
aagugagggcugggcagcug

SEQ ID NO: 911288 - RNA, 20 nt, Homo sapiens
aagugauccucccaccucag

SEQ ID NO: 911289 - RNA, 13 nt, Homo sapiens
aagugaucugucc

SEQ ID NO: 911290 - RNA, 14 nt, Homo sapiens
aagugaucuguccc

SEQ ID NO: 911291 - RNA, 15 nt, Homo sapiens
caugucagacuguac

SEQ ID NO: 911292 - RNA, 12 nt, Homo sapiens
cauguccucaaa

SEQ ID NO: 911293 - RNA, 14 nt, Homo sapiens
cauguccucaaaac

SEQ ID NO: 911294 - RNA, 13 nt, Homo sapiens
caugucucacaga

SEQ ID NO: 911295 - RNA, 18 nt, Homo sapiens
caugucuuguacaugugu

SEQ ID NO: 911296 - RNA, 18 nt, Homo sapiens
caugugacacauaugcac

SEQ ID NO: 911297 - RNA, 14 nt, Homo sapiens
caugugcacaugca

SEQ ID NO: 911298 - RNA, 12 nt, Homo sapiens
caugugccaguu

SEQ ID NO: 911299 - RNA, 12 nt, Homo sapiens
caugugccugua

SEQ ID NO: 911300 - RNA, 19 nt, Homo sapiens
cauguggaagcacuuuaag

SEQ ID NO: 911301 - RNA, 18 nt, Homo sapiens
cauguggcguauugggcc

SEQ ID NO: 911302 - RNA, 19 nt, Homo sapiens
cauguggugggacagggac

SEQ ID NO: 911303 - RNA, 20 nt, Homo sapiens
cauguguggauguguaaaug

SEQ ID NO: 911304 - RNA, 17 nt, Homo sapiens
cauguguugccuggaag

SEQ ID NO: 911305 - RNA, 19 nt, Homo sapiens
cauguguuuuaauuccaau

SEQ ID NO: 911306 - RNA, 16 nt, Homo sapiens
cauguuccucaaaagc

SEQ ID NO: 911307 - RNA, 15 nt, Homo sapiens
cauguuggcccagac

SEQ ID NO: 911308 - RNA, 17 nt, Homo sapiens
cauguuguaagcacuga

SEQ ID NO: 911309 - RNA, 18 nt, Homo sapiens
cauguuuagauuccagga

SEQ ID NO: 911310 - RNA, 12 nt, Homo sapiens
cauguuuuuacc

SEQ ID NO: 911311 - RNA, 23 nt, Homo sapiens
cauuaaaaaugcauauacuuuaa

SEQ ID NO: 911312 - RNA, 15 nt, Homo sapiens
cauuaaaagcuauca

SEQ ID NO: 911313 - RNA, 15 nt, Homo sapiens
cauuaaacuuaccug

SEQ ID NO: 911314 - RNA, 13 nt, Homo sapiens
cauuaaaugacaa

SEQ ID NO: 911315 - RNA, 17 nt, Homo sapiens
cauuaaauucacaugca

SEQ ID NO: 911316 - RNA, 13 nt, Homo sapiens
cauuacaguuugg

SEQ ID NO: 911317 - RNA, 18 nt, Homo sapiens
cauuaccaaguuacuuga

SEQ ID NO: 911318 - RNA, 17 nt, Homo sapiens
cauuacugcaugcacuu

SEQ ID NO: 911319 - RNA, 15 nt, Homo sapiens
cauuacuugcacaag

SEQ ID NO: 911320 - RNA, 22 nt, Homo sapiens
cauuacuuuaauacucaccucc

SEQ ID NO: 911321 - RNA, 23 nt, Homo sapiens
cauuacuuuaauacucaccuccu

SEQ ID NO: 911322 - RNA, 14 nt, Homo sapiens
cauuagaaacugaa

SEQ ID NO: 911323 - RNA, 23 nt, Homo sapiens
cauuagaaacugaaaacuguaaa

SEQ ID NO: 911324 - RNA, 13 nt, Homo sapiens
cauuagagugaga

SEQ ID NO: 911325 - RNA, 16 nt, Homo sapiens
cauuagcuacuuuuca

SEQ ID NO: 911326 - RNA, 21 nt, Homo sapiens
cauuagguuuccuuuuauucu

SEQ ID NO: 911327 - RNA, 14 nt, Homo sapiens
cauuaguuuugcau

SEQ ID NO: 911328 - RNA, 16 nt, Homo sapiens
cauuauguacaauaca

SEQ ID NO: 911329 - RNA, 17 nt, Homo sapiens
cauuauuuugaauguga

SEQ ID NO: 911330 - RNA, 22 nt, Homo sapiens
cauucaaaacaaccauccugcu

SEQ ID NO: 911331 - RNA, 11 nt, Homo sapiens
cauucaaagaa

SEQ ID NO: 911332 - RNA, 14 nt, Homo sapiens
cauucacagagccu

SEQ ID NO: 911333 - RNA, 17 nt, Homo sapiens
cauucacagccaggaga

SEQ ID NO: 911334 - RNA, 12 nt, Homo sapiens
cauucacuuguu

SEQ ID NO: 911335 - RNA, 17 nt, Homo sapiens
cauucauuuaacagagc

SEQ ID NO: 911336 - RNA, 17 nt, Homo sapiens
cauucauuuauucauuc

SEQ ID NO: 911337 - RNA, 12 nt, Homo sapiens
cauuccaggaaa

SEQ ID NO: 911338 - RNA, 15 nt, Homo sapiens
cauucccagugguca

SEQ ID NO: 911339 - RNA, 22 nt, Homo sapiens
cauuccccucgugugacucucu

SEQ ID NO: 911340 - RNA, 20 nt, Homo sapiens
cauuccugaaagaaacaguu

SEQ ID NO: 911341 - RNA, 23 nt, Homo sapiens
cauuccuguagucaaaaucuggu

SEQ ID NO: 911342 - RNA, 13 nt, Homo sapiens
cauucuacacuga

SEQ ID NO: 911343 - RNA, 16 nt, Homo sapiens
cauucugaccauuuca

SEQ ID NO: 911344 - RNA, 21 nt, Homo sapiens
cauucugcucuuugauucaaa

SEQ ID NO: 911345 - RNA, 16 nt, Homo sapiens
cauucuguuugucucg

SEQ ID NO: 911346 - RNA, 18 nt, Homo sapiens
cauugaacagcaaaguag

SEQ ID NO: 911347 - RNA, 23 nt, Homo sapiens
cauugcaacaagguuaccucuau

SEQ ID NO: 911348 - RNA, 16 nt, Homo sapiens
cauugcauguauugua

SEQ ID NO: 911349 - RNA, 16 nt, Homo sapiens
cauugcuucugcuaaa

SEQ ID NO: 911350 - RNA, 19 nt, Homo sapiens
cauugggcugacaccuacc

SEQ ID NO: 911351 - RNA, 19 nt, Homo sapiens
cauuggguuguagccaaag

SEQ ID NO: 911352 - RNA, 15 nt, Homo sapiens
cgcaaguucagggaa

SEQ ID NO: 911353 - RNA, 21 nt, Homo sapiens
cgcacaaggcugaccaagaga

SEQ ID NO: 911354 - RNA, 13 nt, Homo sapiens
cgcacacauggac

SEQ ID NO: 911355 - RNA, 16 nt, Homo sapiens
cgcaucgugguguguc

SEQ ID NO: 911356 - RNA, 19 nt, Homo sapiens
cgcaucguggugugucaau

SEQ ID NO: 911357 - RNA, 13 nt, Homo sapiens
cgcauucccugag

SEQ ID NO: 911358 - RNA, 22 nt, Homo sapiens
cgccaacugcugaucaaugaaa

SEQ ID NO: 911359 - RNA, 14 nt, Homo sapiens
cgccauuccaaguc

SEQ ID NO: 911360 - RNA, 19 nt, Homo sapiens
cgcccagcugcaccugcca

SEQ ID NO: 911361 - RNA, 21 nt, Homo sapiens
cgcccagucuggaaugcagug

SEQ ID NO: 911362 - RNA, 19 nt, Homo sapiens
cgccccucgcugcugcuac

SEQ ID NO: 911363 - RNA, 16 nt, Homo sapiens
cgcccgaccaggauca

SEQ ID NO: 911364 - RNA, 19 nt, Homo sapiens
cgcccugggcugucuguca

SEQ ID NO: 911365 - RNA, 23 nt, Homo sapiens
cgccucccagccccaggggugcc

SEQ ID NO: 911366 - RNA, 20 nt, Homo sapiens
cgccucucccaccccaugca

SEQ ID NO: 911367 - RNA, 20 nt, Homo sapiens
cgcgcaccuguaaucccagc

SEQ ID NO: 911368 - RNA, 20 nt, Homo sapiens
cgcgugugacagucuugcau

SEQ ID NO: 911369 - RNA, 22 nt, Homo sapiens
cgcuaaaugaaaaucgugacaa

SEQ ID NO: 911370 - RNA, 14 nt, Homo sapiens
cgcuccagaucugc

SEQ ID NO: 911371 - RNA, 22 nt, Homo sapiens
cgcucuuggcagguacucagcg

SEQ ID NO: 911372 - RNA, 19 nt, Homo sapiens
cgcuucuccuccagguauu

SEQ ID NO: 911373 - RNA, 12 nt, Homo sapiens
cgcuuugugagc

SEQ ID NO: 911374 - RNA, 17 nt, Homo sapiens
cggaaccugaaggugcu

SEQ ID NO: 911375 - RNA, 17 nt, Homo sapiens
cggaagaaaaagagcca

SEQ ID NO: 911376 - RNA, 18 nt, Homo sapiens
cggaagcccuugccugaa

SEQ ID NO: 911377 - RNA, 19 nt, Homo sapiens
cggaagcccuugccugaaa

SEQ ID NO: 911378 - RNA, 12 nt, Homo sapiens
cggaaggcaaag

SEQ ID NO: 911379 - RNA, 14 nt, Homo sapiens
cggacaaguuuuaa

SEQ ID NO: 911380 - RNA, 20 nt, Homo sapiens
cggacacagagggggccuuc

SEQ ID NO: 911381 - RNA, 20 nt, Homo sapiens
cggagaagagcuguucacag

SEQ ID NO: 911382 - RNA, 14 nt, Homo sapiens
cggagaauugccuc

SEQ ID NO: 911383 - RNA, 23 nt, Homo sapiens
cggagacggagucccaccuuggc

SEQ ID NO: 911384 - RNA, 20 nt, Homo sapiens
cggagcuugcagugagccga

SEQ ID NO: 911385 - RNA, 17 nt, Homo sapiens
cggaggagaccagcuca

SEQ ID NO: 911386 - RNA, 15 nt, Homo sapiens
cggagguuccaguga

SEQ ID NO: 911387 - RNA, 14 nt, Homo sapiens
cggccccaucagag

SEQ ID NO: 911388 - RNA, 20 nt, Homo sapiens
cggccuagggguccacggga

SEQ ID NO: 911389 - RNA, 19 nt, Homo sapiens
cgggagaggagaucagggc

SEQ ID NO: 911390 - RNA, 23 nt, Homo sapiens
cgggauccccagccuacugccuc

SEQ ID NO: 911391 - RNA, 20 nt, Homo sapiens
cgggaucucguaucuuuaaa

SEQ ID NO: 911392 - RNA, 13 nt, Homo sapiens
cgggcugcacaga

SEQ ID NO: 911393 - RNA, 15 nt, Homo sapiens
cggggcccuguguag

SEQ ID NO: 911394 - RNA, 14 nt, Homo sapiens
cgggggaaagcaca

SEQ ID NO: 911395 - RNA, 22 nt, Homo sapiens
cggguaccgugcaugugcaguc

SEQ ID NO: 911396 - RNA, 13 nt, Homo sapiens
cggguguguacac

SEQ ID NO: 911397 - RNA, 21 nt, Homo sapiens
cgguggggcguagacuugaca

SEQ ID NO: 911398 - RNA, 22 nt, Homo sapiens
cggugucuggaaaagcacuuua

SEQ ID NO: 911399 - RNA, 22 nt, Homo sapiens
cguaauguauuuauauguuaau

SEQ ID NO: 911400 - RNA, 13 nt, Homo sapiens
cguagacuugaca

SEQ ID NO: 911401 - RNA, 15 nt, Homo sapiens
cgucccaugugcaug

SEQ ID NO: 911402 - RNA, 13 nt, Homo sapiens
cguccuuccucuc

SEQ ID NO: 911403 - RNA, 14 nt, Homo sapiens
cgucucaagacuga

SEQ ID NO: 911404 - RNA, 16 nt, Homo sapiens
cgugcacacaccagag

SEQ ID NO: 911405 - RNA, 20 nt, Homo sapiens
cgugccagcucuaguuuuca

SEQ ID NO: 911406 - RNA, 14 nt, Homo sapiens
cgugccaugaucug

SEQ ID NO: 911407 - RNA, 20 nt, Homo sapiens
cgugccccgccuccccgaaa

SEQ ID NO: 911408 - RNA, 13 nt, Homo sapiens
cgugcuaccugca

SEQ ID NO: 911409 - RNA, 13 nt, Homo sapiens
cguggacucugca

SEQ ID NO: 911410 - RNA, 14 nt, Homo sapiens
cguggacucugcac

SEQ ID NO: 911411 - RNA, 21 nt, Homo sapiens
cguggacucugcacaugucuu

SEQ ID NO: 911412 - RNA, 15 nt, Homo sapiens
cgugguagaagccag

SEQ ID NO: 911413 - RNA, 14 nt, Homo sapiens
cguguccgacucuu

SEQ ID NO: 911414 - RNA, 15 nt, Homo sapiens
cguguccugccuuga

SEQ ID NO: 911415 - RNA, 23 nt, Homo sapiens
cgugugaaguguaguggcaucca

SEQ ID NO: 911416 - RNA, 18 nt, Homo sapiens
cguguuacuguugcacug

SEQ ID NO: 911417 - RNA, 16 nt, Homo sapiens
cguguucucacacugg

SEQ ID NO: 911418 - RNA, 18 nt, Homo sapiens
cguuacugcauacugauc

SEQ ID NO: 911419 - RNA, 19 nt, Homo sapiens
cguuccuuccgaugacagu

SEQ ID NO: 911420 - RNA, 20 nt, Homo sapiens
cguugaagaggaagggcaaa

SEQ ID NO: 911421 - RNA, 14 nt, Homo sapiens
cguuuggcauuucu

SEQ ID NO: 911422 - RNA, 18 nt, Homo sapiens
cuaaaaaacagaggccau

SEQ ID NO: 911423 - RNA, 21 nt, Homo sapiens
cuaaaaaguggcuaauucaau

SEQ ID NO: 911424 - RNA, 13 nt, Homo sapiens
cuaaaaaucauga

SEQ ID NO: 911425 - RNA, 15 nt, Homo sapiens
cuaaaaaugcaacuu

SEQ ID NO: 911426 - RNA, 15 nt, Homo sapiens
cuaaaaccugagcua

SEQ ID NO: 911427 - RNA, 15 nt, Homo sapiens
cuaaaacugcugaac

SEQ ID NO: 911428 - RNA, 19 nt, Homo sapiens
cuaaaauacaaacaagcac

SEQ ID NO: 911429 - RNA, 18 nt, Homo sapiens
cuaaaauucacuuagggu

SEQ ID NO: 911430 - RNA, 14 nt, Homo sapiens
cuaaacagauauaa

SEQ ID NO: 911431 - RNA, 20 nt, Homo sapiens
cuaaacugcuguuaauugau

SEQ ID NO: 911432 - RNA, 22 nt, Homo sapiens
cuaaagguagaucaucuugaau

SEQ ID NO: 911433 - RNA, 17 nt, Homo sapiens
cuaaaguauaucuuuaa

SEQ ID NO: 911434 - RNA, 18 nt, Homo sapiens
cuaaagugccuaccccag

SEQ ID NO: 911435 - RNA, 16 nt, Homo sapiens
cuaaauaauacaggau

SEQ ID NO: 911436 - RNA, 21 nt, Homo sapiens
cuaaauaauguuaucugugua

SEQ ID NO: 911437 - RNA, 14 nt, Homo sapiens
cuaaauaggagaua

SEQ ID NO: 911438 - RNA, 18 nt, Homo sapiens
cuaaauccuuuacuguua

SEQ ID NO: 911439 - RNA, 15 nt, Homo sapiens
cuaaaucucuaauau

SEQ ID NO: 911440 - RNA, 14 nt, Homo sapiens
cuaaaugaccucag

SEQ ID NO: 911441 - RNA, 11 nt, Homo sapiens
cuaaauuucca

SEQ ID NO: 911442 - RNA, 13 nt, Homo sapiens
cccugagguccug

SEQ ID NO: 911443 - RNA, 14 nt, Homo sapiens
cccugauaagcaaa

SEQ ID NO: 911444 - RNA, 14 nt, Homo sapiens
cccugaucaaguca

SEQ ID NO: 911445 - RNA, 14 nt, Homo sapiens
cccugcacaaagcc

SEQ ID NO: 911446 - RNA, 17 nt, Homo sapiens
cccugcaggaaaacuga

SEQ ID NO: 911447 - RNA, 19 nt, Homo sapiens
cccugcauugcugagucaa

SEQ ID NO: 911448 - RNA, 17 nt, Homo sapiens
cccugcauuucugaguu

SEQ ID NO: 911449 - RNA, 14 nt, Homo sapiens
cccugccuuugaaa

SEQ ID NO: 911450 - RNA, 14 nt, Homo sapiens
cccugcuuaccuga

SEQ ID NO: 911451 - RNA, 22 nt, Homo sapiens
cccuggcccugccucauccacc

SEQ ID NO: 911452 - RNA, 16 nt, Homo sapiens
cccugggcucaucagc

SEQ ID NO: 911453 - RNA, 22 nt, Homo sapiens
cccuggggcuucuccugaccca

SEQ ID NO: 911454 - RNA, 16 nt, Homo sapiens
cccuggugucaggcag

SEQ ID NO: 911455 - RNA, 16 nt, Homo sapiens
cccuguccccugaaaa

SEQ ID NO: 911456 - RNA, 17 nt, Homo sapiens
cccuguccccugaaaaa

SEQ ID NO: 911457 - RNA, 18 nt, Homo sapiens
cccugucucuagccacuu

SEQ ID NO: 911458 - RNA, 20 nt, Homo sapiens
cccugugcugacggaagcca

SEQ ID NO: 911459 - RNA, 14 nt, Homo sapiens
cccuguuaagcaau

SEQ ID NO: 911460 - RNA, 21 nt, Homo sapiens
cccaauacauaccacuuugaa

SEQ ID NO: 911461 - RNA, 15 nt, Homo sapiens
cccaaucagcacuga

SEQ ID NO: 911462 - RNA, 17 nt, Homo sapiens
cccaaucagcacugaaa

SEQ ID NO: 911463 - RNA, 19 nt, Homo sapiens
cccacaccccuccaaagcc

SEQ ID NO: 911464 - RNA, 22 nt, Homo sapiens
cccacacugaccuguguucccu

SEQ ID NO: 911465 - RNA, 12 nt, Homo sapiens
cccacagcacua

SEQ ID NO: 911466 - RNA, 20 nt, Homo sapiens
cccacagcacuacgaugugu

SEQ ID NO: 911467 - RNA, 13 nt, Homo sapiens
cccacaguccuca

SEQ ID NO: 911468 - RNA, 15 nt, Homo sapiens
cccacauauggcaca

SEQ ID NO: 911469 - RNA, 23 nt, Homo sapiens
cccacaugugacacauaugcacc

SEQ ID NO: 911470 - RNA, 14 nt, Homo sapiens
cccaccaacucugc

SEQ ID NO: 911471 - RNA, 14 nt, Homo sapiens
cccacccuaccaca

SEQ ID NO: 911472 - RNA, 20 nt, Homo sapiens
cccaccuccgccccagacac

SEQ ID NO: 911473 - RNA, 20 nt, Homo sapiens
cccacgugugcagacugugg

SEQ ID NO: 911474 - RNA, 23 nt, Homo sapiens
cccacuaagcuuucuccuuugag

SEQ ID NO: 911475 - RNA, 14 nt, Homo sapiens
cccacuguccagca

SEQ ID NO: 911476 - RNA, 18 nt, Homo sapiens
cagccuccgccauuccaa

SEQ ID NO: 911477 - RNA, 20 nt, Homo sapiens
caaguauuuuaucuguguug

SEQ ID NO: 911478 - RNA, 21 nt, Homo sapiens
caaguccugugaauuucuuca

SEQ ID NO: 911479 - RNA, 17 nt, Homo sapiens
caagucuaacaguuaau

SEQ ID NO: 911480 - RNA, 16 nt, Homo sapiens
caagucuacuucacua

SEQ ID NO: 911481 - RNA, 21 nt, Homo sapiens
caagucuacuucacuaaugac

SEQ ID NO: 911482 - RNA, 14 nt, Homo sapiens
caagugacaucucu

SEQ ID NO: 911483 - RNA, 17 nt, Homo sapiens
cccuuacuaugaucuca

SEQ ID NO: 911484 - RNA, 21 nt, Homo sapiens
cccuuccacuuugaguaccaa

SEQ ID NO: 911485 - RNA, 21 nt, Homo sapiens
cccuuccaugucgccucugca

SEQ ID NO: 911486 - RNA, 16 nt, Homo sapiens
cccuucccaaucagca

SEQ ID NO: 911487 - RNA, 22 nt, Homo sapiens
cccuuggcccucucccaugcac

SEQ ID NO: 911488 - RNA, 19 nt, Homo sapiens
cccuuuccuacucucagga

SEQ ID NO: 911489 - RNA, 21 nt, Homo sapiens
cccuuuccugggggaugugca

SEQ ID NO: 911490 - RNA, 20 nt, Homo sapiens
ccgaagcccaggcugaagag

SEQ ID NO: 911491 - RNA, 14 nt, Homo sapiens
ccgaagucuuccau

SEQ ID NO: 911492 - RNA, 17 nt, Homo sapiens
ccgaauagcugggacua

SEQ ID NO: 911493 - RNA, 23 nt, Homo sapiens
ccgacacugcugcaccagaguga

SEQ ID NO: 911494 - RNA, 21 nt, Homo sapiens
ccgacugcuagggaguggucu

SEQ ID NO: 911495 - RNA, 16 nt, Homo sapiens
ccgagcuagagugcag

SEQ ID NO: 911496 - RNA, 20 nt, Homo sapiens
ccgagucucuucuccacugg

SEQ ID NO: 911497 - RNA, 17 nt, Homo sapiens
ccgauguacacacacag

SEQ ID NO: 911498 - RNA, 19 nt, Homo sapiens
ccgaugugcgcacacacag

SEQ ID NO: 911499 - RNA, 23 nt, Homo sapiens
ccgcaacaguuuuuuaugcuaau

SEQ ID NO: 911500 - RNA, 21 nt, Homo sapiens
ccgcaccgggcccuccuugcc

SEQ ID NO: 911501 - RNA, 18 nt, Homo sapiens
ccgcagugggaagugaau

SEQ ID NO: 911502 - RNA, 16 nt, Homo sapiens
ccgccaaacacuccac

SEQ ID NO: 911503 - RNA, 18 nt, Homo sapiens
ccgccuccaaaugccaac

SEQ ID NO: 911504 - RNA, 20 nt, Homo sapiens
ccgccuggccggcuccaguu

SEQ ID NO: 911505 - RNA, 23 nt, Homo sapiens
ccgcgcgaagugggcauugcaaa

SEQ ID NO: 911506 - RNA, 14 nt, Homo sapiens
ccgcggugcucugg

SEQ ID NO: 911507 - RNA, 14 nt, Homo sapiens
ccgcgugccaugca

SEQ ID NO: 911508 - RNA, 12 nt, Homo sapiens
ccgcguggaaug

SEQ ID NO: 911509 - RNA, 14 nt, Homo sapiens
ccgcucuggaccaa

SEQ ID NO: 911510 - RNA, 13 nt, Homo sapiens
ccgcuugccauau

SEQ ID NO: 911511 - RNA, 12 nt, Homo sapiens
ccggccagccuu

SEQ ID NO: 911512 - RNA, 22 nt, Homo sapiens
ccggcucccuucuacagccuca

SEQ ID NO: 911513 - RNA, 21 nt, Homo sapiens
ccgggagaggagaucagggcg

SEQ ID NO: 911514 - RNA, 15 nt, Homo sapiens
ccggggaacuggcca

SEQ ID NO: 911515 - RNA, 13 nt, Homo sapiens
ccgggugccauuc

SEQ ID NO: 911516 - RNA, 22 nt, Homo sapiens
ccggugucuggaaaagcacuuu

SEQ ID NO: 911517 - RNA, 17 nt, Homo sapiens
ccguaacaacugugguc

SEQ ID NO: 911518 - RNA, 22 nt, Homo sapiens
ccgucaccucagagacauacac

SEQ ID NO: 911519 - RNA, 12 nt, Homo sapiens
ccgucucaaaaa

SEQ ID NO: 911520 - RNA, 20 nt, Homo sapiens
ccgugaaauugaugccagug

SEQ ID NO: 911521 - RNA, 22 nt, Homo sapiens
ccgugcucgcccacaaacugau

SEQ ID NO: 911522 - RNA, 13 nt, Homo sapiens
ccguucaacuuuu

SEQ ID NO: 911523 - RNA, 18 nt, Homo sapiens
ccguucgcccccauguga

SEQ ID NO: 911524 - RNA, 20 nt, Homo sapiens
ccguuuuuacuaaguaaaag

SEQ ID NO: 911525 - RNA, 17 nt, Homo sapiens
ccuaaacaucauucauu

SEQ ID NO: 911526 - RNA, 14 nt, Homo sapiens
ccuaaagucucugc

SEQ ID NO: 911527 - RNA, 14 nt, Homo sapiens
ccuaaccuagagau

SEQ ID NO: 911528 - RNA, 17 nt, Homo sapiens
ccuaagacuuauguauu

SEQ ID NO: 911529 - RNA, 20 nt, Homo sapiens
ccuaagagagcaccugguga

SEQ ID NO: 911530 - RNA, 21 nt, Homo sapiens
ccuaagaucaaaccccaugga

SEQ ID NO: 911531 - RNA, 15 nt, Homo sapiens
ccuaaggaucucuca

SEQ ID NO: 911532 - RNA, 13 nt, Homo sapiens
ccuaauacaacau

SEQ ID NO: 911533 - RNA, 17 nt, Homo sapiens
ccuaauacaacauguag

SEQ ID NO: 911534 - RNA, 19 nt, Homo sapiens
ccuaaugauuagcacuuaa

SEQ ID NO: 911535 - RNA, 17 nt, Homo sapiens
ccuaaugcuaguuucau

SEQ ID NO: 911536 - RNA, 14 nt, Homo sapiens
ccuaccacaguguc

SEQ ID NO: 911537 - RNA, 15 nt, Homo sapiens
ccuaccacagugucu

SEQ ID NO: 911538 - RNA, 23 nt, Homo sapiens
ccuaccaguuggccaugaugucu

SEQ ID NO: 911539 - RNA, 11 nt, Homo sapiens
ccuaccccaga

SEQ ID NO: 911540 - RNA, 14 nt, Homo sapiens
ccuacguuaaccca

SEQ ID NO: 911541 - RNA, 21 nt, Homo sapiens
ccuacugccucuccagcacuu

SEQ ID NO: 911542 - RNA, 17 nt, Homo sapiens
ccuacuuacaugcauua

SEQ ID NO: 911543 - RNA, 20 nt, Homo sapiens
ccuacuuuauguauggagcu

SEQ ID NO: 911544 - RNA, 23 nt, Homo sapiens
ccuagaagggcuagaaccuggag

SEQ ID NO: 911545 - RNA, 23 nt, Homo sapiens
ccuagcaaggcaugauguuaacc

SEQ ID NO: 911546 - RNA, 23 nt, Homo sapiens
ccuagcaggcacaggacaccugg

SEQ ID NO: 911547 - RNA, 19 nt, Homo sapiens
ccuagccucgcucuuggca

SEQ ID NO: 911548 - RNA, 16 nt, Homo sapiens
ccuagcugugaccucu

SEQ ID NO: 911549 - RNA, 13 nt, Homo sapiens
ccuaggaccucag

SEQ ID NO: 911550 - RNA, 16 nt, Homo sapiens
ccuaggaccucaggcg

SEQ ID NO: 911551 - RNA, 11 nt, Homo sapiens
ccuaggcaaag

SEQ ID NO: 911552 - RNA, 18 nt, Homo sapiens
ccuaggccaaaugcacaa

SEQ ID NO: 911553 - RNA, 13 nt, Homo sapiens
ccuagugcuauuc

SEQ ID NO: 911554 - RNA, 18 nt, Homo sapiens
ccuauaaggagaguucaa

SEQ ID NO: 911555 - RNA, 17 nt, Homo sapiens
ccuauauguagcuuuau

SEQ ID NO: 911556 - RNA, 23 nt, Homo sapiens
ccuaucagaaguuucucagcucc

SEQ ID NO: 911557 - RNA, 16 nt, Homo sapiens
ccuaucuguaugucug

SEQ ID NO: 911558 - RNA, 16 nt, Homo sapiens
ccuaucuugugcucuu

SEQ ID NO: 911559 - RNA, 16 nt, Homo sapiens
ccuaugcacauaugga

SEQ ID NO: 911560 - RNA, 23 nt, Homo sapiens
ccuaugucaauuuguauaucaug

SEQ ID NO: 911561 - RNA, 16 nt, Homo sapiens
ccuauuaaccuagaga

SEQ ID NO: 911562 - RNA, 15 nt, Homo sapiens
ccuauuuauucauuc

SEQ ID NO: 911563 - RNA, 11 nt, Homo sapiens
ccuauuugcac

SEQ ID NO: 911564 - RNA, 22 nt, Homo sapiens
ccuauuuuaauuggaauucugg

SEQ ID NO: 911565 - RNA, 17 nt, Homo sapiens
ccucaaaaaaagccuuu

SEQ ID NO: 911566 - RNA, 22 nt, Homo sapiens
ccucaaagcccccacuucucuc

SEQ ID NO: 911567 - RNA, 22 nt, Homo sapiens
ccucaaaguuggggcaggcugg

SEQ ID NO: 911568 - RNA, 17 nt, Homo sapiens
ccucaaaugacccaaag

SEQ ID NO: 911569 - RNA, 13 nt, Homo sapiens
ccucaaaugucag

SEQ ID NO: 911570 - RNA, 19 nt, Homo sapiens
ccucaaaugucagagcuau

SEQ ID NO: 911571 - RNA, 20 nt, Homo sapiens
ccucaacaacaaaccaaaac

SEQ ID NO: 911572 - RNA, 22 nt, Homo sapiens
ccucaacaacguaaacuuccua

SEQ ID NO: 911573 - RNA, 11 nt, Homo sapiens
ccucaagaaga

SEQ ID NO: 911574 - RNA, 18 nt, Homo sapiens
ccucaccugguugaccca

SEQ ID NO: 911575 - RNA, 15 nt, Homo sapiens
ccucacugauauauu

SEQ ID NO: 911576 - RNA, 20 nt, Homo sapiens
ccucagacaauccacucuca

SEQ ID NO: 911577 - RNA, 14 nt, Homo sapiens
caaaucaucucuca

SEQ ID NO: 911578 - RNA, 20 nt, Homo sapiens
caaaucaucucucaucacuu

SEQ ID NO: 911579 - RNA, 14 nt, Homo sapiens
caaaucccacaggg

SEQ ID NO: 911580 - RNA, 22 nt, Homo sapiens
caaaucuccaguauucuuguca

SEQ ID NO: 911581 - RNA, 16 nt, Homo sapiens
caaaucuuaacuugaa

SEQ ID NO: 911582 - RNA, 20 nt, Homo sapiens
caaaugacaugcacugaccc

SEQ ID NO: 911583 - RNA, 20 nt, Homo sapiens
caaaugaguucaacuuugag

SEQ ID NO: 911584 - RNA, 18 nt, Homo sapiens
caaaugaugccacuuccc

SEQ ID NO: 911585 - RNA, 19 nt, Homo sapiens
auccucaacaacaaaccaa

SEQ ID NO: 911586 - RNA, 20 nt, Homo sapiens
auccucaacaacaaaccaaa

SEQ ID NO: 911587 - RNA, 23 nt, Homo sapiens
auccucaauucaauguggugaug

SEQ ID NO: 911588 - RNA, 17 nt, Homo sapiens
auccucaccauccacag

SEQ ID NO: 911589 - RNA, 14 nt, Homo sapiens
auccucccaccuca

SEQ ID NO: 911590 - RNA, 15 nt, Homo sapiens
auccucccaccucag

SEQ ID NO: 911591 - RNA, 14 nt, Homo sapiens
auccugaugcuguu

SEQ ID NO: 911592 - RNA, 23 nt, Homo sapiens
auccugcccccagccauggugag

SEQ ID NO: 911593 - RNA, 16 nt, Homo sapiens
auccuguuaggggaaa

SEQ ID NO: 911594 - RNA, 18 nt, Homo sapiens
auccuguuucuugcucug

SEQ ID NO: 911595 - RNA, 15 nt, Homo sapiens
auccuucaucuggau

SEQ ID NO: 911596 - RNA, 14 nt, Homo sapiens
auccuuuaucaaga

SEQ ID NO: 911597 - RNA, 14 nt, Homo sapiens
aucgagccacugca

SEQ ID NO: 911598 - RNA, 21 nt, Homo sapiens
aucgcaaccaggauugacagg

SEQ ID NO: 911599 - RNA, 23 nt, Homo sapiens
aucgccguguuacuguugcacug

SEQ ID NO: 911600 - RNA, 16 nt, Homo sapiens
aucggaagcagugccu

SEQ ID NO: 911601 - RNA, 21 nt, Homo sapiens
auaaaaacccuguauggcacu

SEQ ID NO: 911602 - RNA, 15 nt, Homo sapiens
auaaaaauaccucuu

SEQ ID NO: 911603 - RNA, 13 nt, Homo sapiens
auaaaacaaugaa

SEQ ID NO: 911604 - RNA, 21 nt, Homo sapiens
auaaaaccaucaaaaauauuc

SEQ ID NO: 911605 - RNA, 18 nt, Homo sapiens
auaaaagauguacuugug

SEQ ID NO: 911606 - RNA, 16 nt, Homo sapiens
auaaaagcacuuacuu

SEQ ID NO: 911607 - RNA, 20 nt, Homo sapiens
auaaaauaaaguacauuauu

SEQ ID NO: 911608 - RNA, 21 nt, Homo sapiens
auaaaauauacaaacaugugg

SEQ ID NO: 911609 - RNA, 14 nt, Homo sapiens
auaaaauauguaca

SEQ ID NO: 911610 - RNA, 18 nt, Homo sapiens
auaaaaugaauacaauua

SEQ ID NO: 911611 - RNA, 15 nt, Homo sapiens
auaaaaugauguaug

SEQ ID NO: 911612 - RNA, 22 nt, Homo sapiens
auaaacaacuuaauguucugaa

SEQ ID NO: 911613 - RNA, 19 nt, Homo sapiens
auaaacacauacauugcca

SEQ ID NO: 911614 - RNA, 14 nt, Homo sapiens
auaaacacccauga

SEQ ID NO: 911615 - RNA, 18 nt, Homo sapiens
auaaacacccaugaauca

SEQ ID NO: 911616 - RNA, 23 nt, Homo sapiens
auaaacacccaugaaucaaagac

SEQ ID NO: 911617 - RNA, 22 nt, Homo sapiens
auaaacauccuucaagaacucu

SEQ ID NO: 911618 - RNA, 20 nt, Homo sapiens
auaaacauuaaaugucuuau

SEQ ID NO: 911619 - RNA, 20 nt, Homo sapiens
auaaaccaaaggacauuaug

SEQ ID NO: 911620 - RNA, 19 nt, Homo sapiens
auaaaccaaugagcuguau

SEQ ID NO: 911621 - RNA, 14 nt, Homo sapiens
auaaacuacuguaa

SEQ ID NO: 911622 - RNA, 14 nt, Homo sapiens
auaaacuagaucuc

SEQ ID NO: 911623 - RNA, 21 nt, Homo sapiens
auaaacugagccucuuuucaa

SEQ ID NO: 911624 - RNA, 15 nt, Homo sapiens
auaaagaccugagaa

SEQ ID NO: 911625 - RNA, 15 nt, Homo sapiens
auaaagagaacucug

SEQ ID NO: 911626 - RNA, 14 nt, Homo sapiens
auaaagaugaucua

SEQ ID NO: 911627 - RNA, 21 nt, Homo sapiens
auaaagaugucaaauaucuca

SEQ ID NO: 911628 - RNA, 15 nt, Homo sapiens
auaaagcccuugaac

SEQ ID NO: 911629 - RNA, 18 nt, Homo sapiens
auaaaggaagucaccaaa

SEQ ID NO: 911630 - RNA, 12 nt, Homo sapiens
auaaaguaccau

SEQ ID NO: 911631 - RNA, 12 nt, Homo sapiens
auaaagugccag

SEQ ID NO: 911632 - RNA, 17 nt, Homo sapiens
auaaaguuggugacaga

SEQ ID NO: 911633 - RNA, 16 nt, Homo sapiens
auaaaucaacuccagc

SEQ ID NO: 911634 - RNA, 19 nt, Homo sapiens
auaaaucaaugucacuuaa

SEQ ID NO: 911635 - RNA, 18 nt, Homo sapiens
auaaaugaagaaagggag

SEQ ID NO: 911636 - RNA, 20 nt, Homo sapiens
auaaaugaggaaacuccaaa

SEQ ID NO: 911637 - RNA, 15 nt, Homo sapiens
auaaauuaagacuuu

SEQ ID NO: 911638 - RNA, 17 nt, Homo sapiens
auaaauucagauauauu

SEQ ID NO: 911639 - RNA, 18 nt, Homo sapiens
auaaauugcuccuugaca

SEQ ID NO: 911640 - RNA, 21 nt, Homo sapiens
auaaauuggugauaaguggaa

SEQ ID NO: 911641 - RNA, 19 nt, Homo sapiens
auaacaaccccggacaaau

SEQ ID NO: 911642 - RNA, 18 nt, Homo sapiens
auaacaugauacuauuca

SEQ ID NO: 911643 - RNA, 21 nt, Homo sapiens
auaacaugucuuucagcauua

SEQ ID NO: 911644 - RNA, 20 nt, Homo sapiens
auaaccccagcucccuagga

SEQ ID NO: 911645 - RNA, 14 nt, Homo sapiens
auaaccccaggcau

SEQ ID NO: 911646 - RNA, 18 nt, Homo sapiens
auaaccccaggcauccca

SEQ ID NO: 911647 - RNA, 19 nt, Homo sapiens
auaaccuucaugaugaauu

SEQ ID NO: 911648 - RNA, 21 nt, Homo sapiens
auaacuuauaucaucagcaua

SEQ ID NO: 911649 - RNA, 13 nt, Homo sapiens
auaagaagcaaau

SEQ ID NO: 911650 - RNA, 13 nt, Homo sapiens
auaagacuacuau

SEQ ID NO: 911651 - RNA, 17 nt, Homo sapiens
auaagcucccagggccu

SEQ ID NO: 911652 - RNA, 13 nt, Homo sapiens
auaaguacauuau

SEQ ID NO: 911653 - RNA, 19 nt, Homo sapiens
auaagucaauuccuagaag

SEQ ID NO: 911654 - RNA, 17 nt, Homo sapiens
auaaguguuugucauau

SEQ ID NO: 911655 - RNA, 23 nt, Homo sapiens
auaauagguuugugacuuuccua

SEQ ID NO: 911656 - RNA, 19 nt, Homo sapiens
auaaucacauuaucaucug

SEQ ID NO: 911657 - RNA, 18 nt, Homo sapiens
auaaucugaggaagggag

SEQ ID NO: 911658 - RNA, 14 nt, Homo sapiens
auaaugaacacgug

SEQ ID NO: 911659 - RNA, 18 nt, Homo sapiens
auaaugcucccaucuccu

SEQ ID NO: 911660 - RNA, 15 nt, Homo sapiens
auaauuaaaaaccac

SEQ ID NO: 911661 - RNA, 16 nt, Homo sapiens
auaauuaaaaaccacu

SEQ ID NO: 911662 - RNA, 23 nt, Homo sapiens
auaauuaggaucuaugcaauuuu

SEQ ID NO: 911663 - RNA, 17 nt, Homo sapiens
auaauuaugucccaggg

SEQ ID NO: 911664 - RNA, 22 nt, Homo sapiens
auaauugguuagaaccuccuau

SEQ ID NO: 911665 - RNA, 21 nt, Homo sapiens
auaauuuucuaccuggucucu

SEQ ID NO: 911666 - RNA, 23 nt, Homo sapiens
auaauuuucuaccuggucucucc

SEQ ID NO: 911667 - RNA, 19 nt, Homo sapiens
auaauuuucuggcacuggu

SEQ ID NO: 911668 - RNA, 16 nt, Homo sapiens
auacaaacaagcacag

SEQ ID NO: 911669 - RNA, 16 nt, Homo sapiens
auacaagaaagcaaug

SEQ ID NO: 911670 - RNA, 20 nt, Homo sapiens
auacaauguucuguuguaaa

SEQ ID NO: 911671 - RNA, 14 nt, Homo sapiens
auacaauuaaagcu

SEQ ID NO: 911672 - RNA, 18 nt, Homo sapiens
auacaauuaaagcuguua

SEQ ID NO: 911673 - RNA, 14 nt, Homo sapiens
auacaauuugcacu

SEQ ID NO: 911674 - RNA, 14 nt, Homo sapiens
auacacaacauuua

SEQ ID NO: 911675 - RNA, 12 nt, Homo sapiens
auacacacauau

SEQ ID NO: 911676 - RNA, 14 nt, Homo sapiens
auacacacauauac

SEQ ID NO: 911677 - RNA, 20 nt, Homo sapiens
auacacacauauacauauau

SEQ ID NO: 911678 - RNA, 14 nt, Homo sapiens
auacaccuauguca

SEQ ID NO: 911679 - RNA, 21 nt, Homo sapiens
auacagccccaaaccagggug

SEQ ID NO: 911680 - RNA, 16 nt, Homo sapiens
auacagcucagcuuuu

SEQ ID NO: 911681 - RNA, 13 nt, Homo sapiens
auacauaagacca

SEQ ID NO: 911682 - RNA, 14 nt, Homo sapiens
auacauacauauau

SEQ ID NO: 911683 - RNA, 18 nt, Homo sapiens
auacauauauauauacac

SEQ ID NO: 911684 - RNA, 13 nt, Homo sapiens
auacauauauauc

SEQ ID NO: 911685 - RNA, 18 nt, Homo sapiens
auacauauauguauauau

SEQ ID NO: 911686 - RNA, 16 nt, Homo sapiens
auacaugacucagcau

SEQ ID NO: 911687 - RNA, 20 nt, Homo sapiens
auacauggaaacgcaaauga

SEQ ID NO: 911688 - RNA, 20 nt, Homo sapiens
auacauucuccuuuuugccc

SEQ ID NO: 911689 - RNA, 20 nt, Homo sapiens
auacauucuuuaucuugaca

SEQ ID NO: 911690 - RNA, 19 nt, Homo sapiens
auaccagagaccugaggca

SEQ ID NO: 911691 - RNA, 15 nt, Homo sapiens
auaccagaucacuca

SEQ ID NO: 911692 - RNA, 16 nt, Homo sapiens
auaccagaucacucaa

SEQ ID NO: 911693 - RNA, 17 nt, Homo sapiens
auaccauauacagcuca

SEQ ID NO: 911694 - RNA, 15 nt, Homo sapiens
auacccacuaacaaa

SEQ ID NO: 911695 - RNA, 18 nt, Homo sapiens
auaccccuguuaagcaau

SEQ ID NO: 911696 - RNA, 17 nt, Homo sapiens
auacccuuuaucucugu

SEQ ID NO: 911697 - RNA, 12 nt, Homo sapiens
auauucccugac

SEQ ID NO: 911698 - RNA, 13 nt, Homo sapiens
auauuccugcauu

SEQ ID NO: 911699 - RNA, 10 nt, Homo sapiens
auauucuugg

SEQ ID NO: 911700 - RNA, 19 nt, Homo sapiens
auauugauaaaaccauaca

SEQ ID NO: 911701 - RNA, 22 nt, Homo sapiens
auauugucugaacggcugaaua

SEQ ID NO: 911702 - RNA, 21 nt, Homo sapiens
auauuguggguaacgugagaa

SEQ ID NO: 911703 - RNA, 15 nt, Homo sapiens
auauuuauagcaauc

SEQ ID NO: 911704 - RNA, 18 nt, Homo sapiens
auauuuaugucuauuuaa

SEQ ID NO: 911705 - RNA, 14 nt, Homo sapiens
auauuuccauucau

SEQ ID NO: 911706 - RNA, 20 nt, Homo sapiens
auauuucccaauacauacca

SEQ ID NO: 911707 - RNA, 14 nt, Homo sapiens
auauuucuagacau

SEQ ID NO: 911708 - RNA, 16 nt, Homo sapiens
auauuugaauaucauu

SEQ ID NO: 911709 - RNA, 19 nt, Homo sapiens
auauuugaaucuuucuuac

SEQ ID NO: 911710 - RNA, 17 nt, Homo sapiens
auauuugcuaugaagcg

SEQ ID NO: 911711 - RNA, 21 nt, Homo sapiens
auauuuguuaaauauuuacau

SEQ ID NO: 911712 - RNA, 15 nt, Homo sapiens
auauuuucacaugac

SEQ ID NO: 911713 - RNA, 19 nt, Homo sapiens
auauuuucccucucuugcc

SEQ ID NO: 911714 - RNA, 12 nt, Homo sapiens
caguagugcauu

SEQ ID NO: 911715 - RNA, 20 nt, Homo sapiens
caguauauuuauagucacaa

SEQ ID NO: 911716 - RNA, 13 nt, Homo sapiens
caguauuccaugg

SEQ ID NO: 911717 - RNA, 19 nt, Homo sapiens
caguauuuguacaaauacu

SEQ ID NO: 911718 - RNA, 17 nt, Homo sapiens
cagucaaaggcauuuug

SEQ ID NO: 911719 - RNA, 23 nt, Homo sapiens
cagucccuuacacguaccucuca

SEQ ID NO: 911720 - RNA, 13 nt, Homo sapiens
cagucucccauuc

SEQ ID NO: 911721 - RNA, 22 nt, Homo sapiens
cagucucuucugauuaaagaga

SEQ ID NO: 911722 - RNA, 12 nt, Homo sapiens
cagucuuggaau

SEQ ID NO: 911723 - RNA, 21 nt, Homo sapiens
cagugaaccaaagagacugga

SEQ ID NO: 911724 - RNA, 18 nt, Homo sapiens
cagugaagggaguggcag

SEQ ID NO: 911725 - RNA, 12 nt, Homo sapiens
cagugacuggca

SEQ ID NO: 911726 - RNA, 17 nt, Homo sapiens
cagugagcugaugugcc

SEQ ID NO: 911727 - RNA, 23 nt, Homo sapiens
cagugauauaugccuauaauaua

SEQ ID NO: 911728 - RNA, 15 nt, Homo sapiens
cagugaucuccauau

SEQ ID NO: 911729 - RNA, 20 nt, Homo sapiens
cagugcauguugccaugagg

SEQ ID NO: 911730 - RNA, 22 nt, Homo sapiens
cagugcccacaggaucagucug

SEQ ID NO: 911731 - RNA, 21 nt, Homo sapiens
cagugcccaccaacaucccau

SEQ ID NO: 911732 - RNA, 15 nt, Homo sapiens
cagugccuuccauaa

SEQ ID NO: 911733 - RNA, 17 nt, Homo sapiens
cagugcuucagccugag

SEQ ID NO: 911734 - RNA, 14 nt, Homo sapiens
caguggaucucaau

SEQ ID NO: 911735 - RNA, 16 nt, Homo sapiens
cagugguaccagcuca

SEQ ID NO: 911736 - RNA, 21 nt, Homo sapiens
caguguaugcucauacuugga

SEQ ID NO: 911737 - RNA, 19 nt, Homo sapiens
caguguccucuugcucaaa

SEQ ID NO: 911738 - RNA, 15 nt, Homo sapiens
cagugucuuccauaa

SEQ ID NO: 911739 - RNA, 23 nt, Homo sapiens
cagugugaucccaagugccaguc

SEQ ID NO: 911740 - RNA, 16 nt, Homo sapiens
cagugugucacacuga

SEQ ID NO: 911741 - RNA, 17 nt, Homo sapiens
caguguuauuaaugaca

SEQ ID NO: 911742 - RNA, 16 nt, Homo sapiens
caguguuugcaauggu

SEQ ID NO: 911743 - RNA, 20 nt, Homo sapiens
caguguuugggguguuucaa

SEQ ID NO: 911744 - RNA, 13 nt, Homo sapiens
caguuaaggggag

SEQ ID NO: 911745 - RNA, 15 nt, Homo sapiens
caguuaauacuuaac

SEQ ID NO: 911746 - RNA, 16 nt, Homo sapiens
caguuacuuaccugca

SEQ ID NO: 911747 - RNA, 21 nt, Homo sapiens
caguucaguggcauucacauc

SEQ ID NO: 911748 - RNA, 23 nt, Homo sapiens
caguuccuccaagaggucuccau

SEQ ID NO: 911749 - RNA, 21 nt, Homo sapiens
caguuccuguagaacugagaa

SEQ ID NO: 911750 - RNA, 21 nt, Homo sapiens
caguugaaugacaacagaagc

SEQ ID NO: 911751 - RNA, 17 nt, Homo sapiens
caguugaauucauguga

SEQ ID NO: 911752 - RNA, 17 nt, Homo sapiens
caguuggcagaaaggau

SEQ ID NO: 911753 - RNA, 16 nt, Homo sapiens
caguugggagcacugg

SEQ ID NO: 911754 - RNA, 20 nt, Homo sapiens
caguuucacaaaguuuguuc

SEQ ID NO: 911755 - RNA, 20 nt, Homo sapiens
caguuucuccuuuauugcuc

SEQ ID NO: 911756 - RNA, 16 nt, Homo sapiens
caguuuucuugcagau

SEQ ID NO: 911757 - RNA, 14 nt, Homo sapiens
caguuuugccuuaa

SEQ ID NO: 911758 - RNA, 15 nt, Homo sapiens
caguuuuuaaacuag

SEQ ID NO: 911759 - RNA, 22 nt, Homo sapiens
cauaaacacccaugaaucaaag

SEQ ID NO: 911760 - RNA, 23 nt, Homo sapiens
cauaaacacccaugaaucaaaga

SEQ ID NO: 911761 - RNA, 15 nt, Homo sapiens
cauaaacagcauuua

SEQ ID NO: 911762 - RNA, 18 nt, Homo sapiens
cauaaacuucaucuucaa

SEQ ID NO: 911763 - RNA, 17 nt, Homo sapiens
cauaaacuucaugguca

SEQ ID NO: 911764 - RNA, 19 nt, Homo sapiens
cauaaaggcauggcauuug

SEQ ID NO: 911765 - RNA, 19 nt, Homo sapiens
cauaaaguaugccuuccug

SEQ ID NO: 911766 - RNA, 22 nt, Homo sapiens
cauaaauuagaggucuccaaaa

SEQ ID NO: 911767 - RNA, 19 nt, Homo sapiens
cauaaauuuaucaucucga

SEQ ID NO: 911768 - RNA, 20 nt, Homo sapiens
cauaaccccaggcaucccau

SEQ ID NO: 911769 - RNA, 20 nt, Homo sapiens
cauaacucauaauccagaga

SEQ ID NO: 911770 - RNA, 20 nt, Homo sapiens
cauaacucauugucugugga

SEQ ID NO: 911771 - RNA, 17 nt, Homo sapiens
cauaacugaaggcauau

SEQ ID NO: 911772 - RNA, 14 nt, Homo sapiens
cauaacuucucuga

SEQ ID NO: 911773 - RNA, 19 nt, Homo sapiens
cauaacuugcugaauuuca

SEQ ID NO: 911774 - RNA, 16 nt, Homo sapiens
cauaagaaaacuaaga

SEQ ID NO: 911775 - RNA, 14 nt, Homo sapiens
cauaagaacgucau

SEQ ID NO: 911776 - RNA, 21 nt, Homo sapiens
cauaagccuaccaauguagac

SEQ ID NO: 911777 - RNA, 19 nt, Homo sapiens
cauaaggcauauacaaaua

SEQ ID NO: 911778 - RNA, 17 nt, Homo sapiens
cauaaugaaugcuauug

SEQ ID NO: 911779 - RNA, 22 nt, Homo sapiens
cauaauuaaacaugauccugag

SEQ ID NO: 911780 - RNA, 21 nt, Homo sapiens
cauaauuuucuucaugcaaug

SEQ ID NO: 911781 - RNA, 22 nt, Homo sapiens
cauacacacacacgcgugcaca

SEQ ID NO: 911782 - RNA, 15 nt, Homo sapiens
cauacagauuugcaa

SEQ ID NO: 911783 - RNA, 12 nt, Homo sapiens
cauacaggccau

SEQ ID NO: 911784 - RNA, 15 nt, Homo sapiens
cauacgugucugugu

SEQ ID NO: 911785 - RNA, 16 nt, Homo sapiens
cauacuucuucauuca

SEQ ID NO: 911786 - RNA, 13 nt, Homo sapiens
cauacuuggacag

SEQ ID NO: 911787 - RNA, 12 nt, Homo sapiens
cauagaaaaacu

SEQ ID NO: 911788 - RNA, 19 nt, Homo sapiens
cauagaaauuacacccaaa

SEQ ID NO: 911789 - RNA, 21 nt, Homo sapiens
cauagaacuccggaaugacca

SEQ ID NO: 911790 - RNA, 15 nt, Homo sapiens
cauagagauaugcac

SEQ ID NO: 911791 - RNA, 22 nt, Homo sapiens
cauagagauaugcacacacaga

SEQ ID NO: 911792 - RNA, 22 nt, Homo sapiens
cauagagaucuauguacuguaa

SEQ ID NO: 911793 - RNA, 23 nt, Homo sapiens
cauagagaucuauguacuguaau

SEQ ID NO: 911794 - RNA, 21 nt, Homo sapiens
cauagaggacagcaacuggug

SEQ ID NO: 911795 - RNA, 21 nt, Homo sapiens
cauagauguaucauuaaugua

SEQ ID NO: 911796 - RNA, 15 nt, Homo sapiens
cauagcuacccaaaa

SEQ ID NO: 911797 - RNA, 19 nt, Homo sapiens
cauaggcaauaucuuuaau

SEQ ID NO: 911798 - RNA, 15 nt, Homo sapiens
cauagggccuccuua

SEQ ID NO: 911799 - RNA, 22 nt, Homo sapiens
cauaguaacucuuauggagacc

SEQ ID NO: 911800 - RNA, 13 nt, Homo sapiens
cauagugcacuag

SEQ ID NO: 911801 - RNA, 18 nt, Homo sapiens
cauaguggagagaacuga

SEQ ID NO: 911802 - RNA, 20 nt, Homo sapiens
cauaguuauucuaucacugg

SEQ ID NO: 911803 - RNA, 17 nt, Homo sapiens
cauaguuauuuacuuga

SEQ ID NO: 911804 - RNA, 19 nt, Homo sapiens
cauaguuauuuacuugaaa

SEQ ID NO: 911805 - RNA, 20 nt, Homo sapiens
cauaguucuuacuacuugcc

SEQ ID NO: 911806 - RNA, 19 nt, Homo sapiens
cauauaauguuguuauuua

SEQ ID NO: 911807 - RNA, 16 nt, Homo sapiens
cauauacaaaagcaag

SEQ ID NO: 911808 - RNA, 12 nt, Homo sapiens
cauauacauaua

SEQ ID NO: 911809 - RNA, 21 nt, Homo sapiens
cauauacuuuggggacuugua

SEQ ID NO: 911810 - RNA, 16 nt, Homo sapiens
cauauauauguauaua

SEQ ID NO: 911811 - RNA, 13 nt, Homo sapiens
cauauauauguca

SEQ ID NO: 911812 - RNA, 21 nt, Homo sapiens
cauauauguauauauaugcac

SEQ ID NO: 911813 - RNA, 16 nt, Homo sapiens
cauauauuagcauuua

SEQ ID NO: 911814 - RNA, 22 nt, Homo sapiens
cauauauuagcauuuaguccaa

SEQ ID NO: 911815 - RNA, 13 nt, Homo sapiens
cauaucaaaaagu

SEQ ID NO: 911816 - RNA, 20 nt, Homo sapiens
cauaucuccuuccccuacac

SEQ ID NO: 911817 - RNA, 11 nt, Homo sapiens
cauaugaacug

SEQ ID NO: 911818 - RNA, 20 nt, Homo sapiens
cauaugaauuuacuacuuua

SEQ ID NO: 911819 - RNA, 16 nt, Homo sapiens
cauaugacaugccacc

SEQ ID NO: 911820 - RNA, 14 nt, Homo sapiens
cauaugauacugau

SEQ ID NO: 911821 - RNA, 16 nt, Homo sapiens
cauaugauacugaugc

SEQ ID NO: 911822 - RNA, 16 nt, Homo sapiens
cauaugcagugauaua

SEQ ID NO: 911823 - RNA, 11 nt, Homo sapiens
cauaugcauuu

SEQ ID NO: 911824 - RNA, 14 nt, Homo sapiens
cauaugcuauguua

SEQ ID NO: 911825 - RNA, 15 nt, Homo sapiens
cauauggacucugca

SEQ ID NO: 911826 - RNA, 16 nt, Homo sapiens
cauauggacucugcac

SEQ ID NO: 911827 - RNA, 19 nt, Homo sapiens
cauauggacucugcacaug

SEQ ID NO: 911828 - RNA, 15 nt, Homo sapiens
ccaaauaaauauauu

SEQ ID NO: 911829 - RNA, 19 nt, Homo sapiens
ccaaauauaaacuugugua

SEQ ID NO: 911830 - RNA, 15 nt, Homo sapiens
ccaaaucaucucuca

SEQ ID NO: 911831 - RNA, 18 nt, Homo sapiens
ccaaauccacaagccauu

SEQ ID NO: 911832 - RNA, 12 nt, Homo sapiens
ccaaaugagauc

SEQ ID NO: 911833 - RNA, 19 nt, Homo sapiens
ccaaaugaugccacuuccc

SEQ ID NO: 911834 - RNA, 19 nt, Homo sapiens
ccaaaugcauggugcaguu

SEQ ID NO: 911835 - RNA, 20 nt, Homo sapiens
ccaaauuacguguacuacaa

SEQ ID NO: 911836 - RNA, 16 nt, Homo sapiens
ccaaauuauuguccaa

SEQ ID NO: 911837 - RNA, 13 nt, Homo sapiens
ccaacaaacaaug

SEQ ID NO: 911838 - RNA, 16 nt, Homo sapiens
ccaacaaacaaugcca

SEQ ID NO: 911839 - RNA, 21 nt, Homo sapiens
ccaacagaagcuuccauucca

SEQ ID NO: 911840 - RNA, 21 nt, Homo sapiens
ccaacauggugaaacccugua

SEQ ID NO: 911841 - RNA, 15 nt, Homo sapiens
ccaacccaaccucau

SEQ ID NO: 911842 - RNA, 18 nt, Homo sapiens
ccaacccccgacuucauc

SEQ ID NO: 911843 - RNA, 22 nt, Homo sapiens
ccaaccuggaguauaauauuca

SEQ ID NO: 911844 - RNA, 13 nt, Homo sapiens
ccaacgcacagga

SEQ ID NO: 911845 - RNA, 16 nt, Homo sapiens
ccaacgcacaggaaaa

SEQ ID NO: 911846 - RNA, 15 nt, Homo sapiens
ccaacgggaagcaac

SEQ ID NO: 911847 - RNA, 21 nt, Homo sapiens
ccaacuccuggagauuucagu

SEQ ID NO: 911848 - RNA, 15 nt, Homo sapiens
ccaacucugcacucc

SEQ ID NO: 911849 - RNA, 19 nt, Homo sapiens
ccaacuugguuuugcuaca

SEQ ID NO: 911850 - RNA, 16 nt, Homo sapiens
ccaagagagacauugc

SEQ ID NO: 911851 - RNA, 17 nt, Homo sapiens
ccaagagagacauugcc

SEQ ID NO: 911852 - RNA, 21 nt, Homo sapiens
ccaagagagggccaugcaauu

SEQ ID NO: 911853 - RNA, 10 nt, Homo sapiens
ccaagagcua

SEQ ID NO: 911854 - RNA, 14 nt, Homo sapiens
ccaagaugggcaca

SEQ ID NO: 911855 - RNA, 15 nt, Homo sapiens
ccaagauucaaagag

SEQ ID NO: 911856 - RNA, 21 nt, Homo sapiens
ccaagcaaaaacaaaugggaa

SEQ ID NO: 911857 - RNA, 17 nt, Homo sapiens
ccaagccauucacuucc

SEQ ID NO: 911858 - RNA, 13 nt, Homo sapiens
ccaagccugacca

SEQ ID NO: 911859 - RNA, 17 nt, Homo sapiens
ccaagcuucaacccuca

SEQ ID NO: 911860 - RNA, 16 nt, Homo sapiens
ccaaggcaguguuccu

SEQ ID NO: 911861 - RNA, 18 nt, Homo sapiens
ccaaggcccagcuauggc

SEQ ID NO: 911862 - RNA, 17 nt, Homo sapiens
ccaagguuacucagcag

SEQ ID NO: 911863 - RNA, 19 nt, Homo sapiens
ccaagguuuuggagucagu

SEQ ID NO: 911864 - RNA, 21 nt, Homo sapiens
ccaagugaccauaaaggcaug

SEQ ID NO: 911865 - RNA, 21 nt, Homo sapiens
ccaauaccuccuccagaucag

SEQ ID NO: 911866 - RNA, 14 nt, Homo sapiens
ccaauacuacugua

SEQ ID NO: 911867 - RNA, 14 nt, Homo sapiens
ccaaucauuugcaa

SEQ ID NO: 911868 - RNA, 17 nt, Homo sapiens
ccaaucauuugcaaugc

SEQ ID NO: 911869 - RNA, 14 nt, Homo sapiens
ccaaucauuuuaau

SEQ ID NO: 911870 - RNA, 19 nt, Homo sapiens
ccaaucccaccaacccuca

SEQ ID NO: 911871 - RNA, 14 nt, Homo sapiens
ccaaucccgugaaa

SEQ ID NO: 911872 - RNA, 18 nt, Homo sapiens
ccaauccucaggauuuca

SEQ ID NO: 911873 - RNA, 15 nt, Homo sapiens
ccaauccuuuccacc

SEQ ID NO: 911874 - RNA, 22 nt, Homo sapiens
ccaaugaggucugaaauggagg

SEQ ID NO: 911875 - RNA, 13 nt, Homo sapiens
ccaaugauucaua

SEQ ID NO: 911876 - RNA, 18 nt, Homo sapiens
ccaaugcacauccauucc

SEQ ID NO: 911877 - RNA, 21 nt, Homo sapiens
ccaaugcacgcacacaucagu

SEQ ID NO: 911878 - RNA, 15 nt, Homo sapiens
ccaauuuuaaauaca

SEQ ID NO: 911879 - RNA, 12 nt, Homo sapiens
ccacaaacugau

SEQ ID NO: 911880 - RNA, 13 nt, Homo sapiens
ccacaaaugccac

SEQ ID NO: 911881 - RNA, 18 nt, Homo sapiens
ccacaaguccuuguucca

SEQ ID NO: 911882 - RNA, 21 nt, Homo sapiens
ccacaauagcagacaguguuu

SEQ ID NO: 911883 - RNA, 18 nt, Homo sapiens
ccacaaucugggacuuuc

SEQ ID NO: 911884 - RNA, 19 nt, Homo sapiens
ccacaaucugggacuuuca

SEQ ID NO: 911885 - RNA, 14 nt, Homo sapiens
ccacacagggugca

SEQ ID NO: 911886 - RNA, 16 nt, Homo sapiens
ccacacagggugcaug

SEQ ID NO: 911887 - RNA, 16 nt, Homo sapiens
ccacagaaguucaaua

SEQ ID NO: 911888 - RNA, 14 nt, Homo sapiens
ccacagacucccuc

SEQ ID NO: 911889 - RNA, 18 nt, Homo sapiens
ccacagagagaggggaga

SEQ ID NO: 911890 - RNA, 20 nt, Homo sapiens
ccacagcagcugaacagcca

SEQ ID NO: 911891 - RNA, 17 nt, Homo sapiens
ccacagcuucugcagca

SEQ ID NO: 911892 - RNA, 16 nt, Homo sapiens
ccacagucucugggag

SEQ ID NO: 911893 - RNA, 18 nt, Homo sapiens
ccacaguuuugccuuaaa

SEQ ID NO: 911894 - RNA, 21 nt, Homo sapiens
ccacaucccuaacaucaugca

SEQ ID NO: 911895 - RNA, 22 nt, Homo sapiens
ccacaugugacacauaugcacc

SEQ ID NO: 911896 - RNA, 15 nt, Homo sapiens
ccaccacgugcucaa

SEQ ID NO: 911897 - RNA, 16 nt, Homo sapiens
ccaccacuucuuuuau

SEQ ID NO: 911898 - RNA, 12 nt, Homo sapiens
ccaccuaccugc

SEQ ID NO: 911899 - RNA, 21 nt, Homo sapiens
ccaccuacuuuucuuuccuca

SEQ ID NO: 911900 - RNA, 12 nt, Homo sapiens
ccaccucaggcu

SEQ ID NO: 911901 - RNA, 10 nt, Homo sapiens
ccaccucuca

SEQ ID NO: 911902 - RNA, 17 nt, Homo sapiens
ccaccuuggcucaaguc

SEQ ID NO: 911903 - RNA, 19 nt, Homo sapiens
ccacgaagcugugaacuca

SEQ ID NO: 911904 - RNA, 20 nt, Homo sapiens
ccacgacuguuguacaagcu

SEQ ID NO: 911905 - RNA, 22 nt, Homo sapiens
ccacgaggagcuuccagugcau

SEQ ID NO: 911906 - RNA, 21 nt, Homo sapiens
ccacgagggucaggacuguga

SEQ ID NO: 911907 - RNA, 16 nt, Homo sapiens
ccacgaugucaaggac

SEQ ID NO: 911908 - RNA, 12 nt, Homo sapiens
ccacggagcuga

SEQ ID NO: 911909 - RNA, 18 nt, Homo sapiens
ccacuaccuucugaccuc

SEQ ID NO: 911910 - RNA, 15 nt, Homo sapiens
ccacuccaccuccac

SEQ ID NO: 911911 - RNA, 17 nt, Homo sapiens
ccacucccaaagcucag

SEQ ID NO: 911912 - RNA, 18 nt, Homo sapiens
ccacucuauacuagggac

SEQ ID NO: 911913 - RNA, 15 nt, Homo sapiens
ccacucuuugcuaca

SEQ ID NO: 911914 - RNA, 16 nt, Homo sapiens
ccacucuuugcuacaa

SEQ ID NO: 911915 - RNA, 18 nt, Homo sapiens
ccacugaacauuugcuuu

SEQ ID NO: 911916 - RNA, 16 nt, Homo sapiens
ccacugagccugagau

SEQ ID NO: 911917 - RNA, 22 nt, Homo sapiens
ccacuggcauuaaagugcugua

SEQ ID NO: 911918 - RNA, 17 nt, Homo sapiens
ccacugguuucucagaa

SEQ ID NO: 911919 - RNA, 19 nt, Homo sapiens
ccacuuaaaaaauguccau

SEQ ID NO: 911920 - RNA, 23 nt, Homo sapiens
ccacuuuucaugucauuugacau

SEQ ID NO: 911921 - RNA, 15 nt, Homo sapiens
ccagaaacagggaca

SEQ ID NO: 911922 - RNA, 21 nt, Homo sapiens
ccagaaacguaacugugugca

SEQ ID NO: 911923 - RNA, 16 nt, Homo sapiens
ccagaaagaggcagug

SEQ ID NO: 911924 - RNA, 17 nt, Homo sapiens
ccagaacaguuuguaca

SEQ ID NO: 911925 - RNA, 12 nt, Homo sapiens
ccagaacccaga

SEQ ID NO: 911926 - RNA, 23 nt, Homo sapiens
ccagaaggagggcagagccaugg

SEQ ID NO: 911927 - RNA, 21 nt, Homo sapiens
ccagaauaaaacgcaaagggc

SEQ ID NO: 911928 - RNA, 13 nt, Homo sapiens
ccagaauagcuuu

SEQ ID NO: 911929 - RNA, 14 nt, Homo sapiens
ccagaaugcuaaag

SEQ ID NO: 911930 - RNA, 16 nt, Homo sapiens
ccagacaggcucaggu

SEQ ID NO: 911931 - RNA, 21 nt, Homo sapiens
ccagacauacgaaacacaaac

SEQ ID NO: 911932 - RNA, 21 nt, Homo sapiens
ccagacucguucuucugggaa

SEQ ID NO: 911933 - RNA, 18 nt, Homo sapiens
ccagacugguuagacagu

SEQ ID NO: 911934 - RNA, 18 nt, Homo sapiens
ccagacuucucuuucuua

SEQ ID NO: 911935 - RNA, 14 nt, Homo sapiens
ccagagaauucuua

SEQ ID NO: 911936 - RNA, 14 nt, Homo sapiens
ccagagcaaaauaa

SEQ ID NO: 911937 - RNA, 18 nt, Homo sapiens
ccagagcccaagugccau

SEQ ID NO: 911938 - RNA, 22 nt, Homo sapiens
ccagagcuggaaggcagggcag

SEQ ID NO: 911939 - RNA, 20 nt, Homo sapiens
ccagagcugggaggcauggc

SEQ ID NO: 911940 - RNA, 18 nt, Homo sapiens
ccagaggcagagccugag

SEQ ID NO: 911941 - RNA, 20 nt, Homo sapiens
ccagaggugcugucagcuca

SEQ ID NO: 911942 - RNA, 11 nt, Homo sapiens
ccagagucaga

SEQ ID NO: 911943 - RNA, 20 nt, Homo sapiens
cccaaauuucauaccuauca

SEQ ID NO: 911944 - RNA, 14 nt, Homo sapiens
cccaacgcacagga

SEQ ID NO: 911945 - RNA, 15 nt, Homo sapiens
cccaacgcacaggaa

SEQ ID NO: 911946 - RNA, 20 nt, Homo sapiens
cccaacuauuaaagugccau

SEQ ID NO: 911947 - RNA, 15 nt, Homo sapiens
cccaagccaugguga

SEQ ID NO: 911948 - RNA, 17 nt, Homo sapiens
cccaagccuggucuccu

SEQ ID NO: 911949 - RNA, 21 nt, Homo sapiens
cccaaggaaaauggacauauu

SEQ ID NO: 911950 - RNA, 18 nt, Homo sapiens
cccaagugaaaucaaagg

SEQ ID NO: 911951 - RNA, 14 nt, Homo sapiens
cccaagugccaucc

SEQ ID NO: 911952 - RNA, 18 nt, Homo sapiens
cccaauaaaagugacucu

SEQ ID NO: 911953 - RNA, 18 nt, Homo sapiens
cccaaucauuugcaaugc

SEQ ID NO: 911954 - RNA, 20 nt, Homo sapiens
cccaaugcacauccauuccc

SEQ ID NO: 911955 - RNA, 12 nt, Homo sapiens
cccacaaagggg

SEQ ID NO: 911956 - RNA, 15 nt, Homo sapiens
cccacagggaccaag

SEQ ID NO: 911957 - RNA, 19 nt, Homo sapiens
cccaccaugcgcugcucaa

SEQ ID NO: 911958 - RNA, 17 nt, Homo sapiens
cccacccaacaagccau

SEQ ID NO: 911959 - RNA, 19 nt, Homo sapiens
cccaccuagugcuuccacu

SEQ ID NO: 911960 - RNA, 23 nt, Homo sapiens
cccaccuccgcugggaggaaccu

SEQ ID NO: 911961 - RNA, 22 nt, Homo sapiens
cccaccuucuucagccaccucu

SEQ ID NO: 911962 - RNA, 22 nt, Homo sapiens
cccacgagggucaggacuguga

SEQ ID NO: 911963 - RNA, 19 nt, Homo sapiens
cccacgcuggagugcagug

SEQ ID NO: 911964 - RNA, 20 nt, Homo sapiens
cccacuuucaccaguuucug

SEQ ID NO: 911965 - RNA, 18 nt, Homo sapiens
cccagaaaaccuccagua

SEQ ID NO: 911966 - RNA, 10 nt, Homo sapiens
cccagaacac

SEQ ID NO: 911967 - RNA, 23 nt, Homo sapiens
cccagagaccccuuccuuuccuc

SEQ ID NO: 911968 - RNA, 20 nt, Homo sapiens
cccagagaggguggugaccu

SEQ ID NO: 911969 - RNA, 18 nt, Homo sapiens
cccagagcaaaauaauuu

SEQ ID NO: 911970 - RNA, 21 nt, Homo sapiens
cccagagcccagggcauccca

SEQ ID NO: 911971 - RNA, 20 nt, Homo sapiens
cccagagguuaucugccugg

SEQ ID NO: 911972 - RNA, 15 nt, Homo sapiens
cccagauacuuccca

SEQ ID NO: 911973 - RNA, 21 nt, Homo sapiens
cccagauggccgggacaugca

SEQ ID NO: 911974 - RNA, 12 nt, Homo sapiens
cccagcaaagag

SEQ ID NO: 911975 - RNA, 11 nt, Homo sapiens
cccagcacuga

SEQ ID NO: 911976 - RNA, 16 nt, Homo sapiens
cccagcacugauguug

SEQ ID NO: 911977 - RNA, 12 nt, Homo sapiens
cccagcacuuug

SEQ ID NO: 911978 - RNA, 15 nt, Homo sapiens
cccagcagggccuca

SEQ ID NO: 911979 - RNA, 11 nt, Homo sapiens
cccagcauuca

SEQ ID NO: 911980 - RNA, 15 nt, Homo sapiens
cccagccaacugccc

SEQ ID NO: 911981 - RNA, 15 nt, Homo sapiens
cccagccauggugag

SEQ ID NO: 911982 - RNA, 18 nt, Homo sapiens
cccagccccgcccgccug

SEQ ID NO: 911983 - RNA, 18 nt, Homo sapiens
cccagcgaguugcgcugg

SEQ ID NO: 911984 - RNA, 21 nt, Homo sapiens
cccagcuuaauggcucaugac

SEQ ID NO: 911985 - RNA, 15 nt, Homo sapiens
cccaggaccucugga

SEQ ID NO: 911986 - RNA, 22 nt, Homo sapiens
cccaggacgccacucauuucau

SEQ ID NO: 911987 - RNA, 21 nt, Homo sapiens
cccaggagguggcuauggcca

SEQ ID NO: 911988 - RNA, 18 nt, Homo sapiens
cccaggcaucccaucccu

SEQ ID NO: 911989 - RNA, 22 nt, Homo sapiens
cccaggcucugggaaggggugc

SEQ ID NO: 911990 - RNA, 15 nt, Homo sapiens
cccaggcugaagagu

SEQ ID NO: 911991 - RNA, 14 nt, Homo sapiens
cccaggcugcacug

SEQ ID NO: 911992 - RNA, 19 nt, Homo sapiens
cccaggcuggagugcagua

SEQ ID NO: 911993 - RNA, 16 nt, Homo sapiens
cccaggcuggucuuga

SEQ ID NO: 911994 - RNA, 15 nt, Homo sapiens
cccagggacaaggga

SEQ ID NO: 911995 - RNA, 20 nt, Homo sapiens
cccagggccugggggcagug

SEQ ID NO: 911996 - RNA, 23 nt, Homo sapiens
cccaguauaugcuauucaaugau

SEQ ID NO: 911997 - RNA, 16 nt, Homo sapiens
cccagugcuaccucuc

SEQ ID NO: 911998 - RNA, 23 nt, Homo sapiens
cccaguguggccccagcccgaca

SEQ ID NO: 911999 - RNA, 16 nt, Homo sapiens
cccauaaucucauuca

SEQ ID NO: 912000 - RNA, 23 nt, Homo sapiens
cccauagaaacaugacacugacc

SEQ ID NO: 912001 - RNA, 17 nt, Homo sapiens
cccaucagcaccaugga

SEQ ID NO: 912002 - RNA, 12 nt, Homo sapiens
cccaucauccca

SEQ ID NO: 912003 - RNA, 23 nt, Homo sapiens
cccaucuuguuucacacuaguca

SEQ ID NO: 912004 - RNA, 18 nt, Homo sapiens
cccaugaggacaaagugu

SEQ ID NO: 912005 - RNA, 18 nt, Homo sapiens
cccaugagguacagcaga

SEQ ID NO: 912006 - RNA, 18 nt, Homo sapiens
cccaugcucaaccacugu

SEQ ID NO: 912007 - RNA, 21 nt, Homo sapiens
cccauggcuuuagcuaccuca

SEQ ID NO: 912008 - RNA, 14 nt, Homo sapiens
cccaugucaccuca

SEQ ID NO: 912009 - RNA, 23 nt, Homo sapiens
cccauuacuuuaauacucaccuc

SEQ ID NO: 912010 - RNA, 17 nt, Homo sapiens
cccauuccuauuucuua

SEQ ID NO: 912011 - RNA, 12 nt, Homo sapiens
cccauucuugca

SEQ ID NO: 912012 - RNA, 16 nt, Homo sapiens
cccauugacuugcaca

SEQ ID NO: 912013 - RNA, 20 nt, Homo sapiens
cccauuugcacagguuuuca

SEQ ID NO: 912014 - RNA, 22 nt, Homo sapiens
ccccaaacauuaaucaccaaag

SEQ ID NO: 912015 - RNA, 17 nt, Homo sapiens
ccccaaauugcuaccuc

SEQ ID NO: 912016 - RNA, 21 nt, Homo sapiens
ccccaacuauuaaagugccau

SEQ ID NO: 912017 - RNA, 10 nt, Homo sapiens
ccccaagaca

SEQ ID NO: 912018 - RNA, 16 nt, Homo sapiens
ccccaagccaugguga

SEQ ID NO: 912019 - RNA, 21 nt, Homo sapiens
ccccaagguuuuggagucagu

SEQ ID NO: 912020 - RNA, 22 nt, Homo sapiens
ccccacacugaccuguguuccc

SEQ ID NO: 912021 - RNA, 18 nt, Homo sapiens
ccccaccagccaccucuu

SEQ ID NO: 912022 - RNA, 20 nt, Homo sapiens
ccccaccuugccaagcuuuc

SEQ ID NO: 912023 - RNA, 21 nt, Homo sapiens
ccccaccuuucucgcuggaau

SEQ ID NO: 912024 - RNA, 17 nt, Homo sapiens
ccccagcaagagcacaa

SEQ ID NO: 912025 - RNA, 13 nt, Homo sapiens
ccccagcuuugca

SEQ ID NO: 912026 - RNA, 23 nt, Homo sapiens
ccccaggucucuccacugcucuc

SEQ ID NO: 912027 - RNA, 22 nt, Homo sapiens
ccccagucuacguucuccagcc

SEQ ID NO: 912028 - RNA, 19 nt, Homo sapiens
ccccauaucuuuaaagugu

SEQ ID NO: 912029 - RNA, 15 nt, Homo sapiens
cccccaccuuuggga

SEQ ID NO: 912030 - RNA, 15 nt, Homo sapiens
cccccagacagagcc

SEQ ID NO: 912031 - RNA, 14 nt, Homo sapiens
ccccccagcuguca

SEQ ID NO: 912032 - RNA, 17 nt, Homo sapiens
cccccggagcagggguc

SEQ ID NO: 912033 - RNA, 17 nt, Homo sapiens
cccccgucuucucucca

SEQ ID NO: 912034 - RNA, 15 nt, Homo sapiens
cccccugcugcucau

SEQ ID NO: 912035 - RNA, 14 nt, Homo sapiens
cccccuggagagaa

SEQ ID NO: 912036 - RNA, 14 nt, Homo sapiens
cccccuuacugugc

SEQ ID NO: 912037 - RNA, 14 nt, Homo sapiens
cccccuucagugcc

SEQ ID NO: 912038 - RNA, 21 nt, Homo sapiens
cccccuuggaggagggcugua

SEQ ID NO: 912039 - RNA, 16 nt, Homo sapiens
ccccgacuucauccca

SEQ ID NO: 912040 - RNA, 16 nt, Homo sapiens
ccccguggucuuugaa

SEQ ID NO: 912041 - RNA, 19 nt, Homo sapiens
ccccuaagaggcagugaga

SEQ ID NO: 912042 - RNA, 14 nt, Homo sapiens
ccccuaugcuccag

SEQ ID NO: 912043 - RNA, 22 nt, Homo sapiens
ccccucagagaggcaugugaug

SEQ ID NO: 912044 - RNA, 16 nt, Homo sapiens
ccccucagaugaucuc

SEQ ID NO: 912045 - RNA, 13 nt, Homo sapiens
ccccucagugcuc

SEQ ID NO: 912046 - RNA, 23 nt, Homo sapiens
ccccuccagcaaauaaagcauga

SEQ ID NO: 912047 - RNA, 16 nt, Homo sapiens
ccccucccugugugaa

SEQ ID NO: 912048 - RNA, 17 nt, Homo sapiens
ccccugccuggguuuuc

SEQ ID NO: 912049 - RNA, 21 nt, Homo sapiens
ccccuggccuuugaggcaaag

SEQ ID NO: 912050 - RNA, 16 nt, Homo sapiens
ccccugguaagcagag

SEQ ID NO: 912051 - RNA, 15 nt, Homo sapiens
ccccuuaucuuuuau

SEQ ID NO: 912052 - RNA, 21 nt, Homo sapiens
ccccuucuuuuuugucucaag

SEQ ID NO: 912053 - RNA, 18 nt, Homo sapiens
ccccuugccagacaugug

SEQ ID NO: 912054 - RNA, 13 nt, Homo sapiens
cccgacagccugg

SEQ ID NO: 912055 - RNA, 18 nt, Homo sapiens
cccgagcuagagugcagu

SEQ ID NO: 912056 - RNA, 23 nt, Homo sapiens
cccgaucaucuuuccuguuccag

SEQ ID NO: 912057 - RNA, 15 nt, Homo sapiens
gagccuggcacagga

SEQ ID NO: 912058 - RNA, 16 nt, Homo sapiens
gagccuggcacaggac

SEQ ID NO: 912059 - RNA, 21 nt, Homo sapiens
gagccuucacaaccagccaca

SEQ ID NO: 912060 - RNA, 20 nt, Homo sapiens
gagccuuucuuauggaagaa

SEQ ID NO: 912061 - RNA, 20 nt, Homo sapiens
gagccuuuucuuauauaaga

SEQ ID NO: 912062 - RNA, 19 nt, Homo sapiens
gagcgagacuccgucucaa

SEQ ID NO: 912063 - RNA, 18 nt, Homo sapiens
gagcggcugcccgacuca

SEQ ID NO: 912064 - RNA, 13 nt, Homo sapiens
gagcuagaaccug

SEQ ID NO: 912065 - RNA, 18 nt, Homo sapiens
gagcuagaaccuggagag

SEQ ID NO: 912066 - RNA, 19 nt, Homo sapiens
gagcuaggagcaaagccug

SEQ ID NO: 912067 - RNA, 22 nt, Homo sapiens
gagcugaacccauuuugaguga

SEQ ID NO: 912068 - RNA, 15 nt, Homo sapiens
gagcugaagcuggga

SEQ ID NO: 912069 - RNA, 13 nt, Homo sapiens
gagcugcucugcu

SEQ ID NO: 912070 - RNA, 14 nt, Homo sapiens
gagcuggaaggcag

SEQ ID NO: 912071 - RNA, 17 nt, Homo sapiens
gagcuggcaaagguggc

SEQ ID NO: 912072 - RNA, 15 nt, Homo sapiens
gagcugucuccagga

SEQ ID NO: 912073 - RNA, 20 nt, Homo sapiens
gagcuguuuucccugaccuc

SEQ ID NO: 912074 - RNA, 16 nt, Homo sapiens
gagcuuccagugcaug

SEQ ID NO: 912075 - RNA, 24 nt, Homo sapiens
gagcuucugggaagacaacuagga

SEQ ID NO: 912076 - RNA, 16 nt, Homo sapiens
gagcuuggcagcugaa

SEQ ID NO: 912077 - RNA, 13 nt, Homo sapiens
gaggaaccucaaa

SEQ ID NO: 912078 - RNA, 14 nt, Homo sapiens
gaggaagaaaacca

SEQ ID NO: 912079 - RNA, 17 nt, Homo sapiens
gaggaagaaaaccagcg

SEQ ID NO: 912080 - RNA, 23 nt, Homo sapiens
gaggaauaagaauggagcaguac

SEQ ID NO: 912081 - RNA, 13 nt, Homo sapiens
gaggacaaagugu

SEQ ID NO: 912082 - RNA, 21 nt, Homo sapiens
gaggaggauugcuucuuguga

SEQ ID NO: 912083 - RNA, 15 nt, Homo sapiens
gaggaugcaacaaau

SEQ ID NO: 912084 - RNA, 14 nt, Homo sapiens
gaggcaaaggccag

SEQ ID NO: 912085 - RNA, 21 nt, Homo sapiens
gaggcaccugcuggaaaccac

SEQ ID NO: 912086 - RNA, 23 nt, Homo sapiens
gaggcagcgugaaagcagaugag

SEQ ID NO: 912087 - RNA, 20 nt, Homo sapiens
gaggcaggaggauugcuuga

SEQ ID NO: 912088 - RNA, 18 nt, Homo sapiens
gaggccaaggugggugga

SEQ ID NO: 912089 - RNA, 22 nt, Homo sapiens
gaggccccuccugcccaaguga

SEQ ID NO: 912090 - RNA, 20 nt, Homo sapiens
gaggccuuacuuaaacccag

SEQ ID NO: 912091 - RNA, 13 nt, Homo sapiens
gaggccuuggaaa

SEQ ID NO: 912092 - RNA, 20 nt, Homo sapiens
gaggccuuuccccagugugg

SEQ ID NO: 912093 - RNA, 19 nt, Homo sapiens
gaggcggagaguacaguga

SEQ ID NO: 912094 - RNA, 19 nt, Homo sapiens
gaggcgggcagaucaccag

SEQ ID NO: 912095 - RNA, 20 nt, Homo sapiens
gaggcucagccacacaggaa

SEQ ID NO: 912096 - RNA, 15 nt, Homo sapiens
gaggcuccugugcua

SEQ ID NO: 912097 - RNA, 13 nt, Homo sapiens
gaggcucuucagu

SEQ ID NO: 912098 - RNA, 12 nt, Homo sapiens
gaggcugcagaa

SEQ ID NO: 912099 - RNA, 14 nt, Homo sapiens
gagggaaaaugagu

SEQ ID NO: 912100 - RNA, 14 nt, Homo sapiens
gagggagagcaccu

SEQ ID NO: 912101 - RNA, 16 nt, Homo sapiens
gagggcaggugcccuc

SEQ ID NO: 912102 - RNA, 16 nt, Homo sapiens
gagggccaggauuccu

SEQ ID NO: 912103 - RNA, 18 nt, Homo sapiens
gagggcuagaaccuggag

SEQ ID NO: 912104 - RNA, 16 nt, Homo sapiens
gaggggcugacucagu

SEQ ID NO: 912105 - RNA, 23 nt, Homo sapiens
gaggguuggguucaucugagcaa

SEQ ID NO: 912106 - RNA, 18 nt, Homo sapiens
gaggucaagauuucagga

SEQ ID NO: 912107 - RNA, 16 nt, Homo sapiens
gagguccugagcacug

SEQ ID NO: 912108 - RNA, 17 nt, Homo sapiens
gaggucgggauggggcu

SEQ ID NO: 912109 - RNA, 15 nt, Homo sapiens
gagguggacaguccu

SEQ ID NO: 912110 - RNA, 21 nt, Homo sapiens
gagguggugggggcagggaug

SEQ ID NO: 912111 - RNA, 17 nt, Homo sapiens
gagguguggauaaggcu

SEQ ID NO: 912112 - RNA, 22 nt, Homo sapiens
gagguuccggugucuggaaaag

SEQ ID NO: 912113 - RNA, 20 nt, Homo sapiens
gagguuccucgcaggucuca

SEQ ID NO: 912114 - RNA, 14 nt, Homo sapiens
gagguugcagggag

SEQ ID NO: 912115 - RNA, 19 nt, Homo sapiens
gagguuuggggucugccac

SEQ ID NO: 912116 - RNA, 17 nt, Homo sapiens
gaguaacaugccagcuu

SEQ ID NO: 912117 - RNA, 17 nt, Homo sapiens
gaguacagacgucucaa

SEQ ID NO: 912118 - RNA, 21 nt, Homo sapiens
gaguacagauguaaaugccac

SEQ ID NO: 912119 - RNA, 19 nt, Homo sapiens
gaguauguuaagcucuuua

SEQ ID NO: 912120 - RNA, 13 nt, Homo sapiens
gagucacugaccc

SEQ ID NO: 912121 - RNA, 14 nt, Homo sapiens
gagucauuguuaca

SEQ ID NO: 912122 - RNA, 20 nt, Homo sapiens
gaguccucguagccaucucu

SEQ ID NO: 912123 - RNA, 14 nt, Homo sapiens
gagucgacuuugag

SEQ ID NO: 912124 - RNA, 17 nt, Homo sapiens
gagucucacuguugccc

SEQ ID NO: 912125 - RNA, 21 nt, Homo sapiens
gagucucauucuguugcccag

SEQ ID NO: 912126 - RNA, 19 nt, Homo sapiens
gagucugcauaaacuucau

SEQ ID NO: 912127 - RNA, 22 nt, Homo sapiens
gagucugggcaaugaaaccaaa

SEQ ID NO: 912128 - RNA, 23 nt, Homo sapiens
gagucugggcaaugaaaccaaag

SEQ ID NO: 912129 - RNA, 20 nt, Homo sapiens
gagucuugcucuguugccca

SEQ ID NO: 912130 - RNA, 22 nt, Homo sapiens
gagugacggucccacacuggug

SEQ ID NO: 912131 - RNA, 19 nt, Homo sapiens
gagugagacucugucucaa

SEQ ID NO: 912132 - RNA, 18 nt, Homo sapiens
gagugagagacauuaacu

SEQ ID NO: 912133 - RNA, 22 nt, Homo sapiens
gagugagaggguuugagucaaa

SEQ ID NO: 912134 - RNA, 14 nt, Homo sapiens
gagugauccuccaa

SEQ ID NO: 912135 - RNA, 22 nt, Homo sapiens
gagugccguaacaacugugguc

SEQ ID NO: 912136 - RNA, 19 nt, Homo sapiens
gaguggaacagaaggggug

SEQ ID NO: 912137 - RNA, 14 nt, Homo sapiens
gaguggcacguuua

SEQ ID NO: 912138 - RNA, 21 nt, Homo sapiens
gagugggaaggagauggcaua

SEQ ID NO: 912139 - RNA, 15 nt, Homo sapiens
gagugugcagacuga

SEQ ID NO: 912140 - RNA, 22 nt, Homo sapiens
gagugugggcauagcauuagcu

SEQ ID NO: 912141 - RNA, 21 nt, Homo sapiens
gaguguguuugugugcaugaa

SEQ ID NO: 912142 - RNA, 18 nt, Homo sapiens
gaguguuuaaaguucaac

SEQ ID NO: 912143 - RNA, 17 nt, Homo sapiens
gaguuacuuccuaucaa

SEQ ID NO: 912144 - RNA, 19 nt, Homo sapiens
gaguuaucacuucauuuau

SEQ ID NO: 912145 - RNA, 20 nt, Homo sapiens
gaguucauacccuguuacca

SEQ ID NO: 912146 - RNA, 22 nt, Homo sapiens
gaguuccucagggaguuugacg

SEQ ID NO: 912147 - RNA, 14 nt, Homo sapiens
gaguucugaagcug

SEQ ID NO: 912148 - RNA, 22 nt, Homo sapiens
gaguucuugugccauagucaca

SEQ ID NO: 912149 - RNA, 21 nt, Homo sapiens
gaguuuaacuuugggcccaga

SEQ ID NO: 912150 - RNA, 19 nt, Homo sapiens
gaguuuaugggaaugccuu

SEQ ID NO: 912151 - RNA, 14 nt, Homo sapiens
gaguuucgagguag

SEQ ID NO: 912152 - RNA, 20 nt, Homo sapiens
gauaaaggaagucaccaaaa

SEQ ID NO: 912153 - RNA, 21 nt, Homo sapiens
gauaaaucaguuaugucaauu

SEQ ID NO: 912154 - RNA, 15 nt, Homo sapiens
gauaacugagaauuu

SEQ ID NO: 912155 - RNA, 20 nt, Homo sapiens
gauaaguaaguuugauuuca

SEQ ID NO: 912156 - RNA, 15 nt, Homo sapiens
gauaauaugcuaaau

SEQ ID NO: 912157 - RNA, 19 nt, Homo sapiens
gauaaucgagucuaccucu

SEQ ID NO: 912158 - RNA, 20 nt, Homo sapiens
gauaauggaaagcagcagcu

SEQ ID NO: 912159 - RNA, 18 nt, Homo sapiens
gauaauucaaacugacaa

SEQ ID NO: 912160 - RNA, 20 nt, Homo sapiens
gauacaaggaucagaaugga

SEQ ID NO: 912161 - RNA, 19 nt, Homo sapiens
gauacaggaaaagcugcug

SEQ ID NO: 912162 - RNA, 20 nt, Homo sapiens
gauacccaaguuauugggau

SEQ ID NO: 912163 - RNA, 13 nt, Homo sapiens
gauacccagagca

SEQ ID NO: 912164 - RNA, 14 nt, Homo sapiens
gauacugcaauaaa

SEQ ID NO: 912165 - RNA, 12 nt, Homo sapiens
gauagcuuuauu

SEQ ID NO: 912166 - RNA, 23 nt, Homo sapiens
gauagucagcuguaccaagcccc

SEQ ID NO: 912167 - RNA, 12 nt, Homo sapiens
gauagucugucc

SEQ ID NO: 912168 - RNA, 16 nt, Homo sapiens
gauaguuaaaagacug

SEQ ID NO: 912169 - RNA, 20 nt, Homo sapiens
gauauaugacuuuuucucag

SEQ ID NO: 912170 - RNA, 23 nt, Homo sapiens
gauauauuuuccagggcaaucaa

SEQ ID NO: 912171 - RNA, 15 nt, Homo sapiens
gcaaauauugucaua

SEQ ID NO: 912172 - RNA, 16 nt, Homo sapiens
gcaaauauugucauaa

SEQ ID NO: 912173 - RNA, 23 nt, Homo sapiens
gcaaauguaguauggccuguguc

SEQ ID NO: 912174 - RNA, 18 nt, Homo sapiens
gcaaauguuucugcagua

SEQ ID NO: 912175 - RNA, 22 nt, Homo sapiens
gcaacaggaaucucagagacag

SEQ ID NO: 912176 - RNA, 16 nt, Homo sapiens
gcaaccacacaccuca

SEQ ID NO: 912177 - RNA, 11 nt, Homo sapiens
gcaaccuguag

SEQ ID NO: 912178 - RNA, 15 nt, Homo sapiens
gcaacugaggcagac

SEQ ID NO: 912179 - RNA, 18 nt, Homo sapiens
gcaagaaccaguguuuag

SEQ ID NO: 912180 - RNA, 18 nt, Homo sapiens
gcaagaagucaaaguaaa

SEQ ID NO: 912181 - RNA, 22 nt, Homo sapiens
gcaagacuucucuuugccucaa

SEQ ID NO: 912182 - RNA, 18 nt, Homo sapiens
gcaagagacucuggccuc

SEQ ID NO: 912183 - RNA, 17 nt, Homo sapiens
gcaagaucuugucucca

SEQ ID NO: 912184 - RNA, 21 nt, Homo sapiens
gcaagauuucacaucagcuuu

SEQ ID NO: 912185 - RNA, 21 nt, Homo sapiens
gcaaggacggccuucaacuga

SEQ ID NO: 912186 - RNA, 17 nt, Homo sapiens
gcaaggccucugccccu

SEQ ID NO: 912187 - RNA, 15 nt, Homo sapiens
gcaagggcugugcug

SEQ ID NO: 912188 - RNA, 20 nt, Homo sapiens
gcaagguuauaugcacuuuc

SEQ ID NO: 912189 - RNA, 16 nt, Homo sapiens
gcaagucccugacucu

SEQ ID NO: 912190 - RNA, 21 nt, Homo sapiens
gcaauacuauuauauuaugua

SEQ ID NO: 912191 - RNA, 16 nt, Homo sapiens
gcaaucucuugucuca

SEQ ID NO: 912192 - RNA, 19 nt, Homo sapiens
gcaaucugagagauuugaa

SEQ ID NO: 912193 - RNA, 21 nt, Homo sapiens
gcaaucugagagauuugaaua

SEQ ID NO: 912194 - RNA, 22 nt, Homo sapiens
gcaaugccaaucuucaguauuu

SEQ ID NO: 912195 - RNA, 19 nt, Homo sapiens
gcaaugcccuaauuagggc

SEQ ID NO: 912196 - RNA, 17 nt, Homo sapiens
gcaaugggagggggcuc

SEQ ID NO: 912197 - RNA, 21 nt, Homo sapiens
gcaaugggagggggcuccaug

SEQ ID NO: 912198 - RNA, 19 nt, Homo sapiens
gcaauucagcaaagaacaa

SEQ ID NO: 912199 - RNA, 13 nt, Homo sapiens
gcaauucuaccca

SEQ ID NO: 912200 - RNA, 18 nt, Homo sapiens
gcaauucuccugccucag

SEQ ID NO: 912201 - RNA, 14 nt, Homo sapiens
gcaauugacuguca

SEQ ID NO: 912202 - RNA, 13 nt, Homo sapiens
gcaauuugcacau

SEQ ID NO: 912203 - RNA, 13 nt, Homo sapiens
gcaauuuuuccau

SEQ ID NO: 912204 - RNA, 21 nt, Homo sapiens
gcacaaagcucaagaugacag

SEQ ID NO: 912205 - RNA, 18 nt, Homo sapiens
gcacaaggcugaccaaga

SEQ ID NO: 912206 - RNA, 20 nt, Homo sapiens
gcacacaaugcuauugaaau

SEQ ID NO: 912207 - RNA, 15 nt, Homo sapiens
gcacacacacagaga

SEQ ID NO: 912208 - RNA, 19 nt, Homo sapiens
gcacacacaccgaugcuga

SEQ ID NO: 912209 - RNA, 15 nt, Homo sapiens
gcacacacagaugca

SEQ ID NO: 912210 - RNA, 18 nt, Homo sapiens
gcacacacagaugcacac

SEQ ID NO: 912211 - RNA, 20 nt, Homo sapiens
gcacacacagaugcacacac

SEQ ID NO: 912212 - RNA, 11 nt, Homo sapiens
gcacaccucau

SEQ ID NO: 912213 - RNA, 18 nt, Homo sapiens
gcacaccucaugcugagc

SEQ ID NO: 912214 - RNA, 16 nt, Homo sapiens
gcacagauuacuucag

SEQ ID NO: 912215 - RNA, 22 nt, Homo sapiens
gcacagcccacacaugaaccau

SEQ ID NO: 912216 - RNA, 16 nt, Homo sapiens
gcacaggagcuaccug

SEQ ID NO: 912217 - RNA, 13 nt, Homo sapiens
gcacauaacaugc

SEQ ID NO: 912218 - RNA, 22 nt, Homo sapiens
gcacauagagauaugcacacac

SEQ ID NO: 912219 - RNA, 21 nt, Homo sapiens
gcacauauggacucugcacau

SEQ ID NO: 912220 - RNA, 12 nt, Homo sapiens
gcacaucucugc

SEQ ID NO: 912221 - RNA, 16 nt, Homo sapiens
gcacaucucugcagua

SEQ ID NO: 912222 - RNA, 15 nt, Homo sapiens
gcacaugccaaugca

SEQ ID NO: 912223 - RNA, 20 nt, Homo sapiens
gcacaugucuuguacaugug

SEQ ID NO: 912224 - RNA, 21 nt, Homo sapiens
gcacauguuauccacaagcaa

SEQ ID NO: 912225 - RNA, 19 nt, Homo sapiens
gcaccaaaucaucucucau

SEQ ID NO: 912226 - RNA, 14 nt, Homo sapiens
gcaccaccaugcca

SEQ ID NO: 912227 - RNA, 21 nt, Homo sapiens
gcaccccuccuauaccauaug

SEQ ID NO: 912228 - RNA, 12 nt, Homo sapiens
gcacccuggauu

SEQ ID NO: 912229 - RNA, 16 nt, Homo sapiens
gcacccuguucccucu

SEQ ID NO: 912230 - RNA, 18 nt, Homo sapiens
gcaccgggccacagagaa

SEQ ID NO: 912231 - RNA, 20 nt, Homo sapiens
gcaccuacuuacaugcauua

SEQ ID NO: 912232 - RNA, 22 nt, Homo sapiens
gcaccuggcuaguuucuaacau

SEQ ID NO: 912233 - RNA, 12 nt, Homo sapiens
gcaccugugcag

SEQ ID NO: 912234 - RNA, 12 nt, Homo sapiens
gcaccuucaaua

SEQ ID NO: 912235 - RNA, 16 nt, Homo sapiens
gcacgucuugcuauuu

SEQ ID NO: 912236 - RNA, 21 nt, Homo sapiens
gcacguucuauauugugccaa

SEQ ID NO: 912237 - RNA, 17 nt, Homo sapiens
gcacguuuggcauuucu

SEQ ID NO: 912238 - RNA, 23 nt, Homo sapiens
gcacuaaaaaguggcuaauucaa

SEQ ID NO: 912239 - RNA, 22 nt, Homo sapiens
gcacuaccacgccaagcuaauu

SEQ ID NO: 912240 - RNA, 13 nt, Homo sapiens
gcacuagcauuuu

SEQ ID NO: 912241 - RNA, 16 nt, Homo sapiens
gcacucaaccaaccuc

SEQ ID NO: 912242 - RNA, 20 nt, Homo sapiens
gcacucacccaugugccaag

SEQ ID NO: 912243 - RNA, 22 nt, Homo sapiens
gcacucagaaaagaaaaccauu

SEQ ID NO: 912244 - RNA, 18 nt, Homo sapiens
gcacucccucccagagaa

SEQ ID NO: 912245 - RNA, 18 nt, Homo sapiens
gcacucuucccaccucag

SEQ ID NO: 912246 - RNA, 17 nt, Homo sapiens
gcacugaggaccagcca

SEQ ID NO: 912247 - RNA, 20 nt, Homo sapiens
gcacugugacaccagaauaa

SEQ ID NO: 912248 - RNA, 18 nt, Homo sapiens
gcacuuuacagaugagau

SEQ ID NO: 912249 - RNA, 19 nt, Homo sapiens
gcacuuuauaaaagcaaaa

SEQ ID NO: 912250 - RNA, 18 nt, Homo sapiens
gcacuuuucugugucaua

SEQ ID NO: 912251 - RNA, 15 nt, Homo sapiens
gcagaaaaacucugg

SEQ ID NO: 912252 - RNA, 12 nt, Homo sapiens
gcagaaagccag

SEQ ID NO: 912253 - RNA, 19 nt, Homo sapiens
gcagaaagguuaguaucau

SEQ ID NO: 912254 - RNA, 12 nt, Homo sapiens
gcagaaccaaag

SEQ ID NO: 912255 - RNA, 12 nt, Homo sapiens
gcagacagagaa

SEQ ID NO: 912256 - RNA, 23 nt, Homo sapiens
gcagagaccuugcgaccaugugu

SEQ ID NO: 912257 - RNA, 12 nt, Homo sapiens
gcagagccacca

SEQ ID NO: 912258 - RNA, 21 nt, Homo sapiens
gcagaggcggaaaccuugcag

SEQ ID NO: 912259 - RNA, 19 nt, Homo sapiens
gcagagguaaaagugugag

SEQ ID NO: 912260 - RNA, 18 nt, Homo sapiens
gcagauacauucaugagg

SEQ ID NO: 912261 - RNA, 21 nt, Homo sapiens
gcagaugagcagucacacugu

SEQ ID NO: 912262 - RNA, 18 nt, Homo sapiens
gcagcauagcaagacaca

SEQ ID NO: 912263 - RNA, 21 nt, Homo sapiens
gcagcaucuucaaacauguac

SEQ ID NO: 912264 - RNA, 21 nt, Homo sapiens
gcagccaccaggucaucuccu

SEQ ID NO: 912265 - RNA, 17 nt, Homo sapiens
gcagccaggggcugcuc

SEQ ID NO: 912266 - RNA, 15 nt, Homo sapiens
gcagcgcgugcacag

SEQ ID NO: 912267 - RNA, 13 nt, Homo sapiens
gcagcuuguagcc

SEQ ID NO: 912268 - RNA, 23 nt, Homo sapiens
gcaggacacaagcacaguuuuaa

SEQ ID NO: 912269 - RNA, 21 nt, Homo sapiens
gcaggagaaucacuugcacuc

SEQ ID NO: 912270 - RNA, 17 nt, Homo sapiens
gcaggaggauugcuuga

SEQ ID NO: 912271 - RNA, 20 nt, Homo sapiens
gcaggaguagcugagcucac

SEQ ID NO: 912272 - RNA, 22 nt, Homo sapiens
gcaggauccgcugccaccacgu

SEQ ID NO: 912273 - RNA, 21 nt, Homo sapiens
gcaggcaaacgggucgugaug

SEQ ID NO: 912274 - RNA, 21 nt, Homo sapiens
gcaggcuaugaaguugcaaug

SEQ ID NO: 912275 - RNA, 15 nt, Homo sapiens
gcaggcucagacucu

SEQ ID NO: 912276 - RNA, 24 nt, Homo sapiens
gcagggaauugauccacuucuuaa

SEQ ID NO: 912277 - RNA, 18 nt, Homo sapiens
gcagguagugggugaaug

SEQ ID NO: 912278 - RNA, 21 nt, Homo sapiens
gcagguugaccgggacuucaa

SEQ ID NO: 912279 - RNA, 17 nt, Homo sapiens
gcaguacuuuaccuccu

SEQ ID NO: 912280 - RNA, 17 nt, Homo sapiens
gcagucaacaguucaaa

SEQ ID NO: 912281 - RNA, 19 nt, Homo sapiens
gcaguccgcagucuggccu

SEQ ID NO: 912282 - RNA, 17 nt, Homo sapiens
gcagucucagaaagccu

SEQ ID NO: 912283 - RNA, 23 nt, Homo sapiens
gcagugacgugcaccuguacuca

SEQ ID NO: 912284 - RNA, 15 nt, Homo sapiens
gcagugagcuucuau

SEQ ID NO: 912285 - RNA, 14 nt, Homo sapiens
gcgcacacacagau

SEQ ID NO: 912286 - RNA, 20 nt, Homo sapiens
gcgcagcccgaagcccaguu

SEQ ID NO: 912287 - RNA, 15 nt, Homo sapiens
gcgccugugcugagg

SEQ ID NO: 912288 - RNA, 24 nt, Homo sapiens
gcgcgcagcgcgugcacagcgcgg

SEQ ID NO: 912289 - RNA, 14 nt, Homo sapiens
gcgcgguggcucac

SEQ ID NO: 912290 - RNA, 15 nt, Homo sapiens
gcgcuggcucaggaa

SEQ ID NO: 912291 - RNA, 13 nt, Homo sapiens
gcggaaccauagc

SEQ ID NO: 912292 - RNA, 16 nt, Homo sapiens
gcggacaucucaggga

SEQ ID NO: 912293 - RNA, 19 nt, Homo sapiens
gcggccaugauggugcuga

SEQ ID NO: 912294 - RNA, 19 nt, Homo sapiens
gcggcgggucaaucugccu

SEQ ID NO: 912295 - RNA, 20 nt, Homo sapiens
gcggucauucuacacugagg

SEQ ID NO: 912296 - RNA, 12 nt, Homo sapiens
gcgguggcucac

SEQ ID NO: 912297 - RNA, 22 nt, Homo sapiens
gcguaacaaacaaaaucaugga

SEQ ID NO: 912298 - RNA, 16 nt, Homo sapiens
gcguacucagcacagc

SEQ ID NO: 912299 - RNA, 12 nt, Homo sapiens
gcgucaguuuuu

SEQ ID NO: 912300 - RNA, 12 nt, Homo sapiens
gcgugcacacac

SEQ ID NO: 912301 - RNA, 19 nt, Homo sapiens
gcguggaccccgacaaagg

SEQ ID NO: 912302 - RNA, 18 nt, Homo sapiens
gcguggacucugcacaug

SEQ ID NO: 912303 - RNA, 23 nt, Homo sapiens
gcguggcaacccucacuguguug

SEQ ID NO: 912304 - RNA, 20 nt, Homo sapiens
gcuaaaauuagaugaacuca

SEQ ID NO: 912305 - RNA, 19 nt, Homo sapiens
gcuaaaauugaacuacuug

SEQ ID NO: 912306 - RNA, 13 nt, Homo sapiens
gcuaaauacugua

SEQ ID NO: 912307 - RNA, 17 nt, Homo sapiens
gcuaacuccagucuccu

SEQ ID NO: 912308 - RNA, 20 nt, Homo sapiens
gcuaacuguguguacauaua

SEQ ID NO: 912309 - RNA, 21 nt, Homo sapiens
gcuaagauuuagagaugaauu

SEQ ID NO: 912310 - RNA, 15 nt, Homo sapiens
gcuaaggaagggaaa

SEQ ID NO: 912311 - RNA, 20 nt, Homo sapiens
gcuaaucauuaagguauuau

SEQ ID NO: 912312 - RNA, 15 nt, Homo sapiens
gcuaauucaauuuau

SEQ ID NO: 912313 - RNA, 20 nt, Homo sapiens
gcuacaccacucuggcagcc

SEQ ID NO: 912314 - RNA, 19 nt, Homo sapiens
gcuaccucacuaugcugcu

SEQ ID NO: 912315 - RNA, 18 nt, Homo sapiens
gcuacucagaagccugag

SEQ ID NO: 912316 - RNA, 21 nt, Homo sapiens
gcuacuuuucagaauugaagg

SEQ ID NO: 912317 - RNA, 13 nt, Homo sapiens
gcuagaaggccac

SEQ ID NO: 912318 - RNA, 21 nt, Homo sapiens
gcuagaaggccacaugucacc

SEQ ID NO: 912319 - RNA, 14 nt, Homo sapiens
gcuagagugcagug

SEQ ID NO: 912320 - RNA, 20 nt, Homo sapiens
gcuagcaacauaccagacca

SEQ ID NO: 912321 - RNA, 14 nt, Homo sapiens
gcuagcagaaguau

SEQ ID NO: 912322 - RNA, 21 nt, Homo sapiens
gcuagcugcaagugacaucuc

SEQ ID NO: 912323 - RNA, 20 nt, Homo sapiens
gcuagugccugagaugcacg

SEQ ID NO: 912324 - RNA, 18 nt, Homo sapiens
gcuaguucguagcuuucc

SEQ ID NO: 912325 - RNA, 22 nt, Homo sapiens
gcuaguuuauuggaaguguuca

SEQ ID NO: 912326 - RNA, 16 nt, Homo sapiens
gcuaguuugaccucau

SEQ ID NO: 912327 - RNA, 17 nt, Homo sapiens
gcuaucgcaccacugug

SEQ ID NO: 912328 - RNA, 11 nt, Homo sapiens
gcuaucucugu

SEQ ID NO: 912329 - RNA, 23 nt, Homo sapiens
gcuaugguuuucuccaagagcua

SEQ ID NO: 912330 - RNA, 20 nt, Homo sapiens
gcucaaaucauuuaagaagg

SEQ ID NO: 912331 - RNA, 19 nt, Homo sapiens
gcucacaguacaauguuuc

SEQ ID NO: 912332 - RNA, 22 nt, Homo sapiens
gcucacucccugggaaaggggu

SEQ ID NO: 912333 - RNA, 22 nt, Homo sapiens
gcucacugaaaagacuauugug

SEQ ID NO: 912334 - RNA, 14 nt, Homo sapiens
gcucacuguucuau

SEQ ID NO: 912335 - RNA, 16 nt, Homo sapiens
gcucagacuugccagg

SEQ ID NO: 912336 - RNA, 10 nt, Homo sapiens
gcucagagau

SEQ ID NO: 912337 - RNA, 23 nt, Homo sapiens
gcucagaggcccaggaaucggag

SEQ ID NO: 912338 - RNA, 19 nt, Homo sapiens
gcucagcccugacuggugc

SEQ ID NO: 912339 - RNA, 14 nt, Homo sapiens
gcucaggcauuuga

SEQ ID NO: 912340 - RNA, 13 nt, Homo sapiens
gcucaucacugga

SEQ ID NO: 912341 - RNA, 14 nt, Homo sapiens
gcucaucacuggau

SEQ ID NO: 912342 - RNA, 20 nt, Homo sapiens
gcucauucauuuaacagagc

SEQ ID NO: 912343 - RNA, 17 nt, Homo sapiens
gcucauuuuuucuuaca

SEQ ID NO: 912344 - RNA, 21 nt, Homo sapiens
gcuccaagagaauucacuuua

SEQ ID NO: 912345 - RNA, 15 nt, Homo sapiens
gcuccccuuccugcc

SEQ ID NO: 912346 - RNA, 22 nt, Homo sapiens
gcucccgagcuacucucuugcc

SEQ ID NO: 912347 - RNA, 12 nt, Homo sapiens
gcucccuaacac

SEQ ID NO: 912348 - RNA, 22 nt, Homo sapiens
gcuccgaaaaacuuuguuauau

SEQ ID NO: 912349 - RNA, 15 nt, Homo sapiens
gcuccgccucugucc

SEQ ID NO: 912350 - RNA, 16 nt, Homo sapiens
gcuccuccccucuuga

SEQ ID NO: 912351 - RNA, 14 nt, Homo sapiens
gcuccuggaaccaa

SEQ ID NO: 912352 - RNA, 13 nt, Homo sapiens
gcuccuguuucca

SEQ ID NO: 912353 - RNA, 14 nt, Homo sapiens
gcuccuugacuccu

SEQ ID NO: 912354 - RNA, 21 nt, Homo sapiens
gcuccuuucuccagccagcaa

SEQ ID NO: 912355 - RNA, 22 nt, Homo sapiens
gcucuagagaaaagucuacccc

SEQ ID NO: 912356 - RNA, 13 nt, Homo sapiens
gcucuaguuuuca

SEQ ID NO: 912357 - RNA, 15 nt, Homo sapiens
gcucugccuccugcc

SEQ ID NO: 912358 - RNA, 23 nt, Homo sapiens
gcucuggauaacaagacuuugac

SEQ ID NO: 912359 - RNA, 21 nt, Homo sapiens
gcucuucuaaccucagccaaa

SEQ ID NO: 912360 - RNA, 18 nt, Homo sapiens
gcucuucuaccauuugaa

SEQ ID NO: 912361 - RNA, 17 nt, Homo sapiens
gcucuucugucaucccg

SEQ ID NO: 912362 - RNA, 12 nt, Homo sapiens
gcucuugggagu

SEQ ID NO: 912363 - RNA, 18 nt, Homo sapiens
gcucuuucccuuuaucag

SEQ ID NO: 912364 - RNA, 15 nt, Homo sapiens
gcucuuuggggucag

SEQ ID NO: 912365 - RNA, 22 nt, Homo sapiens
gcugacccaaguguugagggga

SEQ ID NO: 912366 - RNA, 19 nt, Homo sapiens
gcugacccagaguggaguc

SEQ ID NO: 912367 - RNA, 14 nt, Homo sapiens
gcugagagacccaa

SEQ ID NO: 912368 - RNA, 14 nt, Homo sapiens
gcugagauuccugg

SEQ ID NO: 912369 - RNA, 20 nt, Homo sapiens
gcugagguccugaucagcuu

SEQ ID NO: 912370 - RNA, 13 nt, Homo sapiens
gcugaucaaugaa

SEQ ID NO: 912371 - RNA, 24 nt, Homo sapiens
gcugaugagugauugacacacagc

SEQ ID NO: 912372 - RNA, 22 nt, Homo sapiens
gcugaugugcccaccaccgugu

SEQ ID NO: 912373 - RNA, 21 nt, Homo sapiens
gcugcaacggaauuaggaaga

SEQ ID NO: 912374 - RNA, 14 nt, Homo sapiens
gcugcagaaggcca

SEQ ID NO: 912375 - RNA, 14 nt, Homo sapiens
gcugcaggaaucaa

SEQ ID NO: 912376 - RNA, 24 nt, Homo sapiens
gcugcagugacccagauauugcac

SEQ ID NO: 912377 - RNA, 18 nt, Homo sapiens
gcugccaaacacccaugc

SEQ ID NO: 912378 - RNA, 17 nt, Homo sapiens
gcugccaggacaccugc

SEQ ID NO: 912379 - RNA, 18 nt, Homo sapiens
gcugccaggacaccugcc

SEQ ID NO: 912380 - RNA, 14 nt, Homo sapiens
gcugccugccuugg

SEQ ID NO: 912381 - RNA, 24 nt, Homo sapiens
gcugccuuuuuuaacacuagaaaa

SEQ ID NO: 912382 - RNA, 18 nt, Homo sapiens
gcugcggugucacugggc

SEQ ID NO: 912383 - RNA, 13 nt, Homo sapiens
gcugcucucugag

SEQ ID NO: 912384 - RNA, 18 nt, Homo sapiens
gcugcugagaaucuagcc

SEQ ID NO: 912385 - RNA, 20 nt, Homo sapiens
gcugcugagaaucuagccuc

SEQ ID NO: 912386 - RNA, 15 nt, Homo sapiens
gcugcuuguccugcu

SEQ ID NO: 912387 - RNA, 18 nt, Homo sapiens
gcuggacggggacugggg

SEQ ID NO: 912388 - RNA, 16 nt, Homo sapiens
gcuggacugaggacca

SEQ ID NO: 912389 - RNA, 19 nt, Homo sapiens
gcuggaggacuagaaccug

SEQ ID NO: 912390 - RNA, 20 nt, Homo sapiens
gcuggagugcaguggugcga

SEQ ID NO: 912391 - RNA, 17 nt, Homo sapiens
gcuggauaaaaugaggu

SEQ ID NO: 912392 - RNA, 20 nt, Homo sapiens
gcuggaugucuccaucucug

SEQ ID NO: 912393 - RNA, 14 nt, Homo sapiens
gcuggcacugagca

SEQ ID NO: 912394 - RNA, 14 nt, Homo sapiens
gcuggcagccaccc

SEQ ID NO: 912395 - RNA, 12 nt, Homo sapiens
gcuggccucuag

SEQ ID NO: 912396 - RNA, 16 nt, Homo sapiens
gcugggauuacaggug

SEQ ID NO: 912397 - RNA, 19 nt, Homo sapiens
gcugggcuuguagaccacu

SEQ ID NO: 912398 - RNA, 15 nt, Homo sapiens
gcuggggccagugua

SEQ ID NO: 912399 - RNA, 13 nt, Homo sapiens
gcuggguguugca

SEQ ID NO: 912400 - RNA, 15 nt, Homo sapiens
ggacgugucucagga

SEQ ID NO: 912401 - RNA, 19 nt, Homo sapiens
ggacuauuuaugaaggcaa

SEQ ID NO: 912402 - RNA, 15 nt, Homo sapiens
ggacucaagggucca

SEQ ID NO: 912403 - RNA, 22 nt, Homo sapiens
ggacucaaugcacugacauugu

SEQ ID NO: 912404 - RNA, 23 nt, Homo sapiens
ggacucaaugcacugacauuguu

SEQ ID NO: 912405 - RNA, 16 nt, Homo sapiens
ggacuuacuauuuauu

SEQ ID NO: 912406 - RNA, 23 nt, Homo sapiens
ggagaaccucaggcuuccuuggc

SEQ ID NO: 912407 - RNA, 14 nt, Homo sapiens
ggagaacuauccaa

SEQ ID NO: 912408 - RNA, 19 nt, Homo sapiens
ggagaaggaaggcuccauc

SEQ ID NO: 912409 - RNA, 19 nt, Homo sapiens
ggagaaugaagacuguuaa

SEQ ID NO: 912410 - RNA, 23 nt, Homo sapiens
ggagacacuauuuaucugugcaa

SEQ ID NO: 912411 - RNA, 16 nt, Homo sapiens
ggagacugucucaaga

SEQ ID NO: 912412 - RNA, 12 nt, Homo sapiens
ggagacuuguau

SEQ ID NO: 912413 - RNA, 13 nt, Homo sapiens
ggagagaacugaa

SEQ ID NO: 912414 - RNA, 13 nt, Homo sapiens
ggagagaaguuuc

SEQ ID NO: 912415 - RNA, 22 nt, Homo sapiens
ggagagacacucccagggacaa

SEQ ID NO: 912416 - RNA, 15 nt, Homo sapiens
ggagagcagcuggcu

SEQ ID NO: 912417 - RNA, 18 nt, Homo sapiens
ggagaggggaagggccag

SEQ ID NO: 912418 - RNA, 16 nt, Homo sapiens
ggagaguacagugagc

SEQ ID NO: 912419 - RNA, 21 nt, Homo sapiens
ggagaguacagugagccaaga

SEQ ID NO: 912420 - RNA, 14 nt, Homo sapiens
ggagaugaugauga

SEQ ID NO: 912421 - RNA, 19 nt, Homo sapiens
ggagcaagugacaugccau

SEQ ID NO: 912422 - RNA, 17 nt, Homo sapiens
ggagcaauuugcacaug

SEQ ID NO: 912423 - RNA, 18 nt, Homo sapiens
ggagccucccccucagau

SEQ ID NO: 912424 - RNA, 23 nt, Homo sapiens
ggagccucgguggccaugcuucu

SEQ ID NO: 912425 - RNA, 23 nt, Homo sapiens
ggagccucuccuugccuggugac

SEQ ID NO: 912426 - RNA, 22 nt, Homo sapiens
ggagccugaacaugacauuucu

SEQ ID NO: 912427 - RNA, 13 nt, Homo sapiens
ggagcgcaccugc

SEQ ID NO: 912428 - RNA, 23 nt, Homo sapiens
ggagcugccgcaaggcccugucc

SEQ ID NO: 912429 - RNA, 18 nt, Homo sapiens
ggaggacacacagucuca

SEQ ID NO: 912430 - RNA, 16 nt, Homo sapiens
ggaggacacaguuucu

SEQ ID NO: 912431 - RNA, 16 nt, Homo sapiens
ggaggauggcacuccg

SEQ ID NO: 912432 - RNA, 20 nt, Homo sapiens
ggaggcggagguuccaguga

SEQ ID NO: 912433 - RNA, 15 nt, Homo sapiens
ggaggcugaggcaag

SEQ ID NO: 912434 - RNA, 17 nt, Homo sapiens
ggagggacacuuaccca

SEQ ID NO: 912435 - RNA, 22 nt, Homo sapiens
ggagggcgugacucacccaagc

SEQ ID NO: 912436 - RNA, 23 nt, Homo sapiens
ggagggguuuuggugauacccaa

SEQ ID NO: 912437 - RNA, 22 nt, Homo sapiens
ggaggucccugccaguguuuag

SEQ ID NO: 912438 - RNA, 19 nt, Homo sapiens
ggagguggagguugcagug

SEQ ID NO: 912439 - RNA, 19 nt, Homo sapiens
ggaggugggguacauuucu

SEQ ID NO: 912440 - RNA, 18 nt, Homo sapiens
ggagugagaucauuuucu

SEQ ID NO: 912441 - RNA, 16 nt, Homo sapiens
ggaguggaugcgauaa

SEQ ID NO: 912442 - RNA, 20 nt, Homo sapiens
ggaguucgaggcugcaguca

SEQ ID NO: 912443 - RNA, 19 nt, Homo sapiens
ggaguugcucacucaggac

SEQ ID NO: 912444 - RNA, 14 nt, Homo sapiens
ggaguuggagacca

SEQ ID NO: 912445 - RNA, 23 nt, Homo sapiens
ggauaaucacauuaucaucugaa

SEQ ID NO: 912446 - RNA, 17 nt, Homo sapiens
ggauacagaaugaaucc

SEQ ID NO: 912447 - RNA, 24 nt, Homo sapiens
ggauaucaucuuuucuaaucucuu

SEQ ID NO: 912448 - RNA, 22 nt, Homo sapiens
ggaucaagaaggggacagcgcc

SEQ ID NO: 912449 - RNA, 16 nt, Homo sapiens
ggaucacaaggucacu

SEQ ID NO: 912450 - RNA, 21 nt, Homo sapiens
ggaucagccuccgccauucca

SEQ ID NO: 912451 - RNA, 18 nt, Homo sapiens
ggaucccaggccagggaa

SEQ ID NO: 912452 - RNA, 14 nt, Homo sapiens
ggauccgcugccac

SEQ ID NO: 912453 - RNA, 14 nt, Homo sapiens
ggauccuuuccugg

SEQ ID NO: 912454 - RNA, 14 nt, Homo sapiens
ggaucgcaccuuuu

SEQ ID NO: 912455 - RNA, 17 nt, Homo sapiens
ggaugaagcucuggcca

SEQ ID NO: 912456 - RNA, 21 nt, Homo sapiens
ggaugacgugaagccacagga

SEQ ID NO: 912457 - RNA, 23 nt, Homo sapiens
ggaugaggaaccucaaacugggu

SEQ ID NO: 912458 - RNA, 13 nt, Homo sapiens
ggaugaggucaua

SEQ ID NO: 912459 - RNA, 16 nt, Homo sapiens
ggaugaugguugcaaa

SEQ ID NO: 912460 - RNA, 12 nt, Homo sapiens
ggaugcacacac

SEQ ID NO: 912461 - RNA, 14 nt, Homo sapiens
ggauggaagugucu

SEQ ID NO: 912462 - RNA, 20 nt, Homo sapiens
ggauggacgaacaggggcca

SEQ ID NO: 912463 - RNA, 21 nt, Homo sapiens
ggauggacgaacaggggccaa

SEQ ID NO: 912464 - RNA, 14 nt, Homo sapiens
ggauggcaccagag

SEQ ID NO: 912465 - RNA, 14 nt, Homo sapiens
ggauuacaggcaug

SEQ ID NO: 912466 - RNA, 14 nt, Homo sapiens
ggauuauucauuua

SEQ ID NO: 912467 - RNA, 16 nt, Homo sapiens
ggauugcuaugaauga

SEQ ID NO: 912468 - RNA, 18 nt, Homo sapiens
ggauuuaacagucauuua

SEQ ID NO: 912469 - RNA, 20 nt, Homo sapiens
ggauuugaugaaagugcaaa

SEQ ID NO: 912470 - RNA, 18 nt, Homo sapiens
ggauuuguuuaaaaacca

SEQ ID NO: 912471 - RNA, 23 nt, Homo sapiens
ggauuuuuuguuauguuugcacu

SEQ ID NO: 912472 - RNA, 20 nt, Homo sapiens
ggcaaaaccacuagaacucu

SEQ ID NO: 912473 - RNA, 17 nt, Homo sapiens
ggcaaagaaaagccaga

SEQ ID NO: 912474 - RNA, 22 nt, Homo sapiens
ggcaaagaacugccccaucucc

SEQ ID NO: 912475 - RNA, 20 nt, Homo sapiens
ggcaaaugcuugauucuuuc

SEQ ID NO: 912476 - RNA, 16 nt, Homo sapiens
ggcaacaaagugagac

SEQ ID NO: 912477 - RNA, 23 nt, Homo sapiens
ggcaacaauacaugcugcuaauu

SEQ ID NO: 912478 - RNA, 14 nt, Homo sapiens
ggcaacaaugagca

SEQ ID NO: 912479 - RNA, 20 nt, Homo sapiens
ggcaacauaguaagacccca

SEQ ID NO: 912480 - RNA, 22 nt, Homo sapiens
ggcaacccaccaucuacccacu

SEQ ID NO: 912481 - RNA, 22 nt, Homo sapiens
ggcaaccuugucucuaugccag

SEQ ID NO: 912482 - RNA, 12 nt, Homo sapiens
ggcaacugugag

SEQ ID NO: 912483 - RNA, 20 nt, Homo sapiens
ggcaagggcaacccaccauc

SEQ ID NO: 912484 - RNA, 14 nt, Homo sapiens
ggcaagggguuucc

SEQ ID NO: 912485 - RNA, 21 nt, Homo sapiens
ggcaauaaguuccauguuaaa

SEQ ID NO: 912486 - RNA, 17 nt, Homo sapiens
ggcaauugcggggccca

SEQ ID NO: 912487 - RNA, 16 nt, Homo sapiens
ggcacaaaugcaccuc

SEQ ID NO: 912488 - RNA, 23 nt, Homo sapiens
ggcacaaaugcaccucccaguuu

SEQ ID NO: 912489 - RNA, 17 nt, Homo sapiens
ggcacauggcuggcacu

SEQ ID NO: 912490 - RNA, 15 nt, Homo sapiens
ggcacauuggcagug

SEQ ID NO: 912491 - RNA, 18 nt, Homo sapiens
ggcacauuggcagugugu

SEQ ID NO: 912492 - RNA, 18 nt, Homo sapiens
ggcaccacgaagcuguga

SEQ ID NO: 912493 - RNA, 22 nt, Homo sapiens
ggcaccuacaagguugugcccu

SEQ ID NO: 912494 - RNA, 21 nt, Homo sapiens
ggcaccuccuacgucaaacau

SEQ ID NO: 912495 - RNA, 16 nt, Homo sapiens
ggcacucacaugccgc

SEQ ID NO: 912496 - RNA, 18 nt, Homo sapiens
ggcacucagaagacacug

SEQ ID NO: 912497 - RNA, 19 nt, Homo sapiens
ggcacucuucccaccucag

SEQ ID NO: 912498 - RNA, 20 nt, Homo sapiens
ggcacugauaauauguuuga

SEQ ID NO: 912499 - RNA, 11 nt, Homo sapiens
ggcacugccug

SEQ ID NO: 912500 - RNA, 11 nt, Homo sapiens
ggcacugggau

SEQ ID NO: 912501 - RNA, 12 nt, Homo sapiens
ggcagagaagaa

SEQ ID NO: 912502 - RNA, 18 nt, Homo sapiens
ggcagcaucagggacaca

SEQ ID NO: 912503 - RNA, 22 nt, Homo sapiens
ggcagccacacuucucaggaca

SEQ ID NO: 912504 - RNA, 10 nt, Homo sapiens
ggcagccacc

SEQ ID NO: 912505 - RNA, 20 nt, Homo sapiens
ggcagccacccccuccccca

SEQ ID NO: 912506 - RNA, 21 nt, Homo sapiens
ggcagccacccccucccccau

SEQ ID NO: 912507 - RNA, 19 nt, Homo sapiens
ggcaggagaaucaauaaaa

SEQ ID NO: 912508 - RNA, 22 nt, Homo sapiens
ggcaggaggaucacagugaccu

SEQ ID NO: 912509 - RNA, 16 nt, Homo sapiens
ggcagggcaaaugaca

SEQ ID NO: 912510 - RNA, 23 nt, Homo sapiens
ggcaggggugggagagccagcuc

SEQ ID NO: 912511 - RNA, 14 nt, Homo sapiens
ggcagggucucacu

SEQ ID NO: 912512 - RNA, 12 nt, Homo sapiens
ggcaggugcaga

SEQ ID NO: 912513 - RNA, 22 nt, Homo sapiens
ggcagucugaacccuugugcuu

SEQ ID NO: 912514 - RNA, 18 nt, Homo sapiens
uccguccggaaaugaagg

SEQ ID NO: 912515 - RNA, 21 nt, Homo sapiens
uccgucucaaaaaaagggcaa

SEQ ID NO: 912516 - RNA, 21 nt, Homo sapiens
uccuaagcuucaaaucagaag

SEQ ID NO: 912517 - RNA, 22 nt, Homo sapiens
uccuaauaugcuuuacaaucug

SEQ ID NO: 912518 - RNA, 21 nt, Homo sapiens
uccuaaugauuagcacuuaau

SEQ ID NO: 912519 - RNA, 14 nt, Homo sapiens
uccuacaagcuaaa

SEQ ID NO: 912520 - RNA, 17 nt, Homo sapiens
uccuacagauagucaaa

SEQ ID NO: 912521 - RNA, 12 nt, Homo sapiens
uccuaccucagc

SEQ ID NO: 912522 - RNA, 19 nt, Homo sapiens
uccuaccugcugcugcuau

SEQ ID NO: 912523 - RNA, 21 nt, Homo sapiens
uccuagaaccaagcuucagag

SEQ ID NO: 912524 - RNA, 21 nt, Homo sapiens
uccuagaauggaugugcucac

SEQ ID NO: 912525 - RNA, 19 nt, Homo sapiens
uccuaggccacaccaucuc

SEQ ID NO: 912526 - RNA, 20 nt, Homo sapiens
uccuauuuaugaaaaccaua

SEQ ID NO: 912527 - RNA, 18 nt, Homo sapiens
uccuauuuuaaaaccaug

SEQ ID NO: 912528 - RNA, 20 nt, Homo sapiens
uccuauuuuaaaaccaugca

SEQ ID NO: 912529 - RNA, 20 nt, Homo sapiens
uccucaacaacaaaccaaaa

SEQ ID NO: 912530 - RNA, 19 nt, Homo sapiens
uccucagguaguacuggga

SEQ ID NO: 912531 - RNA, 13 nt, Homo sapiens
uccucauuccuga

SEQ ID NO: 912532 - RNA, 22 nt, Homo sapiens
uccuccacaauaaggucaaugc

SEQ ID NO: 912533 - RNA, 13 nt, Homo sapiens
uccuccacuccac

SEQ ID NO: 912534 - RNA, 12 nt, Homo sapiens
uccuccaggcaa

SEQ ID NO: 912535 - RNA, 13 nt, Homo sapiens
uccucccagacuu

SEQ ID NO: 912536 - RNA, 21 nt, Homo sapiens
uccuccccuccuggcacccac

SEQ ID NO: 912537 - RNA, 13 nt, Homo sapiens
uccucgucucucu

SEQ ID NO: 912538 - RNA, 22 nt, Homo sapiens
uccucuacuacuuuuacuacag

SEQ ID NO: 912539 - RNA, 23 nt, Homo sapiens
uccucugccucccauucugacca

SEQ ID NO: 912540 - RNA, 14 nt, Homo sapiens
uccucuugcaaaag

SEQ ID NO: 912541 - RNA, 16 nt, Homo sapiens
uccucuuguugcugag

SEQ ID NO: 912542 - RNA, 18 nt, Homo sapiens
uccugaguggcugaaaua

SEQ ID NO: 912543 - RNA, 22 nt, Homo sapiens
uccugagugugggcuucugaaa

SEQ ID NO: 912544 - RNA, 14 nt, Homo sapiens
uccugauacugggu

SEQ ID NO: 912545 - RNA, 16 nt, Homo sapiens
uccugauuucagggaa

SEQ ID NO: 912546 - RNA, 16 nt, Homo sapiens
uccugauuucucugaa

SEQ ID NO: 912547 - RNA, 16 nt, Homo sapiens
uccugcagagauccag

SEQ ID NO: 912548 - RNA, 20 nt, Homo sapiens
uccugcagccuccuccugac

SEQ ID NO: 912549 - RNA, 21 nt, Homo sapiens
uccugcauuuuuuuaccuuaa

SEQ ID NO: 912550 - RNA, 14 nt, Homo sapiens
uccugccaguugaa

SEQ ID NO: 912551 - RNA, 15 nt, Homo sapiens
uccugccuacauucc

SEQ ID NO: 912552 - RNA, 13 nt, Homo sapiens
uccugccuacccc

SEQ ID NO: 912553 - RNA, 15 nt, Homo sapiens
uccugccuucaugga

SEQ ID NO: 912554 - RNA, 16 nt, Homo sapiens
uccugccuucauggaa

SEQ ID NO: 912555 - RNA, 12 nt, Homo sapiens
uccugccuugau

SEQ ID NO: 912556 - RNA, 13 nt, Homo sapiens
uccugcuucuuca

SEQ ID NO: 912557 - RNA, 12 nt, Homo sapiens
uccuggaaccaa

SEQ ID NO: 912558 - RNA, 16 nt, Homo sapiens
uccuggaggugggaga

SEQ ID NO: 912559 - RNA, 23 nt, Homo sapiens
uccuggaggugggagacaaggaa

SEQ ID NO: 912560 - RNA, 15 nt, Homo sapiens
uccuggauucacuca

SEQ ID NO: 912561 - RNA, 21 nt, Homo sapiens
uccuggcccucuucuuauuca

SEQ ID NO: 912562 - RNA, 16 nt, Homo sapiens
uccuggccucaaguga

SEQ ID NO: 912563 - RNA, 14 nt, Homo sapiens
uccuggcugagaga

SEQ ID NO: 912564 - RNA, 21 nt, Homo sapiens
uccuggcuucuagaucuggaa

SEQ ID NO: 912565 - RNA, 19 nt, Homo sapiens
uccuggcuuugacaugaaa

SEQ ID NO: 912566 - RNA, 17 nt, Homo sapiens
uccugggcuaagugauc

SEQ ID NO: 912567 - RNA, 18 nt, Homo sapiens
uccugggggaugugcacg

SEQ ID NO: 912568 - RNA, 17 nt, Homo sapiens
uccuggucugcucagga

SEQ ID NO: 912569 - RNA, 17 nt, Homo sapiens
uccuguacgaaccccuc

SEQ ID NO: 912570 - RNA, 16 nt, Homo sapiens
uccugugccaaccuga

SEQ ID NO: 912571 - RNA, 12 nt, Homo sapiens
uccuguguacag

SEQ ID NO: 912572 - RNA, 13 nt, Homo sapiens
uccugugugcuga

SEQ ID NO: 912573 - RNA, 17 nt, Homo sapiens
uccuguuuacacucggg

SEQ ID NO: 912574 - RNA, 17 nt, Homo sapiens
uccuguuuuucugggug

SEQ ID NO: 912575 - RNA, 13 nt, Homo sapiens
uccuuaauccuga

SEQ ID NO: 912576 - RNA, 16 nt, Homo sapiens
uccuuaccuuuacaua

SEQ ID NO: 912577 - RNA, 20 nt, Homo sapiens
uccuuacucccaggcacugu

SEQ ID NO: 912578 - RNA, 19 nt, Homo sapiens
uccuuagcuuagaccucag

SEQ ID NO: 912579 - RNA, 15 nt, Homo sapiens
uccuucaagaacucu

SEQ ID NO: 912580 - RNA, 13 nt, Homo sapiens
uccuucagugcau

SEQ ID NO: 912581 - RNA, 19 nt, Homo sapiens
uccuuccucaguccuggaa

SEQ ID NO: 912582 - RNA, 18 nt, Homo sapiens
uccuucucguuugcucua

SEQ ID NO: 912583 - RNA, 19 nt, Homo sapiens
uccuugauacuaaaaguuc

SEQ ID NO: 912584 - RNA, 20 nt, Homo sapiens
uccuuguauuuaaauauuaa

SEQ ID NO: 912585 - RNA, 23 nt, Homo sapiens
uccuugucccaagcccagggacu

SEQ ID NO: 912586 - RNA, 18 nt, Homo sapiens
uccuugugguuuauguca

SEQ ID NO: 912587 - RNA, 22 nt, Homo sapiens
uccuuuaccuaccaccuucccu

SEQ ID NO: 912588 - RNA, 15 nt, Homo sapiens
uccuuucacaaccuu

SEQ ID NO: 912589 - RNA, 16 nt, Homo sapiens
uccuuucucuauccca

SEQ ID NO: 912590 - RNA, 19 nt, Homo sapiens
uccuuugagaaugugauuc

SEQ ID NO: 912591 - RNA, 20 nt, Homo sapiens
uccuuugcaccgauccccac

SEQ ID NO: 912592 - RNA, 18 nt, Homo sapiens
uccuuugcauuccaugau

SEQ ID NO: 912593 - RNA, 23 nt, Homo sapiens
uccuuuugaaagaaucagucuug

SEQ ID NO: 912594 - RNA, 16 nt, Homo sapiens
uccuuuugaccaaaua

SEQ ID NO: 912595 - RNA, 14 nt, Homo sapiens
ucgaagcuccguga

SEQ ID NO: 912596 - RNA, 15 nt, Homo sapiens
ucgaguccccagaac

SEQ ID NO: 912597 - RNA, 14 nt, Homo sapiens
ucgaguuuacuuca

SEQ ID NO: 912598 - RNA, 20 nt, Homo sapiens
ucgaguuuacuucaugagga

SEQ ID NO: 912599 - RNA, 13 nt, Homo sapiens
ucgauauaugacu

SEQ ID NO: 912600 - RNA, 22 nt, Homo sapiens
ucgauauaugacuuuuucucag

SEQ ID NO: 912601 - RNA, 18 nt, Homo sapiens
ucgaugagaaauugaacu

SEQ ID NO: 912602 - RNA, 21 nt, Homo sapiens
ucgaugccacuccugcuucuc

SEQ ID NO: 912603 - RNA, 12 nt, Homo sapiens
ucgauuagacug

SEQ ID NO: 912604 - RNA, 19 nt, Homo sapiens
ucgauuauucccuguacaa

SEQ ID NO: 912605 - RNA, 16 nt, Homo sapiens
ucgcagccacccugag

SEQ ID NO: 912606 - RNA, 16 nt, Homo sapiens
ucgcccacaaacugau

SEQ ID NO: 912607 - RNA, 18 nt, Homo sapiens
ucgcccaggagacauccg

SEQ ID NO: 912608 - RNA, 16 nt, Homo sapiens
ucgccuaggccuguga

SEQ ID NO: 912609 - RNA, 23 nt, Homo sapiens
ucgccucucccaccccaugcauu

SEQ ID NO: 912610 - RNA, 20 nt, Homo sapiens
ucgcuuguuuuucuuugaag

SEQ ID NO: 912611 - RNA, 23 nt, Homo sapiens
ucggcaucgggccaucucagaua

SEQ ID NO: 912612 - RNA, 22 nt, Homo sapiens
ucgggaggcugaggcggaagaa

SEQ ID NO: 912613 - RNA, 16 nt, Homo sapiens
ucgggauuguguuuga

SEQ ID NO: 912614 - RNA, 10 nt, Homo sapiens
ucggggagcu

SEQ ID NO: 912615 - RNA, 18 nt, Homo sapiens
ucgguggccaugcuucuu

SEQ ID NO: 912616 - RNA, 22 nt, Homo sapiens
ucguagagacgggguuucacca

SEQ ID NO: 912617 - RNA, 18 nt, Homo sapiens
ucguauccccaagccaca

SEQ ID NO: 912618 - RNA, 15 nt, Homo sapiens
ucguucuucugggaa

SEQ ID NO: 912619 - RNA, 12 nt, Homo sapiens
ucuaaaacugcc

SEQ ID NO: 912620 - RNA, 14 nt, Homo sapiens
ucuaaaauagccac

SEQ ID NO: 912621 - RNA, 15 nt, Homo sapiens
ucuaaacauuuuggg

SEQ ID NO: 912622 - RNA, 18 nt, Homo sapiens
ucuaaagccaguggcagu

SEQ ID NO: 912623 - RNA, 14 nt, Homo sapiens
ucuaaauagcccuu

SEQ ID NO: 912624 - RNA, 17 nt, Homo sapiens
ucuaaaugaagugcaaa

SEQ ID NO: 912625 - RNA, 12 nt, Homo sapiens
ucuaaaugccca

SEQ ID NO: 912626 - RNA, 14 nt, Homo sapiens
ucuaacaguauuug

SEQ ID NO: 912627 - RNA, 20 nt, Homo sapiens
ucuaacaguauuuguacaaa

SEQ ID NO: 912628 - RNA, 16 nt, Homo sapiens
ucuaacuacaaggaca

SEQ ID NO: 912629 - RNA, 18 nt, Homo sapiens
ucuugauaugaccuguua

SEQ ID NO: 912630 - RNA, 13 nt, Homo sapiens
ucuugcagaucaa

SEQ ID NO: 912631 - RNA, 16 nt, Homo sapiens
ucuugcauucccagug

SEQ ID NO: 912632 - RNA, 13 nt, Homo sapiens
ucuugcauugcaa

SEQ ID NO: 912633 - RNA, 14 nt, Homo sapiens
ucuugcauugcaaa

SEQ ID NO: 912634 - RNA, 13 nt, Homo sapiens
ucuugcucaaaaa

SEQ ID NO: 912635 - RNA, 15 nt, Homo sapiens
ucuuggaagugugug

SEQ ID NO: 912636 - RNA, 20 nt, Homo sapiens
ucuugggcuacuggcagcuc

SEQ ID NO: 912637 - RNA, 19 nt, Homo sapiens
ucuuggggucccagggaag

SEQ ID NO: 912638 - RNA, 15 nt, Homo sapiens
ucuugucuccauuug

SEQ ID NO: 912639 - RNA, 17 nt, Homo sapiens
ucuugugaaaccacagg

SEQ ID NO: 912640 - RNA, 13 nt, Homo sapiens
ucuugugccucag

SEQ ID NO: 912641 - RNA, 12 nt, Homo sapiens
ucuuuaccugag

SEQ ID NO: 912642 - RNA, 16 nt, Homo sapiens
ucuuuauugcugugaa

SEQ ID NO: 912643 - RNA, 12 nt, Homo sapiens
ucuuucagagag

SEQ ID NO: 912644 - RNA, 14 nt, Homo sapiens
ucuuuccccaccuc

SEQ ID NO: 912645 - RNA, 22 nt, Homo sapiens
ucuuuccccaccucuuccuucc

SEQ ID NO: 912646 - RNA, 20 nt, Homo sapiens
ucuuucccuuuaucaguuug

SEQ ID NO: 912647 - RNA, 18 nt, Homo sapiens
ucuuuccuuuugcaacaa

SEQ ID NO: 912648 - RNA, 15 nt, Homo sapiens
ucuuucuauucauaa

SEQ ID NO: 912649 - RNA, 14 nt, Homo sapiens
ucuuucugugcuuc

SEQ ID NO: 912650 - RNA, 19 nt, Homo sapiens
ucuuugaauaaagucugag

SEQ ID NO: 912651 - RNA, 19 nt, Homo sapiens
ucuuugaauuauaugucua

SEQ ID NO: 912652 - RNA, 12 nt, Homo sapiens
ucuuugccucaa

SEQ ID NO: 912653 - RNA, 19 nt, Homo sapiens
ucuuuguaaugucaccacc

SEQ ID NO: 912654 - RNA, 15 nt, Homo sapiens
ucuuuguccccaaau

SEQ ID NO: 912655 - RNA, 17 nt, Homo sapiens
ucuuuuuucaacuggcu

SEQ ID NO: 912656 - RNA, 22 nt, Homo sapiens
ugaaaaaaaauuuuauaguguc

SEQ ID NO: 912657 - RNA, 19 nt, Homo sapiens
ugaaaaaaaguacauguau

SEQ ID NO: 912658 - RNA, 11 nt, Homo sapiens
ugaaaaccaua

SEQ ID NO: 912659 - RNA, 19 nt, Homo sapiens
ugaaaagguuaacagauac

SEQ ID NO: 912660 - RNA, 16 nt, Homo sapiens
ugaaaauaauguugua

SEQ ID NO: 912661 - RNA, 18 nt, Homo sapiens
ugaaaauaauuguuccaa

SEQ ID NO: 912662 - RNA, 18 nt, Homo sapiens
ugaaaauuaugagucucu

SEQ ID NO: 912663 - RNA, 22 nt, Homo sapiens
ugaaaccagaaggauauuuacu

SEQ ID NO: 912664 - RNA, 18 nt, Homo sapiens
ugaaacuguguacgacaa

SEQ ID NO: 912665 - RNA, 21 nt, Homo sapiens
ugaaagaaccaaaagagauca

SEQ ID NO: 912666 - RNA, 16 nt, Homo sapiens
ugaaagaaggagcaag

SEQ ID NO: 912667 - RNA, 17 nt, Homo sapiens
ugaaagaaucagucuug

SEQ ID NO: 912668 - RNA, 12 nt, Homo sapiens
ugaaagaugcaa

SEQ ID NO: 912669 - RNA, 13 nt, Homo sapiens
ugaaagggcaaua

SEQ ID NO: 912670 - RNA, 16 nt, Homo sapiens
ugaaagggguugugaa

SEQ ID NO: 912671 - RNA, 18 nt, Homo sapiens
ugaaagugaauaaacuuc

SEQ ID NO: 912672 - RNA, 13 nt, Homo sapiens
ugaaagugguuug

SEQ ID NO: 912673 - RNA, 18 nt, Homo sapiens
ugaaauaaaagccucugg

SEQ ID NO: 912674 - RNA, 18 nt, Homo sapiens
ugaaauaccagugaacca

SEQ ID NO: 912675 - RNA, 23 nt, Homo sapiens
ugaaauaccagugaaccaaagag

SEQ ID NO: 912676 - RNA, 15 nt, Homo sapiens
ugaaauauuugcuua

SEQ ID NO: 912677 - RNA, 16 nt, Homo sapiens
ugaaaucagaagccua

SEQ ID NO: 912678 - RNA, 22 nt, Homo sapiens
ugaaaucagaagccuacuuuga

SEQ ID NO: 912679 - RNA, 14 nt, Homo sapiens
ugaaaucugaggaa

SEQ ID NO: 912680 - RNA, 11 nt, Homo sapiens
ugaaaugcuag

SEQ ID NO: 912681 - RNA, 19 nt, Homo sapiens
ugaaaugcuuguugaauca

SEQ ID NO: 912682 - RNA, 15 nt, Homo sapiens
ugaaauuauaucugu

SEQ ID NO: 912683 - RNA, 20 nt, Homo sapiens
ugaaauugaugccaguggaa

SEQ ID NO: 912684 - RNA, 21 nt, Homo sapiens
ugaaauuugacucaugaacua

SEQ ID NO: 912685 - RNA, 21 nt, Homo sapiens
ugaaauuuucucaucuaaaau

SEQ ID NO: 912686 - RNA, 23 nt, Homo sapiens
ugaacaaacuaugaucacaguga

SEQ ID NO: 912687 - RNA, 21 nt, Homo sapiens
ugaacacacauggaugcacac

SEQ ID NO: 912688 - RNA, 15 nt, Homo sapiens
ugaacacacucagca

SEQ ID NO: 912689 - RNA, 14 nt, Homo sapiens
ugaacacaucagcu

SEQ ID NO: 912690 - RNA, 15 nt, Homo sapiens
ugaacaccacuuugu

SEQ ID NO: 912691 - RNA, 23 nt, Homo sapiens
ugaacaccacuuugucucugaga

SEQ ID NO: 912692 - RNA, 20 nt, Homo sapiens
ugaacaccuccuagccacau

SEQ ID NO: 912693 - RNA, 13 nt, Homo sapiens
ugaacacuggggg

SEQ ID NO: 912694 - RNA, 18 nt, Homo sapiens
ugaacagcagaaagacug

SEQ ID NO: 912695 - RNA, 11 nt, Homo sapiens
ugaacagccaa

SEQ ID NO: 912696 - RNA, 13 nt, Homo sapiens
ugaaccacuuugc

SEQ ID NO: 912697 - RNA, 20 nt, Homo sapiens
ugaaccucaagcugcaucua

SEQ ID NO: 912698 - RNA, 19 nt, Homo sapiens
ugaaccugggaaccaugaa

SEQ ID NO: 912699 - RNA, 22 nt, Homo sapiens
ugaacuaaguuuuuuacuucca

SEQ ID NO: 912700 - RNA, 14 nt, Homo sapiens
ugaacugagccuag

SEQ ID NO: 912701 - RNA, 17 nt, Homo sapiens
ugaacugagccuagcua

SEQ ID NO: 912702 - RNA, 13 nt, Homo sapiens
ugaacugcugauu

SEQ ID NO: 912703 - RNA, 22 nt, Homo sapiens
ugaacuuuccaaaaccuaaaga

SEQ ID NO: 912704 - RNA, 20 nt, Homo sapiens
ugaagaaaagcacuuuuuaa

SEQ ID NO: 912705 - RNA, 22 nt, Homo sapiens
ugaagaacaucccaagccagaa

SEQ ID NO: 912706 - RNA, 16 nt, Homo sapiens
ugaagacaacagcaua

SEQ ID NO: 912707 - RNA, 16 nt, Homo sapiens
ugaagacccaguguaa

SEQ ID NO: 912708 - RNA, 22 nt, Homo sapiens
ugaagacccaguguaaagaaua

SEQ ID NO: 912709 - RNA, 22 nt, Homo sapiens
ugaagacccuauuucagaaaua

SEQ ID NO: 912710 - RNA, 19 nt, Homo sapiens
ugaagagauuucaacaaga

SEQ ID NO: 912711 - RNA, 22 nt, Homo sapiens
ugaagaggaagggcaaaaccac

SEQ ID NO: 912712 - RNA, 18 nt, Homo sapiens
ugaagagggagaagggau

SEQ ID NO: 912713 - RNA, 17 nt, Homo sapiens
ugaagaguaguuuacua

SEQ ID NO: 912714 - RNA, 21 nt, Homo sapiens
ugaagaugccagugaaacuuc

SEQ ID NO: 912715 - RNA, 22 nt, Homo sapiens
ugaagccagcugcaggaaucaa

SEQ ID NO: 912716 - RNA, 18 nt, Homo sapiens
ugaagccccuuguccucu

SEQ ID NO: 912717 - RNA, 21 nt, Homo sapiens
ugaagcugacagcacuacaaa

SEQ ID NO: 912718 - RNA, 20 nt, Homo sapiens
ugaagcuucacucacuguca

SEQ ID NO: 912719 - RNA, 20 nt, Homo sapiens
ugaaggaaaaccucacuuga

SEQ ID NO: 912720 - RNA, 19 nt, Homo sapiens
ugaaggacgugucucagga

SEQ ID NO: 912721 - RNA, 16 nt, Homo sapiens
ugaaggagaaggugcc

SEQ ID NO: 912722 - RNA, 17 nt, Homo sapiens
ugaaggaggugagggau

SEQ ID NO: 912723 - RNA, 10 nt, Homo sapiens
ugaaggugcu

SEQ ID NO: 912724 - RNA, 12 nt, Homo sapiens
ugaaggugcuga

SEQ ID NO: 912725 - RNA, 20 nt, Homo sapiens
ugaaggugcugacaaagaug

SEQ ID NO: 912726 - RNA, 17 nt, Homo sapiens
ugaagguggggccagug

SEQ ID NO: 912727 - RNA, 20 nt, Homo sapiens
ugaaguaaaggauugaucac

SEQ ID NO: 912728 - RNA, 13 nt, Homo sapiens
ugaaguagaaucc

SEQ ID NO: 912729 - RNA, 15 nt, Homo sapiens
ugaagucacacagug

SEQ ID NO: 912730 - RNA, 16 nt, Homo sapiens
ugaagucacacaguga

SEQ ID NO: 912731 - RNA, 11 nt, Homo sapiens
ugaagugcuug

SEQ ID NO: 912732 - RNA, 21 nt, Homo sapiens
ugaaguuagggaugacuguga

SEQ ID NO: 912733 - RNA, 23 nt, Homo sapiens
ugaaguuagggaugacugugauu

SEQ ID NO: 912734 - RNA, 21 nt, Homo sapiens
ugaaguuguguuaacaaugca

SEQ ID NO: 912735 - RNA, 16 nt, Homo sapiens
ugaaguuugaacuuca

SEQ ID NO: 912736 - RNA, 16 nt, Homo sapiens
ugaaguuuuuauuuag

SEQ ID NO: 912737 - RNA, 21 nt, Homo sapiens
ugaauaaagccugcuuuuuaa

SEQ ID NO: 912738 - RNA, 21 nt, Homo sapiens
ugaauaaaguuaguguguugu

SEQ ID NO: 912739 - RNA, 20 nt, Homo sapiens
ugaauagaaaaaguaaucaa

SEQ ID NO: 912740 - RNA, 22 nt, Homo sapiens
ugaauaucugccccaguaguca

SEQ ID NO: 912741 - RNA, 18 nt, Homo sapiens
ugaauccucucucugugu

SEQ ID NO: 912742 - RNA, 21 nt, Homo sapiens
ugaauccucucucuguguuac

SEQ ID NO: 912743 - RNA, 17 nt, Homo sapiens
ugaaucuaaaagcuuuu

SEQ ID NO: 912744 - RNA, 17 nt, Homo sapiens
ugcaggauuucuucaca

SEQ ID NO: 912745 - RNA, 18 nt, Homo sapiens
ugcagggaagagggcagu

SEQ ID NO: 912746 - RNA, 11 nt, Homo sapiens
ugcaguagcac

SEQ ID NO: 912747 - RNA, 17 nt, Homo sapiens
ugcaguagcacgaucuc

SEQ ID NO: 912748 - RNA, 19 nt, Homo sapiens
ugcaguauggccaugggcu

SEQ ID NO: 912749 - RNA, 16 nt, Homo sapiens
ugcaguauuuuauuaa

SEQ ID NO: 912750 - RNA, 20 nt, Homo sapiens
ugcagucaacaguucaaaga

SEQ ID NO: 912751 - RNA, 23 nt, Homo sapiens
ugcagugguaugaucacggcuca

SEQ ID NO: 912752 - RNA, 14 nt, Homo sapiens
ugcaguugauucug

SEQ ID NO: 912753 - RNA, 17 nt, Homo sapiens
ugcauagugcuaagaaa

SEQ ID NO: 912754 - RNA, 18 nt, Homo sapiens
ugcauauaaaaugcuuua

SEQ ID NO: 912755 - RNA, 18 nt, Homo sapiens
ugcaucaauuuaccuacu

SEQ ID NO: 912756 - RNA, 22 nt, Homo sapiens
ugcauccacgcacacauggaca

SEQ ID NO: 912757 - RNA, 14 nt, Homo sapiens
ugcaucccccagca

SEQ ID NO: 912758 - RNA, 18 nt, Homo sapiens
ugcauccguaguucccug

SEQ ID NO: 912759 - RNA, 12 nt, Homo sapiens
ugcaucuacuca

SEQ ID NO: 912760 - RNA, 13 nt, Homo sapiens
ugcaucuacucag

SEQ ID NO: 912761 - RNA, 21 nt, Homo sapiens
ugcaugaccugaucauuacau

SEQ ID NO: 912762 - RNA, 22 nt, Homo sapiens
ugcaugauuuuauacauaguca

SEQ ID NO: 912763 - RNA, 20 nt, Homo sapiens
ugcauggaacccccagaaua

SEQ ID NO: 912764 - RNA, 13 nt, Homo sapiens
ugcauguguauau

SEQ ID NO: 912765 - RNA, 15 nt, Homo sapiens
ugcauguguguauaa

SEQ ID NO: 912766 - RNA, 15 nt, Homo sapiens
ugcaugugugugaug

SEQ ID NO: 912767 - RNA, 17 nt, Homo sapiens
ugcauuacugcaugcac

SEQ ID NO: 912768 - RNA, 10 nt, Homo sapiens
ugcauuccau

SEQ ID NO: 912769 - RNA, 13 nt, Homo sapiens
ugcauuugcacua

SEQ ID NO: 912770 - RNA, 23 nt, Homo sapiens
ugcauuugucaaagcauugagau

SEQ ID NO: 912771 - RNA, 14 nt, Homo sapiens
ugcauuugugucau

SEQ ID NO: 912772 - RNA, 17 nt, Homo sapiens
ugcauuuuuaaauacaa

SEQ ID NO: 912773 - RNA, 18 nt, Homo sapiens
ugccaagaaaguauuugg

SEQ ID NO: 912774 - RNA, 16 nt, Homo sapiens
ugccaaugcacgcaca

SEQ ID NO: 912775 - RNA, 13 nt, Homo sapiens
ugccacaaugccu

SEQ ID NO: 912776 - RNA, 14 nt, Homo sapiens
ugccacaucugugu

SEQ ID NO: 912777 - RNA, 15 nt, Homo sapiens
ugccaccugucuguc

SEQ ID NO: 912778 - RNA, 17 nt, Homo sapiens
ugccacucccugagcuu

SEQ ID NO: 912779 - RNA, 14 nt, Homo sapiens
ugccacuucccaga

SEQ ID NO: 912780 - RNA, 12 nt, Homo sapiens
ugccacuuugca

SEQ ID NO: 912781 - RNA, 18 nt, Homo sapiens
ugccagaaagcauaaaau

SEQ ID NO: 912782 - RNA, 17 nt, Homo sapiens
ugccagcagaacaugug

SEQ ID NO: 912783 - RNA, 20 nt, Homo sapiens
ugccaggcuguaagcauucu

SEQ ID NO: 912784 - RNA, 20 nt, Homo sapiens
ugccagucucuucugauuaa

SEQ ID NO: 912785 - RNA, 23 nt, Homo sapiens
ugccaguguuuagaagagccuga

SEQ ID NO: 912786 - RNA, 14 nt, Homo sapiens
ugccauaaagccau

SEQ ID NO: 912787 - RNA, 23 nt, Homo sapiens
ugccaucaagaugagagaacugg

SEQ ID NO: 912788 - RNA, 20 nt, Homo sapiens
ugccauguaaaggccuuuaa

SEQ ID NO: 912789 - RNA, 17 nt, Homo sapiens
ugccaugucuuguucag

SEQ ID NO: 912790 - RNA, 18 nt, Homo sapiens
ugccauguuuagauucca

SEQ ID NO: 912791 - RNA, 21 nt, Homo sapiens
ugcccaaccugcucuccucuu

SEQ ID NO: 912792 - RNA, 20 nt, Homo sapiens
ugcccacgcuggagugcagu

SEQ ID NO: 912793 - RNA, 15 nt, Homo sapiens
ugcccacuacgugcc

SEQ ID NO: 912794 - RNA, 16 nt, Homo sapiens
ugcccacuauggucau

SEQ ID NO: 912795 - RNA, 15 nt, Homo sapiens
ugcccagggcucagc

SEQ ID NO: 912796 - RNA, 20 nt, Homo sapiens
ugcccagggcucagccuggu

SEQ ID NO: 912797 - RNA, 21 nt, Homo sapiens
ugcccagugcacuugcuggaa

SEQ ID NO: 912798 - RNA, 17 nt, Homo sapiens
ugccccagagaugggca

SEQ ID NO: 912799 - RNA, 19 nt, Homo sapiens
ugcccccagccucuguccc

SEQ ID NO: 912800 - RNA, 14 nt, Homo sapiens
ugcccccaucuuuc

SEQ ID NO: 912801 - RNA, 16 nt, Homo sapiens
ugccccccuugccaga

SEQ ID NO: 912802 - RNA, 16 nt, Homo sapiens
ugccccucaccugccu

SEQ ID NO: 912803 - RNA, 13 nt, Homo sapiens
ugccccucuuccc

SEQ ID NO: 912804 - RNA, 16 nt, Homo sapiens
ugccccuggccuuuga

SEQ ID NO: 912805 - RNA, 15 nt, Homo sapiens
ugccccuguaaauag

SEQ ID NO: 912806 - RNA, 21 nt, Homo sapiens
ugcccuagcgcucucuuccag

SEQ ID NO: 912807 - RNA, 20 nt, Homo sapiens
ugcccuguauauaauacuaa

SEQ ID NO: 912808 - RNA, 18 nt, Homo sapiens
ugcccuucuuucuacccu

SEQ ID NO: 912809 - RNA, 20 nt, Homo sapiens
ugccggacacagagggggcc

SEQ ID NO: 912810 - RNA, 15 nt, Homo sapiens
ugccggcccagugac

SEQ ID NO: 912811 - RNA, 14 nt, Homo sapiens
ugccgugacagggc

SEQ ID NO: 912812 - RNA, 12 nt, Homo sapiens
ugccuaccccag

SEQ ID NO: 912813 - RNA, 15 nt, Homo sapiens
ugccuagaggugcuc

SEQ ID NO: 912814 - RNA, 17 nt, Homo sapiens
ugccuagaggugcucau

SEQ ID NO: 912815 - RNA, 22 nt, Homo sapiens
ugccuauuuauuggggugccua

SEQ ID NO: 912816 - RNA, 14 nt, Homo sapiens
ugccuccagcacuc

SEQ ID NO: 912817 - RNA, 23 nt, Homo sapiens
ugccuccucccugggcagaaagu

SEQ ID NO: 912818 - RNA, 19 nt, Homo sapiens
ugccuccugggaccaugga

SEQ ID NO: 912819 - RNA, 15 nt, Homo sapiens
ugccucuaccuggac

SEQ ID NO: 912820 - RNA, 17 nt, Homo sapiens
ugccucucugcuccaga

SEQ ID NO: 912821 - RNA, 14 nt, Homo sapiens
ugccucugucucac

SEQ ID NO: 912822 - RNA, 15 nt, Homo sapiens
ugccugaauccauca

SEQ ID NO: 912823 - RNA, 19 nt, Homo sapiens
ugccuggaaauuaaacccu

SEQ ID NO: 912824 - RNA, 21 nt, Homo sapiens
ugccuguacuaaggagcauga

SEQ ID NO: 912825 - RNA, 22 nt, Homo sapiens
ugccugugcacggccagcugca

SEQ ID NO: 912826 - RNA, 21 nt, Homo sapiens
ugccugugcaugaccugauca

SEQ ID NO: 912827 - RNA, 15 nt, Homo sapiens
ugccugugugagcau

SEQ ID NO: 912828 - RNA, 19 nt, Homo sapiens
ugccugugugagcaucucu

SEQ ID NO: 912829 - RNA, 21 nt, Homo sapiens
ugccugugugggacugagaug

SEQ ID NO: 912830 - RNA, 15 nt, Homo sapiens
ugccuuaaaggaccu

SEQ ID NO: 912831 - RNA, 15 nt, Homo sapiens
ugccuuaagccaaua

SEQ ID NO: 912832 - RNA, 21 nt, Homo sapiens
ugccuucucacaucuguccag

SEQ ID NO: 912833 - RNA, 17 nt, Homo sapiens
ugccuucucccugggaa

SEQ ID NO: 912834 - RNA, 16 nt, Homo sapiens
ugccuugccaugucuu

SEQ ID NO: 912835 - RNA, 20 nt, Homo sapiens
ugccuuguaaacaugaaggg

SEQ ID NO: 912836 - RNA, 16 nt, Homo sapiens
ugccuuugaccaucuc

SEQ ID NO: 912837 - RNA, 21 nt, Homo sapiens
ugccuuugggaggcagcauca

SEQ ID NO: 912838 - RNA, 20 nt, Homo sapiens
ugccuuuuuuaacacuagaa

SEQ ID NO: 912839 - RNA, 17 nt, Homo sapiens
ugcgaaguggcucucag

SEQ ID NO: 912840 - RNA, 17 nt, Homo sapiens
ugcgaccgugaccagga

SEQ ID NO: 912841 - RNA, 16 nt, Homo sapiens
ugcgacgcagguguac

SEQ ID NO: 912842 - RNA, 15 nt, Homo sapiens
ugcgagcauuucccu

SEQ ID NO: 912843 - RNA, 19 nt, Homo sapiens
ugcgcacaaggcugaccaa

SEQ ID NO: 912844 - RNA, 21 nt, Homo sapiens
ugcgcacacacagauaugcac

SEQ ID NO: 912845 - RNA, 21 nt, Homo sapiens
ugcgccacugcacuccagucu

SEQ ID NO: 912846 - RNA, 13 nt, Homo sapiens
ugcgcugcucaac

SEQ ID NO: 912847 - RNA, 15 nt, Homo sapiens
ugcgucgaagcuuug

SEQ ID NO: 912848 - RNA, 15 nt, Homo sapiens
ugcguggacucugca

SEQ ID NO: 912849 - RNA, 15 nt, Homo sapiens
ugcuaaauacuguac

SEQ ID NO: 912850 - RNA, 22 nt, Homo sapiens
ugcuaaauaguucuaucaggaa

SEQ ID NO: 912851 - RNA, 22 nt, Homo sapiens
ugcuaacuagcuuggaaacugg

SEQ ID NO: 912852 - RNA, 16 nt, Homo sapiens
ugcuaaggaguucuca

SEQ ID NO: 912853 - RNA, 21 nt, Homo sapiens
ugcuaaucagggaggucauuu

SEQ ID NO: 912854 - RNA, 24 nt, Homo sapiens
ugcuaauuaaaaaguuaaucuuca

SEQ ID NO: 912855 - RNA, 18 nt, Homo sapiens
ugcuacaaaaacacagca

SEQ ID NO: 912856 - RNA, 16 nt, Homo sapiens
ugcuacucuaguauuc

SEQ ID NO: 912857 - RNA, 20 nt, Homo sapiens
ugcuagacaagcuuguccau

SEQ ID NO: 912858 - RNA, 16 nt, Homo sapiens
ugcuagcugcaaguga

SEQ ID NO: 912859 - RNA, 14 nt, Homo sapiens
aacagucucaggaa

SEQ ID NO: 912860 - RNA, 11 nt, Homo sapiens
aacaguucaaa

SEQ ID NO: 912861 - RNA, 20 nt, Homo sapiens
aacaguuccuucagcuucca

SEQ ID NO: 912862 - RNA, 13 nt, Homo sapiens
aacaguucuugga

SEQ ID NO: 912863 - RNA, 22 nt, Homo sapiens
aacaguuuuuuaugcuaaucag

SEQ ID NO: 912864 - RNA, 19 nt, Homo sapiens
aacauaaagagaacucugg

SEQ ID NO: 912865 - RNA, 17 nt, Homo sapiens
aacauaagguacuagca

SEQ ID NO: 912866 - RNA, 19 nt, Homo sapiens
aacauaagguacuagcagu

SEQ ID NO: 912867 - RNA, 13 nt, Homo sapiens
aacauaccagacc

SEQ ID NO: 912868 - RNA, 12 nt, Homo sapiens
aacauagacaga

SEQ ID NO: 912869 - RNA, 16 nt, Homo sapiens
aacauagacagaagaa

SEQ ID NO: 912870 - RNA, 15 nt, Homo sapiens
aacauauuugcacaa

SEQ ID NO: 912871 - RNA, 15 nt, Homo sapiens
aacaucaugcauuca

SEQ ID NO: 912872 - RNA, 19 nt, Homo sapiens
aacauccuucaagaacucu

SEQ ID NO: 912873 - RNA, 20 nt, Homo sapiens
aacaugaaaaacacggcagc

SEQ ID NO: 912874 - RNA, 17 nt, Homo sapiens
aacaugauacuauucag

SEQ ID NO: 912875 - RNA, 14 nt, Homo sapiens
aacaugcacgguga

SEQ ID NO: 912876 - RNA, 13 nt, Homo sapiens
aacaugcuuuaga

SEQ ID NO: 912877 - RNA, 22 nt, Homo sapiens
aacaugguaaaaccccaucucu

SEQ ID NO: 912878 - RNA, 22 nt, Homo sapiens
aacauggugaaaccucaucucu

SEQ ID NO: 912879 - RNA, 23 nt, Homo sapiens
aacauggugaaaccucaucucua

SEQ ID NO: 912880 - RNA, 19 nt, Homo sapiens
aacaugugguuaaugccau

SEQ ID NO: 912881 - RNA, 20 nt, Homo sapiens
aacauucacacagggcucuu

SEQ ID NO: 912882 - RNA, 17 nt, Homo sapiens
aacauuccaaugcauug

SEQ ID NO: 912883 - RNA, 15 nt, Homo sapiens
aacauuccugugaaa

SEQ ID NO: 912884 - RNA, 11 nt, Homo sapiens
aacauucugua

SEQ ID NO: 912885 - RNA, 13 nt, Homo sapiens
aacauuuacacau

SEQ ID NO: 912886 - RNA, 21 nt, Homo sapiens
aacauuuauuucaaacuauug

SEQ ID NO: 912887 - RNA, 20 nt, Homo sapiens
aacauuucuauagccaaaaa

SEQ ID NO: 912888 - RNA, 19 nt, Homo sapiens
aaccaaaugcugucuccau

SEQ ID NO: 912889 - RNA, 19 nt, Homo sapiens
aaccaagucuacuucacua

SEQ ID NO: 912890 - RNA, 19 nt, Homo sapiens
aaccaaguggcucccacac

SEQ ID NO: 912891 - RNA, 9 nt, Homo sapiens
aaccaauga

SEQ ID NO: 912892 - RNA, 13 nt, Homo sapiens
aaccacucaaauu

SEQ ID NO: 912893 - RNA, 15 nt, Homo sapiens
aaccacuguacauau

SEQ ID NO: 912894 - RNA, 11 nt, Homo sapiens
aaccacugugg

SEQ ID NO: 912895 - RNA, 13 nt, Homo sapiens
aaccagagcagga

SEQ ID NO: 912896 - RNA, 14 nt, Homo sapiens
aaccagaggguugu

SEQ ID NO: 912897 - RNA, 20 nt, Homo sapiens
aaccagcagaaaagugcuua

SEQ ID NO: 912898 - RNA, 23 nt, Homo sapiens
aaccagccgaccggcccugcccc

SEQ ID NO: 912899 - RNA, 18 nt, Homo sapiens
aaccaguuaugugaauga

SEQ ID NO: 912900 - RNA, 13 nt, Homo sapiens
aaccauaaacuuc

SEQ ID NO: 912901 - RNA, 15 nt, Homo sapiens
aaccauaaacuucau

SEQ ID NO: 912902 - RNA, 18 nt, Homo sapiens
aaccaucgcgugcaauga

SEQ ID NO: 912903 - RNA, 15 nt, Homo sapiens
aacccaccagccuaa

SEQ ID NO: 912904 - RNA, 20 nt, Homo sapiens
aacccagcucccuucuuccc

SEQ ID NO: 912905 - RNA, 15 nt, Homo sapiens
aacccauacuacccu

SEQ ID NO: 912906 - RNA, 18 nt, Homo sapiens
aaccccaacgcacaggaa

SEQ ID NO: 912907 - RNA, 16 nt, Homo sapiens
aacccccugacauuau

SEQ ID NO: 912908 - RNA, 17 nt, Homo sapiens
aaccccgcggugcucug

SEQ ID NO: 912909 - RNA, 13 nt, Homo sapiens
aacccucacugug

SEQ ID NO: 912910 - RNA, 12 nt, Homo sapiens
aacccuccccaa

SEQ ID NO: 912911 - RNA, 13 nt, Homo sapiens
aacccuccccaaa

SEQ ID NO: 912912 - RNA, 15 nt, Homo sapiens
aacccucucuucccu

SEQ ID NO: 912913 - RNA, 19 nt, Homo sapiens
aacccugccccacuucucu

SEQ ID NO: 912914 - RNA, 22 nt, Homo sapiens
aacccuuuuccuccagacagau

SEQ ID NO: 912915 - RNA, 19 nt, Homo sapiens
aaccgcuugccauauuccg

SEQ ID NO: 912916 - RNA, 20 nt, Homo sapiens
aaccuaccaccccuuccugu

SEQ ID NO: 912917 - RNA, 13 nt, Homo sapiens
aaccuacuagaca

SEQ ID NO: 912918 - RNA, 20 nt, Homo sapiens
aaccuacuagacaaugaugu

SEQ ID NO: 912919 - RNA, 17 nt, Homo sapiens
aaccuaugaaacuauug

SEQ ID NO: 912920 - RNA, 15 nt, Homo sapiens
aaccucaagcugcau

SEQ ID NO: 912921 - RNA, 22 nt, Homo sapiens
aaccucagccaaacacagagcg

SEQ ID NO: 912922 - RNA, 13 nt, Homo sapiens
aaccucagggaca

SEQ ID NO: 912923 - RNA, 21 nt, Homo sapiens
aaccucaugacagccagagcc

SEQ ID NO: 912924 - RNA, 14 nt, Homo sapiens
aaccucauuuacca

SEQ ID NO: 912925 - RNA, 18 nt, Homo sapiens
aaccucucuucuaccuua

SEQ ID NO: 912926 - RNA, 17 nt, Homo sapiens
aaccugaaccugggaac

SEQ ID NO: 912927 - RNA, 17 nt, Homo sapiens
aaccugccugugcauga

SEQ ID NO: 912928 - RNA, 21 nt, Homo sapiens
aaccuggagggcuagaaccua

SEQ ID NO: 912929 - RNA, 17 nt, Homo sapiens
aaccuggcuuauuccca

SEQ ID NO: 912930 - RNA, 20 nt, Homo sapiens
aaccugggaaccaugaagcu

SEQ ID NO: 912931 - RNA, 18 nt, Homo sapiens
aaccuuauuguaccucuc

SEQ ID NO: 912932 - RNA, 18 nt, Homo sapiens
aaccuuuaaaaaagcaaa

SEQ ID NO: 912933 - RNA, 23 nt, Homo sapiens
aaccuuugagacuauugagauau

SEQ ID NO: 912934 - RNA, 15 nt, Homo sapiens
aacgaacugggaaaa

SEQ ID NO: 912935 - RNA, 15 nt, Homo sapiens
aacgacaaagccaaa

SEQ ID NO: 912936 - RNA, 23 nt, Homo sapiens
aacgacaaagccaaacucugcca

SEQ ID NO: 912937 - RNA, 21 nt, Homo sapiens
aacgacgguuucaaaccagga

SEQ ID NO: 912938 - RNA, 17 nt, Homo sapiens
aacgagggauaauucaa

SEQ ID NO: 912939 - RNA, 15 nt, Homo sapiens
aacgaguuguuggcu

SEQ ID NO: 912940 - RNA, 17 nt, Homo sapiens
aacgcuuuuugggagaa

SEQ ID NO: 912941 - RNA, 18 nt, Homo sapiens
aacggcuuauuagugaaa

SEQ ID NO: 912942 - RNA, 14 nt, Homo sapiens
aacguaaauacaca

SEQ ID NO: 912943 - RNA, 14 nt, Homo sapiens
aacgucaucucagg

SEQ ID NO: 912944 - RNA, 18 nt, Homo sapiens
aacuaaaguuuacagucu

SEQ ID NO: 912945 - RNA, 17 nt, Homo sapiens
aacuaagaaauaugcac

SEQ ID NO: 912946 - RNA, 19 nt, Homo sapiens
aacuaagaaauaugcacaa

SEQ ID NO: 912947 - RNA, 15 nt, Homo sapiens
aacuaauaaucacca

SEQ ID NO: 912948 - RNA, 21 nt, Homo sapiens
aacuacagaguuuaugauuua

SEQ ID NO: 912949 - RNA, 11 nt, Homo sapiens
aacuaccuccu

SEQ ID NO: 912950 - RNA, 23 nt, Homo sapiens
aacuacuaaagugccuaccccag

SEQ ID NO: 912951 - RNA, 16 nt, Homo sapiens
aacuagaaaucugcca

SEQ ID NO: 912952 - RNA, 19 nt, Homo sapiens
aacuauaagcaugaucuug

SEQ ID NO: 912953 - RNA, 14 nt, Homo sapiens
aacuauauucucag

SEQ ID NO: 912954 - RNA, 17 nt, Homo sapiens
aacuauuacaccaaaua

SEQ ID NO: 912955 - RNA, 17 nt, Homo sapiens
aacuauuguauaauggg

SEQ ID NO: 912956 - RNA, 16 nt, Homo sapiens
aacucaacuuugacaa

SEQ ID NO: 912957 - RNA, 15 nt, Homo sapiens
aacucagacauucca

SEQ ID NO: 912958 - RNA, 17 nt, Homo sapiens
aacucauuagacuggaa

SEQ ID NO: 912959 - RNA, 13 nt, Homo sapiens
aacuccagcuccc

SEQ ID NO: 912960 - RNA, 12 nt, Homo sapiens
aacuccagugaa

SEQ ID NO: 912961 - RNA, 23 nt, Homo sapiens
aacuccggaaugaccagcaugau

SEQ ID NO: 912962 - RNA, 21 nt, Homo sapiens
aacucuccaucuuauuuucau

SEQ ID NO: 912963 - RNA, 14 nt, Homo sapiens
aacucugacaaggg

SEQ ID NO: 912964 - RNA, 15 nt, Homo sapiens
aacucugcacuccau

SEQ ID NO: 912965 - RNA, 14 nt, Homo sapiens
aacucuugaccuca

SEQ ID NO: 912966 - RNA, 16 nt, Homo sapiens
aacucuugaccucagg

SEQ ID NO: 912967 - RNA, 14 nt, Homo sapiens
aacugacacaggaa

SEQ ID NO: 912968 - RNA, 17 nt, Homo sapiens
aacugaggucacugggu

SEQ ID NO: 912969 - RNA, 13 nt, Homo sapiens
aacugcgugccag

SEQ ID NO: 912970 - RNA, 15 nt, Homo sapiens
aacugcugauuugau

SEQ ID NO: 912971 - RNA, 20 nt, Homo sapiens
aacuggaauccuuucagcaa

SEQ ID NO: 912972 - RNA, 22 nt, Homo sapiens
aacuggacuugucuuccuuggc

SEQ ID NO: 912973 - RNA, 23 nt, Homo sapiens
aagcacuguuggagcuacugcaa

SEQ ID NO: 912974 - RNA, 17 nt, Homo sapiens
aagcacuguuucucuca

SEQ ID NO: 912975 - RNA, 20 nt, Homo sapiens
aagcagagugauucaggggc

SEQ ID NO: 912976 - RNA, 23 nt, Homo sapiens
aagcagcacauagcacugggaac

SEQ ID NO: 912977 - RNA, 23 nt, Homo sapiens
aagcagcagcuuguugguuguca

SEQ ID NO: 912978 - RNA, 11 nt, Homo sapiens
aagcagggaaa

SEQ ID NO: 912979 - RNA, 15 nt, Homo sapiens
aagcagggcucugcc

SEQ ID NO: 912980 - RNA, 19 nt, Homo sapiens
aagcagguggcaucucuaa

SEQ ID NO: 912981 - RNA, 15 nt, Homo sapiens
aagcagguucuugau

SEQ ID NO: 912982 - RNA, 20 nt, Homo sapiens
aagcaguaagcuaucuucaa

SEQ ID NO: 912983 - RNA, 20 nt, Homo sapiens
aagcagugaauaguaacaau

SEQ ID NO: 912984 - RNA, 18 nt, Homo sapiens
aagcagugccuuccauaa

SEQ ID NO: 912985 - RNA, 22 nt, Homo sapiens
aagcaucccgcuggugccuccc

SEQ ID NO: 912986 - RNA, 23 nt, Homo sapiens
aagcaucucagccuaccaugaga

SEQ ID NO: 912987 - RNA, 13 nt, Homo sapiens
aagcaucugugua

SEQ ID NO: 912988 - RNA, 21 nt, Homo sapiens
aagcaucuguguaaccuccac

SEQ ID NO: 912989 - RNA, 20 nt, Homo sapiens
aagcaugcaauaaugugcaa

SEQ ID NO: 912990 - RNA, 16 nt, Homo sapiens
aagcauggacuaaccc

SEQ ID NO: 912991 - RNA, 19 nt, Homo sapiens
aagcauucugagcugggcu

SEQ ID NO: 912992 - RNA, 19 nt, Homo sapiens
aagcauuguauacauugau

SEQ ID NO: 912993 - RNA, 18 nt, Homo sapiens
aagcauuucccccaggga

SEQ ID NO: 912994 - RNA, 23 nt, Homo sapiens
aagcauuuuaaaugucaguuaca

SEQ ID NO: 912995 - RNA, 16 nt, Homo sapiens
aagccaaacucugcca

SEQ ID NO: 912996 - RNA, 19 nt, Homo sapiens
aagccaaauuuauaugcca

SEQ ID NO: 912997 - RNA, 13 nt, Homo sapiens
aagccacaggagc

SEQ ID NO: 912998 - RNA, 18 nt, Homo sapiens
aagccacauggcugggau

SEQ ID NO: 912999 - RNA, 20 nt, Homo sapiens
aagccagaaacguaacugug

SEQ ID NO: 913000 - RNA, 17 nt, Homo sapiens
aagccagaguuccaugu

SEQ ID NO: 913001 - RNA, 17 nt, Homo sapiens
aagccaggguccugagu

SEQ ID NO: 913002 - RNA, 17 nt, Homo sapiens
aagcccccacuucucuc

SEQ ID NO: 913003 - RNA, 16 nt, Homo sapiens
aagccccggacucagg

SEQ ID NO: 913004 - RNA, 14 nt, Homo sapiens
aagccggccggcug

SEQ ID NO: 913005 - RNA, 18 nt, Homo sapiens
aagccgugccuuucucug

SEQ ID NO: 913006 - RNA, 20 nt, Homo sapiens
aagcgaaauauuacaguagu

SEQ ID NO: 913007 - RNA, 20 nt, Homo sapiens
aagcgagaucccaucucuac

SEQ ID NO: 913008 - RNA, 17 nt, Homo sapiens
aagcgauucuucugccu

SEQ ID NO: 913009 - RNA, 20 nt, Homo sapiens
aagcgauucuucugccucag

SEQ ID NO: 913010 - RNA, 18 nt, Homo sapiens
aagcggagcuugcaguga

SEQ ID NO: 913011 - RNA, 22 nt, Homo sapiens
aagcuaaaauuagaugaacuca

SEQ ID NO: 913012 - RNA, 22 nt, Homo sapiens
aagcuaaauccuuuacuguuag

SEQ ID NO: 913013 - RNA, 16 nt, Homo sapiens
aagcuaacagggaagg

SEQ ID NO: 913014 - RNA, 15 nt, Homo sapiens
aagcuagaaccugga

SEQ ID NO: 913015 - RNA, 16 nt, Homo sapiens
aagcuaucaggccaag

SEQ ID NO: 913016 - RNA, 15 nt, Homo sapiens
aagcucagacuugcc

SEQ ID NO: 913017 - RNA, 22 nt, Homo sapiens
aagcuccuguccucccaucccc

SEQ ID NO: 913018 - RNA, 19 nt, Homo sapiens
aagcucuuuaugacuguuu

SEQ ID NO: 913019 - RNA, 19 nt, Homo sapiens
aagcugagacccucgccac

SEQ ID NO: 913020 - RNA, 21 nt, Homo sapiens
aagcugggauaaucacauuau

SEQ ID NO: 913021 - RNA, 21 nt, Homo sapiens
aagcugggccgaguaccuuaa

SEQ ID NO: 913022 - RNA, 21 nt, Homo sapiens
aagcuguacucagagcagagc

SEQ ID NO: 913023 - RNA, 22 nt, Homo sapiens
aagcugugaaagaaccaaaaga

SEQ ID NO: 913024 - RNA, 21 nt, Homo sapiens
aagcuuguauauacauauuau

SEQ ID NO: 913025 - RNA, 16 nt, Homo sapiens
aaggaacuggaacaca

SEQ ID NO: 913026 - RNA, 23 nt, Homo sapiens
aaggaagaaauuccaggaaaauc

SEQ ID NO: 913027 - RNA, 15 nt, Homo sapiens
aaggaagccacagcu

SEQ ID NO: 913028 - RNA, 16 nt, Homo sapiens
aaggaagcuccacugu

SEQ ID NO: 913029 - RNA, 18 nt, Homo sapiens
aaggaaggcuccaucucc

SEQ ID NO: 913030 - RNA, 17 nt, Homo sapiens
aaggaccugcauuuucc

SEQ ID NO: 913031 - RNA, 16 nt, Homo sapiens
aaggagaacuauccaa

SEQ ID NO: 913032 - RNA, 19 nt, Homo sapiens
aaggagaacuauccaaaac

SEQ ID NO: 913033 - RNA, 22 nt, Homo sapiens
aaggaggacgguuaacuuguau

SEQ ID NO: 913034 - RNA, 14 nt, Homo sapiens
aaggagguagcucc

SEQ ID NO: 913035 - RNA, 15 nt, Homo sapiens
aaggaguaugcaggg

SEQ ID NO: 913036 - RNA, 18 nt, Homo sapiens
agauggaauaaagcccuu

SEQ ID NO: 913037 - RNA, 14 nt, Homo sapiens
agauggaguucuug

SEQ ID NO: 913038 - RNA, 19 nt, Homo sapiens
agauggauguuugucaaaa

SEQ ID NO: 913039 - RNA, 17 nt, Homo sapiens
agauggauuuguaucaa

SEQ ID NO: 913040 - RNA, 14 nt, Homo sapiens
agaugggauuucau

SEQ ID NO: 913041 - RNA, 22 nt, Homo sapiens
agauggguauuaaacuugucag

SEQ ID NO: 913042 - RNA, 19 nt, Homo sapiens
agauguggcaaagugcugu

SEQ ID NO: 913043 - RNA, 16 nt, Homo sapiens
agauuaauggcacuga

SEQ ID NO: 913044 - RNA, 18 nt, Homo sapiens
agauuaccugccacuucc

SEQ ID NO: 913045 - RNA, 23 nt, Homo sapiens
agauuaguauuuuccacgucacu

SEQ ID NO: 913046 - RNA, 18 nt, Homo sapiens
agauucccacccaauuca

SEQ ID NO: 913047 - RNA, 21 nt, Homo sapiens
agauucccacccaauucaaaa

SEQ ID NO: 913048 - RNA, 18 nt, Homo sapiens
agauucccucuuccugcc

SEQ ID NO: 913049 - RNA, 22 nt, Homo sapiens
agauuccugguuaaauuugaau

SEQ ID NO: 913050 - RNA, 16 nt, Homo sapiens
agauucuccugugcua

SEQ ID NO: 913051 - RNA, 14 nt, Homo sapiens
agauugacuuugaa

SEQ ID NO: 913052 - RNA, 20 nt, Homo sapiens
agauugcaccauugcgcucu

SEQ ID NO: 913053 - RNA, 17 nt, Homo sapiens
agauugcgccacugcac

SEQ ID NO: 913054 - RNA, 20 nt, Homo sapiens
agauugcgccacugcacucc

SEQ ID NO: 913055 - RNA, 17 nt, Homo sapiens
agauuggcucccaacuc

SEQ ID NO: 913056 - RNA, 23 nt, Homo sapiens
agauuguaauucagaaaacauaa

SEQ ID NO: 913057 - RNA, 21 nt, Homo sapiens
agauuguccagugcaaccaca

SEQ ID NO: 913058 - RNA, 17 nt, Homo sapiens
agauugugcccagcccu

SEQ ID NO: 913059 - RNA, 23 nt, Homo sapiens
agauuguucuguccaguuuccaa

SEQ ID NO: 913060 - RNA, 15 nt, Homo sapiens
agauuuaacacuaaa

SEQ ID NO: 913061 - RNA, 21 nt, Homo sapiens
agauuucaaaguuaauuuucc

SEQ ID NO: 913062 - RNA, 15 nt, Homo sapiens
agauuucaacauauc

SEQ ID NO: 913063 - RNA, 14 nt, Homo sapiens
agauuucaguuacu

SEQ ID NO: 913064 - RNA, 23 nt, Homo sapiens
agauuugaauagaaaaaguaauc

SEQ ID NO: 913065 - RNA, 18 nt, Homo sapiens
agauuugcuguucaccca

SEQ ID NO: 913066 - RNA, 21 nt, Homo sapiens
agauuugcuguucacccacau

SEQ ID NO: 913067 - RNA, 15 nt, Homo sapiens
agauuuuaugcugcu

SEQ ID NO: 913068 - RNA, 17 nt, Homo sapiens
agauuuugucgggacag

SEQ ID NO: 913069 - RNA, 19 nt, Homo sapiens
agauuuuuuuuggacuguu

SEQ ID NO: 913070 - RNA, 13 nt, Homo sapiens
agcaaaacaagga

SEQ ID NO: 913071 - RNA, 16 nt, Homo sapiens
agcaaaccucagucau

SEQ ID NO: 913072 - RNA, 18 nt, Homo sapiens
agcaaagcuuaaaugccu

SEQ ID NO: 913073 - RNA, 18 nt, Homo sapiens
agcaaagggagcacuggg

SEQ ID NO: 913074 - RNA, 18 nt, Homo sapiens
agcaaagguuggccuuac

SEQ ID NO: 913075 - RNA, 17 nt, Homo sapiens
agcaaauaaagaccuga

SEQ ID NO: 913076 - RNA, 15 nt, Homo sapiens
agcaaauuaguaauu

SEQ ID NO: 913077 - RNA, 22 nt, Homo sapiens
agcaaccguggcccuuccugga

SEQ ID NO: 913078 - RNA, 18 nt, Homo sapiens
agcaagacucugucucaa

SEQ ID NO: 913079 - RNA, 19 nt, Homo sapiens
agcaagacuucucuuugcc

SEQ ID NO: 913080 - RNA, 15 nt, Homo sapiens
agcaaggugugaaug

SEQ ID NO: 913081 - RNA, 13 nt, Homo sapiens
agcaaguuucacc

SEQ ID NO: 913082 - RNA, 16 nt, Homo sapiens
agcaauacuaagggaa

SEQ ID NO: 913083 - RNA, 23 nt, Homo sapiens
agcaaucugagagauuugaauag

SEQ ID NO: 913084 - RNA, 19 nt, Homo sapiens
agcaaugcccguaaugcuu

SEQ ID NO: 913085 - RNA, 16 nt, Homo sapiens
agcaauguaacauuaa

SEQ ID NO: 913086 - RNA, 15 nt, Homo sapiens
agcaauucauuucac

SEQ ID NO: 913087 - RNA, 16 nt, Homo sapiens
agcaauuccagggugg

SEQ ID NO: 913088 - RNA, 19 nt, Homo sapiens
agcacaauuuauauuuucc

SEQ ID NO: 913089 - RNA, 13 nt, Homo sapiens
agcacaccccaag

SEQ ID NO: 913090 - RNA, 13 nt, Homo sapiens
agcacacuguagc

SEQ ID NO: 913091 - RNA, 14 nt, Homo sapiens
agcacauuccuccu

SEQ ID NO: 913092 - RNA, 15 nt, Homo sapiens
agcaccaauuguaca

SEQ ID NO: 913093 - RNA, 19 nt, Homo sapiens
agcaccccugucucuagcc

SEQ ID NO: 913094 - RNA, 20 nt, Homo sapiens
agcaccuacuuacaugcauu

SEQ ID NO: 913095 - RNA, 21 nt, Homo sapiens
agcaccuacuuacaugcauua

SEQ ID NO: 913096 - RNA, 18 nt, Homo sapiens
agcacgauuuugcacaaa

SEQ ID NO: 913097 - RNA, 23 nt, Homo sapiens
agcacuaaggugugcucugauca

SEQ ID NO: 913098 - RNA, 18 nt, Homo sapiens
agcacuaauucaacauau

SEQ ID NO: 913099 - RNA, 12 nt, Homo sapiens
agcacucaacca

SEQ ID NO: 913100 - RNA, 14 nt, Homo sapiens
agcacucuacugca

SEQ ID NO: 913101 - RNA, 16 nt, Homo sapiens
agcacucuacugcaag

SEQ ID NO: 913102 - RNA, 20 nt, Homo sapiens
agcacugccucuuccagggc

SEQ ID NO: 913103 - RNA, 22 nt, Homo sapiens
aggccagggaaagcccguguca

SEQ ID NO: 913104 - RNA, 14 nt, Homo sapiens
aggccagggacuca

SEQ ID NO: 913105 - RNA, 20 nt, Homo sapiens
aggccaggugcaguggcuca

SEQ ID NO: 913106 - RNA, 21 nt, Homo sapiens
aggccauccauucacagccag

SEQ ID NO: 913107 - RNA, 18 nt, Homo sapiens
aggcccacuggcauuaaa

SEQ ID NO: 913108 - RNA, 17 nt, Homo sapiens
aggcccacuguccagca

SEQ ID NO: 913109 - RNA, 22 nt, Homo sapiens
aggcccagaaagaggcagugau

SEQ ID NO: 913110 - RNA, 19 nt, Homo sapiens
aggcccaggucaacaucua

SEQ ID NO: 913111 - RNA, 19 nt, Homo sapiens
aggcccuuauuuucaagaa

SEQ ID NO: 913112 - RNA, 23 nt, Homo sapiens
aggcccuuccucuccacugccuu

SEQ ID NO: 913113 - RNA, 16 nt, Homo sapiens
aggccuaggaccucag

SEQ ID NO: 913114 - RNA, 15 nt, Homo sapiens
aggccucacacccag

SEQ ID NO: 913115 - RNA, 15 nt, Homo sapiens
aggccucaucuccuu

SEQ ID NO: 913116 - RNA, 14 nt, Homo sapiens
aggccugagggcug

SEQ ID NO: 913117 - RNA, 12 nt, Homo sapiens
aggccugccugu

SEQ ID NO: 913118 - RNA, 17 nt, Homo sapiens
aggccuuacuuaaaccc

SEQ ID NO: 913119 - RNA, 20 nt, Homo sapiens
aggccuuacuuaaacccagc

SEQ ID NO: 913120 - RNA, 22 nt, Homo sapiens
aggccuucugggccuccaaagc

SEQ ID NO: 913121 - RNA, 19 nt, Homo sapiens
aggccuuuccccagugugg

SEQ ID NO: 913122 - RNA, 18 nt, Homo sapiens
aggcggauggcugugacc

SEQ ID NO: 913123 - RNA, 17 nt, Homo sapiens
aggcgggagcaucucuu

SEQ ID NO: 913124 - RNA, 20 nt, Homo sapiens
aggcgggagcaucucuugag

SEQ ID NO: 913125 - RNA, 21 nt, Homo sapiens
aggcggggaggaggagcugcc

SEQ ID NO: 913126 - RNA, 18 nt, Homo sapiens
aggcggguggaucaccug

SEQ ID NO: 913127 - RNA, 22 nt, Homo sapiens
aggcgucagucaaaggcauuuu

SEQ ID NO: 913128 - RNA, 23 nt, Homo sapiens
aggcuaauuuuuauauuuuuaga

SEQ ID NO: 913129 - RNA, 15 nt, Homo sapiens
aggcuauguauggaa

SEQ ID NO: 913130 - RNA, 16 nt, Homo sapiens
aggcucacagcuggaa

SEQ ID NO: 913131 - RNA, 19 nt, Homo sapiens
aggcuccugugcuacuuug

SEQ ID NO: 913132 - RNA, 13 nt, Homo sapiens
aggcucugggaag

SEQ ID NO: 913133 - RNA, 19 nt, Homo sapiens
aggcugaggggaggaucac

SEQ ID NO: 913134 - RNA, 15 nt, Homo sapiens
aggcugcaugcucug

SEQ ID NO: 913135 - RNA, 16 nt, Homo sapiens
aggcugcuguguagcu

SEQ ID NO: 913136 - RNA, 23 nt, Homo sapiens
aggcuggagauccuaacugagaa

SEQ ID NO: 913137 - RNA, 15 nt, Homo sapiens
aggcuggagugcagu

SEQ ID NO: 913138 - RNA, 19 nt, Homo sapiens
aggcugggauggagcacuu

SEQ ID NO: 913139 - RNA, 13 nt, Homo sapiens
aggcuggucucaa

SEQ ID NO: 913140 - RNA, 18 nt, Homo sapiens
aggcuguucugcacugaa

SEQ ID NO: 913141 - RNA, 21 nt, Homo sapiens
aggcuuccagagaguccucug

SEQ ID NO: 913142 - RNA, 13 nt, Homo sapiens
aggcuuccuucau

SEQ ID NO: 913143 - RNA, 16 nt, Homo sapiens
aggcuugccaccgggg

SEQ ID NO: 913144 - RNA, 16 nt, Homo sapiens
aggcuugucacuagca

SEQ ID NO: 913145 - RNA, 14 nt, Homo sapiens
agggaaaaugagua

SEQ ID NO: 913146 - RNA, 19 nt, Homo sapiens
agggaaacuggcugagggg

SEQ ID NO: 913147 - RNA, 14 nt, Homo sapiens
agggaaugacuugg

SEQ ID NO: 913148 - RNA, 11 nt, Homo sapiens
agcugucauca

SEQ ID NO: 913149 - RNA, 15 nt, Homo sapiens
agcugucgcaucuca

SEQ ID NO: 913150 - RNA, 11 nt, Homo sapiens
agcugugauuu

SEQ ID NO: 913151 - RNA, 19 nt, Homo sapiens
agcuguggccagcuuguua

SEQ ID NO: 913152 - RNA, 21 nt, Homo sapiens
agcuguuuuuauuagcaguag

SEQ ID NO: 913153 - RNA, 21 nt, Homo sapiens
agcuuaauggcucaugaccug

SEQ ID NO: 913154 - RNA, 14 nt, Homo sapiens
agcuuaugucagac

SEQ ID NO: 913155 - RNA, 17 nt, Homo sapiens
agcuucagagccuagcc

SEQ ID NO: 913156 - RNA, 16 nt, Homo sapiens
agcuucuaucccagga

SEQ ID NO: 913157 - RNA, 13 nt, Homo sapiens
agcuucuguccug

SEQ ID NO: 913158 - RNA, 13 nt, Homo sapiens
agcuugagccugu

SEQ ID NO: 913159 - RNA, 14 nt, Homo sapiens
agcuugcaacaaaa

SEQ ID NO: 913160 - RNA, 17 nt, Homo sapiens
agcuugcucuucagugg

SEQ ID NO: 913161 - RNA, 23 nt, Homo sapiens
agcuugcucuucagugggagaaa

SEQ ID NO: 913162 - RNA, 22 nt, Homo sapiens
agcuuggaaacuggaugagguc

SEQ ID NO: 913163 - RNA, 23 nt, Homo sapiens
agcuuguccaacaacuccaggaa

SEQ ID NO: 913164 - RNA, 20 nt, Homo sapiens
agcuuuagcuucucugccaa

SEQ ID NO: 913165 - RNA, 16 nt, Homo sapiens
agcuuuaggggaccau

SEQ ID NO: 913166 - RNA, 19 nt, Homo sapiens
agcuuucaugaguuuccca

SEQ ID NO: 913167 - RNA, 12 nt, Homo sapiens
agcuuugcucuu

SEQ ID NO: 913168 - RNA, 15 nt, Homo sapiens
aggaaaaaaaugacu

SEQ ID NO: 913169 - RNA, 20 nt, Homo sapiens
aggaaaacugaggcccuugg

SEQ ID NO: 913170 - RNA, 17 nt, Homo sapiens
aggaaaaucugcacugu

SEQ ID NO: 913171 - RNA, 15 nt, Homo sapiens
aggaaaauuucacau

SEQ ID NO: 913172 - RNA, 21 nt, Homo sapiens
aggaaaccaacacccaaagca

SEQ ID NO: 913173 - RNA, 17 nt, Homo sapiens
aggaaagaugaugcaag

SEQ ID NO: 913174 - RNA, 16 nt, Homo sapiens
aggaaagccaaacacu

SEQ ID NO: 913175 - RNA, 21 nt, Homo sapiens
aggaaagccaaacacuguuuc

SEQ ID NO: 913176 - RNA, 20 nt, Homo sapiens
aggaaauauucuguaaucuu

SEQ ID NO: 913177 - RNA, 20 nt, Homo sapiens
aggaaauggagaagcucugu

SEQ ID NO: 913178 - RNA, 22 nt, Homo sapiens
aggaacacccggaaagacugaa

SEQ ID NO: 913179 - RNA, 15 nt, Homo sapiens
aggaaccuaauugaa

SEQ ID NO: 913180 - RNA, 22 nt, Homo sapiens
aggaacugggccaacucaccug

SEQ ID NO: 913181 - RNA, 12 nt, Homo sapiens
aggaacuguaca

SEQ ID NO: 913182 - RNA, 20 nt, Homo sapiens
aggaagaaaccccaagcagc

SEQ ID NO: 913183 - RNA, 19 nt, Homo sapiens
aggaagccaggcugaguga

SEQ ID NO: 913184 - RNA, 19 nt, Homo sapiens
aggaaggauggcaagcacg

SEQ ID NO: 913185 - RNA, 22 nt, Homo sapiens
aggaagggaaagggaagugaua

SEQ ID NO: 913186 - RNA, 13 nt, Homo sapiens
aggaagguacaaa

SEQ ID NO: 913187 - RNA, 20 nt, Homo sapiens
aggaaggugcuugccuggga

SEQ ID NO: 913188 - RNA, 22 nt, Homo sapiens
aggaagguggugcuuacauccu

SEQ ID NO: 913189 - RNA, 15 nt, Homo sapiens
aggaaucugugcaga

SEQ ID NO: 913190 - RNA, 18 nt, Homo sapiens
aggaaucugugcagauga

SEQ ID NO: 913191 - RNA, 21 nt, Homo sapiens
aggaauguccagacugugggu

SEQ ID NO: 913192 - RNA, 17 nt, Homo sapiens
aggaauuugcauuuagu

SEQ ID NO: 913193 - RNA, 12 nt, Homo sapiens
aggacaagcaug

SEQ ID NO: 913194 - RNA, 18 nt, Homo sapiens
aggacagggaggugaccc

SEQ ID NO: 913195 - RNA, 22 nt, Homo sapiens
aggacaugauacugaugccaug

SEQ ID NO: 913196 - RNA, 11 nt, Homo sapiens
aggacccauag

SEQ ID NO: 913197 - RNA, 17 nt, Homo sapiens
aggacccauagaugaac

SEQ ID NO: 913198 - RNA, 13 nt, Homo sapiens
aggaccuuaccug

SEQ ID NO: 913199 - RNA, 17 nt, Homo sapiens
aggacuauagcccaggu

SEQ ID NO: 913200 - RNA, 22 nt, Homo sapiens
aggacucccucuaaguggaaua

SEQ ID NO: 913201 - RNA, 13 nt, Homo sapiens
aggacuccuuaaa

SEQ ID NO: 913202 - RNA, 17 nt, Homo sapiens
aggacuucugcagcuau

SEQ ID NO: 913203 - RNA, 16 nt, Homo sapiens
aggacuugaacccagg

SEQ ID NO: 913204 - RNA, 16 nt, Homo sapiens
aggacuuuccagugag

SEQ ID NO: 913205 - RNA, 16 nt, Homo sapiens
aggagaaaaugcauua

SEQ ID NO: 913206 - RNA, 12 nt, Homo sapiens
aggagaagcagc

SEQ ID NO: 913207 - RNA, 19 nt, Homo sapiens
aggagacaagaaauccagu

SEQ ID NO: 913208 - RNA, 12 nt, Homo sapiens
aggagaccaagg

SEQ ID NO: 913209 - RNA, 18 nt, Homo sapiens
aggagacccacagguaug

SEQ ID NO: 913210 - RNA, 19 nt, Homo sapiens
aggagaggggaagggccag

SEQ ID NO: 913211 - RNA, 22 nt, Homo sapiens
aggagaggggcagaacagccgc

SEQ ID NO: 913212 - RNA, 13 nt, Homo sapiens
aggagcagcuuca

SEQ ID NO: 913213 - RNA, 16 nt, Homo sapiens
aggagcuaaacaugcu

SEQ ID NO: 913214 - RNA, 13 nt, Homo sapiens
aggagcugggcuu

SEQ ID NO: 913215 - RNA, 15 nt, Homo sapiens
aggagcuuccagugc

SEQ ID NO: 913216 - RNA, 16 nt, Homo sapiens
aggagcuuccagugca

SEQ ID NO: 913217 - RNA, 16 nt, Homo sapiens
aggaggcugcaugcuc

SEQ ID NO: 913218 - RNA, 19 nt, Homo sapiens
aggaggcugcaugcucugg

SEQ ID NO: 913219 - RNA, 19 nt, Homo sapiens
aggaggcuuggaaagcauc

SEQ ID NO: 913220 - RNA, 22 nt, Homo sapiens
aggagggaugcugccugaguca

SEQ ID NO: 913221 - RNA, 19 nt, Homo sapiens
aggaggggcaccugccacc

SEQ ID NO: 913222 - RNA, 22 nt, Homo sapiens
aggaggugcuaucgcaccacug

SEQ ID NO: 913223 - RNA, 22 nt, Homo sapiens
aggaggugggggcuauuucuau

SEQ ID NO: 913224 - RNA, 19 nt, Homo sapiens
aggagguuuggggucugcc

SEQ ID NO: 913225 - RNA, 17 nt, Homo sapiens
aggaguggcagcugucc

SEQ ID NO: 913226 - RNA, 13 nt, Homo sapiens
aggaguuccuuga

SEQ ID NO: 913227 - RNA, 22 nt, Homo sapiens
aggaguucgagaccagccugac

SEQ ID NO: 913228 - RNA, 18 nt, Homo sapiens
aggaguuugagaccagcc

SEQ ID NO: 913229 - RNA, 16 nt, Homo sapiens
aggauauuuucuucca

SEQ ID NO: 913230 - RNA, 14 nt, Homo sapiens
aggaucuguacaau

SEQ ID NO: 913231 - RNA, 13 nt, Homo sapiens
aggaugacacugc

SEQ ID NO: 913232 - RNA, 13 nt, Homo sapiens
aggauguaacuuu

SEQ ID NO: 913233 - RNA, 17 nt, Homo sapiens
aggauguucugggacac

SEQ ID NO: 913234 - RNA, 19 nt, Homo sapiens
aggauuuauauucaaggau

SEQ ID NO: 913235 - RNA, 15 nt, Homo sapiens
aggauuuugauccaa

SEQ ID NO: 913236 - RNA, 13 nt, Homo sapiens
aggcaaaggcaau

SEQ ID NO: 913237 - RNA, 16 nt, Homo sapiens
aggcaaauaucuugaa

SEQ ID NO: 913238 - RNA, 15 nt, Homo sapiens
aggcaaccagaggaa

SEQ ID NO: 913239 - RNA, 23 nt, Homo sapiens
aggcaacugaggcagacagcagc

SEQ ID NO: 913240 - RNA, 19 nt, Homo sapiens
aggcaagccccucagcccu

SEQ ID NO: 913241 - RNA, 19 nt, Homo sapiens
aggcaccugcuggaaacca

SEQ ID NO: 913242 - RNA, 18 nt, Homo sapiens
aggcacguuuggcauuuc

SEQ ID NO: 913243 - RNA, 20 nt, Homo sapiens
aggcagaggauguucuggac

SEQ ID NO: 913244 - RNA, 14 nt, Homo sapiens
aggcagcauuccau

SEQ ID NO: 913245 - RNA, 17 nt, Homo sapiens
aggcaggaggaucacuu

SEQ ID NO: 913246 - RNA, 15 nt, Homo sapiens
aggcaggaguggcag

SEQ ID NO: 913247 - RNA, 17 nt, Homo sapiens
aggcagggcaaaugaca

SEQ ID NO: 913248 - RNA, 21 nt, Homo sapiens
aggcagggccuugcccagaga

SEQ ID NO: 913249 - RNA, 14 nt, Homo sapiens
aggcagugagaugu

SEQ ID NO: 913250 - RNA, 14 nt, Homo sapiens
aggcauauacaaau

SEQ ID NO: 913251 - RNA, 16 nt, Homo sapiens
aggcauccugugugcu

SEQ ID NO: 913252 - RNA, 18 nt, Homo sapiens
aggcauccugugugcuga

SEQ ID NO: 913253 - RNA, 14 nt, Homo sapiens
aggcaugaacacac

SEQ ID NO: 913254 - RNA, 20 nt, Homo sapiens
aggcaugagaaucacuugaa

SEQ ID NO: 913255 - RNA, 22 nt, Homo sapiens
aggcaugagggaucacagggcc

SEQ ID NO: 913256 - RNA, 13 nt, Homo sapiens
aggccaaggcagg

SEQ ID NO: 913257 - RNA, 16 nt, Homo sapiens
aggccacaccaucucc

SEQ ID NO: 913258 - RNA, 14 nt, Homo sapiens
aggccacaugucac

SEQ ID NO: 913259 - RNA, 23 nt, Homo sapiens
aggccagaaaacauaugcauuau

SEQ ID NO: 913260 - RNA, 20 nt, Homo sapiens
aggccagagggagugacaga

SEQ ID NO: 913261 - RNA, 17 nt, Homo sapiens
aggccagagugcugcca

SEQ ID NO: 913262 - RNA, 18 nt, Homo sapiens
aggccaggaaucugccau

SEQ ID NO: 913263 - RNA, 16 nt, Homo sapiens
agccgcauggcacucu

SEQ ID NO: 913264 - RNA, 15 nt, Homo sapiens
agccggccacuuugg

SEQ ID NO: 913265 - RNA, 18 nt, Homo sapiens
agccggggcgaguggcac

SEQ ID NO: 913266 - RNA, 18 nt, Homo sapiens
agccggggguggugacau

SEQ ID NO: 913267 - RNA, 17 nt, Homo sapiens
agccgugaugcucaggc

SEQ ID NO: 913268 - RNA, 19 nt, Homo sapiens
agccuaagaaaaucaucuu

SEQ ID NO: 913269 - RNA, 19 nt, Homo sapiens
agccuaauacaacauguag

SEQ ID NO: 913270 - RNA, 16 nt, Homo sapiens
agccuaccaauguaga

SEQ ID NO: 913271 - RNA, 20 nt, Homo sapiens
agccuagaaacuaacacagc

SEQ ID NO: 913272 - RNA, 17 nt, Homo sapiens
agccuagccaccuccca

SEQ ID NO: 913273 - RNA, 16 nt, Homo sapiens
agccuagccgaccuca

SEQ ID NO: 913274 - RNA, 16 nt, Homo sapiens
agccuaggugacagag

SEQ ID NO: 913275 - RNA, 16 nt, Homo sapiens
agccucaagaugaagg

SEQ ID NO: 913276 - RNA, 18 nt, Homo sapiens
agccucccaaguagcugg

SEQ ID NO: 913277 - RNA, 17 nt, Homo sapiens
agccucccgaguagcug

SEQ ID NO: 913278 - RNA, 17 nt, Homo sapiens
agccuccgccauuccaa

SEQ ID NO: 913279 - RNA, 11 nt, Homo sapiens
agccuccucag

SEQ ID NO: 913280 - RNA, 15 nt, Homo sapiens
agccuccuccugacc

SEQ ID NO: 913281 - RNA, 15 nt, Homo sapiens
agccuccucucucaa

SEQ ID NO: 913282 - RNA, 19 nt, Homo sapiens
agccuccuuuugcuugaaa

SEQ ID NO: 913283 - RNA, 19 nt, Homo sapiens
agccucugcccugccuccc

SEQ ID NO: 913284 - RNA, 16 nt, Homo sapiens
agccugagccaaagag

SEQ ID NO: 913285 - RNA, 18 nt, Homo sapiens
agccugcaaacucacugc

SEQ ID NO: 913286 - RNA, 18 nt, Homo sapiens
agccugcagacucacugu

SEQ ID NO: 913287 - RNA, 23 nt, Homo sapiens
agccugcaguuauuaacacuaac

SEQ ID NO: 913288 - RNA, 17 nt, Homo sapiens
agccugcccucagcaca

SEQ ID NO: 913289 - RNA, 16 nt, Homo sapiens
agccuggccuccugcc

SEQ ID NO: 913290 - RNA, 17 nt, Homo sapiens
agccugggcaacaaagu

SEQ ID NO: 913291 - RNA, 21 nt, Homo sapiens
agccugggcagcauagcaaga

SEQ ID NO: 913292 - RNA, 16 nt, Homo sapiens
agccugggccuaugga

SEQ ID NO: 913293 - RNA, 21 nt, Homo sapiens
agccugggugagaauccugcc

SEQ ID NO: 913294 - RNA, 15 nt, Homo sapiens
agccuguauagacag

SEQ ID NO: 913295 - RNA, 14 nt, Homo sapiens
agccugugauuaac

SEQ ID NO: 913296 - RNA, 14 nt, Homo sapiens
agccuuagaaguca

SEQ ID NO: 913297 - RNA, 19 nt, Homo sapiens
agccuuagaagucacacag

SEQ ID NO: 913298 - RNA, 20 nt, Homo sapiens
agccuucucuguucauuucc

SEQ ID NO: 913299 - RNA, 18 nt, Homo sapiens
agccuugcucaggugcaa

SEQ ID NO: 913300 - RNA, 17 nt, Homo sapiens
agcgagagucugucuca

SEQ ID NO: 913301 - RNA, 17 nt, Homo sapiens
agcgaguugcgcuggga

SEQ ID NO: 913302 - RNA, 20 nt, Homo sapiens
agcgccugcccucccugggg

SEQ ID NO: 913303 - RNA, 14 nt, Homo sapiens
agcgcgugcacagc

SEQ ID NO: 913304 - RNA, 14 nt, Homo sapiens
agcgcuuucuggaa

SEQ ID NO: 913305 - RNA, 18 nt, Homo sapiens
agcggaggagaccagcuc

SEQ ID NO: 913306 - RNA, 19 nt, Homo sapiens
agcggcuggguggugaagg

SEQ ID NO: 913307 - RNA, 13 nt, Homo sapiens
agcgguaccccag

SEQ ID NO: 913308 - RNA, 14 nt, Homo sapiens
agcgguaccccagg

SEQ ID NO: 913309 - RNA, 22 nt, Homo sapiens
agcggucauucuacacugagga

SEQ ID NO: 913310 - RNA, 17 nt, Homo sapiens
agcuaacuccagucucc

SEQ ID NO: 913311 - RNA, 18 nt, Homo sapiens
agcuaagccacauggcug

SEQ ID NO: 913312 - RNA, 22 nt, Homo sapiens
agcuacaaucuguucaauguuu

SEQ ID NO: 913313 - RNA, 13 nt, Homo sapiens
agcuacauuccuc

SEQ ID NO: 913314 - RNA, 19 nt, Homo sapiens
agcuaccuguggugauguu

SEQ ID NO: 913315 - RNA, 22 nt, Homo sapiens
agcuacuguuuauuauuuuauu

SEQ ID NO: 913316 - RNA, 12 nt, Homo sapiens
agcuagaaccua

SEQ ID NO: 913317 - RNA, 12 nt, Homo sapiens
agcuagccagag

SEQ ID NO: 913318 - RNA, 14 nt, Homo sapiens
agcuagccagcugu

SEQ ID NO: 913319 - RNA, 18 nt, Homo sapiens
agcuaggccuggccagau

SEQ ID NO: 913320 - RNA, 22 nt, Homo sapiens
agcuaggccuggccagaugcac

SEQ ID NO: 913321 - RNA, 15 nt, Homo sapiens
agcuagugauuugcc

SEQ ID NO: 913322 - RNA, 21 nt, Homo sapiens
agcuaucauuucuuuuccaaa

SEQ ID NO: 913323 - RNA, 20 nt, Homo sapiens
agcuauuagcaacugugcua

SEQ ID NO: 913324 - RNA, 16 nt, Homo sapiens
agcuauugcauguaaa

SEQ ID NO: 913325 - RNA, 20 nt, Homo sapiens
agcucaagaugacagcucuu

SEQ ID NO: 913326 - RNA, 14 nt, Homo sapiens
agcucacaagccca

SEQ ID NO: 913327 - RNA, 15 nt, Homo sapiens
agcucacaagcccag

SEQ ID NO: 913328 - RNA, 21 nt, Homo sapiens
agcucacaguacaauguuuca

SEQ ID NO: 913329 - RNA, 16 nt, Homo sapiens
agcucagacuugccag

SEQ ID NO: 913330 - RNA, 12 nt, Homo sapiens
agcucagguguc

SEQ ID NO: 913331 - RNA, 13 nt, Homo sapiens
agcuccacuguca

SEQ ID NO: 913332 - RNA, 14 nt, Homo sapiens
agcuccacugucac

SEQ ID NO: 913333 - RNA, 23 nt, Homo sapiens
agcuccaggaaggggaguucugg

SEQ ID NO: 913334 - RNA, 14 nt, Homo sapiens
agcuccaguaagau

SEQ ID NO: 913335 - RNA, 22 nt, Homo sapiens
agcuccaguuuccaaguuccug

SEQ ID NO: 913336 - RNA, 18 nt, Homo sapiens
agcucccgagcuacucuc

SEQ ID NO: 913337 - RNA, 18 nt, Homo sapiens
agcuccgcuuucuaccca

SEQ ID NO: 913338 - RNA, 16 nt, Homo sapiens
agcuccucugcugcuc

SEQ ID NO: 913339 - RNA, 18 nt, Homo sapiens
agcucugaacaaacacug

SEQ ID NO: 913340 - RNA, 23 nt, Homo sapiens
agcucugccucccucuccauauc

SEQ ID NO: 913341 - RNA, 15 nt, Homo sapiens
agcucuguuuuacaa

SEQ ID NO: 913342 - RNA, 14 nt, Homo sapiens
agcucuucuaagga

SEQ ID NO: 913343 - RNA, 17 nt, Homo sapiens
agcugaacaaugaaugc

SEQ ID NO: 913344 - RNA, 20 nt, Homo sapiens
agcugaacagccaaaugcau

SEQ ID NO: 913345 - RNA, 12 nt, Homo sapiens
agcugaacccau

SEQ ID NO: 913346 - RNA, 22 nt, Homo sapiens
agcugaagaaaaugaagcccua

SEQ ID NO: 913347 - RNA, 18 nt, Homo sapiens
agcugacagcacuacaaa

SEQ ID NO: 913348 - RNA, 21 nt, Homo sapiens
agcugagaagaagcugaggau

SEQ ID NO: 913349 - RNA, 23 nt, Homo sapiens
agcugagacccucgccacgggga

SEQ ID NO: 913350 - RNA, 21 nt, Homo sapiens
agcugagauugcgccacugca

SEQ ID NO: 913351 - RNA, 18 nt, Homo sapiens
agcugaggaggugccuug

SEQ ID NO: 913352 - RNA, 18 nt, Homo sapiens
agcugaguuuaacaugug

SEQ ID NO: 913353 - RNA, 11 nt, Homo sapiens
agcugaucagu

SEQ ID NO: 913354 - RNA, 13 nt, Homo sapiens
agcugaugugccc

SEQ ID NO: 913355 - RNA, 14 nt, Homo sapiens
agcugcacauuccu

SEQ ID NO: 913356 - RNA, 19 nt, Homo sapiens
agcugcagaugccacaccu

SEQ ID NO: 913357 - RNA, 20 nt, Homo sapiens
agcugcagucaacaguucaa

SEQ ID NO: 913358 - RNA, 15 nt, Homo sapiens
agcugcucaaaucau

SEQ ID NO: 913359 - RNA, 13 nt, Homo sapiens
agcugcucgcaca

SEQ ID NO: 913360 - RNA, 20 nt, Homo sapiens
agcugcuguccuuuuaggaa

SEQ ID NO: 913361 - RNA, 19 nt, Homo sapiens
agcuggaaauaaaccugga

SEQ ID NO: 913362 - RNA, 20 nt, Homo sapiens
agcuggaaauaaaccuggag

SEQ ID NO: 913363 - RNA, 19 nt, Homo sapiens
agcuggcaaagguggcucu

SEQ ID NO: 913364 - RNA, 18 nt, Homo sapiens
agcugggacuacaggcac

SEQ ID NO: 913365 - RNA, 15 nt, Homo sapiens
agcugggaguagcau

SEQ ID NO: 913366 - RNA, 17 nt, Homo sapiens
agcugggauaaucacau

SEQ ID NO: 913367 - RNA, 22 nt, Homo sapiens
agcugggauaaucacauuauca

SEQ ID NO: 913368 - RNA, 15 nt, Homo sapiens
agcugggcaugaacg

SEQ ID NO: 913369 - RNA, 20 nt, Homo sapiens
agcugggccgaguaccuuaa

SEQ ID NO: 913370 - RNA, 17 nt, Homo sapiens
agcugggcuucugucca

SEQ ID NO: 913371 - RNA, 14 nt, Homo sapiens
agcugguaaacuau

SEQ ID NO: 913372 - RNA, 18 nt, Homo sapiens
agcugguaaacuauuugu

SEQ ID NO: 913373 - RNA, 13 nt, Homo sapiens
agcugguccaggg

SEQ ID NO: 913374 - RNA, 19 nt, Homo sapiens
agcuggugccccacugaau

SEQ ID NO: 913375 - RNA, 16 nt, Homo sapiens
agcuggugguaucuga

SEQ ID NO: 913376 - RNA, 20 nt, Homo sapiens
agcuguaaaaagagagaaaa

SEQ ID NO: 913377 - RNA, 21 nt, Homo sapiens
agcuguaguagcccuuucugu

SEQ ID NO: 913378 - RNA, 19 nt, Homo sapiens
agacaccugccuuaacaca

SEQ ID NO: 913379 - RNA, 15 nt, Homo sapiens
agacacuauuuaucu

SEQ ID NO: 913380 - RNA, 21 nt, Homo sapiens
agacagaaccccuacaugaaa

SEQ ID NO: 913381 - RNA, 14 nt, Homo sapiens
agacagaaugauau

SEQ ID NO: 913382 - RNA, 10 nt, Homo sapiens
agacagagac

SEQ ID NO: 913383 - RNA, 18 nt, Homo sapiens
agacagagcccugugagg

SEQ ID NO: 913384 - RNA, 18 nt, Homo sapiens
agacagauuaccaaagaa

SEQ ID NO: 913385 - RNA, 19 nt, Homo sapiens
agacaggaagguggugcuu

SEQ ID NO: 913386 - RNA, 20 nt, Homo sapiens
agacaggaugguuacucuug

SEQ ID NO: 913387 - RNA, 20 nt, Homo sapiens
agacaggcgcuggacagagg

SEQ ID NO: 913388 - RNA, 18 nt, Homo sapiens
agacaggguuuugccaug

SEQ ID NO: 913389 - RNA, 23 nt, Homo sapiens
agacagguaaaugggcagugccu

SEQ ID NO: 913390 - RNA, 18 nt, Homo sapiens
agacaggucuagacuuuc

SEQ ID NO: 913391 - RNA, 13 nt, Homo sapiens
agacagucucaag

SEQ ID NO: 913392 - RNA, 13 nt, Homo sapiens
agacagugcugcc

SEQ ID NO: 913393 - RNA, 18 nt, Homo sapiens
agacaguggaucaugaaa

SEQ ID NO: 913394 - RNA, 19 nt, Homo sapiens
agacaguguuuucugggau

SEQ ID NO: 913395 - RNA, 14 nt, Homo sapiens
agacaguucaagaa

SEQ ID NO: 913396 - RNA, 21 nt, Homo sapiens
agacauauucuuggagaacuu

SEQ ID NO: 913397 - RNA, 16 nt, Homo sapiens
agacaugaaaucugag

SEQ ID NO: 913398 - RNA, 12 nt, Homo sapiens
agaccaaaauaa

SEQ ID NO: 913399 - RNA, 20 nt, Homo sapiens
agaccaacucucuccuguau

SEQ ID NO: 913400 - RNA, 19 nt, Homo sapiens
agaccaagacacagaucac

SEQ ID NO: 913401 - RNA, 22 nt, Homo sapiens
agaccaaggcgggagcaucucu

SEQ ID NO: 913402 - RNA, 13 nt, Homo sapiens
agaccacauccac

SEQ ID NO: 913403 - RNA, 12 nt, Homo sapiens
agaccacucccu

SEQ ID NO: 913404 - RNA, 13 nt, Homo sapiens
agaccaguacugg

SEQ ID NO: 913405 - RNA, 21 nt, Homo sapiens
agaccagugaaagaguagugc

SEQ ID NO: 913406 - RNA, 19 nt, Homo sapiens
agaccaguugggagcacug

SEQ ID NO: 913407 - RNA, 14 nt, Homo sapiens
agaccauaauguua

SEQ ID NO: 913408 - RNA, 16 nt, Homo sapiens
agaccauaauguuaca

SEQ ID NO: 913409 - RNA, 19 nt, Homo sapiens
agaccauuuguauuaccau

SEQ ID NO: 913410 - RNA, 17 nt, Homo sapiens
agacccaccacaccgca

SEQ ID NO: 913411 - RNA, 15 nt, Homo sapiens
agacccagaucucau

SEQ ID NO: 913412 - RNA, 13 nt, Homo sapiens
agaccccaucucu

SEQ ID NO: 913413 - RNA, 16 nt, Homo sapiens
agacccugaagauuuc

SEQ ID NO: 913414 - RNA, 15 nt, Homo sapiens
agaccgggggccaga

SEQ ID NO: 913415 - RNA, 21 nt, Homo sapiens
agaccuagaccugggccaaaa

SEQ ID NO: 913416 - RNA, 15 nt, Homo sapiens
agaccuagugcuguu

SEQ ID NO: 913417 - RNA, 16 nt, Homo sapiens
agaccucuacugccuu

SEQ ID NO: 913418 - RNA, 15 nt, Homo sapiens
agaccugacugccug

SEQ ID NO: 913419 - RNA, 18 nt, Homo sapiens
agaccuuuucucucccau

SEQ ID NO: 913420 - RNA, 12 nt, Homo sapiens
agacgcagcccu

SEQ ID NO: 913421 - RNA, 21 nt, Homo sapiens
agacgcagcccugggggccag

SEQ ID NO: 913422 - RNA, 19 nt, Homo sapiens
agacgccuuucuccuccaa

SEQ ID NO: 913423 - RNA, 15 nt, Homo sapiens
agacggagucuugcu

SEQ ID NO: 913424 - RNA, 15 nt, Homo sapiens
agacggccaagugaa

SEQ ID NO: 913425 - RNA, 14 nt, Homo sapiens
agacgguguugcag

SEQ ID NO: 913426 - RNA, 15 nt, Homo sapiens
acugggucucacucc

SEQ ID NO: 913427 - RNA, 23 nt, Homo sapiens
acugguuucucagaauccaaaga

SEQ ID NO: 913428 - RNA, 20 nt, Homo sapiens
acuguaauuaaguaaaccaa

SEQ ID NO: 913429 - RNA, 17 nt, Homo sapiens
acuguacugagacauua

SEQ ID NO: 913430 - RNA, 21 nt, Homo sapiens
acuguacugagacauuacagu

SEQ ID NO: 913431 - RNA, 20 nt, Homo sapiens
acugucaagucaugauggag

SEQ ID NO: 913432 - RNA, 12 nt, Homo sapiens
acugucacuguu

SEQ ID NO: 913433 - RNA, 21 nt, Homo sapiens
acugucccucaaaugacccaa

SEQ ID NO: 913434 - RNA, 14 nt, Homo sapiens
acuguccuacccac

SEQ ID NO: 913435 - RNA, 22 nt, Homo sapiens
acuguccuggcugcucucaugc

SEQ ID NO: 913436 - RNA, 14 nt, Homo sapiens
acugugacaccaga

SEQ ID NO: 913437 - RNA, 21 nt, Homo sapiens
acuguggccuguuaacuggua

SEQ ID NO: 913438 - RNA, 15 nt, Homo sapiens
acuguguguacauau

SEQ ID NO: 913439 - RNA, 14 nt, Homo sapiens
acuguguucagugc

SEQ ID NO: 913440 - RNA, 19 nt, Homo sapiens
acuguguucagugccuugg

SEQ ID NO: 913441 - RNA, 20 nt, Homo sapiens
acuguuagucauuugcugag

SEQ ID NO: 913442 - RNA, 14 nt, Homo sapiens
acuguugcacugau

SEQ ID NO: 913443 - RNA, 13 nt, Homo sapiens
acuguugcccagg

SEQ ID NO: 913444 - RNA, 13 nt, Homo sapiens
acuuaaacccagc

SEQ ID NO: 913445 - RNA, 22 nt, Homo sapiens
acuuaagcugggauaaucacau

SEQ ID NO: 913446 - RNA, 15 nt, Homo sapiens
acuuaauaauugcau

SEQ ID NO: 913447 - RNA, 23 nt, Homo sapiens
acuuaccugcauguguuguacaa

SEQ ID NO: 913448 - RNA, 23 nt, Homo sapiens
acuuagaaauugcauuuccugac

SEQ ID NO: 913449 - RNA, 19 nt, Homo sapiens
acuuagcuggccacaguga

SEQ ID NO: 913450 - RNA, 22 nt, Homo sapiens
acuuauauggaaauucugcuca

SEQ ID NO: 913451 - RNA, 13 nt, Homo sapiens
acuucaaauugca

SEQ ID NO: 913452 - RNA, 19 nt, Homo sapiens
acuucaaguuaaagugaau

SEQ ID NO: 913453 - RNA, 20 nt, Homo sapiens
acuucaaguuaaagugaaua

SEQ ID NO: 913454 - RNA, 20 nt, Homo sapiens
acuucagagacuaucugauu

SEQ ID NO: 913455 - RNA, 18 nt, Homo sapiens
acuucagagcacacuuau

SEQ ID NO: 913456 - RNA, 11 nt, Homo sapiens
acuucagucuu

SEQ ID NO: 913457 - RNA, 15 nt, Homo sapiens
acuucagucuuggag

SEQ ID NO: 913458 - RNA, 21 nt, Homo sapiens
acuuccaguguuggcugugug

SEQ ID NO: 913459 - RNA, 16 nt, Homo sapiens
acuuccauuaacuuag

SEQ ID NO: 913460 - RNA, 14 nt, Homo sapiens
acuucccugggaac

SEQ ID NO: 913461 - RNA, 17 nt, Homo sapiens
acuuccuguguacucuu

SEQ ID NO: 913462 - RNA, 15 nt, Homo sapiens
acuucuaaaugaagu

SEQ ID NO: 913463 - RNA, 20 nt, Homo sapiens
acuucuaaguaaaaccacag

SEQ ID NO: 913464 - RNA, 12 nt, Homo sapiens
acuucuaugcaa

SEQ ID NO: 913465 - RNA, 11 nt, Homo sapiens
acuucucacca

SEQ ID NO: 913466 - RNA, 23 nt, Homo sapiens
acuucucauuuuuuaaaaaagcu

SEQ ID NO: 913467 - RNA, 20 nt, Homo sapiens
acuucugagaccuuguuuca

SEQ ID NO: 913468 - RNA, 15 nt, Homo sapiens
acuucugucuucaca

SEQ ID NO: 913469 - RNA, 21 nt, Homo sapiens
acuucugucuucacaacagau

SEQ ID NO: 913470 - RNA, 21 nt, Homo sapiens
acuucuuacuucccuaaugaa

SEQ ID NO: 913471 - RNA, 23 nt, Homo sapiens
acuucuuggaaaaaaauuacaaa

SEQ ID NO: 913472 - RNA, 15 nt, Homo sapiens
acuugaaaaccucau

SEQ ID NO: 913473 - RNA, 14 nt, Homo sapiens
acuugaacccaggu

SEQ ID NO: 913474 - RNA, 16 nt, Homo sapiens
acuugaacccaggucu

SEQ ID NO: 913475 - RNA, 15 nt, Homo sapiens
acuugaauacucuca

SEQ ID NO: 913476 - RNA, 17 nt, Homo sapiens
acuugacagaacacugu

SEQ ID NO: 913477 - RNA, 13 nt, Homo sapiens
acuugagcaccgu

SEQ ID NO: 913478 - RNA, 21 nt, Homo sapiens
acuugaggcuggcacuccccu

SEQ ID NO: 913479 - RNA, 20 nt, Homo sapiens
acuugaugacccccaaccaa

SEQ ID NO: 913480 - RNA, 16 nt, Homo sapiens
acuugcauacagagac

SEQ ID NO: 913481 - RNA, 18 nt, Homo sapiens
acuugcccugccacuuug

SEQ ID NO: 913482 - RNA, 14 nt, Homo sapiens
acuugcugccugaa

SEQ ID NO: 913483 - RNA, 23 nt, Homo sapiens
acuuggggagauggaguucuugu

SEQ ID NO: 913484 - RNA, 22 nt, Homo sapiens
acuugggggaggaggaacaaau

SEQ ID NO: 913485 - RNA, 21 nt, Homo sapiens
acuuggggucaccacccuccc

SEQ ID NO: 913486 - RNA, 20 nt, Homo sapiens
acuuguagaaaucuguaauu

SEQ ID NO: 913487 - RNA, 17 nt, Homo sapiens
acuuguagggaugccuu

SEQ ID NO: 913488 - RNA, 14 nt, Homo sapiens
acuuguggacacag

SEQ ID NO: 913489 - RNA, 16 nt, Homo sapiens
acuuguggacacagcu

SEQ ID NO: 913490 - RNA, 19 nt, Homo sapiens
acuuguugcugauucaaga

SEQ ID NO: 913491 - RNA, 19 nt, Homo sapiens
acuuguuuucacuuuauca

SEQ ID NO: 913492 - RNA, 16 nt, Homo sapiens
acuauucuauggccau

SEQ ID NO: 913493 - RNA, 18 nt, Homo sapiens
acuauucuuaacuauuca

SEQ ID NO: 913494 - RNA, 16 nt, Homo sapiens
acuauugaaaucaagc

SEQ ID NO: 913495 - RNA, 21 nt, Homo sapiens
acuauugaaguugcagauuca

SEQ ID NO: 913496 - RNA, 17 nt, Homo sapiens
acuauuuaucugugcaa

SEQ ID NO: 913497 - RNA, 12 nt, Homo sapiens
acucaaacaauc

SEQ ID NO: 913498 - RNA, 20 nt, Homo sapiens
acucaaacaaucaugaguca

SEQ ID NO: 913499 - RNA, 13 nt, Homo sapiens
acucaaacucaag

SEQ ID NO: 913500 - RNA, 14 nt, Homo sapiens
acucacaugccgcc

SEQ ID NO: 913501 - RNA, 23 nt, Homo sapiens
acucaccaguguccccuccacug

SEQ ID NO: 913502 - RNA, 19 nt, Homo sapiens
acucacccucauaccaucu

SEQ ID NO: 913503 - RNA, 20 nt, Homo sapiens
acucacuccacaacccaaga

SEQ ID NO: 913504 - RNA, 11 nt, Homo sapiens
acucacugugg

SEQ ID NO: 913505 - RNA, 19 nt, Homo sapiens
acucagaaaagaaaaccau

SEQ ID NO: 913506 - RNA, 17 nt, Homo sapiens
acucagaagacacugau

SEQ ID NO: 913507 - RNA, 15 nt, Homo sapiens
acucagacuguugca

SEQ ID NO: 913508 - RNA, 18 nt, Homo sapiens
acucagacuguugcacuc

SEQ ID NO: 913509 - RNA, 17 nt, Homo sapiens
acucagcacagcagugg

SEQ ID NO: 913510 - RNA, 21 nt, Homo sapiens
acucaggaggcugaggcagga

SEQ ID NO: 913511 - RNA, 19 nt, Homo sapiens
acucagggccccagcacua

SEQ ID NO: 913512 - RNA, 21 nt, Homo sapiens
acucaguuguuccuacucaga

SEQ ID NO: 913513 - RNA, 22 nt, Homo sapiens
acucaguuugucagacuuuaaa

SEQ ID NO: 913514 - RNA, 16 nt, Homo sapiens
acucauauucugggcu

SEQ ID NO: 913515 - RNA, 23 nt, Homo sapiens
acucaucccuguuccucaaggcc

SEQ ID NO: 913516 - RNA, 16 nt, Homo sapiens
acucauugucugugga

SEQ ID NO: 913517 - RNA, 16 nt, Homo sapiens
acucauuucaucucau

SEQ ID NO: 913518 - RNA, 23 nt, Homo sapiens
acucauuuuuguuuucauuaucu

SEQ ID NO: 913519 - RNA, 20 nt, Homo sapiens
acuccagauuuuuuacagcu

SEQ ID NO: 913520 - RNA, 21 nt, Homo sapiens
acuccagauuuuuuacagcug

SEQ ID NO: 913521 - RNA, 14 nt, Homo sapiens
acuccauacauaac

SEQ ID NO: 913522 - RNA, 16 nt, Homo sapiens
acuccauuacuaaaga

SEQ ID NO: 913523 - RNA, 21 nt, Homo sapiens
acucccucccuggcucugcca

SEQ ID NO: 913524 - RNA, 15 nt, Homo sapiens
acuccggagguagag

SEQ ID NO: 913525 - RNA, 16 nt, Homo sapiens
acuccugcccuguugu

SEQ ID NO: 913526 - RNA, 12 nt, Homo sapiens
acuccuguuacu

SEQ ID NO: 913527 - RNA, 17 nt, Homo sapiens
acuccuuagagacauca

SEQ ID NO: 913528 - RNA, 23 nt, Homo sapiens
acuccuuccagcuagugacccac

SEQ ID NO: 913529 - RNA, 17 nt, Homo sapiens
acuccuuugcauuccau

SEQ ID NO: 913530 - RNA, 13 nt, Homo sapiens
acucuaaguucua

SEQ ID NO: 913531 - RNA, 21 nt, Homo sapiens
acucuacaaagagaagcaaag

SEQ ID NO: 913532 - RNA, 14 nt, Homo sapiens
acucuaccugcaag

SEQ ID NO: 913533 - RNA, 13 nt, Homo sapiens
acucuacugcaag

SEQ ID NO: 913534 - RNA, 20 nt, Homo sapiens
acucuaggggucaggcucca

SEQ ID NO: 913535 - RNA, 17 nt, Homo sapiens
acucuauguaugcaucu

SEQ ID NO: 913536 - RNA, 18 nt, Homo sapiens
acucucugugaccugccc

SEQ ID NO: 913537 - RNA, 22 nt, Homo sapiens
acucugaaaaacauuccaggaa

SEQ ID NO: 913538 - RNA, 16 nt, Homo sapiens
acucugaaacugagaa

SEQ ID NO: 913539 - RNA, 13 nt, Homo sapiens
acucugacuuuga

SEQ ID NO: 913540 - RNA, 14 nt, Homo sapiens
acucugacuuugag

SEQ ID NO: 913541 - RNA, 14 nt, Homo sapiens
acucugcacauguc

SEQ ID NO: 913542 - RNA, 18 nt, Homo sapiens
acucugcacaugucuugu

SEQ ID NO: 913543 - RNA, 19 nt, Homo sapiens
acucugccagccacaucca

SEQ ID NO: 913544 - RNA, 23 nt, Homo sapiens
acucugcuucauuuuugggagaa

SEQ ID NO: 913545 - RNA, 14 nt, Homo sapiens
acucuuaacuccua

SEQ ID NO: 913546 - RNA, 21 nt, Homo sapiens
acucuuauagaaaguucaaaa

SEQ ID NO: 913547 - RNA, 16 nt, Homo sapiens
acucuuccaaaggcau

SEQ ID NO: 913548 - RNA, 21 nt, Homo sapiens
acucuucugagcaccuacuua

SEQ ID NO: 913549 - RNA, 14 nt, Homo sapiens
acugaaaacuguaa

SEQ ID NO: 913550 - RNA, 13 nt, Homo sapiens
acugaaacauuca

SEQ ID NO: 913551 - RNA, 15 nt, Homo sapiens
acugaacugcacguu

SEQ ID NO: 913552 - RNA, 13 nt, Homo sapiens
acugaagaccucc

SEQ ID NO: 913553 - RNA, 19 nt, Homo sapiens
acugaaggagaaggugccc

SEQ ID NO: 913554 - RNA, 19 nt, Homo sapiens
acugaaggcauaugcuggc

SEQ ID NO: 913555 - RNA, 19 nt, Homo sapiens
acugaauuugggccucuug

SEQ ID NO: 913556 - RNA, 20 nt, Homo sapiens
acugaauuuuaaauguucac

SEQ ID NO: 913557 - RNA, 16 nt, Homo sapiens
acugacauuguuggcc

SEQ ID NO: 913558 - RNA, 19 nt, Homo sapiens
aaaaaaaugcacugugaca

SEQ ID NO: 913559 - RNA, 14 nt, Homo sapiens
aaaaacaaauggga

SEQ ID NO: 913560 - RNA, 18 nt, Homo sapiens
aaaaaccaauagcuuuaa

SEQ ID NO: 913561 - RNA, 12 nt, Homo sapiens
aaaaaccaauga

SEQ ID NO: 913562 - RNA, 18 nt, Homo sapiens
aaaaacuaacacccaguc

SEQ ID NO: 913563 - RNA, 12 nt, Homo sapiens
aaaaacuuccau

SEQ ID NO: 913564 - RNA, 24 nt, Homo sapiens
aaaaacuuccaucccuacuuuuca

SEQ ID NO: 913565 - RNA, 15 nt, Homo sapiens
aaaaacuuugacaaa

SEQ ID NO: 913566 - RNA, 17 nt, Homo sapiens
aaaaaggcauaugcaau

SEQ ID NO: 913567 - RNA, 13 nt, Homo sapiens
aaaaagucacaaa

SEQ ID NO: 913568 - RNA, 17 nt, Homo sapiens
aaaaauaaaccaaagga

SEQ ID NO: 913569 - RNA, 22 nt, Homo sapiens
aaaaauauaaccauuacauguu

SEQ ID NO: 913570 - RNA, 20 nt, Homo sapiens
aaaaauauauauagugcuau

SEQ ID NO: 913571 - RNA, 20 nt, Homo sapiens
aaaaauauauuuaauggcaa

SEQ ID NO: 913572 - RNA, 18 nt, Homo sapiens
aaaaauauucuccaugga

SEQ ID NO: 913573 - RNA, 21 nt, Homo sapiens
aaaaauucaucauaugaaugu

SEQ ID NO: 913574 - RNA, 21 nt, Homo sapiens
aaaaauuucaaccagcauuca

SEQ ID NO: 913575 - RNA, 13 nt, Homo sapiens
aaaacagaaagca

SEQ ID NO: 913576 - RNA, 15 nt, Homo sapiens
aaaacagaacaauua

SEQ ID NO: 913577 - RNA, 18 nt, Homo sapiens
aaaacagagaugugauaa

SEQ ID NO: 913578 - RNA, 15 nt, Homo sapiens
aaaacagucgaucaa

SEQ ID NO: 913579 - RNA, 11 nt, Homo sapiens
aaaacaucacu

SEQ ID NO: 913580 - RNA, 13 nt, Homo sapiens
aaaacaugacuuu

SEQ ID NO: 913581 - RNA, 10 nt, Homo sapiens
aaaacaugca

SEQ ID NO: 913582 - RNA, 19 nt, Homo sapiens
aaaacauugauuauaagca

SEQ ID NO: 913583 - RNA, 10 nt, Homo sapiens
aaaaccaaug

SEQ ID NO: 913584 - RNA, 18 nt, Homo sapiens
aaaaccacagcaguugaa

SEQ ID NO: 913585 - RNA, 19 nt, Homo sapiens
aaaaccagaaucauaauuu

SEQ ID NO: 913586 - RNA, 14 nt, Homo sapiens
aaaaccauguugau

SEQ ID NO: 913587 - RNA, 20 nt, Homo sapiens
aaaaccucaugacagccaga

SEQ ID NO: 913588 - RNA, 19 nt, Homo sapiens
aaaaccucauuuaccauaa

SEQ ID NO: 913589 - RNA, 19 nt, Homo sapiens
aaaaccuuuccccagacac

SEQ ID NO: 913590 - RNA, 20 nt, Homo sapiens
aaaacucuugauaugaccug

SEQ ID NO: 913591 - RNA, 19 nt, Homo sapiens
aaaacugaaaaucuaauau

SEQ ID NO: 913592 - RNA, 20 nt, Homo sapiens
aaaacugccuuuuaucugcc

SEQ ID NO: 913593 - RNA, 13 nt, Homo sapiens
aaaacuucucaca

SEQ ID NO: 913594 - RNA, 17 nt, Homo sapiens
aaaacuugcugccugaa

SEQ ID NO: 913595 - RNA, 11 nt, Homo sapiens
aaaagacauaa

SEQ ID NO: 913596 - RNA, 17 nt, Homo sapiens
aaaagagagaucuugau

SEQ ID NO: 913597 - RNA, 17 nt, Homo sapiens
aaaagcaaaagcucugu

SEQ ID NO: 913598 - RNA, 11 nt, Homo sapiens
aaaagcacuug

SEQ ID NO: 913599 - RNA, 11 nt, Homo sapiens
aaaagcacuuu

SEQ ID NO: 913600 - RNA, 15 nt, Homo sapiens
aaaagcaguggggac

SEQ ID NO: 913601 - RNA, 17 nt, Homo sapiens
aaaaggcauaugcaaua

SEQ ID NO: 913602 - RNA, 12 nt, Homo sapiens
aaaagggcaaua

SEQ ID NO: 913603 - RNA, 15 nt, Homo sapiens
aaaagguuauauacc

SEQ ID NO: 913604 - RNA, 22 nt, Homo sapiens
aaaaguaauuguagauggaaau

SEQ ID NO: 913605 - RNA, 19 nt, Homo sapiens
aaaaguccuugauuuagca

SEQ ID NO: 913606 - RNA, 20 nt, Homo sapiens
aaaaguguuauuauuuggca

SEQ ID NO: 913607 - RNA, 14 nt, Homo sapiens
aaaaguuaaacuac

SEQ ID NO: 913608 - RNA, 13 nt, Homo sapiens
aaaaguugugauu

SEQ ID NO: 913609 - RNA, 18 nt, Homo sapiens
aaaauaaacuaguuucca

SEQ ID NO: 913610 - RNA, 20 nt, Homo sapiens
aaaauaaacuggggaguuau

SEQ ID NO: 913611 - RNA, 12 nt, Homo sapiens
aaaauaacuuau

SEQ ID NO: 913612 - RNA, 14 nt, Homo sapiens
aaaauaauuguucc

SEQ ID NO: 913613 - RNA, 12 nt, Homo sapiens
aaaauaccucuu

SEQ ID NO: 913614 - RNA, 11 nt, Homo sapiens
aaaauagccac

SEQ ID NO: 913615 - RNA, 17 nt, Homo sapiens
aaaauagccacuuaccu

SEQ ID NO: 913616 - RNA, 15 nt, Homo sapiens
aaaauagcucuuuca

SEQ ID NO: 913617 - RNA, 14 nt, Homo sapiens
aaaauauaaaugca

SEQ ID NO: 913618 - RNA, 22 nt, Homo sapiens
aaaauauaagaacuugauauau

SEQ ID NO: 913619 - RNA, 23 nt, Homo sapiens
aaaauauauaugugcaguauuuu

SEQ ID NO: 913620 - RNA, 14 nt, Homo sapiens
aaaauaugaaagac

SEQ ID NO: 913621 - RNA, 17 nt, Homo sapiens
aaaauaugaaagacuua

SEQ ID NO: 913622 - RNA, 13 nt, Homo sapiens
aaaauauucugua

SEQ ID NO: 913623 - RNA, 19 nt, Homo sapiens
aaaauauuuuuaugugcaa

SEQ ID NO: 913624 - RNA, 14 nt, Homo sapiens
aaaaucaacuguau

SEQ ID NO: 913625 - RNA, 19 nt, Homo sapiens
aaaaugaaagcaugucuca

SEQ ID NO: 913626 - RNA, 20 nt, Homo sapiens
aaaaugaaaugacugucuaa

SEQ ID NO: 913627 - RNA, 13 nt, Homo sapiens
aaaaugaaauguc

SEQ ID NO: 913628 - RNA, 17 nt, Homo sapiens
aaaaugaauacaauuaa

SEQ ID NO: 913629 - RNA, 17 nt, Homo sapiens
aaaaugaauugucuuca

SEQ ID NO: 913630 - RNA, 12 nt, Homo sapiens
aaaaugcacugu

SEQ ID NO: 913631 - RNA, 16 nt, Homo sapiens
aaaauggccauuugcu

SEQ ID NO: 913632 - RNA, 18 nt, Homo sapiens
aaaaugguaauuguugcu

SEQ ID NO: 913633 - RNA, 13 nt, Homo sapiens
aaaauguaacuuu

SEQ ID NO: 913634 - RNA, 15 nt, Homo sapiens
aaaauguaaugauca

SEQ ID NO: 913635 - RNA, 14 nt, Homo sapiens
aaaauguacacugg

SEQ ID NO: 913636 - RNA, 20 nt, Homo sapiens
aaaaugucuguuaacuuaau

SEQ ID NO: 913637 - RNA, 16 nt, Homo sapiens
aaaaugucuguuucaa

SEQ ID NO: 913638 - RNA, 17 nt, Homo sapiens
aaaaugugucuguaaga

SEQ ID NO: 913639 - RNA, 23 nt, Homo sapiens
aaaauguuuucuucaucugugac

SEQ ID NO: 913640 - RNA, 19 nt, Homo sapiens
aaaauuaaaugcauguccu

SEQ ID NO: 913641 - RNA, 21 nt, Homo sapiens
aaaauuaagagauacauuccc

SEQ ID NO: 913642 - RNA, 21 nt, Homo sapiens
aaaauuagccgggcauggugg

SEQ ID NO: 913643 - RNA, 23 nt, Homo sapiens
aaaauuauguauuuuugucauau

SEQ ID NO: 913644 - RNA, 13 nt, Homo sapiens
aaaauugauauac

SEQ ID NO: 913645 - RNA, 9 nt, Homo sapiens
aaaauugca

SEQ ID NO: 913646 - RNA, 15 nt, Homo sapiens
aaaauugcacuuuua

SEQ ID NO: 913647 - RNA, 14 nt, Homo sapiens
aaacaaaacaaaac

SEQ ID NO: 913648 - RNA, 18 nt, Homo sapiens
aaacaaauagucuaucaa

SEQ ID NO: 913649 - RNA, 23 nt, Homo sapiens
aaacaaggcuuaaaagaguagaa

SEQ ID NO: 913650 - RNA, 15 nt, Homo sapiens
aaacaagugcacuug

SEQ ID NO: 913651 - RNA, 11 nt, Homo sapiens
aaacaaugcca

SEQ ID NO: 913652 - RNA, 19 nt, Homo sapiens
aaacaauuggcaaacuuug

SEQ ID NO: 913653 - RNA, 17 nt, Homo sapiens
aaacacaccgaugcaca

SEQ ID NO: 913654 - RNA, 11 nt, Homo sapiens
aaacacagccu

SEQ ID NO: 913655 - RNA, 15 nt, Homo sapiens
aaacacgugucuaua

SEQ ID NO: 913656 - RNA, 20 nt, Homo sapiens
aaacagaaagcauccuaaau

SEQ ID NO: 913657 - RNA, 15 nt, Homo sapiens
aaacagacuauuuaa

SEQ ID NO: 913658 - RNA, 22 nt, Homo sapiens
aaacagacuauuuaacuugagg

SEQ ID NO: 913659 - RNA, 21 nt, Homo sapiens
aaacagaggaaucuaccugug

SEQ ID NO: 913660 - RNA, 19 nt, Homo sapiens
aaacauaaagagaacucug

SEQ ID NO: 913661 - RNA, 14 nt, Homo sapiens
aaacauaauaucuu

SEQ ID NO: 913662 - RNA, 19 nt, Homo sapiens
aaacauaauaucuugaaga

SEQ ID NO: 913663 - RNA, 16 nt, Homo sapiens
aaacauaucaauucaa

SEQ ID NO: 913664 - RNA, 15 nt, Homo sapiens
aaacauauguauaca

SEQ ID NO: 913665 - RNA, 19 nt, Homo sapiens
aaacaugcuaaauaguucu

SEQ ID NO: 913666 - RNA, 22 nt, Homo sapiens
aaacauucaucaagcuguacau

SEQ ID NO: 913667 - RNA, 15 nt, Homo sapiens
aaacauuccaggaaa

SEQ ID NO: 913668 - RNA, 19 nt, Homo sapiens
aaacauugugccaugucaa

SEQ ID NO: 913669 - RNA, 15 nt, Homo sapiens
aaacauuuauggaau

SEQ ID NO: 913670 - RNA, 11 nt, Homo sapiens
aaaccaaagau

SEQ ID NO: 913671 - RNA, 17 nt, Homo sapiens
aaaccaauaguccccau

SEQ ID NO: 913672 - RNA, 14 nt, Homo sapiens
aaaccaaugauuca

SEQ ID NO: 913673 - RNA, 14 nt, Homo sapiens
aaaccagagucaaa

SEQ ID NO: 913674 - RNA, 18 nt, Homo sapiens
aaaccaucaaaaauauuc

SEQ ID NO: 913675 - RNA, 23 nt, Homo sapiens
aaacccaaauaaauguguaaaug

SEQ ID NO: 913676 - RNA, 15 nt, Homo sapiens
aaacccaucagacag

SEQ ID NO: 913677 - RNA, 13 nt, Homo sapiens
aaaccccaucucu

SEQ ID NO: 913678 - RNA, 13 nt, Homo sapiens
aaaccucaucucu

SEQ ID NO: 913679 - RNA, 15 nt, Homo sapiens
aaaccucaucucuac

SEQ ID NO: 913680 - RNA, 17 nt, Homo sapiens
aaaccuccggugugaga

SEQ ID NO: 913681 - RNA, 14 nt, Homo sapiens
aaaccuuacuuaaa

SEQ ID NO: 913682 - RNA, 13 nt, Homo sapiens
aaaccuucaguga

SEQ ID NO: 913683 - RNA, 22 nt, Homo sapiens
aaaccuugauuuaaaauaucac

SEQ ID NO: 913684 - RNA, 16 nt, Homo sapiens
aaaccuugcagcauuu

SEQ ID NO: 913685 - RNA, 19 nt, Homo sapiens
aaaccuuucaaauuucaca

SEQ ID NO: 913686 - RNA, 17 nt, Homo sapiens
aaacgaucgcugugaaa

SEQ ID NO: 913687 - RNA, 21 nt, Homo sapiens
aaacgcaaaaccugcaguucc

SEQ ID NO: 913688 - RNA, 21 nt, Homo sapiens
aaacuagcagaagaacuagua

SEQ ID NO: 913689 - RNA, 19 nt, Homo sapiens
aaacuaguuuccaguggau

SEQ ID NO: 913690 - RNA, 13 nt, Homo sapiens
aaacuauauucuc

SEQ ID NO: 913691 - RNA, 13 nt, Homo sapiens
aaacuccaucuca

SEQ ID NO: 913692 - RNA, 23 nt, Homo sapiens
aaacuccugauuuuguaguuaau

SEQ ID NO: 913693 - RNA, 21 nt, Homo sapiens
aaacugagaugugaacacauc

SEQ ID NO: 913694 - RNA, 20 nt, Homo sapiens
aaacugagccucuuuucaau

SEQ ID NO: 913695 - RNA, 20 nt, Homo sapiens
aaacugcaaauauugucaua

SEQ ID NO: 913696 - RNA, 16 nt, Homo sapiens
aaacuguuaucacuua

SEQ ID NO: 913697 - RNA, 19 nt, Homo sapiens
aaacuuauuugagugauua

SEQ ID NO: 913698 - RNA, 12 nt, Homo sapiens
aaacuucaucuu

SEQ ID NO: 913699 - RNA, 15 nt, Homo sapiens
aaacuucauggucau

SEQ ID NO: 913700 - RNA, 20 nt, Homo sapiens
aaacuugaaucaaagcaguu

SEQ ID NO: 913701 - RNA, 13 nt, Homo sapiens
aaacuuguguaug

SEQ ID NO: 913702 - RNA, 17 nt, Homo sapiens
aaacuuuggcuuauaaa

SEQ ID NO: 913703 - RNA, 18 nt, Homo sapiens
aaacuuuuaaacaugaga

SEQ ID NO: 913704 - RNA, 15 nt, Homo sapiens
aaagaaaacuaacaa

SEQ ID NO: 913705 - RNA, 19 nt, Homo sapiens
aaagaaaauuaguaauugu

SEQ ID NO: 913706 - RNA, 16 nt, Homo sapiens
aaagaaagaaacugau

SEQ ID NO: 913707 - RNA, 19 nt, Homo sapiens
aaagaacacgaauugcuca

SEQ ID NO: 913708 - RNA, 17 nt, Homo sapiens
aaagaaggacacuugua

SEQ ID NO: 913709 - RNA, 15 nt, Homo sapiens
aaagaaucagucuug

SEQ ID NO: 913710 - RNA, 20 nt, Homo sapiens
aaagaaugcuggguguugca

SEQ ID NO: 913711 - RNA, 14 nt, Homo sapiens
aaagacaacauaac

SEQ ID NO: 913712 - RNA, 15 nt, Homo sapiens
aaagacaauggaaac

SEQ ID NO: 913713 - RNA, 14 nt, Homo sapiens
aaagacauagccaa

SEQ ID NO: 913714 - RNA, 12 nt, Homo sapiens
aaagacauguug

SEQ ID NO: 913715 - RNA, 16 nt, Homo sapiens
aaagacuacacuguug

SEQ ID NO: 913716 - RNA, 12 nt, Homo sapiens
aaagacuauuaa

SEQ ID NO: 913717 - RNA, 23 nt, Homo sapiens
aaagacuuguguccccaccucag

SEQ ID NO: 913718 - RNA, 12 nt, Homo sapiens
aaagagacugag

SEQ ID NO: 913719 - RNA, 22 nt, Homo sapiens
aaagagguggauuccugggcaa

SEQ ID NO: 913720 - RNA, 15 nt, Homo sapiens
aaagaguagugcauu

SEQ ID NO: 913721 - RNA, 19 nt, Homo sapiens
aaagaugaaaaaugguccc

SEQ ID NO: 913722 - RNA, 12 nt, Homo sapiens
aaagaugucaau

SEQ ID NO: 913723 - RNA, 14 nt, Homo sapiens
aaagauuuuaccug

SEQ ID NO: 913724 - RNA, 18 nt, Homo sapiens
aaagcaaaauaauaagaa

SEQ ID NO: 913725 - RNA, 12 nt, Homo sapiens
aaagcacuguuu

SEQ ID NO: 913726 - RNA, 18 nt, Homo sapiens
aaagcacuguuucucuca

SEQ ID NO: 913727 - RNA, 12 nt, Homo sapiens
aaagcagcaucu

SEQ ID NO: 913728 - RNA, 10 nt, Homo sapiens
aaagcagugu

SEQ ID NO: 913729 - RNA, 20 nt, Homo sapiens
aaagcauuacauuuccaaau

SEQ ID NO: 913730 - RNA, 22 nt, Homo sapiens
aaagcauuacauuuccaaauga

SEQ ID NO: 913731 - RNA, 13 nt, Homo sapiens
aaagccaaaaggu

SEQ ID NO: 913732 - RNA, 18 nt, Homo sapiens
aaagccaaacucugccag

SEQ ID NO: 913733 - RNA, 18 nt, Homo sapiens
aaagccagaguuccaugu

SEQ ID NO: 913734 - RNA, 16 nt, Homo sapiens
aaagcccagcucuuug

SEQ ID NO: 913735 - RNA, 18 nt, Homo sapiens
aaagcccccacuucucuc

SEQ ID NO: 913736 - RNA, 14 nt, Homo sapiens
aaagcccuugaacc

SEQ ID NO: 913737 - RNA, 22 nt, Homo sapiens
aaagccgguugcagagaaucug

SEQ ID NO: 913738 - RNA, 14 nt, Homo sapiens
aaagccucuggaaa

SEQ ID NO: 913739 - RNA, 22 nt, Homo sapiens
aaagcuacaacaaauacuacag

SEQ ID NO: 913740 - RNA, 15 nt, Homo sapiens
aaaggaaaccaaagg

SEQ ID NO: 913741 - RNA, 16 nt, Homo sapiens
aaaggagaacuaucca

SEQ ID NO: 913742 - RNA, 15 nt, Homo sapiens
aaaggagccugugaa

SEQ ID NO: 913743 - RNA, 16 nt, Homo sapiens
aaaggagccugugaac

SEQ ID NO: 913744 - RNA, 22 nt, Homo sapiens
aaaggagccugugaacccagga

SEQ ID NO: 913745 - RNA, 15 nt, Homo sapiens
aaaggauugaucacu

SEQ ID NO: 913746 - RNA, 22 nt, Homo sapiens
aaaggcauccauagugcacuag

SEQ ID NO: 913747 - RNA, 21 nt, Homo sapiens
aaaggcuagguacacagcucu

SEQ ID NO: 913748 - RNA, 18 nt, Homo sapiens
aaagggauaguccaaaga

SEQ ID NO: 913749 - RNA, 18 nt, Homo sapiens
aaagggcccagagagggu

SEQ ID NO: 913750 - RNA, 17 nt, Homo sapiens
aaagggcugaaagccau

SEQ ID NO: 913751 - RNA, 20 nt, Homo sapiens
aaagguagaucaucuugaau

SEQ ID NO: 913752 - RNA, 18 nt, Homo sapiens
aaagguagcuuaccugac

SEQ ID NO: 913753 - RNA, 19 nt, Homo sapiens
aaagguagcuuaccugaca

SEQ ID NO: 913754 - RNA, 13 nt, Homo sapiens
aaaggugacuggg

SEQ ID NO: 913755 - RNA, 16 nt, Homo sapiens
aaagguucacucucaa

SEQ ID NO: 913756 - RNA, 18 nt, Homo sapiens
aaagguuuaugaaaaaga

SEQ ID NO: 913757 - RNA, 18 nt, Homo sapiens
aaaguaaaagaaccacga

SEQ ID NO: 913758 - RNA, 20 nt, Homo sapiens
aaaguaaaggccucaucucc

SEQ ID NO: 913759 - RNA, 13 nt, Homo sapiens
aaaguaaugccac

SEQ ID NO: 913760 - RNA, 14 nt, Homo sapiens
aaaguagcaauuuc

SEQ ID NO: 913761 - RNA, 14 nt, Homo sapiens
aaaguauauuuucc

SEQ ID NO: 913762 - RNA, 18 nt, Homo sapiens
aaaguauuuuaucugccu

SEQ ID NO: 913763 - RNA, 16 nt, Homo sapiens
aaagucaaaaggugcc

SEQ ID NO: 913764 - RNA, 15 nt, Homo sapiens
aaagugcagcccuuc

SEQ ID NO: 913765 - RNA, 15 nt, Homo sapiens
aaaguguaagcacuu

SEQ ID NO: 913766 - RNA, 18 nt, Homo sapiens
aaaguuacauguuugcac

SEQ ID NO: 913767 - RNA, 23 nt, Homo sapiens
aaaguucccuacuuccugugacu

SEQ ID NO: 913768 - RNA, 13 nt, Homo sapiens
aaaguucuggucc

SEQ ID NO: 913769 - RNA, 19 nt, Homo sapiens
aaaguugcagucucagaaa

SEQ ID NO: 913770 - RNA, 21 nt, Homo sapiens
aaaguuguaguucuugugcau

SEQ ID NO: 913771 - RNA, 15 nt, Homo sapiens
aaaguuguuugugcc

SEQ ID NO: 913772 - RNA, 15 nt, Homo sapiens
aaaguuuugaugaaa

SEQ ID NO: 913773 - RNA, 14 nt, Homo sapiens
aaauaaaaauauuc

SEQ ID NO: 913774 - RNA, 14 nt, Homo sapiens
aggugcugacaaua

SEQ ID NO: 913775 - RNA, 15 nt, Homo sapiens
aggugcuucuucacu

SEQ ID NO: 913776 - RNA, 16 nt, Homo sapiens
agguggagaacuggga

SEQ ID NO: 913777 - RNA, 15 nt, Homo sapiens
agguggccacuccag

SEQ ID NO: 913778 - RNA, 19 nt, Homo sapiens
aggugggaucacuaaggga

SEQ ID NO: 913779 - RNA, 19 nt, Homo sapiens
agguggggaccaaaaccau

SEQ ID NO: 913780 - RNA, 22 nt, Homo sapiens
aggugggggcuauuucuaugca

SEQ ID NO: 913781 - RNA, 14 nt, Homo sapiens
agguggguccagga

SEQ ID NO: 913782 - RNA, 23 nt, Homo sapiens
agguggguccaggaaggcagcug

SEQ ID NO: 913783 - RNA, 13 nt, Homo sapiens
agguggugccuuc

SEQ ID NO: 913784 - RNA, 19 nt, Homo sapiens
agguggugggggcagggau

SEQ ID NO: 913785 - RNA, 12 nt, Homo sapiens
aggugguguuga

SEQ ID NO: 913786 - RNA, 13 nt, Homo sapiens
agguguaccuccc

SEQ ID NO: 913787 - RNA, 20 nt, Homo sapiens
agguguaccucccccugccu

SEQ ID NO: 913788 - RNA, 16 nt, Homo sapiens
aggugugccaaacuac

SEQ ID NO: 913789 - RNA, 13 nt, Homo sapiens
agguuaacagaua

SEQ ID NO: 913790 - RNA, 23 nt, Homo sapiens
agguuaucugccuggccuggcuc

SEQ ID NO: 913791 - RNA, 15 nt, Homo sapiens
agguucacaccauuu

SEQ ID NO: 913792 - RNA, 21 nt, Homo sapiens
agguuccucgcaggucucagc

SEQ ID NO: 913793 - RNA, 14 nt, Homo sapiens
agguucuguguguc

SEQ ID NO: 913794 - RNA, 19 nt, Homo sapiens
agguucuuagugucacuua

SEQ ID NO: 913795 - RNA, 22 nt, Homo sapiens
agguucuuuuuuuuuucaggaa

SEQ ID NO: 913796 - RNA, 23 nt, Homo sapiens
agguugccccuuccccaucucca

SEQ ID NO: 913797 - RNA, 21 nt, Homo sapiens
agguuggugacugaaacauuc

SEQ ID NO: 913798 - RNA, 21 nt, Homo sapiens
agguugucugaagucacugca

SEQ ID NO: 913799 - RNA, 13 nt, Homo sapiens
agguuuacauuca

SEQ ID NO: 913800 - RNA, 15 nt, Homo sapiens
agguuugccagugaa

SEQ ID NO: 913801 - RNA, 16 nt, Homo sapiens
aguaaaaauacaagca

SEQ ID NO: 913802 - RNA, 13 nt, Homo sapiens
aguaaacaaugaa

SEQ ID NO: 913803 - RNA, 12 nt, Homo sapiens
aguaaacuuucu

SEQ ID NO: 913804 - RNA, 19 nt, Homo sapiens
aguaaaggccucaucuccu

SEQ ID NO: 913805 - RNA, 20 nt, Homo sapiens
aguaaaggccucaucuccuu

SEQ ID NO: 913806 - RNA, 17 nt, Homo sapiens
aguaaauagcauucucu

SEQ ID NO: 913807 - RNA, 17 nt, Homo sapiens
aguaacaggaaaccacu

SEQ ID NO: 913808 - RNA, 17 nt, Homo sapiens
aguaacugcacacuauu

SEQ ID NO: 913809 - RNA, 20 nt, Homo sapiens
aguaaguaccacucaggcca

SEQ ID NO: 913810 - RNA, 15 nt, Homo sapiens
aguaaguaucuggag

SEQ ID NO: 913811 - RNA, 22 nt, Homo sapiens
aguaaguuugauuucauuaaua

SEQ ID NO: 913812 - RNA, 14 nt, Homo sapiens
aguaauagggcccu

SEQ ID NO: 913813 - RNA, 15 nt, Homo sapiens
aguaaugcacucuca

SEQ ID NO: 913814 - RNA, 21 nt, Homo sapiens
aguaaugccacacauugugcu

SEQ ID NO: 913815 - RNA, 16 nt, Homo sapiens
aguaauguuaauucuu

SEQ ID NO: 913816 - RNA, 12 nt, Homo sapiens
aguacaaccuga

SEQ ID NO: 913817 - RNA, 21 nt, Homo sapiens
aguacagacgucucaagacug

SEQ ID NO: 913818 - RNA, 22 nt, Homo sapiens
aguacagagaaauucuguggug

SEQ ID NO: 913819 - RNA, 11 nt, Homo sapiens
agugcugccau

SEQ ID NO: 913820 - RNA, 21 nt, Homo sapiens
agugcugggauuacaggugug

SEQ ID NO: 913821 - RNA, 23 nt, Homo sapiens
agugcuugcagaucaucugggga

SEQ ID NO: 913822 - RNA, 16 nt, Homo sapiens
agugcuuuaccuuuaa

SEQ ID NO: 913823 - RNA, 15 nt, Homo sapiens
aguggaauacaguga

SEQ ID NO: 913824 - RNA, 20 nt, Homo sapiens
aguggauuuuccugaauauu

SEQ ID NO: 913825 - RNA, 23 nt, Homo sapiens
aguggcaaccuugucucuaugcc

SEQ ID NO: 913826 - RNA, 19 nt, Homo sapiens
aguggcauuaaacauuuga

SEQ ID NO: 913827 - RNA, 20 nt, Homo sapiens
aguggccaugccacccuguu

SEQ ID NO: 913828 - RNA, 21 nt, Homo sapiens
aguggcuuuuuuccuccugug

SEQ ID NO: 913829 - RNA, 17 nt, Homo sapiens
agugggaacucugacaa

SEQ ID NO: 913830 - RNA, 21 nt, Homo sapiens
aguggggaguagucagaaguu

SEQ ID NO: 913831 - RNA, 20 nt, Homo sapiens
agugggugccccccuugcca

SEQ ID NO: 913832 - RNA, 16 nt, Homo sapiens
agugggugguggaucu

SEQ ID NO: 913833 - RNA, 19 nt, Homo sapiens
agugggugguggaucuguc

SEQ ID NO: 913834 - RNA, 20 nt, Homo sapiens
aguggugcgaucuuggcuca

SEQ ID NO: 913835 - RNA, 14 nt, Homo sapiens
agugguuguugcca

SEQ ID NO: 913836 - RNA, 19 nt, Homo sapiens
aguguaaagaauaaaugaa

SEQ ID NO: 913837 - RNA, 15 nt, Homo sapiens
aguguaauugagaag

SEQ ID NO: 913838 - RNA, 21 nt, Homo sapiens
aguguauuuuauguguggccc

SEQ ID NO: 913839 - RNA, 17 nt, Homo sapiens
aguguccucuugcucaa

SEQ ID NO: 913840 - RNA, 22 nt, Homo sapiens
agugucguuuucauaacuugcu

SEQ ID NO: 913841 - RNA, 23 nt, Homo sapiens
agugugaguggcagccaugccuc

SEQ ID NO: 913842 - RNA, 15 nt, Homo sapiens
agugugcugcaugga

SEQ ID NO: 913843 - RNA, 15 nt, Homo sapiens
aguguggaagcagaa

SEQ ID NO: 913844 - RNA, 22 nt, Homo sapiens
aguguggcccagggaagccaaa

SEQ ID NO: 913845 - RNA, 15 nt, Homo sapiens
agugugucacacuga

SEQ ID NO: 913846 - RNA, 22 nt, Homo sapiens
aguguuaucagucauaacuaaa

SEQ ID NO: 913847 - RNA, 21 nt, Homo sapiens
aguguucauuuuagugacugu

SEQ ID NO: 913848 - RNA, 21 nt, Homo sapiens
aguguugaagaagaguuugca

SEQ ID NO: 913849 - RNA, 12 nt, Homo sapiens
aguguugcuugg

SEQ ID NO: 913850 - RNA, 20 nt, Homo sapiens
aguguuuagaagagccugac

SEQ ID NO: 913851 - RNA, 20 nt, Homo sapiens
aguguuuuuuagauacagag

SEQ ID NO: 913852 - RNA, 16 nt, Homo sapiens
aguuaaaagacugcag

SEQ ID NO: 913853 - RNA, 13 nt, Homo sapiens
aguuaagaaccug

SEQ ID NO: 913854 - RNA, 14 nt, Homo sapiens
aguuaagaaccuga

SEQ ID NO: 913855 - RNA, 22 nt, Homo sapiens
aguuaagaauggaagaaaacgg

SEQ ID NO: 913856 - RNA, 20 nt, Homo sapiens
aguuaaggggagcaacagag

SEQ ID NO: 913857 - RNA, 23 nt, Homo sapiens
aguuacggagggaggacaucaua

SEQ ID NO: 913858 - RNA, 14 nt, Homo sapiens
aguuacuuaccugc

SEQ ID NO: 913859 - RNA, 22 nt, Homo sapiens
aguuagguagcuuuagggcaau

SEQ ID NO: 913860 - RNA, 22 nt, Homo sapiens
aguuauaaaucaaugucacuua

SEQ ID NO: 913861 - RNA, 19 nt, Homo sapiens
aguuauucucuucacuccc

SEQ ID NO: 913862 - RNA, 14 nt, Homo sapiens
aguuauucuugaca

SEQ ID NO: 913863 - RNA, 22 nt, Homo sapiens
aguuauucuugacaugagaaaa

SEQ ID NO: 913864 - RNA, 14 nt, Homo sapiens
aguucaacuuugag

SEQ ID NO: 913865 - RNA, 14 nt, Homo sapiens
aguucagcaaagag

SEQ ID NO: 913866 - RNA, 18 nt, Homo sapiens
aguucauagggucucuuc

SEQ ID NO: 913867 - RNA, 18 nt, Homo sapiens
aguucauggugaucagug

SEQ ID NO: 913868 - RNA, 17 nt, Homo sapiens
aguucccggagcacagc

SEQ ID NO: 913869 - RNA, 19 nt, Homo sapiens
aguuccucagggaguuuga

SEQ ID NO: 913870 - RNA, 13 nt, Homo sapiens
aguuccugcacuc

SEQ ID NO: 913871 - RNA, 18 nt, Homo sapiens
aguuccuugaucuguaua

SEQ ID NO: 913872 - RNA, 23 nt, Homo sapiens
aguucucaucccucugucagggu

SEQ ID NO: 913873 - RNA, 22 nt, Homo sapiens
aguucuggaagggacuuuagag

SEQ ID NO: 913874 - RNA, 20 nt, Homo sapiens
aguucuggugaauguucaau

SEQ ID NO: 913875 - RNA, 17 nt, Homo sapiens
aguucuguuguccauca

SEQ ID NO: 913876 - RNA, 17 nt, Homo sapiens
aguugaacacugucauc

SEQ ID NO: 913877 - RNA, 13 nt, Homo sapiens
aguugaacaucuc

SEQ ID NO: 913878 - RNA, 18 nt, Homo sapiens
aguugaagcuaagauuua

SEQ ID NO: 913879 - RNA, 15 nt, Homo sapiens
aguugacuuacuguu

SEQ ID NO: 913880 - RNA, 20 nt, Homo sapiens
aguugaucuacaaaggccau

SEQ ID NO: 913881 - RNA, 21 nt, Homo sapiens
aguugaugaccaaucucugug

SEQ ID NO: 913882 - RNA, 18 nt, Homo sapiens
aguugcguggacucugca

SEQ ID NO: 913883 - RNA, 20 nt, Homo sapiens
aguugcguggacucugcaca

SEQ ID NO: 913884 - RNA, 21 nt, Homo sapiens
aguugcguggacucugcacau

SEQ ID NO: 913885 - RNA, 13 nt, Homo sapiens
aguuggagaccag

SEQ ID NO: 913886 - RNA, 23 nt, Homo sapiens
aguugugagcacucuacugcaag

SEQ ID NO: 913887 - RNA, 17 nt, Homo sapiens
aucggagacagugaucu

SEQ ID NO: 913888 - RNA, 23 nt, Homo sapiens
aucggaucuggggcucugggaua

SEQ ID NO: 913889 - RNA, 14 nt, Homo sapiens
aucgggccaucuca

SEQ ID NO: 913890 - RNA, 20 nt, Homo sapiens
aucguggugugucaaugcca

SEQ ID NO: 913891 - RNA, 19 nt, Homo sapiens
aucuaaaaagacuaaccug

SEQ ID NO: 913892 - RNA, 18 nt, Homo sapiens
aucuaacuacaaggacaa

SEQ ID NO: 913893 - RNA, 13 nt, Homo sapiens
aucuaauaccauc

SEQ ID NO: 913894 - RNA, 17 nt, Homo sapiens
aucuaaucuaugcaugu

SEQ ID NO: 913895 - RNA, 16 nt, Homo sapiens
aucuaaugugaaguag

SEQ ID NO: 913896 - RNA, 15 nt, Homo sapiens
aucuacaagcauuug

SEQ ID NO: 913897 - RNA, 21 nt, Homo sapiens
aucuaccaucuaaucuaugca

SEQ ID NO: 913898 - RNA, 21 nt, Homo sapiens
aucuacccacuuacuaaccug

SEQ ID NO: 913899 - RNA, 19 nt, Homo sapiens
aucuaccugcccucucuca

SEQ ID NO: 913900 - RNA, 22 nt, Homo sapiens
aucuacuucaacacuucaugua

SEQ ID NO: 913901 - RNA, 23 nt, Homo sapiens
aucuagaggcuuccuucauuucc

SEQ ID NO: 913902 - RNA, 18 nt, Homo sapiens
aucuagaucaauuaauuc

SEQ ID NO: 913903 - RNA, 17 nt, Homo sapiens
aucuagcucuaguucaa

SEQ ID NO: 913904 - RNA, 19 nt, Homo sapiens
aucuaguucucaaucacug

SEQ ID NO: 913905 - RNA, 14 nt, Homo sapiens
aucuaguuuacuuc

SEQ ID NO: 913906 - RNA, 17 nt, Homo sapiens
aucuaucuguauuuuca

SEQ ID NO: 913907 - RNA, 16 nt, Homo sapiens
aucuauuuccuuucca

SEQ ID NO: 913908 - RNA, 22 nt, Homo sapiens
aucucaaauccuugagcacuca

SEQ ID NO: 913909 - RNA, 19 nt, Homo sapiens
aucucacacaccagggcau

SEQ ID NO: 913910 - RNA, 17 nt, Homo sapiens
aucucagagacaggugg

SEQ ID NO: 913911 - RNA, 20 nt, Homo sapiens
aucucaggagcuugcaagaa

SEQ ID NO: 913912 - RNA, 18 nt, Homo sapiens
aucucaggccucccucaa

SEQ ID NO: 913913 - RNA, 18 nt, Homo sapiens
aucucauucagguguucu

SEQ ID NO: 913914 - RNA, 20 nt, Homo sapiens
aucuccacccugagccugac

SEQ ID NO: 913915 - RNA, 22 nt, Homo sapiens
aucuccagugggaacucuucaa

SEQ ID NO: 913916 - RNA, 17 nt, Homo sapiens
aucuccauauguuacac

SEQ ID NO: 913917 - RNA, 14 nt, Homo sapiens
aucuccauuucaca

SEQ ID NO: 913918 - RNA, 22 nt, Homo sapiens
aucucccugccgccucaaugug

SEQ ID NO: 913919 - RNA, 20 nt, Homo sapiens
aucucuaaacugcuguuaau

SEQ ID NO: 913920 - RNA, 18 nt, Homo sapiens
aucucuaauacaguguga

SEQ ID NO: 913921 - RNA, 19 nt, Homo sapiens
aucucuagagugagaaucu

SEQ ID NO: 913922 - RNA, 14 nt, Homo sapiens
aucucucuccugua

SEQ ID NO: 913923 - RNA, 13 nt, Homo sapiens
aucucugucucaa

SEQ ID NO: 913924 - RNA, 20 nt, Homo sapiens
aucucuugucucacaugcua

SEQ ID NO: 913925 - RNA, 16 nt, Homo sapiens
aucugaaccacuuugc

SEQ ID NO: 913926 - RNA, 11 nt, Homo sapiens
aucugaauaua

SEQ ID NO: 913927 - RNA, 20 nt, Homo sapiens
aucugacaucuuauuuacuu

SEQ ID NO: 913928 - RNA, 16 nt, Homo sapiens
aucugacucacaagaa

SEQ ID NO: 913929 - RNA, 18 nt, Homo sapiens
aucugagaaaagcuuuga

SEQ ID NO: 913930 - RNA, 19 nt, Homo sapiens
aucugagagauuugaauag

SEQ ID NO: 913931 - RNA, 20 nt, Homo sapiens
aucugaggaaggugcuugcc

SEQ ID NO: 913932 - RNA, 20 nt, Homo sapiens
aucugaguugacuugacaga

SEQ ID NO: 913933 - RNA, 20 nt, Homo sapiens
aucugauuuccuaaugucag

SEQ ID NO: 913934 - RNA, 15 nt, Homo sapiens
aucugccucuauuca

SEQ ID NO: 913935 - RNA, 16 nt, Homo sapiens
aucugccucuauucaa

SEQ ID NO: 913936 - RNA, 16 nt, Homo sapiens
aucugccuuagacaaa

SEQ ID NO: 913937 - RNA, 19 nt, Homo sapiens
aucugcuccucccauuccc

SEQ ID NO: 913938 - RNA, 13 nt, Homo sapiens
aucuggaauuuaa

SEQ ID NO: 913939 - RNA, 13 nt, Homo sapiens
aucuguaaggaac

SEQ ID NO: 913940 - RNA, 11 nt, Homo sapiens
aucuguacaau

SEQ ID NO: 913941 - RNA, 14 nt, Homo sapiens
aucuguagucuuuu

SEQ ID NO: 913942 - RNA, 16 nt, Homo sapiens
aucuguauauacaaua

SEQ ID NO: 913943 - RNA, 18 nt, Homo sapiens
aucuguaugucugccuaa

SEQ ID NO: 913944 - RNA, 16 nt, Homo sapiens
aucuguauuuuuuaca

SEQ ID NO: 913945 - RNA, 16 nt, Homo sapiens
aucugugucucuggaa

SEQ ID NO: 913946 - RNA, 22 nt, Homo sapiens
aucugugucucuggaacccagg

SEQ ID NO: 913947 - RNA, 14 nt, Homo sapiens
aucuguucugggug

SEQ ID NO: 913948 - RNA, 16 nt, Homo sapiens
aucuguuuuucaugua

SEQ ID NO: 913949 - RNA, 19 nt, Homo sapiens
aucuuacaaaaacaagaca

SEQ ID NO: 913950 - RNA, 22 nt, Homo sapiens
aucuuacagguaucaggcacag

SEQ ID NO: 913951 - RNA, 12 nt, Homo sapiens
aucuuacuuugu

SEQ ID NO: 913952 - RNA, 23 nt, Homo sapiens
aucuuagcuucuauuauagccac

SEQ ID NO: 913953 - RNA, 17 nt, Homo sapiens
aucuuagcuuuccacag

SEQ ID NO: 913954 - RNA, 20 nt, Homo sapiens
aucuuagcuuuccacaggag

SEQ ID NO: 913955 - RNA, 13 nt, Homo sapiens
aucuuauguuaaa

SEQ ID NO: 913956 - RNA, 22 nt, Homo sapiens
aucuucaaacauguacaaaauc

SEQ ID NO: 913957 - RNA, 19 nt, Homo sapiens
aucuucaaagcuugaagau

SEQ ID NO: 913958 - RNA, 19 nt, Homo sapiens
aucuucauacaaugacaag

SEQ ID NO: 913959 - RNA, 20 nt, Homo sapiens
aucuucauacaaugacaagu

SEQ ID NO: 913960 - RNA, 14 nt, Homo sapiens
aucuuccaaagaca

SEQ ID NO: 913961 - RNA, 18 nt, Homo sapiens
aucuuccugccucaggcu

SEQ ID NO: 913962 - RNA, 15 nt, Homo sapiens
aucuuccugcugcug

SEQ ID NO: 913963 - RNA, 21 nt, Homo sapiens
aucuuuaaaauacacacucaa

SEQ ID NO: 913964 - RNA, 19 nt, Homo sapiens
aucuuuccuugucucucau

SEQ ID NO: 913965 - RNA, 14 nt, Homo sapiens
aucuuuuuccuccc

SEQ ID NO: 913966 - RNA, 20 nt, Homo sapiens
augaaaaaaaguacauguau

SEQ ID NO: 913967 - RNA, 18 nt, Homo sapiens
augaaaaagauauaugaa

SEQ ID NO: 913968 - RNA, 19 nt, Homo sapiens
augaaaauaagugaauaau

SEQ ID NO: 913969 - RNA, 12 nt, Homo sapiens
augaaaccaaag

SEQ ID NO: 913970 - RNA, 13 nt, Homo sapiens
augaaaccaaagc

SEQ ID NO: 913971 - RNA, 16 nt, Homo sapiens
augaaaccagaaggau

SEQ ID NO: 913972 - RNA, 19 nt, Homo sapiens
augaaagacuuacaggccu

SEQ ID NO: 913973 - RNA, 21 nt, Homo sapiens
augaaaugucuggucugucca

SEQ ID NO: 913974 - RNA, 20 nt, Homo sapiens
augaaauucuugaaguucau

SEQ ID NO: 913975 - RNA, 20 nt, Homo sapiens
augaaauuguaaaaccuguc

SEQ ID NO: 913976 - RNA, 18 nt, Homo sapiens
augaacacagcugcugaa

SEQ ID NO: 913977 - RNA, 23 nt, Homo sapiens
augaacgauauguagcagaaagg

SEQ ID NO: 913978 - RNA, 21 nt, Homo sapiens
augaacuauuuacauuuucca

SEQ ID NO: 913979 - RNA, 12 nt, Homo sapiens
augaacugugac

SEQ ID NO: 913980 - RNA, 12 nt, Homo sapiens
augaacuuucuc

SEQ ID NO: 913981 - RNA, 16 nt, Homo sapiens
augaagacccagugua

SEQ ID NO: 913982 - RNA, 17 nt, Homo sapiens
augaagacccaguguaa

SEQ ID NO: 913983 - RNA, 19 nt, Homo sapiens
augaagagaagcugagaag

SEQ ID NO: 913984 - RNA, 15 nt, Homo sapiens
augaagagacucucu

SEQ ID NO: 913985 - RNA, 13 nt, Homo sapiens
auggaguuucccu

SEQ ID NO: 913986 - RNA, 12 nt, Homo sapiens
auggaugcacac

SEQ ID NO: 913987 - RNA, 19 nt, Homo sapiens
auggaugcacgcacaugcc

SEQ ID NO: 913988 - RNA, 17 nt, Homo sapiens
auggauguuugucaaaa

SEQ ID NO: 913989 - RNA, 17 nt, Homo sapiens
auggcacauggcuggca

SEQ ID NO: 913990 - RNA, 21 nt, Homo sapiens
auggcacauggcuggcacuga

SEQ ID NO: 913991 - RNA, 15 nt, Homo sapiens
auggcaccuuuugca

SEQ ID NO: 913992 - RNA, 16 nt, Homo sapiens
auggcaccuuuugcac

SEQ ID NO: 913993 - RNA, 21 nt, Homo sapiens
auggcacucuucccaccucag

SEQ ID NO: 913994 - RNA, 21 nt, Homo sapiens
auggcacugcuuuucugagga

SEQ ID NO: 913995 - RNA, 13 nt, Homo sapiens
auggcauccugca

SEQ ID NO: 913996 - RNA, 14 nt, Homo sapiens
auggcauugaacug

SEQ ID NO: 913997 - RNA, 22 nt, Homo sapiens
auggccauagcuuuuauucauu

SEQ ID NO: 913998 - RNA, 20 nt, Homo sapiens
auggcccugggagagccaga

SEQ ID NO: 913999 - RNA, 22 nt, Homo sapiens
auggccuggggaagcugugaaa

SEQ ID NO: 914000 - RNA, 17 nt, Homo sapiens
gaagcucacccaauaaa

SEQ ID NO: 914001 - RNA, 14 nt, Homo sapiens
gaagcuccacuguc

SEQ ID NO: 914002 - RNA, 16 nt, Homo sapiens
gaagcucugaagucac

SEQ ID NO: 914003 - RNA, 12 nt, Homo sapiens
gaagcugugaaa

SEQ ID NO: 914004 - RNA, 17 nt, Homo sapiens
gaagcuucaugccaggu

SEQ ID NO: 914005 - RNA, 15 nt, Homo sapiens
gaagcuuccauucca

SEQ ID NO: 914006 - RNA, 13 nt, Homo sapiens
gaaggaagugaag

SEQ ID NO: 914007 - RNA, 16 nt, Homo sapiens
gaaggagaucagggca

SEQ ID NO: 914008 - RNA, 23 nt, Homo sapiens
gaaggaugucccggguguguaca

SEQ ID NO: 914009 - RNA, 20 nt, Homo sapiens
gaaggcaaagccccuggaaa

SEQ ID NO: 914010 - RNA, 13 nt, Homo sapiens
gaaggccacuggu

SEQ ID NO: 914011 - RNA, 17 nt, Homo sapiens
gaaggcccacugaggca

SEQ ID NO: 914012 - RNA, 14 nt, Homo sapiens
gaaggccuuuucac

SEQ ID NO: 914013 - RNA, 13 nt, Homo sapiens
gaaggcgugcaag

SEQ ID NO: 914014 - RNA, 16 nt, Homo sapiens
gaagggugacauccca

SEQ ID NO: 914015 - RNA, 15 nt, Homo sapiens
gaaggucuugccuga

SEQ ID NO: 914016 - RNA, 17 nt, Homo sapiens
gaagguuggaccuucau

SEQ ID NO: 914017 - RNA, 15 nt, Homo sapiens
gaaguaugagggaaa

SEQ ID NO: 914018 - RNA, 22 nt, Homo sapiens
gaaguaugagggaaaaugagua

SEQ ID NO: 914019 - RNA, 16 nt, Homo sapiens
gaagucacugcacagu

SEQ ID NO: 914020 - RNA, 21 nt, Homo sapiens
gaagucaucagcuuugugcca

SEQ ID NO: 914021 - RNA, 15 nt, Homo sapiens
gaagucguuucagga

SEQ ID NO: 914022 - RNA, 15 nt, Homo sapiens
gaagucuacuuuguc

SEQ ID NO: 914023 - RNA, 11 nt, Homo sapiens
gaagugcuugc

SEQ ID NO: 914024 - RNA, 18 nt, Homo sapiens
gaagugguaggaaagccu

SEQ ID NO: 914025 - RNA, 11 nt, Homo sapiens
gaaguguaauu

SEQ ID NO: 914026 - RNA, 18 nt, Homo sapiens
gaaguuaagcagccuuuc

SEQ ID NO: 914027 - RNA, 17 nt, Homo sapiens
gaaguucuuuuacugua

SEQ ID NO: 914028 - RNA, 18 nt, Homo sapiens
gaauaaaauuguaaaauu

SEQ ID NO: 914029 - RNA, 16 nt, Homo sapiens
gaauaaacaggaaaau

SEQ ID NO: 914030 - RNA, 14 nt, Homo sapiens
gaauaaagcccuug

SEQ ID NO: 914031 - RNA, 17 nt, Homo sapiens
gaauaaauugcuccuug

SEQ ID NO: 914032 - RNA, 20 nt, Homo sapiens
gaauaacaugauacuauuca

SEQ ID NO: 914033 - RNA, 15 nt, Homo sapiens
gaauaaccacuuaaa

SEQ ID NO: 914034 - RNA, 17 nt, Homo sapiens
gaauaagaaaacaauca

SEQ ID NO: 914035 - RNA, 16 nt, Homo sapiens
gaauaagaauggagca

SEQ ID NO: 914036 - RNA, 12 nt, Homo sapiens
gaauaaggagcc

SEQ ID NO: 914037 - RNA, 14 nt, Homo sapiens
gaauaauaccuaag

SEQ ID NO: 914038 - RNA, 12 nt, Homo sapiens
gaauacaguaag

SEQ ID NO: 914039 - RNA, 14 nt, Homo sapiens
gaauaccaguguua

SEQ ID NO: 914040 - RNA, 15 nt, Homo sapiens
gaauaccuucuucgc

SEQ ID NO: 914041 - RNA, 12 nt, Homo sapiens
gaauacuuggaa

SEQ ID NO: 914042 - RNA, 15 nt, Homo sapiens
gaauagaugcugacu

SEQ ID NO: 914043 - RNA, 23 nt, Homo sapiens
gaauauauggucugugugucuga

SEQ ID NO: 914044 - RNA, 22 nt, Homo sapiens
gaauauauuugugugugugaua

SEQ ID NO: 914045 - RNA, 20 nt, Homo sapiens
gaauaucauuaaauuggaau

SEQ ID NO: 914046 - RNA, 19 nt, Homo sapiens
gaauaucgagaacugccau

SEQ ID NO: 914047 - RNA, 14 nt, Homo sapiens
gaauauguucacau

SEQ ID NO: 914048 - RNA, 13 nt, Homo sapiens
gaauauuguuaaa

SEQ ID NO: 914049 - RNA, 21 nt, Homo sapiens
gaauauuuauuaccucugaua

SEQ ID NO: 914050 - RNA, 22 nt, Homo sapiens
gaaucaaagcaguuaacuuuaa

SEQ ID NO: 914051 - RNA, 15 nt, Homo sapiens
gaaucacuugaacuc

SEQ ID NO: 914052 - RNA, 16 nt, Homo sapiens
gaaucacuugcacucc

SEQ ID NO: 914053 - RNA, 18 nt, Homo sapiens
gaaucagacuucacacug

SEQ ID NO: 914054 - RNA, 20 nt, Homo sapiens
gaaucagugaagaugccagu

SEQ ID NO: 914055 - RNA, 19 nt, Homo sapiens
gaaucaucucaaauccuug

SEQ ID NO: 914056 - RNA, 21 nt, Homo sapiens
gaauccaucaggacuugggaa

SEQ ID NO: 914057 - RNA, 17 nt, Homo sapiens
gaaucccggcugucaag

SEQ ID NO: 914058 - RNA, 16 nt, Homo sapiens
gaaucccuuaaacuca

SEQ ID NO: 914059 - RNA, 14 nt, Homo sapiens
gaauccuacagccu

SEQ ID NO: 914060 - RNA, 19 nt, Homo sapiens
gaaucuacaaaaaacaaca

SEQ ID NO: 914061 - RNA, 18 nt, Homo sapiens
gaaucuccccuccucaca

SEQ ID NO: 914062 - RNA, 16 nt, Homo sapiens
gaaucuguaucagaaa

SEQ ID NO: 914063 - RNA, 17 nt, Homo sapiens
gaaugacucugacuuug

SEQ ID NO: 914064 - RNA, 14 nt, Homo sapiens
gaaugagaagaaug

SEQ ID NO: 914065 - RNA, 12 nt, Homo sapiens
gaaugauggacu

SEQ ID NO: 914066 - RNA, 21 nt, Homo sapiens
caagucgagagggcuguugga

SEQ ID NO: 914067 - RNA, 12 nt, Homo sapiens
caagucuucccu

SEQ ID NO: 914068 - RNA, 22 nt, Homo sapiens
caagugaagaaaagugaaugcu

SEQ ID NO: 914069 - RNA, 16 nt, Homo sapiens
caagugaaggagccag

SEQ ID NO: 914070 - RNA, 18 nt, Homo sapiens
caagugaauuugccugua

SEQ ID NO: 914071 - RNA, 15 nt, Homo sapiens
caagugacaugccau

SEQ ID NO: 914072 - RNA, 15 nt, Homo sapiens
caagugagacaauca

SEQ ID NO: 914073 - RNA, 17 nt, Homo sapiens
caagugauaucaccucu

SEQ ID NO: 914074 - RNA, 15 nt, Homo sapiens
caagugcacuugaac

SEQ ID NO: 914075 - RNA, 22 nt, Homo sapiens
caagugccucuuguugcagaga

SEQ ID NO: 914076 - RNA, 20 nt, Homo sapiens
caaguguaaccuugcaucuc

SEQ ID NO: 914077 - RNA, 21 nt, Homo sapiens
caaguguguugggaauugcau

SEQ ID NO: 914078 - RNA, 17 nt, Homo sapiens
caaguuauagauucaau

SEQ ID NO: 914079 - RNA, 17 nt, Homo sapiens
caaguuauuaaucuuau

SEQ ID NO: 914080 - RNA, 20 nt, Homo sapiens
caaguuccugcacuccagaa

SEQ ID NO: 914081 - RNA, 19 nt, Homo sapiens
caaguucuggaaaccacgu

SEQ ID NO: 914082 - RNA, 19 nt, Homo sapiens
caaguuucccaaauucccu

SEQ ID NO: 914083 - RNA, 16 nt, Homo sapiens
caaguuucuaaauuga

SEQ ID NO: 914084 - RNA, 18 nt, Homo sapiens
caaguuucuagcuagaaa

SEQ ID NO: 914085 - RNA, 14 nt, Homo sapiens
caaguuuuaagaga

SEQ ID NO: 914086 - RNA, 12 nt, Homo sapiens
caaguuuuuaca

SEQ ID NO: 914087 - RNA, 14 nt, Homo sapiens
caaguuuuucuaac

SEQ ID NO: 914088 - RNA, 14 nt, Homo sapiens
caauaaaacauucc

SEQ ID NO: 914089 - RNA, 14 nt, Homo sapiens
caauaaagacugag

SEQ ID NO: 914090 - RNA, 18 nt, Homo sapiens
caauaaaucaacuccagc

SEQ ID NO: 914091 - RNA, 13 nt, Homo sapiens
caauaacagguca

SEQ ID NO: 914092 - RNA, 16 nt, Homo sapiens
caauaauaaauccuca

SEQ ID NO: 914093 - RNA, 13 nt, Homo sapiens
caauaaugugcaa

SEQ ID NO: 914094 - RNA, 15 nt, Homo sapiens
caauacaugcugcua

SEQ ID NO: 914095 - RNA, 16 nt, Homo sapiens
caauacaugcugcuaa

SEQ ID NO: 914096 - RNA, 19 nt, Homo sapiens
caauaccccuguuaagcaa

SEQ ID NO: 914097 - RNA, 15 nt, Homo sapiens
caauacucaaaagag

SEQ ID NO: 914098 - RNA, 12 nt, Homo sapiens
caauacugccuu

SEQ ID NO: 914099 - RNA, 23 nt, Homo sapiens
caauagacuguacuuauuuucca

SEQ ID NO: 914100 - RNA, 14 nt, Homo sapiens
caauaguuugcaua

SEQ ID NO: 914101 - RNA, 18 nt, Homo sapiens
caauaugaugacucccuu

SEQ ID NO: 914102 - RNA, 16 nt, Homo sapiens
caauauuaaauacaga

SEQ ID NO: 914103 - RNA, 21 nt, Homo sapiens
caauauuaaauacagacacua

SEQ ID NO: 914104 - RNA, 13 nt, Homo sapiens
caauauugccaug

SEQ ID NO: 914105 - RNA, 19 nt, Homo sapiens
caauauugccaugguuuua

SEQ ID NO: 914106 - RNA, 17 nt, Homo sapiens
caaucagugcagugaua

SEQ ID NO: 914107 - RNA, 17 nt, Homo sapiens
caaucaugaguaccuca

SEQ ID NO: 914108 - RNA, 21 nt, Homo sapiens
caauccaggugggagagacac

SEQ ID NO: 914109 - RNA, 21 nt, Homo sapiens
caauccuagaaccaagcuuca

SEQ ID NO: 914110 - RNA, 22 nt, Homo sapiens
caauccuuaacauauuugcaca

SEQ ID NO: 914111 - RNA, 16 nt, Homo sapiens
caaucugccuaggguc

SEQ ID NO: 914112 - RNA, 17 nt, Homo sapiens
caaucuguucaauguuu

SEQ ID NO: 914113 - RNA, 19 nt, Homo sapiens
caaucuucggggugugaug

SEQ ID NO: 914114 - RNA, 18 nt, Homo sapiens
caaugaaaccaaagccag

SEQ ID NO: 914115 - RNA, 14 nt, Homo sapiens
caaugaugauuaaa

SEQ ID NO: 914116 - RNA, 17 nt, Homo sapiens
caaugcacacacacaga

SEQ ID NO: 914117 - RNA, 19 nt, Homo sapiens
caaugcacauccauuccca

SEQ ID NO: 914118 - RNA, 13 nt, Homo sapiens
caaugcagaauuu

SEQ ID NO: 914119 - RNA, 9 nt, Homo sapiens
caaugccau

SEQ ID NO: 914120 - RNA, 14 nt, Homo sapiens
caaugcgcacacac

SEQ ID NO: 914121 - RNA, 21 nt, Homo sapiens
caauggagugggagaucagcc

SEQ ID NO: 914122 - RNA, 20 nt, Homo sapiens
caaugggagggggcuccaug

SEQ ID NO: 914123 - RNA, 16 nt, Homo sapiens
caaugggcacugggau

SEQ ID NO: 914124 - RNA, 20 nt, Homo sapiens
caauguauuugucaaugcau

SEQ ID NO: 914125 - RNA, 21 nt, Homo sapiens
caauguauuugucaaugcauc

SEQ ID NO: 914126 - RNA, 19 nt, Homo sapiens
caauguuuuuaaaaaucug

SEQ ID NO: 914127 - RNA, 21 nt, Homo sapiens
caauuaugugacaaccuuugu

SEQ ID NO: 914128 - RNA, 16 nt, Homo sapiens
caauuauuacauuuau

SEQ ID NO: 914129 - RNA, 23 nt, Homo sapiens
caauucacuagaccagaagugga

SEQ ID NO: 914130 - RNA, 12 nt, Homo sapiens
caauucauuuca

SEQ ID NO: 914131 - RNA, 15 nt, Homo sapiens
caauuccucugggaa

SEQ ID NO: 914132 - RNA, 20 nt, Homo sapiens
caauucuaacuuuuuugcua

SEQ ID NO: 914133 - RNA, 19 nt, Homo sapiens
caauucuccuguugcaaug

SEQ ID NO: 914134 - RNA, 15 nt, Homo sapiens
caauucuguauagau

SEQ ID NO: 914135 - RNA, 14 nt, Homo sapiens
caauugauacuuca

SEQ ID NO: 914136 - RNA, 21 nt, Homo sapiens
caauugcggggcccaccuuag

SEQ ID NO: 914137 - RNA, 21 nt, Homo sapiens
caauugucugccucagccucc

SEQ ID NO: 914138 - RNA, 13 nt, Homo sapiens
caauuugccuuuu

SEQ ID NO: 914139 - RNA, 13 nt, Homo sapiens
caauuugcugcca

SEQ ID NO: 914140 - RNA, 19 nt, Homo sapiens
caauuuguaauugcuuaca

SEQ ID NO: 914141 - RNA, 16 nt, Homo sapiens
caauuuguauaucaug

SEQ ID NO: 914142 - RNA, 17 nt, Homo sapiens
caauuuuauagcacaaa

SEQ ID NO: 914143 - RNA, 15 nt, Homo sapiens
caauuuuuauacaua

SEQ ID NO: 914144 - RNA, 14 nt, Homo sapiens
caauuuuugaacaa

SEQ ID NO: 914145 - RNA, 16 nt, Homo sapiens
caauuuuuugcuaaac

SEQ ID NO: 914146 - RNA, 18 nt, Homo sapiens
cacaaagcccuuccaugu

SEQ ID NO: 914147 - RNA, 23 nt, Homo sapiens
cacaaaucaaagcaagggcucca

SEQ ID NO: 914148 - RNA, 11 nt, Homo sapiens
cacaacauuua

SEQ ID NO: 914149 - RNA, 13 nt, Homo sapiens
cacaacugacaca

SEQ ID NO: 914150 - RNA, 13 nt, Homo sapiens
cacaagaagacca

SEQ ID NO: 914151 - RNA, 20 nt, Homo sapiens
cacaagaagaccagacugug

SEQ ID NO: 914152 - RNA, 19 nt, Homo sapiens
cacaagaggaauaagaaug

SEQ ID NO: 914153 - RNA, 19 nt, Homo sapiens
cacaagaugcugcaaugug

SEQ ID NO: 914154 - RNA, 12 nt, Homo sapiens
cacaagcacuuu

SEQ ID NO: 914155 - RNA, 18 nt, Homo sapiens
cacaagccacagaagcca

SEQ ID NO: 914156 - RNA, 15 nt, Homo sapiens
cacaaguccugugaa

SEQ ID NO: 914157 - RNA, 19 nt, Homo sapiens
cacaauaauuuucuaccug

SEQ ID NO: 914158 - RNA, 20 nt, Homo sapiens
cacaauagcaguugaaacaa

SEQ ID NO: 914159 - RNA, 13 nt, Homo sapiens
cacaauaugaaua

SEQ ID NO: 914160 - RNA, 16 nt, Homo sapiens
cacaauuccauuucca

SEQ ID NO: 914161 - RNA, 21 nt, Homo sapiens
cacaauuccauuuccaguuca

SEQ ID NO: 914162 - RNA, 15 nt, Homo sapiens
cacacaaaaugucac

SEQ ID NO: 914163 - RNA, 15 nt, Homo sapiens
cacacaacagcagau

SEQ ID NO: 914164 - RNA, 14 nt, Homo sapiens
cacacacacagaga

SEQ ID NO: 914165 - RNA, 15 nt, Homo sapiens
cacacacacagagau

SEQ ID NO: 914166 - RNA, 13 nt, Homo sapiens
cacacacagaugc

SEQ ID NO: 914167 - RNA, 17 nt, Homo sapiens
cacacaccgauguacac

SEQ ID NO: 914168 - RNA, 17 nt, Homo sapiens
cacacagagauaugcac

SEQ ID NO: 914169 - RNA, 18 nt, Homo sapiens
cacacagauggucacaca

SEQ ID NO: 914170 - RNA, 15 nt, Homo sapiens
cacacagcccauaaa

SEQ ID NO: 914171 - RNA, 11 nt, Homo sapiens
cacacauauac

SEQ ID NO: 914172 - RNA, 17 nt, Homo sapiens
cacacauggaugagcac

SEQ ID NO: 914173 - RNA, 14 nt, Homo sapiens
cacacauugugcuu

SEQ ID NO: 914174 - RNA, 15 nt, Homo sapiens
cacaccaaugcgcac

SEQ ID NO: 914175 - RNA, 18 nt, Homo sapiens
cacaccaaugcgcacaca

SEQ ID NO: 914176 - RNA, 22 nt, Homo sapiens
cacacccagcccacuucugcca

SEQ ID NO: 914177 - RNA, 20 nt, Homo sapiens
cacaccccucaaaaaaagcc

SEQ ID NO: 914178 - RNA, 15 nt, Homo sapiens
cacaccgaugcacac

SEQ ID NO: 914179 - RNA, 15 nt, Homo sapiens
cacaccgaugugcgc

SEQ ID NO: 914180 - RNA, 22 nt, Homo sapiens
cacaccuuauauuuacguauga

SEQ ID NO: 914181 - RNA, 17 nt, Homo sapiens
cacacgccaaugcacac

SEQ ID NO: 914182 - RNA, 20 nt, Homo sapiens
gaaugauuuagguacgucaa

SEQ ID NO: 914183 - RNA, 13 nt, Homo sapiens
gaaugcagggaag

SEQ ID NO: 914184 - RNA, 14 nt, Homo sapiens
gaaugccacaguga

SEQ ID NO: 914185 - RNA, 24 nt, Homo sapiens
gaaugcuuaccaaguccugggaau

SEQ ID NO: 914186 - RNA, 18 nt, Homo sapiens
gaaugcuuaccugugaga

SEQ ID NO: 914187 - RNA, 14 nt, Homo sapiens
gaaugucaguucau

SEQ ID NO: 914188 - RNA, 15 nt, Homo sapiens
gaaugugauauuuga

SEQ ID NO: 914189 - RNA, 17 nt, Homo sapiens
gaaugugauauuugaag

SEQ ID NO: 914190 - RNA, 21 nt, Homo sapiens
gaaugugucugcguuccuguu

SEQ ID NO: 914191 - RNA, 23 nt, Homo sapiens
gaauguucccugcacccuggaaa

SEQ ID NO: 914192 - RNA, 16 nt, Homo sapiens
gaauuaggaagaccaa

SEQ ID NO: 914193 - RNA, 13 nt, Homo sapiens
gaauucuugaguu

SEQ ID NO: 914194 - RNA, 22 nt, Homo sapiens
gaauugaaggagaaaaugcauu

SEQ ID NO: 914195 - RNA, 21 nt, Homo sapiens
gaauugagauaauaucuguga

SEQ ID NO: 914196 - RNA, 18 nt, Homo sapiens
gaauugcaugccaucucc

SEQ ID NO: 914197 - RNA, 23 nt, Homo sapiens
gaauuggccucaguguaguuaaa

SEQ ID NO: 914198 - RNA, 23 nt, Homo sapiens
gaauuguuuccuuauuugcacuu

SEQ ID NO: 914199 - RNA, 15 nt, Homo sapiens
gaauuuaaaaucaua

SEQ ID NO: 914200 - RNA, 19 nt, Homo sapiens
gaauuugggccucuuguac

SEQ ID NO: 914201 - RNA, 14 nt, Homo sapiens
gaauuugguaaauu

SEQ ID NO: 914202 - RNA, 14 nt, Homo sapiens
gaauuuucuuccaa

SEQ ID NO: 914203 - RNA, 18 nt, Homo sapiens
gaauuuuguuuguugaug

SEQ ID NO: 914204 - RNA, 19 nt, Homo sapiens
gaauuuuuuuuaacauucc

SEQ ID NO: 914205 - RNA, 13 nt, Homo sapiens
gacaaaccagagc

SEQ ID NO: 914206 - RNA, 14 nt, Homo sapiens
gacaaaccagagca

SEQ ID NO: 914207 - RNA, 21 nt, Homo sapiens
gacaaaccagagcagagagca

SEQ ID NO: 914208 - RNA, 17 nt, Homo sapiens
gacaaagaaacccaagu

SEQ ID NO: 914209 - RNA, 15 nt, Homo sapiens
gacaaaggagccugu

SEQ ID NO: 914210 - RNA, 16 nt, Homo sapiens
gacaaauaauaagcaa

SEQ ID NO: 914211 - RNA, 16 nt, Homo sapiens
gacaacugacaauaug

SEQ ID NO: 914212 - RNA, 17 nt, Homo sapiens
gacaacugacaauauga

SEQ ID NO: 914213 - RNA, 19 nt, Homo sapiens
gacaagcaagggcugugcu

SEQ ID NO: 914214 - RNA, 22 nt, Homo sapiens
gacaagccaacuuguaaauaca

SEQ ID NO: 914215 - RNA, 20 nt, Homo sapiens
gacaauaggccauguuaauu

SEQ ID NO: 914216 - RNA, 22 nt, Homo sapiens
gacaauccugaagaaaccacag

SEQ ID NO: 914217 - RNA, 21 nt, Homo sapiens
gacaaugucacauaaugaaug

SEQ ID NO: 914218 - RNA, 20 nt, Homo sapiens
gacaauuugcugccaaacac

SEQ ID NO: 914219 - RNA, 16 nt, Homo sapiens
gacacaggcccggcuc

SEQ ID NO: 914220 - RNA, 15 nt, Homo sapiens
gacacaggugccuca

SEQ ID NO: 914221 - RNA, 12 nt, Homo sapiens
gacaccaccauc

SEQ ID NO: 914222 - RNA, 20 nt, Homo sapiens
gacaccucaaauacauaccu

SEQ ID NO: 914223 - RNA, 14 nt, Homo sapiens
gacaccucacugag

SEQ ID NO: 914224 - RNA, 21 nt, Homo sapiens
gacaccuccauuucucuccag

SEQ ID NO: 914225 - RNA, 14 nt, Homo sapiens
gacaccugccuuaa

SEQ ID NO: 914226 - RNA, 22 nt, Homo sapiens
gacaccuggauugcagacucau

SEQ ID NO: 914227 - RNA, 21 nt, Homo sapiens
gacacuauuuaucugugcaaa

SEQ ID NO: 914228 - RNA, 15 nt, Homo sapiens
gacacugcaaaggcg

SEQ ID NO: 914229 - RNA, 17 nt, Homo sapiens
gacagaagaucuauauu

SEQ ID NO: 914230 - RNA, 23 nt, Homo sapiens
gacagacauuuucaauaauguga

SEQ ID NO: 914231 - RNA, 17 nt, Homo sapiens
gacuucugucuucacaa

SEQ ID NO: 914232 - RNA, 20 nt, Homo sapiens
gacuuggucugauuucagga

SEQ ID NO: 914233 - RNA, 18 nt, Homo sapiens
gacuuugaugcauuucca

SEQ ID NO: 914234 - RNA, 22 nt, Homo sapiens
gagaaaagaaaccagagucaaa

SEQ ID NO: 914235 - RNA, 12 nt, Homo sapiens
gagaaacaggcc

SEQ ID NO: 914236 - RNA, 17 nt, Homo sapiens
gagaaaguucucauuua

SEQ ID NO: 914237 - RNA, 17 nt, Homo sapiens
gagaacccuuccuuucc

SEQ ID NO: 914238 - RNA, 21 nt, Homo sapiens
gagaaccuggccuucagugua

SEQ ID NO: 914239 - RNA, 14 nt, Homo sapiens
gagaagaaauccau

SEQ ID NO: 914240 - RNA, 22 nt, Homo sapiens
gagaagaagaaaaucaaccagc

SEQ ID NO: 914241 - RNA, 23 nt, Homo sapiens
gagaagaagaaaaucaaccagca

SEQ ID NO: 914242 - RNA, 16 nt, Homo sapiens
gagaagaccucuguga

SEQ ID NO: 914243 - RNA, 22 nt, Homo sapiens
gagaagccggcucuucaaagac

SEQ ID NO: 914244 - RNA, 14 nt, Homo sapiens
gagaagcucaccca

SEQ ID NO: 914245 - RNA, 17 nt, Homo sapiens
gagaaucacuugaacuc

SEQ ID NO: 914246 - RNA, 17 nt, Homo sapiens
gagaaugcccaacucuu

SEQ ID NO: 914247 - RNA, 22 nt, Homo sapiens
gagaauggggguggggaggcaa

SEQ ID NO: 914248 - RNA, 17 nt, Homo sapiens
gagaauuauuccuuucc

SEQ ID NO: 914249 - RNA, 21 nt, Homo sapiens
gagacaaaaucuuaaaugcca

SEQ ID NO: 914250 - RNA, 20 nt, Homo sapiens
gagacagcgaacuagaagaa

SEQ ID NO: 914251 - RNA, 12 nt, Homo sapiens
gagacaggguuu

SEQ ID NO: 914252 - RNA, 14 nt, Homo sapiens
gagacaguucaaga

SEQ ID NO: 914253 - RNA, 19 nt, Homo sapiens
gagacauacaccuauguca

SEQ ID NO: 914254 - RNA, 22 nt, Homo sapiens
gagaccaaaggauccagagacu

SEQ ID NO: 914255 - RNA, 19 nt, Homo sapiens
gagacccagagagcuaggg

SEQ ID NO: 914256 - RNA, 20 nt, Homo sapiens
gagaccccuuccuuuccucu

SEQ ID NO: 914257 - RNA, 22 nt, Homo sapiens
gagaccuuguuucaaucuuugc

SEQ ID NO: 914258 - RNA, 23 nt, Homo sapiens
gagacgcagcccugggggccagc

SEQ ID NO: 914259 - RNA, 15 nt, Homo sapiens
gagacggccaaguga

SEQ ID NO: 914260 - RNA, 16 nt, Homo sapiens
gagacggccaagugaa

SEQ ID NO: 914261 - RNA, 17 nt, Homo sapiens
gagacuauaacugucau

SEQ ID NO: 914262 - RNA, 16 nt, Homo sapiens
gagacuauggagccug

SEQ ID NO: 914263 - RNA, 13 nt, Homo sapiens
gagacuccgucuc

SEQ ID NO: 914264 - RNA, 13 nt, Homo sapiens
gagacucugucuc

SEQ ID NO: 914265 - RNA, 20 nt, Homo sapiens
gagacugacaccucacugag

SEQ ID NO: 914266 - RNA, 17 nt, Homo sapiens
gagacuggagcaucuga

SEQ ID NO: 914267 - RNA, 14 nt, Homo sapiens
gagagaaaucugaa

SEQ ID NO: 914268 - RNA, 12 nt, Homo sapiens
gagagaacugaa

SEQ ID NO: 914269 - RNA, 13 nt, Homo sapiens
gagagaacuggag

SEQ ID NO: 914270 - RNA, 15 nt, Homo sapiens
gagagacacucccag

SEQ ID NO: 914271 - RNA, 19 nt, Homo sapiens
gagagaggcucagccacac

SEQ ID NO: 914272 - RNA, 16 nt, Homo sapiens
gagagagugcugagaa

SEQ ID NO: 914273 - RNA, 22 nt, Homo sapiens
gagagaucauagcucacuguaa

SEQ ID NO: 914274 - RNA, 13 nt, Homo sapiens
gagagauggaaua

SEQ ID NO: 914275 - RNA, 20 nt, Homo sapiens
gagagauggaauaaagcccu

SEQ ID NO: 914276 - RNA, 20 nt, Homo sapiens
gagagcagcuggcucuccac

SEQ ID NO: 914277 - RNA, 18 nt, Homo sapiens
gagagcucgcucuuggga

SEQ ID NO: 914278 - RNA, 17 nt, Homo sapiens
gagaggaaaaguggaug

SEQ ID NO: 914279 - RNA, 17 nt, Homo sapiens
gagaggaagagcugcaa

SEQ ID NO: 914280 - RNA, 17 nt, Homo sapiens
gagaggaagcucucuuu

SEQ ID NO: 914281 - RNA, 18 nt, Homo sapiens
gagaggaccccacuggac

SEQ ID NO: 914282 - RNA, 14 nt, Homo sapiens
gagaggcaugugau

SEQ ID NO: 914283 - RNA, 18 nt, Homo sapiens
gagagggaagagugcauu

SEQ ID NO: 914284 - RNA, 20 nt, Homo sapiens
gagaguacagugagccaaga

SEQ ID NO: 914285 - RNA, 11 nt, Homo sapiens
gagaguaccau

SEQ ID NO: 914286 - RNA, 19 nt, Homo sapiens
gagaguaguuuuucagcua

SEQ ID NO: 914287 - RNA, 18 nt, Homo sapiens
gagaguauauuauguauu

SEQ ID NO: 914288 - RNA, 14 nt, Homo sapiens
gagagucggccaga

SEQ ID NO: 914289 - RNA, 16 nt, Homo sapiens
gagaguggaacagaag

SEQ ID NO: 914290 - RNA, 16 nt, Homo sapiens
gagaguggcuccuccc

SEQ ID NO: 914291 - RNA, 18 nt, Homo sapiens
gagauaaccacaaccagg

SEQ ID NO: 914292 - RNA, 18 nt, Homo sapiens
gagauaaugucaaaauca

SEQ ID NO: 914293 - RNA, 16 nt, Homo sapiens
gagauacgcaaacaca

SEQ ID NO: 914294 - RNA, 11 nt, Homo sapiens
gagauaugcac

SEQ ID NO: 914295 - RNA, 13 nt, Homo sapiens
gagauauuuacau

SEQ ID NO: 914296 - RNA, 14 nt, Homo sapiens
caccuuauguauua

SEQ ID NO: 914297 - RNA, 18 nt, Homo sapiens
caccuucaagcacccugu

SEQ ID NO: 914298 - RNA, 17 nt, Homo sapiens
caccuucaauacuucau

SEQ ID NO: 914299 - RNA, 17 nt, Homo sapiens
caccuucaccuucaucc

SEQ ID NO: 914300 - RNA, 17 nt, Homo sapiens
caccuugccaagcuuuc

SEQ ID NO: 914301 - RNA, 16 nt, Homo sapiens
caccuugcccuuuacg

SEQ ID NO: 914302 - RNA, 17 nt, Homo sapiens
caccuugcuccuccuuc

SEQ ID NO: 914303 - RNA, 21 nt, Homo sapiens
caccuugcuccuccuucugcu

SEQ ID NO: 914304 - RNA, 15 nt, Homo sapiens
caccuugugucugua

SEQ ID NO: 914305 - RNA, 23 nt, Homo sapiens
caccuuugcaaaguuacagaugc

SEQ ID NO: 914306 - RNA, 21 nt, Homo sapiens
caccuuuggugcagagguuuc

SEQ ID NO: 914307 - RNA, 18 nt, Homo sapiens
caccuuuugcacauaaca

SEQ ID NO: 914308 - RNA, 17 nt, Homo sapiens
cacgacucuuccugcaa

SEQ ID NO: 914309 - RNA, 20 nt, Homo sapiens
cacgagagagggcuuucuca

SEQ ID NO: 914310 - RNA, 17 nt, Homo sapiens
cacgagagagucuucca

SEQ ID NO: 914311 - RNA, 15 nt, Homo sapiens
cacgcaagggcauca

SEQ ID NO: 914312 - RNA, 15 nt, Homo sapiens
cacgccaaugcacac

SEQ ID NO: 914313 - RNA, 13 nt, Homo sapiens
cacgccuguaauc

SEQ ID NO: 914314 - RNA, 22 nt, Homo sapiens
cacgccuguaaucccagcacuu

SEQ ID NO: 914315 - RNA, 16 nt, Homo sapiens
cacgguggcucaggcc

SEQ ID NO: 914316 - RNA, 15 nt, Homo sapiens
cacgugucuauaaug

SEQ ID NO: 914317 - RNA, 15 nt, Homo sapiens
cacgugugcagacug

SEQ ID NO: 914318 - RNA, 22 nt, Homo sapiens
cacuaaagggugcccacaaaau

SEQ ID NO: 914319 - RNA, 18 nt, Homo sapiens
cacuaaggccgugucucu

SEQ ID NO: 914320 - RNA, 11 nt, Homo sapiens
cacuaauuccu

SEQ ID NO: 914321 - RNA, 19 nt, Homo sapiens
cacuaauugacccaaaacg

SEQ ID NO: 914322 - RNA, 22 nt, Homo sapiens
cacuagcauuuucuugaaccaa

SEQ ID NO: 914323 - RNA, 22 nt, Homo sapiens
cacuagccaugauaacugcaau

SEQ ID NO: 914324 - RNA, 17 nt, Homo sapiens
cacuagucacauucuug

SEQ ID NO: 914325 - RNA, 18 nt, Homo sapiens
cacuauguugcccaggcu

SEQ ID NO: 914326 - RNA, 16 nt, Homo sapiens
cacuauuauggaugaa

SEQ ID NO: 914327 - RNA, 19 nt, Homo sapiens
cacuauucuuaacuauuca

SEQ ID NO: 914328 - RNA, 20 nt, Homo sapiens
cacuauuucccucuacugag

SEQ ID NO: 914329 - RNA, 21 nt, Homo sapiens
cacucacauuuauucugcuca

SEQ ID NO: 914330 - RNA, 20 nt, Homo sapiens
cacucagaaaagaaaaccau

SEQ ID NO: 914331 - RNA, 18 nt, Homo sapiens
cacucauuccuucacuca

SEQ ID NO: 914332 - RNA, 19 nt, Homo sapiens
cacuccagaacaaaccucu

SEQ ID NO: 914333 - RNA, 19 nt, Homo sapiens
cacuccucgguacucccau

SEQ ID NO: 914334 - RNA, 17 nt, Homo sapiens
cacucucaaauccugau

SEQ ID NO: 914335 - RNA, 18 nt, Homo sapiens
cacucuccccucccucuu

SEQ ID NO: 914336 - RNA, 19 nt, Homo sapiens
cacucugcaucagcacugc

SEQ ID NO: 914337 - RNA, 22 nt, Homo sapiens
cacucuuaugaaaugggcuuua

SEQ ID NO: 914338 - RNA, 13 nt, Homo sapiens
cacugaaaugcua

SEQ ID NO: 914339 - RNA, 22 nt, Homo sapiens
cacugaaaugcuagcugcaagu

SEQ ID NO: 914340 - RNA, 20 nt, Homo sapiens
cacugaaucuccccuccuca

SEQ ID NO: 914341 - RNA, 17 nt, Homo sapiens
cacugacauuauaucau

SEQ ID NO: 914342 - RNA, 16 nt, Homo sapiens
cacugaccugccugua

SEQ ID NO: 914343 - RNA, 23 nt, Homo sapiens
cacugacuucuaaguaaaaccac

SEQ ID NO: 914344 - RNA, 10 nt, Homo sapiens
cacugagaua

SEQ ID NO: 914345 - RNA, 23 nt, Homo sapiens
ccccuggggcuucuccugaccca

SEQ ID NO: 914346 - RNA, 16 nt, Homo sapiens
ccccugucuucucuca

SEQ ID NO: 914347 - RNA, 23 nt, Homo sapiens
ccccuuauccaggacucugucaa

SEQ ID NO: 914348 - RNA, 14 nt, Homo sapiens
ccccuucuguguca

SEQ ID NO: 914349 - RNA, 22 nt, Homo sapiens
cccgacugugaaaguaugugau

SEQ ID NO: 914350 - RNA, 22 nt, Homo sapiens
cccgccgccuccugcaccgaga

SEQ ID NO: 914351 - RNA, 15 nt, Homo sapiens
cccgcggugcucugg

SEQ ID NO: 914352 - RNA, 17 nt, Homo sapiens
cccggcugucaaggggu

SEQ ID NO: 914353 - RNA, 22 nt, Homo sapiens
cccgggacagggucuugcaagc

SEQ ID NO: 914354 - RNA, 22 nt, Homo sapiens
cccgggagaggagaucagggcg

SEQ ID NO: 914355 - RNA, 22 nt, Homo sapiens
cccggggcuggcggcuacucag

SEQ ID NO: 914356 - RNA, 14 nt, Homo sapiens
cccgucauguuccu

SEQ ID NO: 914357 - RNA, 16 nt, Homo sapiens
cccgucauguuccuca

SEQ ID NO: 914358 - RNA, 22 nt, Homo sapiens
cccgucauguuccucaaaagca

SEQ ID NO: 914359 - RNA, 22 nt, Homo sapiens
cccguggucuccuugcacuuuc

SEQ ID NO: 914360 - RNA, 22 nt, Homo sapiens
cccuaaauguggacaucaugaa

SEQ ID NO: 914361 - RNA, 16 nt, Homo sapiens
cccuauccacccagcc

SEQ ID NO: 914362 - RNA, 17 nt, Homo sapiens
cccuauuaaccuagaga

SEQ ID NO: 914363 - RNA, 22 nt, Homo sapiens
cccuauuggguagaugagggga

SEQ ID NO: 914364 - RNA, 19 nt, Homo sapiens
cccucagagaggcauguga

SEQ ID NO: 914365 - RNA, 19 nt, Homo sapiens
cccucagcacagacucuuu

SEQ ID NO: 914366 - RNA, 13 nt, Homo sapiens
cccuccaauccca

SEQ ID NO: 914367 - RNA, 11 nt, Homo sapiens
cccucccacac

SEQ ID NO: 914368 - RNA, 17 nt, Homo sapiens
cccuccuaaccuagaga

SEQ ID NO: 914369 - RNA, 22 nt, Homo sapiens
cccucuccuuccuuacccaaac

SEQ ID NO: 914370 - RNA, 20 nt, Homo sapiens
cccucugggcagcugucaug

SEQ ID NO: 914371 - RNA, 13 nt, Homo sapiens
cccucuuccacuc

SEQ ID NO: 914372 - RNA, 15 nt, Homo sapiens
cccucuuccugccaa

SEQ ID NO: 914373 - RNA, 22 nt, Homo sapiens
cccucuucuucucccugugugg

SEQ ID NO: 914374 - RNA, 19 nt, Homo sapiens
cccucuuucuacauucuca

SEQ ID NO: 914375 - RNA, 22 nt, Homo sapiens
cccugacucucugugaccugcc

SEQ ID NO: 914376 - RNA, 18 nt, Homo sapiens
cccugaguggaucuccaa

SEQ ID NO: 914377 - RNA, 15 nt, Homo sapiens
cccugauaagcaaau

SEQ ID NO: 914378 - RNA, 18 nt, Homo sapiens
cccugcagggccaagcac

SEQ ID NO: 914379 - RNA, 11 nt, Homo sapiens
cccugcauguu

SEQ ID NO: 914380 - RNA, 18 nt, Homo sapiens
cccugccacuuugcaugg

SEQ ID NO: 914381 - RNA, 19 nt, Homo sapiens
cccugcuaaggaguucuca

SEQ ID NO: 914382 - RNA, 19 nt, Homo sapiens
cccugcuugcacuuuguaa

SEQ ID NO: 914383 - RNA, 19 nt, Homo sapiens
cccugggccccaccaccua

SEQ ID NO: 914384 - RNA, 21 nt, Homo sapiens
cccuggggcuucuccugaccc

SEQ ID NO: 914385 - RNA, 16 nt, Homo sapiens
cccugggguaugagcu

SEQ ID NO: 914386 - RNA, 18 nt, Homo sapiens
cccuguaucuacuaaaaa

SEQ ID NO: 914387 - RNA, 14 nt, Homo sapiens
cccuguaugauucc

SEQ ID NO: 914388 - RNA, 18 nt, Homo sapiens
cccuguggggccugaugg

SEQ ID NO: 914389 - RNA, 15 nt, Homo sapiens
cccuguuaagcaauu

SEQ ID NO: 914390 - RNA, 22 nt, Homo sapiens
cccuucaaccauuccccauggg

SEQ ID NO: 914391 - RNA, 17 nt, Homo sapiens
cccuucacauacccucc

SEQ ID NO: 914392 - RNA, 10 nt, Homo sapiens
cccuuccuuu

SEQ ID NO: 914393 - RNA, 11 nt, Homo sapiens
cccuuucacaa

SEQ ID NO: 914394 - RNA, 19 nt, Homo sapiens
cccuuugaugauuaauuca

SEQ ID NO: 914395 - RNA, 18 nt, Homo sapiens
ccgaacuuuaauuucagg

SEQ ID NO: 914396 - RNA, 17 nt, Homo sapiens
ccgacuccucaaaagca

SEQ ID NO: 914397 - RNA, 16 nt, Homo sapiens
ccgagagagauggaau

SEQ ID NO: 914398 - RNA, 17 nt, Homo sapiens
ccgagagagauggaaua

SEQ ID NO: 914399 - RNA, 20 nt, Homo sapiens
ccgagagagauggaauaaag

SEQ ID NO: 914400 - RNA, 15 nt, Homo sapiens
ccgagucucuucucc

SEQ ID NO: 914401 - RNA, 11 nt, Homo sapiens
ccgaugcacac

SEQ ID NO: 914402 - RNA, 20 nt, Homo sapiens
ccgaugugcgcacacacaga

SEQ ID NO: 914403 - RNA, 16 nt, Homo sapiens
ccgcauggaacagugc

SEQ ID NO: 914404 - RNA, 20 nt, Homo sapiens
ccgcauggaacagugcagga

SEQ ID NO: 914405 - RNA, 22 nt, Homo sapiens
ccgcccuucccacagcauuccu

SEQ ID NO: 914406 - RNA, 14 nt, Homo sapiens
ccgcgccaacgcac

SEQ ID NO: 914407 - RNA, 15 nt, Homo sapiens
ccgcuuucaugaaca

SEQ ID NO: 914408 - RNA, 19 nt, Homo sapiens
ccgcuuucaugaacacagc

SEQ ID NO: 914409 - RNA, 19 nt, Homo sapiens
ccggaagaaaaagagccau

SEQ ID NO: 914410 - RNA, 16 nt, Homo sapiens
ccggcucuucaaagac

SEQ ID NO: 914411 - RNA, 12 nt, Homo sapiens
ccggcugcgugg

SEQ ID NO: 914412 - RNA, 22 nt, Homo sapiens
ccgggaagcggagguugcaggg

SEQ ID NO: 914413 - RNA, 18 nt, Homo sapiens
ggccagagggagugacag

SEQ ID NO: 914414 - RNA, 19 nt, Homo sapiens
ggccagagggagugacaga

SEQ ID NO: 914415 - RNA, 20 nt, Homo sapiens
ggccagcugucgcaucucag

SEQ ID NO: 914416 - RNA, 20 nt, Homo sapiens
ggccaggaguuugagaccag

SEQ ID NO: 914417 - RNA, 18 nt, Homo sapiens
ggccaggggacacuguau

SEQ ID NO: 914418 - RNA, 12 nt, Homo sapiens
ggccagugccag

SEQ ID NO: 914419 - RNA, 20 nt, Homo sapiens
ggcccagcuguagccauggc

SEQ ID NO: 914420 - RNA, 17 nt, Homo sapiens
ggccccugggccugcca

SEQ ID NO: 914421 - RNA, 19 nt, Homo sapiens
ggcccgacagccuggcaca

SEQ ID NO: 914422 - RNA, 14 nt, Homo sapiens
ggcccguccggcgg

SEQ ID NO: 914423 - RNA, 15 nt, Homo sapiens
ggcccugagcucggu

SEQ ID NO: 914424 - RNA, 19 nt, Homo sapiens
ggcccugggccucaguuca

SEQ ID NO: 914425 - RNA, 23 nt, Homo sapiens
ggcccuuccucuccacugccuuc

SEQ ID NO: 914426 - RNA, 18 nt, Homo sapiens
ggccgggcaauccagaca

SEQ ID NO: 914427 - RNA, 17 nt, Homo sapiens
ggccuaacacugggcug

SEQ ID NO: 914428 - RNA, 23 nt, Homo sapiens
ggccuaacacugggcugcagaga

SEQ ID NO: 914429 - RNA, 17 nt, Homo sapiens
ggccucaucuccuuuau

SEQ ID NO: 914430 - RNA, 16 nt, Homo sapiens
ggccuccugugugugc

SEQ ID NO: 914431 - RNA, 22 nt, Homo sapiens
ggccugggggcagugacuggca

SEQ ID NO: 914432 - RNA, 21 nt, Homo sapiens
ggccugugagguaacugggau

SEQ ID NO: 914433 - RNA, 18 nt, Homo sapiens
ggccuguguagcugugac

SEQ ID NO: 914434 - RNA, 14 nt, Homo sapiens
ggccuugucaggac

SEQ ID NO: 914435 - RNA, 19 nt, Homo sapiens
ggcgacagagcgagacucc

SEQ ID NO: 914436 - RNA, 15 nt, Homo sapiens
ggcgcaucauaugca

SEQ ID NO: 914437 - RNA, 22 nt, Homo sapiens
ggcgcuguggcuccugccuuga

SEQ ID NO: 914438 - RNA, 22 nt, Homo sapiens
ggcggaaaccuugcagcauuuu

SEQ ID NO: 914439 - RNA, 16 nt, Homo sapiens
ggcgggcagggguucc

SEQ ID NO: 914440 - RNA, 15 nt, Homo sapiens
ggcgucggaaaugau

SEQ ID NO: 914441 - RNA, 21 nt, Homo sapiens
ggcuaagaugagauuugccag

SEQ ID NO: 914442 - RNA, 23 nt, Homo sapiens
ggcuaccgugggucaaccuggga

SEQ ID NO: 914443 - RNA, 17 nt, Homo sapiens
ggcuagaaccuggagag

SEQ ID NO: 914444 - RNA, 21 nt, Homo sapiens
ggcuagacacccauuuucaca

SEQ ID NO: 914445 - RNA, 15 nt, Homo sapiens
ggcuaucugcauuua

SEQ ID NO: 914446 - RNA, 12 nt, Homo sapiens
ggcucacagcug

SEQ ID NO: 914447 - RNA, 16 nt, Homo sapiens
ggcucagucucaggag

SEQ ID NO: 914448 - RNA, 21 nt, Homo sapiens
ggcuccugccuugaugaagcc

SEQ ID NO: 914449 - RNA, 21 nt, Homo sapiens
ggcucugcaaugggcacuggg

SEQ ID NO: 914450 - RNA, 21 nt, Homo sapiens
ggcugauuauuaaaguccuuu

SEQ ID NO: 914451 - RNA, 16 nt, Homo sapiens
ggcugcacgcggcgga

SEQ ID NO: 914452 - RNA, 14 nt, Homo sapiens
ggcugcagauuucc

SEQ ID NO: 914453 - RNA, 18 nt, Homo sapiens
ggcugcggccuagggguc

SEQ ID NO: 914454 - RNA, 18 nt, Homo sapiens
ggcugcucggggugcaca

SEQ ID NO: 914455 - RNA, 17 nt, Homo sapiens
ggcuggaaucuggagag

SEQ ID NO: 914456 - RNA, 22 nt, Homo sapiens
ggcugggguggggguggggaga

SEQ ID NO: 914457 - RNA, 15 nt, Homo sapiens
ggcuguacacugcac

SEQ ID NO: 914458 - RNA, 18 nt, Homo sapiens
ggcuguacgucugguguu

SEQ ID NO: 914459 - RNA, 21 nt, Homo sapiens
ccuaggaauucccagcccaaa

SEQ ID NO: 914460 - RNA, 14 nt, Homo sapiens
ccuaggauuccucc

SEQ ID NO: 914461 - RNA, 20 nt, Homo sapiens
ccuaggauuucaugauuuca

SEQ ID NO: 914462 - RNA, 21 nt, Homo sapiens
ccuauaccuguguuucuugcc

SEQ ID NO: 914463 - RNA, 13 nt, Homo sapiens
ccuauauguagcu

SEQ ID NO: 914464 - RNA, 19 nt, Homo sapiens
ccuauauguaguauaaaga

SEQ ID NO: 914465 - RNA, 21 nt, Homo sapiens
ccuaugaaaaaauuaguugag

SEQ ID NO: 914466 - RNA, 12 nt, Homo sapiens
ccuaugauccca

SEQ ID NO: 914467 - RNA, 14 nt, Homo sapiens
ccuaugcacauaug

SEQ ID NO: 914468 - RNA, 14 nt, Homo sapiens
ccuaugucauuuca

SEQ ID NO: 914469 - RNA, 15 nt, Homo sapiens
ccuauguccuaagga

SEQ ID NO: 914470 - RNA, 22 nt, Homo sapiens
ccuauguccuaaggacacacua

SEQ ID NO: 914471 - RNA, 19 nt, Homo sapiens
ccuauuacuguuucuggag

SEQ ID NO: 914472 - RNA, 20 nt, Homo sapiens
ccuauuuaugaaaaccauau

SEQ ID NO: 914473 - RNA, 16 nt, Homo sapiens
ccuauuuauucauuca

SEQ ID NO: 914474 - RNA, 20 nt, Homo sapiens
ccuauuuauuggggugccua

SEQ ID NO: 914475 - RNA, 15 nt, Homo sapiens
ccuauuuguuuucau

SEQ ID NO: 914476 - RNA, 15 nt, Homo sapiens
ccucaaaaagauuuc

SEQ ID NO: 914477 - RNA, 14 nt, Homo sapiens
ccucaaaagcacuu

SEQ ID NO: 914478 - RNA, 20 nt, Homo sapiens
ccucaaaugacccaaagacc

SEQ ID NO: 914479 - RNA, 22 nt, Homo sapiens
ccucaaaugacccaaagaccaa

SEQ ID NO: 914480 - RNA, 16 nt, Homo sapiens
ccucaacaugguccuu

SEQ ID NO: 914481 - RNA, 18 nt, Homo sapiens
ccucaaccuccugggcua

SEQ ID NO: 914482 - RNA, 18 nt, Homo sapiens
ccucaagggccaggacuu

SEQ ID NO: 914483 - RNA, 23 nt, Homo sapiens
ccucaaggguuauagacugccau

SEQ ID NO: 914484 - RNA, 19 nt, Homo sapiens
ccucagacaauccacucuc

SEQ ID NO: 914485 - RNA, 22 nt, Homo sapiens
ccucagccucccaaagugcugg

SEQ ID NO: 914486 - RNA, 18 nt, Homo sapiens
ccucagccuuuagggcuu

SEQ ID NO: 914487 - RNA, 17 nt, Homo sapiens
ccucaggccagugccag

SEQ ID NO: 914488 - RNA, 19 nt, Homo sapiens
ccucaggcugccaggaugg

SEQ ID NO: 914489 - RNA, 18 nt, Homo sapiens
ccucagggacaacauuuu

SEQ ID NO: 914490 - RNA, 15 nt, Homo sapiens
ccucagguaguacug

SEQ ID NO: 914491 - RNA, 13 nt, Homo sapiens
ccucaggugaucc

SEQ ID NO: 914492 - RNA, 12 nt, Homo sapiens
ccucaggugcua

SEQ ID NO: 914493 - RNA, 23 nt, Homo sapiens
ccucagugccacuugacauuccu

SEQ ID NO: 914494 - RNA, 17 nt, Homo sapiens
ccucaguuuuaucauuu

SEQ ID NO: 914495 - RNA, 20 nt, Homo sapiens
ccucaucugcagaaugggga

SEQ ID NO: 914496 - RNA, 16 nt, Homo sapiens
ccucauggucauggac

SEQ ID NO: 914497 - RNA, 14 nt, Homo sapiens
ccucauuuaccaua

SEQ ID NO: 914498 - RNA, 14 nt, Homo sapiens
ccuccaaagcccau

SEQ ID NO: 914499 - RNA, 21 nt, Homo sapiens
ccuccaagauuucagaagcca

SEQ ID NO: 914500 - RNA, 17 nt, Homo sapiens
ccuccacaguagcauuu

SEQ ID NO: 914501 - RNA, 12 nt, Homo sapiens
ccuccacuccac

SEQ ID NO: 914502 - RNA, 19 nt, Homo sapiens
ccuccagcuccaguuucca

SEQ ID NO: 914503 - RNA, 14 nt, Homo sapiens
ccuccagcuuuccu

SEQ ID NO: 914504 - RNA, 12 nt, Homo sapiens
ccuccauucuga

SEQ ID NO: 914505 - RNA, 15 nt, Homo sapiens
ccucccaaccccagg

SEQ ID NO: 914506 - RNA, 20 nt, Homo sapiens
ccucccaguuugcuggguuu

SEQ ID NO: 914507 - RNA, 20 nt, Homo sapiens
ccucccccaccuucaagcac

SEQ ID NO: 914508 - RNA, 16 nt, Homo sapiens
ccucccucacaugaua

SEQ ID NO: 914509 - RNA, 10 nt, Homo sapiens
ccucccugaa

SEQ ID NO: 914510 - RNA, 15 nt, Homo sapiens
ccucccuggucccuu

SEQ ID NO: 914511 - RNA, 16 nt, Homo sapiens
ccuccggugugagaua

SEQ ID NO: 914512 - RNA, 13 nt, Homo sapiens
ccuccgucaggag

SEQ ID NO: 914513 - RNA, 21 nt, Homo sapiens
ccuccuagaggugggcagcug

SEQ ID NO: 914514 - RNA, 19 nt, Homo sapiens
ccuccucccagacuuucua

SEQ ID NO: 914515 - RNA, 19 nt, Homo sapiens
ccuccucggaucaccgaga

SEQ ID NO: 914516 - RNA, 16 nt, Homo sapiens
ccuccucugcuugcau

SEQ ID NO: 914517 - RNA, 15 nt, Homo sapiens
ccuccugcaccgaga

SEQ ID NO: 914518 - RNA, 13 nt, Homo sapiens
ccuccugcccaag

SEQ ID NO: 914519 - RNA, 18 nt, Homo sapiens
ccuccuuccccugugguc

SEQ ID NO: 914520 - RNA, 15 nt, Homo sapiens
ccuccuuggugccug

SEQ ID NO: 914521 - RNA, 17 nt, Homo sapiens
ccucgguacucccauaa

SEQ ID NO: 914522 - RNA, 13 nt, Homo sapiens
ccucguaccagcc

SEQ ID NO: 914523 - RNA, 14 nt, Homo sapiens
ccucguaugcaugg

SEQ ID NO: 914524 - RNA, 13 nt, Homo sapiens
ccucuaagccacu

SEQ ID NO: 914525 - RNA, 13 nt, Homo sapiens
ccucuacaagcaa

SEQ ID NO: 914526 - RNA, 13 nt, Homo sapiens
ccucuacugggaa

SEQ ID NO: 914527 - RNA, 14 nt, Homo sapiens
ccucuauuucucuc

SEQ ID NO: 914528 - RNA, 22 nt, Homo sapiens
ggggccucuuucugugcuucuc

SEQ ID NO: 914529 - RNA, 16 nt, Homo sapiens
ggggcucugugcaggg

SEQ ID NO: 914530 - RNA, 18 nt, Homo sapiens
gggguaugagcugccaag

SEQ ID NO: 914531 - RNA, 16 nt, Homo sapiens
ggguacuacugcugca

SEQ ID NO: 914532 - RNA, 21 nt, Homo sapiens
ggguaucccagaccccucuca

SEQ ID NO: 914533 - RNA, 18 nt, Homo sapiens
ggguaugggaagccauau

SEQ ID NO: 914534 - RNA, 20 nt, Homo sapiens
ggguccacccagcaaagagu

SEQ ID NO: 914535 - RNA, 21 nt, Homo sapiens
ggguccauuuggguacgucug

SEQ ID NO: 914536 - RNA, 20 nt, Homo sapiens
gggucccucggagcugccag

SEQ ID NO: 914537 - RNA, 13 nt, Homo sapiens
ggguccuguccau

SEQ ID NO: 914538 - RNA, 20 nt, Homo sapiens
gggucucacuauguugccca

SEQ ID NO: 914539 - RNA, 14 nt, Homo sapiens
gggugacaucccag

SEQ ID NO: 914540 - RNA, 22 nt, Homo sapiens
ggguucaagcaauugucugccu

SEQ ID NO: 914541 - RNA, 15 nt, Homo sapiens
ggguucaucuaggga

SEQ ID NO: 914542 - RNA, 22 nt, Homo sapiens
ggguuccuuuuucaacuuggaa

SEQ ID NO: 914543 - RNA, 22 nt, Homo sapiens
ggguugucaagagagagucaaa

SEQ ID NO: 914544 - RNA, 17 nt, Homo sapiens
ggguuucauauccagcu

SEQ ID NO: 914545 - RNA, 22 nt, Homo sapiens
gguaaaaauauaagaacuugau

SEQ ID NO: 914546 - RNA, 23 nt, Homo sapiens
gguaacuuuuuuuuaaagcucau

SEQ ID NO: 914547 - RNA, 19 nt, Homo sapiens
gguaauaaguacuguguac

SEQ ID NO: 914548 - RNA, 20 nt, Homo sapiens
gguaauauaaaguguaauag

SEQ ID NO: 914549 - RNA, 23 nt, Homo sapiens
gguagaaccacuuggcugcucau

SEQ ID NO: 914550 - RNA, 19 nt, Homo sapiens
gguagcaauucuacccaga

SEQ ID NO: 914551 - RNA, 19 nt, Homo sapiens
gguaguacuccugcaaaau

SEQ ID NO: 914552 - RNA, 14 nt, Homo sapiens
gguaucuccaggau

SEQ ID NO: 914553 - RNA, 21 nt, Homo sapiens
gguauucuuaagggaacuucc

SEQ ID NO: 914554 - RNA, 19 nt, Homo sapiens
gguauuugcuuuguaacuc

SEQ ID NO: 914555 - RNA, 23 nt, Homo sapiens
ggucaaccugcucacuguucuau

SEQ ID NO: 914556 - RNA, 18 nt, Homo sapiens
ggucacuaaccaagccag

SEQ ID NO: 914557 - RNA, 14 nt, Homo sapiens
ggucauuuucuauu

SEQ ID NO: 914558 - RNA, 17 nt, Homo sapiens
gguccccaucaucccag

SEQ ID NO: 914559 - RNA, 21 nt, Homo sapiens
gguccuaacccccuuacugug

SEQ ID NO: 914560 - RNA, 21 nt, Homo sapiens
gguccucuacuuaaugagaua

SEQ ID NO: 914561 - RNA, 20 nt, Homo sapiens
gguccugaguggcugaaaua

SEQ ID NO: 914562 - RNA, 18 nt, Homo sapiens
gguccugauuucagggaa

SEQ ID NO: 914563 - RNA, 14 nt, Homo sapiens
gguccuucauucuu

SEQ ID NO: 914564 - RNA, 15 nt, Homo sapiens
ggucguccaagcaaa

SEQ ID NO: 914565 - RNA, 22 nt, Homo sapiens
ggucucagcccgggacaggguc

SEQ ID NO: 914566 - RNA, 16 nt, Homo sapiens
ggucuccuugcacuuu

SEQ ID NO: 914567 - RNA, 23 nt, Homo sapiens
ggucuguuguaggguugccagau

SEQ ID NO: 914568 - RNA, 18 nt, Homo sapiens
ggucuucugccagcccau

SEQ ID NO: 914569 - RNA, 18 nt, Homo sapiens
ggucuuuauuccucccuc

SEQ ID NO: 914570 - RNA, 20 nt, Homo sapiens
ggucuuuauuccucccucau

SEQ ID NO: 914571 - RNA, 16 nt, Homo sapiens
ggugaaagauggaacu

SEQ ID NO: 914572 - RNA, 16 nt, Homo sapiens
ggugacacacagcagc

SEQ ID NO: 914573 - RNA, 20 nt, Homo sapiens
gucaaugcaucaauuuaccu

SEQ ID NO: 914574 - RNA, 16 nt, Homo sapiens
gucaauuucaguguau

SEQ ID NO: 914575 - RNA, 14 nt, Homo sapiens
gucacaauccuaac

SEQ ID NO: 914576 - RNA, 11 nt, Homo sapiens
gucacacuggu

SEQ ID NO: 914577 - RNA, 14 nt, Homo sapiens
gucacagccaugaa

SEQ ID NO: 914578 - RNA, 17 nt, Homo sapiens
gucaccucagagacaua

SEQ ID NO: 914579 - RNA, 19 nt, Homo sapiens
gucacugcucuggacugug

SEQ ID NO: 914580 - RNA, 17 nt, Homo sapiens
gucacuuuuauuugaaa

SEQ ID NO: 914581 - RNA, 15 nt, Homo sapiens
gucagagaugggcug

SEQ ID NO: 914582 - RNA, 13 nt, Homo sapiens
gucagaguagaag

SEQ ID NO: 914583 - RNA, 13 nt, Homo sapiens
gucagaguucugc

SEQ ID NO: 914584 - RNA, 14 nt, Homo sapiens
gucaggacccaggc

SEQ ID NO: 914585 - RNA, 16 nt, Homo sapiens
gucagucaugauggca

SEQ ID NO: 914586 - RNA, 18 nt, Homo sapiens
gucagucugggugucuca

SEQ ID NO: 914587 - RNA, 13 nt, Homo sapiens
gucaguugccaug

SEQ ID NO: 914588 - RNA, 13 nt, Homo sapiens
gucauauauucau

SEQ ID NO: 914589 - RNA, 22 nt, Homo sapiens
gucaucaaauauuaccaaaaaa

SEQ ID NO: 914590 - RNA, 23 nt, Homo sapiens
gucaucaauuaaaggcaaaggca

SEQ ID NO: 914591 - RNA, 20 nt, Homo sapiens
gucauccccuugugucagag

SEQ ID NO: 914592 - RNA, 13 nt, Homo sapiens
gucaugauuucaa

SEQ ID NO: 914593 - RNA, 17 nt, Homo sapiens
gucauuguccaugccua

SEQ ID NO: 914594 - RNA, 21 nt, Homo sapiens
gucauuuggugccaguauuuu

SEQ ID NO: 914595 - RNA, 21 nt, Homo sapiens
guccacgggaagccuccguca

SEQ ID NO: 914596 - RNA, 17 nt, Homo sapiens
guccagaauaagugcug

SEQ ID NO: 914597 - RNA, 23 nt, Homo sapiens
guccagagccggggcacuuucag

SEQ ID NO: 914598 - RNA, 17 nt, Homo sapiens
guccagccaacauuuaa

SEQ ID NO: 914599 - RNA, 13 nt, Homo sapiens
guccaguuuccaa

SEQ ID NO: 914600 - RNA, 13 nt, Homo sapiens
gucccaacucgau

SEQ ID NO: 914601 - RNA, 21 nt, Homo sapiens
gucccaaguuggaaauauuca

SEQ ID NO: 914602 - RNA, 13 nt, Homo sapiens
gucccaccaacuc

SEQ ID NO: 914603 - RNA, 19 nt, Homo sapiens
gucccagaaccacacuguu

SEQ ID NO: 914604 - RNA, 17 nt, Homo sapiens
gucccagcuacucagaa

SEQ ID NO: 914605 - RNA, 14 nt, Homo sapiens
guccccaccuggga

SEQ ID NO: 914606 - RNA, 19 nt, Homo sapiens
guccccagcaccuuccuga

SEQ ID NO: 914607 - RNA, 15 nt, Homo sapiens
gucccccuaugcucc

SEQ ID NO: 914608 - RNA, 23 nt, Homo sapiens
guccccuccacugucacauugua

SEQ ID NO: 914609 - RNA, 15 nt, Homo sapiens
guccccuccguagga

SEQ ID NO: 914610 - RNA, 17 nt, Homo sapiens
guccccucuugacccau

SEQ ID NO: 914611 - RNA, 23 nt, Homo sapiens
guccccugaaaaacugaucaaaa

SEQ ID NO: 914612 - RNA, 21 nt, Homo sapiens
gucccucaaaugacccaaaga

SEQ ID NO: 914613 - RNA, 17 nt, Homo sapiens
gucccugccaguguuua

SEQ ID NO: 914614 - RNA, 22 nt, Homo sapiens
guccgacucuucugagcaccua

SEQ ID NO: 914615 - RNA, 20 nt, Homo sapiens
guccucaccugguugaccca

SEQ ID NO: 914616 - RNA, 19 nt, Homo sapiens
guccuccauuucaacucca

SEQ ID NO: 914617 - RNA, 19 nt, Homo sapiens
guccucuacuuaaugagau

SEQ ID NO: 914618 - RNA, 15 nt, Homo sapiens
guccucuugcucaaa

SEQ ID NO: 914619 - RNA, 20 nt, Homo sapiens
guccugagcacugccaggag

SEQ ID NO: 914620 - RNA, 22 nt, Homo sapiens
guccugcccaaugccuugacaa

SEQ ID NO: 914621 - RNA, 16 nt, Homo sapiens
guccugccuugaugaa

SEQ ID NO: 914622 - RNA, 16 nt, Homo sapiens
guccugcucucuucag

SEQ ID NO: 914623 - RNA, 19 nt, Homo sapiens
guccuggucugcucaggaa

SEQ ID NO: 914624 - RNA, 14 nt, Homo sapiens
guccuugugugcau

SEQ ID NO: 914625 - RNA, 20 nt, Homo sapiens
gucgagcccugcagccaaac

SEQ ID NO: 914626 - RNA, 14 nt, Homo sapiens
gucuacuucacuaa

SEQ ID NO: 914627 - RNA, 14 nt, Homo sapiens
gucuagaggugaga

SEQ ID NO: 914628 - RNA, 20 nt, Homo sapiens
gucuagaggugagaccaaag

SEQ ID NO: 914629 - RNA, 18 nt, Homo sapiens
gucuaguagcggaucuca

SEQ ID NO: 914630 - RNA, 15 nt, Homo sapiens
gucuauaugucuagc

SEQ ID NO: 914631 - RNA, 13 nt, Homo sapiens
gucucaauccuua

SEQ ID NO: 914632 - RNA, 13 nt, Homo sapiens
gucucaguccaga

SEQ ID NO: 914633 - RNA, 19 nt, Homo sapiens
gucuccacuaaaugagcuc

SEQ ID NO: 914634 - RNA, 16 nt, Homo sapiens
gucuccgcacuuggaa

SEQ ID NO: 914635 - RNA, 15 nt, Homo sapiens
gucucgaacuccuga

SEQ ID NO: 914636 - RNA, 23 nt, Homo sapiens
gucucgucuccugacaugucuca

SEQ ID NO: 914637 - RNA, 14 nt, Homo sapiens
gucucuacuaaaaa

SEQ ID NO: 914638 - RNA, 18 nt, Homo sapiens
gucucuacuaaaaauaca

SEQ ID NO: 914639 - RNA, 18 nt, Homo sapiens
gucucuaugaucuuggca

SEQ ID NO: 914640 - RNA, 21 nt, Homo sapiens
gucucucaugaaccucaagcu

SEQ ID NO: 914641 - RNA, 12 nt, Homo sapiens
gucucucauggg

SEQ ID NO: 914642 - RNA, 21 nt, Homo sapiens
gucucuuuaaugucacaggca

SEQ ID NO: 914643 - RNA, 20 nt, Homo sapiens
ccuguucaccuuauguauua

SEQ ID NO: 914644 - RNA, 12 nt, Homo sapiens
ccuguuccucaa

SEQ ID NO: 914645 - RNA, 22 nt, Homo sapiens
ccuguuucugaaccauuacugu

SEQ ID NO: 914646 - RNA, 20 nt, Homo sapiens
ccuguuuguggaacaaaagu

SEQ ID NO: 914647 - RNA, 12 nt, Homo sapiens
ccuuaagccagg

SEQ ID NO: 914648 - RNA, 19 nt, Homo sapiens
ccuuaauagccauaugcaa

SEQ ID NO: 914649 - RNA, 19 nt, Homo sapiens
ccuuaauucacucccacac

SEQ ID NO: 914650 - RNA, 14 nt, Homo sapiens
ccuuacuacuucuu

SEQ ID NO: 914651 - RNA, 15 nt, Homo sapiens
ccuuagaagucacac

SEQ ID NO: 914652 - RNA, 16 nt, Homo sapiens
ccuuagauuagcucug

SEQ ID NO: 914653 - RNA, 22 nt, Homo sapiens
ccuuagauuagcucuggaccag

SEQ ID NO: 914654 - RNA, 20 nt, Homo sapiens
ccuuagcagggaaacagcua

SEQ ID NO: 914655 - RNA, 23 nt, Homo sapiens
ccuucacaaccagccacacagag

SEQ ID NO: 914656 - RNA, 12 nt, Homo sapiens
ccuucacuuuac

SEQ ID NO: 914657 - RNA, 20 nt, Homo sapiens
ccuucagaacagaggcauuu

SEQ ID NO: 914658 - RNA, 21 nt, Homo sapiens
ccuucagaacagaggcauuua

SEQ ID NO: 914659 - RNA, 17 nt, Homo sapiens
ccuucagcauaauucgg

SEQ ID NO: 914660 - RNA, 15 nt, Homo sapiens
ccuucagggacucaa

SEQ ID NO: 914661 - RNA, 21 nt, Homo sapiens
ccuucaugaugaauuacuucu

SEQ ID NO: 914662 - RNA, 23 nt, Homo sapiens
ccuucauuuccuccgucaccuca

SEQ ID NO: 914663 - RNA, 20 nt, Homo sapiens
ccuuccagcuagugacccac

SEQ ID NO: 914664 - RNA, 14 nt, Homo sapiens
ccuuccgaugacag

SEQ ID NO: 914665 - RNA, 15 nt, Homo sapiens
ccuuccuggacagcu

SEQ ID NO: 914666 - RNA, 19 nt, Homo sapiens
ccuuccugucccaccucuu

SEQ ID NO: 914667 - RNA, 18 nt, Homo sapiens
ccuuccuuaagccaggaa

SEQ ID NO: 914668 - RNA, 18 nt, Homo sapiens
ccuucgggagggcacuca

SEQ ID NO: 914669 - RNA, 22 nt, Homo sapiens
ccuucucagaccugcgcacucc

SEQ ID NO: 914670 - RNA, 13 nt, Homo sapiens
ccuucucuccuuc

SEQ ID NO: 914671 - RNA, 20 nt, Homo sapiens
ccuucugcuguauacuguac

SEQ ID NO: 914672 - RNA, 14 nt, Homo sapiens
ccuucuguggcuca

SEQ ID NO: 914673 - RNA, 15 nt, Homo sapiens
ccuugagcuguccua

SEQ ID NO: 914674 - RNA, 16 nt, Homo sapiens
ccuugaguguguuacc

SEQ ID NO: 914675 - RNA, 13 nt, Homo sapiens
ccuugaugaagcc

SEQ ID NO: 914676 - RNA, 14 nt, Homo sapiens
ccuugauucacaau

SEQ ID NO: 914677 - RNA, 14 nt, Homo sapiens
ccuugccaugucuu

SEQ ID NO: 914678 - RNA, 21 nt, Homo sapiens
ccuugcuggacggggacuggg

SEQ ID NO: 914679 - RNA, 23 nt, Homo sapiens
ccuuggccucccaaagugcuagu

SEQ ID NO: 914680 - RNA, 19 nt, Homo sapiens
ccuuguaauucuaaaugaa

SEQ ID NO: 914681 - RNA, 21 nt, Homo sapiens
ccuuguguacaguuauuuaug

SEQ ID NO: 914682 - RNA, 14 nt, Homo sapiens
ccuuguuacacauu

SEQ ID NO: 914683 - RNA, 21 nt, Homo sapiens
ccuuguuuggggcaggaguag

SEQ ID NO: 914684 - RNA, 21 nt, Homo sapiens
ccuuuaaaaauaugcaccaaa

SEQ ID NO: 914685 - RNA, 19 nt, Homo sapiens
ccuuuaccuaccaccuucc

SEQ ID NO: 914686 - RNA, 18 nt, Homo sapiens
ccuuuagagccagcccau

SEQ ID NO: 914687 - RNA, 22 nt, Homo sapiens
ccuuuauuaaugaacugugaca

SEQ ID NO: 914688 - RNA, 19 nt, Homo sapiens
cuugccuggugaccuacua

SEQ ID NO: 914689 - RNA, 19 nt, Homo sapiens
cuuggaaaaaaauuacaaa

SEQ ID NO: 914690 - RNA, 16 nt, Homo sapiens
cuuggaaaaagaaaga

SEQ ID NO: 914691 - RNA, 22 nt, Homo sapiens
cuuggaaguguguggaaggcag

SEQ ID NO: 914692 - RNA, 13 nt, Homo sapiens
cuuggacuugagg

SEQ ID NO: 914693 - RNA, 16 nt, Homo sapiens
cuuggcaguauuccau

SEQ ID NO: 914694 - RNA, 22 nt, Homo sapiens
cuuggcaguauuccaugggaug

SEQ ID NO: 914695 - RNA, 22 nt, Homo sapiens
cuuggccucccaaagugcuagu

SEQ ID NO: 914696 - RNA, 19 nt, Homo sapiens
cuugggaguguugucacac

SEQ ID NO: 914697 - RNA, 19 nt, Homo sapiens
cuugggcaaaaugacaagg

SEQ ID NO: 914698 - RNA, 14 nt, Homo sapiens
cuuggggucaccac

SEQ ID NO: 914699 - RNA, 23 nt, Homo sapiens
cuuguaaauagcucagguguccc

SEQ ID NO: 914700 - RNA, 19 nt, Homo sapiens
cuuguacaguuaacucucc

SEQ ID NO: 914701 - RNA, 17 nt, Homo sapiens
cuuguagaccacugucc

SEQ ID NO: 914702 - RNA, 16 nt, Homo sapiens
cuuguauaguguaaaa

SEQ ID NO: 914703 - RNA, 16 nt, Homo sapiens
cuuguauuuuccauac

SEQ ID NO: 914704 - RNA, 19 nt, Homo sapiens
cuugucauggaaaaugucc

SEQ ID NO: 914705 - RNA, 17 nt, Homo sapiens
cuugucaugugacaggu

SEQ ID NO: 914706 - RNA, 15 nt, Homo sapiens
cuugucauugccagc

SEQ ID NO: 914707 - RNA, 22 nt, Homo sapiens
cuugucccaacucgaugggcac

SEQ ID NO: 914708 - RNA, 17 nt, Homo sapiens
cuugucccugcccagaa

SEQ ID NO: 914709 - RNA, 12 nt, Homo sapiens
cuugucucaaga

SEQ ID NO: 914710 - RNA, 15 nt, Homo sapiens
cuugucucaagaaga

SEQ ID NO: 914711 - RNA, 16 nt, Homo sapiens
cuugucucacuugugc

SEQ ID NO: 914712 - RNA, 11 nt, Homo sapiens
cuugugccaua

SEQ ID NO: 914713 - RNA, 16 nt, Homo sapiens
cuugugccauagucac

SEQ ID NO: 914714 - RNA, 20 nt, Homo sapiens
cuuguguccccaccucaggc

SEQ ID NO: 914715 - RNA, 20 nt, Homo sapiens
cuuguuaaauugcuuauucu

SEQ ID NO: 914716 - RNA, 21 nt, Homo sapiens
cuuguugucuauuaucuguag

SEQ ID NO: 914717 - RNA, 22 nt, Homo sapiens
cuuguuuuaagauuguaauuca

SEQ ID NO: 914718 - RNA, 19 nt, Homo sapiens
cuuguuuuaaguugcuuua

SEQ ID NO: 914719 - RNA, 20 nt, Homo sapiens
cuuuaaaaauaugcaccaaa

SEQ ID NO: 914720 - RNA, 18 nt, Homo sapiens
cuuuaaccucaucuacaa

SEQ ID NO: 914721 - RNA, 21 nt, Homo sapiens
cuuuaaccucaucuacaagca

SEQ ID NO: 914722 - RNA, 22 nt, Homo sapiens
cuuuaauaguuuugauccuaaa

SEQ ID NO: 914723 - RNA, 19 nt, Homo sapiens
cuuuaaucuucaguuuuau

SEQ ID NO: 914724 - RNA, 12 nt, Homo sapiens
cuuuaauguugu

SEQ ID NO: 914725 - RNA, 20 nt, Homo sapiens
cuuuacuagauauccuggcc

SEQ ID NO: 914726 - RNA, 13 nt, Homo sapiens
cuuuagaaugaga

SEQ ID NO: 914727 - RNA, 20 nt, Homo sapiens
cuuuagagccagcccauggc

SEQ ID NO: 914728 - RNA, 15 nt, Homo sapiens
cuuuagcugucacuu

SEQ ID NO: 914729 - RNA, 17 nt, Homo sapiens
cuuuauaaaagcaaaag

SEQ ID NO: 914730 - RNA, 18 nt, Homo sapiens
cuuuaucaagaagucuga

SEQ ID NO: 914731 - RNA, 18 nt, Homo sapiens
cuuuaucuaauaccucug

SEQ ID NO: 914732 - RNA, 16 nt, Homo sapiens
cuuuauguuacuacau

SEQ ID NO: 914733 - RNA, 14 nt, Homo sapiens
cuuuauuuauuucu

SEQ ID NO: 914734 - RNA, 20 nt, Homo sapiens
cuuuauuucuagcagaguga

SEQ ID NO: 914735 - RNA, 20 nt, Homo sapiens
cuuuauuuguauuugccauu

SEQ ID NO: 914736 - RNA, 12 nt, Homo sapiens
cuuucaaagugu

SEQ ID NO: 914737 - RNA, 19 nt, Homo sapiens
cuuucagccaaaacagauc

SEQ ID NO: 914738 - RNA, 16 nt, Homo sapiens
cuuucagcugugaaca

SEQ ID NO: 914739 - RNA, 18 nt, Homo sapiens
cuuucaugaguuucccag

SEQ ID NO: 914740 - RNA, 20 nt, Homo sapiens
cuuuccaaaaccuaaagagg

SEQ ID NO: 914741 - RNA, 18 nt, Homo sapiens
cuuuccagucauuucaau

SEQ ID NO: 914742 - RNA, 19 nt, Homo sapiens
cuuucccuuuaucaguuug

SEQ ID NO: 914743 - RNA, 23 nt, Homo sapiens
cuuuccuaaagucucugcugcua

SEQ ID NO: 914744 - RNA, 14 nt, Homo sapiens
cuuuccuacucuca

SEQ ID NO: 914745 - RNA, 16 nt, Homo sapiens
cuuuccucagaucauc

SEQ ID NO: 914746 - RNA, 10 nt, Homo sapiens
cuuuccucau

SEQ ID NO: 914747 - RNA, 21 nt, Homo sapiens
cuuuccugucugcacaaguga

SEQ ID NO: 914748 - RNA, 13 nt, Homo sapiens
cuuuccuguucca

SEQ ID NO: 914749 - RNA, 17 nt, Homo sapiens
cuuuccuuuucuuccuu

SEQ ID NO: 914750 - RNA, 20 nt, Homo sapiens
cuuucuacuuuuucuagcua

SEQ ID NO: 914751 - RNA, 21 nt, Homo sapiens
cuuucucaggaccuaguugcu

SEQ ID NO: 914752 - RNA, 21 nt, Homo sapiens
cuuucucgugguagaagccag

SEQ ID NO: 914753 - RNA, 12 nt, Homo sapiens
cuuucucuaaaa

SEQ ID NO: 914754 - RNA, 16 nt, Homo sapiens
cuuucuggaaaagagg

SEQ ID NO: 914755 - RNA, 15 nt, Homo sapiens
cuuucugggccaagu

SEQ ID NO: 914756 - RNA, 16 nt, Homo sapiens
cuuucuguaaccaaaa

SEQ ID NO: 914757 - RNA, 18 nt, Homo sapiens
cuuucuuauuuuguaaua

SEQ ID NO: 914758 - RNA, 16 nt, Homo sapiens
cuuucuucaccaaauc

SEQ ID NO: 914759 - RNA, 19 nt, Homo sapiens
cuuugaagcaguuguguca

SEQ ID NO: 914760 - RNA, 17 nt, Homo sapiens
cuuugaauaaagucuga

SEQ ID NO: 914761 - RNA, 12 nt, Homo sapiens
uauuugaaucuu

SEQ ID NO: 914762 - RNA, 19 nt, Homo sapiens
uauuugcauguuaccuccu

SEQ ID NO: 914763 - RNA, 11 nt, Homo sapiens
uauuugccagc

SEQ ID NO: 914764 - RNA, 12 nt, Homo sapiens
uauuugccagcu

SEQ ID NO: 914765 - RNA, 13 nt, Homo sapiens
uauuugcuaugaa

SEQ ID NO: 914766 - RNA, 22 nt, Homo sapiens
uauuugguuuuuugcaguucac

SEQ ID NO: 914767 - RNA, 17 nt, Homo sapiens
uauuuguauaauggugu

SEQ ID NO: 914768 - RNA, 15 nt, Homo sapiens
uauuuguuugugcau

SEQ ID NO: 914769 - RNA, 19 nt, Homo sapiens
uauuuucccucucuugccu

SEQ ID NO: 914770 - RNA, 18 nt, Homo sapiens
uauuuugcauaguaccaa

SEQ ID NO: 914771 - RNA, 22 nt, Homo sapiens
uauuuugcauaguaccaaucau

SEQ ID NO: 914772 - RNA, 17 nt, Homo sapiens
uauuuuguaauaaacuc

SEQ ID NO: 914773 - RNA, 18 nt, Homo sapiens
uauuuuuuacaauggcca

SEQ ID NO: 914774 - RNA, 22 nt, Homo sapiens
uauuuuuucaauuuaaagguua

SEQ ID NO: 914775 - RNA, 17 nt, Homo sapiens
uauuuuuuuaagcugua

SEQ ID NO: 914776 - RNA, 15 nt, Homo sapiens
ucaaaaagacugugg

SEQ ID NO: 914777 - RNA, 13 nt, Homo sapiens
ucaaaaauacuca

SEQ ID NO: 914778 - RNA, 19 nt, Homo sapiens
ucaaaacagagaugugaua

SEQ ID NO: 914779 - RNA, 19 nt, Homo sapiens
ucaaaaguaaugcuucaau

SEQ ID NO: 914780 - RNA, 23 nt, Homo sapiens
ucaaacugcaaauauugucauaa

SEQ ID NO: 914781 - RNA, 22 nt, Homo sapiens
ucaaagacaauggaaacuguac

SEQ ID NO: 914782 - RNA, 19 nt, Homo sapiens
ucaaagagggagugcauuu

SEQ ID NO: 914783 - RNA, 23 nt, Homo sapiens
ucaaagauguguugcuauccuga

SEQ ID NO: 914784 - RNA, 21 nt, Homo sapiens
ucaaagcacuguuucucucac

SEQ ID NO: 914785 - RNA, 18 nt, Homo sapiens
ucaaagcccccacuucuc

SEQ ID NO: 914786 - RNA, 16 nt, Homo sapiens
ucaaaguaaaacuugc

SEQ ID NO: 914787 - RNA, 18 nt, Homo sapiens
ucaaaguaaaacuugcug

SEQ ID NO: 914788 - RNA, 23 nt, Homo sapiens
ucaaauacauaccuacugacuga

SEQ ID NO: 914789 - RNA, 14 nt, Homo sapiens
ucaaauaugcaaag

SEQ ID NO: 914790 - RNA, 17 nt, Homo sapiens
ucaaauauuaccaaaaa

SEQ ID NO: 914791 - RNA, 21 nt, Homo sapiens
ucaaaucaguccuuugauucc

SEQ ID NO: 914792 - RNA, 17 nt, Homo sapiens
ucaaaucuauucagaca

SEQ ID NO: 914793 - RNA, 12 nt, Homo sapiens
ucaaaucuccag

SEQ ID NO: 914794 - RNA, 15 nt, Homo sapiens
ucaaaugacccaaag

SEQ ID NO: 914795 - RNA, 16 nt, Homo sapiens
ucaaaugcacaucuca

SEQ ID NO: 914796 - RNA, 14 nt, Homo sapiens
ucaaaugcauuuug

SEQ ID NO: 914797 - RNA, 22 nt, Homo sapiens
ucaaauugcuacauaguccaaa

SEQ ID NO: 914798 - RNA, 20 nt, Homo sapiens
ucaaauuuugcauuguguga

SEQ ID NO: 914799 - RNA, 18 nt, Homo sapiens
ucaacaacaaaccaaaac

SEQ ID NO: 914800 - RNA, 17 nt, Homo sapiens
ucaacaauaaagacuga

SEQ ID NO: 914801 - RNA, 13 nt, Homo sapiens
ucaacaguucaaa

SEQ ID NO: 914802 - RNA, 19 nt, Homo sapiens
ucagacauuugguauauua

SEQ ID NO: 914803 - RNA, 16 nt, Homo sapiens
ucagaccaguacuggg

SEQ ID NO: 914804 - RNA, 17 nt, Homo sapiens
ucagaccaguacuggga

SEQ ID NO: 914805 - RNA, 14 nt, Homo sapiens
ucagacugagcucc

SEQ ID NO: 914806 - RNA, 21 nt, Homo sapiens
ucagacugcugggacuggcca

SEQ ID NO: 914807 - RNA, 23 nt, Homo sapiens
ucagagacauacaccuaugucau

SEQ ID NO: 914808 - RNA, 20 nt, Homo sapiens
ucagagagcuaaauuacaau

SEQ ID NO: 914809 - RNA, 23 nt, Homo sapiens
ucagagccccucccugcuaccaa

SEQ ID NO: 914810 - RNA, 21 nt, Homo sapiens
ucagauauuuuuucagaaaua

SEQ ID NO: 914811 - RNA, 17 nt, Homo sapiens
ucagaucugaacacagu

SEQ ID NO: 914812 - RNA, 16 nt, Homo sapiens
ucagaugaucucucca

SEQ ID NO: 914813 - RNA, 12 nt, Homo sapiens
ucagauggacaa

SEQ ID NO: 914814 - RNA, 14 nt, Homo sapiens
ucagcaaagagugg

SEQ ID NO: 914815 - RNA, 17 nt, Homo sapiens
ucagcaaggugugaaug

SEQ ID NO: 914816 - RNA, 11 nt, Homo sapiens
ucagcacugaa

SEQ ID NO: 914817 - RNA, 14 nt, Homo sapiens
ucagcacuguuuca

SEQ ID NO: 914818 - RNA, 14 nt, Homo sapiens
ucagcauaccugcu

SEQ ID NO: 914819 - RNA, 12 nt, Homo sapiens
ucagcauaccuu

SEQ ID NO: 914820 - RNA, 15 nt, Homo sapiens
ucagcauuauuccuc

SEQ ID NO: 914821 - RNA, 18 nt, Homo sapiens
ucagccauugcccuguga

SEQ ID NO: 914822 - RNA, 19 nt, Homo sapiens
ucagccauugcccugugag

SEQ ID NO: 914823 - RNA, 18 nt, Homo sapiens
ucagccuagccgaccuca

SEQ ID NO: 914824 - RNA, 14 nt, Homo sapiens
ucagccucccaaag

SEQ ID NO: 914825 - RNA, 19 nt, Homo sapiens
ucagccucccgaauagcug

SEQ ID NO: 914826 - RNA, 13 nt, Homo sapiens
ucagccucugauc

SEQ ID NO: 914827 - RNA, 20 nt, Homo sapiens
ucagccucuuaaagcugccu

SEQ ID NO: 914828 - RNA, 14 nt, Homo sapiens
ucagccugagucuc

SEQ ID NO: 914829 - RNA, 17 nt, Homo sapiens
ucagccuugaaaaacaa

SEQ ID NO: 914830 - RNA, 22 nt, Homo sapiens
ucagcggucauucuacacugag

SEQ ID NO: 914831 - RNA, 24 nt, Homo sapiens
ucaggacggaaggucaguugccau

SEQ ID NO: 914832 - RNA, 17 nt, Homo sapiens
ucaggagcuugcaagaa

SEQ ID NO: 914833 - RNA, 19 nt, Homo sapiens
ucaggaggcccugguguca

SEQ ID NO: 914834 - RNA, 17 nt, Homo sapiens
ucaggaggcugaggcag

SEQ ID NO: 914835 - RNA, 15 nt, Homo sapiens
ucaggagucaacgug

SEQ ID NO: 914836 - RNA, 18 nt, Homo sapiens
ucaggaguuccuaaccag

SEQ ID NO: 914837 - RNA, 18 nt, Homo sapiens
ucaggaguuggagaccag

SEQ ID NO: 914838 - RNA, 13 nt, Homo sapiens
ucaggauaccaua

SEQ ID NO: 914839 - RNA, 17 nt, Homo sapiens
ucaggcaaagugcugcu

SEQ ID NO: 914840 - RNA, 18 nt, Homo sapiens
ucaggcaaagugcugcug

SEQ ID NO: 914841 - RNA, 20 nt, Homo sapiens
ucagggagccuggaagccaa

SEQ ID NO: 914842 - RNA, 19 nt, Homo sapiens
ucagggauuuuuauuugua

SEQ ID NO: 914843 - RNA, 21 nt, Homo sapiens
ucagggauuuuucuaccuuca

SEQ ID NO: 914844 - RNA, 23 nt, Homo sapiens
ucagggggccuuuaaagacuuaa

SEQ ID NO: 914845 - RNA, 19 nt, Homo sapiens
ucaggguccagacccugaa

SEQ ID NO: 914846 - RNA, 18 nt, Homo sapiens
ucaggguguuaaggcagu

SEQ ID NO: 914847 - RNA, 19 nt, Homo sapiens
ucaggucccccccaggugc

SEQ ID NO: 914848 - RNA, 14 nt, Homo sapiens
ucaggugcuacaca

SEQ ID NO: 914849 - RNA, 21 nt, Homo sapiens
ucagguggagagcacuagaag

SEQ ID NO: 914850 - RNA, 22 nt, Homo sapiens
ucaggugucccugcacuugcag

SEQ ID NO: 914851 - RNA, 24 nt, Homo sapiens
ucaguaaauuguuuuuacugauga

SEQ ID NO: 914852 - RNA, 17 nt, Homo sapiens
ucaguaaguaucuggag

SEQ ID NO: 914853 - RNA, 22 nt, Homo sapiens
ucaguaggaacuguacaugugu

SEQ ID NO: 914854 - RNA, 18 nt, Homo sapiens
ucaguauaauuuaacuuc

SEQ ID NO: 914855 - RNA, 13 nt, Homo sapiens
ucaguauagcauu

SEQ ID NO: 914856 - RNA, 16 nt, Homo sapiens
ucagucccccaccaca

SEQ ID NO: 914857 - RNA, 20 nt, Homo sapiens
ucagucgguguguaaucacg

SEQ ID NO: 914858 - RNA, 14 nt, Homo sapiens
ucagucuuggaguu

SEQ ID NO: 914859 - RNA, 15 nt, Homo sapiens
ucagugaaagccaga

SEQ ID NO: 914860 - RNA, 20 nt, Homo sapiens
ucagugaaagccagauucaa

SEQ ID NO: 914861 - RNA, 19 nt, Homo sapiens
ucagugcucggcagucaua

SEQ ID NO: 914862 - RNA, 18 nt, Homo sapiens
ucaguuguguuuggcagg

SEQ ID NO: 914863 - RNA, 14 nt, Homo sapiens
ucaguuguuuuccc

SEQ ID NO: 914864 - RNA, 16 nt, Homo sapiens
ucauaauccagagaua

SEQ ID NO: 914865 - RNA, 15 nt, Homo sapiens
ucauaauuagaacaa

SEQ ID NO: 914866 - RNA, 14 nt, Homo sapiens
ucauacaaugacaa

SEQ ID NO: 914867 - RNA, 15 nt, Homo sapiens
ucauacagauuugca

SEQ ID NO: 914868 - RNA, 23 nt, Homo sapiens
ucauagaaauaccucauucgccu

SEQ ID NO: 914869 - RNA, 14 nt, Homo sapiens
ucauagcugagauu

SEQ ID NO: 914870 - RNA, 15 nt, Homo sapiens
ucauagggucucuuc

SEQ ID NO: 914871 - RNA, 20 nt, Homo sapiens
ucauaugaaaaaaaugcauu

SEQ ID NO: 914872 - RNA, 15 nt, Homo sapiens
ucauauugaauguuu

SEQ ID NO: 914873 - RNA, 14 nt, Homo sapiens
ucauauuggacuga

SEQ ID NO: 914874 - RNA, 15 nt, Homo sapiens
ucauauugugccaau

SEQ ID NO: 914875 - RNA, 20 nt, Homo sapiens
ucauauuuuguauauaucug

SEQ ID NO: 914876 - RNA, 22 nt, Homo sapiens
ucaucaacuuauuauaugacua

SEQ ID NO: 914877 - RNA, 21 nt, Homo sapiens
gaaaucuuaaaaaccugccuc

SEQ ID NO: 914878 - RNA, 21 nt, Homo sapiens
gaaaugcccaucuaugucccu

SEQ ID NO: 914879 - RNA, 19 nt, Homo sapiens
gaaaugucuggucugucca

SEQ ID NO: 914880 - RNA, 23 nt, Homo sapiens
gaaaugugucuugucuccauuug

SEQ ID NO: 914881 - RNA, 18 nt, Homo sapiens
gaaauuaaagucuuccau

SEQ ID NO: 914882 - RNA, 14 nt, Homo sapiens
gaaauuauuauuca

SEQ ID NO: 914883 - RNA, 14 nt, Homo sapiens
gaaauucuguggug

SEQ ID NO: 914884 - RNA, 14 nt, Homo sapiens
gaaauugaaccugg

SEQ ID NO: 914885 - RNA, 13 nt, Homo sapiens
gaaauugcuauuu

SEQ ID NO: 914886 - RNA, 20 nt, Homo sapiens
gaaauuuacugugagacugu

SEQ ID NO: 914887 - RNA, 19 nt, Homo sapiens
gaacaaguuguuucauuga

SEQ ID NO: 914888 - RNA, 21 nt, Homo sapiens
gaacaaugaauuauccagcau

SEQ ID NO: 914889 - RNA, 24 nt, Homo sapiens
gaacacagcaguucugcagaggac

SEQ ID NO: 914890 - RNA, 14 nt, Homo sapiens
gaacacagugccug

SEQ ID NO: 914891 - RNA, 14 nt, Homo sapiens
gaacacaucagcuu

SEQ ID NO: 914892 - RNA, 21 nt, Homo sapiens
gaacaccuuuguuuugcacug

SEQ ID NO: 914893 - RNA, 13 nt, Homo sapiens
gaacagaaggaug

SEQ ID NO: 914894 - RNA, 21 nt, Homo sapiens
gaacagacaacagaagucaug

SEQ ID NO: 914895 - RNA, 23 nt, Homo sapiens
gaacagccgcuccugucugccag

SEQ ID NO: 914896 - RNA, 15 nt, Homo sapiens
gaacaguaacugcca

SEQ ID NO: 914897 - RNA, 12 nt, Homo sapiens
gaacaguuugua

SEQ ID NO: 914898 - RNA, 15 nt, Homo sapiens
gaacauaaagcaaau

SEQ ID NO: 914899 - RNA, 18 nt, Homo sapiens
gaacaucccaagccagaa

SEQ ID NO: 914900 - RNA, 16 nt, Homo sapiens
gaacaugcacauuuau

SEQ ID NO: 914901 - RNA, 20 nt, Homo sapiens
gaacauuuacacauucucac

SEQ ID NO: 914902 - RNA, 17 nt, Homo sapiens
gaaccacagaacacugg

SEQ ID NO: 914903 - RNA, 17 nt, Homo sapiens
gaaccaucucaauguaa

SEQ ID NO: 914904 - RNA, 10 nt, Homo sapiens
gaaccaugaa

SEQ ID NO: 914905 - RNA, 13 nt, Homo sapiens
gaaccauuacugu

SEQ ID NO: 914906 - RNA, 21 nt, Homo sapiens
gaacccauuuugagugacucg

SEQ ID NO: 914907 - RNA, 21 nt, Homo sapiens
gaaccccaaaucccacagggc

SEQ ID NO: 914908 - RNA, 19 nt, Homo sapiens
gaacccugcuugcacuuug

SEQ ID NO: 914909 - RNA, 16 nt, Homo sapiens
gaacccuuccugagac

SEQ ID NO: 914910 - RNA, 17 nt, Homo sapiens
gaacccuuccugagacc

SEQ ID NO: 914911 - RNA, 14 nt, Homo sapiens
gaaccucaaacugg

SEQ ID NO: 914912 - RNA, 15 nt, Homo sapiens
gaaccugggaaccau

SEQ ID NO: 914913 - RNA, 15 nt, Homo sapiens
gaacgaguuguuggc

SEQ ID NO: 914914 - RNA, 13 nt, Homo sapiens
gaacgcucuuagc

SEQ ID NO: 914915 - RNA, 21 nt, Homo sapiens
gaacuaaguuuuuuacuucca

SEQ ID NO: 914916 - RNA, 13 nt, Homo sapiens
gaacuagaaccug

SEQ ID NO: 914917 - RNA, 15 nt, Homo sapiens
gcuuauuucccucau

SEQ ID NO: 914918 - RNA, 22 nt, Homo sapiens
gcuucaaggaguaugcagggag

SEQ ID NO: 914919 - RNA, 18 nt, Homo sapiens
gcuucaagugauauaugu

SEQ ID NO: 914920 - RNA, 18 nt, Homo sapiens
gcuucagagccuagccac

SEQ ID NO: 914921 - RNA, 17 nt, Homo sapiens
gcuucagccucucccac

SEQ ID NO: 914922 - RNA, 16 nt, Homo sapiens
gcuucaggauaccaua

SEQ ID NO: 914923 - RNA, 15 nt, Homo sapiens
gcuucaguggcagcu

SEQ ID NO: 914924 - RNA, 23 nt, Homo sapiens
gcuucaucaauuuuuauacauau

SEQ ID NO: 914925 - RNA, 16 nt, Homo sapiens
gcuucauuaugcagcu

SEQ ID NO: 914926 - RNA, 17 nt, Homo sapiens
gcuucauuaugcagcug

SEQ ID NO: 914927 - RNA, 23 nt, Homo sapiens
gcuucauuugggaaauucagcuu

SEQ ID NO: 914928 - RNA, 17 nt, Homo sapiens
gcuucauuuuugggaga

SEQ ID NO: 914929 - RNA, 14 nt, Homo sapiens
gcuuccacuucuau

SEQ ID NO: 914930 - RNA, 19 nt, Homo sapiens
gcuucucauggauggcacu

SEQ ID NO: 914931 - RNA, 13 nt, Homo sapiens
gcuucuugugaaa

SEQ ID NO: 914932 - RNA, 13 nt, Homo sapiens
gcuucuuuucacu

SEQ ID NO: 914933 - RNA, 20 nt, Homo sapiens
gcuugccaccggggaaccca

SEQ ID NO: 914934 - RNA, 23 nt, Homo sapiens
gcuuggaaacuggaugaggucau

SEQ ID NO: 914935 - RNA, 17 nt, Homo sapiens
gcuugggcccugcacag

SEQ ID NO: 914936 - RNA, 23 nt, Homo sapiens
gcuuguagcagaaggcaagcacc

SEQ ID NO: 914937 - RNA, 16 nt, Homo sapiens
gcuuguauauacauau

SEQ ID NO: 914938 - RNA, 19 nt, Homo sapiens
gcuuguccugcucucuuca

SEQ ID NO: 914939 - RNA, 17 nt, Homo sapiens
gcuuuaaaucuaucuau

SEQ ID NO: 914940 - RNA, 14 nt, Homo sapiens
gcuuuaacaaaaca

SEQ ID NO: 914941 - RNA, 18 nt, Homo sapiens
gcuuuaacaaaacaagaa

SEQ ID NO: 914942 - RNA, 19 nt, Homo sapiens
gcuuuaauuuucacucugg

SEQ ID NO: 914943 - RNA, 14 nt, Homo sapiens
gcuuuacauuuuau

SEQ ID NO: 914944 - RNA, 18 nt, Homo sapiens
gcuuuaguaauguggauu

SEQ ID NO: 914945 - RNA, 20 nt, Homo sapiens
gcuuuaguccuagaggaccu

SEQ ID NO: 914946 - RNA, 14 nt, Homo sapiens
gcuuucuuucacaa

SEQ ID NO: 914947 - RNA, 18 nt, Homo sapiens
gcuuugcuucaaauccau

SEQ ID NO: 914948 - RNA, 11 nt, Homo sapiens
gcuuuguccug

SEQ ID NO: 914949 - RNA, 19 nt, Homo sapiens
gcuuuucuaaucuuguuaa

SEQ ID NO: 914950 - RNA, 20 nt, Homo sapiens
gcuuuuuuccuccuguguac

SEQ ID NO: 914951 - RNA, 23 nt, Homo sapiens
ggaaaaaaaauaauguaaggguc

SEQ ID NO: 914952 - RNA, 20 nt, Homo sapiens
ggaaaaaaguuuugaugaaa

SEQ ID NO: 914953 - RNA, 20 nt, Homo sapiens
ggaaaaagaaagaaacacuc

SEQ ID NO: 914954 - RNA, 22 nt, Homo sapiens
ggaaaacagaggaaucuaccug

SEQ ID NO: 914955 - RNA, 20 nt, Homo sapiens
ggaaaagaaucccugcagcc

SEQ ID NO: 914956 - RNA, 20 nt, Homo sapiens
ggaaaagcugcugacagugu

SEQ ID NO: 914957 - RNA, 21 nt, Homo sapiens
ggaaaaucacaccaccugaca

SEQ ID NO: 914958 - RNA, 18 nt, Homo sapiens
ggaaaauguccuguggug

SEQ ID NO: 914959 - RNA, 18 nt, Homo sapiens
ggaaacagggcagugaca

SEQ ID NO: 914960 - RNA, 17 nt, Homo sapiens
ggaaacuggaugagguc

SEQ ID NO: 914961 - RNA, 20 nt, Homo sapiens
ggaaacuggaugaggucaua

SEQ ID NO: 914962 - RNA, 22 nt, Homo sapiens
ggaaagcaucaccucaggccag

SEQ ID NO: 914963 - RNA, 17 nt, Homo sapiens
ggaaagggauaguccaa

SEQ ID NO: 914964 - RNA, 12 nt, Homo sapiens
ggaaaguucagc

SEQ ID NO: 914965 - RNA, 22 nt, Homo sapiens
ggaaauaaaauuuaggaccaau

SEQ ID NO: 914966 - RNA, 21 nt, Homo sapiens
ggaaauguaacuugaagcagc

SEQ ID NO: 914967 - RNA, 13 nt, Homo sapiens
ggaacaccaggcu

SEQ ID NO: 914968 - RNA, 22 nt, Homo sapiens
ggaacacccgacuccucaaaag

SEQ ID NO: 914969 - RNA, 15 nt, Homo sapiens
ggaaccuguacuggg

SEQ ID NO: 914970 - RNA, 21 nt, Homo sapiens
ggaacuagagggauacacuga

SEQ ID NO: 914971 - RNA, 19 nt, Homo sapiens
ggaacucuggcuuccaggu

SEQ ID NO: 914972 - RNA, 16 nt, Homo sapiens
ggaacugguucaagag

SEQ ID NO: 914973 - RNA, 16 nt, Homo sapiens
ggaagaaauuccugua

SEQ ID NO: 914974 - RNA, 18 nt, Homo sapiens
ggaagaagccagacuggu

SEQ ID NO: 914975 - RNA, 17 nt, Homo sapiens
ggaagacgugaugccag

SEQ ID NO: 914976 - RNA, 18 nt, Homo sapiens
ggaagacuugaagcacag

SEQ ID NO: 914977 - RNA, 16 nt, Homo sapiens
ggaagcccuugccuga

SEQ ID NO: 914978 - RNA, 16 nt, Homo sapiens
ggaagcuccacuguca

SEQ ID NO: 914979 - RNA, 17 nt, Homo sapiens
ggaagcucugaagucac

SEQ ID NO: 914980 - RNA, 16 nt, Homo sapiens
ggaaggaagggacaca

SEQ ID NO: 914981 - RNA, 14 nt, Homo sapiens
ggaagggacacaca

SEQ ID NO: 914982 - RNA, 18 nt, Homo sapiens
ggaaggucaguugccaug

SEQ ID NO: 914983 - RNA, 15 nt, Homo sapiens
ggaaguuuguucacu

SEQ ID NO: 914984 - RNA, 14 nt, Homo sapiens
ggaauaaagcccuu

SEQ ID NO: 914985 - RNA, 15 nt, Homo sapiens
ggaauaugcuaguga

SEQ ID NO: 914986 - RNA, 12 nt, Homo sapiens
ggaauuaccuua

SEQ ID NO: 914987 - RNA, 18 nt, Homo sapiens
ggacaaaacacugugucc

SEQ ID NO: 914988 - RNA, 12 nt, Homo sapiens
ggacaaaaugga

SEQ ID NO: 914989 - RNA, 11 nt, Homo sapiens
ggacacagacc

SEQ ID NO: 914990 - RNA, 18 nt, Homo sapiens
ggacacuaauacaccagg

SEQ ID NO: 914991 - RNA, 21 nt, Homo sapiens
ggacagcgccaccucuuguca

SEQ ID NO: 914992 - RNA, 17 nt, Homo sapiens
ggacaggacuaacacuc

SEQ ID NO: 914993 - RNA, 13 nt, Homo sapiens
ggacauaagacag

SEQ ID NO: 914994 - RNA, 14 nt, Homo sapiens
ggacaugugcuauu

SEQ ID NO: 914995 - RNA, 14 nt, Homo sapiens
ggaccaggaugaca

SEQ ID NO: 914996 - RNA, 19 nt, Homo sapiens
ggaccauugaccucagcug

SEQ ID NO: 914997 - RNA, 22 nt, Homo sapiens
ggacccccuggcccugccucau

SEQ ID NO: 914998 - RNA, 14 nt, Homo sapiens
ggaccucaguuuua

SEQ ID NO: 914999 - RNA, 19 nt, Homo sapiens
uggaucuggggacugagug

SEQ ID NO: 915000 - RNA, 14 nt, Homo sapiens
uggaugaagcucug

SEQ ID NO: 915001 - RNA, 21 nt, Homo sapiens
uggaugaaggacgugucucag

SEQ ID NO: 915002 - RNA, 22 nt, Homo sapiens
uggaugacgugaagccacagga

SEQ ID NO: 915003 - RNA, 18 nt, Homo sapiens
uggaugacuaacuaucaa

SEQ ID NO: 915004 - RNA, 14 nt, Homo sapiens
uggaugcacgcaca

SEQ ID NO: 915005 - RNA, 18 nt, Homo sapiens
uggaugugcccacaggga

SEQ ID NO: 915006 - RNA, 19 nt, Homo sapiens
uggauugcagacucaugaa

SEQ ID NO: 915007 - RNA, 19 nt, Homo sapiens
uggauuuacgacugaagaa

SEQ ID NO: 915008 - RNA, 14 nt, Homo sapiens
uggcaagugauauc

SEQ ID NO: 915009 - RNA, 15 nt, Homo sapiens
uggcaccagaugcaa

SEQ ID NO: 915010 - RNA, 23 nt, Homo sapiens
uggcacccacuguggccuggcau

SEQ ID NO: 915011 - RNA, 15 nt, Homo sapiens
uggcaccucagacaa

SEQ ID NO: 915012 - RNA, 21 nt, Homo sapiens
uggcacuuggggcaccuugcu

SEQ ID NO: 915013 - RNA, 22 nt, Homo sapiens
uggcagagaggaccccacugga

SEQ ID NO: 915014 - RNA, 20 nt, Homo sapiens
uggcagcgccucaucuucaa

SEQ ID NO: 915015 - RNA, 13 nt, Homo sapiens
uggcagggacccc

SEQ ID NO: 915016 - RNA, 13 nt, Homo sapiens
uggcagugaugaa

SEQ ID NO: 915017 - RNA, 21 nt, Homo sapiens
uggcagugggagcugccuguu

SEQ ID NO: 915018 - RNA, 16 nt, Homo sapiens
uggcauucacaucuca

SEQ ID NO: 915019 - RNA, 23 nt, Homo sapiens
uggccacugggucucacuccuga

SEQ ID NO: 915020 - RNA, 15 nt, Homo sapiens
uggccagcacucuga

SEQ ID NO: 915021 - RNA, 18 nt, Homo sapiens
uggccauuccaacagcuc

SEQ ID NO: 915022 - RNA, 19 nt, Homo sapiens
uggcccauagaaacaugac

SEQ ID NO: 915023 - RNA, 22 nt, Homo sapiens
uggcccauagaaacaugacacu

SEQ ID NO: 915024 - RNA, 19 nt, Homo sapiens
uggcccugcaaaaauauaa

SEQ ID NO: 915025 - RNA, 15 nt, Homo sapiens
uggccgacucaggga

SEQ ID NO: 915026 - RNA, 19 nt, Homo sapiens
uggccuaaaaaugcaacuu

SEQ ID NO: 915027 - RNA, 13 nt, Homo sapiens
uggccuaugcaca

SEQ ID NO: 915028 - RNA, 18 nt, Homo sapiens
uggccuaugcacauaugg

SEQ ID NO: 915029 - RNA, 20 nt, Homo sapiens
uggccuuccccuuuugccug

SEQ ID NO: 915030 - RNA, 23 nt, Homo sapiens
uggcgacugcagcugcaccauca

SEQ ID NO: 915031 - RNA, 22 nt, Homo sapiens
ggccucagcaccccugucucua

SEQ ID NO: 915032 - RNA, 19 nt, Homo sapiens
ggccucccaaagugcuagu

SEQ ID NO: 915033 - RNA, 22 nt, Homo sapiens
ggccuccugccucuacugggaa

SEQ ID NO: 915034 - RNA, 19 nt, Homo sapiens
ggccuccugugcaucugua

SEQ ID NO: 915035 - RNA, 16 nt, Homo sapiens
ggccugcccucaggga

SEQ ID NO: 915036 - RNA, 17 nt, Homo sapiens
ggccugcccucagggau

SEQ ID NO: 915037 - RNA, 17 nt, Homo sapiens
ggccuggcaagugggug

SEQ ID NO: 915038 - RNA, 15 nt, Homo sapiens
ggccuggcaucgcau

SEQ ID NO: 915039 - RNA, 19 nt, Homo sapiens
ggccuggggugacccggca

SEQ ID NO: 915040 - RNA, 22 nt, Homo sapiens
ggccuuaauuuucaguauaauu

SEQ ID NO: 915041 - RNA, 18 nt, Homo sapiens
ggccuucacagugaccau

SEQ ID NO: 915042 - RNA, 17 nt, Homo sapiens
ggcgaguucagcaaaga

SEQ ID NO: 915043 - RNA, 13 nt, Homo sapiens
ggcgcagugcuuc

SEQ ID NO: 915044 - RNA, 11 nt, Homo sapiens
ggcgcgguggc

SEQ ID NO: 915045 - RNA, 16 nt, Homo sapiens
ggcggauggcugugac

SEQ ID NO: 915046 - RNA, 12 nt, Homo sapiens
ggcuaaucucag

SEQ ID NO: 915047 - RNA, 13 nt, Homo sapiens
ggcuacuaccugg

SEQ ID NO: 915048 - RNA, 13 nt, Homo sapiens
ggcuacucugugc

SEQ ID NO: 915049 - RNA, 18 nt, Homo sapiens
ggcuauauuucugggaug

SEQ ID NO: 915050 - RNA, 16 nt, Homo sapiens
ggcuaucugcauuuau

SEQ ID NO: 915051 - RNA, 12 nt, Homo sapiens
ggcuaugccuug

SEQ ID NO: 915052 - RNA, 15 nt, Homo sapiens
ggcucacgccuguaa

SEQ ID NO: 915053 - RNA, 20 nt, Homo sapiens
ggcucaggaagaaaccccaa

SEQ ID NO: 915054 - RNA, 16 nt, Homo sapiens
ggcucaugaccuggaa

SEQ ID NO: 915055 - RNA, 15 nt, Homo sapiens
ggcuccagguccgga

SEQ ID NO: 915056 - RNA, 13 nt, Homo sapiens
ggcucccaucuga

SEQ ID NO: 915057 - RNA, 20 nt, Homo sapiens
ggcuccugccacugaccuca

SEQ ID NO: 915058 - RNA, 13 nt, Homo sapiens
ggcuccugucauc

SEQ ID NO: 915059 - RNA, 13 nt, Homo sapiens
ggcuccugugcua

SEQ ID NO: 915060 - RNA, 19 nt, Homo sapiens
ggcucuccuguagcucucc

SEQ ID NO: 915061 - RNA, 15 nt, Homo sapiens
ggcucuuucagagag

SEQ ID NO: 915062 - RNA, 18 nt, Homo sapiens
ggcugaaauaaaagccuc

SEQ ID NO: 915063 - RNA, 19 nt, Homo sapiens
ggcugaauagcuucuccaa

SEQ ID NO: 915064 - RNA, 23 nt, Homo sapiens
ggcugaauagcuucuccaaaggc

SEQ ID NO: 915065 - RNA, 21 nt, Homo sapiens
ggcugacaccuaccaugcugc

SEQ ID NO: 915066 - RNA, 16 nt, Homo sapiens
ggcugacaccuggauu

SEQ ID NO: 915067 - RNA, 13 nt, Homo sapiens
ggcugacggugaa

SEQ ID NO: 915068 - RNA, 15 nt, Homo sapiens
ggcugagcaccucag

SEQ ID NO: 915069 - RNA, 15 nt, Homo sapiens
ggcugcaagggccag

SEQ ID NO: 915070 - RNA, 17 nt, Homo sapiens
ggcugccaggauggcgu

SEQ ID NO: 915071 - RNA, 13 nt, Homo sapiens
ggcugcugacuca

SEQ ID NO: 915072 - RNA, 21 nt, Homo sapiens
ggcugcugcggugucacuggg

SEQ ID NO: 915073 - RNA, 15 nt, Homo sapiens
ggcugcuggggcaug

SEQ ID NO: 915074 - RNA, 20 nt, Homo sapiens
ggcuggaaaagucacacaga

SEQ ID NO: 915075 - RNA, 16 nt, Homo sapiens
ggcuggaguucagugg

SEQ ID NO: 915076 - RNA, 19 nt, Homo sapiens
ggcuggaugugguggcaua

SEQ ID NO: 915077 - RNA, 23 nt, Homo sapiens
ggcuggugcuguggccaggguga

SEQ ID NO: 915078 - RNA, 13 nt, Homo sapiens
ggcugugcugagg

SEQ ID NO: 915079 - RNA, 21 nt, Homo sapiens
ggcugugggucugcaccucug

SEQ ID NO: 915080 - RNA, 16 nt, Homo sapiens
ggcuguuauucuucca

SEQ ID NO: 915081 - RNA, 13 nt, Homo sapiens
ggcuuaugcccuc

SEQ ID NO: 915082 - RNA, 18 nt, Homo sapiens
ggcuucagccucucccac

SEQ ID NO: 915083 - RNA, 19 nt, Homo sapiens
ggcuuccagagaguccucu

SEQ ID NO: 915084 - RNA, 15 nt, Homo sapiens
ggcuuugggguccua

SEQ ID NO: 915085 - RNA, 19 nt, Homo sapiens
ggcuuuuaagaaacacagg

SEQ ID NO: 915086 - RNA, 14 nt, Homo sapiens
ggcuuuuauugcca

SEQ ID NO: 915087 - RNA, 22 nt, Homo sapiens
gggaaaccaguguagccuugcc

SEQ ID NO: 915088 - RNA, 15 nt, Homo sapiens
gggaaaggaggcaug

SEQ ID NO: 915089 - RNA, 15 nt, Homo sapiens
gggaaaucuuauauu

SEQ ID NO: 915090 - RNA, 17 nt, Homo sapiens
gggaaauucacacugug

SEQ ID NO: 915091 - RNA, 19 nt, Homo sapiens
gggaacccagcccuggggu

SEQ ID NO: 915092 - RNA, 21 nt, Homo sapiens
gggaagacaacuaggauacuu

SEQ ID NO: 915093 - RNA, 14 nt, Homo sapiens
gggaagacuguggc

SEQ ID NO: 915094 - RNA, 22 nt, Homo sapiens
gggaagauacugacuagucaua

SEQ ID NO: 915095 - RNA, 22 nt, Homo sapiens
gggaagcgaugaauuuggagac

SEQ ID NO: 915096 - RNA, 21 nt, Homo sapiens
gggaagcugggggaagggugg

SEQ ID NO: 915097 - RNA, 16 nt, Homo sapiens
gggaaggaagggacac

SEQ ID NO: 915098 - RNA, 21 nt, Homo sapiens
gggaaugccacagugaaggga

SEQ ID NO: 915099 - RNA, 16 nt, Homo sapiens
gggacaaaggagccug

SEQ ID NO: 915100 - RNA, 13 nt, Homo sapiens
gggacaaccccau

SEQ ID NO: 915101 - RNA, 18 nt, Homo sapiens
gggacagggucuugcaag

SEQ ID NO: 915102 - RNA, 21 nt, Homo sapiens
gggaccaugaagagacucucu

SEQ ID NO: 915103 - RNA, 16 nt, Homo sapiens
gggacgaucuuugaau

SEQ ID NO: 915104 - RNA, 16 nt, Homo sapiens
gggacucaaugcacug

SEQ ID NO: 915105 - RNA, 18 nt, Homo sapiens
gggacucucccccuuuca

SEQ ID NO: 915106 - RNA, 15 nt, Homo sapiens
gggagagccagaccc

SEQ ID NO: 915107 - RNA, 22 nt, Homo sapiens
gggagcaugggacugugccuuu

SEQ ID NO: 915108 - RNA, 20 nt, Homo sapiens
gggagccuaaggaagcgugg

SEQ ID NO: 915109 - RNA, 19 nt, Homo sapiens
gggagccucuccuugccug

SEQ ID NO: 915110 - RNA, 15 nt, Homo sapiens
gggagcuaugaucca

SEQ ID NO: 915111 - RNA, 13 nt, Homo sapiens
gggagcuggaaau

SEQ ID NO: 915112 - RNA, 11 nt, Homo sapiens
gggagggauga

SEQ ID NO: 915113 - RNA, 23 nt, Homo sapiens
gggaucagccuccgccauuccaa

SEQ ID NO: 915114 - RNA, 16 nt, Homo sapiens
gggaucuugcauuccc

SEQ ID NO: 915115 - RNA, 21 nt, Homo sapiens
ugucuguuucaaugaccugua

SEQ ID NO: 915116 - RNA, 21 nt, Homo sapiens
ugucuuaauuaaaagaauauu

SEQ ID NO: 915117 - RNA, 13 nt, Homo sapiens
ugucuuagcugua

SEQ ID NO: 915118 - RNA, 14 nt, Homo sapiens
ugucuucacucuuc

SEQ ID NO: 915119 - RNA, 18 nt, Homo sapiens
ugucuucauagcagauuu

SEQ ID NO: 915120 - RNA, 19 nt, Homo sapiens
ugucuuccaaccccagcug

SEQ ID NO: 915121 - RNA, 19 nt, Homo sapiens
ugucuugaugugucaucua

SEQ ID NO: 915122 - RNA, 18 nt, Homo sapiens
ugucuuggacacuguaca

SEQ ID NO: 915123 - RNA, 13 nt, Homo sapiens
ugucuuucuccaa

SEQ ID NO: 915124 - RNA, 18 nt, Homo sapiens
ugucuuuuuaagcuuauu

SEQ ID NO: 915125 - RNA, 18 nt, Homo sapiens
ugugaaaguaugugauau

SEQ ID NO: 915126 - RNA, 19 nt, Homo sapiens
ugugaacauggacucuucc

SEQ ID NO: 915127 - RNA, 18 nt, Homo sapiens
ugugaacauugucuggau

SEQ ID NO: 915128 - RNA, 23 nt, Homo sapiens
ugugaacucagagccccucccug

SEQ ID NO: 915129 - RNA, 17 nt, Homo sapiens
ugugaaggucuugccug

SEQ ID NO: 915130 - RNA, 21 nt, Homo sapiens
ugugaaguguaguggcaucca

SEQ ID NO: 915131 - RNA, 14 nt, Homo sapiens
ugugacacauaugc

SEQ ID NO: 915132 - RNA, 15 nt, Homo sapiens
ugugacacauaugca

SEQ ID NO: 915133 - RNA, 13 nt, Homo sapiens
ugugacagucuug

SEQ ID NO: 915134 - RNA, 15 nt, Homo sapiens
ugugaccagggguga

SEQ ID NO: 915135 - RNA, 18 nt, Homo sapiens
ugugacccagggugcauu

SEQ ID NO: 915136 - RNA, 21 nt, Homo sapiens
ugugaccuguuagaugugaca

SEQ ID NO: 915137 - RNA, 22 nt, Homo sapiens
ugugacuuuuuagccagugacu

SEQ ID NO: 915138 - RNA, 20 nt, Homo sapiens
ugugagcacucuacugcaag

SEQ ID NO: 915139 - RNA, 17 nt, Homo sapiens
ugugagcagugaguuac

SEQ ID NO: 915140 - RNA, 16 nt, Homo sapiens
ugugaggcugggucca

SEQ ID NO: 915141 - RNA, 16 nt, Homo sapiens
ugugaucaucccaucu

SEQ ID NO: 915142 - RNA, 17 nt, Homo sapiens
ugugauccuucaucgaa

SEQ ID NO: 915143 - RNA, 20 nt, Homo sapiens
ugugaucuaucaauagucaa

SEQ ID NO: 915144 - RNA, 13 nt, Homo sapiens
ugugcaacaaaca

SEQ ID NO: 915145 - RNA, 23 nt, Homo sapiens
ugugcaccccuccccauucacag

SEQ ID NO: 915146 - RNA, 17 nt, Homo sapiens
uagaacguaaccacgga

SEQ ID NO: 915147 - RNA, 21 nt, Homo sapiens
uagaagagccugacuguguuc

SEQ ID NO: 915148 - RNA, 18 nt, Homo sapiens
uagaagauuuuaugcugc

SEQ ID NO: 915149 - RNA, 19 nt, Homo sapiens
uagaagauuuuaugcugcu

SEQ ID NO: 915150 - RNA, 15 nt, Homo sapiens
uagaagcaucacagg

SEQ ID NO: 915151 - RNA, 24 nt, Homo sapiens
uagaaggauggcaucuccauguag

SEQ ID NO: 915152 - RNA, 20 nt, Homo sapiens
uagaaguacguuuuugcauu

SEQ ID NO: 915153 - RNA, 15 nt, Homo sapiens
uagaauaaaugaaga

SEQ ID NO: 915154 - RNA, 23 nt, Homo sapiens
uagaauauuuauuaccucugaua

SEQ ID NO: 915155 - RNA, 14 nt, Homo sapiens
uagaaugauucccu

SEQ ID NO: 915156 - RNA, 12 nt, Homo sapiens
uagaaugcacac

SEQ ID NO: 915157 - RNA, 22 nt, Homo sapiens
uagacaugucuagccacugauc

SEQ ID NO: 915158 - RNA, 15 nt, Homo sapiens
uagacuuacuuuccu

SEQ ID NO: 915159 - RNA, 17 nt, Homo sapiens
uagagaaauuugccaau

SEQ ID NO: 915160 - RNA, 23 nt, Homo sapiens
uagagaagaucuaauaccauccu

SEQ ID NO: 915161 - RNA, 14 nt, Homo sapiens
uagagcacacugua

SEQ ID NO: 915162 - RNA, 19 nt, Homo sapiens
uagagcauaccaguacuca

SEQ ID NO: 915163 - RNA, 16 nt, Homo sapiens
uagaggaagaaaacca

SEQ ID NO: 915164 - RNA, 23 nt, Homo sapiens
uagaggcaugaacacacauggau

SEQ ID NO: 915165 - RNA, 23 nt, Homo sapiens
uagaggugcucauucauuuaaca

SEQ ID NO: 915166 - RNA, 13 nt, Homo sapiens
uagagucacugac

SEQ ID NO: 915167 - RNA, 15 nt, Homo sapiens
uagauaaauuucaau

SEQ ID NO: 915168 - RNA, 16 nt, Homo sapiens
uagauauuauucauuc

SEQ ID NO: 915169 - RNA, 23 nt, Homo sapiens
uagaucuuacaucugcagcucuu

SEQ ID NO: 915170 - RNA, 17 nt, Homo sapiens
uagaugcugacuguacu

SEQ ID NO: 915171 - RNA, 14 nt, Homo sapiens
uagauuaccugcca

SEQ ID NO: 915172 - RNA, 16 nt, Homo sapiens
uagcaaagauaucuca

SEQ ID NO: 915173 - RNA, 19 nt, Homo sapiens
uagcacacaauaagcauuc

SEQ ID NO: 915174 - RNA, 14 nt, Homo sapiens
uagcacuauuuaca

SEQ ID NO: 915175 - RNA, 23 nt, Homo sapiens
uagcagaaaccaagucuacuuca

SEQ ID NO: 915176 - RNA, 19 nt, Homo sapiens
uagcagaaggcaagcacca

SEQ ID NO: 915177 - RNA, 14 nt, Homo sapiens
uagcagacaguguu

SEQ ID NO: 915178 - RNA, 18 nt, Homo sapiens
uagcagggaaacagcuaa

SEQ ID NO: 915179 - RNA, 15 nt, Homo sapiens
uagcagucaaaucua

SEQ ID NO: 915180 - RNA, 20 nt, Homo sapiens
uagccacaucacuacaguac

SEQ ID NO: 915181 - RNA, 19 nt, Homo sapiens
uagccaugauaacugcaau

SEQ ID NO: 915182 - RNA, 13 nt, Homo sapiens
uagcccagcacug

SEQ ID NO: 915183 - RNA, 17 nt, Homo sapiens
uagccgaccucagccuu

SEQ ID NO: 915184 - RNA, 22 nt, Homo sapiens
uagccucgccgucugugaauug

SEQ ID NO: 915185 - RNA, 17 nt, Homo sapiens
uagcggaucucacucag

SEQ ID NO: 915186 - RNA, 19 nt, Homo sapiens
uagcggugaagaguacaga

SEQ ID NO: 915187 - RNA, 14 nt, Homo sapiens
uagcuauugcaugu

SEQ ID NO: 915188 - RNA, 20 nt, Homo sapiens
uagcuauuuguuuacaugca

SEQ ID NO: 915189 - RNA, 17 nt, Homo sapiens
uagcucuggaccagccu

SEQ ID NO: 915190 - RNA, 18 nt, Homo sapiens
uagcugagccuucugaug

SEQ ID NO: 915191 - RNA, 21 nt, Homo sapiens
uagcugagccuucugaugaga

SEQ ID NO: 915192 - RNA, 14 nt, Homo sapiens
uagcugagcucaca

SEQ ID NO: 915193 - RNA, 16 nt, Homo sapiens
uagcugggacuacagg

SEQ ID NO: 915194 - RNA, 17 nt, Homo sapiens
uagcugggacuacaggu

SEQ ID NO: 915195 - RNA, 18 nt, Homo sapiens
uagcugggacuacaggug

SEQ ID NO: 915196 - RNA, 23 nt, Homo sapiens
uagcugguucacacugaccaaga

SEQ ID NO: 915197 - RNA, 17 nt, Homo sapiens
uagcuuaaauaaauuca

SEQ ID NO: 915198 - RNA, 20 nt, Homo sapiens
uagcuuggagggauggagag

SEQ ID NO: 915199 - RNA, 22 nt, Homo sapiens
uagcuuuagggcaauauugcca

SEQ ID NO: 915200 - RNA, 17 nt, Homo sapiens
uaggaaaaugcuucugu

SEQ ID NO: 915201 - RNA, 21 nt, Homo sapiens
uaggaaaccuggcauggugcu

SEQ ID NO: 915202 - RNA, 19 nt, Homo sapiens
uaggaaagaagagaaccau

SEQ ID NO: 915203 - RNA, 16 nt, Homo sapiens
uaggaagaccaagaca

SEQ ID NO: 915204 - RNA, 16 nt, Homo sapiens
uaggaagagaaaccag

SEQ ID NO: 915205 - RNA, 23 nt, Homo sapiens
uaggaagugaccgagucuaggaa

SEQ ID NO: 915206 - RNA, 15 nt, Homo sapiens
uaggagacuaaugga

SEQ ID NO: 915207 - RNA, 16 nt, Homo sapiens
uaggagcaauacuauu

SEQ ID NO: 915208 - RNA, 12 nt, Homo sapiens
uaggcaaagacu

SEQ ID NO: 915209 - RNA, 18 nt, Homo sapiens
uaggcaauacauguaucu

SEQ ID NO: 915210 - RNA, 22 nt, Homo sapiens
uaggcauuaaauuuuagcaaag

SEQ ID NO: 915211 - RNA, 23 nt, Homo sapiens
uaggcggucaugugugcauguga

SEQ ID NO: 915212 - RNA, 12 nt, Homo sapiens
uaggcuuaucaa

SEQ ID NO: 915213 - RNA, 17 nt, Homo sapiens
uagggaugacugugauu

SEQ ID NO: 915214 - RNA, 22 nt, Homo sapiens
uagggaugccuuucuaguccua

SEQ ID NO: 915215 - RNA, 16 nt, Homo sapiens
uagggcaacaauacau

SEQ ID NO: 915216 - RNA, 19 nt, Homo sapiens
uagggcaauauugccaugg

SEQ ID NO: 915217 - RNA, 17 nt, Homo sapiens
uagggcagcagaucuuc

SEQ ID NO: 915218 - RNA, 11 nt, Homo sapiens
uaggggaugag

SEQ ID NO: 915219 - RNA, 13 nt, Homo sapiens
uaggggcaaaaau

SEQ ID NO: 915220 - RNA, 22 nt, Homo sapiens
uaggguuauuaguccaaaugug

SEQ ID NO: 915221 - RNA, 12 nt, Homo sapiens
uagguagcuuua

SEQ ID NO: 915222 - RNA, 22 nt, Homo sapiens
uaggugccaggcuguaagcauu

SEQ ID NO: 915223 - RNA, 13 nt, Homo sapiens
uagguuaaaugca

SEQ ID NO: 915224 - RNA, 16 nt, Homo sapiens
uagguuuuuaugggaa

SEQ ID NO: 915225 - RNA, 19 nt, Homo sapiens
uaguaacuuuccauagggc

SEQ ID NO: 915226 - RNA, 21 nt, Homo sapiens
uaguaagaaaacaucacugaa

SEQ ID NO: 915227 - RNA, 17 nt, Homo sapiens
uaguaagccucccuccu

SEQ ID NO: 915228 - RNA, 18 nt, Homo sapiens
uaguagcagagucauugu

SEQ ID NO: 915229 - RNA, 14 nt, Homo sapiens
uaguagcauuucaa

SEQ ID NO: 915230 - RNA, 13 nt, Homo sapiens
uagucaaaccaua

SEQ ID NO: 915231 - RNA, 20 nt, Homo sapiens
uagucaaggaggaaagggau

SEQ ID NO: 915232 - RNA, 23 nt, Homo sapiens
uagucacauggccuaugcacaua

SEQ ID NO: 915233 - RNA, 23 nt, Homo sapiens
uagucagcgcaguuuagcaguua

SEQ ID NO: 915234 - RNA, 21 nt, Homo sapiens
uaguccguuaacacuacuuaa

SEQ ID NO: 915235 - RNA, 23 nt, Homo sapiens
ugaguggcuugugauucugggau

SEQ ID NO: 915236 - RNA, 13 nt, Homo sapiens
ugaguguguuugu

SEQ ID NO: 915237 - RNA, 16 nt, Homo sapiens
ugaguuauuuugcuaa

SEQ ID NO: 915238 - RNA, 19 nt, Homo sapiens
ugaguugggaaaaacugac

SEQ ID NO: 915239 - RNA, 21 nt, Homo sapiens
ugaguugguguugacaugugc

SEQ ID NO: 915240 - RNA, 18 nt, Homo sapiens
ugaguuugcuguuugcaa

SEQ ID NO: 915241 - RNA, 15 nt, Homo sapiens
ugauaaaagcacuua

SEQ ID NO: 915242 - RNA, 15 nt, Homo sapiens
ugauaaagcaguauu

SEQ ID NO: 915243 - RNA, 14 nt, Homo sapiens
ugauaaauucacau

SEQ ID NO: 915244 - RNA, 13 nt, Homo sapiens
ugauaagccuuuc

SEQ ID NO: 915245 - RNA, 15 nt, Homo sapiens
ugauaaggaugauaa

SEQ ID NO: 915246 - RNA, 24 nt, Homo sapiens
uguggacaggacuaacacucagaa

SEQ ID NO: 915247 - RNA, 16 nt, Homo sapiens
uguggagagugagaau

SEQ ID NO: 915248 - RNA, 17 nt, Homo sapiens
uguggagagugagaaua

SEQ ID NO: 915249 - RNA, 18 nt, Homo sapiens
uguggaguggacauucaa

SEQ ID NO: 915250 - RNA, 14 nt, Homo sapiens
uguggauaagggag

SEQ ID NO: 915251 - RNA, 18 nt, Homo sapiens
uguggaugcuccagggca

SEQ ID NO: 915252 - RNA, 22 nt, Homo sapiens
uguggcaggccuaggaccucag

SEQ ID NO: 915253 - RNA, 17 nt, Homo sapiens
uguggcaguuacagggc

SEQ ID NO: 915254 - RNA, 18 nt, Homo sapiens
uguggccuguguccagca

SEQ ID NO: 915255 - RNA, 16 nt, Homo sapiens
uguggcuaaaugccua

SEQ ID NO: 915256 - RNA, 17 nt, Homo sapiens
uguggcugucaggacac

SEQ ID NO: 915257 - RNA, 20 nt, Homo sapiens
ugugggaguaaaacuuuaau

SEQ ID NO: 915258 - RNA, 19 nt, Homo sapiens
uguggucacagccaugaag

SEQ ID NO: 915259 - RNA, 21 nt, Homo sapiens
ugugguccgaagucuuccaua

SEQ ID NO: 915260 - RNA, 22 nt, Homo sapiens
uguggugacaggcccaguggaa

SEQ ID NO: 915261 - RNA, 14 nt, Homo sapiens
uguggugucuagca

SEQ ID NO: 915262 - RNA, 14 nt, Homo sapiens
ugugguuagaaaag

SEQ ID NO: 915263 - RNA, 13 nt, Homo sapiens
uguguacaaagug

SEQ ID NO: 915264 - RNA, 20 nt, Homo sapiens
uguguaccugugacuaaaca

SEQ ID NO: 915265 - RNA, 14 nt, Homo sapiens
uguguagauugcgu

SEQ ID NO: 915266 - RNA, 17 nt, Homo sapiens
uguguauuuaacugccu

SEQ ID NO: 915267 - RNA, 23 nt, Homo sapiens
uguguauuuugagauaaugucaa

SEQ ID NO: 915268 - RNA, 14 nt, Homo sapiens
ugugucacacugag

SEQ ID NO: 915269 - RNA, 15 nt, Homo sapiens
ugugucagcuacugc

SEQ ID NO: 915270 - RNA, 22 nt, Homo sapiens
uguguccccucacucugucagc

SEQ ID NO: 915271 - RNA, 23 nt, Homo sapiens
ugugucucuggaacccaggaccu

SEQ ID NO: 915272 - RNA, 22 nt, Homo sapiens
ugugugaaauguauuaucacca

SEQ ID NO: 915273 - RNA, 17 nt, Homo sapiens
ugugugaaggucuugcc

SEQ ID NO: 915274 - RNA, 14 nt, Homo sapiens
ugugugaccccaaa

SEQ ID NO: 915275 - RNA, 15 nt, Homo sapiens
ugugugaguauguau

SEQ ID NO: 915276 - RNA, 21 nt, Homo sapiens
ugugugcacguacacacacau

SEQ ID NO: 915277 - RNA, 14 nt, Homo sapiens
ugugugcauguaug

SEQ ID NO: 915278 - RNA, 16 nt, Homo sapiens
ugugugcgugugcgca

SEQ ID NO: 915279 - RNA, 13 nt, Homo sapiens
uguguguagccaa

SEQ ID NO: 915280 - RNA, 12 nt, Homo sapiens
ugugugugauau

SEQ ID NO: 915281 - RNA, 12 nt, Homo sapiens
ugugugugcaug

SEQ ID NO: 915282 - RNA, 20 nt, Homo sapiens
uguguuauuauuuugcacug

SEQ ID NO: 915283 - RNA, 20 nt, Homo sapiens
uguguucacacuguaaacau

SEQ ID NO: 915284 - RNA, 15 nt, Homo sapiens
uguuaaaauguacac

SEQ ID NO: 915285 - RNA, 13 nt, Homo sapiens
uguuaaacacgug

SEQ ID NO: 915286 - RNA, 20 nt, Homo sapiens
uguuaacuauuuauucccug

SEQ ID NO: 915287 - RNA, 12 nt, Homo sapiens
uguuaagcaauu

SEQ ID NO: 915288 - RNA, 13 nt, Homo sapiens
uguuaagcaauuc

SEQ ID NO: 915289 - RNA, 13 nt, Homo sapiens
uguuaagugcagg

SEQ ID NO: 915290 - RNA, 19 nt, Homo sapiens
uguuacacagcccaagagg

SEQ ID NO: 915291 - RNA, 17 nt, Homo sapiens
uguuacagaagcugaaa

SEQ ID NO: 915292 - RNA, 15 nt, Homo sapiens
uguuaccuccuauaa

SEQ ID NO: 915293 - RNA, 14 nt, Homo sapiens
uguuacuacaugca

SEQ ID NO: 915294 - RNA, 19 nt, Homo sapiens
uguuagauagaauuuccaa

SEQ ID NO: 915295 - RNA, 13 nt, Homo sapiens
uguuaucugcuag

SEQ ID NO: 915296 - RNA, 17 nt, Homo sapiens
uguuauugcacuaugaa

SEQ ID NO: 915297 - RNA, 15 nt, Homo sapiens
uguucacacuguaaa

SEQ ID NO: 915298 - RNA, 15 nt, Homo sapiens
uguucauguuacuca

SEQ ID NO: 915299 - RNA, 18 nt, Homo sapiens
uguuccauuggguccucu

SEQ ID NO: 915300 - RNA, 22 nt, Homo sapiens
uguucccuccccgaucaucuuu

SEQ ID NO: 915301 - RNA, 20 nt, Homo sapiens
uguuccuacucagacuguug

SEQ ID NO: 915302 - RNA, 17 nt, Homo sapiens
uguuccuguugaaucuu

SEQ ID NO: 915303 - RNA, 15 nt, Homo sapiens
uguucuaaguauuug

SEQ ID NO: 915304 - RNA, 21 nt, Homo sapiens
uguucuagcccucccuggcau

SEQ ID NO: 915305 - RNA, 13 nt, Homo sapiens
uguucucacuuau

SEQ ID NO: 915306 - RNA, 16 nt, Homo sapiens
uguucucugaggacac

SEQ ID NO: 915307 - RNA, 14 nt, Homo sapiens
uguucucuucuaua

SEQ ID NO: 915308 - RNA, 21 nt, Homo sapiens
uguucuuagcugaacaaugaa

SEQ ID NO: 915309 - RNA, 14 nt, Homo sapiens
uguucuugaugaca

SEQ ID NO: 915310 - RNA, 15 nt, Homo sapiens
uguugagugcaacaa

SEQ ID NO: 915311 - RNA, 16 nt, Homo sapiens
uguugcaaugacacau

SEQ ID NO: 915312 - RNA, 12 nt, Homo sapiens
uguugcaccuca

SEQ ID NO: 915313 - RNA, 21 nt, Homo sapiens
uguugcuggacugucauagaa

SEQ ID NO: 915314 - RNA, 18 nt, Homo sapiens
uguuggaaaaugugcaau

SEQ ID NO: 915315 - RNA, 19 nt, Homo sapiens
uguuggaaaaugugcaaua

SEQ ID NO: 915316 - RNA, 19 nt, Homo sapiens
uguuguaaaugaccaagaa

SEQ ID NO: 915317 - RNA, 15 nt, Homo sapiens
uguuguaagcacuga

SEQ ID NO: 915318 - RNA, 22 nt, Homo sapiens
uguugucauuauguacaauaca

SEQ ID NO: 915319 - RNA, 22 nt, Homo sapiens
uguuguggguuuuuucacauaa

SEQ ID NO: 915320 - RNA, 19 nt, Homo sapiens
uguuuaaauaaaguaucau

SEQ ID NO: 915321 - RNA, 22 nt, Homo sapiens
uguuuaaguggcuuucagcaaa

SEQ ID NO: 915322 - RNA, 15 nt, Homo sapiens
uguuuacagacugug

SEQ ID NO: 915323 - RNA, 13 nt, Homo sapiens
uguuuacccagua

SEQ ID NO: 915324 - RNA, 16 nt, Homo sapiens
uguuuacccaguauuc

SEQ ID NO: 915325 - RNA, 14 nt, Homo sapiens
uguuuacuaaagag

SEQ ID NO: 915326 - RNA, 23 nt, Homo sapiens
uguuuagaagagccugacugugu

SEQ ID NO: 915327 - RNA, 12 nt, Homo sapiens
uguuuaguugca

SEQ ID NO: 915328 - RNA, 14 nt, Homo sapiens
uguuuauuccugau

SEQ ID NO: 915329 - RNA, 14 nt, Homo sapiens
uguuucacuaugau

SEQ ID NO: 915330 - RNA, 23 nt, Homo sapiens
uguuuccaugggucaaagccggu

SEQ ID NO: 915331 - RNA, 14 nt, Homo sapiens
uguuucccaccuca

SEQ ID NO: 915332 - RNA, 21 nt, Homo sapiens
uguuucuaaaacuaugguucc

SEQ ID NO: 915333 - RNA, 13 nt, Homo sapiens
uguuucuaacuca

SEQ ID NO: 915334 - RNA, 15 nt, Homo sapiens
uguuucuggggacac

SEQ ID NO: 915335 - RNA, 12 nt, Homo sapiens
uguuucuuccaa

SEQ ID NO: 915336 - RNA, 16 nt, Homo sapiens
uguuucuuucauauga

SEQ ID NO: 915337 - RNA, 11 nt, Homo sapiens
uguuugcacuu

SEQ ID NO: 915338 - RNA, 17 nt, Homo sapiens
uguuuuagcuccuugac

SEQ ID NO: 915339 - RNA, 20 nt, Homo sapiens
uguuuuaucauuaccauuaa

SEQ ID NO: 915340 - RNA, 12 nt, Homo sapiens
uguuuucaccuc

SEQ ID NO: 915341 - RNA, 22 nt, Homo sapiens
uguuuuccuggcaucuuucaac

SEQ ID NO: 915342 - RNA, 17 nt, Homo sapiens
uguuuugcccaccagau

SEQ ID NO: 915343 - RNA, 14 nt, Homo sapiens
uguuuuuaaguccu

SEQ ID NO: 915344 - RNA, 23 nt, Homo sapiens
uguuuuuacccugccccugccuu

SEQ ID NO: 915345 - RNA, 20 nt, Homo sapiens
uuaaaaaaaguauauauucu

SEQ ID NO: 915346 - RNA, 16 nt, Homo sapiens
uuaaaaaacguauuau

SEQ ID NO: 915347 - RNA, 11 nt, Homo sapiens
uuaaaaaccac

SEQ ID NO: 915348 - RNA, 18 nt, Homo sapiens
uuaaaaaguucauaacag

SEQ ID NO: 915349 - RNA, 19 nt, Homo sapiens
uuaaaaauaaagcuacuga

SEQ ID NO: 915350 - RNA, 16 nt, Homo sapiens
uuaaaacaaggcuuaa

SEQ ID NO: 915351 - RNA, 13 nt, Homo sapiens
uuaaaacacagcu

SEQ ID NO: 915352 - RNA, 19 nt, Homo sapiens
uuaaaagacugcagcugcu

SEQ ID NO: 915353 - RNA, 15 nt, Homo sapiens
uuaaaagauucacua

SEQ ID NO: 915354 - RNA, 14 nt, Homo sapiens
uuaaaauagcaaaa

SEQ ID NO: 915355 - RNA, 23 nt, Homo sapiens
uuaaaauauuuuuaugugcaaua

SEQ ID NO: 915356 - RNA, 16 nt, Homo sapiens
uuaaaauuagugagau

SEQ ID NO: 915357 - RNA, 13 nt, Homo sapiens
uuaaaauugguaa

SEQ ID NO: 915358 - RNA, 22 nt, Homo sapiens
uuaaacaacaaacaaaacgcaa

SEQ ID NO: 915359 - RNA, 20 nt, Homo sapiens
uuaaacccugccccacuucu

SEQ ID NO: 915360 - RNA, 18 nt, Homo sapiens
uuaaaccucucuucuacc

SEQ ID NO: 915361 - RNA, 21 nt, Homo sapiens
uuaaacucagggagcauuuau

SEQ ID NO: 915362 - RNA, 10 nt, Homo sapiens
ugcaucucau

SEQ ID NO: 915363 - RNA, 11 nt, Homo sapiens
ugcaucucauu

SEQ ID NO: 915364 - RNA, 15 nt, Homo sapiens
ugcaucuguacucac

SEQ ID NO: 915365 - RNA, 14 nt, Homo sapiens
ugcauggaauuugu

SEQ ID NO: 915366 - RNA, 13 nt, Homo sapiens
ugcauguccucaa

SEQ ID NO: 915367 - RNA, 14 nt, Homo sapiens
ugcauguccucaaa

SEQ ID NO: 915368 - RNA, 15 nt, Homo sapiens
ugcauguccucaaaa

SEQ ID NO: 915369 - RNA, 15 nt, Homo sapiens
ugcauuaaaaaugca

SEQ ID NO: 915370 - RNA, 16 nt, Homo sapiens
ugcauucccagugguc

SEQ ID NO: 915371 - RNA, 20 nt, Homo sapiens
ugcauuuauggucaacacuu

SEQ ID NO: 915372 - RNA, 14 nt, Homo sapiens
uuucaagacuugau

SEQ ID NO: 915373 - RNA, 21 nt, Homo sapiens
uuucacaaaaaggcauaugca

SEQ ID NO: 915374 - RNA, 18 nt, Homo sapiens
uggggagccugagccaca

SEQ ID NO: 915375 - RNA, 19 nt, Homo sapiens
uggggagggagagccauca

SEQ ID NO: 915376 - RNA, 15 nt, Homo sapiens
uggggcaggaucuca

SEQ ID NO: 915377 - RNA, 18 nt, Homo sapiens
ugggggaggcggcacauu

SEQ ID NO: 915378 - RNA, 21 nt, Homo sapiens
ugggggccucuuucugugcuu

SEQ ID NO: 915379 - RNA, 16 nt, Homo sapiens
ugggggcuagcagaag

SEQ ID NO: 915380 - RNA, 18 nt, Homo sapiens
ugggguacccacugcucu

SEQ ID NO: 915381 - RNA, 16 nt, Homo sapiens
ugggguauggcaucua

SEQ ID NO: 915382 - RNA, 19 nt, Homo sapiens
ugggguugcaaccacugca

SEQ ID NO: 915383 - RNA, 17 nt, Homo sapiens
ugggguuucaccaucuu

SEQ ID NO: 915384 - RNA, 18 nt, Homo sapiens
uggguacuuguggacaca

SEQ ID NO: 915385 - RNA, 18 nt, Homo sapiens
ugggucuggggagggaga

SEQ ID NO: 915386 - RNA, 21 nt, Homo sapiens
ugggucuucccuguaugauuc

SEQ ID NO: 915387 - RNA, 20 nt, Homo sapiens
ugggugucaagagggucuga

SEQ ID NO: 915388 - RNA, 14 nt, Homo sapiens
uggguguugaccac

SEQ ID NO: 915389 - RNA, 17 nt, Homo sapiens
uggguguuuaaaaaagu

SEQ ID NO: 915390 - RNA, 18 nt, Homo sapiens
ugguaaacauucucucag

SEQ ID NO: 915391 - RNA, 15 nt, Homo sapiens
ugguaaauuaguauu

SEQ ID NO: 915392 - RNA, 12 nt, Homo sapiens
ugguaacugcac

SEQ ID NO: 915393 - RNA, 13 nt, Homo sapiens
ugguaaguaacug

SEQ ID NO: 915394 - RNA, 16 nt, Homo sapiens
ugguaauaaaccuuga

SEQ ID NO: 915395 - RNA, 14 nt, Homo sapiens
ugguacagcacugu

SEQ ID NO: 915396 - RNA, 14 nt, Homo sapiens
ugguaccagcucac

SEQ ID NO: 915397 - RNA, 17 nt, Homo sapiens
ugguauauuuguguaug

SEQ ID NO: 915398 - RNA, 20 nt, Homo sapiens
ugguaugaacuugaggacac

SEQ ID NO: 915399 - RNA, 20 nt, Homo sapiens
ugguaugcuggccagcaccc

SEQ ID NO: 915400 - RNA, 15 nt, Homo sapiens
ugguauuaauacugc

SEQ ID NO: 915401 - RNA, 19 nt, Homo sapiens
ugguauuauuuacaaugca

SEQ ID NO: 915402 - RNA, 15 nt, Homo sapiens
uggucaacacuuaag

SEQ ID NO: 915403 - RNA, 19 nt, Homo sapiens
uggucacagccaugaaguc

SEQ ID NO: 915404 - RNA, 19 nt, Homo sapiens
uggucagcucacacccuaa

SEQ ID NO: 915405 - RNA, 18 nt, Homo sapiens
ugguccgaagucuuccau

SEQ ID NO: 915406 - RNA, 23 nt, Homo sapiens
uggucuaaaaauaaaccaaagga

SEQ ID NO: 915407 - RNA, 19 nt, Homo sapiens
uggucuccucugauuauca

SEQ ID NO: 915408 - RNA, 16 nt, Homo sapiens
uggucuccuugcacuu

SEQ ID NO: 915409 - RNA, 18 nt, Homo sapiens
uggucuccuugcacuuuc

SEQ ID NO: 915410 - RNA, 20 nt, Homo sapiens
uggucuuguggaauugggag

SEQ ID NO: 915411 - RNA, 17 nt, Homo sapiens
uggucuuuauuccuccc

SEQ ID NO: 915412 - RNA, 23 nt, Homo sapiens
uggugaaagaaaauucuuggaau

SEQ ID NO: 915413 - RNA, 15 nt, Homo sapiens
uggugacacacagca

SEQ ID NO: 915414 - RNA, 17 nt, Homo sapiens
uggugacacacagcagc

SEQ ID NO: 915415 - RNA, 17 nt, Homo sapiens
uggugacaugugccugu

SEQ ID NO: 915416 - RNA, 17 nt, Homo sapiens
uggugacugaaacauuc

SEQ ID NO: 915417 - RNA, 19 nt, Homo sapiens
uggugagccgagauugcac

SEQ ID NO: 915418 - RNA, 22 nt, Homo sapiens
uggugaggaagccccaagccau

SEQ ID NO: 915419 - RNA, 14 nt, Homo sapiens
uggugaucagugca

SEQ ID NO: 915420 - RNA, 21 nt, Homo sapiens
uggugccuauuuauucauuca

SEQ ID NO: 915421 - RNA, 20 nt, Homo sapiens
ugguggcacacgccuguaau

SEQ ID NO: 915422 - RNA, 17 nt, Homo sapiens
uggugggaacauucgag

SEQ ID NO: 915423 - RNA, 17 nt, Homo sapiens
uggugggccacguguuc

SEQ ID NO: 915424 - RNA, 17 nt, Homo sapiens
ugguggugggugccugu

SEQ ID NO: 915425 - RNA, 22 nt, Homo sapiens
ugguguaaagccaacacccugu

SEQ ID NO: 915426 - RNA, 17 nt, Homo sapiens
ugguguaaugcacaauu

SEQ ID NO: 915427 - RNA, 15 nt, Homo sapiens
ugguguaauuuauaa

SEQ ID NO: 915428 - RNA, 11 nt, Homo sapiens
uggugucuguc

SEQ ID NO: 915429 - RNA, 20 nt, Homo sapiens
ugguguggccagcacucuga

SEQ ID NO: 915430 - RNA, 21 nt, Homo sapiens
ugguguggccagcacucugaa

SEQ ID NO: 915431 - RNA, 20 nt, Homo sapiens
ugguguuguauacuucauua

SEQ ID NO: 915432 - RNA, 16 nt, Homo sapiens
ugguuacucuggugcu

SEQ ID NO: 915433 - RNA, 20 nt, Homo sapiens
ugguuaucuaauauguaaca

SEQ ID NO: 915434 - RNA, 19 nt, Homo sapiens
ugguuccaugccugagggu

SEQ ID NO: 915435 - RNA, 20 nt, Homo sapiens
ugguucguguucauacugca

SEQ ID NO: 915436 - RNA, 14 nt, Homo sapiens
ugguugacauugua

SEQ ID NO: 915437 - RNA, 16 nt, Homo sapiens
ugguugaugccaaaaa

SEQ ID NO: 915438 - RNA, 13 nt, Homo sapiens
ugguugauuccca

SEQ ID NO: 915439 - RNA, 20 nt, Homo sapiens
ugguugggguggggcaggau

SEQ ID NO: 915440 - RNA, 12 nt, Homo sapiens
ugguugucacuc

SEQ ID NO: 915441 - RNA, 19 nt, Homo sapiens
uguaaaauaaguauuucca

SEQ ID NO: 915442 - RNA, 13 nt, Homo sapiens
uguaaacagcucu

SEQ ID NO: 915443 - RNA, 21 nt, Homo sapiens
uguaaacauagauagugcuuu

SEQ ID NO: 915444 - RNA, 19 nt, Homo sapiens
uguaaacuauaaacuacug

SEQ ID NO: 915445 - RNA, 23 nt, Homo sapiens
uguaaacuauaaacuacuguaau

SEQ ID NO: 915446 - RNA, 22 nt, Homo sapiens
uguaaagaauaaaugaaucuua

SEQ ID NO: 915447 - RNA, 15 nt, Homo sapiens
uguaaaggccuuuaa

SEQ ID NO: 915448 - RNA, 20 nt, Homo sapiens
uguaaauaaauagauuugau

SEQ ID NO: 915449 - RNA, 17 nt, Homo sapiens
uguaaaucacuuguaaa

SEQ ID NO: 915450 - RNA, 20 nt, Homo sapiens
uguaaaugcucgugugauuu

SEQ ID NO: 915451 - RNA, 13 nt, Homo sapiens
uguaaaugugcuu

SEQ ID NO: 915452 - RNA, 16 nt, Homo sapiens
uguaaauuaauacuuc

SEQ ID NO: 915453 - RNA, 22 nt, Homo sapiens
uguaaauuauuucauacaaaac

SEQ ID NO: 915454 - RNA, 17 nt, Homo sapiens
uguaacacugcaagaag

SEQ ID NO: 915455 - RNA, 15 nt, Homo sapiens
uguaauaaaucugag

SEQ ID NO: 915456 - RNA, 16 nt, Homo sapiens
uguaaucaaacugcaa

SEQ ID NO: 915457 - RNA, 14 nt, Homo sapiens
uguaaucauauaau

SEQ ID NO: 915458 - RNA, 13 nt, Homo sapiens
uguaaucccagca

SEQ ID NO: 915459 - RNA, 19 nt, Homo sapiens
uguaaucccagcacuuugg

SEQ ID NO: 915460 - RNA, 23 nt, Homo sapiens
uguaauucaucagucauuauuag

SEQ ID NO: 915461 - RNA, 13 nt, Homo sapiens
uguacaccaaggu

SEQ ID NO: 915462 - RNA, 13 nt, Homo sapiens
uguacacugugua

SEQ ID NO: 915463 - RNA, 15 nt, Homo sapiens
uguacagacguaugc

SEQ ID NO: 915464 - RNA, 19 nt, Homo sapiens
uguacaguguguaaagugu

SEQ ID NO: 915465 - RNA, 19 nt, Homo sapiens
uguacaguuauacauaccu

SEQ ID NO: 915466 - RNA, 22 nt, Homo sapiens
uguacauauauauucuacauau

SEQ ID NO: 915467 - RNA, 20 nt, Homo sapiens
uguacauguguagccugugc

SEQ ID NO: 915468 - RNA, 22 nt, Homo sapiens
uguacauguguagccugugcau

SEQ ID NO: 915469 - RNA, 17 nt, Homo sapiens
uguacauuccugauacu

SEQ ID NO: 915470 - RNA, 22 nt, Homo sapiens
uguacauuccugauacugggua

SEQ ID NO: 915471 - RNA, 19 nt, Homo sapiens
uguacauuggucuuucuac

SEQ ID NO: 915472 - RNA, 19 nt, Homo sapiens
uguaccaaaaaauauugcu

SEQ ID NO: 915473 - RNA, 14 nt, Homo sapiens
uguaccaguguacu

SEQ ID NO: 915474 - RNA, 13 nt, Homo sapiens
uguaccaguguga

SEQ ID NO: 915475 - RNA, 19 nt, Homo sapiens
uguaccaucugucuugcca

SEQ ID NO: 915476 - RNA, 15 nt, Homo sapiens
uguacccacuccuca

SEQ ID NO: 915477 - RNA, 14 nt, Homo sapiens
uguacccuuccuac

SEQ ID NO: 915478 - RNA, 19 nt, Homo sapiens
uguacccuuccuacagaua

SEQ ID NO: 915479 - RNA, 15 nt, Homo sapiens
uguaccuaugugaca

SEQ ID NO: 915480 - RNA, 23 nt, Homo sapiens
uguacgguggucuuugaauuaua

SEQ ID NO: 915481 - RNA, 12 nt, Homo sapiens
uguacguaaugu

SEQ ID NO: 915482 - RNA, 19 nt, Homo sapiens
uguacuauguuaauaacuu

SEQ ID NO: 915483 - RNA, 15 nt, Homo sapiens
uguacuccugugcug

SEQ ID NO: 915484 - RNA, 23 nt, Homo sapiens
uguacucuacgccaaagugcagc

SEQ ID NO: 915485 - RNA, 17 nt, Homo sapiens
uguacugagacauuaca

SEQ ID NO: 915486 - RNA, 19 nt, Homo sapiens
uuuucaagagugcaguuga

SEQ ID NO: 915487 - RNA, 12 nt, Homo sapiens
uuuucaccucau

SEQ ID NO: 915488 - RNA, 23 nt, Homo sapiens
uuuucacgggaacucuccaaaua

SEQ ID NO: 915489 - RNA, 18 nt, Homo sapiens
uguagacuuacuuuccua

SEQ ID NO: 915490 - RNA, 20 nt, Homo sapiens
uguagaguggcccagaauug

SEQ ID NO: 915491 - RNA, 21 nt, Homo sapiens
uguagauuaccugccacuucc

SEQ ID NO: 915492 - RNA, 19 nt, Homo sapiens
uguagccauggcucaggca

SEQ ID NO: 915493 - RNA, 17 nt, Homo sapiens
uguagccccagugacag

SEQ ID NO: 915494 - RNA, 20 nt, Homo sapiens
uguagccucgccgucuguga

SEQ ID NO: 915495 - RNA, 14 nt, Homo sapiens
uguagccugugcau

SEQ ID NO: 915496 - RNA, 13 nt, Homo sapiens
uguagcucuaugg

SEQ ID NO: 915497 - RNA, 15 nt, Homo sapiens
uguagcucuguccac

SEQ ID NO: 915498 - RNA, 12 nt, Homo sapiens
uguaggaagauu

SEQ ID NO: 915499 - RNA, 18 nt, Homo sapiens
uguaggcagggaaccuua

SEQ ID NO: 915500 - RNA, 21 nt, Homo sapiens
uguaggccccuggucugcccu

SEQ ID NO: 915501 - RNA, 16 nt, Homo sapiens
uguaggguaaggugcc

SEQ ID NO: 915502 - RNA, 15 nt, Homo sapiens
uguaggugaaagugu

SEQ ID NO: 915503 - RNA, 16 nt, Homo sapiens
uguagugugucagagu

SEQ ID NO: 915504 - RNA, 15 nt, Homo sapiens
uguauaagcuacuca

SEQ ID NO: 915505 - RNA, 22 nt, Homo sapiens
uguauaaugguguuacuaaagu

SEQ ID NO: 915506 - RNA, 22 nt, Homo sapiens
uguauaauuuaacagugcccuu

SEQ ID NO: 915507 - RNA, 12 nt, Homo sapiens
uguauacugugg

SEQ ID NO: 915508 - RNA, 16 nt, Homo sapiens
uguauagacagcacuu

SEQ ID NO: 915509 - RNA, 13 nt, Homo sapiens
uguaucagaguug

SEQ ID NO: 915510 - RNA, 18 nt, Homo sapiens
uguaucggagacagugau

SEQ ID NO: 915511 - RNA, 15 nt, Homo sapiens
uguaucuaauccuca

SEQ ID NO: 915512 - RNA, 20 nt, Homo sapiens
uguaucuaccucacuauuca

SEQ ID NO: 915513 - RNA, 15 nt, Homo sapiens
uguaucuaugcauuu

SEQ ID NO: 915514 - RNA, 22 nt, Homo sapiens
uguauguaggcaauacauguau

SEQ ID NO: 915515 - RNA, 15 nt, Homo sapiens
uguaugucugccuaa

SEQ ID NO: 915516 - RNA, 15 nt, Homo sapiens
uguaugugaaagugu

SEQ ID NO: 915517 - RNA, 18 nt, Homo sapiens
uguauguuccucuaugaa

SEQ ID NO: 915518 - RNA, 23 nt, Homo sapiens
uguauguuuacauaucaccucau

SEQ ID NO: 915519 - RNA, 16 nt, Homo sapiens
uguauuugcauaugua

SEQ ID NO: 915520 - RNA, 19 nt, Homo sapiens
uguauuuuugucauaugua

SEQ ID NO: 915521 - RNA, 13 nt, Homo sapiens
ugucaaugcauca

SEQ ID NO: 915522 - RNA, 14 nt, Homo sapiens
ugucaaugcaucaa

SEQ ID NO: 915523 - RNA, 14 nt, Homo sapiens
ugucaccagcaaca

SEQ ID NO: 915524 - RNA, 18 nt, Homo sapiens
ugucaccagcugccaaaa

SEQ ID NO: 915525 - RNA, 18 nt, Homo sapiens
ugucacccugcagagcua

SEQ ID NO: 915526 - RNA, 18 nt, Homo sapiens
ugucacuguuccuuguca

SEQ ID NO: 915527 - RNA, 21 nt, Homo sapiens
ugucagaaaccaguuauguga

SEQ ID NO: 915528 - RNA, 21 nt, Homo sapiens
ugucagagcugggaguagcau

SEQ ID NO: 915529 - RNA, 19 nt, Homo sapiens
ugucagucugggugucuca

SEQ ID NO: 915530 - RNA, 12 nt, Homo sapiens
ugucagugcucg

SEQ ID NO: 915531 - RNA, 16 nt, Homo sapiens
ugucaguuucauggag

SEQ ID NO: 915532 - RNA, 20 nt, Homo sapiens
ugucauagaaagugccagaa

SEQ ID NO: 915533 - RNA, 23 nt, Homo sapiens
ugucauauguauuuuguauuugc

SEQ ID NO: 915534 - RNA, 16 nt, Homo sapiens
ugucaucauacaugac

SEQ ID NO: 915535 - RNA, 23 nt, Homo sapiens
ugucaucccauauaacuaagaca

SEQ ID NO: 915536 - RNA, 20 nt, Homo sapiens
ugucauggaaaagcccagug

SEQ ID NO: 915537 - RNA, 19 nt, Homo sapiens
ugucauuauguacaauaca

SEQ ID NO: 915538 - RNA, 23 nt, Homo sapiens
uguccaaauggacauaagacaga

SEQ ID NO: 915539 - RNA, 22 nt, Homo sapiens
uguccagaccauugucuuccaa

SEQ ID NO: 915540 - RNA, 18 nt, Homo sapiens
uguccagugcaaccacac

SEQ ID NO: 915541 - RNA, 17 nt, Homo sapiens
uguccauguauucacac

SEQ ID NO: 915542 - RNA, 12 nt, Homo sapiens
ugucccaaagaa

SEQ ID NO: 915543 - RNA, 18 nt, Homo sapiens
uguccgcuuucaugaaca

SEQ ID NO: 915544 - RNA, 22 nt, Homo sapiens
uguccuaaaauacaaacaagca

SEQ ID NO: 915545 - RNA, 17 nt, Homo sapiens
uguccuacccacccucc

SEQ ID NO: 915546 - RNA, 17 nt, Homo sapiens
uguccucccuuguggcu

SEQ ID NO: 915547 - RNA, 16 nt, Homo sapiens
uguccucuugcucaaa

SEQ ID NO: 915548 - RNA, 14 nt, Homo sapiens
uguccugccagcug

SEQ ID NO: 915549 - RNA, 21 nt, Homo sapiens
uguccuucuuuaucugugaua

SEQ ID NO: 915550 - RNA, 21 nt, Homo sapiens
uguccuuuuggcacugagaua

SEQ ID NO: 915551 - RNA, 17 nt, Homo sapiens
ugucgauuucaccaaga

SEQ ID NO: 915552 - RNA, 15 nt, Homo sapiens
ugucgcaucucagcg

SEQ ID NO: 915553 - RNA, 19 nt, Homo sapiens
ugucgccaggcuagagugc

SEQ ID NO: 915554 - RNA, 14 nt, Homo sapiens
ugucgucuuuaugu

SEQ ID NO: 915555 - RNA, 16 nt, Homo sapiens
ugucuaaagagcuuua

SEQ ID NO: 915556 - RNA, 15 nt, Homo sapiens
ugucuauaauggaaa

SEQ ID NO: 915557 - RNA, 16 nt, Homo sapiens
ugucuauaauggaaac

SEQ ID NO: 915558 - RNA, 17 nt, Homo sapiens
ugucuauguugugaucc

SEQ ID NO: 915559 - RNA, 20 nt, Homo sapiens
ugucuauguugugauccuuc

SEQ ID NO: 915560 - RNA, 21 nt, Homo sapiens
ugucucaacuacucagcucuc

SEQ ID NO: 915561 - RNA, 10 nt, Homo sapiens
ugucucucau

SEQ ID NO: 915562 - RNA, 13 nt, Homo sapiens
ugucucucaugaa

SEQ ID NO: 915563 - RNA, 13 nt, Homo sapiens
ugucucugagaac

SEQ ID NO: 915564 - RNA, 12 nt, Homo sapiens
ugucucugccug

SEQ ID NO: 915565 - RNA, 18 nt, Homo sapiens
ugucucuuuaaugucaca

SEQ ID NO: 915566 - RNA, 15 nt, Homo sapiens
ugucuggugguggca

SEQ ID NO: 915567 - RNA, 14 nt, Homo sapiens
ugucugucccaaag

SEQ ID NO: 915568 - RNA, 17 nt, Homo sapiens
ugucuuacauaaucaca

SEQ ID NO: 915569 - RNA, 15 nt, Homo sapiens
ugucuuacugugauc

SEQ ID NO: 915570 - RNA, 22 nt, Homo sapiens
ugucuuauagguuuccacugcc

SEQ ID NO: 915571 - RNA, 16 nt, Homo sapiens
ugucuucacaaccucc

SEQ ID NO: 915572 - RNA, 19 nt, Homo sapiens
ugucuuccuuggccuauuc

SEQ ID NO: 915573 - RNA, 18 nt, Homo sapiens
ugucuuuuuucacuacau

SEQ ID NO: 915574 - RNA, 23 nt, Homo sapiens
ugugaaagaaccaaaagagauca

SEQ ID NO: 915575 - RNA, 15 nt, Homo sapiens
ugugaacacaucagc

SEQ ID NO: 915576 - RNA, 16 nt, Homo sapiens
ugugaauaaaaacccu

SEQ ID NO: 915577 - RNA, 14 nt, Homo sapiens
ugugaaugaucucu

SEQ ID NO: 915578 - RNA, 21 nt, Homo sapiens
ugugaccaaaaguuacauguu

SEQ ID NO: 915579 - RNA, 18 nt, Homo sapiens
ugugaccccaccuugacg

SEQ ID NO: 915580 - RNA, 13 nt, Homo sapiens
ugugacuuuccua

SEQ ID NO: 915581 - RNA, 20 nt, Homo sapiens
ugugagagcugguugcuaca

SEQ ID NO: 915582 - RNA, 12 nt, Homo sapiens
ugugagcaagaa

SEQ ID NO: 915583 - RNA, 20 nt, Homo sapiens
ugugaggaugaaaggaguga

SEQ ID NO: 915584 - RNA, 15 nt, Homo sapiens
ugugagguaacuggg

SEQ ID NO: 915585 - RNA, 19 nt, Homo sapiens
ugugauauuuuuacuugca

SEQ ID NO: 915586 - RNA, 17 nt, Homo sapiens
ugugauguuaacuauua

SEQ ID NO: 915587 - RNA, 12 nt, Homo sapiens
ugugauuuucag

SEQ ID NO: 915588 - RNA, 9 nt, Homo sapiens
ugugcaaua

SEQ ID NO: 915589 - RNA, 20 nt, Homo sapiens
ugugcaccccuccccauuca

SEQ ID NO: 915590 - RNA, 22 nt, Homo sapiens
ugugcacggcagcuugagccug

SEQ ID NO: 915591 - RNA, 12 nt, Homo sapiens
ugugcagacuga

SEQ ID NO: 915592 - RNA, 15 nt, Homo sapiens
ugugcagacuguggc

SEQ ID NO: 915593 - RNA, 17 nt, Homo sapiens
ugugccaaagugcauag

SEQ ID NO: 915594 - RNA, 17 nt, Homo sapiens
ugugccccuguaaauag

SEQ ID NO: 915595 - RNA, 20 nt, Homo sapiens
ugugcccuccaccuaccugc

SEQ ID NO: 915596 - RNA, 16 nt, Homo sapiens
ugugccgugacagggc

SEQ ID NO: 915597 - RNA, 15 nt, Homo sapiens
ugugccuuacuuaag

SEQ ID NO: 915598 - RNA, 18 nt, Homo sapiens
ugugccuuugaccaucuc

SEQ ID NO: 915599 - RNA, 13 nt, Homo sapiens
ugugcgcacacac

SEQ ID NO: 915600 - RNA, 15 nt, Homo sapiens
ugugcgucucucuuu

SEQ ID NO: 915601 - RNA, 22 nt, Homo sapiens
ugugcugaguugguguugacau

SEQ ID NO: 915602 - RNA, 18 nt, Homo sapiens
ugugcuucucuuuguccc

SEQ ID NO: 915603 - RNA, 16 nt, Homo sapiens
ugugcuugucaucugc

SEQ ID NO: 915604 - RNA, 13 nt, Homo sapiens
uuuucacucuggg

SEQ ID NO: 915605 - RNA, 10 nt, Homo sapiens
uuuucacugc

SEQ ID NO: 915606 - RNA, 17 nt, Homo sapiens
uuuucaggaauacauuu

SEQ ID NO: 915607 - RNA, 22 nt, Homo sapiens
uuuuccacaagauucccagaga

SEQ ID NO: 915608 - RNA, 13 nt, Homo sapiens
uuuuccaucaugu

SEQ ID NO: 915609 - RNA, 13 nt, Homo sapiens
uuuucccaccacc

SEQ ID NO: 915610 - RNA, 14 nt, Homo sapiens
uuuuccuacauuga

SEQ ID NO: 915611 - RNA, 20 nt, Homo sapiens
uuuucuccacuuuguuggaa

SEQ ID NO: 915612 - RNA, 12 nt, Homo sapiens
uuuucugauuug

SEQ ID NO: 915613 - RNA, 22 nt, Homo sapiens
uuuucugcuaaaaaguccuuga

SEQ ID NO: 915614 - RNA, 17 nt, Homo sapiens
uuuucuggugaugccca

SEQ ID NO: 915615 - RNA, 14 nt, Homo sapiens
uuuucugucucucu

SEQ ID NO: 915616 - RNA, 20 nt, Homo sapiens
uuuugagaauacacuaucaa

SEQ ID NO: 915617 - RNA, 22 nt, Homo sapiens
uuuugaggaauuaucaugggaa

SEQ ID NO: 915618 - RNA, 11 nt, Homo sapiens
uuuugaugaaa

SEQ ID NO: 915619 - RNA, 19 nt, Homo sapiens
uuuuggcagcaaaguguca

SEQ ID NO: 915620 - RNA, 13 nt, Homo sapiens
uuuuggccaaagu

SEQ ID NO: 915621 - RNA, 15 nt, Homo sapiens
uuuugggaaaacugg

SEQ ID NO: 915622 - RNA, 21 nt, Homo sapiens
uuuugucugcuuaguaucuca

SEQ ID NO: 915623 - RNA, 15 nt, Homo sapiens
uuuuguuauugggca

SEQ ID NO: 915624 - RNA, 17 nt, Homo sapiens
uuuuuaacugcauaaua

SEQ ID NO: 915625 - RNA, 17 nt, Homo sapiens
uuuuuacuccaguggug

SEQ ID NO: 915626 - RNA, 12 nt, Homo sapiens
uuuuuaguaugu

SEQ ID NO: 915627 - RNA, 20 nt, Homo sapiens
uuuuuauggaggcuuugcau

SEQ ID NO: 915628 - RNA, 23 nt, Homo sapiens
uuuuucagaaagcauuacauuuc

SEQ ID NO: 915629 - RNA, 15 nt, Homo sapiens
uuuuucuugugcuga

SEQ ID NO: 915630 - RNA, 18 nt, Homo sapiens
uuuuuguggugucuagca

SEQ ID NO: 915631 - RNA, 18 nt, Homo sapiens
uuuuuuaaaaaagcuuaa

SEQ ID NO: 915632 - RNA, 13 nt, Homo sapiens
uuuuuuaacauuc

SEQ ID NO: 915633 - RNA, 21 nt, Homo sapiens
uuuuuuaggaagcaagcuuaa

SEQ ID NO: 915634 - RNA, 18 nt, Homo sapiens
uuaaacuuaccugggcau

SEQ ID NO: 915635 - RNA, 19 nt, Homo sapiens
uuaaacuugacccaggugg

SEQ ID NO: 915636 - RNA, 20 nt, Homo sapiens
uuaaagaaagucgaauuaau

SEQ ID NO: 915637 - RNA, 19 nt, Homo sapiens
uuaaagcauuuacuuugaa

SEQ ID NO: 915638 - RNA, 20 nt, Homo sapiens
uuaaagccuuuagagccagc

SEQ ID NO: 915639 - RNA, 13 nt, Homo sapiens
uuaaagcuguuau

SEQ ID NO: 915640 - RNA, 22 nt, Homo sapiens
uuaaaggagaaguagcugugaa

SEQ ID NO: 915641 - RNA, 22 nt, Homo sapiens
uuaaaggcugugguaguacucc

SEQ ID NO: 915642 - RNA, 18 nt, Homo sapiens
uuaaagugguucuggaua

SEQ ID NO: 915643 - RNA, 19 nt, Homo sapiens
uuaaaguuguuugugccuu

SEQ ID NO: 915644 - RNA, 22 nt, Homo sapiens
uuaaaucacagauggguauuaa

SEQ ID NO: 915645 - RNA, 14 nt, Homo sapiens
uuaaaugaacauca

SEQ ID NO: 915646 - RNA, 15 nt, Homo sapiens
uuaaaugacagugaa

SEQ ID NO: 915647 - RNA, 15 nt, Homo sapiens
uuaaauggcuuuaug

SEQ ID NO: 915648 - RNA, 13 nt, Homo sapiens
uuaaauuauaucu

SEQ ID NO: 915649 - RNA, 16 nt, Homo sapiens
uuaaauuguaaaugaa

SEQ ID NO: 915650 - RNA, 17 nt, Homo sapiens
uuaaauuguaucuaauc

SEQ ID NO: 915651 - RNA, 14 nt, Homo sapiens
uuaaauuucuggau

SEQ ID NO: 915652 - RNA, 11 nt, Homo sapiens
uuaaauuugaa

SEQ ID NO: 915653 - RNA, 14 nt, Homo sapiens
uuaacacauaacua

SEQ ID NO: 915654 - RNA, 16 nt, Homo sapiens
uuaacagaaccagagg

SEQ ID NO: 915655 - RNA, 23 nt, Homo sapiens
uuaacagaaccagaggguuguac

SEQ ID NO: 915656 - RNA, 16 nt, Homo sapiens
uuaaccuacuagacaa

SEQ ID NO: 915657 - RNA, 16 nt, Homo sapiens
uuaaccucaucuacaa

SEQ ID NO: 915658 - RNA, 21 nt, Homo sapiens
uuaaccugaauuauuccaacu

SEQ ID NO: 915659 - RNA, 14 nt, Homo sapiens
uuaacuaugugaug

SEQ ID NO: 915660 - RNA, 15 nt, Homo sapiens
uuaacuuaacauucu

SEQ ID NO: 915661 - RNA, 15 nt, Homo sapiens
uuaacuugaggguaa

SEQ ID NO: 915662 - RNA, 15 nt, Homo sapiens
uuaagaaacacaggg

SEQ ID NO: 915663 - RNA, 22 nt, Homo sapiens
uuaagaaacacaggguuuugua

SEQ ID NO: 915664 - RNA, 16 nt, Homo sapiens
uuaagaaccugaauau

SEQ ID NO: 915665 - RNA, 14 nt, Homo sapiens
uuaagacacaccuc

SEQ ID NO: 915666 - RNA, 21 nt, Homo sapiens
uuaagagaagaugugauuuau

SEQ ID NO: 915667 - RNA, 20 nt, Homo sapiens
uuaagaggcagggucucacu

SEQ ID NO: 915668 - RNA, 15 nt, Homo sapiens
uuaagaguuacuuaa

SEQ ID NO: 915669 - RNA, 19 nt, Homo sapiens
uuaagaguuguaugaacau

SEQ ID NO: 915670 - RNA, 21 nt, Homo sapiens
uuaagcaaaggaaaccaaagg

SEQ ID NO: 915671 - RNA, 17 nt, Homo sapiens
uuaaguaaaccaaaaag

SEQ ID NO: 915672 - RNA, 14 nt, Homo sapiens
uuaaguaauuuugc

SEQ ID NO: 915673 - RNA, 19 nt, Homo sapiens
uuaagucucugacucuugc

SEQ ID NO: 915674 - RNA, 12 nt, Homo sapiens
uuaagugccuuu

SEQ ID NO: 915675 - RNA, 15 nt, Homo sapiens
uuaaguuuaucuuuc

SEQ ID NO: 915676 - RNA, 14 nt, Homo sapiens
uuaauaaauguaua

SEQ ID NO: 915677 - RNA, 16 nt, Homo sapiens
uuaauaaauucagaua

SEQ ID NO: 915678 - RNA, 21 nt, Homo sapiens
uuaauaacuuguccuauguca

SEQ ID NO: 915679 - RNA, 21 nt, Homo sapiens
uuaauaagaaacaugauguga

SEQ ID NO: 915680 - RNA, 21 nt, Homo sapiens
uuaauaguuuugauccuaaau

SEQ ID NO: 915681 - RNA, 15 nt, Homo sapiens
uuaauaucaaugaag

SEQ ID NO: 915682 - RNA, 17 nt, Homo sapiens
uuaauaugacaaaacaa

SEQ ID NO: 915683 - RNA, 16 nt, Homo sapiens
uuaauauguucauuaa

SEQ ID NO: 915684 - RNA, 12 nt, Homo sapiens
uuaauauugaua

SEQ ID NO: 915685 - RNA, 20 nt, Homo sapiens
uuaaugaacaaauggccuuu

SEQ ID NO: 915686 - RNA, 20 nt, Homo sapiens
uuaaugaacaugugaaguua

SEQ ID NO: 915687 - RNA, 17 nt, Homo sapiens
uuaaugaacugugacag

SEQ ID NO: 915688 - RNA, 15 nt, Homo sapiens
uuaauggugccuuca

SEQ ID NO: 915689 - RNA, 13 nt, Homo sapiens
uuaauuacaucca

SEQ ID NO: 915690 - RNA, 18 nt, Homo sapiens
uuaauuagggguugcuaa

SEQ ID NO: 915691 - RNA, 16 nt, Homo sapiens
uuaauuggaguaucua

SEQ ID NO: 915692 - RNA, 19 nt, Homo sapiens
uuaauuuuugauacuaagc

SEQ ID NO: 915693 - RNA, 13 nt, Homo sapiens
uuacaaauucaag

SEQ ID NO: 915694 - RNA, 16 nt, Homo sapiens
uuacagagaaucugaa

SEQ ID NO: 915695 - RNA, 24 nt, Homo sapiens
uuacagcugccugcaguacuuuac

SEQ ID NO: 915696 - RNA, 16 nt, Homo sapiens
uuacauaauugcaaua

SEQ ID NO: 915697 - RNA, 12 nt, Homo sapiens
uuacauacaaau

SEQ ID NO: 915698 - RNA, 14 nt, Homo sapiens
uuacaucauccucc

SEQ ID NO: 915699 - RNA, 16 nt, Homo sapiens
uuacaugaaacuacuc

SEQ ID NO: 915700 - RNA, 12 nt, Homo sapiens
uuacaugauuca

SEQ ID NO: 915701 - RNA, 13 nt, Homo sapiens
uuacaugauucau

SEQ ID NO: 915702 - RNA, 22 nt, Homo sapiens
uuacauuauuaaauguuucuca

SEQ ID NO: 915703 - RNA, 13 nt, Homo sapiens
uuaccaaagaaga

SEQ ID NO: 915704 - RNA, 15 nt, Homo sapiens
uuaccaaguccuggg

SEQ ID NO: 915705 - RNA, 21 nt, Homo sapiens
uuaccaggcaccaaaagaagu

SEQ ID NO: 915706 - RNA, 16 nt, Homo sapiens
uuacccaguauuccau

SEQ ID NO: 915707 - RNA, 21 nt, Homo sapiens
uuaccuauuauaaaaucuuac

SEQ ID NO: 915708 - RNA, 14 nt, Homo sapiens
uuaccuccuaucag

SEQ ID NO: 915709 - RNA, 17 nt, Homo sapiens
uuaccucuauuuugcca

SEQ ID NO: 915710 - RNA, 17 nt, Homo sapiens
uuaccucuucuaugcaa

SEQ ID NO: 915711 - RNA, 22 nt, Homo sapiens
uuaccugggcauucuuguuuca

SEQ ID NO: 915712 - RNA, 23 nt, Homo sapiens
uuaccuuuauuaaugaacuguga

SEQ ID NO: 915713 - RNA, 12 nt, Homo sapiens
uuacgugcaaua

SEQ ID NO: 915714 - RNA, 22 nt, Homo sapiens
uuacuaaugugccccaugucca

SEQ ID NO: 915715 - RNA, 11 nt, Homo sapiens
uuacuacuauu

SEQ ID NO: 915716 - RNA, 20 nt, Homo sapiens
uuacuacuauucuguuaaaa

SEQ ID NO: 915717 - RNA, 23 nt, Homo sapiens
uuacucaaggaauuugcauuuag

SEQ ID NO: 915718 - RNA, 12 nt, Homo sapiens
uuacuccagugg

SEQ ID NO: 915719 - RNA, 14 nt, Homo sapiens
uuacucucaaugca

SEQ ID NO: 915720 - RNA, 21 nt, Homo sapiens
uuacugaaaacaaaauaucug

SEQ ID NO: 915721 - RNA, 12 nt, Homo sapiens
uuacugaaguua

SEQ ID NO: 915722 - RNA, 23 nt, Homo sapiens
uuacuggaauuaaaaauauauau

SEQ ID NO: 915723 - RNA, 11 nt, Homo sapiens
uuacugugauc

SEQ ID NO: 915724 - RNA, 21 nt, Homo sapiens
uuacuguuuggcugacaugac

SEQ ID NO: 915725 - RNA, 14 nt, Homo sapiens
uuacuuccacagaa

SEQ ID NO: 915726 - RNA, 20 nt, Homo sapiens
uuacuuccuaucaagccagu

SEQ ID NO: 915727 - RNA, 22 nt, Homo sapiens
uuagaacggagcccucggugau

SEQ ID NO: 915728 - RNA, 14 nt, Homo sapiens
uuagaagucacaca

SEQ ID NO: 915729 - RNA, 16 nt, Homo sapiens
uuagaagucacacagu

SEQ ID NO: 915730 - RNA, 16 nt, Homo sapiens
uuagacaaaguucaag

SEQ ID NO: 915731 - RNA, 23 nt, Homo sapiens
uuagagcccauuucaauucucaa

SEQ ID NO: 915732 - RNA, 18 nt, Homo sapiens
uuagaggaagaaaaccag

SEQ ID NO: 915733 - RNA, 17 nt, Homo sapiens
uuagauuagcucuggac

SEQ ID NO: 915734 - RNA, 20 nt, Homo sapiens
uuagauuguuaaaauaacua

SEQ ID NO: 915735 - RNA, 22 nt, Homo sapiens
uuagcacccuucugcuguauac

SEQ ID NO: 915736 - RNA, 21 nt, Homo sapiens
uuagcaccucuuuuugaacag

SEQ ID NO: 915737 - RNA, 13 nt, Homo sapiens
uuagcugaacaau

SEQ ID NO: 915738 - RNA, 16 nt, Homo sapiens
uuagcugaacaaugaa

SEQ ID NO: 915739 - RNA, 23 nt, Homo sapiens
uuagcuguaaauacaugugugga

SEQ ID NO: 915740 - RNA, 13 nt, Homo sapiens
uuaggacugacau

SEQ ID NO: 915741 - RNA, 20 nt, Homo sapiens
uuaggcaggaucuguacaau

SEQ ID NO: 915742 - RNA, 14 nt, Homo sapiens
uuaggcagggauuu

SEQ ID NO: 915743 - RNA, 13 nt, Homo sapiens
uuaggcaugccua

SEQ ID NO: 915744 - RNA, 21 nt, Homo sapiens
uuaggucauuacuaaccauag

SEQ ID NO: 915745 - RNA, 21 nt, Homo sapiens
uuaggugcuucuucacuucag

SEQ ID NO: 915746 - RNA, 17 nt, Homo sapiens
uuagguuuuguacaauu

SEQ ID NO: 915747 - RNA, 17 nt, Homo sapiens
uuaguaacauagacaaa

SEQ ID NO: 915748 - RNA, 12 nt, Homo sapiens
uuaguaauuucu

SEQ ID NO: 915749 - RNA, 18 nt, Homo sapiens
uauaagaugucauccccu

SEQ ID NO: 915750 - RNA, 20 nt, Homo sapiens
uauaagcagaagcacauaug

SEQ ID NO: 915751 - RNA, 18 nt, Homo sapiens
uauaagcauguauauucu

SEQ ID NO: 915752 - RNA, 15 nt, Homo sapiens
uauaagcccagcucu

SEQ ID NO: 915753 - RNA, 16 nt, Homo sapiens
uauaaugcaaaccaua

SEQ ID NO: 915754 - RNA, 15 nt, Homo sapiens
uauaaugguuuacug

SEQ ID NO: 915755 - RNA, 16 nt, Homo sapiens
uauaauucuacaggau

SEQ ID NO: 915756 - RNA, 15 nt, Homo sapiens
uauacacauggaugc

SEQ ID NO: 915757 - RNA, 12 nt, Homo sapiens
uauacauaucag

SEQ ID NO: 915758 - RNA, 12 nt, Homo sapiens
uauacauuugau

SEQ ID NO: 915759 - RNA, 15 nt, Homo sapiens
uauacuauacaacaa

SEQ ID NO: 915760 - RNA, 15 nt, Homo sapiens
uauacuguacuuaau

SEQ ID NO: 915761 - RNA, 17 nt, Homo sapiens
uauagaauggaacucaa

SEQ ID NO: 915762 - RNA, 14 nt, Homo sapiens
uauagacucuagga

SEQ ID NO: 915763 - RNA, 16 nt, Homo sapiens
uauagauauguagaua

SEQ ID NO: 915764 - RNA, 21 nt, Homo sapiens
uauagcgauugaaagggcaau

SEQ ID NO: 915765 - RNA, 16 nt, Homo sapiens
uauagcugacaucucc

SEQ ID NO: 915766 - RNA, 20 nt, Homo sapiens
uauaggaaacauaauuuuga

SEQ ID NO: 915767 - RNA, 22 nt, Homo sapiens
uauaggaucauuuguuggaaug

SEQ ID NO: 915768 - RNA, 21 nt, Homo sapiens
uauaggugcuacaaaaacaca

SEQ ID NO: 915769 - RNA, 17 nt, Homo sapiens
uauauaguuugugguaa

SEQ ID NO: 915770 - RNA, 11 nt, Homo sapiens
uauauauagua

SEQ ID NO: 915771 - RNA, 17 nt, Homo sapiens
uauauauuuuguguaua

SEQ ID NO: 915772 - RNA, 15 nt, Homo sapiens
uauaugcuauucaau

SEQ ID NO: 915773 - RNA, 16 nt, Homo sapiens
uauauguacaguuaua

SEQ ID NO: 915774 - RNA, 18 nt, Homo sapiens
uauauguauauacauaua

SEQ ID NO: 915775 - RNA, 19 nt, Homo sapiens
uauaugucuaauucuaugu

SEQ ID NO: 915776 - RNA, 13 nt, Homo sapiens
uauauguguauau

SEQ ID NO: 915777 - RNA, 21 nt, Homo sapiens
uauauguguauauauacauac

SEQ ID NO: 915778 - RNA, 11 nt, Homo sapiens
uauauguuaau

SEQ ID NO: 915779 - RNA, 14 nt, Homo sapiens
uauauuaccucaaa

SEQ ID NO: 915780 - RNA, 13 nt, Homo sapiens
uauauuauggaag

SEQ ID NO: 915781 - RNA, 15 nt, Homo sapiens
uauauucucagugua

SEQ ID NO: 915782 - RNA, 21 nt, Homo sapiens
uauauuggucauugccuugcc

SEQ ID NO: 915783 - RNA, 15 nt, Homo sapiens
uauauuuauacucua

SEQ ID NO: 915784 - RNA, 20 nt, Homo sapiens
uauauuuauucaucugggag

SEQ ID NO: 915785 - RNA, 17 nt, Homo sapiens
uauauuuccauucaugc

SEQ ID NO: 915786 - RNA, 13 nt, Homo sapiens
uauauuugcugau

SEQ ID NO: 915787 - RNA, 20 nt, Homo sapiens
uauauuugugugugugauau

SEQ ID NO: 915788 - RNA, 21 nt, Homo sapiens
uauauuuucccucucuugccu

SEQ ID NO: 915789 - RNA, 18 nt, Homo sapiens
uauauuuuuauaagacua

SEQ ID NO: 915790 - RNA, 16 nt, Homo sapiens
uaucaaaacauaucaa

SEQ ID NO: 915791 - RNA, 20 nt, Homo sapiens
uaucaaaacauaucaauuca

SEQ ID NO: 915792 - RNA, 23 nt, Homo sapiens
uaucaaggauguucuggcuuuac

SEQ ID NO: 915793 - RNA, 22 nt, Homo sapiens
uaucacauuacaucauccuccu

SEQ ID NO: 915794 - RNA, 20 nt, Homo sapiens
uaucaccccuugaagccuuu

SEQ ID NO: 915795 - RNA, 15 nt, Homo sapiens
uaucaccucauggcc

SEQ ID NO: 915796 - RNA, 14 nt, Homo sapiens
uaucaccucucuuc

SEQ ID NO: 915797 - RNA, 14 nt, Homo sapiens
uaucaggugcugcc

SEQ ID NO: 915798 - RNA, 14 nt, Homo sapiens
uaucagucauaacu

SEQ ID NO: 915799 - RNA, 19 nt, Homo sapiens
uaucaugaaacacuucuca

SEQ ID NO: 915800 - RNA, 23 nt, Homo sapiens
uauccccaaacaccaugaaucuu

SEQ ID NO: 915801 - RNA, 15 nt, Homo sapiens
uauccgaacuuuaau

SEQ ID NO: 915802 - RNA, 22 nt, Homo sapiens
uauccugauaaacauuaaacac

SEQ ID NO: 915803 - RNA, 16 nt, Homo sapiens
uauccugcuagcugua

SEQ ID NO: 915804 - RNA, 22 nt, Homo sapiens
uaucggagacagugaucuccau

SEQ ID NO: 915805 - RNA, 20 nt, Homo sapiens
uaucuccuuuauagccugua

SEQ ID NO: 915806 - RNA, 16 nt, Homo sapiens
uaucucggaccuuuca

SEQ ID NO: 915807 - RNA, 14 nt, Homo sapiens
uaucugaguugacu

SEQ ID NO: 915808 - RNA, 16 nt, Homo sapiens
uaucugucaucucucu

SEQ ID NO: 915809 - RNA, 13 nt, Homo sapiens
uaucuucauacaa

SEQ ID NO: 915810 - RNA, 21 nt, Homo sapiens
uaugaaaaagaagaaucucau

SEQ ID NO: 915811 - RNA, 13 nt, Homo sapiens
uaugaaacuauug

SEQ ID NO: 915812 - RNA, 14 nt, Homo sapiens
uaugaacuugagga

SEQ ID NO: 915813 - RNA, 16 nt, Homo sapiens
uaugacaucacuugua

SEQ ID NO: 915814 - RNA, 23 nt, Homo sapiens
uaugacuguuuuuauaugcacau

SEQ ID NO: 915815 - RNA, 21 nt, Homo sapiens
uaugacuguuuuuguaguggu

SEQ ID NO: 915816 - RNA, 18 nt, Homo sapiens
uaugagcaccccuaugcc

SEQ ID NO: 915817 - RNA, 12 nt, Homo sapiens
uaugagggaaaa

SEQ ID NO: 915818 - RNA, 18 nt, Homo sapiens
uaugagggaaaaugagua

SEQ ID NO: 915819 - RNA, 23 nt, Homo sapiens
uaugagucucuaugaucuuggca

SEQ ID NO: 915820 - RNA, 19 nt, Homo sapiens
uaugaguggcuucugggag

SEQ ID NO: 915821 - RNA, 14 nt, Homo sapiens
uaugauacugaugc

SEQ ID NO: 915822 - RNA, 18 nt, Homo sapiens
uaugauauugcauaugca

SEQ ID NO: 915823 - RNA, 15 nt, Homo sapiens
uaugaucuaauacaa

SEQ ID NO: 915824 - RNA, 19 nt, Homo sapiens
uaugcaaacaguucuugga

SEQ ID NO: 915825 - RNA, 13 nt, Homo sapiens
uaugcaauucuua

SEQ ID NO: 915826 - RNA, 14 nt, Homo sapiens
uaugcccacucuaa

SEQ ID NO: 915827 - RNA, 16 nt, Homo sapiens
uaugcccccaauuuau

SEQ ID NO: 915828 - RNA, 15 nt, Homo sapiens
uaugccucuguauuu

SEQ ID NO: 915829 - RNA, 15 nt, Homo sapiens
uaugcuccaguaugg

SEQ ID NO: 915830 - RNA, 16 nt, Homo sapiens
uaugcugcuguuuaca

SEQ ID NO: 915831 - RNA, 18 nt, Homo sapiens
uauggaaaaaaugaacuu

SEQ ID NO: 915832 - RNA, 19 nt, Homo sapiens
uauggaaucagcugcuaca

SEQ ID NO: 915833 - RNA, 21 nt, Homo sapiens
uauggacucaguuuucuugca

SEQ ID NO: 915834 - RNA, 15 nt, Homo sapiens
uauggacucugcaca

SEQ ID NO: 915835 - RNA, 19 nt, Homo sapiens
uauggaggccucacaccca

SEQ ID NO: 915836 - RNA, 13 nt, Homo sapiens
uauggcaagugau

SEQ ID NO: 915837 - RNA, 21 nt, Homo sapiens
uaugggccaagcccagcuuaa

SEQ ID NO: 915838 - RNA, 15 nt, Homo sapiens
uaugggggcacugag

SEQ ID NO: 915839 - RNA, 20 nt, Homo sapiens
uaugggggcacugaggacca

SEQ ID NO: 915840 - RNA, 13 nt, Homo sapiens
aaauaaacaugag

SEQ ID NO: 915841 - RNA, 17 nt, Homo sapiens
aaauaaagcuacugaau

SEQ ID NO: 915842 - RNA, 17 nt, Homo sapiens
aaauaaaguaucaugca

SEQ ID NO: 915843 - RNA, 21 nt, Homo sapiens
aaauaacuaggcguggacuua

SEQ ID NO: 915844 - RNA, 15 nt, Homo sapiens
aaauaagaaugauuu

SEQ ID NO: 915845 - RNA, 20 nt, Homo sapiens
aaauaagagaaaaaauuaaa

SEQ ID NO: 915846 - RNA, 21 nt, Homo sapiens
aaauaaggggcaccugggaaa

SEQ ID NO: 915847 - RNA, 13 nt, Homo sapiens
aaauaauagccau

SEQ ID NO: 915848 - RNA, 20 nt, Homo sapiens
aaauaauagccauccuuggc

SEQ ID NO: 915849 - RNA, 22 nt, Homo sapiens
aaauaauaggauauaaaacaca

SEQ ID NO: 915850 - RNA, 19 nt, Homo sapiens
aaauacaaacaagcacaga

SEQ ID NO: 915851 - RNA, 16 nt, Homo sapiens
aaauacccacuaacaa

SEQ ID NO: 915852 - RNA, 20 nt, Homo sapiens
aaauacuguacauagaugua

SEQ ID NO: 915853 - RNA, 11 nt, Homo sapiens
aaauacuucua

SEQ ID NO: 915854 - RNA, 14 nt, Homo sapiens
aaauagaccucuca

SEQ ID NO: 915855 - RNA, 14 nt, Homo sapiens
aaauagcaaaagaa

SEQ ID NO: 915856 - RNA, 17 nt, Homo sapiens
aaauagcaaaagaagaa

SEQ ID NO: 915857 - RNA, 23 nt, Homo sapiens
aaauagcaucugcucuucucuua

SEQ ID NO: 915858 - RNA, 15 nt, Homo sapiens
aaauaguuguccaua

SEQ ID NO: 915859 - RNA, 14 nt, Homo sapiens
aaauauacaaacau

SEQ ID NO: 915860 - RNA, 18 nt, Homo sapiens
aaauauacaaacaugugg

SEQ ID NO: 915861 - RNA, 13 nt, Homo sapiens
aaauauauauaca

SEQ ID NO: 915862 - RNA, 20 nt, Homo sapiens
aaauaugauuuuauuugaca

SEQ ID NO: 915863 - RNA, 22 nt, Homo sapiens
aaauaugcucagccacccugug

SEQ ID NO: 915864 - RNA, 22 nt, Homo sapiens
aaauaugugcuugaaaugagaa

SEQ ID NO: 915865 - RNA, 12 nt, Homo sapiens
aaauauuauuca

SEQ ID NO: 915866 - RNA, 22 nt, Homo sapiens
aaauauuauugguguuuaccca

SEQ ID NO: 915867 - RNA, 15 nt, Homo sapiens
aaauauuauuugcua

SEQ ID NO: 915868 - RNA, 13 nt, Homo sapiens
aaauauuccugca

SEQ ID NO: 915869 - RNA, 14 nt, Homo sapiens
aaauauucucucca

SEQ ID NO: 915870 - RNA, 17 nt, Homo sapiens
aaauauugcuuaugucu

SEQ ID NO: 915871 - RNA, 18 nt, Homo sapiens
aaauauugcuucaauaau

SEQ ID NO: 915872 - RNA, 23 nt, Homo sapiens
aaauauuuaugagaaaguucuca

SEQ ID NO: 915873 - RNA, 18 nt, Homo sapiens
aaauauuuuuaugugcaa

SEQ ID NO: 915874 - RNA, 15 nt, Homo sapiens
aaaucaaccccagac

SEQ ID NO: 915875 - RNA, 16 nt, Homo sapiens
aaaucaaccccagacu

SEQ ID NO: 915876 - RNA, 15 nt, Homo sapiens
aaaucaaugucacuu

SEQ ID NO: 915877 - RNA, 16 nt, Homo sapiens
aaaucaaugucacuua

SEQ ID NO: 915878 - RNA, 23 nt, Homo sapiens
aaaucacaacacagagcugcuau

SEQ ID NO: 915879 - RNA, 13 nt, Homo sapiens
aaaucacuuguaa

SEQ ID NO: 915880 - RNA, 13 nt, Homo sapiens
aaaucaucucuca

SEQ ID NO: 915881 - RNA, 16 nt, Homo sapiens
aaaucaugaaaagagg

SEQ ID NO: 915882 - RNA, 11 nt, Homo sapiens
aaauccaaaga

SEQ ID NO: 915883 - RNA, 11 nt, Homo sapiens
aaauccuugau

SEQ ID NO: 915884 - RNA, 12 nt, Homo sapiens
aaaucuccagug

SEQ ID NO: 915885 - RNA, 15 nt, Homo sapiens
aaaucugagaucucc

SEQ ID NO: 915886 - RNA, 22 nt, Homo sapiens
aaaucugccugauaggacccau

SEQ ID NO: 915887 - RNA, 22 nt, Homo sapiens
aaaucuuaaaagcccuaaguga

SEQ ID NO: 915888 - RNA, 20 nt, Homo sapiens
aaaucuuaauucaacuagua

SEQ ID NO: 915889 - RNA, 20 nt, Homo sapiens
aaaucuuccaaagacaagaa

SEQ ID NO: 915890 - RNA, 22 nt, Homo sapiens
aaaucuugguugaugccaaaaa

SEQ ID NO: 915891 - RNA, 23 nt, Homo sapiens
aaaucuuugauucagacagcuua

SEQ ID NO: 915892 - RNA, 13 nt, Homo sapiens
aaaugaaucuuac

SEQ ID NO: 915893 - RNA, 15 nt, Homo sapiens
aaaugaaucuuacuc

SEQ ID NO: 915894 - RNA, 14 nt, Homo sapiens
aaaugaauguuguc

SEQ ID NO: 915895 - RNA, 14 nt, Homo sapiens
aaaugacaugcacu

SEQ ID NO: 915896 - RNA, 11 nt, Homo sapiens
aaaguauauau

SEQ ID NO: 915897 - RNA, 22 nt, Homo sapiens
aaaguaugccuuccuguuuaaa

SEQ ID NO: 915898 - RNA, 19 nt, Homo sapiens
aaaguauuuuaucugccuu

SEQ ID NO: 915899 - RNA, 22 nt, Homo sapiens
aaagucaccacuccauucccaa

SEQ ID NO: 915900 - RNA, 21 nt, Homo sapiens
aaagucuaccccugcuaagga

SEQ ID NO: 915901 - RNA, 15 nt, Homo sapiens
aaagucuuaccucag

SEQ ID NO: 915902 - RNA, 20 nt, Homo sapiens
aaagugagacccccaucucu

SEQ ID NO: 915903 - RNA, 22 nt, Homo sapiens
aaagugcaaguggaugcauucc

SEQ ID NO: 915904 - RNA, 17 nt, Homo sapiens
aaagugcagcccuuccu

SEQ ID NO: 915905 - RNA, 20 nt, Homo sapiens
aaagugcugcuggaaguaga

SEQ ID NO: 915906 - RNA, 17 nt, Homo sapiens
aaaguuaaaaaaaagcc

SEQ ID NO: 915907 - RNA, 23 nt, Homo sapiens
aaaguuaugguacuauguuagcc

SEQ ID NO: 915908 - RNA, 15 nt, Homo sapiens
aaaguugcagucuca

SEQ ID NO: 915909 - RNA, 17 nt, Homo sapiens
aaauaaaaacacuuaaa

SEQ ID NO: 915910 - RNA, 17 nt, Homo sapiens
aaauaaaaugaaauguc

SEQ ID NO: 915911 - RNA, 14 nt, Homo sapiens
aaauaaacuaguuu

SEQ ID NO: 915912 - RNA, 18 nt, Homo sapiens
aaauaaaggugacuggga

SEQ ID NO: 915913 - RNA, 14 nt, Homo sapiens
aaauaaaguaccau

SEQ ID NO: 915914 - RNA, 16 nt, Homo sapiens
aaauaaaguaccauua

SEQ ID NO: 915915 - RNA, 13 nt, Homo sapiens
aaauaaaugccaa

SEQ ID NO: 915916 - RNA, 14 nt, Homo sapiens
aaauaagcuuuauu

SEQ ID NO: 915917 - RNA, 13 nt, Homo sapiens
aaauaaucugaca

SEQ ID NO: 915918 - RNA, 12 nt, Homo sapiens
aaauaaugauuu

SEQ ID NO: 915919 - RNA, 17 nt, Homo sapiens
aaauaauucaugauuca

SEQ ID NO: 915920 - RNA, 16 nt, Homo sapiens
aaauaauugauuucaa

SEQ ID NO: 915921 - RNA, 13 nt, Homo sapiens
aaauacauaccua

SEQ ID NO: 915922 - RNA, 22 nt, Homo sapiens
aaauacauucuccuuuuugccc

SEQ ID NO: 915923 - RNA, 19 nt, Homo sapiens
aaauaccagugaaccaaag

SEQ ID NO: 915924 - RNA, 12 nt, Homo sapiens
aaauacugccua

SEQ ID NO: 915925 - RNA, 15 nt, Homo sapiens
aaauacuucuugaag

SEQ ID NO: 915926 - RNA, 19 nt, Homo sapiens
aaauacuucuugaagccga

SEQ ID NO: 915927 - RNA, 14 nt, Homo sapiens
aaauagcaucugcu

SEQ ID NO: 915928 - RNA, 17 nt, Homo sapiens
aaauauaagaacuugau

SEQ ID NO: 915929 - RNA, 17 nt, Homo sapiens
aaauauacaaacaugug

SEQ ID NO: 915930 - RNA, 21 nt, Homo sapiens
aaauauauuuuaugauuuaaa

SEQ ID NO: 915931 - RNA, 19 nt, Homo sapiens
aaauauccacagacucccu

SEQ ID NO: 915932 - RNA, 21 nt, Homo sapiens
aaauaugauuuuauuugacaa

SEQ ID NO: 915933 - RNA, 20 nt, Homo sapiens
aaauauggaacuucuaauau

SEQ ID NO: 915934 - RNA, 19 nt, Homo sapiens
aaauauuaaggagaauuca

SEQ ID NO: 915935 - RNA, 12 nt, Homo sapiens
aaauauuucagg

SEQ ID NO: 915936 - RNA, 16 nt, Homo sapiens
aaauauuuggucucua

SEQ ID NO: 915937 - RNA, 19 nt, Homo sapiens
aaaucacaaggcaacugug

SEQ ID NO: 915938 - RNA, 21 nt, Homo sapiens
aaaucauggcaacauaauuca

SEQ ID NO: 915939 - RNA, 19 nt, Homo sapiens
aaaucauuaauacucuucu

SEQ ID NO: 915940 - RNA, 15 nt, Homo sapiens
aaaucauuguagaaa

SEQ ID NO: 915941 - RNA, 10 nt, Homo sapiens
aaauccaaag

SEQ ID NO: 915942 - RNA, 15 nt, Homo sapiens
aaauccaguuuccca

SEQ ID NO: 915943 - RNA, 18 nt, Homo sapiens
aaaucccauauauucuuc

SEQ ID NO: 915944 - RNA, 22 nt, Homo sapiens
aaauccucaccauccacagcaa

SEQ ID NO: 915945 - RNA, 15 nt, Homo sapiens
aaauccugaugcugu

SEQ ID NO: 915946 - RNA, 19 nt, Homo sapiens
aaaucuaacuacaaggaca

SEQ ID NO: 915947 - RNA, 20 nt, Homo sapiens
aaaucuaggugauuguucau

SEQ ID NO: 915948 - RNA, 13 nt, Homo sapiens
aaaucuccagugu

SEQ ID NO: 915949 - RNA, 23 nt, Homo sapiens
aaaucugaggaaggugcuugccu

SEQ ID NO: 915950 - RNA, 18 nt, Homo sapiens
aaaucuguuuauaugaca

SEQ ID NO: 915951 - RNA, 21 nt, Homo sapiens
aaaucuguuuuucuaacuggg

SEQ ID NO: 915952 - RNA, 20 nt, Homo sapiens
aaaugaaggaauagcccgag

SEQ ID NO: 915953 - RNA, 17 nt, Homo sapiens
aaaugacagauguugaa

SEQ ID NO: 915954 - RNA, 13 nt, Homo sapiens
aaaugacccaaag

SEQ ID NO: 915955 - RNA, 14 nt, Homo sapiens
aaaugacccaaaga

SEQ ID NO: 915956 - RNA, 14 nt, Homo sapiens
aaaugauuaucucc

SEQ ID NO: 915957 - RNA, 11 nt, Homo sapiens
aaaugcaacuu

SEQ ID NO: 915958 - RNA, 18 nt, Homo sapiens
aaaugcaguccagaauaa

SEQ ID NO: 915959 - RNA, 14 nt, Homo sapiens
aaaugcagugaauu

SEQ ID NO: 915960 - RNA, 16 nt, Homo sapiens
aaaugcauguccucaa

SEQ ID NO: 915961 - RNA, 11 nt, Homo sapiens
aaaugccucau

SEQ ID NO: 915962 - RNA, 20 nt, Homo sapiens
aaaugccuccaagccauuca

SEQ ID NO: 915963 - RNA, 22 nt, Homo sapiens
aaaugccuccaagccauucacu

SEQ ID NO: 915964 - RNA, 14 nt, Homo sapiens
aaaugcuauauugc

SEQ ID NO: 915965 - RNA, 23 nt, Homo sapiens
aaauggggauauguuaacuauug

SEQ ID NO: 915966 - RNA, 22 nt, Homo sapiens
aaauguaaaauaaguauuucca

SEQ ID NO: 915967 - RNA, 15 nt, Homo sapiens
aaauguaauugaaua

SEQ ID NO: 915968 - RNA, 16 nt, Homo sapiens
aaauguacgaaacugu

SEQ ID NO: 915969 - RNA, 14 nt, Homo sapiens
aaauguauauacac

SEQ ID NO: 915970 - RNA, 17 nt, Homo sapiens
aaaugucuaagguagua

SEQ ID NO: 915971 - RNA, 19 nt, Homo sapiens
aaaugucuaagguaguaac

SEQ ID NO: 915972 - RNA, 21 nt, Homo sapiens
aaaugucuguuucaaugaccu

SEQ ID NO: 915973 - RNA, 12 nt, Homo sapiens
aaaugugcaaua

SEQ ID NO: 915974 - RNA, 14 nt, Homo sapiens
aaaugugccuucau

SEQ ID NO: 915975 - RNA, 17 nt, Homo sapiens
aaaugugucuugucucc

SEQ ID NO: 915976 - RNA, 12 nt, Homo sapiens
aaauuaaacccu

SEQ ID NO: 915977 - RNA, 22 nt, Homo sapiens
aaauuaaagucuuccauugcau

SEQ ID NO: 915978 - RNA, 15 nt, Homo sapiens
aaauuaaaugcaugu

SEQ ID NO: 915979 - RNA, 20 nt, Homo sapiens
aaauuagaaagcaacuuauc

SEQ ID NO: 915980 - RNA, 16 nt, Homo sapiens
aaauuauaucucagua

SEQ ID NO: 915981 - RNA, 14 nt, Homo sapiens
aaauuaugccauag

SEQ ID NO: 915982 - RNA, 18 nt, Homo sapiens
aaauuauguauguuuaca

SEQ ID NO: 915983 - RNA, 21 nt, Homo sapiens
aaauucacagcgcuaugcaau

SEQ ID NO: 915984 - RNA, 20 nt, Homo sapiens
aaauucagaaagucauagau

SEQ ID NO: 915985 - RNA, 12 nt, Homo sapiens
aaauuccuguag

SEQ ID NO: 915986 - RNA, 14 nt, Homo sapiens
aaauuccuguagca

SEQ ID NO: 915987 - RNA, 17 nt, Homo sapiens
aaauuccuugauucaca

SEQ ID NO: 915988 - RNA, 18 nt, Homo sapiens
aaauucucucucuugcag

SEQ ID NO: 915989 - RNA, 13 nt, Homo sapiens
aaauugaugagag

SEQ ID NO: 915990 - RNA, 15 nt, Homo sapiens
aaauugaugccagug

SEQ ID NO: 915991 - RNA, 15 nt, Homo sapiens
aaauugccugacgaa

SEQ ID NO: 915992 - RNA, 15 nt, Homo sapiens
aaauugcuccuugac

SEQ ID NO: 915993 - RNA, 24 nt, Homo sapiens
aaauugucuuuugucauguggcua

SEQ ID NO: 915994 - RNA, 14 nt, Homo sapiens
aaauuuaaccuacu

SEQ ID NO: 915995 - RNA, 14 nt, Homo sapiens
aaauuuacugugag

SEQ ID NO: 915996 - RNA, 19 nt, Homo sapiens
aaauuucuucgaucccaag

SEQ ID NO: 915997 - RNA, 20 nt, Homo sapiens
aaauuucuucgaucccaagg

SEQ ID NO: 915998 - RNA, 16 nt, Homo sapiens
aaauuugaauuucagu

SEQ ID NO: 915999 - RNA, 13 nt, Homo sapiens
aaauuuucaccug

SEQ ID NO: 916000 - RNA, 19 nt, Homo sapiens
aaauuuuuaucuuacuuuu

SEQ ID NO: 916001 - RNA, 13 nt, Homo sapiens
aacaaaauaucug

SEQ ID NO: 916002 - RNA, 15 nt, Homo sapiens
aacaaacaaacaauu

SEQ ID NO: 916003 - RNA, 13 nt, Homo sapiens
aacaaacccaggu

SEQ ID NO: 916004 - RNA, 15 nt, Homo sapiens
aacaaacuacaugua

SEQ ID NO: 916005 - RNA, 23 nt, Homo sapiens
aacaaagugagacccccaucucu

SEQ ID NO: 916006 - RNA, 15 nt, Homo sapiens
aacaacaaaccaaaa

SEQ ID NO: 916007 - RNA, 14 nt, Homo sapiens
aacaacaaauaauu

SEQ ID NO: 916008 - RNA, 17 nt, Homo sapiens
aacaacaauacaacaag

SEQ ID NO: 916009 - RNA, 14 nt, Homo sapiens
aacaacuacuguga

SEQ ID NO: 916010 - RNA, 15 nt, Homo sapiens
aacaacuucuuugua

SEQ ID NO: 916011 - RNA, 23 nt, Homo sapiens
aacaacuugucuauuaccuguua

SEQ ID NO: 916012 - RNA, 21 nt, Homo sapiens
aaggaggacgguuaacuugua

SEQ ID NO: 916013 - RNA, 20 nt, Homo sapiens
aaggauaucgggucacuguc

SEQ ID NO: 916014 - RNA, 18 nt, Homo sapiens
aaggauauuuacuacuuu

SEQ ID NO: 916015 - RNA, 14 nt, Homo sapiens
aaggauugugauau

SEQ ID NO: 916016 - RNA, 20 nt, Homo sapiens
aaggcaacauuuccgaagac

SEQ ID NO: 916017 - RNA, 13 nt, Homo sapiens
aaggcaagcacca

SEQ ID NO: 916018 - RNA, 16 nt, Homo sapiens
aaggcaggaggaucac

SEQ ID NO: 916019 - RNA, 16 nt, Homo sapiens
aaggcaggcagggcuc

SEQ ID NO: 916020 - RNA, 17 nt, Homo sapiens
aaggcaucugacaugca

SEQ ID NO: 916021 - RNA, 19 nt, Homo sapiens
aaggccacaugucaccgug

SEQ ID NO: 916022 - RNA, 21 nt, Homo sapiens
aaggcccucuauuucucucuu

SEQ ID NO: 916023 - RNA, 17 nt, Homo sapiens
aaggccuggggugaccc

SEQ ID NO: 916024 - RNA, 17 nt, Homo sapiens
aaggcucagucucagga

SEQ ID NO: 916025 - RNA, 14 nt, Homo sapiens
aaggcucccugugu

SEQ ID NO: 916026 - RNA, 12 nt, Homo sapiens
aaggcugaccaa

SEQ ID NO: 916027 - RNA, 17 nt, Homo sapiens
aaggcugaccaagagag

SEQ ID NO: 916028 - RNA, 17 nt, Homo sapiens
aaggcuggggccagugu

SEQ ID NO: 916029 - RNA, 18 nt, Homo sapiens
aaggcuuugccaugggcc

SEQ ID NO: 916030 - RNA, 17 nt, Homo sapiens
aagggagggcucugagg

SEQ ID NO: 916031 - RNA, 21 nt, Homo sapiens
aagggaguugcucacucagga

SEQ ID NO: 916032 - RNA, 21 nt, Homo sapiens
aagggauaauagacacaucaa

SEQ ID NO: 916033 - RNA, 18 nt, Homo sapiens
aagggauccguacauuca

SEQ ID NO: 916034 - RNA, 20 nt, Homo sapiens
aagggccacaucccacugcc

SEQ ID NO: 916035 - RNA, 17 nt, Homo sapiens
aaggggagauacucucc

SEQ ID NO: 916036 - RNA, 22 nt, Homo sapiens
aaggggcaaagaaaagccagag

SEQ ID NO: 916037 - RNA, 12 nt, Homo sapiens
aaggggucugua

SEQ ID NO: 916038 - RNA, 18 nt, Homo sapiens
aaggggugcccucuggau

SEQ ID NO: 916039 - RNA, 23 nt, Homo sapiens
aaggguaccuugaacacuggggg

SEQ ID NO: 916040 - RNA, 16 nt, Homo sapiens
aagguagacauggauu

SEQ ID NO: 916041 - RNA, 17 nt, Homo sapiens
aagguagcccagcacug

SEQ ID NO: 916042 - RNA, 21 nt, Homo sapiens
aagguagcuuaccugacacaa

SEQ ID NO: 916043 - RNA, 19 nt, Homo sapiens
aaggucaauuucaguguau

SEQ ID NO: 916044 - RNA, 22 nt, Homo sapiens
aaggucacacaguauuaaguga

SEQ ID NO: 916045 - RNA, 20 nt, Homo sapiens
aaggucccauaauaaaaaga

SEQ ID NO: 916046 - RNA, 17 nt, Homo sapiens
aaggucccuuguuucca

SEQ ID NO: 916047 - RNA, 16 nt, Homo sapiens
aaggugucauacagau

SEQ ID NO: 916048 - RNA, 21 nt, Homo sapiens
aagguguugguguauuugcca

SEQ ID NO: 916049 - RNA, 15 nt, Homo sapiens
aagguuauaacugug

SEQ ID NO: 916050 - RNA, 18 nt, Homo sapiens
aagguucuuuagcuguca

SEQ ID NO: 916051 - RNA, 22 nt, Homo sapiens
aagguuuccaagauaaaaccag

SEQ ID NO: 916052 - RNA, 12 nt, Homo sapiens
aaguaaaaccac

SEQ ID NO: 916053 - RNA, 15 nt, Homo sapiens
aaguaaaaccacagc

SEQ ID NO: 916054 - RNA, 15 nt, Homo sapiens
aaguaaauauuucag

SEQ ID NO: 916055 - RNA, 16 nt, Homo sapiens
aaguaaauuacauuaa

SEQ ID NO: 916056 - RNA, 18 nt, Homo sapiens
aaguaaauuuguccaaug

SEQ ID NO: 916057 - RNA, 22 nt, Homo sapiens
aaguaaauuuguccaauggcug

SEQ ID NO: 916058 - RNA, 19 nt, Homo sapiens
aaguaacugugguuuacua

SEQ ID NO: 916059 - RNA, 17 nt, Homo sapiens
aaguaaguuugauuuca

SEQ ID NO: 916060 - RNA, 24 nt, Homo sapiens
aaguaauuccuguauucuacagca

SEQ ID NO: 916061 - RNA, 12 nt, Homo sapiens
aaguaauuuugc

SEQ ID NO: 916062 - RNA, 17 nt, Homo sapiens
aaguaauuuugccaucc

SEQ ID NO: 916063 - RNA, 17 nt, Homo sapiens
aaguacaaauauuccug

SEQ ID NO: 916064 - RNA, 21 nt, Homo sapiens
aaguacaaauauuccuguuuc

SEQ ID NO: 916065 - RNA, 12 nt, Homo sapiens
aaguacauguau

SEQ ID NO: 916066 - RNA, 20 nt, Homo sapiens
aaguaccccugauaagcaaa

SEQ ID NO: 916067 - RNA, 16 nt, Homo sapiens
aaguagaauccuaaau

SEQ ID NO: 916068 - RNA, 19 nt, Homo sapiens
aaguagcugugaacauugu

SEQ ID NO: 916069 - RNA, 21 nt, Homo sapiens
aaguaggaacucuuaagcaau

SEQ ID NO: 916070 - RNA, 23 nt, Homo sapiens
aaguauacaauaaagucuuaccu

SEQ ID NO: 916071 - RNA, 13 nt, Homo sapiens
aaguaucaugcau

SEQ ID NO: 916072 - RNA, 16 nt, Homo sapiens
aaguaugagggaaaau

SEQ ID NO: 916073 - RNA, 14 nt, Homo sapiens
aaguaugccuuccu

SEQ ID NO: 916074 - RNA, 18 nt, Homo sapiens
aaguaugugaauaugaau

SEQ ID NO: 916075 - RNA, 23 nt, Homo sapiens
aaguauucuucaucagcauuuaa

SEQ ID NO: 916076 - RNA, 12 nt, Homo sapiens
aaguauuugaaa

SEQ ID NO: 916077 - RNA, 14 nt, Homo sapiens
aagucaacaaccau

SEQ ID NO: 916078 - RNA, 17 nt, Homo sapiens
aagucaacaaccaugcc

SEQ ID NO: 916079 - RNA, 14 nt, Homo sapiens
aagucaacacucuu

SEQ ID NO: 916080 - RNA, 18 nt, Homo sapiens
aagucaccggagcuuuca

SEQ ID NO: 916081 - RNA, 13 nt, Homo sapiens
aagucacuuuuau

SEQ ID NO: 916082 - RNA, 13 nt, Homo sapiens
aagucagcuuuca

SEQ ID NO: 916083 - RNA, 18 nt, Homo sapiens
aagucagucuuauagcaa

SEQ ID NO: 916084 - RNA, 18 nt, Homo sapiens
aaguccaaccugccugug

SEQ ID NO: 916085 - RNA, 23 nt, Homo sapiens
aaguccaaccugccugugcauga

SEQ ID NO: 916086 - RNA, 17 nt, Homo sapiens
aaguccacaucuucuca

SEQ ID NO: 916087 - RNA, 18 nt, Homo sapiens
aagucguuucaggacaug

SEQ ID NO: 916088 - RNA, 23 nt, Homo sapiens
aagucuaaaguuuacaguaaaua

SEQ ID NO: 916089 - RNA, 18 nt, Homo sapiens
aagucucugacucuugcc

SEQ ID NO: 916090 - RNA, 21 nt, Homo sapiens
aagugaagagggagaagggau

SEQ ID NO: 916091 - RNA, 18 nt, Homo sapiens
aagugaagccccuugucc

SEQ ID NO: 916092 - RNA, 16 nt, Homo sapiens
aagugaaggagccagu

SEQ ID NO: 916093 - RNA, 19 nt, Homo sapiens
aagugagacccccaucucu

SEQ ID NO: 916094 - RNA, 22 nt, Homo sapiens
aagugauaucccccagccucaa

SEQ ID NO: 916095 - RNA, 18 nt, Homo sapiens
aagugcauuuguaauuca

SEQ ID NO: 916096 - RNA, 18 nt, Homo sapiens
aagugcuauuucuugcau

SEQ ID NO: 916097 - RNA, 16 nt, Homo sapiens
aaguggggcucuggga

SEQ ID NO: 916098 - RNA, 18 nt, Homo sapiens
aagugguaggaaagccuc

SEQ ID NO: 916099 - RNA, 15 nt, Homo sapiens
aaguguaaauccuuu

SEQ ID NO: 916100 - RNA, 14 nt, Homo sapiens
aaguguaauagauu

SEQ ID NO: 916101 - RNA, 15 nt, Homo sapiens
aaguguagcacccug

SEQ ID NO: 916102 - RNA, 16 nt, Homo sapiens
aagugucgaaagcaac

SEQ ID NO: 916103 - RNA, 18 nt, Homo sapiens
aaguguguaugauaauga

SEQ ID NO: 916104 - RNA, 13 nt, Homo sapiens
aaguguguuuccu

SEQ ID NO: 916105 - RNA, 18 nt, Homo sapiens
aaguguugauuacauaau

SEQ ID NO: 916106 - RNA, 20 nt, Homo sapiens
aaguguuuucucagaacagc

SEQ ID NO: 916107 - RNA, 23 nt, Homo sapiens
aaguuaagcagccuuucugugga

SEQ ID NO: 916108 - RNA, 16 nt, Homo sapiens
aaguuaaucuucaugg

SEQ ID NO: 916109 - RNA, 19 nt, Homo sapiens
aaguuacaaauucaaggag

SEQ ID NO: 916110 - RNA, 13 nt, Homo sapiens
aaguuacuugaaa

SEQ ID NO: 916111 - RNA, 22 nt, Homo sapiens
aaguuagggaauggcacagccc

SEQ ID NO: 916112 - RNA, 19 nt, Homo sapiens
aaguuagggaugacuguga

SEQ ID NO: 916113 - RNA, 21 nt, Homo sapiens
aaguuagggaugacugugauu

SEQ ID NO: 916114 - RNA, 14 nt, Homo sapiens
aaguuaugaggguc

SEQ ID NO: 916115 - RNA, 14 nt, Homo sapiens
aaguucaacuucca

SEQ ID NO: 916116 - RNA, 20 nt, Homo sapiens
aaguugaagcuaagauuuag

SEQ ID NO: 916117 - RNA, 22 nt, Homo sapiens
aaguugcagucucagaaagccu

SEQ ID NO: 916118 - RNA, 17 nt, Homo sapiens
aaguuuagugcccucau

SEQ ID NO: 916119 - RNA, 13 nt, Homo sapiens
aaguuucacccaa

SEQ ID NO: 916120 - RNA, 23 nt, Homo sapiens
aaguuucuucuuuaggcauuaaa

SEQ ID NO: 916121 - RNA, 14 nt, Homo sapiens
aaguuuugaugaaa

SEQ ID NO: 916122 - RNA, 16 nt, Homo sapiens
aauaaaaguacugaag

SEQ ID NO: 916123 - RNA, 13 nt, Homo sapiens
aauaaaauguuau

SEQ ID NO: 916124 - RNA, 18 nt, Homo sapiens
aauaaacauuuggcauag

SEQ ID NO: 916125 - RNA, 15 nt, Homo sapiens
aauaaacccuuccug

SEQ ID NO: 916126 - RNA, 21 nt, Homo sapiens
aauucuauuacgugcaauacu

SEQ ID NO: 916127 - RNA, 23 nt, Homo sapiens
aauucucaaaagaaaaggcaaaa

SEQ ID NO: 916128 - RNA, 23 nt, Homo sapiens
aauucucaugugauccuuuuaug

SEQ ID NO: 916129 - RNA, 17 nt, Homo sapiens
aauucucauuugucaca

SEQ ID NO: 916130 - RNA, 18 nt, Homo sapiens
aauucucauuugucacac

SEQ ID NO: 916131 - RNA, 20 nt, Homo sapiens
aauucugcaacuagccaagg

SEQ ID NO: 916132 - RNA, 18 nt, Homo sapiens
aauucuuacaaacaugug

SEQ ID NO: 916133 - RNA, 16 nt, Homo sapiens
aauugacccaaaacgu

SEQ ID NO: 916134 - RNA, 21 nt, Homo sapiens
aauugaccuuuugacuuaaag

SEQ ID NO: 916135 - RNA, 15 nt, Homo sapiens
aauugacgccaccau

SEQ ID NO: 916136 - RNA, 16 nt, Homo sapiens
aauugagaaacaugaa

SEQ ID NO: 916137 - RNA, 15 nt, Homo sapiens
aauugauacuucagg

SEQ ID NO: 916138 - RNA, 12 nt, Homo sapiens
aauugauuucaa

SEQ ID NO: 916139 - RNA, 12 nt, Homo sapiens
aauugcauuuaa

SEQ ID NO: 916140 - RNA, 12 nt, Homo sapiens
aauugcauuucc

SEQ ID NO: 916141 - RNA, 16 nt, Homo sapiens
aauugcauuucugcuc

SEQ ID NO: 916142 - RNA, 14 nt, Homo sapiens
aauugcuacauucu

SEQ ID NO: 916143 - RNA, 17 nt, Homo sapiens
aauugcucaaugcauga

SEQ ID NO: 916144 - RNA, 19 nt, Homo sapiens
aauugcucaaugcaugaau

SEQ ID NO: 916145 - RNA, 16 nt, Homo sapiens
aauuggccucagugua

SEQ ID NO: 916146 - RNA, 14 nt, Homo sapiens
aauuguacauuccc

SEQ ID NO: 916147 - RNA, 16 nt, Homo sapiens
aauugucaaaugucau

SEQ ID NO: 916148 - RNA, 22 nt, Homo sapiens
aauugucaauaccccuguuaag

SEQ ID NO: 916149 - RNA, 19 nt, Homo sapiens
aauugugaucagaccauaa

SEQ ID NO: 916150 - RNA, 12 nt, Homo sapiens
aauugugcuuau

SEQ ID NO: 916151 - RNA, 13 nt, Homo sapiens
aauuguuaggaag

SEQ ID NO: 916152 - RNA, 19 nt, Homo sapiens
aauuuaaaauuaaaugcau

SEQ ID NO: 916153 - RNA, 19 nt, Homo sapiens
aauuuaacaugacuucugc

SEQ ID NO: 916154 - RNA, 17 nt, Homo sapiens
aauuuaaucacuuucau

SEQ ID NO: 916155 - RNA, 12 nt, Homo sapiens
aauuuacuuugu

SEQ ID NO: 916156 - RNA, 18 nt, Homo sapiens
aauuuaggaccaauaccu

SEQ ID NO: 916157 - RNA, 16 nt, Homo sapiens
aauuuagucacaccau

SEQ ID NO: 916158 - RNA, 17 nt, Homo sapiens
aauuuagucacaccauc

SEQ ID NO: 916159 - RNA, 18 nt, Homo sapiens
aauuuauacacacaaaaa

SEQ ID NO: 916160 - RNA, 15 nt, Homo sapiens
aauuucaaaagugau

SEQ ID NO: 916161 - RNA, 18 nt, Homo sapiens
aauuucacgucgucuucu

SEQ ID NO: 916162 - RNA, 15 nt, Homo sapiens
aauuuccucugacau

SEQ ID NO: 916163 - RNA, 22 nt, Homo sapiens
aauuuggauuuacgacugaaga

SEQ ID NO: 916164 - RNA, 18 nt, Homo sapiens
aauuuggccugcacuaau

SEQ ID NO: 916165 - RNA, 12 nt, Homo sapiens
aauuuguacaua

SEQ ID NO: 916166 - RNA, 16 nt, Homo sapiens
aauuuucuaugcuuau

SEQ ID NO: 916167 - RNA, 24 nt, Homo sapiens
aauuuucuucaugcaaugacaucu

SEQ ID NO: 916168 - RNA, 13 nt, Homo sapiens
aauuuucuuccaa

SEQ ID NO: 916169 - RNA, 21 nt, Homo sapiens
aauuuugcagcagaagccaaa

SEQ ID NO: 916170 - RNA, 21 nt, Homo sapiens
aauuuugccauaaagucaaau

SEQ ID NO: 916171 - RNA, 21 nt, Homo sapiens
aauuuuguaguaguugaugac

SEQ ID NO: 916172 - RNA, 19 nt, Homo sapiens
aauuuuguuuguugaugug

SEQ ID NO: 916173 - RNA, 18 nt, Homo sapiens
acaaaaaacaacaaauaa

SEQ ID NO: 916174 - RNA, 16 nt, Homo sapiens
acaaaaaagaaggcuu

SEQ ID NO: 916175 - RNA, 14 nt, Homo sapiens
acaaaaaauuagcu

SEQ ID NO: 916176 - RNA, 22 nt, Homo sapiens
acaaaaaugaaagcaugucuca

SEQ ID NO: 916177 - RNA, 12 nt, Homo sapiens
acaaaaauuuca

SEQ ID NO: 916178 - RNA, 16 nt, Homo sapiens
acaaaauaacauuuga

SEQ ID NO: 916179 - RNA, 14 nt, Homo sapiens
acaaacauauuugu

SEQ ID NO: 916180 - RNA, 16 nt, Homo sapiens
acaaaccuuacuaugg

SEQ ID NO: 916181 - RNA, 23 nt, Homo sapiens
acaaagagucuugguuccucuac

SEQ ID NO: 916182 - RNA, 18 nt, Homo sapiens
acaaagauuauuugcacg

SEQ ID NO: 916183 - RNA, 13 nt, Homo sapiens
acaaagcuucuau

SEQ ID NO: 916184 - RNA, 19 nt, Homo sapiens
acaaaguaguugucccuuu

SEQ ID NO: 916185 - RNA, 17 nt, Homo sapiens
acaaauaaucacauuga

SEQ ID NO: 916186 - RNA, 19 nt, Homo sapiens
acaaauaaugaacagcaga

SEQ ID NO: 916187 - RNA, 13 nt, Homo sapiens
acaaauacuacag

SEQ ID NO: 916188 - RNA, 16 nt, Homo sapiens
acaaauagucuaucaa

SEQ ID NO: 916189 - RNA, 18 nt, Homo sapiens
acaaaugaacgauaugua

SEQ ID NO: 916190 - RNA, 13 nt, Homo sapiens
acaaauguaugau

SEQ ID NO: 916191 - RNA, 16 nt, Homo sapiens
acaaauuaucauacua

SEQ ID NO: 916192 - RNA, 17 nt, Homo sapiens
acaacauguauaauauu

SEQ ID NO: 916193 - RNA, 19 nt, Homo sapiens
acaacauuuacuuaacaga

SEQ ID NO: 916194 - RNA, 19 nt, Homo sapiens
acaacauuucucaaaugca

SEQ ID NO: 916195 - RNA, 13 nt, Homo sapiens
acaaccagccaca

SEQ ID NO: 916196 - RNA, 22 nt, Homo sapiens
acaaccauccugcucauaacau

SEQ ID NO: 916197 - RNA, 21 nt, Homo sapiens
acaaccaugagaccacuguua

SEQ ID NO: 916198 - RNA, 16 nt, Homo sapiens
acaaccuccgugcugg

SEQ ID NO: 916199 - RNA, 13 nt, Homo sapiens
acaaccuuugugu

SEQ ID NO: 916200 - RNA, 15 nt, Homo sapiens
acaacuaccuccuca

SEQ ID NO: 916201 - RNA, 17 nt, Homo sapiens
acaacuguggucaaucc

SEQ ID NO: 916202 - RNA, 21 nt, Homo sapiens
acaacuuccacuccaagugag

SEQ ID NO: 916203 - RNA, 19 nt, Homo sapiens
acaagaagaccagacugug

SEQ ID NO: 916204 - RNA, 22 nt, Homo sapiens
acaagcauucugucuugaaggg

SEQ ID NO: 916205 - RNA, 15 nt, Homo sapiens
acaagccacuaccuu

SEQ ID NO: 916206 - RNA, 14 nt, Homo sapiens
acaagccauagugg

SEQ ID NO: 916207 - RNA, 17 nt, Homo sapiens
acaagcuggaagcacau

SEQ ID NO: 916208 - RNA, 20 nt, Homo sapiens
acaagcuuguauauacauau

SEQ ID NO: 916209 - RNA, 15 nt, Homo sapiens
acaaggcugaccaag

SEQ ID NO: 916210 - RNA, 16 nt, Homo sapiens
acaaggcugaccaaga

SEQ ID NO: 916211 - RNA, 15 nt, Homo sapiens
acaagggcugaccug

SEQ ID NO: 916212 - RNA, 14 nt, Homo sapiens
acaaguaugaugau

SEQ ID NO: 916213 - RNA, 18 nt, Homo sapiens
acaaguauguugagaguu

SEQ ID NO: 916214 - RNA, 12 nt, Homo sapiens
acaagugcacuu

SEQ ID NO: 916215 - RNA, 18 nt, Homo sapiens
acaagugcgccuugcaaa

SEQ ID NO: 916216 - RNA, 14 nt, Homo sapiens
acaaguuucccaaa

SEQ ID NO: 916217 - RNA, 18 nt, Homo sapiens
acaaguuuuaauccagaa

SEQ ID NO: 916218 - RNA, 20 nt, Homo sapiens
acaauaaaggcugagcucuu

SEQ ID NO: 916219 - RNA, 18 nt, Homo sapiens
acaauaauuuucuaccug

SEQ ID NO: 916220 - RNA, 18 nt, Homo sapiens
acaaucugggacuuucac

SEQ ID NO: 916221 - RNA, 15 nt, Homo sapiens
acaaugaaaugcucu

SEQ ID NO: 916222 - RNA, 19 nt, Homo sapiens
acaaugaaggaaaaccuca

SEQ ID NO: 916223 - RNA, 18 nt, Homo sapiens
acaauggcuaauucccag

SEQ ID NO: 916224 - RNA, 18 nt, Homo sapiens
acaauuacuaaauuguau

SEQ ID NO: 916225 - RNA, 11 nt, Homo sapiens
acaauucacuu

SEQ ID NO: 916226 - RNA, 22 nt, Homo sapiens
acaauucucucuuauaugugua

SEQ ID NO: 916227 - RNA, 16 nt, Homo sapiens
acaauugaacuuaaau

SEQ ID NO: 916228 - RNA, 23 nt, Homo sapiens
acaauuugagcaauucauuucac

SEQ ID NO: 916229 - RNA, 16 nt, Homo sapiens
acaauuuuuaagcauu

SEQ ID NO: 916230 - RNA, 15 nt, Homo sapiens
acacaaaaugucaca

SEQ ID NO: 916231 - RNA, 19 nt, Homo sapiens
acacaagccacagaagcca

SEQ ID NO: 916232 - RNA, 22 nt, Homo sapiens
acacacacucuacccuauacaa

SEQ ID NO: 916233 - RNA, 17 nt, Homo sapiens
acacacagagauaugca

SEQ ID NO: 916234 - RNA, 18 nt, Homo sapiens
acacacagauaugcacac

SEQ ID NO: 916235 - RNA, 13 nt, Homo sapiens
acacacagcacuc

SEQ ID NO: 916236 - RNA, 12 nt, Homo sapiens
acacacauggau

SEQ ID NO: 916237 - RNA, 23 nt, Homo sapiens
acacaccccucaaaaaaagccuu

SEQ ID NO: 916238 - RNA, 19 nt, Homo sapiens
acacaccucuaggacucca

SEQ ID NO: 916239 - RNA, 13 nt, Homo sapiens
acacacucugcau

SEQ ID NO: 916240 - RNA, 23 nt, Homo sapiens
acacagacccacacauguuuaca

SEQ ID NO: 916241 - RNA, 16 nt, Homo sapiens
accuaccaugcugcuu

SEQ ID NO: 916242 - RNA, 10 nt, Homo sapiens
accuaccugc

SEQ ID NO: 916243 - RNA, 15 nt, Homo sapiens
accuacucuauguau

SEQ ID NO: 916244 - RNA, 17 nt, Homo sapiens
accuacugacugaugac

SEQ ID NO: 916245 - RNA, 23 nt, Homo sapiens
accuagaagggcuagaaccugga

SEQ ID NO: 916246 - RNA, 17 nt, Homo sapiens
accuagcaauuccauca

SEQ ID NO: 916247 - RNA, 15 nt, Homo sapiens
accuagcaucuuaca

SEQ ID NO: 916248 - RNA, 13 nt, Homo sapiens
accuaggauuuca

SEQ ID NO: 916249 - RNA, 17 nt, Homo sapiens
accuaucaauccugccc

SEQ ID NO: 916250 - RNA, 17 nt, Homo sapiens
accuaugucccuucuca

SEQ ID NO: 916251 - RNA, 13 nt, Homo sapiens
accucacagugac

SEQ ID NO: 916252 - RNA, 16 nt, Homo sapiens
accucaccugaccuca

SEQ ID NO: 916253 - RNA, 19 nt, Homo sapiens
accucagccucccaaagug

SEQ ID NO: 916254 - RNA, 21 nt, Homo sapiens
accucauuuaccauaaaaauc

SEQ ID NO: 916255 - RNA, 17 nt, Homo sapiens
accuccacccacugucc

SEQ ID NO: 916256 - RNA, 18 nt, Homo sapiens
accuccagcuuuccugua

SEQ ID NO: 916257 - RNA, 22 nt, Homo sapiens
accucggcucacugcagccucc

SEQ ID NO: 916258 - RNA, 13 nt, Homo sapiens
accucguccuccc

SEQ ID NO: 916259 - RNA, 16 nt, Homo sapiens
accucuagugcuacug

SEQ ID NO: 916260 - RNA, 17 nt, Homo sapiens
accucugccugaaguca

SEQ ID NO: 916261 - RNA, 13 nt, Homo sapiens
accucugcucuga

SEQ ID NO: 916262 - RNA, 15 nt, Homo sapiens
accucuugucagugc

SEQ ID NO: 916263 - RNA, 21 nt, Homo sapiens
accucuuuauuuuuugauuga

SEQ ID NO: 916264 - RNA, 18 nt, Homo sapiens
accugaaccugggaacca

SEQ ID NO: 916265 - RNA, 18 nt, Homo sapiens
accugaccggcaccugcg

SEQ ID NO: 916266 - RNA, 13 nt, Homo sapiens
accugagaaccuu

SEQ ID NO: 916267 - RNA, 19 nt, Homo sapiens
accugagccuuuucuuaua

SEQ ID NO: 916268 - RNA, 14 nt, Homo sapiens
accugaucauuaca

SEQ ID NO: 916269 - RNA, 23 nt, Homo sapiens
accugcaccuccccccacugcag

SEQ ID NO: 916270 - RNA, 13 nt, Homo sapiens
accugcagauucu

SEQ ID NO: 916271 - RNA, 22 nt, Homo sapiens
accugccacuuccaggagccca

SEQ ID NO: 916272 - RNA, 17 nt, Homo sapiens
accugcccacccacucc

SEQ ID NO: 916273 - RNA, 21 nt, Homo sapiens
accugccuuaacacacacacc

SEQ ID NO: 916274 - RNA, 22 nt, Homo sapiens
accugccuuaacacacacaccu

SEQ ID NO: 916275 - RNA, 16 nt, Homo sapiens
accuggagaugaugau

SEQ ID NO: 916276 - RNA, 22 nt, Homo sapiens
accuggaggggcuagaaccuag

SEQ ID NO: 916277 - RNA, 22 nt, Homo sapiens
accuggauugcagacucaugaa

SEQ ID NO: 916278 - RNA, 19 nt, Homo sapiens
accuggggucaucgauuca

SEQ ID NO: 916279 - RNA, 16 nt, Homo sapiens
accuguaaucauauaa

SEQ ID NO: 916280 - RNA, 15 nt, Homo sapiens
accuguaaucccagc

SEQ ID NO: 916281 - RNA, 13 nt, Homo sapiens
accuguagugaga

SEQ ID NO: 916282 - RNA, 17 nt, Homo sapiens
accuguggggccccaga

SEQ ID NO: 916283 - RNA, 23 nt, Homo sapiens
accugugucuuauagguuuccac

SEQ ID NO: 916284 - RNA, 23 nt, Homo sapiens
accuguuaucuguguuugcugag

SEQ ID NO: 916285 - RNA, 21 nt, Homo sapiens
accuguucuuccuaccaaaua

SEQ ID NO: 916286 - RNA, 22 nt, Homo sapiens
accuguucuuccuaccaaauau

SEQ ID NO: 916287 - RNA, 14 nt, Homo sapiens
accuuaaaauguaa

SEQ ID NO: 916288 - RNA, 14 nt, Homo sapiens
accuuaaucugcca

SEQ ID NO: 916289 - RNA, 19 nt, Homo sapiens
accuuagauuagcucugga

SEQ ID NO: 916290 - RNA, 15 nt, Homo sapiens
accuuaguggcuuuu

SEQ ID NO: 916291 - RNA, 19 nt, Homo sapiens
accuucaauaaaguaucua

SEQ ID NO: 916292 - RNA, 19 nt, Homo sapiens
accuucaucagaccacucc

SEQ ID NO: 916293 - RNA, 17 nt, Homo sapiens
accuucugaagaucuca

SEQ ID NO: 916294 - RNA, 20 nt, Homo sapiens
accuucuguggcucacagaa

SEQ ID NO: 916295 - RNA, 15 nt, Homo sapiens
accuugaacacuggg

SEQ ID NO: 916296 - RNA, 16 nt, Homo sapiens
accuugaacacugggg

SEQ ID NO: 916297 - RNA, 20 nt, Homo sapiens
accuugcucagccaucccgu

SEQ ID NO: 916298 - RNA, 18 nt, Homo sapiens
accuuggacugacuacca

SEQ ID NO: 916299 - RNA, 19 nt, Homo sapiens
accuuuacauaauugcaau

SEQ ID NO: 916300 - RNA, 15 nt, Homo sapiens
accuuuuguauuuaa

SEQ ID NO: 916301 - RNA, 17 nt, Homo sapiens
accuuuuugacuuuucc

SEQ ID NO: 916302 - RNA, 23 nt, Homo sapiens
acgaaacacaaaccacaacugac

SEQ ID NO: 916303 - RNA, 12 nt, Homo sapiens
acgaacuggacu

SEQ ID NO: 916304 - RNA, 23 nt, Homo sapiens
acgaagucuguuuuaaugacaag

SEQ ID NO: 916305 - RNA, 14 nt, Homo sapiens
acgagauaauguau

SEQ ID NO: 916306 - RNA, 19 nt, Homo sapiens
acgaggagcuuccagugca

SEQ ID NO: 916307 - RNA, 21 nt, Homo sapiens
acgaggagcuuccagugcaug

SEQ ID NO: 916308 - RNA, 17 nt, Homo sapiens
acgagggauaauucaaa

SEQ ID NO: 916309 - RNA, 18 nt, Homo sapiens
acgauucuucacuucuug

SEQ ID NO: 916310 - RNA, 14 nt, Homo sapiens
acgcacacauggac

SEQ ID NO: 916311 - RNA, 17 nt, Homo sapiens
acgcacccccacugcug

SEQ ID NO: 916312 - RNA, 15 nt, Homo sapiens
acgcagaucacuaaa

SEQ ID NO: 916313 - RNA, 20 nt, Homo sapiens
acgcagccugcagacucacu

SEQ ID NO: 916314 - RNA, 11 nt, Homo sapiens
acgccaaugca

SEQ ID NO: 916315 - RNA, 14 nt, Homo sapiens
acgccaaugcacac

SEQ ID NO: 916316 - RNA, 15 nt, Homo sapiens
acgccacucauuuca

SEQ ID NO: 916317 - RNA, 21 nt, Homo sapiens
acgccacucauuucaucucau

SEQ ID NO: 916318 - RNA, 21 nt, Homo sapiens
acgccacugcacuauagccua

SEQ ID NO: 916319 - RNA, 17 nt, Homo sapiens
acgccucuuuucccucu

SEQ ID NO: 916320 - RNA, 15 nt, Homo sapiens
acgccuguaauccca

SEQ ID NO: 916321 - RNA, 18 nt, Homo sapiens
acgccuguaaucccagca

SEQ ID NO: 916322 - RNA, 21 nt, Homo sapiens
acgccuguaaucccagcacuu

SEQ ID NO: 916323 - RNA, 19 nt, Homo sapiens
acgccuguaguccuagcca

SEQ ID NO: 916324 - RNA, 12 nt, Homo sapiens
acgcgugcacac

SEQ ID NO: 916325 - RNA, 15 nt, Homo sapiens
acgcucaagaauccu

SEQ ID NO: 916326 - RNA, 16 nt, Homo sapiens
acgcucauuguagaaa

SEQ ID NO: 916327 - RNA, 21 nt, Homo sapiens
acgcuuccagaccaccugcca

SEQ ID NO: 916328 - RNA, 21 nt, Homo sapiens
acggaagccaacuuggcuuuc

SEQ ID NO: 916329 - RNA, 16 nt, Homo sapiens
acggagucuugcucug

SEQ ID NO: 916330 - RNA, 14 nt, Homo sapiens
acggcucacugcag

SEQ ID NO: 916331 - RNA, 12 nt, Homo sapiens
acguaacuauuu

SEQ ID NO: 916332 - RNA, 13 nt, Homo sapiens
acguacugguuua

SEQ ID NO: 916333 - RNA, 16 nt, Homo sapiens
acgucaaacaugaagu

SEQ ID NO: 916334 - RNA, 13 nt, Homo sapiens
acgucaucucagg

SEQ ID NO: 916335 - RNA, 15 nt, Homo sapiens
acgucucaagacuga

SEQ ID NO: 916336 - RNA, 16 nt, Homo sapiens
acgucucaagacugaa

SEQ ID NO: 916337 - RNA, 17 nt, Homo sapiens
acgugaagccacaggag

SEQ ID NO: 916338 - RNA, 19 nt, Homo sapiens
acgugaagccacaggagcc

SEQ ID NO: 916339 - RNA, 14 nt, Homo sapiens
acgugagccaggua

SEQ ID NO: 916340 - RNA, 14 nt, Homo sapiens
acgugccugugauc

SEQ ID NO: 916341 - RNA, 17 nt, Homo sapiens
acgugccugugauccca

SEQ ID NO: 916342 - RNA, 15 nt, Homo sapiens
acguguccuacagcc

SEQ ID NO: 916343 - RNA, 20 nt, Homo sapiens
acgugugugcacguacacac

SEQ ID NO: 916344 - RNA, 20 nt, Homo sapiens
acguguguguguuucaucug

SEQ ID NO: 916345 - RNA, 13 nt, Homo sapiens
acuaaaaagccau

SEQ ID NO: 916346 - RNA, 12 nt, Homo sapiens
acuaaaagaauu

SEQ ID NO: 916347 - RNA, 21 nt, Homo sapiens
acuaaacaacuaccuccucag

SEQ ID NO: 916348 - RNA, 18 nt, Homo sapiens
acuaaacagacuauuuaa

SEQ ID NO: 916349 - RNA, 12 nt, Homo sapiens
acuaaaguauau

SEQ ID NO: 916350 - RNA, 17 nt, Homo sapiens
acuaaaguauaucuuua

SEQ ID NO: 916351 - RNA, 21 nt, Homo sapiens
acuaaccccaacgcacaggaa

SEQ ID NO: 916352 - RNA, 15 nt, Homo sapiens
acuaagaaauaugca

SEQ ID NO: 916353 - RNA, 20 nt, Homo sapiens
acuaagcaguaagcuaucuu

SEQ ID NO: 916354 - RNA, 15 nt, Homo sapiens
acuaauagagacaca

SEQ ID NO: 916355 - RNA, 15 nt, Homo sapiens
acuaaugcuaagaaa

SEQ ID NO: 916356 - RNA, 17 nt, Homo sapiens
auaaugaguucacuaca

SEQ ID NO: 916357 - RNA, 17 nt, Homo sapiens
auaauggaaacauuuac

SEQ ID NO: 916358 - RNA, 18 nt, Homo sapiens
auaaugguuuuuaauguc

SEQ ID NO: 916359 - RNA, 22 nt, Homo sapiens
auaauguuaacuaaauaacuuu

SEQ ID NO: 916360 - RNA, 16 nt, Homo sapiens
auaauguuacauuauu

SEQ ID NO: 916361 - RNA, 21 nt, Homo sapiens
auaauguuacauuauuaucaa

SEQ ID NO: 916362 - RNA, 13 nt, Homo sapiens
auaauuaaugugu

SEQ ID NO: 916363 - RNA, 15 nt, Homo sapiens
auaauucccuaucuu

SEQ ID NO: 916364 - RNA, 15 nt, Homo sapiens
auaauucuacaggau

SEQ ID NO: 916365 - RNA, 22 nt, Homo sapiens
auaauucuuuucuuuuccauuu

SEQ ID NO: 916366 - RNA, 15 nt, Homo sapiens
auaauugacaugggc

SEQ ID NO: 916367 - RNA, 13 nt, Homo sapiens
auacaaaacuguu

SEQ ID NO: 916368 - RNA, 20 nt, Homo sapiens
auacaaaagcaagacuucca

SEQ ID NO: 916369 - RNA, 14 nt, Homo sapiens
auacaaacaagcac

SEQ ID NO: 916370 - RNA, 15 nt, Homo sapiens
auacaacacaaagag

SEQ ID NO: 916371 - RNA, 13 nt, Homo sapiens
auacacacauaua

SEQ ID NO: 916372 - RNA, 12 nt, Homo sapiens
auacacacucaa

SEQ ID NO: 916373 - RNA, 21 nt, Homo sapiens
auacacauggaugcacgcaca

SEQ ID NO: 916374 - RNA, 19 nt, Homo sapiens
auacaccaccucacuccug

SEQ ID NO: 916375 - RNA, 17 nt, Homo sapiens
auacaccuacuacucaa

SEQ ID NO: 916376 - RNA, 22 nt, Homo sapiens
auacacugaaguuaacagagac

SEQ ID NO: 916377 - RNA, 16 nt, Homo sapiens
auacagaaaaugcuuu

SEQ ID NO: 916378 - RNA, 18 nt, Homo sapiens
auacaguaagcugcucua

SEQ ID NO: 916379 - RNA, 16 nt, Homo sapiens
auacaguggaucucaa

SEQ ID NO: 916380 - RNA, 18 nt, Homo sapiens
auacauacacuuguauaa

SEQ ID NO: 916381 - RNA, 13 nt, Homo sapiens
auacauacauaua

SEQ ID NO: 916382 - RNA, 14 nt, Homo sapiens
auacauaccacuuu

SEQ ID NO: 916383 - RNA, 12 nt, Homo sapiens
auacauaccuac

SEQ ID NO: 916384 - RNA, 19 nt, Homo sapiens
auacauauguagacuauau

SEQ ID NO: 916385 - RNA, 19 nt, Homo sapiens
auacaucacagcagugcau

SEQ ID NO: 916386 - RNA, 13 nt, Homo sapiens
auacaugcugcua

SEQ ID NO: 916387 - RNA, 18 nt, Homo sapiens
auacaugcugcuaauuca

SEQ ID NO: 916388 - RNA, 14 nt, Homo sapiens
auacauguguguau

SEQ ID NO: 916389 - RNA, 15 nt, Homo sapiens
auacauguguguaua

SEQ ID NO: 916390 - RNA, 17 nt, Homo sapiens
auacauguguguauaua

SEQ ID NO: 916391 - RNA, 18 nt, Homo sapiens
auaccagugaaccaaaga

SEQ ID NO: 916392 - RNA, 20 nt, Homo sapiens
auacccagucccagaaccac

SEQ ID NO: 916393 - RNA, 17 nt, Homo sapiens
auacccugaauuuggcc

SEQ ID NO: 916394 - RNA, 21 nt, Homo sapiens
auaccucaacccccauuucua

SEQ ID NO: 916395 - RNA, 14 nt, Homo sapiens
auaccucugaccaa

SEQ ID NO: 916396 - RNA, 19 nt, Homo sapiens
auaccuguguuucuugccu

SEQ ID NO: 916397 - RNA, 21 nt, Homo sapiens
auaccuuacugagagcauguu

SEQ ID NO: 916398 - RNA, 17 nt, Homo sapiens
auaccuuuauugugauc

SEQ ID NO: 916399 - RNA, 13 nt, Homo sapiens
auacgugucugug

SEQ ID NO: 916400 - RNA, 22 nt, Homo sapiens
auacuagaaagcucugcaugug

SEQ ID NO: 916401 - RNA, 20 nt, Homo sapiens
auacuagaaugguagcacua

SEQ ID NO: 916402 - RNA, 16 nt, Homo sapiens
auacuaugugggacac

SEQ ID NO: 916403 - RNA, 17 nt, Homo sapiens
auacucaaaagagagag

SEQ ID NO: 916404 - RNA, 19 nt, Homo sapiens
auacucuagaacaugcaca

SEQ ID NO: 916405 - RNA, 23 nt, Homo sapiens
auacugcaauaaauuauggcucu

SEQ ID NO: 916406 - RNA, 15 nt, Homo sapiens
auacugcaugcucag

SEQ ID NO: 916407 - RNA, 18 nt, Homo sapiens
auacugcaugcucaggac

SEQ ID NO: 916408 - RNA, 17 nt, Homo sapiens
auacugccggucaccca

SEQ ID NO: 916409 - RNA, 15 nt, Homo sapiens
auacuuaacauugau

SEQ ID NO: 916410 - RNA, 16 nt, Homo sapiens
auacuucuaccaacau

SEQ ID NO: 916411 - RNA, 13 nt, Homo sapiens
auacuuuacaaag

SEQ ID NO: 916412 - RNA, 19 nt, Homo sapiens
auacuuucccacagcacua

SEQ ID NO: 916413 - RNA, 18 nt, Homo sapiens
auacuuuuuuucacaguu

SEQ ID NO: 916414 - RNA, 17 nt, Homo sapiens
auagaaacaugacacug

SEQ ID NO: 916415 - RNA, 18 nt, Homo sapiens
auagaaacaugacacuga

SEQ ID NO: 916416 - RNA, 12 nt, Homo sapiens
auagaaacugag

SEQ ID NO: 916417 - RNA, 14 nt, Homo sapiens
auagaaacugagga

SEQ ID NO: 916418 - RNA, 14 nt, Homo sapiens
auagaaaguucaaa

SEQ ID NO: 916419 - RNA, 14 nt, Homo sapiens
auagaauacaugga

SEQ ID NO: 916420 - RNA, 18 nt, Homo sapiens
auagaauauuuacaauaa

SEQ ID NO: 916421 - RNA, 20 nt, Homo sapiens
auagacacuggagacuugga

SEQ ID NO: 916422 - RNA, 21 nt, Homo sapiens
auagacagcacuuggcuccuu

SEQ ID NO: 916423 - RNA, 23 nt, Homo sapiens
auagagauuaauuuuaacuuaaa

SEQ ID NO: 916424 - RNA, 13 nt, Homo sapiens
auagaguacugca

SEQ ID NO: 916425 - RNA, 15 nt, Homo sapiens
auagauauguagaua

SEQ ID NO: 916426 - RNA, 13 nt, Homo sapiens
auagaucuuuuca

SEQ ID NO: 916427 - RNA, 19 nt, Homo sapiens
auagaugaacuauuagaca

SEQ ID NO: 916428 - RNA, 23 nt, Homo sapiens
auagaugugcaagucuugucaga

SEQ ID NO: 916429 - RNA, 18 nt, Homo sapiens
auagauuaauggcacuga

SEQ ID NO: 916430 - RNA, 13 nt, Homo sapiens
auagauuaccuga

SEQ ID NO: 916431 - RNA, 22 nt, Homo sapiens
auagauuuucauguucuugcag

SEQ ID NO: 916432 - RNA, 23 nt, Homo sapiens
auagcaguugaaacaagaagcca

SEQ ID NO: 916433 - RNA, 14 nt, Homo sapiens
auagccaacugcug

SEQ ID NO: 916434 - RNA, 16 nt, Homo sapiens
auagccauaugcaaua

SEQ ID NO: 916435 - RNA, 21 nt, Homo sapiens
auagcucacuguaaccucaaa

SEQ ID NO: 916436 - RNA, 17 nt, Homo sapiens
auagcuucuccaaaggc

SEQ ID NO: 916437 - RNA, 21 nt, Homo sapiens
auaggagagauaccuugaaaa

SEQ ID NO: 916438 - RNA, 18 nt, Homo sapiens
auaggcauuugauuuugc

SEQ ID NO: 916439 - RNA, 19 nt, Homo sapiens
auaggcauuugauuuugcc

SEQ ID NO: 916440 - RNA, 22 nt, Homo sapiens
auagggguaagguaugggagag

SEQ ID NO: 916441 - RNA, 13 nt, Homo sapiens
auaguccaaagac

SEQ ID NO: 916442 - RNA, 23 nt, Homo sapiens
auagugauugauagaguguuauc

SEQ ID NO: 916443 - RNA, 17 nt, Homo sapiens
auagugcacuagcauuu

SEQ ID NO: 916444 - RNA, 18 nt, Homo sapiens
auaguuaauuauuucaac

SEQ ID NO: 916445 - RNA, 15 nt, Homo sapiens
auauaaacacuauau

SEQ ID NO: 916446 - RNA, 22 nt, Homo sapiens
auauaaggaaagugauccaaaa

SEQ ID NO: 916447 - RNA, 21 nt, Homo sapiens
auauaauacuaaagugucuau

SEQ ID NO: 916448 - RNA, 15 nt, Homo sapiens
auauaaugguuuacu

SEQ ID NO: 916449 - RNA, 15 nt, Homo sapiens
auauacaauaacaua

SEQ ID NO: 916450 - RNA, 13 nt, Homo sapiens
auauacacauaca

SEQ ID NO: 916451 - RNA, 14 nt, Homo sapiens
auauacacauacau

SEQ ID NO: 916452 - RNA, 19 nt, Homo sapiens
auauacacauauaccuaua

SEQ ID NO: 916453 - RNA, 15 nt, Homo sapiens
auauacacauggaug

SEQ ID NO: 916454 - RNA, 14 nt, Homo sapiens
auauacauaugaca

SEQ ID NO: 916455 - RNA, 20 nt, Homo sapiens
auauacuucacucacuuuuc

SEQ ID NO: 916456 - RNA, 16 nt, Homo sapiens
auauagcguucccaac

SEQ ID NO: 916457 - RNA, 16 nt, Homo sapiens
auauagguugugcaaa

SEQ ID NO: 916458 - RNA, 15 nt, Homo sapiens
auauaugugcaguau

SEQ ID NO: 916459 - RNA, 19 nt, Homo sapiens
auauauguguauauauaca

SEQ ID NO: 916460 - RNA, 17 nt, Homo sapiens
auauauuucagauauca

SEQ ID NO: 916461 - RNA, 23 nt, Homo sapiens
auauauuuuugguugucaauauu

SEQ ID NO: 916462 - RNA, 17 nt, Homo sapiens
auaucaagauguuaaau

SEQ ID NO: 916463 - RNA, 14 nt, Homo sapiens
auaucagagcucuu

SEQ ID NO: 916464 - RNA, 14 nt, Homo sapiens
auaucaucagcaua

SEQ ID NO: 916465 - RNA, 15 nt, Homo sapiens
auaucaucagcauac

SEQ ID NO: 916466 - RNA, 16 nt, Homo sapiens
auaucaucagcauacc

SEQ ID NO: 916467 - RNA, 17 nt, Homo sapiens
auaucauuuuuuuaaca

SEQ ID NO: 916468 - RNA, 23 nt, Homo sapiens
auauccaagaagcaugcagagaa

SEQ ID NO: 916469 - RNA, 15 nt, Homo sapiens
auauccacagacucc

SEQ ID NO: 916470 - RNA, 16 nt, Homo sapiens
auaucgagaacugcca

SEQ ID NO: 916471 - RNA, 19 nt, Homo sapiens
augaacacacauggaugca

SEQ ID NO: 916472 - RNA, 22 nt, Homo sapiens
augaacacacauggaugcacac

SEQ ID NO: 916473 - RNA, 17 nt, Homo sapiens
augaacagcagaaagac

SEQ ID NO: 916474 - RNA, 15 nt, Homo sapiens
augaacucuuaauca

SEQ ID NO: 916475 - RNA, 16 nt, Homo sapiens
augaacucuuaaucaa

SEQ ID NO: 916476 - RNA, 18 nt, Homo sapiens
augaagacccaguguaaa

SEQ ID NO: 916477 - RNA, 20 nt, Homo sapiens
augaagacccuggaguucaa

SEQ ID NO: 916478 - RNA, 21 nt, Homo sapiens
augaagaccuaaaugaccuca

SEQ ID NO: 916479 - RNA, 16 nt, Homo sapiens
augaagagacucucuu

SEQ ID NO: 916480 - RNA, 23 nt, Homo sapiens
augaaggaauagcccgaggaccg

SEQ ID NO: 916481 - RNA, 17 nt, Homo sapiens
augaaggacgugucuca

SEQ ID NO: 916482 - RNA, 15 nt, Homo sapiens
augaaggacuauuaa

SEQ ID NO: 916483 - RNA, 15 nt, Homo sapiens
augaaggcgugcaag

SEQ ID NO: 916484 - RNA, 14 nt, Homo sapiens
augaaggcuguaca

SEQ ID NO: 916485 - RNA, 23 nt, Homo sapiens
augaaggugucauacagauuugc

SEQ ID NO: 916486 - RNA, 21 nt, Homo sapiens
augaagguuucugaaaauuaa

SEQ ID NO: 916487 - RNA, 20 nt, Homo sapiens
augaaguguguuuccuucag

SEQ ID NO: 916488 - RNA, 20 nt, Homo sapiens
augaauagagaguauguaau

SEQ ID NO: 916489 - RNA, 20 nt, Homo sapiens
augaauagaugugaucacug

SEQ ID NO: 916490 - RNA, 17 nt, Homo sapiens
augaaucaaagacaugg

SEQ ID NO: 916491 - RNA, 18 nt, Homo sapiens
augaaucauugauugaau

SEQ ID NO: 916492 - RNA, 15 nt, Homo sapiens
augaaucuuacuccu

SEQ ID NO: 916493 - RNA, 16 nt, Homo sapiens
augaaucuuacuccuu

SEQ ID NO: 916494 - RNA, 17 nt, Homo sapiens
augaaugauguuuuaga

SEQ ID NO: 916495 - RNA, 14 nt, Homo sapiens
augaauugucuuca

SEQ ID NO: 916496 - RNA, 23 nt, Homo sapiens
augacaccuccauuucucuccag

SEQ ID NO: 916497 - RNA, 12 nt, Homo sapiens
augacacugacc

SEQ ID NO: 916498 - RNA, 13 nt, Homo sapiens
augacacugaccu

SEQ ID NO: 916499 - RNA, 13 nt, Homo sapiens
augacagccagag

SEQ ID NO: 916500 - RNA, 15 nt, Homo sapiens
augacaugcacugac

SEQ ID NO: 916501 - RNA, 12 nt, Homo sapiens
augaccaagaaa

SEQ ID NO: 916502 - RNA, 23 nt, Homo sapiens
augacccccaaccaaguggcucc

SEQ ID NO: 916503 - RNA, 22 nt, Homo sapiens
augaccuacuaguuuuccuuga

SEQ ID NO: 916504 - RNA, 18 nt, Homo sapiens
augaccugaucauuacau

SEQ ID NO: 916505 - RNA, 17 nt, Homo sapiens
augaccugcugcuguug

SEQ ID NO: 916506 - RNA, 23 nt, Homo sapiens
augaccuguuauuaccauuagca

SEQ ID NO: 916507 - RNA, 22 nt, Homo sapiens
augacggcugcucgaagaacaa

SEQ ID NO: 916508 - RNA, 21 nt, Homo sapiens
augacugcugaaugacauauu

SEQ ID NO: 916509 - RNA, 20 nt, Homo sapiens
augagaaaguucucauuuaa

SEQ ID NO: 916510 - RNA, 13 nt, Homo sapiens
augagaacauuua

SEQ ID NO: 916511 - RNA, 23 nt, Homo sapiens
augagaacauuuacacauucuca

SEQ ID NO: 916512 - RNA, 12 nt, Homo sapiens
augagaaucacu

SEQ ID NO: 916513 - RNA, 17 nt, Homo sapiens
augagaccacuguuauc

SEQ ID NO: 916514 - RNA, 23 nt, Homo sapiens
augagaguuucuguuaaucaugu

SEQ ID NO: 916515 - RNA, 23 nt, Homo sapiens
augagcacacacacaccaaugcg

SEQ ID NO: 916516 - RNA, 11 nt, Homo sapiens
augagcaugaa

SEQ ID NO: 916517 - RNA, 20 nt, Homo sapiens
augagcauuagcuacuuuuc

SEQ ID NO: 916518 - RNA, 18 nt, Homo sapiens
augagccaccaugcccag

SEQ ID NO: 916519 - RNA, 15 nt, Homo sapiens
augagcccuagaaga

SEQ ID NO: 916520 - RNA, 19 nt, Homo sapiens
augagccguugugcuccag

SEQ ID NO: 916521 - RNA, 21 nt, Homo sapiens
augagccucagcauccuggca

SEQ ID NO: 916522 - RNA, 17 nt, Homo sapiens
augaggaauauuugcaa

SEQ ID NO: 916523 - RNA, 22 nt, Homo sapiens
augaggacuugugucucugugc

SEQ ID NO: 916524 - RNA, 15 nt, Homo sapiens
augaggcaaugucag

SEQ ID NO: 916525 - RNA, 13 nt, Homo sapiens
augagggaaaaug

SEQ ID NO: 916526 - RNA, 16 nt, Homo sapiens
augagggaaaaugagu

SEQ ID NO: 916527 - RNA, 22 nt, Homo sapiens
augaggucauagcagugcuuga

SEQ ID NO: 916528 - RNA, 14 nt, Homo sapiens
augagucagucucu

SEQ ID NO: 916529 - RNA, 18 nt, Homo sapiens
augaguuuauauggaaaa

SEQ ID NO: 916530 - RNA, 15 nt, Homo sapiens
augauaaucugggca

SEQ ID NO: 916531 - RNA, 14 nt, Homo sapiens
augauacuauucag

SEQ ID NO: 916532 - RNA, 16 nt, Homo sapiens
augauacugaugccau

SEQ ID NO: 916533 - RNA, 17 nt, Homo sapiens
augaucagcuguuuguc

SEQ ID NO: 916534 - RNA, 21 nt, Homo sapiens
augaucauaauguuaacuaaa

SEQ ID NO: 916535 - RNA, 22 nt, Homo sapiens
augaucgcgccacuacacucca

SEQ ID NO: 916536 - RNA, 12 nt, Homo sapiens
augaucucagga

SEQ ID NO: 916537 - RNA, 20 nt, Homo sapiens
augaucuuugcagacaggca

SEQ ID NO: 916538 - RNA, 18 nt, Homo sapiens
augaugaccaagaauuac

SEQ ID NO: 916539 - RNA, 12 nt, Homo sapiens
augaugaugaug

SEQ ID NO: 916540 - RNA, 17 nt, Homo sapiens
augauggugcugaccuc

SEQ ID NO: 916541 - RNA, 15 nt, Homo sapiens
augauguguagggcu

SEQ ID NO: 916542 - RNA, 15 nt, Homo sapiens
augauuagcacuuaa

SEQ ID NO: 916543 - RNA, 19 nt, Homo sapiens
augauucagaaauuuucau

SEQ ID NO: 916544 - RNA, 14 nt, Homo sapiens
augauucauaacaa

SEQ ID NO: 916545 - RNA, 16 nt, Homo sapiens
augauugugaccucca

SEQ ID NO: 916546 - RNA, 14 nt, Homo sapiens
augauuuuauuuga

SEQ ID NO: 916547 - RNA, 18 nt, Homo sapiens
augcaaaguagcaauuuc

SEQ ID NO: 916548 - RNA, 16 nt, Homo sapiens
augcaacaacauguau

SEQ ID NO: 916549 - RNA, 17 nt, Homo sapiens
augcaacaacauguaua

SEQ ID NO: 916550 - RNA, 18 nt, Homo sapiens
augcaacaacauguauaa

SEQ ID NO: 916551 - RNA, 18 nt, Homo sapiens
augcaaccuuuggaugca

SEQ ID NO: 916552 - RNA, 22 nt, Homo sapiens
augcaaccuuuggaugcacuuu

SEQ ID NO: 916553 - RNA, 24 nt, Homo sapiens
augcaaccuuuggaugcacuuuau

SEQ ID NO: 916554 - RNA, 18 nt, Homo sapiens
augcaagaguggacugaa

SEQ ID NO: 916555 - RNA, 18 nt, Homo sapiens
augcaaucucuugucuca

SEQ ID NO: 916556 - RNA, 15 nt, Homo sapiens
augcacacacacaga

SEQ ID NO: 916557 - RNA, 23 nt, Homo sapiens
augcacacacacagagauaugca

SEQ ID NO: 916558 - RNA, 15 nt, Homo sapiens
augcacacacacgga

SEQ ID NO: 916559 - RNA, 21 nt, Homo sapiens
augcacacacacggaugcaca

SEQ ID NO: 916560 - RNA, 19 nt, Homo sapiens
augcacacacagaugcaca

SEQ ID NO: 916561 - RNA, 16 nt, Homo sapiens
augcacacacauggau

SEQ ID NO: 916562 - RNA, 15 nt, Homo sapiens
augcacaccaaaaaa

SEQ ID NO: 916563 - RNA, 20 nt, Homo sapiens
augcacagagauaugcacac

SEQ ID NO: 916564 - RNA, 20 nt, Homo sapiens
augcacauauggacucugca

SEQ ID NO: 916565 - RNA, 14 nt, Homo sapiens
augcaccagugccg

SEQ ID NO: 916566 - RNA, 20 nt, Homo sapiens
augcacuuggcugcauaaau

SEQ ID NO: 916567 - RNA, 13 nt, Homo sapiens
augcagacuuccu

SEQ ID NO: 916568 - RNA, 19 nt, Homo sapiens
augcagaggggugcugcuc

SEQ ID NO: 916569 - RNA, 13 nt, Homo sapiens
augcagcucugau

SEQ ID NO: 916570 - RNA, 14 nt, Homo sapiens
augcauccauuuca

SEQ ID NO: 916571 - RNA, 15 nt, Homo sapiens
augcauccauuucag

SEQ ID NO: 916572 - RNA, 18 nt, Homo sapiens
augcaugcgcaggcucau

SEQ ID NO: 916573 - RNA, 14 nt, Homo sapiens
augcauguccucaa

SEQ ID NO: 916574 - RNA, 15 nt, Homo sapiens
augcauguccucaaa

SEQ ID NO: 916575 - RNA, 15 nt, Homo sapiens
augcauugcuaaaau

SEQ ID NO: 916576 - RNA, 19 nt, Homo sapiens
augcauuuuuaauaugaca

SEQ ID NO: 916577 - RNA, 15 nt, Homo sapiens
augccaacuggucac

SEQ ID NO: 916578 - RNA, 21 nt, Homo sapiens
augccacccucuccaugccca

SEQ ID NO: 916579 - RNA, 23 nt, Homo sapiens
augccacuccugcuucucugggg

SEQ ID NO: 916580 - RNA, 17 nt, Homo sapiens
augccacugcuuuccag

SEQ ID NO: 916581 - RNA, 22 nt, Homo sapiens
augccagcucagucccaucaga

SEQ ID NO: 916582 - RNA, 13 nt, Homo sapiens
augcccacucuaa

SEQ ID NO: 916583 - RNA, 17 nt, Homo sapiens
augcccucaaucccagc

SEQ ID NO: 916584 - RNA, 20 nt, Homo sapiens
augccguauaggaugucaga

SEQ ID NO: 916585 - RNA, 18 nt, Homo sapiens
auucauaauuagaacaau

SEQ ID NO: 916586 - RNA, 17 nt, Homo sapiens
auucaucagucauuauu

SEQ ID NO: 916587 - RNA, 13 nt, Homo sapiens
auucauccaacag

SEQ ID NO: 916588 - RNA, 19 nt, Homo sapiens
auucaucucucuuuaauau

SEQ ID NO: 916589 - RNA, 22 nt, Homo sapiens
auucauugaucaaauauuucaa

SEQ ID NO: 916590 - RNA, 20 nt, Homo sapiens
auucauuuaaaaugauuaga

SEQ ID NO: 916591 - RNA, 18 nt, Homo sapiens
auucauuuauucauucau

SEQ ID NO: 916592 - RNA, 18 nt, Homo sapiens
auucauuuuaacaucuga

SEQ ID NO: 916593 - RNA, 12 nt, Homo sapiens
auucauuuuccu

SEQ ID NO: 916594 - RNA, 13 nt, Homo sapiens
auuccaagucaac

SEQ ID NO: 916595 - RNA, 23 nt, Homo sapiens
auuccagagcacugcuccagugg

SEQ ID NO: 916596 - RNA, 12 nt, Homo sapiens
auuccagugcag

SEQ ID NO: 916597 - RNA, 16 nt, Homo sapiens
auuccaugggauguua

SEQ ID NO: 916598 - RNA, 18 nt, Homo sapiens
auuccauuuccaguucau

SEQ ID NO: 916599 - RNA, 13 nt, Homo sapiens
auucccaccaagg

SEQ ID NO: 916600 - RNA, 18 nt, Homo sapiens
auucccccuaagaggcag

SEQ ID NO: 916601 - RNA, 19 nt, Homo sapiens
auucccuaucuuuuaguuu

SEQ ID NO: 916602 - RNA, 14 nt, Homo sapiens
auucccugcaucca

SEQ ID NO: 916603 - RNA, 14 nt, Homo sapiens
auucccuguacaau

SEQ ID NO: 916604 - RNA, 23 nt, Homo sapiens
auucccuguuaaaauuuaaccua

SEQ ID NO: 916605 - RNA, 13 nt, Homo sapiens
auuccgucuuaaa

SEQ ID NO: 916606 - RNA, 14 nt, Homo sapiens
auuccuacaaagau

SEQ ID NO: 916607 - RNA, 15 nt, Homo sapiens
auuccuagaaguuga

SEQ ID NO: 916608 - RNA, 16 nt, Homo sapiens
auuccuauauguagcu

SEQ ID NO: 916609 - RNA, 15 nt, Homo sapiens
auuccucagcugcca

SEQ ID NO: 916610 - RNA, 12 nt, Homo sapiens
auuccucuugcc

SEQ ID NO: 916611 - RNA, 20 nt, Homo sapiens
auuccugauaauaauugauc

SEQ ID NO: 916612 - RNA, 15 nt, Homo sapiens
auuccuggcaugaca

SEQ ID NO: 916613 - RNA, 15 nt, Homo sapiens
auuccuguagcaucu

SEQ ID NO: 916614 - RNA, 14 nt, Homo sapiens
auuccuucaauuca

SEQ ID NO: 916615 - RNA, 13 nt, Homo sapiens
auuccuugauuca

SEQ ID NO: 916616 - RNA, 14 nt, Homo sapiens
auuccuugauucac

SEQ ID NO: 916617 - RNA, 13 nt, Homo sapiens
auucgccuguggg

SEQ ID NO: 916618 - RNA, 15 nt, Homo sapiens
auucggauuugacaa

SEQ ID NO: 916619 - RNA, 18 nt, Homo sapiens
auucuaacuuuuuugcua

SEQ ID NO: 916620 - RNA, 14 nt, Homo sapiens
auucuacacauaua

SEQ ID NO: 916621 - RNA, 18 nt, Homo sapiens
auucuacuucugucuucc

SEQ ID NO: 916622 - RNA, 21 nt, Homo sapiens
auucuacuucugucuuccuuc

SEQ ID NO: 916623 - RNA, 18 nt, Homo sapiens
auucuauuacgugcaaua

SEQ ID NO: 916624 - RNA, 19 nt, Homo sapiens
auucuauuacgugcaauac

SEQ ID NO: 916625 - RNA, 12 nt, Homo sapiens
auucucaccagg

SEQ ID NO: 916626 - RNA, 14 nt, Homo sapiens
auucucaccaggaa

SEQ ID NO: 916627 - RNA, 19 nt, Homo sapiens
auucucauuugucacacac

SEQ ID NO: 916628 - RNA, 14 nt, Homo sapiens
auucucuuacccag

SEQ ID NO: 916629 - RNA, 21 nt, Homo sapiens
auucugaaaauaccagugugu

SEQ ID NO: 916630 - RNA, 22 nt, Homo sapiens
auucuggaaaagcaaaacugua

SEQ ID NO: 916631 - RNA, 12 nt, Homo sapiens
auucuggaagau

SEQ ID NO: 916632 - RNA, 21 nt, Homo sapiens
auucugggcuccuggaaccaa

SEQ ID NO: 916633 - RNA, 16 nt, Homo sapiens
auucuguaagaaucaa

SEQ ID NO: 916634 - RNA, 20 nt, Homo sapiens
auucuuaaaggaaaagucaa

SEQ ID NO: 916635 - RNA, 23 nt, Homo sapiens
auucuuaaaggaaaagucaacau

SEQ ID NO: 916636 - RNA, 19 nt, Homo sapiens
auucuuaagggaacuucca

SEQ ID NO: 916637 - RNA, 17 nt, Homo sapiens
auucuuaauaggcuuua

SEQ ID NO: 916638 - RNA, 15 nt, Homo sapiens
auucuugacauucac

SEQ ID NO: 916639 - RNA, 13 nt, Homo sapiens
auucuuggaauac

SEQ ID NO: 916640 - RNA, 19 nt, Homo sapiens
auucuuguauauuauggaa

SEQ ID NO: 916641 - RNA, 17 nt, Homo sapiens
auugaagaaaagcacuu

SEQ ID NO: 916642 - RNA, 19 nt, Homo sapiens
auugaaucugauuggacau

SEQ ID NO: 916643 - RNA, 17 nt, Homo sapiens
auugacacacagcacuc

SEQ ID NO: 916644 - RNA, 20 nt, Homo sapiens
auugacacacagcacucucu

SEQ ID NO: 916645 - RNA, 21 nt, Homo sapiens
auugacacacagcacucucua

SEQ ID NO: 916646 - RNA, 16 nt, Homo sapiens
auugacccauguuccc

SEQ ID NO: 916647 - RNA, 18 nt, Homo sapiens
auugacgcauauuuaacu

SEQ ID NO: 916648 - RNA, 21 nt, Homo sapiens
auugagauaauaucugugagg

SEQ ID NO: 916649 - RNA, 14 nt, Homo sapiens
auugauuauucuga

SEQ ID NO: 916650 - RNA, 13 nt, Homo sapiens
auugcacuaugaa

SEQ ID NO: 916651 - RNA, 15 nt, Homo sapiens
auugcagacucauga

SEQ ID NO: 916652 - RNA, 15 nt, Homo sapiens
auugccugcagagag

SEQ ID NO: 916653 - RNA, 18 nt, Homo sapiens
auugcuaccucuuuguca

SEQ ID NO: 916654 - RNA, 14 nt, Homo sapiens
auugcuaugaauga

SEQ ID NO: 916655 - RNA, 14 nt, Homo sapiens
auuggaaucuguau

SEQ ID NO: 916656 - RNA, 22 nt, Homo sapiens
auuggacuuccuugguuuggac

SEQ ID NO: 916657 - RNA, 18 nt, Homo sapiens
auuggagggaagacaggu

SEQ ID NO: 916658 - RNA, 18 nt, Homo sapiens
auuggcuauaacaugucu

SEQ ID NO: 916659 - RNA, 18 nt, Homo sapiens
auuggcuggagauggaaa

SEQ ID NO: 916660 - RNA, 18 nt, Homo sapiens
auugggcugacaccuacc

SEQ ID NO: 916661 - RNA, 19 nt, Homo sapiens
auuggguacccaguuaaau

SEQ ID NO: 916662 - RNA, 13 nt, Homo sapiens
auuguacacuauc

SEQ ID NO: 916663 - RNA, 14 nt, Homo sapiens
auuguaccaugaaa

SEQ ID NO: 916664 - RNA, 16 nt, Homo sapiens
auuguagaaacacagu

SEQ ID NO: 916665 - RNA, 13 nt, Homo sapiens
auuguauaagauu

SEQ ID NO: 916666 - RNA, 18 nt, Homo sapiens
auuguauauucuggaaaa

SEQ ID NO: 916667 - RNA, 13 nt, Homo sapiens
auugucaccuaac

SEQ ID NO: 916668 - RNA, 16 nt, Homo sapiens
auugucagaguucugc

SEQ ID NO: 916669 - RNA, 20 nt, Homo sapiens
auugucagaguucugcucua

SEQ ID NO: 916670 - RNA, 15 nt, Homo sapiens
auugucauaaccaac

SEQ ID NO: 916671 - RNA, 23 nt, Homo sapiens
auuguccagugcaaccacacacc

SEQ ID NO: 916672 - RNA, 21 nt, Homo sapiens
auugugaauaaaaauugauga

SEQ ID NO: 916673 - RNA, 16 nt, Homo sapiens
auugugcccagcccuu

SEQ ID NO: 916674 - RNA, 15 nt, Homo sapiens
auugugccucuggcu

SEQ ID NO: 916675 - RNA, 18 nt, Homo sapiens
auuguggguaacgugaga

SEQ ID NO: 916676 - RNA, 13 nt, Homo sapiens
auuguuucuggaa

SEQ ID NO: 916677 - RNA, 16 nt, Homo sapiens
auuguuuuauguucua

SEQ ID NO: 916678 - RNA, 18 nt, Homo sapiens
auuguuuuugcucaaggc

SEQ ID NO: 916679 - RNA, 21 nt, Homo sapiens
auuuaaaaaacuaacacccag

SEQ ID NO: 916680 - RNA, 15 nt, Homo sapiens
auuuaaaaucauuca

SEQ ID NO: 916681 - RNA, 13 nt, Homo sapiens
auuuaaaccagca

SEQ ID NO: 916682 - RNA, 13 nt, Homo sapiens
auuuaaacuucuu

SEQ ID NO: 916683 - RNA, 20 nt, Homo sapiens
auuuaaagguuaguauggaa

SEQ ID NO: 916684 - RNA, 13 nt, Homo sapiens
auuuaacacuaaa

SEQ ID NO: 916685 - RNA, 15 nt, Homo sapiens
auuuaacacuaaaaa

SEQ ID NO: 916686 - RNA, 17 nt, Homo sapiens
auuuaacagucauuuaa

SEQ ID NO: 916687 - RNA, 18 nt, Homo sapiens
auuuaaccuacuagacaa

SEQ ID NO: 916688 - RNA, 13 nt, Homo sapiens
auuuaacuugagg

SEQ ID NO: 916689 - RNA, 22 nt, Homo sapiens
auuuaaugaagacccaguguaa

SEQ ID NO: 916690 - RNA, 16 nt, Homo sapiens
auuuacacauucucac

SEQ ID NO: 916691 - RNA, 22 nt, Homo sapiens
auuuacuacuuuaaagagcuua

SEQ ID NO: 916692 - RNA, 20 nt, Homo sapiens
auuuacugcaagaaguacau

SEQ ID NO: 916693 - RNA, 20 nt, Homo sapiens
auuuacuuaauggguacaau

SEQ ID NO: 916694 - RNA, 18 nt, Homo sapiens
auuuaguaacaguuguga

SEQ ID NO: 916695 - RNA, 21 nt, Homo sapiens
auuuaguaauaguccaauauu

SEQ ID NO: 916696 - RNA, 15 nt, Homo sapiens
auuuagugucuugaa

SEQ ID NO: 916697 - RNA, 17 nt, Homo sapiens
auuuauaaaauaaugaa

SEQ ID NO: 916698 - RNA, 19 nt, Homo sapiens
auuuauaaacuagaucucc

SEQ ID NO: 916699 - RNA, 14 nt, Homo sapiens
auuuauaucuaagu

SEQ ID NO: 916700 - RNA, 13 nt, Homo sapiens
auuuaucccucaa

SEQ ID NO: 916701 - RNA, 16 nt, Homo sapiens
caauauuuacucauca

SEQ ID NO: 916702 - RNA, 23 nt, Homo sapiens
caauauuucccccuuacuacuuc

SEQ ID NO: 916703 - RNA, 13 nt, Homo sapiens
caaucagcacuga

SEQ ID NO: 916704 - RNA, 21 nt, Homo sapiens
caaucaggguuuuuagauuaa

SEQ ID NO: 916705 - RNA, 15 nt, Homo sapiens
caaucagugcaguga

SEQ ID NO: 916706 - RNA, 18 nt, Homo sapiens
caauccucaggauuucau

SEQ ID NO: 916707 - RNA, 19 nt, Homo sapiens
caaucucaucugauaugca

SEQ ID NO: 916708 - RNA, 18 nt, Homo sapiens
caaucuccccuugcacua

SEQ ID NO: 916709 - RNA, 16 nt, Homo sapiens
caaucucgcaguacau

SEQ ID NO: 916710 - RNA, 21 nt, Homo sapiens
caaucugagaagacaauaugu

SEQ ID NO: 916711 - RNA, 13 nt, Homo sapiens
caaucuguucaau

SEQ ID NO: 916712 - RNA, 18 nt, Homo sapiens
caaucuuguccacagucu

SEQ ID NO: 916713 - RNA, 14 nt, Homo sapiens
caaugaaaugcucu

SEQ ID NO: 916714 - RNA, 13 nt, Homo sapiens
caaugaccuguau

SEQ ID NO: 916715 - RNA, 17 nt, Homo sapiens
caaugauacagucccua

SEQ ID NO: 916716 - RNA, 16 nt, Homo sapiens
caaugauggcaauuuu

SEQ ID NO: 916717 - RNA, 21 nt, Homo sapiens
caaugauuauuuucauuacaa

SEQ ID NO: 916718 - RNA, 10 nt, Homo sapiens
caaugauuca

SEQ ID NO: 916719 - RNA, 17 nt, Homo sapiens
caaugcaaaguaaaaaa

SEQ ID NO: 916720 - RNA, 15 nt, Homo sapiens
caaugccaaucuuca

SEQ ID NO: 916721 - RNA, 22 nt, Homo sapiens
caaugccuugacaacagacuga

SEQ ID NO: 916722 - RNA, 23 nt, Homo sapiens
caaugccuuuuugauuacagugu

SEQ ID NO: 916723 - RNA, 11 nt, Homo sapiens
caaugcuauaa

SEQ ID NO: 916724 - RNA, 19 nt, Homo sapiens
caaugcuauugaaauuacu

SEQ ID NO: 916725 - RNA, 18 nt, Homo sapiens
caaugcuggcuuucuccc

SEQ ID NO: 916726 - RNA, 16 nt, Homo sapiens
caauggcuuacuccag

SEQ ID NO: 916727 - RNA, 21 nt, Homo sapiens
caaugggagggggcuccaugg

SEQ ID NO: 916728 - RNA, 13 nt, Homo sapiens
caaugucacuuaa

SEQ ID NO: 916729 - RNA, 18 nt, Homo sapiens
caaugugaaaaauguguc

SEQ ID NO: 916730 - RNA, 22 nt, Homo sapiens
caaugugaaaaaugugucugua

SEQ ID NO: 916731 - RNA, 18 nt, Homo sapiens
caauguuuuuaaaaaucu

SEQ ID NO: 916732 - RNA, 23 nt, Homo sapiens
caauuaauucuuaauaggcuuua

SEQ ID NO: 916733 - RNA, 15 nt, Homo sapiens
caauuaggcucugaa

SEQ ID NO: 916734 - RNA, 19 nt, Homo sapiens
caauucaaaacauugugcc

SEQ ID NO: 916735 - RNA, 17 nt, Homo sapiens
caauucacuagaccaga

SEQ ID NO: 916736 - RNA, 15 nt, Homo sapiens
caauucccauugcau

SEQ ID NO: 916737 - RNA, 16 nt, Homo sapiens
caauucuacccagagc

SEQ ID NO: 916738 - RNA, 18 nt, Homo sapiens
caauucuacccagagccu

SEQ ID NO: 916739 - RNA, 20 nt, Homo sapiens
caauucucaaaagaaaaggc

SEQ ID NO: 916740 - RNA, 18 nt, Homo sapiens
caauucuuugaauuuccc

SEQ ID NO: 916741 - RNA, 19 nt, Homo sapiens
caauugaccuucucccuca

SEQ ID NO: 916742 - RNA, 18 nt, Homo sapiens
caauuguccccagggaca

SEQ ID NO: 916743 - RNA, 23 nt, Homo sapiens
caauuuaccuacucuauguaugc

SEQ ID NO: 916744 - RNA, 14 nt, Homo sapiens
caauuucaguguau

SEQ ID NO: 916745 - RNA, 14 nt, Homo sapiens
caauuucuaccuuu

SEQ ID NO: 916746 - RNA, 16 nt, Homo sapiens
caauuugcugccaaac

SEQ ID NO: 916747 - RNA, 18 nt, Homo sapiens
caauuuuuauacauauca

SEQ ID NO: 916748 - RNA, 12 nt, Homo sapiens
caauuuuuccau

SEQ ID NO: 916749 - RNA, 20 nt, Homo sapiens
caauuuuuuuauacuaccaa

SEQ ID NO: 916750 - RNA, 21 nt, Homo sapiens
cacaaaaguccacugaugcaa

SEQ ID NO: 916751 - RNA, 12 nt, Homo sapiens
cacaaaccacaa

SEQ ID NO: 916752 - RNA, 19 nt, Homo sapiens
cacaaaccacaacugacac

SEQ ID NO: 916753 - RNA, 20 nt, Homo sapiens
cacaaaccacaacugacaca

SEQ ID NO: 916754 - RNA, 19 nt, Homo sapiens
cacaaagaagaaguuuaaa

SEQ ID NO: 916755 - RNA, 20 nt, Homo sapiens
cacaaagaagaaguuuaaaa

SEQ ID NO: 916756 - RNA, 18 nt, Homo sapiens
cacaaagcucaagaugac

SEQ ID NO: 916757 - RNA, 12 nt, Homo sapiens
cacaaauuguac

SEQ ID NO: 916758 - RNA, 23 nt, Homo sapiens
cacaacacagagcugcuauuaaa

SEQ ID NO: 916759 - RNA, 16 nt, Homo sapiens
cacaacaggcauucca

SEQ ID NO: 916760 - RNA, 17 nt, Homo sapiens
cacaacauuuacuuaac

SEQ ID NO: 916761 - RNA, 16 nt, Homo sapiens
cacaacuaggaccuca

SEQ ID NO: 916762 - RNA, 16 nt, Homo sapiens
cacaacugacacagga

SEQ ID NO: 916763 - RNA, 18 nt, Homo sapiens
cacaacugacacaggaaa

SEQ ID NO: 916764 - RNA, 18 nt, Homo sapiens
cacaagcuggaagcacau

SEQ ID NO: 916765 - RNA, 16 nt, Homo sapiens
cacaagcuuguauaua

SEQ ID NO: 916766 - RNA, 20 nt, Homo sapiens
cacaagcuuguauauacaua

SEQ ID NO: 916767 - RNA, 21 nt, Homo sapiens
cacaaggcugaccaagagaga

SEQ ID NO: 916768 - RNA, 16 nt, Homo sapiens
cacaaggucacuagau

SEQ ID NO: 916769 - RNA, 17 nt, Homo sapiens
cacaaggugcaaaucaa

SEQ ID NO: 916770 - RNA, 14 nt, Homo sapiens
cacaaguccuguga

SEQ ID NO: 916771 - RNA, 12 nt, Homo sapiens
cacaagugcgcc

SEQ ID NO: 916772 - RNA, 20 nt, Homo sapiens
cacaauaaaggcugagcucu

SEQ ID NO: 916773 - RNA, 23 nt, Homo sapiens
cacaauaauauauccacaucuaa

SEQ ID NO: 916774 - RNA, 17 nt, Homo sapiens
cacaaucugggacuuuc

SEQ ID NO: 916775 - RNA, 16 nt, Homo sapiens
cacacaaaaugucaca

SEQ ID NO: 916776 - RNA, 15 nt, Homo sapiens
cacacaaacaccucc

SEQ ID NO: 916777 - RNA, 16 nt, Homo sapiens
cacacaaacaccuccu

SEQ ID NO: 916778 - RNA, 16 nt, Homo sapiens
cacacaaggugcaaau

SEQ ID NO: 916779 - RNA, 13 nt, Homo sapiens
cacacacaccaau

SEQ ID NO: 916780 - RNA, 13 nt, Homo sapiens
cacacacaccgau

SEQ ID NO: 916781 - RNA, 14 nt, Homo sapiens
cacacacagagaua

SEQ ID NO: 916782 - RNA, 13 nt, Homo sapiens
cacacacagaugg

SEQ ID NO: 916783 - RNA, 13 nt, Homo sapiens
cacacacauacac

SEQ ID NO: 916784 - RNA, 17 nt, Homo sapiens
cacacaccgaugugcgc

SEQ ID NO: 916785 - RNA, 13 nt, Homo sapiens
cacacaccucuag

SEQ ID NO: 916786 - RNA, 23 nt, Homo sapiens
cacacacggaugcacacacagau

SEQ ID NO: 916787 - RNA, 15 nt, Homo sapiens
cacacagagauaugc

SEQ ID NO: 916788 - RNA, 21 nt, Homo sapiens
cacacagauauacacauggau

SEQ ID NO: 916789 - RNA, 13 nt, Homo sapiens
cacacagauaugc

SEQ ID NO: 916790 - RNA, 15 nt, Homo sapiens
cacacagauaugcac

SEQ ID NO: 916791 - RNA, 20 nt, Homo sapiens
cacacagaugcacacacaga

SEQ ID NO: 916792 - RNA, 22 nt, Homo sapiens
cacacagauggucacacagaga

SEQ ID NO: 916793 - RNA, 12 nt, Homo sapiens
cacacagcacuc

SEQ ID NO: 916794 - RNA, 16 nt, Homo sapiens
cacacagcacucucua

SEQ ID NO: 916795 - RNA, 20 nt, Homo sapiens
cacacagucucaguccagau

SEQ ID NO: 916796 - RNA, 15 nt, Homo sapiens
cacacaucagugcac

SEQ ID NO: 916797 - RNA, 14 nt, Homo sapiens
cacacauguuuaca

SEQ ID NO: 916798 - RNA, 18 nt, Homo sapiens
cacaccaaagucagggag

SEQ ID NO: 916799 - RNA, 15 nt, Homo sapiens
cacaccccucaaaaa

SEQ ID NO: 916800 - RNA, 19 nt, Homo sapiens
cacaccucuccuuugugac

SEQ ID NO: 916801 - RNA, 17 nt, Homo sapiens
cacacgcugucucuuga

SEQ ID NO: 916802 - RNA, 15 nt, Homo sapiens
cacacggaugcacac

SEQ ID NO: 916803 - RNA, 16 nt, Homo sapiens
cacacggaugcacaga

SEQ ID NO: 916804 - RNA, 21 nt, Homo sapiens
cacacuauuucccucuacuga

SEQ ID NO: 916805 - RNA, 11 nt, Homo sapiens
cacacuguaaa

SEQ ID NO: 916806 - RNA, 20 nt, Homo sapiens
cacacuguaaauauccacag

SEQ ID NO: 916807 - RNA, 14 nt, Homo sapiens
cacacuucucagga

SEQ ID NO: 916808 - RNA, 22 nt, Homo sapiens
cacacuuugagaaccugugcuc

SEQ ID NO: 916809 - RNA, 20 nt, Homo sapiens
cacagaaauauauauacaua

SEQ ID NO: 916810 - RNA, 12 nt, Homo sapiens
cacagaacugcu

SEQ ID NO: 916811 - RNA, 23 nt, Homo sapiens
cacagacacacaaaaugucacaa

SEQ ID NO: 916812 - RNA, 17 nt, Homo sapiens
cacagagauaugcacac

SEQ ID NO: 916813 - RNA, 14 nt, Homo sapiens
cacagagaugcaug

SEQ ID NO: 916814 - RNA, 19 nt, Homo sapiens
cacagagaugcaugcgcag

SEQ ID NO: 916815 - RNA, 15 nt, Homo sapiens
cacagauaugcacac

SEQ ID NO: 916816 - RNA, 21 nt, Homo sapiens
ccuauggagagcccugggacc

SEQ ID NO: 916817 - RNA, 18 nt, Homo sapiens
ccuauuucuuauagucaa

SEQ ID NO: 916818 - RNA, 20 nt, Homo sapiens
ccuauuuggggcuugcaugc

SEQ ID NO: 916819 - RNA, 17 nt, Homo sapiens
ccuauuuucuuuuccau

SEQ ID NO: 916820 - RNA, 18 nt, Homo sapiens
ccuauuuucuuuuccauu

SEQ ID NO: 916821 - RNA, 23 nt, Homo sapiens
ccucaaacuccuggacucaugca

SEQ ID NO: 916822 - RNA, 21 nt, Homo sapiens
ccucaaauacauaccuacuga

SEQ ID NO: 916823 - RNA, 17 nt, Homo sapiens
ccucaagugauccaccu

SEQ ID NO: 916824 - RNA, 20 nt, Homo sapiens
ccucacccccagcuuugcua

SEQ ID NO: 916825 - RNA, 21 nt, Homo sapiens
ccucacccccagguguugcca

SEQ ID NO: 916826 - RNA, 19 nt, Homo sapiens
ccucacgcucuggacauga

SEQ ID NO: 916827 - RNA, 13 nt, Homo sapiens
ccucacuauucaa

SEQ ID NO: 916828 - RNA, 22 nt, Homo sapiens
ccucacuccuguuacuuaccua

SEQ ID NO: 916829 - RNA, 17 nt, Homo sapiens
ccucacugaaugccuca

SEQ ID NO: 916830 - RNA, 17 nt, Homo sapiens
ccucagagcucuuaugu

SEQ ID NO: 916831 - RNA, 20 nt, Homo sapiens
ccucagcugcucgcacagau

SEQ ID NO: 916832 - RNA, 13 nt, Homo sapiens
ccucaggccagug

SEQ ID NO: 916833 - RNA, 15 nt, Homo sapiens
ccucagggacagaga

SEQ ID NO: 916834 - RNA, 23 nt, Homo sapiens
ccucagggacagagacaccugca

SEQ ID NO: 916835 - RNA, 16 nt, Homo sapiens
ccucaggugcuaggga

SEQ ID NO: 916836 - RNA, 12 nt, Homo sapiens
ccucaguguccu

SEQ ID NO: 916837 - RNA, 20 nt, Homo sapiens
ccucaguuuuaucauuuuca

SEQ ID NO: 916838 - RNA, 17 nt, Homo sapiens
ccucaucucacugccca

SEQ ID NO: 916839 - RNA, 18 nt, Homo sapiens
ccucaugagcacaggguc

SEQ ID NO: 916840 - RNA, 13 nt, Homo sapiens
ccucauuccugaa

SEQ ID NO: 916841 - RNA, 20 nt, Homo sapiens
ccuccaagcuccaucuccac

SEQ ID NO: 916842 - RNA, 12 nt, Homo sapiens
ccuccaccuacc

SEQ ID NO: 916843 - RNA, 15 nt, Homo sapiens
ccuccaccuaccugc

SEQ ID NO: 916844 - RNA, 23 nt, Homo sapiens
ccuccagcacucccucccagaga

SEQ ID NO: 916845 - RNA, 21 nt, Homo sapiens
ccucccaaagugcugggauua

SEQ ID NO: 916846 - RNA, 22 nt, Homo sapiens
ccucccaggaacugggccaacu

SEQ ID NO: 916847 - RNA, 17 nt, Homo sapiens
ccuccccacaguccuca

SEQ ID NO: 916848 - RNA, 15 nt, Homo sapiens
ccuccccacccugac

SEQ ID NO: 916849 - RNA, 14 nt, Homo sapiens
ccucccucauucca

SEQ ID NO: 916850 - RNA, 12 nt, Homo sapiens
ccucccuggcau

SEQ ID NO: 916851 - RNA, 16 nt, Homo sapiens
ccuccguguagugucu

SEQ ID NO: 916852 - RNA, 15 nt, Homo sapiens
ccuccuaauuugauc

SEQ ID NO: 916853 - RNA, 23 nt, Homo sapiens
ccuccuaauuugaucacaguggc

SEQ ID NO: 916854 - RNA, 14 nt, Homo sapiens
ccuccuccugacca

SEQ ID NO: 916855 - RNA, 15 nt, Homo sapiens
ccuccugauggccaa

SEQ ID NO: 916856 - RNA, 14 nt, Homo sapiens
ccuccuguccagca

SEQ ID NO: 916857 - RNA, 20 nt, Homo sapiens
ccuccuuuucuuucucucuc

SEQ ID NO: 916858 - RNA, 23 nt, Homo sapiens
ccucgaacuccuggucucaagca

SEQ ID NO: 916859 - RNA, 14 nt, Homo sapiens
ccucggagcugcca

SEQ ID NO: 916860 - RNA, 23 nt, Homo sapiens
ccucgggggaaagcacaccucau

SEQ ID NO: 916861 - RNA, 18 nt, Homo sapiens
ccucuaagccacucuucc

SEQ ID NO: 916862 - RNA, 13 nt, Homo sapiens
ccucuacugccuu

SEQ ID NO: 916863 - RNA, 20 nt, Homo sapiens
ccucuaguuuuaagacugaa

SEQ ID NO: 916864 - RNA, 15 nt, Homo sapiens
ccucuccaauuguaa

SEQ ID NO: 916865 - RNA, 20 nt, Homo sapiens
ccucuccaggaaugccuccu

SEQ ID NO: 916866 - RNA, 17 nt, Homo sapiens
ccucuccuuccuuaccc

SEQ ID NO: 916867 - RNA, 21 nt, Homo sapiens
ccucuccuuggaaauacuuua

SEQ ID NO: 916868 - RNA, 21 nt, Homo sapiens
ccucucuaggccuguugccuc

SEQ ID NO: 916869 - RNA, 12 nt, Homo sapiens
ccucucucuaua

SEQ ID NO: 916870 - RNA, 11 nt, Homo sapiens
ccucucuugcc

SEQ ID NO: 916871 - RNA, 14 nt, Homo sapiens
ccucugaaaugccu

SEQ ID NO: 916872 - RNA, 15 nt, Homo sapiens
ccucugaaaugccuc

SEQ ID NO: 916873 - RNA, 20 nt, Homo sapiens
ccucugagaauuccaaggag

SEQ ID NO: 916874 - RNA, 19 nt, Homo sapiens
ccucugaucaguuucacaa

SEQ ID NO: 916875 - RNA, 14 nt, Homo sapiens
ccucugcugccaug

SEQ ID NO: 916876 - RNA, 16 nt, Homo sapiens
ccucuggauucucugg

SEQ ID NO: 916877 - RNA, 14 nt, Homo sapiens
ccucuguccaggca

SEQ ID NO: 916878 - RNA, 19 nt, Homo sapiens
ccucuuaaagcugccugua

SEQ ID NO: 916879 - RNA, 14 nt, Homo sapiens
ccucuuauuugcuc

SEQ ID NO: 916880 - RNA, 19 nt, Homo sapiens
ccucuucuuauucaugcuu

SEQ ID NO: 916881 - RNA, 22 nt, Homo sapiens
ccucuuguugcagagauuuccu

SEQ ID NO: 916882 - RNA, 15 nt, Homo sapiens
ccucuuucuacauuc

SEQ ID NO: 916883 - RNA, 22 nt, Homo sapiens
ccucuuucuacauucucaucua

SEQ ID NO: 916884 - RNA, 22 nt, Homo sapiens
ccucuuucuuucuuuuguguug

SEQ ID NO: 916885 - RNA, 14 nt, Homo sapiens
ccugaaaaccaucc

SEQ ID NO: 916886 - RNA, 20 nt, Homo sapiens
ccugaagggugacaucccag

SEQ ID NO: 916887 - RNA, 13 nt, Homo sapiens
ccugaaggugcug

SEQ ID NO: 916888 - RNA, 13 nt, Homo sapiens
ccugaagucacac

SEQ ID NO: 916889 - RNA, 14 nt, Homo sapiens
ccugaagucacaca

SEQ ID NO: 916890 - RNA, 18 nt, Homo sapiens
ccugaagucccagcauug

SEQ ID NO: 916891 - RNA, 15 nt, Homo sapiens
ccugacagaugucag

SEQ ID NO: 916892 - RNA, 22 nt, Homo sapiens
ccugacauuaagacacaccucu

SEQ ID NO: 916893 - RNA, 22 nt, Homo sapiens
ccugaccucaggugauccaccc

SEQ ID NO: 916894 - RNA, 16 nt, Homo sapiens
ccugacgaacuccuug

SEQ ID NO: 916895 - RNA, 11 nt, Homo sapiens
ccugacugugu

SEQ ID NO: 916896 - RNA, 15 nt, Homo sapiens
ccugacuguguucag

SEQ ID NO: 916897 - RNA, 20 nt, Homo sapiens
ccugagccaaggccuagugg

SEQ ID NO: 916898 - RNA, 20 nt, Homo sapiens
ccugaggcucaagaggccca

SEQ ID NO: 916899 - RNA, 18 nt, Homo sapiens
ccugaggcuccugugcua

SEQ ID NO: 916900 - RNA, 20 nt, Homo sapiens
ccugaggguggagacuaagc

SEQ ID NO: 916901 - RNA, 19 nt, Homo sapiens
ccugaguuugggauugugg

SEQ ID NO: 916902 - RNA, 20 nt, Homo sapiens
ccugauaacaaccuggagac

SEQ ID NO: 916903 - RNA, 13 nt, Homo sapiens
ccugauaagcaaa

SEQ ID NO: 916904 - RNA, 20 nt, Homo sapiens
ccugauaggacccauauucc

SEQ ID NO: 916905 - RNA, 19 nt, Homo sapiens
ccugaucauggucagcuca

SEQ ID NO: 916906 - RNA, 21 nt, Homo sapiens
ccugaugccccuuccccaaga

SEQ ID NO: 916907 - RNA, 16 nt, Homo sapiens
ccugauguugagcuga

SEQ ID NO: 916908 - RNA, 14 nt, Homo sapiens
ccugcaccugugca

SEQ ID NO: 916909 - RNA, 16 nt, Homo sapiens
ccugccacugaccuca

SEQ ID NO: 916910 - RNA, 17 nt, Homo sapiens
ccugccacugaccucac

SEQ ID NO: 916911 - RNA, 16 nt, Homo sapiens
ccugccacuuugcaug

SEQ ID NO: 916912 - RNA, 16 nt, Homo sapiens
ccugcccagugcacuu

SEQ ID NO: 916913 - RNA, 18 nt, Homo sapiens
ccugccucauccaccaau

SEQ ID NO: 916914 - RNA, 19 nt, Homo sapiens
ccugccucccuuucuggga

SEQ ID NO: 916915 - RNA, 20 nt, Homo sapiens
ccugccuguagcagugagaa

SEQ ID NO: 916916 - RNA, 10 nt, Homo sapiens
ccugccuuca

SEQ ID NO: 916917 - RNA, 17 nt, Homo sapiens
ccugccuuugaaauucc

SEQ ID NO: 916918 - RNA, 23 nt, Homo sapiens
ccugcgaaguggcucucaggggc

SEQ ID NO: 916919 - RNA, 21 nt, Homo sapiens
ccugcggcugcugugugccuu

SEQ ID NO: 916920 - RNA, 17 nt, Homo sapiens
ccugcguugugagcucu

SEQ ID NO: 916921 - RNA, 18 nt, Homo sapiens
ccugcuaaggcugccuca

SEQ ID NO: 916922 - RNA, 14 nt, Homo sapiens
ccugcuacacaaaa

SEQ ID NO: 916923 - RNA, 20 nt, Homo sapiens
ccugcuacacaaaagccaaa

SEQ ID NO: 916924 - RNA, 10 nt, Homo sapiens
ccugcuggaa

SEQ ID NO: 916925 - RNA, 22 nt, Homo sapiens
ccuggaaauaucaguuacucag

SEQ ID NO: 916926 - RNA, 14 nt, Homo sapiens
ccuggaauuuaauu

SEQ ID NO: 916927 - RNA, 22 nt, Homo sapiens
ccuggaggugggagacaaggaa

SEQ ID NO: 916928 - RNA, 20 nt, Homo sapiens
ccuggaucucacaagcacuu

SEQ ID NO: 916929 - RNA, 13 nt, Homo sapiens
ccuggauguugcu

SEQ ID NO: 916930 - RNA, 18 nt, Homo sapiens
ccuggcaugucagagcca

SEQ ID NO: 916931 - RNA, 19 nt, Homo sapiens
cuauugaaaaaucaccaca

SEQ ID NO: 916932 - RNA, 18 nt, Homo sapiens
cuauugaaauuacugaaa

SEQ ID NO: 916933 - RNA, 19 nt, Homo sapiens
cuauugacaagucauuuua

SEQ ID NO: 916934 - RNA, 18 nt, Homo sapiens
cuauugcugcucucucac

SEQ ID NO: 916935 - RNA, 16 nt, Homo sapiens
cuauuggaaugugguc

SEQ ID NO: 916936 - RNA, 18 nt, Homo sapiens
cuauuuaugaaaaccaua

SEQ ID NO: 916937 - RNA, 18 nt, Homo sapiens
cuauuuauucccuguuaa

SEQ ID NO: 916938 - RNA, 23 nt, Homo sapiens
cuauuuccuuuccagucauuuca

SEQ ID NO: 916939 - RNA, 14 nt, Homo sapiens
cuauuucuaugcaa

SEQ ID NO: 916940 - RNA, 15 nt, Homo sapiens
cuauuuuauucccuu

SEQ ID NO: 916941 - RNA, 18 nt, Homo sapiens
cuauuuuauuuguauuca

SEQ ID NO: 916942 - RNA, 17 nt, Homo sapiens
cuauuuucuuuuccauu

SEQ ID NO: 916943 - RNA, 14 nt, Homo sapiens
cuauuuuugaggaa

SEQ ID NO: 916944 - RNA, 16 nt, Homo sapiens
cucaaaacugcacugu

SEQ ID NO: 916945 - RNA, 18 nt, Homo sapiens
cucaaaacugcacuguca

SEQ ID NO: 916946 - RNA, 19 nt, Homo sapiens
cucaaaagauuguuuuaua

SEQ ID NO: 916947 - RNA, 18 nt, Homo sapiens
cucaaaauaccaugccau

SEQ ID NO: 916948 - RNA, 23 nt, Homo sapiens
cucaaacuccugaccuugugauu

SEQ ID NO: 916949 - RNA, 19 nt, Homo sapiens
cucaaagcccccacuucuc

SEQ ID NO: 916950 - RNA, 15 nt, Homo sapiens
cucaaauacauaccu

SEQ ID NO: 916951 - RNA, 20 nt, Homo sapiens
cucaaauauuugcuaugaag

SEQ ID NO: 916952 - RNA, 21 nt, Homo sapiens
cucaaaugacccaaagaccaa

SEQ ID NO: 916953 - RNA, 18 nt, Homo sapiens
cucaaaugcacaucucau

SEQ ID NO: 916954 - RNA, 21 nt, Homo sapiens
cucaaaugcacaucucauggc

SEQ ID NO: 916955 - RNA, 20 nt, Homo sapiens
cucaaauucauggugcacug

SEQ ID NO: 916956 - RNA, 17 nt, Homo sapiens
cucaacaacaaaccaaa

SEQ ID NO: 916957 - RNA, 19 nt, Homo sapiens
cucaacaacaaaccaaaac

SEQ ID NO: 916958 - RNA, 11 nt, Homo sapiens
cucaagacuga

SEQ ID NO: 916959 - RNA, 21 nt, Homo sapiens
cucaaguuuuucagaaagcau

SEQ ID NO: 916960 - RNA, 19 nt, Homo sapiens
cucaauuguauaguuauau

SEQ ID NO: 916961 - RNA, 14 nt, Homo sapiens
cucacaagcacuuu

SEQ ID NO: 916962 - RNA, 14 nt, Homo sapiens
cucacacacauaga

SEQ ID NO: 916963 - RNA, 14 nt, Homo sapiens
cucacacccuaaua

SEQ ID NO: 916964 - RNA, 19 nt, Homo sapiens
cucacacgggguauuuuag

SEQ ID NO: 916965 - RNA, 20 nt, Homo sapiens
cucacaguacaauguuucag

SEQ ID NO: 916966 - RNA, 18 nt, Homo sapiens
cucacaucagagugacau

SEQ ID NO: 916967 - RNA, 17 nt, Homo sapiens
cucacauuuauucugcu

SEQ ID NO: 916968 - RNA, 23 nt, Homo sapiens
cucacccccagcuuugcuaccaa

SEQ ID NO: 916969 - RNA, 23 nt, Homo sapiens
cucacccccagguguugccauuu

SEQ ID NO: 916970 - RNA, 20 nt, Homo sapiens
cucacccgccccacucccuc

SEQ ID NO: 916971 - RNA, 18 nt, Homo sapiens
cucacgcccagccuccuc

SEQ ID NO: 916972 - RNA, 15 nt, Homo sapiens
cucacuaugcugcuu

SEQ ID NO: 916973 - RNA, 19 nt, Homo sapiens
cucacuauucaaguauuag

SEQ ID NO: 916974 - RNA, 12 nt, Homo sapiens
cucacucaggac

SEQ ID NO: 916975 - RNA, 14 nt, Homo sapiens
cucacuccuguuac

SEQ ID NO: 916976 - RNA, 12 nt, Homo sapiens
cucacucuguca

SEQ ID NO: 916977 - RNA, 15 nt, Homo sapiens
cucagaauccaaaga

SEQ ID NO: 916978 - RNA, 13 nt, Homo sapiens
cucagacauucca

SEQ ID NO: 916979 - RNA, 15 nt, Homo sapiens
cucagagcaggcuca

SEQ ID NO: 916980 - RNA, 15 nt, Homo sapiens
cucagcaccccuguc

SEQ ID NO: 916981 - RNA, 15 nt, Homo sapiens
cucagccacccugug

SEQ ID NO: 916982 - RNA, 19 nt, Homo sapiens
cucagccgugcacucccua

SEQ ID NO: 916983 - RNA, 22 nt, Homo sapiens
cucagccgugcacucccuaaga

SEQ ID NO: 916984 - RNA, 23 nt, Homo sapiens
cucagccgugcacucccuaagaa

SEQ ID NO: 916985 - RNA, 16 nt, Homo sapiens
cucagccuccucagua

SEQ ID NO: 916986 - RNA, 19 nt, Homo sapiens
cucagccuuuagggcuuau

SEQ ID NO: 916987 - RNA, 20 nt, Homo sapiens
cucagcuccagaauaccuuc

SEQ ID NO: 916988 - RNA, 16 nt, Homo sapiens
cucaggccagugccag

SEQ ID NO: 916989 - RNA, 22 nt, Homo sapiens
cucagggaguuugacgagcuca

SEQ ID NO: 916990 - RNA, 16 nt, Homo sapiens
cucagguagauuuugu

SEQ ID NO: 916991 - RNA, 17 nt, Homo sapiens
cucagguaguacuggga

SEQ ID NO: 916992 - RNA, 22 nt, Homo sapiens
cucagguccgcccgaccaggau

SEQ ID NO: 916993 - RNA, 15 nt, Homo sapiens
cucagguucuuucca

SEQ ID NO: 916994 - RNA, 21 nt, Homo sapiens
cucagucugggugggacuuau

SEQ ID NO: 916995 - RNA, 21 nt, Homo sapiens
cucaguuugucagacuuuaaa

SEQ ID NO: 916996 - RNA, 22 nt, Homo sapiens
cucauaaguuggaccagaggaa

SEQ ID NO: 916997 - RNA, 20 nt, Homo sapiens
cucauauauaucuaucuuau

SEQ ID NO: 916998 - RNA, 13 nt, Homo sapiens
cucauaucaaucc

SEQ ID NO: 916999 - RNA, 15 nt, Homo sapiens
cucaucccucuguca

SEQ ID NO: 917000 - RNA, 21 nt, Homo sapiens
cucaucuacaagcauuugccc

SEQ ID NO: 917001 - RNA, 11 nt, Homo sapiens
cucaugacagc

SEQ ID NO: 917002 - RNA, 16 nt, Homo sapiens
cucaugggccuagcau

SEQ ID NO: 917003 - RNA, 17 nt, Homo sapiens
cucaugggccuagcaua

SEQ ID NO: 917004 - RNA, 11 nt, Homo sapiens
cucaugucuca

SEQ ID NO: 917005 - RNA, 20 nt, Homo sapiens
cucauguugaagccacugcc

SEQ ID NO: 917006 - RNA, 12 nt, Homo sapiens
cucauuagacug

SEQ ID NO: 917007 - RNA, 13 nt, Homo sapiens
cucauuccaccuu

SEQ ID NO: 917008 - RNA, 16 nt, Homo sapiens
cucauuccuucacuca

SEQ ID NO: 917009 - RNA, 16 nt, Homo sapiens
cucauucuguugccca

SEQ ID NO: 917010 - RNA, 22 nt, Homo sapiens
cucauuguuuauuaacaaauua

SEQ ID NO: 917011 - RNA, 19 nt, Homo sapiens
cucauuugucacacacuuu

SEQ ID NO: 917012 - RNA, 16 nt, Homo sapiens
cuccaaaaauucacau

SEQ ID NO: 917013 - RNA, 21 nt, Homo sapiens
cuccaaaugagacacauuaaa

SEQ ID NO: 917014 - RNA, 18 nt, Homo sapiens
cuccaaauuuuuuuuacu

SEQ ID NO: 917015 - RNA, 13 nt, Homo sapiens
cuccaacuggauu

SEQ ID NO: 917016 - RNA, 12 nt, Homo sapiens
cuccaagauuuc

SEQ ID NO: 917017 - RNA, 21 nt, Homo sapiens
cuccacaccaaagucagggag

SEQ ID NO: 917018 - RNA, 19 nt, Homo sapiens
cuccacaguuuugccuuaa

SEQ ID NO: 917019 - RNA, 21 nt, Homo sapiens
cuccaccaacuggagcacuga

SEQ ID NO: 917020 - RNA, 12 nt, Homo sapiens
cuccacccuaua

SEQ ID NO: 917021 - RNA, 21 nt, Homo sapiens
cuccaccuuguuacacauuau

SEQ ID NO: 917022 - RNA, 15 nt, Homo sapiens
cuccacucacuccag

SEQ ID NO: 917023 - RNA, 18 nt, Homo sapiens
cuccacugaggaugugag

SEQ ID NO: 917024 - RNA, 17 nt, Homo sapiens
cuccagaacaaaccucu

SEQ ID NO: 917025 - RNA, 23 nt, Homo sapiens
cuccagaauggucuuucuaaugu

SEQ ID NO: 917026 - RNA, 16 nt, Homo sapiens
cuccagaggccaagga

SEQ ID NO: 917027 - RNA, 20 nt, Homo sapiens
cuccagagugugcagacuga

SEQ ID NO: 917028 - RNA, 13 nt, Homo sapiens
cuccagcuccagu

SEQ ID NO: 917029 - RNA, 22 nt, Homo sapiens
cuccaggaugaguuacuugaaa

SEQ ID NO: 917030 - RNA, 13 nt, Homo sapiens
cuccaggcaaaau

SEQ ID NO: 917031 - RNA, 17 nt, Homo sapiens
cuccaguauucuuguca

SEQ ID NO: 917032 - RNA, 19 nt, Homo sapiens
cuccagucuggucggcaag

SEQ ID NO: 917033 - RNA, 17 nt, Homo sapiens
cuccagugguugcuguu

SEQ ID NO: 917034 - RNA, 16 nt, Homo sapiens
cuccagugugaauaua

SEQ ID NO: 917035 - RNA, 18 nt, Homo sapiens
cuccaguguuacuuuuaa

SEQ ID NO: 917036 - RNA, 15 nt, Homo sapiens
cuccaguuuccccau

SEQ ID NO: 917037 - RNA, 17 nt, Homo sapiens
cuccaucaugcuugauu

SEQ ID NO: 917038 - RNA, 22 nt, Homo sapiens
cuccaucuuauuuucauguaua

SEQ ID NO: 917039 - RNA, 15 nt, Homo sapiens
cucccacauugucac

SEQ ID NO: 917040 - RNA, 17 nt, Homo sapiens
cucccaccccacuccag

SEQ ID NO: 917041 - RNA, 20 nt, Homo sapiens
cucccauaagcuaagccuua

SEQ ID NO: 917042 - RNA, 18 nt, Homo sapiens
cuccccaaacccaucaga

SEQ ID NO: 917043 - RNA, 18 nt, Homo sapiens
cuccccacaguccucaca

SEQ ID NO: 917044 - RNA, 18 nt, Homo sapiens
cuccccagcaagugagag

SEQ ID NO: 917045 - RNA, 18 nt, Homo sapiens
cuggagcaucugacucac

SEQ ID NO: 917046 - RNA, 19 nt, Homo sapiens
cuggagcccgagggccuga

SEQ ID NO: 917047 - RNA, 22 nt, Homo sapiens
cuggaggaagaagacacauucc

SEQ ID NO: 917048 - RNA, 16 nt, Homo sapiens
cuggaggacacacagu

SEQ ID NO: 917049 - RNA, 20 nt, Homo sapiens
cuggagggcuggaaucugga

SEQ ID NO: 917050 - RNA, 21 nt, Homo sapiens
cuggagggcuugguaaaacac

SEQ ID NO: 917051 - RNA, 20 nt, Homo sapiens
cuggagucccuucugagcga

SEQ ID NO: 917052 - RNA, 12 nt, Homo sapiens
cuggagugcagu

SEQ ID NO: 917053 - RNA, 13 nt, Homo sapiens
cuggagugcaguu

SEQ ID NO: 917054 - RNA, 16 nt, Homo sapiens
cuggaucucagccucu

SEQ ID NO: 917055 - RNA, 15 nt, Homo sapiens
cuggauucacucacu

SEQ ID NO: 917056 - RNA, 16 nt, Homo sapiens
cuggauugcagacuca

SEQ ID NO: 917057 - RNA, 19 nt, Homo sapiens
cuggauugcagacucauga

SEQ ID NO: 917058 - RNA, 16 nt, Homo sapiens
cuggcaagcagggaaa

SEQ ID NO: 917059 - RNA, 15 nt, Homo sapiens
cuggcaauauuuguu

SEQ ID NO: 917060 - RNA, 12 nt, Homo sapiens
cuggcacccacu

SEQ ID NO: 917061 - RNA, 20 nt, Homo sapiens
cuggcagagaaggcuuccuc

SEQ ID NO: 917062 - RNA, 19 nt, Homo sapiens
cuggccaaccaaagacacu

SEQ ID NO: 917063 - RNA, 12 nt, Homo sapiens
cuggccacugcu

SEQ ID NO: 917064 - RNA, 19 nt, Homo sapiens
cuggccagaugcaccagcc

SEQ ID NO: 917065 - RNA, 16 nt, Homo sapiens
cuggccagcacccucu

SEQ ID NO: 917066 - RNA, 18 nt, Homo sapiens
cuggccauccccagaggu

SEQ ID NO: 917067 - RNA, 20 nt, Homo sapiens
cuggccccgggcucuggcca

SEQ ID NO: 917068 - RNA, 21 nt, Homo sapiens
cuggcccuuucuggaccagau

SEQ ID NO: 917069 - RNA, 22 nt, Homo sapiens
cuggccucagccgacugcacag

SEQ ID NO: 917070 - RNA, 13 nt, Homo sapiens
cuggccucuagaa

SEQ ID NO: 917071 - RNA, 21 nt, Homo sapiens
cuggccucuagaacacccacu

SEQ ID NO: 917072 - RNA, 12 nt, Homo sapiens
cuggcucaggaa

SEQ ID NO: 917073 - RNA, 19 nt, Homo sapiens
cuggcucuucucucggggc

SEQ ID NO: 917074 - RNA, 13 nt, Homo sapiens
cuggcugcaguga

SEQ ID NO: 917075 - RNA, 13 nt, Homo sapiens
cuggcugggcaug

SEQ ID NO: 917076 - RNA, 14 nt, Homo sapiens
cuggcuuccuagaa

SEQ ID NO: 917077 - RNA, 21 nt, Homo sapiens
cuggcuucucuuucucugagu

SEQ ID NO: 917078 - RNA, 22 nt, Homo sapiens
cuggcuucuguugcgccacuga

SEQ ID NO: 917079 - RNA, 17 nt, Homo sapiens
cuggcuuuacauuuuau

SEQ ID NO: 917080 - RNA, 16 nt, Homo sapiens
cugggaaaacagagga

SEQ ID NO: 917081 - RNA, 18 nt, Homo sapiens
cugggaaaggaaaaccag

SEQ ID NO: 917082 - RNA, 21 nt, Homo sapiens
cugggaaaggaaaaccaggga

SEQ ID NO: 917083 - RNA, 12 nt, Homo sapiens
cugggaagacaa

SEQ ID NO: 917084 - RNA, 13 nt, Homo sapiens
cugggacuauggc

SEQ ID NO: 917085 - RNA, 15 nt, Homo sapiens
cugggagaaccucag

SEQ ID NO: 917086 - RNA, 23 nt, Homo sapiens
cugggagagaaggagaucagggc

SEQ ID NO: 917087 - RNA, 20 nt, Homo sapiens
cugggaucaagaaggggaca

SEQ ID NO: 917088 - RNA, 21 nt, Homo sapiens
cugggaucaagaaggggacag

SEQ ID NO: 917089 - RNA, 18 nt, Homo sapiens
cugggauuacaagcguga

SEQ ID NO: 917090 - RNA, 22 nt, Homo sapiens
cugggauuacaggcaugagcca

SEQ ID NO: 917091 - RNA, 20 nt, Homo sapiens
cugggauuacaggugugaac

SEQ ID NO: 917092 - RNA, 22 nt, Homo sapiens
cugggcaagggggaacaaauca

SEQ ID NO: 917093 - RNA, 14 nt, Homo sapiens
cugggcagcauagc

SEQ ID NO: 917094 - RNA, 22 nt, Homo sapiens
cugggccaaguuccucuagugc

SEQ ID NO: 917095 - RNA, 16 nt, Homo sapiens
cugggcuagggagaau

SEQ ID NO: 917096 - RNA, 19 nt, Homo sapiens
cugggcuugugaacaccuc

SEQ ID NO: 917097 - RNA, 19 nt, Homo sapiens
cugggcuuguuguuuuuaa

SEQ ID NO: 917098 - RNA, 19 nt, Homo sapiens
cuggggaagcugugaaaga

SEQ ID NO: 917099 - RNA, 14 nt, Homo sapiens
cuggggacaccagc

SEQ ID NO: 917100 - RNA, 22 nt, Homo sapiens
cuggggagaagguggacagauu

SEQ ID NO: 917101 - RNA, 15 nt, Homo sapiens
cugggggcuagcaga

SEQ ID NO: 917102 - RNA, 19 nt, Homo sapiens
cuggguaacugucaaguca

SEQ ID NO: 917103 - RNA, 21 nt, Homo sapiens
cugggugguguacaagcauuu

SEQ ID NO: 917104 - RNA, 14 nt, Homo sapiens
cuggguucuagaac

SEQ ID NO: 917105 - RNA, 19 nt, Homo sapiens
cugguaauuuguaucugaa

SEQ ID NO: 917106 - RNA, 23 nt, Homo sapiens
cugguaggaaggauaucggguca

SEQ ID NO: 917107 - RNA, 15 nt, Homo sapiens
cugguauauacauau

SEQ ID NO: 917108 - RNA, 16 nt, Homo sapiens
cugguccacucagggc

SEQ ID NO: 917109 - RNA, 20 nt, Homo sapiens
cuggucccccacgugugaag

SEQ ID NO: 917110 - RNA, 14 nt, Homo sapiens
cuggucugaaaaug

SEQ ID NO: 917111 - RNA, 15 nt, Homo sapiens
cuggucugcucagga

SEQ ID NO: 917112 - RNA, 23 nt, Homo sapiens
cuggucugugcugcccugcucug

SEQ ID NO: 917113 - RNA, 17 nt, Homo sapiens
cuggugaugcccaaaga

SEQ ID NO: 917114 - RNA, 21 nt, Homo sapiens
cuggugccuauuuauucauuc

SEQ ID NO: 917115 - RNA, 16 nt, Homo sapiens
cugguggcaccagaug

SEQ ID NO: 917116 - RNA, 18 nt, Homo sapiens
cugguggggcagcuccuc

SEQ ID NO: 917117 - RNA, 13 nt, Homo sapiens
cuggugggugaca

SEQ ID NO: 917118 - RNA, 16 nt, Homo sapiens
cugguuagacaguacu

SEQ ID NO: 917119 - RNA, 14 nt, Homo sapiens
cugguucagccucu

SEQ ID NO: 917120 - RNA, 13 nt, Homo sapiens
cugguugcuguau

SEQ ID NO: 917121 - RNA, 23 nt, Homo sapiens
cuguaaacuauaaacuacuguaa

SEQ ID NO: 917122 - RNA, 20 nt, Homo sapiens
cuguaaagucuaaucucuaa

SEQ ID NO: 917123 - RNA, 15 nt, Homo sapiens
cuguaacacaagcca

SEQ ID NO: 917124 - RNA, 14 nt, Homo sapiens
cuguaagauugucc

SEQ ID NO: 917125 - RNA, 21 nt, Homo sapiens
cuguaagauuguccagugcaa

SEQ ID NO: 917126 - RNA, 17 nt, Homo sapiens
cuguaaggaacuggaac

SEQ ID NO: 917127 - RNA, 21 nt, Homo sapiens
cuguaaucccagcacuuuggg

SEQ ID NO: 917128 - RNA, 18 nt, Homo sapiens
cuguaaucccagcuacuu

SEQ ID NO: 917129 - RNA, 16 nt, Homo sapiens
cuguaauuaagugcaa

SEQ ID NO: 917130 - RNA, 19 nt, Homo sapiens
cuguaauuaauaucuugcu

SEQ ID NO: 917131 - RNA, 18 nt, Homo sapiens
cuguacugagacauuaca

SEQ ID NO: 917132 - RNA, 13 nt, Homo sapiens
cuguagcucuccu

SEQ ID NO: 917133 - RNA, 22 nt, Homo sapiens
cuguagucccagcuacucggga

SEQ ID NO: 917134 - RNA, 17 nt, Homo sapiens
cuguagugagaaacuga

SEQ ID NO: 917135 - RNA, 20 nt, Homo sapiens
cuguauacagauucuagcca

SEQ ID NO: 917136 - RNA, 18 nt, Homo sapiens
cuguaucggagacaguga

SEQ ID NO: 917137 - RNA, 16 nt, Homo sapiens
cuguaugauuccuuga

SEQ ID NO: 917138 - RNA, 14 nt, Homo sapiens
cuguauggcacuua

SEQ ID NO: 917139 - RNA, 22 nt, Homo sapiens
cuguauguuugaucacacagcc

SEQ ID NO: 917140 - RNA, 23 nt, Homo sapiens
cugucacaucagcuccacuuuca

SEQ ID NO: 917141 - RNA, 15 nt, Homo sapiens
cugucaccaagccuu

SEQ ID NO: 917142 - RNA, 18 nt, Homo sapiens
cugucagcccacagcagc

SEQ ID NO: 917143 - RNA, 15 nt, Homo sapiens
cugucagcucaggug

SEQ ID NO: 917144 - RNA, 15 nt, Homo sapiens
cuguccaguuuccaa

SEQ ID NO: 917145 - RNA, 14 nt, Homo sapiens
cugucccaccaacu

SEQ ID NO: 917146 - RNA, 22 nt, Homo sapiens
cugucccagagcuuauuggcca

SEQ ID NO: 917147 - RNA, 16 nt, Homo sapiens
cuguccccacacugac

SEQ ID NO: 917148 - RNA, 16 nt, Homo sapiens
cuguccccacagcagg

SEQ ID NO: 917149 - RNA, 21 nt, Homo sapiens
cugucccgccuuccuccucca

SEQ ID NO: 917150 - RNA, 23 nt, Homo sapiens
cugucccucaaaugacccaaaga

SEQ ID NO: 917151 - RNA, 13 nt, Homo sapiens
cugucuaccucac

SEQ ID NO: 917152 - RNA, 16 nt, Homo sapiens
cugucucaacuacuca

SEQ ID NO: 917153 - RNA, 17 nt, Homo sapiens
cugucucucaugaaccu

SEQ ID NO: 917154 - RNA, 18 nt, Homo sapiens
cugucucucaugaaccuc

SEQ ID NO: 917155 - RNA, 20 nt, Homo sapiens
cugucucucaugaaccucaa

SEQ ID NO: 917156 - RNA, 16 nt, Homo sapiens
cugucucucucugucc

SEQ ID NO: 917157 - RNA, 18 nt, Homo sapiens
cugucugcagugugcacg

SEQ ID NO: 917158 - RNA, 21 nt, Homo sapiens
cugucuguagagccgcauggc

SEQ ID NO: 917159 - RNA, 12 nt, Homo sapiens
gaaaaccauaug

SEQ ID NO: 917160 - RNA, 14 nt, Homo sapiens
gaaaaccuccagua

SEQ ID NO: 917161 - RNA, 15 nt, Homo sapiens
gaaaacuggaaaucu

SEQ ID NO: 917162 - RNA, 20 nt, Homo sapiens
gaaaagaaaccagagucaaa

SEQ ID NO: 917163 - RNA, 12 nt, Homo sapiens
gaaaagcacuuu

SEQ ID NO: 917164 - RNA, 17 nt, Homo sapiens
gaaaagccagaguucca

SEQ ID NO: 917165 - RNA, 15 nt, Homo sapiens
gaaaagcugcugaca

SEQ ID NO: 917166 - RNA, 21 nt, Homo sapiens
gaaaagguagcuuaccugaca

SEQ ID NO: 917167 - RNA, 14 nt, Homo sapiens
gaaaagucuacccc

SEQ ID NO: 917168 - RNA, 17 nt, Homo sapiens
gaaaauaauuguuccaa

SEQ ID NO: 917169 - RNA, 18 nt, Homo sapiens
gaaaauaccaucaggccu

SEQ ID NO: 917170 - RNA, 22 nt, Homo sapiens
gaaaaucaguuauauucuuuaa

SEQ ID NO: 917171 - RNA, 14 nt, Homo sapiens
gaaaauccauggau

SEQ ID NO: 917172 - RNA, 12 nt, Homo sapiens
gaaaaugcauua

SEQ ID NO: 917173 - RNA, 15 nt, Homo sapiens
gaaaaugugacccag

SEQ ID NO: 917174 - RNA, 15 nt, Homo sapiens
gaaaaugugcaauau

SEQ ID NO: 917175 - RNA, 15 nt, Homo sapiens
gaaaauuaacacugc

SEQ ID NO: 917176 - RNA, 15 nt, Homo sapiens
gaaaauuaugagucu

SEQ ID NO: 917177 - RNA, 16 nt, Homo sapiens
gaaaauugaaugcaaa

SEQ ID NO: 917178 - RNA, 20 nt, Homo sapiens
gaaaauuucuucgaucccaa

SEQ ID NO: 917179 - RNA, 20 nt, Homo sapiens
gaaacaaaaaaguguucccu

SEQ ID NO: 917180 - RNA, 19 nt, Homo sapiens
gaaacaacuuguguucuau

SEQ ID NO: 917181 - RNA, 15 nt, Homo sapiens
gaaacaagguuuuca

SEQ ID NO: 917182 - RNA, 19 nt, Homo sapiens
gaaacaauuauuguacacu

SEQ ID NO: 917183 - RNA, 18 nt, Homo sapiens
gaaacagagaacccugug

SEQ ID NO: 917184 - RNA, 19 nt, Homo sapiens
gaaacagagaacccugugg

SEQ ID NO: 917185 - RNA, 16 nt, Homo sapiens
gaaacauuaugccuua

SEQ ID NO: 917186 - RNA, 16 nt, Homo sapiens
gaaacauuuauggaau

SEQ ID NO: 917187 - RNA, 21 nt, Homo sapiens
gaaacauuuuguggucauuaa

SEQ ID NO: 917188 - RNA, 16 nt, Homo sapiens
gaaacccauuaggcau

SEQ ID NO: 917189 - RNA, 19 nt, Homo sapiens
gaaaccuaaggcaacauuu

SEQ ID NO: 917190 - RNA, 18 nt, Homo sapiens
gaaaccuccggugugaga

SEQ ID NO: 917191 - RNA, 20 nt, Homo sapiens
gaaaccuuauuguaccucuc

SEQ ID NO: 917192 - RNA, 23 nt, Homo sapiens
gaaaccuucagauuuguguuaua

SEQ ID NO: 917193 - RNA, 18 nt, Homo sapiens
gaaacggccccauugccu

SEQ ID NO: 917194 - RNA, 14 nt, Homo sapiens
gaaacuaacacagc

SEQ ID NO: 917195 - RNA, 19 nt, Homo sapiens
gaaacuaacacagccauca

SEQ ID NO: 917196 - RNA, 18 nt, Homo sapiens
gaaacucacgaugaaauu

SEQ ID NO: 917197 - RNA, 18 nt, Homo sapiens
gaaacugaaaacuguaaa

SEQ ID NO: 917198 - RNA, 18 nt, Homo sapiens
gaaacuggaugaggucau

SEQ ID NO: 917199 - RNA, 19 nt, Homo sapiens
gaaacuggaugaggucaua

SEQ ID NO: 917200 - RNA, 16 nt, Homo sapiens
gaaacuguuaucacuu

SEQ ID NO: 917201 - RNA, 22 nt, Homo sapiens
gaaacuuccuuugagaauugug

SEQ ID NO: 917202 - RNA, 17 nt, Homo sapiens
gaaacuugcauacagag

SEQ ID NO: 917203 - RNA, 15 nt, Homo sapiens
gaaagaaacacucaa

SEQ ID NO: 917204 - RNA, 23 nt, Homo sapiens
gaaagaaguuaacuacaguguuu

SEQ ID NO: 917205 - RNA, 18 nt, Homo sapiens
gaaagaauuugccuucuc

SEQ ID NO: 917206 - RNA, 18 nt, Homo sapiens
gaaagacagagcugggau

SEQ ID NO: 917207 - RNA, 20 nt, Homo sapiens
gaaagacugaaagaauacau

SEQ ID NO: 917208 - RNA, 14 nt, Homo sapiens
gaaagaggcaguga

SEQ ID NO: 917209 - RNA, 15 nt, Homo sapiens
gaaagaguagugcau

SEQ ID NO: 917210 - RNA, 19 nt, Homo sapiens
gaaagaguccuauuugcac

SEQ ID NO: 917211 - RNA, 14 nt, Homo sapiens
gaaagauggaacuu

SEQ ID NO: 917212 - RNA, 18 nt, Homo sapiens
gaaagcaucacuugggau

SEQ ID NO: 917213 - RNA, 17 nt, Homo sapiens
gaaagccaggguccuga

SEQ ID NO: 917214 - RNA, 14 nt, Homo sapiens
gaaagccucacuga

SEQ ID NO: 917215 - RNA, 20 nt, Homo sapiens
gaaaggaagcuccacuguca

SEQ ID NO: 917216 - RNA, 19 nt, Homo sapiens
gaaaggucauuguggcuau

SEQ ID NO: 917217 - RNA, 14 nt, Homo sapiens
gaaagugacuacca

SEQ ID NO: 917218 - RNA, 23 nt, Homo sapiens
gaaaguggccaugccacccuguu

SEQ ID NO: 917219 - RNA, 17 nt, Homo sapiens
gaaagugguucuaugau

SEQ ID NO: 917220 - RNA, 14 nt, Homo sapiens
gaaauaaacuuugg

SEQ ID NO: 917221 - RNA, 18 nt, Homo sapiens
gaaauaaauuuuguuuca

SEQ ID NO: 917222 - RNA, 13 nt, Homo sapiens
gaaauaauguucu

SEQ ID NO: 917223 - RNA, 17 nt, Homo sapiens
gaaauaccagugaacca

SEQ ID NO: 917224 - RNA, 20 nt, Homo sapiens
gaaauaccagugaaccaaag

SEQ ID NO: 917225 - RNA, 20 nt, Homo sapiens
gaaauaugugguuuccacga

SEQ ID NO: 917226 - RNA, 19 nt, Homo sapiens
gaaauauuuuacaguuuuu

SEQ ID NO: 917227 - RNA, 15 nt, Homo sapiens
gaaaucaaagcgcca

SEQ ID NO: 917228 - RNA, 15 nt, Homo sapiens
gaaaucuccagugug

SEQ ID NO: 917229 - RNA, 13 nt, Homo sapiens
gaaaucugccaau

SEQ ID NO: 917230 - RNA, 11 nt, Homo sapiens
gaaaugaagga

SEQ ID NO: 917231 - RNA, 14 nt, Homo sapiens
gaaaugacuuugaa

SEQ ID NO: 917232 - RNA, 21 nt, Homo sapiens
gaaaugacuuugaaaaccugg

SEQ ID NO: 917233 - RNA, 18 nt, Homo sapiens
gaaaugagaaacuuugau

SEQ ID NO: 917234 - RNA, 17 nt, Homo sapiens
gaaauuauaucuguggu

SEQ ID NO: 917235 - RNA, 18 nt, Homo sapiens
gaaauuauaucugugguc

SEQ ID NO: 917236 - RNA, 16 nt, Homo sapiens
gaaauuuacugugaga

SEQ ID NO: 917237 - RNA, 18 nt, Homo sapiens
gaaauuuaggaagcgaaa

SEQ ID NO: 917238 - RNA, 18 nt, Homo sapiens
gaaauuucccacacccca

SEQ ID NO: 917239 - RNA, 23 nt, Homo sapiens
gaaauuugccaauuuacuuuguu

SEQ ID NO: 917240 - RNA, 22 nt, Homo sapiens
gaacaacuaggcuucagcauau

SEQ ID NO: 917241 - RNA, 14 nt, Homo sapiens
gaacaaugcuauaa

SEQ ID NO: 917242 - RNA, 16 nt, Homo sapiens
gaacaauucucucuua

SEQ ID NO: 917243 - RNA, 22 nt, Homo sapiens
gaacacagccugggaccagggc

SEQ ID NO: 917244 - RNA, 13 nt, Homo sapiens
gaacaccuccuag

SEQ ID NO: 917245 - RNA, 14 nt, Homo sapiens
gaacacgcuuucac

SEQ ID NO: 917246 - RNA, 12 nt, Homo sapiens
gaacacuggggg

SEQ ID NO: 917247 - RNA, 14 nt, Homo sapiens
gaacacugucaucc

SEQ ID NO: 917248 - RNA, 16 nt, Homo sapiens
gaacaguaacugccau

SEQ ID NO: 917249 - RNA, 13 nt, Homo sapiens
gaacaguguuucc

SEQ ID NO: 917250 - RNA, 18 nt, Homo sapiens
gaacaguuuuuaagcuau

SEQ ID NO: 917251 - RNA, 17 nt, Homo sapiens
gaacaucccaagccaga

SEQ ID NO: 917252 - RNA, 12 nt, Homo sapiens
gaacaucugugu

SEQ ID NO: 917253 - RNA, 12 nt, Homo sapiens
gaacaugacauu

SEQ ID NO: 917254 - RNA, 21 nt, Homo sapiens
gaacauuccucugcagcacuu

SEQ ID NO: 917255 - RNA, 18 nt, Homo sapiens
gaaccaaaagagaucaca

SEQ ID NO: 917256 - RNA, 15 nt, Homo sapiens
gaaccaauauuugua

SEQ ID NO: 917257 - RNA, 17 nt, Homo sapiens
gaaccaaucccgugaaa

SEQ ID NO: 917258 - RNA, 18 nt, Homo sapiens
gaaccaugaaaaugggga

SEQ ID NO: 917259 - RNA, 10 nt, Homo sapiens
gaacccagga

SEQ ID NO: 917260 - RNA, 22 nt, Homo sapiens
gaaccccuggccucaagcaauc

SEQ ID NO: 917261 - RNA, 21 nt, Homo sapiens
gaacccugcuugcacuuugua

SEQ ID NO: 917262 - RNA, 22 nt, Homo sapiens
gaacccuuggagccaauggaga

SEQ ID NO: 917263 - RNA, 18 nt, Homo sapiens
gaaccucaaacuggguau

SEQ ID NO: 917264 - RNA, 13 nt, Homo sapiens
gaaccuggagcca

SEQ ID NO: 917265 - RNA, 16 nt, Homo sapiens
gaaccuggagggcuag

SEQ ID NO: 917266 - RNA, 23 nt, Homo sapiens
gaacgaguuguuggcugcucccu

SEQ ID NO: 917267 - RNA, 16 nt, Homo sapiens
gaacuagaaccuggag

SEQ ID NO: 917268 - RNA, 20 nt, Homo sapiens
gaacuagaagaaagggcaag

SEQ ID NO: 917269 - RNA, 15 nt, Homo sapiens
gaacuagagaaggac

SEQ ID NO: 917270 - RNA, 16 nt, Homo sapiens
gaacuaugaacuacaa

SEQ ID NO: 917271 - RNA, 21 nt, Homo sapiens
gaacucaaggaaaucuguguc

SEQ ID NO: 917272 - RNA, 14 nt, Homo sapiens
gaacucucuccacc

SEQ ID NO: 917273 - RNA, 18 nt, Homo sapiens
gaacugauucacaucuca

SEQ ID NO: 917274 - RNA, 21 nt, Homo sapiens
ggcagugccuccugggaccau

SEQ ID NO: 917275 - RNA, 14 nt, Homo sapiens
ggcagugggaccca

SEQ ID NO: 917276 - RNA, 23 nt, Homo sapiens
ggcauagaacuccggaaugacca

SEQ ID NO: 917277 - RNA, 20 nt, Homo sapiens
ggcauccugcagugggccau

SEQ ID NO: 917278 - RNA, 18 nt, Homo sapiens
ggcaucgggccaucucag

SEQ ID NO: 917279 - RNA, 19 nt, Homo sapiens
ggcaugaacacacauggau

SEQ ID NO: 917280 - RNA, 16 nt, Homo sapiens
ggcaugaaggugucau

SEQ ID NO: 917281 - RNA, 20 nt, Homo sapiens
ggccaaccaaagacacuguc

SEQ ID NO: 917282 - RNA, 17 nt, Homo sapiens
ggccaagacuuggcaac

SEQ ID NO: 917283 - RNA, 19 nt, Homo sapiens
ggccaagagcaucgugacc

SEQ ID NO: 917284 - RNA, 12 nt, Homo sapiens
ggccaagcugaa

SEQ ID NO: 917285 - RNA, 22 nt, Homo sapiens
ggccacguguucucacacuggu

SEQ ID NO: 917286 - RNA, 22 nt, Homo sapiens
ggccacugggucucacuccuga

SEQ ID NO: 917287 - RNA, 17 nt, Homo sapiens
ggccacuguggccagag

SEQ ID NO: 917288 - RNA, 19 nt, Homo sapiens
ggccagcugucgcaucuca

SEQ ID NO: 917289 - RNA, 20 nt, Homo sapiens
ggccaggcaggggugggaga

SEQ ID NO: 917290 - RNA, 21 nt, Homo sapiens
ggccagggaaagcccguguca

SEQ ID NO: 917291 - RNA, 24 nt, Homo sapiens
ggccagggaaagcccgugucaaug

SEQ ID NO: 917292 - RNA, 13 nt, Homo sapiens
ggccagguggcca

SEQ ID NO: 917293 - RNA, 11 nt, Homo sapiens
ggccaguguga

SEQ ID NO: 917294 - RNA, 17 nt, Homo sapiens
ggccaugccacccuguu

SEQ ID NO: 917295 - RNA, 16 nt, Homo sapiens
ggccaugcuucuugcc

SEQ ID NO: 917296 - RNA, 21 nt, Homo sapiens
ggcccaaagcccagcucuuug

SEQ ID NO: 917297 - RNA, 17 nt, Homo sapiens
ggcccaagccuggucuc

SEQ ID NO: 917298 - RNA, 15 nt, Homo sapiens
ggcccagaccucagg

SEQ ID NO: 917299 - RNA, 15 nt, Homo sapiens
ggcccagagaagcaa

SEQ ID NO: 917300 - RNA, 16 nt, Homo sapiens
ggccccagaucugccu

SEQ ID NO: 917301 - RNA, 15 nt, Homo sapiens
ggccccccuccaggc

SEQ ID NO: 917302 - RNA, 15 nt, Homo sapiens
ggcccccugugccag

SEQ ID NO: 917303 - RNA, 15 nt, Homo sapiens
ggccccugcaucccc

SEQ ID NO: 917304 - RNA, 16 nt, Homo sapiens
ggccccugcccggcug

SEQ ID NO: 917305 - RNA, 13 nt, Homo sapiens
ggcccuccuugcc

SEQ ID NO: 917306 - RNA, 13 nt, Homo sapiens
ggcccugggagag

SEQ ID NO: 917307 - RNA, 21 nt, Homo sapiens
ggcccuucuugccuacuaugc

SEQ ID NO: 917308 - RNA, 20 nt, Homo sapiens
ggccuaagggccacauccca

SEQ ID NO: 917309 - RNA, 13 nt, Homo sapiens
ggccuaggaccuc

SEQ ID NO: 917310 - RNA, 14 nt, Homo sapiens
ggccuauuccggaa

SEQ ID NO: 917311 - RNA, 20 nt, Homo sapiens
ggccucacacccagagggua

SEQ ID NO: 917312 - RNA, 12 nt, Homo sapiens
ggccuccacucc

SEQ ID NO: 917313 - RNA, 14 nt, Homo sapiens
ggccuccugccucu

SEQ ID NO: 917314 - RNA, 21 nt, Homo sapiens
ggccugaagucccagcauuga

SEQ ID NO: 917315 - RNA, 13 nt, Homo sapiens
ggccugauggugc

SEQ ID NO: 917316 - RNA, 23 nt, Homo sapiens
ggccugccuugaagccacugaag

SEQ ID NO: 917317 - RNA, 16 nt, Homo sapiens
ggccuggccagaugca

SEQ ID NO: 917318 - RNA, 14 nt, Homo sapiens
ggccugugugugaa

SEQ ID NO: 917319 - RNA, 19 nt, Homo sapiens
ggccuuacuuaaacccagc

SEQ ID NO: 917320 - RNA, 22 nt, Homo sapiens
ggccuuuccugugccaaccuga

SEQ ID NO: 917321 - RNA, 14 nt, Homo sapiens
ggcgaaccaucuca

SEQ ID NO: 917322 - RNA, 20 nt, Homo sapiens
ggcgacagagcgagacuccg

SEQ ID NO: 917323 - RNA, 19 nt, Homo sapiens
ggcgagcucuggcuuugca

SEQ ID NO: 917324 - RNA, 20 nt, Homo sapiens
ggcgagugugggcauagcau

SEQ ID NO: 917325 - RNA, 15 nt, Homo sapiens
ggcggcccucaaaag

SEQ ID NO: 917326 - RNA, 21 nt, Homo sapiens
ggcuaauucccagagugugaa

SEQ ID NO: 917327 - RNA, 17 nt, Homo sapiens
ggcuaccccacccaagu

SEQ ID NO: 917328 - RNA, 21 nt, Homo sapiens
ggcuaccccuucauggugacu

SEQ ID NO: 917329 - RNA, 17 nt, Homo sapiens
ggcuagaaucuggagag

SEQ ID NO: 917330 - RNA, 19 nt, Homo sapiens
ggcucaagaggcccaggga

SEQ ID NO: 917331 - RNA, 20 nt, Homo sapiens
ggcucaagcaguccucccac

SEQ ID NO: 917332 - RNA, 23 nt, Homo sapiens
ggcucaccccucucccccgccca

SEQ ID NO: 917333 - RNA, 21 nt, Homo sapiens
ggcucaccuugugcuggggac

SEQ ID NO: 917334 - RNA, 23 nt, Homo sapiens
ggcuccacauccaccccacugga

SEQ ID NO: 917335 - RNA, 22 nt, Homo sapiens
ggcuccaccccauccaguucau

SEQ ID NO: 917336 - RNA, 19 nt, Homo sapiens
ggcuccaucuccaguggga

SEQ ID NO: 917337 - RNA, 22 nt, Homo sapiens
ggcucccuaacacacacagcgg

SEQ ID NO: 917338 - RNA, 21 nt, Homo sapiens
ggcucccuccuggagcauccc

SEQ ID NO: 917339 - RNA, 16 nt, Homo sapiens
ggcuccuggcugccag

SEQ ID NO: 917340 - RNA, 14 nt, Homo sapiens
ggcucuucaaagac

SEQ ID NO: 917341 - RNA, 13 nt, Homo sapiens
ggcugagcugaac

SEQ ID NO: 917342 - RNA, 15 nt, Homo sapiens
ggcugaggauuucaa

SEQ ID NO: 917343 - RNA, 21 nt, Homo sapiens
ggcugccacuaaccuguagaa

SEQ ID NO: 917344 - RNA, 17 nt, Homo sapiens
ggcugccggaacaacag

SEQ ID NO: 917345 - RNA, 19 nt, Homo sapiens
ggcugccugcaucuauucu

SEQ ID NO: 917346 - RNA, 14 nt, Homo sapiens
ggcuggagugcagu

SEQ ID NO: 917347 - RNA, 13 nt, Homo sapiens
ggcugggugguga

SEQ ID NO: 917348 - RNA, 15 nt, Homo sapiens
ggcuguaucccauga

SEQ ID NO: 917349 - RNA, 23 nt, Homo sapiens
ggcugucaggacaccagccuggu

SEQ ID NO: 917350 - RNA, 21 nt, Homo sapiens
ggcugucugucaccagcuauc

SEQ ID NO: 917351 - RNA, 20 nt, Homo sapiens
ggcugugcucucaccagcug

SEQ ID NO: 917352 - RNA, 13 nt, Homo sapiens
ggcuguucugcac

SEQ ID NO: 917353 - RNA, 21 nt, Homo sapiens
ggcuuagacuucgacucagga

SEQ ID NO: 917354 - RNA, 16 nt, Homo sapiens
ggcuuaggacuuucca

SEQ ID NO: 917355 - RNA, 15 nt, Homo sapiens
ggcuuccuucauuuc

SEQ ID NO: 917356 - RNA, 14 nt, Homo sapiens
ggcuucucuuucuc

SEQ ID NO: 917357 - RNA, 14 nt, Homo sapiens
ggcuugcaugccaa

SEQ ID NO: 917358 - RNA, 17 nt, Homo sapiens
ggcuuggggcuggagag

SEQ ID NO: 917359 - RNA, 18 nt, Homo sapiens
gggaaaagcaguggggac

SEQ ID NO: 917360 - RNA, 13 nt, Homo sapiens
gggaaacagggag

SEQ ID NO: 917361 - RNA, 16 nt, Homo sapiens
gggaaagagauccagg

SEQ ID NO: 917362 - RNA, 21 nt, Homo sapiens
gggaaaggauauuuucuucca

SEQ ID NO: 917363 - RNA, 12 nt, Homo sapiens
gggaaauugcuu

SEQ ID NO: 917364 - RNA, 21 nt, Homo sapiens
gggaacccugcccacucccag

SEQ ID NO: 917365 - RNA, 21 nt, Homo sapiens
gggaacuggccaagcugaggu

SEQ ID NO: 917366 - RNA, 14 nt, Homo sapiens
gggaagagggcagu

SEQ ID NO: 917367 - RNA, 21 nt, Homo sapiens
gggaagccuccgucaggagag

SEQ ID NO: 917368 - RNA, 12 nt, Homo sapiens
gggaaugagcau

SEQ ID NO: 917369 - RNA, 15 nt, Homo sapiens
gggaauggauccugg

SEQ ID NO: 917370 - RNA, 22 nt, Homo sapiens
gggaaugugccucggccuccaa

SEQ ID NO: 917371 - RNA, 15 nt, Homo sapiens
gggacacaggggcaa

SEQ ID NO: 917372 - RNA, 13 nt, Homo sapiens
gggacaccagcca

SEQ ID NO: 917373 - RNA, 14 nt, Homo sapiens
gggacacuuaccca

SEQ ID NO: 917374 - RNA, 14 nt, Homo sapiens
gggacagcauaccu

SEQ ID NO: 917375 - RNA, 12 nt, Homo sapiens
gggacaugcagc

SEQ ID NO: 917376 - RNA, 22 nt, Homo sapiens
gggacauuucccuccugggaga

SEQ ID NO: 917377 - RNA, 16 nt, Homo sapiens
gggacuccaguucaca

SEQ ID NO: 917378 - RNA, 23 nt, Homo sapiens
gggacuuauguauuuaugaccuu

SEQ ID NO: 917379 - RNA, 13 nt, Homo sapiens
gggagaaaugacu

SEQ ID NO: 917380 - RNA, 15 nt, Homo sapiens
gggagagcagagggu

SEQ ID NO: 917381 - RNA, 11 nt, Homo sapiens
gggagcacaga

SEQ ID NO: 917382 - RNA, 13 nt, Homo sapiens
gggagcagugucu

SEQ ID NO: 917383 - RNA, 23 nt, Homo sapiens
gggagccccuaggaaagcagugu

SEQ ID NO: 917384 - RNA, 21 nt, Homo sapiens
gggagccuccucugcuugcau

SEQ ID NO: 917385 - RNA, 23 nt, Homo sapiens
gggagcuggaaauaaaccuggag

SEQ ID NO: 917386 - RNA, 23 nt, Homo sapiens
gggaggccgaagcuaacagggaa

SEQ ID NO: 917387 - RNA, 20 nt, Homo sapiens
gggagguggagguugcagug

SEQ ID NO: 917388 - RNA, 21 nt, Homo sapiens
guguuauuaaugacaaaggca

SEQ ID NO: 917389 - RNA, 22 nt, Homo sapiens
guguucacacuguaaacauuca

SEQ ID NO: 917390 - RNA, 14 nt, Homo sapiens
guguugaucccaag

SEQ ID NO: 917391 - RNA, 18 nt, Homo sapiens
guguugguguauuugcca

SEQ ID NO: 917392 - RNA, 22 nt, Homo sapiens
guguuguacaauaccagaucac

SEQ ID NO: 917393 - RNA, 16 nt, Homo sapiens
guguuuaaaacaugca

SEQ ID NO: 917394 - RNA, 22 nt, Homo sapiens
guguuuaaaacaugcacgguga

SEQ ID NO: 917395 - RNA, 20 nt, Homo sapiens
guuaaagggcagaaggggaa

SEQ ID NO: 917396 - RNA, 19 nt, Homo sapiens
guuaaccucagugucauuu

SEQ ID NO: 917397 - RNA, 19 nt, Homo sapiens
guuaacuuaauaguauuua

SEQ ID NO: 917398 - RNA, 16 nt, Homo sapiens
guuaagcagccuuucu

SEQ ID NO: 917399 - RNA, 19 nt, Homo sapiens
guuaaggggagcaacagag

SEQ ID NO: 917400 - RNA, 13 nt, Homo sapiens
guuaauaaagaag

SEQ ID NO: 917401 - RNA, 14 nt, Homo sapiens
guuaauacuuaaca

SEQ ID NO: 917402 - RNA, 19 nt, Homo sapiens
guuaauacuuaacauugau

SEQ ID NO: 917403 - RNA, 14 nt, Homo sapiens
guuaaugguuugaa

SEQ ID NO: 917404 - RNA, 18 nt, Homo sapiens
guuaauuuguuauguaua

SEQ ID NO: 917405 - RNA, 22 nt, Homo sapiens
guuacaaauucaaggagauaua

SEQ ID NO: 917406 - RNA, 16 nt, Homo sapiens
guuacauaacaagaaa

SEQ ID NO: 917407 - RNA, 16 nt, Homo sapiens
guuacaucacaguguu

SEQ ID NO: 917408 - RNA, 17 nt, Homo sapiens
guuacucauaaggcaua

SEQ ID NO: 917409 - RNA, 16 nt, Homo sapiens
guuacuguugcacuga

SEQ ID NO: 917410 - RNA, 15 nt, Homo sapiens
guuacuucacuuuaa

SEQ ID NO: 917411 - RNA, 22 nt, Homo sapiens
guuagauaaugaaugauaagca

SEQ ID NO: 917412 - RNA, 24 nt, Homo sapiens
guuagaugcccccacccaccugua

SEQ ID NO: 917413 - RNA, 22 nt, Homo sapiens
guuaggcacaggcugggaugga

SEQ ID NO: 917414 - RNA, 19 nt, Homo sapiens
guuagggaugacugugauu

SEQ ID NO: 917415 - RNA, 23 nt, Homo sapiens
guuaguaauaaacgucuugccac

SEQ ID NO: 917416 - RNA, 15 nt, Homo sapiens
guuaguaucaucaga

SEQ ID NO: 917417 - RNA, 20 nt, Homo sapiens
guuauaaaucaaugucacuu

SEQ ID NO: 917418 - RNA, 15 nt, Homo sapiens
guuauagacugccau

SEQ ID NO: 917419 - RNA, 22 nt, Homo sapiens
guuaugagggucagggcaguau

SEQ ID NO: 917420 - RNA, 15 nt, Homo sapiens
guuauguuugcacuu

SEQ ID NO: 917421 - RNA, 16 nt, Homo sapiens
guuauguuugcacuuu

SEQ ID NO: 917422 - RNA, 19 nt, Homo sapiens
guuauuuugcuauuugccu

SEQ ID NO: 917423 - RNA, 20 nt, Homo sapiens
guucaaaaaacucuugauau

SEQ ID NO: 917424 - RNA, 19 nt, Homo sapiens
guucaaauuuugcauugug

SEQ ID NO: 917425 - RNA, 12 nt, Homo sapiens
guucaagccaug

SEQ ID NO: 917426 - RNA, 15 nt, Homo sapiens
guucaaggaccacau

SEQ ID NO: 917427 - RNA, 13 nt, Homo sapiens
guucacacuguaa

SEQ ID NO: 917428 - RNA, 16 nt, Homo sapiens
guucagcuucagacuu

SEQ ID NO: 917429 - RNA, 20 nt, Homo sapiens
guucaggaguuggagaccag

SEQ ID NO: 917430 - RNA, 14 nt, Homo sapiens
guucagugccuugg

SEQ ID NO: 917431 - RNA, 13 nt, Homo sapiens
guucaguggcauu

SEQ ID NO: 917432 - RNA, 19 nt, Homo sapiens
guucauauuggacugauaa

SEQ ID NO: 917433 - RNA, 21 nt, Homo sapiens
guucaucagacuccugugcaa

SEQ ID NO: 917434 - RNA, 18 nt, Homo sapiens
guucauucuuaccgagaa

SEQ ID NO: 917435 - RNA, 14 nt, Homo sapiens
guuccauguuaaaa

SEQ ID NO: 917436 - RNA, 18 nt, Homo sapiens
guucccagcagcugggcc

SEQ ID NO: 917437 - RNA, 19 nt, Homo sapiens
guucccccucccuguguga

SEQ ID NO: 917438 - RNA, 20 nt, Homo sapiens
guucccucuuucuuucuuuu

SEQ ID NO: 917439 - RNA, 12 nt, Homo sapiens
guucccuuuaaa

SEQ ID NO: 917440 - RNA, 16 nt, Homo sapiens
guuccuccaagagguc

SEQ ID NO: 917441 - RNA, 17 nt, Homo sapiens
guuccucgcaggucuca

SEQ ID NO: 917442 - RNA, 17 nt, Homo sapiens
guuccucuuugcaugga

SEQ ID NO: 917443 - RNA, 19 nt, Homo sapiens
guuccuguagaacugagaa

SEQ ID NO: 917444 - RNA, 16 nt, Homo sapiens
guuccuucacauuuaa

SEQ ID NO: 917445 - RNA, 17 nt, Homo sapiens
guucucuauugcugcuc

SEQ ID NO: 917446 - RNA, 21 nt, Homo sapiens
guucucuucuuuaaagggaug

SEQ ID NO: 917447 - RNA, 18 nt, Homo sapiens
guucucuuugguguuaca

SEQ ID NO: 917448 - RNA, 19 nt, Homo sapiens
guucugaugggucccaaaa

SEQ ID NO: 917449 - RNA, 14 nt, Homo sapiens
guucugcacugaaa

SEQ ID NO: 917450 - RNA, 16 nt, Homo sapiens
guucuggaaaccacgu

SEQ ID NO: 917451 - RNA, 15 nt, Homo sapiens
guucugggacacagu

SEQ ID NO: 917452 - RNA, 22 nt, Homo sapiens
guucuggggaggaagggccagg

SEQ ID NO: 917453 - RNA, 19 nt, Homo sapiens
guucuggguguugaccacu

SEQ ID NO: 917454 - RNA, 16 nt, Homo sapiens
guucugguaugaacuu

SEQ ID NO: 917455 - RNA, 13 nt, Homo sapiens
guucuuagcugaa

SEQ ID NO: 917456 - RNA, 18 nt, Homo sapiens
guucuuuaagaauuacag

SEQ ID NO: 917457 - RNA, 19 nt, Homo sapiens
guugaaaucagaagccuac

SEQ ID NO: 917458 - RNA, 19 nt, Homo sapiens
guugaacacaauugauacu

SEQ ID NO: 917459 - RNA, 20 nt, Homo sapiens
guugaacaucucacuuugcc

SEQ ID NO: 917460 - RNA, 18 nt, Homo sapiens
guugaaccguuucuuuaa

SEQ ID NO: 917461 - RNA, 16 nt, Homo sapiens
guugaagccacugccu

SEQ ID NO: 917462 - RNA, 20 nt, Homo sapiens
guugaaucuugcacauauuu

SEQ ID NO: 917463 - RNA, 19 nt, Homo sapiens
guugagucgucaucacuuu

SEQ ID NO: 917464 - RNA, 15 nt, Homo sapiens
guugaucccaagaca

SEQ ID NO: 917465 - RNA, 23 nt, Homo sapiens
guugauucccagcauucaguggu

SEQ ID NO: 917466 - RNA, 15 nt, Homo sapiens
guugcacugaugucc

SEQ ID NO: 917467 - RNA, 12 nt, Homo sapiens
guugcagucuca

SEQ ID NO: 917468 - RNA, 15 nt, Homo sapiens
guugcuggacuguca

SEQ ID NO: 917469 - RNA, 16 nt, Homo sapiens
guugcuggacugucau

SEQ ID NO: 917470 - RNA, 22 nt, Homo sapiens
guugcuucaccuuggagccuga

SEQ ID NO: 917471 - RNA, 21 nt, Homo sapiens
guugcuuuucuaaucuuguua

SEQ ID NO: 917472 - RNA, 22 nt, Homo sapiens
guuggaaccguguccagcacag

SEQ ID NO: 917473 - RNA, 23 nt, Homo sapiens
guuggaaccguguccagcacaga

SEQ ID NO: 917474 - RNA, 18 nt, Homo sapiens
guuggacccgcucuggac

SEQ ID NO: 917475 - RNA, 22 nt, Homo sapiens
guuggccagugugacaaggauu

SEQ ID NO: 917476 - RNA, 15 nt, Homo sapiens
guuggccugguggcc

SEQ ID NO: 917477 - RNA, 16 nt, Homo sapiens
guugggaauugcaugc

SEQ ID NO: 917478 - RNA, 20 nt, Homo sapiens
guuggugacugaaacauuca

SEQ ID NO: 917479 - RNA, 16 nt, Homo sapiens
guugguguauuugcca

SEQ ID NO: 917480 - RNA, 17 nt, Homo sapiens
guuguaauaaaacuuau

SEQ ID NO: 917481 - RNA, 15 nt, Homo sapiens
guuguacaagcucag

SEQ ID NO: 917482 - RNA, 21 nt, Homo sapiens
guugucugaagucacugcaca

SEQ ID NO: 917483 - RNA, 20 nt, Homo sapiens
guugugagcacucuacugca

SEQ ID NO: 917484 - RNA, 19 nt, Homo sapiens
guugugccaaagugcauag

SEQ ID NO: 917485 - RNA, 21 nt, Homo sapiens
guugugcccuccaccuaccug

SEQ ID NO: 917486 - RNA, 19 nt, Homo sapiens
guuguuaaugaaaauguca

SEQ ID NO: 917487 - RNA, 13 nt, Homo sapiens
guuguuccuucac

SEQ ID NO: 917488 - RNA, 13 nt, Homo sapiens
guuguuguuguug

SEQ ID NO: 917489 - RNA, 17 nt, Homo sapiens
guuuaaaaaaaguauau

SEQ ID NO: 917490 - RNA, 21 nt, Homo sapiens
guuuaauuaacuaugugaugu

SEQ ID NO: 917491 - RNA, 20 nt, Homo sapiens
guuuaauuguaggucaauga

SEQ ID NO: 917492 - RNA, 14 nt, Homo sapiens
guuuacagacugug

SEQ ID NO: 917493 - RNA, 16 nt, Homo sapiens
guuuagaagagccuga

SEQ ID NO: 917494 - RNA, 12 nt, Homo sapiens
guuuagauauau

SEQ ID NO: 917495 - RNA, 17 nt, Homo sapiens
guuuagauuucaagaaa

SEQ ID NO: 917496 - RNA, 18 nt, Homo sapiens
guuuaguauuaugucuua

SEQ ID NO: 917497 - RNA, 20 nt, Homo sapiens
guuuaugucaucauacauga

SEQ ID NO: 917498 - RNA, 19 nt, Homo sapiens
guuuauuuaucagugacag

SEQ ID NO: 917499 - RNA, 18 nt, Homo sapiens
guuucaagcuaccuucau

SEQ ID NO: 917500 - RNA, 18 nt, Homo sapiens
guuucacaaacuacaaag

SEQ ID NO: 917501 - RNA, 20 nt, Homo sapiens
guuucacaacaggcauucca

SEQ ID NO: 917502 - RNA, 12 nt, Homo sapiens
uacauucaugag

SEQ ID NO: 917503 - RNA, 15 nt, Homo sapiens
uacauuucccugugc

SEQ ID NO: 917504 - RNA, 18 nt, Homo sapiens
uacauuuuauaucuggau

SEQ ID NO: 917505 - RNA, 23 nt, Homo sapiens
uacauuuucuuguggagcaauag

SEQ ID NO: 917506 - RNA, 22 nt, Homo sapiens
uacauuuugccugacuuaccuu

SEQ ID NO: 917507 - RNA, 15 nt, Homo sapiens
uaccaaaauguuaau

SEQ ID NO: 917508 - RNA, 20 nt, Homo sapiens
uaccaaauccacaagccauu

SEQ ID NO: 917509 - RNA, 23 nt, Homo sapiens
uaccaacagcuuuucccaggaga

SEQ ID NO: 917510 - RNA, 14 nt, Homo sapiens
uaccaaguauuuau

SEQ ID NO: 917511 - RNA, 13 nt, Homo sapiens
uaccaagugacca

SEQ ID NO: 917512 - RNA, 15 nt, Homo sapiens
uaccaaguguguugg

SEQ ID NO: 917513 - RNA, 18 nt, Homo sapiens
uaccaaguguguugggaa

SEQ ID NO: 917514 - RNA, 17 nt, Homo sapiens
uaccaaguuacuugaaa

SEQ ID NO: 917515 - RNA, 13 nt, Homo sapiens
uaccaaucauuuu

SEQ ID NO: 917516 - RNA, 18 nt, Homo sapiens
uaccacagugucuguauc

SEQ ID NO: 917517 - RNA, 19 nt, Homo sapiens
uaccacugauuuggagaua

SEQ ID NO: 917518 - RNA, 21 nt, Homo sapiens
uaccagauauuugaaucuuuc

SEQ ID NO: 917519 - RNA, 15 nt, Homo sapiens
uaccagaucacucaa

SEQ ID NO: 917520 - RNA, 16 nt, Homo sapiens
uaccagugaaccaaag

SEQ ID NO: 917521 - RNA, 16 nt, Homo sapiens
uaccaguguacugcuu

SEQ ID NO: 917522 - RNA, 14 nt, Homo sapiens
uaccaugccucucc

SEQ ID NO: 917523 - RNA, 15 nt, Homo sapiens
uaccaugccucucca

SEQ ID NO: 917524 - RNA, 11 nt, Homo sapiens
uacccacuucc

SEQ ID NO: 917525 - RNA, 20 nt, Homo sapiens
uacccagagaauauauacau

SEQ ID NO: 917526 - RNA, 17 nt, Homo sapiens
uacccaggaugauuucc

SEQ ID NO: 917527 - RNA, 16 nt, Homo sapiens
uacccagugggacaga

SEQ ID NO: 917528 - RNA, 19 nt, Homo sapiens
uacccauagcuuccaugag

SEQ ID NO: 917529 - RNA, 13 nt, Homo sapiens
uaccccaccacga

SEQ ID NO: 917530 - RNA, 17 nt, Homo sapiens
uaccccaccucaugccu

SEQ ID NO: 917531 - RNA, 18 nt, Homo sapiens
uacccccguggucuuuga

SEQ ID NO: 917532 - RNA, 19 nt, Homo sapiens
uaccgugggucaaccuggg

SEQ ID NO: 917533 - RNA, 15 nt, Homo sapiens
uaccuaccacagugu

SEQ ID NO: 917534 - RNA, 22 nt, Homo sapiens
uaccuauaauguguguaugugu

SEQ ID NO: 917535 - RNA, 13 nt, Homo sapiens
uaccuauauuaca

SEQ ID NO: 917536 - RNA, 15 nt, Homo sapiens
uaccuauauuacaca

SEQ ID NO: 917537 - RNA, 15 nt, Homo sapiens
uaccuaucaucuuaa

SEQ ID NO: 917538 - RNA, 18 nt, Homo sapiens
uaccucacuaugcugcuu

SEQ ID NO: 917539 - RNA, 13 nt, Homo sapiens
uaccucagccuag

SEQ ID NO: 917540 - RNA, 21 nt, Homo sapiens
uaccugacggacguccugcug

SEQ ID NO: 917541 - RNA, 13 nt, Homo sapiens
uaccugggcauuc

SEQ ID NO: 917542 - RNA, 22 nt, Homo sapiens
uaccuguaagggcaaagucaau

SEQ ID NO: 917543 - RNA, 22 nt, Homo sapiens
uaccuucaauaaaguaucuaca

SEQ ID NO: 917544 - RNA, 17 nt, Homo sapiens
uaccuugagccaguaau

SEQ ID NO: 917545 - RNA, 18 nt, Homo sapiens
uaccuugcagccaugacc

SEQ ID NO: 917546 - RNA, 13 nt, Homo sapiens
uaccuugguauau

SEQ ID NO: 917547 - RNA, 18 nt, Homo sapiens
uaccuuuaaaauuuacca

SEQ ID NO: 917548 - RNA, 22 nt, Homo sapiens
uaccuuuaaaauuuaccacaga

SEQ ID NO: 917549 - RNA, 18 nt, Homo sapiens
uaccuuuacauaauugca

SEQ ID NO: 917550 - RNA, 20 nt, Homo sapiens
uacgguaccuggcaauguuu

SEQ ID NO: 917551 - RNA, 15 nt, Homo sapiens
uacgucaaagcagua

SEQ ID NO: 917552 - RNA, 18 nt, Homo sapiens
uacuaaagucacauauaa

SEQ ID NO: 917553 - RNA, 16 nt, Homo sapiens
uacuaaaugguugucu

SEQ ID NO: 917554 - RNA, 16 nt, Homo sapiens
uacuagcaggaauauu

SEQ ID NO: 917555 - RNA, 23 nt, Homo sapiens
uacuaguguguguguguauauau

SEQ ID NO: 917556 - RNA, 19 nt, Homo sapiens
uacuauaaugugaugauuc

SEQ ID NO: 917557 - RNA, 18 nt, Homo sapiens
uacuauacaacaauguuc

SEQ ID NO: 917558 - RNA, 12 nt, Homo sapiens
uacuauaugauu

SEQ ID NO: 917559 - RNA, 18 nt, Homo sapiens
uacuaugcucuagagaaa

SEQ ID NO: 917560 - RNA, 16 nt, Homo sapiens
uacuauggaaagcagc

SEQ ID NO: 917561 - RNA, 12 nt, Homo sapiens
uacuauguuaau

SEQ ID NO: 917562 - RNA, 17 nt, Homo sapiens
uacuauuugaagcaaug

SEQ ID NO: 917563 - RNA, 13 nt, Homo sapiens
uacucagacuguu

SEQ ID NO: 917564 - RNA, 12 nt, Homo sapiens
uacuccugugcu

SEQ ID NO: 917565 - RNA, 15 nt, Homo sapiens
uacucuaagucucca

SEQ ID NO: 917566 - RNA, 11 nt, Homo sapiens
uacucucaccg

SEQ ID NO: 917567 - RNA, 12 nt, Homo sapiens
uacucucuugcc

SEQ ID NO: 917568 - RNA, 21 nt, Homo sapiens
uacucugugccagagccuggg

SEQ ID NO: 917569 - RNA, 17 nt, Homo sapiens
uacucuuucacucaggc

SEQ ID NO: 917570 - RNA, 21 nt, Homo sapiens
uacugaaagguuacccuguaa

SEQ ID NO: 917571 - RNA, 17 nt, Homo sapiens
uacugauucuccuguca

SEQ ID NO: 917572 - RNA, 23 nt, Homo sapiens
uacugcaaaugcuauauugcacu

SEQ ID NO: 917573 - RNA, 22 nt, Homo sapiens
uacugcaauaaauuauggcucu

SEQ ID NO: 917574 - RNA, 15 nt, Homo sapiens
uacugcaugcacuuc

SEQ ID NO: 917575 - RNA, 19 nt, Homo sapiens
uacuggaccccgccuccca

SEQ ID NO: 917576 - RNA, 12 nt, Homo sapiens
uacuguacuuaa

SEQ ID NO: 917577 - RNA, 13 nt, Homo sapiens
uacuguacuuaau

SEQ ID NO: 917578 - RNA, 19 nt, Homo sapiens
uacuguugcacugaugucc

SEQ ID NO: 917579 - RNA, 19 nt, Homo sapiens
uacuuaauggguacaaugu

SEQ ID NO: 917580 - RNA, 17 nt, Homo sapiens
uacuuauucuagauuac

SEQ ID NO: 917581 - RNA, 13 nt, Homo sapiens
uacuucaugagga

SEQ ID NO: 917582 - RNA, 17 nt, Homo sapiens
uacuuccuaaauuucag

SEQ ID NO: 917583 - RNA, 15 nt, Homo sapiens
uacuugaaaaccuca

SEQ ID NO: 917584 - RNA, 14 nt, Homo sapiens
uacuugaaauacca

SEQ ID NO: 917585 - RNA, 18 nt, Homo sapiens
uacuugaauacucucaca

SEQ ID NO: 917586 - RNA, 18 nt, Homo sapiens
uacuugccacacacuguu

SEQ ID NO: 917587 - RNA, 16 nt, Homo sapiens
uacuuguaaaggugcu

SEQ ID NO: 917588 - RNA, 17 nt, Homo sapiens
uacuuguggacacagcu

SEQ ID NO: 917589 - RNA, 15 nt, Homo sapiens
uacuuuaaagagcuu

SEQ ID NO: 917590 - RNA, 19 nt, Homo sapiens
uacuuugaguuagugccau

SEQ ID NO: 917591 - RNA, 19 nt, Homo sapiens
uacuuugccuuuugcaaac

SEQ ID NO: 917592 - RNA, 17 nt, Homo sapiens
uacuuuucuuuccucag

SEQ ID NO: 917593 - RNA, 16 nt, Homo sapiens
uacuuuuuauacucca

SEQ ID NO: 917594 - RNA, 17 nt, Homo sapiens
uagaaacaugacacuga

SEQ ID NO: 917595 - RNA, 18 nt, Homo sapiens
uagaaagcaacuuaucag

SEQ ID NO: 917596 - RNA, 12 nt, Homo sapiens
uagaaauaagcc

SEQ ID NO: 917597 - RNA, 16 nt, Homo sapiens
uagaaauaauugaaag

SEQ ID NO: 917598 - RNA, 18 nt, Homo sapiens
uagaaauuggcuggaugu

SEQ ID NO: 917599 - RNA, 13 nt, Homo sapiens
uagaacacccacu

SEQ ID NO: 917600 - RNA, 19 nt, Homo sapiens
uagaacacccacuggccag

SEQ ID NO: 917601 - RNA, 22 nt, Homo sapiens
uagaacauaaagcaaauagaca

SEQ ID NO: 917602 - RNA, 18 nt, Homo sapiens
uagaaccacuuggcugcu

SEQ ID NO: 917603 - RNA, 12 nt, Homo sapiens
uagaacugagaa

SEQ ID NO: 917604 - RNA, 20 nt, Homo sapiens
uagaacuucaagaaguaaga

SEQ ID NO: 917605 - RNA, 23 nt, Homo sapiens
uagaagagccugacuguguucag

SEQ ID NO: 917606 - RNA, 20 nt, Homo sapiens
uagaagauuuuaugcugcug

SEQ ID NO: 917607 - RNA, 22 nt, Homo sapiens
uagaagccugcagcggcacaaa

SEQ ID NO: 917608 - RNA, 21 nt, Homo sapiens
uagaagcuguaguagcccuuu

SEQ ID NO: 917609 - RNA, 12 nt, Homo sapiens
uagaaggcugug

SEQ ID NO: 917610 - RNA, 16 nt, Homo sapiens
uagaagucacacagua

SEQ ID NO: 917611 - RNA, 19 nt, Homo sapiens
uagaauaaaauuguaaaau

SEQ ID NO: 917612 - RNA, 20 nt, Homo sapiens
uagaauaauacuagucuuau

SEQ ID NO: 917613 - RNA, 16 nt, Homo sapiens
uagaauggaugugcuc

SEQ ID NO: 917614 - RNA, 18 nt, Homo sapiens
uagaauggaugugcucac

SEQ ID NO: 917615 - RNA, 15 nt, Homo sapiens
uagaauuuaacauga

SEQ ID NO: 917616 - RNA, 13 nt, Homo sapiens
uagaauuuauuca

SEQ ID NO: 917617 - RNA, 14 nt, Homo sapiens
uauuuauucccugu

SEQ ID NO: 917618 - RNA, 20 nt, Homo sapiens
uauuucaaaugaacacgugc

SEQ ID NO: 917619 - RNA, 17 nt, Homo sapiens
uauuucaaccgcuugcc

SEQ ID NO: 917620 - RNA, 14 nt, Homo sapiens
uauuucauaaacaa

SEQ ID NO: 917621 - RNA, 17 nt, Homo sapiens
uauuucucaacaaagca

SEQ ID NO: 917622 - RNA, 16 nt, Homo sapiens
uauuucucugaauuca

SEQ ID NO: 917623 - RNA, 16 nt, Homo sapiens
uauuucuuuucaggga

SEQ ID NO: 917624 - RNA, 21 nt, Homo sapiens
uauuugaacuuauuuacacau

SEQ ID NO: 917625 - RNA, 13 nt, Homo sapiens
uauuugaauauca

SEQ ID NO: 917626 - RNA, 21 nt, Homo sapiens
uauuugccauucagucuagcu

SEQ ID NO: 917627 - RNA, 15 nt, Homo sapiens
uauuugcugauacua

SEQ ID NO: 917628 - RNA, 21 nt, Homo sapiens
uauuuggaauaauaauuuucc

SEQ ID NO: 917629 - RNA, 16 nt, Homo sapiens
uauuugugcucuguga

SEQ ID NO: 917630 - RNA, 17 nt, Homo sapiens
uauuuguuugcaauuuu

SEQ ID NO: 917631 - RNA, 20 nt, Homo sapiens
uauuuguuuggucacugcua

SEQ ID NO: 917632 - RNA, 17 nt, Homo sapiens
uauuuuaagacgugaau

SEQ ID NO: 917633 - RNA, 15 nt, Homo sapiens
uauuuuaagcauucu

SEQ ID NO: 917634 - RNA, 19 nt, Homo sapiens
uauuuuccccuagcuuucc

SEQ ID NO: 917635 - RNA, 12 nt, Homo sapiens
uauuuugcacug

SEQ ID NO: 917636 - RNA, 23 nt, Homo sapiens
uauuuuucaaagauguguugcua

SEQ ID NO: 917637 - RNA, 22 nt, Homo sapiens
uauuuuuguuucuuccaaagca

SEQ ID NO: 917638 - RNA, 17 nt, Homo sapiens
uauuuuuuaaguauuua

SEQ ID NO: 917639 - RNA, 21 nt, Homo sapiens
uauuuuuuuaagcuguaaaaa

SEQ ID NO: 917640 - RNA, 21 nt, Homo sapiens
uauuuuuuuuacugugcauac

SEQ ID NO: 917641 - RNA, 14 nt, Homo sapiens
ucaaaaaguguuua

SEQ ID NO: 917642 - RNA, 16 nt, Homo sapiens
ucaaaaauacucacau

SEQ ID NO: 917643 - RNA, 21 nt, Homo sapiens
ucaaaaauuagugaaguucuu

SEQ ID NO: 917644 - RNA, 17 nt, Homo sapiens
ucaaaacagagauguga

SEQ ID NO: 917645 - RNA, 18 nt, Homo sapiens
ucaaaacauugugccaug

SEQ ID NO: 917646 - RNA, 15 nt, Homo sapiens
ucaaaacugcuaaau

SEQ ID NO: 917647 - RNA, 21 nt, Homo sapiens
ucaaaagacagcacuacagau

SEQ ID NO: 917648 - RNA, 12 nt, Homo sapiens
ucaaaaggugcc

SEQ ID NO: 917649 - RNA, 18 nt, Homo sapiens
ucaaaagugaucuguccc

SEQ ID NO: 917650 - RNA, 21 nt, Homo sapiens
ucaaacauauguauacaaauu

SEQ ID NO: 917651 - RNA, 23 nt, Homo sapiens
ucaaacaugaaguguguuuccuu

SEQ ID NO: 917652 - RNA, 18 nt, Homo sapiens
ucaaacugacaaccugug

SEQ ID NO: 917653 - RNA, 19 nt, Homo sapiens
ucaaacugacaaccugugc

SEQ ID NO: 917654 - RNA, 12 nt, Homo sapiens
ucaaacugcucc

SEQ ID NO: 917655 - RNA, 15 nt, Homo sapiens
ucaaacuuuacucua

SEQ ID NO: 917656 - RNA, 15 nt, Homo sapiens
ucaaagacaauggaa

SEQ ID NO: 917657 - RNA, 14 nt, Homo sapiens
ucaaagacauggaa

SEQ ID NO: 917658 - RNA, 22 nt, Homo sapiens
ucaaagagggagugcauuuaug

SEQ ID NO: 917659 - RNA, 22 nt, Homo sapiens
ucaaagcccccacuucucucca

SEQ ID NO: 917660 - RNA, 23 nt, Homo sapiens
ucaaagcccccacuucucuccag

SEQ ID NO: 917661 - RNA, 19 nt, Homo sapiens
ucaaauagauggauuugua

SEQ ID NO: 917662 - RNA, 13 nt, Homo sapiens
ucaaauauuucaa

SEQ ID NO: 917663 - RNA, 21 nt, Homo sapiens
ucaaaucacauggcuuuccac

SEQ ID NO: 917664 - RNA, 16 nt, Homo sapiens
ucaaaugacccaaaga

SEQ ID NO: 917665 - RNA, 17 nt, Homo sapiens
ucaaaugacccaaagac

SEQ ID NO: 917666 - RNA, 17 nt, Homo sapiens
ucaaaugcacaucucau

SEQ ID NO: 917667 - RNA, 16 nt, Homo sapiens
ucaaauguuguucucu

SEQ ID NO: 917668 - RNA, 23 nt, Homo sapiens
ucaaauuugccaccacuagagcu

SEQ ID NO: 917669 - RNA, 19 nt, Homo sapiens
ucaacaaagcacaguguua

SEQ ID NO: 917670 - RNA, 17 nt, Homo sapiens
ucaacaagaguugucuu

SEQ ID NO: 917671 - RNA, 22 nt, Homo sapiens
ucaacacccgccccccccaugu

SEQ ID NO: 917672 - RNA, 16 nt, Homo sapiens
ucaacacucuucuuga

SEQ ID NO: 917673 - RNA, 15 nt, Homo sapiens
ucaaccaauguagaa

SEQ ID NO: 917674 - RNA, 13 nt, Homo sapiens
ucaaccacugugg

SEQ ID NO: 917675 - RNA, 18 nt, Homo sapiens
ucaaccaggaacauguaa

SEQ ID NO: 917676 - RNA, 17 nt, Homo sapiens
ucaaccccagacacugg

SEQ ID NO: 917677 - RNA, 13 nt, Homo sapiens
ucaacgugcauuu

SEQ ID NO: 917678 - RNA, 10 nt, Homo sapiens
ucaacugagg

SEQ ID NO: 917679 - RNA, 19 nt, Homo sapiens
ucaacuucagagacuaucu

SEQ ID NO: 917680 - RNA, 18 nt, Homo sapiens
ucaagaagucugaagcga

SEQ ID NO: 917681 - RNA, 18 nt, Homo sapiens
ucaagacuugauacugca

SEQ ID NO: 917682 - RNA, 15 nt, Homo sapiens
ucaagagacugaguc

SEQ ID NO: 917683 - RNA, 23 nt, Homo sapiens
ucaaggcccggccccaucagagg

SEQ ID NO: 917684 - RNA, 17 nt, Homo sapiens
ucaagggccagucagca

SEQ ID NO: 917685 - RNA, 15 nt, Homo sapiens
ucaaguagaggcaau

SEQ ID NO: 917686 - RNA, 16 nt, Homo sapiens
ucaagucuucccugau

SEQ ID NO: 917687 - RNA, 18 nt, Homo sapiens
ucaaguuaggagcuuuua

SEQ ID NO: 917688 - RNA, 16 nt, Homo sapiens
ucaaguugcuucucau

SEQ ID NO: 917689 - RNA, 23 nt, Homo sapiens
ucaaguuguuccuuaagucagaa

SEQ ID NO: 917690 - RNA, 20 nt, Homo sapiens
ucaauaccccuguuaagcaa

SEQ ID NO: 917691 - RNA, 14 nt, Homo sapiens
ucaauaugugauuu

SEQ ID NO: 917692 - RNA, 20 nt, Homo sapiens
ucaaucaugaguaccucaaa

SEQ ID NO: 917693 - RNA, 15 nt, Homo sapiens
ucaauccucuaagcu

SEQ ID NO: 917694 - RNA, 20 nt, Homo sapiens
ucaaucuucggggugugaug

SEQ ID NO: 917695 - RNA, 12 nt, Homo sapiens
ucaaugaagauu

SEQ ID NO: 917696 - RNA, 22 nt, Homo sapiens
ucaaugaagauuuuuaauuaca

SEQ ID NO: 917697 - RNA, 13 nt, Homo sapiens
ucaaugaccugua

SEQ ID NO: 917698 - RNA, 14 nt, Homo sapiens
ucaaugguaugcaa

SEQ ID NO: 917699 - RNA, 19 nt, Homo sapiens
ucaauuaggcucugaaauc

SEQ ID NO: 917700 - RNA, 21 nt, Homo sapiens
ucaauucuauuacgugcaaua

SEQ ID NO: 917701 - RNA, 15 nt, Homo sapiens
ucaauuuaaauaacc

SEQ ID NO: 917702 - RNA, 19 nt, Homo sapiens
ucacaaaaaggcauaugca

SEQ ID NO: 917703 - RNA, 14 nt, Homo sapiens
ucacaaacuacaaa

SEQ ID NO: 917704 - RNA, 23 nt, Homo sapiens
ucacaaaucuuaacuugaaggag

SEQ ID NO: 917705 - RNA, 13 nt, Homo sapiens
ucacaacaggcau

SEQ ID NO: 917706 - RNA, 18 nt, Homo sapiens
ucacaaccaccuaaucag

SEQ ID NO: 917707 - RNA, 16 nt, Homo sapiens
ucacaaccagccacac

SEQ ID NO: 917708 - RNA, 18 nt, Homo sapiens
ucacaagaaucaccucaa

SEQ ID NO: 917709 - RNA, 22 nt, Homo sapiens
ucacaagcccaggcuggagauc

SEQ ID NO: 917710 - RNA, 13 nt, Homo sapiens
ucacaaguucaau

SEQ ID NO: 917711 - RNA, 20 nt, Homo sapiens
ucacaauaauauauccacau

SEQ ID NO: 917712 - RNA, 16 nt, Homo sapiens
ucacaauuccauuucc

SEQ ID NO: 917713 - RNA, 12 nt, Homo sapiens
ucacacagagau

SEQ ID NO: 917714 - RNA, 22 nt, Homo sapiens
ucacaccauuuuguuuagacaa

SEQ ID NO: 917715 - RNA, 15 nt, Homo sapiens
ucacacccuaauaag

SEQ ID NO: 917716 - RNA, 11 nt, Homo sapiens
ucacacuggug

SEQ ID NO: 917717 - RNA, 19 nt, Homo sapiens
ucacacuguaaacauucau

SEQ ID NO: 917718 - RNA, 20 nt, Homo sapiens
ucacagaaauguuaaacuga

SEQ ID NO: 917719 - RNA, 14 nt, Homo sapiens
ucacagcugcagcu

SEQ ID NO: 917720 - RNA, 19 nt, Homo sapiens
ucacaggacucugccuccu

SEQ ID NO: 917721 - RNA, 21 nt, Homo sapiens
ucacaggcagguccaggguuu

SEQ ID NO: 917722 - RNA, 20 nt, Homo sapiens
ucacagggccccagaaggca

SEQ ID NO: 917723 - RNA, 19 nt, Homo sapiens
ucacaguuagguagcuuua

SEQ ID NO: 917724 - RNA, 15 nt, Homo sapiens
ucacaguuccucgcc

SEQ ID NO: 917725 - RNA, 18 nt, Homo sapiens
ucacaguugacaaaaagc

SEQ ID NO: 917726 - RNA, 20 nt, Homo sapiens
ucacauaacuucucugaguc

SEQ ID NO: 917727 - RNA, 14 nt, Homo sapiens
ucacauauaaaagu

SEQ ID NO: 917728 - RNA, 16 nt, Homo sapiens
ucacaugauaccccuu

SEQ ID NO: 917729 - RNA, 22 nt, Homo sapiens
ucacaugccgcccccagcagcu

SEQ ID NO: 917730 - RNA, 17 nt, Homo sapiens
ucacauggccuaugcac

SEQ ID NO: 917731 - RNA, 19 nt, Homo sapiens
ucacauuuguucaugagug

SEQ ID NO: 917732 - RNA, 16 nt, Homo sapiens
uggugaucagugcaau

SEQ ID NO: 917733 - RNA, 22 nt, Homo sapiens
uggugccuucucacaucugucc

SEQ ID NO: 917734 - RNA, 15 nt, Homo sapiens
uggugcgaucuuggc

SEQ ID NO: 917735 - RNA, 14 nt, Homo sapiens
ugguggaccacagg

SEQ ID NO: 917736 - RNA, 15 nt, Homo sapiens
ugguggagaaccaca

SEQ ID NO: 917737 - RNA, 16 nt, Homo sapiens
ugguggaucuguccaa

SEQ ID NO: 917738 - RNA, 22 nt, Homo sapiens
ugguguauuugccagcuuuauu

SEQ ID NO: 917739 - RNA, 13 nt, Homo sapiens
uggugucaggcag

SEQ ID NO: 917740 - RNA, 21 nt, Homo sapiens
ugguguucaaaaaaacacuag

SEQ ID NO: 917741 - RNA, 17 nt, Homo sapiens
ugguguugacaugugcu

SEQ ID NO: 917742 - RNA, 18 nt, Homo sapiens
ugguguuuacccaguauu

SEQ ID NO: 917743 - RNA, 23 nt, Homo sapiens
ugguuacagcccagacuuuacca

SEQ ID NO: 917744 - RNA, 16 nt, Homo sapiens
ugguuaccgaggaccc

SEQ ID NO: 917745 - RNA, 22 nt, Homo sapiens
ugguuagccuuaguuucucaga

SEQ ID NO: 917746 - RNA, 14 nt, Homo sapiens
ugguucaggguugg

SEQ ID NO: 917747 - RNA, 15 nt, Homo sapiens
ugguuccaagaaaga

SEQ ID NO: 917748 - RNA, 19 nt, Homo sapiens
ugguuccaagaaagaucca

SEQ ID NO: 917749 - RNA, 15 nt, Homo sapiens
ugguugcauuuguca

SEQ ID NO: 917750 - RNA, 20 nt, Homo sapiens
ugguuggccgugguccagcu

SEQ ID NO: 917751 - RNA, 14 nt, Homo sapiens
ugguuuacugcugu

SEQ ID NO: 917752 - RNA, 19 nt, Homo sapiens
ugguuuauauaaggcagua

SEQ ID NO: 917753 - RNA, 18 nt, Homo sapiens
ugguuucaguugacaaaa

SEQ ID NO: 917754 - RNA, 18 nt, Homo sapiens
ugguuucccaagagcuac

SEQ ID NO: 917755 - RNA, 19 nt, Homo sapiens
ugguuuuuggcucuuucag

SEQ ID NO: 917756 - RNA, 20 nt, Homo sapiens
uguaaaauaaguauuuccau

SEQ ID NO: 917757 - RNA, 21 nt, Homo sapiens
uguaaaauauuuaugagaaag

SEQ ID NO: 917758 - RNA, 21 nt, Homo sapiens
uguaaacagcuaauaaugaag

SEQ ID NO: 917759 - RNA, 19 nt, Homo sapiens
uguaaacauaauucuugua

SEQ ID NO: 917760 - RNA, 16 nt, Homo sapiens
uguaaacccucaaggg

SEQ ID NO: 917761 - RNA, 16 nt, Homo sapiens
uguaaauuauuucaua

SEQ ID NO: 917762 - RNA, 15 nt, Homo sapiens
uguaacaagccagau

SEQ ID NO: 917763 - RNA, 16 nt, Homo sapiens
uguaacacugcaagaa

SEQ ID NO: 917764 - RNA, 17 nt, Homo sapiens
uguaacagguaaccaca

SEQ ID NO: 917765 - RNA, 12 nt, Homo sapiens
uguaaccaaaaa

SEQ ID NO: 917766 - RNA, 20 nt, Homo sapiens
uguaagcaacuugcuucuaa

SEQ ID NO: 917767 - RNA, 16 nt, Homo sapiens
uguaauaaacucucua

SEQ ID NO: 917768 - RNA, 18 nt, Homo sapiens
uguaaucaguuuuaucca

SEQ ID NO: 917769 - RNA, 17 nt, Homo sapiens
uguaaucccagcacuuu

SEQ ID NO: 917770 - RNA, 17 nt, Homo sapiens
uguaaucccagcuacau

SEQ ID NO: 917771 - RNA, 17 nt, Homo sapiens
uguaaugucaccaccuu

SEQ ID NO: 917772 - RNA, 15 nt, Homo sapiens
uguacaaagauaugc

SEQ ID NO: 917773 - RNA, 15 nt, Homo sapiens
uguacacacacagau

SEQ ID NO: 917774 - RNA, 21 nt, Homo sapiens
uguacacacacagaugcacac

SEQ ID NO: 917775 - RNA, 23 nt, Homo sapiens
uguacacacacagaugcacacac

SEQ ID NO: 917776 - RNA, 23 nt, Homo sapiens
uguacacacggaccaugugguau

SEQ ID NO: 917777 - RNA, 19 nt, Homo sapiens
uguacagaguaaguucuca

SEQ ID NO: 917778 - RNA, 12 nt, Homo sapiens
uguacauuucac

SEQ ID NO: 917779 - RNA, 18 nt, Homo sapiens
uguacauuucacaaaaag

SEQ ID NO: 917780 - RNA, 15 nt, Homo sapiens
uguaccacaaacaca

SEQ ID NO: 917781 - RNA, 18 nt, Homo sapiens
uguaccauacacauugga

SEQ ID NO: 917782 - RNA, 17 nt, Homo sapiens
uguacuuccuguguacu

SEQ ID NO: 917783 - RNA, 19 nt, Homo sapiens
uguacuuuaaaaagaugua

SEQ ID NO: 917784 - RNA, 14 nt, Homo sapiens
uguagaacugagaa

SEQ ID NO: 917785 - RNA, 17 nt, Homo sapiens
uguagaauaaaugaaga

SEQ ID NO: 917786 - RNA, 15 nt, Homo sapiens
uguagaaugauuuca

SEQ ID NO: 917787 - RNA, 15 nt, Homo sapiens
uguagaccacugucc

SEQ ID NO: 917788 - RNA, 22 nt, Homo sapiens
uguagcaucuucuggagucucc

SEQ ID NO: 917789 - RNA, 22 nt, Homo sapiens
uguagcauuucuugauguugcu

SEQ ID NO: 917790 - RNA, 13 nt, Homo sapiens
uguagcugaugaa

SEQ ID NO: 917791 - RNA, 16 nt, Homo sapiens
uguagcuuuauccuua

SEQ ID NO: 917792 - RNA, 15 nt, Homo sapiens
uguagcuuugcucuu

SEQ ID NO: 917793 - RNA, 20 nt, Homo sapiens
uguaggcaauacauguaucu

SEQ ID NO: 917794 - RNA, 22 nt, Homo sapiens
uguagguaaaucuaguuuacuu

SEQ ID NO: 917795 - RNA, 15 nt, Homo sapiens
uguagguaauauugu

SEQ ID NO: 917796 - RNA, 17 nt, Homo sapiens
uguaguucuugugcaug

SEQ ID NO: 917797 - RNA, 21 nt, Homo sapiens
uguauaaccccaccuugccaa

SEQ ID NO: 917798 - RNA, 13 nt, Homo sapiens
uguauaauggugu

SEQ ID NO: 917799 - RNA, 18 nt, Homo sapiens
uguauacuguacugagac

SEQ ID NO: 917800 - RNA, 23 nt, Homo sapiens
uguauccccccccuguauaguua

SEQ ID NO: 917801 - RNA, 13 nt, Homo sapiens
uguauccugauaa

SEQ ID NO: 917802 - RNA, 19 nt, Homo sapiens
uguaucuaccucacuauuc

SEQ ID NO: 917803 - RNA, 13 nt, Homo sapiens
uguaucuaugcau

SEQ ID NO: 917804 - RNA, 22 nt, Homo sapiens
uguaugaaaauuccugugauuu

SEQ ID NO: 917805 - RNA, 20 nt, Homo sapiens
uguaugauuacaucaaggcu

SEQ ID NO: 917806 - RNA, 12 nt, Homo sapiens
uguaugcacuuu

SEQ ID NO: 917807 - RNA, 14 nt, Homo sapiens
uguaugcaucuaua

SEQ ID NO: 917808 - RNA, 16 nt, Homo sapiens
uguaugcauucaucca

SEQ ID NO: 917809 - RNA, 22 nt, Homo sapiens
uguauguuuacauaucaccuca

SEQ ID NO: 917810 - RNA, 22 nt, Homo sapiens
uguauguuuuaauugcauuuaa

SEQ ID NO: 917811 - RNA, 23 nt, Homo sapiens
uguauuaauguguuaagugcagg

SEQ ID NO: 917812 - RNA, 19 nt, Homo sapiens
uguauucaugaacuuggcu

SEQ ID NO: 917813 - RNA, 15 nt, Homo sapiens
uguauuuaacugccu

SEQ ID NO: 917814 - RNA, 17 nt, Homo sapiens
uguauuuuuguacccuu

SEQ ID NO: 917815 - RNA, 21 nt, Homo sapiens
ugucaaagcauugagaucucc

SEQ ID NO: 917816 - RNA, 17 nt, Homo sapiens
ugucaaguauaaaguca

SEQ ID NO: 917817 - RNA, 13 nt, Homo sapiens
ugucaauaccccu

SEQ ID NO: 917818 - RNA, 19 nt, Homo sapiens
ugucaccguggaccuuccu

SEQ ID NO: 917819 - RNA, 19 nt, Homo sapiens
ugucaccucagcugauauu

SEQ ID NO: 917820 - RNA, 20 nt, Homo sapiens
ugucagagcugggaguagca

SEQ ID NO: 917821 - RNA, 17 nt, Homo sapiens
ugucagaguagaagauu

SEQ ID NO: 917822 - RNA, 13 nt, Homo sapiens
ugucauauggaau

SEQ ID NO: 917823 - RNA, 13 nt, Homo sapiens
ugucauccagaaa

SEQ ID NO: 917824 - RNA, 15 nt, Homo sapiens
ugucauucauuuaau

SEQ ID NO: 917825 - RNA, 17 nt, Homo sapiens
uguccaacaacuccagg

SEQ ID NO: 917826 - RNA, 20 nt, Homo sapiens
uguccagaggcugcaaggau

SEQ ID NO: 917827 - RNA, 12 nt, Homo sapiens
uguccagcagcc

SEQ ID NO: 917828 - RNA, 19 nt, Homo sapiens
ugucccaccaacucugcac

SEQ ID NO: 917829 - RNA, 14 nt, Homo sapiens
uguccccaccucag

SEQ ID NO: 917830 - RNA, 16 nt, Homo sapiens
uguccccuccacuguc

SEQ ID NO: 917831 - RNA, 17 nt, Homo sapiens
uguccccuccacuguca

SEQ ID NO: 917832 - RNA, 18 nt, Homo sapiens
uguccccuccacugucac

SEQ ID NO: 917833 - RNA, 12 nt, Homo sapiens
uguccucagggg

SEQ ID NO: 917834 - RNA, 13 nt, Homo sapiens
ugucguagccaag

SEQ ID NO: 917835 - RNA, 16 nt, Homo sapiens
ugucuauguauguuau

SEQ ID NO: 917836 - RNA, 15 nt, Homo sapiens
ugucucaacuacuca

SEQ ID NO: 917837 - RNA, 17 nt, Homo sapiens
ugucucagaccacuauu

SEQ ID NO: 917838 - RNA, 18 nt, Homo sapiens
ugucucagaccacuauuc

SEQ ID NO: 917839 - RNA, 13 nt, Homo sapiens
ugucucagccucc

SEQ ID NO: 917840 - RNA, 19 nt, Homo sapiens
ugucuccaucucugucuca

SEQ ID NO: 917841 - RNA, 22 nt, Homo sapiens
ugucuccuccagcgugguggaa

SEQ ID NO: 917842 - RNA, 9 nt, Homo sapiens
ugucucucu

SEQ ID NO: 917843 - RNA, 11 nt, Homo sapiens
ugucugaagac

SEQ ID NO: 917844 - RNA, 21 nt, Homo sapiens
ugucugauuggcucacccaag

SEQ ID NO: 917845 - RNA, 22 nt, Homo sapiens
ugucuguaucggagacagugau

SEQ ID NO: 917846 - RNA, 15 nt, Homo sapiens
ugucugucaccagcu

SEQ ID NO: 917847 - RNA, 20 nt, Homo sapiens
uucagaacagaggcauuuaa

SEQ ID NO: 917848 - RNA, 17 nt, Homo sapiens
uucagaacauccuccaa

SEQ ID NO: 917849 - RNA, 14 nt, Homo sapiens
uucagaagacacug

SEQ ID NO: 917850 - RNA, 15 nt, Homo sapiens
uucagaagacacugc

SEQ ID NO: 917851 - RNA, 21 nt, Homo sapiens
uucagaagccccauuugcaca

SEQ ID NO: 917852 - RNA, 17 nt, Homo sapiens
uucagaagguugcucua

SEQ ID NO: 917853 - RNA, 23 nt, Homo sapiens
uucagaauguacggaaagaugau

SEQ ID NO: 917854 - RNA, 18 nt, Homo sapiens
uucagaccagugaaagag

SEQ ID NO: 917855 - RNA, 13 nt, Homo sapiens
uucagagauguac

SEQ ID NO: 917856 - RNA, 19 nt, Homo sapiens
uucagagugacacccaaga

SEQ ID NO: 917857 - RNA, 17 nt, Homo sapiens
uucagauuccacacaaa

SEQ ID NO: 917858 - RNA, 20 nt, Homo sapiens
uucagcacccugggugccau

SEQ ID NO: 917859 - RNA, 19 nt, Homo sapiens
uucagccauugcccuguga

SEQ ID NO: 917860 - RNA, 14 nt, Homo sapiens
uucagccccuccuc

SEQ ID NO: 917861 - RNA, 21 nt, Homo sapiens
uucagccuagccgaccucagc

SEQ ID NO: 917862 - RNA, 16 nt, Homo sapiens
uucagccucucccacc

SEQ ID NO: 917863 - RNA, 23 nt, Homo sapiens
uucagcuucagacuuuuaucaaa

SEQ ID NO: 917864 - RNA, 21 nt, Homo sapiens
uucaggaagguacaaacacaa

SEQ ID NO: 917865 - RNA, 16 nt, Homo sapiens
uucaggacuggcucac

SEQ ID NO: 917866 - RNA, 18 nt, Homo sapiens
uucaggaguuggagacca

SEQ ID NO: 917867 - RNA, 18 nt, Homo sapiens
uucagggaauuucaggaa

SEQ ID NO: 917868 - RNA, 13 nt, Homo sapiens
uucaggugcuuuu

SEQ ID NO: 917869 - RNA, 20 nt, Homo sapiens
uucaggugcuuuugauguga

SEQ ID NO: 917870 - RNA, 16 nt, Homo sapiens
uucaguggugugaucu

SEQ ID NO: 917871 - RNA, 19 nt, Homo sapiens
uucaguugaucacuggcaa

SEQ ID NO: 917872 - RNA, 21 nt, Homo sapiens
uucaguuggcugacuuccaca

SEQ ID NO: 917873 - RNA, 14 nt, Homo sapiens
uucaucaagcugua

SEQ ID NO: 917874 - RNA, 20 nt, Homo sapiens
uucaucagacuccugugcaa

SEQ ID NO: 917875 - RNA, 14 nt, Homo sapiens
uucaucaugacaac

SEQ ID NO: 917876 - RNA, 15 nt, Homo sapiens
uucauccguguaacc

SEQ ID NO: 917877 - RNA, 17 nt, Homo sapiens
uucaucuucaaccuuaa

SEQ ID NO: 917878 - RNA, 21 nt, Homo sapiens
uucaugaacacagccugggac

SEQ ID NO: 917879 - RNA, 15 nt, Homo sapiens
uucaugaacuuggcu

SEQ ID NO: 917880 - RNA, 16 nt, Homo sapiens
uucaugagcugaguga

SEQ ID NO: 917881 - RNA, 19 nt, Homo sapiens
uucauggugaaaauguacu

SEQ ID NO: 917882 - RNA, 14 nt, Homo sapiens
uucauguuacucau

SEQ ID NO: 917883 - RNA, 21 nt, Homo sapiens
uucauugaccaagaugaucac

SEQ ID NO: 917884 - RNA, 19 nt, Homo sapiens
uucauuucagauaaacaac

SEQ ID NO: 917885 - RNA, 14 nt, Homo sapiens
uucauuuccgugaa

SEQ ID NO: 917886 - RNA, 20 nt, Homo sapiens
uucauuucuuuucauuguaa

SEQ ID NO: 917887 - RNA, 20 nt, Homo sapiens
uucauuuuaacaucugagaa

SEQ ID NO: 917888 - RNA, 17 nt, Homo sapiens
uucauuuuuuucacugg

SEQ ID NO: 917889 - RNA, 16 nt, Homo sapiens
uuccaaaaugccaaau

SEQ ID NO: 917890 - RNA, 21 nt, Homo sapiens
uuccaaaccugacagauguca

SEQ ID NO: 917891 - RNA, 19 nt, Homo sapiens
uuccaaaucuuaauucaac

SEQ ID NO: 917892 - RNA, 14 nt, Homo sapiens
uuccaaaugaauga

SEQ ID NO: 917893 - RNA, 23 nt, Homo sapiens
uuccaacaauggggugggcccau

SEQ ID NO: 917894 - RNA, 13 nt, Homo sapiens
uuccaaugcauug

SEQ ID NO: 917895 - RNA, 19 nt, Homo sapiens
uuccacucaauaugugauu

SEQ ID NO: 917896 - RNA, 22 nt, Homo sapiens
uuccagaauuaugaggcauuga

SEQ ID NO: 917897 - RNA, 12 nt, Homo sapiens
uuccagcaugca

SEQ ID NO: 917898 - RNA, 15 nt, Homo sapiens
uuccagcaugcaucc

SEQ ID NO: 917899 - RNA, 20 nt, Homo sapiens
uuccagcauuugccauuccu

SEQ ID NO: 917900 - RNA, 17 nt, Homo sapiens
uuccagugcauguugcc

SEQ ID NO: 917901 - RNA, 19 nt, Homo sapiens
uuccauaaacacccaugaa

SEQ ID NO: 917902 - RNA, 19 nt, Homo sapiens
uuccauaaucuggacuccu

SEQ ID NO: 917903 - RNA, 15 nt, Homo sapiens
uuccaugaagaccac

SEQ ID NO: 917904 - RNA, 23 nt, Homo sapiens
uuccaugucgccucugcauucag

SEQ ID NO: 917905 - RNA, 15 nt, Homo sapiens
uuccauuccaagccu

SEQ ID NO: 917906 - RNA, 13 nt, Homo sapiens
uuccauuuaguaa

SEQ ID NO: 917907 - RNA, 17 nt, Homo sapiens
uucccaacaacauccau

SEQ ID NO: 917908 - RNA, 20 nt, Homo sapiens
uucccaauaaaagugacucu

SEQ ID NO: 917909 - RNA, 20 nt, Homo sapiens
uucccaaucagcacugaaaa

SEQ ID NO: 917910 - RNA, 19 nt, Homo sapiens
uucccacagcacuaauuca

SEQ ID NO: 917911 - RNA, 13 nt, Homo sapiens
uucccacauucau

SEQ ID NO: 917912 - RNA, 12 nt, Homo sapiens
uucccauccaua

SEQ ID NO: 917913 - RNA, 17 nt, Homo sapiens
uucccauucuacauacu

SEQ ID NO: 917914 - RNA, 17 nt, Homo sapiens
uuccccaaaggcaucca

SEQ ID NO: 917915 - RNA, 15 nt, Homo sapiens
uuccccacucaauga

SEQ ID NO: 917916 - RNA, 13 nt, Homo sapiens
uuccccagugugg

SEQ ID NO: 917917 - RNA, 23 nt, Homo sapiens
uucccccacuugggagcuuguau

SEQ ID NO: 917918 - RNA, 12 nt, Homo sapiens
uucccccaguca

SEQ ID NO: 917919 - RNA, 17 nt, Homo sapiens
uuccccucagagcucuu

SEQ ID NO: 917920 - RNA, 14 nt, Homo sapiens
uuccccuccugacc

SEQ ID NO: 917921 - RNA, 18 nt, Homo sapiens
uuccccucuguguccucu

SEQ ID NO: 917922 - RNA, 21 nt, Homo sapiens
uuccccuugcccagggcucag

SEQ ID NO: 917923 - RNA, 16 nt, Homo sapiens
uucccgggaucacuua

SEQ ID NO: 917924 - RNA, 19 nt, Homo sapiens
uucccucuggcacuccaga

SEQ ID NO: 917925 - RNA, 17 nt, Homo sapiens
uucccuuugagguugcu

SEQ ID NO: 917926 - RNA, 20 nt, Homo sapiens
uuccuaauaaguuugaucaa

SEQ ID NO: 917927 - RNA, 19 nt, Homo sapiens
uuccuaauaugcuuuacaa

SEQ ID NO: 917928 - RNA, 23 nt, Homo sapiens
uuccuacacccuuggacuugagg

SEQ ID NO: 917929 - RNA, 17 nt, Homo sapiens
uuccuacccaaccacuc

SEQ ID NO: 917930 - RNA, 12 nt, Homo sapiens
uuccucaccaau

SEQ ID NO: 917931 - RNA, 13 nt, Homo sapiens
uuccucagaucau

SEQ ID NO: 917932 - RNA, 16 nt, Homo sapiens
uuccucaguccuggaa

SEQ ID NO: 917933 - RNA, 19 nt, Homo sapiens
uuccucccuauuaaccuag

SEQ ID NO: 917934 - RNA, 20 nt, Homo sapiens
uuccuccgucaccucagaga

SEQ ID NO: 917935 - RNA, 21 nt, Homo sapiens
uuccuccuaaauuuccagggg

SEQ ID NO: 917936 - RNA, 22 nt, Homo sapiens
uuccucuauccuguacauuuca

SEQ ID NO: 917937 - RNA, 12 nt, Homo sapiens
uuccucugucaa

SEQ ID NO: 917938 - RNA, 19 nt, Homo sapiens
uuccucuguucuaucccac

SEQ ID NO: 917939 - RNA, 21 nt, Homo sapiens
uuccugacugacacaggccag

SEQ ID NO: 917940 - RNA, 13 nt, Homo sapiens
uuccugcacucca

SEQ ID NO: 917941 - RNA, 14 nt, Homo sapiens
uuccugccaccagu

SEQ ID NO: 917942 - RNA, 18 nt, Homo sapiens
uuccugcuacacaaaagc

SEQ ID NO: 917943 - RNA, 11 nt, Homo sapiens
uuccugugaaa

SEQ ID NO: 917944 - RNA, 17 nt, Homo sapiens
uuccuguugaaucuugc

SEQ ID NO: 917945 - RNA, 23 nt, Homo sapiens
uuccuuacucccaggcacugucu

SEQ ID NO: 917946 - RNA, 15 nt, Homo sapiens
uuccuucacauuuaa

SEQ ID NO: 917947 - RNA, 14 nt, Homo sapiens
uuccuucacucauc

SEQ ID NO: 917948 - RNA, 16 nt, Homo sapiens
uuccuucccugggaag

SEQ ID NO: 917949 - RNA, 20 nt, Homo sapiens
uuccuucuuucucuucccuc

SEQ ID NO: 917950 - RNA, 17 nt, Homo sapiens
uuccuugaucuguauau

SEQ ID NO: 917951 - RNA, 21 nt, Homo sapiens
uuccuugauggagauauuuac

SEQ ID NO: 917952 - RNA, 15 nt, Homo sapiens
uucgaaugacacugu

SEQ ID NO: 917953 - RNA, 19 nt, Homo sapiens
uucgagaccagccugacca

SEQ ID NO: 917954 - RNA, 16 nt, Homo sapiens
uucgauggcauccugc

SEQ ID NO: 917955 - RNA, 17 nt, Homo sapiens
uucgauggcauccugca

SEQ ID NO: 917956 - RNA, 21 nt, Homo sapiens
uucgggagggcacucacaugc

SEQ ID NO: 917957 - RNA, 22 nt, Homo sapiens
uucgggagggcacucacaugcc

SEQ ID NO: 917958 - RNA, 16 nt, Homo sapiens
uucgugccccagagau

SEQ ID NO: 917959 - RNA, 23 nt, Homo sapiens
uucuaaaugaauguuuacacucu

SEQ ID NO: 917960 - RNA, 20 nt, Homo sapiens
uucuaacauguuuugugcag

SEQ ID NO: 917961 - RNA, 16 nt, Homo sapiens
aaaguacaaccugaau

SEQ ID NO: 917962 - RNA, 15 nt, Homo sapiens
aaauauaaacuugug

SEQ ID NO: 917963 - RNA, 18 nt, Homo sapiens
aaauauacaaacaugugg

SEQ ID NO: 917964 - RNA, 18 nt, Homo sapiens
aaaugcaaacacugugua

SEQ ID NO: 917965 - RNA, 21 nt, Homo sapiens
aacaccacuuugucucugaga

SEQ ID NO: 917966 - RNA, 17 nt, Homo sapiens
aacacccuuuccaaagc

SEQ ID NO: 917967 - RNA, 21 nt, Homo sapiens
aacauguggcaaccuguucuu

SEQ ID NO: 917968 - RNA, 17 nt, Homo sapiens
aacuggaauccuuucag

SEQ ID NO: 917969 - RNA, 14 nt, Homo sapiens
aagagcccugucag

SEQ ID NO: 917970 - RNA, 19 nt, Homo sapiens
aagugaccuauaccugugu

SEQ ID NO: 917971 - RNA, 17 nt, Homo sapiens
aauugugcgacuucaca

SEQ ID NO: 917972 - RNA, 15 nt, Homo sapiens
acauucccccaacau

SEQ ID NO: 917973 - RNA, 19 nt, Homo sapiens
accacuuugucucugagaa

SEQ ID NO: 917974 - RNA, 23 nt, Homo sapiens
accuauaccuguguuucuugccu

SEQ ID NO: 917975 - RNA, 13 nt, Homo sapiens
acuuccuuugaga

SEQ ID NO: 917976 - RNA, 13 nt, Homo sapiens
acuucucuagaga

SEQ ID NO: 917977 - RNA, 17 nt, Homo sapiens
agaaacuuccuuugaga

SEQ ID NO: 917978 - RNA, 16 nt, Homo sapiens
agaagguggacagauu

SEQ ID NO: 917979 - RNA, 14 nt, Homo sapiens
agaagucucuucca

SEQ ID NO: 917980 - RNA, 19 nt, Homo sapiens
agacuucucuuugccucaa

SEQ ID NO: 917981 - RNA, 16 nt, Homo sapiens
agcccccuacugagaa

SEQ ID NO: 917982 - RNA, 11 nt, Homo sapiens
agcugccaaaa

SEQ ID NO: 917983 - RNA, 13 nt, Homo sapiens
auaaaaacauaaa

SEQ ID NO: 917984 - RNA, 21 nt, Homo sapiens
auaaaauauacaaacaugugg

SEQ ID NO: 917985 - RNA, 14 nt, Homo sapiens
auaaauguguaaau

SEQ ID NO: 917986 - RNA, 17 nt, Homo sapiens
auaaauguguaaaugug

SEQ ID NO: 917987 - RNA, 22 nt, Homo sapiens
auaccuguguuucuugccucau

SEQ ID NO: 917988 - RNA, 15 nt, Homo sapiens
auauacaaacaugug

SEQ ID NO: 917989 - RNA, 15 nt, Homo sapiens
augacaucaacauuc

SEQ ID NO: 917990 - RNA, 19 nt, Homo sapiens
auuacuccauuacuaaaga

SEQ ID NO: 917991 - RNA, 24 nt, Homo sapiens
auuuauuaguuaggugugccaaac

SEQ ID NO: 917992 - RNA, 17 nt, Homo sapiens
caaauaaauguguaaau

SEQ ID NO: 917993 - RNA, 21 nt, Homo sapiens
caaccuguucuuccuaccaaa

SEQ ID NO: 917994 - RNA, 15 nt, Homo sapiens
caccacuuugucucu

SEQ ID NO: 917995 - RNA, 21 nt, Homo sapiens
cagcaagacuucucuuugccu

SEQ ID NO: 917996 - RNA, 11 nt, Homo sapiens
ccaaagcaaau

SEQ ID NO: 917997 - RNA, 19 nt, Homo sapiens
ccaaauauaaacuugugua

SEQ ID NO: 917998 - RNA, 21 nt, Homo sapiens
ccuauaccuguguuucuugcc

SEQ ID NO: 917999 - RNA, 17 nt, Homo sapiens
ccugugucacucagcag

SEQ ID NO: 918000 - RNA, 14 nt, Homo sapiens
cuaaacccaaauaa

SEQ ID NO: 918001 - RNA, 12 nt, Homo sapiens
cuaaagacagaa

SEQ ID NO: 918002 - RNA, 23 nt, Homo sapiens
cuacccugcuggggaaaguacaa

SEQ ID NO: 918003 - RNA, 15 nt, Homo sapiens
cuagagaacaugccc

SEQ ID NO: 918004 - RNA, 20 nt, Homo sapiens
cucaaauaaaaagugcuuuu

SEQ ID NO: 918005 - RNA, 15 nt, Homo sapiens
cuccauuacuaaaga

SEQ ID NO: 918006 - RNA, 16 nt, Homo sapiens
cucucuaaacccaaau

SEQ ID NO: 918007 - RNA, 17 nt, Homo sapiens
cucucuaaacccaaaua

SEQ ID NO: 918008 - RNA, 22 nt, Homo sapiens
cucuucagaauauggacaaaga

SEQ ID NO: 918009 - RNA, 19 nt, Homo sapiens
cugaccaaagagaagcaaa

SEQ ID NO: 918010 - RNA, 20 nt, Homo sapiens
cuucagaauauggacaaaga

SEQ ID NO: 918011 - RNA, 15 nt, Homo sapiens
cuuccuaccaaauau

SEQ ID NO: 918012 - RNA, 22 nt, Homo sapiens
gaaacuuccuuugagaauugug

SEQ ID NO: 918013 - RNA, 13 nt, Homo sapiens
gaagucucuucca

SEQ ID NO: 918014 - RNA, 22 nt, Homo sapiens
gaggccccuccugcccaaguga

SEQ ID NO: 918015 - RNA, 18 nt, Homo sapiens
gcaagacuucucuuugcc

SEQ ID NO: 918016 - RNA, 22 nt, Homo sapiens
gcaagacuucucuuugccucaa

SEQ ID NO: 918017 - RNA, 22 nt, Homo sapiens
gccugccagcugggcuuggaag

SEQ ID NO: 918018 - RNA, 16 nt, Homo sapiens
guagaagucucuucca

SEQ ID NO: 918019 - RNA, 17 nt, Homo sapiens
gucucuuccaguuugcu

SEQ ID NO: 918020 - RNA, 19 nt, Homo sapiens
gugucacucagcaguggga

SEQ ID NO: 918021 - RNA, 21 nt, Homo sapiens
uaaaaacauaaaauauacaaa

SEQ ID NO: 918022 - RNA, 15 nt, Homo sapiens
uaaaauauacaaaca

SEQ ID NO: 918023 - RNA, 15 nt, Homo sapiens
uagaagucucuucca

SEQ ID NO: 918024 - RNA, 14 nt, Homo sapiens
uaggugugccaaac

SEQ ID NO: 918025 - RNA, 21 nt, Homo sapiens
uauuaguuaggugugccaaac

SEQ ID NO: 918026 - RNA, 13 nt, Homo sapiens
ucaaauaaaaagu

SEQ ID NO: 918027 - RNA, 18 nt, Homo sapiens
uccccaagugaccuauac

SEQ ID NO: 918028 - RNA, 14 nt, Homo sapiens
ucuaaacccaaaua

SEQ ID NO: 918029 - RNA, 15 nt, Homo sapiens
ucuagagaacaugcc

SEQ ID NO: 918030 - RNA, 14 nt, Homo sapiens
ucucugagaacaga

SEQ ID NO: 918031 - RNA, 21 nt, Homo sapiens
ucuucagaauauggacaaaga

SEQ ID NO: 918032 - RNA, 20 nt, Homo sapiens
ucuuccuaccaaauauaaac

SEQ ID NO: 918033 - RNA, 13 nt, Homo sapiens
ugucucugagaac

SEQ ID NO: 918034 - RNA, 18 nt, Homo sapiens
uguucucaaaugcuaaau

SEQ ID NO: 918035 - RNA, 17 nt, Homo sapiens
uuaucuguguugucucu

SEQ ID NO: 918036 - RNA, 14 nt, Homo sapiens
uucucuuugccuca

SEQ ID NO: 918037 - RNA, 12 nt, Homo sapiens
uucuugccucau

SEQ ID NO: 918038 - RNA, 22 nt, Homo sapiens
uugcacgugcucuucuguucuc

SEQ ID NO: 918039 - RNA, 22 nt, Homo sapiens
uugucucucuaaacccaaauaa

SEQ ID NO: 918040 - RNA, 13 nt, Homo sapiens
uuuccuugcaaau

SEQ ID NO: 918041 - RNA, 12 nt, Homo sapiens
uuucuugccuca

SEQ ID NO: 918042 - RNA, 12 nt, Homo sapiens
aaacccaaauaa

SEQ ID NO: 918043 - RNA, 16 nt, Homo sapiens
aaauauaaacuugugu

SEQ ID NO: 918044 - RNA, 14 nt, Homo sapiens
aaauauacaaacau

SEQ ID NO: 918045 - RNA, 13 nt, Homo sapiens
aaaugcaagguga

SEQ ID NO: 918046 - RNA, 23 nt, Homo sapiens
aaaugcaaggugaacaccacuuu

SEQ ID NO: 918047 - RNA, 22 nt, Homo sapiens
aacaccacuuugucucugagaa

SEQ ID NO: 918048 - RNA, 18 nt, Homo sapiens
aagcccccuacugagaaa

SEQ ID NO: 918049 - RNA, 22 nt, Homo sapiens
aaguacaaccugaauacccuuu

SEQ ID NO: 918050 - RNA, 15 nt, Homo sapiens
aauauaguagcagga

SEQ ID NO: 918051 - RNA, 19 nt, Homo sapiens
aauauggacaaagaaggca

SEQ ID NO: 918052 - RNA, 14 nt, Homo sapiens
aaucguagguguug

SEQ ID NO: 918053 - RNA, 16 nt, Homo sapiens
acaccacuuugucucu

SEQ ID NO: 918054 - RNA, 10 nt, Homo sapiens
acagauuugg

SEQ ID NO: 918055 - RNA, 12 nt, Homo sapiens
acagguguaaau

SEQ ID NO: 918056 - RNA, 14 nt, Homo sapiens
acaucaacauuccc

SEQ ID NO: 918057 - RNA, 14 nt, Homo sapiens
accagcugccaaaa

SEQ ID NO: 918058 - RNA, 15 nt, Homo sapiens
accaggucaaaauag

SEQ ID NO: 918059 - RNA, 20 nt, Homo sapiens
acccaaauaaauguguaaau

SEQ ID NO: 918060 - RNA, 18 nt, Homo sapiens
acugcuuggaacuggaau

SEQ ID NO: 918061 - RNA, 16 nt, Homo sapiens
acuucucuuugccuca

SEQ ID NO: 918062 - RNA, 18 nt, Homo sapiens
agaagcaaaaucuaccag

SEQ ID NO: 918063 - RNA, 18 nt, Homo sapiens
agcaagacuucucuuugc

SEQ ID NO: 918064 - RNA, 19 nt, Homo sapiens
agcaagacuucucuuugcc

SEQ ID NO: 918065 - RNA, 17 nt, Homo sapiens
agcuguuccacuucucu

SEQ ID NO: 918066 - RNA, 13 nt, Homo sapiens
agguggacagauu

SEQ ID NO: 918067 - RNA, 13 nt, Homo sapiens
aggugugccaaac

SEQ ID NO: 918068 - RNA, 16 nt, Homo sapiens
aggugugccaaacuac

SEQ ID NO: 918069 - RNA, 17 nt, Homo sapiens
aguuaggugugccaaac

SEQ ID NO: 918070 - RNA, 22 nt, Homo sapiens
aucaacauucccccaacauuac

SEQ ID NO: 918071 - RNA, 16 nt, Homo sapiens
augacaucaacauucc

SEQ ID NO: 918072 - RNA, 13 nt, Homo sapiens
caaacacugugua

SEQ ID NO: 918073 - RNA, 22 nt, Homo sapiens
caaagaaggcacagguguaaau

SEQ ID NO: 918074 - RNA, 13 nt, Homo sapiens
caaauuccccucc

SEQ ID NO: 918075 - RNA, 21 nt, Homo sapiens
caacauuacuccauuacuaaa

SEQ ID NO: 918076 - RNA, 12 nt, Homo sapiens
cacaaaaugcaa

SEQ ID NO: 918077 - RNA, 13 nt, Homo sapiens
cacagguguaaau

SEQ ID NO: 918078 - RNA, 20 nt, Homo sapiens
caccacuuugucucugagaa

SEQ ID NO: 918079 - RNA, 21 nt, Homo sapiens
cacuucucuagagaacaugcc

SEQ ID NO: 918080 - RNA, 22 nt, Homo sapiens
cagaaaaaaauaaaaacauaaa

SEQ ID NO: 918081 - RNA, 20 nt, Homo sapiens
cagauuugggaggccccucc

SEQ ID NO: 918082 - RNA, 13 nt, Homo sapiens
caguagaguagaa

SEQ ID NO: 918083 - RNA, 16 nt, Homo sapiens
caguuugcuuugcccu

SEQ ID NO: 918084 - RNA, 17 nt, Homo sapiens
ccaaaaucguagguguu

SEQ ID NO: 918085 - RNA, 23 nt, Homo sapiens
ccaacauuacuccauuacuaaag

SEQ ID NO: 918086 - RNA, 21 nt, Homo sapiens
ccaagcuguuccacuucucua

SEQ ID NO: 918087 - RNA, 16 nt, Homo sapiens
ccacuuugucucugag

SEQ ID NO: 918088 - RNA, 16 nt, Homo sapiens
ccaguuugcuuugccc

SEQ ID NO: 918089 - RNA, 14 nt, Homo sapiens
ccccaagugaccua

SEQ ID NO: 918090 - RNA, 13 nt, Homo sapiens
cccuacugagaaa

SEQ ID NO: 918091 - RNA, 23 nt, Homo sapiens
ccugggaauuuacagagccugcc

SEQ ID NO: 918092 - RNA, 17 nt, Homo sapiens
ccuguguuucuugccuc

SEQ ID NO: 918093 - RNA, 19 nt, Homo sapiens
ccuguucuuccuaccaaau

SEQ ID NO: 918094 - RNA, 18 nt, Homo sapiens
cugaccaaagagaagcaa

SEQ ID NO: 918095 - RNA, 13 nt, Homo sapiens
cuguguugucucu

SEQ ID NO: 918096 - RNA, 17 nt, Homo sapiens
cuguguuucuugccuca

SEQ ID NO: 918097 - RNA, 19 nt, Homo sapiens
cuguuccacuucucuagag

SEQ ID NO: 918098 - RNA, 19 nt, Homo sapiens
cuguucuuccuaccaaaua

SEQ ID NO: 918099 - RNA, 17 nt, Homo sapiens
cuugauguuggaucuca

SEQ ID NO: 918100 - RNA, 18 nt, Homo sapiens
gaauacccuuuucugacc

SEQ ID NO: 918101 - RNA, 20 nt, Homo sapiens
gaauacccuuuucugaccaa

SEQ ID NO: 918102 - RNA, 21 nt, Homo sapiens
gagaagcaaaaucuaccaggu

SEQ ID NO: 918103 - RNA, 16 nt, Homo sapiens
gagcccugucaguaga

SEQ ID NO: 918104 - RNA, 13 nt, Homo sapiens
gaggaaccucaaa

SEQ ID NO: 918105 - RNA, 23 nt, Homo sapiens
gccagcugggcuuggaaggaaaa

SEQ ID NO: 918106 - RNA, 20 nt, Homo sapiens
gccucauuuuuuuccuugca

SEQ ID NO: 918107 - RNA, 20 nt, Homo sapiens
gucucucuaaacccaaauaa

SEQ ID NO: 918108 - RNA, 16 nt, Homo sapiens
gugcucuucuguucuc

SEQ ID NO: 918109 - RNA, 14 nt, Homo sapiens
guuucuugccucau

SEQ ID NO: 918110 - RNA, 16 nt, Homo sapiens
uaaauguguaaaugug

SEQ ID NO: 918111 - RNA, 10 nt, Homo sapiens
uaccaaauau

SEQ ID NO: 918112 - RNA, 18 nt, Homo sapiens
uaccuguguuucuugccu

SEQ ID NO: 918113 - RNA, 12 nt, Homo sapiens
uacuaaagacag

SEQ ID NO: 918114 - RNA, 12 nt, Homo sapiens
uccaaagcaaau

SEQ ID NO: 918115 - RNA, 14 nt, Homo sapiens
uccacuucucuaga

SEQ ID NO: 918116 - RNA, 17 nt, Homo sapiens
uccuuucagcaagacuu

SEQ ID NO: 918117 - RNA, 18 nt, Homo sapiens
ucucugagaacagacguu

SEQ ID NO: 918118 - RNA, 23 nt, Homo sapiens
ugaacaccacuuugucucugaga

SEQ ID NO: 918119 - RNA, 22 nt, Homo sapiens
ugagaacagacguuaccaauua

SEQ ID NO: 918120 - RNA, 21 nt, Homo sapiens
ugcgacuucacaaaaugcaag

SEQ ID NO: 918121 - RNA, 13 nt, Homo sapiens
ugcuaaaugcaaa

SEQ ID NO: 918122 - RNA, 15 nt, Homo sapiens
uggaucucaagagcc

SEQ ID NO: 918123 - RNA, 15 nt, Homo sapiens
uggcaaccuguucuu

SEQ ID NO: 918124 - RNA, 16 nt, Homo sapiens
uguuucugaaugacau

SEQ ID NO: 918125 - RNA, 22 nt, Homo sapiens
uucucaaaugcuaaaugcaaac

SEQ ID NO: 918126 - RNA, 17 nt, Homo sapiens
uucuuccuaccaaauau

SEQ ID NO: 918127 - RNA, 15 nt, Homo sapiens
cuuugucucugagaa

SEQ ID NO: 918128 - RNA, 18 nt, Homo sapiens
cuuuucugaccaaagaga

SEQ ID NO: 918129 - RNA, 18 nt, Homo sapiens
gaaccucaaacuggguau

SEQ ID NO: 918130 - RNA, 17 nt, Homo sapiens
gacuucacaaaaugcaa

SEQ ID NO: 918131 - RNA, 17 nt, Homo sapiens
gacuucucuuugccuca

SEQ ID NO: 918132 - RNA, 20 nt, Homo sapiens
gagugucaccagcugccaaa

SEQ ID NO: 918133 - RNA, 13 nt, Homo sapiens
gcaaaaucuacca

SEQ ID NO: 918134 - RNA, 15 nt, Homo sapiens
gcaaacacuguguau

SEQ ID NO: 918135 - RNA, 23 nt, Homo sapiens
gcaaauguaguauggccuguguc

SEQ ID NO: 918136 - RNA, 17 nt, Homo sapiens
gcccuucuuucuacccu

SEQ ID NO: 918137 - RNA, 17 nt, Homo sapiens
gcucugcuggucacugg

SEQ ID NO: 918138 - RNA, 18 nt, Homo sapiens
ggucaaaauagugccacu

SEQ ID NO: 918139 - RNA, 17 nt, Homo sapiens
gucaccagcugccaaaa

SEQ ID NO: 918140 - RNA, 11 nt, Homo sapiens
gugugccaaac

SEQ ID NO: 918141 - RNA, 13 nt, Homo sapiens
guguuucuugccu

SEQ ID NO: 918142 - RNA, 16 nt, Homo sapiens
guuaggugugccaaac

SEQ ID NO: 918143 - RNA, 15 nt, Homo sapiens
guucuuccuaccaaa

SEQ ID NO: 918144 - RNA, 23 nt, Homo sapiens
guugucucucuaaacccaaauaa

SEQ ID NO: 918145 - RNA, 22 nt, Homo sapiens
uaaacccaaauaaauguguaaa

SEQ ID NO: 918146 - RNA, 17 nt, Homo sapiens
uaaaugcaaacacugug

SEQ ID NO: 918147 - RNA, 21 nt, Homo sapiens
uagcuugauguuggaucucaa

SEQ ID NO: 918148 - RNA, 20 nt, Homo sapiens
uauaccuguguuucuugccu

SEQ ID NO: 918149 - RNA, 22 nt, Homo sapiens
ucagcaagacuucucuuugccu

SEQ ID NO: 918150 - RNA, 22 nt, Homo sapiens
uccccaagugaccuauaccugu

SEQ ID NO: 918151 - RNA, 14 nt, Homo sapiens
ucucuuugccucaa

SEQ ID NO: 918152 - RNA, 12 nt, Homo sapiens
ucuuugccucaa

SEQ ID NO: 918153 - RNA, 19 nt, Homo sapiens
ugaacaccacuuugucucu

SEQ ID NO: 918154 - RNA, 17 nt, Homo sapiens
ugagaaacuuccuuuga

SEQ ID NO: 918155 - RNA, 22 nt, Homo sapiens
ugcaaggugaacaccacuuugu

SEQ ID NO: 918156 - RNA, 18 nt, Homo sapiens
ugcccuucuuucuacccu

SEQ ID NO: 918157 - RNA, 23 nt, Homo sapiens
ugcucaccaagcuguuccacuuc

SEQ ID NO: 918158 - RNA, 21 nt, Homo sapiens
uggaauccuuucagcaagacu

SEQ ID NO: 918159 - RNA, 23 nt, Homo sapiens
uggagugucaccagcugccaaaa

SEQ ID NO: 918160 - RNA, 12 nt, Homo sapiens
uuacuaaagaca

SEQ ID NO: 918161 - RNA, 11 nt, Homo sapiens
uuccaaagcaa

SEQ ID NO: 918162 - RNA, 18 nt, Homo sapiens
uuccacuucucuagagaa

SEQ ID NO: 918163 - RNA, 13 nt, Homo sapiens
uuucuugccucau

SEQ ID NO: 918164 - RNA, 13 nt, Homo sapiens
aaacuuguguaug

SEQ ID NO: 918165 - RNA, 16 nt, Homo sapiens
aaauaaauguguaaau

SEQ ID NO: 918166 - RNA, 23 nt, Homo sapiens
aacaccacuuugucucugagaac

SEQ ID NO: 918167 - RNA, 20 nt, Homo sapiens
aacuggaauccuuucagcaa

SEQ ID NO: 918168 - RNA, 14 nt, Homo sapiens
aaggcacaggugua

SEQ ID NO: 918169 - RNA, 11 nt, Homo sapiens
aagugaccuau

SEQ ID NO: 918170 - RNA, 15 nt, Homo sapiens
aaugcuaaaugcaaa

SEQ ID NO: 918171 - RNA, 13 nt, Homo sapiens
aauuuacagagcc

SEQ ID NO: 918172 - RNA, 19 nt, Homo sapiens
accaaagagaagcaaaauc

SEQ ID NO: 918173 - RNA, 19 nt, Homo sapiens
accuguguuucuugccuca

SEQ ID NO: 918174 - RNA, 21 nt, Homo sapiens
accuguucuuccuaccaaaua

SEQ ID NO: 918175 - RNA, 22 nt, Homo sapiens
accuguucuuccuaccaaauau

SEQ ID NO: 918176 - RNA, 16 nt, Homo sapiens
acuccauuacuaaaga

SEQ ID NO: 918177 - RNA, 17 nt, Homo sapiens
acuucacaaaaugcaag

SEQ ID NO: 918178 - RNA, 16 nt, Homo sapiens
agaaggcacaggugua

SEQ ID NO: 918179 - RNA, 20 nt, Homo sapiens
agaagucucuuccaguuugc

SEQ ID NO: 918180 - RNA, 19 nt, Homo sapiens
aggaaccucaaacugggua

SEQ ID NO: 918181 - RNA, 13 nt, Homo sapiens
aguacaaccugaa

SEQ ID NO: 918182 - RNA, 18 nt, Homo sapiens
auaaauguguaaaugugg

SEQ ID NO: 918183 - RNA, 19 nt, Homo sapiens
auaccuguguuucuugccu

SEQ ID NO: 918184 - RNA, 16 nt, Homo sapiens
caaaugcuaaaugcaa

SEQ ID NO: 918185 - RNA, 23 nt, Homo sapiens
caacauuacuccauuacuaaaga

SEQ ID NO: 918186 - RNA, 17 nt, Homo sapiens
caacauucccccaacau

SEQ ID NO: 918187 - RNA, 23 nt, Homo sapiens
caaccuguucuuccuaccaaaua

SEQ ID NO: 918188 - RNA, 20 nt, Homo sapiens
caaguauuuuaucuguguug

SEQ ID NO: 918189 - RNA, 17 nt, Homo sapiens
cacaaaaugcaagguga

SEQ ID NO: 918190 - RNA, 15 nt, Homo sapiens
caccagcugccaaaa

SEQ ID NO: 918191 - RNA, 17 nt, Homo sapiens
cagaauauggacaaaga

SEQ ID NO: 918192 - RNA, 20 nt, Homo sapiens
cagcaagacuucucuuugcc

SEQ ID NO: 918193 - RNA, 21 nt, Homo sapiens
cagcuaagcccccuacugaga

SEQ ID NO: 918194 - RNA, 22 nt, Homo sapiens
cagcuaagcccccuacugagaa

SEQ ID NO: 918195 - RNA, 23 nt, Homo sapiens
cagcugccaaaaucguagguguu

SEQ ID NO: 918196 - RNA, 18 nt, Homo sapiens
ccaaauaaauguguaaau

SEQ ID NO: 918197 - RNA, 18 nt, Homo sapiens
ccagcgagggcgugucua

SEQ ID NO: 918198 - RNA, 12 nt, Homo sapiens
ccuaccaaauau

SEQ ID NO: 918199 - RNA, 19 nt, Homo sapiens
ccugggaauuuacagagcc

SEQ ID NO: 918200 - RNA, 14 nt, Homo sapiens
cuagagaacaugcc

SEQ ID NO: 918201 - RNA, 14 nt, Homo sapiens
cucaaaugcuaaau

SEQ ID NO: 918202 - RNA, 15 nt, Homo sapiens
cucguccccaaguga

SEQ ID NO: 918203 - RNA, 15 nt, Homo sapiens
cucuagagaacaugc

SEQ ID NO: 918204 - RNA, 16 nt, Homo sapiens
aaaacacccuuuccaa

SEQ ID NO: 918205 - RNA, 20 nt, Homo sapiens
aaaacacccuuuccaaagca

SEQ ID NO: 918206 - RNA, 20 nt, Homo sapiens
aaacacccuuuccaaagcaa

SEQ ID NO: 918207 - RNA, 22 nt, Homo sapiens
aaacauguggcaaccuguucuu

SEQ ID NO: 918208 - RNA, 23 nt, Homo sapiens
aaacccaaauaaauguguaaaug

SEQ ID NO: 918209 - RNA, 17 nt, Homo sapiens
aaauauacaaacaugug

SEQ ID NO: 918210 - RNA, 15 nt, Homo sapiens
aaaugcaaacacugu

SEQ ID NO: 918211 - RNA, 16 nt, Homo sapiens
aaaugcaaacacugug

SEQ ID NO: 918212 - RNA, 20 nt, Homo sapiens
aaauguaguauggccugugu

SEQ ID NO: 918213 - RNA, 14 nt, Homo sapiens
aacacccuuuccaa

SEQ ID NO: 918214 - RNA, 18 nt, Homo sapiens
aacagacguuaccaauua

SEQ ID NO: 918215 - RNA, 11 nt, Homo sapiens
aacccaaauaa

SEQ ID NO: 918216 - RNA, 16 nt, Homo sapiens
aaccucaaacugggua

SEQ ID NO: 918217 - RNA, 17 nt, Homo sapiens
aagcuguuccacuucuc

SEQ ID NO: 918218 - RNA, 13 nt, Homo sapiens
aaggcacaggugu

SEQ ID NO: 918219 - RNA, 22 nt, Homo sapiens
aaugcaaggugaacaccacuuu

SEQ ID NO: 918220 - RNA, 12 nt, Homo sapiens
acaaaaugcaag

SEQ ID NO: 918221 - RNA, 13 nt, Homo sapiens
acagcaaccugua

SEQ ID NO: 918222 - RNA, 18 nt, Homo sapiens
acgugcucuucuguucuc

SEQ ID NO: 918223 - RNA, 17 nt, Homo sapiens
acuuugucucugagaac

SEQ ID NO: 918224 - RNA, 12 nt, Homo sapiens
agaaacuuccuu

SEQ ID NO: 918225 - RNA, 23 nt, Homo sapiens
agcaagacuucucuuugccucaa

SEQ ID NO: 918226 - RNA, 12 nt, Homo sapiens
aguacaaccuga

SEQ ID NO: 918227 - RNA, 20 nt, Homo sapiens
agugucaccagcugccaaaa

SEQ ID NO: 918228 - RNA, 12 nt, Homo sapiens
gcuaaaugcaaa

SEQ ID NO: 918229 - RNA, 15 nt, Homo sapiens
gcuguuccacuucuc

SEQ ID NO: 918230 - RNA, 23 nt, Homo sapiens
ggaguaguugcuacucuucagaa

SEQ ID NO: 918231 - RNA, 23 nt, Homo sapiens
ggaugaggaaccucaaacugggu

SEQ ID NO: 918232 - RNA, 16 nt, Homo sapiens
gggcuuggaaggaaaa

SEQ ID NO: 918233 - RNA, 20 nt, Homo sapiens
guaguauggccugugucacu

SEQ ID NO: 918234 - RNA, 18 nt, Homo sapiens
gucucucuaaacccaaau

SEQ ID NO: 918235 - RNA, 16 nt, Homo sapiens
guguuucuugccucau

SEQ ID NO: 918236 - RNA, 18 nt, Homo sapiens
guucuuccuaccaaauau

SEQ ID NO: 918237 - RNA, 13 nt, Homo sapiens
guuucuugccuca

SEQ ID NO: 918238 - RNA, 15 nt, Homo sapiens
uaaacuuguguauga

SEQ ID NO: 918239 - RNA, 18 nt, Homo sapiens
uaaaugcaaacacugugu

SEQ ID NO: 918240 - RNA, 19 nt, Homo sapiens
uaagcccccuacugagaaa

SEQ ID NO: 918241 - RNA, 17 nt, Homo sapiens
uacaaccugaauacccu

SEQ ID NO: 918242 - RNA, 20 nt, Homo sapiens
uaccuguguuucuugccuca

SEQ ID NO: 918243 - RNA, 14 nt, Homo sapiens
uauacaaacaugug

SEQ ID NO: 918244 - RNA, 17 nt, Homo sapiens
uaucauuuugcacgugc

SEQ ID NO: 918245 - RNA, 15 nt, Homo sapiens
uauuaguuaggugug

SEQ ID NO: 918246 - RNA, 21 nt, Homo sapiens
ucaacauucccccaacauuac

SEQ ID NO: 918247 - RNA, 14 nt, Homo sapiens
uccugcccaaguga

SEQ ID NO: 918248 - RNA, 17 nt, Homo sapiens
ucuaccaggucaaaaua

SEQ ID NO: 918249 - RNA, 15 nt, Homo sapiens
ucugaaugacaucaa

SEQ ID NO: 918250 - RNA, 14 nt, Homo sapiens
ucuuccuaccaaau

SEQ ID NO: 918251 - RNA, 15 nt, Homo sapiens
ugaacaccacuuugu

SEQ ID NO: 918252 - RNA, 16 nt, Homo sapiens
ugggacagcaaccugu

SEQ ID NO: 918253 - RNA, 18 nt, Homo sapiens
ugucaccagcugccaaaa

SEQ ID NO: 918254 - RNA, 23 nt, Homo sapiens
ugugccaaacuaccguucccaaa

SEQ ID NO: 918255 - RNA, 17 nt, Homo sapiens
ugugcgacuucacaaaa

SEQ ID NO: 918256 - RNA, 21 nt, Homo sapiens
ugugcgacuucacaaaaugca

SEQ ID NO: 918257 - RNA, 22 nt, Homo sapiens
uguucucaaaugcuaaaugcaa

SEQ ID NO: 918258 - RNA, 18 nt, Homo sapiens
uuaggugugccaaacuac

SEQ ID NO: 918259 - RNA, 15 nt, Homo sapiens
uucucuuugccucaa

SEQ ID NO: 918260 - RNA, 16 nt, Homo sapiens
uugacugcuuggaacu

SEQ ID NO: 918261 - RNA, 23 nt, Homo sapiens
uugucucucuaaacccaaauaaa

SEQ ID NO: 918262 - RNA, 23 nt, Homo sapiens
uuuauuaguuaggugugccaaac

SEQ ID NO: 918263 - RNA, 13 nt, Homo sapiens
uuugccucaaaua

SEQ ID NO: 918264 - RNA, 19 nt, Homo sapiens
aaacacccuuuccaaagca

SEQ ID NO: 918265 - RNA, 21 nt, Homo sapiens
aaagaaggcacagguguaaau

SEQ ID NO: 918266 - RNA, 21 nt, Homo sapiens
aaagagaagcaaaaucuacca

SEQ ID NO: 918267 - RNA, 11 nt, Homo sapiens
aguuaggugug

SEQ ID NO: 918268 - RNA, 16 nt, Homo sapiens
aucucaagagcccugu

SEQ ID NO: 918269 - RNA, 15 nt, Homo sapiens
aucuguguugucucu

SEQ ID NO: 918270 - RNA, 18 nt, Homo sapiens
auuauggagugucaccag

SEQ ID NO: 918271 - RNA, 14 nt, Homo sapiens
auuuacagagccug

SEQ ID NO: 918272 - RNA, 21 nt, Homo sapiens
auuugggaggccccuccugcc

SEQ ID NO: 918273 - RNA, 24 nt, Homo sapiens
caaaaucuaccaggucaaaauagu

SEQ ID NO: 918274 - RNA, 13 nt, Homo sapiens
caagagcccuguc

SEQ ID NO: 918275 - RNA, 17 nt, Homo sapiens
caaggugaacaccacuu

SEQ ID NO: 918276 - RNA, 23 nt, Homo sapiens
caauuauggagugucaccagcug

SEQ ID NO: 918277 - RNA, 23 nt, Homo sapiens
cagcaagacuucucuuugccuca

SEQ ID NO: 918278 - RNA, 16 nt, Homo sapiens
ccaaauaaauguguaa

SEQ ID NO: 918279 - RNA, 23 nt, Homo sapiens
ccccuccagcaaauaaagcauga

SEQ ID NO: 918280 - RNA, 13 nt, Homo sapiens
ccuccugcccaag

SEQ ID NO: 918281 - RNA, 21 nt, Homo sapiens
ccuguucuuccuaccaaauau

SEQ ID NO: 918282 - RNA, 14 nt, Homo sapiens
cucugagaacagac

SEQ ID NO: 918283 - RNA, 22 nt, Homo sapiens
cucugagaacagacguuaccaa

SEQ ID NO: 918284 - RNA, 14 nt, Homo sapiens
cugaaugacaucaa

SEQ ID NO: 918285 - RNA, 13 nt, Homo sapiens
cugaccaaagaga

SEQ ID NO: 918286 - RNA, 15 nt, Homo sapiens
cugagaaacuuccuu

SEQ ID NO: 918287 - RNA, 18 nt, Homo sapiens
cugcucguccccaaguga

SEQ ID NO: 918288 - RNA, 19 nt, Homo sapiens
cuguucucaaaugcuaaau

SEQ ID NO: 918289 - RNA, 14 nt, Homo sapiens
cuuccuaccaaaua

SEQ ID NO: 918290 - RNA, 14 nt, Homo sapiens
cuucucuuugccuc

SEQ ID NO: 918291 - RNA, 22 nt, Homo sapiens
cuucuguucucaaaugcuaaau

SEQ ID NO: 918292 - RNA, 22 nt, Homo sapiens
cucuuccaguuugcuuugcccu

SEQ ID NO: 918293 - RNA, 13 nt, Homo sapiens
cugagaaacuucc

SEQ ID NO: 918294 - RNA, 18 nt, Homo sapiens
cugagaaacuuccuuuga

SEQ ID NO: 918295 - RNA, 22 nt, Homo sapiens
cuggggagaagguggacagauu

SEQ ID NO: 918296 - RNA, 16 nt, Homo sapiens
cuuccaguuugcuuug

SEQ ID NO: 918297 - RNA, 13 nt, Homo sapiens
cuuccuaccaaau

SEQ ID NO: 918298 - RNA, 15 nt, Homo sapiens
cuucucuuugccuca

SEQ ID NO: 918299 - RNA, 14 nt, Homo sapiens
gaaccucaaacugg

SEQ ID NO: 918300 - RNA, 16 nt, Homo sapiens
gaagucucuuccaguu

SEQ ID NO: 918301 - RNA, 16 nt, Homo sapiens
gacuucucuuugccuc

SEQ ID NO: 918302 - RNA, 13 nt, Homo sapiens
gagaaacuuccuu

SEQ ID NO: 918303 - RNA, 17 nt, Homo sapiens
gaguagaagucucuucc

SEQ ID NO: 918304 - RNA, 17 nt, Homo sapiens
gcaaaaucuaccagguc

SEQ ID NO: 918305 - RNA, 21 nt, Homo sapiens
gcaaauguaguauggccugug

SEQ ID NO: 918306 - RNA, 11 nt, Homo sapiens
gcaaccuguag

SEQ ID NO: 918307 - RNA, 23 nt, Homo sapiens
auuuuggaucuaucaccugucau

SEQ ID NO: 918308 - RNA, 17 nt, Homo sapiens
auuuugggacauuugca

SEQ ID NO: 918309 - RNA, 17 nt, Homo sapiens
auuuuuuuaaauuugca

SEQ ID NO: 918310 - RNA, 16 nt, Homo sapiens
caaaaaacuaauguga

SEQ ID NO: 918311 - RNA, 12 nt, Homo sapiens
caaaaaauuaca

SEQ ID NO: 918312 - RNA, 17 nt, Homo sapiens
caaaaagccaacaaacc

SEQ ID NO: 918313 - RNA, 20 nt, Homo sapiens
caaaaauuauauuuugaaca

SEQ ID NO: 918314 - RNA, 16 nt, Homo sapiens
caaaacaaaauguuau

SEQ ID NO: 918315 - RNA, 18 nt, Homo sapiens
caaaacuuccugauuuga

SEQ ID NO: 918316 - RNA, 15 nt, Homo sapiens
caaaagcucagccag

SEQ ID NO: 918317 - RNA, 16 nt, Homo sapiens
caaaauacagcacuuu

SEQ ID NO: 918318 - RNA, 19 nt, Homo sapiens
caaaaugcuuuugugucua

SEQ ID NO: 918319 - RNA, 12 nt, Homo sapiens
caaaauguuaau

SEQ ID NO: 918320 - RNA, 21 nt, Homo sapiens
caaaauuguuacccauuugaa

SEQ ID NO: 918321 - RNA, 19 nt, Homo sapiens
caaacacugugauuacucu

SEQ ID NO: 918322 - RNA, 17 nt, Homo sapiens
caaaccucuaacccagg

SEQ ID NO: 918323 - RNA, 20 nt, Homo sapiens
caaagaaguguauuuacaau

SEQ ID NO: 918324 - RNA, 21 nt, Homo sapiens
caaagaaguguauuuacaaua

SEQ ID NO: 918325 - RNA, 14 nt, Homo sapiens
caaagacauuauuu

SEQ ID NO: 918326 - RNA, 16 nt, Homo sapiens
caaagaccaaugugaa

SEQ ID NO: 918327 - RNA, 18 nt, Homo sapiens
caaaggacaaaaauauaa

SEQ ID NO: 918328 - RNA, 18 nt, Homo sapiens
caaaggacugaccugccc

SEQ ID NO: 918329 - RNA, 16 nt, Homo sapiens
caaaggcuuccugaaa

SEQ ID NO: 918330 - RNA, 17 nt, Homo sapiens
caaagugcugagauuac

SEQ ID NO: 918331 - RNA, 19 nt, Homo sapiens
caaagugcugagauuacag

SEQ ID NO: 918332 - RNA, 23 nt, Homo sapiens
caaagugcugagauuacaggugu

SEQ ID NO: 918333 - RNA, 17 nt, Homo sapiens
caaagugcugggauuac

SEQ ID NO: 918334 - RNA, 16 nt, Homo sapiens
caaagugguacaggaa

SEQ ID NO: 918335 - RNA, 11 nt, Homo sapiens
caaaguuuaag

SEQ ID NO: 918336 - RNA, 17 nt, Homo sapiens
caaauaacugaugaagg

SEQ ID NO: 918337 - RNA, 19 nt, Homo sapiens
caaauacauuaacaagcuc

SEQ ID NO: 918338 - RNA, 18 nt, Homo sapiens
caaauccucccuacuucc

SEQ ID NO: 918339 - RNA, 16 nt, Homo sapiens
caaaucuucaaggugu

SEQ ID NO: 918340 - RNA, 17 nt, Homo sapiens
caaaugauuuacacuga

SEQ ID NO: 918341 - RNA, 20 nt, Homo sapiens
caaaugcuucuaaauaugaa

SEQ ID NO: 918342 - RNA, 11 nt, Homo sapiens
caaauguguac

SEQ ID NO: 918343 - RNA, 16 nt, Homo sapiens
caacaguggcuaauaa

SEQ ID NO: 918344 - RNA, 18 nt, Homo sapiens
caacaguuaaacuugcaa

SEQ ID NO: 918345 - RNA, 16 nt, Homo sapiens
caacaucuguuacauu

SEQ ID NO: 918346 - RNA, 20 nt, Homo sapiens
caacccucucaggugaccaa

SEQ ID NO: 918347 - RNA, 22 nt, Homo sapiens
caacccugagguaucuguguua

SEQ ID NO: 918348 - RNA, 19 nt, Homo sapiens
caagaaagcauugccagcu

SEQ ID NO: 918349 - RNA, 15 nt, Homo sapiens
caagaaauugauuga

SEQ ID NO: 918350 - RNA, 13 nt, Homo sapiens
caagaacagcagg

SEQ ID NO: 918351 - RNA, 16 nt, Homo sapiens
caagaacugccauaaa

SEQ ID NO: 918352 - RNA, 14 nt, Homo sapiens
caagcaaaaccaaa

SEQ ID NO: 918353 - RNA, 21 nt, Homo sapiens
caagcauuuaauguagccaug

SEQ ID NO: 918354 - RNA, 13 nt, Homo sapiens
caagcgcacuuga

SEQ ID NO: 918355 - RNA, 21 nt, Homo sapiens
caagcugaaaccccaucucca

SEQ ID NO: 918356 - RNA, 17 nt, Homo sapiens
caagcugccugccugag

SEQ ID NO: 918357 - RNA, 15 nt, Homo sapiens
caagcugucccugca

SEQ ID NO: 918358 - RNA, 16 nt, Homo sapiens
caaggauauacugcag

SEQ ID NO: 918359 - RNA, 16 nt, Homo sapiens
caaggcagagcgcaaa

SEQ ID NO: 918360 - RNA, 17 nt, Homo sapiens
caaggugagggaugcca

SEQ ID NO: 918361 - RNA, 19 nt, Homo sapiens
caaggugggcggaucaccu

SEQ ID NO: 918362 - RNA, 23 nt, Homo sapiens
caagucuuuaguguucaaauacu

SEQ ID NO: 918363 - RNA, 19 nt, Homo sapiens
caauacggaacacugucaa

SEQ ID NO: 918364 - RNA, 14 nt, Homo sapiens
caaucucaucccaa

SEQ ID NO: 918365 - RNA, 13 nt, Homo sapiens
caaucuccaucac

SEQ ID NO: 918366 - RNA, 14 nt, Homo sapiens
caaugcacagggcu

SEQ ID NO: 918367 - RNA, 17 nt, Homo sapiens
caaugcaugcuuuggaa

SEQ ID NO: 918368 - RNA, 14 nt, Homo sapiens
caauuaaacucaaa

SEQ ID NO: 918369 - RNA, 13 nt, Homo sapiens
caauuauuuugca

SEQ ID NO: 918370 - RNA, 18 nt, Homo sapiens
caauuguauucccagccu

SEQ ID NO: 918371 - RNA, 20 nt, Homo sapiens
cacaaaauacagcacuuuga

SEQ ID NO: 918372 - RNA, 21 nt, Homo sapiens
cacaacuccacugucuuuaaa

SEQ ID NO: 918373 - RNA, 23 nt, Homo sapiens
cacacaagcagucuuuuucuaca

SEQ ID NO: 918374 - RNA, 13 nt, Homo sapiens
cacacucuucagu

SEQ ID NO: 918375 - RNA, 12 nt, Homo sapiens
cacacugggacu

SEQ ID NO: 918376 - RNA, 13 nt, Homo sapiens
cacacuuugccau

SEQ ID NO: 918377 - RNA, 20 nt, Homo sapiens
cacagacuauuuuuagauuu

SEQ ID NO: 918378 - RNA, 22 nt, Homo sapiens
cacagacuggagacaaugcaga

SEQ ID NO: 918379 - RNA, 15 nt, Homo sapiens
cacagacuucacaca

SEQ ID NO: 918380 - RNA, 21 nt, Homo sapiens
cacagagacacagggcaucca

SEQ ID NO: 918381 - RNA, 18 nt, Homo sapiens
cacagaggcaguggcagc

SEQ ID NO: 918382 - RNA, 17 nt, Homo sapiens
cacagcccgcaugcagc

SEQ ID NO: 918383 - RNA, 22 nt, Homo sapiens
cacagucaccacuccaugacau

SEQ ID NO: 918384 - RNA, 22 nt, Homo sapiens
cacagucuggugcccagacuca

SEQ ID NO: 918385 - RNA, 19 nt, Homo sapiens
cacaucuaacaaagucaag

SEQ ID NO: 918386 - RNA, 22 nt, Homo sapiens
caccaagagccucccugccguu

SEQ ID NO: 918387 - RNA, 14 nt, Homo sapiens
caccaauccucacc

SEQ ID NO: 918388 - RNA, 14 nt, Homo sapiens
caccaccauucucc

SEQ ID NO: 918389 - RNA, 20 nt, Homo sapiens
caccccuacucuauucugua

SEQ ID NO: 918390 - RNA, 22 nt, Homo sapiens
caccccuugcucucaacccagg

SEQ ID NO: 918391 - RNA, 20 nt, Homo sapiens
cacccggcucguguauuuau

SEQ ID NO: 918392 - RNA, 16 nt, Homo sapiens
cacccuaccacagucc

SEQ ID NO: 918393 - RNA, 17 nt, Homo sapiens
caccugagcuuuggacg

SEQ ID NO: 918394 - RNA, 22 nt, Homo sapiens
caccugagcuuuggacgcacac

SEQ ID NO: 918395 - RNA, 23 nt, Homo sapiens
caccuggaaagcauauacuauau

SEQ ID NO: 918396 - RNA, 12 nt, Homo sapiens
caccugucauug

SEQ ID NO: 918397 - RNA, 16 nt, Homo sapiens
cacgagcugcugucca

SEQ ID NO: 918398 - RNA, 14 nt, Homo sapiens
cacggaaaugcagu

SEQ ID NO: 918399 - RNA, 23 nt, Homo sapiens
cacgguggugcaugccuguaauc

SEQ ID NO: 918400 - RNA, 22 nt, Homo sapiens
cacgugcaauacggaacacugu

SEQ ID NO: 918401 - RNA, 14 nt, Homo sapiens
cacgugugauguau

SEQ ID NO: 918402 - RNA, 19 nt, Homo sapiens
cacuaagcuaauuccacac

SEQ ID NO: 918403 - RNA, 20 nt, Homo sapiens
cacuaggaggucaucaaccg

SEQ ID NO: 918404 - RNA, 20 nt, Homo sapiens
cacucaacaaaagugcuuug

SEQ ID NO: 918405 - RNA, 17 nt, Homo sapiens
cacucaugggucacugg

SEQ ID NO: 918406 - RNA, 12 nt, Homo sapiens
cacuccaaccag

SEQ ID NO: 918407 - RNA, 14 nt, Homo sapiens
cacucucuacuggu

SEQ ID NO: 918408 - RNA, 12 nt, Homo sapiens
cacugcacucca

SEQ ID NO: 918409 - RNA, 19 nt, Homo sapiens
cacugcccucuguucagua

SEQ ID NO: 918410 - RNA, 13 nt, Homo sapiens
cacugcucaagaa

SEQ ID NO: 918411 - RNA, 23 nt, Homo sapiens
cacuggauccagaagcuauggaa

SEQ ID NO: 918412 - RNA, 23 nt, Homo sapiens
aaaucuugcucuuccauaaucuu

SEQ ID NO: 918413 - RNA, 20 nt, Homo sapiens
aaaugccacucaccaaccca

SEQ ID NO: 918414 - RNA, 19 nt, Homo sapiens
aaaugccaggacagcugca

SEQ ID NO: 918415 - RNA, 22 nt, Homo sapiens
aaauggccaccaccauucuccu

SEQ ID NO: 918416 - RNA, 22 nt, Homo sapiens
aaauggcccuguuuacggccua

SEQ ID NO: 918417 - RNA, 19 nt, Homo sapiens
aaaugguuuguuuucuaca

SEQ ID NO: 918418 - RNA, 16 nt, Homo sapiens
aaaugugaauggaaac

SEQ ID NO: 918419 - RNA, 18 nt, Homo sapiens
aaauuaauuugaccaucu

SEQ ID NO: 918420 - RNA, 21 nt, Homo sapiens
aaauuaccaaaugcuucuaaa

SEQ ID NO: 918421 - RNA, 17 nt, Homo sapiens
aaauuaguaauguacua

SEQ ID NO: 918422 - RNA, 13 nt, Homo sapiens
aaauuauuaucuu

SEQ ID NO: 918423 - RNA, 13 nt, Homo sapiens
aaauuuggaagau

SEQ ID NO: 918424 - RNA, 16 nt, Homo sapiens
aaauuuguaugcucaa

SEQ ID NO: 918425 - RNA, 20 nt, Homo sapiens
aaauuuuuuguagacagggu

SEQ ID NO: 918426 - RNA, 16 nt, Homo sapiens
aacaacacuaauugac

SEQ ID NO: 918427 - RNA, 15 nt, Homo sapiens
aacaaccuuucaugu

SEQ ID NO: 918428 - RNA, 19 nt, Homo sapiens
aacaacucgaaucacucau

SEQ ID NO: 918429 - RNA, 16 nt, Homo sapiens
aacaacugauauacuu

SEQ ID NO: 918430 - RNA, 19 nt, Homo sapiens
cagaucuaccccuuacuua

SEQ ID NO: 918431 - RNA, 22 nt, Homo sapiens
cagaugcaaucacuuuuggaca

SEQ ID NO: 918432 - RNA, 19 nt, Homo sapiens
cagaugcugaaagagaaaa

SEQ ID NO: 918433 - RNA, 14 nt, Homo sapiens
cagauggucccauu

SEQ ID NO: 918434 - RNA, 17 nt, Homo sapiens
cagauuaaaugaauaua

SEQ ID NO: 918435 - RNA, 17 nt, Homo sapiens
cagauuaucuuguacag

SEQ ID NO: 918436 - RNA, 16 nt, Homo sapiens
cagauugacaagguag

SEQ ID NO: 918437 - RNA, 18 nt, Homo sapiens
cagcacuuaaacugccuc

SEQ ID NO: 918438 - RNA, 18 nt, Homo sapiens
cagcauuuccucagucuc

SEQ ID NO: 918439 - RNA, 20 nt, Homo sapiens
cagccaccccucagacuggg

SEQ ID NO: 918440 - RNA, 16 nt, Homo sapiens
cagccacuuauuucca

SEQ ID NO: 918441 - RNA, 20 nt, Homo sapiens
cagccacuuauuuccaugga

SEQ ID NO: 918442 - RNA, 15 nt, Homo sapiens
cagccuacuuuucag

SEQ ID NO: 918443 - RNA, 14 nt, Homo sapiens
cagccuagaccaag

SEQ ID NO: 918444 - RNA, 20 nt, Homo sapiens
cagccucccgaguagcugga

SEQ ID NO: 918445 - RNA, 16 nt, Homo sapiens
cagcuaagccugauga

SEQ ID NO: 918446 - RNA, 17 nt, Homo sapiens
cagcuauaccucauuca

SEQ ID NO: 918447 - RNA, 18 nt, Homo sapiens
cagcuauaccucauucac

SEQ ID NO: 918448 - RNA, 14 nt, Homo sapiens
cagcucacugcaac

SEQ ID NO: 918449 - RNA, 20 nt, Homo sapiens
cagcugcauuucuuuugcaa

SEQ ID NO: 918450 - RNA, 19 nt, Homo sapiens
cagcugcugguuuugguuu

SEQ ID NO: 918451 - RNA, 13 nt, Homo sapiens
cagcuguggugag

SEQ ID NO: 918452 - RNA, 14 nt, Homo sapiens
cagcuuccuuccaa

SEQ ID NO: 918453 - RNA, 16 nt, Homo sapiens
cagcuuuacuagugcc

SEQ ID NO: 918454 - RNA, 17 nt, Homo sapiens
caggaaaagguccuuga

SEQ ID NO: 918455 - RNA, 15 nt, Homo sapiens
caggaaggggcgggg

SEQ ID NO: 918456 - RNA, 12 nt, Homo sapiens
caggacacuggu

SEQ ID NO: 918457 - RNA, 17 nt, Homo sapiens
caggacagcauggugca

SEQ ID NO: 918458 - RNA, 14 nt, Homo sapiens
caggacccucagga

SEQ ID NO: 918459 - RNA, 19 nt, Homo sapiens
caggacgauuucacugaca

SEQ ID NO: 918460 - RNA, 15 nt, Homo sapiens
caggacuucugugca

SEQ ID NO: 918461 - RNA, 21 nt, Homo sapiens
caggauggcugcaagcgcacu

SEQ ID NO: 918462 - RNA, 18 nt, Homo sapiens
caggccacugaccuccca

SEQ ID NO: 918463 - RNA, 19 nt, Homo sapiens
cagggcauccaacugagaa

SEQ ID NO: 918464 - RNA, 15 nt, Homo sapiens
cagggccucugcucu

SEQ ID NO: 918465 - RNA, 20 nt, Homo sapiens
caggggcuucacccaugaaa

SEQ ID NO: 918466 - RNA, 21 nt, Homo sapiens
caggggcuugaacaacacuac

SEQ ID NO: 918467 - RNA, 21 nt, Homo sapiens
cagggucucccuauguugccc

SEQ ID NO: 918468 - RNA, 22 nt, Homo sapiens
caggguucuccauuacagugua

SEQ ID NO: 918469 - RNA, 19 nt, Homo sapiens
caggugagugccaccacac

SEQ ID NO: 918470 - RNA, 14 nt, Homo sapiens
caggugugagccac

SEQ ID NO: 918471 - RNA, 20 nt, Homo sapiens
caguaacaaucugcuuucuu

SEQ ID NO: 918472 - RNA, 19 nt, Homo sapiens
caguaaggcagcucugucg

SEQ ID NO: 918473 - RNA, 18 nt, Homo sapiens
caguacucccuuccauac

SEQ ID NO: 918474 - RNA, 14 nt, Homo sapiens
caguaugugucuag

SEQ ID NO: 918475 - RNA, 19 nt, Homo sapiens
caguauucuagugauaaga

SEQ ID NO: 918476 - RNA, 17 nt, Homo sapiens
cagucagcgagugcuug

SEQ ID NO: 918477 - RNA, 14 nt, Homo sapiens
cagucugaaccuga

SEQ ID NO: 918478 - RNA, 15 nt, Homo sapiens
cagucuggugcccag

SEQ ID NO: 918479 - RNA, 18 nt, Homo sapiens
cagugauugaaguaucug

SEQ ID NO: 918480 - RNA, 16 nt, Homo sapiens
caguggugagacugua

SEQ ID NO: 918481 - RNA, 18 nt, Homo sapiens
caguggugagacuguauc

SEQ ID NO: 918482 - RNA, 14 nt, Homo sapiens
caguguguguaaca

SEQ ID NO: 918483 - RNA, 16 nt, Homo sapiens
caguuacuuaccugca

SEQ ID NO: 918484 - RNA, 14 nt, Homo sapiens
caguucaauaacaa

SEQ ID NO: 918485 - RNA, 21 nt, Homo sapiens
caguucuaaaaagauguaaua

SEQ ID NO: 918486 - RNA, 12 nt, Homo sapiens
caguuucacugc

SEQ ID NO: 918487 - RNA, 18 nt, Homo sapiens
cauaaaacaaaaccaagc

SEQ ID NO: 918488 - RNA, 14 nt, Homo sapiens
cauaaaacuucuga

SEQ ID NO: 918489 - RNA, 13 nt, Homo sapiens
cauaauuugcaua

SEQ ID NO: 918490 - RNA, 21 nt, Homo sapiens
cauagauguaucauuaaugua

SEQ ID NO: 918491 - RNA, 16 nt, Homo sapiens
cauagcuggacaucca

SEQ ID NO: 918492 - RNA, 14 nt, Homo sapiens
cauaguaauuaccc

SEQ ID NO: 918493 - RNA, 15 nt, Homo sapiens
cauaucaacuugagg

SEQ ID NO: 918494 - RNA, 15 nt, Homo sapiens
cauauccauaagaau

SEQ ID NO: 918495 - RNA, 16 nt, Homo sapiens
cauaugaucaaauacu

SEQ ID NO: 918496 - RNA, 13 nt, Homo sapiens
cauaugauuuauc

SEQ ID NO: 918497 - RNA, 20 nt, Homo sapiens
cauauuuuuagauacaguga

SEQ ID NO: 918498 - RNA, 23 nt, Homo sapiens
cauauuuuuauauuauguuaaag

SEQ ID NO: 918499 - RNA, 17 nt, Homo sapiens
caucacugcacuccagc

SEQ ID NO: 918500 - RNA, 16 nt, Homo sapiens
caucaguuaggauuag

SEQ ID NO: 918501 - RNA, 17 nt, Homo sapiens
cauccacaggauuccag

SEQ ID NO: 918502 - RNA, 19 nt, Homo sapiens
caucccgugcaaaacaugc

SEQ ID NO: 918503 - RNA, 14 nt, Homo sapiens
cauccugaccagcu

SEQ ID NO: 918504 - RNA, 21 nt, Homo sapiens
cauccuggcuaacacggugaa

SEQ ID NO: 918505 - RNA, 20 nt, Homo sapiens
caucugacugccaagccaga

SEQ ID NO: 918506 - RNA, 14 nt, Homo sapiens
caucuuuuauagau

SEQ ID NO: 918507 - RNA, 20 nt, Homo sapiens
caugaauacacaacuccacu

SEQ ID NO: 918508 - RNA, 21 nt, Homo sapiens
caugaauucuggucacauucc

SEQ ID NO: 918509 - RNA, 20 nt, Homo sapiens
caugacacauuugaaaucau

SEQ ID NO: 918510 - RNA, 19 nt, Homo sapiens
caugacugaaggacaucug

SEQ ID NO: 918511 - RNA, 21 nt, Homo sapiens
caugagcgucuguggagccau

SEQ ID NO: 918512 - RNA, 13 nt, Homo sapiens
caugcaauuccau

SEQ ID NO: 918513 - RNA, 23 nt, Homo sapiens
caugcacuacugaaauuuacaca

SEQ ID NO: 918514 - RNA, 21 nt, Homo sapiens
caugcagucuuguacugugac

SEQ ID NO: 918515 - RNA, 21 nt, Homo sapiens
cauggccacauccaacauuuc

SEQ ID NO: 918516 - RNA, 18 nt, Homo sapiens
cauggcuuccuaaauggc

SEQ ID NO: 918517 - RNA, 20 nt, Homo sapiens
caugucuaacaggacuugaa

SEQ ID NO: 918518 - RNA, 18 nt, Homo sapiens
caugugcugcuguggcau

SEQ ID NO: 918519 - RNA, 14 nt, Homo sapiens
cauuaaaugcaaaa

SEQ ID NO: 918520 - RNA, 16 nt, Homo sapiens
cauuaacaagcucuua

SEQ ID NO: 918521 - RNA, 14 nt, Homo sapiens
cauuacaguguaaa

SEQ ID NO: 918522 - RNA, 12 nt, Homo sapiens
cauuacugccaa

SEQ ID NO: 918523 - RNA, 17 nt, Homo sapiens
cauuagaaaccaugaaa

SEQ ID NO: 918524 - RNA, 20 nt, Homo sapiens
cauuauuacuccuugccauu

SEQ ID NO: 918525 - RNA, 15 nt, Homo sapiens
cauucaagagucuca

SEQ ID NO: 918526 - RNA, 16 nt, Homo sapiens
cauucaccaaccaaag

SEQ ID NO: 918527 - RNA, 18 nt, Homo sapiens
cauuccugcgcauggugc

SEQ ID NO: 918528 - RNA, 14 nt, Homo sapiens
cauucuaaaccaaa

SEQ ID NO: 918529 - RNA, 11 nt, Homo sapiens
cauucuucucu

SEQ ID NO: 918530 - RNA, 18 nt, Homo sapiens
cauugaaauguaauuuca

SEQ ID NO: 918531 - RNA, 16 nt, Homo sapiens
cauugauuucauugaa

SEQ ID NO: 918532 - RNA, 18 nt, Homo sapiens
cauuucauauaaauggaa

SEQ ID NO: 918533 - RNA, 22 nt, Homo sapiens
cauuuccucaggcaauuccuuu

SEQ ID NO: 918534 - RNA, 14 nt, Homo sapiens
aagucaaccugcuu

SEQ ID NO: 918535 - RNA, 15 nt, Homo sapiens
aagucuccuguauca

SEQ ID NO: 918536 - RNA, 16 nt, Homo sapiens
aagucuccuguaucau

SEQ ID NO: 918537 - RNA, 13 nt, Homo sapiens
aagugauccuccu

SEQ ID NO: 918538 - RNA, 15 nt, Homo sapiens
aaguggagacauauu

SEQ ID NO: 918539 - RNA, 17 nt, Homo sapiens
aagugggcagcauaaag

SEQ ID NO: 918540 - RNA, 20 nt, Homo sapiens
aaguguauuuuauaagcauu

SEQ ID NO: 918541 - RNA, 20 nt, Homo sapiens
aaguguuucugaagucucaa

SEQ ID NO: 918542 - RNA, 22 nt, Homo sapiens
aaguuaaauugcacgugcaaua

SEQ ID NO: 918543 - RNA, 20 nt, Homo sapiens
aaguuacuauccuggcuuug

SEQ ID NO: 918544 - RNA, 21 nt, Homo sapiens
aaguuguaaaguauguauuau

SEQ ID NO: 918545 - RNA, 16 nt, Homo sapiens
aaguuuagaaauuaca

SEQ ID NO: 918546 - RNA, 15 nt, Homo sapiens
aaguuuuaaccucag

SEQ ID NO: 918547 - RNA, 19 nt, Homo sapiens
aaguuuuauugucaagaca

SEQ ID NO: 918548 - RNA, 13 nt, Homo sapiens
aauaaaaccacca

SEQ ID NO: 918549 - RNA, 13 nt, Homo sapiens
aauaaaaugcacu

SEQ ID NO: 918550 - RNA, 20 nt, Homo sapiens
aauaaagcugauagcauaua

SEQ ID NO: 918551 - RNA, 18 nt, Homo sapiens
aauaaauuuguaugcuca

SEQ ID NO: 918552 - RNA, 22 nt, Homo sapiens
aauaaauuuguaugcucaauua

SEQ ID NO: 918553 - RNA, 16 nt, Homo sapiens
aauaacuggaaaaagu

SEQ ID NO: 918554 - RNA, 17 nt, Homo sapiens
ccaagagguuaggugaa

SEQ ID NO: 918555 - RNA, 18 nt, Homo sapiens
ccaagcaggaagaacauu

SEQ ID NO: 918556 - RNA, 17 nt, Homo sapiens
ccaagcuggagugcagu

SEQ ID NO: 918557 - RNA, 18 nt, Homo sapiens
ccaagcuggagugcagug

SEQ ID NO: 918558 - RNA, 19 nt, Homo sapiens
ccaagggcagguugaucag

SEQ ID NO: 918559 - RNA, 23 nt, Homo sapiens
ccaaguccaggucgggcucagcu

SEQ ID NO: 918560 - RNA, 23 nt, Homo sapiens
ccaagugaaugaguuuccagcua

SEQ ID NO: 918561 - RNA, 14 nt, Homo sapiens
ccaaguuuacucaa

SEQ ID NO: 918562 - RNA, 22 nt, Homo sapiens
ccaaguuuugaaaggcuuuccu

SEQ ID NO: 918563 - RNA, 17 nt, Homo sapiens
ccacaaugagauuccau

SEQ ID NO: 918564 - RNA, 22 nt, Homo sapiens
ccacagucucucccugggguuu

SEQ ID NO: 918565 - RNA, 15 nt, Homo sapiens
ccacaucuaacaaag

SEQ ID NO: 918566 - RNA, 13 nt, Homo sapiens
ccacauuauuugu

SEQ ID NO: 918567 - RNA, 14 nt, Homo sapiens
ccacauucaccaac

SEQ ID NO: 918568 - RNA, 13 nt, Homo sapiens
ccaccaacauaaa

SEQ ID NO: 918569 - RNA, 16 nt, Homo sapiens
ccaccaccauucuccu

SEQ ID NO: 918570 - RNA, 18 nt, Homo sapiens
ccaccccacucacagaga

SEQ ID NO: 918571 - RNA, 16 nt, Homo sapiens
ccacccccaaugcaca

SEQ ID NO: 918572 - RNA, 21 nt, Homo sapiens
ccaccccuacucuauucugua

SEQ ID NO: 918573 - RNA, 17 nt, Homo sapiens
ccaccugagcuuuggac

SEQ ID NO: 918574 - RNA, 15 nt, Homo sapiens
ccacggccacugcag

SEQ ID NO: 918575 - RNA, 20 nt, Homo sapiens
ccacuccaaccagaagugaa

SEQ ID NO: 918576 - RNA, 23 nt, Homo sapiens
ccacucugagugaauacuuugau

SEQ ID NO: 918577 - RNA, 20 nt, Homo sapiens
ccacugaccggaggcaaaag

SEQ ID NO: 918578 - RNA, 20 nt, Homo sapiens
ccacugcaaauaaagccuuu

SEQ ID NO: 918579 - RNA, 17 nt, Homo sapiens
ccacuuauuuccaugga

SEQ ID NO: 918580 - RNA, 20 nt, Homo sapiens
ccagaaaguuguguaggcac

SEQ ID NO: 918581 - RNA, 22 nt, Homo sapiens
ccagacaucuggacacugggca

SEQ ID NO: 918582 - RNA, 10 nt, Homo sapiens
ccagaggcac

SEQ ID NO: 918583 - RNA, 20 nt, Homo sapiens
ccagccugggugacagagca

SEQ ID NO: 918584 - RNA, 21 nt, Homo sapiens
ccagcuacccaggaggcugaa

SEQ ID NO: 918585 - RNA, 14 nt, Homo sapiens
ccagcugcucugcc

SEQ ID NO: 918586 - RNA, 21 nt, Homo sapiens
ccaggagguugagaaugcagu

SEQ ID NO: 918587 - RNA, 16 nt, Homo sapiens
ccaggccugaccucaa

SEQ ID NO: 918588 - RNA, 20 nt, Homo sapiens
ccagggcugggcacuccucc

SEQ ID NO: 918589 - RNA, 23 nt, Homo sapiens
ccagugauggcauuacucugcac

SEQ ID NO: 918590 - RNA, 18 nt, Homo sapiens
ccauacccccacaugcca

SEQ ID NO: 918591 - RNA, 19 nt, Homo sapiens
ccauacccccacaugccaa

SEQ ID NO: 918592 - RNA, 19 nt, Homo sapiens
ccauagccaauacauuuac

SEQ ID NO: 918593 - RNA, 18 nt, Homo sapiens
ccauccagccaccaccua

SEQ ID NO: 918594 - RNA, 12 nt, Homo sapiens
ccaucugcauuu

SEQ ID NO: 918595 - RNA, 14 nt, Homo sapiens
ccaucugcauuuga

SEQ ID NO: 918596 - RNA, 15 nt, Homo sapiens
ccaugaauacacaac

SEQ ID NO: 918597 - RNA, 17 nt, Homo sapiens
ccaugagaaaagggaag

SEQ ID NO: 918598 - RNA, 15 nt, Homo sapiens
ccauggcccaucacu

SEQ ID NO: 918599 - RNA, 15 nt, Homo sapiens
ccauuacaguguaaa

SEQ ID NO: 918600 - RNA, 16 nt, Homo sapiens
ccauuuuuuucacuca

SEQ ID NO: 918601 - RNA, 22 nt, Homo sapiens
cccaaaagaauuaucaucccaa

SEQ ID NO: 918602 - RNA, 18 nt, Homo sapiens
cccaaauucuccuccuga

SEQ ID NO: 918603 - RNA, 17 nt, Homo sapiens
cccaagccuggucuccu

SEQ ID NO: 918604 - RNA, 19 nt, Homo sapiens
cccaagcuggagugcagug

SEQ ID NO: 918605 - RNA, 14 nt, Homo sapiens
cccaauaauucugu

SEQ ID NO: 918606 - RNA, 13 nt, Homo sapiens
cccagaaaacaca

SEQ ID NO: 918607 - RNA, 17 nt, Homo sapiens
cccagaaaacacauuuc

SEQ ID NO: 918608 - RNA, 20 nt, Homo sapiens
cccagacaucuggacacugg

SEQ ID NO: 918609 - RNA, 23 nt, Homo sapiens
cccagauccauucccuacaauuc

SEQ ID NO: 918610 - RNA, 21 nt, Homo sapiens
cccagcugcauuucuuuugca

SEQ ID NO: 918611 - RNA, 19 nt, Homo sapiens
cccaggcuggagugcagug

SEQ ID NO: 918612 - RNA, 21 nt, Homo sapiens
cccaggcuggucuugaacucc

SEQ ID NO: 918613 - RNA, 20 nt, Homo sapiens
cccagggacugcagguugug

SEQ ID NO: 918614 - RNA, 19 nt, Homo sapiens
cccagggcaaagaacacaa

SEQ ID NO: 918615 - RNA, 19 nt, Homo sapiens
cccaguuucuugagaucug

SEQ ID NO: 918616 - RNA, 15 nt, Homo sapiens
cccauagcaaagggu

SEQ ID NO: 918617 - RNA, 17 nt, Homo sapiens
ccccaugacaggaguuu

SEQ ID NO: 918618 - RNA, 16 nt, Homo sapiens
ccccauucauuccuga

SEQ ID NO: 918619 - RNA, 17 nt, Homo sapiens
ccccgugaagcaaucau

SEQ ID NO: 918620 - RNA, 19 nt, Homo sapiens
ccccuccuugccgcuggga

SEQ ID NO: 918621 - RNA, 14 nt, Homo sapiens
ccccucucuuugag

SEQ ID NO: 918622 - RNA, 22 nt, Homo sapiens
ccccucugcuggccgggcacag

SEQ ID NO: 918623 - RNA, 22 nt, Homo sapiens
ccccuggcugguaagggccaag

SEQ ID NO: 918624 - RNA, 23 nt, Homo sapiens
cccgccuuggccucccaaagugc

SEQ ID NO: 918625 - RNA, 24 nt, Homo sapiens
cccuaaccccuaugaacucuugau

SEQ ID NO: 918626 - RNA, 23 nt, Homo sapiens
cccuacacaaaauacagcacuuu

SEQ ID NO: 918627 - RNA, 17 nt, Homo sapiens
cccuagcuuagagccuc

SEQ ID NO: 918628 - RNA, 17 nt, Homo sapiens
cccucaaauuaacuuuc

SEQ ID NO: 918629 - RNA, 14 nt, Homo sapiens
cccuccccagugcc

SEQ ID NO: 918630 - RNA, 18 nt, Homo sapiens
cccuggcucaagcgaucc

SEQ ID NO: 918631 - RNA, 19 nt, Homo sapiens
cccuguuauaauuugcaca

SEQ ID NO: 918632 - RNA, 22 nt, Homo sapiens
cccuguuuacgguacuugguaa

SEQ ID NO: 918633 - RNA, 15 nt, Homo sapiens
cccuucuccuuccaa

SEQ ID NO: 918634 - RNA, 11 nt, Homo sapiens
cccuugugcau

SEQ ID NO: 918635 - RNA, 14 nt, Homo sapiens
ccgaugguccucac

SEQ ID NO: 918636 - RNA, 14 nt, Homo sapiens
ccgccagaccucaa

SEQ ID NO: 918637 - RNA, 15 nt, Homo sapiens
ccgcugaccuugcac

SEQ ID NO: 918638 - RNA, 14 nt, Homo sapiens
ccgggcuggagaaa

SEQ ID NO: 918639 - RNA, 13 nt, Homo sapiens
ccgugacccugag

SEQ ID NO: 918640 - RNA, 15 nt, Homo sapiens
ccgugggucaugcag

SEQ ID NO: 918641 - RNA, 22 nt, Homo sapiens
ccguuuugugaagaaacauuua

SEQ ID NO: 918642 - RNA, 20 nt, Homo sapiens
ccuaaguuaccuuucuaggu

SEQ ID NO: 918643 - RNA, 18 nt, Homo sapiens
ccuacagggugucuguca

SEQ ID NO: 918644 - RNA, 14 nt, Homo sapiens
ccuagcugugugca

SEQ ID NO: 918645 - RNA, 17 nt, Homo sapiens
ccuaggauaucuucucc

SEQ ID NO: 918646 - RNA, 17 nt, Homo sapiens
ccuaucauagauuuaca

SEQ ID NO: 918647 - RNA, 14 nt, Homo sapiens
ccuaucaucaguua

SEQ ID NO: 918648 - RNA, 19 nt, Homo sapiens
ccuauuggcuauuuuccca

SEQ ID NO: 918649 - RNA, 15 nt, Homo sapiens
ccucaaggggccauc

SEQ ID NO: 918650 - RNA, 15 nt, Homo sapiens
ccucagcaacagcca

SEQ ID NO: 918651 - RNA, 20 nt, Homo sapiens
ccucagcaccugggacccaa

SEQ ID NO: 918652 - RNA, 12 nt, Homo sapiens
ccucauguucuc

SEQ ID NO: 918653 - RNA, 14 nt, Homo sapiens
ccucauucuucucu

SEQ ID NO: 918654 - RNA, 19 nt, Homo sapiens
ccuccaagugaaugaguuu

SEQ ID NO: 918655 - RNA, 13 nt, Homo sapiens
ccuccagccacuu

SEQ ID NO: 918656 - RNA, 16 nt, Homo sapiens
gcaccaccucugucac

SEQ ID NO: 918657 - RNA, 20 nt, Homo sapiens
gcaccacugcacuccagccu

SEQ ID NO: 918658 - RNA, 14 nt, Homo sapiens
gcacgguggcucac

SEQ ID NO: 918659 - RNA, 22 nt, Homo sapiens
gcacugaccccgaccucagaga

SEQ ID NO: 918660 - RNA, 18 nt, Homo sapiens
gcacugagaagcaaucaa

SEQ ID NO: 918661 - RNA, 14 nt, Homo sapiens
gcacugcacauaau

SEQ ID NO: 918662 - RNA, 16 nt, Homo sapiens
gcagaggccacaggaa

SEQ ID NO: 918663 - RNA, 20 nt, Homo sapiens
gcagaguggauuaaaggcaa

SEQ ID NO: 918664 - RNA, 20 nt, Homo sapiens
gcagaucuaccccuuacuua

SEQ ID NO: 918665 - RNA, 16 nt, Homo sapiens
gcagccaugagaacaa

SEQ ID NO: 918666 - RNA, 23 nt, Homo sapiens
gcagccucaggcccaauucugcc

SEQ ID NO: 918667 - RNA, 16 nt, Homo sapiens
gcaggaucacagcuca

SEQ ID NO: 918668 - RNA, 14 nt, Homo sapiens
gcaggcugagugca

SEQ ID NO: 918669 - RNA, 22 nt, Homo sapiens
gcaggggaacaaaauaagggcc

SEQ ID NO: 918670 - RNA, 22 nt, Homo sapiens
gcaggugcuccucgagagugag

SEQ ID NO: 918671 - RNA, 15 nt, Homo sapiens
gcagucacccugugg

SEQ ID NO: 918672 - RNA, 22 nt, Homo sapiens
gcagugcccagugauggcauua

SEQ ID NO: 918673 - RNA, 17 nt, Homo sapiens
gcaguuauuagaacuua

SEQ ID NO: 918674 - RNA, 14 nt, Homo sapiens
gcaguucauacuga

SEQ ID NO: 918675 - RNA, 20 nt, Homo sapiens
gcauaucaacuugaggccag

SEQ ID NO: 918676 - RNA, 12 nt, Homo sapiens
gcauaugauuua

SEQ ID NO: 918677 - RNA, 14 nt, Homo sapiens
gcauaugauuuauc

SEQ ID NO: 918678 - RNA, 12 nt, Homo sapiens
gcauccugugac

SEQ ID NO: 918679 - RNA, 19 nt, Homo sapiens
gcauuuaaacucauuugag

SEQ ID NO: 918680 - RNA, 13 nt, Homo sapiens
gccaaagaccucc

SEQ ID NO: 918681 - RNA, 12 nt, Homo sapiens
gccaacccugug

SEQ ID NO: 918682 - RNA, 14 nt, Homo sapiens
gccaagaagcagug

SEQ ID NO: 918683 - RNA, 22 nt, Homo sapiens
gccaagacccaacaggugcuga

SEQ ID NO: 918684 - RNA, 19 nt, Homo sapiens
gccaagggccgacuaagag

SEQ ID NO: 918685 - RNA, 17 nt, Homo sapiens
gccacauucaccaacca

SEQ ID NO: 918686 - RNA, 14 nt, Homo sapiens
aucuaucaccauua

SEQ ID NO: 918687 - RNA, 19 nt, Homo sapiens
aucuaucaccauuacuuuu

SEQ ID NO: 918688 - RNA, 16 nt, Homo sapiens
aucucaacauggaaaa

SEQ ID NO: 918689 - RNA, 17 nt, Homo sapiens
aucucaucccaacaaac

SEQ ID NO: 918690 - RNA, 17 nt, Homo sapiens
aucugacaaugaggcaa

SEQ ID NO: 918691 - RNA, 22 nt, Homo sapiens
aucugccaagggccgacuaaga

SEQ ID NO: 918692 - RNA, 22 nt, Homo sapiens
aucuguugcaaacucagccuca

SEQ ID NO: 918693 - RNA, 17 nt, Homo sapiens
aucuucaagguguaaaa

SEQ ID NO: 918694 - RNA, 19 nt, Homo sapiens
aucuucauaauauucccag

SEQ ID NO: 918695 - RNA, 20 nt, Homo sapiens
aucuuccuccucuacuggua

SEQ ID NO: 918696 - RNA, 23 nt, Homo sapiens
augaaaaauaguguguccaugca

SEQ ID NO: 918697 - RNA, 20 nt, Homo sapiens
augaacaaugugugggauaa

SEQ ID NO: 918698 - RNA, 22 nt, Homo sapiens
augaauauuguaaauguucaag

SEQ ID NO: 918699 - RNA, 15 nt, Homo sapiens
augaauucuggucac

SEQ ID NO: 918700 - RNA, 22 nt, Homo sapiens
augaccagaaaacaaaucuuca

SEQ ID NO: 918701 - RNA, 16 nt, Homo sapiens
augacggcuaccacac

SEQ ID NO: 918702 - RNA, 14 nt, Homo sapiens
augacucagcagaa

SEQ ID NO: 918703 - RNA, 18 nt, Homo sapiens
augagaaugacccuguca

SEQ ID NO: 918704 - RNA, 15 nt, Homo sapiens
augagauguaugccc

SEQ ID NO: 918705 - RNA, 23 nt, Homo sapiens
augauauuuuuauccuguucuca

SEQ ID NO: 918706 - RNA, 14 nt, Homo sapiens
augauugccaacag

SEQ ID NO: 918707 - RNA, 16 nt, Homo sapiens
augcaaaguuacauga

SEQ ID NO: 918708 - RNA, 20 nt, Homo sapiens
augcaaucacuuuuggacau

SEQ ID NO: 918709 - RNA, 19 nt, Homo sapiens
augcacuaaucaauacuuu

SEQ ID NO: 918710 - RNA, 19 nt, Homo sapiens
augcagucuuguacuguga

SEQ ID NO: 918711 - RNA, 18 nt, Homo sapiens
augcauucccuacagauu

SEQ ID NO: 918712 - RNA, 20 nt, Homo sapiens
augcgcacgaccuacauuaa

SEQ ID NO: 918713 - RNA, 15 nt, Homo sapiens
augcuauauaaucug

SEQ ID NO: 918714 - RNA, 23 nt, Homo sapiens
augcuaucucgcuagccauauau

SEQ ID NO: 918715 - RNA, 14 nt, Homo sapiens
augcuauuaauaca

SEQ ID NO: 918716 - RNA, 16 nt, Homo sapiens
augcugcacaccaguu

SEQ ID NO: 918717 - RNA, 22 nt, Homo sapiens
augcugcuaugaagacuacuuu

SEQ ID NO: 918718 - RNA, 14 nt, Homo sapiens
augcugcuuugcac

SEQ ID NO: 918719 - RNA, 23 nt, Homo sapiens
augcuuuugugucuaccuuguua

SEQ ID NO: 918720 - RNA, 18 nt, Homo sapiens
auggaauuuugcaaagau

SEQ ID NO: 918721 - RNA, 19 nt, Homo sapiens
auggaccaauuagcauucc

SEQ ID NO: 918722 - RNA, 23 nt, Homo sapiens
auggauuugaugaaagugcaaag

SEQ ID NO: 918723 - RNA, 15 nt, Homo sapiens
auggcagucccaaag

SEQ ID NO: 918724 - RNA, 20 nt, Homo sapiens
auggcugcaagcgcacuuga

SEQ ID NO: 918725 - RNA, 23 nt, Homo sapiens
auggcugcaagcgcacuugaugg

SEQ ID NO: 918726 - RNA, 14 nt, Homo sapiens
auggcugugaaaau

SEQ ID NO: 918727 - RNA, 13 nt, Homo sapiens
auggcuguugaag

SEQ ID NO: 918728 - RNA, 16 nt, Homo sapiens
augggucaggucauuu

SEQ ID NO: 918729 - RNA, 13 nt, Homo sapiens
augguaauacaca

SEQ ID NO: 918730 - RNA, 15 nt, Homo sapiens
augguagacugugac

SEQ ID NO: 918731 - RNA, 14 nt, Homo sapiens
auguaaacaaucag

SEQ ID NO: 918732 - RNA, 12 nt, Homo sapiens
auguaaccaagc

SEQ ID NO: 918733 - RNA, 18 nt, Homo sapiens
auguaaguugaccuucuc

SEQ ID NO: 918734 - RNA, 22 nt, Homo sapiens
auguacuuccaguauccugaaa

SEQ ID NO: 918735 - RNA, 17 nt, Homo sapiens
auguagauaaagcacug

SEQ ID NO: 918736 - RNA, 13 nt, Homo sapiens
auguagauugccu

SEQ ID NO: 918737 - RNA, 20 nt, Homo sapiens
auguagcaguucugcacuuu

SEQ ID NO: 918738 - RNA, 17 nt, Homo sapiens
auguagccagacaguuu

SEQ ID NO: 918739 - RNA, 15 nt, Homo sapiens
auguauagcuuaaga

SEQ ID NO: 918740 - RNA, 13 nt, Homo sapiens
auguccaggaaag

SEQ ID NO: 918741 - RNA, 20 nt, Homo sapiens
augucccccaccucuuuucc

SEQ ID NO: 918742 - RNA, 14 nt, Homo sapiens
auguccuauucauu

SEQ ID NO: 918743 - RNA, 13 nt, Homo sapiens
augugaacugacu

SEQ ID NO: 918744 - RNA, 21 nt, Homo sapiens
augugagcaugaaacuaugca

SEQ ID NO: 918745 - RNA, 17 nt, Homo sapiens
auguguucuuuguucca

SEQ ID NO: 918746 - RNA, 15 nt, Homo sapiens
auguguuguacaaua

SEQ ID NO: 918747 - RNA, 20 nt, Homo sapiens
auguuaagggcuuuaauaca

SEQ ID NO: 918748 - RNA, 21 nt, Homo sapiens
auguucuauuucagugccaau

SEQ ID NO: 918749 - RNA, 20 nt, Homo sapiens
auguugaccuuugcaaaaug

SEQ ID NO: 918750 - RNA, 13 nt, Homo sapiens
auguuugcauuaa

SEQ ID NO: 918751 - RNA, 16 nt, Homo sapiens
auuaacaagcucuuac

SEQ ID NO: 918752 - RNA, 20 nt, Homo sapiens
auuaacugaauucugaacuu

SEQ ID NO: 918753 - RNA, 18 nt, Homo sapiens
auuaagcaaacacuugaa

SEQ ID NO: 918754 - RNA, 20 nt, Homo sapiens
auuacuaggagauaccaccg

SEQ ID NO: 918755 - RNA, 16 nt, Homo sapiens
auuagaaaccaugaaa

SEQ ID NO: 918756 - RNA, 12 nt, Homo sapiens
auuagaugacug

SEQ ID NO: 918757 - RNA, 18 nt, Homo sapiens
auuaucuacuuacuugag

SEQ ID NO: 918758 - RNA, 18 nt, Homo sapiens
auuauuacuccuugccau

SEQ ID NO: 918759 - RNA, 18 nt, Homo sapiens
auuauuugucuccaugau

SEQ ID NO: 918760 - RNA, 14 nt, Homo sapiens
auucaagauuacaa

SEQ ID NO: 918761 - RNA, 18 nt, Homo sapiens
auucagagaauagcaguu

SEQ ID NO: 918762 - RNA, 22 nt, Homo sapiens
auucagcucuggagaacagugg

SEQ ID NO: 918763 - RNA, 14 nt, Homo sapiens
auucagugcauuuu

SEQ ID NO: 918764 - RNA, 16 nt, Homo sapiens
auucagugcauuuuca

SEQ ID NO: 918765 - RNA, 22 nt, Homo sapiens
auucauaccuguuguacacuug

SEQ ID NO: 918766 - RNA, 14 nt, Homo sapiens
auucauuccauuug

SEQ ID NO: 918767 - RNA, 20 nt, Homo sapiens
auucauuucaucuacuacag

SEQ ID NO: 918768 - RNA, 16 nt, Homo sapiens
auuccuaauaaacugc

SEQ ID NO: 918769 - RNA, 12 nt, Homo sapiens
auuccuauuuaa

SEQ ID NO: 918770 - RNA, 18 nt, Homo sapiens
auucgcagugcccaguga

SEQ ID NO: 918771 - RNA, 14 nt, Homo sapiens
auucugucuuccag

SEQ ID NO: 918772 - RNA, 17 nt, Homo sapiens
auucuuauaguaccuca

SEQ ID NO: 918773 - RNA, 23 nt, Homo sapiens
auucuucuucucaagcacugaca

SEQ ID NO: 918774 - RNA, 15 nt, Homo sapiens
auucuuuccaugcag

SEQ ID NO: 918775 - RNA, 23 nt, Homo sapiens
auugagccuuuuauuaacauaua

SEQ ID NO: 918776 - RNA, 19 nt, Homo sapiens
auugauugaacguucucaa

SEQ ID NO: 918777 - RNA, 19 nt, Homo sapiens
auugcaaccuaguacuuua

SEQ ID NO: 918778 - RNA, 15 nt, Homo sapiens
auugcacgugcaaua

SEQ ID NO: 918779 - RNA, 16 nt, Homo sapiens
auugccagcucuucca

SEQ ID NO: 918780 - RNA, 19 nt, Homo sapiens
auugcugugaauuagcuca

SEQ ID NO: 918781 - RNA, 14 nt, Homo sapiens
auuguaccaaagcu

SEQ ID NO: 918782 - RNA, 18 nt, Homo sapiens
auuuaacccuuucuucaa

SEQ ID NO: 918783 - RNA, 20 nt, Homo sapiens
auuuaguaaaaauaaaucaa

SEQ ID NO: 918784 - RNA, 15 nt, Homo sapiens
auuucacucuggcau

SEQ ID NO: 918785 - RNA, 16 nt, Homo sapiens
auuucaucuacuacag

SEQ ID NO: 918786 - RNA, 20 nt, Homo sapiens
auuuccucuuccuagcuuaa

SEQ ID NO: 918787 - RNA, 16 nt, Homo sapiens
auuucuucacgcaccu

SEQ ID NO: 918788 - RNA, 23 nt, Homo sapiens
auuucuuccuucaaauccugcca

SEQ ID NO: 918789 - RNA, 15 nt, Homo sapiens
auuucuucugcacaa

SEQ ID NO: 918790 - RNA, 22 nt, Homo sapiens
auuugaaacugcuaauuacaca

SEQ ID NO: 918791 - RNA, 12 nt, Homo sapiens
auuugccaugcu

SEQ ID NO: 918792 - RNA, 16 nt, Homo sapiens
auuugccccaacuuaa

SEQ ID NO: 918793 - RNA, 18 nt, Homo sapiens
auuugucuccaugauacc

SEQ ID NO: 918794 - RNA, 21 nt, Homo sapiens
auuugugguugcaugucuguu

SEQ ID NO: 918795 - RNA, 14 nt, Homo sapiens
auuuuaaaauuuca

SEQ ID NO: 918796 - RNA, 20 nt, Homo sapiens
auuuuaaaggaagaaaccau

SEQ ID NO: 918797 - RNA, 19 nt, Homo sapiens
auuuuaccugggauaugac

SEQ ID NO: 918798 - RNA, 16 nt, Homo sapiens
auuuucaaaaccagcu

SEQ ID NO: 918799 - RNA, 19 nt, Homo sapiens
auuuucacuuuuaaacuac

SEQ ID NO: 918800 - RNA, 19 nt, Homo sapiens
auuuuccgccagaccucaa

SEQ ID NO: 918801 - RNA, 17 nt, Homo sapiens
auuuucuaaccaaauac

SEQ ID NO: 918802 - RNA, 15 nt, Homo sapiens
auuuucuggaaugga

SEQ ID NO: 918803 - RNA, 14 nt, Homo sapiens
auuuucuucacacu

SEQ ID NO: 918804 - RNA, 16 nt, Homo sapiens
auuuugcaaagauuua

SEQ ID NO: 918805 - RNA, 16 nt, Homo sapiens
auuuuggaucuaucac

SEQ ID NO: 918806 - RNA, 12 nt, Homo sapiens
auuuuuacuugu

SEQ ID NO: 918807 - RNA, 15 nt, Homo sapiens
auuuuuagauuccca

SEQ ID NO: 918808 - RNA, 23 nt, Homo sapiens
auuuuucucuuuuaaucuaucua

SEQ ID NO: 918809 - RNA, 19 nt, Homo sapiens
gccacauucaccaaccaaa

SEQ ID NO: 918810 - RNA, 16 nt, Homo sapiens
gccaccaagggccuca

SEQ ID NO: 918811 - RNA, 18 nt, Homo sapiens
gccaccacucaagcaaca

SEQ ID NO: 918812 - RNA, 17 nt, Homo sapiens
gccacuaucacauaugc

SEQ ID NO: 918813 - RNA, 17 nt, Homo sapiens
gccacucaccaacccag

SEQ ID NO: 918814 - RNA, 21 nt, Homo sapiens
gccacugagcccagccuacuu

SEQ ID NO: 918815 - RNA, 13 nt, Homo sapiens
gccacugccagcu

SEQ ID NO: 918816 - RNA, 19 nt, Homo sapiens
gccacugugcccagcaguu

SEQ ID NO: 918817 - RNA, 12 nt, Homo sapiens
gccagaccucaa

SEQ ID NO: 918818 - RNA, 18 nt, Homo sapiens
gccaggcugcggugggca

SEQ ID NO: 918819 - RNA, 16 nt, Homo sapiens
gccaguaaggcagcuc

SEQ ID NO: 918820 - RNA, 22 nt, Homo sapiens
gccaguggagacuggaacacaa

SEQ ID NO: 918821 - RNA, 19 nt, Homo sapiens
gccaucagaggccuaguca

SEQ ID NO: 918822 - RNA, 17 nt, Homo sapiens
gccaugauuuuggccac

SEQ ID NO: 918823 - RNA, 18 nt, Homo sapiens
gcccaaaaacaagcaaaa

SEQ ID NO: 918824 - RNA, 14 nt, Homo sapiens
gcccaaucacugcc

SEQ ID NO: 918825 - RNA, 17 nt, Homo sapiens
gcccaauucugccacuu

SEQ ID NO: 918826 - RNA, 20 nt, Homo sapiens
gcccacccgucuucaaucuc

SEQ ID NO: 918827 - RNA, 20 nt, Homo sapiens
gcccaggcuggagugcagug

SEQ ID NO: 918828 - RNA, 21 nt, Homo sapiens
gccccaucaggacucuuguga

SEQ ID NO: 918829 - RNA, 21 nt, Homo sapiens
gccccaugaguuugccauguu

SEQ ID NO: 918830 - RNA, 17 nt, Homo sapiens
gcccccagcugcuccuc

SEQ ID NO: 918831 - RNA, 22 nt, Homo sapiens
gccccugccgccugugcccuug

SEQ ID NO: 918832 - RNA, 15 nt, Homo sapiens
gcccuaaacacacgc

SEQ ID NO: 918833 - RNA, 22 nt, Homo sapiens
gcccuaauuguguuugauuuca

SEQ ID NO: 918834 - RNA, 19 nt, Homo sapiens
gcccugaaggugccacucc

SEQ ID NO: 918835 - RNA, 14 nt, Homo sapiens
gccgggcucagugg

SEQ ID NO: 918836 - RNA, 21 nt, Homo sapiens
gccgggcucaguggcucacac

SEQ ID NO: 918837 - RNA, 17 nt, Homo sapiens
gccuaaagaaacucagc

SEQ ID NO: 918838 - RNA, 17 nt, Homo sapiens
gccuaaagccagcauuu

SEQ ID NO: 918839 - RNA, 18 nt, Homo sapiens
gccuaaagccagcauuuc

SEQ ID NO: 918840 - RNA, 22 nt, Homo sapiens
gccucaguuucuucaccuguaa

SEQ ID NO: 918841 - RNA, 15 nt, Homo sapiens
gccucauuacuuuac

SEQ ID NO: 918842 - RNA, 22 nt, Homo sapiens
gccucuuccucccucccugcag

SEQ ID NO: 918843 - RNA, 21 nt, Homo sapiens
gccucuugcuggugcacauga

SEQ ID NO: 918844 - RNA, 15 nt, Homo sapiens
gccugcaccccagga

SEQ ID NO: 918845 - RNA, 21 nt, Homo sapiens
gccugcuuugugcaggguccu

SEQ ID NO: 918846 - RNA, 19 nt, Homo sapiens
gccugggggcuuuugccac

SEQ ID NO: 918847 - RNA, 14 nt, Homo sapiens
gccuguccuggauc

SEQ ID NO: 918848 - RNA, 19 nt, Homo sapiens
gccugugccgcacuagccu

SEQ ID NO: 918849 - RNA, 20 nt, Homo sapiens
gccuucuccccuccaaguga

SEQ ID NO: 918850 - RNA, 20 nt, Homo sapiens
gccuucuuuuguacuuuuca

SEQ ID NO: 918851 - RNA, 15 nt, Homo sapiens
gccuugcugcaccug

SEQ ID NO: 918852 - RNA, 17 nt, Homo sapiens
gccuuuguucacuguga

SEQ ID NO: 918853 - RNA, 16 nt, Homo sapiens
gccuuuuauggaccaa

SEQ ID NO: 918854 - RNA, 12 nt, Homo sapiens
gccuuuugcccg

SEQ ID NO: 918855 - RNA, 22 nt, Homo sapiens
gcgacucuccugccucagccuc

SEQ ID NO: 918856 - RNA, 23 nt, Homo sapiens
gcgccaggagccuggacccggcc

SEQ ID NO: 918857 - RNA, 15 nt, Homo sapiens
gcggccgccuguccu

SEQ ID NO: 918858 - RNA, 22 nt, Homo sapiens
gcuaaaaugaaaaauagugugu

SEQ ID NO: 918859 - RNA, 14 nt, Homo sapiens
gcuaagccugauga

SEQ ID NO: 918860 - RNA, 22 nt, Homo sapiens
gcuacaagagggcaaagcugau

SEQ ID NO: 918861 - RNA, 16 nt, Homo sapiens
gcuagccacuggaaau

SEQ ID NO: 918862 - RNA, 16 nt, Homo sapiens
gcuauggaaccagcag

SEQ ID NO: 918863 - RNA, 18 nt, Homo sapiens
gcuauuaagaaaaucaca

SEQ ID NO: 918864 - RNA, 23 nt, Homo sapiens
gcuauuugccaagaccauuucac

SEQ ID NO: 918865 - RNA, 15 nt, Homo sapiens
gcucaugucuguuaa

SEQ ID NO: 918866 - RNA, 16 nt, Homo sapiens
gcuccagacacacagc

SEQ ID NO: 918867 - RNA, 21 nt, Homo sapiens
gcucgcuggaccaaccccagg

SEQ ID NO: 918868 - RNA, 22 nt, Homo sapiens
gcucguguuugcuacaaauagu

SEQ ID NO: 918869 - RNA, 13 nt, Homo sapiens
gcucuucauuuau

SEQ ID NO: 918870 - RNA, 18 nt, Homo sapiens
gcucuuggggccagccua

SEQ ID NO: 918871 - RNA, 21 nt, Homo sapiens
gcugaaggcaguggcagggga

SEQ ID NO: 918872 - RNA, 17 nt, Homo sapiens
gcugagaacaccccagc

SEQ ID NO: 918873 - RNA, 17 nt, Homo sapiens
gcugagauuacaggugu

SEQ ID NO: 918874 - RNA, 22 nt, Homo sapiens
gcugauucaauaaaaugcacug

SEQ ID NO: 918875 - RNA, 18 nt, Homo sapiens
gcugauuuagaccaaaag

SEQ ID NO: 918876 - RNA, 23 nt, Homo sapiens
gcugauuuuuuuuuuaacuugaa

SEQ ID NO: 918877 - RNA, 14 nt, Homo sapiens
gcugcucuacugcu

SEQ ID NO: 918878 - RNA, 16 nt, Homo sapiens
gcugcugaccagcacu

SEQ ID NO: 918879 - RNA, 22 nt, Homo sapiens
gcugcuggcacagacuucacac

SEQ ID NO: 918880 - RNA, 14 nt, Homo sapiens
gcugggagagccaa

SEQ ID NO: 918881 - RNA, 16 nt, Homo sapiens
gcugggauuacaggug

SEQ ID NO: 918882 - RNA, 15 nt, Homo sapiens
gcugguaagggccaa

SEQ ID NO: 918883 - RNA, 15 nt, Homo sapiens
gcuggugcacaugac

SEQ ID NO: 918884 - RNA, 24 nt, Homo sapiens
gcuggugcacaugacauuuguccu

SEQ ID NO: 918885 - RNA, 15 nt, Homo sapiens
gcuggugggcaccaa

SEQ ID NO: 918886 - RNA, 19 nt, Homo sapiens
gcuguccaggaacuuucca

SEQ ID NO: 918887 - RNA, 21 nt, Homo sapiens
gcuguuuuuaauccaguuuag

SEQ ID NO: 918888 - RNA, 19 nt, Homo sapiens
gcuuaaggggguguaauga

SEQ ID NO: 918889 - RNA, 16 nt, Homo sapiens
gcuuauauuaagcaaa

SEQ ID NO: 918890 - RNA, 15 nt, Homo sapiens
gcuucaauacccaaa

SEQ ID NO: 918891 - RNA, 21 nt, Homo sapiens
gcuucuuuuggaaaguacuau

SEQ ID NO: 918892 - RNA, 16 nt, Homo sapiens
gcuuguuccacugcaa

SEQ ID NO: 918893 - RNA, 13 nt, Homo sapiens
gcuuuacugccuu

SEQ ID NO: 918894 - RNA, 16 nt, Homo sapiens
gcuuucugucugugaa

SEQ ID NO: 918895 - RNA, 19 nt, Homo sapiens
gcuuuggacacacacagcu

SEQ ID NO: 918896 - RNA, 20 nt, Homo sapiens
gcuuuggacacacacagcuu

SEQ ID NO: 918897 - RNA, 13 nt, Homo sapiens
gcuuuugugucua

SEQ ID NO: 918898 - RNA, 22 nt, Homo sapiens
gcuuuuucucccuuuguuuaaa

SEQ ID NO: 918899 - RNA, 16 nt, Homo sapiens
ggaaaaauccugucau

SEQ ID NO: 918900 - RNA, 16 nt, Homo sapiens
ggaaagauugugucug

SEQ ID NO: 918901 - RNA, 13 nt, Homo sapiens
ggaacacaaccau

SEQ ID NO: 918902 - RNA, 15 nt, Homo sapiens
ggaacacaaccauag

SEQ ID NO: 918903 - RNA, 19 nt, Homo sapiens
ggaaggaugacuugacaag

SEQ ID NO: 918904 - RNA, 14 nt, Homo sapiens
ggaaggcuugcagu

SEQ ID NO: 918905 - RNA, 18 nt, Homo sapiens
ggaaucuuuuacugugga

SEQ ID NO: 918906 - RNA, 18 nt, Homo sapiens
ggaaugaauacagcauuu

SEQ ID NO: 918907 - RNA, 19 nt, Homo sapiens
ggaaugaauacagcauuua

SEQ ID NO: 918908 - RNA, 18 nt, Homo sapiens
ggacagcggguaaaaaga

SEQ ID NO: 918909 - RNA, 18 nt, Homo sapiens
ggacagcuuuccugggug

SEQ ID NO: 918910 - RNA, 22 nt, Homo sapiens
ggaccaauuagcauuccaucaa

SEQ ID NO: 918911 - RNA, 14 nt, Homo sapiens
ggaccucaaaauaa

SEQ ID NO: 918912 - RNA, 16 nt, Homo sapiens
ggacgcagacugacuc

SEQ ID NO: 918913 - RNA, 14 nt, Homo sapiens
ggacgccuguguca

SEQ ID NO: 918914 - RNA, 13 nt, Homo sapiens
ggacuauugcaau

SEQ ID NO: 918915 - RNA, 17 nt, Homo sapiens
ggacuauuucuggcacu

SEQ ID NO: 918916 - RNA, 11 nt, Homo sapiens
ggacugugucc

SEQ ID NO: 918917 - RNA, 18 nt, Homo sapiens
ggagagaaaguuacuguu

SEQ ID NO: 918918 - RNA, 22 nt, Homo sapiens
ggagagaaugagagagugugga

SEQ ID NO: 918919 - RNA, 22 nt, Homo sapiens
ggagagccaaggccuaugccac

SEQ ID NO: 918920 - RNA, 16 nt, Homo sapiens
ggagccaccuguccca

SEQ ID NO: 918921 - RNA, 21 nt, Homo sapiens
ggagccaccugucccaccuca

SEQ ID NO: 918922 - RNA, 16 nt, Homo sapiens
ggagcuguaaaccaga

SEQ ID NO: 918923 - RNA, 14 nt, Homo sapiens
ggaggccaaggugg

SEQ ID NO: 918924 - RNA, 16 nt, Homo sapiens
ggaggccaaggugggc

SEQ ID NO: 918925 - RNA, 18 nt, Homo sapiens
ggaggccguucagcugug

SEQ ID NO: 918926 - RNA, 17 nt, Homo sapiens
ggagggucagugccaag

SEQ ID NO: 918927 - RNA, 18 nt, Homo sapiens
ggagguugagaaugcagu

SEQ ID NO: 918928 - RNA, 16 nt, Homo sapiens
ggagguugcagugagc

SEQ ID NO: 918929 - RNA, 23 nt, Homo sapiens
ggagucuaucuggcauucagaga

SEQ ID NO: 918930 - RNA, 21 nt, Homo sapiens
ggauauacugcagcuuuacug

SEQ ID NO: 918931 - RNA, 19 nt, Homo sapiens
auuuuuugcugcagacuca

SEQ ID NO: 918932 - RNA, 12 nt, Homo sapiens
caaaaaaaccuu

SEQ ID NO: 918933 - RNA, 17 nt, Homo sapiens
caaaaacaaagugcaaa

SEQ ID NO: 918934 - RNA, 13 nt, Homo sapiens
caaaacacugucu

SEQ ID NO: 918935 - RNA, 17 nt, Homo sapiens
caaaacacugucugcau

SEQ ID NO: 918936 - RNA, 23 nt, Homo sapiens
caaaaccaaugagcauuacuuuc

SEQ ID NO: 918937 - RNA, 16 nt, Homo sapiens
caaaaguuuaaaaagc

SEQ ID NO: 918938 - RNA, 19 nt, Homo sapiens
caaaauacagcacuuugac

SEQ ID NO: 918939 - RNA, 19 nt, Homo sapiens
caaaauacuacacauccaa

SEQ ID NO: 918940 - RNA, 14 nt, Homo sapiens
caaaaugguuuauu

SEQ ID NO: 918941 - RNA, 14 nt, Homo sapiens
caaaauguuaauaa

SEQ ID NO: 918942 - RNA, 13 nt, Homo sapiens
caaacagcucagg

SEQ ID NO: 918943 - RNA, 15 nt, Homo sapiens
caaaccacuguacau

SEQ ID NO: 918944 - RNA, 13 nt, Homo sapiens
caaagaggugacu

SEQ ID NO: 918945 - RNA, 16 nt, Homo sapiens
caaagauucugcauuu

SEQ ID NO: 918946 - RNA, 16 nt, Homo sapiens
caaaggaagcuuucuc

SEQ ID NO: 918947 - RNA, 19 nt, Homo sapiens
caaaggagacuuaauuuca

SEQ ID NO: 918948 - RNA, 13 nt, Homo sapiens
caaagggggacag

SEQ ID NO: 918949 - RNA, 15 nt, Homo sapiens
caaaggugauuuucc

SEQ ID NO: 918950 - RNA, 16 nt, Homo sapiens
caaaggugauuuuccu

SEQ ID NO: 918951 - RNA, 20 nt, Homo sapiens
caaagugcuagccacuggaa

SEQ ID NO: 918952 - RNA, 19 nt, Homo sapiens
caaagugcugggauuacag

SEQ ID NO: 918953 - RNA, 12 nt, Homo sapiens
caaauacauuaa

SEQ ID NO: 918954 - RNA, 22 nt, Homo sapiens
caaaugauuuacacugacuguu

SEQ ID NO: 918955 - RNA, 23 nt, Homo sapiens
caaaugcuucuaaauaugaagga

SEQ ID NO: 918956 - RNA, 18 nt, Homo sapiens
caaauuucaucuuuccaa

SEQ ID NO: 918957 - RNA, 13 nt, Homo sapiens
caacaacugucag

SEQ ID NO: 918958 - RNA, 23 nt, Homo sapiens
caacaguuaaacuugcaaugaaa

SEQ ID NO: 918959 - RNA, 20 nt, Homo sapiens
caacccugagguaucugugu

SEQ ID NO: 918960 - RNA, 11 nt, Homo sapiens
caacccugugu

SEQ ID NO: 918961 - RNA, 15 nt, Homo sapiens
caaccuugugugagu

SEQ ID NO: 918962 - RNA, 14 nt, Homo sapiens
caacgcaaaccucu

SEQ ID NO: 918963 - RNA, 20 nt, Homo sapiens
caacuagggagugagugcaa

SEQ ID NO: 918964 - RNA, 17 nt, Homo sapiens
caacuccacugucuuua

SEQ ID NO: 918965 - RNA, 18 nt, Homo sapiens
caacuccuggagauuuca

SEQ ID NO: 918966 - RNA, 17 nt, Homo sapiens
caacugaucauuugcag

SEQ ID NO: 918967 - RNA, 20 nt, Homo sapiens
caacugcucucaaaauguga

SEQ ID NO: 918968 - RNA, 15 nt, Homo sapiens
caacuggaaagucaa

SEQ ID NO: 918969 - RNA, 13 nt, Homo sapiens
caagaaaaauaau

SEQ ID NO: 918970 - RNA, 16 nt, Homo sapiens
caagauuccuuuccac

SEQ ID NO: 918971 - RNA, 22 nt, Homo sapiens
caagauuccuuuccacuccaac

SEQ ID NO: 918972 - RNA, 15 nt, Homo sapiens
caagcaaaaccaaag

SEQ ID NO: 918973 - RNA, 17 nt, Homo sapiens
caaggcaggcauaucaa

SEQ ID NO: 918974 - RNA, 22 nt, Homo sapiens
caaggucacuuugcguguguca

SEQ ID NO: 918975 - RNA, 14 nt, Homo sapiens
caaguaacaaugca

SEQ ID NO: 918976 - RNA, 13 nt, Homo sapiens
caagucccaugau

SEQ ID NO: 918977 - RNA, 13 nt, Homo sapiens
caagucugugaaa

SEQ ID NO: 918978 - RNA, 12 nt, Homo sapiens
caagugagcaaa

SEQ ID NO: 918979 - RNA, 22 nt, Homo sapiens
caagugagcaaaccugccccau

SEQ ID NO: 918980 - RNA, 14 nt, Homo sapiens
caagugcugucuug

SEQ ID NO: 918981 - RNA, 22 nt, Homo sapiens
caauaaaguacugcaaaaugcu

SEQ ID NO: 918982 - RNA, 16 nt, Homo sapiens
caauaauucuguauua

SEQ ID NO: 918983 - RNA, 14 nt, Homo sapiens
caauaccagaucac

SEQ ID NO: 918984 - RNA, 14 nt, Homo sapiens
caauaucaauaugg

SEQ ID NO: 918985 - RNA, 20 nt, Homo sapiens
caauaugaacugcaggcaaa

SEQ ID NO: 918986 - RNA, 20 nt, Homo sapiens
caaucacaaaaguauauuca

SEQ ID NO: 918987 - RNA, 15 nt, Homo sapiens
caaucagcagucuag

SEQ ID NO: 918988 - RNA, 20 nt, Homo sapiens
caauuuucuucacacuauca

SEQ ID NO: 918989 - RNA, 15 nt, Homo sapiens
cacaaacucauccau

SEQ ID NO: 918990 - RNA, 15 nt, Homo sapiens
cacaaauguuuuaaa

SEQ ID NO: 918991 - RNA, 22 nt, Homo sapiens
cacaacuugagaagacauuuau

SEQ ID NO: 918992 - RNA, 22 nt, Homo sapiens
cacaagaagugggagugggaga

SEQ ID NO: 918993 - RNA, 11 nt, Homo sapiens
cacacacagcu

SEQ ID NO: 918994 - RNA, 13 nt, Homo sapiens
cacacccagccuc

SEQ ID NO: 918995 - RNA, 23 nt, Homo sapiens
cacaccccuguacccccccaggg

SEQ ID NO: 918996 - RNA, 19 nt, Homo sapiens
cacaccuagcgucaguauu

SEQ ID NO: 918997 - RNA, 15 nt, Homo sapiens
cacacucuucaguga

SEQ ID NO: 918998 - RNA, 12 nt, Homo sapiens
cacacugaaccg

SEQ ID NO: 918999 - RNA, 13 nt, Homo sapiens
cacagaggcagug

SEQ ID NO: 919000 - RNA, 17 nt, Homo sapiens
cacagaucuguaauuca

SEQ ID NO: 919001 - RNA, 23 nt, Homo sapiens
cacagauuaucuuguacagccuu

SEQ ID NO: 919002 - RNA, 16 nt, Homo sapiens
cacagcaaaugagaug

SEQ ID NO: 919003 - RNA, 14 nt, Homo sapiens
cacagcugugguga

SEQ ID NO: 919004 - RNA, 11 nt, Homo sapiens
cacaggcaaug

SEQ ID NO: 919005 - RNA, 15 nt, Homo sapiens
cacagggacacaaag

SEQ ID NO: 919006 - RNA, 13 nt, Homo sapiens
cacagggacacag

SEQ ID NO: 919007 - RNA, 20 nt, Homo sapiens
cacauagaugucuguaacca

SEQ ID NO: 919008 - RNA, 18 nt, Homo sapiens
cacauauggaauuuugca

SEQ ID NO: 919009 - RNA, 18 nt, Homo sapiens
cacaucaaguguuccauu

SEQ ID NO: 919010 - RNA, 15 nt, Homo sapiens
cacauccaacauuuc

SEQ ID NO: 919011 - RNA, 18 nt, Homo sapiens
cacaucuaacaaagucaa

SEQ ID NO: 919012 - RNA, 12 nt, Homo sapiens
cacauuacauga

SEQ ID NO: 919013 - RNA, 17 nt, Homo sapiens
caccagcaguguuuaaa

SEQ ID NO: 919014 - RNA, 18 nt, Homo sapiens
cacccaggccacugaccu

SEQ ID NO: 919015 - RNA, 16 nt, Homo sapiens
caccgagaggaaaaag

SEQ ID NO: 919016 - RNA, 22 nt, Homo sapiens
caccgagaggaaaaaggcuucu

SEQ ID NO: 919017 - RNA, 19 nt, Homo sapiens
caccuccuucucugucuca

SEQ ID NO: 919018 - RNA, 21 nt, Homo sapiens
caccucuuacuuccugccuca

SEQ ID NO: 919019 - RNA, 17 nt, Homo sapiens
caccugagcuuuggaca

SEQ ID NO: 919020 - RNA, 18 nt, Homo sapiens
caccuuucccagauucuc

SEQ ID NO: 919021 - RNA, 14 nt, Homo sapiens
cacgaccuacauua

SEQ ID NO: 919022 - RNA, 21 nt, Homo sapiens
cacgacuucugcccauucucu

SEQ ID NO: 919023 - RNA, 12 nt, Homo sapiens
cacgcugccauu

SEQ ID NO: 919024 - RNA, 21 nt, Homo sapiens
cacgcuucaaggauauacugc

SEQ ID NO: 919025 - RNA, 24 nt, Homo sapiens
cacgugcaauacggaacacuguca

SEQ ID NO: 919026 - RNA, 16 nt, Homo sapiens
cacuaucaacacugca

SEQ ID NO: 919027 - RNA, 15 nt, Homo sapiens
cacuauggugccaau

SEQ ID NO: 919028 - RNA, 14 nt, Homo sapiens
cacucaucacuaaa

SEQ ID NO: 919029 - RNA, 21 nt, Homo sapiens
cacucauuaccgucugugauu

SEQ ID NO: 919030 - RNA, 16 nt, Homo sapiens
cacucauuuauuucca

SEQ ID NO: 919031 - RNA, 22 nt, Homo sapiens
cacucugagugaauacuuugau

SEQ ID NO: 919032 - RNA, 13 nt, Homo sapiens
cacugcacuccag

SEQ ID NO: 919033 - RNA, 23 nt, Homo sapiens
cacuggucaucaguauuguguaa

SEQ ID NO: 919034 - RNA, 18 nt, Homo sapiens
cacuggucgagagccaaa

SEQ ID NO: 919035 - RNA, 16 nt, Homo sapiens
cacuuauuuccaugga

SEQ ID NO: 919036 - RNA, 20 nt, Homo sapiens
cacuugaaagugaacaauca

SEQ ID NO: 919037 - RNA, 22 nt, Homo sapiens
cacuuggugauauguccuauau

SEQ ID NO: 919038 - RNA, 18 nt, Homo sapiens
cacuuugcgugugucaua

SEQ ID NO: 919039 - RNA, 21 nt, Homo sapiens
cacuuugguauucaauuugau

SEQ ID NO: 919040 - RNA, 19 nt, Homo sapiens
cagaaacuaccagauuuga

SEQ ID NO: 919041 - RNA, 16 nt, Homo sapiens
cagaaauaagugcugu

SEQ ID NO: 919042 - RNA, 14 nt, Homo sapiens
cagaaauccuuuca

SEQ ID NO: 919043 - RNA, 16 nt, Homo sapiens
cagaaaugccacucac

SEQ ID NO: 919044 - RNA, 13 nt, Homo sapiens
cagaagcuaugga

SEQ ID NO: 919045 - RNA, 21 nt, Homo sapiens
cagaagcuccgugagccucag

SEQ ID NO: 919046 - RNA, 23 nt, Homo sapiens
cagaaggaaagaagggggcccug

SEQ ID NO: 919047 - RNA, 16 nt, Homo sapiens
cagaaguuaguuugua

SEQ ID NO: 919048 - RNA, 19 nt, Homo sapiens
cagaaguuaguuuguauau

SEQ ID NO: 919049 - RNA, 18 nt, Homo sapiens
cagaauuuugggacauuu

SEQ ID NO: 919050 - RNA, 19 nt, Homo sapiens
cagagaauagcaguuucac

SEQ ID NO: 919051 - RNA, 22 nt, Homo sapiens
cagagccacccaggccacugac

SEQ ID NO: 919052 - RNA, 15 nt, Homo sapiens
cagagcgcaaagugc

SEQ ID NO: 919053 - RNA, 20 nt, Homo sapiens
cagaguggauuaaaggcaaa

SEQ ID NO: 919054 - RNA, 12 nt, Homo sapiens
ggauaugagaug

SEQ ID NO: 919055 - RNA, 17 nt, Homo sapiens
ggaugaauugccugucc

SEQ ID NO: 919056 - RNA, 15 nt, Homo sapiens
ggaugcagugccuuu

SEQ ID NO: 919057 - RNA, 20 nt, Homo sapiens
ggaugcauucccuacagauu

SEQ ID NO: 919058 - RNA, 12 nt, Homo sapiens
ggauuacaggug

SEQ ID NO: 919059 - RNA, 14 nt, Homo sapiens
ggauuacaggugac

SEQ ID NO: 919060 - RNA, 20 nt, Homo sapiens
ggauuacaggugacugccac

SEQ ID NO: 919061 - RNA, 21 nt, Homo sapiens
ggauucuggccuagucccuuc

SEQ ID NO: 919062 - RNA, 18 nt, Homo sapiens
ggauuuuccaccaaauuc

SEQ ID NO: 919063 - RNA, 22 nt, Homo sapiens
ggcaguuacagggcccagguga

SEQ ID NO: 919064 - RNA, 13 nt, Homo sapiens
ggcauucgcagug

SEQ ID NO: 919065 - RNA, 20 nt, Homo sapiens
ggcauucgcagugcccagug

SEQ ID NO: 919066 - RNA, 21 nt, Homo sapiens
ggcauucgcagugcccaguga

SEQ ID NO: 919067 - RNA, 18 nt, Homo sapiens
ggcauuuaguacauccag

SEQ ID NO: 919068 - RNA, 23 nt, Homo sapiens
ggccacauucaccaaccaaaggg

SEQ ID NO: 919069 - RNA, 17 nt, Homo sapiens
ggccacuggcaucucug

SEQ ID NO: 919070 - RNA, 13 nt, Homo sapiens
ggcccaauucugc

SEQ ID NO: 919071 - RNA, 18 nt, Homo sapiens
ggcccaauucugccacuu

SEQ ID NO: 919072 - RNA, 15 nt, Homo sapiens
ggcccucugccucau

SEQ ID NO: 919073 - RNA, 16 nt, Homo sapiens
ggccucacuccaggaa

SEQ ID NO: 919074 - RNA, 16 nt, Homo sapiens
ggcucugaacugcaca

SEQ ID NO: 919075 - RNA, 19 nt, Homo sapiens
ggcugcaagcgcacuugau

SEQ ID NO: 919076 - RNA, 21 nt, Homo sapiens
ggcugcaggcucuaugggguu

SEQ ID NO: 919077 - RNA, 14 nt, Homo sapiens
ggcugcggugggca

SEQ ID NO: 919078 - RNA, 19 nt, Homo sapiens
ggcuuugucccacagcuug

SEQ ID NO: 919079 - RNA, 13 nt, Homo sapiens
gggagugggagag

SEQ ID NO: 919080 - RNA, 20 nt, Homo sapiens
gggcacccagccucuaggga

SEQ ID NO: 919081 - RNA, 18 nt, Homo sapiens
gggcagccugugggagaa

SEQ ID NO: 919082 - RNA, 16 nt, Homo sapiens
gggcaugguggugagc

SEQ ID NO: 919083 - RNA, 22 nt, Homo sapiens
gggcuccugcuuccccaucccg

SEQ ID NO: 919084 - RNA, 23 nt, Homo sapiens
gggcuuguuuucuacuuugccac

SEQ ID NO: 919085 - RNA, 13 nt, Homo sapiens
gggcuuuugccac

SEQ ID NO: 919086 - RNA, 20 nt, Homo sapiens
ggggacagaaaugccacuca

SEQ ID NO: 919087 - RNA, 22 nt, Homo sapiens
gggggcucaggccauccagcca

SEQ ID NO: 919088 - RNA, 21 nt, Homo sapiens
gggucuguggccaguugacau

SEQ ID NO: 919089 - RNA, 13 nt, Homo sapiens
gggugaaggugac

SEQ ID NO: 919090 - RNA, 13 nt, Homo sapiens
gggugguguccuu

SEQ ID NO: 919091 - RNA, 23 nt, Homo sapiens
gguaaagccucagcaacagccag

SEQ ID NO: 919092 - RNA, 13 nt, Homo sapiens
gguacuugguaag

SEQ ID NO: 919093 - RNA, 19 nt, Homo sapiens
ggucacuuugcguguguca

SEQ ID NO: 919094 - RNA, 21 nt, Homo sapiens
ggucccgagcccccuguccuu

SEQ ID NO: 919095 - RNA, 23 nt, Homo sapiens
gguccucacaagccucuucugaa

SEQ ID NO: 919096 - RNA, 20 nt, Homo sapiens
ggucugccucugagccacug

SEQ ID NO: 919097 - RNA, 15 nt, Homo sapiens
ggucuugacaccagc

SEQ ID NO: 919098 - RNA, 21 nt, Homo sapiens
ggugauaaguuccaaauaugu

SEQ ID NO: 919099 - RNA, 16 nt, Homo sapiens
ggugcaggacacuggu

SEQ ID NO: 919100 - RNA, 14 nt, Homo sapiens
ggugcagugccgcu

SEQ ID NO: 919101 - RNA, 13 nt, Homo sapiens
ggugcccaccuaa

SEQ ID NO: 919102 - RNA, 12 nt, Homo sapiens
gguggaaggugg

SEQ ID NO: 919103 - RNA, 14 nt, Homo sapiens
ggugugagccacug

SEQ ID NO: 919104 - RNA, 20 nt, Homo sapiens
gguguguucguggagccaca

SEQ ID NO: 919105 - RNA, 19 nt, Homo sapiens
gguuaaauaccuguguuca

SEQ ID NO: 919106 - RNA, 23 nt, Homo sapiens
gguuagaaucccauggauguuuc

SEQ ID NO: 919107 - RNA, 13 nt, Homo sapiens
gguuuagaaucaa

SEQ ID NO: 919108 - RNA, 15 nt, Homo sapiens
gguuuagcugcagga

SEQ ID NO: 919109 - RNA, 17 nt, Homo sapiens
guaaaacuuauauuaaa

SEQ ID NO: 919110 - RNA, 22 nt, Homo sapiens
guaaagccucagcaacagccag

SEQ ID NO: 919111 - RNA, 23 nt, Homo sapiens
guaacaguucccaucaccaucac

SEQ ID NO: 919112 - RNA, 13 nt, Homo sapiens
guaacugcauuag

SEQ ID NO: 919113 - RNA, 22 nt, Homo sapiens
guaacuuaauuuuaauaccacu

SEQ ID NO: 919114 - RNA, 14 nt, Homo sapiens
guaagguauugcaa

SEQ ID NO: 919115 - RNA, 18 nt, Homo sapiens
guaaucccaacacuuugg

SEQ ID NO: 919116 - RNA, 18 nt, Homo sapiens
guaauuuccccacucuga

SEQ ID NO: 919117 - RNA, 16 nt, Homo sapiens
guacagauuguucuca

SEQ ID NO: 919118 - RNA, 19 nt, Homo sapiens
guacccaccugagcuuugg

SEQ ID NO: 919119 - RNA, 17 nt, Homo sapiens
guacuuaaauuacacau

SEQ ID NO: 919120 - RNA, 12 nt, Homo sapiens
guagacauacuu

SEQ ID NO: 919121 - RNA, 14 nt, Homo sapiens
guagacauacuugu

SEQ ID NO: 919122 - RNA, 15 nt, Homo sapiens
guagaggagcagggu

SEQ ID NO: 919123 - RNA, 18 nt, Homo sapiens
guagcagcauuuacagaa

SEQ ID NO: 919124 - RNA, 19 nt, Homo sapiens
guagcauuggucagggaaa

SEQ ID NO: 919125 - RNA, 17 nt, Homo sapiens
guagccagacaguuuau

SEQ ID NO: 919126 - RNA, 22 nt, Homo sapiens
guaggcauucugagcaggggaa

SEQ ID NO: 919127 - RNA, 20 nt, Homo sapiens
guagguuggaagcuagcucc

SEQ ID NO: 919128 - RNA, 11 nt, Homo sapiens
guauauucaaa

SEQ ID NO: 919129 - RNA, 20 nt, Homo sapiens
guaugcacuaaucaauacuu

SEQ ID NO: 919130 - RNA, 21 nt, Homo sapiens
guauguugguuuuuuagugca

SEQ ID NO: 919131 - RNA, 22 nt, Homo sapiens
guauuaaccuaccugugaauca

SEQ ID NO: 919132 - RNA, 22 nt, Homo sapiens
guauucaauuugauucuaugac

SEQ ID NO: 919133 - RNA, 15 nt, Homo sapiens
guauucuagugauaa

SEQ ID NO: 919134 - RNA, 20 nt, Homo sapiens
guauuugaaauaagaauuca

SEQ ID NO: 919135 - RNA, 18 nt, Homo sapiens
guauuuuauaagcauuua

SEQ ID NO: 919136 - RNA, 19 nt, Homo sapiens
guauuuuuaguaaagacag

SEQ ID NO: 919137 - RNA, 18 nt, Homo sapiens
gucaaagugguacaggaa

SEQ ID NO: 919138 - RNA, 18 nt, Homo sapiens
gucaaauuuggauuuucc

SEQ ID NO: 919139 - RNA, 19 nt, Homo sapiens
gucaagacagugucauggu

SEQ ID NO: 919140 - RNA, 17 nt, Homo sapiens
gucacacucuucaguga

SEQ ID NO: 919141 - RNA, 18 nt, Homo sapiens
gucacaggacgauuucac

SEQ ID NO: 919142 - RNA, 18 nt, Homo sapiens
gucagcccugcugucaga

SEQ ID NO: 919143 - RNA, 14 nt, Homo sapiens
cauugguaucugau

SEQ ID NO: 919144 - RNA, 23 nt, Homo sapiens
cauuuagcuuguucacacuuugc

SEQ ID NO: 919145 - RNA, 18 nt, Homo sapiens
cauuuaguacauccagaa

SEQ ID NO: 919146 - RNA, 18 nt, Homo sapiens
cauuuauuuugacuguga

SEQ ID NO: 919147 - RNA, 17 nt, Homo sapiens
cauuucauauaaaugga

SEQ ID NO: 919148 - RNA, 21 nt, Homo sapiens
cauuucauauaaauggaauca

SEQ ID NO: 919149 - RNA, 15 nt, Homo sapiens
cauuuccucaggcaa

SEQ ID NO: 919150 - RNA, 18 nt, Homo sapiens
cauuucuugguaugauca

SEQ ID NO: 919151 - RNA, 19 nt, Homo sapiens
cauuugcauucaauuuaca

SEQ ID NO: 919152 - RNA, 12 nt, Homo sapiens
cauuuugccaaa

SEQ ID NO: 919153 - RNA, 12 nt, Homo sapiens
ccaaaacacugu

SEQ ID NO: 919154 - RNA, 14 nt, Homo sapiens
ccaaaauacuacac

SEQ ID NO: 919155 - RNA, 22 nt, Homo sapiens
ccaaaauccccuucucaucacu

SEQ ID NO: 919156 - RNA, 19 nt, Homo sapiens
ccaaagagcugccuaagag

SEQ ID NO: 919157 - RNA, 17 nt, Homo sapiens
ccaaagggggacaguga

SEQ ID NO: 919158 - RNA, 20 nt, Homo sapiens
ccaaagggggacagugauuu

SEQ ID NO: 919159 - RNA, 12 nt, Homo sapiens
ccaaauacauua

SEQ ID NO: 919160 - RNA, 13 nt, Homo sapiens
ccaaauacauuaa

SEQ ID NO: 919161 - RNA, 22 nt, Homo sapiens
ccaaauauguuaagggcuuuaa

SEQ ID NO: 919162 - RNA, 11 nt, Homo sapiens
ccaaauucuga

SEQ ID NO: 919163 - RNA, 14 nt, Homo sapiens
ccaacaaaccaaga

SEQ ID NO: 919164 - RNA, 17 nt, Homo sapiens
ccaacacaaggugggca

SEQ ID NO: 919165 - RNA, 14 nt, Homo sapiens
ccaacagauuuuau

SEQ ID NO: 919166 - RNA, 23 nt, Homo sapiens
ccaacaguggcuaauaaaaugac

SEQ ID NO: 919167 - RNA, 21 nt, Homo sapiens
ccaacauaaaacaaaaccaag

SEQ ID NO: 919168 - RNA, 17 nt, Homo sapiens
ccaagaguagcaccuuc

SEQ ID NO: 919169 - RNA, 21 nt, Homo sapiens
ccaaggacacgacacacagua

SEQ ID NO: 919170 - RNA, 22 nt, Homo sapiens
ccacagaaggaggaaguggaag

SEQ ID NO: 919171 - RNA, 11 nt, Homo sapiens
ccacagccauc

SEQ ID NO: 919172 - RNA, 18 nt, Homo sapiens
ccacauucaccaaccaaa

SEQ ID NO: 919173 - RNA, 19 nt, Homo sapiens
ccacauucaccaaccaaag

SEQ ID NO: 919174 - RNA, 13 nt, Homo sapiens
ccaccaaauucug

SEQ ID NO: 919175 - RNA, 12 nt, Homo sapiens
ccacccuaucau

SEQ ID NO: 919176 - RNA, 18 nt, Homo sapiens
ccacgccucuugaccagg

SEQ ID NO: 919177 - RNA, 16 nt, Homo sapiens
ccacggugguccccaa

SEQ ID NO: 919178 - RNA, 14 nt, Homo sapiens
guggcaucaggaaa

SEQ ID NO: 919179 - RNA, 15 nt, Homo sapiens
guggggcaaucuauu

SEQ ID NO: 919180 - RNA, 22 nt, Homo sapiens
gugguaaauauagaaccaugaa

SEQ ID NO: 919181 - RNA, 13 nt, Homo sapiens
gugguacaggaag

SEQ ID NO: 919182 - RNA, 18 nt, Homo sapiens
guggugaucgcacaagga

SEQ ID NO: 919183 - RNA, 21 nt, Homo sapiens
guguaacuugugcuuuugcaa

SEQ ID NO: 919184 - RNA, 19 nt, Homo sapiens
guguauuaaaccuuuccau

SEQ ID NO: 919185 - RNA, 16 nt, Homo sapiens
gugucacaaagcuaaa

SEQ ID NO: 919186 - RNA, 20 nt, Homo sapiens
guguccuucuccucuuguag

SEQ ID NO: 919187 - RNA, 16 nt, Homo sapiens
gugugggggucuggga

SEQ ID NO: 919188 - RNA, 20 nt, Homo sapiens
guguuaugcggucuagggaa

SEQ ID NO: 919189 - RNA, 13 nt, Homo sapiens
guguuuaaacuga

SEQ ID NO: 919190 - RNA, 14 nt, Homo sapiens
guuaacacauggcu

SEQ ID NO: 919191 - RNA, 20 nt, Homo sapiens
guuagauuuuguauucaggg

SEQ ID NO: 919192 - RNA, 13 nt, Homo sapiens
guuauaauuugca

SEQ ID NO: 919193 - RNA, 15 nt, Homo sapiens
guuaucccugcacac

SEQ ID NO: 919194 - RNA, 19 nt, Homo sapiens
guuaucccugcacacggca

SEQ ID NO: 919195 - RNA, 13 nt, Homo sapiens
guucacacuuugc

SEQ ID NO: 919196 - RNA, 18 nt, Homo sapiens
guucacacuuugcccuau

SEQ ID NO: 919197 - RNA, 21 nt, Homo sapiens
guuccauacccccacaugcca

SEQ ID NO: 919198 - RNA, 22 nt, Homo sapiens
guuccccacguuuguuccccuu

SEQ ID NO: 919199 - RNA, 17 nt, Homo sapiens
guucccucagugugaag

SEQ ID NO: 919200 - RNA, 15 nt, Homo sapiens
guucuggaacauucu

SEQ ID NO: 919201 - RNA, 15 nt, Homo sapiens
guugaaugagugugu

SEQ ID NO: 919202 - RNA, 16 nt, Homo sapiens
guugauuacuuuucag

SEQ ID NO: 919203 - RNA, 20 nt, Homo sapiens
guuggagccugcucuuugaa

SEQ ID NO: 919204 - RNA, 17 nt, Homo sapiens
guugggauuacagguga

SEQ ID NO: 919205 - RNA, 22 nt, Homo sapiens
guuuacggccuaugagaugaaa

SEQ ID NO: 919206 - RNA, 21 nt, Homo sapiens
guuuagaaucaagucugugaa

SEQ ID NO: 919207 - RNA, 13 nt, Homo sapiens
guuucaguaauag

SEQ ID NO: 919208 - RNA, 20 nt, Homo sapiens
guuucugagacggagucuca

SEQ ID NO: 919209 - RNA, 14 nt, Homo sapiens
guuuucccuguucu

SEQ ID NO: 919210 - RNA, 16 nt, Homo sapiens
guuuuuacaguggaau

SEQ ID NO: 919211 - RNA, 13 nt, Homo sapiens
uaaaaaaugcaga

SEQ ID NO: 919212 - RNA, 17 nt, Homo sapiens
uaaaaacacuaccucuu

SEQ ID NO: 919213 - RNA, 16 nt, Homo sapiens
uaaaaauaugugagca

SEQ ID NO: 919214 - RNA, 22 nt, Homo sapiens
uaaaacaaucuguaauugcuua

SEQ ID NO: 919215 - RNA, 15 nt, Homo sapiens
uaaaaccaccaaagu

SEQ ID NO: 919216 - RNA, 18 nt, Homo sapiens
uaaaacccacaagugucu

SEQ ID NO: 919217 - RNA, 15 nt, Homo sapiens
uaaaacccagcaugu

SEQ ID NO: 919218 - RNA, 16 nt, Homo sapiens
uaaaacccagcaugua

SEQ ID NO: 919219 - RNA, 16 nt, Homo sapiens
uaaaacguuaucucau

SEQ ID NO: 919220 - RNA, 19 nt, Homo sapiens
uaaaagacaagcacuuugg

SEQ ID NO: 919221 - RNA, 20 nt, Homo sapiens
uaaaagcuauaaagcaguau

SEQ ID NO: 919222 - RNA, 22 nt, Homo sapiens
uaaaauaaauuuguaugcucaa

SEQ ID NO: 919223 - RNA, 18 nt, Homo sapiens
uaaaaucaagugcaccua

SEQ ID NO: 919224 - RNA, 21 nt, Homo sapiens
uaaaaucacaaacucauccau

SEQ ID NO: 919225 - RNA, 16 nt, Homo sapiens
uaaaaucugauuuaca

SEQ ID NO: 919226 - RNA, 13 nt, Homo sapiens
uaaaaugcacuga

SEQ ID NO: 919227 - RNA, 21 nt, Homo sapiens
uaaaauuucacucuggcauau

SEQ ID NO: 919228 - RNA, 22 nt, Homo sapiens
uaaacaaucagaccacauuuga

SEQ ID NO: 919229 - RNA, 19 nt, Homo sapiens
uaaacagaaauccuuucau

SEQ ID NO: 919230 - RNA, 10 nt, Homo sapiens
uaaaccaaac

SEQ ID NO: 919231 - RNA, 10 nt, Homo sapiens
uaaaccugga

SEQ ID NO: 919232 - RNA, 13 nt, Homo sapiens
uaaaccuuuccau

SEQ ID NO: 919233 - RNA, 16 nt, Homo sapiens
uaaacuggcaguuaca

SEQ ID NO: 919234 - RNA, 9 nt, Homo sapiens
uaaagcagu

SEQ ID NO: 919235 - RNA, 11 nt, Homo sapiens
uaaagcauuuu

SEQ ID NO: 919236 - RNA, 14 nt, Homo sapiens
uaaagggcaaagga

SEQ ID NO: 919237 - RNA, 21 nt, Homo sapiens
uaaaguaguaaucauaaagga

SEQ ID NO: 919238 - RNA, 17 nt, Homo sapiens
uaaaguaugcaugcagu

SEQ ID NO: 919239 - RNA, 12 nt, Homo sapiens
uaaauacuguac

SEQ ID NO: 919240 - RNA, 15 nt, Homo sapiens
uaaauacuguacaua

SEQ ID NO: 919241 - RNA, 17 nt, Homo sapiens
uaaauauagaaccauga

SEQ ID NO: 919242 - RNA, 13 nt, Homo sapiens
uaaauguucaagu

SEQ ID NO: 919243 - RNA, 20 nt, Homo sapiens
uaaauuaauuugaccaucuc

SEQ ID NO: 919244 - RNA, 17 nt, Homo sapiens
uaaauuacacauguaga

SEQ ID NO: 919245 - RNA, 13 nt, Homo sapiens
uaacaaugcaugc

SEQ ID NO: 919246 - RNA, 17 nt, Homo sapiens
uaacaccaagaguagca

SEQ ID NO: 919247 - RNA, 21 nt, Homo sapiens
uaacaccaagaguagcaccuu

SEQ ID NO: 919248 - RNA, 15 nt, Homo sapiens
uaacauauauuguua

SEQ ID NO: 919249 - RNA, 12 nt, Homo sapiens
uaacaugacaca

SEQ ID NO: 919250 - RNA, 17 nt, Homo sapiens
uaaccccuaugaacucu

SEQ ID NO: 919251 - RNA, 21 nt, Homo sapiens
uaacccuuuucaugauuucaa

SEQ ID NO: 919252 - RNA, 14 nt, Homo sapiens
uaaccuguuuaaga

SEQ ID NO: 919253 - RNA, 15 nt, Homo sapiens
uaacucugcccaccc

SEQ ID NO: 919254 - RNA, 22 nt, Homo sapiens
uaacucugcccacccuccugua

SEQ ID NO: 919255 - RNA, 15 nt, Homo sapiens
uaacugaauucugaa

SEQ ID NO: 919256 - RNA, 14 nt, Homo sapiens
uaacugaugaagga

SEQ ID NO: 919257 - RNA, 19 nt, Homo sapiens
uaacugccuggccuggcac

SEQ ID NO: 919258 - RNA, 17 nt, Homo sapiens
uaagaacaaaacuguaa

SEQ ID NO: 919259 - RNA, 14 nt, Homo sapiens
uaagaauguucaua

SEQ ID NO: 919260 - RNA, 18 nt, Homo sapiens
uaagaauuucaauaucaa

SEQ ID NO: 919261 - RNA, 20 nt, Homo sapiens
uaagagucacaauuugcaaa

SEQ ID NO: 919262 - RNA, 16 nt, Homo sapiens
uaagcaacaugaauua

SEQ ID NO: 919263 - RNA, 13 nt, Homo sapiens
uaagccugaugau

SEQ ID NO: 919264 - RNA, 14 nt, Homo sapiens
uaaggaaaaaagca

SEQ ID NO: 919265 - RNA, 20 nt, Homo sapiens
uaagguauugcaaggucacu

SEQ ID NO: 919266 - RNA, 15 nt, Homo sapiens
ccuauuuauucauuc

SEQ ID NO: 919267 - RNA, 16 nt, Homo sapiens
ccuauuuauucauuca

SEQ ID NO: 919268 - RNA, 16 nt, Homo sapiens
ccucaaaauaagccau

SEQ ID NO: 919269 - RNA, 16 nt, Homo sapiens
ccucaaauuaacuuuc

SEQ ID NO: 919270 - RNA, 21 nt, Homo sapiens
ccucaggcccaauucugccac

SEQ ID NO: 919271 - RNA, 20 nt, Homo sapiens
ccucccaaagugcugagauu

SEQ ID NO: 919272 - RNA, 13 nt, Homo sapiens
ccucccugcuuca

SEQ ID NO: 919273 - RNA, 18 nt, Homo sapiens
ccucccuuguggcagcaa

SEQ ID NO: 919274 - RNA, 17 nt, Homo sapiens
ccuccuuuacuucccag

SEQ ID NO: 919275 - RNA, 15 nt, Homo sapiens
ccucgagagugagaa

SEQ ID NO: 919276 - RNA, 22 nt, Homo sapiens
ccucgagagugagaaauggcag

SEQ ID NO: 919277 - RNA, 21 nt, Homo sapiens
ccucggggacacuagugacag

SEQ ID NO: 919278 - RNA, 12 nt, Homo sapiens
ccucuccaagcu

SEQ ID NO: 919279 - RNA, 13 nt, Homo sapiens
ccucuccagcuau

SEQ ID NO: 919280 - RNA, 18 nt, Homo sapiens
ccucuccaguaucuucac

SEQ ID NO: 919281 - RNA, 15 nt, Homo sapiens
ccucuccuuccucag

SEQ ID NO: 919282 - RNA, 16 nt, Homo sapiens
ccucugagccacugga

SEQ ID NO: 919283 - RNA, 22 nt, Homo sapiens
ccucugccuuuguucacuguga

SEQ ID NO: 919284 - RNA, 18 nt, Homo sapiens
ccugaaacugaguugaau

SEQ ID NO: 919285 - RNA, 19 nt, Homo sapiens
ccugaagcaacacugccag

SEQ ID NO: 919286 - RNA, 14 nt, Homo sapiens
ccugaaggugccac

SEQ ID NO: 919287 - RNA, 13 nt, Homo sapiens
ccugagaauauua

SEQ ID NO: 919288 - RNA, 14 nt, Homo sapiens
ccugagauuuacac

SEQ ID NO: 919289 - RNA, 18 nt, Homo sapiens
ccugagcccuaaacacac

SEQ ID NO: 919290 - RNA, 20 nt, Homo sapiens
ccugagguugcuuuauccua

SEQ ID NO: 919291 - RNA, 20 nt, Homo sapiens
ccugauccaaguuuacucaa

SEQ ID NO: 919292 - RNA, 19 nt, Homo sapiens
ccugcaucagccucuggcc

SEQ ID NO: 919293 - RNA, 21 nt, Homo sapiens
ccugcgaccacagcagggauu

SEQ ID NO: 919294 - RNA, 17 nt, Homo sapiens
ccugcuucaauacccaa

SEQ ID NO: 919295 - RNA, 19 nt, Homo sapiens
ccugcuucaauacccaaau

SEQ ID NO: 919296 - RNA, 22 nt, Homo sapiens
ccugcuuuuuucuguuuuuaca

SEQ ID NO: 919297 - RNA, 20 nt, Homo sapiens
ccuggcacccccacaagcug

SEQ ID NO: 919298 - RNA, 19 nt, Homo sapiens
ccuggcuaacacggugaaa

SEQ ID NO: 919299 - RNA, 15 nt, Homo sapiens
ccugggccacuggca

SEQ ID NO: 919300 - RNA, 18 nt, Homo sapiens
ccugggggcuuuugccac

SEQ ID NO: 919301 - RNA, 22 nt, Homo sapiens
ccugggguggggaucaccaggg

SEQ ID NO: 919302 - RNA, 17 nt, Homo sapiens
ccugucauggcucugaa

SEQ ID NO: 919303 - RNA, 21 nt, Homo sapiens
uaccacugucuucuucagggu

SEQ ID NO: 919304 - RNA, 15 nt, Homo sapiens
uacccaccugagcuu

SEQ ID NO: 919305 - RNA, 21 nt, Homo sapiens
uacccauagguaauacaaaaa

SEQ ID NO: 919306 - RNA, 14 nt, Homo sapiens
uaccgucugugauu

SEQ ID NO: 919307 - RNA, 18 nt, Homo sapiens
uaccuguuguacacuugg

SEQ ID NO: 919308 - RNA, 14 nt, Homo sapiens
uacgggcugcucua

SEQ ID NO: 919309 - RNA, 18 nt, Homo sapiens
uacuccuugccauuuuca

SEQ ID NO: 919310 - RNA, 19 nt, Homo sapiens
uacucuuuguaugaugaaa

SEQ ID NO: 919311 - RNA, 19 nt, Homo sapiens
uacugaggagcaaagcagc

SEQ ID NO: 919312 - RNA, 21 nt, Homo sapiens
uacuguaugccggcuccuuca

SEQ ID NO: 919313 - RNA, 15 nt, Homo sapiens
uacuuaaugccaagu

SEQ ID NO: 919314 - RNA, 19 nt, Homo sapiens
uacuuccaguauccugaaa

SEQ ID NO: 919315 - RNA, 23 nt, Homo sapiens
uacuuuacaauuaaacucaaagc

SEQ ID NO: 919316 - RNA, 17 nt, Homo sapiens
uagaaaagaagcaguaa

SEQ ID NO: 919317 - RNA, 12 nt, Homo sapiens
uagaaaccauga

SEQ ID NO: 919318 - RNA, 19 nt, Homo sapiens
uagaagauauuagucuugg

SEQ ID NO: 919319 - RNA, 17 nt, Homo sapiens
uagaaguggcaucugaa

SEQ ID NO: 919320 - RNA, 20 nt, Homo sapiens
uagaauauccuacuucucca

SEQ ID NO: 919321 - RNA, 13 nt, Homo sapiens
uagacaacccuga

SEQ ID NO: 919322 - RNA, 21 nt, Homo sapiens
uagacugaagugccagaucaa

SEQ ID NO: 919323 - RNA, 13 nt, Homo sapiens
uagaggaagaaua

SEQ ID NO: 919324 - RNA, 14 nt, Homo sapiens
uagauguaucauua

SEQ ID NO: 919325 - RNA, 13 nt, Homo sapiens
uagcaacuuugau

SEQ ID NO: 919326 - RNA, 17 nt, Homo sapiens
uagcaagcaccaaaaaa

SEQ ID NO: 919327 - RNA, 14 nt, Homo sapiens
uagcagcauuuaca

SEQ ID NO: 919328 - RNA, 15 nt, Homo sapiens
uagcauccugugacc

SEQ ID NO: 919329 - RNA, 23 nt, Homo sapiens
uagccgagcacgguggugcaugc

SEQ ID NO: 919330 - RNA, 20 nt, Homo sapiens
uagccuguuucguagccaua

SEQ ID NO: 919331 - RNA, 18 nt, Homo sapiens
uagcugagacuacaggug

SEQ ID NO: 919332 - RNA, 18 nt, Homo sapiens
uagcugcaggacauguau

SEQ ID NO: 919333 - RNA, 16 nt, Homo sapiens
uagcuuaagaucaaaa

SEQ ID NO: 919334 - RNA, 17 nt, Homo sapiens
uaggagagaacagggau

SEQ ID NO: 919335 - RNA, 16 nt, Homo sapiens
uaggauauacuguaug

SEQ ID NO: 919336 - RNA, 18 nt, Homo sapiens
uaggauggaacgugacug

SEQ ID NO: 919337 - RNA, 17 nt, Homo sapiens
uaggcaccucugugcug

SEQ ID NO: 919338 - RNA, 22 nt, Homo sapiens
uaggcauuaaaugcaaaaauau

SEQ ID NO: 919339 - RNA, 23 nt, Homo sapiens
uagguacaguaaaacaauuguga

SEQ ID NO: 919340 - RNA, 18 nt, Homo sapiens
uaguaacguguuacugga

SEQ ID NO: 919341 - RNA, 13 nt, Homo sapiens
uagugucaccugc

SEQ ID NO: 919342 - RNA, 19 nt, Homo sapiens
uaguugggauuacagguga

SEQ ID NO: 919343 - RNA, 15 nt, Homo sapiens
uauaaaccuuaugaa

SEQ ID NO: 919344 - RNA, 16 nt, Homo sapiens
uauaaagggcaaagga

SEQ ID NO: 919345 - RNA, 20 nt, Homo sapiens
uauacuuucaucuaaauuac

SEQ ID NO: 919346 - RNA, 17 nt, Homo sapiens
uauagaaccaugaauuc

SEQ ID NO: 919347 - RNA, 22 nt, Homo sapiens
uauagcacauagaugucuguaa

SEQ ID NO: 919348 - RNA, 18 nt, Homo sapiens
uauaggucauacaaucca

SEQ ID NO: 919349 - RNA, 13 nt, Homo sapiens
uaucaaacagcuc

SEQ ID NO: 919350 - RNA, 23 nt, Homo sapiens
uaucagcauagugacuaaacuac

SEQ ID NO: 919351 - RNA, 16 nt, Homo sapiens
uaucauagauuuacaa

SEQ ID NO: 919352 - RNA, 23 nt, Homo sapiens
uauccacaacuuuucaaguauug

SEQ ID NO: 919353 - RNA, 13 nt, Homo sapiens
uaucccaucucac

SEQ ID NO: 919354 - RNA, 13 nt, Homo sapiens
uaucccugcacac

SEQ ID NO: 919355 - RNA, 15 nt, Homo sapiens
uauccucgcugguga

SEQ ID NO: 919356 - RNA, 21 nt, Homo sapiens
uaucuaccugcccucucucag

SEQ ID NO: 919357 - RNA, 19 nt, Homo sapiens
uaucucgcuagccauauau

SEQ ID NO: 919358 - RNA, 15 nt, Homo sapiens
uaucuucuccaggau

SEQ ID NO: 919359 - RNA, 14 nt, Homo sapiens
uaugaacucuugau

SEQ ID NO: 919360 - RNA, 16 nt, Homo sapiens
uaugaacucuugauaa

SEQ ID NO: 919361 - RNA, 14 nt, Homo sapiens
uaugaauguuacua

SEQ ID NO: 919362 - RNA, 19 nt, Homo sapiens
uaugagaaugacccuguca

SEQ ID NO: 919363 - RNA, 16 nt, Homo sapiens
uaugauguauacccau

SEQ ID NO: 919364 - RNA, 21 nt, Homo sapiens
uaugcaugcagucuuguacug

SEQ ID NO: 919365 - RNA, 16 nt, Homo sapiens
uauggauuuaauacca

SEQ ID NO: 919366 - RNA, 15 nt, Homo sapiens
uauguccuauucauu

SEQ ID NO: 919367 - RNA, 16 nt, Homo sapiens
uauguugaccuuugca

SEQ ID NO: 919368 - RNA, 16 nt, Homo sapiens
uauuaaccuaccugug

SEQ ID NO: 919369 - RNA, 15 nt, Homo sapiens
uauuaauaugcaugc

SEQ ID NO: 919370 - RNA, 14 nt, Homo sapiens
uauuaauguacuua

SEQ ID NO: 919371 - RNA, 22 nt, Homo sapiens
uauuaauugccuuugagguuau

SEQ ID NO: 919372 - RNA, 15 nt, Homo sapiens
uauuagccaacuguu

SEQ ID NO: 919373 - RNA, 16 nt, Homo sapiens
uauucaguaaugaaga

SEQ ID NO: 919374 - RNA, 14 nt, Homo sapiens
uauucauagcugua

SEQ ID NO: 919375 - RNA, 16 nt, Homo sapiens
uauucauagcuguaua

SEQ ID NO: 919376 - RNA, 21 nt, Homo sapiens
uauucccaugguagacuguga

SEQ ID NO: 919377 - RNA, 21 nt, Homo sapiens
uauucuagugauaagaauucu

SEQ ID NO: 919378 - RNA, 23 nt, Homo sapiens
uauugauaauaaaauucauucca

SEQ ID NO: 919379 - RNA, 18 nt, Homo sapiens
uauugcaguucauacuga

SEQ ID NO: 919380 - RNA, 21 nt, Homo sapiens
uauugccaacuggaaagucaa

SEQ ID NO: 919381 - RNA, 13 nt, Homo sapiens
uauuggacuucca

SEQ ID NO: 919382 - RNA, 15 nt, Homo sapiens
uauuguuaguucuca

SEQ ID NO: 919383 - RNA, 22 nt, Homo sapiens
uauuuccauauuaaaaucacaa

SEQ ID NO: 919384 - RNA, 16 nt, Homo sapiens
uauuuuaaaauuucac

SEQ ID NO: 919385 - RNA, 22 nt, Homo sapiens
uauuuuaauagaaagauacaac

SEQ ID NO: 919386 - RNA, 14 nt, Homo sapiens
uauuuugcaaacaa

SEQ ID NO: 919387 - RNA, 16 nt, Homo sapiens
uauuuuggaucuauca

SEQ ID NO: 919388 - RNA, 13 nt, Homo sapiens
auaaucauuuuag

SEQ ID NO: 919389 - RNA, 21 nt, Homo sapiens
auaaucuccuuuuaugcucac

SEQ ID NO: 919390 - RNA, 21 nt, Homo sapiens
auaauuaaagaaaauugccaa

SEQ ID NO: 919391 - RNA, 17 nt, Homo sapiens
auacaaaaagcaaaaau

SEQ ID NO: 919392 - RNA, 15 nt, Homo sapiens
auacagcacuuugac

SEQ ID NO: 919393 - RNA, 20 nt, Homo sapiens
auacagguccugcacauuac

SEQ ID NO: 919394 - RNA, 14 nt, Homo sapiens
auacauggguagcu

SEQ ID NO: 919395 - RNA, 23 nt, Homo sapiens
auacauuauacuuuauaacuaau

SEQ ID NO: 919396 - RNA, 20 nt, Homo sapiens
auacauuauuggacuuccau

SEQ ID NO: 919397 - RNA, 20 nt, Homo sapiens
auaccacucaagcagugugc

SEQ ID NO: 919398 - RNA, 16 nt, Homo sapiens
auaccucauucacagc

SEQ ID NO: 919399 - RNA, 13 nt, Homo sapiens
auacuguacauag

SEQ ID NO: 919400 - RNA, 17 nt, Homo sapiens
auacuugagugugcaag

SEQ ID NO: 919401 - RNA, 21 nt, Homo sapiens
auacuugugaacaugccuuau

SEQ ID NO: 919402 - RNA, 19 nt, Homo sapiens
auagacuuagccccaugag

SEQ ID NO: 919403 - RNA, 20 nt, Homo sapiens
auagaugucuguaaccaaua

SEQ ID NO: 919404 - RNA, 14 nt, Homo sapiens
auaggaauauucaa

SEQ ID NO: 919405 - RNA, 19 nt, Homo sapiens
auaggaggaucacuugaac

SEQ ID NO: 919406 - RNA, 17 nt, Homo sapiens
auaggauauacuguaug

SEQ ID NO: 919407 - RNA, 20 nt, Homo sapiens
auaguaacguguuacuggaa

SEQ ID NO: 919408 - RNA, 14 nt, Homo sapiens
auauaaaguuacac

SEQ ID NO: 919409 - RNA, 14 nt, Homo sapiens
auauaagagcaaga

SEQ ID NO: 919410 - RNA, 14 nt, Homo sapiens
auugaaccgccguc

SEQ ID NO: 919411 - RNA, 20 nt, Homo sapiens
auugaagcgguuucacuccg

SEQ ID NO: 919412 - RNA, 12 nt, Homo sapiens
auugagaugaaa

SEQ ID NO: 919413 - RNA, 23 nt, Homo sapiens
auugagcgcuauggguguuaacg

SEQ ID NO: 919414 - RNA, 16 nt, Homo sapiens
auugcaaggucacuuu

SEQ ID NO: 919415 - RNA, 18 nt, Homo sapiens
auugcaguucauacugaa

SEQ ID NO: 919416 - RNA, 17 nt, Homo sapiens
auugcaucccaaaccac

SEQ ID NO: 919417 - RNA, 22 nt, Homo sapiens
auugcugccuaaagaaacucag

SEQ ID NO: 919418 - RNA, 20 nt, Homo sapiens
auugcuuuucuagauuugau

SEQ ID NO: 919419 - RNA, 19 nt, Homo sapiens
auuguauauuguaauuuaa

SEQ ID NO: 919420 - RNA, 23 nt, Homo sapiens
auuguuuugugcucaacuugugu

SEQ ID NO: 919421 - RNA, 16 nt, Homo sapiens
auuuaaaaauaucuga

SEQ ID NO: 919422 - RNA, 21 nt, Homo sapiens
auuuaaagacaaagacauuau

SEQ ID NO: 919423 - RNA, 15 nt, Homo sapiens
auuuaagaguccuga

SEQ ID NO: 919424 - RNA, 20 nt, Homo sapiens
auuuaauuuuuacaugacca

SEQ ID NO: 919425 - RNA, 18 nt, Homo sapiens
auuuaugcagagacagcu

SEQ ID NO: 919426 - RNA, 20 nt, Homo sapiens
auuuaugcagagacagcugu

SEQ ID NO: 919427 - RNA, 14 nt, Homo sapiens
auuuauucuacuuu

SEQ ID NO: 919428 - RNA, 14 nt, Homo sapiens
auuucaaagcaagu

SEQ ID NO: 919429 - RNA, 19 nt, Homo sapiens
auuucaauaucaagacuga

SEQ ID NO: 919430 - RNA, 20 nt, Homo sapiens
auuucagaaguuaguuugua

SEQ ID NO: 919431 - RNA, 21 nt, Homo sapiens
auuucagcuggagauacugau

SEQ ID NO: 919432 - RNA, 15 nt, Homo sapiens
auuucaguuacuuac

SEQ ID NO: 919433 - RNA, 18 nt, Homo sapiens
auuucaucuacuacaggg

SEQ ID NO: 919434 - RNA, 15 nt, Homo sapiens
auuucaucuuuccaa

SEQ ID NO: 919435 - RNA, 19 nt, Homo sapiens
auuucauugaaauaauuga

SEQ ID NO: 919436 - RNA, 16 nt, Homo sapiens
auuuccccacucugag

SEQ ID NO: 919437 - RNA, 19 nt, Homo sapiens
auuuccguaccccugagga

SEQ ID NO: 919438 - RNA, 22 nt, Homo sapiens
auuucucccuucaauccuguca

SEQ ID NO: 919439 - RNA, 15 nt, Homo sapiens
auuucuuaaguauaa

SEQ ID NO: 919440 - RNA, 23 nt, Homo sapiens
auuugaagacccuugugcauugu

SEQ ID NO: 919441 - RNA, 18 nt, Homo sapiens
auuugauucuaugacuga

SEQ ID NO: 919442 - RNA, 22 nt, Homo sapiens
auuugcuagagggagggagcag

SEQ ID NO: 919443 - RNA, 15 nt, Homo sapiens
auuuuauaagcauuu

SEQ ID NO: 919444 - RNA, 16 nt, Homo sapiens
auuuuauaagcauuua

SEQ ID NO: 919445 - RNA, 19 nt, Homo sapiens
auuuuauuuuuaucccauc

SEQ ID NO: 919446 - RNA, 17 nt, Homo sapiens
auuuuccuguguccaca

SEQ ID NO: 919447 - RNA, 14 nt, Homo sapiens
auuuucuacacagc

SEQ ID NO: 919448 - RNA, 14 nt, Homo sapiens
auuuucuacagugu

SEQ ID NO: 919449 - RNA, 16 nt, Homo sapiens
auuuuggacgugugag

SEQ ID NO: 919450 - RNA, 17 nt, Homo sapiens
auuuuucuuuccaaguc

SEQ ID NO: 919451 - RNA, 19 nt, Homo sapiens
auuuuuguuuuauccacaa

SEQ ID NO: 919452 - RNA, 19 nt, Homo sapiens
auuuuuuuuaacugcauuc

SEQ ID NO: 919453 - RNA, 17 nt, Homo sapiens
caaaaaacuaaagcagu

SEQ ID NO: 919454 - RNA, 16 nt, Homo sapiens
caaaaacaaagugcaa

SEQ ID NO: 919455 - RNA, 22 nt, Homo sapiens
caaaacacugucugcauaucca

SEQ ID NO: 919456 - RNA, 11 nt, Homo sapiens
caaaacuguaa

SEQ ID NO: 919457 - RNA, 17 nt, Homo sapiens
caaaacuguaacugcau

SEQ ID NO: 919458 - RNA, 19 nt, Homo sapiens
caaaacuguaacugcauua

SEQ ID NO: 919459 - RNA, 19 nt, Homo sapiens
caaaacuuccugauuugau

SEQ ID NO: 919460 - RNA, 18 nt, Homo sapiens
caaaagaaguugaucuga

SEQ ID NO: 919461 - RNA, 22 nt, Homo sapiens
caaaagagagaagaguccagga

SEQ ID NO: 919462 - RNA, 20 nt, Homo sapiens
caaaaguuuaaaaagcucac

SEQ ID NO: 919463 - RNA, 18 nt, Homo sapiens
caaaauacagcacuuuga

SEQ ID NO: 919464 - RNA, 20 nt, Homo sapiens
caaaaucagugaugggagua

SEQ ID NO: 919465 - RNA, 22 nt, Homo sapiens
caaacacuugaagugagaagau

SEQ ID NO: 919466 - RNA, 22 nt, Homo sapiens
caaaccaggagcauuuuguguc

SEQ ID NO: 919467 - RNA, 15 nt, Homo sapiens
caaacuccugaccuc

SEQ ID NO: 919468 - RNA, 20 nt, Homo sapiens
caaacuguggguauuguuaa

SEQ ID NO: 919469 - RNA, 18 nt, Homo sapiens
caaagacauuauuucuca

SEQ ID NO: 919470 - RNA, 18 nt, Homo sapiens
caaagagccaguuaucuu

SEQ ID NO: 919471 - RNA, 14 nt, Homo sapiens
caaagauucugcau

SEQ ID NO: 919472 - RNA, 18 nt, Homo sapiens
caaagcuaaauacaugga

SEQ ID NO: 919473 - RNA, 24 nt, Homo sapiens
caaaggaggcuuacaacuccugca

SEQ ID NO: 919474 - RNA, 23 nt, Homo sapiens
caaagggggacagugauuuucaa

SEQ ID NO: 919475 - RNA, 22 nt, Homo sapiens
caaaguagggaugcggauccug

SEQ ID NO: 919476 - RNA, 23 nt, Homo sapiens
caaagugcugggauuacaggugu

SEQ ID NO: 919477 - RNA, 14 nt, Homo sapiens
caaauagugcuaau

SEQ ID NO: 919478 - RNA, 13 nt, Homo sapiens
caaauauccucca

SEQ ID NO: 919479 - RNA, 20 nt, Homo sapiens
caaauauccuccacuuucag

SEQ ID NO: 919480 - RNA, 17 nt, Homo sapiens
caaaucaagaaauauga

SEQ ID NO: 919481 - RNA, 14 nt, Homo sapiens
caaauccucuccag

SEQ ID NO: 919482 - RNA, 23 nt, Homo sapiens
caaaugcccuuacacuuacuguu

SEQ ID NO: 919483 - RNA, 16 nt, Homo sapiens
caaaugggacugaugu

SEQ ID NO: 919484 - RNA, 11 nt, Homo sapiens
caacacuuugg

SEQ ID NO: 919485 - RNA, 20 nt, Homo sapiens
caacagauuuuauugaauga

SEQ ID NO: 919486 - RNA, 22 nt, Homo sapiens
caacaggcaccucuaaucagac

SEQ ID NO: 919487 - RNA, 18 nt, Homo sapiens
caacaggguuuuuuucca

SEQ ID NO: 919488 - RNA, 21 nt, Homo sapiens
caacauaaaacaaaaccaagc

SEQ ID NO: 919489 - RNA, 21 nt, Homo sapiens
caacauaccaauuuucugcua

SEQ ID NO: 919490 - RNA, 11 nt, Homo sapiens
caaccaaaggg

SEQ ID NO: 919491 - RNA, 21 nt, Homo sapiens
caaccaaagggggacagugau

SEQ ID NO: 919492 - RNA, 15 nt, Homo sapiens
caaccaugucauuuc

SEQ ID NO: 919493 - RNA, 18 nt, Homo sapiens
caacccucucaggugacc

SEQ ID NO: 919494 - RNA, 21 nt, Homo sapiens
caacuagggagugagugcaaa

SEQ ID NO: 919495 - RNA, 14 nt, Homo sapiens
caacuccacugucu

SEQ ID NO: 919496 - RNA, 15 nt, Homo sapiens
caacugcugccccaa

SEQ ID NO: 919497 - RNA, 20 nt, Homo sapiens
caacuguuucccugcugaau

SEQ ID NO: 919498 - RNA, 11 nt, Homo sapiens
caacuuuucaa

SEQ ID NO: 919499 - RNA, 13 nt, Homo sapiens
caagaacugccau

SEQ ID NO: 919500 - RNA, 20 nt, Homo sapiens
caagaagugggagugggaga

SEQ ID NO: 919501 - RNA, 16 nt, Homo sapiens
caagagguuaggugaa

SEQ ID NO: 919502 - RNA, 17 nt, Homo sapiens
caagaguagcaccuuca

SEQ ID NO: 919503 - RNA, 21 nt, Homo sapiens
caagagucuguauuccugaua

SEQ ID NO: 919504 - RNA, 18 nt, Homo sapiens
caagaugguuaagucaau

SEQ ID NO: 919505 - RNA, 21 nt, Homo sapiens
caagauuccuuuccacuccaa

SEQ ID NO: 919506 - RNA, 24 nt, Homo sapiens
caagcaaaaccaaagaauauguag

SEQ ID NO: 919507 - RNA, 22 nt, Homo sapiens
caagcaaagaacccauuugcca

SEQ ID NO: 919508 - RNA, 14 nt, Homo sapiens
caagcacugacacu

SEQ ID NO: 919509 - RNA, 15 nt, Homo sapiens
caagcauuuaaugua

SEQ ID NO: 919510 - RNA, 12 nt, Homo sapiens
caagccugugga

SEQ ID NO: 919511 - RNA, 20 nt, Homo sapiens
cugaguagcauauauaauuu

SEQ ID NO: 919512 - RNA, 22 nt, Homo sapiens
cugauauacuugagugugcaag

SEQ ID NO: 919513 - RNA, 15 nt, Homo sapiens
cugaugacacugaga

SEQ ID NO: 919514 - RNA, 23 nt, Homo sapiens
cugauucaauaaaaugcacugac

SEQ ID NO: 919515 - RNA, 16 nt, Homo sapiens
cugauuucacauauug

SEQ ID NO: 919516 - RNA, 23 nt, Homo sapiens
cugauuucucuucagcuuugaaa

SEQ ID NO: 919517 - RNA, 16 nt, Homo sapiens
cugauuuucuggaaug

SEQ ID NO: 919518 - RNA, 16 nt, Homo sapiens
cugcacgccggcacca

SEQ ID NO: 919519 - RNA, 17 nt, Homo sapiens
cugcacuauagccauuu

SEQ ID NO: 919520 - RNA, 16 nt, Homo sapiens
cugcagacucauccuu

SEQ ID NO: 919521 - RNA, 18 nt, Homo sapiens
cugcagcuuuacugccuu

SEQ ID NO: 919522 - RNA, 17 nt, Homo sapiens
cugcagugccacuaaaa

SEQ ID NO: 919523 - RNA, 22 nt, Homo sapiens
cugcauguguuguacaauacca

SEQ ID NO: 919524 - RNA, 15 nt, Homo sapiens
caauuagcauuccau

SEQ ID NO: 919525 - RNA, 15 nt, Homo sapiens
caauucaaucaaagc

SEQ ID NO: 919526 - RNA, 21 nt, Homo sapiens
caauucaaucaaagcuaccuu

SEQ ID NO: 919527 - RNA, 23 nt, Homo sapiens
caauucagagaauagcaguuuca

SEQ ID NO: 919528 - RNA, 20 nt, Homo sapiens
caauucauucucucugaaca

SEQ ID NO: 919529 - RNA, 17 nt, Homo sapiens
caauugugacagcaguu

SEQ ID NO: 919530 - RNA, 20 nt, Homo sapiens
caauuugauucuaugacuga

SEQ ID NO: 919531 - RNA, 23 nt, Homo sapiens
caauuugggucccagcuaaagag

SEQ ID NO: 919532 - RNA, 21 nt, Homo sapiens
cacaaaaagaaagcugugaaa

SEQ ID NO: 919533 - RNA, 18 nt, Homo sapiens
cacaaaauacagcacuuu

SEQ ID NO: 919534 - RNA, 18 nt, Homo sapiens
cacaaacucauccauuaa

SEQ ID NO: 919535 - RNA, 17 nt, Homo sapiens
cacaaccuccuccucca

SEQ ID NO: 919536 - RNA, 16 nt, Homo sapiens
cacaacuugagaagac

SEQ ID NO: 919537 - RNA, 22 nt, Homo sapiens
cacaaucuuuccuugucucuca

SEQ ID NO: 919538 - RNA, 16 nt, Homo sapiens
cacaccaguuacuguu

SEQ ID NO: 919539 - RNA, 19 nt, Homo sapiens
cacaccuggaaagcauaua

SEQ ID NO: 919540 - RNA, 16 nt, Homo sapiens
cacacuggcuccagac

SEQ ID NO: 919541 - RNA, 18 nt, Homo sapiens
cacagacuucacacagca

SEQ ID NO: 919542 - RNA, 15 nt, Homo sapiens
cacagccugucuuca

SEQ ID NO: 919543 - RNA, 14 nt, Homo sapiens
cacagggacacagu

SEQ ID NO: 919544 - RNA, 20 nt, Homo sapiens
cacagggcauccaacugaga

SEQ ID NO: 919545 - RNA, 15 nt, Homo sapiens
cacauaauuugcaua

SEQ ID NO: 919546 - RNA, 18 nt, Homo sapiens
cacauauacauaugauca

SEQ ID NO: 919547 - RNA, 17 nt, Homo sapiens
cacaugcacuacugaaa

SEQ ID NO: 919548 - RNA, 19 nt, Homo sapiens
cacauugcuauucccaucc

SEQ ID NO: 919549 - RNA, 14 nt, Homo sapiens
caccaaauucugaa

SEQ ID NO: 919550 - RNA, 14 nt, Homo sapiens
caccaaccaaaggg

SEQ ID NO: 919551 - RNA, 14 nt, Homo sapiens
caccacugcuuuaa

SEQ ID NO: 919552 - RNA, 20 nt, Homo sapiens
caccaggggaggagccugug

SEQ ID NO: 919553 - RNA, 12 nt, Homo sapiens
caccauggacaa

SEQ ID NO: 919554 - RNA, 22 nt, Homo sapiens
cacccggcucguguauuuauua

SEQ ID NO: 919555 - RNA, 15 nt, Homo sapiens
cacccuacacaaaau

SEQ ID NO: 919556 - RNA, 15 nt, Homo sapiens
cacccuaucaucagu

SEQ ID NO: 919557 - RNA, 17 nt, Homo sapiens
cacgacuucugcccauu

SEQ ID NO: 919558 - RNA, 23 nt, Homo sapiens
cacgguggcucacgccuguaauc

SEQ ID NO: 919559 - RNA, 11 nt, Homo sapiens
cacgugcaaua

SEQ ID NO: 919560 - RNA, 23 nt, Homo sapiens
cacuaaaaugugggugaagguga

SEQ ID NO: 919561 - RNA, 20 nt, Homo sapiens
cacuauagccauuugcccca

SEQ ID NO: 919562 - RNA, 14 nt, Homo sapiens
cacuauuggacuuu

SEQ ID NO: 919563 - RNA, 21 nt, Homo sapiens
cacucaaaaaggugugucaaa

SEQ ID NO: 919564 - RNA, 13 nt, Homo sapiens
cacucaagcaaca

SEQ ID NO: 919565 - RNA, 22 nt, Homo sapiens
cacucacagagacacagggcau

SEQ ID NO: 919566 - RNA, 19 nt, Homo sapiens
cacucauuuauuuccauau

SEQ ID NO: 919567 - RNA, 15 nt, Homo sapiens
cacugucugcauauc

SEQ ID NO: 919568 - RNA, 19 nt, Homo sapiens
cacugucuuuaaaagucau

SEQ ID NO: 919569 - RNA, 22 nt, Homo sapiens
cacugucuuuaaaagucauuca

SEQ ID NO: 919570 - RNA, 10 nt, Homo sapiens
cacugugagu

SEQ ID NO: 919571 - RNA, 17 nt, Homo sapiens
cacuucgugggaucugc

SEQ ID NO: 919572 - RNA, 19 nt, Homo sapiens
cacuugcaagucccaugau

SEQ ID NO: 919573 - RNA, 21 nt, Homo sapiens
cacuuugggaggccaaggugg

SEQ ID NO: 919574 - RNA, 23 nt, Homo sapiens
cagaaaacaaaucuucaaggugu

SEQ ID NO: 919575 - RNA, 12 nt, Homo sapiens
cagaaaacagag

SEQ ID NO: 919576 - RNA, 16 nt, Homo sapiens
cagaaagaguucagua

SEQ ID NO: 919577 - RNA, 16 nt, Homo sapiens
cagaaaucccaguuca

SEQ ID NO: 919578 - RNA, 17 nt, Homo sapiens
cagaaaucccaguucau

SEQ ID NO: 919579 - RNA, 21 nt, Homo sapiens
cagaaaugaaacagacccuca

SEQ ID NO: 919580 - RNA, 14 nt, Homo sapiens
cagaaauuguauau

SEQ ID NO: 919581 - RNA, 22 nt, Homo sapiens
cagaacucuccuaucugaaccu

SEQ ID NO: 919582 - RNA, 18 nt, Homo sapiens
cagaagugaugauuguaa

SEQ ID NO: 919583 - RNA, 19 nt, Homo sapiens
cagacaucuggacacuggg

SEQ ID NO: 919584 - RNA, 14 nt, Homo sapiens
cagaccacauuuga

SEQ ID NO: 919585 - RNA, 15 nt, Homo sapiens
cagaccacauuugaa

SEQ ID NO: 919586 - RNA, 14 nt, Homo sapiens
cagacuggagacaa

SEQ ID NO: 919587 - RNA, 16 nt, Homo sapiens
cagagcauccgucucc

SEQ ID NO: 919588 - RNA, 23 nt, Homo sapiens
cagaggcccuggaggucuccagg

SEQ ID NO: 919589 - RNA, 19 nt, Homo sapiens
cagagguccugccauggaa

SEQ ID NO: 919590 - RNA, 20 nt, Homo sapiens
cagaggucguuugauuucaa

SEQ ID NO: 919591 - RNA, 19 nt, Homo sapiens
cagagguuuagcugcagga

SEQ ID NO: 919592 - RNA, 13 nt, Homo sapiens
cagagugccccac

SEQ ID NO: 919593 - RNA, 17 nt, Homo sapiens
cagauaaugauaguguu

SEQ ID NO: 919594 - RNA, 14 nt, Homo sapiens
cagaucacucaaaa

SEQ ID NO: 919595 - RNA, 17 nt, Homo sapiens
cagaucuguaauucacu

SEQ ID NO: 919596 - RNA, 15 nt, Homo sapiens
cagaugccugcagug

SEQ ID NO: 919597 - RNA, 15 nt, Homo sapiens
cagauggcugugaaa

SEQ ID NO: 919598 - RNA, 13 nt, Homo sapiens
cagauugacaagg

SEQ ID NO: 919599 - RNA, 13 nt, Homo sapiens
cagauuguucuca

SEQ ID NO: 919600 - RNA, 19 nt, Homo sapiens
cagcaagaaacguguucua

SEQ ID NO: 919601 - RNA, 14 nt, Homo sapiens
cagcaaucugugua

SEQ ID NO: 919602 - RNA, 21 nt, Homo sapiens
cagcaaucuguguacugaaca

SEQ ID NO: 919603 - RNA, 14 nt, Homo sapiens
cagcagcuugacgc

SEQ ID NO: 919604 - RNA, 21 nt, Homo sapiens
cagcauuuccucagucucccu

SEQ ID NO: 919605 - RNA, 23 nt, Homo sapiens
cagccacccuaacugagcugcca

SEQ ID NO: 919606 - RNA, 17 nt, Homo sapiens
cagccauaaaaccuggg

SEQ ID NO: 919607 - RNA, 12 nt, Homo sapiens
cagcccuaggcu

SEQ ID NO: 919608 - RNA, 14 nt, Homo sapiens
cagcccugagcugg

SEQ ID NO: 919609 - RNA, 17 nt, Homo sapiens
cagccgugcugagcaca

SEQ ID NO: 919610 - RNA, 19 nt, Homo sapiens
cagccuccugaguagcuga

SEQ ID NO: 919611 - RNA, 20 nt, Homo sapiens
cagccuccugaguagcugag

SEQ ID NO: 919612 - RNA, 21 nt, Homo sapiens
cagccuggcuaacauggugaa

SEQ ID NO: 919613 - RNA, 15 nt, Homo sapiens
cagccugucuucaga

SEQ ID NO: 919614 - RNA, 19 nt, Homo sapiens
cagcgagaaaacuucguaa

SEQ ID NO: 919615 - RNA, 13 nt, Homo sapiens
cagcucuggagaa

SEQ ID NO: 919616 - RNA, 19 nt, Homo sapiens
cagcugcauuucuuuugca

SEQ ID NO: 919617 - RNA, 22 nt, Homo sapiens
cagcuucuguccucuucuguga

SEQ ID NO: 919618 - RNA, 17 nt, Homo sapiens
caggacuucugugcauu

SEQ ID NO: 919619 - RNA, 10 nt, Homo sapiens
caggagcuca

SEQ ID NO: 919620 - RNA, 12 nt, Homo sapiens
caggagcucaga

SEQ ID NO: 919621 - RNA, 16 nt, Homo sapiens
caggagguacugugag

SEQ ID NO: 919622 - RNA, 16 nt, Homo sapiens
caggaucacagcucac

SEQ ID NO: 919623 - RNA, 19 nt, Homo sapiens
caggcaaagucugaaguca

SEQ ID NO: 919624 - RNA, 19 nt, Homo sapiens
caggcacaguaagcaugcu

SEQ ID NO: 919625 - RNA, 12 nt, Homo sapiens
caggcaccagca

SEQ ID NO: 919626 - RNA, 14 nt, Homo sapiens
caggcagaaggugg

SEQ ID NO: 919627 - RNA, 19 nt, Homo sapiens
uauuagugaaguaugcacu

SEQ ID NO: 919628 - RNA, 13 nt, Homo sapiens
uauucuaaccuac

SEQ ID NO: 919629 - RNA, 16 nt, Homo sapiens
uauucuuuccaugcag

SEQ ID NO: 919630 - RNA, 13 nt, Homo sapiens
uauugaguucuga

SEQ ID NO: 919631 - RNA, 21 nt, Homo sapiens
uauuuaaaaaaaaacauucaa

SEQ ID NO: 919632 - RNA, 19 nt, Homo sapiens
uauuuaacccuuucuucaa

SEQ ID NO: 919633 - RNA, 13 nt, Homo sapiens
uauuuaguggaac

SEQ ID NO: 919634 - RNA, 17 nt, Homo sapiens
uugaaaauguccaggaa

SEQ ID NO: 919635 - RNA, 14 nt, Homo sapiens
uugaauaggcauua

SEQ ID NO: 919636 - RNA, 17 nt, Homo sapiens
uugaccaucucucuuau

SEQ ID NO: 919637 - RNA, 15 nt, Homo sapiens
uugacuggcuuuccu

SEQ ID NO: 919638 - RNA, 18 nt, Homo sapiens
uugacuuuagggacucaa

SEQ ID NO: 919639 - RNA, 9 nt, Homo sapiens
uugagacag

SEQ ID NO: 919640 - RNA, 14 nt, Homo sapiens
uugagcgagcccau

SEQ ID NO: 919641 - RNA, 14 nt, Homo sapiens
uugaguauuacaca

SEQ ID NO: 919642 - RNA, 19 nt, Homo sapiens
uugcaaccuaguacuuuau

SEQ ID NO: 919643 - RNA, 15 nt, Homo sapiens
uugcagacaguccuu

SEQ ID NO: 919644 - RNA, 13 nt, Homo sapiens
uugcauguguaaa

SEQ ID NO: 919645 - RNA, 18 nt, Homo sapiens
uugccaacccugugucac

SEQ ID NO: 919646 - RNA, 15 nt, Homo sapiens
uugccgcugggagag

SEQ ID NO: 919647 - RNA, 21 nt, Homo sapiens
uugccugggggcuuuugccac

SEQ ID NO: 919648 - RNA, 14 nt, Homo sapiens
uugccuuuggcaau

SEQ ID NO: 919649 - RNA, 20 nt, Homo sapiens
uugccuuuugcaaccaggaa

SEQ ID NO: 919650 - RNA, 17 nt, Homo sapiens
uugcuacucuugcugca

SEQ ID NO: 919651 - RNA, 17 nt, Homo sapiens
uuggaaaguacuaugaa

SEQ ID NO: 919652 - RNA, 14 nt, Homo sapiens
uuggagaaaggauu

SEQ ID NO: 919653 - RNA, 23 nt, Homo sapiens
uuggauuuuccaccaaauucuga

SEQ ID NO: 919654 - RNA, 23 nt, Homo sapiens
uuggccaaaacaggcucaggcca

SEQ ID NO: 919655 - RNA, 19 nt, Homo sapiens
uugggacauuugcauucaa

SEQ ID NO: 919656 - RNA, 20 nt, Homo sapiens
uugggcuuguuuucuacuuu

SEQ ID NO: 919657 - RNA, 14 nt, Homo sapiens
uugguaacugccug

SEQ ID NO: 919658 - RNA, 15 nt, Homo sapiens
uuggucauauugcca

SEQ ID NO: 919659 - RNA, 14 nt, Homo sapiens
uugguccuaagucc

SEQ ID NO: 919660 - RNA, 17 nt, Homo sapiens
uuggugacauaaugcca

SEQ ID NO: 919661 - RNA, 12 nt, Homo sapiens
uugguuuccuca

SEQ ID NO: 919662 - RNA, 13 nt, Homo sapiens
uuguacugugacc

SEQ ID NO: 919663 - RNA, 12 nt, Homo sapiens
uuguagccagaa

SEQ ID NO: 919664 - RNA, 15 nt, Homo sapiens
uuguagcguuuccuu

SEQ ID NO: 919665 - RNA, 22 nt, Homo sapiens
uugugaaggaaaaacaugcuua

SEQ ID NO: 919666 - RNA, 16 nt, Homo sapiens
uugugggggugucaca

SEQ ID NO: 919667 - RNA, 18 nt, Homo sapiens
uuguuauuuuugucucga

SEQ ID NO: 919668 - RNA, 17 nt, Homo sapiens
uuguuguuuaucaggaa

SEQ ID NO: 919669 - RNA, 23 nt, Homo sapiens
uuguuuuauccacaacuuuucaa

SEQ ID NO: 919670 - RNA, 16 nt, Homo sapiens
uuuaaaaaaguaugaa

SEQ ID NO: 919671 - RNA, 17 nt, Homo sapiens
uuuaaagacaaagacau

SEQ ID NO: 919672 - RNA, 22 nt, Homo sapiens
uuuaaagacaaagacauuauuu

SEQ ID NO: 919673 - RNA, 14 nt, Homo sapiens
uuuaauugagauga

SEQ ID NO: 919674 - RNA, 19 nt, Homo sapiens
uuuaauugcaaagcuguca

SEQ ID NO: 919675 - RNA, 17 nt, Homo sapiens
uuuacaauuaaacucaa

SEQ ID NO: 919676 - RNA, 12 nt, Homo sapiens
uuuacacugacu

SEQ ID NO: 919677 - RNA, 11 nt, Homo sapiens
uuuacauauau

SEQ ID NO: 919678 - RNA, 17 nt, Homo sapiens
uuuacggccuaugagau

SEQ ID NO: 919679 - RNA, 20 nt, Homo sapiens
uuuacuucccagagaacuuc

SEQ ID NO: 919680 - RNA, 18 nt, Homo sapiens
uuuagauuuucuuuugcc

SEQ ID NO: 919681 - RNA, 21 nt, Homo sapiens
uuuaggaccgugggucaugca

SEQ ID NO: 919682 - RNA, 23 nt, Homo sapiens
uuuauggaccaauuagcauucca

SEQ ID NO: 919683 - RNA, 15 nt, Homo sapiens
uuuauucacuugugu

SEQ ID NO: 919684 - RNA, 23 nt, Homo sapiens
uuucacaaauguuuuaaacucau

SEQ ID NO: 919685 - RNA, 20 nt, Homo sapiens
uuucacuccgcaaauauccu

SEQ ID NO: 919686 - RNA, 19 nt, Homo sapiens
uuucauugaaauaauugau

SEQ ID NO: 919687 - RNA, 13 nt, Homo sapiens
uuuccacacagcc

SEQ ID NO: 919688 - RNA, 19 nt, Homo sapiens
uuuccaccuuucugaaugg

SEQ ID NO: 919689 - RNA, 14 nt, Homo sapiens
uuuccucagucucc

SEQ ID NO: 919690 - RNA, 13 nt, Homo sapiens
uuuccuugucucu

SEQ ID NO: 919691 - RNA, 15 nt, Homo sapiens
uuuccuugucucuca

SEQ ID NO: 919692 - RNA, 20 nt, Homo sapiens
uuucuaguuguaauguguau

SEQ ID NO: 919693 - RNA, 24 nt, Homo sapiens
uuucuggugccuauuuauucauuc

SEQ ID NO: 919694 - RNA, 22 nt, Homo sapiens
uuucuuccuucaaauccugcca

SEQ ID NO: 919695 - RNA, 18 nt, Homo sapiens
uuugaaaggcuuuccuca

SEQ ID NO: 919696 - RNA, 13 nt, Homo sapiens
uuugaagagacca

SEQ ID NO: 919697 - RNA, 16 nt, Homo sapiens
uuugcugcagacucau

SEQ ID NO: 919698 - RNA, 19 nt, Homo sapiens
uuugguauucaauuugauu

SEQ ID NO: 919699 - RNA, 22 nt, Homo sapiens
uuuggucaccuuccucugccuu

SEQ ID NO: 919700 - RNA, 16 nt, Homo sapiens
uuuguaacaugacaca

SEQ ID NO: 919701 - RNA, 23 nt, Homo sapiens
uuuguacagaagaggauucaaaa

SEQ ID NO: 919702 - RNA, 19 nt, Homo sapiens
uuugucuaagaacuucgaa

SEQ ID NO: 919703 - RNA, 22 nt, Homo sapiens
uuugugcauguauauuacugau

SEQ ID NO: 919704 - RNA, 17 nt, Homo sapiens
uuuguuaagaauuucaa

SEQ ID NO: 919705 - RNA, 14 nt, Homo sapiens
uuuguucacuguga

SEQ ID NO: 919706 - RNA, 14 nt, Homo sapiens
uuuguucaugaaua

SEQ ID NO: 919707 - RNA, 16 nt, Homo sapiens
uuuguugagcaagagu

SEQ ID NO: 919708 - RNA, 17 nt, Homo sapiens
uuuuaagcaacuggaaa

SEQ ID NO: 919709 - RNA, 13 nt, Homo sapiens
uuuuaauugagau

SEQ ID NO: 919710 - RNA, 15 nt, Homo sapiens
uuuuauaagcauuua

SEQ ID NO: 919711 - RNA, 16 nt, Homo sapiens
uuuuauaagcauuuaa

SEQ ID NO: 919712 - RNA, 13 nt, Homo sapiens
uuuuauaugaugu

SEQ ID NO: 919713 - RNA, 23 nt, Homo sapiens
uuuucagacaaauuacugauaaa

SEQ ID NO: 919714 - RNA, 12 nt, Homo sapiens
uuuucuuuccaa

SEQ ID NO: 919715 - RNA, 15 nt, Homo sapiens
uuuugccaacccugu

SEQ ID NO: 919716 - RNA, 20 nt, Homo sapiens
uuuugggacauuugcauuca

SEQ ID NO: 919717 - RNA, 22 nt, Homo sapiens
uuuuuauuugaaaauuugcuga

SEQ ID NO: 919718 - RNA, 15 nt, Homo sapiens
cuuuuggagcugaga

SEQ ID NO: 919719 - RNA, 20 nt, Homo sapiens
cuuuuguaaaauaaaaccac

SEQ ID NO: 919720 - RNA, 19 nt, Homo sapiens
cuuuuguaguauacuuuca

SEQ ID NO: 919721 - RNA, 20 nt, Homo sapiens
cuuuuuauuguuaguucuca

SEQ ID NO: 919722 - RNA, 16 nt, Homo sapiens
cuuuuuugccucacaa

SEQ ID NO: 919723 - RNA, 14 nt, Homo sapiens
gaaaaacaugucau

SEQ ID NO: 919724 - RNA, 22 nt, Homo sapiens
gaaaaaggagcuuaccucccac

SEQ ID NO: 919725 - RNA, 20 nt, Homo sapiens
gaaaacagcagcaaugcaau

SEQ ID NO: 919726 - RNA, 17 nt, Homo sapiens
gaaaagaagcacccaga

SEQ ID NO: 919727 - RNA, 14 nt, Homo sapiens
gaaaagaagcagua

SEQ ID NO: 919728 - RNA, 15 nt, Homo sapiens
gaaaagacugaccuu

SEQ ID NO: 919729 - RNA, 15 nt, Homo sapiens
gaaaagcuguuccca

SEQ ID NO: 919730 - RNA, 19 nt, Homo sapiens
cccaccagccuuguccuaa

SEQ ID NO: 919731 - RNA, 15 nt, Homo sapiens
cccacccgucuucaa

SEQ ID NO: 919732 - RNA, 14 nt, Homo sapiens
cccaccuaccuuca

SEQ ID NO: 919733 - RNA, 15 nt, Homo sapiens
cccagcucagucuuc

SEQ ID NO: 919734 - RNA, 17 nt, Homo sapiens
cccagcugaaggcagug

SEQ ID NO: 919735 - RNA, 13 nt, Homo sapiens
cccagcugcauuu

SEQ ID NO: 919736 - RNA, 16 nt, Homo sapiens
cccaggcuggucuuga

SEQ ID NO: 919737 - RNA, 19 nt, Homo sapiens
cccaguucauguugcucag

SEQ ID NO: 919738 - RNA, 23 nt, Homo sapiens
cccauggauguuucuucuuugac

SEQ ID NO: 919739 - RNA, 19 nt, Homo sapiens
cccaugguagacugugaca

SEQ ID NO: 919740 - RNA, 16 nt, Homo sapiens
cccauugcaccgagac

SEQ ID NO: 919741 - RNA, 20 nt, Homo sapiens
cccauuuaaaaauaucugaa

SEQ ID NO: 919742 - RNA, 17 nt, Homo sapiens
ccccucacacuuugcca

SEQ ID NO: 919743 - RNA, 15 nt, Homo sapiens
ccccucccugcuuca

SEQ ID NO: 919744 - RNA, 16 nt, Homo sapiens
ccccucccugcuucaa

SEQ ID NO: 919745 - RNA, 21 nt, Homo sapiens
ccccuggcugguaagggccaa

SEQ ID NO: 919746 - RNA, 12 nt, Homo sapiens
cccgaguagcau

SEQ ID NO: 919747 - RNA, 16 nt, Homo sapiens
cccuacacaaaauaca

SEQ ID NO: 919748 - RNA, 16 nt, Homo sapiens
cccuacuggcuguaaa

SEQ ID NO: 919749 - RNA, 15 nt, Homo sapiens
cccucacccaaaaga

SEQ ID NO: 919750 - RNA, 20 nt, Homo sapiens
cccucauuacugccaacagu

SEQ ID NO: 919751 - RNA, 15 nt, Homo sapiens
cccucuggggcucag

SEQ ID NO: 919752 - RNA, 16 nt, Homo sapiens
cccugagcuggccuca

SEQ ID NO: 919753 - RNA, 23 nt, Homo sapiens
cccugagggacuuggcaguagaa

SEQ ID NO: 919754 - RNA, 17 nt, Homo sapiens
cccugagguaucugugu

SEQ ID NO: 919755 - RNA, 18 nt, Homo sapiens
cccugcacgccggcacca

SEQ ID NO: 919756 - RNA, 16 nt, Homo sapiens
cccugcuaugcagaug

SEQ ID NO: 919757 - RNA, 17 nt, Homo sapiens
cccugcucuucagcacc

SEQ ID NO: 919758 - RNA, 22 nt, Homo sapiens
cccugggguuuuuuucaucccu

SEQ ID NO: 919759 - RNA, 15 nt, Homo sapiens
cccuggugccucuca

SEQ ID NO: 919760 - RNA, 19 nt, Homo sapiens
cccuguucuggacauuuca

SEQ ID NO: 919761 - RNA, 20 nt, Homo sapiens
cccuuaggucgcgcucuugc

SEQ ID NO: 919762 - RNA, 20 nt, Homo sapiens
cccuuggggcucccuguguc

SEQ ID NO: 919763 - RNA, 22 nt, Homo sapiens
cccuuuguuuaaaaugucauuu

SEQ ID NO: 919764 - RNA, 22 nt, Homo sapiens
ccgaguggauagaugcccugcu

SEQ ID NO: 919765 - RNA, 19 nt, Homo sapiens
ccgcaugcagcagcuugcu

SEQ ID NO: 919766 - RNA, 18 nt, Homo sapiens
ccgcuuugaaagaagcaa

SEQ ID NO: 919767 - RNA, 21 nt, Homo sapiens
ccggaaguugcugugccccau

SEQ ID NO: 919768 - RNA, 16 nt, Homo sapiens
ccggacuugcugugua

SEQ ID NO: 919769 - RNA, 23 nt, Homo sapiens
ccgggagguggagguugcaguga

SEQ ID NO: 919770 - RNA, 19 nt, Homo sapiens
ccgggcacagcugugguga

SEQ ID NO: 919771 - RNA, 15 nt, Homo sapiens
ccgggcuggagaaag

SEQ ID NO: 919772 - RNA, 17 nt, Homo sapiens
ccgguugcuucugggaa

SEQ ID NO: 919773 - RNA, 21 nt, Homo sapiens
ccguuggcaccucugugccac

SEQ ID NO: 919774 - RNA, 14 nt, Homo sapiens
ccuaaaaaugaaua

SEQ ID NO: 919775 - RNA, 19 nt, Homo sapiens
ccuacaccaacugcucuca

SEQ ID NO: 919776 - RNA, 18 nt, Homo sapiens
ccuacagagggauuuauu

SEQ ID NO: 919777 - RNA, 19 nt, Homo sapiens
ccuacaugguccauugcua

SEQ ID NO: 919778 - RNA, 11 nt, Homo sapiens
ccuacuuuuca

SEQ ID NO: 919779 - RNA, 22 nt, Homo sapiens
ccuagcuuagagccucccucaa

SEQ ID NO: 919780 - RNA, 12 nt, Homo sapiens
ccuaggcuaccc

SEQ ID NO: 919781 - RNA, 20 nt, Homo sapiens
ccuaguacuuuauuaguuua

SEQ ID NO: 919782 - RNA, 17 nt, Homo sapiens
ccuauaccccucaucac

SEQ ID NO: 919783 - RNA, 16 nt, Homo sapiens
ccuauucauucacaau

SEQ ID NO: 919784 - RNA, 20 nt, Homo sapiens
ccuauuuaaaaaaauagaaa

SEQ ID NO: 919785 - RNA, 19 nt, Homo sapiens
ccucaaagauucugcauuu

SEQ ID NO: 919786 - RNA, 19 nt, Homo sapiens
ccucagcuucaaauaaagu

SEQ ID NO: 919787 - RNA, 20 nt, Homo sapiens
ccucaguuucuucaccugua

SEQ ID NO: 919788 - RNA, 14 nt, Homo sapiens
ccucauguucucau

SEQ ID NO: 919789 - RNA, 21 nt, Homo sapiens
ccucauuacugccaacaguuu

SEQ ID NO: 919790 - RNA, 13 nt, Homo sapiens
ccucccaaagugc

SEQ ID NO: 919791 - RNA, 21 nt, Homo sapiens
ccucccuguuugauauuaaaa

SEQ ID NO: 919792 - RNA, 12 nt, Homo sapiens
ccuccuuuccca

SEQ ID NO: 919793 - RNA, 12 nt, Homo sapiens
ccucggcuaccc

SEQ ID NO: 919794 - RNA, 13 nt, Homo sapiens
ccucucacacugg

SEQ ID NO: 919795 - RNA, 19 nt, Homo sapiens
ccucuccacgcacucagcu

SEQ ID NO: 919796 - RNA, 20 nt, Homo sapiens
ccucugaggcucagcccuga

SEQ ID NO: 919797 - RNA, 21 nt, Homo sapiens
ccucugugcugcaucccacca

SEQ ID NO: 919798 - RNA, 21 nt, Homo sapiens
ccucuuuugagacuuugccca

SEQ ID NO: 919799 - RNA, 12 nt, Homo sapiens
ccugaaaggaag

SEQ ID NO: 919800 - RNA, 18 nt, Homo sapiens
ccugacacaaucccuaca

SEQ ID NO: 919801 - RNA, 16 nt, Homo sapiens
ccugacucaggcauca

SEQ ID NO: 919802 - RNA, 14 nt, Homo sapiens
ccugaggucgucaa

SEQ ID NO: 919803 - RNA, 21 nt, Homo sapiens
ccugaguuggcguugugggca

SEQ ID NO: 919804 - RNA, 22 nt, Homo sapiens
ccugcauucgcagcagcuccgc

SEQ ID NO: 919805 - RNA, 15 nt, Homo sapiens
ccugccuagcacuca

SEQ ID NO: 919806 - RNA, 15 nt, Homo sapiens
ccugcgcauggugca

SEQ ID NO: 919807 - RNA, 14 nt, Homo sapiens
ccugcuauuuccca

SEQ ID NO: 919808 - RNA, 20 nt, Homo sapiens
ccuggaaugcauucacucag

SEQ ID NO: 919809 - RNA, 21 nt, Homo sapiens
ccuggccaucucugaacuuca

SEQ ID NO: 919810 - RNA, 20 nt, Homo sapiens
ccuggcguggggggagcucu

SEQ ID NO: 919811 - RNA, 19 nt, Homo sapiens
ccugggugcaggacacugg

SEQ ID NO: 919812 - RNA, 22 nt, Homo sapiens
ccugguccagauuguagcucuu

SEQ ID NO: 919813 - RNA, 21 nt, Homo sapiens
ccuguaaucccaacacuuugg

SEQ ID NO: 919814 - RNA, 17 nt, Homo sapiens
ccugugccgcacuagcc

SEQ ID NO: 919815 - RNA, 22 nt, Homo sapiens
ccuguguggaguuauucacucu

SEQ ID NO: 919816 - RNA, 19 nt, Homo sapiens
ccuguugccuugagcucuu

SEQ ID NO: 919817 - RNA, 16 nt, Homo sapiens
ccuuagcaacagccga

SEQ ID NO: 919818 - RNA, 23 nt, Homo sapiens
ccuucaauuuucuucacacuauc

SEQ ID NO: 919819 - RNA, 17 nt, Homo sapiens
ccuuccaugcaaaggcu

SEQ ID NO: 919820 - RNA, 15 nt, Homo sapiens
ccuuccugucuggcc

SEQ ID NO: 919821 - RNA, 17 nt, Homo sapiens
ccuugagcucuucugag

SEQ ID NO: 919822 - RNA, 20 nt, Homo sapiens
ccuugaguugaguauuacac

SEQ ID NO: 919823 - RNA, 21 nt, Homo sapiens
ccuugcacuauuggacuuugg

SEQ ID NO: 919824 - RNA, 15 nt, Homo sapiens
ccuuucucuucucug

SEQ ID NO: 919825 - RNA, 15 nt, Homo sapiens
ccuuucuucaauaca

SEQ ID NO: 919826 - RNA, 16 nt, Homo sapiens
ccuuucuucaauacaa

SEQ ID NO: 919827 - RNA, 21 nt, Homo sapiens
ccuuuguuuaaaaugucauuu

SEQ ID NO: 919828 - RNA, 11 nt, Homo sapiens
ccuuuugcaac

SEQ ID NO: 919829 - RNA, 17 nt, Homo sapiens
ccuuuugcaaccaggaa

SEQ ID NO: 919830 - RNA, 14 nt, Homo sapiens
cgaagacuauuuag

SEQ ID NO: 919831 - RNA, 20 nt, Homo sapiens
cgaagacuauuuaguggaac

SEQ ID NO: 919832 - RNA, 16 nt, Homo sapiens
cgacuucugcccauuc

SEQ ID NO: 919833 - RNA, 15 nt, Homo sapiens
cgaggacgcauucca

SEQ ID NO: 919834 - RNA, 22 nt, Homo sapiens
cgaggucaggagauggagacca

SEQ ID NO: 919835 - RNA, 17 nt, Homo sapiens
cgcaaaacccacugacc

SEQ ID NO: 919836 - RNA, 15 nt, Homo sapiens
uauuuuucuuuccaa

SEQ ID NO: 919837 - RNA, 18 nt, Homo sapiens
ucaaaaacacuugagaag

SEQ ID NO: 919838 - RNA, 21 nt, Homo sapiens
ucaaaaacauggccacaucca

SEQ ID NO: 919839 - RNA, 19 nt, Homo sapiens
ucaaaaucuguagagcagg

SEQ ID NO: 919840 - RNA, 19 nt, Homo sapiens
ucaaaaucuuaaccugaug

SEQ ID NO: 919841 - RNA, 17 nt, Homo sapiens
ucaaagauucugcauuu

SEQ ID NO: 919842 - RNA, 22 nt, Homo sapiens
ucaaauuuuuuguagacagggu

SEQ ID NO: 919843 - RNA, 21 nt, Homo sapiens
ucaacaauaaaaaaaaaccua

SEQ ID NO: 919844 - RNA, 21 nt, Homo sapiens
ucaacacauauuuuuauauua

SEQ ID NO: 919845 - RNA, 18 nt, Homo sapiens
ucaacacugcagcauuuu

SEQ ID NO: 919846 - RNA, 23 nt, Homo sapiens
ucaacauggaaaaauccugucau

SEQ ID NO: 919847 - RNA, 17 nt, Homo sapiens
ucaagauuaaacugagu

SEQ ID NO: 919848 - RNA, 19 nt, Homo sapiens
ucaagauuacaacaucugu

SEQ ID NO: 919849 - RNA, 17 nt, Homo sapiens
ucaagcaauccuccuga

SEQ ID NO: 919850 - RNA, 14 nt, Homo sapiens
ucaagcagugugcu

SEQ ID NO: 919851 - RNA, 14 nt, Homo sapiens
ucaagcuucauuau

SEQ ID NO: 919852 - RNA, 14 nt, Homo sapiens
ucaaggagauauga

SEQ ID NO: 919853 - RNA, 15 nt, Homo sapiens
ucaaguauuguuaau

SEQ ID NO: 919854 - RNA, 20 nt, Homo sapiens
ucaagugcaccuacaccaac

SEQ ID NO: 919855 - RNA, 17 nt, Homo sapiens
ucaauaaaguacugcaa

SEQ ID NO: 919856 - RNA, 18 nt, Homo sapiens
ucaauaaaguacugcaaa

SEQ ID NO: 919857 - RNA, 19 nt, Homo sapiens
ucaaucacuugaaagugaa

SEQ ID NO: 919858 - RNA, 17 nt, Homo sapiens
ucaaucucuguucugcu

SEQ ID NO: 919859 - RNA, 17 nt, Homo sapiens
ucaauggacugcaccuu

SEQ ID NO: 919860 - RNA, 19 nt, Homo sapiens
ucaauucucaauauauuca

SEQ ID NO: 919861 - RNA, 16 nt, Homo sapiens
ucaauuuuauaucuag

SEQ ID NO: 919862 - RNA, 16 nt, Homo sapiens
ucacaaacucauccau

SEQ ID NO: 919863 - RNA, 20 nt, Homo sapiens
ucacaaacucauccauuaau

SEQ ID NO: 919864 - RNA, 16 nt, Homo sapiens
ucacacuauccagcua

SEQ ID NO: 919865 - RNA, 21 nt, Homo sapiens
ucacagagacucuguccuucc

SEQ ID NO: 919866 - RNA, 22 nt, Homo sapiens
ucacaggacgauuucacugaca

SEQ ID NO: 919867 - RNA, 12 nt, Homo sapiens
ucaccaccacca

SEQ ID NO: 919868 - RNA, 14 nt, Homo sapiens
ucaccaggggagga

SEQ ID NO: 919869 - RNA, 19 nt, Homo sapiens
ucaccaggggaggagccug

SEQ ID NO: 919870 - RNA, 19 nt, Homo sapiens
ucacccaaaagaauuauca

SEQ ID NO: 919871 - RNA, 15 nt, Homo sapiens
ucacccccacacugg

SEQ ID NO: 919872 - RNA, 13 nt, Homo sapiens
ucacccuccucau

SEQ ID NO: 919873 - RNA, 20 nt, Homo sapiens
ucaccugcacagggcccucu

SEQ ID NO: 919874 - RNA, 23 nt, Homo sapiens
ccugucuuggccucccaaagugc

SEQ ID NO: 919875 - RNA, 11 nt, Homo sapiens
ccugugccugg

SEQ ID NO: 919876 - RNA, 13 nt, Homo sapiens
ccugugucagggc

SEQ ID NO: 919877 - RNA, 21 nt, Homo sapiens
ccuguucaagaaacaaccuuu

SEQ ID NO: 919878 - RNA, 18 nt, Homo sapiens
ccuguuuacgguacuugg

SEQ ID NO: 919879 - RNA, 23 nt, Homo sapiens
ccuuacauuauuacuccuugcca

SEQ ID NO: 919880 - RNA, 13 nt, Homo sapiens
ccuuccaacugcu

SEQ ID NO: 919881 - RNA, 15 nt, Homo sapiens
ccuucccucuaagcc

SEQ ID NO: 919882 - RNA, 12 nt, Homo sapiens
ccuucucuucuc

SEQ ID NO: 919883 - RNA, 20 nt, Homo sapiens
ccuucugugcccagcucagu

SEQ ID NO: 919884 - RNA, 10 nt, Homo sapiens
ccuugcuaau

SEQ ID NO: 919885 - RNA, 12 nt, Homo sapiens
ccuugcugcacc

SEQ ID NO: 919886 - RNA, 21 nt, Homo sapiens
ccuuguccccaacguuccaca

SEQ ID NO: 919887 - RNA, 20 nt, Homo sapiens
ccuugucccccgugaucucc

SEQ ID NO: 919888 - RNA, 14 nt, Homo sapiens
ccuuuagaauauua

SEQ ID NO: 919889 - RNA, 20 nt, Homo sapiens
ccuuucugacaauaaauaau

SEQ ID NO: 919890 - RNA, 14 nt, Homo sapiens
ccuuuucaugauuu

SEQ ID NO: 919891 - RNA, 22 nt, Homo sapiens
ccuuuuuuuuacggaauuccaa

SEQ ID NO: 919892 - RNA, 23 nt, Homo sapiens
cgacaagccugccaacaagcuga

SEQ ID NO: 919893 - RNA, 17 nt, Homo sapiens
cgaggagcuccugggaa

SEQ ID NO: 919894 - RNA, 17 nt, Homo sapiens
cgaguaguugggauuac

SEQ ID NO: 919895 - RNA, 19 nt, Homo sapiens
cgaguaguugggauuacag

SEQ ID NO: 919896 - RNA, 18 nt, Homo sapiens
cgaucauggcucacugca

SEQ ID NO: 919897 - RNA, 16 nt, Homo sapiens
cgauuucagcacaugc

SEQ ID NO: 919898 - RNA, 14 nt, Homo sapiens
cgccuuaguuugaa

SEQ ID NO: 919899 - RNA, 15 nt, Homo sapiens
cgcuggcugcacuca

SEQ ID NO: 919900 - RNA, 13 nt, Homo sapiens
cggaacacuguca

SEQ ID NO: 919901 - RNA, 16 nt, Homo sapiens
cggaacucuucaucuu

SEQ ID NO: 919902 - RNA, 14 nt, Homo sapiens
cggaauuccaauau

SEQ ID NO: 919903 - RNA, 15 nt, Homo sapiens
cggaccucaguuucu

SEQ ID NO: 919904 - RNA, 22 nt, Homo sapiens
cggcaaaugcgcacgaccuaca

SEQ ID NO: 919905 - RNA, 21 nt, Homo sapiens
cgguggcgccagcccuaggcu

SEQ ID NO: 919906 - RNA, 23 nt, Homo sapiens
cgguuugggagagaccauugcau

SEQ ID NO: 919907 - RNA, 14 nt, Homo sapiens
cguaagaacauguu

SEQ ID NO: 919908 - RNA, 17 nt, Homo sapiens
cguaauugaaacauuua

SEQ ID NO: 919909 - RNA, 15 nt, Homo sapiens
cgucccuggggcucc

SEQ ID NO: 919910 - RNA, 17 nt, Homo sapiens
cgucugugauugccauu

SEQ ID NO: 919911 - RNA, 22 nt, Homo sapiens
cgugagccucagccaccccuca

SEQ ID NO: 919912 - RNA, 21 nt, Homo sapiens
cgugcaauacggaacacuguc

SEQ ID NO: 919913 - RNA, 14 nt, Homo sapiens
cguggaugaccucc

SEQ ID NO: 919914 - RNA, 13 nt, Homo sapiens
cgugggucaugca

SEQ ID NO: 919915 - RNA, 17 nt, Homo sapiens
cguuccacaacaguccc

SEQ ID NO: 919916 - RNA, 14 nt, Homo sapiens
cguucuaaaaucaa

SEQ ID NO: 919917 - RNA, 18 nt, Homo sapiens
cuaaaaaacggauuuccu

SEQ ID NO: 919918 - RNA, 16 nt, Homo sapiens
cuaaaaaucaaucacu

SEQ ID NO: 919919 - RNA, 21 nt, Homo sapiens
cuaaaaugugggugaagguga

SEQ ID NO: 919920 - RNA, 16 nt, Homo sapiens
cuaaacguauuucacu

SEQ ID NO: 919921 - RNA, 12 nt, Homo sapiens
cuaaagccagca

SEQ ID NO: 919922 - RNA, 16 nt, Homo sapiens
cuaaauacuguacaua

SEQ ID NO: 919923 - RNA, 18 nt, Homo sapiens
cuaagaucacaucacugc

SEQ ID NO: 919924 - RNA, 21 nt, Homo sapiens
cuaagggggugaccaugcaau

SEQ ID NO: 919925 - RNA, 18 nt, Homo sapiens
cuaauaaaauacauacua

SEQ ID NO: 919926 - RNA, 23 nt, Homo sapiens
cuaauaaaauuaaguuguaucau

SEQ ID NO: 919927 - RNA, 16 nt, Homo sapiens
cuaauguaacuuccuc

SEQ ID NO: 919928 - RNA, 23 nt, Homo sapiens
cuaauuagaaaauauaguuugag

SEQ ID NO: 919929 - RNA, 23 nt, Homo sapiens
cuaauuuucuucccaagugcugu

SEQ ID NO: 919930 - RNA, 15 nt, Homo sapiens
cuacaagagggcaaa

SEQ ID NO: 919931 - RNA, 18 nt, Homo sapiens
cuacugaaauuuacacaa

SEQ ID NO: 919932 - RNA, 14 nt, Homo sapiens
cuacugaggagcaa

SEQ ID NO: 919933 - RNA, 13 nt, Homo sapiens
cuacuuugccaca

SEQ ID NO: 919934 - RNA, 19 nt, Homo sapiens
cuacuuugccacagauuau

SEQ ID NO: 919935 - RNA, 14 nt, Homo sapiens
cuagaauacuaaua

SEQ ID NO: 919936 - RNA, 17 nt, Homo sapiens
cuagaugagaauucagc

SEQ ID NO: 919937 - RNA, 12 nt, Homo sapiens
cuaggccccaga

SEQ ID NO: 919938 - RNA, 19 nt, Homo sapiens
cuaggugcccgaguagcau

SEQ ID NO: 919939 - RNA, 21 nt, Homo sapiens
cuaguacuuuauuaguuuaaa

SEQ ID NO: 919940 - RNA, 20 nt, Homo sapiens
cuagugcagagagguuguga

SEQ ID NO: 919941 - RNA, 14 nt, Homo sapiens
cuauacaugaauca

SEQ ID NO: 919942 - RNA, 14 nt, Homo sapiens
cuauaccucauuca

SEQ ID NO: 919943 - RNA, 14 nt, Homo sapiens
cuaucaacacugca

SEQ ID NO: 919944 - RNA, 15 nt, Homo sapiens
cuaucaacacugcag

SEQ ID NO: 919945 - RNA, 15 nt, Homo sapiens
cuaucauagauuuac

SEQ ID NO: 919946 - RNA, 21 nt, Homo sapiens
cuauugugcuuucuaucuaau

SEQ ID NO: 919947 - RNA, 16 nt, Homo sapiens
cuauuuuucuuuccaa

SEQ ID NO: 919948 - RNA, 17 nt, Homo sapiens
cucacgcucccaacaca

SEQ ID NO: 919949 - RNA, 21 nt, Homo sapiens
cucaggcuguuuuugggugca

SEQ ID NO: 919950 - RNA, 17 nt, Homo sapiens
cucaguuucuguuguuu

SEQ ID NO: 919951 - RNA, 20 nt, Homo sapiens
cucaucccaacaaacuuuaa

SEQ ID NO: 919952 - RNA, 16 nt, Homo sapiens
cucauggcagucccaa

SEQ ID NO: 919953 - RNA, 19 nt, Homo sapiens
cucauguucucauguuugu

SEQ ID NO: 919954 - RNA, 13 nt, Homo sapiens
cucauguuugugc

SEQ ID NO: 919955 - RNA, 21 nt, Homo sapiens
cucauuucaaguuaugauuca

SEQ ID NO: 919956 - RNA, 13 nt, Homo sapiens
cuccaccauuucu

SEQ ID NO: 919957 - RNA, 15 nt, Homo sapiens
cuccaguucugauga

SEQ ID NO: 919958 - RNA, 17 nt, Homo sapiens
uguccuaugggagucaa

SEQ ID NO: 919959 - RNA, 12 nt, Homo sapiens
ugucguccugcc

SEQ ID NO: 919960 - RNA, 12 nt, Homo sapiens
ugucucauuaua

SEQ ID NO: 919961 - RNA, 17 nt, Homo sapiens
agaucacaucacugcac

SEQ ID NO: 919962 - RNA, 16 nt, Homo sapiens
agaucuuggggugcag

SEQ ID NO: 919963 - RNA, 20 nt, Homo sapiens
agaugccuccucuguccuca

SEQ ID NO: 919964 - RNA, 19 nt, Homo sapiens
agauggugcagaugccugc

SEQ ID NO: 919965 - RNA, 14 nt, Homo sapiens
agaugguuaaguca

SEQ ID NO: 919966 - RNA, 14 nt, Homo sapiens
agauuauguucaau

SEQ ID NO: 919967 - RNA, 16 nt, Homo sapiens
agauuuucuuuugccu

SEQ ID NO: 919968 - RNA, 18 nt, Homo sapiens
agauuuucuuuugccuuu

SEQ ID NO: 919969 - RNA, 21 nt, Homo sapiens
agcaaagcagcaauuacaugg

SEQ ID NO: 919970 - RNA, 21 nt, Homo sapiens
agcaaauauguuugcauuaaa

SEQ ID NO: 919971 - RNA, 22 nt, Homo sapiens
agcaaaugagauguaugcccaa

SEQ ID NO: 919972 - RNA, 15 nt, Homo sapiens
agcaaauuccaauac

SEQ ID NO: 919973 - RNA, 21 nt, Homo sapiens
agcaaauuccaauacauuauu

SEQ ID NO: 919974 - RNA, 14 nt, Homo sapiens
agcaacaagccuca

SEQ ID NO: 919975 - RNA, 23 nt, Homo sapiens
agcaacaugaauuaagaacugac

SEQ ID NO: 919976 - RNA, 15 nt, Homo sapiens
agcaaccaugaacuc

SEQ ID NO: 919977 - RNA, 15 nt, Homo sapiens
agcaacccauuaauc

SEQ ID NO: 919978 - RNA, 13 nt, Homo sapiens
agcaacuggaaaa

SEQ ID NO: 919979 - RNA, 12 nt, Homo sapiens
agcaacuuugau

SEQ ID NO: 919980 - RNA, 21 nt, Homo sapiens
agcaaguuugaagagaccaca

SEQ ID NO: 919981 - RNA, 23 nt, Homo sapiens
agcaauccuccugagugauccca

SEQ ID NO: 919982 - RNA, 15 nt, Homo sapiens
agcaaugcaaugugg

SEQ ID NO: 919983 - RNA, 17 nt, Homo sapiens
agcacaaaagccucuca

SEQ ID NO: 919984 - RNA, 22 nt, Homo sapiens
agcacauauggaauuuugcaaa

SEQ ID NO: 919985 - RNA, 20 nt, Homo sapiens
agcagaaaacagaggccaca

SEQ ID NO: 919986 - RNA, 22 nt, Homo sapiens
agcagauggucccauuauucua

SEQ ID NO: 919987 - RNA, 20 nt, Homo sapiens
agcaggaaaagguccuugac

SEQ ID NO: 919988 - RNA, 15 nt, Homo sapiens
agcaggaagaacauu

SEQ ID NO: 919989 - RNA, 23 nt, Homo sapiens
agcaggaaggugacucugaccuu

SEQ ID NO: 919990 - RNA, 21 nt, Homo sapiens
agcaggcccagcuggggcccc

SEQ ID NO: 919991 - RNA, 18 nt, Homo sapiens
agcaggggaacaaaauaa

SEQ ID NO: 919992 - RNA, 18 nt, Homo sapiens
agcaguucaauaacaaag

SEQ ID NO: 919993 - RNA, 17 nt, Homo sapiens
agcauaaagucacucau

SEQ ID NO: 919994 - RNA, 14 nt, Homo sapiens
agcauggccuccag

SEQ ID NO: 919995 - RNA, 22 nt, Homo sapiens
agcauuauuuuuuguugaauag

SEQ ID NO: 919996 - RNA, 21 nt, Homo sapiens
agccacaugggaaacuuccaa

SEQ ID NO: 919997 - RNA, 22 nt, Homo sapiens
agccacccaggccacugaccuc

SEQ ID NO: 919998 - RNA, 20 nt, Homo sapiens
agccaccccucagacugggu

SEQ ID NO: 919999 - RNA, 21 nt, Homo sapiens
agccagccacccuaacugagc

SEQ ID NO: 920000 - RNA, 22 nt, Homo sapiens
agccaggccugaccucaagcaa

SEQ ID NO: 920001 - RNA, 21 nt, Homo sapiens
agccaguggggaugaggucac

SEQ ID NO: 920002 - RNA, 20 nt, Homo sapiens
agccauauauuuucugagua

SEQ ID NO: 920003 - RNA, 15 nt, Homo sapiens
agcccccuguccuuc

SEQ ID NO: 920004 - RNA, 23 nt, Homo sapiens
agcccugggugcaggacacuggu

SEQ ID NO: 920005 - RNA, 16 nt, Homo sapiens
agcccuuaaaugagau

SEQ ID NO: 920006 - RNA, 16 nt, Homo sapiens
agccguuggcaccucu

SEQ ID NO: 920007 - RNA, 19 nt, Homo sapiens
agccucgaacuccugggcu

SEQ ID NO: 920008 - RNA, 20 nt, Homo sapiens
agccugauuuaggcacugcu

SEQ ID NO: 920009 - RNA, 23 nt, Homo sapiens
agccugcggcugcuggcacagac

SEQ ID NO: 920010 - RNA, 16 nt, Homo sapiens
agccugggccacuggc

SEQ ID NO: 920011 - RNA, 23 nt, Homo sapiens
agccugugcgucccagcugaagg

SEQ ID NO: 920012 - RNA, 18 nt, Homo sapiens
agccuucagucccuauca

SEQ ID NO: 920013 - RNA, 20 nt, Homo sapiens
agcuaagaucacaucacugc

SEQ ID NO: 920014 - RNA, 16 nt, Homo sapiens
agcuaagccugaugau

SEQ ID NO: 920015 - RNA, 23 nt, Homo sapiens
agcuacauguguaagaaggcccu

SEQ ID NO: 920016 - RNA, 22 nt, Homo sapiens
agcuacucuggaggcugagaua

SEQ ID NO: 920017 - RNA, 21 nt, Homo sapiens
agcuauaccucauucacagcu

SEQ ID NO: 920018 - RNA, 19 nt, Homo sapiens
agcucagagguauccucuu

SEQ ID NO: 920019 - RNA, 23 nt, Homo sapiens
agcuccacaagagagaugauacu

SEQ ID NO: 920020 - RNA, 18 nt, Homo sapiens
agcuccugggaagcccug

SEQ ID NO: 920021 - RNA, 21 nt, Homo sapiens
agcuccugggaagcccugggu

SEQ ID NO: 920022 - RNA, 18 nt, Homo sapiens
agcucuggagaacagugg

SEQ ID NO: 920023 - RNA, 17 nt, Homo sapiens
agcugaaggcaguggca

SEQ ID NO: 920024 - RNA, 15 nt, Homo sapiens
agcuggagugcagug

SEQ ID NO: 920025 - RNA, 19 nt, Homo sapiens
agcuggcgggagcaguuug

SEQ ID NO: 920026 - RNA, 17 nt, Homo sapiens
agcugugucuuuagaca

SEQ ID NO: 920027 - RNA, 14 nt, Homo sapiens
agcugugugcaguc

SEQ ID NO: 920028 - RNA, 17 nt, Homo sapiens
agcuguucugucccuug

SEQ ID NO: 920029 - RNA, 23 nt, Homo sapiens
agcuucauuauuacguggcaaaa

SEQ ID NO: 920030 - RNA, 13 nt, Homo sapiens
agcuucugaccuc

SEQ ID NO: 920031 - RNA, 21 nt, Homo sapiens
agcuucuguccucuucuguga

SEQ ID NO: 920032 - RNA, 17 nt, Homo sapiens
agcuuuacuagugccaa

SEQ ID NO: 920033 - RNA, 22 nt, Homo sapiens
agcuuuuguaaaauaaaaccac

SEQ ID NO: 920034 - RNA, 13 nt, Homo sapiens
aggaaacaaccau

SEQ ID NO: 920035 - RNA, 19 nt, Homo sapiens
aggaacaagaauugcuaaa

SEQ ID NO: 920036 - RNA, 17 nt, Homo sapiens
aggaagaacuugaagug

SEQ ID NO: 920037 - RNA, 19 nt, Homo sapiens
aggaaucuaaacaaacagg

SEQ ID NO: 920038 - RNA, 15 nt, Homo sapiens
aggacaaaggugauu

SEQ ID NO: 920039 - RNA, 18 nt, Homo sapiens
aggacaggacccucagga

SEQ ID NO: 920040 - RNA, 21 nt, Homo sapiens
aggaccacucccuaaguaauc

SEQ ID NO: 920041 - RNA, 14 nt, Homo sapiens
aggagacuuguaca

SEQ ID NO: 920042 - RNA, 17 nt, Homo sapiens
aggagcaaagcagcaau

SEQ ID NO: 920043 - RNA, 19 nt, Homo sapiens
aggaggaaauaaauugcag

SEQ ID NO: 920044 - RNA, 21 nt, Homo sapiens
aggaggaccugggaauuucag

SEQ ID NO: 920045 - RNA, 15 nt, Homo sapiens
aggauguuucaccaa

SEQ ID NO: 920046 - RNA, 14 nt, Homo sapiens
aggauuaagcuuuu

SEQ ID NO: 920047 - RNA, 22 nt, Homo sapiens
aggauugaaaauguccaggaaa

SEQ ID NO: 920048 - RNA, 14 nt, Homo sapiens
aggcaagcuggcag

SEQ ID NO: 920049 - RNA, 21 nt, Homo sapiens
aggcaucauuccaccauggcu

SEQ ID NO: 920050 - RNA, 15 nt, Homo sapiens
aggccccugguggca

SEQ ID NO: 920051 - RNA, 18 nt, Homo sapiens
aggccuaugccaccugca

SEQ ID NO: 920052 - RNA, 14 nt, Homo sapiens
aggccuuuugcccg

SEQ ID NO: 920053 - RNA, 17 nt, Homo sapiens
aggcucccuuccugggg

SEQ ID NO: 920054 - RNA, 12 nt, Homo sapiens
aggcuccugggg

SEQ ID NO: 920055 - RNA, 23 nt, Homo sapiens
aggcucguguuugcuacaaauag

SEQ ID NO: 920056 - RNA, 21 nt, Homo sapiens
aggcucugcacagacaagcag

SEQ ID NO: 920057 - RNA, 21 nt, Homo sapiens
aggcugagauaggaggaucac

SEQ ID NO: 920058 - RNA, 17 nt, Homo sapiens
aggcuuuccucagcacc

SEQ ID NO: 920059 - RNA, 23 nt, Homo sapiens
agggacuccccauagcaaagggu

SEQ ID NO: 920060 - RNA, 19 nt, Homo sapiens
agggagaucuuggggugca

SEQ ID NO: 920061 - RNA, 12 nt, Homo sapiens
agggagggagca

SEQ ID NO: 920062 - RNA, 18 nt, Homo sapiens
agggaugaguacccaaaa

SEQ ID NO: 920063 - RNA, 23 nt, Homo sapiens
agggcagcuguggcuucuaggug

SEQ ID NO: 920064 - RNA, 21 nt, Homo sapiens
agggcccucugaggcucagcc

SEQ ID NO: 920065 - RNA, 20 nt, Homo sapiens
agggccuucuccacagggac

SEQ ID NO: 920066 - RNA, 23 nt, Homo sapiens
agggggcccucugccucauggca

SEQ ID NO: 920067 - RNA, 19 nt, Homo sapiens
agguagacauggauuugau

SEQ ID NO: 920068 - RNA, 13 nt, Homo sapiens
agguccugcacau

SEQ ID NO: 920069 - RNA, 17 nt, Homo sapiens
agguccuugacuugaug

SEQ ID NO: 920070 - RNA, 12 nt, Homo sapiens
aucccagccuug

SEQ ID NO: 920071 - RNA, 18 nt, Homo sapiens
aucccaucugcauuugau

SEQ ID NO: 920072 - RNA, 19 nt, Homo sapiens
auccuacaguacaaucagc

SEQ ID NO: 920073 - RNA, 23 nt, Homo sapiens
auccuauuuugaaccccucucca

SEQ ID NO: 920074 - RNA, 17 nt, Homo sapiens
auccucccuacuuccaa

SEQ ID NO: 920075 - RNA, 16 nt, Homo sapiens
auccuccuugucuuaa

SEQ ID NO: 920076 - RNA, 13 nt, Homo sapiens
auccugaccagcu

SEQ ID NO: 920077 - RNA, 16 nt, Homo sapiens
auccuggcuaacacgg

SEQ ID NO: 920078 - RNA, 12 nt, Homo sapiens
auccuguucuca

SEQ ID NO: 920079 - RNA, 16 nt, Homo sapiens
aucuaaacaccaaaaa

SEQ ID NO: 920080 - RNA, 11 nt, Homo sapiens
aucuaccugcc

SEQ ID NO: 920081 - RNA, 19 nt, Homo sapiens
aucuaccugcccucucuca

SEQ ID NO: 920082 - RNA, 20 nt, Homo sapiens
aucuauuuucacacuaucca

SEQ ID NO: 920083 - RNA, 16 nt, Homo sapiens
aucucagaaaauauua

SEQ ID NO: 920084 - RNA, 22 nt, Homo sapiens
aucucagaaaauauuaaggaaa

SEQ ID NO: 920085 - RNA, 18 nt, Homo sapiens
agaucuguaauucacuag

SEQ ID NO: 920086 - RNA, 16 nt, Homo sapiens
agaugucuaagacagg

SEQ ID NO: 920087 - RNA, 12 nt, Homo sapiens
agauuacaggug

SEQ ID NO: 920088 - RNA, 13 nt, Homo sapiens
agauuacaggugu

SEQ ID NO: 920089 - RNA, 21 nt, Homo sapiens
agauugcaaagggacauugaa

SEQ ID NO: 920090 - RNA, 18 nt, Homo sapiens
agauuucucaagaaggaa

SEQ ID NO: 920091 - RNA, 18 nt, Homo sapiens
agauuuuguauucagggg

SEQ ID NO: 920092 - RNA, 13 nt, Homo sapiens
agcaaaccugccc

SEQ ID NO: 920093 - RNA, 14 nt, Homo sapiens
agcaaagaacccau

SEQ ID NO: 920094 - RNA, 23 nt, Homo sapiens
agcaaaggacuuaaaauuaccaa

SEQ ID NO: 920095 - RNA, 21 nt, Homo sapiens
agcaaccuguaagacugauaa

SEQ ID NO: 920096 - RNA, 19 nt, Homo sapiens
agcaagacccugucuuaaa

SEQ ID NO: 920097 - RNA, 18 nt, Homo sapiens
agcacaugcacuacugaa

SEQ ID NO: 920098 - RNA, 11 nt, Homo sapiens
agcagccucag

SEQ ID NO: 920099 - RNA, 18 nt, Homo sapiens
agcaggaagaacauugau

SEQ ID NO: 920100 - RNA, 14 nt, Homo sapiens
agcaggcaccagca

SEQ ID NO: 920101 - RNA, 20 nt, Homo sapiens
agcaguucaauaaacuauac

SEQ ID NO: 920102 - RNA, 20 nt, Homo sapiens
agcauauauucauaccuguu

SEQ ID NO: 920103 - RNA, 23 nt, Homo sapiens
agcauugccagcucuuccaaucu

SEQ ID NO: 920104 - RNA, 19 nt, Homo sapiens
agccaaggccuaugccacc

SEQ ID NO: 920105 - RNA, 18 nt, Homo sapiens
agccagaauucacuagga

SEQ ID NO: 920106 - RNA, 16 nt, Homo sapiens
agccaggccugaccuc

SEQ ID NO: 920107 - RNA, 17 nt, Homo sapiens
agccaggccugaccuca

SEQ ID NO: 920108 - RNA, 19 nt, Homo sapiens
agcccauccugaccagcug

SEQ ID NO: 920109 - RNA, 18 nt, Homo sapiens
agcccgcaugcagcagcu

SEQ ID NO: 920110 - RNA, 23 nt, Homo sapiens
agccgagcacgguggugcaugcc

SEQ ID NO: 920111 - RNA, 16 nt, Homo sapiens
agccgaggucaugcca

SEQ ID NO: 920112 - RNA, 22 nt, Homo sapiens
agccgccaggaccgccaaagaa

SEQ ID NO: 920113 - RNA, 18 nt, Homo sapiens
agccgcgaggcuaaaaaa

SEQ ID NO: 920114 - RNA, 19 nt, Homo sapiens
agccuccugaguagcugag

SEQ ID NO: 920115 - RNA, 14 nt, Homo sapiens
agccucgaacuccu

SEQ ID NO: 920116 - RNA, 15 nt, Homo sapiens
agccuggguggcuca

SEQ ID NO: 920117 - RNA, 19 nt, Homo sapiens
agccuugguacuaggcagu

SEQ ID NO: 920118 - RNA, 21 nt, Homo sapiens
agcgguuguaaauacaauuca

SEQ ID NO: 920119 - RNA, 18 nt, Homo sapiens
agcuacagccagcggcau

SEQ ID NO: 920120 - RNA, 17 nt, Homo sapiens
agcuagugucaccugca

SEQ ID NO: 920121 - RNA, 17 nt, Homo sapiens
agcuauggaaccagcag

SEQ ID NO: 920122 - RNA, 15 nt, Homo sapiens
agcuauuucucauca

SEQ ID NO: 920123 - RNA, 14 nt, Homo sapiens
agcucacgccuuag

SEQ ID NO: 920124 - RNA, 14 nt, Homo sapiens
agcucagccagugg

SEQ ID NO: 920125 - RNA, 16 nt, Homo sapiens
agcucagccagugggg

SEQ ID NO: 920126 - RNA, 19 nt, Homo sapiens
agcucccaugugcugagaa

SEQ ID NO: 920127 - RNA, 18 nt, Homo sapiens
agcugagacuacagguga

SEQ ID NO: 920128 - RNA, 23 nt, Homo sapiens
agcugcuccgaggacccaggaaa

SEQ ID NO: 920129 - RNA, 13 nt, Homo sapiens
agcugcuguccag

SEQ ID NO: 920130 - RNA, 14 nt, Homo sapiens
agcugcuguccagg

SEQ ID NO: 920131 - RNA, 16 nt, Homo sapiens
agcugcuguccaggaa

SEQ ID NO: 920132 - RNA, 22 nt, Homo sapiens
agcuggagauacugauuauuga

SEQ ID NO: 920133 - RNA, 15 nt, Homo sapiens
agcuggggacagcuu

SEQ ID NO: 920134 - RNA, 16 nt, Homo sapiens
agcuggggacagcuuu

SEQ ID NO: 920135 - RNA, 23 nt, Homo sapiens
agcuguacccuugagaccuggaa

SEQ ID NO: 920136 - RNA, 22 nt, Homo sapiens
agcugugaugugccuacuccca

SEQ ID NO: 920137 - RNA, 12 nt, Homo sapiens
agcuguggugag

SEQ ID NO: 920138 - RNA, 19 nt, Homo sapiens
agcuuaaaaucugauuuac

SEQ ID NO: 920139 - RNA, 12 nt, Homo sapiens
agcuuacaggaa

SEQ ID NO: 920140 - RNA, 15 nt, Homo sapiens
agcuuagagccuccc

SEQ ID NO: 920141 - RNA, 18 nt, Homo sapiens
agcuucuagcagcuaagg

SEQ ID NO: 920142 - RNA, 23 nt, Homo sapiens
agcuucuguccucuucugugagu

SEQ ID NO: 920143 - RNA, 20 nt, Homo sapiens
agcuugcuggagaguggcau

SEQ ID NO: 920144 - RNA, 20 nt, Homo sapiens
agcuuuggacacacacagcu

SEQ ID NO: 920145 - RNA, 19 nt, Homo sapiens
agcuuuggacgcacacagc

SEQ ID NO: 920146 - RNA, 22 nt, Homo sapiens
aggaaaaccgaguaucuggccu

SEQ ID NO: 920147 - RNA, 19 nt, Homo sapiens
aggaaaacguugucacuuu

SEQ ID NO: 920148 - RNA, 15 nt, Homo sapiens
aggaaaagcuguucc

SEQ ID NO: 920149 - RNA, 21 nt, Homo sapiens
aggaaacaaaaaggaaaugag

SEQ ID NO: 920150 - RNA, 18 nt, Homo sapiens
aggaaacuuuuuccaccu

SEQ ID NO: 920151 - RNA, 13 nt, Homo sapiens
aggaaagaaucuc

SEQ ID NO: 920152 - RNA, 17 nt, Homo sapiens
aggaaagcguuuggaaa

SEQ ID NO: 920153 - RNA, 15 nt, Homo sapiens
aggaacuuuccagca

SEQ ID NO: 920154 - RNA, 18 nt, Homo sapiens
aggaacuuuccagcagua

SEQ ID NO: 920155 - RNA, 16 nt, Homo sapiens
aggaagagcaggcacc

SEQ ID NO: 920156 - RNA, 15 nt, Homo sapiens
aggaagccacgugcu

SEQ ID NO: 920157 - RNA, 16 nt, Homo sapiens
aggaagccacugccag

SEQ ID NO: 920158 - RNA, 19 nt, Homo sapiens
aggaagggucaaaacauuu

SEQ ID NO: 920159 - RNA, 14 nt, Homo sapiens
aggaauauaagguu

SEQ ID NO: 920160 - RNA, 22 nt, Homo sapiens
aggaauggccuuucaccuucuc

SEQ ID NO: 920161 - RNA, 15 nt, Homo sapiens
aggaccgccaaagaa

SEQ ID NO: 920162 - RNA, 16 nt, Homo sapiens
aggacgauuucacuga

SEQ ID NO: 920163 - RNA, 13 nt, Homo sapiens
aggacuggcuuug

SEQ ID NO: 920164 - RNA, 15 nt, Homo sapiens
aggacuggcuuuguc

SEQ ID NO: 920165 - RNA, 20 nt, Homo sapiens
aggacuugaauucaaagcau

SEQ ID NO: 920166 - RNA, 14 nt, Homo sapiens
aggagacacuguuc

SEQ ID NO: 920167 - RNA, 16 nt, Homo sapiens
aggagagaacagggau

SEQ ID NO: 920168 - RNA, 22 nt, Homo sapiens
aggagcaaagcagcaauuacau

SEQ ID NO: 920169 - RNA, 13 nt, Homo sapiens
aggaggaucacuu

SEQ ID NO: 920170 - RNA, 14 nt, Homo sapiens
aggaggcagaaagc

SEQ ID NO: 920171 - RNA, 24 nt, Homo sapiens
aggauauguucacaccuagcguca

SEQ ID NO: 920172 - RNA, 21 nt, Homo sapiens
aggaucacagcucacggcagc

SEQ ID NO: 920173 - RNA, 16 nt, Homo sapiens
aggauuaugugcccca

SEQ ID NO: 920174 - RNA, 14 nt, Homo sapiens
aggcaaaaggcagu

SEQ ID NO: 920175 - RNA, 14 nt, Homo sapiens
aggcaaaguggaau

SEQ ID NO: 920176 - RNA, 16 nt, Homo sapiens
aggcaagcuggcagga

SEQ ID NO: 920177 - RNA, 21 nt, Homo sapiens
aggcacagccggggccugccu

SEQ ID NO: 920178 - RNA, 20 nt, Homo sapiens
aggcaccucugugcugcauc

SEQ ID NO: 920179 - RNA, 21 nt, Homo sapiens
aggcacgcuggcuugugaucu

SEQ ID NO: 920180 - RNA, 16 nt, Homo sapiens
aggcagccuugaccac

SEQ ID NO: 920181 - RNA, 16 nt, Homo sapiens
aggccaaagaccuccc

SEQ ID NO: 920182 - RNA, 22 nt, Homo sapiens
aggccagucugaaccugagguu

SEQ ID NO: 920183 - RNA, 16 nt, Homo sapiens
aggcccaagcugccug

SEQ ID NO: 920184 - RNA, 19 nt, Homo sapiens
aggccccgcgcgccggugc

SEQ ID NO: 920185 - RNA, 12 nt, Homo sapiens
aggcccuaggcg

SEQ ID NO: 920186 - RNA, 19 nt, Homo sapiens
aggcugagugcacuggcag

SEQ ID NO: 920187 - RNA, 20 nt, Homo sapiens
aggcuugccccaaaucucaa

SEQ ID NO: 920188 - RNA, 13 nt, Homo sapiens
agggaagaacucu

SEQ ID NO: 920189 - RNA, 21 nt, Homo sapiens
agggacgguuguggugaaguu

SEQ ID NO: 920190 - RNA, 22 nt, Homo sapiens
agggacugcagguugugcccug

SEQ ID NO: 920191 - RNA, 16 nt, Homo sapiens
agggcagaggugauca

SEQ ID NO: 920192 - RNA, 21 nt, Homo sapiens
agggccaacgcuugacacaaa

SEQ ID NO: 920193 - RNA, 18 nt, Homo sapiens
aggggagcuacagccagc

SEQ ID NO: 920194 - RNA, 13 nt, Homo sapiens
aggggauccagcc

SEQ ID NO: 920195 - RNA, 16 nt, Homo sapiens
aggggauccagccacu

SEQ ID NO: 920196 - RNA, 18 nt, Homo sapiens
aggggccauccuguccca

SEQ ID NO: 920197 - RNA, 13 nt, Homo sapiens
aggggguguaaug

SEQ ID NO: 920198 - RNA, 16 nt, Homo sapiens
agggucagugccaagu

SEQ ID NO: 920199 - RNA, 17 nt, Homo sapiens
agggugguuuccugcca

SEQ ID NO: 920200 - RNA, 22 nt, Homo sapiens
aggguuacccugggcacuggcc

SEQ ID NO: 920201 - RNA, 13 nt, Homo sapiens
agguagacacaaa

SEQ ID NO: 920202 - RNA, 17 nt, Homo sapiens
aggucacugaaacuuca

SEQ ID NO: 920203 - RNA, 22 nt, Homo sapiens
agguccugcacauuacaugacu

SEQ ID NO: 920204 - RNA, 22 nt, Homo sapiens
aggugaccgcccgccucugucc

SEQ ID NO: 920205 - RNA, 17 nt, Homo sapiens
aggugagggaugccaua

SEQ ID NO: 920206 - RNA, 14 nt, Homo sapiens
agguggagguugca

SEQ ID NO: 920207 - RNA, 22 nt, Homo sapiens
auuuaggaccgugggucaugca

SEQ ID NO: 920208 - RNA, 13 nt, Homo sapiens
auuuauucauuca

SEQ ID NO: 920209 - RNA, 15 nt, Homo sapiens
auuuauucauucagu

SEQ ID NO: 920210 - RNA, 15 nt, Homo sapiens
auuuauuguaccaaa

SEQ ID NO: 920211 - RNA, 20 nt, Homo sapiens
auuucaaaaucuuaaccuga

SEQ ID NO: 920212 - RNA, 13 nt, Homo sapiens
auuucaauaucaa

SEQ ID NO: 920213 - RNA, 12 nt, Homo sapiens
auuucacugaca

SEQ ID NO: 920214 - RNA, 18 nt, Homo sapiens
auuucagcacaugcacua

SEQ ID NO: 920215 - RNA, 19 nt, Homo sapiens
auuucaucuacuacagggu

SEQ ID NO: 920216 - RNA, 18 nt, Homo sapiens
auuugccaagaccauuuc

SEQ ID NO: 920217 - RNA, 22 nt, Homo sapiens
auuugcgguuagaaucccaugg

SEQ ID NO: 920218 - RNA, 13 nt, Homo sapiens
auuuguugagcaa

SEQ ID NO: 920219 - RNA, 20 nt, Homo sapiens
auuuuaucaggggaauuuca

SEQ ID NO: 920220 - RNA, 19 nt, Homo sapiens
auuuuauugcuggaaucua

SEQ ID NO: 920221 - RNA, 16 nt, Homo sapiens
auuuuccaccaaauuc

SEQ ID NO: 920222 - RNA, 15 nt, Homo sapiens
auuuucuacacagcg

SEQ ID NO: 920223 - RNA, 15 nt, Homo sapiens
auuuucuuucaacau

SEQ ID NO: 920224 - RNA, 22 nt, Homo sapiens
auuuuuauaugauguauaccca

SEQ ID NO: 920225 - RNA, 22 nt, Homo sapiens
auuuuuccugcuguauccagaa

SEQ ID NO: 920226 - RNA, 19 nt, Homo sapiens
auuuuucucuuuuaaucua

SEQ ID NO: 920227 - RNA, 16 nt, Homo sapiens
caaaaaaacagaaaag

SEQ ID NO: 920228 - RNA, 21 nt, Homo sapiens
caaaaacaagcaaaaccaaag

SEQ ID NO: 920229 - RNA, 13 nt, Homo sapiens
caaaaauuugcau

SEQ ID NO: 920230 - RNA, 17 nt, Homo sapiens
caaaacaaaauguuaug

SEQ ID NO: 920231 - RNA, 13 nt, Homo sapiens
caaaacuguaacu

SEQ ID NO: 920232 - RNA, 19 nt, Homo sapiens
caaaagauucaaaucuccu

SEQ ID NO: 920233 - RNA, 20 nt, Homo sapiens
caaaauaagccaugcugcuu

SEQ ID NO: 920234 - RNA, 17 nt, Homo sapiens
caaaaugugaacugacu

SEQ ID NO: 920235 - RNA, 19 nt, Homo sapiens
caaaauguuaauaaagguu

SEQ ID NO: 920236 - RNA, 11 nt, Homo sapiens
caaacauuuga

SEQ ID NO: 920237 - RNA, 24 nt, Homo sapiens
caaaccacgccucuugaccaggcu

SEQ ID NO: 920238 - RNA, 16 nt, Homo sapiens
caaaccacuguacaua

SEQ ID NO: 920239 - RNA, 19 nt, Homo sapiens
caaaccuuuaaauuuucaa

SEQ ID NO: 920240 - RNA, 21 nt, Homo sapiens
caaacucgcacaaccaugacg

SEQ ID NO: 920241 - RNA, 18 nt, Homo sapiens
caaagcagcaauuacaug

SEQ ID NO: 920242 - RNA, 13 nt, Homo sapiens
caaagcuaccuuu

SEQ ID NO: 920243 - RNA, 12 nt, Homo sapiens
caaagcuuucuu

SEQ ID NO: 920244 - RNA, 18 nt, Homo sapiens
caaaggaaaaccgaguau

SEQ ID NO: 920245 - RNA, 15 nt, Homo sapiens
caaaggacugaccug

SEQ ID NO: 920246 - RNA, 23 nt, Homo sapiens
caaaggcuugccccaaaucucaa

SEQ ID NO: 920247 - RNA, 16 nt, Homo sapiens
caaagucugaagucag

SEQ ID NO: 920248 - RNA, 21 nt, Homo sapiens
caaagugcuagccacuggaaa

SEQ ID NO: 920249 - RNA, 16 nt, Homo sapiens
caaaguuuaagcaauu

SEQ ID NO: 920250 - RNA, 17 nt, Homo sapiens
caaauccucccuacuuc

SEQ ID NO: 920251 - RNA, 20 nt, Homo sapiens
caaaugagauguaugcccaa

SEQ ID NO: 920252 - RNA, 19 nt, Homo sapiens
caaaugcgcacgaccuaca

SEQ ID NO: 920253 - RNA, 23 nt, Homo sapiens
caaaugcgcacgaccuacauuaa

SEQ ID NO: 920254 - RNA, 21 nt, Homo sapiens
caaauuuuuuguagacagggu

SEQ ID NO: 920255 - RNA, 16 nt, Homo sapiens
caacaacaaaaaaccu

SEQ ID NO: 920256 - RNA, 23 nt, Homo sapiens
caacaauauuacaggggcuugaa

SEQ ID NO: 920257 - RNA, 15 nt, Homo sapiens
caacagaguccugua

SEQ ID NO: 920258 - RNA, 21 nt, Homo sapiens
caacaguuaaacuugcaauga

SEQ ID NO: 920259 - RNA, 21 nt, Homo sapiens
caacauggaaaaauccuguca

SEQ ID NO: 920260 - RNA, 22 nt, Homo sapiens
caaccaggaagaguucuauccc

SEQ ID NO: 920261 - RNA, 16 nt, Homo sapiens
caaccuaguacuuuau

SEQ ID NO: 920262 - RNA, 13 nt, Homo sapiens
caacuuuaaguaa

SEQ ID NO: 920263 - RNA, 14 nt, Homo sapiens
caagaaaguccagu

SEQ ID NO: 920264 - RNA, 20 nt, Homo sapiens
caagaaauaugaagcacuuu

SEQ ID NO: 920265 - RNA, 14 nt, Homo sapiens
caagaacugccaua

SEQ ID NO: 920266 - RNA, 14 nt, Homo sapiens
caagauacacuugu

SEQ ID NO: 920267 - RNA, 16 nt, Homo sapiens
caagauuaaacugagu

SEQ ID NO: 920268 - RNA, 21 nt, Homo sapiens
caagauucccggcuggacuuu

SEQ ID NO: 920269 - RNA, 22 nt, Homo sapiens
caagcaaaucccaaauucuccu

SEQ ID NO: 920270 - RNA, 12 nt, Homo sapiens
caagcacugaca

SEQ ID NO: 920271 - RNA, 16 nt, Homo sapiens
caagcacugacacuca

SEQ ID NO: 920272 - RNA, 12 nt, Homo sapiens
caagcacuuugg

SEQ ID NO: 920273 - RNA, 14 nt, Homo sapiens
caagcagauguccu

SEQ ID NO: 920274 - RNA, 14 nt, Homo sapiens
caagccggugccca

SEQ ID NO: 920275 - RNA, 21 nt, Homo sapiens
caagccuggucuccucccaaa

SEQ ID NO: 920276 - RNA, 12 nt, Homo sapiens
caagcuucauua

SEQ ID NO: 920277 - RNA, 22 nt, Homo sapiens
caaggcaaggggugccugggaa

SEQ ID NO: 920278 - RNA, 21 nt, Homo sapiens
caaggccuaugccaccugcag

SEQ ID NO: 920279 - RNA, 19 nt, Homo sapiens
caaggcugccggcugcacc

SEQ ID NO: 920280 - RNA, 15 nt, Homo sapiens
caagggacugggggu

SEQ ID NO: 920281 - RNA, 21 nt, Homo sapiens
caagggcagguugaucaguga

SEQ ID NO: 920282 - RNA, 22 nt, Homo sapiens
caaggugggcagggaggcacca

SEQ ID NO: 920283 - RNA, 21 nt, Homo sapiens
caaguaacaaugcaugcuuug

SEQ ID NO: 920284 - RNA, 20 nt, Homo sapiens
caagugucuaaaauacuuga

SEQ ID NO: 920285 - RNA, 15 nt, Homo sapiens
caauaaaaugcacug

SEQ ID NO: 920286 - RNA, 16 nt, Homo sapiens
caauacaaaaagccaa

SEQ ID NO: 920287 - RNA, 21 nt, Homo sapiens
caauauggugucuugauauau

SEQ ID NO: 920288 - RNA, 17 nt, Homo sapiens
caaucacuugaaaguga

SEQ ID NO: 920289 - RNA, 18 nt, Homo sapiens
caaucagaccacauuuga

SEQ ID NO: 920290 - RNA, 16 nt, Homo sapiens
caaucguucuguguuu

SEQ ID NO: 920291 - RNA, 12 nt, Homo sapiens
caaucuguaauu

SEQ ID NO: 920292 - RNA, 21 nt, Homo sapiens
caaucuuuccuugucucucau

SEQ ID NO: 920293 - RNA, 20 nt, Homo sapiens
caaugacugcgcagagugga

SEQ ID NO: 920294 - RNA, 20 nt, Homo sapiens
caaugcacagggcugcaaca

SEQ ID NO: 920295 - RNA, 14 nt, Homo sapiens
caauggacugcacc

SEQ ID NO: 920296 - RNA, 20 nt, Homo sapiens
caaugugaagacacuacaga

SEQ ID NO: 920297 - RNA, 17 nt, Homo sapiens
caauguuaaaugcaauu

SEQ ID NO: 920298 - RNA, 15 nt, Homo sapiens
caauuaugcugugaa

SEQ ID NO: 920299 - RNA, 13 nt, Homo sapiens
caauucauucucu

SEQ ID NO: 920300 - RNA, 15 nt, Homo sapiens
caauucuucuucuca

SEQ ID NO: 920301 - RNA, 18 nt, Homo sapiens
caauugugacagcaguuu

SEQ ID NO: 920302 - RNA, 20 nt, Homo sapiens
cacaaccuccuccuccaguu

SEQ ID NO: 920303 - RNA, 13 nt, Homo sapiens
cacaacuuuucaa

SEQ ID NO: 920304 - RNA, 16 nt, Homo sapiens
cacacagaucuguaau

SEQ ID NO: 920305 - RNA, 24 nt, Homo sapiens
cacagacuggagacaaugcagaug

SEQ ID NO: 920306 - RNA, 23 nt, Homo sapiens
cacagccagaaccccgagcccua

SEQ ID NO: 920307 - RNA, 19 nt, Homo sapiens
cacaggacgauuucacuga

SEQ ID NO: 920308 - RNA, 11 nt, Homo sapiens
cacauucacca

SEQ ID NO: 920309 - RNA, 16 nt, Homo sapiens
caccaaauucugaauu

SEQ ID NO: 920310 - RNA, 19 nt, Homo sapiens
caccaaggaaauauugaga

SEQ ID NO: 920311 - RNA, 14 nt, Homo sapiens
caccaucaccacca

SEQ ID NO: 920312 - RNA, 22 nt, Homo sapiens
cacccaaaagaauuaucauccc

SEQ ID NO: 920313 - RNA, 15 nt, Homo sapiens
cacccaacuuuguca

SEQ ID NO: 920314 - RNA, 17 nt, Homo sapiens
caccuagcgucaguauu

SEQ ID NO: 920315 - RNA, 12 nt, Homo sapiens
caccuccugucg

SEQ ID NO: 920316 - RNA, 18 nt, Homo sapiens
caccucugugccaccucu

SEQ ID NO: 920317 - RNA, 17 nt, Homo sapiens
caccuuccucugccuuu

SEQ ID NO: 920318 - RNA, 23 nt, Homo sapiens
caccuuccucugccuuuguucac

SEQ ID NO: 920319 - RNA, 22 nt, Homo sapiens
caccuugugaaggaaaaacaug

SEQ ID NO: 920320 - RNA, 15 nt, Homo sapiens
cacgaccuacauuaa

SEQ ID NO: 920321 - RNA, 20 nt, Homo sapiens
cacgcuucaaggauauacug

SEQ ID NO: 920322 - RNA, 15 nt, Homo sapiens
cacguggccucguga

SEQ ID NO: 920323 - RNA, 15 nt, Homo sapiens
cacuagugacaguau

SEQ ID NO: 920324 - RNA, 14 nt, Homo sapiens
cacuccagugccca

SEQ ID NO: 920325 - RNA, 19 nt, Homo sapiens
cacugaaacuucaagcacc

SEQ ID NO: 920326 - RNA, 21 nt, Homo sapiens
cacugacacugcgaacucuca

SEQ ID NO: 920327 - RNA, 19 nt, Homo sapiens
cacuuaacuacuuaucucu

SEQ ID NO: 920328 - RNA, 17 nt, Homo sapiens
cacuuacuguuguccua

SEQ ID NO: 920329 - RNA, 14 nt, Homo sapiens
ccuggccuggcacc

SEQ ID NO: 920330 - RNA, 17 nt, Homo sapiens
ccugggggcuuuugcca

SEQ ID NO: 920331 - RNA, 14 nt, Homo sapiens
ccuggggugcccuc

SEQ ID NO: 920332 - RNA, 18 nt, Homo sapiens
ccuggguaacagagugag

SEQ ID NO: 920333 - RNA, 11 nt, Homo sapiens
ccuguccuccc

SEQ ID NO: 920334 - RNA, 21 nt, Homo sapiens
ccugucuaggucaguacccac

SEQ ID NO: 920335 - RNA, 21 nt, Homo sapiens
ccugugcccacccgucuucaa

SEQ ID NO: 920336 - RNA, 17 nt, Homo sapiens
ccugugccugugacucu

SEQ ID NO: 920337 - RNA, 17 nt, Homo sapiens
ccugugcgucccagcug

SEQ ID NO: 920338 - RNA, 23 nt, Homo sapiens
ccugugcuuuuggagcugagauc

SEQ ID NO: 920339 - RNA, 16 nt, Homo sapiens
ccugugucagggcaca

SEQ ID NO: 920340 - RNA, 19 nt, Homo sapiens
ccugugucccaugggcaca

SEQ ID NO: 920341 - RNA, 14 nt, Homo sapiens
ccuguguggugcca

SEQ ID NO: 920342 - RNA, 13 nt, Homo sapiens
ccuguucuggaca

SEQ ID NO: 920343 - RNA, 21 nt, Homo sapiens
ccuguucugguagcuccacaa

SEQ ID NO: 920344 - RNA, 14 nt, Homo sapiens
ccuuaaaugagauu

SEQ ID NO: 920345 - RNA, 19 nt, Homo sapiens
ccuuauauuuguccaacaa

SEQ ID NO: 920346 - RNA, 20 nt, Homo sapiens
ccuuauuuuuacuuguaugu

SEQ ID NO: 920347 - RNA, 17 nt, Homo sapiens
ccuucuccacagggaca

SEQ ID NO: 920348 - RNA, 14 nt, Homo sapiens
ccuugaggagucuu

SEQ ID NO: 920349 - RNA, 15 nt, Homo sapiens
ccuugccauuuucaa

SEQ ID NO: 920350 - RNA, 14 nt, Homo sapiens
ccuugucugcugcu

SEQ ID NO: 920351 - RNA, 17 nt, Homo sapiens
ccuuuggcaauucuucu

SEQ ID NO: 920352 - RNA, 14 nt, Homo sapiens
cgaacugugcaguu

SEQ ID NO: 920353 - RNA, 15 nt, Homo sapiens
cgagauggugcagau

SEQ ID NO: 920354 - RNA, 16 nt, Homo sapiens
cgagggauguggagca

SEQ ID NO: 920355 - RNA, 21 nt, Homo sapiens
cgaggucaugccacugcacug

SEQ ID NO: 920356 - RNA, 14 nt, Homo sapiens
cgcauggugcagug

SEQ ID NO: 920357 - RNA, 15 nt, Homo sapiens
cgccagcccuaggcu

SEQ ID NO: 920358 - RNA, 15 nt, Homo sapiens
cggacucccuacccc

SEQ ID NO: 920359 - RNA, 15 nt, Homo sapiens
cggaggagguggaca

SEQ ID NO: 920360 - RNA, 20 nt, Homo sapiens
cggccggagaacaucugccu

SEQ ID NO: 920361 - RNA, 18 nt, Homo sapiens
cggcuccuucaagcugcu

SEQ ID NO: 920362 - RNA, 19 nt, Homo sapiens
cgggaaugacuugggccaa

SEQ ID NO: 920363 - RNA, 19 nt, Homo sapiens
cgucucgaagcaguauucu

SEQ ID NO: 920364 - RNA, 13 nt, Homo sapiens
cgugggaucugcc

SEQ ID NO: 920365 - RNA, 14 nt, Homo sapiens
cgugugaggaugug

SEQ ID NO: 920366 - RNA, 23 nt, Homo sapiens
cguuccugggacugucagauaau

SEQ ID NO: 920367 - RNA, 19 nt, Homo sapiens
cuaaaaguuuuaaccucag

SEQ ID NO: 920368 - RNA, 15 nt, Homo sapiens
cuaaaggucccaagg

SEQ ID NO: 920369 - RNA, 14 nt, Homo sapiens
cuaaagugcucuau

SEQ ID NO: 920370 - RNA, 15 nt, Homo sapiens
cuaaauguaucuuua

SEQ ID NO: 920371 - RNA, 21 nt, Homo sapiens
cuaacacggugaaaccccuua

SEQ ID NO: 920372 - RNA, 18 nt, Homo sapiens
cuaacuagagcagcccug

SEQ ID NO: 920373 - RNA, 16 nt, Homo sapiens
cuaaguuaccuuucua

SEQ ID NO: 920374 - RNA, 22 nt, Homo sapiens
cuaauagacuuagccccaugag

SEQ ID NO: 920375 - RNA, 20 nt, Homo sapiens
cuaaucaauacuuugaacac

SEQ ID NO: 920376 - RNA, 13 nt, Homo sapiens
cuaauccaugugc

SEQ ID NO: 920377 - RNA, 16 nt, Homo sapiens
cuaauucaagauuaca

SEQ ID NO: 920378 - RNA, 15 nt, Homo sapiens
cuaauuccacacccc

SEQ ID NO: 920379 - RNA, 19 nt, Homo sapiens
cuacacaguuugguuacag

SEQ ID NO: 920380 - RNA, 12 nt, Homo sapiens
cuacagccagcg

SEQ ID NO: 920381 - RNA, 11 nt, Homo sapiens
cuacaggguga

SEQ ID NO: 920382 - RNA, 17 nt, Homo sapiens
cuacaggugagugccac

SEQ ID NO: 920383 - RNA, 22 nt, Homo sapiens
cuacaugugccaccaacauaaa

SEQ ID NO: 920384 - RNA, 13 nt, Homo sapiens
cuaccacaguccg

SEQ ID NO: 920385 - RNA, 12 nt, Homo sapiens
cuacuggcugua

SEQ ID NO: 920386 - RNA, 23 nt, Homo sapiens
cuagaaccuucuaauccaugugc

SEQ ID NO: 920387 - RNA, 19 nt, Homo sapiens
cuagauuaguagaugcauc

SEQ ID NO: 920388 - RNA, 16 nt, Homo sapiens
cuagcugugugcaguc

SEQ ID NO: 920389 - RNA, 18 nt, Homo sapiens
cuaggaggucaucaaccg

SEQ ID NO: 920390 - RNA, 19 nt, Homo sapiens
cuagucagccacaugggaa

SEQ ID NO: 920391 - RNA, 21 nt, Homo sapiens
cuagugucaccugcacagggc

SEQ ID NO: 920392 - RNA, 20 nt, Homo sapiens
cuaguucuuuucauuuggaa

SEQ ID NO: 920393 - RNA, 15 nt, Homo sapiens
cuauaccucauucac

SEQ ID NO: 920394 - RNA, 11 nt, Homo sapiens
cuauauauuca

SEQ ID NO: 920395 - RNA, 13 nt, Homo sapiens
cuaucauauauua

SEQ ID NO: 920396 - RNA, 14 nt, Homo sapiens
cuaucauguugaag

SEQ ID NO: 920397 - RNA, 19 nt, Homo sapiens
cuaugaacucuugauaaca

SEQ ID NO: 920398 - RNA, 13 nt, Homo sapiens
cuauuccauugac

SEQ ID NO: 920399 - RNA, 14 nt, Homo sapiens
cuauucuuugacca

SEQ ID NO: 920400 - RNA, 18 nt, Homo sapiens
cuauugcaauacauuucu

SEQ ID NO: 920401 - RNA, 21 nt, Homo sapiens
cuauuuauucauucagugaga

SEQ ID NO: 920402 - RNA, 17 nt, Homo sapiens
cuauuugccaagaccau

SEQ ID NO: 920403 - RNA, 15 nt, Homo sapiens
cucaaaauaagccau

SEQ ID NO: 920404 - RNA, 15 nt, Homo sapiens
cucaaacacagagag

SEQ ID NO: 920405 - RNA, 16 nt, Homo sapiens
cucaaauuaacuuucc

SEQ ID NO: 920406 - RNA, 18 nt, Homo sapiens
cucaacauaacauaagcu

SEQ ID NO: 920407 - RNA, 20 nt, Homo sapiens
cucaaccugggucaaagugg

SEQ ID NO: 920408 - RNA, 23 nt, Homo sapiens
cucaacuuguguuuuguauuuaa

SEQ ID NO: 920409 - RNA, 14 nt, Homo sapiens
cucaagcacugaca

SEQ ID NO: 920410 - RNA, 14 nt, Homo sapiens
cucacgcugccauu

SEQ ID NO: 920411 - RNA, 21 nt, Homo sapiens
cucagagaguacucgcagggg

SEQ ID NO: 920412 - RNA, 19 nt, Homo sapiens
cucagcuauaccucauuca

SEQ ID NO: 920413 - RNA, 16 nt, Homo sapiens
cucaggaauucagugc

SEQ ID NO: 920414 - RNA, 12 nt, Homo sapiens
cucaggccaaag

SEQ ID NO: 920415 - RNA, 16 nt, Homo sapiens
cucaguuucuguuguu

SEQ ID NO: 920416 - RNA, 19 nt, Homo sapiens
cucaguuucuucaccugua

SEQ ID NO: 920417 - RNA, 20 nt, Homo sapiens
cucaguuucuucaccuguaa

SEQ ID NO: 920418 - RNA, 15 nt, Homo sapiens
cucaucacuaaacag

SEQ ID NO: 920419 - RNA, 20 nt, Homo sapiens
cucauccuuuuuaaaugaga

SEQ ID NO: 920420 - RNA, 15 nt, Homo sapiens
cucaugccuguaauc

SEQ ID NO: 920421 - RNA, 13 nt, Homo sapiens
cucauuacuuuac

SEQ ID NO: 920422 - RNA, 17 nt, Homo sapiens
cucauucacagcuccuu

SEQ ID NO: 920423 - RNA, 19 nt, Homo sapiens
cucauuuauuuccauauua

SEQ ID NO: 920424 - RNA, 21 nt, Homo sapiens
cucauuuauuuccauauuaaa

SEQ ID NO: 920425 - RNA, 16 nt, Homo sapiens
cuccaccccacucaca

SEQ ID NO: 920426 - RNA, 21 nt, Homo sapiens
cuccacugucuuuaaaaguca

SEQ ID NO: 920427 - RNA, 22 nt, Homo sapiens
cuccacugucuuuaaaagucau

SEQ ID NO: 920428 - RNA, 16 nt, Homo sapiens
cuccaguucugaugag

SEQ ID NO: 920429 - RNA, 23 nt, Homo sapiens
cucccaccuuugguccuaagucc

SEQ ID NO: 920430 - RNA, 16 nt, Homo sapiens
cucccaugugcugaga

SEQ ID NO: 920431 - RNA, 20 nt, Homo sapiens
cuccccuaccacugucuucu

SEQ ID NO: 920432 - RNA, 20 nt, Homo sapiens
cucccugcuucaauacccaa

SEQ ID NO: 920433 - RNA, 18 nt, Homo sapiens
cuccgugagccucagcca

SEQ ID NO: 920434 - RNA, 18 nt, Homo sapiens
cuccucuuugugaaaucc

SEQ ID NO: 920435 - RNA, 23 nt, Homo sapiens
cuccugguggcaggcaagcagau

SEQ ID NO: 920436 - RNA, 18 nt, Homo sapiens
cuccuguuguuacugggu

SEQ ID NO: 920437 - RNA, 15 nt, Homo sapiens
cuccuucaagcugcu

SEQ ID NO: 920438 - RNA, 17 nt, Homo sapiens
cuccuugucccccguga

SEQ ID NO: 920439 - RNA, 21 nt, Homo sapiens
cucgaaauaauuuuuuaguua

SEQ ID NO: 920440 - RNA, 22 nt, Homo sapiens
cucgaacccacacugcaacagg

SEQ ID NO: 920441 - RNA, 18 nt, Homo sapiens
cucguguuugcuacaaau

SEQ ID NO: 920442 - RNA, 19 nt, Homo sapiens
cucucaacccaggagcauc

SEQ ID NO: 920443 - RNA, 21 nt, Homo sapiens
cucucaucccccauuaaccag

SEQ ID NO: 920444 - RNA, 16 nt, Homo sapiens
cucuccucugucccca

SEQ ID NO: 920445 - RNA, 20 nt, Homo sapiens
cucuccuggcacccagagaa

SEQ ID NO: 920446 - RNA, 16 nt, Homo sapiens
cucuccuuccucagaa

SEQ ID NO: 920447 - RNA, 22 nt, Homo sapiens
cucucugaacacacauugcuau

SEQ ID NO: 920448 - RNA, 13 nt, Homo sapiens
cucugaacugcac

SEQ ID NO: 920449 - RNA, 22 nt, Homo sapiens
cucugcacuauagccauuugcc

SEQ ID NO: 920450 - RNA, 15 nt, Homo sapiens
cucuggaggcugaga

SEQ ID NO: 920451 - RNA, 22 nt, Homo sapiens
guaauagcugaaccuguucaaa

SEQ ID NO: 920452 - RNA, 17 nt, Homo sapiens
guaauugaaacauuuac

SEQ ID NO: 920453 - RNA, 15 nt, Homo sapiens
guaccaaagcuguuu

SEQ ID NO: 920454 - RNA, 17 nt, Homo sapiens
guaccccugaggaaaca

SEQ ID NO: 920455 - RNA, 14 nt, Homo sapiens
guacugugcugauu

SEQ ID NO: 920456 - RNA, 16 nt, Homo sapiens
guacuugggaggccaa

SEQ ID NO: 920457 - RNA, 17 nt, Homo sapiens
guagcauuggucaggga

SEQ ID NO: 920458 - RNA, 21 nt, Homo sapiens
guagcguuuccuuucuucccu

SEQ ID NO: 920459 - RNA, 14 nt, Homo sapiens
guagcuccacaaga

SEQ ID NO: 920460 - RNA, 20 nt, Homo sapiens
guagcugagacuacagguga

SEQ ID NO: 920461 - RNA, 14 nt, Homo sapiens
guagcuucugaccu

SEQ ID NO: 920462 - RNA, 19 nt, Homo sapiens
guaggcaccaccucuguca

SEQ ID NO: 920463 - RNA, 15 nt, Homo sapiens
guagguagacacaaa

SEQ ID NO: 920464 - RNA, 16 nt, Homo sapiens
guauauaaaguuacac

SEQ ID NO: 920465 - RNA, 15 nt, Homo sapiens
guauccucgcuggug

SEQ ID NO: 920466 - RNA, 17 nt, Homo sapiens
guauccugaaacagugu

SEQ ID NO: 920467 - RNA, 18 nt, Homo sapiens
guaugaaaaugauuuauu

SEQ ID NO: 920468 - RNA, 20 nt, Homo sapiens
guaugucugucuacaggaaa

SEQ ID NO: 920469 - RNA, 16 nt, Homo sapiens
guauuugaaauaagaa

SEQ ID NO: 920470 - RNA, 18 nt, Homo sapiens
gucaaccuugugugagug

SEQ ID NO: 920471 - RNA, 21 nt, Homo sapiens
gucacacauuucuauuuugca

SEQ ID NO: 920472 - RNA, 18 nt, Homo sapiens
gucacuauaggucauaca

SEQ ID NO: 920473 - RNA, 16 nt, Homo sapiens
gucagaccuucuucca

SEQ ID NO: 920474 - RNA, 22 nt, Homo sapiens
gucaucaaccgaugguccucac

SEQ ID NO: 920475 - RNA, 17 nt, Homo sapiens
guccccagcccacugga

SEQ ID NO: 920476 - RNA, 13 nt, Homo sapiens
gucccuuccaggc

SEQ ID NO: 920477 - RNA, 16 nt, Homo sapiens
gucccuuccaggccau

SEQ ID NO: 920478 - RNA, 11 nt, Homo sapiens
guccuauucau

SEQ ID NO: 920479 - RNA, 17 nt, Homo sapiens
guccuccggggcucagc

SEQ ID NO: 920480 - RNA, 20 nt, Homo sapiens
guccugaggcagaaccuggu

SEQ ID NO: 920481 - RNA, 16 nt, Homo sapiens
gucgagacauuccugc

SEQ ID NO: 920482 - RNA, 17 nt, Homo sapiens
gucuaauucccuguuau

SEQ ID NO: 920483 - RNA, 13 nt, Homo sapiens
gucuaccaucucc

SEQ ID NO: 920484 - RNA, 16 nt, Homo sapiens
gucuccugaggguccu

SEQ ID NO: 920485 - RNA, 12 nt, Homo sapiens
gucuggcccaaa

SEQ ID NO: 920486 - RNA, 21 nt, Homo sapiens
gucuguauuccugauaugccu

SEQ ID NO: 920487 - RNA, 15 nt, Homo sapiens
gucugugauugccau

SEQ ID NO: 920488 - RNA, 15 nt, Homo sapiens
gucuguggagccauc

SEQ ID NO: 920489 - RNA, 13 nt, Homo sapiens
gucuucaaucucu

SEQ ID NO: 920490 - RNA, 17 nt, Homo sapiens
gucuugaugacugcuga

SEQ ID NO: 920491 - RNA, 22 nt, Homo sapiens
gucuuuuaaugauacugucuaa

SEQ ID NO: 920492 - RNA, 18 nt, Homo sapiens
gucuuuuucuacagccag

SEQ ID NO: 920493 - RNA, 22 nt, Homo sapiens
gugaaaacagcagcaaugcaau

SEQ ID NO: 920494 - RNA, 20 nt, Homo sapiens
gugaaagucuccuguaucau

SEQ ID NO: 920495 - RNA, 15 nt, Homo sapiens
gugaagugguuuaaa

SEQ ID NO: 920496 - RNA, 13 nt, Homo sapiens
gugaauuagcuca

SEQ ID NO: 920497 - RNA, 23 nt, Homo sapiens
gugacaguauaaagggcaaagga

SEQ ID NO: 920498 - RNA, 14 nt, Homo sapiens
gugacuuacagugc

SEQ ID NO: 920499 - RNA, 19 nt, Homo sapiens
gugacuuacagugccaaca

SEQ ID NO: 920500 - RNA, 19 nt, Homo sapiens
gugagccgaggucaugcca

SEQ ID NO: 920501 - RNA, 14 nt, Homo sapiens
gugaggggcaagcu

SEQ ID NO: 920502 - RNA, 15 nt, Homo sapiens
gugaucgcacaagga

SEQ ID NO: 920503 - RNA, 16 nt, Homo sapiens
gugauuacucuuugcu

SEQ ID NO: 920504 - RNA, 19 nt, Homo sapiens
gugauuuucucuaauguaa

SEQ ID NO: 920505 - RNA, 20 nt, Homo sapiens
gugcaauacggaacacuguc

SEQ ID NO: 920506 - RNA, 14 nt, Homo sapiens
gugcagaaacuacc

SEQ ID NO: 920507 - RNA, 16 nt, Homo sapiens
gugcaggacacugguc

SEQ ID NO: 920508 - RNA, 14 nt, Homo sapiens
gugcccacagcccg

SEQ ID NO: 920509 - RNA, 16 nt, Homo sapiens
gugccucuugggagac

SEQ ID NO: 920510 - RNA, 15 nt, Homo sapiens
gugcuggagccacua

SEQ ID NO: 920511 - RNA, 20 nt, Homo sapiens
gugcuuaaaagcuguucuca

SEQ ID NO: 920512 - RNA, 12 nt, Homo sapiens
guggagaacaaa

SEQ ID NO: 920513 - RNA, 13 nt, Homo sapiens
guggagagaccag

SEQ ID NO: 920514 - RNA, 23 nt, Homo sapiens
guggcagcaacaaaggauuugaa

SEQ ID NO: 920515 - RNA, 20 nt, Homo sapiens
guggcugccugcaccccagg

SEQ ID NO: 920516 - RNA, 21 nt, Homo sapiens
guguaaaaaacaaacauuuga

SEQ ID NO: 920517 - RNA, 20 nt, Homo sapiens
guguauuuuauaagcauuua

SEQ ID NO: 920518 - RNA, 17 nt, Homo sapiens
gugucuaaaauacuuga

SEQ ID NO: 920519 - RNA, 19 nt, Homo sapiens
gugugcauugcugugaauu

SEQ ID NO: 920520 - RNA, 12 nt, Homo sapiens
guguuugggauc

SEQ ID NO: 920521 - RNA, 10 nt, Homo sapiens
acaacauuuu

SEQ ID NO: 920522 - RNA, 19 nt, Homo sapiens
acaaccuuuuuauuuucac

SEQ ID NO: 920523 - RNA, 16 nt, Homo sapiens
acaacucgaaucacuc

SEQ ID NO: 920524 - RNA, 16 nt, Homo sapiens
acaagcaaaaccaaag

SEQ ID NO: 920525 - RNA, 13 nt, Homo sapiens
acaagcacuuugg

SEQ ID NO: 920526 - RNA, 22 nt, Homo sapiens
acaagcaggcucaacauaacau

SEQ ID NO: 920527 - RNA, 20 nt, Homo sapiens
acaaucagaccacauuugaa

SEQ ID NO: 920528 - RNA, 17 nt, Homo sapiens
acaaucagcggcauuua

SEQ ID NO: 920529 - RNA, 20 nt, Homo sapiens
acaaucguucuguguuugau

SEQ ID NO: 920530 - RNA, 15 nt, Homo sapiens
acaaucuguaauugc

SEQ ID NO: 920531 - RNA, 22 nt, Homo sapiens
acaaucuuuccuugucucucau

SEQ ID NO: 920532 - RNA, 21 nt, Homo sapiens
acaauucaaacaauucaauca

SEQ ID NO: 920533 - RNA, 15 nt, Homo sapiens
acaauucaaucaaag

SEQ ID NO: 920534 - RNA, 23 nt, Homo sapiens
acaauuucagaauuuugggacau

SEQ ID NO: 920535 - RNA, 19 nt, Homo sapiens
acacaaaauacagcacuuu

SEQ ID NO: 920536 - RNA, 16 nt, Homo sapiens
acacaacuccacuguc

SEQ ID NO: 920537 - RNA, 23 nt, Homo sapiens
acacaaucuuuccuugucucuca

SEQ ID NO: 920538 - RNA, 14 nt, Homo sapiens
acacacagcuucua

SEQ ID NO: 920539 - RNA, 17 nt, Homo sapiens
acacacagcuucuagug

SEQ ID NO: 920540 - RNA, 15 nt, Homo sapiens
acacaggcaaugacu

SEQ ID NO: 920541 - RNA, 16 nt, Homo sapiens
acacauuugaaaucau

SEQ ID NO: 920542 - RNA, 22 nt, Homo sapiens
acacccccaccccuugcucuca

SEQ ID NO: 920543 - RNA, 19 nt, Homo sapiens
acaccuagcgucaguauuu

SEQ ID NO: 920544 - RNA, 16 nt, Homo sapiens
acacuaucaacacugc

SEQ ID NO: 920545 - RNA, 14 nt, Homo sapiens
acacucuucaguga

SEQ ID NO: 920546 - RNA, 19 nt, Homo sapiens
acacugacuguugcuguaa

SEQ ID NO: 920547 - RNA, 14 nt, Homo sapiens
acacugcagcauuu

SEQ ID NO: 920548 - RNA, 21 nt, Homo sapiens
acacuuguaaauaaagcugau

SEQ ID NO: 920549 - RNA, 15 nt, Homo sapiens
acagaaauccuuuca

SEQ ID NO: 920550 - RNA, 16 nt, Homo sapiens
acagaaauccuuucau

SEQ ID NO: 920551 - RNA, 18 nt, Homo sapiens
acagaaauccuuucauaa

SEQ ID NO: 920552 - RNA, 23 nt, Homo sapiens
acagaaauccuuucauaaagcac

SEQ ID NO: 920553 - RNA, 13 nt, Homo sapiens
acagaaauuguau

SEQ ID NO: 920554 - RNA, 20 nt, Homo sapiens
acagaaggaggaaguggaag

SEQ ID NO: 920555 - RNA, 15 nt, Homo sapiens
acagacuggagacaa

SEQ ID NO: 920556 - RNA, 16 nt, Homo sapiens
acagagcauccgucuc

SEQ ID NO: 920557 - RNA, 18 nt, Homo sapiens
acagaggcuagaaagcau

SEQ ID NO: 920558 - RNA, 22 nt, Homo sapiens
acagauuaucuuguacagccuu

SEQ ID NO: 920559 - RNA, 19 nt, Homo sapiens
acagcauggaaaagguuaa

SEQ ID NO: 920560 - RNA, 17 nt, Homo sapiens
acagcauggugcaugcc

SEQ ID NO: 920561 - RNA, 15 nt, Homo sapiens
acagccugucuucag

SEQ ID NO: 920562 - RNA, 17 nt, Homo sapiens
acagcugcaggugccca

SEQ ID NO: 920563 - RNA, 14 nt, Homo sapiens
acagcuucuaguga

SEQ ID NO: 920564 - RNA, 16 nt, Homo sapiens
acagggacacagucug

SEQ ID NO: 920565 - RNA, 22 nt, Homo sapiens
acagggcauccaacugagaaaa

SEQ ID NO: 920566 - RNA, 15 nt, Homo sapiens
acaggugugagccac

SEQ ID NO: 920567 - RNA, 20 nt, Homo sapiens
acaguauaaagggcaaagga

SEQ ID NO: 920568 - RNA, 22 nt, Homo sapiens
acaguuaaaggcaacccugagg

SEQ ID NO: 920569 - RNA, 18 nt, Homo sapiens
acaguuuuuuacauauua

SEQ ID NO: 920570 - RNA, 13 nt, Homo sapiens
acauaacuucaga

SEQ ID NO: 920571 - RNA, 22 nt, Homo sapiens
acauaacuucagauacuuguga

SEQ ID NO: 920572 - RNA, 21 nt, Homo sapiens
acauacuauagauucuuuauu

SEQ ID NO: 920573 - RNA, 23 nt, Homo sapiens
acauagauagaaugaaccaauau

SEQ ID NO: 920574 - RNA, 14 nt, Homo sapiens
acauauacauauga

SEQ ID NO: 920575 - RNA, 15 nt, Homo sapiens
acauauacauaugau

SEQ ID NO: 920576 - RNA, 16 nt, Homo sapiens
acauaugaucaaauac

SEQ ID NO: 920577 - RNA, 23 nt, Homo sapiens
acauauucccaugguagacugug

SEQ ID NO: 920578 - RNA, 20 nt, Homo sapiens
acauccaggauggcugcaag

SEQ ID NO: 920579 - RNA, 14 nt, Homo sapiens
acauccccaaaggu

SEQ ID NO: 920580 - RNA, 22 nt, Homo sapiens
acauccccaaaggucaaaaaca

SEQ ID NO: 920581 - RNA, 21 nt, Homo sapiens
acaucuccaugcugucacuug

SEQ ID NO: 920582 - RNA, 15 nt, Homo sapiens
acaucuggacacugg

SEQ ID NO: 920583 - RNA, 16 nt, Homo sapiens
acaucuggacacuggg

SEQ ID NO: 920584 - RNA, 15 nt, Homo sapiens
acaugaaucauagcc

SEQ ID NO: 920585 - RNA, 15 nt, Homo sapiens
acaugacacauuuga

SEQ ID NO: 920586 - RNA, 20 nt, Homo sapiens
acaugaccagaaaacaaauc

SEQ ID NO: 920587 - RNA, 20 nt, Homo sapiens
acaugcuaccugaucccacu

SEQ ID NO: 920588 - RNA, 19 nt, Homo sapiens
acauggaaaaauccuguca

SEQ ID NO: 920589 - RNA, 19 nt, Homo sapiens
acauguauucccauugcac

SEQ ID NO: 920590 - RNA, 16 nt, Homo sapiens
acauuaacaagcucuu

SEQ ID NO: 920591 - RNA, 15 nt, Homo sapiens
acauuauuacuccuu

SEQ ID NO: 920592 - RNA, 19 nt, Homo sapiens
acauuauuacuccuugcca

SEQ ID NO: 920593 - RNA, 15 nt, Homo sapiens
acauucaccaaccaa

SEQ ID NO: 920594 - RNA, 15 nt, Homo sapiens
accaaaacuauucca

SEQ ID NO: 920595 - RNA, 12 nt, Homo sapiens
accaaacugugg

SEQ ID NO: 920596 - RNA, 20 nt, Homo sapiens
accaacugcucucaaaaugu

SEQ ID NO: 920597 - RNA, 20 nt, Homo sapiens
accaagaguagcaccuucag

SEQ ID NO: 920598 - RNA, 18 nt, Homo sapiens
accaaguuuuauugucaa

SEQ ID NO: 920599 - RNA, 11 nt, Homo sapiens
accacauuuga

SEQ ID NO: 920600 - RNA, 14 nt, Homo sapiens
accaccaucaccac

SEQ ID NO: 920601 - RNA, 22 nt, Homo sapiens
accacgccucuugaccaggcug

SEQ ID NO: 920602 - RNA, 14 nt, Homo sapiens
accacuguacauau

SEQ ID NO: 920603 - RNA, 23 nt, Homo sapiens
accagcucccaugugcugagaac

SEQ ID NO: 920604 - RNA, 14 nt, Homo sapiens
accaucauuugcaa

SEQ ID NO: 920605 - RNA, 17 nt, Homo sapiens
accaucuaugugaauau

SEQ ID NO: 920606 - RNA, 23 nt, Homo sapiens
accaugcagugccccuagcuuag

SEQ ID NO: 920607 - RNA, 21 nt, Homo sapiens
accauuucagaugcaaucacu

SEQ ID NO: 920608 - RNA, 14 nt, Homo sapiens
acccaaaagcucag

SEQ ID NO: 920609 - RNA, 14 nt, Homo sapiens
acccaggccacuga

SEQ ID NO: 920610 - RNA, 21 nt, Homo sapiens
acccaggucuugacaccagcu

SEQ ID NO: 920611 - RNA, 21 nt, Homo sapiens
acccauuugaaagaauauuag

SEQ ID NO: 920612 - RNA, 20 nt, Homo sapiens
acccccaccccuugcucuca

SEQ ID NO: 920613 - RNA, 23 nt, Homo sapiens
acccgccuuggccucccaaagug

SEQ ID NO: 920614 - RNA, 16 nt, Homo sapiens
acccuaccacaguccg

SEQ ID NO: 920615 - RNA, 15 nt, Homo sapiens
acccuaucaucaguu

SEQ ID NO: 920616 - RNA, 17 nt, Homo sapiens
acccucaggaauucagu

SEQ ID NO: 920617 - RNA, 22 nt, Homo sapiens
acccugagguaucuguguuaca

SEQ ID NO: 920618 - RNA, 12 nt, Homo sapiens
acccugugucac

SEQ ID NO: 920619 - RNA, 14 nt, Homo sapiens
accgaugguccuca

SEQ ID NO: 920620 - RNA, 16 nt, Homo sapiens
accgauuucagcacau

SEQ ID NO: 920621 - RNA, 17 nt, Homo sapiens
accgccaaagaaugccu

SEQ ID NO: 920622 - RNA, 18 nt, Homo sapiens
accgcccgccucuguccu

SEQ ID NO: 920623 - RNA, 18 nt, Homo sapiens
accgucacacucuucagu

SEQ ID NO: 920624 - RNA, 18 nt, Homo sapiens
accgucugugauugccau

SEQ ID NO: 920625 - RNA, 16 nt, Homo sapiens
accgugggucaugcag

SEQ ID NO: 920626 - RNA, 23 nt, Homo sapiens
accuaaaaaucaaucacuugaaa

SEQ ID NO: 920627 - RNA, 20 nt, Homo sapiens
accuacauuaauuuaugcag

SEQ ID NO: 920628 - RNA, 14 nt, Homo sapiens
accuaccugugaau

SEQ ID NO: 920629 - RNA, 13 nt, Homo sapiens
accuaguacuuua

SEQ ID NO: 920630 - RNA, 18 nt, Homo sapiens
accucagguuccaaauuc

SEQ ID NO: 920631 - RNA, 12 nt, Homo sapiens
accucuccuucc

SEQ ID NO: 920632 - RNA, 17 nt, Homo sapiens
accugacacaaucccua

SEQ ID NO: 920633 - RNA, 16 nt, Homo sapiens
accugcccucucucag

SEQ ID NO: 920634 - RNA, 14 nt, Homo sapiens
accuggaaccagag

SEQ ID NO: 920635 - RNA, 22 nt, Homo sapiens
accuguucugguagcuccacaa

SEQ ID NO: 920636 - RNA, 19 nt, Homo sapiens
accuuaaaaauuagaacuu

SEQ ID NO: 920637 - RNA, 21 nt, Homo sapiens
accuuacccuacuggcuguaa

SEQ ID NO: 920638 - RNA, 13 nt, Homo sapiens
accuucuaaucca

SEQ ID NO: 920639 - RNA, 16 nt, Homo sapiens
accuugauugcaccaa

SEQ ID NO: 920640 - RNA, 20 nt, Homo sapiens
accuugcacuauuggacuuu

SEQ ID NO: 920641 - RNA, 14 nt, Homo sapiens
accuuggcauccuu

SEQ ID NO: 920642 - RNA, 17 nt, Homo sapiens
accuuuuucauaaucug

SEQ ID NO: 920643 - RNA, 14 nt, Homo sapiens
gaggccccuggugg

SEQ ID NO: 920644 - RNA, 20 nt, Homo sapiens
gagggccggugcgacccagu

SEQ ID NO: 920645 - RNA, 17 nt, Homo sapiens
gagguggggugaagcug

SEQ ID NO: 920646 - RNA, 13 nt, Homo sapiens
gagguugcaguga

SEQ ID NO: 920647 - RNA, 14 nt, Homo sapiens
gagguuggggacac

SEQ ID NO: 920648 - RNA, 18 nt, Homo sapiens
gagucccuuccaggccau

SEQ ID NO: 920649 - RNA, 14 nt, Homo sapiens
gagucucauuauuu

SEQ ID NO: 920650 - RNA, 16 nt, Homo sapiens
gagugaucucagcuca

SEQ ID NO: 920651 - RNA, 15 nt, Homo sapiens
gaguggagcccucag

SEQ ID NO: 920652 - RNA, 23 nt, Homo sapiens
gaguuuccagcuaagccugauga

SEQ ID NO: 920653 - RNA, 16 nt, Homo sapiens
gauaaugauaguguuu

SEQ ID NO: 920654 - RNA, 22 nt, Homo sapiens
gauacuugugaacaugccuuau

SEQ ID NO: 920655 - RNA, 12 nt, Homo sapiens
gauaucuucucc

SEQ ID NO: 920656 - RNA, 22 nt, Homo sapiens
gaucagaacucuccuaucugaa

SEQ ID NO: 920657 - RNA, 15 nt, Homo sapiens
gaucauuugcagcug

SEQ ID NO: 920658 - RNA, 17 nt, Homo sapiens
gaucuaucaccugucau

SEQ ID NO: 920659 - RNA, 12 nt, Homo sapiens
gaucugcagcuc

SEQ ID NO: 920660 - RNA, 17 nt, Homo sapiens
gaucugggaacucccaa

SEQ ID NO: 920661 - RNA, 19 nt, Homo sapiens
gaucuuggggugcagcacu

SEQ ID NO: 920662 - RNA, 19 nt, Homo sapiens
gaugaaaaccacccuauca

SEQ ID NO: 920663 - RNA, 15 nt, Homo sapiens
gaugauugccaacag

SEQ ID NO: 920664 - RNA, 16 nt, Homo sapiens
gaugcaucuaagcagg

SEQ ID NO: 920665 - RNA, 12 nt, Homo sapiens
gauggcugugaa

SEQ ID NO: 920666 - RNA, 18 nt, Homo sapiens
gaugggaguaagagcaaa

SEQ ID NO: 920667 - RNA, 14 nt, Homo sapiens
gauguaaccaagcu

SEQ ID NO: 920668 - RNA, 18 nt, Homo sapiens
gauguaauaaucauuuua

SEQ ID NO: 920669 - RNA, 19 nt, Homo sapiens
gauguauucagagccaccc

SEQ ID NO: 920670 - RNA, 16 nt, Homo sapiens
gaugucaacugaccua

SEQ ID NO: 920671 - RNA, 22 nt, Homo sapiens
gaugucaucuugagcucuucau

SEQ ID NO: 920672 - RNA, 13 nt, Homo sapiens
gauguuauauuaa

SEQ ID NO: 920673 - RNA, 15 nt, Homo sapiens
gauuacaacaucugu

SEQ ID NO: 920674 - RNA, 20 nt, Homo sapiens
gauuacaggugugagccacc

SEQ ID NO: 920675 - RNA, 16 nt, Homo sapiens
gauuagaaagacuuuc

SEQ ID NO: 920676 - RNA, 13 nt, Homo sapiens
gauuaucauuuau

SEQ ID NO: 920677 - RNA, 20 nt, Homo sapiens
gauuaucuuguacagccuuu

SEQ ID NO: 920678 - RNA, 16 nt, Homo sapiens
gauucaacacauauuu

SEQ ID NO: 920679 - RNA, 17 nt, Homo sapiens
gauucuccacggugguc

SEQ ID NO: 920680 - RNA, 15 nt, Homo sapiens
gauucucgacucuuu

SEQ ID NO: 920681 - RNA, 14 nt, Homo sapiens
gauugcaccaacag

SEQ ID NO: 920682 - RNA, 19 nt, Homo sapiens
gauugcgugacccuaugac

SEQ ID NO: 920683 - RNA, 14 nt, Homo sapiens
gauugcucuggaag

SEQ ID NO: 920684 - RNA, 16 nt, Homo sapiens
gauugguaacugccug

SEQ ID NO: 920685 - RNA, 16 nt, Homo sapiens
gauuuaaucugccaag

SEQ ID NO: 920686 - RNA, 14 nt, Homo sapiens
gauuucacugacac

SEQ ID NO: 920687 - RNA, 15 nt, Homo sapiens
gauuucuggggcccc

SEQ ID NO: 920688 - RNA, 12 nt, Homo sapiens
gcaaaaccaaag

SEQ ID NO: 920689 - RNA, 19 nt, Homo sapiens
gcaaagaacccauuugcca

SEQ ID NO: 920690 - RNA, 16 nt, Homo sapiens
gcaaagggacauugaa

SEQ ID NO: 920691 - RNA, 18 nt, Homo sapiens
gcaaagggucuguggcca

SEQ ID NO: 920692 - RNA, 15 nt, Homo sapiens
gcaaagugcuagcca

SEQ ID NO: 920693 - RNA, 12 nt, Homo sapiens
gcaaaguggaau

SEQ ID NO: 920694 - RNA, 16 nt, Homo sapiens
gcaaaguggaauuaaa

SEQ ID NO: 920695 - RNA, 15 nt, Homo sapiens
gcaaauaaagccuuu

SEQ ID NO: 920696 - RNA, 21 nt, Homo sapiens
gcaaauuccaccccuccuucc

SEQ ID NO: 920697 - RNA, 16 nt, Homo sapiens
gcaacaggaacuguga

SEQ ID NO: 920698 - RNA, 12 nt, Homo sapiens
gcaaccaggaac

SEQ ID NO: 920699 - RNA, 13 nt, Homo sapiens
gcaacugcugauc

SEQ ID NO: 920700 - RNA, 22 nt, Homo sapiens
gcaagauccccgccacccgggg

SEQ ID NO: 920701 - RNA, 13 nt, Homo sapiens
gcaauacauuucu

SEQ ID NO: 920702 - RNA, 20 nt, Homo sapiens
gcaaucucggcucauagcaa

SEQ ID NO: 920703 - RNA, 13 nt, Homo sapiens
gcaauucauucuc

SEQ ID NO: 920704 - RNA, 20 nt, Homo sapiens
gcaauugucuuguaccuuga

SEQ ID NO: 920705 - RNA, 21 nt, Homo sapiens
gcaauugucuuguaccuugag

SEQ ID NO: 920706 - RNA, 23 nt, Homo sapiens
gcacaaccaugacgcacugcuca

SEQ ID NO: 920707 - RNA, 12 nt, Homo sapiens
gcacagaacaag

SEQ ID NO: 920708 - RNA, 14 nt, Homo sapiens
gcacagacuucaca

SEQ ID NO: 920709 - RNA, 21 nt, Homo sapiens
gcacccggcucguguauuuau

SEQ ID NO: 920710 - RNA, 17 nt, Homo sapiens
gcacgaccuacauuaau

SEQ ID NO: 920711 - RNA, 22 nt, Homo sapiens
gcacuugcuugcggaacucuuc

SEQ ID NO: 920712 - RNA, 14 nt, Homo sapiens
gcagaaccuggugg

SEQ ID NO: 920713 - RNA, 18 nt, Homo sapiens
gcagagcgcaaagugcua

SEQ ID NO: 920714 - RNA, 21 nt, Homo sapiens
gcagaucuaccccuuacuuau

SEQ ID NO: 920715 - RNA, 17 nt, Homo sapiens
gcagaugccugcagugc

SEQ ID NO: 920716 - RNA, 21 nt, Homo sapiens
gcagaugccugcagugccacu

SEQ ID NO: 920717 - RNA, 14 nt, Homo sapiens
gcagcaaugcaaug

SEQ ID NO: 920718 - RNA, 22 nt, Homo sapiens
gcagccugugggagaagggaca

SEQ ID NO: 920719 - RNA, 18 nt, Homo sapiens
gcaggaucacagcucacg

SEQ ID NO: 920720 - RNA, 16 nt, Homo sapiens
gcaggcaagcagaugu

SEQ ID NO: 920721 - RNA, 13 nt, Homo sapiens
gcagggcucuuug

SEQ ID NO: 920722 - RNA, 22 nt, Homo sapiens
gcaggguuuuaucucugucuac

SEQ ID NO: 920723 - RNA, 20 nt, Homo sapiens
gcagguuccccaagggcccu

SEQ ID NO: 920724 - RNA, 14 nt, Homo sapiens
gcagugagcuugua

SEQ ID NO: 920725 - RNA, 17 nt, Homo sapiens
gcagugccccuagcuua

SEQ ID NO: 920726 - RNA, 19 nt, Homo sapiens
gcaguggcagcaacaaagg

SEQ ID NO: 920727 - RNA, 22 nt, Homo sapiens
gcaguugcuaaauuuguguucc

SEQ ID NO: 920728 - RNA, 18 nt, Homo sapiens
gcaguugucaccaaauac

SEQ ID NO: 920729 - RNA, 20 nt, Homo sapiens
gcauaaaagacaagcacuuu

SEQ ID NO: 920730 - RNA, 22 nt, Homo sapiens
gcauaaaagacaagcacuuugg

SEQ ID NO: 920731 - RNA, 13 nt, Homo sapiens
gcauacuguguua

SEQ ID NO: 920732 - RNA, 22 nt, Homo sapiens
gcauagagaacgggaguggcca

SEQ ID NO: 920733 - RNA, 15 nt, Homo sapiens
gcauaucaacuugag

SEQ ID NO: 920734 - RNA, 14 nt, Homo sapiens
gcauccaacugaga

SEQ ID NO: 920735 - RNA, 22 nt, Homo sapiens
gcaucccaaaccacgccucuug

SEQ ID NO: 920736 - RNA, 17 nt, Homo sapiens
gcauuaaaugcaaaaau

SEQ ID NO: 920737 - RNA, 16 nt, Homo sapiens
gcauuacucugcacua

SEQ ID NO: 920738 - RNA, 15 nt, Homo sapiens
gcauugccagcucuu

SEQ ID NO: 920739 - RNA, 22 nt, Homo sapiens
gcauuuucuacacagcgagaaa

SEQ ID NO: 920740 - RNA, 13 nt, Homo sapiens
gccaacaguggcu

SEQ ID NO: 920741 - RNA, 15 nt, Homo sapiens
gccaacccuguguca

SEQ ID NO: 920742 - RNA, 14 nt, Homo sapiens
gccaagaccauuuc

SEQ ID NO: 920743 - RNA, 17 nt, Homo sapiens
gccaaggcagagcgcaa

SEQ ID NO: 920744 - RNA, 22 nt, Homo sapiens
gccaaguaacaaugcaugcuuu

SEQ ID NO: 920745 - RNA, 18 nt, Homo sapiens
gccacauccaacauuucc

SEQ ID NO: 920746 - RNA, 23 nt, Homo sapiens
gccacaugggaaacuuccaagac

SEQ ID NO: 920747 - RNA, 20 nt, Homo sapiens
gccaccaacauaaaacaaaa

SEQ ID NO: 920748 - RNA, 20 nt, Homo sapiens
gccacccaggccacugaccu

SEQ ID NO: 920749 - RNA, 14 nt, Homo sapiens
gccacccucugcag

SEQ ID NO: 920750 - RNA, 18 nt, Homo sapiens
gccaccucucacacuggc

SEQ ID NO: 920751 - RNA, 17 nt, Homo sapiens
gccaggccugaccucaa

SEQ ID NO: 920752 - RNA, 23 nt, Homo sapiens
gccaugagaaaagggaagccgcc

SEQ ID NO: 920753 - RNA, 13 nt, Homo sapiens
gccauuucuuccc

SEQ ID NO: 920754 - RNA, 19 nt, Homo sapiens
gcccaggcuggagugcagu

SEQ ID NO: 920755 - RNA, 21 nt, Homo sapiens
gccccaggcucguggacugag

SEQ ID NO: 920756 - RNA, 15 nt, Homo sapiens
gccccaucagcagcu

SEQ ID NO: 920757 - RNA, 16 nt, Homo sapiens
gccccaucagcagcuu

SEQ ID NO: 920758 - RNA, 17 nt, Homo sapiens
gcccccgcucaugggcc

SEQ ID NO: 920759 - RNA, 15 nt, Homo sapiens
gcccugaaggugcca

SEQ ID NO: 920760 - RNA, 13 nt, Homo sapiens
gcccugauuugcu

SEQ ID NO: 920761 - RNA, 22 nt, Homo sapiens
gcccuggaggccgcugcugacc

SEQ ID NO: 920762 - RNA, 21 nt, Homo sapiens
gcccugggugcaggacacugg

SEQ ID NO: 920763 - RNA, 14 nt, Homo sapiens
gccgcugcugacca

SEQ ID NO: 920764 - RNA, 15 nt, Homo sapiens
gccuagucagccaca

SEQ ID NO: 920765 - RNA, 16 nt, Homo sapiens
gccuagucccuuccac

SEQ ID NO: 920766 - RNA, 21 nt, Homo sapiens
guguuucuuguuaagugcuuu

SEQ ID NO: 920767 - RNA, 13 nt, Homo sapiens
guuaaaugcaauu

SEQ ID NO: 920768 - RNA, 20 nt, Homo sapiens
guuaaauugcacgugcaaua

SEQ ID NO: 920769 - RNA, 12 nt, Homo sapiens
guuaagugcuuu

SEQ ID NO: 920770 - RNA, 21 nt, Homo sapiens
guuacugcuguuuaggaauau

SEQ ID NO: 920771 - RNA, 14 nt, Homo sapiens
guuauaauuugcac

SEQ ID NO: 920772 - RNA, 19 nt, Homo sapiens
guucaaaguuuaagcaauu

SEQ ID NO: 920773 - RNA, 22 nt, Homo sapiens
guuccauacccccacaugccaa

SEQ ID NO: 920774 - RNA, 18 nt, Homo sapiens
guucuaaaaucaagugca

SEQ ID NO: 920775 - RNA, 16 nt, Homo sapiens
guucuauccccaagcu

SEQ ID NO: 920776 - RNA, 17 nt, Homo sapiens
guucucuccccuugcac

SEQ ID NO: 920777 - RNA, 19 nt, Homo sapiens
guugacuggcuuuccucuc

SEQ ID NO: 920778 - RNA, 23 nt, Homo sapiens
guugauauauucuuuccaugcag

SEQ ID NO: 920779 - RNA, 14 nt, Homo sapiens
guuggugaccaguu

SEQ ID NO: 920780 - RNA, 15 nt, Homo sapiens
guuucacugccaacu

SEQ ID NO: 920781 - RNA, 21 nt, Homo sapiens
guuucauucuauuggucaauu

SEQ ID NO: 920782 - RNA, 14 nt, Homo sapiens
guuuccacacagcc

SEQ ID NO: 920783 - RNA, 16 nt, Homo sapiens
guuuggaugaaaaaag

SEQ ID NO: 920784 - RNA, 16 nt, Homo sapiens
guuuuaaguguuugcu

SEQ ID NO: 920785 - RNA, 14 nt, Homo sapiens
guuuugcuccuucu

SEQ ID NO: 920786 - RNA, 24 nt, Homo sapiens
guuuuuuaagaaacaaaagugcau

SEQ ID NO: 920787 - RNA, 21 nt, Homo sapiens
uaaaaaaaaaacuucauucua

SEQ ID NO: 920788 - RNA, 18 nt, Homo sapiens
uaaaaaacggauuuccuc

SEQ ID NO: 920789 - RNA, 20 nt, Homo sapiens
uaaaaaaugagcuuccauua

SEQ ID NO: 920790 - RNA, 21 nt, Homo sapiens
uaaaaaaugagcuuccauuaa

SEQ ID NO: 920791 - RNA, 16 nt, Homo sapiens
uaaaaaucaaucacuu

SEQ ID NO: 920792 - RNA, 16 nt, Homo sapiens
uaaaacaaaaccaagc

SEQ ID NO: 920793 - RNA, 20 nt, Homo sapiens
uaaaacaauugugacagcag

SEQ ID NO: 920794 - RNA, 21 nt, Homo sapiens
uaaaacccagcauguacaaaa

SEQ ID NO: 920795 - RNA, 17 nt, Homo sapiens
uaaaacuucugauuucu

SEQ ID NO: 920796 - RNA, 17 nt, Homo sapiens
uaaaagaacaacacuaa

SEQ ID NO: 920797 - RNA, 17 nt, Homo sapiens
uaaaagacaagcacuuu

SEQ ID NO: 920798 - RNA, 18 nt, Homo sapiens
uaaaaggcacugcacaua

SEQ ID NO: 920799 - RNA, 20 nt, Homo sapiens
uaaaaucacaaacucaucca

SEQ ID NO: 920800 - RNA, 22 nt, Homo sapiens
uaaaauuagauuagaaagacuu

SEQ ID NO: 920801 - RNA, 23 nt, Homo sapiens
uaaacaaucagaccacauuugaa

SEQ ID NO: 920802 - RNA, 15 nt, Homo sapiens
uaaacacaauuccaa

SEQ ID NO: 920803 - RNA, 23 nt, Homo sapiens
uaaacuacuauuuuucuuuccaa

SEQ ID NO: 920804 - RNA, 19 nt, Homo sapiens
uaaagacaaagacauuauu

SEQ ID NO: 920805 - RNA, 20 nt, Homo sapiens
uaaagccagcauuuccucag

SEQ ID NO: 920806 - RNA, 21 nt, Homo sapiens
uaaagccucagcaacagccag

SEQ ID NO: 920807 - RNA, 17 nt, Homo sapiens
uaaaggcaaaguggaau

SEQ ID NO: 920808 - RNA, 19 nt, Homo sapiens
uaaagguuucacuguucau

SEQ ID NO: 920809 - RNA, 20 nt, Homo sapiens
uaaagugagcaugcuuucug

SEQ ID NO: 920810 - RNA, 15 nt, Homo sapiens
uaaauaauaccauaa

SEQ ID NO: 920811 - RNA, 16 nt, Homo sapiens
uaaauacaauauugca

SEQ ID NO: 920812 - RNA, 18 nt, Homo sapiens
uaaauauagaaccaugaa

SEQ ID NO: 920813 - RNA, 11 nt, Homo sapiens
uaaaugcuuug

SEQ ID NO: 920814 - RNA, 16 nt, Homo sapiens
uaaauuaauuugacca

SEQ ID NO: 920815 - RNA, 23 nt, Homo sapiens
uaaauuauuuuuaaugauuugag

SEQ ID NO: 920816 - RNA, 15 nt, Homo sapiens
uaacaauguuuguca

SEQ ID NO: 920817 - RNA, 16 nt, Homo sapiens
uaacagaaauuguaua

SEQ ID NO: 920818 - RNA, 14 nt, Homo sapiens
uaacagagugagac

SEQ ID NO: 920819 - RNA, 19 nt, Homo sapiens
uaacaguucccaucaccau

SEQ ID NO: 920820 - RNA, 15 nt, Homo sapiens
uaacaguuuuuuaca

SEQ ID NO: 920821 - RNA, 18 nt, Homo sapiens
uaaccccuaugaacucuu

SEQ ID NO: 920822 - RNA, 16 nt, Homo sapiens
uaacccuuucuucaau

SEQ ID NO: 920823 - RNA, 21 nt, Homo sapiens
uaagaauucuuaacauagcca

SEQ ID NO: 920824 - RNA, 22 nt, Homo sapiens
uaagacaggaggaucacaagag

SEQ ID NO: 920825 - RNA, 22 nt, Homo sapiens
uaagcccacaaucaugccuccc

SEQ ID NO: 920826 - RNA, 23 nt, Homo sapiens
uaaggggguguaaugaaaaugau

SEQ ID NO: 920827 - RNA, 21 nt, Homo sapiens
uaaguaauuuccccacucuga

SEQ ID NO: 920828 - RNA, 19 nt, Homo sapiens
uaaguucuuugaagacuua

SEQ ID NO: 920829 - RNA, 20 nt, Homo sapiens
uaauaaaaaucaugcuuaua

SEQ ID NO: 920830 - RNA, 19 nt, Homo sapiens
uaauaaaauacauacuaua

SEQ ID NO: 920831 - RNA, 24 nt, Homo sapiens
uaauaaaguuaaauugcacgugca

SEQ ID NO: 920832 - RNA, 22 nt, Homo sapiens
uaauccaguggguuccucccag

SEQ ID NO: 920833 - RNA, 18 nt, Homo sapiens
uaauccaguuuagaaagu

SEQ ID NO: 920834 - RNA, 20 nt, Homo sapiens
uaaucccagcuacuugggag

SEQ ID NO: 920835 - RNA, 23 nt, Homo sapiens
uaaugauaguguuuuguacuugu

SEQ ID NO: 920836 - RNA, 16 nt, Homo sapiens
uaaugggaaguguaca

SEQ ID NO: 920837 - RNA, 20 nt, Homo sapiens
uaauguagauaaagcacugu

SEQ ID NO: 920838 - RNA, 23 nt, Homo sapiens
uaauguguaugucugguaaauag

SEQ ID NO: 920839 - RNA, 22 nt, Homo sapiens
uaauguguauuuacuguacuaa

SEQ ID NO: 920840 - RNA, 10 nt, Homo sapiens
uaauugagau

SEQ ID NO: 920841 - RNA, 17 nt, Homo sapiens
uaauuuccccacucuga

SEQ ID NO: 920842 - RNA, 15 nt, Homo sapiens
uaauuugaccaucuc

SEQ ID NO: 920843 - RNA, 18 nt, Homo sapiens
uacaacugaucauuugca

SEQ ID NO: 920844 - RNA, 17 nt, Homo sapiens
uacaaguuucaguaaua

SEQ ID NO: 920845 - RNA, 14 nt, Homo sapiens
uacacaagacuuuc

SEQ ID NO: 920846 - RNA, 21 nt, Homo sapiens
uacacacgugugauguauguu

SEQ ID NO: 920847 - RNA, 15 nt, Homo sapiens
uacaccaacugcucu

SEQ ID NO: 920848 - RNA, 17 nt, Homo sapiens
uacacuugggugaaaag

SEQ ID NO: 920849 - RNA, 16 nt, Homo sapiens
uacagagguccugcca

SEQ ID NO: 920850 - RNA, 15 nt, Homo sapiens
uacagauuguucuca

SEQ ID NO: 920851 - RNA, 13 nt, Homo sapiens
uacagcccagugg

SEQ ID NO: 920852 - RNA, 21 nt, Homo sapiens
uacaggacuucugugcauugu

SEQ ID NO: 920853 - RNA, 16 nt, Homo sapiens
uacaggugacugccac

SEQ ID NO: 920854 - RNA, 20 nt, Homo sapiens
uacaggugugagccaccaca

SEQ ID NO: 920855 - RNA, 16 nt, Homo sapiens
uacaguaacaaucugc

SEQ ID NO: 920856 - RNA, 10 nt, Homo sapiens
uacaguauua

SEQ ID NO: 920857 - RNA, 18 nt, Homo sapiens
uacauuauuggacuucca

SEQ ID NO: 920858 - RNA, 18 nt, Homo sapiens
uacauuuagcuuguucac

SEQ ID NO: 920859 - RNA, 18 nt, Homo sapiens
uacauuucuuccuucaaa

SEQ ID NO: 920860 - RNA, 14 nt, Homo sapiens
uaccaaugcuuuga

SEQ ID NO: 920861 - RNA, 15 nt, Homo sapiens
uaccaccgacauuuu

SEQ ID NO: 920862 - RNA, 20 nt, Homo sapiens
uaccaccgacauuuuucaau

SEQ ID NO: 920863 - RNA, 15 nt, Homo sapiens
uaccagaucacucaa

SEQ ID NO: 920864 - RNA, 22 nt, Homo sapiens
uaccaguacguacauauuuuaa

SEQ ID NO: 920865 - RNA, 19 nt, Homo sapiens
uacccaccugagcuuugga

SEQ ID NO: 920866 - RNA, 21 nt, Homo sapiens
uacccaccugagcuuuggaca

SEQ ID NO: 920867 - RNA, 15 nt, Homo sapiens
uaccccaaccccagg

SEQ ID NO: 920868 - RNA, 18 nt, Homo sapiens
uaccguaacaauguuugu

SEQ ID NO: 920869 - RNA, 21 nt, Homo sapiens
uaccugcauguguuguacaau

SEQ ID NO: 920870 - RNA, 16 nt, Homo sapiens
uaccugcccucucuca

SEQ ID NO: 920871 - RNA, 17 nt, Homo sapiens
uaccugcccucucucag

SEQ ID NO: 920872 - RNA, 14 nt, Homo sapiens
uaccuguguucaga

SEQ ID NO: 920873 - RNA, 20 nt, Homo sapiens
uacggaaggcucugggaucu

SEQ ID NO: 920874 - RNA, 16 nt, Homo sapiens
uacggaauuccaauau

SEQ ID NO: 920875 - RNA, 18 nt, Homo sapiens
uacuaaaagucagcuuua

SEQ ID NO: 920876 - RNA, 13 nt, Homo sapiens
uacuaaagcuaua

SEQ ID NO: 920877 - RNA, 16 nt, Homo sapiens
uacuauaaaaaacauu

SEQ ID NO: 920878 - RNA, 18 nt, Homo sapiens
uacuauuuuucuuuccaa

SEQ ID NO: 920879 - RNA, 17 nt, Homo sapiens
uacuccaagccaaauac

SEQ ID NO: 920880 - RNA, 21 nt, Homo sapiens
uacuggguagguucugaacag

SEQ ID NO: 920881 - RNA, 22 nt, Homo sapiens
uacugguuuguaugauguauua

SEQ ID NO: 920882 - RNA, 13 nt, Homo sapiens
uacugucgcaucu

SEQ ID NO: 920883 - RNA, 13 nt, Homo sapiens
uacuuaaauuaca

SEQ ID NO: 920884 - RNA, 18 nt, Homo sapiens
uacuucaaaucauauccu

SEQ ID NO: 920885 - RNA, 16 nt, Homo sapiens
uacuugggccauagcu

SEQ ID NO: 920886 - RNA, 20 nt, Homo sapiens
uacuuguauguagcagcauu

SEQ ID NO: 920887 - RNA, 22 nt, Homo sapiens
ugccuauauuuuuccucaaaga

SEQ ID NO: 920888 - RNA, 21 nt, Homo sapiens
ugccucggggacacuagugac

SEQ ID NO: 920889 - RNA, 16 nt, Homo sapiens
ugcgcagggcucuuug

SEQ ID NO: 920890 - RNA, 15 nt, Homo sapiens
ugcuaaauacuguac

SEQ ID NO: 920891 - RNA, 17 nt, Homo sapiens
ugcuaaauauaaaaaca

SEQ ID NO: 920892 - RNA, 19 nt, Homo sapiens
ugcuaauggauguagccag

SEQ ID NO: 920893 - RNA, 14 nt, Homo sapiens
ugcuagccacugga

SEQ ID NO: 920894 - RNA, 17 nt, Homo sapiens
ugcuagccacuggaaau

SEQ ID NO: 920895 - RNA, 16 nt, Homo sapiens
ugcuaguucaacagaa

SEQ ID NO: 920896 - RNA, 20 nt, Homo sapiens
ugcuccgaggacccaggaaa

SEQ ID NO: 920897 - RNA, 16 nt, Homo sapiens
ugcucuacugcuucag

SEQ ID NO: 920898 - RNA, 20 nt, Homo sapiens
ugcucuggaagccugcugau

SEQ ID NO: 920899 - RNA, 22 nt, Homo sapiens
ugcugauucaauaaaaugcacu

SEQ ID NO: 920900 - RNA, 15 nt, Homo sapiens
ugcuggcacagacuu

SEQ ID NO: 920901 - RNA, 23 nt, Homo sapiens
ugcuggcacagacuucacacagc

SEQ ID NO: 920902 - RNA, 19 nt, Homo sapiens
ugcuggguuuccacacagc

SEQ ID NO: 920903 - RNA, 20 nt, Homo sapiens
ugcuggguuuccacacagcc

SEQ ID NO: 920904 - RNA, 21 nt, Homo sapiens
ugcuggguuuccacacagccu

SEQ ID NO: 920905 - RNA, 16 nt, Homo sapiens
ugcuguaaaagugaau

SEQ ID NO: 920906 - RNA, 21 nt, Homo sapiens
ugcuguccaggaacuuuccag

SEQ ID NO: 920907 - RNA, 23 nt, Homo sapiens
ugcuucaggaaggacauggacaa

SEQ ID NO: 920908 - RNA, 13 nt, Homo sapiens
ugcuugucaucca

SEQ ID NO: 920909 - RNA, 21 nt, Homo sapiens
uggaaacuguugguugagaua

SEQ ID NO: 920910 - RNA, 19 nt, Homo sapiens
uggaaagagguuuucacaa

SEQ ID NO: 920911 - RNA, 11 nt, Homo sapiens
uggaaagucaa

SEQ ID NO: 920912 - RNA, 23 nt, Homo sapiens
uggaaauaaaguuauuacucuga

SEQ ID NO: 920913 - RNA, 22 nt, Homo sapiens
uggaauagcuuguacacauaua

SEQ ID NO: 920914 - RNA, 21 nt, Homo sapiens
uggaauuuugcaaagauuuaa

SEQ ID NO: 920915 - RNA, 16 nt, Homo sapiens
uggacacacacagcuu

SEQ ID NO: 920916 - RNA, 23 nt, Homo sapiens
uggaccaaccccaggcagaaggu

SEQ ID NO: 920917 - RNA, 15 nt, Homo sapiens
uggacgcacacagcu

SEQ ID NO: 920918 - RNA, 16 nt, Homo sapiens
uggacgcacacagcuu

SEQ ID NO: 920919 - RNA, 15 nt, Homo sapiens
uggacuuccauuugg

SEQ ID NO: 920920 - RNA, 23 nt, Homo sapiens
uggagaacaaagaccaaugugaa

SEQ ID NO: 920921 - RNA, 20 nt, Homo sapiens
uggagacuggaacacaacca

SEQ ID NO: 920922 - RNA, 17 nt, Homo sapiens
uggagauuucaguuacu

SEQ ID NO: 920923 - RNA, 18 nt, Homo sapiens
uggagccagccacccuaa

SEQ ID NO: 920924 - RNA, 17 nt, Homo sapiens
uggagccugcucuuuga

SEQ ID NO: 920925 - RNA, 17 nt, Homo sapiens
uggaggccgcugcugac

SEQ ID NO: 920926 - RNA, 19 nt, Homo sapiens
uggagggguuuaugcucaa

SEQ ID NO: 920927 - RNA, 15 nt, Homo sapiens
uggagguuggccaca

SEQ ID NO: 920928 - RNA, 15 nt, Homo sapiens
uggaugaaaaaagcc

SEQ ID NO: 920929 - RNA, 21 nt, Homo sapiens
uggcaagaccaauaguuugaa

SEQ ID NO: 920930 - RNA, 22 nt, Homo sapiens
uggcaaggacuuuguacauuug

SEQ ID NO: 920931 - RNA, 20 nt, Homo sapiens
uggcaagucaguggggacag

SEQ ID NO: 920932 - RNA, 18 nt, Homo sapiens
uggcacccgggaaugacu

SEQ ID NO: 920933 - RNA, 23 nt, Homo sapiens
uggcaguuacagggcccagguga

SEQ ID NO: 920934 - RNA, 22 nt, Homo sapiens
uggcauucgcagugcccaguga

SEQ ID NO: 920935 - RNA, 19 nt, Homo sapiens
uggccacauccaacauuuc

SEQ ID NO: 920936 - RNA, 23 nt, Homo sapiens
uggcccuguugugggggugucac

SEQ ID NO: 920937 - RNA, 14 nt, Homo sapiens
uggcccuguuuacg

SEQ ID NO: 920938 - RNA, 19 nt, Homo sapiens
uggccuaaagccagcauuu

SEQ ID NO: 920939 - RNA, 23 nt, Homo sapiens
uggccuguguggugccacccugc

SEQ ID NO: 920940 - RNA, 21 nt, Homo sapiens
uggcuaccgauuucagcacau

SEQ ID NO: 920941 - RNA, 19 nt, Homo sapiens
uggcuauuuucccaugcca

SEQ ID NO: 920942 - RNA, 22 nt, Homo sapiens
uggcucugaacugcacaaugca

SEQ ID NO: 920943 - RNA, 20 nt, Homo sapiens
uggcugauuuagaccaaaag

SEQ ID NO: 920944 - RNA, 18 nt, Homo sapiens
uggcuuaaaaauacuuaa

SEQ ID NO: 920945 - RNA, 12 nt, Homo sapiens
uggcuugaaccu

SEQ ID NO: 920946 - RNA, 19 nt, Homo sapiens
uggcuuugucccacagcuu

SEQ ID NO: 920947 - RNA, 16 nt, Homo sapiens
ugggaggccaaggugg

SEQ ID NO: 920948 - RNA, 21 nt, Homo sapiens
ugggaguaagagcaaauuuca

SEQ ID NO: 920949 - RNA, 17 nt, Homo sapiens
ugggcagcauaaaguca

SEQ ID NO: 920950 - RNA, 17 nt, Homo sapiens
uggggagacaccucaga

SEQ ID NO: 920951 - RNA, 17 nt, Homo sapiens
ugggggguuuucuugcc

SEQ ID NO: 920952 - RNA, 22 nt, Homo sapiens
ugggguuucucuuuuccacuga

SEQ ID NO: 920953 - RNA, 22 nt, Homo sapiens
ugggucaaagugguacaggaag

SEQ ID NO: 920954 - RNA, 21 nt, Homo sapiens
ugguagguucugucugugcca

SEQ ID NO: 920955 - RNA, 20 nt, Homo sapiens
uggucaauuccauguggcug

SEQ ID NO: 920956 - RNA, 15 nt, Homo sapiens
uggucauauugccaa

SEQ ID NO: 920957 - RNA, 11 nt, Homo sapiens
ugguccagauu

SEQ ID NO: 920958 - RNA, 17 nt, Homo sapiens
uggucuccucccaaaau

SEQ ID NO: 920959 - RNA, 14 nt, Homo sapiens
uggucugccucuga

SEQ ID NO: 920960 - RNA, 20 nt, Homo sapiens
uggugaugggguuuagcaac

SEQ ID NO: 920961 - RNA, 17 nt, Homo sapiens
uggugucaugaggaaaa

SEQ ID NO: 920962 - RNA, 22 nt, Homo sapiens
uggugucuugauauauuuauaa

SEQ ID NO: 920963 - RNA, 16 nt, Homo sapiens
ugguugccacaucuua

SEQ ID NO: 920964 - RNA, 20 nt, Homo sapiens
ugguuuguuuucuacauuga

SEQ ID NO: 920965 - RNA, 17 nt, Homo sapiens
ugguuuuuuagugcaau

SEQ ID NO: 920966 - RNA, 22 nt, Homo sapiens
uguaaaauaaaaccaccaaagu

SEQ ID NO: 920967 - RNA, 13 nt, Homo sapiens
uguaaauguucaa

SEQ ID NO: 920968 - RNA, 17 nt, Homo sapiens
uguaaguugaccuucuc

SEQ ID NO: 920969 - RNA, 19 nt, Homo sapiens
uguaaucccagcuacuugg

SEQ ID NO: 920970 - RNA, 19 nt, Homo sapiens
uguaccuuucugacaauaa

SEQ ID NO: 920971 - RNA, 14 nt, Homo sapiens
uguagauugccuuu

SEQ ID NO: 920972 - RNA, 15 nt, Homo sapiens
uguagccagaauucu

SEQ ID NO: 920973 - RNA, 13 nt, Homo sapiens
uguagccagacag

SEQ ID NO: 920974 - RNA, 20 nt, Homo sapiens
uguagcuagcucgugacuac

SEQ ID NO: 920975 - RNA, 18 nt, Homo sapiens
uguaucauuaauguaggu

SEQ ID NO: 920976 - RNA, 20 nt, Homo sapiens
uguauuaacugaauucugaa

SEQ ID NO: 920977 - RNA, 21 nt, Homo sapiens
ugucacuauaggucauacaau

SEQ ID NO: 920978 - RNA, 18 nt, Homo sapiens
ugucacuugugauuugcc

SEQ ID NO: 920979 - RNA, 22 nt, Homo sapiens
ugucaggcacaguaagcaugcu

SEQ ID NO: 920980 - RNA, 22 nt, Homo sapiens
ugucauggcucugaacugcaca

SEQ ID NO: 920981 - RNA, 16 nt, Homo sapiens
uguccaaguguuucuu

SEQ ID NO: 920982 - RNA, 20 nt, Homo sapiens
uguccuucccacggccacug

SEQ ID NO: 920983 - RNA, 19 nt, Homo sapiens
ugucuaaaaauaaaaugca

SEQ ID NO: 920984 - RNA, 14 nt, Homo sapiens
ugucuaagaacuuc

SEQ ID NO: 920985 - RNA, 9 nt, Homo sapiens
ugucucucu

SEQ ID NO: 920986 - RNA, 10 nt, Homo sapiens
ugucugguaa

SEQ ID NO: 920987 - RNA, 17 nt, Homo sapiens
ugucuguaaccaauaau

SEQ ID NO: 920988 - RNA, 14 nt, Homo sapiens
ugugaaaacagcag

SEQ ID NO: 920989 - RNA, 14 nt, Homo sapiens
ugugaacaugccuu

SEQ ID NO: 920990 - RNA, 14 nt, Homo sapiens
ugugaauuuuacaa

SEQ ID NO: 920991 - RNA, 22 nt, Homo sapiens
ugugaccccuccccagugccuc

SEQ ID NO: 920992 - RNA, 16 nt, Homo sapiens
ugugagugugugcaca

SEQ ID NO: 920993 - RNA, 14 nt, Homo sapiens
ugugaucugggaac

SEQ ID NO: 920994 - RNA, 12 nt, Homo sapiens
ugugauugccau

SEQ ID NO: 920995 - RNA, 16 nt, Homo sapiens
ugugcaucaaccagga

SEQ ID NO: 920996 - RNA, 19 nt, Homo sapiens
ugugcauguauauuacuga

SEQ ID NO: 920997 - RNA, 16 nt, Homo sapiens
ugugccuggagcuccu

SEQ ID NO: 920998 - RNA, 14 nt, Homo sapiens
ugugcuuuugcaaa

SEQ ID NO: 920999 - RNA, 18 nt, Homo sapiens
uguggcaguuacagggcc

SEQ ID NO: 921000 - RNA, 19 nt, Homo sapiens
uguggguguggcaguuaca

SEQ ID NO: 921001 - RNA, 19 nt, Homo sapiens
ugugguucgaaggauaugg

SEQ ID NO: 921002 - RNA, 18 nt, Homo sapiens
uguguuuauaauuguuau

SEQ ID NO: 921003 - RNA, 14 nt, Homo sapiens
uguuacgugugcaa

SEQ ID NO: 921004 - RNA, 20 nt, Homo sapiens
uguucaaaguuuaagcaauu

SEQ ID NO: 921005 - RNA, 14 nt, Homo sapiens
uguucaaugaauau

SEQ ID NO: 921006 - RNA, 14 nt, Homo sapiens
uguucacacuuugc

SEQ ID NO: 921007 - RNA, 15 nt, Homo sapiens
uguuccccucaccca

SEQ ID NO: 921008 - RNA, 16 nt, Homo sapiens
aaagaaagcugugaaa

SEQ ID NO: 921009 - RNA, 14 nt, Homo sapiens
aaagaccaauguga

SEQ ID NO: 921010 - RNA, 19 nt, Homo sapiens
aaagaggauuaagcuuuuu

SEQ ID NO: 921011 - RNA, 17 nt, Homo sapiens
aaagagguuuucacaaa

SEQ ID NO: 921012 - RNA, 17 nt, Homo sapiens
aaagaucucaacaugga

SEQ ID NO: 921013 - RNA, 14 nt, Homo sapiens
aaagauucugcauu

SEQ ID NO: 921014 - RNA, 14 nt, Homo sapiens
aaagauuuuaccug

SEQ ID NO: 921015 - RNA, 22 nt, Homo sapiens
aaagcauugccagcucuuccaa

SEQ ID NO: 921016 - RNA, 13 nt, Homo sapiens
aaagcuguuccca

SEQ ID NO: 921017 - RNA, 22 nt, Homo sapiens
aaagcuguuucuaaacaguuga

SEQ ID NO: 921018 - RNA, 12 nt, Homo sapiens
aaaggacugacc

SEQ ID NO: 921019 - RNA, 16 nt, Homo sapiens
aaagguuuacagugaa

SEQ ID NO: 921020 - RNA, 16 nt, Homo sapiens
aaaguaaagaaaugca

SEQ ID NO: 921021 - RNA, 13 nt, Homo sapiens
aaaguacuaugaa

SEQ ID NO: 921022 - RNA, 12 nt, Homo sapiens
aaaguagggaug

SEQ ID NO: 921023 - RNA, 22 nt, Homo sapiens
aaaguaugcaugcagucuugua

SEQ ID NO: 921024 - RNA, 14 nt, Homo sapiens
aaaguauggcagug

SEQ ID NO: 921025 - RNA, 19 nt, Homo sapiens
aaagucagcuuuacuagug

SEQ ID NO: 921026 - RNA, 14 nt, Homo sapiens
aaaguccaguuuau

SEQ ID NO: 921027 - RNA, 16 nt, Homo sapiens
aaagugucuacaugug

SEQ ID NO: 921028 - RNA, 14 nt, Homo sapiens
aaaguuuaagcaau

SEQ ID NO: 921029 - RNA, 13 nt, Homo sapiens
aaauaaaugugca

SEQ ID NO: 921030 - RNA, 15 nt, Homo sapiens
aaauaauauugauuu

SEQ ID NO: 921031 - RNA, 16 nt, Homo sapiens
aaauacuacacaucca

SEQ ID NO: 921032 - RNA, 13 nt, Homo sapiens
aaauagacuuuug

SEQ ID NO: 921033 - RNA, 15 nt, Homo sapiens
aaauagggcuuuuaa

SEQ ID NO: 921034 - RNA, 14 nt, Homo sapiens
aaauaguggccaga

SEQ ID NO: 921035 - RNA, 15 nt, Homo sapiens
aaauaguguguccau

SEQ ID NO: 921036 - RNA, 19 nt, Homo sapiens
aaauauuggcugauuuaga

SEQ ID NO: 921037 - RNA, 18 nt, Homo sapiens
aaaucaagugcaccuaca

SEQ ID NO: 921038 - RNA, 14 nt, Homo sapiens
aaaucaaucacuug

SEQ ID NO: 921039 - RNA, 21 nt, Homo sapiens
aaauccuuucauaaagcacca

SEQ ID NO: 921040 - RNA, 15 nt, Homo sapiens
aaaucugauuuacac

SEQ ID NO: 921041 - RNA, 13 nt, Homo sapiens
aaauggaacauua

SEQ ID NO: 921042 - RNA, 18 nt, Homo sapiens
aaaugggaacaauaucaa

SEQ ID NO: 921043 - RNA, 18 nt, Homo sapiens
aaaugggacugaugucau

SEQ ID NO: 921044 - RNA, 12 nt, Homo sapiens
aaauggggugaa

SEQ ID NO: 921045 - RNA, 22 nt, Homo sapiens
aaaugugccauuuuuuucacuc

SEQ ID NO: 921046 - RNA, 21 nt, Homo sapiens
aaauuaaguuguaucauuuca

SEQ ID NO: 921047 - RNA, 22 nt, Homo sapiens
aaauuagauauuguuuugugac

SEQ ID NO: 921048 - RNA, 18 nt, Homo sapiens
aaauuauauuuugaacaa

SEQ ID NO: 921049 - RNA, 14 nt, Homo sapiens
aaauuaugaauauu

SEQ ID NO: 921050 - RNA, 16 nt, Homo sapiens
aaauucuccuccugaa

SEQ ID NO: 921051 - RNA, 16 nt, Homo sapiens
aaauugcagaagcagg

SEQ ID NO: 921052 - RNA, 16 nt, Homo sapiens
aaauugcagagucugu

SEQ ID NO: 921053 - RNA, 22 nt, Homo sapiens
aaauuugcaaaucucaggauaa

SEQ ID NO: 921054 - RNA, 14 nt, Homo sapiens
aacaaacauuugaa

SEQ ID NO: 921055 - RNA, 16 nt, Homo sapiens
aacaaagugcaaagcu

SEQ ID NO: 921056 - RNA, 16 nt, Homo sapiens
aacaacucgaaucacu

SEQ ID NO: 921057 - RNA, 18 nt, Homo sapiens
aacaacucgaaucacuca

SEQ ID NO: 921058 - RNA, 17 nt, Homo sapiens
aacaagcaaaaccaaag

SEQ ID NO: 921059 - RNA, 22 nt, Homo sapiens
aacaaucugcuuucuuuguaac

SEQ ID NO: 921060 - RNA, 14 nt, Homo sapiens
aacaauucaaucaa

SEQ ID NO: 921061 - RNA, 18 nt, Homo sapiens
aacacacuugggcacgga

SEQ ID NO: 921062 - RNA, 13 nt, Homo sapiens
aacacuaccucuu

SEQ ID NO: 921063 - RNA, 19 nt, Homo sapiens
aacacugaagccauuugcc

SEQ ID NO: 921064 - RNA, 19 nt, Homo sapiens
aacacugucugcauaucca

SEQ ID NO: 921065 - RNA, 19 nt, Homo sapiens
aacagaaaggaauggccuu

SEQ ID NO: 921066 - RNA, 13 nt, Homo sapiens
aacagaaauccuu

SEQ ID NO: 921067 - RNA, 17 nt, Homo sapiens
aacagaaauccuuucau

SEQ ID NO: 921068 - RNA, 21 nt, Homo sapiens
aacagaaauuguauauuguaa

SEQ ID NO: 921069 - RNA, 14 nt, Homo sapiens
aacagaaugcauug

SEQ ID NO: 921070 - RNA, 20 nt, Homo sapiens
aacagaaugcauugcaucau

SEQ ID NO: 921071 - RNA, 13 nt, Homo sapiens
aacagccagugga

SEQ ID NO: 921072 - RNA, 23 nt, Homo sapiens
aacaggugcugaacugugcauca

SEQ ID NO: 921073 - RNA, 20 nt, Homo sapiens
aacaguucccaucaccauca

SEQ ID NO: 921074 - RNA, 22 nt, Homo sapiens
aacauaaaacaaaaccaagccu

SEQ ID NO: 921075 - RNA, 15 nt, Homo sapiens
aacauaguaacgugu

SEQ ID NO: 921076 - RNA, 15 nt, Homo sapiens
aacaugacacauuug

SEQ ID NO: 921077 - RNA, 14 nt, Homo sapiens
aacauugcugccua

SEQ ID NO: 921078 - RNA, 13 nt, Homo sapiens
aaccaaaacagag

SEQ ID NO: 921079 - RNA, 19 nt, Homo sapiens
aaccaaacggaacucuuca

SEQ ID NO: 921080 - RNA, 16 nt, Homo sapiens
aaccaaggugcacuga

SEQ ID NO: 921081 - RNA, 22 nt, Homo sapiens
aaccauauccauguugcugacu

SEQ ID NO: 921082 - RNA, 17 nt, Homo sapiens
aacccagcauguacaaa

SEQ ID NO: 921083 - RNA, 12 nt, Homo sapiens
aacccuguguca

SEQ ID NO: 921084 - RNA, 16 nt, Homo sapiens
aacccugugucacuua

SEQ ID NO: 921085 - RNA, 19 nt, Homo sapiens
aaccuaaaaaucaaucacu

SEQ ID NO: 921086 - RNA, 13 nt, Homo sapiens
aaccucuccuucc

SEQ ID NO: 921087 - RNA, 16 nt, Homo sapiens
aaccuucaaagcuuuu

SEQ ID NO: 921088 - RNA, 17 nt, Homo sapiens
aaccuucuaauccaugu

SEQ ID NO: 921089 - RNA, 17 nt, Homo sapiens
aaccuuuuuauuuucac

SEQ ID NO: 921090 - RNA, 18 nt, Homo sapiens
aacgcaaaccucuccuuc

SEQ ID NO: 921091 - RNA, 15 nt, Homo sapiens
aacgcuugacacaaa

SEQ ID NO: 921092 - RNA, 14 nt, Homo sapiens
aacggaacucuuca

SEQ ID NO: 921093 - RNA, 14 nt, Homo sapiens
aacuaaagcaguuu

SEQ ID NO: 921094 - RNA, 16 nt, Homo sapiens
aacuaauaggaccuca

SEQ ID NO: 921095 - RNA, 16 nt, Homo sapiens
aacuaccagauuugag

SEQ ID NO: 921096 - RNA, 21 nt, Homo sapiens
aacuacuauuuuucuuuccaa

SEQ ID NO: 921097 - RNA, 21 nt, Homo sapiens
aacuacuuaucucuaaaccau

SEQ ID NO: 921098 - RNA, 17 nt, Homo sapiens
aacucgcacaaccauga

SEQ ID NO: 921099 - RNA, 15 nt, Homo sapiens
aacucugggcacuuu

SEQ ID NO: 921100 - RNA, 15 nt, Homo sapiens
aacugcacaaugcau

SEQ ID NO: 921101 - RNA, 18 nt, Homo sapiens
aacugcauuagaaaccau

SEQ ID NO: 921102 - RNA, 13 nt, Homo sapiens
aacuucauucuaa

SEQ ID NO: 921103 - RNA, 19 nt, Homo sapiens
aagaaaaucacauuuccag

SEQ ID NO: 921104 - RNA, 20 nt, Homo sapiens
aagaaaauccuaacuuucag

SEQ ID NO: 921105 - RNA, 15 nt, Homo sapiens
aagaaagcauugcca

SEQ ID NO: 921106 - RNA, 16 nt, Homo sapiens
aagaacaacacuaauu

SEQ ID NO: 921107 - RNA, 13 nt, Homo sapiens
aagaccaauguga

SEQ ID NO: 921108 - RNA, 12 nt, Homo sapiens
aagacuaagggg

SEQ ID NO: 921109 - RNA, 18 nt, Homo sapiens
aagacuauuuaguggaac

SEQ ID NO: 921110 - RNA, 15 nt, Homo sapiens
aagacuuagugcugu

SEQ ID NO: 921111 - RNA, 14 nt, Homo sapiens
aagagaacugauga

SEQ ID NO: 921112 - RNA, 21 nt, Homo sapiens
aagagaagcugugucuuuaga

SEQ ID NO: 921113 - RNA, 13 nt, Homo sapiens
aagagaccaaaaa

SEQ ID NO: 921114 - RNA, 23 nt, Homo sapiens
aagagggagccgguuugggagag

SEQ ID NO: 921115 - RNA, 20 nt, Homo sapiens
aagagguagagaaaauggaa

SEQ ID NO: 921116 - RNA, 14 nt, Homo sapiens
aagagucacaauuu

SEQ ID NO: 921117 - RNA, 16 nt, Homo sapiens
aagaguuaauagcuau

SEQ ID NO: 921118 - RNA, 17 nt, Homo sapiens
aagaucaaaacagucau

SEQ ID NO: 921119 - RNA, 18 nt, Homo sapiens
aagaucaaaacagucaua

SEQ ID NO: 921120 - RNA, 20 nt, Homo sapiens
aagaucacaucacugcacuc

SEQ ID NO: 921121 - RNA, 23 nt, Homo sapiens
aagaucacaucacugcacuccag

SEQ ID NO: 921122 - RNA, 22 nt, Homo sapiens
aagaugguuuuauucuuugaga

SEQ ID NO: 921123 - RNA, 17 nt, Homo sapiens
aagauuccuuuccacuc

SEQ ID NO: 921124 - RNA, 13 nt, Homo sapiens
aagcaagcucuuc

SEQ ID NO: 921125 - RNA, 13 nt, Homo sapiens
aagcaccaaaaaa

SEQ ID NO: 921126 - RNA, 19 nt, Homo sapiens
aagcaccagcaguguuuaa

SEQ ID NO: 921127 - RNA, 19 nt, Homo sapiens
aagcaccuuuagaauauua

SEQ ID NO: 921128 - RNA, 17 nt, Homo sapiens
aagcaugucaaguggau

SEQ ID NO: 921129 - RNA, 23 nt, Homo sapiens
aagcccugggugcaggacacugg

SEQ ID NO: 921130 - RNA, 23 nt, Homo sapiens
aagccgccaggaccgccaaagaa

SEQ ID NO: 921131 - RNA, 20 nt, Homo sapiens
cuuucaggagggaaaaccca

SEQ ID NO: 921132 - RNA, 14 nt, Homo sapiens
cuuucauaaagcac

SEQ ID NO: 921133 - RNA, 18 nt, Homo sapiens
cuuucuucaauacaaaaa

SEQ ID NO: 921134 - RNA, 22 nt, Homo sapiens
cuuucuucccucauguucucau

SEQ ID NO: 921135 - RNA, 18 nt, Homo sapiens
cuuugacacaagguguaa

SEQ ID NO: 921136 - RNA, 21 nt, Homo sapiens
cuuugaguaaacuuacuacaa

SEQ ID NO: 921137 - RNA, 15 nt, Homo sapiens
cuuugagucaaguca

SEQ ID NO: 921138 - RNA, 17 nt, Homo sapiens
cuuuguaaguaaacugc

SEQ ID NO: 921139 - RNA, 16 nt, Homo sapiens
cuuuguucacugugag

SEQ ID NO: 921140 - RNA, 12 nt, Homo sapiens
cuuuuacugugg

SEQ ID NO: 921141 - RNA, 16 nt, Homo sapiens
cuuuuagaucaacaau

SEQ ID NO: 921142 - RNA, 23 nt, Homo sapiens
cuuuugaauaauguagugcaguc

SEQ ID NO: 921143 - RNA, 14 nt, Homo sapiens
gaaaaacaugcuua

SEQ ID NO: 921144 - RNA, 19 nt, Homo sapiens
gaaaaacuaaacuacagaa

SEQ ID NO: 921145 - RNA, 13 nt, Homo sapiens
gaaaaaggcuucu

SEQ ID NO: 921146 - RNA, 21 nt, Homo sapiens
gaaaacaaguauuuacuucug

SEQ ID NO: 921147 - RNA, 22 nt, Homo sapiens
gaaaaggcacgcuggcuuguga

SEQ ID NO: 921148 - RNA, 16 nt, Homo sapiens
gaaaagguccuugacu

SEQ ID NO: 921149 - RNA, 11 nt, Homo sapiens
gaaaauuacac

SEQ ID NO: 921150 - RNA, 20 nt, Homo sapiens
gaaaauuguauaaauuacuu

SEQ ID NO: 921151 - RNA, 21 nt, Homo sapiens
gaaaauuguauaaauuacuuu

SEQ ID NO: 921152 - RNA, 22 nt, Homo sapiens
gaaaauuuuagaagacagccua

SEQ ID NO: 921153 - RNA, 22 nt, Homo sapiens
gaaacaguacagcuauuucuca

SEQ ID NO: 921154 - RNA, 12 nt, Homo sapiens
gaaaccaugaaa

SEQ ID NO: 921155 - RNA, 23 nt, Homo sapiens
gaaacucuauggguaucaaacag

SEQ ID NO: 921156 - RNA, 19 nt, Homo sapiens
gaaacuuuuuccaccuuuc

SEQ ID NO: 921157 - RNA, 17 nt, Homo sapiens
gaaagaaucucuugaga

SEQ ID NO: 921158 - RNA, 17 nt, Homo sapiens
gaaagagagaagccagc

SEQ ID NO: 921159 - RNA, 18 nt, Homo sapiens
gaaagcauccauuaauua

SEQ ID NO: 921160 - RNA, 20 nt, Homo sapiens
gaaagcuaugaauguuacua

SEQ ID NO: 921161 - RNA, 17 nt, Homo sapiens
gaaauaugaagcacuuu

SEQ ID NO: 921162 - RNA, 20 nt, Homo sapiens
gaaauccagcugguuaucca

SEQ ID NO: 921163 - RNA, 15 nt, Homo sapiens
gaaaucccaguucau

SEQ ID NO: 921164 - RNA, 21 nt, Homo sapiens
gaaaugaauagccaggccuga

SEQ ID NO: 921165 - RNA, 16 nt, Homo sapiens
gaaaugccacucacca

SEQ ID NO: 921166 - RNA, 16 nt, Homo sapiens
gaacaagaauugcuaa

SEQ ID NO: 921167 - RNA, 12 nt, Homo sapiens
gaacaagccaca

SEQ ID NO: 921168 - RNA, 18 nt, Homo sapiens
gaacacugucaauggacu

SEQ ID NO: 921169 - RNA, 12 nt, Homo sapiens
gaacagcagaaa

SEQ ID NO: 921170 - RNA, 22 nt, Homo sapiens
gaacagggaugcuaucucgcua

SEQ ID NO: 921171 - RNA, 16 nt, Homo sapiens
gaacauucugucauca

SEQ ID NO: 921172 - RNA, 18 nt, Homo sapiens
gaaccaauaugaacugca

SEQ ID NO: 921173 - RNA, 16 nt, Homo sapiens
gaacccauuugccaug

SEQ ID NO: 921174 - RNA, 15 nt, Homo sapiens
gaacucacgagccuu

SEQ ID NO: 921175 - RNA, 18 nt, Homo sapiens
gaacucugggcacuuuug

SEQ ID NO: 921176 - RNA, 13 nt, Homo sapiens
gaacucuucaucu

SEQ ID NO: 921177 - RNA, 15 nt, Homo sapiens
gaacugcacaaugca

SEQ ID NO: 921178 - RNA, 18 nt, Homo sapiens
gaacugcacaaugcauug

SEQ ID NO: 921179 - RNA, 17 nt, Homo sapiens
gaacugugcaucaacca

SEQ ID NO: 921180 - RNA, 18 nt, Homo sapiens
gaacuucgaaaacuuuaa

SEQ ID NO: 921181 - RNA, 19 nt, Homo sapiens
gaagacccuugugcauugu

SEQ ID NO: 921182 - RNA, 19 nt, Homo sapiens
gaagacuauuuaguggaac

SEQ ID NO: 921183 - RNA, 15 nt, Homo sapiens
gaagaguccaggaag

SEQ ID NO: 921184 - RNA, 20 nt, Homo sapiens
gaagauaggauggaacguga

SEQ ID NO: 921185 - RNA, 18 nt, Homo sapiens
gaagauguaagaagcuaa

SEQ ID NO: 921186 - RNA, 16 nt, Homo sapiens
gaagccacugccagcu

SEQ ID NO: 921187 - RNA, 13 nt, Homo sapiens
gaagccugcugau

SEQ ID NO: 921188 - RNA, 14 nt, Homo sapiens
gaagccugcugauu

SEQ ID NO: 921189 - RNA, 16 nt, Homo sapiens
gaagccugcugauuuc

SEQ ID NO: 921190 - RNA, 16 nt, Homo sapiens
gaagcuuucaguauua

SEQ ID NO: 921191 - RNA, 18 nt, Homo sapiens
gaaggacaggacccucag

SEQ ID NO: 921192 - RNA, 15 nt, Homo sapiens
gaaguauugcuaaua

SEQ ID NO: 921193 - RNA, 20 nt, Homo sapiens
gaagucucaagaacugccau

SEQ ID NO: 921194 - RNA, 17 nt, Homo sapiens
gaagugggagugggaga

SEQ ID NO: 921195 - RNA, 21 nt, Homo sapiens
gaaguuugucaggcacaguaa

SEQ ID NO: 921196 - RNA, 20 nt, Homo sapiens
gaauacuuugaugauugcca

SEQ ID NO: 921197 - RNA, 22 nt, Homo sapiens
gaauauaagguuaagauaucau

SEQ ID NO: 921198 - RNA, 19 nt, Homo sapiens
gaaucccauggauguuucu

SEQ ID NO: 921199 - RNA, 18 nt, Homo sapiens
gaaucgaggcuguguguc

SEQ ID NO: 921200 - RNA, 15 nt, Homo sapiens
gaaugaaacaagcag

SEQ ID NO: 921201 - RNA, 13 nt, Homo sapiens
gaaugacccuguc

SEQ ID NO: 921202 - RNA, 14 nt, Homo sapiens
gaaugacccuguca

SEQ ID NO: 921203 - RNA, 21 nt, Homo sapiens
gaaugcucauauuaauguacu

SEQ ID NO: 921204 - RNA, 20 nt, Homo sapiens
gaauggcucacuauggugcc

SEQ ID NO: 921205 - RNA, 18 nt, Homo sapiens
gaauucuuaacauagcca

SEQ ID NO: 921206 - RNA, 23 nt, Homo sapiens
gaauuguuauacuagguuaacau

SEQ ID NO: 921207 - RNA, 21 nt, Homo sapiens
gaauuuagcuuauacaauuca

SEQ ID NO: 921208 - RNA, 12 nt, Homo sapiens
gacaagcacuuu

SEQ ID NO: 921209 - RNA, 23 nt, Homo sapiens
gacaagugggcagcauaaaguca

SEQ ID NO: 921210 - RNA, 16 nt, Homo sapiens
gacacauuugaaauca

SEQ ID NO: 921211 - RNA, 19 nt, Homo sapiens
gacaucccccuccuugccg

SEQ ID NO: 921212 - RNA, 20 nt, Homo sapiens
gacaucgcuggaaaugaaua

SEQ ID NO: 921213 - RNA, 23 nt, Homo sapiens
gacaucuaauucaagauuacaac

SEQ ID NO: 921214 - RNA, 12 nt, Homo sapiens
gacaucuucaau

SEQ ID NO: 921215 - RNA, 20 nt, Homo sapiens
gacauguauucccauugcac

SEQ ID NO: 921216 - RNA, 21 nt, Homo sapiens
gacauuucauauaaauggaau

SEQ ID NO: 921217 - RNA, 20 nt, Homo sapiens
gacauuugggacugucuuga

SEQ ID NO: 921218 - RNA, 22 nt, Homo sapiens
gacauuugggacugucuugaga

SEQ ID NO: 921219 - RNA, 13 nt, Homo sapiens
gacauuuuucaau

SEQ ID NO: 921220 - RNA, 16 nt, Homo sapiens
gaccaaaacuauucca

SEQ ID NO: 921221 - RNA, 22 nt, Homo sapiens
gaccaagcaggaagaacauuga

SEQ ID NO: 921222 - RNA, 17 nt, Homo sapiens
gacgauuucacugacac

SEQ ID NO: 921223 - RNA, 13 nt, Homo sapiens
gacgcagacugac

SEQ ID NO: 921224 - RNA, 20 nt, Homo sapiens
gacuauugcaauacauuucu

SEQ ID NO: 921225 - RNA, 15 nt, Homo sapiens
gacugaccugccccu

SEQ ID NO: 921226 - RNA, 14 nt, Homo sapiens
gacugagcccauga

SEQ ID NO: 921227 - RNA, 13 nt, Homo sapiens
gacuggcuuuguc

SEQ ID NO: 921228 - RNA, 18 nt, Homo sapiens
gacugugauuuauuugga

SEQ ID NO: 921229 - RNA, 22 nt, Homo sapiens
gacuguuauuuuuauuugcacu

SEQ ID NO: 921230 - RNA, 12 nt, Homo sapiens
gacuuggcagua

SEQ ID NO: 921231 - RNA, 19 nt, Homo sapiens
gagaaagagagaagccagc

SEQ ID NO: 921232 - RNA, 12 nt, Homo sapiens
gagaacugauga

SEQ ID NO: 921233 - RNA, 16 nt, Homo sapiens
gagaagccugugcccu

SEQ ID NO: 921234 - RNA, 14 nt, Homo sapiens
gagaauguguguag

SEQ ID NO: 921235 - RNA, 20 nt, Homo sapiens
gagacaggauuucacugugu

SEQ ID NO: 921236 - RNA, 21 nt, Homo sapiens
gagaccagcuucuagcagcua

SEQ ID NO: 921237 - RNA, 16 nt, Homo sapiens
gagaccuggaaccaga

SEQ ID NO: 921238 - RNA, 19 nt, Homo sapiens
gagacggagucucagucug

SEQ ID NO: 921239 - RNA, 13 nt, Homo sapiens
gagacuacaggug

SEQ ID NO: 921240 - RNA, 14 nt, Homo sapiens
gagagaacagggau

SEQ ID NO: 921241 - RNA, 16 nt, Homo sapiens
gagagaacagggaugc

SEQ ID NO: 921242 - RNA, 22 nt, Homo sapiens
gagagagcuuccuguuucuaag

SEQ ID NO: 921243 - RNA, 21 nt, Homo sapiens
gagagccaaggccuaugccac

SEQ ID NO: 921244 - RNA, 17 nt, Homo sapiens
gagagucucacuccccu

SEQ ID NO: 921245 - RNA, 22 nt, Homo sapiens
gagauuacaggugugagccacu

SEQ ID NO: 921246 - RNA, 13 nt, Homo sapiens
gagauugcaguga

SEQ ID NO: 921247 - RNA, 19 nt, Homo sapiens
gagcccaaaaacaagcaaa

SEQ ID NO: 921248 - RNA, 20 nt, Homo sapiens
gagcuuuggacgcacacagc

SEQ ID NO: 921249 - RNA, 16 nt, Homo sapiens
gaggcagaaccuggug

SEQ ID NO: 921250 - RNA, 13 nt, Homo sapiens
gaggcaguggcag

SEQ ID NO: 921251 - RNA, 16 nt, Homo sapiens
gaggcaguggcagcaa

SEQ ID NO: 921252 - RNA, 13 nt, Homo sapiens
gaggccacaggaa

SEQ ID NO: 921253 - RNA, 23 nt, Homo sapiens
gggaaaacccacccuaccacagu

SEQ ID NO: 921254 - RNA, 15 nt, Homo sapiens
gggacugagcccaug

SEQ ID NO: 921255 - RNA, 14 nt, Homo sapiens
gggacuuggcagua

SEQ ID NO: 921256 - RNA, 21 nt, Homo sapiens
gggagaucuuggggugcagca

SEQ ID NO: 921257 - RNA, 21 nt, Homo sapiens
gggaggacaaaggugauuuuc

SEQ ID NO: 921258 - RNA, 13 nt, Homo sapiens
gggccacagccag

SEQ ID NO: 921259 - RNA, 13 nt, Homo sapiens
gggccacuggcau

SEQ ID NO: 921260 - RNA, 21 nt, Homo sapiens
gggccuggggauguaaccaag

SEQ ID NO: 921261 - RNA, 17 nt, Homo sapiens
gggcucaggccauccag

SEQ ID NO: 921262 - RNA, 19 nt, Homo sapiens
gggcuuugauuccaucucc

SEQ ID NO: 921263 - RNA, 23 nt, Homo sapiens
ggggaaaagaagcacccagaccc

SEQ ID NO: 921264 - RNA, 14 nt, Homo sapiens
ggggcuuuugccac

SEQ ID NO: 921265 - RNA, 21 nt, Homo sapiens
ggguagguucugaacagcaga

SEQ ID NO: 921266 - RNA, 20 nt, Homo sapiens
gguaagagucacaauuugca

SEQ ID NO: 921267 - RNA, 14 nt, Homo sapiens
gguagacugugaca

SEQ ID NO: 921268 - RNA, 14 nt, Homo sapiens
ggucagugugccac

SEQ ID NO: 921269 - RNA, 20 nt, Homo sapiens
gguccucugauuucacauau

SEQ ID NO: 921270 - RNA, 18 nt, Homo sapiens
ggucgucaaugaugaguc

SEQ ID NO: 921271 - RNA, 18 nt, Homo sapiens
ggucuaaagugagcucua

SEQ ID NO: 921272 - RNA, 20 nt, Homo sapiens
ggucuguggccaguugacau

SEQ ID NO: 921273 - RNA, 17 nt, Homo sapiens
gguggagguugcaguga

SEQ ID NO: 921274 - RNA, 14 nt, Homo sapiens
gguguggcaguuac

SEQ ID NO: 921275 - RNA, 18 nt, Homo sapiens
gguuaaauaccuguguuc

SEQ ID NO: 921276 - RNA, 22 nt, Homo sapiens
gguucccagaaaacacauuucu

SEQ ID NO: 921277 - RNA, 23 nt, Homo sapiens
gguugauauauucuuuccaugca

SEQ ID NO: 921278 - RNA, 14 nt, Homo sapiens
gguuuaugcucaau

SEQ ID NO: 921279 - RNA, 18 nt, Homo sapiens
gguuuaugcucaauccau

SEQ ID NO: 921280 - RNA, 11 nt, Homo sapiens
gguuucacucc

SEQ ID NO: 921281 - RNA, 22 nt, Homo sapiens
gguuucuaacccacccucacga

SEQ ID NO: 921282 - RNA, 16 nt, Homo sapiens
gguuucuuauucaaag

SEQ ID NO: 921283 - RNA, 20 nt, Homo sapiens
gguuuggcuuccuauucuca

SEQ ID NO: 921284 - RNA, 17 nt, Homo sapiens
gguuuuuuaauugagau

SEQ ID NO: 921285 - RNA, 16 nt, Homo sapiens
gguuuuuuagugcaau

SEQ ID NO: 921286 - RNA, 17 nt, Homo sapiens
guaaaaggcacugcaca

SEQ ID NO: 921287 - RNA, 18 nt, Homo sapiens
guaaaauaucuaccugcc

SEQ ID NO: 921288 - RNA, 20 nt, Homo sapiens
guaaacagaaauccuuucau

SEQ ID NO: 921289 - RNA, 12 nt, Homo sapiens
guaaacagugag

SEQ ID NO: 921290 - RNA, 18 nt, Homo sapiens
guaaacuugaaagcaaga

SEQ ID NO: 921291 - RNA, 23 nt, Homo sapiens
guaaagccucagcaacagccagu

SEQ ID NO: 921292 - RNA, 22 nt, Homo sapiens
guaaauuaguguaccuauuaaa

SEQ ID NO: 921293 - RNA, 20 nt, Homo sapiens
guaacaugacacauuugaaa

SEQ ID NO: 921294 - RNA, 21 nt, Homo sapiens
guaaccaauaauguagcaguu

SEQ ID NO: 921295 - RNA, 23 nt, Homo sapiens
guaaccauaugcaguuuacuuug

SEQ ID NO: 921296 - RNA, 21 nt, Homo sapiens
guaacccuuuucaugauuuca

SEQ ID NO: 921297 - RNA, 17 nt, Homo sapiens
guaacguguuacuggaa

SEQ ID NO: 921298 - RNA, 12 nt, Homo sapiens
guaacugcauua

SEQ ID NO: 921299 - RNA, 23 nt, Homo sapiens
guaacuuccucuuaggauguuuc

SEQ ID NO: 921300 - RNA, 23 nt, Homo sapiens
guaaggacuugugccucuuggga

SEQ ID NO: 921301 - RNA, 16 nt, Homo sapiens
guaaguugaccuucuc

SEQ ID NO: 921302 - RNA, 20 nt, Homo sapiens
guaaucccagcuacuuggga

SEQ ID NO: 921303 - RNA, 19 nt, Homo sapiens
guaaucccaguacuuggga

SEQ ID NO: 921304 - RNA, 16 nt, Homo sapiens
guaauugaaacauuua

SEQ ID NO: 921305 - RNA, 17 nt, Homo sapiens
guaauuuaauaaacuga

SEQ ID NO: 921306 - RNA, 21 nt, Homo sapiens
guacagccuuuuauggaccaa

SEQ ID NO: 921307 - RNA, 22 nt, Homo sapiens
guacccaccugagcuuuggaca

SEQ ID NO: 921308 - RNA, 23 nt, Homo sapiens
guagacaucccccuccuugccgc

SEQ ID NO: 921309 - RNA, 14 nt, Homo sapiens
guagcaaauuccaa

SEQ ID NO: 921310 - RNA, 20 nt, Homo sapiens
guauaaagucccugauuuca

SEQ ID NO: 921311 - RNA, 22 nt, Homo sapiens
guauagaauauuauaguuuaaa

SEQ ID NO: 921312 - RNA, 21 nt, Homo sapiens
guaucucgaagucuuccauca

SEQ ID NO: 921313 - RNA, 14 nt, Homo sapiens
guaucuguguuaca

SEQ ID NO: 921314 - RNA, 15 nt, Homo sapiens
guaucuucacacucu

SEQ ID NO: 921315 - RNA, 18 nt, Homo sapiens
guaugauaaacaguugaa

SEQ ID NO: 921316 - RNA, 21 nt, Homo sapiens
guaugcucaauuauuuugcau

SEQ ID NO: 921317 - RNA, 20 nt, Homo sapiens
guauguauuauuuacauuua

SEQ ID NO: 921318 - RNA, 17 nt, Homo sapiens
guauuccugauaugccu

SEQ ID NO: 921319 - RNA, 16 nt, Homo sapiens
guauuuaaagcauuuu

SEQ ID NO: 921320 - RNA, 17 nt, Homo sapiens
gucaagcuucauuauua

SEQ ID NO: 921321 - RNA, 15 nt, Homo sapiens
gucacaaagcuaaau

SEQ ID NO: 921322 - RNA, 23 nt, Homo sapiens
gucacaggacgauuucacugaca

SEQ ID NO: 921323 - RNA, 21 nt, Homo sapiens
gucaccuuccucugccuuugu

SEQ ID NO: 921324 - RNA, 14 nt, Homo sapiens
gucauacaauccau

SEQ ID NO: 921325 - RNA, 19 nt, Homo sapiens
gucaugccaagcauuuaau

SEQ ID NO: 921326 - RNA, 18 nt, Homo sapiens
gucauggcauucgcagug

SEQ ID NO: 921327 - RNA, 11 nt, Homo sapiens
guccaguuuau

SEQ ID NO: 921328 - RNA, 23 nt, Homo sapiens
guccccaaaacacugucugcaua

SEQ ID NO: 921329 - RNA, 14 nt, Homo sapiens
guccccuuguucua

SEQ ID NO: 921330 - RNA, 18 nt, Homo sapiens
gucccuggggcuccugcu

SEQ ID NO: 921331 - RNA, 19 nt, Homo sapiens
guccuucaauuuucuucac

SEQ ID NO: 921332 - RNA, 16 nt, Homo sapiens
gucguugacuuuaggg

SEQ ID NO: 921333 - RNA, 23 nt, Homo sapiens
gucuaaaaauaaaaugcauuuaa

SEQ ID NO: 921334 - RNA, 13 nt, Homo sapiens
gucuaagaacuuc

SEQ ID NO: 921335 - RNA, 14 nt, Homo sapiens
gucuacaugugcca

SEQ ID NO: 921336 - RNA, 17 nt, Homo sapiens
gucuagcaaagccacca

SEQ ID NO: 921337 - RNA, 13 nt, Homo sapiens
gucucucauucuc

SEQ ID NO: 921338 - RNA, 24 nt, Homo sapiens
gucucucuugcuuuguucuuuauu

SEQ ID NO: 921339 - RNA, 13 nt, Homo sapiens
gucugcauaucca

SEQ ID NO: 921340 - RNA, 22 nt, Homo sapiens
gucugguaaauagguauuauau

SEQ ID NO: 921341 - RNA, 14 nt, Homo sapiens
gucuuaaucguccu

SEQ ID NO: 921342 - RNA, 18 nt, Homo sapiens
gucuuacucuuuguauga

SEQ ID NO: 921343 - RNA, 13 nt, Homo sapiens
gucuucuucaggg

SEQ ID NO: 921344 - RNA, 14 nt, Homo sapiens
gucuuguacuguga

SEQ ID NO: 921345 - RNA, 19 nt, Homo sapiens
gugaaaucccaucugcauu

SEQ ID NO: 921346 - RNA, 20 nt, Homo sapiens
gugacaaaaugauacuguga

SEQ ID NO: 921347 - RNA, 18 nt, Homo sapiens
gugacugcuuuuuugccu

SEQ ID NO: 921348 - RNA, 14 nt, Homo sapiens
gugaggaccugaca

SEQ ID NO: 921349 - RNA, 17 nt, Homo sapiens
gugaguuuuucuuuuga

SEQ ID NO: 921350 - RNA, 17 nt, Homo sapiens
gugaugucaucugucac

SEQ ID NO: 921351 - RNA, 15 nt, Homo sapiens
gugaugugccuacuc

SEQ ID NO: 921352 - RNA, 14 nt, Homo sapiens
gugauuauucugua

SEQ ID NO: 921353 - RNA, 18 nt, Homo sapiens
gugauuuucaaaaccagc

SEQ ID NO: 921354 - RNA, 10 nt, Homo sapiens
gugauuuucc

SEQ ID NO: 921355 - RNA, 21 nt, Homo sapiens
gugcaauacggaacacuguca

SEQ ID NO: 921356 - RNA, 12 nt, Homo sapiens
gugcagugccgc

SEQ ID NO: 921357 - RNA, 23 nt, Homo sapiens
gugcaugcuuuucucuugcuaau

SEQ ID NO: 921358 - RNA, 17 nt, Homo sapiens
gugcccagucaugacau

SEQ ID NO: 921359 - RNA, 15 nt, Homo sapiens
gugcccgaguagcau

SEQ ID NO: 921360 - RNA, 20 nt, Homo sapiens
gugccuauuuauucauucag

SEQ ID NO: 921361 - RNA, 13 nt, Homo sapiens
gugccucauuaag

SEQ ID NO: 921362 - RNA, 22 nt, Homo sapiens
gugcuaauaaaguuaaauugca

SEQ ID NO: 921363 - RNA, 16 nt, Homo sapiens
gugcuagccacuggaa

SEQ ID NO: 921364 - RNA, 21 nt, Homo sapiens
gugcugcuguggcaucaggaa

SEQ ID NO: 921365 - RNA, 21 nt, Homo sapiens
gugcugggauuacagguguga

SEQ ID NO: 921366 - RNA, 18 nt, Homo sapiens
guggaaaaaaaaagaaua

SEQ ID NO: 921367 - RNA, 20 nt, Homo sapiens
guggagacauauuucaguga

SEQ ID NO: 921368 - RNA, 21 nt, Homo sapiens
guggagcacaaaagccucuca

SEQ ID NO: 921369 - RNA, 15 nt, Homo sapiens
guggccaguugacau

SEQ ID NO: 921370 - RNA, 12 nt, Homo sapiens
gugucacaaagc

SEQ ID NO: 921371 - RNA, 19 nt, Homo sapiens
gugucauccaccagugugu

SEQ ID NO: 921372 - RNA, 22 nt, Homo sapiens
gugugcuucccaaauacauuaa

SEQ ID NO: 921373 - RNA, 22 nt, Homo sapiens
guguuguacaauaccagaucac

SEQ ID NO: 921374 - RNA, 21 nt, Homo sapiens
ucuuccuggaaugcauucacu

SEQ ID NO: 921375 - RNA, 12 nt, Homo sapiens
ucuucucaagca

SEQ ID NO: 921376 - RNA, 23 nt, Homo sapiens
ucuucucaagcacugacacucau

SEQ ID NO: 921377 - RNA, 23 nt, Homo sapiens
ucuucuuugacuauaacaaaauc

SEQ ID NO: 921378 - RNA, 13 nt, Homo sapiens
ucuugccuugucc

SEQ ID NO: 921379 - RNA, 13 nt, Homo sapiens
ucuuggagacaau

SEQ ID NO: 921380 - RNA, 17 nt, Homo sapiens
ucuugguuggucaggca

SEQ ID NO: 921381 - RNA, 21 nt, Homo sapiens
ucuuguacugugaccuaagaa

SEQ ID NO: 921382 - RNA, 17 nt, Homo sapiens
ucuuguagccagaauuc

SEQ ID NO: 921383 - RNA, 13 nt, Homo sapiens
ucuuuaaucacau

SEQ ID NO: 921384 - RNA, 21 nt, Homo sapiens
ucuuuagacaacccugaggua

SEQ ID NO: 921385 - RNA, 14 nt, Homo sapiens
ucuuuccuugucuc

SEQ ID NO: 921386 - RNA, 18 nt, Homo sapiens
ucuuugacuauaacaaaa

SEQ ID NO: 921387 - RNA, 16 nt, Homo sapiens
ucuuugagucaaguca

SEQ ID NO: 921388 - RNA, 17 nt, Homo sapiens
ucuuugggauaaccuuu

SEQ ID NO: 921389 - RNA, 22 nt, Homo sapiens
ucuuuuacuguggagguggcug

SEQ ID NO: 921390 - RNA, 12 nt, Homo sapiens
ucuuuugccuuu

SEQ ID NO: 921391 - RNA, 21 nt, Homo sapiens
ucuuuuggaaaguacuaugaa

SEQ ID NO: 921392 - RNA, 14 nt, Homo sapiens
ucuuuuucugucuc

SEQ ID NO: 921393 - RNA, 17 nt, Homo sapiens
ugaaaaucaacccaaua

SEQ ID NO: 921394 - RNA, 17 nt, Homo sapiens
ugaaaaugauguagaca

SEQ ID NO: 921395 - RNA, 17 nt, Homo sapiens
ugaaaauguccaggaaa

SEQ ID NO: 921396 - RNA, 13 nt, Homo sapiens
ugaaacagauucu

SEQ ID NO: 921397 - RNA, 15 nt, Homo sapiens
ugaaagaagcaagac

SEQ ID NO: 921398 - RNA, 16 nt, Homo sapiens
ugaaagcuaugaaugu

SEQ ID NO: 921399 - RNA, 17 nt, Homo sapiens
ugaaaggcuuuccucag

SEQ ID NO: 921400 - RNA, 18 nt, Homo sapiens
ugaaagucuccuguauca

SEQ ID NO: 921401 - RNA, 19 nt, Homo sapiens
ugaaaugggaacaauauca

SEQ ID NO: 921402 - RNA, 20 nt, Homo sapiens
ugaaaugggaacaauaucaa

SEQ ID NO: 921403 - RNA, 17 nt, Homo sapiens
ugaaauuaucauuggua

SEQ ID NO: 921404 - RNA, 15 nt, Homo sapiens
ugaacacaaagccug

SEQ ID NO: 921405 - RNA, 23 nt, Homo sapiens
ugaacacaggcaaugacugcgca

SEQ ID NO: 921406 - RNA, 14 nt, Homo sapiens
ugaagaaacauuua

SEQ ID NO: 921407 - RNA, 15 nt, Homo sapiens
ugaagacaugauucc

SEQ ID NO: 921408 - RNA, 18 nt, Homo sapiens
ugaagacccuugugcauu

SEQ ID NO: 921409 - RNA, 16 nt, Homo sapiens
ugaagauuuaaucuca

SEQ ID NO: 921410 - RNA, 14 nt, Homo sapiens
ugaagccauuugcc

SEQ ID NO: 921411 - RNA, 20 nt, Homo sapiens
ugaaggcaguggcaggggag

SEQ ID NO: 921412 - RNA, 22 nt, Homo sapiens
ugaaggugccacuccagugccc

SEQ ID NO: 921413 - RNA, 14 nt, Homo sapiens
ugaaguauugcuaa

SEQ ID NO: 921414 - RNA, 21 nt, Homo sapiens
ugaagucucaagaacugccau

SEQ ID NO: 921415 - RNA, 15 nt, Homo sapiens
ugaauacacaacucc

SEQ ID NO: 921416 - RNA, 19 nt, Homo sapiens
ugaauacagcauuuagcuu

SEQ ID NO: 921417 - RNA, 16 nt, Homo sapiens
ugaauaggaauauuca

SEQ ID NO: 921418 - RNA, 19 nt, Homo sapiens
ugaauauaugauuugcaug

SEQ ID NO: 921419 - RNA, 16 nt, Homo sapiens
ugaauguacauuuaau

SEQ ID NO: 921420 - RNA, 16 nt, Homo sapiens
ugacaggcuuucccag

SEQ ID NO: 921421 - RNA, 14 nt, Homo sapiens
ugacauaaugccaa

SEQ ID NO: 921422 - RNA, 17 nt, Homo sapiens
ugacaucuaauucaaga

SEQ ID NO: 921423 - RNA, 15 nt, Homo sapiens
ugacauggcaaguca

SEQ ID NO: 921424 - RNA, 22 nt, Homo sapiens
ugacauuuugccaaaauuauua

SEQ ID NO: 921425 - RNA, 17 nt, Homo sapiens
ugaccccuccccagugc

SEQ ID NO: 921426 - RNA, 16 nt, Homo sapiens
ugacccuaugaccaaa

SEQ ID NO: 921427 - RNA, 21 nt, Homo sapiens
ugaccuugaugucuugagagc

SEQ ID NO: 921428 - RNA, 14 nt, Homo sapiens
ugacgcguggucac

SEQ ID NO: 921429 - RNA, 19 nt, Homo sapiens
ugagaaauggcagucugcc

SEQ ID NO: 921430 - RNA, 20 nt, Homo sapiens
ugagaaauggcagucugccu

SEQ ID NO: 921431 - RNA, 21 nt, Homo sapiens
ugagaacagaucuccaaagcu

SEQ ID NO: 921432 - RNA, 22 nt, Homo sapiens
ugagaccuugucuccacaaaaa

SEQ ID NO: 921433 - RNA, 22 nt, Homo sapiens
ugagagaaagagagaagccagc

SEQ ID NO: 921434 - RNA, 20 nt, Homo sapiens
ugagagcccaaucacugccu

SEQ ID NO: 921435 - RNA, 14 nt, Homo sapiens
ugagauuacaggug

SEQ ID NO: 921436 - RNA, 13 nt, Homo sapiens
ugagcaccuguaa

SEQ ID NO: 921437 - RNA, 19 nt, Homo sapiens
ugagcuaaggcagccuuca

SEQ ID NO: 921438 - RNA, 22 nt, Homo sapiens
ugagcugauuuggucaccuucc

SEQ ID NO: 921439 - RNA, 17 nt, Homo sapiens
ugagcugguuugacuca

SEQ ID NO: 921440 - RNA, 19 nt, Homo sapiens
ugagcuuuggacacacaca

SEQ ID NO: 921441 - RNA, 15 nt, Homo sapiens
ugaggacaauccccc

SEQ ID NO: 921442 - RNA, 16 nt, Homo sapiens
ugaggcagaaccuggu

SEQ ID NO: 921443 - RNA, 23 nt, Homo sapiens
ugagggccaacgcuugacacaaa

SEQ ID NO: 921444 - RNA, 11 nt, Homo sapiens
ugaguaugugu

SEQ ID NO: 921445 - RNA, 18 nt, Homo sapiens
ugagucccuuccaggcca

SEQ ID NO: 921446 - RNA, 16 nt, Homo sapiens
ugagucuuguaauuaa

SEQ ID NO: 921447 - RNA, 20 nt, Homo sapiens
ugagugaaucugcauuuucu

SEQ ID NO: 921448 - RNA, 17 nt, Homo sapiens
ugagugaucccauuucu

SEQ ID NO: 921449 - RNA, 16 nt, Homo sapiens
ugauaaguuccaaaua

SEQ ID NO: 921450 - RNA, 21 nt, Homo sapiens
ugauaggagacuuguacaguu

SEQ ID NO: 921451 - RNA, 20 nt, Homo sapiens
ugauaguguuuuguacuugu

SEQ ID NO: 921452 - RNA, 16 nt, Homo sapiens
ugaugaaggauucaua

SEQ ID NO: 921453 - RNA, 23 nt, Homo sapiens
ugaugauguguuuaaacugagua

SEQ ID NO: 921454 - RNA, 15 nt, Homo sapiens
ugauguauacccaua

SEQ ID NO: 921455 - RNA, 16 nt, Homo sapiens
ugauugccauuucuuc

SEQ ID NO: 921456 - RNA, 16 nt, Homo sapiens
ugauuguaagucccau

SEQ ID NO: 921457 - RNA, 17 nt, Homo sapiens
ugauuuagaccaaaaga

SEQ ID NO: 921458 - RNA, 16 nt, Homo sapiens
ugauuuaucuaucacc

SEQ ID NO: 921459 - RNA, 23 nt, Homo sapiens
ugauuuuuugcugcagacucauc

SEQ ID NO: 921460 - RNA, 17 nt, Homo sapiens
ugcaaagggacauugaa

SEQ ID NO: 921461 - RNA, 22 nt, Homo sapiens
ugcaagauuccuuuccacucca

SEQ ID NO: 921462 - RNA, 13 nt, Homo sapiens
ugcaagucccaug

SEQ ID NO: 921463 - RNA, 15 nt, Homo sapiens
ugcaagucccaugau

SEQ ID NO: 921464 - RNA, 18 nt, Homo sapiens
ugcaaucacuuuuggaca

SEQ ID NO: 921465 - RNA, 19 nt, Homo sapiens
ugcacaaugcauugaaccg

SEQ ID NO: 921466 - RNA, 17 nt, Homo sapiens
ugcagaaggaaagaagg

SEQ ID NO: 921467 - RNA, 15 nt, Homo sapiens
ugcagaccugggacu

SEQ ID NO: 921468 - RNA, 16 nt, Homo sapiens
ugcagagagguuguga

SEQ ID NO: 921469 - RNA, 14 nt, Homo sapiens
ugcaggacacuggu

SEQ ID NO: 921470 - RNA, 14 nt, Homo sapiens
ugcaggguaggggg

SEQ ID NO: 921471 - RNA, 18 nt, Homo sapiens
ugcagucuuguacuguga

SEQ ID NO: 921472 - RNA, 17 nt, Homo sapiens
ugcaguggcaccaucuc

SEQ ID NO: 921473 - RNA, 21 nt, Homo sapiens
ugcaugcaaaauauacacuca

SEQ ID NO: 921474 - RNA, 15 nt, Homo sapiens
ugcauucaauuuaca

SEQ ID NO: 921475 - RNA, 21 nt, Homo sapiens
ugccaaagugucuacaugugc

SEQ ID NO: 921476 - RNA, 19 nt, Homo sapiens
ugccaacaguggcuaauaa

SEQ ID NO: 921477 - RNA, 13 nt, Homo sapiens
ugccaagaacucu

SEQ ID NO: 921478 - RNA, 20 nt, Homo sapiens
ugccaagggcagguugauca

SEQ ID NO: 921479 - RNA, 16 nt, Homo sapiens
ugccaccacucaagca

SEQ ID NO: 921480 - RNA, 17 nt, Homo sapiens
ugccauggaaccuuccc

SEQ ID NO: 921481 - RNA, 20 nt, Homo sapiens
ugcccagacucaaggccucc

SEQ ID NO: 921482 - RNA, 23 nt, Homo sapiens
ugcccagcaaggaccagugagac

SEQ ID NO: 921483 - RNA, 17 nt, Homo sapiens
ugcccagugauggcauu

SEQ ID NO: 921484 - RNA, 12 nt, Homo sapiens
ugcccauucucu

SEQ ID NO: 921485 - RNA, 23 nt, Homo sapiens
ugccccaaaucucaacuucucag

SEQ ID NO: 921486 - RNA, 12 nt, Homo sapiens
ugccccaccugc

SEQ ID NO: 921487 - RNA, 20 nt, Homo sapiens
ugccccaguguggucaagca

SEQ ID NO: 921488 - RNA, 15 nt, Homo sapiens
ugccccuuggcugcu

SEQ ID NO: 921489 - RNA, 22 nt, Homo sapiens
ugcccggccggagaacaucugc

SEQ ID NO: 921490 - RNA, 13 nt, Homo sapiens
ugcccucucucag

SEQ ID NO: 921491 - RNA, 18 nt, Homo sapiens
ugcccugauccaaguuua

SEQ ID NO: 921492 - RNA, 19 nt, Homo sapiens
ugcccugauccaaguuuac

SEQ ID NO: 921493 - RNA, 15 nt, Homo sapiens
ugcccugcucuucag

SEQ ID NO: 921494 - RNA, 18 nt, Homo sapiens
ugccgauaaccuguuuaa

SEQ ID NO: 921495 - RNA, 20 nt, Homo sapiens
ugccuacagagggauuuauu

SEQ ID NO: 921496 - RNA, 16 nt, Homo sapiens
aaaaacaccuaaguga

SEQ ID NO: 921497 - RNA, 12 nt, Homo sapiens
aaaaacuauucu

SEQ ID NO: 921498 - RNA, 12 nt, Homo sapiens
aaaaagacauuu

SEQ ID NO: 921499 - RNA, 16 nt, Homo sapiens
aaaaagacccuaucau

SEQ ID NO: 921500 - RNA, 16 nt, Homo sapiens
aaaaaguguauugcaa

SEQ ID NO: 921501 - RNA, 17 nt, Homo sapiens
aaaaauaaguacauaua

SEQ ID NO: 921502 - RNA, 13 nt, Homo sapiens
aaaaauaucugaa

SEQ ID NO: 921503 - RNA, 18 nt, Homo sapiens
aaaaaucaaucacuugaa

SEQ ID NO: 921504 - RNA, 15 nt, Homo sapiens
aaaaauuuauuauuu

SEQ ID NO: 921505 - RNA, 15 nt, Homo sapiens
aaaacaaaaccaagc

SEQ ID NO: 921506 - RNA, 18 nt, Homo sapiens
aaaacauugacuguggcu

SEQ ID NO: 921507 - RNA, 17 nt, Homo sapiens
aaaacauugcugccuaa

SEQ ID NO: 921508 - RNA, 12 nt, Homo sapiens
aaaacuauucca

SEQ ID NO: 921509 - RNA, 14 nt, Homo sapiens
aaaagguccuugac

SEQ ID NO: 921510 - RNA, 20 nt, Homo sapiens
aaaaguguauugcaagugaa

SEQ ID NO: 921511 - RNA, 18 nt, Homo sapiens
aaaaguuuaaaaagcuca

SEQ ID NO: 921512 - RNA, 19 nt, Homo sapiens
aaaauaaaaccaccaaagu

SEQ ID NO: 921513 - RNA, 13 nt, Homo sapiens
aaaauacuacaca

SEQ ID NO: 921514 - RNA, 15 nt, Homo sapiens
aaaauaguggccaga

SEQ ID NO: 921515 - RNA, 18 nt, Homo sapiens
aaaauaguguguccaugc

SEQ ID NO: 921516 - RNA, 18 nt, Homo sapiens
aaaaugagcuuccauuaa

SEQ ID NO: 921517 - RNA, 18 nt, Homo sapiens
aaaaugcuauauaaucug

SEQ ID NO: 921518 - RNA, 22 nt, Homo sapiens
aaacaaaagugcauaguuuaga

SEQ ID NO: 921519 - RNA, 20 nt, Homo sapiens
aaacagcucagccagugggg

SEQ ID NO: 921520 - RNA, 16 nt, Homo sapiens
aaacauauguucuccc

SEQ ID NO: 921521 - RNA, 18 nt, Homo sapiens
aaacauggccacauccaa

SEQ ID NO: 921522 - RNA, 14 nt, Homo sapiens
aaacauuuacuuuu

SEQ ID NO: 921523 - RNA, 16 nt, Homo sapiens
aaacauuuaucuuugu

SEQ ID NO: 921524 - RNA, 23 nt, Homo sapiens
aaaccacgccucuugaccaggcu

SEQ ID NO: 921525 - RNA, 17 nt, Homo sapiens
aaaccacuguacauaua

SEQ ID NO: 921526 - RNA, 20 nt, Homo sapiens
aaaccaucuaugugaauauu

SEQ ID NO: 921527 - RNA, 14 nt, Homo sapiens
aaacccagcaugua

SEQ ID NO: 921528 - RNA, 22 nt, Homo sapiens
aaacuacuauuuuucuuuccaa

SEQ ID NO: 921529 - RNA, 17 nt, Homo sapiens
aaacugaaagcuuuaau

SEQ ID NO: 921530 - RNA, 19 nt, Homo sapiens
aaagaaaauauaguuugau

SEQ ID NO: 921531 - RNA, 17 nt, Homo sapiens
aaagaaaauugccaaaa

SEQ ID NO: 921532 - RNA, 19 nt, Homo sapiens
aaagaaucucuugagacau

SEQ ID NO: 921533 - RNA, 11 nt, Homo sapiens
aaagacacaaa

SEQ ID NO: 921534 - RNA, 16 nt, Homo sapiens
aaagacccuaucauag

SEQ ID NO: 921535 - RNA, 17 nt, Homo sapiens
aaagagaagcugugucu

SEQ ID NO: 921536 - RNA, 23 nt, Homo sapiens
aaagccagcauuuccucagucuc

SEQ ID NO: 921537 - RNA, 22 nt, Homo sapiens
aaagccucagcaacagccagug

SEQ ID NO: 921538 - RNA, 16 nt, Homo sapiens
aaagcguuuggaaaac

SEQ ID NO: 921539 - RNA, 12 nt, Homo sapiens
aaagcugugaaa

SEQ ID NO: 921540 - RNA, 13 nt, Homo sapiens
aaaggaagaugua

SEQ ID NO: 921541 - RNA, 13 nt, Homo sapiens
aaaggaauggccu

SEQ ID NO: 921542 - RNA, 14 nt, Homo sapiens
aaaggacaaaaaua

SEQ ID NO: 921543 - RNA, 16 nt, Homo sapiens
aaaggacaaaaauaua

SEQ ID NO: 921544 - RNA, 18 nt, Homo sapiens
aaaggucccuccccagac

SEQ ID NO: 921545 - RNA, 22 nt, Homo sapiens
aaaggugugucaaagauuuuac

SEQ ID NO: 921546 - RNA, 19 nt, Homo sapiens
aaaguaaaaacacuaccuc

SEQ ID NO: 921547 - RNA, 15 nt, Homo sapiens
aaaguauucuagugu

SEQ ID NO: 921548 - RNA, 20 nt, Homo sapiens
aaagugcugagauuacaggu

SEQ ID NO: 921549 - RNA, 20 nt, Homo sapiens
aaagugcugggauuacaggu

SEQ ID NO: 921550 - RNA, 20 nt, Homo sapiens
aaaguggcuuucaacuucaa

SEQ ID NO: 921551 - RNA, 16 nt, Homo sapiens
aaaguuuaagcaauuc

SEQ ID NO: 921552 - RNA, 15 nt, Homo sapiens
aaaguuuuaaccuca

SEQ ID NO: 921553 - RNA, 17 nt, Homo sapiens
aaauaaaaccaccaaag

SEQ ID NO: 921554 - RNA, 18 nt, Homo sapiens
aaauaaaaccaccaaagu

SEQ ID NO: 921555 - RNA, 16 nt, Homo sapiens
aaauauaagagcaaga

SEQ ID NO: 921556 - RNA, 13 nt, Homo sapiens
aaauaugugauua

SEQ ID NO: 921557 - RNA, 22 nt, Homo sapiens
aaauauuuaaaaaaaaacauuc

SEQ ID NO: 921558 - RNA, 16 nt, Homo sapiens
aaaucauuaacacuuu

SEQ ID NO: 921559 - RNA, 16 nt, Homo sapiens
aaaucccaaauucucc

SEQ ID NO: 921560 - RNA, 16 nt, Homo sapiens
cauuucuucugcacaa

SEQ ID NO: 921561 - RNA, 21 nt, Homo sapiens
cauuugaagacccuugugcau

SEQ ID NO: 921562 - RNA, 19 nt, Homo sapiens
cauuuggaaugaauacagc

SEQ ID NO: 921563 - RNA, 17 nt, Homo sapiens
cauuuugaaugaagugu

SEQ ID NO: 921564 - RNA, 20 nt, Homo sapiens
cauuuuguauguauguguag

SEQ ID NO: 921565 - RNA, 19 nt, Homo sapiens
cauuuugugucugugaaca

SEQ ID NO: 921566 - RNA, 14 nt, Homo sapiens
cauuuuucaauaaa

SEQ ID NO: 921567 - RNA, 15 nt, Homo sapiens
ccaaaggaagcuuuc

SEQ ID NO: 921568 - RNA, 18 nt, Homo sapiens
ccaaagugcugagauuac

SEQ ID NO: 921569 - RNA, 22 nt, Homo sapiens
ccaaagugcugagauuacaggu

SEQ ID NO: 921570 - RNA, 18 nt, Homo sapiens
ccaaaucucaacuucuca

SEQ ID NO: 921571 - RNA, 20 nt, Homo sapiens
ccaaauugaugggugggcua

SEQ ID NO: 921572 - RNA, 17 nt, Homo sapiens
ccaaccaaagggggaca

SEQ ID NO: 921573 - RNA, 21 nt, Homo sapiens
ccaacguuccacaacaguccc

SEQ ID NO: 921574 - RNA, 19 nt, Homo sapiens
ccaacugcucucaaaaugu

SEQ ID NO: 921575 - RNA, 17 nt, Homo sapiens
ccaacuguuucccugcu

SEQ ID NO: 921576 - RNA, 17 nt, Homo sapiens
ccaacuuaaguuuagaa

SEQ ID NO: 921577 - RNA, 15 nt, Homo sapiens
ccaagaaaguccagu

SEQ ID NO: 921578 - RNA, 22 nt, Homo sapiens
ccaagaccugacucaggcauca

SEQ ID NO: 921579 - RNA, 20 nt, Homo sapiens
aacaauguuaaaugcaauug

SEQ ID NO: 921580 - RNA, 14 nt, Homo sapiens
aacacauggcuucc

SEQ ID NO: 921581 - RNA, 15 nt, Homo sapiens
aacacugcagcauuu

SEQ ID NO: 921582 - RNA, 22 nt, Homo sapiens
aacacugucaauggacugcacc

SEQ ID NO: 921583 - RNA, 14 nt, Homo sapiens
aacagaaauuguau

SEQ ID NO: 921584 - RNA, 16 nt, Homo sapiens
aacagcagaaacccau

SEQ ID NO: 921585 - RNA, 18 nt, Homo sapiens
aacagguaaacagaaauc

SEQ ID NO: 921586 - RNA, 21 nt, Homo sapiens
aacaucugccuugcugcaccu

SEQ ID NO: 921587 - RNA, 18 nt, Homo sapiens
aacaucuguuacauucua

SEQ ID NO: 921588 - RNA, 17 nt, Homo sapiens
aacauggccacauccaa

SEQ ID NO: 921589 - RNA, 13 nt, Homo sapiens
aacauucugucau

SEQ ID NO: 921590 - RNA, 15 nt, Homo sapiens
aacauucugucauca

SEQ ID NO: 921591 - RNA, 23 nt, Homo sapiens
aacauuugaagacccuugugcau

SEQ ID NO: 921592 - RNA, 13 nt, Homo sapiens
aaccaaacggaac

SEQ ID NO: 921593 - RNA, 17 nt, Homo sapiens
aaccaagcuguacccuu

SEQ ID NO: 921594 - RNA, 22 nt, Homo sapiens
aaccaagcuguacccuugagac

SEQ ID NO: 921595 - RNA, 15 nt, Homo sapiens
aaccacuguacauau

SEQ ID NO: 921596 - RNA, 16 nt, Homo sapiens
aaccagagccacaggc

SEQ ID NO: 921597 - RNA, 13 nt, Homo sapiens
aaccaugaacuca

SEQ ID NO: 921598 - RNA, 17 nt, Homo sapiens
aaccaugaacucagcua

SEQ ID NO: 921599 - RNA, 19 nt, Homo sapiens
aacccagaagauguauuca

SEQ ID NO: 921600 - RNA, 23 nt, Homo sapiens
aacccaggucuugacaccagcug

SEQ ID NO: 921601 - RNA, 22 nt, Homo sapiens
aaccccucuuagcuuacaggaa

SEQ ID NO: 921602 - RNA, 21 nt, Homo sapiens
aacccuccaggccucaguuuc

SEQ ID NO: 921603 - RNA, 23 nt, Homo sapiens
aacccuguuuuauugaguucuga

SEQ ID NO: 921604 - RNA, 13 nt, Homo sapiens
aacccuuucuuca

SEQ ID NO: 921605 - RNA, 23 nt, Homo sapiens
aacccuuucuucaauacaaaaag

SEQ ID NO: 921606 - RNA, 18 nt, Homo sapiens
aaccgaguaucuggccuu

SEQ ID NO: 921607 - RNA, 22 nt, Homo sapiens
aaccgaugguccucacaagccu

SEQ ID NO: 921608 - RNA, 23 nt, Homo sapiens
aaccgcuacaagagggcaaagcu

SEQ ID NO: 921609 - RNA, 17 nt, Homo sapiens
aaccuaaaaaucaauca

SEQ ID NO: 921610 - RNA, 12 nt, Homo sapiens
aaccuaccugug

SEQ ID NO: 921611 - RNA, 14 nt, Homo sapiens
aaccuccaccuccc

SEQ ID NO: 921612 - RNA, 20 nt, Homo sapiens
aaccuccaccucccagguuc

SEQ ID NO: 921613 - RNA, 17 nt, Homo sapiens
aaccuccuccuccaguu

SEQ ID NO: 921614 - RNA, 21 nt, Homo sapiens
aaccuccuuucucuucucugu

SEQ ID NO: 921615 - RNA, 16 nt, Homo sapiens
aaccucuaacccaggu

SEQ ID NO: 921616 - RNA, 21 nt, Homo sapiens
aaccuucucuuuuauaaucug

SEQ ID NO: 921617 - RNA, 22 nt, Homo sapiens
aacgccacguguaguggcucau

SEQ ID NO: 921618 - RNA, 17 nt, Homo sapiens
aacuccacugucuuuaa

SEQ ID NO: 921619 - RNA, 20 nt, Homo sapiens
aacuccaucugcugccauga

SEQ ID NO: 921620 - RNA, 13 nt, Homo sapiens
aacuccuagacuc

SEQ ID NO: 921621 - RNA, 10 nt, Homo sapiens
aacuccuucc

SEQ ID NO: 921622 - RNA, 18 nt, Homo sapiens
aacucgccccccuacccc

SEQ ID NO: 921623 - RNA, 19 nt, Homo sapiens
aacucugauuaugaauaca

SEQ ID NO: 921624 - RNA, 22 nt, Homo sapiens
aacucuuccuggaaugcauuca

SEQ ID NO: 921625 - RNA, 15 nt, Homo sapiens
aacugaaagcuuuaa

SEQ ID NO: 921626 - RNA, 18 nt, Homo sapiens
aacugaucauuugcagcu

SEQ ID NO: 921627 - RNA, 21 nt, Homo sapiens
aacugucagaauaaagaacau

SEQ ID NO: 921628 - RNA, 16 nt, Homo sapiens
aacuguuucccugcug

SEQ ID NO: 921629 - RNA, 16 nt, Homo sapiens
aacuuauucuacugaa

SEQ ID NO: 921630 - RNA, 18 nt, Homo sapiens
aacuucagauacuuguga

SEQ ID NO: 921631 - RNA, 17 nt, Homo sapiens
aacuugaauacuuugag

SEQ ID NO: 921632 - RNA, 23 nt, Homo sapiens
aacuuuuagugggugagaaauuu

SEQ ID NO: 921633 - RNA, 15 nt, Homo sapiens
aagaaaaauaaucuu

SEQ ID NO: 921634 - RNA, 15 nt, Homo sapiens
aagaaaugcauaaaa

SEQ ID NO: 921635 - RNA, 18 nt, Homo sapiens
aagaaauggcauaaucuu

SEQ ID NO: 921636 - RNA, 14 nt, Homo sapiens
aagaacaacacuaa

SEQ ID NO: 921637 - RNA, 15 nt, Homo sapiens
aagaacugccauaaa

SEQ ID NO: 921638 - RNA, 18 nt, Homo sapiens
aagaagcuuucaguauua

SEQ ID NO: 921639 - RNA, 18 nt, Homo sapiens
aagacaaaccacuguaca

SEQ ID NO: 921640 - RNA, 17 nt, Homo sapiens
aagaccucccaagcugu

SEQ ID NO: 921641 - RNA, 12 nt, Homo sapiens
aagacgcccucu

SEQ ID NO: 921642 - RNA, 12 nt, Homo sapiens
aagagaaggcaa

SEQ ID NO: 921643 - RNA, 21 nt, Homo sapiens
aagagcugccuggaugagaaa

SEQ ID NO: 921644 - RNA, 17 nt, Homo sapiens
aagaugguuaagucaau

SEQ ID NO: 921645 - RNA, 18 nt, Homo sapiens
aagauuucuuaaugcuau

SEQ ID NO: 921646 - RNA, 14 nt, Homo sapiens
aagcaaccaugaac

SEQ ID NO: 921647 - RNA, 13 nt, Homo sapiens
aagcaacuggaaa

SEQ ID NO: 921648 - RNA, 18 nt, Homo sapiens
aagcacaaacuucuguaa

SEQ ID NO: 921649 - RNA, 21 nt, Homo sapiens
aagcacacggagacgugauga

SEQ ID NO: 921650 - RNA, 21 nt, Homo sapiens
aagcaggaagaacauugauuu

SEQ ID NO: 921651 - RNA, 17 nt, Homo sapiens
aagcagucuuuuucuac

SEQ ID NO: 921652 - RNA, 23 nt, Homo sapiens
aagcauccauuaauuaaugagac

SEQ ID NO: 921653 - RNA, 12 nt, Homo sapiens
aagcaugcugag

SEQ ID NO: 921654 - RNA, 20 nt, Homo sapiens
aagcauugccagcucuucca

SEQ ID NO: 921655 - RNA, 17 nt, Homo sapiens
aagccaggaaagcguuu

SEQ ID NO: 921656 - RNA, 13 nt, Homo sapiens
aagccaugcugcu

SEQ ID NO: 921657 - RNA, 20 nt, Homo sapiens
aagccaugcugcuuugcaca

SEQ ID NO: 921658 - RNA, 14 nt, Homo sapiens
aagccguuggcacc

SEQ ID NO: 921659 - RNA, 18 nt, Homo sapiens
aagccugcugauuucuac

SEQ ID NO: 921660 - RNA, 13 nt, Homo sapiens
aagcuaauuccac

SEQ ID NO: 921661 - RNA, 13 nt, Homo sapiens
aagcuaccaaaaa

SEQ ID NO: 921662 - RNA, 18 nt, Homo sapiens
aagcugugaugugccuac

SEQ ID NO: 921663 - RNA, 15 nt, Homo sapiens
aaggaaaaaagcaag

SEQ ID NO: 921664 - RNA, 19 nt, Homo sapiens
aaggaaaucuccucuuuug

SEQ ID NO: 921665 - RNA, 23 nt, Homo sapiens
aaggagagguuggggacacgcac

SEQ ID NO: 921666 - RNA, 23 nt, Homo sapiens
aaggccugucccuggccaucucu

SEQ ID NO: 921667 - RNA, 20 nt, Homo sapiens
aagggaagccgccuuugcaa

SEQ ID NO: 921668 - RNA, 15 nt, Homo sapiens
aagggggacagugau

SEQ ID NO: 921669 - RNA, 17 nt, Homo sapiens
aaggggugccugggaac

SEQ ID NO: 921670 - RNA, 22 nt, Homo sapiens
aagguauugcaaggucacuuug

SEQ ID NO: 921671 - RNA, 20 nt, Homo sapiens
aaggucuagacuaguuacau

SEQ ID NO: 921672 - RNA, 14 nt, Homo sapiens
aaggugauuuuccu

SEQ ID NO: 921673 - RNA, 22 nt, Homo sapiens
aaggugcacugagaagcaauca

SEQ ID NO: 921674 - RNA, 20 nt, Homo sapiens
aagguuucacuguucaugaa

SEQ ID NO: 921675 - RNA, 20 nt, Homo sapiens
aaguaaaaacacuaccucuu

SEQ ID NO: 921676 - RNA, 23 nt, Homo sapiens
aaguaaaaacacuaccucuuuug

SEQ ID NO: 921677 - RNA, 20 nt, Homo sapiens
aaguaaacugcccugucuag

SEQ ID NO: 921678 - RNA, 23 nt, Homo sapiens
aaguaacaaugcaugcuuuggaa

SEQ ID NO: 921679 - RNA, 13 nt, Homo sapiens
aaguauuguuaau

SEQ ID NO: 921680 - RNA, 21 nt, Homo sapiens
aagucaaauuuggauuuucca

SEQ ID NO: 921681 - RNA, 21 nt, Homo sapiens
gucagcuuuacuagugccaaa

SEQ ID NO: 921682 - RNA, 21 nt, Homo sapiens
gucaguaacuuacccuuaggg

SEQ ID NO: 921683 - RNA, 14 nt, Homo sapiens
gucccagcuaccca

SEQ ID NO: 921684 - RNA, 19 nt, Homo sapiens
guccccgcucagucuuuga

SEQ ID NO: 921685 - RNA, 15 nt, Homo sapiens
guccuaagcccacaa

SEQ ID NO: 921686 - RNA, 18 nt, Homo sapiens
gucucgaagcaguauucu

SEQ ID NO: 921687 - RNA, 21 nt, Homo sapiens
gucucucauucucuuucuuuu

SEQ ID NO: 921688 - RNA, 17 nt, Homo sapiens
gucuucauccuuagcaa

SEQ ID NO: 921689 - RNA, 19 nt, Homo sapiens
gucuuuaaaagucauucaa

SEQ ID NO: 921690 - RNA, 14 nt, Homo sapiens
gugaaaacagcagc

SEQ ID NO: 921691 - RNA, 22 nt, Homo sapiens
gugaacaaucagcggcauuuag

SEQ ID NO: 921692 - RNA, 21 nt, Homo sapiens
gugaagagcagugagcagggu

SEQ ID NO: 921693 - RNA, 16 nt, Homo sapiens
gugaauuagcucacuu

SEQ ID NO: 921694 - RNA, 12 nt, Homo sapiens
gugaccaugcaa

SEQ ID NO: 921695 - RNA, 21 nt, Homo sapiens
gugaccccuccccagugccuc

SEQ ID NO: 921696 - RNA, 19 nt, Homo sapiens
gugacuaaacuacauuaua

SEQ ID NO: 921697 - RNA, 20 nt, Homo sapiens
gugacuucuaguccaaauau

SEQ ID NO: 921698 - RNA, 23 nt, Homo sapiens
gugagagaaagagagaagccagc

SEQ ID NO: 921699 - RNA, 13 nt, Homo sapiens
gugagccacugug

SEQ ID NO: 921700 - RNA, 15 nt, Homo sapiens
gugauguguuuccau

SEQ ID NO: 921701 - RNA, 14 nt, Homo sapiens
gugcaagcaaagaa

SEQ ID NO: 921702 - RNA, 18 nt, Homo sapiens
gugcagaugccugcagug

SEQ ID NO: 921703 - RNA, 14 nt, Homo sapiens
gugcaggacacugg

SEQ ID NO: 921704 - RNA, 20 nt, Homo sapiens
gugcaguggcaccaucucag

SEQ ID NO: 921705 - RNA, 22 nt, Homo sapiens
gugcaugaggaucaguuugcag

SEQ ID NO: 921706 - RNA, 22 nt, Homo sapiens
gugcccacccgucuucaaucuc

SEQ ID NO: 921707 - RNA, 13 nt, Homo sapiens
gugccugugacuc

SEQ ID NO: 921708 - RNA, 13 nt, Homo sapiens
gugcuagccacug

SEQ ID NO: 921709 - RNA, 18 nt, Homo sapiens
gugcugagauuacaggug

SEQ ID NO: 921710 - RNA, 19 nt, Homo sapiens
gugcugggauuacaggugu

SEQ ID NO: 921711 - RNA, 17 nt, Homo sapiens
gugcuguuuuuaaucca

SEQ ID NO: 921712 - RNA, 15 nt, Homo sapiens
guggagguugcagug

SEQ ID NO: 921713 - RNA, 14 nt, Homo sapiens
guggcaaaugccag

SEQ ID NO: 921714 - RNA, 21 nt, Homo sapiens
cagaucacucaaaaaggugug

SEQ ID NO: 921715 - RNA, 18 nt, Homo sapiens
cagaugccuccucugucc

SEQ ID NO: 921716 - RNA, 23 nt, Homo sapiens
cagauggcugugaaaauuacacc

SEQ ID NO: 921717 - RNA, 22 nt, Homo sapiens
cagauuugauuuuugcuuucuu

SEQ ID NO: 921718 - RNA, 13 nt, Homo sapiens
cagcaaaugagau

SEQ ID NO: 921719 - RNA, 21 nt, Homo sapiens
cagcaaccuguaagacugaua

SEQ ID NO: 921720 - RNA, 18 nt, Homo sapiens
cagcaccaugggccuucu

SEQ ID NO: 921721 - RNA, 18 nt, Homo sapiens
cagcauccuccacgggcu

SEQ ID NO: 921722 - RNA, 12 nt, Homo sapiens
cagccaugagaa

SEQ ID NO: 921723 - RNA, 12 nt, Homo sapiens
cagccucccacc

SEQ ID NO: 921724 - RNA, 19 nt, Homo sapiens
cagcuauaccucauucaca

SEQ ID NO: 921725 - RNA, 14 nt, Homo sapiens
cagcucagccagug

SEQ ID NO: 921726 - RNA, 16 nt, Homo sapiens
cagcuguggcuucuag

SEQ ID NO: 921727 - RNA, 22 nt, Homo sapiens
cagcuguggcuucuaggugccc

SEQ ID NO: 921728 - RNA, 16 nt, Homo sapiens
cagcuuggggcagcca

SEQ ID NO: 921729 - RNA, 16 nt, Homo sapiens
cagcuuguaaauuaca

SEQ ID NO: 921730 - RNA, 23 nt, Homo sapiens
cagcuuuuaguacccaccugagc

SEQ ID NO: 921731 - RNA, 22 nt, Homo sapiens
caggacagcugcaggugcccau

SEQ ID NO: 921732 - RNA, 20 nt, Homo sapiens
caggacgccuggagaagggu

SEQ ID NO: 921733 - RNA, 19 nt, Homo sapiens
caggagcauuuugugucuu

SEQ ID NO: 921734 - RNA, 21 nt, Homo sapiens
caggaggagggcgcaugugug

SEQ ID NO: 921735 - RNA, 15 nt, Homo sapiens
caggaucacagcuca

SEQ ID NO: 921736 - RNA, 12 nt, Homo sapiens
caggauugaaaa

SEQ ID NO: 921737 - RNA, 18 nt, Homo sapiens
caggcccaauucugccac

SEQ ID NO: 921738 - RNA, 19 nt, Homo sapiens
caggcugagugcacuggca

SEQ ID NO: 921739 - RNA, 18 nt, Homo sapiens
caggcuggucuugaacuc

SEQ ID NO: 921740 - RNA, 16 nt, Homo sapiens
cagggcccucuggggc

SEQ ID NO: 921741 - RNA, 15 nt, Homo sapiens
caggguccugugccu

SEQ ID NO: 921742 - RNA, 22 nt, Homo sapiens
cagguaggaugaacacaggcaa

SEQ ID NO: 921743 - RNA, 21 nt, Homo sapiens
caggucuugacaccagcuguu

SEQ ID NO: 921744 - RNA, 18 nt, Homo sapiens
caguagguagacacaaac

SEQ ID NO: 921745 - RNA, 17 nt, Homo sapiens
caguauuauguacucua

SEQ ID NO: 921746 - RNA, 22 nt, Homo sapiens
cagucccuaucagcgccuccuu

SEQ ID NO: 921747 - RNA, 18 nt, Homo sapiens
cagugauuuucaaaacca

SEQ ID NO: 921748 - RNA, 14 nt, Homo sapiens
caguuaaaggcaac

SEQ ID NO: 921749 - RNA, 12 nt, Homo sapiens
caguuacagggc

SEQ ID NO: 921750 - RNA, 15 nt, Homo sapiens
caguuauuucaaaaa

SEQ ID NO: 921751 - RNA, 17 nt, Homo sapiens
caguucauguugcucag

SEQ ID NO: 921752 - RNA, 22 nt, Homo sapiens
caguuuaugagaaugacccugu

SEQ ID NO: 921753 - RNA, 16 nt, Homo sapiens
caguuuuuaacauaau

SEQ ID NO: 921754 - RNA, 17 nt, Homo sapiens
cauaaaacaaaaccaag

SEQ ID NO: 921755 - RNA, 19 nt, Homo sapiens
cauaaaacuucugauuucu

SEQ ID NO: 921756 - RNA, 21 nt, Homo sapiens
cauaaaagacaagcacuuugg

SEQ ID NO: 921757 - RNA, 19 nt, Homo sapiens
cauaaaauauauaggauua

SEQ ID NO: 921758 - RNA, 16 nt, Homo sapiens
cauaaagguuuacagu

SEQ ID NO: 921759 - RNA, 20 nt, Homo sapiens
cauaccuguuguacacuugg

SEQ ID NO: 921760 - RNA, 20 nt, Homo sapiens
cauagauagaaugaaccaau

SEQ ID NO: 921761 - RNA, 16 nt, Homo sapiens
cauagcuccugcucca

SEQ ID NO: 921762 - RNA, 13 nt, Homo sapiens
cauauacauauga

SEQ ID NO: 921763 - RNA, 24 nt, Homo sapiens
cauauauaauuuuauugcuggaau

SEQ ID NO: 921764 - RNA, 22 nt, Homo sapiens
cauauuaauugguuugugccuu

SEQ ID NO: 921765 - RNA, 13 nt, Homo sapiens
caucaauucucua

SEQ ID NO: 921766 - RNA, 16 nt, Homo sapiens
caucaauucucuauca

SEQ ID NO: 921767 - RNA, 19 nt, Homo sapiens
caucaccccgugaagcaau

SEQ ID NO: 921768 - RNA, 11 nt, Homo sapiens
caucaccugcg

SEQ ID NO: 921769 - RNA, 20 nt, Homo sapiens
caucuacagaccugcggcuu

SEQ ID NO: 921770 - RNA, 15 nt, Homo sapiens
caucuggacacuggg

SEQ ID NO: 921771 - RNA, 16 nt, Homo sapiens
caucuggacacugggc

SEQ ID NO: 921772 - RNA, 13 nt, Homo sapiens
caugaauacacaa

SEQ ID NO: 921773 - RNA, 20 nt, Homo sapiens
caugaauuaagaacugacac

SEQ ID NO: 921774 - RNA, 22 nt, Homo sapiens
caugaauucuggucacauucca

SEQ ID NO: 921775 - RNA, 19 nt, Homo sapiens
caugacacauuugaaauca

SEQ ID NO: 921776 - RNA, 13 nt, Homo sapiens
caugcacuacuga

SEQ ID NO: 921777 - RNA, 21 nt, Homo sapiens
cauggcaagucaguggggaca

SEQ ID NO: 921778 - RNA, 17 nt, Homo sapiens
cauggcucugaacugca

SEQ ID NO: 921779 - RNA, 19 nt, Homo sapiens
cauggcucugaacugcaca

SEQ ID NO: 921780 - RNA, 20 nt, Homo sapiens
cauggcucugaacugcacaa

SEQ ID NO: 921781 - RNA, 16 nt, Homo sapiens
caugguaagagucaca

SEQ ID NO: 921782 - RNA, 17 nt, Homo sapiens
caugguagacugugaca

SEQ ID NO: 921783 - RNA, 22 nt, Homo sapiens
caugguagacugugacacagcu

SEQ ID NO: 921784 - RNA, 22 nt, Homo sapiens
caugguggugagcaccuguaau

SEQ ID NO: 921785 - RNA, 19 nt, Homo sapiens
caugucauuucagaaguua

SEQ ID NO: 921786 - RNA, 19 nt, Homo sapiens
cauguguuguacaauacca

SEQ ID NO: 921787 - RNA, 15 nt, Homo sapiens
cauuaaaugcaaaaa

SEQ ID NO: 921788 - RNA, 14 nt, Homo sapiens
cauuaaaugcuuug

SEQ ID NO: 921789 - RNA, 17 nt, Homo sapiens
cauuaauauauccuaaa

SEQ ID NO: 921790 - RNA, 12 nt, Homo sapiens
cauuacucugca

SEQ ID NO: 921791 - RNA, 23 nt, Homo sapiens
cauuacucugcacuauagccauu

SEQ ID NO: 921792 - RNA, 21 nt, Homo sapiens
cauuauuacuccuugccauuu

SEQ ID NO: 921793 - RNA, 17 nt, Homo sapiens
cauuauuggacuuccau

SEQ ID NO: 921794 - RNA, 15 nt, Homo sapiens
cauucaccaaccaaa

SEQ ID NO: 921795 - RNA, 21 nt, Homo sapiens
cauucagugagacacagagug

SEQ ID NO: 921796 - RNA, 12 nt, Homo sapiens
cauuccauuugc

SEQ ID NO: 921797 - RNA, 20 nt, Homo sapiens
cauucgcagugcccagugau

SEQ ID NO: 921798 - RNA, 15 nt, Homo sapiens
cauucuaaaccaaaa

SEQ ID NO: 921799 - RNA, 15 nt, Homo sapiens
cauucucucugaaca

SEQ ID NO: 921800 - RNA, 14 nt, Homo sapiens
cauucugcucccag

SEQ ID NO: 921801 - RNA, 16 nt, Homo sapiens
cauucuggaugggcuu

SEQ ID NO: 921802 - RNA, 20 nt, Homo sapiens
uaaguuaccuuucuagguca

SEQ ID NO: 921803 - RNA, 13 nt, Homo sapiens
uaaguuuuugcca

SEQ ID NO: 921804 - RNA, 16 nt, Homo sapiens
uaauaaucauuuuaga

SEQ ID NO: 921805 - RNA, 23 nt, Homo sapiens
uaauacauggcuaucaucaaaag

SEQ ID NO: 921806 - RNA, 14 nt, Homo sapiens
uaauaccaccaaca

SEQ ID NO: 921807 - RNA, 16 nt, Homo sapiens
uaauauguauuuguug

SEQ ID NO: 921808 - RNA, 17 nt, Homo sapiens
uaaucauaaaggacaag

SEQ ID NO: 921809 - RNA, 24 nt, Homo sapiens
uaauccaguuuagaaaguaacuua

SEQ ID NO: 921810 - RNA, 12 nt, Homo sapiens
uaauccaugugc

SEQ ID NO: 921811 - RNA, 19 nt, Homo sapiens
uaaucuuucuccacuguuc

SEQ ID NO: 921812 - RNA, 18 nt, Homo sapiens
uaaugacguauugugaaa

SEQ ID NO: 921813 - RNA, 15 nt, Homo sapiens
uaauguaacuuccuc

SEQ ID NO: 921814 - RNA, 22 nt, Homo sapiens
uaauuaaaaaaaaaacuucauu

SEQ ID NO: 921815 - RNA, 22 nt, Homo sapiens
uaauucucccgcauugguggcu

SEQ ID NO: 921816 - RNA, 16 nt, Homo sapiens
uaauucuuuaucacau

SEQ ID NO: 921817 - RNA, 20 nt, Homo sapiens
uaauugccuuugagguuauu

SEQ ID NO: 921818 - RNA, 13 nt, Homo sapiens
uaauuuucuuccc

SEQ ID NO: 921819 - RNA, 13 nt, Homo sapiens
uacaaaaagccaa

SEQ ID NO: 921820 - RNA, 22 nt, Homo sapiens
uacaaaaguuuaaaaagcucac

SEQ ID NO: 921821 - RNA, 20 nt, Homo sapiens
uacaaaaugacauuuugcca

SEQ ID NO: 921822 - RNA, 20 nt, Homo sapiens
uacaacaucuguuacauucu

SEQ ID NO: 921823 - RNA, 23 nt, Homo sapiens
uacaacugaucauuugcagcugc

SEQ ID NO: 921824 - RNA, 14 nt, Homo sapiens
uacaaguguuuacu

SEQ ID NO: 921825 - RNA, 19 nt, Homo sapiens
uacaauaccagaucacuca

SEQ ID NO: 921826 - RNA, 21 nt, Homo sapiens
uacaauaccagaucacucaaa

SEQ ID NO: 921827 - RNA, 12 nt, Homo sapiens
uacaauauugca

SEQ ID NO: 921828 - RNA, 18 nt, Homo sapiens
uacaaucagcagucuagu

SEQ ID NO: 921829 - RNA, 18 nt, Homo sapiens
uacacguugaaaaucaac

SEQ ID NO: 921830 - RNA, 21 nt, Homo sapiens
uacagaggauucugucuucca

SEQ ID NO: 921831 - RNA, 22 nt, Homo sapiens
uacagaugaaccaagugucuaa

SEQ ID NO: 921832 - RNA, 18 nt, Homo sapiens
uacaggugagugccacca

SEQ ID NO: 921833 - RNA, 22 nt, Homo sapiens
uacaguaaaacaauugugacag

SEQ ID NO: 921834 - RNA, 14 nt, Homo sapiens
uacaguguaaaaau

SEQ ID NO: 921835 - RNA, 11 nt, Homo sapiens
uacauggguag

SEQ ID NO: 921836 - RNA, 19 nt, Homo sapiens
uacauuauuggacuuccau

SEQ ID NO: 921837 - RNA, 19 nt, Homo sapiens
uacauuuaauagacuuaca

SEQ ID NO: 921838 - RNA, 16 nt, Homo sapiens
ccacuccaaccagaag

SEQ ID NO: 921839 - RNA, 22 nt, Homo sapiens
ccacuccaaccagaagugaaua

SEQ ID NO: 921840 - RNA, 15 nt, Homo sapiens
ccacuggaaacuuag

SEQ ID NO: 921841 - RNA, 22 nt, Homo sapiens
ccacugguguaaaaaacaaaca

SEQ ID NO: 921842 - RNA, 16 nt, Homo sapiens
ccagaaaacacauuuc

SEQ ID NO: 921843 - RNA, 17 nt, Homo sapiens
ccagaaaacacauuucu

SEQ ID NO: 921844 - RNA, 20 nt, Homo sapiens
ccagaacaauggcuauucau

SEQ ID NO: 921845 - RNA, 21 nt, Homo sapiens
ccagacacacagccugugcuu

SEQ ID NO: 921846 - RNA, 15 nt, Homo sapiens
ccagaucugcaguca

SEQ ID NO: 921847 - RNA, 13 nt, Homo sapiens
ccagcccacugga

SEQ ID NO: 921848 - RNA, 12 nt, Homo sapiens
ccagcucuucca

SEQ ID NO: 921849 - RNA, 16 nt, Homo sapiens
ccaggccacugaccuc

SEQ ID NO: 921850 - RNA, 16 nt, Homo sapiens
ccaggcccaguccacu

SEQ ID NO: 921851 - RNA, 20 nt, Homo sapiens
ccagggcaaagaacacaaac

SEQ ID NO: 921852 - RNA, 19 nt, Homo sapiens
ccagggcugggcacuccuc

SEQ ID NO: 921853 - RNA, 19 nt, Homo sapiens
ccagggggcccucugccuc

SEQ ID NO: 921854 - RNA, 22 nt, Homo sapiens
ccagguagagagaccacaagca

SEQ ID NO: 921855 - RNA, 16 nt, Homo sapiens
ccagguaggaugaaca

SEQ ID NO: 921856 - RNA, 21 nt, Homo sapiens
ccagguucugguuagcucagc

SEQ ID NO: 921857 - RNA, 21 nt, Homo sapiens
ccagguuggaggcccuaggcg

SEQ ID NO: 921858 - RNA, 19 nt, Homo sapiens
ccaguggccuggcuccgcu

SEQ ID NO: 921859 - RNA, 14 nt, Homo sapiens
ccaguucugaugag

SEQ ID NO: 921860 - RNA, 21 nt, Homo sapiens
ccauauuggcaaggcugccac

SEQ ID NO: 921861 - RNA, 12 nt, Homo sapiens
ccaucaccacca

SEQ ID NO: 921862 - RNA, 16 nt, Homo sapiens
ccaugcagugccccua

SEQ ID NO: 921863 - RNA, 15 nt, Homo sapiens
ccaugguagacugug

SEQ ID NO: 921864 - RNA, 21 nt, Homo sapiens
ccaugguagacugugacacag

SEQ ID NO: 921865 - RNA, 16 nt, Homo sapiens
ccaugugcugcugugg

SEQ ID NO: 921866 - RNA, 20 nt, Homo sapiens
ccauuacaguguaaaaauuc

SEQ ID NO: 921867 - RNA, 17 nt, Homo sapiens
ccauucucuccagugug

SEQ ID NO: 921868 - RNA, 15 nt, Homo sapiens
ccauuuaaaaauauc

SEQ ID NO: 921869 - RNA, 19 nt, Homo sapiens
ccauuugccaugcugcuau

SEQ ID NO: 921870 - RNA, 23 nt, Homo sapiens
ccauuuuguggauuguguccuau

SEQ ID NO: 921871 - RNA, 15 nt, Homo sapiens
cccaacaaacuuuaa

SEQ ID NO: 921872 - RNA, 16 nt, Homo sapiens
cccaauucauuucauc

SEQ ID NO: 921873 - RNA, 19 nt, Homo sapiens
cccacaugccaauuucagc

SEQ ID NO: 921874 - RNA, 21 nt, Homo sapiens
cccagaucggaucuguugcaa

SEQ ID NO: 921875 - RNA, 18 nt, Homo sapiens
cccagcaaggaccaguga

SEQ ID NO: 921876 - RNA, 18 nt, Homo sapiens
cccagccucccaaagugc

SEQ ID NO: 921877 - RNA, 18 nt, Homo sapiens
cccaggcuggagugaucu

SEQ ID NO: 921878 - RNA, 20 nt, Homo sapiens
cccaggcuggagugaucuca

SEQ ID NO: 921879 - RNA, 20 nt, Homo sapiens
cccaggucuugacaccagcu

SEQ ID NO: 921880 - RNA, 14 nt, Homo sapiens
cccaucccgugcaa

SEQ ID NO: 921881 - RNA, 22 nt, Homo sapiens
cccaugcacagaacaagccaca

SEQ ID NO: 921882 - RNA, 15 nt, Homo sapiens
cccaugccaguuuug

SEQ ID NO: 921883 - RNA, 18 nt, Homo sapiens
cccaugguagacugugac

SEQ ID NO: 921884 - RNA, 21 nt, Homo sapiens
cccaugguagacugugacaca

SEQ ID NO: 921885 - RNA, 22 nt, Homo sapiens
ccccaacguuccacaacagucc

SEQ ID NO: 921886 - RNA, 22 nt, Homo sapiens
ccccaccuccugucguccugcc

SEQ ID NO: 921887 - RNA, 18 nt, Homo sapiens
ccccagaagcagccauaa

SEQ ID NO: 921888 - RNA, 20 nt, Homo sapiens
ccccagaugccuccucuguc

SEQ ID NO: 921889 - RNA, 22 nt, Homo sapiens
ccccagccucccaaagugcuaa

SEQ ID NO: 921890 - RNA, 18 nt, Homo sapiens
ccccaggacgcagacuga

SEQ ID NO: 921891 - RNA, 21 nt, Homo sapiens
ccccgugaagcaaucauuucc

SEQ ID NO: 921892 - RNA, 19 nt, Homo sapiens
ccccuccuucccuggucca

SEQ ID NO: 921893 - RNA, 22 nt, Homo sapiens
ccccuggaaucgaggcugugug

SEQ ID NO: 921894 - RNA, 17 nt, Homo sapiens
ccccuggacauauuccc

SEQ ID NO: 921895 - RNA, 13 nt, Homo sapiens
ccccuugcucuca

SEQ ID NO: 921896 - RNA, 15 nt, Homo sapiens
cccgugaagcaauca

SEQ ID NO: 921897 - RNA, 21 nt, Homo sapiens
cccuacauuaguaaaaauaaa

SEQ ID NO: 921898 - RNA, 23 nt, Homo sapiens
cccuacuuccagguucugguuag

SEQ ID NO: 921899 - RNA, 13 nt, Homo sapiens
cccucuauuuauu

SEQ ID NO: 921900 - RNA, 22 nt, Homo sapiens
cccugagggacuuggcaguaga

SEQ ID NO: 921901 - RNA, 16 nt, Homo sapiens
cccugaguuggcauca

SEQ ID NO: 921902 - RNA, 18 nt, Homo sapiens
cccugaguuggcaucacc

SEQ ID NO: 921903 - RNA, 18 nt, Homo sapiens
cccugcagagaugcggug

SEQ ID NO: 921904 - RNA, 18 nt, Homo sapiens
cccuguuauaauuugcac

SEQ ID NO: 921905 - RNA, 19 nt, Homo sapiens
cccuguugccuugagcucu

SEQ ID NO: 921906 - RNA, 22 nt, Homo sapiens
cccuugugcauugugugucaca

SEQ ID NO: 921907 - RNA, 12 nt, Homo sapiens
cccuuucuucaa

SEQ ID NO: 921908 - RNA, 17 nt, Homo sapiens
ccggagcgcugggcggu

SEQ ID NO: 921909 - RNA, 19 nt, Homo sapiens
ccggucuaaagugagcucu

SEQ ID NO: 921910 - RNA, 19 nt, Homo sapiens
ccgugaagcaaucauuucc

SEQ ID NO: 921911 - RNA, 18 nt, Homo sapiens
ccguucgcugagucccag

SEQ ID NO: 921912 - RNA, 14 nt, Homo sapiens
ccuaaaauuugccc

SEQ ID NO: 921913 - RNA, 23 nt, Homo sapiens
ccuaauagacuuagccccaugag

SEQ ID NO: 921914 - RNA, 22 nt, Homo sapiens
ccuacacaaaauacagcacuuu

SEQ ID NO: 921915 - RNA, 20 nt, Homo sapiens
ccuaccacugucuucuucag

SEQ ID NO: 921916 - RNA, 12 nt, Homo sapiens
ccuaccauuuca

SEQ ID NO: 921917 - RNA, 19 nt, Homo sapiens
ccuacucccaaggacacga

SEQ ID NO: 921918 - RNA, 17 nt, Homo sapiens
ccuagcugugugcaguc

SEQ ID NO: 921919 - RNA, 13 nt, Homo sapiens
ccuaguacuuuau

SEQ ID NO: 921920 - RNA, 18 nt, Homo sapiens
ccuauaccccucaucaca

SEQ ID NO: 921921 - RNA, 18 nt, Homo sapiens
ccuaucauagauuuacaa

SEQ ID NO: 921922 - RNA, 17 nt, Homo sapiens
ccuaugaacucuugaua

SEQ ID NO: 921923 - RNA, 17 nt, Homo sapiens
caagcucuucuccucag

SEQ ID NO: 921924 - RNA, 18 nt, Homo sapiens
caaggcaggccuuuccua

SEQ ID NO: 921925 - RNA, 21 nt, Homo sapiens
caagggaggaacaaaugaaga

SEQ ID NO: 921926 - RNA, 16 nt, Homo sapiens
caaggucgagacauuc

SEQ ID NO: 921927 - RNA, 21 nt, Homo sapiens
caagugggcagcauaaaguca

SEQ ID NO: 921928 - RNA, 19 nt, Homo sapiens
caauaaaaugcacugacca

SEQ ID NO: 921929 - RNA, 16 nt, Homo sapiens
caauaacaaagguuac

SEQ ID NO: 921930 - RNA, 15 nt, Homo sapiens
caauaauuguggaga

SEQ ID NO: 921931 - RNA, 14 nt, Homo sapiens
caauacaaaaagcc

SEQ ID NO: 921932 - RNA, 22 nt, Homo sapiens
caauacauuauuggacuuccau

SEQ ID NO: 921933 - RNA, 17 nt, Homo sapiens
caauaccagaucacuca

SEQ ID NO: 921934 - RNA, 18 nt, Homo sapiens
caauaccagaucacucaa

SEQ ID NO: 921935 - RNA, 12 nt, Homo sapiens
caauacccaaau

SEQ ID NO: 921936 - RNA, 16 nt, Homo sapiens
caauaccguaacaaug

SEQ ID NO: 921937 - RNA, 16 nt, Homo sapiens
caauacggaacacugu

SEQ ID NO: 921938 - RNA, 20 nt, Homo sapiens
caauaggauuuaauuuguug

SEQ ID NO: 921939 - RNA, 23 nt, Homo sapiens
caaucccuacagggugucuguca

SEQ ID NO: 921940 - RNA, 20 nt, Homo sapiens
caaucguucuguguuugaua

SEQ ID NO: 921941 - RNA, 15 nt, Homo sapiens
caaugcaauguggaa

SEQ ID NO: 921942 - RNA, 15 nt, Homo sapiens
caaugcuucugcaua

SEQ ID NO: 921943 - RNA, 19 nt, Homo sapiens
aaaguuuaaaaagcucaca

SEQ ID NO: 921944 - RNA, 23 nt, Homo sapiens
aaaguuuaagcaauucauucucu

SEQ ID NO: 921945 - RNA, 16 nt, Homo sapiens
aaaguuuuuacagugu

SEQ ID NO: 921946 - RNA, 13 nt, Homo sapiens
aaauacaauucaa

SEQ ID NO: 921947 - RNA, 14 nt, Homo sapiens
aaauacagcacuuu

SEQ ID NO: 921948 - RNA, 20 nt, Homo sapiens
aaauacuguacauagaugua

SEQ ID NO: 921949 - RNA, 22 nt, Homo sapiens
aaauagggagacugacugagua

SEQ ID NO: 921950 - RNA, 13 nt, Homo sapiens
aaaucaagugcac

SEQ ID NO: 921951 - RNA, 15 nt, Homo sapiens
aaaucaagugcaccu

SEQ ID NO: 921952 - RNA, 17 nt, Homo sapiens
aaaucaguuuuguguac

SEQ ID NO: 921953 - RNA, 22 nt, Homo sapiens
aaaucccaguucauguugcuca

SEQ ID NO: 921954 - RNA, 24 nt, Homo sapiens
aaaugaauagccaggccugaccuc

SEQ ID NO: 921955 - RNA, 21 nt, Homo sapiens
aaaugggacugaugucaucuu

SEQ ID NO: 921956 - RNA, 23 nt, Homo sapiens
aaaugggcacaguaugcuccuua

SEQ ID NO: 921957 - RNA, 15 nt, Homo sapiens
aaaugugaacugacu

SEQ ID NO: 921958 - RNA, 20 nt, Homo sapiens
aaauuacacccaugcacaga

SEQ ID NO: 921959 - RNA, 10 nt, Homo sapiens
aaauugcacg

SEQ ID NO: 921960 - RNA, 19 nt, Homo sapiens
aaauuugcaugcaaaauau

SEQ ID NO: 921961 - RNA, 17 nt, Homo sapiens
aaauuuuuuacaagagu

SEQ ID NO: 921962 - RNA, 17 nt, Homo sapiens
aacaaaagugcuuugga

SEQ ID NO: 921963 - RNA, 13 nt, Homo sapiens
aacaaaaucuggg

SEQ ID NO: 921964 - RNA, 13 nt, Homo sapiens
aacaaacauuuga

SEQ ID NO: 921965 - RNA, 13 nt, Homo sapiens
aacaaacuuuaau

SEQ ID NO: 921966 - RNA, 16 nt, Homo sapiens
aacaaacuuuaauggu

SEQ ID NO: 921967 - RNA, 19 nt, Homo sapiens
aacaaaugauuuacacuga

SEQ ID NO: 921968 - RNA, 18 nt, Homo sapiens
aacaaccaugucauuuca

SEQ ID NO: 921969 - RNA, 20 nt, Homo sapiens
aacaacgcaaaccucuccuu

SEQ ID NO: 921970 - RNA, 18 nt, Homo sapiens
aacaauguuaaaugcaau

SEQ ID NO: 921971 - RNA, 15 nt, Homo sapiens
auauagaaccaugaa

SEQ ID NO: 921972 - RNA, 19 nt, Homo sapiens
auauauaguuguacauaua

SEQ ID NO: 921973 - RNA, 22 nt, Homo sapiens
auaucaucuugaguauagcaau

SEQ ID NO: 921974 - RNA, 20 nt, Homo sapiens
auaucuucauaauauuccca

SEQ ID NO: 921975 - RNA, 13 nt, Homo sapiens
auaugaagcacuu

SEQ ID NO: 921976 - RNA, 18 nt, Homo sapiens
auauggugucuugauaua

SEQ ID NO: 921977 - RNA, 16 nt, Homo sapiens
auauguaaacagugag

SEQ ID NO: 921978 - RNA, 21 nt, Homo sapiens
auauguuuauguaacuaucaa

SEQ ID NO: 921979 - RNA, 15 nt, Homo sapiens
auauuaaaaucacaa

SEQ ID NO: 921980 - RNA, 22 nt, Homo sapiens
auauuaaauaaaugugcaugcu

SEQ ID NO: 921981 - RNA, 18 nt, Homo sapiens
auauuaagcaaacacuug

SEQ ID NO: 921982 - RNA, 17 nt, Homo sapiens
auauuaauaugcaugcu

SEQ ID NO: 921983 - RNA, 23 nt, Homo sapiens
auauucuaaccuacuaagucugu

SEQ ID NO: 921984 - RNA, 16 nt, Homo sapiens
auauugugcaugcaaa

SEQ ID NO: 921985 - RNA, 21 nt, Homo sapiens
auauuuuuagauacagugaaa

SEQ ID NO: 921986 - RNA, 18 nt, Homo sapiens
aucaaaccuacuauaaaa

SEQ ID NO: 921987 - RNA, 17 nt, Homo sapiens
aucaaaugguuauuugu

SEQ ID NO: 921988 - RNA, 22 nt, Homo sapiens
aucaagaaauaugaagcacuuu

SEQ ID NO: 921989 - RNA, 16 nt, Homo sapiens
aucaagauacacuugu

SEQ ID NO: 921990 - RNA, 19 nt, Homo sapiens
aucacauaugcuuacucuu

SEQ ID NO: 921991 - RNA, 15 nt, Homo sapiens
aucaccauuacuuuu

SEQ ID NO: 921992 - RNA, 14 nt, Homo sapiens
aucacuuuuggaca

SEQ ID NO: 921993 - RNA, 15 nt, Homo sapiens
aucagaacauucagc

SEQ ID NO: 921994 - RNA, 14 nt, Homo sapiens
aucagccucuggcc

SEQ ID NO: 921995 - RNA, 15 nt, Homo sapiens
aucagugaugggagu

SEQ ID NO: 921996 - RNA, 17 nt, Homo sapiens
aucaucccaacagccaa

SEQ ID NO: 921997 - RNA, 21 nt, Homo sapiens
aucaucuuagcuuagcuuucu

SEQ ID NO: 921998 - RNA, 17 nt, Homo sapiens
aucauggcucacugcag

SEQ ID NO: 921999 - RNA, 23 nt, Homo sapiens
aucauuuccccucccgucuuccu

SEQ ID NO: 922000 - RNA, 20 nt, Homo sapiens
auccauucuuaaaguacuug

SEQ ID NO: 922001 - RNA, 19 nt, Homo sapiens
aucccacccccaaugcaca

SEQ ID NO: 922002 - RNA, 14 nt, Homo sapiens
aucccccuccuugc

SEQ ID NO: 922003 - RNA, 18 nt, Homo sapiens
aucccuuaacaguuguau

SEQ ID NO: 922004 - RNA, 18 nt, Homo sapiens
auccuccugucuuggccu

SEQ ID NO: 922005 - RNA, 21 nt, Homo sapiens
auccuggccacauucaccaac

SEQ ID NO: 922006 - RNA, 18 nt, Homo sapiens
auccugucccaccaugca

SEQ ID NO: 922007 - RNA, 14 nt, Homo sapiens
aucuacuacagggu

SEQ ID NO: 922008 - RNA, 21 nt, Homo sapiens
aucuacuagaaccuucuaauc

SEQ ID NO: 922009 - RNA, 17 nt, Homo sapiens
aucuaucaccugucauc

SEQ ID NO: 922010 - RNA, 18 nt, Homo sapiens
aucuaucaccugucauca

SEQ ID NO: 922011 - RNA, 17 nt, Homo sapiens
aucuaugcgccuguagu

SEQ ID NO: 922012 - RNA, 21 nt, Homo sapiens
aucuccccucacacuuugcca

SEQ ID NO: 922013 - RNA, 18 nt, Homo sapiens
aucucgaagucuuccauc

SEQ ID NO: 922014 - RNA, 19 nt, Homo sapiens
aucugacugccaagccaga

SEQ ID NO: 922015 - RNA, 16 nt, Homo sapiens
aucugagucacuugaa

SEQ ID NO: 922016 - RNA, 13 nt, Homo sapiens
aucuggacacugg

SEQ ID NO: 922017 - RNA, 14 nt, Homo sapiens
aucuguguacugaa

SEQ ID NO: 922018 - RNA, 12 nt, Homo sapiens
aucuguguuaca

SEQ ID NO: 922019 - RNA, 14 nt, Homo sapiens
aucuuccuccucua

SEQ ID NO: 922020 - RNA, 23 nt, Homo sapiens
aucuuuguacagaagaggauuca

SEQ ID NO: 922021 - RNA, 14 nt, Homo sapiens
augaaagugcaaag

SEQ ID NO: 922022 - RNA, 15 nt, Homo sapiens
augaaguauugcuaa

SEQ ID NO: 922023 - RNA, 14 nt, Homo sapiens
augaauacagcauu

SEQ ID NO: 922024 - RNA, 13 nt, Homo sapiens
augaauagccagg

SEQ ID NO: 922025 - RNA, 13 nt, Homo sapiens
augacacauuuga

SEQ ID NO: 922026 - RNA, 20 nt, Homo sapiens
augaccaaaacuauuccauu

SEQ ID NO: 922027 - RNA, 16 nt, Homo sapiens
augacgcacugcucaa

SEQ ID NO: 922028 - RNA, 16 nt, Homo sapiens
augacguuccugucua

SEQ ID NO: 922029 - RNA, 20 nt, Homo sapiens
augacugaaggacaucugac

SEQ ID NO: 922030 - RNA, 23 nt, Homo sapiens
augacugaaguacuggaauuuau

SEQ ID NO: 922031 - RNA, 15 nt, Homo sapiens
augagugcaagcaaa

SEQ ID NO: 922032 - RNA, 19 nt, Homo sapiens
augaugcuggaaauaugaa

SEQ ID NO: 922033 - RNA, 13 nt, Homo sapiens
augauuaaugugu

SEQ ID NO: 922034 - RNA, 15 nt, Homo sapiens
augcagcagcuugcu

SEQ ID NO: 922035 - RNA, 14 nt, Homo sapiens
augcaguacuguaa

SEQ ID NO: 922036 - RNA, 16 nt, Homo sapiens
augcaugcagucuugu

SEQ ID NO: 922037 - RNA, 22 nt, Homo sapiens
augccaaagugucuacaugugc

SEQ ID NO: 922038 - RNA, 23 nt, Homo sapiens
augccucgcucccuucaagacga

SEQ ID NO: 922039 - RNA, 20 nt, Homo sapiens
augcuaguucaacagaaagg

SEQ ID NO: 922040 - RNA, 19 nt, Homo sapiens
augcugaaaacacagagaa

SEQ ID NO: 922041 - RNA, 16 nt, Homo sapiens
augcuggaaauaugaa

SEQ ID NO: 922042 - RNA, 20 nt, Homo sapiens
augcuucuaaauaugaagga

SEQ ID NO: 922043 - RNA, 21 nt, Homo sapiens
augcuuugauuguucauauca

SEQ ID NO: 922044 - RNA, 12 nt, Homo sapiens
auggacugcacc

SEQ ID NO: 922045 - RNA, 20 nt, Homo sapiens
auggcaaaggcuugccccaa

SEQ ID NO: 922046 - RNA, 20 nt, Homo sapiens
auggccacauccaacauuuc

SEQ ID NO: 922047 - RNA, 15 nt, Homo sapiens
augggaaacuuccaa

SEQ ID NO: 922048 - RNA, 13 nt, Homo sapiens
augggacugaugu

SEQ ID NO: 922049 - RNA, 23 nt, Homo sapiens
auggggugaagcugugaugugcc

SEQ ID NO: 922050 - RNA, 16 nt, Homo sapiens
augguccauugcuacu

SEQ ID NO: 922051 - RNA, 14 nt, Homo sapiens
auguaaacagugag

SEQ ID NO: 922052 - RNA, 16 nt, Homo sapiens
auguagauaaagcacu

SEQ ID NO: 922053 - RNA, 14 nt, Homo sapiens
augucuguaaccaa

SEQ ID NO: 922054 - RNA, 15 nt, Homo sapiens
augugcgucagcaau

SEQ ID NO: 922055 - RNA, 17 nt, Homo sapiens
augugggugaaggugac

SEQ ID NO: 922056 - RNA, 23 nt, Homo sapiens
auguguguagauacuuccugccc

SEQ ID NO: 922057 - RNA, 14 nt, Homo sapiens
auguguuuccauau

SEQ ID NO: 922058 - RNA, 21 nt, Homo sapiens
auguucuacuuaaauauauua

SEQ ID NO: 922059 - RNA, 14 nt, Homo sapiens
auguuucaccaagg

SEQ ID NO: 922060 - RNA, 15 nt, Homo sapiens
auuaaaccuuuccau

SEQ ID NO: 922061 - RNA, 14 nt, Homo sapiens
auuaaacucaaagc

SEQ ID NO: 922062 - RNA, 18 nt, Homo sapiens
auuaaagaaaauugccaa

SEQ ID NO: 922063 - RNA, 13 nt, Homo sapiens
auuaaaugaauau

SEQ ID NO: 922064 - RNA, 15 nt, Homo sapiens
auuaccgucugugau

SEQ ID NO: 922065 - RNA, 15 nt, Homo sapiens
auuagaaaccaugaa

SEQ ID NO: 922066 - RNA, 17 nt, Homo sapiens
auuagcaacgccugccu

SEQ ID NO: 922067 - RNA, 19 nt, Homo sapiens
auuaguuuaaaaagaaauu

SEQ ID NO: 922068 - RNA, 17 nt, Homo sapiens
auuauuacguggcaaaa

SEQ ID NO: 922069 - RNA, 12 nt, Homo sapiens
auuauuacuguu

SEQ ID NO: 922070 - RNA, 13 nt, Homo sapiens
auuauuacuguuu

SEQ ID NO: 922071 - RNA, 20 nt, Homo sapiens
auuauucaguaguggaaaug

SEQ ID NO: 922072 - RNA, 17 nt, Homo sapiens
cacuggucgagagccaa

SEQ ID NO: 922073 - RNA, 15 nt, Homo sapiens
cacuuauuuccaugg

SEQ ID NO: 922074 - RNA, 12 nt, Homo sapiens
cacuugccccag

SEQ ID NO: 922075 - RNA, 19 nt, Homo sapiens
cacuuggugauauguccua

SEQ ID NO: 922076 - RNA, 21 nt, Homo sapiens
cacuuugcagaccugggacuu

SEQ ID NO: 922077 - RNA, 17 nt, Homo sapiens
cagaaaacaaaucuuca

SEQ ID NO: 922078 - RNA, 23 nt, Homo sapiens
cagaaaacagaggccacacuuuc

SEQ ID NO: 922079 - RNA, 18 nt, Homo sapiens
cagaaauccuuucauaaa

SEQ ID NO: 922080 - RNA, 15 nt, Homo sapiens
cagaacccuggugag

SEQ ID NO: 922081 - RNA, 18 nt, Homo sapiens
cagaacucuccuaucuga

SEQ ID NO: 922082 - RNA, 15 nt, Homo sapiens
cagaaucccuuaaca

SEQ ID NO: 922083 - RNA, 21 nt, Homo sapiens
cagaaucccuuaacaguugua

SEQ ID NO: 922084 - RNA, 22 nt, Homo sapiens
cagaauuuugggacauuugcau

SEQ ID NO: 922085 - RNA, 15 nt, Homo sapiens
cagacaaauuacuga

SEQ ID NO: 922086 - RNA, 17 nt, Homo sapiens
cagagcucuggagccac

SEQ ID NO: 922087 - RNA, 14 nt, Homo sapiens
cagaggcacagccg

SEQ ID NO: 922088 - RNA, 16 nt, Homo sapiens
cagaguaugagugcaa

SEQ ID NO: 922089 - RNA, 17 nt, Homo sapiens
cagaguaugagugcaag

SEQ ID NO: 922090 - RNA, 22 nt, Homo sapiens
ugcaaaaauauauauguagcca

SEQ ID NO: 922091 - RNA, 22 nt, Homo sapiens
ugcaaaaugcccagggauuuaa

SEQ ID NO: 922092 - RNA, 16 nt, Homo sapiens
ugcaaagcugcuugaa

SEQ ID NO: 922093 - RNA, 13 nt, Homo sapiens
ugcaaccaggaac

SEQ ID NO: 922094 - RNA, 21 nt, Homo sapiens
ugcaccuacaccaacugcucu

SEQ ID NO: 922095 - RNA, 20 nt, Homo sapiens
ugcagaauuuuaugugacug

SEQ ID NO: 922096 - RNA, 23 nt, Homo sapiens
ugcaguuauuucaaaaauuugca

SEQ ID NO: 922097 - RNA, 14 nt, Homo sapiens
ugcaugcagaaagg

SEQ ID NO: 922098 - RNA, 13 nt, Homo sapiens
ugccaaaccuuua

SEQ ID NO: 922099 - RNA, 14 nt, Homo sapiens
ugccaaaccuuuaa

SEQ ID NO: 922100 - RNA, 13 nt, Homo sapiens
ugccaacauuuaa

SEQ ID NO: 922101 - RNA, 14 nt, Homo sapiens
ugccaacuggaaag

SEQ ID NO: 922102 - RNA, 18 nt, Homo sapiens
ugccaaguaacaaugcau

SEQ ID NO: 922103 - RNA, 12 nt, Homo sapiens
ugccaauggaac

SEQ ID NO: 922104 - RNA, 18 nt, Homo sapiens
ugccaccucucacacugg

SEQ ID NO: 922105 - RNA, 21 nt, Homo sapiens
ugccaguaggcucaacuaggg

SEQ ID NO: 922106 - RNA, 16 nt, Homo sapiens
ugccauggaaccuucc

SEQ ID NO: 922107 - RNA, 15 nt, Homo sapiens
ugccauuucuuccca

SEQ ID NO: 922108 - RNA, 17 nt, Homo sapiens
ugcccacccgucuucaa

SEQ ID NO: 922109 - RNA, 12 nt, Homo sapiens
ugccgcucagag

SEQ ID NO: 922110 - RNA, 23 nt, Homo sapiens
ugccuagcacucacaugcuggac

SEQ ID NO: 922111 - RNA, 22 nt, Homo sapiens
ugccucacaauuaugcugugaa

SEQ ID NO: 922112 - RNA, 14 nt, Homo sapiens
ugccucggggacac

SEQ ID NO: 922113 - RNA, 15 nt, Homo sapiens
ugccugcaccccagg

SEQ ID NO: 922114 - RNA, 20 nt, Homo sapiens
ugccugggggcuuuugccac

SEQ ID NO: 922115 - RNA, 14 nt, Homo sapiens
ugccuuauguaauu

SEQ ID NO: 922116 - RNA, 13 nt, Homo sapiens
ugccuuuugcaac

SEQ ID NO: 922117 - RNA, 18 nt, Homo sapiens
ugcgcacgaccuacauua

SEQ ID NO: 922118 - RNA, 17 nt, Homo sapiens
ugcgcagggcucuuuga

SEQ ID NO: 922119 - RNA, 19 nt, Homo sapiens
ugcgcucuggggacugagc

SEQ ID NO: 922120 - RNA, 21 nt, Homo sapiens
ugcguaggagagaacagggau

SEQ ID NO: 922121 - RNA, 16 nt, Homo sapiens
ugcuagccacuggaaa

SEQ ID NO: 922122 - RNA, 22 nt, Homo sapiens
ugcucauauuaauguacuuaaa

SEQ ID NO: 922123 - RNA, 14 nt, Homo sapiens
ugcucucaaaaugu

SEQ ID NO: 922124 - RNA, 19 nt, Homo sapiens
ugcugacagauguuccauc

SEQ ID NO: 922125 - RNA, 17 nt, Homo sapiens
ugcugagcacacaacag

SEQ ID NO: 922126 - RNA, 17 nt, Homo sapiens
ugcugggauuacaggug

SEQ ID NO: 922127 - RNA, 20 nt, Homo sapiens
ugcuggugcacaugacauuu

SEQ ID NO: 922128 - RNA, 22 nt, Homo sapiens
ugcugucacuugugauuugccc

SEQ ID NO: 922129 - RNA, 21 nt, Homo sapiens
ugcuuauaagcaacaugaauu

SEQ ID NO: 922130 - RNA, 13 nt, Homo sapiens
ugcuucugggaag

SEQ ID NO: 922131 - RNA, 20 nt, Homo sapiens
uggaaaagucuucaagggcu

SEQ ID NO: 922132 - RNA, 19 nt, Homo sapiens
uggaaaaguguuccuugcu

SEQ ID NO: 922133 - RNA, 16 nt, Homo sapiens
uggaaaguacuaugaa

SEQ ID NO: 922134 - RNA, 15 nt, Homo sapiens
uggaacauucuguca

SEQ ID NO: 922135 - RNA, 17 nt, Homo sapiens
uggaaucauaugggaua

SEQ ID NO: 922136 - RNA, 15 nt, Homo sapiens
uggaauuuugcaaag

SEQ ID NO: 922137 - RNA, 15 nt, Homo sapiens
uggacaacaagccuu

SEQ ID NO: 922138 - RNA, 21 nt, Homo sapiens
uggacaacccaagucucuggg

SEQ ID NO: 922139 - RNA, 15 nt, Homo sapiens
uggacacacacagcu

SEQ ID NO: 922140 - RNA, 13 nt, Homo sapiens
uggaccaaagcug

SEQ ID NO: 922141 - RNA, 19 nt, Homo sapiens
uggacuuuugcagcuuccu

SEQ ID NO: 922142 - RNA, 17 nt, Homo sapiens
uggagaacucauuucaa

SEQ ID NO: 922143 - RNA, 21 nt, Homo sapiens
uggagagaccagccuuucuuc

SEQ ID NO: 922144 - RNA, 22 nt, Homo sapiens
uggagccaccugucccaccuca

SEQ ID NO: 922145 - RNA, 22 nt, Homo sapiens
uggagggcagcuguggcuucua

SEQ ID NO: 922146 - RNA, 19 nt, Homo sapiens
uggaucccaauucauuuca

SEQ ID NO: 922147 - RNA, 13 nt, Homo sapiens
uggcaacugcuga

SEQ ID NO: 922148 - RNA, 18 nt, Homo sapiens
uggcaauucuucuucuca

SEQ ID NO: 922149 - RNA, 22 nt, Homo sapiens
uggcagaaaucccaguucaugu

SEQ ID NO: 922150 - RNA, 22 nt, Homo sapiens
uggcagcaacaaaggauuugaa

SEQ ID NO: 922151 - RNA, 16 nt, Homo sapiens
uggcauaugauuuauc

SEQ ID NO: 922152 - RNA, 14 nt, Homo sapiens
uggcauucgcagug

SEQ ID NO: 922153 - RNA, 13 nt, Homo sapiens
uggcgucaccugu

SEQ ID NO: 922154 - RNA, 20 nt, Homo sapiens
uggcucacaccuguaauccc

SEQ ID NO: 922155 - RNA, 19 nt, Homo sapiens
uggcucacuauggugccaa

SEQ ID NO: 922156 - RNA, 16 nt, Homo sapiens
uggcucgggacuucaa

SEQ ID NO: 922157 - RNA, 15 nt, Homo sapiens
uggcugcacucaaga

SEQ ID NO: 922158 - RNA, 18 nt, Homo sapiens
uggcuucugcuugucauc

SEQ ID NO: 922159 - RNA, 13 nt, Homo sapiens
ugggaacucccaa

SEQ ID NO: 922160 - RNA, 15 nt, Homo sapiens
ugggaacucccaaga

SEQ ID NO: 922161 - RNA, 16 nt, Homo sapiens
ugggacugaugucauc

SEQ ID NO: 922162 - RNA, 15 nt, Homo sapiens
ugggauuacaggugu

SEQ ID NO: 922163 - RNA, 20 nt, Homo sapiens
ugggccccucugacucccaa

SEQ ID NO: 922164 - RNA, 13 nt, Homo sapiens
ugggccuccucua

SEQ ID NO: 922165 - RNA, 17 nt, Homo sapiens
ugggcuagauaggauau

SEQ ID NO: 922166 - RNA, 14 nt, Homo sapiens
uggggccacagcca

SEQ ID NO: 922167 - RNA, 20 nt, Homo sapiens
ugggggguuuucuugccuug

SEQ ID NO: 922168 - RNA, 16 nt, Homo sapiens
uggguaucaaacagcu

SEQ ID NO: 922169 - RNA, 19 nt, Homo sapiens
ugguaaagccucagcaaca

SEQ ID NO: 922170 - RNA, 14 nt, Homo sapiens
ugguagacugugac

SEQ ID NO: 922171 - RNA, 14 nt, Homo sapiens
ugguagcaggaaaa

SEQ ID NO: 922172 - RNA, 15 nt, Homo sapiens
ugguaugcacugguu

SEQ ID NO: 922173 - RNA, 22 nt, Homo sapiens
uggucaccuuccucugccuuug

SEQ ID NO: 922174 - RNA, 15 nt, Homo sapiens
uggucccauuauucu

SEQ ID NO: 922175 - RNA, 19 nt, Homo sapiens
uggucugccucugagccac

SEQ ID NO: 922176 - RNA, 17 nt, Homo sapiens
uggucuugaacuccuga

SEQ ID NO: 922177 - RNA, 15 nt, Homo sapiens
uggugagcaccugua

SEQ ID NO: 922178 - RNA, 15 nt, Homo sapiens
uggugauaaguucca

SEQ ID NO: 922179 - RNA, 23 nt, Homo sapiens
uggugcagaugccugcagugcca

SEQ ID NO: 922180 - RNA, 21 nt, Homo sapiens
ugguuaaaagaacaacacuaa

SEQ ID NO: 922181 - RNA, 18 nt, Homo sapiens
ugguuauuuguuacuaaa

SEQ ID NO: 922182 - RNA, 22 nt, Homo sapiens
ugguucuuuuaccccacgaaga

SEQ ID NO: 922183 - RNA, 15 nt, Homo sapiens
ugguuuauaaucuga

SEQ ID NO: 922184 - RNA, 23 nt, Homo sapiens
ugguuuuuuuuuuuuugagacag

SEQ ID NO: 922185 - RNA, 16 nt, Homo sapiens
uguaaaauaaaaccac

SEQ ID NO: 922186 - RNA, 20 nt, Homo sapiens
uguaaaguaaaagcuauaaa

SEQ ID NO: 922187 - RNA, 15 nt, Homo sapiens
uguaagaggugcucu

SEQ ID NO: 922188 - RNA, 19 nt, Homo sapiens
uguaaucccaacacuuugg

SEQ ID NO: 922189 - RNA, 11 nt, Homo sapiens
uguacauauau

SEQ ID NO: 922190 - RNA, 12 nt, Homo sapiens
uguacugugacc

SEQ ID NO: 922191 - RNA, 16 nt, Homo sapiens
uguacuuaaauuacac

SEQ ID NO: 922192 - RNA, 17 nt, Homo sapiens
uguagauaaagcacugu

SEQ ID NO: 922193 - RNA, 13 nt, Homo sapiens
uguagauugccuu

SEQ ID NO: 922194 - RNA, 14 nt, Homo sapiens
uguagccagacagu

SEQ ID NO: 922195 - RNA, 18 nt, Homo sapiens
uguagucccagcuaccca

SEQ ID NO: 922196 - RNA, 22 nt, Homo sapiens
uguauauauuauuauaaucuua

SEQ ID NO: 922197 - RNA, 16 nt, Homo sapiens
uguaucuucagacuca

SEQ ID NO: 922198 - RNA, 18 nt, Homo sapiens
uguauuuuaaaauuucac

SEQ ID NO: 922199 - RNA, 21 nt, Homo sapiens
uguauuuuggucauauugcca

SEQ ID NO: 922200 - RNA, 12 nt, Homo sapiens
ugucaaauccau

SEQ ID NO: 922201 - RNA, 21 nt, Homo sapiens
ugucaagcuaguucacacucu

SEQ ID NO: 922202 - RNA, 19 nt, Homo sapiens
ugucacgcaggcugagugc

SEQ ID NO: 922203 - RNA, 21 nt, Homo sapiens
ugucagaaacacugaagccau

SEQ ID NO: 922204 - RNA, 21 nt, Homo sapiens
ugucagaauaaagaacauucu

SEQ ID NO: 922205 - RNA, 20 nt, Homo sapiens
ugucauggcucugaacugca

SEQ ID NO: 922206 - RNA, 19 nt, Homo sapiens
ugucauuaauauauccuaa

SEQ ID NO: 922207 - RNA, 13 nt, Homo sapiens
uguccacaucuaa

SEQ ID NO: 922208 - RNA, 15 nt, Homo sapiens
uguccuaugcgcuca

SEQ ID NO: 922209 - RNA, 15 nt, Homo sapiens
aucucuggagugugu

SEQ ID NO: 922210 - RNA, 19 nt, Homo sapiens
aucugaaaaacuaaacuac

SEQ ID NO: 922211 - RNA, 18 nt, Homo sapiens
aucugaaagaaauggcau

SEQ ID NO: 922212 - RNA, 11 nt, Homo sapiens
aucugaauaua

SEQ ID NO: 922213 - RNA, 14 nt, Homo sapiens
aucugauaucuguu

SEQ ID NO: 922214 - RNA, 20 nt, Homo sapiens
aucugauuuucaaaaaucau

SEQ ID NO: 922215 - RNA, 13 nt, Homo sapiens
aucuggucacuuu

SEQ ID NO: 922216 - RNA, 12 nt, Homo sapiens
aucuguaauuca

SEQ ID NO: 922217 - RNA, 13 nt, Homo sapiens
aucuguacuuugg

SEQ ID NO: 922218 - RNA, 15 nt, Homo sapiens
aucuuguacagccuu

SEQ ID NO: 922219 - RNA, 18 nt, Homo sapiens
aucuuuccuugucucuca

SEQ ID NO: 922220 - RNA, 19 nt, Homo sapiens
aucuuuccuugucucucau

SEQ ID NO: 922221 - RNA, 14 nt, Homo sapiens
aucuuuggaggaau

SEQ ID NO: 922222 - RNA, 20 nt, Homo sapiens
augaaaaccacccuaucauc

SEQ ID NO: 922223 - RNA, 13 nt, Homo sapiens
augaaacuaugca

SEQ ID NO: 922224 - RNA, 16 nt, Homo sapiens
augaacacaggcaaug

SEQ ID NO: 922225 - RNA, 18 nt, Homo sapiens
augaacacaggcaaugac

SEQ ID NO: 922226 - RNA, 23 nt, Homo sapiens
augaauacacaacuccacugucu

SEQ ID NO: 922227 - RNA, 13 nt, Homo sapiens
augaauacagaua

SEQ ID NO: 922228 - RNA, 23 nt, Homo sapiens
augaauagccaggccugaccuca

SEQ ID NO: 922229 - RNA, 19 nt, Homo sapiens
augacugcgcagaguggau

SEQ ID NO: 922230 - RNA, 14 nt, Homo sapiens
augacuugacaagu

SEQ ID NO: 922231 - RNA, 19 nt, Homo sapiens
augacuugggccaaucacu

SEQ ID NO: 922232 - RNA, 14 nt, Homo sapiens
augagaaaagggaa

SEQ ID NO: 922233 - RNA, 21 nt, Homo sapiens
augaggcacgccugccuucuc

SEQ ID NO: 922234 - RNA, 13 nt, Homo sapiens
augaguacccaaa

SEQ ID NO: 922235 - RNA, 15 nt, Homo sapiens
augauuuuggccuca

SEQ ID NO: 922236 - RNA, 15 nt, Homo sapiens
augcaaucacuuuug

SEQ ID NO: 922237 - RNA, 14 nt, Homo sapiens
augcacagaacaag

SEQ ID NO: 922238 - RNA, 21 nt, Homo sapiens
augccugcagugccacuaaaa

SEQ ID NO: 922239 - RNA, 15 nt, Homo sapiens
augcggauccugcug

SEQ ID NO: 922240 - RNA, 14 nt, Homo sapiens
augcggucuaggga

SEQ ID NO: 922241 - RNA, 12 nt, Homo sapiens
augcucaccuga

SEQ ID NO: 922242 - RNA, 22 nt, Homo sapiens
augcugugaauuuuacaaaaau

SEQ ID NO: 922243 - RNA, 16 nt, Homo sapiens
augcuuauaagcaaca

SEQ ID NO: 922244 - RNA, 20 nt, Homo sapiens
augcuuauaagcaacaugaa

SEQ ID NO: 922245 - RNA, 23 nt, Homo sapiens
auggaaccuccuuucucuucucu

SEQ ID NO: 922246 - RNA, 16 nt, Homo sapiens
auggaagggccuucuc

SEQ ID NO: 922247 - RNA, 20 nt, Homo sapiens
auggaccaauuagcauucca

SEQ ID NO: 922248 - RNA, 14 nt, Homo sapiens
auggauggggccca

SEQ ID NO: 922249 - RNA, 16 nt, Homo sapiens
auggcuaucaucaaaa

SEQ ID NO: 922250 - RNA, 17 nt, Homo sapiens
auggggccacagccaga

SEQ ID NO: 922251 - RNA, 17 nt, Homo sapiens
augggggaaauggugcc

SEQ ID NO: 922252 - RNA, 20 nt, Homo sapiens
auggguaucaaacagcucag

SEQ ID NO: 922253 - RNA, 16 nt, Homo sapiens
augguaagagucacaa

SEQ ID NO: 922254 - RNA, 18 nt, Homo sapiens
augguccauugcuacucu

SEQ ID NO: 922255 - RNA, 20 nt, Homo sapiens
augguggugagcaccuguaa

SEQ ID NO: 922256 - RNA, 21 nt, Homo sapiens
auguaaucugauuuucaaaaa

SEQ ID NO: 922257 - RNA, 18 nt, Homo sapiens
auguacuuaaauuacaca

SEQ ID NO: 922258 - RNA, 12 nt, Homo sapiens
auguagacauuu

SEQ ID NO: 922259 - RNA, 23 nt, Homo sapiens
auguagcaaauuccaauacauua

SEQ ID NO: 922260 - RNA, 23 nt, Homo sapiens
auguagcaguucugcacuuugac

SEQ ID NO: 922261 - RNA, 13 nt, Homo sapiens
augugcccgccuc

SEQ ID NO: 922262 - RNA, 12 nt, Homo sapiens
augugcugagaa

SEQ ID NO: 922263 - RNA, 22 nt, Homo sapiens
auguggcugacuaggucaauuu

SEQ ID NO: 922264 - RNA, 20 nt, Homo sapiens
augugggaaaaaaagaaauu

SEQ ID NO: 922265 - RNA, 17 nt, Homo sapiens
auguuacgugugcaaca

SEQ ID NO: 922266 - RNA, 19 nt, Homo sapiens
auguuaguuuugcuccuuc

SEQ ID NO: 922267 - RNA, 20 nt, Homo sapiens
auguucauaguuacauauuu

SEQ ID NO: 922268 - RNA, 23 nt, Homo sapiens
auguuccuuuuauuuauaacaau

SEQ ID NO: 922269 - RNA, 12 nt, Homo sapiens
auguucucaugu

SEQ ID NO: 922270 - RNA, 22 nt, Homo sapiens
auguugguuuuuuagugcaauu

SEQ ID NO: 922271 - RNA, 22 nt, Homo sapiens
auguuuaugguaauacacauau

SEQ ID NO: 922272 - RNA, 19 nt, Homo sapiens
auguuucaccaaggaaaua

SEQ ID NO: 922273 - RNA, 13 nt, Homo sapiens
auuaaaugcaaaa

SEQ ID NO: 922274 - RNA, 16 nt, Homo sapiens
auuaacugaauucuga

SEQ ID NO: 922275 - RNA, 15 nt, Homo sapiens
auuaauuuaugcaga

SEQ ID NO: 922276 - RNA, 19 nt, Homo sapiens
auuacaggugugagccacu

SEQ ID NO: 922277 - RNA, 23 nt, Homo sapiens
auuacagguuggaucucacaaau

SEQ ID NO: 922278 - RNA, 21 nt, Homo sapiens
auuaccgucugugauugccau

SEQ ID NO: 922279 - RNA, 17 nt, Homo sapiens
auuagaacuugaauacu

SEQ ID NO: 922280 - RNA, 21 nt, Homo sapiens
auuauaaaaaauaaaggcaaa

SEQ ID NO: 922281 - RNA, 12 nt, Homo sapiens
auuaucauccca

SEQ ID NO: 922282 - RNA, 21 nt, Homo sapiens
auuaucccuuacagacuugaa

SEQ ID NO: 922283 - RNA, 18 nt, Homo sapiens
auuauuggacuuccauuu

SEQ ID NO: 922284 - RNA, 15 nt, Homo sapiens
auuauuuuggaucua

SEQ ID NO: 922285 - RNA, 18 nt, Homo sapiens
auucaauaaaaugcacug

SEQ ID NO: 922286 - RNA, 18 nt, Homo sapiens
auucacagcuccuuguga

SEQ ID NO: 922287 - RNA, 13 nt, Homo sapiens
auucauaaucaca

SEQ ID NO: 922288 - RNA, 11 nt, Homo sapiens
auucauucucu

SEQ ID NO: 922289 - RNA, 11 nt, Homo sapiens
auuccaucucc

SEQ ID NO: 922290 - RNA, 14 nt, Homo sapiens
auucuaugacugaa

SEQ ID NO: 922291 - RNA, 16 nt, Homo sapiens
auucugaggaggaaau

SEQ ID NO: 922292 - RNA, 11 nt, Homo sapiens
auucugcauuu

SEQ ID NO: 922293 - RNA, 14 nt, Homo sapiens
auucuuuaucacau

SEQ ID NO: 922294 - RNA, 20 nt, Homo sapiens
auugaaccgccguccuucaa

SEQ ID NO: 922295 - RNA, 21 nt, Homo sapiens
auugagcccaaaaacaagcaa

SEQ ID NO: 922296 - RNA, 17 nt, Homo sapiens
auugauuuucuuucuaa

SEQ ID NO: 922297 - RNA, 20 nt, Homo sapiens
auugauuuuugauagacuga

SEQ ID NO: 922298 - RNA, 17 nt, Homo sapiens
auugcaguucauacuga

SEQ ID NO: 922299 - RNA, 16 nt, Homo sapiens
auugcaucgcugucca

SEQ ID NO: 922300 - RNA, 21 nt, Homo sapiens
auugccuuuggcaauucuucu

SEQ ID NO: 922301 - RNA, 16 nt, Homo sapiens
auugguugaaggucac

SEQ ID NO: 922302 - RNA, 15 nt, Homo sapiens
auuguaaauguucaa

SEQ ID NO: 922303 - RNA, 17 nt, Homo sapiens
auugucuuguaccuuga

SEQ ID NO: 922304 - RNA, 13 nt, Homo sapiens
auuguucauauca

SEQ ID NO: 922305 - RNA, 16 nt, Homo sapiens
auuguuuugugacuuu

SEQ ID NO: 922306 - RNA, 19 nt, Homo sapiens
auuuaaaaaaaaacauuca

SEQ ID NO: 922307 - RNA, 13 nt, Homo sapiens
auuuaaagcauuu

SEQ ID NO: 922308 - RNA, 14 nt, Homo sapiens
auuuaaagcauuuu

SEQ ID NO: 922309 - RNA, 19 nt, Homo sapiens
auuuaauguauuaguccaa

SEQ ID NO: 922310 - RNA, 19 nt, Homo sapiens
auuuagaccaaaagauuca

SEQ ID NO: 922311 - RNA, 14 nt, Homo sapiens
auuuauucauucag

SEQ ID NO: 922312 - RNA, 15 nt, Homo sapiens
auuucacugacacug

SEQ ID NO: 922313 - RNA, 20 nt, Homo sapiens
auuucagcuggagauacuga

SEQ ID NO: 922314 - RNA, 21 nt, Homo sapiens
auuucauauaaauggaaucac

SEQ ID NO: 922315 - RNA, 13 nt, Homo sapiens
auuucaucuacua

SEQ ID NO: 922316 - RNA, 11 nt, Homo sapiens
auuuccaugga

SEQ ID NO: 922317 - RNA, 16 nt, Homo sapiens
auuucuuaaugcuauu

SEQ ID NO: 922318 - RNA, 16 nt, Homo sapiens
auuuggauuuuccacc

SEQ ID NO: 922319 - RNA, 22 nt, Homo sapiens
auuuggucaccuuccucugccu

SEQ ID NO: 922320 - RNA, 14 nt, Homo sapiens
auuuggucugccuc

SEQ ID NO: 922321 - RNA, 23 nt, Homo sapiens
auuugugggcuuggggacagaaa

SEQ ID NO: 922322 - RNA, 11 nt, Homo sapiens
auuuguugaaa

SEQ ID NO: 922323 - RNA, 19 nt, Homo sapiens
auuuuaauagaaagauaca

SEQ ID NO: 922324 - RNA, 23 nt, Homo sapiens
auuuuaccugggauaugacaagc

SEQ ID NO: 922325 - RNA, 15 nt, Homo sapiens
auuuuaggaaacuuu

SEQ ID NO: 922326 - RNA, 19 nt, Homo sapiens
auuuuaggauaauugccua

SEQ ID NO: 922327 - RNA, 22 nt, Homo sapiens
auuuucaagaaagcauugccag

SEQ ID NO: 922328 - RNA, 14 nt, Homo sapiens
auuuucccaugcca

SEQ ID NO: 922329 - RNA, 19 nt, Homo sapiens
auuuucccaugccaguuuu

SEQ ID NO: 922330 - RNA, 12 nt, Homo sapiens
auuuucuucaca

SEQ ID NO: 922331 - RNA, 20 nt, Homo sapiens
auuuugcaaacacugugauu

SEQ ID NO: 922332 - RNA, 15 nt, Homo sapiens
auuuuggacguguga

SEQ ID NO: 922333 - RNA, 20 nt, Homo sapiens
ucuaaugcucacgcucccaa

SEQ ID NO: 922334 - RNA, 19 nt, Homo sapiens
ucuacaacugaucauuugc

SEQ ID NO: 922335 - RNA, 13 nt, Homo sapiens
ucuacaguauuau

SEQ ID NO: 922336 - RNA, 13 nt, Homo sapiens
ucuacaugugcca

SEQ ID NO: 922337 - RNA, 18 nt, Homo sapiens
ucuaccugcccucucuca

SEQ ID NO: 922338 - RNA, 11 nt, Homo sapiens
ucuacuuuuaa

SEQ ID NO: 922339 - RNA, 20 nt, Homo sapiens
ucuaguucuuuucauuugga

SEQ ID NO: 922340 - RNA, 15 nt, Homo sapiens
ucuaucuacagcuua

SEQ ID NO: 922341 - RNA, 20 nt, Homo sapiens
ucuaugaaagcuaugaaugu

SEQ ID NO: 922342 - RNA, 23 nt, Homo sapiens
ucuauggagguuggccacaguca

SEQ ID NO: 922343 - RNA, 23 nt, Homo sapiens
ucuaugggguucguuaugccaaa

SEQ ID NO: 922344 - RNA, 15 nt, Homo sapiens
ucucaaaaugugaac

SEQ ID NO: 922345 - RNA, 22 nt, Homo sapiens
ucucaaaguuuuuacaguguau

SEQ ID NO: 922346 - RNA, 16 nt, Homo sapiens
ucucaagaacugccau

SEQ ID NO: 922347 - RNA, 23 nt, Homo sapiens
ucucaggaggagggcgcaugugu

SEQ ID NO: 922348 - RNA, 22 nt, Homo sapiens
ucucaucccaacaaacuuuaau

SEQ ID NO: 922349 - RNA, 12 nt, Homo sapiens
ucuccacgcacu

SEQ ID NO: 922350 - RNA, 18 nt, Homo sapiens
ucuccauuacaguguaaa

SEQ ID NO: 922351 - RNA, 16 nt, Homo sapiens
ucuccuuuuaugcuca

SEQ ID NO: 922352 - RNA, 17 nt, Homo sapiens
ucucgaagcaguauucu

SEQ ID NO: 922353 - RNA, 14 nt, Homo sapiens
ucucggacucccua

SEQ ID NO: 922354 - RNA, 19 nt, Homo sapiens
ucucggggccugugccgca

SEQ ID NO: 922355 - RNA, 15 nt, Homo sapiens
ucucuaaaccaucua

SEQ ID NO: 922356 - RNA, 16 nt, Homo sapiens
ucucugaacacacauu

SEQ ID NO: 922357 - RNA, 19 nt, Homo sapiens
ucucugaacacacauugcu

SEQ ID NO: 922358 - RNA, 19 nt, Homo sapiens
ucucugucucaugugugcu

SEQ ID NO: 922359 - RNA, 18 nt, Homo sapiens
ucucuuggggggauuugg

SEQ ID NO: 922360 - RNA, 18 nt, Homo sapiens
ucugaaugggagccagaa

SEQ ID NO: 922361 - RNA, 12 nt, Homo sapiens
ucugacucccaa

SEQ ID NO: 922362 - RNA, 18 nt, Homo sapiens
ucugacugccaagccaga

SEQ ID NO: 922363 - RNA, 13 nt, Homo sapiens
ucugaggcucagc

SEQ ID NO: 922364 - RNA, 18 nt, Homo sapiens
ucugagugaauacuuuga

SEQ ID NO: 922365 - RNA, 16 nt, Homo sapiens
ucugcacagacaagca

SEQ ID NO: 922366 - RNA, 16 nt, Homo sapiens
ucugcacuuugacaca

SEQ ID NO: 922367 - RNA, 15 nt, Homo sapiens
ucugccuuuguucac

SEQ ID NO: 922368 - RNA, 16 nt, Homo sapiens
ucugccuuuguucacu

SEQ ID NO: 922369 - RNA, 21 nt, Homo sapiens
ucuggcacuugcaagucccau

SEQ ID NO: 922370 - RNA, 14 nt, Homo sapiens
ucuggcauaugauu

SEQ ID NO: 922371 - RNA, 19 nt, Homo sapiens
ucuggcccacacagaucug

SEQ ID NO: 922372 - RNA, 19 nt, Homo sapiens
ucuggggcucagcccugag

SEQ ID NO: 922373 - RNA, 22 nt, Homo sapiens
ucuggggcucagcccugagcua

SEQ ID NO: 922374 - RNA, 12 nt, Homo sapiens
ucuguacuuugg

SEQ ID NO: 922375 - RNA, 23 nt, Homo sapiens
ucugugaaagucuccuguaucau

SEQ ID NO: 922376 - RNA, 16 nt, Homo sapiens
ucugugauugccauuu

SEQ ID NO: 922377 - RNA, 19 nt, Homo sapiens
ucugugcucugaaugggag

SEQ ID NO: 922378 - RNA, 15 nt, Homo sapiens
ucuguguacugaaca

SEQ ID NO: 922379 - RNA, 14 nt, Homo sapiens
ucuuagugacuuag

SEQ ID NO: 922380 - RNA, 20 nt, Homo sapiens
ucuuauguauuuuggucaua

SEQ ID NO: 922381 - RNA, 21 nt, Homo sapiens
ucuuccugaccaccuugcacu

SEQ ID NO: 922382 - RNA, 21 nt, Homo sapiens
ucuucuucucaagcacugaca

SEQ ID NO: 922383 - RNA, 16 nt, Homo sapiens
ucuugaacuccugacc

SEQ ID NO: 922384 - RNA, 18 nt, Homo sapiens
ucuuggggugcagcacuu

SEQ ID NO: 922385 - RNA, 13 nt, Homo sapiens
ucuuguacuguga

SEQ ID NO: 922386 - RNA, 14 nt, Homo sapiens
ucuuguagccagaa

SEQ ID NO: 922387 - RNA, 14 nt, Homo sapiens
ucuuucaacauuuc

SEQ ID NO: 922388 - RNA, 21 nt, Homo sapiens
ugaaaaauaguguguccaugc

SEQ ID NO: 922389 - RNA, 19 nt, Homo sapiens
ugaaaagaaaaugugccau

SEQ ID NO: 922390 - RNA, 15 nt, Homo sapiens
ugaaagugaacaauc

SEQ ID NO: 922391 - RNA, 13 nt, Homo sapiens
ugaaagugcaaag

SEQ ID NO: 922392 - RNA, 19 nt, Homo sapiens
ugaaaucccaucugcauuu

SEQ ID NO: 922393 - RNA, 15 nt, Homo sapiens
ugaacacacauugcu

SEQ ID NO: 922394 - RNA, 23 nt, Homo sapiens
ugaacacacauugcuauucccau

SEQ ID NO: 922395 - RNA, 12 nt, Homo sapiens
ugaacacaggca

SEQ ID NO: 922396 - RNA, 11 nt, Homo sapiens
ugaacagcaga

SEQ ID NO: 922397 - RNA, 19 nt, Homo sapiens
ugaaccgccguccuucaau

SEQ ID NO: 922398 - RNA, 19 nt, Homo sapiens
ugaaccugagguugcuuua

SEQ ID NO: 922399 - RNA, 11 nt, Homo sapiens
ugaaccuucaa

SEQ ID NO: 922400 - RNA, 20 nt, Homo sapiens
ugaacuacagcuauaccuca

SEQ ID NO: 922401 - RNA, 19 nt, Homo sapiens
ugaacucgcuucucuguga

SEQ ID NO: 922402 - RNA, 15 nt, Homo sapiens
ugaacugcacaaugc

SEQ ID NO: 922403 - RNA, 16 nt, Homo sapiens
ugaacuucagcuagag

SEQ ID NO: 922404 - RNA, 16 nt, Homo sapiens
ugaagccauguagcca

SEQ ID NO: 922405 - RNA, 19 nt, Homo sapiens
ugaagccauguagccaccc

SEQ ID NO: 922406 - RNA, 18 nt, Homo sapiens
ugaaggccccucuccgca

SEQ ID NO: 922407 - RNA, 19 nt, Homo sapiens
ugaaguacucagauuugau

SEQ ID NO: 922408 - RNA, 14 nt, Homo sapiens
ugaagucagccuug

SEQ ID NO: 922409 - RNA, 22 nt, Homo sapiens
ugaagucucaagaacugccaua

SEQ ID NO: 922410 - RNA, 22 nt, Homo sapiens
ugaauacacaacuccacugucu

SEQ ID NO: 922411 - RNA, 21 nt, Homo sapiens
ugaauacagcauuuagcuugu

SEQ ID NO: 922412 - RNA, 19 nt, Homo sapiens
ugaauaggcauuaaaugca

SEQ ID NO: 922413 - RNA, 19 nt, Homo sapiens
ugaauuuguagacauacuu

SEQ ID NO: 922414 - RNA, 18 nt, Homo sapiens
ugacaauuuucuaccacu

SEQ ID NO: 922415 - RNA, 22 nt, Homo sapiens
ugacaguauaaagggcaaagga

SEQ ID NO: 922416 - RNA, 21 nt, Homo sapiens
ugaccaaaauccccuucucau

SEQ ID NO: 922417 - RNA, 21 nt, Homo sapiens
ugaccaaacuguggguauugu

SEQ ID NO: 922418 - RNA, 17 nt, Homo sapiens
ugaccagagcaccucag

SEQ ID NO: 922419 - RNA, 14 nt, Homo sapiens
ugaccaugcaauuc

SEQ ID NO: 922420 - RNA, 18 nt, Homo sapiens
ugaccccgaccucagaga

SEQ ID NO: 922421 - RNA, 15 nt, Homo sapiens
ugaccuaagaacaaa

SEQ ID NO: 922422 - RNA, 15 nt, Homo sapiens
ugaccucccacuuug

SEQ ID NO: 922423 - RNA, 16 nt, Homo sapiens
ugacgcacugcucaag

SEQ ID NO: 922424 - RNA, 16 nt, Homo sapiens
ugacuaauucagggaa

SEQ ID NO: 922425 - RNA, 20 nt, Homo sapiens
ugacuggacagcgguuguaa

SEQ ID NO: 922426 - RNA, 22 nt, Homo sapiens
ugacuguugcuguaaaagugaa

SEQ ID NO: 922427 - RNA, 20 nt, Homo sapiens
ugagaaaaaagacccuauca

SEQ ID NO: 922428 - RNA, 19 nt, Homo sapiens
ugagaaauaaagaucugaa

SEQ ID NO: 922429 - RNA, 14 nt, Homo sapiens
ugagaaauggcagu

SEQ ID NO: 922430 - RNA, 18 nt, Homo sapiens
ugagaacaccccagcugc

SEQ ID NO: 922431 - RNA, 15 nt, Homo sapiens
ugagacggagucuca

SEQ ID NO: 922432 - RNA, 18 nt, Homo sapiens
ugagacuccugauugcuc

SEQ ID NO: 922433 - RNA, 15 nt, Homo sapiens
ugagcaugcuuucug

SEQ ID NO: 922434 - RNA, 21 nt, Homo sapiens
ugagcccagccuacuuuucag

SEQ ID NO: 922435 - RNA, 18 nt, Homo sapiens
ugagccgaggucaugcca

SEQ ID NO: 922436 - RNA, 21 nt, Homo sapiens
ugagcggccgccuguccuugg

SEQ ID NO: 922437 - RNA, 20 nt, Homo sapiens
ugagcugaagacaaaccacu

SEQ ID NO: 922438 - RNA, 22 nt, Homo sapiens
ugagcuugcuggagaguggcau

SEQ ID NO: 922439 - RNA, 19 nt, Homo sapiens
ugaggaccugacacaaucc

SEQ ID NO: 922440 - RNA, 14 nt, Homo sapiens
ugagguuguucaaa

SEQ ID NO: 922441 - RNA, 22 nt, Homo sapiens
ugaguagcugagacuacaggug

SEQ ID NO: 922442 - RNA, 12 nt, Homo sapiens
ugagucaaguca

SEQ ID NO: 922443 - RNA, 14 nt, Homo sapiens
ugagugaagcaaaa

SEQ ID NO: 922444 - RNA, 17 nt, Homo sapiens
ugagugaauacuuugau

SEQ ID NO: 922445 - RNA, 14 nt, Homo sapiens
ugagugcacuggca

SEQ ID NO: 922446 - RNA, 16 nt, Homo sapiens
ugauaaacaguugaau

SEQ ID NO: 922447 - RNA, 20 nt, Homo sapiens
ugauaacaccaagaguagca

SEQ ID NO: 922448 - RNA, 12 nt, Homo sapiens
ugaucugggaac

SEQ ID NO: 922449 - RNA, 14 nt, Homo sapiens
ugaugaaggauuca

SEQ ID NO: 922450 - RNA, 13 nt, Homo sapiens
ugaugacacugag

SEQ ID NO: 922451 - RNA, 19 nt, Homo sapiens
ugaugauuguaagucccau

SEQ ID NO: 922452 - RNA, 19 nt, Homo sapiens
ugaugcuaauuuucagggu

SEQ ID NO: 922453 - RNA, 19 nt, Homo sapiens
ugaugucauuuuguuuaua

SEQ ID NO: 922454 - RNA, 16 nt, Homo sapiens
ugaugugccuacuccc

SEQ ID NO: 922455 - RNA, 15 nt, Homo sapiens
ugauuaugaauacag

SEQ ID NO: 922456 - RNA, 22 nt, Homo sapiens
caggcccaauucugccacuucu

SEQ ID NO: 922457 - RNA, 20 nt, Homo sapiens
caggcccaccuaccuucaaa

SEQ ID NO: 922458 - RNA, 18 nt, Homo sapiens
caggccucaguuucuuca

SEQ ID NO: 922459 - RNA, 15 nt, Homo sapiens
caggcucaggccaaa

SEQ ID NO: 922460 - RNA, 16 nt, Homo sapiens
caggcuucugaaggua

SEQ ID NO: 922461 - RNA, 14 nt, Homo sapiens
cagggaaauaugaa

SEQ ID NO: 922462 - RNA, 14 nt, Homo sapiens
cagggauggggcca

SEQ ID NO: 922463 - RNA, 21 nt, Homo sapiens
cagggcaaagaacacaaaccc

SEQ ID NO: 922464 - RNA, 14 nt, Homo sapiens
caggggccugcaga

SEQ ID NO: 922465 - RNA, 23 nt, Homo sapiens
cagggugaggugcuugcccccau

SEQ ID NO: 922466 - RNA, 14 nt, Homo sapiens
cagggugucuguca

SEQ ID NO: 922467 - RNA, 21 nt, Homo sapiens
cagguaggaugaacacaggca

SEQ ID NO: 922468 - RNA, 14 nt, Homo sapiens
caggugacugccac

SEQ ID NO: 922469 - RNA, 14 nt, Homo sapiens
caggugagugccac

SEQ ID NO: 922470 - RNA, 22 nt, Homo sapiens
caggugagugccaccacacuca

SEQ ID NO: 922471 - RNA, 17 nt, Homo sapiens
caggugcccauuagcaa

SEQ ID NO: 922472 - RNA, 20 nt, Homo sapiens
caggugugagccacugugcc

SEQ ID NO: 922473 - RNA, 20 nt, Homo sapiens
cagguucugguuagcucagc

SEQ ID NO: 922474 - RNA, 19 nt, Homo sapiens
uccuggcccugaaggugcc

SEQ ID NO: 922475 - RNA, 22 nt, Homo sapiens
uccuggcccugaaggugccacu

SEQ ID NO: 922476 - RNA, 13 nt, Homo sapiens
uccugggagacaa

SEQ ID NO: 922477 - RNA, 11 nt, Homo sapiens
uccuguucuca

SEQ ID NO: 922478 - RNA, 21 nt, Homo sapiens
uccuuccccaccccaccacaa

SEQ ID NO: 922479 - RNA, 17 nt, Homo sapiens
uccuugccgcugggaga

SEQ ID NO: 922480 - RNA, 22 nt, Homo sapiens
uccuuucauaaagcaccagcag

SEQ ID NO: 922481 - RNA, 14 nt, Homo sapiens
uccuuuccacucca

SEQ ID NO: 922482 - RNA, 23 nt, Homo sapiens
uccuuuuauuuauaacaauguua

SEQ ID NO: 922483 - RNA, 19 nt, Homo sapiens
ucgaaaacuuuaacaaaca

SEQ ID NO: 922484 - RNA, 19 nt, Homo sapiens
ucgaacuccugggcucaag

SEQ ID NO: 922485 - RNA, 19 nt, Homo sapiens
ucgacaucuuccuccucua

SEQ ID NO: 922486 - RNA, 20 nt, Homo sapiens
ucgacucuuugcaacagcac

SEQ ID NO: 922487 - RNA, 23 nt, Homo sapiens
ucgacucuuugcaacagcacuug

SEQ ID NO: 922488 - RNA, 18 nt, Homo sapiens
ucgcuggugaagacccag

SEQ ID NO: 922489 - RNA, 17 nt, Homo sapiens
ucggugcagaaacuacc

SEQ ID NO: 922490 - RNA, 16 nt, Homo sapiens
ucguccugcugcugcu

SEQ ID NO: 922491 - RNA, 15 nt, Homo sapiens
ucguucuaaaaucaa

SEQ ID NO: 922492 - RNA, 12 nt, Homo sapiens
ucuaaccaaaua

SEQ ID NO: 922493 - RNA, 15 nt, Homo sapiens
ucuagugauaagaau

SEQ ID NO: 922494 - RNA, 17 nt, Homo sapiens
ucuaugaaagcuaugaa

SEQ ID NO: 922495 - RNA, 21 nt, Homo sapiens
ucuaugggcagaucuaccccu

SEQ ID NO: 922496 - RNA, 14 nt, Homo sapiens
ucuauuuugcaaac

SEQ ID NO: 922497 - RNA, 16 nt, Homo sapiens
ucucaaacccuguuua

SEQ ID NO: 922498 - RNA, 14 nt, Homo sapiens
ucucaacaaaugga

SEQ ID NO: 922499 - RNA, 19 nt, Homo sapiens
ucucaacauggaaaaaucc

SEQ ID NO: 922500 - RNA, 16 nt, Homo sapiens
ucucaauauauucagu

SEQ ID NO: 922501 - RNA, 18 nt, Homo sapiens
ucucaccuuaccugguga

SEQ ID NO: 922502 - RNA, 23 nt, Homo sapiens
ucucacuucguuggugaccaguu

SEQ ID NO: 922503 - RNA, 16 nt, Homo sapiens
ucucagcucacugcaa

SEQ ID NO: 922504 - RNA, 18 nt, Homo sapiens
ucucauguuugugcaugu

SEQ ID NO: 922505 - RNA, 20 nt, Homo sapiens
ucucauguuugugcauguau

SEQ ID NO: 922506 - RNA, 18 nt, Homo sapiens
ucuccaaguaaagccacg

SEQ ID NO: 922507 - RNA, 16 nt, Homo sapiens
ucuccccaggguucag

SEQ ID NO: 922508 - RNA, 16 nt, Homo sapiens
ucuccccuccaaguga

SEQ ID NO: 922509 - RNA, 18 nt, Homo sapiens
ucuccucuuuuguaccca

SEQ ID NO: 922510 - RNA, 22 nt, Homo sapiens
ucuccuuccccaccccaccaca

SEQ ID NO: 922511 - RNA, 13 nt, Homo sapiens
ucucuguugucua

SEQ ID NO: 922512 - RNA, 20 nt, Homo sapiens
ucucuuagauuauguucaau

SEQ ID NO: 922513 - RNA, 23 nt, Homo sapiens
ucucuuuuucuuguaaaccugga

SEQ ID NO: 922514 - RNA, 15 nt, Homo sapiens
cugauauuaaguaau

SEQ ID NO: 922515 - RNA, 16 nt, Homo sapiens
cugaugacacugagaa

SEQ ID NO: 922516 - RNA, 21 nt, Homo sapiens
cugaugacacugagaacagau

SEQ ID NO: 922517 - RNA, 17 nt, Homo sapiens
cugcacaaugcauugaa

SEQ ID NO: 922518 - RNA, 21 nt, Homo sapiens
cugcacaccaguuacuguuca

SEQ ID NO: 922519 - RNA, 11 nt, Homo sapiens
cugcacucaag

SEQ ID NO: 922520 - RNA, 12 nt, Homo sapiens
cugcacucaaga

SEQ ID NO: 922521 - RNA, 14 nt, Homo sapiens
cugcaggacaugua

SEQ ID NO: 922522 - RNA, 15 nt, Homo sapiens
cugcaggucacugaa

SEQ ID NO: 922523 - RNA, 16 nt, Homo sapiens
cugccauaaaaucuca

SEQ ID NO: 922524 - RNA, 22 nt, Homo sapiens
cugcccuguacaugcuaguuca

SEQ ID NO: 922525 - RNA, 16 nt, Homo sapiens
cugccuagcacucaca

SEQ ID NO: 922526 - RNA, 18 nt, Homo sapiens
cugccucuguuugacaaa

SEQ ID NO: 922527 - RNA, 22 nt, Homo sapiens
cugccuucuccccuccaaguga

SEQ ID NO: 922528 - RNA, 14 nt, Homo sapiens
cugccuuuguucac

SEQ ID NO: 922529 - RNA, 20 nt, Homo sapiens
cugccuuuguucacugugag

SEQ ID NO: 922530 - RNA, 16 nt, Homo sapiens
cugcucuuugaacucc

SEQ ID NO: 922531 - RNA, 17 nt, Homo sapiens
cugcugaccagcacuga

SEQ ID NO: 922532 - RNA, 20 nt, Homo sapiens
cugcugguuuugguuuccac

SEQ ID NO: 922533 - RNA, 22 nt, Homo sapiens
cugcuguccaggaacuuuccag

SEQ ID NO: 922534 - RNA, 19 nt, Homo sapiens
cugcuucaaacucaaacac

SEQ ID NO: 922535 - RNA, 22 nt, Homo sapiens
cugcuuucuuuguaacaugaca

SEQ ID NO: 922536 - RNA, 18 nt, Homo sapiens
cuggaacacaaccauagc

SEQ ID NO: 922537 - RNA, 13 nt, Homo sapiens
cuggacacugggc

SEQ ID NO: 922538 - RNA, 17 nt, Homo sapiens
cuggacuuuugcagcuu

SEQ ID NO: 922539 - RNA, 17 nt, Homo sapiens
cuggagucaugccaagc

SEQ ID NO: 922540 - RNA, 13 nt, Homo sapiens
cuggaugagaaac

SEQ ID NO: 922541 - RNA, 20 nt, Homo sapiens
cuggcauagcuggacaucca

SEQ ID NO: 922542 - RNA, 15 nt, Homo sapiens
cuggcccacacagau

SEQ ID NO: 922543 - RNA, 22 nt, Homo sapiens
cuggccuauuuuggacguguga

SEQ ID NO: 922544 - RNA, 14 nt, Homo sapiens
cuggcuugugaucu

SEQ ID NO: 922545 - RNA, 12 nt, Homo sapiens
cugggagacaaa

SEQ ID NO: 922546 - RNA, 15 nt, Homo sapiens
cugggauuacaggug

SEQ ID NO: 922547 - RNA, 23 nt, Homo sapiens
cugggauuacaggugugagccac

SEQ ID NO: 922548 - RNA, 13 nt, Homo sapiens
cugggcacuccuc

SEQ ID NO: 922549 - RNA, 13 nt, Homo sapiens
cugggccaagcca

SEQ ID NO: 922550 - RNA, 14 nt, Homo sapiens
cugggccacuggca

SEQ ID NO: 922551 - RNA, 14 nt, Homo sapiens
cugggcucaagcaa

SEQ ID NO: 922552 - RNA, 20 nt, Homo sapiens
cuggggaggacaaaggugau

SEQ ID NO: 922553 - RNA, 20 nt, Homo sapiens
cuggguccaggguaggcaag

SEQ ID NO: 922554 - RNA, 20 nt, Homo sapiens
cugggugaguggggagacac

SEQ ID NO: 922555 - RNA, 17 nt, Homo sapiens
cugguuccuuaaguggc

SEQ ID NO: 922556 - RNA, 13 nt, Homo sapiens
cugguuugacuca

SEQ ID NO: 922557 - RNA, 22 nt, Homo sapiens
cuguaacugcauuagaaaccau

SEQ ID NO: 922558 - RNA, 20 nt, Homo sapiens
cuguaaucccaacacuuugg

SEQ ID NO: 922559 - RNA, 19 nt, Homo sapiens
cuguaaucccagcuacucu

SEQ ID NO: 922560 - RNA, 22 nt, Homo sapiens
cuguacccuugagaccuggaac

SEQ ID NO: 922561 - RNA, 13 nt, Homo sapiens
cuguauuaacuga

SEQ ID NO: 922562 - RNA, 21 nt, Homo sapiens
cuguauuugaaauaagaauuc

SEQ ID NO: 922563 - RNA, 14 nt, Homo sapiens
cugucagaccuucu

SEQ ID NO: 922564 - RNA, 19 nt, Homo sapiens
cuguccaggaacuuuccag

SEQ ID NO: 922565 - RNA, 21 nt, Homo sapiens
cuguccuggaucugcucuaga

SEQ ID NO: 922566 - RNA, 18 nt, Homo sapiens
cuguccuuccaugcaaag

SEQ ID NO: 922567 - RNA, 19 nt, Homo sapiens
cugucucaugugugcucuu

SEQ ID NO: 922568 - RNA, 16 nt, Homo sapiens
cugucuugaugacugc

SEQ ID NO: 922569 - RNA, 23 nt, Homo sapiens
cugugcucugaaugggagccaga

SEQ ID NO: 922570 - RNA, 21 nt, Homo sapiens
cuguggagaacaaagaccaau

SEQ ID NO: 922571 - RNA, 17 nt, Homo sapiens
cuguggcaaaugccagg

SEQ ID NO: 922572 - RNA, 20 nt, Homo sapiens
cuguggccaguugacaucca

SEQ ID NO: 922573 - RNA, 20 nt, Homo sapiens
cuguuuacgguacuugguaa

SEQ ID NO: 922574 - RNA, 13 nt, Homo sapiens
cuguuuugagcca

SEQ ID NO: 922575 - RNA, 18 nt, Homo sapiens
cuguuuuuacaguggaau

SEQ ID NO: 922576 - RNA, 17 nt, Homo sapiens
cuuaaaguggcuuucaa

SEQ ID NO: 922577 - RNA, 17 nt, Homo sapiens
cuuaauaaugguuacuc

SEQ ID NO: 922578 - RNA, 23 nt, Homo sapiens
cuuaaucaguguagccccaagaa

SEQ ID NO: 922579 - RNA, 20 nt, Homo sapiens
cuuaaugccaaguaacaaug

SEQ ID NO: 922580 - RNA, 20 nt, Homo sapiens
cuuacaacugcucuagauua

SEQ ID NO: 922581 - RNA, 14 nt, Homo sapiens
cuuagccccaugag

SEQ ID NO: 922582 - RNA, 15 nt, Homo sapiens
cuuagcuuacaggaa

SEQ ID NO: 922583 - RNA, 17 nt, Homo sapiens
cuuagcuuagcuuucug

SEQ ID NO: 922584 - RNA, 21 nt, Homo sapiens
cuuauuccuaggcaacuauua

SEQ ID NO: 922585 - RNA, 14 nt, Homo sapiens
cuuauucuacugaa

SEQ ID NO: 922586 - RNA, 15 nt, Homo sapiens
cuuauuuuuacuugu

SEQ ID NO: 922587 - RNA, 15 nt, Homo sapiens
cuucaauacccaaau

SEQ ID NO: 922588 - RNA, 17 nt, Homo sapiens
cuucacaccauaacuag

SEQ ID NO: 922589 - RNA, 19 nt, Homo sapiens
cuucagauacuugugaaca

SEQ ID NO: 922590 - RNA, 13 nt, Homo sapiens
cuuccaacugcug

SEQ ID NO: 922591 - RNA, 16 nt, Homo sapiens
cuuccaaucuccauca

SEQ ID NO: 922592 - RNA, 20 nt, Homo sapiens
cuuccaugcaaaggcuuccu

SEQ ID NO: 922593 - RNA, 13 nt, Homo sapiens
cuuccccucucag

SEQ ID NO: 922594 - RNA, 23 nt, Homo sapiens
cuuccgcuuugaaagaagcaaga

SEQ ID NO: 922595 - RNA, 22 nt, Homo sapiens
uaacaugacacauuugaaauca

SEQ ID NO: 922596 - RNA, 17 nt, Homo sapiens
uaacaugggcaaaggga

SEQ ID NO: 922597 - RNA, 14 nt, Homo sapiens
uaaccuacuuguaa

SEQ ID NO: 922598 - RNA, 11 nt, Homo sapiens
uaacugcauua

SEQ ID NO: 922599 - RNA, 22 nt, Homo sapiens
uaacuggcuucugcuugucauc

SEQ ID NO: 922600 - RNA, 14 nt, Homo sapiens
uaacuugugcuuuu

SEQ ID NO: 922601 - RNA, 22 nt, Homo sapiens
uaacuuuaggaaccaccauauu

SEQ ID NO: 922602 - RNA, 18 nt, Homo sapiens
uaagaagcuuucaguauu

SEQ ID NO: 922603 - RNA, 21 nt, Homo sapiens
uaagaaggcccugcaugugua

SEQ ID NO: 922604 - RNA, 12 nt, Homo sapiens
uaagaauguuca

SEQ ID NO: 922605 - RNA, 12 nt, Homo sapiens
uaagaauuucaa

SEQ ID NO: 922606 - RNA, 17 nt, Homo sapiens
uaagaauuucaauauca

SEQ ID NO: 922607 - RNA, 20 nt, Homo sapiens
uaagaccuuggcauccuucc

SEQ ID NO: 922608 - RNA, 14 nt, Homo sapiens
uaagcaacuggaaa

SEQ ID NO: 922609 - RNA, 23 nt, Homo sapiens
uaagcaauucauucucucugaac

SEQ ID NO: 922610 - RNA, 13 nt, Homo sapiens
uaaguacauauag

SEQ ID NO: 922611 - RNA, 16 nt, Homo sapiens
uaaguggcugugauua

SEQ ID NO: 922612 - RNA, 18 nt, Homo sapiens
uaauaaaauucauuccau

SEQ ID NO: 922613 - RNA, 23 nt, Homo sapiens
uaauaaagguuucguugcauggu

SEQ ID NO: 922614 - RNA, 17 nt, Homo sapiens
uaauaauaaaacaacag

SEQ ID NO: 922615 - RNA, 21 nt, Homo sapiens
uaauaccuuggacuuuggaca

SEQ ID NO: 922616 - RNA, 17 nt, Homo sapiens
uaauagaaagauacaac

SEQ ID NO: 922617 - RNA, 15 nt, Homo sapiens
uaauagcuauccuaa

SEQ ID NO: 922618 - RNA, 19 nt, Homo sapiens
uaaucccaguacuugggag

SEQ ID NO: 922619 - RNA, 17 nt, Homo sapiens
uaaucucagauuccuua

SEQ ID NO: 922620 - RNA, 15 nt, Homo sapiens
uaaugaucaacaauu

SEQ ID NO: 922621 - RNA, 23 nt, Homo sapiens
uaaugccaaguaacaaugcaugc

SEQ ID NO: 922622 - RNA, 18 nt, Homo sapiens
uaauguagauaaagcacu

SEQ ID NO: 922623 - RNA, 18 nt, Homo sapiens
uaauuacccacagaagga

SEQ ID NO: 922624 - RNA, 19 nt, Homo sapiens
uaauuuuucauuacagugu

SEQ ID NO: 922625 - RNA, 19 nt, Homo sapiens
uacaaaaagccaacaaacc

SEQ ID NO: 922626 - RNA, 21 nt, Homo sapiens
uacaaaaauuguucaaccuaa

SEQ ID NO: 922627 - RNA, 17 nt, Homo sapiens
uacaauucagagaauag

SEQ ID NO: 922628 - RNA, 13 nt, Homo sapiens
uacaccugaguca

SEQ ID NO: 922629 - RNA, 15 nt, Homo sapiens
uacagaaaugccaaa

SEQ ID NO: 922630 - RNA, 18 nt, Homo sapiens
uacagaaaugccaaaaau

SEQ ID NO: 922631 - RNA, 18 nt, Homo sapiens
uacaggugugagccacug

SEQ ID NO: 922632 - RNA, 21 nt, Homo sapiens
uacaguguaucucgaagucuu

SEQ ID NO: 922633 - RNA, 18 nt, Homo sapiens
uacaugacugaaggacau

SEQ ID NO: 922634 - RNA, 22 nt, Homo sapiens
uacaugaggggaaaacauguau

SEQ ID NO: 922635 - RNA, 21 nt, Homo sapiens
uacauuauuacuccuugccau

SEQ ID NO: 922636 - RNA, 15 nt, Homo sapiens
uaccaaaugcuucua

SEQ ID NO: 922637 - RNA, 18 nt, Homo sapiens
uaccaaguuuuauuguca

SEQ ID NO: 922638 - RNA, 12 nt, Homo sapiens
uaccagauuuga

SEQ ID NO: 922639 - RNA, 20 nt, Homo sapiens
uaccaguuguuagaucugua

SEQ ID NO: 922640 - RNA, 12 nt, Homo sapiens
uacccaccugag

SEQ ID NO: 922641 - RNA, 21 nt, Homo sapiens
uacccacuuuguggauuugau

SEQ ID NO: 922642 - RNA, 22 nt, Homo sapiens
uacccccacaugccaauuucag

SEQ ID NO: 922643 - RNA, 18 nt, Homo sapiens
uacccuagagguucauga

SEQ ID NO: 922644 - RNA, 13 nt, Homo sapiens
uaccucauucaca

SEQ ID NO: 922645 - RNA, 13 nt, Homo sapiens
uaccugaaaggaa

SEQ ID NO: 922646 - RNA, 21 nt, Homo sapiens
uaccugugaaucauauguugu

SEQ ID NO: 922647 - RNA, 14 nt, Homo sapiens
uaccuuguuauuaa

SEQ ID NO: 922648 - RNA, 17 nt, Homo sapiens
uacggaacacugucaau

SEQ ID NO: 922649 - RNA, 15 nt, Homo sapiens
uacgggcugcucuac

SEQ ID NO: 922650 - RNA, 12 nt, Homo sapiens
uacuaaauauga

SEQ ID NO: 922651 - RNA, 14 nt, Homo sapiens
uacuacacauccaa

SEQ ID NO: 922652 - RNA, 18 nt, Homo sapiens
uacuauagauucuuuauu

SEQ ID NO: 922653 - RNA, 13 nt, Homo sapiens
uacucugcacuau

SEQ ID NO: 922654 - RNA, 19 nt, Homo sapiens
uacucuggaggcugagaua

SEQ ID NO: 922655 - RNA, 18 nt, Homo sapiens
uacugaaugaccacuuga

SEQ ID NO: 922656 - RNA, 13 nt, Homo sapiens
uacuggaauuuau

SEQ ID NO: 922657 - RNA, 22 nt, Homo sapiens
uacuucugggaaccguaauuga

SEQ ID NO: 922658 - RNA, 23 nt, Homo sapiens
uacuuuucaguuuuuaacauaau

SEQ ID NO: 922659 - RNA, 21 nt, Homo sapiens
uagaaaaauuagaugacugaa

SEQ ID NO: 922660 - RNA, 15 nt, Homo sapiens
uagaaaguaacuuaa

SEQ ID NO: 922661 - RNA, 12 nt, Homo sapiens
uauuuacauuua

SEQ ID NO: 922662 - RNA, 23 nt, Homo sapiens
uauuugcacaaguacaguaacaa

SEQ ID NO: 922663 - RNA, 15 nt, Homo sapiens
uauuuuaaaauuuca

SEQ ID NO: 922664 - RNA, 21 nt, Homo sapiens
uauuuuaauagaaagauacaa

SEQ ID NO: 922665 - RNA, 12 nt, Homo sapiens
uauuuugaacaa

SEQ ID NO: 922666 - RNA, 14 nt, Homo sapiens
uauuuugacuguga

SEQ ID NO: 922667 - RNA, 16 nt, Homo sapiens
uauuuuggacguguga

SEQ ID NO: 922668 - RNA, 19 nt, Homo sapiens
ucaaaaaucauuaacacuu

SEQ ID NO: 922669 - RNA, 14 nt, Homo sapiens
ucaaaacagucaua

SEQ ID NO: 922670 - RNA, 14 nt, Homo sapiens
ucaaaaugugaacu

SEQ ID NO: 922671 - RNA, 11 nt, Homo sapiens
ucaaacagcuc

SEQ ID NO: 922672 - RNA, 14 nt, Homo sapiens
ucaaacucaaacac

SEQ ID NO: 922673 - RNA, 16 nt, Homo sapiens
ucaaagauucugcauu

SEQ ID NO: 922674 - RNA, 17 nt, Homo sapiens
ucaaagugguacaggaa

SEQ ID NO: 922675 - RNA, 19 nt, Homo sapiens
ucaaaguuaaccuaccugu

SEQ ID NO: 922676 - RNA, 14 nt, Homo sapiens
ucaaaucauauccu

SEQ ID NO: 922677 - RNA, 14 nt, Homo sapiens
ucaacagaaugcau

SEQ ID NO: 922678 - RNA, 18 nt, Homo sapiens
ucaacccaauaauucugu

SEQ ID NO: 922679 - RNA, 18 nt, Homo sapiens
ucaagaaagcauugccag

SEQ ID NO: 922680 - RNA, 21 nt, Homo sapiens
ucaaguuaugauucagugcau

SEQ ID NO: 922681 - RNA, 14 nt, Homo sapiens
ucaauacaaaaagc

SEQ ID NO: 922682 - RNA, 16 nt, Homo sapiens
ucaauacuuugaacac

SEQ ID NO: 922683 - RNA, 21 nt, Homo sapiens
ucaauggacugcaccuuguga

SEQ ID NO: 922684 - RNA, 14 nt, Homo sapiens
ucaauuucucccca

SEQ ID NO: 922685 - RNA, 15 nt, Homo sapiens
ucacaaacucaucca

SEQ ID NO: 922686 - RNA, 18 nt, Homo sapiens
ucacaaagcuaaauacau

SEQ ID NO: 922687 - RNA, 22 nt, Homo sapiens
ucacaaagcuaaauacauggaa

SEQ ID NO: 922688 - RNA, 22 nt, Homo sapiens
ucacaagaaaaaggaagccacu

SEQ ID NO: 922689 - RNA, 13 nt, Homo sapiens
ucacaagcugccu

SEQ ID NO: 922690 - RNA, 15 nt, Homo sapiens
ucacaauuugcaaau

SEQ ID NO: 922691 - RNA, 17 nt, Homo sapiens
ucacacuaucaacacug

SEQ ID NO: 922692 - RNA, 19 nt, Homo sapiens
ucacacuaucaacacugca

SEQ ID NO: 922693 - RNA, 16 nt, Homo sapiens
ucacagcuccuuguga

SEQ ID NO: 922694 - RNA, 13 nt, Homo sapiens
ucaccaaccaaag

SEQ ID NO: 922695 - RNA, 11 nt, Homo sapiens
ucaccaccacc

SEQ ID NO: 922696 - RNA, 20 nt, Homo sapiens
ucaccugcgcagggcccucu

SEQ ID NO: 922697 - RNA, 20 nt, Homo sapiens
ucaccugugcagggcccucu

SEQ ID NO: 922698 - RNA, 19 nt, Homo sapiens
ucacguucuggaacauucu

SEQ ID NO: 922699 - RNA, 18 nt, Homo sapiens
ucacuaggaggucaucaa

SEQ ID NO: 922700 - RNA, 23 nt, Homo sapiens
ucacucaacaaaagugcuuugga

SEQ ID NO: 922701 - RNA, 15 nt, Homo sapiens
ucacugccaacuuuu

SEQ ID NO: 922702 - RNA, 16 nt, Homo sapiens
ucacuguucaugaaua

SEQ ID NO: 922703 - RNA, 14 nt, Homo sapiens
ucacuucucccacc

SEQ ID NO: 922704 - RNA, 21 nt, Homo sapiens
ucagaauauauugaauaggca

SEQ ID NO: 922705 - RNA, 19 nt, Homo sapiens
ucagaaucccuuaacaguu

SEQ ID NO: 922706 - RNA, 16 nt, Homo sapiens
ucagaccacauuugaa

SEQ ID NO: 922707 - RNA, 14 nt, Homo sapiens
ucagauacuuguga

SEQ ID NO: 922708 - RNA, 17 nt, Homo sapiens
ucagcaauuuccugcuc

SEQ ID NO: 922709 - RNA, 17 nt, Homo sapiens
ucagcacccaacugaga

SEQ ID NO: 922710 - RNA, 14 nt, Homo sapiens
ucagcccugagcug

SEQ ID NO: 922711 - RNA, 14 nt, Homo sapiens
ucagcggcauuuag

SEQ ID NO: 922712 - RNA, 20 nt, Homo sapiens
ucagcuauaccucauucaca

SEQ ID NO: 922713 - RNA, 19 nt, Homo sapiens
ucagcuuuacuagugccaa

SEQ ID NO: 922714 - RNA, 22 nt, Homo sapiens
ucaggagagagcuuccuguuuc

SEQ ID NO: 922715 - RNA, 17 nt, Homo sapiens
ucaguuacuuaccugca

SEQ ID NO: 922716 - RNA, 19 nt, Homo sapiens
ucaguuauucagauugaca

SEQ ID NO: 922717 - RNA, 13 nt, Homo sapiens
ucauagccaaaaa

SEQ ID NO: 922718 - RNA, 17 nt, Homo sapiens
ucauauuaauguacuua

SEQ ID NO: 922719 - RNA, 15 nt, Homo sapiens
ucaucaacaauuuga

SEQ ID NO: 922720 - RNA, 18 nt, Homo sapiens
ucaucaauucucuaucau

SEQ ID NO: 922721 - RNA, 13 nt, Homo sapiens
ucaucaguauugu

SEQ ID NO: 922722 - RNA, 13 nt, Homo sapiens
ucaucuacuacag

SEQ ID NO: 922723 - RNA, 15 nt, Homo sapiens
ucaucuacuacaggg

SEQ ID NO: 922724 - RNA, 16 nt, Homo sapiens
ucaucuacuacagggu

SEQ ID NO: 922725 - RNA, 16 nt, Homo sapiens
uucacccaugaaauua

SEQ ID NO: 922726 - RNA, 17 nt, Homo sapiens
uucacugugaguucuga

SEQ ID NO: 922727 - RNA, 14 nt, Homo sapiens
uucauagcuguaua

SEQ ID NO: 922728 - RNA, 15 nt, Homo sapiens
uucauauaaauggaa

SEQ ID NO: 922729 - RNA, 19 nt, Homo sapiens
uucaucuacuacaggguga

SEQ ID NO: 922730 - RNA, 17 nt, Homo sapiens
uucauuagccaaauuga

SEQ ID NO: 922731 - RNA, 18 nt, Homo sapiens
uuccaaaggaagugcuaa

SEQ ID NO: 922732 - RNA, 16 nt, Homo sapiens
uuccaagccugggcca

SEQ ID NO: 922733 - RNA, 17 nt, Homo sapiens
uuccaccaaauucugaa

SEQ ID NO: 922734 - RNA, 22 nt, Homo sapiens
uuccacuccaaccagaagugaa

SEQ ID NO: 922735 - RNA, 17 nt, Homo sapiens
uuccaguggccuggcuc

SEQ ID NO: 922736 - RNA, 22 nt, Homo sapiens
uuccauauuuauguaccauauu

SEQ ID NO: 922737 - RNA, 17 nt, Homo sapiens
uuccaucuguacuuugg

SEQ ID NO: 922738 - RNA, 21 nt, Homo sapiens
uuccuaagguuaacuuugaau

SEQ ID NO: 922739 - RNA, 20 nt, Homo sapiens
uuccucaaagauucugcauu

SEQ ID NO: 922740 - RNA, 18 nt, Homo sapiens
uuccugcgcauggugcag

SEQ ID NO: 922741 - RNA, 19 nt, Homo sapiens
uuccugugccugugacucu

SEQ ID NO: 922742 - RNA, 22 nt, Homo sapiens
uuccuguguccacaucuaacaa

SEQ ID NO: 922743 - RNA, 19 nt, Homo sapiens
uucggauguuauauuaaaa

SEQ ID NO: 922744 - RNA, 15 nt, Homo sapiens
uucuaauccaugugc

SEQ ID NO: 922745 - RNA, 16 nt, Homo sapiens
uucuaauccaugugcu

SEQ ID NO: 922746 - RNA, 14 nt, Homo sapiens
uucuacuuugccac

SEQ ID NO: 922747 - RNA, 14 nt, Homo sapiens
uucuagauucacug

SEQ ID NO: 922748 - RNA, 18 nt, Homo sapiens
uucuauguucauguuagu

SEQ ID NO: 922749 - RNA, 21 nt, Homo sapiens
uucugaauuuguagacauacu

SEQ ID NO: 922750 - RNA, 24 nt, Homo sapiens
uucugugcauuguaaacauaaaca

SEQ ID NO: 922751 - RNA, 24 nt, Homo sapiens
uucuuaaaguggcuuucaacuuca

SEQ ID NO: 922752 - RNA, 13 nt, Homo sapiens
uucuucaccugua

SEQ ID NO: 922753 - RNA, 21 nt, Homo sapiens
uucuucugaagaucagaacau

SEQ ID NO: 922754 - RNA, 15 nt, Homo sapiens
uucuuguuaagugcu

SEQ ID NO: 922755 - RNA, 13 nt, Homo sapiens
uucuuuaaucaca

SEQ ID NO: 922756 - RNA, 10 nt, Homo sapiens
uucuuuccaa

SEQ ID NO: 922757 - RNA, 14 nt, Homo sapiens
uucuuuccaugcag

SEQ ID NO: 922758 - RNA, 23 nt, Homo sapiens
uugaaaauaauucuuugagacag

SEQ ID NO: 922759 - RNA, 18 nt, Homo sapiens
uugaaagguguagguuug

SEQ ID NO: 922760 - RNA, 13 nt, Homo sapiens
uugaaauguaauu

SEQ ID NO: 922761 - RNA, 22 nt, Homo sapiens
uugaacaacucgaaucacucau

SEQ ID NO: 922762 - RNA, 16 nt, Homo sapiens
uugaacauacuucauc

SEQ ID NO: 922763 - RNA, 12 nt, Homo sapiens
uugaacguucuc

SEQ ID NO: 922764 - RNA, 11 nt, Homo sapiens
uugacauugcg

SEQ ID NO: 922765 - RNA, 21 nt, Homo sapiens
uugagaagcaaauauguuugc

SEQ ID NO: 922766 - RNA, 23 nt, Homo sapiens
uugagaagcaaauauguuugcau

SEQ ID NO: 922767 - RNA, 21 nt, Homo sapiens
uugagguuguucaaaguuuaa

SEQ ID NO: 922768 - RNA, 22 nt, Homo sapiens
uugauauauucuuuccaugcag

SEQ ID NO: 922769 - RNA, 16 nt, Homo sapiens
uugaugaaagugcaaa

SEQ ID NO: 922770 - RNA, 18 nt, Homo sapiens
uugaugccaguaggcuca

SEQ ID NO: 922771 - RNA, 14 nt, Homo sapiens
uugauuacuuuuca

SEQ ID NO: 922772 - RNA, 19 nt, Homo sapiens
uugauucgaaggaugaaga

SEQ ID NO: 922773 - RNA, 13 nt, Homo sapiens
uugauucuugauu

SEQ ID NO: 922774 - RNA, 19 nt, Homo sapiens
gcugacagauguuccaucc

SEQ ID NO: 922775 - RNA, 16 nt, Homo sapiens
gcugagacuacaggug

SEQ ID NO: 922776 - RNA, 23 nt, Homo sapiens
gcugagacuacaggugagugcca

SEQ ID NO: 922777 - RNA, 16 nt, Homo sapiens
gcugagugcacuggca

SEQ ID NO: 922778 - RNA, 16 nt, Homo sapiens
gcugcaccccaagucc

SEQ ID NO: 922779 - RNA, 21 nt, Homo sapiens
gcugcaccccaaguccagguc

SEQ ID NO: 922780 - RNA, 22 nt, Homo sapiens
gcugcacuuauguaaacaauca

SEQ ID NO: 922781 - RNA, 18 nt, Homo sapiens
gcugcaucccaccagccu

SEQ ID NO: 922782 - RNA, 13 nt, Homo sapiens
gcugcggugggca

SEQ ID NO: 922783 - RNA, 14 nt, Homo sapiens
gcugcugaccagca

SEQ ID NO: 922784 - RNA, 17 nt, Homo sapiens
gcuggagaguggcauca

SEQ ID NO: 922785 - RNA, 14 nt, Homo sapiens
gcuggagauacuga

SEQ ID NO: 922786 - RNA, 23 nt, Homo sapiens
gcuggccaaggaggcuccugggg

SEQ ID NO: 922787 - RNA, 24 nt, Homo sapiens
gcuggucuugaacuccuagacuca

SEQ ID NO: 922788 - RNA, 15 nt, Homo sapiens
gcuggugaccggccu

SEQ ID NO: 922789 - RNA, 13 nt, Homo sapiens
gcuguauauuuga

SEQ ID NO: 922790 - RNA, 12 nt, Homo sapiens
gcugucauuaau

SEQ ID NO: 922791 - RNA, 16 nt, Homo sapiens
gcugugaauuagcuca

SEQ ID NO: 922792 - RNA, 13 nt, Homo sapiens
gcugugugcaguc

SEQ ID NO: 922793 - RNA, 22 nt, Homo sapiens
gcuguuuuuaauccaguuuaga

SEQ ID NO: 922794 - RNA, 18 nt, Homo sapiens
gcuuauaucuggccucug

SEQ ID NO: 922795 - RNA, 18 nt, Homo sapiens
gcuuauauuaagcaaaca

SEQ ID NO: 922796 - RNA, 20 nt, Homo sapiens
gcuucaaggauauacugcag

SEQ ID NO: 922797 - RNA, 13 nt, Homo sapiens
gcuuccacaaaca

SEQ ID NO: 922798 - RNA, 17 nt, Homo sapiens
gcuucccuuugauuuuu

SEQ ID NO: 922799 - RNA, 15 nt, Homo sapiens
gcuuccuauucucaa

SEQ ID NO: 922800 - RNA, 13 nt, Homo sapiens
gcuucuagcagcu

SEQ ID NO: 922801 - RNA, 19 nt, Homo sapiens
gcuucucugugacugaugu

SEQ ID NO: 922802 - RNA, 21 nt, Homo sapiens
gcuucuguccucuucugugag

SEQ ID NO: 922803 - RNA, 23 nt, Homo sapiens
gcuucuguccucuucugugaguc

SEQ ID NO: 922804 - RNA, 15 nt, Homo sapiens
gcuuggggacagaaa

SEQ ID NO: 922805 - RNA, 19 nt, Homo sapiens
gcuugguuuccucaccuug

SEQ ID NO: 922806 - RNA, 14 nt, Homo sapiens
gcuuucaguauuag

SEQ ID NO: 922807 - RNA, 17 nt, Homo sapiens
gcuuugauuguucauau

SEQ ID NO: 922808 - RNA, 19 nt, Homo sapiens
gcuuugauuguucauauca

SEQ ID NO: 922809 - RNA, 19 nt, Homo sapiens
gcuuuggacgcacacagcu

SEQ ID NO: 922810 - RNA, 17 nt, Homo sapiens
gcuuugucccacagcuu

SEQ ID NO: 922811 - RNA, 16 nt, Homo sapiens
ggaaaaauuaugugga

SEQ ID NO: 922812 - RNA, 19 nt, Homo sapiens
ggaaacaaccaugucauuu

SEQ ID NO: 922813 - RNA, 18 nt, Homo sapiens
ggaacaagaauugcuaaa

SEQ ID NO: 922814 - RNA, 12 nt, Homo sapiens
ggaacacuguca

SEQ ID NO: 922815 - RNA, 13 nt, Homo sapiens
ggaagcccugggu

SEQ ID NO: 922816 - RNA, 19 nt, Homo sapiens
ggaaucuuuuacuguggag

SEQ ID NO: 922817 - RNA, 12 nt, Homo sapiens
ggaauucagugc

SEQ ID NO: 922818 - RNA, 23 nt, Homo sapiens
ggacaaaggugauuuuccugugu

SEQ ID NO: 922819 - RNA, 17 nt, Homo sapiens
ggacacuagugacagua

SEQ ID NO: 922820 - RNA, 21 nt, Homo sapiens
ggacagugauuuucaaaacca

SEQ ID NO: 922821 - RNA, 19 nt, Homo sapiens
ggaccaauuagcauuccau

SEQ ID NO: 922822 - RNA, 14 nt, Homo sapiens
ggaccucaguuucu

SEQ ID NO: 922823 - RNA, 12 nt, Homo sapiens
ggacgaggucaa

SEQ ID NO: 922824 - RNA, 12 nt, Homo sapiens
ggagaguggcau

SEQ ID NO: 922825 - RNA, 15 nt, Homo sapiens
ggagauuucaguuac

SEQ ID NO: 922826 - RNA, 20 nt, Homo sapiens
ggagcagguuccccaagggc

SEQ ID NO: 922827 - RNA, 14 nt, Homo sapiens
ggaggcaccauuca

SEQ ID NO: 922828 - RNA, 13 nt, Homo sapiens
ggagguacuguga

SEQ ID NO: 922829 - RNA, 19 nt, Homo sapiens
ggagguggagguugcagug

SEQ ID NO: 922830 - RNA, 20 nt, Homo sapiens
ggagguggagguugcaguga

SEQ ID NO: 922831 - RNA, 18 nt, Homo sapiens
ggaucuaucaccugucau

SEQ ID NO: 922832 - RNA, 17 nt, Homo sapiens
ggauugggagauuucau

SEQ ID NO: 922833 - RNA, 20 nt, Homo sapiens
ggauuugaugaaagugcaaa

SEQ ID NO: 922834 - RNA, 20 nt, Homo sapiens
ggcacccagccucuagggac

SEQ ID NO: 922835 - RNA, 14 nt, Homo sapiens
ggcagcuucgugug

SEQ ID NO: 922836 - RNA, 14 nt, Homo sapiens
ggcaguuacagggc

SEQ ID NO: 922837 - RNA, 14 nt, Homo sapiens
ggcauuacucugca

SEQ ID NO: 922838 - RNA, 12 nt, Homo sapiens
ggcauuggccau

SEQ ID NO: 922839 - RNA, 20 nt, Homo sapiens
ggcauuuaguacauccagaa

SEQ ID NO: 922840 - RNA, 17 nt, Homo sapiens
ggcauuuuuccaaagga

SEQ ID NO: 922841 - RNA, 20 nt, Homo sapiens
ggccaggcuggucuugaacu

SEQ ID NO: 922842 - RNA, 17 nt, Homo sapiens
ggcccaagccuggucuc

SEQ ID NO: 922843 - RNA, 17 nt, Homo sapiens
ggcccaccuaccuucaa

SEQ ID NO: 922844 - RNA, 22 nt, Homo sapiens
ggcccaucacucggcuguggag

SEQ ID NO: 922845 - RNA, 13 nt, Homo sapiens
ggccccgggcugg

SEQ ID NO: 922846 - RNA, 14 nt, Homo sapiens
ggccgccuguccuu

SEQ ID NO: 922847 - RNA, 15 nt, Homo sapiens
aaaaacaaagugcaa

SEQ ID NO: 922848 - RNA, 13 nt, Homo sapiens
aaaaacaugucau

SEQ ID NO: 922849 - RNA, 16 nt, Homo sapiens
aaaaacaugucaugua

SEQ ID NO: 922850 - RNA, 23 nt, Homo sapiens
aaaaagcucugaagacccaaaga

SEQ ID NO: 922851 - RNA, 19 nt, Homo sapiens
aaaaauaaaaugcauuuaa

SEQ ID NO: 922852 - RNA, 16 nt, Homo sapiens
aaaaauaguggccaga

SEQ ID NO: 922853 - RNA, 16 nt, Homo sapiens
aaaacacugucugcau

SEQ ID NO: 922854 - RNA, 15 nt, Homo sapiens
aaaacccagcaugua

SEQ ID NO: 922855 - RNA, 21 nt, Homo sapiens
aaaacuucauucuaaaccaaa

SEQ ID NO: 922856 - RNA, 14 nt, Homo sapiens
aaaagagaccaaaa

SEQ ID NO: 922857 - RNA, 17 nt, Homo sapiens
aaaagauucaaaucucc

SEQ ID NO: 922858 - RNA, 12 nt, Homo sapiens
aaaagauugcaa

SEQ ID NO: 922859 - RNA, 13 nt, Homo sapiens
aaaagauugcaaa

SEQ ID NO: 922860 - RNA, 23 nt, Homo sapiens
aaaagcaaaaauugucaguguuu

SEQ ID NO: 922861 - RNA, 15 nt, Homo sapiens
aaaagucauucaaga

SEQ ID NO: 922862 - RNA, 22 nt, Homo sapiens
aaaaucaacccaauaauucugu

SEQ ID NO: 922863 - RNA, 17 nt, Homo sapiens
aaaaucucacgcugcca

SEQ ID NO: 922864 - RNA, 14 nt, Homo sapiens
aaaaugugaacuga

SEQ ID NO: 922865 - RNA, 19 nt, Homo sapiens
aaaauguuaugauaaucuu

SEQ ID NO: 922866 - RNA, 23 nt, Homo sapiens
aaaauguuaugauaaucuuucuc

SEQ ID NO: 922867 - RNA, 15 nt, Homo sapiens
aaaauuuucuuucaa

SEQ ID NO: 922868 - RNA, 14 nt, Homo sapiens
aaacaaaucuucaa

SEQ ID NO: 922869 - RNA, 15 nt, Homo sapiens
aaacagauucuccac

SEQ ID NO: 922870 - RNA, 15 nt, Homo sapiens
aaacaggcgcuguuu

SEQ ID NO: 922871 - RNA, 16 nt, Homo sapiens
aaacauuuacuuuugc

SEQ ID NO: 922872 - RNA, 17 nt, Homo sapiens
aaacccuucucuucucc

SEQ ID NO: 922873 - RNA, 16 nt, Homo sapiens
aaaccucuaacccagg

SEQ ID NO: 922874 - RNA, 12 nt, Homo sapiens
aaaccuuuccau

SEQ ID NO: 922875 - RNA, 22 nt, Homo sapiens
aaacgauuuugaacauacuuca

SEQ ID NO: 922876 - RNA, 17 nt, Homo sapiens
aaacuaaacuacagaaa

SEQ ID NO: 922877 - RNA, 16 nt, Homo sapiens
aaacuaugcuauuaaa

SEQ ID NO: 922878 - RNA, 19 nt, Homo sapiens
aaacuuccaagaccugacu

SEQ ID NO: 922879 - RNA, 17 nt, Homo sapiens
aaacuuuuuccaccuuu

SEQ ID NO: 922880 - RNA, 14 nt, Homo sapiens
aaagacaaagacau

SEQ ID NO: 922881 - RNA, 16 nt, Homo sapiens
aaagagagaagccagc

SEQ ID NO: 922882 - RNA, 18 nt, Homo sapiens
aaagaggauuaagcuuuu

SEQ ID NO: 922883 - RNA, 14 nt, Homo sapiens
aaagagguuuucac

SEQ ID NO: 922884 - RNA, 13 nt, Homo sapiens
aaagauucaaauc

SEQ ID NO: 922885 - RNA, 20 nt, Homo sapiens
aaagcacagggacacaaaga

SEQ ID NO: 922886 - RNA, 15 nt, Homo sapiens
aaagccaacaaacca

SEQ ID NO: 922887 - RNA, 14 nt, Homo sapiens
aaagcugcuugaau

SEQ ID NO: 922888 - RNA, 22 nt, Homo sapiens
aaaggaagucucugggcccaga

SEQ ID NO: 922889 - RNA, 21 nt, Homo sapiens
aaaggcaugcgcucacugcuu

SEQ ID NO: 922890 - RNA, 22 nt, Homo sapiens
aaagggagcagagaaggccagg

SEQ ID NO: 922891 - RNA, 19 nt, Homo sapiens
aaaggggcaggagcucaga

SEQ ID NO: 922892 - RNA, 13 nt, Homo sapiens
aaagguccuugac

SEQ ID NO: 922893 - RNA, 20 nt, Homo sapiens
aaagguuucguugcauggua

SEQ ID NO: 922894 - RNA, 20 nt, Homo sapiens
aaaguauggcagugggagac

SEQ ID NO: 922895 - RNA, 15 nt, Homo sapiens
aaagugcuagccacu

SEQ ID NO: 922896 - RNA, 22 nt, Homo sapiens
aaaguguauugcaagugaaaua

SEQ ID NO: 922897 - RNA, 15 nt, Homo sapiens
aaaguuaaauugcac

SEQ ID NO: 922898 - RNA, 22 nt, Homo sapiens
aaaguuguguaggcaccaccuc

SEQ ID NO: 922899 - RNA, 14 nt, Homo sapiens
aggacuucugugca

SEQ ID NO: 922900 - RNA, 20 nt, Homo sapiens
aggagauuaacacacugaac

SEQ ID NO: 922901 - RNA, 12 nt, Homo sapiens
aggagcucagau

SEQ ID NO: 922902 - RNA, 21 nt, Homo sapiens
aggaggaaauaaauugcagag

SEQ ID NO: 922903 - RNA, 14 nt, Homo sapiens
aggaggaucacuug

SEQ ID NO: 922904 - RNA, 20 nt, Homo sapiens
aggagguugagaaugcagug

SEQ ID NO: 922905 - RNA, 18 nt, Homo sapiens
aggauauacugcagcuuu

SEQ ID NO: 922906 - RNA, 15 nt, Homo sapiens
aggaucaguuugcag

SEQ ID NO: 922907 - RNA, 21 nt, Homo sapiens
aggcaaggggugccugggaac

SEQ ID NO: 922908 - RNA, 22 nt, Homo sapiens
aggcaauuagagaaaguccauu

SEQ ID NO: 922909 - RNA, 18 nt, Homo sapiens
aggcaccaccucugucac

SEQ ID NO: 922910 - RNA, 17 nt, Homo sapiens
aggcagagggucacuuu

SEQ ID NO: 922911 - RNA, 20 nt, Homo sapiens
aggcagagggucacuuuaca

SEQ ID NO: 922912 - RNA, 17 nt, Homo sapiens
aggcauuaaaugcaaaa

SEQ ID NO: 922913 - RNA, 18 nt, Homo sapiens
aggcauuuuuccaaagga

SEQ ID NO: 922914 - RNA, 16 nt, Homo sapiens
aggcccuggaggucuc

SEQ ID NO: 922915 - RNA, 19 nt, Homo sapiens
aggccgggcucaguggcuc

SEQ ID NO: 922916 - RNA, 22 nt, Homo sapiens
aggccugaccucaagcaaccau

SEQ ID NO: 922917 - RNA, 20 nt, Homo sapiens
aggcuaaaaaacggauuucc

SEQ ID NO: 922918 - RNA, 22 nt, Homo sapiens
aggcuaaaaaacggauuuccuc

SEQ ID NO: 922919 - RNA, 17 nt, Homo sapiens
aggcuaggaagaacuug

SEQ ID NO: 922920 - RNA, 15 nt, Homo sapiens
aggcucagcccugag

SEQ ID NO: 922921 - RNA, 15 nt, Homo sapiens
aggcugaagcaggau

SEQ ID NO: 922922 - RNA, 18 nt, Homo sapiens
aggcugagugcacuggca

SEQ ID NO: 922923 - RNA, 15 nt, Homo sapiens
aggcugauaucuuca

SEQ ID NO: 922924 - RNA, 23 nt, Homo sapiens
aggcuggagugaucucagcucac

SEQ ID NO: 922925 - RNA, 17 nt, Homo sapiens
aggcuggucuugaacuc

SEQ ID NO: 922926 - RNA, 23 nt, Homo sapiens
aggcuguguguggaaauggccac

SEQ ID NO: 922927 - RNA, 12 nt, Homo sapiens
aggcuuacaacu

SEQ ID NO: 922928 - RNA, 19 nt, Homo sapiens
agggaagccgccuuugcaa

SEQ ID NO: 922929 - RNA, 22 nt, Homo sapiens
agggagaucuuggggugcagca

SEQ ID NO: 922930 - RNA, 14 nt, Homo sapiens
agggagugagugca

SEQ ID NO: 922931 - RNA, 15 nt, Homo sapiens
agggaugccauaccu

SEQ ID NO: 922932 - RNA, 18 nt, Homo sapiens
agggaugcggauccugcu

SEQ ID NO: 922933 - RNA, 17 nt, Homo sapiens
agggcagcuguggcuuc

SEQ ID NO: 922934 - RNA, 18 nt, Homo sapiens
agggcauccaacugagaa

SEQ ID NO: 922935 - RNA, 14 nt, Homo sapiens
agggcccucugggg

SEQ ID NO: 922936 - RNA, 14 nt, Homo sapiens
agggcuggguguau

SEQ ID NO: 922937 - RNA, 18 nt, Homo sapiens
aggggacgccugugucac

SEQ ID NO: 922938 - RNA, 21 nt, Homo sapiens
aggggcaggagcucagaugaa

SEQ ID NO: 922939 - RNA, 17 nt, Homo sapiens
aggggccucuggcugcc

SEQ ID NO: 922940 - RNA, 19 nt, Homo sapiens
aggggcuucacccaugaaa

SEQ ID NO: 922941 - RNA, 19 nt, Homo sapiens
agggggcccucugccucau

SEQ ID NO: 922942 - RNA, 23 nt, Homo sapiens
aggguagaaaaaggagcuuaccu

SEQ ID NO: 922943 - RNA, 14 nt, Homo sapiens
agggucagugccaa

SEQ ID NO: 922944 - RNA, 13 nt, Homo sapiens
agggugucuguca

SEQ ID NO: 922945 - RNA, 14 nt, Homo sapiens
agggugucugucag

SEQ ID NO: 922946 - RNA, 14 nt, Homo sapiens
aggucaugccacug

SEQ ID NO: 922947 - RNA, 23 nt, Homo sapiens
aggucguuugauuucaaagcaag

SEQ ID NO: 922948 - RNA, 17 nt, Homo sapiens
aggugaccgcccgccuc

SEQ ID NO: 922949 - RNA, 22 nt, Homo sapiens
aggugagugccaccacacucag

SEQ ID NO: 922950 - RNA, 19 nt, Homo sapiens
aggugggcggaucaccuga

SEQ ID NO: 922951 - RNA, 13 nt, Homo sapiens
agguuccaaauuc

SEQ ID NO: 922952 - RNA, 16 nt, Homo sapiens
agguugcagugagcua

SEQ ID NO: 922953 - RNA, 19 nt, Homo sapiens
agguuucacuguucaugaa

SEQ ID NO: 922954 - RNA, 16 nt, Homo sapiens
aguaaaaaauguaagu

SEQ ID NO: 922955 - RNA, 23 nt, Homo sapiens
aguaaaacaauugugacagcagu

SEQ ID NO: 922956 - RNA, 22 nt, Homo sapiens
aguaacaaucugcuuucuuugu

SEQ ID NO: 922957 - RNA, 23 nt, Homo sapiens
aguaacaaugcaugcuuuggaaa

SEQ ID NO: 922958 - RNA, 21 nt, Homo sapiens
aguagaucuguggcgauauga

SEQ ID NO: 922959 - RNA, 15 nt, Homo sapiens
aguagcauccuguga

SEQ ID NO: 922960 - RNA, 12 nt, Homo sapiens
aguauacuuuca

SEQ ID NO: 922961 - RNA, 19 nt, Homo sapiens
aguaugcacuaaucaauac

SEQ ID NO: 922962 - RNA, 20 nt, Homo sapiens
agucaaauuuggauuuucca

SEQ ID NO: 922963 - RNA, 13 nt, Homo sapiens
agucacaauuuca

SEQ ID NO: 922964 - RNA, 15 nt, Homo sapiens
agucacaauuugcaa

SEQ ID NO: 922965 - RNA, 18 nt, Homo sapiens
agucacaauuugcaaauu

SEQ ID NO: 922966 - RNA, 15 nt, Homo sapiens
agucuuguacuguga

SEQ ID NO: 922967 - RNA, 22 nt, Homo sapiens
agucuuuguaaguaaacugccc

SEQ ID NO: 922968 - RNA, 18 nt, Homo sapiens
agugacaguauaaagggc

SEQ ID NO: 922969 - RNA, 11 nt, Homo sapiens
agugagcaaac

SEQ ID NO: 922970 - RNA, 21 nt, Homo sapiens
agugcagucacccuguggcaa

SEQ ID NO: 922971 - RNA, 16 nt, Homo sapiens
agugcaguggugcgau

SEQ ID NO: 922972 - RNA, 14 nt, Homo sapiens
agugcccagugaug

SEQ ID NO: 922973 - RNA, 19 nt, Homo sapiens
agugcugggauuacaggug

SEQ ID NO: 922974 - RNA, 22 nt, Homo sapiens
agugggccccgggcuggagaaa

SEQ ID NO: 922975 - RNA, 14 nt, Homo sapiens
agugucuaauuccc

SEQ ID NO: 922976 - RNA, 13 nt, Homo sapiens
aguguucaaauac

SEQ ID NO: 922977 - RNA, 13 nt, Homo sapiens
aguuaaauugcac

SEQ ID NO: 922978 - RNA, 15 nt, Homo sapiens
aguuacuuaccugca

SEQ ID NO: 922979 - RNA, 14 nt, Homo sapiens
aguucauacugaau

SEQ ID NO: 922980 - RNA, 13 nt, Homo sapiens
aguucccaucacc

SEQ ID NO: 922981 - RNA, 16 nt, Homo sapiens
aguucccucaguguga

SEQ ID NO: 922982 - RNA, 12 nt, Homo sapiens
aguucugaugag

SEQ ID NO: 922983 - RNA, 20 nt, Homo sapiens
aguugguucuuuuaccccac

SEQ ID NO: 922984 - RNA, 13 nt, Homo sapiens
aguuuaagcaauu

SEQ ID NO: 922985 - RNA, 15 nt, Homo sapiens
aguuucuucaccugu

SEQ ID NO: 922986 - RNA, 13 nt, Homo sapiens
aguuugucaggca

SEQ ID NO: 922987 - RNA, 20 nt, Homo sapiens
auaaaaacauaaauaauacc

SEQ ID NO: 922988 - RNA, 16 nt, Homo sapiens
auaaaauacauacuau

SEQ ID NO: 922989 - RNA, 16 nt, Homo sapiens
auaaaauucauuccau

SEQ ID NO: 922990 - RNA, 14 nt, Homo sapiens
auaaagaacauucu

SEQ ID NO: 922991 - RNA, 15 nt, Homo sapiens
auaaagaaugcucau

SEQ ID NO: 922992 - RNA, 18 nt, Homo sapiens
auaaaguuaaauugcacg

SEQ ID NO: 922993 - RNA, 21 nt, Homo sapiens
auaaaguuaaauugcacgugc

SEQ ID NO: 922994 - RNA, 18 nt, Homo sapiens
auaaaucugccauuucaa

SEQ ID NO: 922995 - RNA, 17 nt, Homo sapiens
auaaauuaauuugacca

SEQ ID NO: 922996 - RNA, 14 nt, Homo sapiens
auaagaaugaaucu

SEQ ID NO: 922997 - RNA, 18 nt, Homo sapiens
auaagacugucauguaag

SEQ ID NO: 922998 - RNA, 16 nt, Homo sapiens
auaauaaaauucauuc

SEQ ID NO: 922999 - RNA, 20 nt, Homo sapiens
ccagggaggaauugggguuu

SEQ ID NO: 923000 - RNA, 18 nt, Homo sapiens
ccaggguucaguccucaa

SEQ ID NO: 923001 - RNA, 22 nt, Homo sapiens
ccagguaggaugaacacaggca

SEQ ID NO: 923002 - RNA, 21 nt, Homo sapiens
ccaguacguacauauuuuaau

SEQ ID NO: 923003 - RNA, 19 nt, Homo sapiens
ccaguuuuggaagugggga

SEQ ID NO: 923004 - RNA, 17 nt, Homo sapiens
ccaucccggaguucucc

SEQ ID NO: 923005 - RNA, 22 nt, Homo sapiens
ccauccuggcuaacacggugaa

SEQ ID NO: 923006 - RNA, 17 nt, Homo sapiens
ccaucugcugccaugag

SEQ ID NO: 923007 - RNA, 15 nt, Homo sapiens
ccaucuguacuuugg

SEQ ID NO: 923008 - RNA, 17 nt, Homo sapiens
ccauggcuaaggcacca

SEQ ID NO: 923009 - RNA, 16 nt, Homo sapiens
ccauggucacagagaa

SEQ ID NO: 923010 - RNA, 20 nt, Homo sapiens
ccauuaaccagggcaccaag

SEQ ID NO: 923011 - RNA, 16 nt, Homo sapiens
ccauuucccugaacag

SEQ ID NO: 923012 - RNA, 20 nt, Homo sapiens
cccaaaaacaagcaaaacca

SEQ ID NO: 923013 - RNA, 12 nt, Homo sapiens
cccaaaucucaa

SEQ ID NO: 923014 - RNA, 23 nt, Homo sapiens
cccaagcuggccacuaucacaua

SEQ ID NO: 923015 - RNA, 13 nt, Homo sapiens
cguucagcuguga

SEQ ID NO: 923016 - RNA, 19 nt, Homo sapiens
cguucagcugugacgaagg

SEQ ID NO: 923017 - RNA, 20 nt, Homo sapiens
cguucucuucucucuucaau

SEQ ID NO: 923018 - RNA, 18 nt, Homo sapiens
cuaaaagucagcuuuacu

SEQ ID NO: 923019 - RNA, 21 nt, Homo sapiens
cuaaaaucaagugcaccuaca

SEQ ID NO: 923020 - RNA, 10 nt, Homo sapiens
cuaaagccag

SEQ ID NO: 923021 - RNA, 13 nt, Homo sapiens
cuaaauaugaagg

SEQ ID NO: 923022 - RNA, 23 nt, Homo sapiens
cuaagacaggaggaucacaagag

SEQ ID NO: 923023 - RNA, 17 nt, Homo sapiens
cuaagagacacauacag

SEQ ID NO: 923024 - RNA, 19 nt, Homo sapiens
cuaagccguuggcaccucu

SEQ ID NO: 923025 - RNA, 14 nt, Homo sapiens
cuaagccugaugau

SEQ ID NO: 923026 - RNA, 14 nt, Homo sapiens
cuaagcuaauucca

SEQ ID NO: 923027 - RNA, 23 nt, Homo sapiens
cuaaugggaugccuuuuacuuug

SEQ ID NO: 923028 - RNA, 23 nt, Homo sapiens
cuacaauucacauccccaaaggu

SEQ ID NO: 923029 - RNA, 23 nt, Homo sapiens
cuacacaaaauacagcacuuuga

SEQ ID NO: 923030 - RNA, 15 nt, Homo sapiens
cuacaccaacugcuc

SEQ ID NO: 923031 - RNA, 14 nt, Homo sapiens
cuacaccugucauu

SEQ ID NO: 923032 - RNA, 19 nt, Homo sapiens
cuacagggugucugucagu

SEQ ID NO: 923033 - RNA, 22 nt, Homo sapiens
cuaccacugucuucuucagggu

SEQ ID NO: 923034 - RNA, 13 nt, Homo sapiens
cuaccagauuuga

SEQ ID NO: 923035 - RNA, 11 nt, Homo sapiens
cuaccaucucc

SEQ ID NO: 923036 - RNA, 23 nt, Homo sapiens
cuaccugcccucucucaguuauu

SEQ ID NO: 923037 - RNA, 16 nt, Homo sapiens
cuacugaaauuaucau

SEQ ID NO: 923038 - RNA, 18 nt, Homo sapiens
cuacugaggagcaaagca

SEQ ID NO: 923039 - RNA, 15 nt, Homo sapiens
cuacugguaaccaag

SEQ ID NO: 923040 - RNA, 12 nt, Homo sapiens
cuagagccucac

SEQ ID NO: 923041 - RNA, 14 nt, Homo sapiens
cuagagguacuuuc

SEQ ID NO: 923042 - RNA, 13 nt, Homo sapiens
cuagagguucaug

SEQ ID NO: 923043 - RNA, 14 nt, Homo sapiens
cuagguaacaguuu

SEQ ID NO: 923044 - RNA, 16 nt, Homo sapiens
cuagugauuucugggg

SEQ ID NO: 923045 - RNA, 19 nt, Homo sapiens
cuaguucccucagugugaa

SEQ ID NO: 923046 - RNA, 15 nt, Homo sapiens
cuauaccucacaaua

SEQ ID NO: 923047 - RNA, 19 nt, Homo sapiens
cuauagaaaacgauuuuga

SEQ ID NO: 923048 - RNA, 14 nt, Homo sapiens
cuauagccauuugc

SEQ ID NO: 923049 - RNA, 19 nt, Homo sapiens
cuauagccauuugccccaa

SEQ ID NO: 923050 - RNA, 16 nt, Homo sapiens
cuaucaacacugcagc

SEQ ID NO: 923051 - RNA, 15 nt, Homo sapiens
cuaucaccugucauc

SEQ ID NO: 923052 - RNA, 13 nt, Homo sapiens
cuauccuugauga

SEQ ID NO: 923053 - RNA, 23 nt, Homo sapiens
cuaucggagcaguucaauaacaa

SEQ ID NO: 923054 - RNA, 18 nt, Homo sapiens
cuauuaagaaaaucacau

SEQ ID NO: 923055 - RNA, 16 nt, Homo sapiens
cuauugcuuaaacaaa

SEQ ID NO: 923056 - RNA, 21 nt, Homo sapiens
cuauuucuggcacuugcaagu

SEQ ID NO: 923057 - RNA, 21 nt, Homo sapiens
cuauuucuuuuuuaagucaaa

SEQ ID NO: 923058 - RNA, 16 nt, Homo sapiens
cuauuuugcaaacaaa

SEQ ID NO: 923059 - RNA, 16 nt, Homo sapiens
cuauuuuggacgugug

SEQ ID NO: 923060 - RNA, 18 nt, Homo sapiens
cucaaaaaggugugucaa

SEQ ID NO: 923061 - RNA, 20 nt, Homo sapiens
cucaaaauaagccaugcugc

SEQ ID NO: 923062 - RNA, 16 nt, Homo sapiens
cucaaaggacugaccu

SEQ ID NO: 923063 - RNA, 16 nt, Homo sapiens
cucaaaguuaaccuac

SEQ ID NO: 923064 - RNA, 23 nt, Homo sapiens
cucaacauggaaaaauccuguca

SEQ ID NO: 923065 - RNA, 13 nt, Homo sapiens
cucaacuagggag

SEQ ID NO: 923066 - RNA, 12 nt, Homo sapiens
cucaacuugugu

SEQ ID NO: 923067 - RNA, 17 nt, Homo sapiens
cucaagagguuugugaa

SEQ ID NO: 923068 - RNA, 16 nt, Homo sapiens
cucaagcaaccaugaa

SEQ ID NO: 923069 - RNA, 15 nt, Homo sapiens
cucaagcacugacac

SEQ ID NO: 923070 - RNA, 22 nt, Homo sapiens
cucaauauauucaguaaugaag

SEQ ID NO: 923071 - RNA, 15 nt, Homo sapiens
cucacacuuugccau

SEQ ID NO: 923072 - RNA, 13 nt, Homo sapiens
cucaccaacccag

SEQ ID NO: 923073 - RNA, 14 nt, Homo sapiens
cucaccugacauua

SEQ ID NO: 923074 - RNA, 17 nt, Homo sapiens
cucacgcugccauuucc

SEQ ID NO: 923075 - RNA, 14 nt, Homo sapiens
cucacuauggugcc

SEQ ID NO: 923076 - RNA, 18 nt, Homo sapiens
cucagacguuccauaccc

SEQ ID NO: 923077 - RNA, 17 nt, Homo sapiens
cucagcaacagccagug

SEQ ID NO: 923078 - RNA, 14 nt, Homo sapiens
cucagcagccucag

SEQ ID NO: 923079 - RNA, 15 nt, Homo sapiens
cucagccaccccuca

SEQ ID NO: 923080 - RNA, 21 nt, Homo sapiens
cucagcuauaccucauucaca

SEQ ID NO: 923081 - RNA, 15 nt, Homo sapiens
cucagcucacugcaa

SEQ ID NO: 923082 - RNA, 19 nt, Homo sapiens
cucagguuccaaauucagu

SEQ ID NO: 923083 - RNA, 21 nt, Homo sapiens
cucaguggcucacaccuguaa

SEQ ID NO: 923084 - RNA, 17 nt, Homo sapiens
cucaugggucacugggg

SEQ ID NO: 923085 - RNA, 21 nt, Homo sapiens
cucauguuugugcauguauau

SEQ ID NO: 923086 - RNA, 22 nt, Homo sapiens
cuccaugcugucacuugugauu

SEQ ID NO: 923087 - RNA, 11 nt, Homo sapiens
cucccaaagug

SEQ ID NO: 923088 - RNA, 20 nt, Homo sapiens
cucccaaagugcugagauua

SEQ ID NO: 923089 - RNA, 23 nt, Homo sapiens
cuccccagacaucuggacacugg

SEQ ID NO: 923090 - RNA, 13 nt, Homo sapiens
cucccccauuuua

SEQ ID NO: 923091 - RNA, 14 nt, Homo sapiens
cuccccuccaaaga

SEQ ID NO: 923092 - RNA, 20 nt, Homo sapiens
cucccucgaacccacacugc

SEQ ID NO: 923093 - RNA, 21 nt, Homo sapiens
cucccucgaacccacacugca

SEQ ID NO: 923094 - RNA, 11 nt, Homo sapiens
cuccucugucc

SEQ ID NO: 923095 - RNA, 12 nt, Homo sapiens
cuccuuccucuu

SEQ ID NO: 923096 - RNA, 14 nt, Homo sapiens
cucguuaacacaug

SEQ ID NO: 923097 - RNA, 17 nt, Homo sapiens
cucucaggugaccaaaa

SEQ ID NO: 923098 - RNA, 18 nt, Homo sapiens
cucucaguuauucagauu

SEQ ID NO: 923099 - RNA, 23 nt, Homo sapiens
cucuccuggcccugaaggugcca

SEQ ID NO: 923100 - RNA, 15 nt, Homo sapiens
cucucggacucccua

SEQ ID NO: 923101 - RNA, 21 nt, Homo sapiens
cucucugcuggguuuccacac

SEQ ID NO: 923102 - RNA, 14 nt, Homo sapiens
cucucuucaaucuc

SEQ ID NO: 923103 - RNA, 17 nt, Homo sapiens
cucugaacacacauugc

SEQ ID NO: 923104 - RNA, 13 nt, Homo sapiens
cucugacucccaa

SEQ ID NO: 923105 - RNA, 20 nt, Homo sapiens
cucugagugaauacuuugau

SEQ ID NO: 923106 - RNA, 17 nt, Homo sapiens
cucuggaggcugagaua

SEQ ID NO: 923107 - RNA, 17 nt, Homo sapiens
cucuguugucuaaaaua

SEQ ID NO: 923108 - RNA, 23 nt, Homo sapiens
cucuuccuagcuuaaaaucugau

SEQ ID NO: 923109 - RNA, 18 nt, Homo sapiens
cucuuccuggaaugcauu

SEQ ID NO: 923110 - RNA, 17 nt, Homo sapiens
cucuucggaagaccucg

SEQ ID NO: 923111 - RNA, 18 nt, Homo sapiens
cucuucugagcuaaggca

SEQ ID NO: 923112 - RNA, 22 nt, Homo sapiens
cucuucuucuuucuacaguauu

SEQ ID NO: 923113 - RNA, 21 nt, Homo sapiens
cugaaacugaguugaauagag

SEQ ID NO: 923114 - RNA, 19 nt, Homo sapiens
cugaacauaguagauugac

SEQ ID NO: 923115 - RNA, 17 nt, Homo sapiens
cugaaugggagccagaa

SEQ ID NO: 923116 - RNA, 15 nt, Homo sapiens
cugaccaccuugcac

SEQ ID NO: 923117 - RNA, 17 nt, Homo sapiens
cugacugaguagcucau

SEQ ID NO: 923118 - RNA, 16 nt, Homo sapiens
cugagacggagucuca

SEQ ID NO: 923119 - RNA, 16 nt, Homo sapiens
cugagaucacucgcuu

SEQ ID NO: 923120 - RNA, 15 nt, Homo sapiens
cugagauggggacag

SEQ ID NO: 923121 - RNA, 15 nt, Homo sapiens
cugagauuacaggug

SEQ ID NO: 923122 - RNA, 13 nt, Homo sapiens
cugagccacugga

SEQ ID NO: 923123 - RNA, 20 nt, Homo sapiens
cugagcgggucuaguggaaa

SEQ ID NO: 923124 - RNA, 13 nt, Homo sapiens
auucaaucaaagc

SEQ ID NO: 923125 - RNA, 22 nt, Homo sapiens
auucaauuuacagguaccagua

SEQ ID NO: 923126 - RNA, 14 nt, Homo sapiens
auucaauuugauuc

SEQ ID NO: 923127 - RNA, 15 nt, Homo sapiens
auucaccaaccaaag

SEQ ID NO: 923128 - RNA, 16 nt, Homo sapiens
auucagauugacaagg

SEQ ID NO: 923129 - RNA, 15 nt, Homo sapiens
auucaguaguggaaa

SEQ ID NO: 923130 - RNA, 22 nt, Homo sapiens
auucaguaguggaaaugaguga

SEQ ID NO: 923131 - RNA, 18 nt, Homo sapiens
auucagugagacacagag

SEQ ID NO: 923132 - RNA, 13 nt, Homo sapiens
auucauaccuguu

SEQ ID NO: 923133 - RNA, 18 nt, Homo sapiens
auucauucucucugaaca

SEQ ID NO: 923134 - RNA, 14 nt, Homo sapiens
auucauuucaucua

SEQ ID NO: 923135 - RNA, 20 nt, Homo sapiens
auucccaugguagacuguga

SEQ ID NO: 923136 - RNA, 22 nt, Homo sapiens
auucccaugguagacugugaca

SEQ ID NO: 923137 - RNA, 17 nt, Homo sapiens
auucccggcuggacuuu

SEQ ID NO: 923138 - RNA, 20 nt, Homo sapiens
auuccuaggcaacuauuaau

SEQ ID NO: 923139 - RNA, 18 nt, Homo sapiens
auuccugcgcauggugca

SEQ ID NO: 923140 - RNA, 13 nt, Homo sapiens
auucuaaaccaaa

SEQ ID NO: 923141 - RNA, 20 nt, Homo sapiens
auucuggaugggcuuggcca

SEQ ID NO: 923142 - RNA, 17 nt, Homo sapiens
auucuguuaaaacucaa

SEQ ID NO: 923143 - RNA, 20 nt, Homo sapiens
auucuugugacuuacagugc

SEQ ID NO: 923144 - RNA, 22 nt, Homo sapiens
auugaaaugggaacaauaucaa

SEQ ID NO: 923145 - RNA, 14 nt, Homo sapiens
caguaauagcugaa

SEQ ID NO: 923146 - RNA, 17 nt, Homo sapiens
caguaauagcugaaccu

SEQ ID NO: 923147 - RNA, 16 nt, Homo sapiens
caguagggaccugccc

SEQ ID NO: 923148 - RNA, 12 nt, Homo sapiens
caguaguggaaa

SEQ ID NO: 923149 - RNA, 16 nt, Homo sapiens
caguccgcucuuccaa

SEQ ID NO: 923150 - RNA, 16 nt, Homo sapiens
cagucuuguacuguga

SEQ ID NO: 923151 - RNA, 18 nt, Homo sapiens
cagucuuguacugugacc

SEQ ID NO: 923152 - RNA, 23 nt, Homo sapiens
cagugcccaccagccuuguccua

SEQ ID NO: 923153 - RNA, 15 nt, Homo sapiens
caguguggucaagca

SEQ ID NO: 923154 - RNA, 13 nt, Homo sapiens
caguucauacuga

SEQ ID NO: 923155 - RNA, 18 nt, Homo sapiens
caguucccaucaccauca

SEQ ID NO: 923156 - RNA, 13 nt, Homo sapiens
caguucugaugag

SEQ ID NO: 923157 - RNA, 12 nt, Homo sapiens
caguuuuuuaca

SEQ ID NO: 923158 - RNA, 13 nt, Homo sapiens
cauaaagguuuac

SEQ ID NO: 923159 - RNA, 14 nt, Homo sapiens
cauaacucugauua

SEQ ID NO: 923160 - RNA, 23 nt, Homo sapiens
cauaacuucagauacuugugaac

SEQ ID NO: 923161 - RNA, 17 nt, Homo sapiens
cauaaucacaaauauag

SEQ ID NO: 923162 - RNA, 17 nt, Homo sapiens
cauacccccacaugcca

SEQ ID NO: 923163 - RNA, 19 nt, Homo sapiens
cauauauaugccuuaugua

SEQ ID NO: 923164 - RNA, 14 nt, Homo sapiens
cauauauuguuauu

SEQ ID NO: 923165 - RNA, 14 nt, Homo sapiens
cauaucaacuugag

SEQ ID NO: 923166 - RNA, 21 nt, Homo sapiens
cauaucaagaaauugauugaa

SEQ ID NO: 923167 - RNA, 22 nt, Homo sapiens
cauauugcaaccuaguacuuua

SEQ ID NO: 923168 - RNA, 22 nt, Homo sapiens
cauauuuuuagauacagugaaa

SEQ ID NO: 923169 - RNA, 13 nt, Homo sapiens
caucagcagugau

SEQ ID NO: 923170 - RNA, 13 nt, Homo sapiens
cauccaacugaga

SEQ ID NO: 923171 - RNA, 17 nt, Homo sapiens
caucccaacagccaaga

SEQ ID NO: 923172 - RNA, 20 nt, Homo sapiens
caucccagccuuggcaucua

SEQ ID NO: 923173 - RNA, 19 nt, Homo sapiens
cauccuuuuuaaaugagac

SEQ ID NO: 923174 - RNA, 18 nt, Homo sapiens
caucgcaguggacugugu

SEQ ID NO: 923175 - RNA, 16 nt, Homo sapiens
caucuacuacagggug

SEQ ID NO: 923176 - RNA, 14 nt, Homo sapiens
caucuggacacugg

SEQ ID NO: 923177 - RNA, 21 nt, Homo sapiens
caucuuggccaggcuggucuu

SEQ ID NO: 923178 - RNA, 14 nt, Homo sapiens
caugacacauuuga

SEQ ID NO: 923179 - RNA, 15 nt, Homo sapiens
caugacacauuugaa

SEQ ID NO: 923180 - RNA, 22 nt, Homo sapiens
caugacaggaguuugugugcaa

SEQ ID NO: 923181 - RNA, 14 nt, Homo sapiens
caugccaagcauuu

SEQ ID NO: 923182 - RNA, 23 nt, Homo sapiens
caugccuuauauuuguccaacaa

SEQ ID NO: 923183 - RNA, 21 nt, Homo sapiens
caugcuuaaggggguguaaug

SEQ ID NO: 923184 - RNA, 21 nt, Homo sapiens
caugcuuuugcagacaguccu

SEQ ID NO: 923185 - RNA, 16 nt, Homo sapiens
caugggaaacuuccaa

SEQ ID NO: 923186 - RNA, 16 nt, Homo sapiens
caugggcacaagcaaa

SEQ ID NO: 923187 - RNA, 14 nt, Homo sapiens
caugguagacugug

SEQ ID NO: 923188 - RNA, 13 nt, Homo sapiens
cauggugcaugcc

SEQ ID NO: 923189 - RNA, 18 nt, Homo sapiens
caugguuuagggugauca

SEQ ID NO: 923190 - RNA, 17 nt, Homo sapiens
cauguccaaacccaucu

SEQ ID NO: 923191 - RNA, 20 nt, Homo sapiens
cauguggcugacuaggucaa

SEQ ID NO: 923192 - RNA, 15 nt, Homo sapiens
cauguuacgugugca

SEQ ID NO: 923193 - RNA, 17 nt, Homo sapiens
cauuaaccagggcacca

SEQ ID NO: 923194 - RNA, 16 nt, Homo sapiens
cauuaccgucugugau

SEQ ID NO: 923195 - RNA, 14 nt, Homo sapiens
cauuauuacuccuu

SEQ ID NO: 923196 - RNA, 23 nt, Homo sapiens
cauucucuccaguguguguaaca

SEQ ID NO: 923197 - RNA, 22 nt, Homo sapiens
cauucuugugacuuacagugcc

SEQ ID NO: 923198 - RNA, 22 nt, Homo sapiens
cauugauuuuugauagacugaa

SEQ ID NO: 923199 - RNA, 11 nt, Homo sapiens
cauuguuaaag

SEQ ID NO: 923200 - RNA, 22 nt, Homo sapiens
cauuuaaaaauaucugaauaua

SEQ ID NO: 923201 - RNA, 15 nt, Homo sapiens
cauuuaauagacuua

SEQ ID NO: 923202 - RNA, 19 nt, Homo sapiens
cauuuaauauuuaugcucu

SEQ ID NO: 923203 - RNA, 23 nt, Homo sapiens
cauuuagcuuguuccacugcaaa

SEQ ID NO: 923204 - RNA, 17 nt, Homo sapiens
cauuucaucuacuacag

SEQ ID NO: 923205 - RNA, 20 nt, Homo sapiens
cauuucaucuacuacagggu

SEQ ID NO: 923206 - RNA, 13 nt, Homo sapiens
cauuuggaaugaa

SEQ ID NO: 923207 - RNA, 22 nt, Homo sapiens
cauuuuucaauaaaguacugca

SEQ ID NO: 923208 - RNA, 14 nt, Homo sapiens
ccaaaacacugucu

SEQ ID NO: 923209 - RNA, 18 nt, Homo sapiens
ccaaacggaacucuucau

SEQ ID NO: 923210 - RNA, 23 nt, Homo sapiens
ccaaagagcugccuaagaggcaa

SEQ ID NO: 923211 - RNA, 21 nt, Homo sapiens
ccaaaggaagcuuucucugcu

SEQ ID NO: 923212 - RNA, 18 nt, Homo sapiens
ccaaagggggacagugau

SEQ ID NO: 923213 - RNA, 20 nt, Homo sapiens
ccaaauuugucuaagaacuu

SEQ ID NO: 923214 - RNA, 18 nt, Homo sapiens
ccaacagccaagacccaa

SEQ ID NO: 923215 - RNA, 18 nt, Homo sapiens
ccaacgcuugacacaaag

SEQ ID NO: 923216 - RNA, 14 nt, Homo sapiens
ccaagacccaacag

SEQ ID NO: 923217 - RNA, 23 nt, Homo sapiens
ccaagcuggagugcaguggugcg

SEQ ID NO: 923218 - RNA, 18 nt, Homo sapiens
ccaaggaaauauugagag

SEQ ID NO: 923219 - RNA, 22 nt, Homo sapiens
ccaaggacacgacacacaguag

SEQ ID NO: 923220 - RNA, 21 nt, Homo sapiens
ccaaggcagagcgcaaagugc

SEQ ID NO: 923221 - RNA, 14 nt, Homo sapiens
ccaaggcaggcaua

SEQ ID NO: 923222 - RNA, 15 nt, Homo sapiens
ccaaggucaggaggc

SEQ ID NO: 923223 - RNA, 15 nt, Homo sapiens
ccaagucuuccugac

SEQ ID NO: 923224 - RNA, 12 nt, Homo sapiens
ccaauacauuau

SEQ ID NO: 923225 - RNA, 23 nt, Homo sapiens
ccaauacauuauuggacuuccau

SEQ ID NO: 923226 - RNA, 18 nt, Homo sapiens
ccaauccucaccuaacag

SEQ ID NO: 923227 - RNA, 23 nt, Homo sapiens
ccaaucugcaggcucuaucuuug

SEQ ID NO: 923228 - RNA, 16 nt, Homo sapiens
ccaauuagcauuccau

SEQ ID NO: 923229 - RNA, 18 nt, Homo sapiens
ccaauuagcauuccauca

SEQ ID NO: 923230 - RNA, 17 nt, Homo sapiens
ccaauucauuucaucua

SEQ ID NO: 923231 - RNA, 23 nt, Homo sapiens
ccaauuuuggggugugacacuuu

SEQ ID NO: 923232 - RNA, 13 nt, Homo sapiens
ccacaacaguccc

SEQ ID NO: 923233 - RNA, 13 nt, Homo sapiens
ccacacugggacu

SEQ ID NO: 923234 - RNA, 23 nt, Homo sapiens
ccaccaaauucugaauuuguaga

SEQ ID NO: 923235 - RNA, 19 nt, Homo sapiens
ccaccaguguguugaaucc

SEQ ID NO: 923236 - RNA, 20 nt, Homo sapiens
ccacccccaaugcacagggc

SEQ ID NO: 923237 - RNA, 18 nt, Homo sapiens
ccacuaaaauguggguga

SEQ ID NO: 923238 - RNA, 17 nt, Homo sapiens
ccacuaagcuaauucca

SEQ ID NO: 923239 - RNA, 12 nt, Homo sapiens
ccacucaccaac

SEQ ID NO: 923240 - RNA, 15 nt, Homo sapiens
ccacuccaaccagaa

SEQ ID NO: 923241 - RNA, 13 nt, Homo sapiens
ccacuccagugcc

SEQ ID NO: 923242 - RNA, 22 nt, Homo sapiens
ccacucugagugaauacuuuga

SEQ ID NO: 923243 - RNA, 10 nt, Homo sapiens
ccacuggaaa

SEQ ID NO: 923244 - RNA, 16 nt, Homo sapiens
ccagaagcuccgugag

SEQ ID NO: 923245 - RNA, 19 nt, Homo sapiens
ccagacaucuggacacugg

SEQ ID NO: 923246 - RNA, 17 nt, Homo sapiens
ccagagcugggugagug

SEQ ID NO: 923247 - RNA, 16 nt, Homo sapiens
ccagcacuuugggagg

SEQ ID NO: 923248 - RNA, 21 nt, Homo sapiens
ccagccuggguaacagaguga

SEQ ID NO: 923249 - RNA, 15 nt, Homo sapiens
ccaggcagcuggcua

SEQ ID NO: 923250 - RNA, 16 nt, Homo sapiens
accuagcgucaguauu

SEQ ID NO: 923251 - RNA, 20 nt, Homo sapiens
accuauuuugcaaacaaacu

SEQ ID NO: 923252 - RNA, 20 nt, Homo sapiens
accucaaaauaagccaugcu

SEQ ID NO: 923253 - RNA, 21 nt, Homo sapiens
accucaagcaaccaugaacuc

SEQ ID NO: 923254 - RNA, 15 nt, Homo sapiens
accucauucacagcu

SEQ ID NO: 923255 - RNA, 18 nt, Homo sapiens
accuccuucucugucuca

SEQ ID NO: 923256 - RNA, 15 nt, Homo sapiens
accucugacuugcua

SEQ ID NO: 923257 - RNA, 15 nt, Homo sapiens
accugacacaauccc

SEQ ID NO: 923258 - RNA, 19 nt, Homo sapiens
accugacacaaucccuaca

SEQ ID NO: 923259 - RNA, 16 nt, Homo sapiens
accugagguugcuuua

SEQ ID NO: 923260 - RNA, 15 nt, Homo sapiens
accugccacuaggcu

SEQ ID NO: 923261 - RNA, 17 nt, Homo sapiens
accuguuguacacuugg

SEQ ID NO: 923262 - RNA, 15 nt, Homo sapiens
accuuccucugccuu

SEQ ID NO: 923263 - RNA, 14 nt, Homo sapiens
acgagcccuuuuag

SEQ ID NO: 923264 - RNA, 14 nt, Homo sapiens
acgcagacugacuc

SEQ ID NO: 923265 - RNA, 14 nt, Homo sapiens
acggaacacuguca

SEQ ID NO: 923266 - RNA, 16 nt, Homo sapiens
acggccuaugagauga

SEQ ID NO: 923267 - RNA, 21 nt, Homo sapiens
acgugacuggucuccuaacca

SEQ ID NO: 923268 - RNA, 16 nt, Homo sapiens
acguuccauaccccca

SEQ ID NO: 923269 - RNA, 20 nt, Homo sapiens
acuaaauggcugcagaacuc

SEQ ID NO: 923270 - RNA, 16 nt, Homo sapiens
acuaauaaaauacaua

SEQ ID NO: 923271 - RNA, 17 nt, Homo sapiens
acuaaucaauacuuuga

SEQ ID NO: 923272 - RNA, 22 nt, Homo sapiens
acuaccacuuauuucuaaaucc

SEQ ID NO: 923273 - RNA, 20 nt, Homo sapiens
acuacuuugguuguguaugu

SEQ ID NO: 923274 - RNA, 18 nt, Homo sapiens
acuauagccauuugcccc

SEQ ID NO: 923275 - RNA, 15 nt, Homo sapiens
acuauggugccaaug

SEQ ID NO: 923276 - RNA, 16 nt, Homo sapiens
acuauguaaaugugaa

SEQ ID NO: 923277 - RNA, 17 nt, Homo sapiens
acucaaaggacugaccu

SEQ ID NO: 923278 - RNA, 22 nt, Homo sapiens
acucauccuuuuuaaaugagac

SEQ ID NO: 923279 - RNA, 20 nt, Homo sapiens
acucaucguucuaaaaucaa

SEQ ID NO: 923280 - RNA, 15 nt, Homo sapiens
acucauuuauuucca

SEQ ID NO: 923281 - RNA, 16 nt, Homo sapiens
acuccaucugcugcca

SEQ ID NO: 923282 - RNA, 22 nt, Homo sapiens
acuccgcaaauauccuccacuu

SEQ ID NO: 923283 - RNA, 23 nt, Homo sapiens
acucggaauucccugaagcaaca

SEQ ID NO: 923284 - RNA, 22 nt, Homo sapiens
acucugagugaauacuuugaug

SEQ ID NO: 923285 - RNA, 12 nt, Homo sapiens
acucuuugcaac

SEQ ID NO: 923286 - RNA, 18 nt, Homo sapiens
acugaaugaccacuugau

SEQ ID NO: 923287 - RNA, 23 nt, Homo sapiens
acugaaugaccacuugauaugac

SEQ ID NO: 923288 - RNA, 13 nt, Homo sapiens
acugaauucugaa

SEQ ID NO: 923289 - RNA, 13 nt, Homo sapiens
acugacacucauu

SEQ ID NO: 923290 - RNA, 14 nt, Homo sapiens
acugauaaaccaaa

SEQ ID NO: 923291 - RNA, 12 nt, Homo sapiens
acugaugucauc

SEQ ID NO: 923292 - RNA, 13 nt, Homo sapiens
acugccaacuuuu

SEQ ID NO: 923293 - RNA, 17 nt, Homo sapiens
acugcccugucuagguc

SEQ ID NO: 923294 - RNA, 23 nt, Homo sapiens
acugcguaggagagaacagggau

SEQ ID NO: 923295 - RNA, 12 nt, Homo sapiens
acugcucaagaa

SEQ ID NO: 923296 - RNA, 22 nt, Homo sapiens
acugcucaagaacuacgggcug

SEQ ID NO: 923297 - RNA, 19 nt, Homo sapiens
acugcucucaaaaugugaa

SEQ ID NO: 923298 - RNA, 23 nt, Homo sapiens
acugcuucaggaaggacauggac

SEQ ID NO: 923299 - RNA, 20 nt, Homo sapiens
acugcuuuaaaaaacaauua

SEQ ID NO: 923300 - RNA, 23 nt, Homo sapiens
acuggaaaugcaugacuucccuc

SEQ ID NO: 923301 - RNA, 20 nt, Homo sapiens
acuggcaggaucacagcuca

SEQ ID NO: 923302 - RNA, 20 nt, Homo sapiens
acuggguagguucugaacag

SEQ ID NO: 923303 - RNA, 15 nt, Homo sapiens
acuguaacugcauua

SEQ ID NO: 923304 - RNA, 14 nt, Homo sapiens
acugugacacagcu

SEQ ID NO: 923305 - RNA, 14 nt, Homo sapiens
acugugcugauuca

SEQ ID NO: 923306 - RNA, 16 nt, Homo sapiens
acuguuugucuucucc

SEQ ID NO: 923307 - RNA, 20 nt, Homo sapiens
acuguuuucucugaucucaa

SEQ ID NO: 923308 - RNA, 16 nt, Homo sapiens
acuuaaugguguaugu

SEQ ID NO: 923309 - RNA, 21 nt, Homo sapiens
acuuaauuuuuccugcuguau

SEQ ID NO: 923310 - RNA, 23 nt, Homo sapiens
acuuaccugcauguguuguacaa

SEQ ID NO: 923311 - RNA, 20 nt, Homo sapiens
acuuaucucuaaaccaucua

SEQ ID NO: 923312 - RNA, 16 nt, Homo sapiens
acuuauuuccauggau

SEQ ID NO: 923313 - RNA, 13 nt, Homo sapiens
acuucacacagca

SEQ ID NO: 923314 - RNA, 13 nt, Homo sapiens
acuucacagagac

SEQ ID NO: 923315 - RNA, 21 nt, Homo sapiens
acuucacagagacucuguccu

SEQ ID NO: 923316 - RNA, 18 nt, Homo sapiens
acuucagauacuugugaa

SEQ ID NO: 923317 - RNA, 18 nt, Homo sapiens
acuucccagagaacuuca

SEQ ID NO: 923318 - RNA, 22 nt, Homo sapiens
acuucgaaaacuuuaacaaaca

SEQ ID NO: 923319 - RNA, 17 nt, Homo sapiens
acuucugcccauucucu

SEQ ID NO: 923320 - RNA, 16 nt, Homo sapiens
acuugacaagucagga

SEQ ID NO: 923321 - RNA, 14 nt, Homo sapiens
acuugcaaguccca

SEQ ID NO: 923322 - RNA, 16 nt, Homo sapiens
acuugcggauuuccac

SEQ ID NO: 923323 - RNA, 15 nt, Homo sapiens
acuugggccauagcu

SEQ ID NO: 923324 - RNA, 19 nt, Homo sapiens
acuugugaacaugccuuau

SEQ ID NO: 923325 - RNA, 18 nt, Homo sapiens
acuuuugcuuucuaccug

SEQ ID NO: 923326 - RNA, 14 nt, Homo sapiens
agaaaaauaaucuu

SEQ ID NO: 923327 - RNA, 21 nt, Homo sapiens
agaaaacagaggccacacuuu

SEQ ID NO: 923328 - RNA, 14 nt, Homo sapiens
agaaaauugccaaa

SEQ ID NO: 923329 - RNA, 19 nt, Homo sapiens
agaaacaacgcaaaccucu

SEQ ID NO: 923330 - RNA, 14 nt, Homo sapiens
agaaagaguucagu

SEQ ID NO: 923331 - RNA, 23 nt, Homo sapiens
agaaagcagaggcuggccucaga

SEQ ID NO: 923332 - RNA, 15 nt, Homo sapiens
agaaagcauugccag

SEQ ID NO: 923333 - RNA, 23 nt, Homo sapiens
agaaaucccaguucauguugcuc

SEQ ID NO: 923334 - RNA, 22 nt, Homo sapiens
agaaaugccacucaccaaccca

SEQ ID NO: 923335 - RNA, 19 nt, Homo sapiens
agaacagggaugcuaucuc

SEQ ID NO: 923336 - RNA, 16 nt, Homo sapiens
agaacauugauuucau

SEQ ID NO: 923337 - RNA, 14 nt, Homo sapiens
agaaccugguggcu

SEQ ID NO: 923338 - RNA, 23 nt, Homo sapiens
agaaccugguggcuggaggcauu

SEQ ID NO: 923339 - RNA, 17 nt, Homo sapiens
agaacgggaguggccau

SEQ ID NO: 923340 - RNA, 12 nt, Homo sapiens
agaacugaugac

SEQ ID NO: 923341 - RNA, 21 nt, Homo sapiens
agaacugcuaaauacuguaca

SEQ ID NO: 923342 - RNA, 12 nt, Homo sapiens
agaagagggaga

SEQ ID NO: 923343 - RNA, 13 nt, Homo sapiens
agaagcaagacac

SEQ ID NO: 923344 - RNA, 21 nt, Homo sapiens
agaagccugugcccugaucca

SEQ ID NO: 923345 - RNA, 15 nt, Homo sapiens
agaaggagaggcucu

SEQ ID NO: 923346 - RNA, 13 nt, Homo sapiens
agaaucagccugg

SEQ ID NO: 923347 - RNA, 16 nt, Homo sapiens
agaauuaucaucccaa

SEQ ID NO: 923348 - RNA, 23 nt, Homo sapiens
agaauucacuaggaggucaucaa

SEQ ID NO: 923349 - RNA, 17 nt, Homo sapiens
agaauucagacaucuga

SEQ ID NO: 923350 - RNA, 19 nt, Homo sapiens
agaauucuggacaacccaa

SEQ ID NO: 923351 - RNA, 13 nt, Homo sapiens
agaauucuuaaca

SEQ ID NO: 923352 - RNA, 13 nt, Homo sapiens
agacaagcacuuu

SEQ ID NO: 923353 - RNA, 11 nt, Homo sapiens
agacaccucag

SEQ ID NO: 923354 - RNA, 20 nt, Homo sapiens
agacaguccuuaaugcugaa

SEQ ID NO: 923355 - RNA, 21 nt, Homo sapiens
agacaguuuuccaaacugugu

SEQ ID NO: 923356 - RNA, 19 nt, Homo sapiens
agacauuccugcgcauggu

SEQ ID NO: 923357 - RNA, 23 nt, Homo sapiens
agaccaagcaggaagaacauuga

SEQ ID NO: 923358 - RNA, 15 nt, Homo sapiens
agaccagcuucuagc

SEQ ID NO: 923359 - RNA, 18 nt, Homo sapiens
agaccccuggcugguaag

SEQ ID NO: 923360 - RNA, 12 nt, Homo sapiens
agaccuuggcau

SEQ ID NO: 923361 - RNA, 20 nt, Homo sapiens
agacuacaggugagugccac

SEQ ID NO: 923362 - RNA, 18 nt, Homo sapiens
agguccuugacuugauga

SEQ ID NO: 923363 - RNA, 15 nt, Homo sapiens
aggucgagacauucc

SEQ ID NO: 923364 - RNA, 18 nt, Homo sapiens
aggucgagacauuccugc

SEQ ID NO: 923365 - RNA, 22 nt, Homo sapiens
aggugaacuguuuccacauuca

SEQ ID NO: 923366 - RNA, 12 nt, Homo sapiens
aggugaauaauu

SEQ ID NO: 923367 - RNA, 14 nt, Homo sapiens
aggugccacuccag

SEQ ID NO: 923368 - RNA, 17 nt, Homo sapiens
aggugccacuccagugc

SEQ ID NO: 923369 - RNA, 19 nt, Homo sapiens
aggugcccgaguagcaucc

SEQ ID NO: 923370 - RNA, 23 nt, Homo sapiens
agguuauuuuccgccagaccuca

SEQ ID NO: 923371 - RNA, 18 nt, Homo sapiens
agguucugucugugccaa

SEQ ID NO: 923372 - RNA, 23 nt, Homo sapiens
agguuugggauguauauugcuau

SEQ ID NO: 923373 - RNA, 14 nt, Homo sapiens
agguuuucacaaau

SEQ ID NO: 923374 - RNA, 22 nt, Homo sapiens
uaacaaagaaguguauuuacaa

SEQ ID NO: 923375 - RNA, 22 nt, Homo sapiens
uaacaaagguuacuguugagaa

SEQ ID NO: 923376 - RNA, 17 nt, Homo sapiens
uaacaauguuugucauu

SEQ ID NO: 923377 - RNA, 17 nt, Homo sapiens
uaacaugacacauuuga

SEQ ID NO: 923378 - RNA, 17 nt, Homo sapiens
uaacugauaaaccaaaa

SEQ ID NO: 923379 - RNA, 17 nt, Homo sapiens
uaacuucagauacuugu

SEQ ID NO: 923380 - RNA, 20 nt, Homo sapiens
uaacuucagauacuugugaa

SEQ ID NO: 923381 - RNA, 21 nt, Homo sapiens
uaacuucagauacuugugaac

SEQ ID NO: 923382 - RNA, 16 nt, Homo sapiens
uaagaaaaacauguca

SEQ ID NO: 923383 - RNA, 15 nt, Homo sapiens
uaagaacaaaacugu

SEQ ID NO: 923384 - RNA, 22 nt, Homo sapiens
uaagcaaacuauauuuuaauaa

SEQ ID NO: 923385 - RNA, 17 nt, Homo sapiens
uaagcauuuucuacaca

SEQ ID NO: 923386 - RNA, 20 nt, Homo sapiens
uaagcauuuucuacacagcg

SEQ ID NO: 923387 - RNA, 16 nt, Homo sapiens
uaagcuaauuccacac

SEQ ID NO: 923388 - RNA, 14 nt, Homo sapiens
uaaggaaaugugcg

SEQ ID NO: 923389 - RNA, 23 nt, Homo sapiens
uaagggcuuuaauacaaaaagca

SEQ ID NO: 923390 - RNA, 13 nt, Homo sapiens
uaaguaaacugcc

SEQ ID NO: 923391 - RNA, 22 nt, Homo sapiens
uaaguaauuuccccacucugag

SEQ ID NO: 923392 - RNA, 19 nt, Homo sapiens
uaauacaaaaagcaaaaau

SEQ ID NO: 923393 - RNA, 14 nt, Homo sapiens
uaauaccacuacua

SEQ ID NO: 923394 - RNA, 15 nt, Homo sapiens
uaauaucgcugauau

SEQ ID NO: 923395 - RNA, 15 nt, Homo sapiens
uaauauuuaugcucu

SEQ ID NO: 923396 - RNA, 15 nt, Homo sapiens
uaaucaauacuuuga

SEQ ID NO: 923397 - RNA, 13 nt, Homo sapiens
uaaugacuuuuaa

SEQ ID NO: 923398 - RNA, 11 nt, Homo sapiens
uaaugauacug

SEQ ID NO: 923399 - RNA, 19 nt, Homo sapiens
uaauguagauaaagcacug

SEQ ID NO: 923400 - RNA, 19 nt, Homo sapiens
uaauucuguauuaacugaa

SEQ ID NO: 923401 - RNA, 12 nt, Homo sapiens
uaauucuuuauc

SEQ ID NO: 923402 - RNA, 21 nt, Homo sapiens
uaauuuaugcagagacagcug

SEQ ID NO: 923403 - RNA, 18 nt, Homo sapiens
uaauuuccccacucugag

SEQ ID NO: 923404 - RNA, 14 nt, Homo sapiens
uaauuuuaauacca

SEQ ID NO: 923405 - RNA, 17 nt, Homo sapiens
uaauuuuuacaugacca

SEQ ID NO: 923406 - RNA, 20 nt, Homo sapiens
uacaacauuguggaugugua

SEQ ID NO: 923407 - RNA, 23 nt, Homo sapiens
uacaauaccagaucacucaaaaa

SEQ ID NO: 923408 - RNA, 16 nt, Homo sapiens
uacaaucguucugugu

SEQ ID NO: 923409 - RNA, 22 nt, Homo sapiens
uacacaaaauacagcacuuuga

SEQ ID NO: 923410 - RNA, 13 nt, Homo sapiens
uacacccaugcac

SEQ ID NO: 923411 - RNA, 21 nt, Homo sapiens
uacaccuaacucaccuaacuc

SEQ ID NO: 923412 - RNA, 22 nt, Homo sapiens
uacagaaaccuaggguuuucua

SEQ ID NO: 923413 - RNA, 13 nt, Homo sapiens
uacagcacuuuga

SEQ ID NO: 923414 - RNA, 16 nt, Homo sapiens
uacagggcccagguga

SEQ ID NO: 923415 - RNA, 20 nt, Homo sapiens
uacaggugagugccaccaca

SEQ ID NO: 923416 - RNA, 12 nt, Homo sapiens
uacaguaugugu

SEQ ID NO: 923417 - RNA, 11 nt, Homo sapiens
uacaguggaau

SEQ ID NO: 923418 - RNA, 17 nt, Homo sapiens
uacauagagagagacag

SEQ ID NO: 923419 - RNA, 18 nt, Homo sapiens
uacauaugaucaaauacu

SEQ ID NO: 923420 - RNA, 20 nt, Homo sapiens
uacauucugcucccagcucu

SEQ ID NO: 923421 - RNA, 23 nt, Homo sapiens
uaccaaguuuuauugucaagaca

SEQ ID NO: 923422 - RNA, 18 nt, Homo sapiens
uacccaccugagcuuugg

SEQ ID NO: 923423 - RNA, 21 nt, Homo sapiens
uacccaccugagcuuuggacg

SEQ ID NO: 923424 - RNA, 17 nt, Homo sapiens
uacucuugcugcacuua

SEQ ID NO: 923425 - RNA, 22 nt, Homo sapiens
uacugaacauaguagauugaca

SEQ ID NO: 923426 - RNA, 12 nt, Homo sapiens
uacugacuuuuu

SEQ ID NO: 923427 - RNA, 22 nt, Homo sapiens
uacugugaccuaagaacaaaac

SEQ ID NO: 923428 - RNA, 23 nt, Homo sapiens
uacuuauuauuccagaucugcag

SEQ ID NO: 923429 - RNA, 16 nt, Homo sapiens
uacuuguauguagcag

SEQ ID NO: 923430 - RNA, 21 nt, Homo sapiens
uacuuugaacacaaagccugu

SEQ ID NO: 923431 - RNA, 15 nt, Homo sapiens
uagaaccaugaauuc

SEQ ID NO: 923432 - RNA, 18 nt, Homo sapiens
uagaaucaagucugugaa

SEQ ID NO: 923433 - RNA, 15 nt, Homo sapiens
uagaaugaaccaaua

SEQ ID NO: 923434 - RNA, 22 nt, Homo sapiens
uagaccaagcaggaagaacauu

SEQ ID NO: 923435 - RNA, 14 nt, Homo sapiens
uagauaaagcacug

SEQ ID NO: 923436 - RNA, 22 nt, Homo sapiens
uagauaaagcacuguuuggaua

SEQ ID NO: 923437 - RNA, 15 nt, Homo sapiens
uagaucauaagacug

SEQ ID NO: 923438 - RNA, 14 nt, Homo sapiens
uagauuauguucaa

SEQ ID NO: 923439 - RNA, 19 nt, Homo sapiens
uagauuuucuuuugccuuu

SEQ ID NO: 923440 - RNA, 18 nt, Homo sapiens
uagcaaauuccaauacau

SEQ ID NO: 923441 - RNA, 17 nt, Homo sapiens
uagcagcauuuacagaa

SEQ ID NO: 923442 - RNA, 19 nt, Homo sapiens
uagcaggcccagcuggggc

SEQ ID NO: 923443 - RNA, 15 nt, Homo sapiens
uagcaguuucacugc

SEQ ID NO: 923444 - RNA, 13 nt, Homo sapiens
uagcauauauaau

SEQ ID NO: 923445 - RNA, 14 nt, Homo sapiens
uagccuccaaaagu

SEQ ID NO: 923446 - RNA, 14 nt, Homo sapiens
uagcgucaguauuu

SEQ ID NO: 923447 - RNA, 16 nt, Homo sapiens
uaggaaaagcuguucc

SEQ ID NO: 923448 - RNA, 14 nt, Homo sapiens
uaguagaugcaucu

SEQ ID NO: 923449 - RNA, 13 nt, Homo sapiens
uagucaggagaag

SEQ ID NO: 923450 - RNA, 19 nt, Homo sapiens
uagugaaguaugcacuaau

SEQ ID NO: 923451 - RNA, 18 nt, Homo sapiens
uaguugauuacuuuucag

SEQ ID NO: 923452 - RNA, 18 nt, Homo sapiens
uaguugggauuacaggug

SEQ ID NO: 923453 - RNA, 12 nt, Homo sapiens
uauaaagcagua

SEQ ID NO: 923454 - RNA, 15 nt, Homo sapiens
uauaagaaaauggag

SEQ ID NO: 923455 - RNA, 21 nt, Homo sapiens
uauaagaagcuuucaguauua

SEQ ID NO: 923456 - RNA, 13 nt, Homo sapiens
uauaagcauuuaa

SEQ ID NO: 923457 - RNA, 16 nt, Homo sapiens
uauaaguuucuuuaga

SEQ ID NO: 923458 - RNA, 17 nt, Homo sapiens
uauaauaaaugggcaca

SEQ ID NO: 923459 - RNA, 20 nt, Homo sapiens
uauaauuuuauugcuggaau

SEQ ID NO: 923460 - RNA, 12 nt, Homo sapiens
uauacauaugau

SEQ ID NO: 923461 - RNA, 14 nt, Homo sapiens
uauacauaugauca

SEQ ID NO: 923462 - RNA, 18 nt, Homo sapiens
uauagaaaacgauuuuga

SEQ ID NO: 923463 - RNA, 21 nt, Homo sapiens
uauagauucuuuauuagugaa

SEQ ID NO: 923464 - RNA, 14 nt, Homo sapiens
uauauauguagcca

SEQ ID NO: 923465 - RNA, 13 nt, Homo sapiens
uauauccauaaga

SEQ ID NO: 923466 - RNA, 14 nt, Homo sapiens
uauauccauaagau

SEQ ID NO: 923467 - RNA, 20 nt, Homo sapiens
uauaugauuugcauguguaa

SEQ ID NO: 923468 - RNA, 19 nt, Homo sapiens
uauaugguuuuuccagcua

SEQ ID NO: 923469 - RNA, 16 nt, Homo sapiens
uauauguaaacaguga

SEQ ID NO: 923470 - RNA, 21 nt, Homo sapiens
uauauguuuauguaacuauca

SEQ ID NO: 923471 - RNA, 18 nt, Homo sapiens
uauauucaguaaugaaga

SEQ ID NO: 923472 - RNA, 13 nt, Homo sapiens
uauauuucugaua

SEQ ID NO: 923473 - RNA, 21 nt, Homo sapiens
uauauuuucugaguagcauau

SEQ ID NO: 923474 - RNA, 14 nt, Homo sapiens
uaucaaaugguuau

SEQ ID NO: 923475 - RNA, 13 nt, Homo sapiens
uaucauagauuua

SEQ ID NO: 923476 - RNA, 20 nt, Homo sapiens
uaucuacgcccuuccugugc

SEQ ID NO: 923477 - RNA, 12 nt, Homo sapiens
uaucuguuauau

SEQ ID NO: 923478 - RNA, 21 nt, Homo sapiens
uaugaccaaaacuauuccauu

SEQ ID NO: 923479 - RNA, 18 nt, Homo sapiens
uaugagcugauuugguca

SEQ ID NO: 923480 - RNA, 16 nt, Homo sapiens
uaugauaaacaguuga

SEQ ID NO: 923481 - RNA, 17 nt, Homo sapiens
uaugccggcuccuucaa

SEQ ID NO: 923482 - RNA, 19 nt, Homo sapiens
uauggaauuuugcaaagau

SEQ ID NO: 923483 - RNA, 20 nt, Homo sapiens
uauguucaaugaauauugua

SEQ ID NO: 923484 - RNA, 13 nt, Homo sapiens
uauuacacauuaa

SEQ ID NO: 923485 - RNA, 19 nt, Homo sapiens
uauuacacauuaaaguaaa

SEQ ID NO: 923486 - RNA, 15 nt, Homo sapiens
uauuacuccuugcca

SEQ ID NO: 923487 - RNA, 17 nt, Homo sapiens
uauuacuccuugccauu

SEQ ID NO: 923488 - RNA, 22 nt, Homo sapiens
uauuaggcuauaaauguccuaa

SEQ ID NO: 923489 - RNA, 19 nt, Homo sapiens
aauuagauauauauauuca

SEQ ID NO: 923490 - RNA, 13 nt, Homo sapiens
aauuagaugacug

SEQ ID NO: 923491 - RNA, 14 nt, Homo sapiens
aauuagcauuccau

SEQ ID NO: 923492 - RNA, 12 nt, Homo sapiens
aauucauucucu

SEQ ID NO: 923493 - RNA, 21 nt, Homo sapiens
aauuccuaauaaacugcuauu

SEQ ID NO: 923494 - RNA, 17 nt, Homo sapiens
aauucucaauauauuca

SEQ ID NO: 923495 - RNA, 14 nt, Homo sapiens
aauucuccuccuga

SEQ ID NO: 923496 - RNA, 13 nt, Homo sapiens
aauucucuaucau

SEQ ID NO: 923497 - RNA, 18 nt, Homo sapiens
aauucuggucacauucca

SEQ ID NO: 923498 - RNA, 19 nt, Homo sapiens
aauucuguauuaacugaau

SEQ ID NO: 923499 - RNA, 23 nt, Homo sapiens
aauugaaaugggaacaauaucaa

SEQ ID NO: 923500 - RNA, 9 nt, Homo sapiens
aauugagau

SEQ ID NO: 923501 - RNA, 22 nt, Homo sapiens
aauugcccuguugccuugagcu

SEQ ID NO: 923502 - RNA, 23 nt, Homo sapiens
aauugcccuguugccuugagcuc

SEQ ID NO: 923503 - RNA, 20 nt, Homo sapiens
aauugucuuguaccuugagu

SEQ ID NO: 923504 - RNA, 21 nt, Homo sapiens
aauuugugggcuuggggacag

SEQ ID NO: 923505 - RNA, 18 nt, Homo sapiens
aauuuuagaagacagccu

SEQ ID NO: 923506 - RNA, 20 nt, Homo sapiens
aauuuuagaagacagccuac

SEQ ID NO: 923507 - RNA, 16 nt, Homo sapiens
aauuuugggacauuug

SEQ ID NO: 923508 - RNA, 19 nt, Homo sapiens
aauuuuguuaagaauuuca

SEQ ID NO: 923509 - RNA, 22 nt, Homo sapiens
acaaaaauucacaagcugccuc

SEQ ID NO: 923510 - RNA, 9 nt, Homo sapiens
acaaaauac

SEQ ID NO: 923511 - RNA, 13 nt, Homo sapiens
acaaacucaucca

SEQ ID NO: 923512 - RNA, 22 nt, Homo sapiens
acaaacucgcacaaccaugacg

SEQ ID NO: 923513 - RNA, 19 nt, Homo sapiens
acaaagcuaaauacaugga

SEQ ID NO: 923514 - RNA, 19 nt, Homo sapiens
acaaauauagagaauuccu

SEQ ID NO: 923515 - RNA, 21 nt, Homo sapiens
acaaaucuucaagguguaaaa

SEQ ID NO: 923516 - RNA, 13 nt, Homo sapiens
acaacaggcugug

SEQ ID NO: 923517 - RNA, 23 nt, Homo sapiens
acaaccuccuccuccaguucuga

SEQ ID NO: 923518 - RNA, 17 nt, Homo sapiens
acaaccuuuuuauuuuc

SEQ ID NO: 923519 - RNA, 15 nt, Homo sapiens
acaacuccacugucu

SEQ ID NO: 923520 - RNA, 17 nt, Homo sapiens
acaacucgaaucacuca

SEQ ID NO: 923521 - RNA, 21 nt, Homo sapiens
acaagguagacauggauuuga

SEQ ID NO: 923522 - RNA, 23 nt, Homo sapiens
acaagucuuuaguguucaaauac

SEQ ID NO: 923523 - RNA, 14 nt, Homo sapiens
acaauaucaauaug

SEQ ID NO: 923524 - RNA, 14 nt, Homo sapiens
acaaucguucugug

SEQ ID NO: 923525 - RNA, 20 nt, Homo sapiens
acaaugugugggauaauguc

SEQ ID NO: 923526 - RNA, 14 nt, Homo sapiens
acaauucaaucaaa

SEQ ID NO: 923527 - RNA, 14 nt, Homo sapiens
acacaaauguguac

SEQ ID NO: 923528 - RNA, 18 nt, Homo sapiens
acacaagacuuuccccau

SEQ ID NO: 923529 - RNA, 14 nt, Homo sapiens
acacacauugcuau

SEQ ID NO: 923530 - RNA, 19 nt, Homo sapiens
acacacauugcuauuccca

SEQ ID NO: 923531 - RNA, 20 nt, Homo sapiens
acacagaucuguaauucacu

SEQ ID NO: 923532 - RNA, 21 nt, Homo sapiens
acacagggcauccaacugaga

SEQ ID NO: 923533 - RNA, 14 nt, Homo sapiens
acacauauuugcac

SEQ ID NO: 923534 - RNA, 17 nt, Homo sapiens
acacauauuugcacaag

SEQ ID NO: 923535 - RNA, 24 nt, Homo sapiens
acaccugucauugagccaagaaag

SEQ ID NO: 923536 - RNA, 23 nt, Homo sapiens
acacgcgugauugguaacugccu

SEQ ID NO: 923537 - RNA, 16 nt, Homo sapiens
acacuaauugacauug

SEQ ID NO: 923538 - RNA, 19 nt, Homo sapiens
acacucauuaccgucugug

SEQ ID NO: 923539 - RNA, 20 nt, Homo sapiens
acacucuugucaacucucca

SEQ ID NO: 923540 - RNA, 13 nt, Homo sapiens
acacugucugcau

SEQ ID NO: 923541 - RNA, 19 nt, Homo sapiens
acacuugggugaaaaguau

SEQ ID NO: 923542 - RNA, 12 nt, Homo sapiens
acacuuugccau

SEQ ID NO: 923543 - RNA, 18 nt, Homo sapiens
acacuuugguauucaauu

SEQ ID NO: 923544 - RNA, 17 nt, Homo sapiens
acagaaaacaaaccuua

SEQ ID NO: 923545 - RNA, 22 nt, Homo sapiens
acagaaaggaauggccuuucac

SEQ ID NO: 923546 - RNA, 15 nt, Homo sapiens
acagaaauuguauau

SEQ ID NO: 923547 - RNA, 15 nt, Homo sapiens
acagaacaagccaca

SEQ ID NO: 923548 - RNA, 19 nt, Homo sapiens
acagaaggaggaaguggaa

SEQ ID NO: 923549 - RNA, 17 nt, Homo sapiens
acagacuucacacagca

SEQ ID NO: 923550 - RNA, 20 nt, Homo sapiens
acagacuugaacauuugcag

SEQ ID NO: 923551 - RNA, 18 nt, Homo sapiens
acagagugagacugucuc

SEQ ID NO: 923552 - RNA, 14 nt, Homo sapiens
acagauaaugauag

SEQ ID NO: 923553 - RNA, 17 nt, Homo sapiens
acagaucuguaauucac

SEQ ID NO: 923554 - RNA, 14 nt, Homo sapiens
acagauuguucuca

SEQ ID NO: 923555 - RNA, 21 nt, Homo sapiens
acagauuuuuggagaaaggau

SEQ ID NO: 923556 - RNA, 15 nt, Homo sapiens
acagcaguuugagcu

SEQ ID NO: 923557 - RNA, 22 nt, Homo sapiens
acagccggggccugccuagcac

SEQ ID NO: 923558 - RNA, 20 nt, Homo sapiens
acagcuauaccucacaauaa

SEQ ID NO: 923559 - RNA, 12 nt, Homo sapiens
acaggauuucac

SEQ ID NO: 923560 - RNA, 17 nt, Homo sapiens
acagggccugacuuuua

SEQ ID NO: 923561 - RNA, 17 nt, Homo sapiens
acaggggcuggugggca

SEQ ID NO: 923562 - RNA, 16 nt, Homo sapiens
acagggugucugucag

SEQ ID NO: 923563 - RNA, 23 nt, Homo sapiens
acaggugugagccacugugccca

SEQ ID NO: 923564 - RNA, 19 nt, Homo sapiens
acaguacagcuauuucuca

SEQ ID NO: 923565 - RNA, 21 nt, Homo sapiens
acagucaccacuccaugacau

SEQ ID NO: 923566 - RNA, 11 nt, Homo sapiens
acaguggaauc

SEQ ID NO: 923567 - RNA, 23 nt, Homo sapiens
acaguugaguuucuucuaaagag

SEQ ID NO: 923568 - RNA, 16 nt, Homo sapiens
acauaacuucagauac

SEQ ID NO: 923569 - RNA, 15 nt, Homo sapiens
acaucaaguguucca

SEQ ID NO: 923570 - RNA, 18 nt, Homo sapiens
acaucacugcacuccagc

SEQ ID NO: 923571 - RNA, 13 nt, Homo sapiens
acaucuaacaaag

SEQ ID NO: 923572 - RNA, 13 nt, Homo sapiens
acaugauuccuua

SEQ ID NO: 923573 - RNA, 17 nt, Homo sapiens
acauuauuggacuucca

SEQ ID NO: 923574 - RNA, 20 nt, Homo sapiens
acauuauuugucuccaugau

SEQ ID NO: 923575 - RNA, 23 nt, Homo sapiens
acauucaagauuaaacugaguga

SEQ ID NO: 923576 - RNA, 17 nt, Homo sapiens
acauucaccaaccaaag

SEQ ID NO: 923577 - RNA, 15 nt, Homo sapiens
acauugacuguggcu

SEQ ID NO: 923578 - RNA, 18 nt, Homo sapiens
acauuuagcuuguucaca

SEQ ID NO: 923579 - RNA, 21 nt, Homo sapiens
acauuugggacugucuugaga

SEQ ID NO: 923580 - RNA, 21 nt, Homo sapiens
acauuuugccaaaauuauuaa

SEQ ID NO: 923581 - RNA, 18 nt, Homo sapiens
accaaauucugaauuugu

SEQ ID NO: 923582 - RNA, 22 nt, Homo sapiens
accaaccaaagggggacaguga

SEQ ID NO: 923583 - RNA, 15 nt, Homo sapiens
accaacugcucucaa

SEQ ID NO: 923584 - RNA, 17 nt, Homo sapiens
accaagagccaauggag

SEQ ID NO: 923585 - RNA, 19 nt, Homo sapiens
accaagaguagcaccuuca

SEQ ID NO: 923586 - RNA, 16 nt, Homo sapiens
accaauaugaacugca

SEQ ID NO: 923587 - RNA, 13 nt, Homo sapiens
accaauuagcauu

SEQ ID NO: 923588 - RNA, 19 nt, Homo sapiens
accaauuagcauuccauca

SEQ ID NO: 923589 - RNA, 12 nt, Homo sapiens
accaccaaaguc

SEQ ID NO: 923590 - RNA, 17 nt, Homo sapiens
accaccaacaaauauag

SEQ ID NO: 923591 - RNA, 14 nt, Homo sapiens
accaccucugucac

SEQ ID NO: 923592 - RNA, 17 nt, Homo sapiens
accacuguacauauaua

SEQ ID NO: 923593 - RNA, 17 nt, Homo sapiens
accaguacguacauauu

SEQ ID NO: 923594 - RNA, 19 nt, Homo sapiens
accaugaauucuggucaca

SEQ ID NO: 923595 - RNA, 13 nt, Homo sapiens
accaugcaauucc

SEQ ID NO: 923596 - RNA, 16 nt, Homo sapiens
acccaacaggugcuga

SEQ ID NO: 923597 - RNA, 16 nt, Homo sapiens
acccagccucuaggga

SEQ ID NO: 923598 - RNA, 15 nt, Homo sapiens
acccaggccacugac

SEQ ID NO: 923599 - RNA, 16 nt, Homo sapiens
acccaggccacugacc

SEQ ID NO: 923600 - RNA, 11 nt, Homo sapiens
acccauuugaa

SEQ ID NO: 923601 - RNA, 15 nt, Homo sapiens
accccuaugaacucu

SEQ ID NO: 923602 - RNA, 15 nt, Homo sapiens
gagagggaugcagug

SEQ ID NO: 923603 - RNA, 21 nt, Homo sapiens
gagauuucaguuacuuaccug

SEQ ID NO: 923604 - RNA, 14 nt, Homo sapiens
gagcaagacccugu

SEQ ID NO: 923605 - RNA, 18 nt, Homo sapiens
gagcacacaacaggcugu

SEQ ID NO: 923606 - RNA, 21 nt, Homo sapiens
gagcauccuuaccuccaaaag

SEQ ID NO: 923607 - RNA, 23 nt, Homo sapiens
gagccacugugcccagcaguuuc

SEQ ID NO: 923608 - RNA, 13 nt, Homo sapiens
gagccagccaccc

SEQ ID NO: 923609 - RNA, 20 nt, Homo sapiens
gagcccccuguccuucccac

SEQ ID NO: 923610 - RNA, 18 nt, Homo sapiens
gagcuagugucaccugca

SEQ ID NO: 923611 - RNA, 23 nt, Homo sapiens
gagcuagugucaccugcacaggg

SEQ ID NO: 923612 - RNA, 15 nt, Homo sapiens
gagcucuucauuuau

SEQ ID NO: 923613 - RNA, 17 nt, Homo sapiens
gagcugcuguccaggaa

SEQ ID NO: 923614 - RNA, 18 nt, Homo sapiens
gagcuuguaauugcacca

SEQ ID NO: 923615 - RNA, 20 nt, Homo sapiens
gagcuuuggacacacacagc

SEQ ID NO: 923616 - RNA, 20 nt, Homo sapiens
gaggaaauugcagaagcagg

SEQ ID NO: 923617 - RNA, 19 nt, Homo sapiens
gaggaaucuuuuacugugg

SEQ ID NO: 923618 - RNA, 15 nt, Homo sapiens
gaggcaguggcagca

SEQ ID NO: 923619 - RNA, 15 nt, Homo sapiens
gagggagggucagug

SEQ ID NO: 923620 - RNA, 20 nt, Homo sapiens
gagggaugccauaccuugag

SEQ ID NO: 923621 - RNA, 15 nt, Homo sapiens
gagggauguggagca

SEQ ID NO: 923622 - RNA, 22 nt, Homo sapiens
gagggccaacgcuugacacaaa

SEQ ID NO: 923623 - RNA, 21 nt, Homo sapiens
gagggugggaaggaaacaacc

SEQ ID NO: 923624 - RNA, 12 nt, Homo sapiens
gaguagcagaaa

SEQ ID NO: 923625 - RNA, 20 nt, Homo sapiens
gagucagucagcgagugcuu

SEQ ID NO: 923626 - RNA, 13 nt, Homo sapiens
gagucccuuccag

SEQ ID NO: 923627 - RNA, 20 nt, Homo sapiens
gagucucacucuguugccca

SEQ ID NO: 923628 - RNA, 16 nt, Homo sapiens
gagugaagcaaaaacu

SEQ ID NO: 923629 - RNA, 16 nt, Homo sapiens
gagugcaguggcacca

SEQ ID NO: 923630 - RNA, 18 nt, Homo sapiens
gaguugaguauuacacau

SEQ ID NO: 923631 - RNA, 18 nt, Homo sapiens
gaguuggcguugugggca

SEQ ID NO: 923632 - RNA, 17 nt, Homo sapiens
gaguuucuucuaaagag

SEQ ID NO: 923633 - RNA, 12 nt, Homo sapiens
gauaaaccaaaa

SEQ ID NO: 923634 - RNA, 18 nt, Homo sapiens
gauauggacuauugcaau

SEQ ID NO: 923635 - RNA, 16 nt, Homo sapiens
gauauuagucuugggg

SEQ ID NO: 923636 - RNA, 21 nt, Homo sapiens
gauauuauucaguaguggaaa

SEQ ID NO: 923637 - RNA, 21 nt, Homo sapiens
gauauuuuuauccuguucuca

SEQ ID NO: 923638 - RNA, 22 nt, Homo sapiens
gaucaugguuuagggugaucag

SEQ ID NO: 923639 - RNA, 23 nt, Homo sapiens
gaucuccccucacacuuugccau

SEQ ID NO: 923640 - RNA, 18 nt, Homo sapiens
gaucugcagcucccagaa

SEQ ID NO: 923641 - RNA, 17 nt, Homo sapiens
gaucuuggggugcagca

SEQ ID NO: 923642 - RNA, 14 nt, Homo sapiens
gaugaacacaggca

SEQ ID NO: 923643 - RNA, 15 nt, Homo sapiens
gaugagcugguuuga

SEQ ID NO: 923644 - RNA, 18 nt, Homo sapiens
gaugaggucaccagggga

SEQ ID NO: 923645 - RNA, 14 nt, Homo sapiens
gaugaguacccaaa

SEQ ID NO: 923646 - RNA, 17 nt, Homo sapiens
gaugccucccugacccu

SEQ ID NO: 923647 - RNA, 23 nt, Homo sapiens
ugcccagcaguuucccagaauau

SEQ ID NO: 923648 - RNA, 22 nt, Homo sapiens
ugccucagccucccgaguaguu

SEQ ID NO: 923649 - RNA, 14 nt, Homo sapiens
ugccucugagccac

SEQ ID NO: 923650 - RNA, 16 nt, Homo sapiens
ugccucugagccacug

SEQ ID NO: 923651 - RNA, 17 nt, Homo sapiens
ugccugcagugccacua

SEQ ID NO: 923652 - RNA, 20 nt, Homo sapiens
ugccuggagcuccugggaag

SEQ ID NO: 923653 - RNA, 17 nt, Homo sapiens
ugccuucaacaacguga

SEQ ID NO: 923654 - RNA, 16 nt, Homo sapiens
ugccuuuugcaaccag

SEQ ID NO: 923655 - RNA, 15 nt, Homo sapiens
ugcgcagcuccuucc

SEQ ID NO: 923656 - RNA, 16 nt, Homo sapiens
ugcgcauggugcagug

SEQ ID NO: 923657 - RNA, 22 nt, Homo sapiens
ugcguaggagagaacagggaug

SEQ ID NO: 923658 - RNA, 22 nt, Homo sapiens
ugcuaauaaaguuaaauugcac

SEQ ID NO: 923659 - RNA, 23 nt, Homo sapiens
ugcuaauacagguccugcacauu

SEQ ID NO: 923660 - RNA, 16 nt, Homo sapiens
ugcuaauuuucagggu

SEQ ID NO: 923661 - RNA, 20 nt, Homo sapiens
ugcuaucucgcuagccauau

SEQ ID NO: 923662 - RNA, 22 nt, Homo sapiens
ugcuaucucgcuagccauauau

SEQ ID NO: 923663 - RNA, 15 nt, Homo sapiens
ugcuauuucccaagc

SEQ ID NO: 923664 - RNA, 17 nt, Homo sapiens
ugcucccagcucuaaaa

SEQ ID NO: 923665 - RNA, 21 nt, Homo sapiens
ugcuccgaggacccaggaaag

SEQ ID NO: 923666 - RNA, 20 nt, Homo sapiens
ugcucuacugcuucaggaag

SEQ ID NO: 923667 - RNA, 16 nt, Homo sapiens
ugcucuauauguaaua

SEQ ID NO: 923668 - RNA, 23 nt, Homo sapiens
ugcucucaaaaugugaacugacu

SEQ ID NO: 923669 - RNA, 23 nt, Homo sapiens
ugcucucggacucccuaccccaa

SEQ ID NO: 923670 - RNA, 17 nt, Homo sapiens
ugcugaaugccucgcuc

SEQ ID NO: 923671 - RNA, 17 nt, Homo sapiens
ugcugaccagcacugac

SEQ ID NO: 923672 - RNA, 18 nt, Homo sapiens
ugcugagcacacaacagg

SEQ ID NO: 923673 - RNA, 23 nt, Homo sapiens
ugcugauucaauaaaaugcacug

SEQ ID NO: 923674 - RNA, 21 nt, Homo sapiens
ugcugauucuuuaaaugguuu

SEQ ID NO: 923675 - RNA, 15 nt, Homo sapiens
ugcugcuuugcacac

SEQ ID NO: 923676 - RNA, 18 nt, Homo sapiens
ugcuggaccuaaaauacu

SEQ ID NO: 923677 - RNA, 19 nt, Homo sapiens
ugcuggccgggcacagcug

SEQ ID NO: 923678 - RNA, 16 nt, Homo sapiens
ugcuguuuuuaaucca

SEQ ID NO: 923679 - RNA, 21 nt, Homo sapiens
ugcuuaaaauuaauaaaucau

SEQ ID NO: 923680 - RNA, 19 nt, Homo sapiens
ugcuuaaacaaaacuggaa

SEQ ID NO: 923681 - RNA, 15 nt, Homo sapiens
ugcuucccaaauaca

SEQ ID NO: 923682 - RNA, 20 nt, Homo sapiens
ugcuucugcauacuguguua

SEQ ID NO: 923683 - RNA, 15 nt, Homo sapiens
ugcuuucuaucuaau

SEQ ID NO: 923684 - RNA, 16 nt, Homo sapiens
ugcuuucuugcucuca

SEQ ID NO: 923685 - RNA, 17 nt, Homo sapiens
ugcuuuuggagcugaga

SEQ ID NO: 923686 - RNA, 19 nt, Homo sapiens
uggaaaauaaaaacuguag

SEQ ID NO: 923687 - RNA, 14 nt, Homo sapiens
uggaacacaaccau

SEQ ID NO: 923688 - RNA, 16 nt, Homo sapiens
uggaaccagcaguuga

SEQ ID NO: 923689 - RNA, 21 nt, Homo sapiens
uggaaccuuguagaggagcag

SEQ ID NO: 923690 - RNA, 14 nt, Homo sapiens
uggaauuuugcaaa

SEQ ID NO: 923691 - RNA, 19 nt, Homo sapiens
uggaccaauuagcauucca

SEQ ID NO: 923692 - RNA, 13 nt, Homo sapiens
uggacuuuggaca

SEQ ID NO: 923693 - RNA, 14 nt, Homo sapiens
uggagaaagagcug

SEQ ID NO: 923694 - RNA, 21 nt, Homo sapiens
uggagauacugauuauugagu

SEQ ID NO: 923695 - RNA, 15 nt, Homo sapiens
uggagccauccuccu

SEQ ID NO: 923696 - RNA, 13 nt, Homo sapiens
uggaggugaugaa

SEQ ID NO: 923697 - RNA, 13 nt, Homo sapiens
uggagugaucuca

SEQ ID NO: 923698 - RNA, 13 nt, Homo sapiens
uggaucagaaaga

SEQ ID NO: 923699 - RNA, 20 nt, Homo sapiens
uggaucuaucaccugucauc

SEQ ID NO: 923700 - RNA, 21 nt, Homo sapiens
uggaucuaucaccugucauca

SEQ ID NO: 923701 - RNA, 14 nt, Homo sapiens
uggauuaaaggcaa

SEQ ID NO: 923702 - RNA, 18 nt, Homo sapiens
uggauuuuccaccaaauu

SEQ ID NO: 923703 - RNA, 22 nt, Homo sapiens
uggcaauucuucuucucaagca

SEQ ID NO: 923704 - RNA, 15 nt, Homo sapiens
uggcaguuacagggc

SEQ ID NO: 923705 - RNA, 13 nt, Homo sapiens
uggcaucaccugc

SEQ ID NO: 923706 - RNA, 19 nt, Homo sapiens
uggcaucuuuggaggaauu

SEQ ID NO: 923707 - RNA, 16 nt, Homo sapiens
uggccgggcacagcug

SEQ ID NO: 923708 - RNA, 15 nt, Homo sapiens
uggccuagucccuuc

SEQ ID NO: 923709 - RNA, 21 nt, Homo sapiens
uggccuauuuuggacguguga

SEQ ID NO: 923710 - RNA, 20 nt, Homo sapiens
uggccuuauggauuuggacu

SEQ ID NO: 923711 - RNA, 18 nt, Homo sapiens
uggcuaaaggucccaagg

SEQ ID NO: 923712 - RNA, 16 nt, Homo sapiens
uggcucacaccuguaa

SEQ ID NO: 923713 - RNA, 19 nt, Homo sapiens
uggcucgugggcucuggcu

SEQ ID NO: 923714 - RNA, 21 nt, Homo sapiens
uggcugauuuagaccaaaaga

SEQ ID NO: 923715 - RNA, 11 nt, Homo sapiens
uggcugugaaa

SEQ ID NO: 923716 - RNA, 13 nt, Homo sapiens
uggcuuuccucuc

SEQ ID NO: 923717 - RNA, 12 nt, Homo sapiens
ugggaacagagg

SEQ ID NO: 923718 - RNA, 16 nt, Homo sapiens
ugggacugucuugaga

SEQ ID NO: 923719 - RNA, 18 nt, Homo sapiens
ugggagccagaauucacu

SEQ ID NO: 923720 - RNA, 14 nt, Homo sapiens
ugggauuacaggug

SEQ ID NO: 923721 - RNA, 22 nt, Homo sapiens
ugggcagggguuccagcuuccc

SEQ ID NO: 923722 - RNA, 22 nt, Homo sapiens
ugggccucaugguaagagucac

SEQ ID NO: 923723 - RNA, 21 nt, Homo sapiens
gccaccaccuacagcccagug

SEQ ID NO: 923724 - RNA, 23 nt, Homo sapiens
gccaccugcaggucacugaaacu

SEQ ID NO: 923725 - RNA, 20 nt, Homo sapiens
gccacugugcccagcaguuu

SEQ ID NO: 923726 - RNA, 18 nt, Homo sapiens
gccagagcaaagggccag

SEQ ID NO: 923727 - RNA, 15 nt, Homo sapiens
gccaggacagcugca

SEQ ID NO: 923728 - RNA, 17 nt, Homo sapiens
gccagguaggaugaaca

SEQ ID NO: 923729 - RNA, 13 nt, Homo sapiens
gccauaccuugag

SEQ ID NO: 923730 - RNA, 19 nt, Homo sapiens
gccaugcugcuuugcacac

SEQ ID NO: 923731 - RNA, 20 nt, Homo sapiens
gcccagacucaaggccucca

SEQ ID NO: 923732 - RNA, 19 nt, Homo sapiens
gcccagcaaggaccaguga

SEQ ID NO: 923733 - RNA, 21 nt, Homo sapiens
gcccaugacaccaaaccugcc

SEQ ID NO: 923734 - RNA, 17 nt, Homo sapiens
gccccccucauuacugc

SEQ ID NO: 923735 - RNA, 20 nt, Homo sapiens
gccccuccccaacuccuucc

SEQ ID NO: 923736 - RNA, 15 nt, Homo sapiens
gcccuccacugcccu

SEQ ID NO: 923737 - RNA, 14 nt, Homo sapiens
gcccucugccucau

SEQ ID NO: 923738 - RNA, 21 nt, Homo sapiens
gcccugcgaccacagcaggga

SEQ ID NO: 923739 - RNA, 22 nt, Homo sapiens
gcccugggugcaggacacuggu

SEQ ID NO: 923740 - RNA, 13 nt, Homo sapiens
gccgcugggagag

SEQ ID NO: 923741 - RNA, 16 nt, Homo sapiens
gccgugccugcauucg

SEQ ID NO: 923742 - RNA, 21 nt, Homo sapiens
gccucaguuucuucaccugua

SEQ ID NO: 923743 - RNA, 14 nt, Homo sapiens
gccugacuuuuaca

SEQ ID NO: 923744 - RNA, 23 nt, Homo sapiens
gccugaugauggaagggccuucu

SEQ ID NO: 923745 - RNA, 20 nt, Homo sapiens
gccuggcuaacauggugaaa

SEQ ID NO: 923746 - RNA, 18 nt, Homo sapiens
gccuggggauguaaccaa

SEQ ID NO: 923747 - RNA, 22 nt, Homo sapiens
gccuucuccacagggacacagu

SEQ ID NO: 923748 - RNA, 23 nt, Homo sapiens
gccuucuccacagggacacaguc

SEQ ID NO: 923749 - RNA, 20 nt, Homo sapiens
gccuuggccucccaaagugc

SEQ ID NO: 923750 - RNA, 16 nt, Homo sapiens
gccuuggcucguucuc

SEQ ID NO: 923751 - RNA, 22 nt, Homo sapiens
gcgaaaguaaaaacacuaccuc

SEQ ID NO: 923752 - RNA, 16 nt, Homo sapiens
gcgcagggcucuuuga

SEQ ID NO: 923753 - RNA, 12 nt, Homo sapiens
gcgcauggugca

SEQ ID NO: 923754 - RNA, 17 nt, Homo sapiens
gcgucaccugugcaggg

SEQ ID NO: 923755 - RNA, 16 nt, Homo sapiens
gcgucagcaauuuccu

SEQ ID NO: 923756 - RNA, 20 nt, Homo sapiens
gcuaaauauaaaaacauaaa

SEQ ID NO: 923757 - RNA, 13 nt, Homo sapiens
gcuaauuacacac

SEQ ID NO: 923758 - RNA, 22 nt, Homo sapiens
gcuacucuggaggcugagauag

SEQ ID NO: 923759 - RNA, 13 nt, Homo sapiens
gcuagccacugga

SEQ ID NO: 923760 - RNA, 22 nt, Homo sapiens
gcuagcucgugacuacauugaa

SEQ ID NO: 923761 - RNA, 17 nt, Homo sapiens
gcuaucucgcuagccau

SEQ ID NO: 923762 - RNA, 16 nt, Homo sapiens
gcuauggguguuaacg

SEQ ID NO: 923763 - RNA, 16 nt, Homo sapiens
gcuauuaagaaaauca

SEQ ID NO: 923764 - RNA, 22 nt, Homo sapiens
gcuauuugccaagaccauuuca

SEQ ID NO: 923765 - RNA, 21 nt, Homo sapiens
gcuccgccuggcacccacucc

SEQ ID NO: 923766 - RNA, 13 nt, Homo sapiens
gcucucaaaaugu

SEQ ID NO: 923767 - RNA, 14 nt, Homo sapiens
gcucucaacccagg

SEQ ID NO: 923768 - RNA, 17 nt, Homo sapiens
gcucuccugggagacaa

SEQ ID NO: 923769 - RNA, 14 nt, Homo sapiens
gcucuucagcacca

SEQ ID NO: 923770 - RNA, 19 nt, Homo sapiens
ugugagccaccacacccag

SEQ ID NO: 923771 - RNA, 15 nt, Homo sapiens
ugugauuauucugua

SEQ ID NO: 923772 - RNA, 22 nt, Homo sapiens
ugugcaguguuuuuccugugua

SEQ ID NO: 923773 - RNA, 18 nt, Homo sapiens
ugugccccaucagcagcu

SEQ ID NO: 923774 - RNA, 22 nt, Homo sapiens
ugugcccgccucuccacgcacu

SEQ ID NO: 923775 - RNA, 17 nt, Homo sapiens
ugugcccuguggcugcc

SEQ ID NO: 923776 - RNA, 14 nt, Homo sapiens
ugugcucuggggaa

SEQ ID NO: 923777 - RNA, 17 nt, Homo sapiens
uguggcaguuacagggc

SEQ ID NO: 923778 - RNA, 15 nt, Homo sapiens
ugugggugaagguga

SEQ ID NO: 923779 - RNA, 21 nt, Homo sapiens
ugugucuagcaaagccaccaa

SEQ ID NO: 923780 - RNA, 21 nt, Homo sapiens
uguguggaaauggccaccacc

SEQ ID NO: 923781 - RNA, 21 nt, Homo sapiens
ugugugggauaaugucauuaa

SEQ ID NO: 923782 - RNA, 21 nt, Homo sapiens
uguuaagaauuucaauaucaa

SEQ ID NO: 923783 - RNA, 13 nt, Homo sapiens
uguuaauaaaggu

SEQ ID NO: 923784 - RNA, 13 nt, Homo sapiens
uguuaaugaauag

SEQ ID NO: 923785 - RNA, 14 nt, Homo sapiens
uguuacccauuuga

SEQ ID NO: 923786 - RNA, 13 nt, Homo sapiens
uguucacugugag

SEQ ID NO: 923787 - RNA, 13 nt, Homo sapiens
uguuccauugaau

SEQ ID NO: 923788 - RNA, 23 nt, Homo sapiens
uguugagaaaaaagacccuauca

SEQ ID NO: 923789 - RNA, 16 nt, Homo sapiens
uguuuaaacugaguag

SEQ ID NO: 923790 - RNA, 18 nt, Homo sapiens
uguuuauaauauugcagu

SEQ ID NO: 923791 - RNA, 20 nt, Homo sapiens
uguuucuucuuugacuauaa

SEQ ID NO: 923792 - RNA, 18 nt, Homo sapiens
uguuuuuuuuccaaaaac

SEQ ID NO: 923793 - RNA, 23 nt, Homo sapiens
uguuuuuuuuuuaaaaaagacau

SEQ ID NO: 923794 - RNA, 17 nt, Homo sapiens
uuaaaaaaaaacauuca

SEQ ID NO: 923795 - RNA, 18 nt, Homo sapiens
uuaaaaaaaaacauucaa

SEQ ID NO: 923796 - RNA, 16 nt, Homo sapiens
uuaaaagcuguucuca

SEQ ID NO: 923797 - RNA, 22 nt, Homo sapiens
uuaaacaguaaaacaaaaauuc

SEQ ID NO: 923798 - RNA, 16 nt, Homo sapiens
uuaaaccaaacggaac

SEQ ID NO: 923799 - RNA, 14 nt, Homo sapiens
uuaaaccuuuccau

SEQ ID NO: 923800 - RNA, 15 nt, Homo sapiens
uuaaauauuucuuaa

SEQ ID NO: 923801 - RNA, 13 nt, Homo sapiens
uuaacuugccaca

SEQ ID NO: 923802 - RNA, 17 nt, Homo sapiens
uuaagaaaaacauguca

SEQ ID NO: 923803 - RNA, 23 nt, Homo sapiens
uuaagacuucuggucauuuccaa

SEQ ID NO: 923804 - RNA, 21 nt, Homo sapiens
uuaauagaaagauacaaccuu

SEQ ID NO: 923805 - RNA, 13 nt, Homo sapiens
uuaauagccauuu

SEQ ID NO: 923806 - RNA, 17 nt, Homo sapiens
uuaauugagaugaaauu

SEQ ID NO: 923807 - RNA, 18 nt, Homo sapiens
uuacaaguuucaguaaua

SEQ ID NO: 923808 - RNA, 19 nt, Homo sapiens
uuacaauuaaacucaaagc

SEQ ID NO: 923809 - RNA, 15 nt, Homo sapiens
uuacaggcuuugaag

SEQ ID NO: 923810 - RNA, 16 nt, Homo sapiens
uuacaggggcuugaac

SEQ ID NO: 923811 - RNA, 17 nt, Homo sapiens
uuacauuauuacuccuu

SEQ ID NO: 923812 - RNA, 22 nt, Homo sapiens
uuacuaggagauaccaccgaca

SEQ ID NO: 923813 - RNA, 13 nt, Homo sapiens
uuacuguucaugg

SEQ ID NO: 923814 - RNA, 21 nt, Homo sapiens
uuacuguuugucuucucccca

SEQ ID NO: 923815 - RNA, 23 nt, Homo sapiens
uuagaaaagacugaccuugaugu

SEQ ID NO: 923816 - RNA, 23 nt, Homo sapiens
uuagacaacccugagguaucugu

SEQ ID NO: 923817 - RNA, 16 nt, Homo sapiens
uuagauuuagaagugu

SEQ ID NO: 923818 - RNA, 19 nt, Homo sapiens
uuaguuuagguguuuggga

SEQ ID NO: 923819 - RNA, 18 nt, Homo sapiens
uuaguuugaaacagauuc

SEQ ID NO: 923820 - RNA, 12 nt, Homo sapiens
uuauaagcauuu

SEQ ID NO: 923821 - RNA, 20 nt, Homo sapiens
uuauaauuuugaccauaaau

SEQ ID NO: 923822 - RNA, 20 nt, Homo sapiens
uuauacuagguuaacauuug

SEQ ID NO: 923823 - RNA, 13 nt, Homo sapiens
uuauauauguccu

SEQ ID NO: 923824 - RNA, 21 nt, Homo sapiens
uuaucaucccaacagccaaga

SEQ ID NO: 923825 - RNA, 14 nt, Homo sapiens
uuauccuguucuca

SEQ ID NO: 923826 - RNA, 22 nt, Homo sapiens
uuaugagaaugacccugucaag

SEQ ID NO: 923827 - RNA, 20 nt, Homo sapiens
uuaugcagagacagcuguuu

SEQ ID NO: 923828 - RNA, 14 nt, Homo sapiens
uuaugccaaagugu

SEQ ID NO: 923829 - RNA, 19 nt, Homo sapiens
uuauuugucuccaugauac

SEQ ID NO: 923830 - RNA, 16 nt, Homo sapiens
uuauuuuuaaaauaau

SEQ ID NO: 923831 - RNA, 12 nt, Homo sapiens
uucaaaaaucau

SEQ ID NO: 923832 - RNA, 15 nt, Homo sapiens
uucaaaaccagcucc

SEQ ID NO: 923833 - RNA, 14 nt, Homo sapiens
uucaaacaauucaa

SEQ ID NO: 923834 - RNA, 15 nt, Homo sapiens
uucaaaucuguaauu

SEQ ID NO: 923835 - RNA, 18 nt, Homo sapiens
uucaagguguaaaauauc

SEQ ID NO: 923836 - RNA, 14 nt, Homo sapiens
uucaauaacaaagg

SEQ ID NO: 923837 - RNA, 12 nt, Homo sapiens
uucaaucaaagc

SEQ ID NO: 923838 - RNA, 22 nt, Homo sapiens
uucaauuugauucuaugacuga

SEQ ID NO: 923839 - RNA, 15 nt, Homo sapiens
uucacaccuagcguc

SEQ ID NO: 923840 - RNA, 22 nt, Homo sapiens
uucacaccuagcgucaguauuu

SEQ ID NO: 923841 - RNA, 12 nt, Homo sapiens
uucacacuauca

SEQ ID NO: 923842 - RNA, 20 nt, Homo sapiens
uucacacuaucaacacugca

SEQ ID NO: 923843 - RNA, 17 nt, Homo sapiens
uucacauccccaaaggu

SEQ ID NO: 923844 - RNA, 13 nt, Homo sapiens
ucuguguacugaa

SEQ ID NO: 923845 - RNA, 21 nt, Homo sapiens
ucuuaaugcuauuugccaaga

SEQ ID NO: 923846 - RNA, 17 nt, Homo sapiens
ucuuagcuuacaggaag

SEQ ID NO: 923847 - RNA, 12 nt, Homo sapiens
ucuugauauauu

SEQ ID NO: 923848 - RNA, 18 nt, Homo sapiens
ucuugcucucaaugcagg

SEQ ID NO: 923849 - RNA, 21 nt, Homo sapiens
ucuuggccaggcuggucuuga

SEQ ID NO: 923850 - RNA, 13 nt, Homo sapiens
ucuugggaaaaua

SEQ ID NO: 923851 - RNA, 16 nt, Homo sapiens
ucuuucuacaguauua

SEQ ID NO: 923852 - RNA, 16 nt, Homo sapiens
ucuuugacuauaacaa

SEQ ID NO: 923853 - RNA, 12 nt, Homo sapiens
ugaaaaaagccu

SEQ ID NO: 923854 - RNA, 22 nt, Homo sapiens
ugaaaaauaguguguccaugca

SEQ ID NO: 923855 - RNA, 20 nt, Homo sapiens
ugaaaaccacccuaucauca

SEQ ID NO: 923856 - RNA, 22 nt, Homo sapiens
ugaaaauuacacccaugcacag

SEQ ID NO: 923857 - RNA, 20 nt, Homo sapiens
ugaaagcuaugaauguuacu

SEQ ID NO: 923858 - RNA, 16 nt, Homo sapiens
ugaaagugaacaauca

SEQ ID NO: 923859 - RNA, 22 nt, Homo sapiens
ugaaauacuuaaugccaaguaa

SEQ ID NO: 923860 - RNA, 24 nt, Homo sapiens
ugaaauguauuuuaaaauuucacu

SEQ ID NO: 923861 - RNA, 17 nt, Homo sapiens
ugaaauuaaaauugcca

SEQ ID NO: 923862 - RNA, 23 nt, Homo sapiens
ugaacaccacgcuugacaggaca

SEQ ID NO: 923863 - RNA, 15 nt, Homo sapiens
ugaagaaaauccuaa

SEQ ID NO: 923864 - RNA, 17 nt, Homo sapiens
ugaagacaaaccacugu

SEQ ID NO: 923865 - RNA, 19 nt, Homo sapiens
ugaagcuccuacacagguc

SEQ ID NO: 923866 - RNA, 22 nt, Homo sapiens
ugaagcugugaugugccuacuc

SEQ ID NO: 923867 - RNA, 17 nt, Homo sapiens
ugaaggaaaaacaugcu

SEQ ID NO: 923868 - RNA, 20 nt, Homo sapiens
ugaaggugacaucaggauua

SEQ ID NO: 923869 - RNA, 18 nt, Homo sapiens
ugaagugaacaaauuuca

SEQ ID NO: 923870 - RNA, 13 nt, Homo sapiens
ugaauacuuugag

SEQ ID NO: 923871 - RNA, 23 nt, Homo sapiens
ugaauagccaggccugaccucaa

SEQ ID NO: 923872 - RNA, 22 nt, Homo sapiens
ugaauaggcauuaaaugcaaaa

SEQ ID NO: 923873 - RNA, 15 nt, Homo sapiens
ugaaugccuucuuaa

SEQ ID NO: 923874 - RNA, 23 nt, Homo sapiens
ugaaugggagccagaauucacua

SEQ ID NO: 923875 - RNA, 21 nt, Homo sapiens
ugaauuaagaacugacacaaa

SEQ ID NO: 923876 - RNA, 13 nt, Homo sapiens
ugaauuagcucac

SEQ ID NO: 923877 - RNA, 19 nt, Homo sapiens
ugaauucuggucacauucc

SEQ ID NO: 923878 - RNA, 21 nt, Homo sapiens
ugacacagcugagcuggccua

SEQ ID NO: 923879 - RNA, 13 nt, Homo sapiens
ugacacugagaac

SEQ ID NO: 923880 - RNA, 14 nt, Homo sapiens
ugacggcuaccaca

SEQ ID NO: 923881 - RNA, 17 nt, Homo sapiens
ugacugccaagccagau

SEQ ID NO: 923882 - RNA, 15 nt, Homo sapiens
ugacuggcaccaaca

SEQ ID NO: 923883 - RNA, 15 nt, Homo sapiens
ugacuuuuacagcuu

SEQ ID NO: 923884 - RNA, 22 nt, Homo sapiens
ugagaacagaucuccaaagcuu

SEQ ID NO: 923885 - RNA, 15 nt, Homo sapiens
ugagaagaugaucca

SEQ ID NO: 923886 - RNA, 17 nt, Homo sapiens
ugagaaugacccuguca

SEQ ID NO: 923887 - RNA, 18 nt, Homo sapiens
ugagaaugacccugucaa

SEQ ID NO: 923888 - RNA, 13 nt, Homo sapiens
ugagauuacaggu

SEQ ID NO: 923889 - RNA, 23 nt, Homo sapiens
ugagauuacaggugugagccacu

SEQ ID NO: 923890 - RNA, 17 nt, Homo sapiens
ugagcacacaacaggcu

SEQ ID NO: 923891 - RNA, 17 nt, Homo sapiens
ugagcaccuguaauccc

SEQ ID NO: 923892 - RNA, 17 nt, Homo sapiens
ugagccaaccagaauaa

SEQ ID NO: 923893 - RNA, 14 nt, Homo sapiens
ugagccaagaaagu

SEQ ID NO: 923894 - RNA, 22 nt, Homo sapiens
ugagccuuuuauuaacauauau

SEQ ID NO: 923895 - RNA, 22 nt, Homo sapiens
ugagcuuuggacacacacagcu

SEQ ID NO: 923896 - RNA, 21 nt, Homo sapiens
ugaggaaaaaaaaucaggcau

SEQ ID NO: 923897 - RNA, 13 nt, Homo sapiens
ugaggagucuugu

SEQ ID NO: 923898 - RNA, 14 nt, Homo sapiens
ugagguaucugugu

SEQ ID NO: 923899 - RNA, 15 nt, Homo sapiens
ugaguauuacacauu

SEQ ID NO: 923900 - RNA, 16 nt, Homo sapiens
ugagugaauacuuuga

SEQ ID NO: 923901 - RNA, 15 nt, Homo sapiens
ugagugugugcacag

SEQ ID NO: 923902 - RNA, 12 nt, Homo sapiens
ugauaaaccaaa

SEQ ID NO: 923903 - RNA, 14 nt, Homo sapiens
ugauaaaccaaaau

SEQ ID NO: 923904 - RNA, 14 nt, Homo sapiens
ugauaacaccaaga

SEQ ID NO: 923905 - RNA, 20 nt, Homo sapiens
ugauaaucuuucuccacugu

SEQ ID NO: 923906 - RNA, 19 nt, Homo sapiens
ugauagcuugggauuuaaa

SEQ ID NO: 923907 - RNA, 14 nt, Homo sapiens
ugaucuuugcaaag

SEQ ID NO: 923908 - RNA, 15 nt, Homo sapiens
ugaugaaaaccaccc

SEQ ID NO: 923909 - RNA, 19 nt, Homo sapiens
ugauucaauaaaaugcacu

SEQ ID NO: 923910 - RNA, 14 nt, Homo sapiens
ugauugccaacagu

SEQ ID NO: 923911 - RNA, 13 nt, Homo sapiens
ugauuuacaagac

SEQ ID NO: 923912 - RNA, 22 nt, Homo sapiens
ugauuuucaaaaccagcuccca

SEQ ID NO: 923913 - RNA, 16 nt, Homo sapiens
ugcaaagugcccucau

SEQ ID NO: 923914 - RNA, 22 nt, Homo sapiens
ugcaaauuccaccccuccuucc

SEQ ID NO: 923915 - RNA, 17 nt, Homo sapiens
ugcaaccuaguacuuua

SEQ ID NO: 923916 - RNA, 19 nt, Homo sapiens
ugcaaccuaguacuuuauu

SEQ ID NO: 923917 - RNA, 14 nt, Homo sapiens
ugcaagugagcaaa

SEQ ID NO: 923918 - RNA, 17 nt, Homo sapiens
ugcaauacggaacacug

SEQ ID NO: 923919 - RNA, 20 nt, Homo sapiens
ugcaauacggaacacuguca

SEQ ID NO: 923920 - RNA, 21 nt, Homo sapiens
ugcaauacggaacacugucaa

SEQ ID NO: 923921 - RNA, 21 nt, Homo sapiens
ugcaauugucuuguaccuuga

SEQ ID NO: 923922 - RNA, 14 nt, Homo sapiens
ugcacaaacuccau

SEQ ID NO: 923923 - RNA, 12 nt, Homo sapiens
ugcacaaugcau

SEQ ID NO: 923924 - RNA, 14 nt, Homo sapiens
ugcacaaugcauug

SEQ ID NO: 923925 - RNA, 19 nt, Homo sapiens
ugcaccccaggaaaggagg

SEQ ID NO: 923926 - RNA, 12 nt, Homo sapiens
ugcacuauagcc

SEQ ID NO: 923927 - RNA, 16 nt, Homo sapiens
ugcacuauagccauuu

SEQ ID NO: 923928 - RNA, 16 nt, Homo sapiens
ugcagaggccacagga

SEQ ID NO: 923929 - RNA, 14 nt, Homo sapiens
ugcagcucccagaa

SEQ ID NO: 923930 - RNA, 13 nt, Homo sapiens
ugcaggacacugg

SEQ ID NO: 923931 - RNA, 19 nt, Homo sapiens
ugcagucuuguacugugac

SEQ ID NO: 923932 - RNA, 15 nt, Homo sapiens
ugcagugccacuaaa

SEQ ID NO: 923933 - RNA, 16 nt, Homo sapiens
ugcagugcugagauag

SEQ ID NO: 923934 - RNA, 20 nt, Homo sapiens
ugcaguggcaccaucucagu

SEQ ID NO: 923935 - RNA, 23 nt, Homo sapiens
ugcauaaaagacaagcacuuugg

SEQ ID NO: 923936 - RNA, 23 nt, Homo sapiens
ugcauauguugaccuuugcaaaa

SEQ ID NO: 923937 - RNA, 18 nt, Homo sapiens
ugcaugcauacacaccca

SEQ ID NO: 923938 - RNA, 18 nt, Homo sapiens
ugcauuagaaaccaugaa

SEQ ID NO: 923939 - RNA, 17 nt, Homo sapiens
ugccaagaccauuucac

SEQ ID NO: 923940 - RNA, 22 nt, Homo sapiens
ugccaagaccauuucacagaaa

SEQ ID NO: 923941 - RNA, 22 nt, Homo sapiens
ugccaaggccgcccaccugcau

SEQ ID NO: 923942 - RNA, 21 nt, Homo sapiens
ugccaauuucagcacccaacu

SEQ ID NO: 923943 - RNA, 22 nt, Homo sapiens
ugccacaucccagucacagugg

SEQ ID NO: 923944 - RNA, 15 nt, Homo sapiens
ugccaguaggcucaa

SEQ ID NO: 923945 - RNA, 15 nt, Homo sapiens
ugccaugcugcuaug

SEQ ID NO: 923946 - RNA, 14 nt, Homo sapiens
ugcccaaccucagc

SEQ ID NO: 923947 - RNA, 18 nt, Homo sapiens
ugcccacccgucuucaau

SEQ ID NO: 923948 - RNA, 20 nt, Homo sapiens
ugcccaggcuggagugcagu

SEQ ID NO: 923949 - RNA, 20 nt, Homo sapiens
ugcccucauuuguggcccaa

SEQ ID NO: 923950 - RNA, 13 nt, Homo sapiens
ugcccuccacugc

SEQ ID NO: 923951 - RNA, 23 nt, Homo sapiens
ugccguucgcugagucccagcaa

SEQ ID NO: 923952 - RNA, 23 nt, Homo sapiens
ugccuuauauuuguccaacaacu

SEQ ID NO: 923953 - RNA, 12 nt, Homo sapiens
ugccuuauguaa

SEQ ID NO: 923954 - RNA, 19 nt, Homo sapiens
ugccuuccuccuuauccua

SEQ ID NO: 923955 - RNA, 18 nt, Homo sapiens
ugccuugcugcaccugag

SEQ ID NO: 923956 - RNA, 18 nt, Homo sapiens
ugcgaaaguaaaaacacu

SEQ ID NO: 923957 - RNA, 14 nt, Homo sapiens
ugcgcagcuccuuc

SEQ ID NO: 923958 - RNA, 18 nt, Homo sapiens
ugcuaauggauguagcca

SEQ ID NO: 923959 - RNA, 22 nt, Homo sapiens
ugcucuccugggagacaaagca

SEQ ID NO: 923960 - RNA, 19 nt, Homo sapiens
ugcugauuucuacaacuga

SEQ ID NO: 923961 - RNA, 22 nt, Homo sapiens
ugcugcaccccaaguccagguc

SEQ ID NO: 923962 - RNA, 17 nt, Homo sapiens
uguccucuucugugagu

SEQ ID NO: 923963 - RNA, 21 nt, Homo sapiens
uguccuucccacggccacugc

SEQ ID NO: 923964 - RNA, 10 nt, Homo sapiens
ugucucucau

SEQ ID NO: 923965 - RNA, 20 nt, Homo sapiens
ugucuuuaaaagucauucaa

SEQ ID NO: 923966 - RNA, 18 nt, Homo sapiens
ugugaagauuuaaucuca

SEQ ID NO: 923967 - RNA, 21 nt, Homo sapiens
ugugacugcuuuuuugccuca

SEQ ID NO: 923968 - RNA, 16 nt, Homo sapiens
ugugcaggguccuccg

SEQ ID NO: 923969 - RNA, 17 nt, Homo sapiens
ugugcauugugugucac

SEQ ID NO: 923970 - RNA, 17 nt, Homo sapiens
ugugccaccaacauaaa

SEQ ID NO: 923971 - RNA, 13 nt, Homo sapiens
ugugccuacuccc

SEQ ID NO: 923972 - RNA, 17 nt, Homo sapiens
ugugucccuuccugcuu

SEQ ID NO: 923973 - RNA, 18 nt, Homo sapiens
uguguccuaugcgcucau

SEQ ID NO: 923974 - RNA, 13 nt, Homo sapiens
uguuaagugcuuu

SEQ ID NO: 923975 - RNA, 20 nt, Homo sapiens
uguuccacugcaaauaaagc

SEQ ID NO: 923976 - RNA, 21 nt, Homo sapiens
uguuccacuggaaacuuagag

SEQ ID NO: 923977 - RNA, 17 nt, Homo sapiens
uguucuaaugcugcaca

SEQ ID NO: 923978 - RNA, 19 nt, Homo sapiens
uguuuaggaauauaagguu

SEQ ID NO: 923979 - RNA, 23 nt, Homo sapiens
uguuuaugguaauacacauauuu

SEQ ID NO: 923980 - RNA, 17 nt, Homo sapiens
uguuucuaaacaguuga

SEQ ID NO: 923981 - RNA, 16 nt, Homo sapiens
uguuuggaugaaaaaa

SEQ ID NO: 923982 - RNA, 18 nt, Homo sapiens
uguuuucuacuuugccac

SEQ ID NO: 923983 - RNA, 12 nt, Homo sapiens
uuaaaaauaucu

SEQ ID NO: 923984 - RNA, 18 nt, Homo sapiens
uuaaaaauaucugaauau

SEQ ID NO: 923985 - RNA, 11 nt, Homo sapiens
uuaaaaucaca

SEQ ID NO: 923986 - RNA, 21 nt, Homo sapiens
uuaaaaucacaaacucaucca

SEQ ID NO: 923987 - RNA, 20 nt, Homo sapiens
uuaaaccgugauucuugaaa

SEQ ID NO: 923988 - RNA, 15 nt, Homo sapiens
uuaaagaaaauugcc

SEQ ID NO: 923989 - RNA, 23 nt, Homo sapiens
uuaaauuugcaaaucucaggaua

SEQ ID NO: 923990 - RNA, 13 nt, Homo sapiens
uuaagaauuucaa

SEQ ID NO: 923991 - RNA, 18 nt, Homo sapiens
uuaagcauuuucuacaca

SEQ ID NO: 923992 - RNA, 21 nt, Homo sapiens
uuaaggaugggcauaagcaaa

SEQ ID NO: 923993 - RNA, 13 nt, Homo sapiens
uuaauaaugguua

SEQ ID NO: 923994 - RNA, 16 nt, Homo sapiens
uuaauauauccuaaau

SEQ ID NO: 923995 - RNA, 11 nt, Homo sapiens
uuaaugaauag

SEQ ID NO: 923996 - RNA, 21 nt, Homo sapiens
uuaauugguuugugccuuaca

SEQ ID NO: 923997 - RNA, 23 nt, Homo sapiens
uuaauugguuugugccuuacauu

SEQ ID NO: 923998 - RNA, 19 nt, Homo sapiens
uuaauuuuugauauauuca

SEQ ID NO: 923999 - RNA, 14 nt, Homo sapiens
uuacacccaugcac

SEQ ID NO: 924000 - RNA, 22 nt, Homo sapiens
uuacaccguuguuguuuuacau

SEQ ID NO: 924001 - RNA, 15 nt, Homo sapiens
uuacagaaaugccaa

SEQ ID NO: 924002 - RNA, 13 nt, Homo sapiens
uuacagcuuuucu

SEQ ID NO: 924003 - RNA, 17 nt, Homo sapiens
uuacagcuuuucucuuu

SEQ ID NO: 924004 - RNA, 17 nt, Homo sapiens
uuacaggugugagccac

SEQ ID NO: 924005 - RNA, 13 nt, Homo sapiens
uuacggaauucca

SEQ ID NO: 924006 - RNA, 18 nt, Homo sapiens
uuacguggcaaaaucccu

SEQ ID NO: 924007 - RNA, 11 nt, Homo sapiens
uuacucaaagu

SEQ ID NO: 924008 - RNA, 21 nt, Homo sapiens
uuacuuuuuuuuaagucacaa

SEQ ID NO: 924009 - RNA, 16 nt, Homo sapiens
uuagaaagacuuucua

SEQ ID NO: 924010 - RNA, 16 nt, Homo sapiens
uuagaccaaaagauuc

SEQ ID NO: 924011 - RNA, 16 nt, Homo sapiens
uuagcauaagccagaa

SEQ ID NO: 924012 - RNA, 14 nt, Homo sapiens
ugucugugccaagg

SEQ ID NO: 924013 - RNA, 19 nt, Homo sapiens
ugucuuccaggcccagucc

SEQ ID NO: 924014 - RNA, 17 nt, Homo sapiens
ugucuuuaaaagucauu

SEQ ID NO: 924015 - RNA, 22 nt, Homo sapiens
ugugaaaauuacacccaugcac

SEQ ID NO: 924016 - RNA, 13 nt, Homo sapiens
ugugaacaugccu

SEQ ID NO: 924017 - RNA, 14 nt, Homo sapiens
ugugcaacagguaa

SEQ ID NO: 924018 - RNA, 16 nt, Homo sapiens
ugugccuuacauuauu

SEQ ID NO: 924019 - RNA, 12 nt, Homo sapiens
uguggcuucuag

SEQ ID NO: 924020 - RNA, 20 nt, Homo sapiens
uguggguuucucugugcucu

SEQ ID NO: 924021 - RNA, 19 nt, Homo sapiens
uguguaaaggaacaacuga

SEQ ID NO: 924022 - RNA, 22 nt, Homo sapiens
uguguaggcaccaccucuguca

SEQ ID NO: 924023 - RNA, 16 nt, Homo sapiens
uguguaugucugguaa

SEQ ID NO: 924024 - RNA, 13 nt, Homo sapiens
ugugucacaaagc

SEQ ID NO: 924025 - RNA, 14 nt, Homo sapiens
ugugucacaaagcu

SEQ ID NO: 924026 - RNA, 13 nt, Homo sapiens
ugugucugugaac

SEQ ID NO: 924027 - RNA, 14 nt, Homo sapiens
ugugucugugaaca

SEQ ID NO: 924028 - RNA, 12 nt, Homo sapiens
uguguuacugau

SEQ ID NO: 924029 - RNA, 17 nt, Homo sapiens
uguuacuaaagcuauau

SEQ ID NO: 924030 - RNA, 12 nt, Homo sapiens
uguuagugauuu

SEQ ID NO: 924031 - RNA, 15 nt, Homo sapiens
uguuauaauuugcac

SEQ ID NO: 924032 - RNA, 22 nt, Homo sapiens
uguuauuuguuuuuauuauuac

SEQ ID NO: 924033 - RNA, 17 nt, Homo sapiens
uguucaaugaauauugu

SEQ ID NO: 924034 - RNA, 14 nt, Homo sapiens
uguucacugugagu

SEQ ID NO: 924035 - RNA, 19 nt, Homo sapiens
uguucuauuucagugccaa

SEQ ID NO: 924036 - RNA, 18 nt, Homo sapiens
uguucucagaaucccuua

SEQ ID NO: 924037 - RNA, 18 nt, Homo sapiens
uguugccuugagcucuuc

SEQ ID NO: 924038 - RNA, 16 nt, Homo sapiens
uguuuauguaacuauc

SEQ ID NO: 924039 - RNA, 18 nt, Homo sapiens
uguuuauguaacuaucaa

SEQ ID NO: 924040 - RNA, 14 nt, Homo sapiens
uguuuccacauuca

SEQ ID NO: 924041 - RNA, 17 nt, Homo sapiens
uguuucuaaguggccug

SEQ ID NO: 924042 - RNA, 19 nt, Homo sapiens
uguuucuucuuugacuaua

SEQ ID NO: 924043 - RNA, 13 nt, Homo sapiens
uguuuugagccag

SEQ ID NO: 924044 - RNA, 17 nt, Homo sapiens
uguuuugugacuuuuag

SEQ ID NO: 924045 - RNA, 15 nt, Homo sapiens
uguuuuuaauccagu

SEQ ID NO: 924046 - RNA, 21 nt, Homo sapiens
uguuuuuuagcauaagccaga

SEQ ID NO: 924047 - RNA, 12 nt, Homo sapiens
uuaaaaauaugu

SEQ ID NO: 924048 - RNA, 15 nt, Homo sapiens
uuaaaaguugcaaag

SEQ ID NO: 924049 - RNA, 22 nt, Homo sapiens
uuaaaauaaauuuguaugcuca

SEQ ID NO: 924050 - RNA, 13 nt, Homo sapiens
uuaaaauuucacu

SEQ ID NO: 924051 - RNA, 17 nt, Homo sapiens
uuaaagaaaauugccaa

SEQ ID NO: 924052 - RNA, 12 nt, Homo sapiens
uuaaagcauuuu

SEQ ID NO: 924053 - RNA, 16 nt, Homo sapiens
uuaaaguggcuuucaa

SEQ ID NO: 924054 - RNA, 18 nt, Homo sapiens
uuaacuuuccuuccucau

SEQ ID NO: 924055 - RNA, 15 nt, Homo sapiens
uuaagcaacuggaaa

SEQ ID NO: 924056 - RNA, 19 nt, Homo sapiens
uuaagcauuuucuacacag

SEQ ID NO: 924057 - RNA, 19 nt, Homo sapiens
uuaagcugaaggcauuuga

SEQ ID NO: 924058 - RNA, 22 nt, Homo sapiens
uuaaggaacaagaauugcuaaa

SEQ ID NO: 924059 - RNA, 22 nt, Homo sapiens
uuaaguaauuuccccacucuga

SEQ ID NO: 924060 - RNA, 20 nt, Homo sapiens
uuaauauaagaagcuuucag

SEQ ID NO: 924061 - RNA, 13 nt, Homo sapiens
uuaauccuagcug

SEQ ID NO: 924062 - RNA, 14 nt, Homo sapiens
uuacaacuccugca

SEQ ID NO: 924063 - RNA, 22 nt, Homo sapiens
uuacaaggcaggccuuuccuac

SEQ ID NO: 924064 - RNA, 22 nt, Homo sapiens
uuaccugcauguguuguacaau

SEQ ID NO: 924065 - RNA, 20 nt, Homo sapiens
uuacuaggagauaccaccga

SEQ ID NO: 924066 - RNA, 19 nt, Homo sapiens
uuacuuuaccacccccaca

SEQ ID NO: 924067 - RNA, 19 nt, Homo sapiens
uuacuuuuuuuuaagucac

SEQ ID NO: 924068 - RNA, 15 nt, Homo sapiens
uuagaaaccaugaaa

SEQ ID NO: 924069 - RNA, 17 nt, Homo sapiens
uuagaagcucacgccuu

SEQ ID NO: 924070 - RNA, 21 nt, Homo sapiens
uuagccccaugaguuugccau

SEQ ID NO: 924071 - RNA, 16 nt, Homo sapiens
uuaggaaaaauuccac

SEQ ID NO: 924072 - RNA, 22 nt, Homo sapiens
uuaguaaaaauaaaucaaggcu

SEQ ID NO: 924073 - RNA, 17 nt, Homo sapiens
uuaguuuugcuccuucu

SEQ ID NO: 924074 - RNA, 14 nt, Homo sapiens
uuauauuaccaaug

SEQ ID NO: 924075 - RNA, 14 nt, Homo sapiens
uuauauuugucuca

SEQ ID NO: 924076 - RNA, 20 nt, Homo sapiens
uuaucaucccaacagccaag

SEQ ID NO: 924077 - RNA, 17 nt, Homo sapiens
uuauccacaacuuuuca

SEQ ID NO: 924078 - RNA, 21 nt, Homo sapiens
uuaugaugcuggaaauaugaa

SEQ ID NO: 924079 - RNA, 23 nt, Homo sapiens
uuauggaccaauuagcauuccau

SEQ ID NO: 924080 - RNA, 17 nt, Homo sapiens
uuauguaaacaaucaga

SEQ ID NO: 924081 - RNA, 15 nt, Homo sapiens
uuauguucaaugaau

SEQ ID NO: 924082 - RNA, 13 nt, Homo sapiens
uuauuaaaucagu

SEQ ID NO: 924083 - RNA, 19 nt, Homo sapiens
uuauugcuggaaucuacua

SEQ ID NO: 924084 - RNA, 14 nt, Homo sapiens
uuauuuccauggau

SEQ ID NO: 924085 - RNA, 15 nt, Homo sapiens
uuauuuucacuccuu

SEQ ID NO: 924086 - RNA, 16 nt, Homo sapiens
uuauuuuuaugaugcu

SEQ ID NO: 924087 - RNA, 23 nt, Homo sapiens
uucaaaaauuauauuuugaacaa

SEQ ID NO: 924088 - RNA, 19 nt, Homo sapiens
uucaaacaauucaaucaaa

SEQ ID NO: 924089 - RNA, 16 nt, Homo sapiens
uucaaagaugauaauu

SEQ ID NO: 924090 - RNA, 14 nt, Homo sapiens
uucaaauccugcca

SEQ ID NO: 924091 - RNA, 16 nt, Homo sapiens
uucaaauccugccacu

SEQ ID NO: 924092 - RNA, 13 nt, Homo sapiens
uucaagguguaaa

SEQ ID NO: 924093 - RNA, 14 nt, Homo sapiens
uucaaguuaugauu

SEQ ID NO: 924094 - RNA, 20 nt, Homo sapiens
uucaauaaaaugcacugacc

SEQ ID NO: 924095 - RNA, 15 nt, Homo sapiens
uucaauaaaguacug

SEQ ID NO: 924096 - RNA, 23 nt, Homo sapiens
uucaauuuucuucacacuaucaa

SEQ ID NO: 924097 - RNA, 11 nt, Homo sapiens
uucacacagca

SEQ ID NO: 924098 - RNA, 23 nt, Homo sapiens
uucacacuaucaacacugcagca

SEQ ID NO: 924099 - RNA, 16 nt, Homo sapiens
uucacuaaagugucau

SEQ ID NO: 924100 - RNA, 21 nt, Homo sapiens
uucauaccuguuguacacuug

SEQ ID NO: 924101 - RNA, 14 nt, Homo sapiens
uucauacugaauga

SEQ ID NO: 924102 - RNA, 17 nt, Homo sapiens
uucaucuacuacagggu

SEQ ID NO: 924103 - RNA, 13 nt, Homo sapiens
uucaugagucuug

SEQ ID NO: 924104 - RNA, 20 nt, Homo sapiens
uucauuauuacguggcaaaa

SEQ ID NO: 924105 - RNA, 14 nt, Homo sapiens
uucauuccauuugc

SEQ ID NO: 924106 - RNA, 16 nt, Homo sapiens
uucauucuaaaccaaa

SEQ ID NO: 924107 - RNA, 13 nt, Homo sapiens
uuccacugacagg

SEQ ID NO: 924108 - RNA, 20 nt, Homo sapiens
uuccagcuaagccugaugau

SEQ ID NO: 924109 - RNA, 20 nt, Homo sapiens
uucccaacacuucagacugc

SEQ ID NO: 924110 - RNA, 23 nt, Homo sapiens
uucccggcuggacuuuugcagcu

SEQ ID NO: 924111 - RNA, 22 nt, Homo sapiens
uucccuuugauuuuuugcugca

SEQ ID NO: 924112 - RNA, 22 nt, Homo sapiens
uuccuggggaaaagaagcaccc

SEQ ID NO: 924113 - RNA, 17 nt, Homo sapiens
uuccuuaccauaccacu

SEQ ID NO: 924114 - RNA, 15 nt, Homo sapiens
uuccuuguccccaca

SEQ ID NO: 924115 - RNA, 18 nt, Homo sapiens
uucgaaggaugaagacga

SEQ ID NO: 924116 - RNA, 23 nt, Homo sapiens
uucuaaaaucaagugcaccuaca

SEQ ID NO: 924117 - RNA, 14 nt, Homo sapiens
uucuaaccaaauac

SEQ ID NO: 924118 - RNA, 15 nt, Homo sapiens
uucuacuuugccaca

SEQ ID NO: 924119 - RNA, 17 nt, Homo sapiens
uucuaguuguaaugugu

SEQ ID NO: 924120 - RNA, 19 nt, Homo sapiens
uucucauguuugugcaugu

SEQ ID NO: 924121 - RNA, 14 nt, Homo sapiens
uucuccacuguucu

SEQ ID NO: 924122 - RNA, 22 nt, Homo sapiens
uucucuacugucuggauuaauu

SEQ ID NO: 924123 - RNA, 13 nt, Homo sapiens
uucucugugcucu

SEQ ID NO: 924124 - RNA, 17 nt, Homo sapiens
uucucuucucucuucaa

SEQ ID NO: 924125 - RNA, 17 nt, Homo sapiens
uucugaguagcauauau

SEQ ID NO: 924126 - RNA, 17 nt, Homo sapiens
uucugcccucagcuuca

SEQ ID NO: 924127 - RNA, 19 nt, Homo sapiens
uucuggaagcuaccaaaaa

SEQ ID NO: 924128 - RNA, 15 nt, Homo sapiens
uucuggucacauucc

SEQ ID NO: 924129 - RNA, 19 nt, Homo sapiens
uucugguuuucgaagacua

SEQ ID NO: 924130 - RNA, 18 nt, Homo sapiens
uucuguccucuucuguga

SEQ ID NO: 924131 - RNA, 16 nt, Homo sapiens
uucuucccaaggccag

SEQ ID NO: 924132 - RNA, 14 nt, Homo sapiens
uucuuuuguacuuu

SEQ ID NO: 924133 - RNA, 16 nt, Homo sapiens
uuggacacacacagcu

SEQ ID NO: 924134 - RNA, 16 nt, Homo sapiens
uuggacuuccauuugg

SEQ ID NO: 924135 - RNA, 23 nt, Homo sapiens
uuggaggaauuuucuaaaagcca

SEQ ID NO: 924136 - RNA, 16 nt, Homo sapiens
uuggaggcccuaggcg

SEQ ID NO: 924137 - RNA, 23 nt, Homo sapiens
uuggcaauucuucuucucaagca

SEQ ID NO: 924138 - RNA, 22 nt, Homo sapiens
uugggaccuugcgugaagagca

SEQ ID NO: 924139 - RNA, 16 nt, Homo sapiens
uugggagauuucauuu

SEQ ID NO: 924140 - RNA, 17 nt, Homo sapiens
uugggaggccaaggugg

SEQ ID NO: 924141 - RNA, 12 nt, Homo sapiens
uuggguuccuuu

SEQ ID NO: 924142 - RNA, 22 nt, Homo sapiens
uuguaaaauaaaaccaccaaag

SEQ ID NO: 924143 - RNA, 13 nt, Homo sapiens
uuguaaaccugga

SEQ ID NO: 924144 - RNA, 15 nt, Homo sapiens
uuguacaauaccaga

SEQ ID NO: 924145 - RNA, 21 nt, Homo sapiens
uuguagacagggucucccuau

SEQ ID NO: 924146 - RNA, 10 nt, Homo sapiens
uuguaucauu

SEQ ID NO: 924147 - RNA, 21 nt, Homo sapiens
uugucuggcaaggacuuugua

SEQ ID NO: 924148 - RNA, 19 nt, Homo sapiens
uugucuuaaucguccugcu

SEQ ID NO: 924149 - RNA, 14 nt, Homo sapiens
uugugaagaaacau

SEQ ID NO: 924150 - RNA, 14 nt, Homo sapiens
uugugaguaugugu

SEQ ID NO: 924151 - RNA, 19 nt, Homo sapiens
uuuaaaaaaaaacauucaa

SEQ ID NO: 924152 - RNA, 19 nt, Homo sapiens
uuuaaaaauaucugaauau

SEQ ID NO: 924153 - RNA, 22 nt, Homo sapiens
uuuaagcauuuucuacacagcg

SEQ ID NO: 924154 - RNA, 19 nt, Homo sapiens
uuuaauacaaaaagcaaaa

SEQ ID NO: 924155 - RNA, 16 nt, Homo sapiens
uuuacaaaauacaaaa

SEQ ID NO: 924156 - RNA, 15 nt, Homo sapiens
uuuacgguacuuggu

SEQ ID NO: 924157 - RNA, 16 nt, Homo sapiens
uuuagaaauuacaagu

SEQ ID NO: 924158 - RNA, 20 nt, Homo sapiens
uuuagaaucaagucugugaa

SEQ ID NO: 924159 - RNA, 13 nt, Homo sapiens
uuuagggugauca

SEQ ID NO: 924160 - RNA, 17 nt, Homo sapiens
uuuaugagaaacuuaaa

SEQ ID NO: 924161 - RNA, 16 nt, Homo sapiens
uuuauguaacuaucaa

SEQ ID NO: 924162 - RNA, 16 nt, Homo sapiens
uuuauguggugguuuc

SEQ ID NO: 924163 - RNA, 22 nt, Homo sapiens
uuucaauaaaguacugcaaaau

SEQ ID NO: 924164 - RNA, 11 nt, Homo sapiens
uuucacugaca

SEQ ID NO: 924165 - RNA, 15 nt, Homo sapiens
uuucacuguucauga

SEQ ID NO: 924166 - RNA, 20 nt, Homo sapiens
uuucagcuggagauacugau

SEQ ID NO: 924167 - RNA, 12 nt, Homo sapiens
uuuccacacagc

SEQ ID NO: 924168 - RNA, 17 nt, Homo sapiens
uuucccugcuagggguu

SEQ ID NO: 924169 - RNA, 17 nt, Homo sapiens
uuuccgccagaccucaa

SEQ ID NO: 924170 - RNA, 18 nt, Homo sapiens
uuuccgccagaccucaac

SEQ ID NO: 924171 - RNA, 18 nt, Homo sapiens
uuuccugagcccuaaaca

SEQ ID NO: 924172 - RNA, 21 nt, Homo sapiens
uuuccuuguccccacacuccu

SEQ ID NO: 924173 - RNA, 16 nt, Homo sapiens
uuuccuugucucucau

SEQ ID NO: 924174 - RNA, 14 nt, Homo sapiens
uuucuacuuugcca

SEQ ID NO: 924175 - RNA, 18 nt, Homo sapiens
uuucucccuuuguuuaaa

SEQ ID NO: 924176 - RNA, 21 nt, Homo sapiens
uuucugcugcuuggcacauuu

SEQ ID NO: 924177 - RNA, 19 nt, Homo sapiens
uuucuuguuaagugcuuuu

SEQ ID NO: 924178 - RNA, 17 nt, Homo sapiens
aucaggcauuuuuccaa

SEQ ID NO: 924179 - RNA, 12 nt, Homo sapiens
aucaguuugcag

SEQ ID NO: 924180 - RNA, 14 nt, Homo sapiens
aucauaugggauac

SEQ ID NO: 924181 - RNA, 15 nt, Homo sapiens
aucauguugaaguca

SEQ ID NO: 924182 - RNA, 20 nt, Homo sapiens
aucauuucuugguaugauca

SEQ ID NO: 924183 - RNA, 16 nt, Homo sapiens
auccauaagauuugca

SEQ ID NO: 924184 - RNA, 23 nt, Homo sapiens
auccaugugcugcuguggcauca

SEQ ID NO: 924185 - RNA, 13 nt, Homo sapiens
aucccaucugcau

SEQ ID NO: 924186 - RNA, 12 nt, Homo sapiens
auccccaaaggu

SEQ ID NO: 924187 - RNA, 19 nt, Homo sapiens
aucccggaguucuccugcu

SEQ ID NO: 924188 - RNA, 17 nt, Homo sapiens
aucccuuaacaguugua

SEQ ID NO: 924189 - RNA, 11 nt, Homo sapiens
auccuacccca

SEQ ID NO: 924190 - RNA, 11 nt, Homo sapiens
auccugaacau

SEQ ID NO: 924191 - RNA, 16 nt, Homo sapiens
auccuuagcaacagcc

SEQ ID NO: 924192 - RNA, 15 nt, Homo sapiens
aucgacuaagacuuu

SEQ ID NO: 924193 - RNA, 21 nt, Homo sapiens
aucgcuggaaaugaauagcca

SEQ ID NO: 924194 - RNA, 17 nt, Homo sapiens
aucggggccagaggcag

SEQ ID NO: 924195 - RNA, 17 nt, Homo sapiens
aucggugcugucagccc

SEQ ID NO: 924196 - RNA, 15 nt, Homo sapiens
aucuaacaaagucaa

SEQ ID NO: 924197 - RNA, 15 nt, Homo sapiens
aucuacuuacuugag

SEQ ID NO: 924198 - RNA, 23 nt, Homo sapiens
aucucaggauaaaguuugcuaag

SEQ ID NO: 924199 - RNA, 21 nt, Homo sapiens
aucucuacuaaaaauacaaaa

SEQ ID NO: 924200 - RNA, 16 nt, Homo sapiens
aucucuaucucuuuau

SEQ ID NO: 924201 - RNA, 16 nt, Homo sapiens
aucugcugccaugaga

SEQ ID NO: 924202 - RNA, 14 nt, Homo sapiens
aucuggacacuggg

SEQ ID NO: 924203 - RNA, 15 nt, Homo sapiens
aucuggacacugggc

SEQ ID NO: 924204 - RNA, 16 nt, Homo sapiens
aucugggaacucccaa

SEQ ID NO: 924205 - RNA, 19 nt, Homo sapiens
aucuguaauucacuaggcu

SEQ ID NO: 924206 - RNA, 23 nt, Homo sapiens
aucuuagaacagauggcugugaa

SEQ ID NO: 924207 - RNA, 17 nt, Homo sapiens
aucuuaguucuguauau

SEQ ID NO: 924208 - RNA, 19 nt, Homo sapiens
aucuuaguucuguauauaa

SEQ ID NO: 924209 - RNA, 19 nt, Homo sapiens
aucuuggagacaauuacaa

SEQ ID NO: 924210 - RNA, 15 nt, Homo sapiens
aucuuggggugcagc

SEQ ID NO: 924211 - RNA, 17 nt, Homo sapiens
augaaacagacccucaa

SEQ ID NO: 924212 - RNA, 19 nt, Homo sapiens
augaagauaaguaauuuac

SEQ ID NO: 924213 - RNA, 18 nt, Homo sapiens
augaaguauugcuaauau

SEQ ID NO: 924214 - RNA, 18 nt, Homo sapiens
augacaauuuucuaccac

SEQ ID NO: 924215 - RNA, 15 nt, Homo sapiens
augacacauuugaaa

SEQ ID NO: 924216 - RNA, 18 nt, Homo sapiens
augacugaaggacaucug

SEQ ID NO: 924217 - RNA, 17 nt, Homo sapiens
augagcugguuugacuc

SEQ ID NO: 924218 - RNA, 20 nt, Homo sapiens
augaggaggcagaaagcaga

SEQ ID NO: 924219 - RNA, 13 nt, Homo sapiens
augagucuuguaa

SEQ ID NO: 924220 - RNA, 21 nt, Homo sapiens
augaguuugccauguugagca

SEQ ID NO: 924221 - RNA, 18 nt, Homo sapiens
augauguauacccauaaa

SEQ ID NO: 924222 - RNA, 18 nt, Homo sapiens
augauugccaacaguggc

SEQ ID NO: 924223 - RNA, 16 nt, Homo sapiens
augauuuuggccacuu

SEQ ID NO: 924224 - RNA, 19 nt, Homo sapiens
augcacagggcugcaacac

SEQ ID NO: 924225 - RNA, 19 nt, Homo sapiens
augcagaauuuuaugugac

SEQ ID NO: 924226 - RNA, 20 nt, Homo sapiens
augcauaaaagacaagcacu

SEQ ID NO: 924227 - RNA, 15 nt, Homo sapiens
augccacucaccaac

SEQ ID NO: 924228 - RNA, 16 nt, Homo sapiens
augccugcagugccac

SEQ ID NO: 924229 - RNA, 22 nt, Homo sapiens
augcuggaugaugaaauggauu

SEQ ID NO: 924230 - RNA, 13 nt, Homo sapiens
augcuuaggugaa

SEQ ID NO: 924231 - RNA, 15 nt, Homo sapiens
auggaaggccuuuug

SEQ ID NO: 924232 - RNA, 18 nt, Homo sapiens
auggaagggccuucucca

SEQ ID NO: 924233 - RNA, 20 nt, Homo sapiens
auggacuauugcaauacauu

SEQ ID NO: 924234 - RNA, 19 nt, Homo sapiens
auggacugcaccuugugaa

SEQ ID NO: 924235 - RNA, 18 nt, Homo sapiens
auggcucugaacugcaca

SEQ ID NO: 924236 - RNA, 12 nt, Homo sapiens
auggcugugaaa

SEQ ID NO: 924237 - RNA, 17 nt, Homo sapiens
augggacugaugucauc

SEQ ID NO: 924238 - RNA, 21 nt, Homo sapiens
augggacugaugucaucuuga

SEQ ID NO: 924239 - RNA, 15 nt, Homo sapiens
augggcauaagcaaa

SEQ ID NO: 924240 - RNA, 21 nt, Homo sapiens
auggguagcuucugaccucag

SEQ ID NO: 924241 - RNA, 24 nt, Homo sapiens
augguaauacacauauuugcacaa

SEQ ID NO: 924242 - RNA, 16 nt, Homo sapiens
augguagacugugaca

SEQ ID NO: 924243 - RNA, 22 nt, Homo sapiens
augguuuguuuucuacauugau

SEQ ID NO: 924244 - RNA, 13 nt, Homo sapiens
auguaacuaucaa

SEQ ID NO: 924245 - RNA, 19 nt, Homo sapiens
auguacuuaaauuacacau

SEQ ID NO: 924246 - RNA, 21 nt, Homo sapiens
auguacuuccaguauccugaa

SEQ ID NO: 924247 - RNA, 13 nt, Homo sapiens
auguagugcaguc

SEQ ID NO: 924248 - RNA, 13 nt, Homo sapiens
augucaaauccau

SEQ ID NO: 924249 - RNA, 19 nt, Homo sapiens
augucuaacaggacuugaa

SEQ ID NO: 924250 - RNA, 18 nt, Homo sapiens
augucuguaaccaauaau

SEQ ID NO: 924251 - RNA, 21 nt, Homo sapiens
auguggccacuaggaggaaug

SEQ ID NO: 924252 - RNA, 17 nt, Homo sapiens
auguuccauccuguaca

SEQ ID NO: 924253 - RNA, 17 nt, Homo sapiens
auuaaaaucacaaacuc

SEQ ID NO: 924254 - RNA, 20 nt, Homo sapiens
auuaaaccuuuccauuuuac

SEQ ID NO: 924255 - RNA, 16 nt, Homo sapiens
auuaauauauccuaaa

SEQ ID NO: 924256 - RNA, 23 nt, Homo sapiens
auuaauugguuugugccuuacau

SEQ ID NO: 924257 - RNA, 18 nt, Homo sapiens
auuaauuugaccaucucu

SEQ ID NO: 924258 - RNA, 22 nt, Homo sapiens
auuacacauguagagcauaucu

SEQ ID NO: 924259 - RNA, 13 nt, Homo sapiens
auuagcauuccau

SEQ ID NO: 924260 - RNA, 16 nt, Homo sapiens
auuaggacuggcuuug

SEQ ID NO: 924261 - RNA, 19 nt, Homo sapiens
auuagugaaguaugcacua

SEQ ID NO: 924262 - RNA, 15 nt, Homo sapiens
auuauauaacuguau

SEQ ID NO: 924263 - RNA, 17 nt, Homo sapiens
auuauguacucuacuga

SEQ ID NO: 924264 - RNA, 17 nt, Homo sapiens
auuauuacuccuugcca

SEQ ID NO: 924265 - RNA, 15 nt, Homo sapiens
auucaagagucucau

SEQ ID NO: 924266 - RNA, 19 nt, Homo sapiens
auucaauaaaaugcacuga

SEQ ID NO: 924267 - RNA, 14 nt, Homo sapiens
auucaccaaccaaa

SEQ ID NO: 924268 - RNA, 23 nt, Homo sapiens
auucaccaaccaaagggggacag

SEQ ID NO: 924269 - RNA, 21 nt, Homo sapiens
auucagaccacgacaacuaug

SEQ ID NO: 924270 - RNA, 12 nt, Homo sapiens
auucagcugccc

SEQ ID NO: 924271 - RNA, 16 nt, Homo sapiens
auucaguaaauuuugg

SEQ ID NO: 924272 - RNA, 14 nt, Homo sapiens
auuccacaccccug

SEQ ID NO: 924273 - RNA, 20 nt, Homo sapiens
auucccggcuggacuuuugc

SEQ ID NO: 924274 - RNA, 17 nt, Homo sapiens
auuccucuguagaauuu

SEQ ID NO: 924275 - RNA, 22 nt, Homo sapiens
auuccuuagaggaagaauauaa

SEQ ID NO: 924276 - RNA, 18 nt, Homo sapiens
auuccuuuccacuccaac

SEQ ID NO: 924277 - RNA, 17 nt, Homo sapiens
auucgcagugcccagug

SEQ ID NO: 924278 - RNA, 21 nt, Homo sapiens
auucuaaccuacuaagucugu

SEQ ID NO: 924279 - RNA, 15 nt, Homo sapiens
auucuccugccucag

SEQ ID NO: 924280 - RNA, 15 nt, Homo sapiens
auucuccuuccccac

SEQ ID NO: 924281 - RNA, 19 nt, Homo sapiens
auucucucugaacacacau

SEQ ID NO: 924282 - RNA, 19 nt, Homo sapiens
auucuuaaaguggcuuuca

SEQ ID NO: 924283 - RNA, 22 nt, Homo sapiens
auucuuauaguaccucacugca

SEQ ID NO: 924284 - RNA, 18 nt, Homo sapiens
auucuuuccaugcaguua

SEQ ID NO: 924285 - RNA, 23 nt, Homo sapiens
auugaauaggcauuaaaugcaaa

SEQ ID NO: 924286 - RNA, 11 nt, Homo sapiens
auugacaucua

SEQ ID NO: 924287 - RNA, 15 nt, Homo sapiens
auugcaauacauuuc

SEQ ID NO: 924288 - RNA, 16 nt, Homo sapiens
auugcaauacauuucu

SEQ ID NO: 924289 - RNA, 20 nt, Homo sapiens
auugcaauacauuucuuccu

SEQ ID NO: 924290 - RNA, 15 nt, Homo sapiens
auugcagagucugua

SEQ ID NO: 924291 - RNA, 18 nt, Homo sapiens
auugcucuauauguaaua

SEQ ID NO: 924292 - RNA, 16 nt, Homo sapiens
auuggacuuccauuug

SEQ ID NO: 924293 - RNA, 22 nt, Homo sapiens
auugugucuggucguuugacca

SEQ ID NO: 924294 - RNA, 15 nt, Homo sapiens
auugugugucacaaa

SEQ ID NO: 924295 - RNA, 22 nt, Homo sapiens
auuguuuugugacuuuuagaca

SEQ ID NO: 924296 - RNA, 17 nt, Homo sapiens
auuuaauaccaccaaca

SEQ ID NO: 924297 - RNA, 18 nt, Homo sapiens
auuuaauauuuaugcucu

SEQ ID NO: 924298 - RNA, 11 nt, Homo sapiens
auuuaaucuca

SEQ ID NO: 924299 - RNA, 14 nt, Homo sapiens
auuuacacugacug

SEQ ID NO: 924300 - RNA, 20 nt, Homo sapiens
cacuuugguauucaauuuga

SEQ ID NO: 924301 - RNA, 15 nt, Homo sapiens
cagaaaacauugacu

SEQ ID NO: 924302 - RNA, 20 nt, Homo sapiens
cagaaaagaaaauauaguuu

SEQ ID NO: 924303 - RNA, 15 nt, Homo sapiens
cagaaaugccacuca

SEQ ID NO: 924304 - RNA, 17 nt, Homo sapiens
cagaaaugccacucacc

SEQ ID NO: 924305 - RNA, 11 nt, Homo sapiens
cagaacaguua

SEQ ID NO: 924306 - RNA, 19 nt, Homo sapiens
cagaaggaggaaguggaag

SEQ ID NO: 924307 - RNA, 11 nt, Homo sapiens
cagaagugugu

SEQ ID NO: 924308 - RNA, 19 nt, Homo sapiens
cagaauaaagaacauucua

SEQ ID NO: 924309 - RNA, 17 nt, Homo sapiens
cagaauggagcuaugga

SEQ ID NO: 924310 - RNA, 18 nt, Homo sapiens
cagaauggggaauggaga

SEQ ID NO: 924311 - RNA, 19 nt, Homo sapiens
cagaauugggcaacuauuc

SEQ ID NO: 924312 - RNA, 14 nt, Homo sapiens
cagaccagagcucu

SEQ ID NO: 924313 - RNA, 15 nt, Homo sapiens
cagaccuucuuccac

SEQ ID NO: 924314 - RNA, 19 nt, Homo sapiens
cagacucaaggccuccagc

SEQ ID NO: 924315 - RNA, 18 nt, Homo sapiens
cagacugcaagugagcaa

SEQ ID NO: 924316 - RNA, 11 nt, Homo sapiens
cagagccacag

SEQ ID NO: 924317 - RNA, 20 nt, Homo sapiens
cagagcgagauucugccuca

SEQ ID NO: 924318 - RNA, 21 nt, Homo sapiens
cagaggauucugucuuccagg

SEQ ID NO: 924319 - RNA, 17 nt, Homo sapiens
cagaguggagcccucag

SEQ ID NO: 924320 - RNA, 19 nt, Homo sapiens
cagaguggauuaaaggcaa

SEQ ID NO: 924321 - RNA, 16 nt, Homo sapiens
cagaguguagaccgag

SEQ ID NO: 924322 - RNA, 14 nt, Homo sapiens
cagauacucgccaa

SEQ ID NO: 924323 - RNA, 18 nt, Homo sapiens
cagaucuguaauucacua

SEQ ID NO: 924324 - RNA, 23 nt, Homo sapiens
cagaugccuccucuguccucauu

SEQ ID NO: 924325 - RNA, 19 nt, Homo sapiens
cagaugccugcagugccac

SEQ ID NO: 924326 - RNA, 15 nt, Homo sapiens
cagauggucccauua

SEQ ID NO: 924327 - RNA, 21 nt, Homo sapiens
cagauuaucuuguacagccuu

SEQ ID NO: 924328 - RNA, 12 nt, Homo sapiens
cagcacuuugac

SEQ ID NO: 924329 - RNA, 17 nt, Homo sapiens
cagcagucuaguucuuu

SEQ ID NO: 924330 - RNA, 18 nt, Homo sapiens
cagccaagacccaacagg

SEQ ID NO: 924331 - RNA, 20 nt, Homo sapiens
cagccaccaccuacagccca

SEQ ID NO: 924332 - RNA, 13 nt, Homo sapiens
cagccaucccagc

SEQ ID NO: 924333 - RNA, 13 nt, Homo sapiens
cagcccacuggau

SEQ ID NO: 924334 - RNA, 14 nt, Homo sapiens
cagccucuagggac

SEQ ID NO: 924335 - RNA, 19 nt, Homo sapiens
cagccugggugacagagca

SEQ ID NO: 924336 - RNA, 20 nt, Homo sapiens
cagccugugggagaagggac

SEQ ID NO: 924337 - RNA, 17 nt, Homo sapiens
cagcuaagccugaugau

SEQ ID NO: 924338 - RNA, 13 nt, Homo sapiens
cagcucacugcaa

SEQ ID NO: 924339 - RNA, 12 nt, Homo sapiens
cagcucccaugu

SEQ ID NO: 924340 - RNA, 19 nt, Homo sapiens
cagcucuuccaaucuccau

SEQ ID NO: 924341 - RNA, 22 nt, Homo sapiens
cagcugaacaguguuggcuuuc

SEQ ID NO: 924342 - RNA, 16 nt, Homo sapiens
cagcugguuauccaaa

SEQ ID NO: 924343 - RNA, 13 nt, Homo sapiens
cagcuucaaauaa

SEQ ID NO: 924344 - RNA, 14 nt, Homo sapiens
cagcuuggggccau

SEQ ID NO: 924345 - RNA, 19 nt, Homo sapiens
caggaaagcguuuggaaaa

SEQ ID NO: 924346 - RNA, 20 nt, Homo sapiens
caggaacagcaaaugcaaaa

SEQ ID NO: 924347 - RNA, 18 nt, Homo sapiens
caggaagaguucuauccc

SEQ ID NO: 924348 - RNA, 11 nt, Homo sapiens
caggacacugg

SEQ ID NO: 924349 - RNA, 22 nt, Homo sapiens
caggacacuggucgagagccaa

SEQ ID NO: 924350 - RNA, 11 nt, Homo sapiens
caggagcucag

SEQ ID NO: 924351 - RNA, 20 nt, Homo sapiens
caggagguugagaaugcagu

SEQ ID NO: 924352 - RNA, 14 nt, Homo sapiens
caggaugauuuugg

SEQ ID NO: 924353 - RNA, 23 nt, Homo sapiens
caggauuccaguugcgugucugu

SEQ ID NO: 924354 - RNA, 17 nt, Homo sapiens
caggcacugaagcuccu

SEQ ID NO: 924355 - RNA, 19 nt, Homo sapiens
caggcauuuuuccaaagga

SEQ ID NO: 924356 - RNA, 13 nt, Homo sapiens
caggccacugacc

SEQ ID NO: 924357 - RNA, 14 nt, Homo sapiens
caggccacugaccu

SEQ ID NO: 924358 - RNA, 14 nt, Homo sapiens
caggccugaccuca

SEQ ID NO: 924359 - RNA, 16 nt, Homo sapiens
caggcucaacauaaca

SEQ ID NO: 924360 - RNA, 17 nt, Homo sapiens
caggcugcggugggcag

SEQ ID NO: 924361 - RNA, 22 nt, Homo sapiens
caggcuggagugaucucagcuc

SEQ ID NO: 924362 - RNA, 20 nt, Homo sapiens
caggcuggagugcaguggca

SEQ ID NO: 924363 - RNA, 14 nt, Homo sapiens
caggcuggucuuga

SEQ ID NO: 924364 - RNA, 19 nt, Homo sapiens
caggcuguuuuugggugca

SEQ ID NO: 924365 - RNA, 20 nt, Homo sapiens
cagggauggggccacagcca

SEQ ID NO: 924366 - RNA, 16 nt, Homo sapiens
caggggccugcagaag

SEQ ID NO: 924367 - RNA, 19 nt, Homo sapiens
caggguccuccggggcuca

SEQ ID NO: 924368 - RNA, 20 nt, Homo sapiens
caggugacugccaccgugcc

SEQ ID NO: 924369 - RNA, 22 nt, Homo sapiens
caggugagcugaagacaaacca

SEQ ID NO: 924370 - RNA, 19 nt, Homo sapiens
caggugugagccaccacac

SEQ ID NO: 924371 - RNA, 20 nt, Homo sapiens
caguaacuuacccuuaggga

SEQ ID NO: 924372 - RNA, 18 nt, Homo sapiens
caguacagauuguucuca

SEQ ID NO: 924373 - RNA, 20 nt, Homo sapiens
caguagggaugaguacccaa

SEQ ID NO: 924374 - RNA, 14 nt, Homo sapiens
cagucaccacucca

SEQ ID NO: 924375 - RNA, 20 nt, Homo sapiens
cagucuggugcccagacuca

SEQ ID NO: 924376 - RNA, 14 nt, Homo sapiens
cagugacuccugcu

SEQ ID NO: 924377 - RNA, 20 nt, Homo sapiens
cagugagacacagaguggag

SEQ ID NO: 924378 - RNA, 16 nt, Homo sapiens
cagugccccuagcuua

SEQ ID NO: 924379 - RNA, 18 nt, Homo sapiens
cagugguaaauauagaac

SEQ ID NO: 924380 - RNA, 18 nt, Homo sapiens
caguguguguaacagggu

SEQ ID NO: 924381 - RNA, 22 nt, Homo sapiens
caguguuuggaugaaaaaagcc

SEQ ID NO: 924382 - RNA, 19 nt, Homo sapiens
caguuacguugcauccaca

SEQ ID NO: 924383 - RNA, 20 nt, Homo sapiens
caguuauuaaaauguuaaaa

SEQ ID NO: 924384 - RNA, 12 nt, Homo sapiens
caguucugauga

SEQ ID NO: 924385 - RNA, 15 nt, Homo sapiens
caguuugauaacuag

SEQ ID NO: 924386 - RNA, 19 nt, Homo sapiens
cauaaaagacaagcacuuu

SEQ ID NO: 924387 - RNA, 13 nt, Homo sapiens
cauaaucacaaau

SEQ ID NO: 924388 - RNA, 12 nt, Homo sapiens
cauaaugccaag

SEQ ID NO: 924389 - RNA, 19 nt, Homo sapiens
cauacccccacaugccaau

SEQ ID NO: 924390 - RNA, 18 nt, Homo sapiens
cauagcuguauauuugaa

SEQ ID NO: 924391 - RNA, 15 nt, Homo sapiens
caucaguauugugua

SEQ ID NO: 924392 - RNA, 19 nt, Homo sapiens
cauccaacuccuggagauu

SEQ ID NO: 924393 - RNA, 21 nt, Homo sapiens
cauccccaaaggucaaaaaca

SEQ ID NO: 924394 - RNA, 17 nt, Homo sapiens
caucuaacaaagucaag

SEQ ID NO: 924395 - RNA, 14 nt, Homo sapiens
caucugcauuugau

SEQ ID NO: 924396 - RNA, 14 nt, Homo sapiens
caucuguacuuugg

SEQ ID NO: 924397 - RNA, 15 nt, Homo sapiens
caucuguuacauucu

SEQ ID NO: 924398 - RNA, 16 nt, Homo sapiens
caugaaggaucaaaaa

SEQ ID NO: 924399 - RNA, 12 nt, Homo sapiens
caugagaauuga

SEQ ID NO: 924400 - RNA, 18 nt, Homo sapiens
caugaggaaaaaaaauca

SEQ ID NO: 924401 - RNA, 14 nt, Homo sapiens
caugagucuuguaa

SEQ ID NO: 924402 - RNA, 22 nt, Homo sapiens
caugcagaaagggagcagagaa

SEQ ID NO: 924403 - RNA, 22 nt, Homo sapiens
caugccuguaaucccaacacuu

SEQ ID NO: 924404 - RNA, 15 nt, Homo sapiens
caugcugcuaugaag

SEQ ID NO: 924405 - RNA, 13 nt, Homo sapiens
cauggacaagguc

SEQ ID NO: 924406 - RNA, 15 nt, Homo sapiens
caugguaacaguucc

SEQ ID NO: 924407 - RNA, 16 nt, Homo sapiens
caugguagacugugac

SEQ ID NO: 924408 - RNA, 12 nt, Homo sapiens
cauggugcagug

SEQ ID NO: 924409 - RNA, 21 nt, Homo sapiens
caugguggugagcaccuguaa

SEQ ID NO: 924410 - RNA, 19 nt, Homo sapiens
cauguuaguuuugcuccuu

SEQ ID NO: 924411 - RNA, 13 nt, Homo sapiens
cauuaaaugcaaa

SEQ ID NO: 924412 - RNA, 18 nt, Homo sapiens
cauucaaaaacauggcca

SEQ ID NO: 924413 - RNA, 16 nt, Homo sapiens
cauucaagagucucau

SEQ ID NO: 924414 - RNA, 19 nt, Homo sapiens
cauucacagcuccuuguga

SEQ ID NO: 924415 - RNA, 15 nt, Homo sapiens
cauucagugagacac

SEQ ID NO: 924416 - RNA, 14 nt, Homo sapiens
cauuccaucaauuu

SEQ ID NO: 924417 - RNA, 18 nt, Homo sapiens
cauucuauuguggcaagg

SEQ ID NO: 924418 - RNA, 14 nt, Homo sapiens
cauucuugugacuu

SEQ ID NO: 924419 - RNA, 18 nt, Homo sapiens
cauugguuauauuaccaa

SEQ ID NO: 924420 - RNA, 17 nt, Homo sapiens
cauuuaaauugacuuca

SEQ ID NO: 924421 - RNA, 22 nt, Homo sapiens
cauuuagcuuguuccacugcaa

SEQ ID NO: 924422 - RNA, 17 nt, Homo sapiens
cauuucacagaaaacau

SEQ ID NO: 924423 - RNA, 12 nt, Homo sapiens
cucuggggcuca

SEQ ID NO: 924424 - RNA, 23 nt, Homo sapiens
cucuggugggaaaauguccccca

SEQ ID NO: 924425 - RNA, 14 nt, Homo sapiens
cucuguugaaggcu

SEQ ID NO: 924426 - RNA, 14 nt, Homo sapiens
cucuuaguccuccc

SEQ ID NO: 924427 - RNA, 23 nt, Homo sapiens
cucuuccccucucagagcuacuu

SEQ ID NO: 924428 - RNA, 22 nt, Homo sapiens
cucuuccuggaaugcauucacu

SEQ ID NO: 924429 - RNA, 20 nt, Homo sapiens
cucuugcuuuguucuuuauu

SEQ ID NO: 924430 - RNA, 12 nt, Homo sapiens
cugaaacuucaa

SEQ ID NO: 924431 - RNA, 23 nt, Homo sapiens
cugaaggcaguggcaggggagca

SEQ ID NO: 924432 - RNA, 12 nt, Homo sapiens
cugaagugaaua

SEQ ID NO: 924433 - RNA, 17 nt, Homo sapiens
cugacacuuaccugcuu

SEQ ID NO: 924434 - RNA, 17 nt, Homo sapiens
cugaccuugcacaaacu

SEQ ID NO: 924435 - RNA, 19 nt, Homo sapiens
cugagacuacaggugagug

SEQ ID NO: 924436 - RNA, 22 nt, Homo sapiens
cugagauaggaggaucacuuga

SEQ ID NO: 924437 - RNA, 14 nt, Homo sapiens
cugagcccaugaca

SEQ ID NO: 924438 - RNA, 16 nt, Homo sapiens
cugaugcuaauuuuca

SEQ ID NO: 924439 - RNA, 22 nt, Homo sapiens
cugauuuagaccaaaagauuca

SEQ ID NO: 924440 - RNA, 23 nt, Homo sapiens
cugauuuuuuuuuuaacuugaaa

SEQ ID NO: 924441 - RNA, 14 nt, Homo sapiens
cugcacauuacaug

SEQ ID NO: 924442 - RNA, 20 nt, Homo sapiens
cugcacccuguauggagcua

SEQ ID NO: 924443 - RNA, 13 nt, Homo sapiens
cugcaccuuguga

SEQ ID NO: 924444 - RNA, 14 nt, Homo sapiens
cugcaccuugugaa

SEQ ID NO: 924445 - RNA, 23 nt, Homo sapiens
cugcagcauuuugcugcuuuauc

SEQ ID NO: 924446 - RNA, 15 nt, Homo sapiens
cugcauuuucugggu

SEQ ID NO: 924447 - RNA, 14 nt, Homo sapiens
cugcccucucucag

SEQ ID NO: 924448 - RNA, 15 nt, Homo sapiens
cugccucggggacac

SEQ ID NO: 924449 - RNA, 19 nt, Homo sapiens
cugccugccucggggacac

SEQ ID NO: 924450 - RNA, 19 nt, Homo sapiens
cugcgcagggcucuuugag

SEQ ID NO: 924451 - RNA, 14 nt, Homo sapiens
cugcuaaauacugu

SEQ ID NO: 924452 - RNA, 14 nt, Homo sapiens
cugcucuccuggga

SEQ ID NO: 924453 - RNA, 23 nt, Homo sapiens
cugcuucaaacucaaacacagag

SEQ ID NO: 924454 - RNA, 15 nt, Homo sapiens
cugcuuucuuuguaa

SEQ ID NO: 924455 - RNA, 19 nt, Homo sapiens
cuggaaugcauucacucag

SEQ ID NO: 924456 - RNA, 21 nt, Homo sapiens
cuggaccaaccccaggcagaa

SEQ ID NO: 924457 - RNA, 20 nt, Homo sapiens
cuggaccagaugcugaaaga

SEQ ID NO: 924458 - RNA, 20 nt, Homo sapiens
cuggaugggcuuggccaaaa

SEQ ID NO: 924459 - RNA, 13 nt, Homo sapiens
cuggcaacugcug

SEQ ID NO: 924460 - RNA, 13 nt, Homo sapiens
cuggcaccaacac

SEQ ID NO: 924461 - RNA, 17 nt, Homo sapiens
cugggaacucccaagaa

SEQ ID NO: 924462 - RNA, 22 nt, Homo sapiens
cugggauuacaggugugagcca

SEQ ID NO: 924463 - RNA, 19 nt, Homo sapiens
cugguagcuccacaagaga

SEQ ID NO: 924464 - RNA, 13 nt, Homo sapiens
cugguauuuaaca

SEQ ID NO: 924465 - RNA, 16 nt, Homo sapiens
cuggucgagagccaaa

SEQ ID NO: 924466 - RNA, 14 nt, Homo sapiens
cuggucuugaacuc

SEQ ID NO: 924467 - RNA, 21 nt, Homo sapiens
cuggugccuauuuauucauuc

SEQ ID NO: 924468 - RNA, 15 nt, Homo sapiens
cuguaaaccagagag

SEQ ID NO: 924469 - RNA, 14 nt, Homo sapiens
cuguacuaggauua

SEQ ID NO: 924470 - RNA, 17 nt, Homo sapiens
cuguauuccugauaugc

SEQ ID NO: 924471 - RNA, 13 nt, Homo sapiens
cugucacccaggc

SEQ ID NO: 924472 - RNA, 22 nt, Homo sapiens
cugucacguucuggaacauucu

SEQ ID NO: 924473 - RNA, 18 nt, Homo sapiens
cugucccaccaugcagug

SEQ ID NO: 924474 - RNA, 14 nt, Homo sapiens
cugucuugagaaaa

SEQ ID NO: 924475 - RNA, 23 nt, Homo sapiens
cugugaaaauuacacccaugcac

SEQ ID NO: 924476 - RNA, 15 nt, Homo sapiens
cugugaauuagcuca

SEQ ID NO: 924477 - RNA, 16 nt, Homo sapiens
cugugaauuagcucac

SEQ ID NO: 924478 - RNA, 22 nt, Homo sapiens
cugugccuggagcuccugggaa

SEQ ID NO: 924479 - RNA, 18 nt, Homo sapiens
cugugcugauucaauaaa

SEQ ID NO: 924480 - RNA, 17 nt, Homo sapiens
cugugcugguugccaca

SEQ ID NO: 924481 - RNA, 15 nt, Homo sapiens
cugugcuuucuugcu

SEQ ID NO: 924482 - RNA, 21 nt, Homo sapiens
cuguggcuucuaggugcccga

SEQ ID NO: 924483 - RNA, 20 nt, Homo sapiens
cugugggucagugugccacc

SEQ ID NO: 924484 - RNA, 15 nt, Homo sapiens
cuguuauaauuugca

SEQ ID NO: 924485 - RNA, 22 nt, Homo sapiens
cuguucaagaaacaaccuuuca

SEQ ID NO: 924486 - RNA, 13 nt, Homo sapiens
cuguucauggcac

SEQ ID NO: 924487 - RNA, 15 nt, Homo sapiens
cuguucuggacauuu

SEQ ID NO: 924488 - RNA, 14 nt, Homo sapiens
cuguuuuuaaucca

SEQ ID NO: 924489 - RNA, 13 nt, Homo sapiens
cuuaaagaucuca

SEQ ID NO: 924490 - RNA, 19 nt, Homo sapiens
cuuaaugcugaaaacacag

SEQ ID NO: 924491 - RNA, 17 nt, Homo sapiens
cuuacaacuccugcauc

SEQ ID NO: 924492 - RNA, 18 nt, Homo sapiens
cuuacccuucugugccca

SEQ ID NO: 924493 - RNA, 16 nt, Homo sapiens
cuuagaagaaaagccu

SEQ ID NO: 924494 - RNA, 14 nt, Homo sapiens
cuuagcaacagccg

SEQ ID NO: 924495 - RNA, 16 nt, Homo sapiens
cuuagggcaggaaaga

SEQ ID NO: 924496 - RNA, 15 nt, Homo sapiens
cuuauauuaagcaaa

SEQ ID NO: 924497 - RNA, 21 nt, Homo sapiens
cuuauauuuguccaacaacug

SEQ ID NO: 924498 - RNA, 24 nt, Homo sapiens
cuuauugcaucccaaaccacgccu

SEQ ID NO: 924499 - RNA, 17 nt, Homo sapiens
cuucaaaaucagugaug

SEQ ID NO: 924500 - RNA, 23 nt, Homo sapiens
cuucaaaucauauccucagauau

SEQ ID NO: 924501 - RNA, 14 nt, Homo sapiens
cuucaaauccugcc

SEQ ID NO: 924502 - RNA, 21 nt, Homo sapiens
cuucaagaccuucaccaaaca

SEQ ID NO: 924503 - RNA, 20 nt, Homo sapiens
cuucaaggauauacugcagc

SEQ ID NO: 924504 - RNA, 23 nt, Homo sapiens
cuucaaucucuguucugcuccca

SEQ ID NO: 924505 - RNA, 20 nt, Homo sapiens
cuucacacuaucaacacugc

SEQ ID NO: 924506 - RNA, 18 nt, Homo sapiens
cuucagauacuugugaac

SEQ ID NO: 924507 - RNA, 21 nt, Homo sapiens
cuucaguggugagacuguauc

SEQ ID NO: 924508 - RNA, 16 nt, Homo sapiens
cuucauucuaaaccaa

SEQ ID NO: 924509 - RNA, 21 nt, Homo sapiens
cuuccaacugcugccccaaag

SEQ ID NO: 924510 - RNA, 15 nt, Homo sapiens
cuuccacaaacacca

SEQ ID NO: 924511 - RNA, 18 nt, Homo sapiens
cuuccacaaacaccaucu

SEQ ID NO: 924512 - RNA, 16 nt, Homo sapiens
cuucccucauguucuc

SEQ ID NO: 924513 - RNA, 13 nt, Homo sapiens
cuuccuauucuca

SEQ ID NO: 924514 - RNA, 14 nt, Homo sapiens
cuuccuauucucaa

SEQ ID NO: 924515 - RNA, 13 nt, Homo sapiens
cuuccucacaaaa

SEQ ID NO: 924516 - RNA, 15 nt, Homo sapiens
cuuccucgacaucuu

SEQ ID NO: 924517 - RNA, 13 nt, Homo sapiens
cuuccuugcuaau

SEQ ID NO: 924518 - RNA, 23 nt, Homo sapiens
cuucuccacagggacacagucug

SEQ ID NO: 924519 - RNA, 17 nt, Homo sapiens
cuucuccccuccaagug

SEQ ID NO: 924520 - RNA, 21 nt, Homo sapiens
cuucuccucuuguagccagaa

SEQ ID NO: 924521 - RNA, 19 nt, Homo sapiens
cuucucucccacacaagca

SEQ ID NO: 924522 - RNA, 14 nt, Homo sapiens
cuucuuuaaucaca

SEQ ID NO: 924523 - RNA, 15 nt, Homo sapiens
cuugaaaagauugca

SEQ ID NO: 924524 - RNA, 17 nt, Homo sapiens
cuugaaaagauugcaaa

SEQ ID NO: 924525 - RNA, 22 nt, Homo sapiens
cuugaaacuugguucccagaaa

SEQ ID NO: 924526 - RNA, 23 nt, Homo sapiens
cuugaaagaaaggggcaggagcu

SEQ ID NO: 924527 - RNA, 21 nt, Homo sapiens
cuugaaucaggaggagauuaa

SEQ ID NO: 924528 - RNA, 21 nt, Homo sapiens
cuugaauuuauaaagugcugg

SEQ ID NO: 924529 - RNA, 20 nt, Homo sapiens
cuugaccacggcuguucccc

SEQ ID NO: 924530 - RNA, 12 nt, Homo sapiens
cuugagaccaag

SEQ ID NO: 924531 - RNA, 14 nt, Homo sapiens
cuugagaccuggaa

SEQ ID NO: 924532 - RNA, 19 nt, Homo sapiens
cuugaguugaguauuacac

SEQ ID NO: 924533 - RNA, 22 nt, Homo sapiens
cuugaguugaguauuacacauu

SEQ ID NO: 924534 - RNA, 18 nt, Homo sapiens
cuugauaugacuaauuca

SEQ ID NO: 924535 - RNA, 14 nt, Homo sapiens
cuugaugacugcug

SEQ ID NO: 924536 - RNA, 20 nt, Homo sapiens
cuugaugccaguaggcucaa

SEQ ID NO: 924537 - RNA, 18 nt, Homo sapiens
cuuggccucccaaagugc

SEQ ID NO: 924538 - RNA, 11 nt, Homo sapiens
cuuggggccau

SEQ ID NO: 924539 - RNA, 20 nt, Homo sapiens
cuugguucccagaaaacaca

SEQ ID NO: 924540 - RNA, 21 nt, Homo sapiens
cuuguacagacaugugcucug

SEQ ID NO: 924541 - RNA, 19 nt, Homo sapiens
cuuguagccagaauucugg

SEQ ID NO: 924542 - RNA, 20 nt, Homo sapiens
cuugugaaggaaaaacaugc

SEQ ID NO: 924543 - RNA, 17 nt, Homo sapiens
cuuuaauacaaaaagca

SEQ ID NO: 924544 - RNA, 20 nt, Homo sapiens
cuuuauauauguccuauuca

SEQ ID NO: 924545 - RNA, 12 nt, Homo sapiens
aaaaacaauuau

SEQ ID NO: 924546 - RNA, 11 nt, Homo sapiens
aaaaacauuca

SEQ ID NO: 924547 - RNA, 16 nt, Homo sapiens
aaaaauaucugaauau

SEQ ID NO: 924548 - RNA, 14 nt, Homo sapiens
aaaaauccugucau

SEQ ID NO: 924549 - RNA, 16 nt, Homo sapiens
aaaaauguaaguugac

SEQ ID NO: 924550 - RNA, 13 nt, Homo sapiens
aaaacaaacauuu

SEQ ID NO: 924551 - RNA, 19 nt, Homo sapiens
aaaacaaaccuuauaaguc

SEQ ID NO: 924552 - RNA, 12 nt, Homo sapiens
aaaaccagcucc

SEQ ID NO: 924553 - RNA, 17 nt, Homo sapiens
aaaacuaugcuauuaaa

SEQ ID NO: 924554 - RNA, 23 nt, Homo sapiens
aaaacuuaucugagucacuugaa

SEQ ID NO: 924555 - RNA, 17 nt, Homo sapiens
aaaagaaagcugugaaa

SEQ ID NO: 924556 - RNA, 12 nt, Homo sapiens
aaaagaagcagu

SEQ ID NO: 924557 - RNA, 14 nt, Homo sapiens
aaaagcuguuccca

SEQ ID NO: 924558 - RNA, 14 nt, Homo sapiens
aaaagcuguucuca

SEQ ID NO: 924559 - RNA, 15 nt, Homo sapiens
aaaagucagcuuuac

SEQ ID NO: 924560 - RNA, 13 nt, Homo sapiens
aaaagucauucaa

SEQ ID NO: 924561 - RNA, 21 nt, Homo sapiens
aaaagucauucaagagucuca

SEQ ID NO: 924562 - RNA, 15 nt, Homo sapiens
aaaauaaaaccacca

SEQ ID NO: 924563 - RNA, 16 nt, Homo sapiens
aaaauaucacuuugua

SEQ ID NO: 924564 - RNA, 16 nt, Homo sapiens
aaaaucaagugcaccu

SEQ ID NO: 924565 - RNA, 16 nt, Homo sapiens
aaaaucacaaacucau

SEQ ID NO: 924566 - RNA, 19 nt, Homo sapiens
aaaaucacaaacucaucca

SEQ ID NO: 924567 - RNA, 21 nt, Homo sapiens
aaaaucauguuuuuaaaugca

SEQ ID NO: 924568 - RNA, 18 nt, Homo sapiens
aaaaugcuuuugugucua

SEQ ID NO: 924569 - RNA, 17 nt, Homo sapiens
aaaauuugcugauucuu

SEQ ID NO: 924570 - RNA, 13 nt, Homo sapiens
aaaauuuucuuuc

SEQ ID NO: 924571 - RNA, 13 nt, Homo sapiens
aaacaaaucuuca

SEQ ID NO: 924572 - RNA, 19 nt, Homo sapiens
aaacaagcagguguuuaua

SEQ ID NO: 924573 - RNA, 21 nt, Homo sapiens
aaacaaucagaccacauuuga

SEQ ID NO: 924574 - RNA, 13 nt, Homo sapiens
aaacacuaccucu

SEQ ID NO: 924575 - RNA, 18 nt, Homo sapiens
aaacaggcaccacugcuu

SEQ ID NO: 924576 - RNA, 21 nt, Homo sapiens
aaacaggcaccacugcuuuaa

SEQ ID NO: 924577 - RNA, 14 nt, Homo sapiens
aaaccaggagcauu

SEQ ID NO: 924578 - RNA, 20 nt, Homo sapiens
aaaccccaucuccacuaaaa

SEQ ID NO: 924579 - RNA, 14 nt, Homo sapiens
aaacggaacucuuc

SEQ ID NO: 924580 - RNA, 14 nt, Homo sapiens
aaacuaaugugaua

SEQ ID NO: 924581 - RNA, 12 nt, Homo sapiens
aaacucauccau

SEQ ID NO: 924582 - RNA, 15 nt, Homo sapiens
aaacucuauggguau

SEQ ID NO: 924583 - RNA, 12 nt, Homo sapiens
aaacuuauucua

SEQ ID NO: 924584 - RNA, 16 nt, Homo sapiens
aaacuuauucuacuga

SEQ ID NO: 924585 - RNA, 21 nt, Homo sapiens
aaacuucguaagaacauguua

SEQ ID NO: 924586 - RNA, 18 nt, Homo sapiens
aaacuugguucccagaaa

SEQ ID NO: 924587 - RNA, 20 nt, Homo sapiens
aaacuuuaacaaacaggcug

SEQ ID NO: 924588 - RNA, 22 nt, Homo sapiens
aaacuuuggagaacucauuuca

SEQ ID NO: 924589 - RNA, 13 nt, Homo sapiens
aaacuuuuuccac

SEQ ID NO: 924590 - RNA, 15 nt, Homo sapiens
aaagaaaauugccaa

SEQ ID NO: 924591 - RNA, 17 nt, Homo sapiens
aaagaaaugcauaaaag

SEQ ID NO: 924592 - RNA, 18 nt, Homo sapiens
aaagagcagccuggcuaa

SEQ ID NO: 924593 - RNA, 16 nt, Homo sapiens
aaagagccauguccaa

SEQ ID NO: 924594 - RNA, 17 nt, Homo sapiens
aaagcaagcucuucucc

SEQ ID NO: 924595 - RNA, 18 nt, Homo sapiens
aaagccaacaaaccaaga

SEQ ID NO: 924596 - RNA, 13 nt, Homo sapiens
aaagcuguucuca

SEQ ID NO: 924597 - RNA, 15 nt, Homo sapiens
aaaggaagaaaccau

SEQ ID NO: 924598 - RNA, 19 nt, Homo sapiens
aaaggagcauccuuaccuc

SEQ ID NO: 924599 - RNA, 14 nt, Homo sapiens
aaagggacauugaa

SEQ ID NO: 924600 - RNA, 16 nt, Homo sapiens
aaagguuagauuuugu

SEQ ID NO: 924601 - RNA, 16 nt, Homo sapiens
aaaguacaagcuguaa

SEQ ID NO: 924602 - RNA, 16 nt, Homo sapiens
aaaguacugcaaaaug

SEQ ID NO: 924603 - RNA, 20 nt, Homo sapiens
aaagugcuagccacuggaaa

SEQ ID NO: 924604 - RNA, 11 nt, Homo sapiens
aaagugucauc

SEQ ID NO: 924605 - RNA, 15 nt, Homo sapiens
aaaguuaaccuaccu

SEQ ID NO: 924606 - RNA, 17 nt, Homo sapiens
aaauaaagcugauagca

SEQ ID NO: 924607 - RNA, 20 nt, Homo sapiens
aaauaaaggcaaaguggaau

SEQ ID NO: 924608 - RNA, 20 nt, Homo sapiens
aaauaauuauauaacuguau

SEQ ID NO: 924609 - RNA, 14 nt, Homo sapiens
aaauacauacuaua

SEQ ID NO: 924610 - RNA, 11 nt, Homo sapiens
aaauacuacac

SEQ ID NO: 924611 - RNA, 14 nt, Homo sapiens
aaauauaguuugag

SEQ ID NO: 924612 - RNA, 23 nt, Homo sapiens
aaauaucuaccugcccucucuca

SEQ ID NO: 924613 - RNA, 20 nt, Homo sapiens
aaauaugugauuuucucuaa

SEQ ID NO: 924614 - RNA, 20 nt, Homo sapiens
aaauauguuaagggcuuuaa

SEQ ID NO: 924615 - RNA, 20 nt, Homo sapiens
aaaucauaaaauccaaugcu

SEQ ID NO: 924616 - RNA, 14 nt, Homo sapiens
aaauccuuucauaa

SEQ ID NO: 924617 - RNA, 20 nt, Homo sapiens
aaaucuggggaggacaaagg

SEQ ID NO: 924618 - RNA, 23 nt, Homo sapiens
aaaugcuuugauuguucauauca

SEQ ID NO: 924619 - RNA, 11 nt, Homo sapiens
aaaugguuauu

SEQ ID NO: 924620 - RNA, 14 nt, Homo sapiens
aaauguaucuuuau

SEQ ID NO: 924621 - RNA, 13 nt, Homo sapiens
aaaugugggugaa

SEQ ID NO: 924622 - RNA, 18 nt, Homo sapiens
aaauuaacuuuccuuccu

SEQ ID NO: 924623 - RNA, 17 nt, Homo sapiens
aaauucacaagcugccu

SEQ ID NO: 924624 - RNA, 22 nt, Homo sapiens
aaauuccacaucaaguguucca

SEQ ID NO: 924625 - RNA, 15 nt, Homo sapiens
aaauuccucuguaga

SEQ ID NO: 924626 - RNA, 12 nt, Homo sapiens
aacaaaaccaag

SEQ ID NO: 924627 - RNA, 19 nt, Homo sapiens
aacaaaacuguaacugcau

SEQ ID NO: 924628 - RNA, 22 nt, Homo sapiens
aacaaaauguuaugauaaucuu

SEQ ID NO: 924629 - RNA, 13 nt, Homo sapiens
aacaaaucuucaa

SEQ ID NO: 924630 - RNA, 23 nt, Homo sapiens
aacaacacuacgaagaguauuug

SEQ ID NO: 924631 - RNA, 11 nt, Homo sapiens
aacaauaucaa

SEQ ID NO: 924632 - RNA, 16 nt, Homo sapiens
aacaauuguauuccca

SEQ ID NO: 924633 - RNA, 14 nt, Homo sapiens
aacacugucugcau

SEQ ID NO: 924634 - RNA, 20 nt, Homo sapiens
aacacuuugguauucaauuu

SEQ ID NO: 924635 - RNA, 20 nt, Homo sapiens
aacagguaaacagaaauccu

SEQ ID NO: 924636 - RNA, 16 nt, Homo sapiens
aacaguguuggcuuuc

SEQ ID NO: 924637 - RNA, 17 nt, Homo sapiens
aacaguguuggcuuuca

SEQ ID NO: 924638 - RNA, 22 nt, Homo sapiens
aacauaguaacguguuacugga

SEQ ID NO: 924639 - RNA, 16 nt, Homo sapiens
aacaugacacauuuga

SEQ ID NO: 924640 - RNA, 17 nt, Homo sapiens
aacaugggcaaagggag

SEQ ID NO: 924641 - RNA, 20 nt, Homo sapiens
aacauguuacgugugcaaca

SEQ ID NO: 924642 - RNA, 11 nt, Homo sapiens
aacauugauuu

SEQ ID NO: 924643 - RNA, 20 nt, Homo sapiens
aaccaaagggggacagugau

SEQ ID NO: 924644 - RNA, 22 nt, Homo sapiens
aaccaagccuuggcucguucuc

SEQ ID NO: 924645 - RNA, 20 nt, Homo sapiens
aaccaauacuccacugcuca

SEQ ID NO: 924646 - RNA, 14 nt, Homo sapiens
aaccacuguacaua

SEQ ID NO: 924647 - RNA, 17 nt, Homo sapiens
aaccagagccacaggcc

SEQ ID NO: 924648 - RNA, 12 nt, Homo sapiens
aaccagcaguug

SEQ ID NO: 924649 - RNA, 14 nt, Homo sapiens
aacccagcauguac

SEQ ID NO: 924650 - RNA, 17 nt, Homo sapiens
aaccccgucugcuccuc

SEQ ID NO: 924651 - RNA, 15 nt, Homo sapiens
aacccugugucacuu

SEQ ID NO: 924652 - RNA, 19 nt, Homo sapiens
aacccuguuuuauugaguu

SEQ ID NO: 924653 - RNA, 19 nt, Homo sapiens
aaccgccguccuucaauuu

SEQ ID NO: 924654 - RNA, 20 nt, Homo sapiens
aaccuggcugcgaacugugc

SEQ ID NO: 924655 - RNA, 16 nt, Homo sapiens
aaccuuuaaauuuuca

SEQ ID NO: 924656 - RNA, 18 nt, Homo sapiens
aacguaggcgucaaagag

SEQ ID NO: 924657 - RNA, 15 nt, Homo sapiens
aacguguuacuggaa

SEQ ID NO: 924658 - RNA, 13 nt, Homo sapiens
aacguuccacaac

SEQ ID NO: 924659 - RNA, 15 nt, Homo sapiens
aacguuccacaacag

SEQ ID NO: 924660 - RNA, 18 nt, Homo sapiens
aacuacgggcugcucuac

SEQ ID NO: 924661 - RNA, 19 nt, Homo sapiens
aacuagguaacaguuugau

SEQ ID NO: 924662 - RNA, 13 nt, Homo sapiens
aacuauacuucug

SEQ ID NO: 924663 - RNA, 16 nt, Homo sapiens
aacucauacugugcug

SEQ ID NO: 924664 - RNA, 20 nt, Homo sapiens
aacuccgcugccuuccuuag

SEQ ID NO: 924665 - RNA, 17 nt, Homo sapiens
gauguguaaacaggcac

SEQ ID NO: 924666 - RNA, 18 nt, Homo sapiens
gauguuaggcugggccca

SEQ ID NO: 924667 - RNA, 15 nt, Homo sapiens
gauuaacacacugaa

SEQ ID NO: 924668 - RNA, 19 nt, Homo sapiens
gauuacaggcgugagccac

SEQ ID NO: 924669 - RNA, 11 nt, Homo sapiens
gauuacaggug

SEQ ID NO: 924670 - RNA, 12 nt, Homo sapiens
gauuacagguga

SEQ ID NO: 924671 - RNA, 22 nt, Homo sapiens
gauucaauaaaaugcacugacc

SEQ ID NO: 924672 - RNA, 17 nt, Homo sapiens
gauuccccuggacauau

SEQ ID NO: 924673 - RNA, 13 nt, Homo sapiens
gauucugccucaa

SEQ ID NO: 924674 - RNA, 11 nt, Homo sapiens
gauuguucuca

SEQ ID NO: 924675 - RNA, 16 nt, Homo sapiens
gauuuaggcacugcuu

SEQ ID NO: 924676 - RNA, 19 nt, Homo sapiens
gauuucaaagcaagucaac

SEQ ID NO: 924677 - RNA, 11 nt, Homo sapiens
gauuucacaua

SEQ ID NO: 924678 - RNA, 13 nt, Homo sapiens
gauuucacugaca

SEQ ID NO: 924679 - RNA, 20 nt, Homo sapiens
gauuucacuguguuagccag

SEQ ID NO: 924680 - RNA, 19 nt, Homo sapiens
gauuucagcacaugcacua

SEQ ID NO: 924681 - RNA, 23 nt, Homo sapiens
gauuugagggacgaggucaagga

SEQ ID NO: 924682 - RNA, 17 nt, Homo sapiens
gauuuucaaaaccagcu

SEQ ID NO: 924683 - RNA, 17 nt, Homo sapiens
gcaaaaauauauaugua

SEQ ID NO: 924684 - RNA, 15 nt, Homo sapiens
gcaaaacauugcugc

SEQ ID NO: 924685 - RNA, 20 nt, Homo sapiens
gcaaauauccuccacuuuca

SEQ ID NO: 924686 - RNA, 14 nt, Homo sapiens
gcaaauauguuugc

SEQ ID NO: 924687 - RNA, 15 nt, Homo sapiens
gcaaaugcaaaaacu

SEQ ID NO: 924688 - RNA, 18 nt, Homo sapiens
gcaacagguaaacagaaa

SEQ ID NO: 924689 - RNA, 11 nt, Homo sapiens
gcaacuuugau

SEQ ID NO: 924690 - RNA, 13 nt, Homo sapiens
gcaaggccuugaa

SEQ ID NO: 924691 - RNA, 14 nt, Homo sapiens
gcaagucccaugau

SEQ ID NO: 924692 - RNA, 13 nt, Homo sapiens
gcaaucuguguac

SEQ ID NO: 924693 - RNA, 22 nt, Homo sapiens
gcaaugaaaagaaaaugugcca

SEQ ID NO: 924694 - RNA, 11 nt, Homo sapiens
gcaauguggaa

SEQ ID NO: 924695 - RNA, 22 nt, Homo sapiens
gcaauucuucuucucaagcacu

SEQ ID NO: 924696 - RNA, 22 nt, Homo sapiens
gcacauauggaauuuugcaaag

SEQ ID NO: 924697 - RNA, 22 nt, Homo sapiens
gcacgugcaauacggaacacug

SEQ ID NO: 924698 - RNA, 19 nt, Homo sapiens
gcacugaccccgaccucag

SEQ ID NO: 924699 - RNA, 17 nt, Homo sapiens
gcacugagaagcaauca

SEQ ID NO: 924700 - RNA, 20 nt, Homo sapiens
gcacugcacauaauuugcau

SEQ ID NO: 924701 - RNA, 19 nt, Homo sapiens
gcacuucguggaugaccuc

SEQ ID NO: 924702 - RNA, 14 nt, Homo sapiens
gcagaaaacagagg

SEQ ID NO: 924703 - RNA, 19 nt, Homo sapiens
gcagaaaacagaggccaca

SEQ ID NO: 924704 - RNA, 19 nt, Homo sapiens
gcagaaacccaugugcagg

SEQ ID NO: 924705 - RNA, 12 nt, Homo sapiens
gcagaagugaug

SEQ ID NO: 924706 - RNA, 16 nt, Homo sapiens
gcagaauuuuauguga

SEQ ID NO: 924707 - RNA, 18 nt, Homo sapiens
gcagaccugggacuuuag

SEQ ID NO: 924708 - RNA, 15 nt, Homo sapiens
gcagagagguuguga

SEQ ID NO: 924709 - RNA, 10 nt, Homo sapiens
gcagcauuuu

SEQ ID NO: 924710 - RNA, 12 nt, Homo sapiens
gcagcuccuucc

SEQ ID NO: 924711 - RNA, 14 nt, Homo sapiens
gcaggauaaucgcu

SEQ ID NO: 924712 - RNA, 20 nt, Homo sapiens
gcagggcagccugugggaga

SEQ ID NO: 924713 - RNA, 15 nt, Homo sapiens
gcagugcccagugau

SEQ ID NO: 924714 - RNA, 13 nt, Homo sapiens
gcauaguuuagau

SEQ ID NO: 924715 - RNA, 17 nt, Homo sapiens
gcauaucuguuauaugu

SEQ ID NO: 924716 - RNA, 22 nt, Homo sapiens
gcauguguaaaucugaaaaacu

SEQ ID NO: 924717 - RNA, 16 nt, Homo sapiens
gcauuuaguacaucca

SEQ ID NO: 924718 - RNA, 17 nt, Homo sapiens
gcauuuucaacauugau

SEQ ID NO: 924719 - RNA, 13 nt, Homo sapiens
gccaaaauuauua

SEQ ID NO: 924720 - RNA, 18 nt, Homo sapiens
gccaaaggucccucccca

SEQ ID NO: 924721 - RNA, 20 nt, Homo sapiens
gccaaaggucccuccccaga

SEQ ID NO: 924722 - RNA, 12 nt, Homo sapiens
gccaagaacucu

SEQ ID NO: 924723 - RNA, 17 nt, Homo sapiens
gccacauccaacauuuc

SEQ ID NO: 924724 - RNA, 18 nt, Homo sapiens
gccacaucuuagcaagca

SEQ ID NO: 924725 - RNA, 19 nt, Homo sapiens
gccacccaggccacugacc

SEQ ID NO: 924726 - RNA, 16 nt, Homo sapiens
gccacggccuggcugg

SEQ ID NO: 924727 - RNA, 11 nt, Homo sapiens
gccacugaccu

SEQ ID NO: 924728 - RNA, 20 nt, Homo sapiens
gccacuggaggaagcuguuu

SEQ ID NO: 924729 - RNA, 20 nt, Homo sapiens
gccagcauuuccucagucuc

SEQ ID NO: 924730 - RNA, 15 nt, Homo sapiens
gccaggaaagcguuu

SEQ ID NO: 924731 - RNA, 22 nt, Homo sapiens
gccaggacacaacgcugcugcc

SEQ ID NO: 924732 - RNA, 14 nt, Homo sapiens
gccaucucugaacu

SEQ ID NO: 924733 - RNA, 22 nt, Homo sapiens
gccaucugacugccaagccaga

SEQ ID NO: 924734 - RNA, 24 nt, Homo sapiens
gccaugauuuuggccacuuugcag

SEQ ID NO: 924735 - RNA, 14 nt, Homo sapiens
gccauuucuuccca

SEQ ID NO: 924736 - RNA, 16 nt, Homo sapiens
gcccaccuaccuucaa

SEQ ID NO: 924737 - RNA, 14 nt, Homo sapiens
gcccaccugcauca

SEQ ID NO: 924738 - RNA, 19 nt, Homo sapiens
gcccagagcugggugagug

SEQ ID NO: 924739 - RNA, 17 nt, Homo sapiens
gcccaggcuggucuuga

SEQ ID NO: 924740 - RNA, 20 nt, Homo sapiens
gcccaggguccugugccugg

SEQ ID NO: 924741 - RNA, 14 nt, Homo sapiens
gcccagugauggca

SEQ ID NO: 924742 - RNA, 17 nt, Homo sapiens
gccccucugacucccaa

SEQ ID NO: 924743 - RNA, 21 nt, Homo sapiens
gcccuaggcuacccuugccaa

SEQ ID NO: 924744 - RNA, 13 nt, Homo sapiens
gcccucuauuuau

SEQ ID NO: 924745 - RNA, 16 nt, Homo sapiens
gcccuguugccuugag

SEQ ID NO: 924746 - RNA, 13 nt, Homo sapiens
gccgcugcugacc

SEQ ID NO: 924747 - RNA, 23 nt, Homo sapiens
gccgcugugcuguugucugccgu

SEQ ID NO: 924748 - RNA, 16 nt, Homo sapiens
gccgggaccacccuga

SEQ ID NO: 924749 - RNA, 20 nt, Homo sapiens
gccgggcacagcugugguga

SEQ ID NO: 924750 - RNA, 21 nt, Homo sapiens
gccguccuggcgccuggcagu

SEQ ID NO: 924751 - RNA, 15 nt, Homo sapiens
gccgugcugagcaca

SEQ ID NO: 924752 - RNA, 16 nt, Homo sapiens
gccguucagcugugac

SEQ ID NO: 924753 - RNA, 15 nt, Homo sapiens
gccuaugagaugaaa

SEQ ID NO: 924754 - RNA, 12 nt, Homo sapiens
gccucaaccucc

SEQ ID NO: 924755 - RNA, 19 nt, Homo sapiens
gccuccucuaacaggggcu

SEQ ID NO: 924756 - RNA, 14 nt, Homo sapiens
gccucugagccacu

SEQ ID NO: 924757 - RNA, 19 nt, Homo sapiens
gccugccaacaagcugaaa

SEQ ID NO: 924758 - RNA, 20 nt, Homo sapiens
gccuggggauguaaccaagc

SEQ ID NO: 924759 - RNA, 16 nt, Homo sapiens
gccuucuccacaggga

SEQ ID NO: 924760 - RNA, 21 nt, Homo sapiens
gccuuuauuuggcaaauaacu

SEQ ID NO: 924761 - RNA, 21 nt, Homo sapiens
gcgaucccuccccucagccuc

SEQ ID NO: 924762 - RNA, 20 nt, Homo sapiens
gcguaggagagaacagggau

SEQ ID NO: 924763 - RNA, 13 nt, Homo sapiens
gcuaaauacugua

SEQ ID NO: 924764 - RNA, 15 nt, Homo sapiens
gcuaagccugaugau

SEQ ID NO: 924765 - RNA, 18 nt, Homo sapiens
gcuacaaauagugcuaau

SEQ ID NO: 924766 - RNA, 21 nt, Homo sapiens
gcuaccuguucuugggccuca

SEQ ID NO: 924767 - RNA, 22 nt, Homo sapiens
gcuagaaagcauccauuaauua

SEQ ID NO: 924768 - RNA, 14 nt, Homo sapiens
gcuagccacuggaa

SEQ ID NO: 924769 - RNA, 17 nt, Homo sapiens
gcuaggaagaacuugaa

SEQ ID NO: 924770 - RNA, 18 nt, Homo sapiens
gcuauuuucccaugccag

SEQ ID NO: 924771 - RNA, 14 nt, Homo sapiens
gcucacaccuguaa

SEQ ID NO: 924772 - RNA, 17 nt, Homo sapiens
gcucacuuggugauaug

SEQ ID NO: 924773 - RNA, 16 nt, Homo sapiens
gcucagcccugagcug

SEQ ID NO: 924774 - RNA, 21 nt, Homo sapiens
gcucauauuaauguacuuaaa

SEQ ID NO: 924775 - RNA, 15 nt, Homo sapiens
gcucccuuccugggg

SEQ ID NO: 924776 - RNA, 17 nt, Homo sapiens
gcuccgaggacccagga

SEQ ID NO: 924777 - RNA, 13 nt, Homo sapiens
gcuccugcuccac

SEQ ID NO: 924778 - RNA, 19 nt, Homo sapiens
aacucuugauaacaccaag

SEQ ID NO: 924779 - RNA, 16 nt, Homo sapiens
aacugauaaaccaaaa

SEQ ID NO: 924780 - RNA, 16 nt, Homo sapiens
aacugcacaaugcauu

SEQ ID NO: 924781 - RNA, 22 nt, Homo sapiens
aacugcauuagaaaccaugaaa

SEQ ID NO: 924782 - RNA, 21 nt, Homo sapiens
aacuggaaaaguguuccuugc

SEQ ID NO: 924783 - RNA, 19 nt, Homo sapiens
aacuucugauuucucuuca

SEQ ID NO: 924784 - RNA, 22 nt, Homo sapiens
aacuugccacaucccagucaca

SEQ ID NO: 924785 - RNA, 21 nt, Homo sapiens
aacuuuuggggcuguauuuag

SEQ ID NO: 924786 - RNA, 14 nt, Homo sapiens
aagaaauggcauaa

SEQ ID NO: 924787 - RNA, 21 nt, Homo sapiens
aagaauguguuaugaaucggu

SEQ ID NO: 924788 - RNA, 22 nt, Homo sapiens
aagacauuuauaauacaaauaa

SEQ ID NO: 924789 - RNA, 19 nt, Homo sapiens
aagacccaacaggugcuga

SEQ ID NO: 924790 - RNA, 18 nt, Homo sapiens
aagacugaccuugauguc

SEQ ID NO: 924791 - RNA, 19 nt, Homo sapiens
aagacuuucuaaaucucua

SEQ ID NO: 924792 - RNA, 14 nt, Homo sapiens
aagagaaguuguaa

SEQ ID NO: 924793 - RNA, 15 nt, Homo sapiens
aagagagaagccagc

SEQ ID NO: 924794 - RNA, 14 nt, Homo sapiens
aagaggugggguga

SEQ ID NO: 924795 - RNA, 11 nt, Homo sapiens
aagagucucau

SEQ ID NO: 924796 - RNA, 16 nt, Homo sapiens
aagaucacaucacugc

SEQ ID NO: 924797 - RNA, 23 nt, Homo sapiens
aagauccuaccccaauuccuugu

SEQ ID NO: 924798 - RNA, 22 nt, Homo sapiens
aagaucucaacauggaaaaauc

SEQ ID NO: 924799 - RNA, 14 nt, Homo sapiens
aagauuuaaucuca

SEQ ID NO: 924800 - RNA, 14 nt, Homo sapiens
aagcaaaaccaaag

SEQ ID NO: 924801 - RNA, 22 nt, Homo sapiens
aagcaacuggaaaaguguuccu

SEQ ID NO: 924802 - RNA, 14 nt, Homo sapiens
aagcagaacucuca

SEQ ID NO: 924803 - RNA, 22 nt, Homo sapiens
aagcagaacucucaugcgugac

SEQ ID NO: 924804 - RNA, 13 nt, Homo sapiens
aagcagccauaaa

SEQ ID NO: 924805 - RNA, 11 nt, Homo sapiens
aagccaaauac

SEQ ID NO: 924806 - RNA, 18 nt, Homo sapiens
aagccucucaucccccau

SEQ ID NO: 924807 - RNA, 14 nt, Homo sapiens
aagcuaccaaaaaa

SEQ ID NO: 924808 - RNA, 23 nt, Homo sapiens
aagcuuuuguaaaauaaaaccac

SEQ ID NO: 924809 - RNA, 19 nt, Homo sapiens
aaggaagauguaagaagcu

SEQ ID NO: 924810 - RNA, 23 nt, Homo sapiens
aaggaauggccuuucaccuucuc

SEQ ID NO: 924811 - RNA, 16 nt, Homo sapiens
aaggaggaaguggaag

SEQ ID NO: 924812 - RNA, 16 nt, Homo sapiens
aaggcaaaguggaaug

SEQ ID NO: 924813 - RNA, 16 nt, Homo sapiens
aaggcaggcauaucaa

SEQ ID NO: 924814 - RNA, 19 nt, Homo sapiens
aaggccucuugcuggugca

SEQ ID NO: 924815 - RNA, 21 nt, Homo sapiens
aaggcuaucggagcaguucaa

SEQ ID NO: 924816 - RNA, 23 nt, Homo sapiens
aaggcuaucggagcaguucaaua

SEQ ID NO: 924817 - RNA, 16 nt, Homo sapiens
aaggcugccggcugca

SEQ ID NO: 924818 - RNA, 15 nt, Homo sapiens
aagggaggaggugaa

SEQ ID NO: 924819 - RNA, 19 nt, Homo sapiens
aagggucuacaauucucca

SEQ ID NO: 924820 - RNA, 20 nt, Homo sapiens
aaggugauuuuccugugucc

SEQ ID NO: 924821 - RNA, 19 nt, Homo sapiens
aaggugggcggaucaccug

SEQ ID NO: 924822 - RNA, 23 nt, Homo sapiens
aagguguaaaauaucuaccugcc

SEQ ID NO: 924823 - RNA, 16 nt, Homo sapiens
aagguuucacuguuca

SEQ ID NO: 924824 - RNA, 18 nt, Homo sapiens
aagguuucacuguucaug

SEQ ID NO: 924825 - RNA, 17 nt, Homo sapiens
aaguacaguaacaaucu

SEQ ID NO: 924826 - RNA, 17 nt, Homo sapiens
aagucugagauggauug

SEQ ID NO: 924827 - RNA, 22 nt, Homo sapiens
aagucuguguccuuugcuccuu

SEQ ID NO: 924828 - RNA, 15 nt, Homo sapiens
aagucuucaagggcu

SEQ ID NO: 924829 - RNA, 20 nt, Homo sapiens
aagugaacaaucagcggcau

SEQ ID NO: 924830 - RNA, 23 nt, Homo sapiens
aagugauccuccugucuuggccu

SEQ ID NO: 924831 - RNA, 22 nt, Homo sapiens
aagugaugauuguaagucccau

SEQ ID NO: 924832 - RNA, 19 nt, Homo sapiens
aagugcuagccacuggaaa

SEQ ID NO: 924833 - RNA, 21 nt, Homo sapiens
aagugcugagauuacaggugu

SEQ ID NO: 924834 - RNA, 21 nt, Homo sapiens
aagugcugggauuacaggugu

SEQ ID NO: 924835 - RNA, 19 nt, Homo sapiens
aaguggccaagaagcagug

SEQ ID NO: 924836 - RNA, 20 nt, Homo sapiens
aagugggcagcauaaaguca

SEQ ID NO: 924837 - RNA, 15 nt, Homo sapiens
aaguugaccuucucu

SEQ ID NO: 924838 - RNA, 16 nt, Homo sapiens
aauaaaaugcauuuaa

SEQ ID NO: 924839 - RNA, 19 nt, Homo sapiens
aauaaaguuauuacucuga

SEQ ID NO: 924840 - RNA, 21 nt, Homo sapiens
aauaaauauggaauacauuca

SEQ ID NO: 924841 - RNA, 13 nt, Homo sapiens
aauaacugacccu

SEQ ID NO: 924842 - RNA, 21 nt, Homo sapiens
aauaagaauucagacaucuga

SEQ ID NO: 924843 - RNA, 15 nt, Homo sapiens
aauaauaccauaaua

SEQ ID NO: 924844 - RNA, 13 nt, Homo sapiens
aauacaaaaaagu

SEQ ID NO: 924845 - RNA, 18 nt, Homo sapiens
aauacaaaaagcaaaaau

SEQ ID NO: 924846 - RNA, 14 nt, Homo sapiens
aauacaauucaaac

SEQ ID NO: 924847 - RNA, 18 nt, Homo sapiens
aauacagauauaagaaau

SEQ ID NO: 924848 - RNA, 20 nt, Homo sapiens
aauacauuauuggacuucca

SEQ ID NO: 924849 - RNA, 17 nt, Homo sapiens
aauaccagaucacucaa

SEQ ID NO: 924850 - RNA, 13 nt, Homo sapiens
aauacuguacaua

SEQ ID NO: 924851 - RNA, 16 nt, Homo sapiens
aauacuugagaaauuu

SEQ ID NO: 924852 - RNA, 14 nt, Homo sapiens
aauagcaguuucac

SEQ ID NO: 924853 - RNA, 17 nt, Homo sapiens
aauaggauuuaauuugu

SEQ ID NO: 924854 - RNA, 23 nt, Homo sapiens
aauaggcauuaaaugcaaaaaua

SEQ ID NO: 924855 - RNA, 17 nt, Homo sapiens
aauaguguguccaugca

SEQ ID NO: 924856 - RNA, 17 nt, Homo sapiens
aauauagaaccaugaau

SEQ ID NO: 924857 - RNA, 13 nt, Homo sapiens
aauauaguuugag

SEQ ID NO: 924858 - RNA, 16 nt, Homo sapiens
aauauauauaauacuu

SEQ ID NO: 924859 - RNA, 17 nt, Homo sapiens
aauauccuccacuuuca

SEQ ID NO: 924860 - RNA, 15 nt, Homo sapiens
aauaugcaugcuucu

SEQ ID NO: 924861 - RNA, 19 nt, Homo sapiens
aauauuaaggaaaaaagca

SEQ ID NO: 924862 - RNA, 22 nt, Homo sapiens
aauauuaaggaaaaaagcaagu

SEQ ID NO: 924863 - RNA, 14 nt, Homo sapiens
aauauucccagccu

SEQ ID NO: 924864 - RNA, 12 nt, Homo sapiens
aauauugcaguu

SEQ ID NO: 924865 - RNA, 15 nt, Homo sapiens
aauauuuuaggauaa

SEQ ID NO: 924866 - RNA, 15 nt, Homo sapiens
aaucaagucugugaa

SEQ ID NO: 924867 - RNA, 21 nt, Homo sapiens
aaucauugguuauauuaccaa

SEQ ID NO: 924868 - RNA, 23 nt, Homo sapiens
aaucauuuccccucccgucuucc

SEQ ID NO: 924869 - RNA, 20 nt, Homo sapiens
aauccauagccaauacauuu

SEQ ID NO: 924870 - RNA, 23 nt, Homo sapiens
aauccaugugcugcuguggcauc

SEQ ID NO: 924871 - RNA, 14 nt, Homo sapiens
aaucccaguacuug

SEQ ID NO: 924872 - RNA, 18 nt, Homo sapiens
aauccucccuacuuccaa

SEQ ID NO: 924873 - RNA, 15 nt, Homo sapiens
aauccuccugaguga

SEQ ID NO: 924874 - RNA, 22 nt, Homo sapiens
aauccuuucauaaagcaccagc

SEQ ID NO: 924875 - RNA, 12 nt, Homo sapiens
aaucuaucuaca

SEQ ID NO: 924876 - RNA, 16 nt, Homo sapiens
aaucuccucuuuguga

SEQ ID NO: 924877 - RNA, 21 nt, Homo sapiens
aaucugauuuucaaaaaucau

SEQ ID NO: 924878 - RNA, 21 nt, Homo sapiens
aaucuuaaccugaugcuaauu

SEQ ID NO: 924879 - RNA, 19 nt, Homo sapiens
aaucuuuccuugucucuca

SEQ ID NO: 924880 - RNA, 18 nt, Homo sapiens
aaucuuucuccacuguuc

SEQ ID NO: 924881 - RNA, 16 nt, Homo sapiens
aaucuuuuacugugga

SEQ ID NO: 924882 - RNA, 22 nt, Homo sapiens
aaugaguguguuggcuugugau

SEQ ID NO: 924883 - RNA, 14 nt, Homo sapiens
aaugcaauguggaa

SEQ ID NO: 924884 - RNA, 23 nt, Homo sapiens
aaugcauaaaagacaagcacuuu

SEQ ID NO: 924885 - RNA, 15 nt, Homo sapiens
aaugccaaguaacaa

SEQ ID NO: 924886 - RNA, 20 nt, Homo sapiens
aaugccaaguaacaaugcau

SEQ ID NO: 924887 - RNA, 22 nt, Homo sapiens
aaugcugcacaccaguuacugu

SEQ ID NO: 924888 - RNA, 18 nt, Homo sapiens
aaugcuucuaaauaugaa

SEQ ID NO: 924889 - RNA, 20 nt, Homo sapiens
aauggaaauuccaacagauu

SEQ ID NO: 924890 - RNA, 16 nt, Homo sapiens
aauggacucaucuuag

SEQ ID NO: 924891 - RNA, 21 nt, Homo sapiens
aauggugccaccacucaagca

SEQ ID NO: 924892 - RNA, 16 nt, Homo sapiens
ccucccauaauuucau

SEQ ID NO: 924893 - RNA, 18 nt, Homo sapiens
ccuccccuggcaacugcu

SEQ ID NO: 924894 - RNA, 14 nt, Homo sapiens
ccuccggggcucag

SEQ ID NO: 924895 - RNA, 20 nt, Homo sapiens
ccuccuuucccaacacuuca

SEQ ID NO: 924896 - RNA, 18 nt, Homo sapiens
ccucgaacccacacugca

SEQ ID NO: 924897 - RNA, 19 nt, Homo sapiens
ccucgaacccacacugcaa

SEQ ID NO: 924898 - RNA, 14 nt, Homo sapiens
ccucggggacacua

SEQ ID NO: 924899 - RNA, 15 nt, Homo sapiens
ccucguuaacacaug

SEQ ID NO: 924900 - RNA, 19 nt, Homo sapiens
ccucuaacccaggucuuga

SEQ ID NO: 924901 - RNA, 16 nt, Homo sapiens
ccucucagagcuacuu

SEQ ID NO: 924902 - RNA, 14 nt, Homo sapiens
ccucugauuucaca

SEQ ID NO: 924903 - RNA, 22 nt, Homo sapiens
ccucugcuggccgggcacagcu

SEQ ID NO: 924904 - RNA, 20 nt, Homo sapiens
ccucuggggcucagcccuga

SEQ ID NO: 924905 - RNA, 21 nt, Homo sapiens
ccucugucacguucuggaaca

SEQ ID NO: 924906 - RNA, 22 nt, Homo sapiens
ccucuguucaguaacagggccu

SEQ ID NO: 924907 - RNA, 17 nt, Homo sapiens
ccucuuucuaucuucac

SEQ ID NO: 924908 - RNA, 15 nt, Homo sapiens
ccugaaggugccacu

SEQ ID NO: 924909 - RNA, 21 nt, Homo sapiens
ccugaguuggcaucaccugcg

SEQ ID NO: 924910 - RNA, 17 nt, Homo sapiens
ccugaugcuaauuuuca

SEQ ID NO: 924911 - RNA, 16 nt, Homo sapiens
ccugcaggucacugaa

SEQ ID NO: 924912 - RNA, 16 nt, Homo sapiens
aauaagaaugaaucuc

SEQ ID NO: 924913 - RNA, 19 nt, Homo sapiens
aauaagggccuagaaacuc

SEQ ID NO: 924914 - RNA, 14 nt, Homo sapiens
aauaauuguggaga

SEQ ID NO: 924915 - RNA, 18 nt, Homo sapiens
aauacacauauuugcaca

SEQ ID NO: 924916 - RNA, 16 nt, Homo sapiens
aauacagcacuuugac

SEQ ID NO: 924917 - RNA, 15 nt, Homo sapiens
aauacuuugaguaaa

SEQ ID NO: 924918 - RNA, 14 nt, Homo sapiens
aauagcacauaugg

SEQ ID NO: 924919 - RNA, 19 nt, Homo sapiens
aauagcuacagcugugucc

SEQ ID NO: 924920 - RNA, 23 nt, Homo sapiens
aauaggaccucaaaauaagccau

SEQ ID NO: 924921 - RNA, 14 nt, Homo sapiens
aauauagagaauuc

SEQ ID NO: 924922 - RNA, 23 nt, Homo sapiens
aauaucaagacugacuggcacca

SEQ ID NO: 924923 - RNA, 15 nt, Homo sapiens
aauaucgcugauauu

SEQ ID NO: 924924 - RNA, 14 nt, Homo sapiens
aauaucuaccugcc

SEQ ID NO: 924925 - RNA, 15 nt, Homo sapiens
aauauguuaagggcu

SEQ ID NO: 924926 - RNA, 13 nt, Homo sapiens
aauauuauaguuu

SEQ ID NO: 924927 - RNA, 16 nt, Homo sapiens
aauauugcaguucaua

SEQ ID NO: 924928 - RNA, 22 nt, Homo sapiens
aaucaacccaauaauucuguau

SEQ ID NO: 924929 - RNA, 19 nt, Homo sapiens
aaucacucauuuauuucca

SEQ ID NO: 924930 - RNA, 16 nt, Homo sapiens
aaucagaccacauuug

SEQ ID NO: 924931 - RNA, 19 nt, Homo sapiens
aaucagaccacauuugaag

SEQ ID NO: 924932 - RNA, 21 nt, Homo sapiens
aaucagaccuuuucuuugaaa

SEQ ID NO: 924933 - RNA, 21 nt, Homo sapiens
aauccauucuuaaaguacuug

SEQ ID NO: 924934 - RNA, 22 nt, Homo sapiens
aauccauucuuaaaguacuugu

SEQ ID NO: 924935 - RNA, 24 nt, Homo sapiens
aauccauucuuaaaguacuuguua

SEQ ID NO: 924936 - RNA, 15 nt, Homo sapiens
aaucccaguucaugu

SEQ ID NO: 924937 - RNA, 21 nt, Homo sapiens
aaucccaguucauguugcuca

SEQ ID NO: 924938 - RNA, 22 nt, Homo sapiens
aaucccuacagggugucuguca

SEQ ID NO: 924939 - RNA, 21 nt, Homo sapiens
aaucccucuggcccacacaga

SEQ ID NO: 924940 - RNA, 21 nt, Homo sapiens
aaucugcaggcucuaucuuug

SEQ ID NO: 924941 - RNA, 18 nt, Homo sapiens
aaucuguguacugaacau

SEQ ID NO: 924942 - RNA, 17 nt, Homo sapiens
aaucuuucuccacuguu

SEQ ID NO: 924943 - RNA, 16 nt, Homo sapiens
aaugacauuuugccaa

SEQ ID NO: 924944 - RNA, 15 nt, Homo sapiens
aaugagcuuccauua

SEQ ID NO: 924945 - RNA, 13 nt, Homo sapiens
aaugcaauugucu

SEQ ID NO: 924946 - RNA, 22 nt, Homo sapiens
aaugggacugaugucaucuuga

SEQ ID NO: 924947 - RNA, 16 nt, Homo sapiens
aauguaauauuuacaa

SEQ ID NO: 924948 - RNA, 22 nt, Homo sapiens
aauguagcaguucugcacuuug

SEQ ID NO: 924949 - RNA, 15 nt, Homo sapiens
aaugugcgucagcaa

SEQ ID NO: 924950 - RNA, 19 nt, Homo sapiens
aauuacuuugauuccauuu

SEQ ID NO: 924951 - RNA, 20 nt, Homo sapiens
aauuauauuuugaacaacuc

SEQ ID NO: 924952 - RNA, 16 nt, Homo sapiens
aauuaucuauccuuga

SEQ ID NO: 924953 - RNA, 19 nt, Homo sapiens
aauucaaauaaccuaaaaa

SEQ ID NO: 924954 - RNA, 15 nt, Homo sapiens
aauucagggaauaua

SEQ ID NO: 924955 - RNA, 21 nt, Homo sapiens
aauucauuucaucuacuacag

SEQ ID NO: 924956 - RNA, 16 nt, Homo sapiens
aauuccaauacauuau

SEQ ID NO: 924957 - RNA, 23 nt, Homo sapiens
aauucucuaucauguugaaguca

SEQ ID NO: 924958 - RNA, 16 nt, Homo sapiens
aauucugaacuuuuca

SEQ ID NO: 924959 - RNA, 19 nt, Homo sapiens
aauucuggacaacccaagu

SEQ ID NO: 924960 - RNA, 11 nt, Homo sapiens
aauugagauga

SEQ ID NO: 924961 - RNA, 13 nt, Homo sapiens
aauugagcauagu

SEQ ID NO: 924962 - RNA, 22 nt, Homo sapiens
aauugccuacagagggauuuau

SEQ ID NO: 924963 - RNA, 14 nt, Homo sapiens
aauuucaauaucaa

SEQ ID NO: 924964 - RNA, 11 nt, Homo sapiens
aauuuccccac

SEQ ID NO: 924965 - RNA, 16 nt, Homo sapiens
aauuugauucuaugac

SEQ ID NO: 924966 - RNA, 21 nt, Homo sapiens
aauuugugguugcaugucugu

SEQ ID NO: 924967 - RNA, 20 nt, Homo sapiens
aauuuucuaacaacuuuaag

SEQ ID NO: 924968 - RNA, 13 nt, Homo sapiens
aauuuucuucaca

SEQ ID NO: 924969 - RNA, 19 nt, Homo sapiens
aauuuugggacauuugcau

SEQ ID NO: 924970 - RNA, 14 nt, Homo sapiens
acaaaagccucuca

SEQ ID NO: 924971 - RNA, 21 nt, Homo sapiens
acaaaaugacauuuugccaaa

SEQ ID NO: 924972 - RNA, 15 nt, Homo sapiens
acaaaccacuguaca

SEQ ID NO: 924973 - RNA, 18 nt, Homo sapiens
acaaacuuauucuacuga

SEQ ID NO: 924974 - RNA, 14 nt, Homo sapiens
acaaagcuaaauac

SEQ ID NO: 924975 - RNA, 19 nt, Homo sapiens
acaaaggugauuuuccugu

SEQ ID NO: 924976 - RNA, 14 nt, Homo sapiens
acaaauagugcuaa

SEQ ID NO: 924977 - RNA, 19 nt, Homo sapiens
acaaaugauuuacacugac

SEQ ID NO: 924978 - RNA, 15 nt, Homo sapiens
acaacaacaaaaaac

SEQ ID NO: 924979 - RNA, 15 nt, Homo sapiens
acaagaagugggagu

SEQ ID NO: 924980 - RNA, 15 nt, Homo sapiens
acaagaauugcuaaa

SEQ ID NO: 924981 - RNA, 15 nt, Homo sapiens
acaaucagcagucua

SEQ ID NO: 924982 - RNA, 21 nt, Homo sapiens
acaaucuuuccuugucucuca

SEQ ID NO: 924983 - RNA, 18 nt, Homo sapiens
acaauguuaaaugcaauu

SEQ ID NO: 924984 - RNA, 17 nt, Homo sapiens
acacacagccugugcuu

SEQ ID NO: 924985 - RNA, 19 nt, Homo sapiens
acacagaucuguaauucac

SEQ ID NO: 924986 - RNA, 12 nt, Homo sapiens
acacagcuuuua

SEQ ID NO: 924987 - RNA, 17 nt, Homo sapiens
acacauacagagugggc

SEQ ID NO: 924988 - RNA, 19 nt, Homo sapiens
acaccaaaccugccccuug

SEQ ID NO: 924989 - RNA, 15 nt, Homo sapiens
acaccuguaauccca

SEQ ID NO: 924990 - RNA, 18 nt, Homo sapiens
acacguauguacuaguga

SEQ ID NO: 924991 - RNA, 16 nt, Homo sapiens
acacuagugacaguau

SEQ ID NO: 924992 - RNA, 19 nt, Homo sapiens
acacugcgaacucucagga

SEQ ID NO: 924993 - RNA, 11 nt, Homo sapiens
acacugucaau

SEQ ID NO: 924994 - RNA, 13 nt, Homo sapiens
acagaaaugccac

SEQ ID NO: 924995 - RNA, 23 nt, Homo sapiens
acagaacugcuaaauacuguaca

SEQ ID NO: 924996 - RNA, 17 nt, Homo sapiens
acagagguccugccaug

SEQ ID NO: 924997 - RNA, 18 nt, Homo sapiens
acagaugaaccaaguguc

SEQ ID NO: 924998 - RNA, 21 nt, Homo sapiens
acagcaaucuguguacugaac

SEQ ID NO: 924999 - RNA, 23 nt, Homo sapiens
acagcaaucuguguacugaacau

SEQ ID NO: 925000 - RNA, 12 nt, Homo sapiens
acagcacuuuga

SEQ ID NO: 925001 - RNA, 14 nt, Homo sapiens
acagcgguuguaaa

SEQ ID NO: 925002 - RNA, 23 nt, Homo sapiens
acagcgguuguaaauacaauuca

SEQ ID NO: 925003 - RNA, 18 nt, Homo sapiens
acagcucacggcagccuc

SEQ ID NO: 925004 - RNA, 23 nt, Homo sapiens
acaggaccuaggauaucuucucc

SEQ ID NO: 925005 - RNA, 23 nt, Homo sapiens
acagggucucccuauguugccca

SEQ ID NO: 925006 - RNA, 15 nt, Homo sapiens
acagggugucuguca

SEQ ID NO: 925007 - RNA, 13 nt, Homo sapiens
acaggugugagcc

SEQ ID NO: 925008 - RNA, 18 nt, Homo sapiens
acagugccaacauuuaaa

SEQ ID NO: 925009 - RNA, 23 nt, Homo sapiens
acauauuugcacaaguacaguaa

SEQ ID NO: 925010 - RNA, 19 nt, Homo sapiens
acaucaagauacacuugua

SEQ ID NO: 925011 - RNA, 19 nt, Homo sapiens
acaucuuagcaagcaccaa

SEQ ID NO: 925012 - RNA, 17 nt, Homo sapiens
acaucuuccuccucuac

SEQ ID NO: 925013 - RNA, 15 nt, Homo sapiens
acaugcacuacugaa

SEQ ID NO: 925014 - RNA, 14 nt, Homo sapiens
acaugccaauuuca

SEQ ID NO: 925015 - RNA, 16 nt, Homo sapiens
acaugccaauuucagc

SEQ ID NO: 925016 - RNA, 18 nt, Homo sapiens
acaugcuaccugauccca

SEQ ID NO: 925017 - RNA, 15 nt, Homo sapiens
acauggaaaaauccu

SEQ ID NO: 925018 - RNA, 21 nt, Homo sapiens
acaugucauguagguugucua

SEQ ID NO: 925019 - RNA, 20 nt, Homo sapiens
acauucaccaaccaaagggg

SEQ ID NO: 925020 - RNA, 12 nt, Homo sapiens
acauucugucau

SEQ ID NO: 925021 - RNA, 13 nt, Homo sapiens
acauuugaaauca

SEQ ID NO: 925022 - RNA, 22 nt, Homo sapiens
acauuugaagaaacuccaccua

SEQ ID NO: 925023 - RNA, 22 nt, Homo sapiens
acauuugaagacccuugugcau

SEQ ID NO: 925024 - RNA, 14 nt, Homo sapiens
acauuugcauucaa

SEQ ID NO: 925025 - RNA, 21 nt, Homo sapiens
acauuuuaagcauuuucuaca

SEQ ID NO: 925026 - RNA, 19 nt, Homo sapiens
accaaaauccccuucucau

SEQ ID NO: 925027 - RNA, 20 nt, Homo sapiens
accaacacuuugguauucaa

SEQ ID NO: 925028 - RNA, 13 nt, Homo sapiens
accaauccucacc

SEQ ID NO: 925029 - RNA, 16 nt, Homo sapiens
accaccaccaccauca

SEQ ID NO: 925030 - RNA, 12 nt, Homo sapiens
accaccaucacc

SEQ ID NO: 925031 - RNA, 15 nt, Homo sapiens
accaguuacuguuca

SEQ ID NO: 925032 - RNA, 23 nt, Homo sapiens
accauagccuguuucguagccau

SEQ ID NO: 925033 - RNA, 13 nt, Homo sapiens
accaucuuggcca

SEQ ID NO: 925034 - RNA, 20 nt, Homo sapiens
accaugacgcacugcucaag

SEQ ID NO: 925035 - RNA, 20 nt, Homo sapiens
ccugcccccacucagcauuu

SEQ ID NO: 925036 - RNA, 18 nt, Homo sapiens
ccugcgcauggugcagug

SEQ ID NO: 925037 - RNA, 16 nt, Homo sapiens
ccuggacauauuccca

SEQ ID NO: 925038 - RNA, 11 nt, Homo sapiens
ccuggagcucc

SEQ ID NO: 925039 - RNA, 14 nt, Homo sapiens
ccuggcuuugccca

SEQ ID NO: 925040 - RNA, 13 nt, Homo sapiens
ccugggaauuuca

SEQ ID NO: 925041 - RNA, 17 nt, Homo sapiens
ccuguaaaaugggguga

SEQ ID NO: 925042 - RNA, 18 nt, Homo sapiens
ccuguaaucccaacacuu

SEQ ID NO: 925043 - RNA, 20 nt, Homo sapiens
ccuguaaucccaacacuuug

SEQ ID NO: 925044 - RNA, 17 nt, Homo sapiens
ccugugaaucauauguu

SEQ ID NO: 925045 - RNA, 22 nt, Homo sapiens
ccugugcccacccgucuucaau

SEQ ID NO: 925046 - RNA, 23 nt, Homo sapiens
ccuguguccacaucuaacaaagu

SEQ ID NO: 925047 - RNA, 15 nt, Homo sapiens
ccuguguuacugauu

SEQ ID NO: 925048 - RNA, 20 nt, Homo sapiens
ccuguuguacacuuggguga

SEQ ID NO: 925049 - RNA, 22 nt, Homo sapiens
ccuuaaagucaguaacuuaccc

SEQ ID NO: 925050 - RNA, 23 nt, Homo sapiens
ccuuaggucgcgcucuugcacac

SEQ ID NO: 925051 - RNA, 17 nt, Homo sapiens
ccuuaguuugaaacaga

SEQ ID NO: 925052 - RNA, 16 nt, Homo sapiens
ccuucaaauccugcca

SEQ ID NO: 925053 - RNA, 16 nt, Homo sapiens
ccuucuaauccaugug

SEQ ID NO: 925054 - RNA, 16 nt, Homo sapiens
ccuucuccacagggac

SEQ ID NO: 925055 - RNA, 18 nt, Homo sapiens
ccuugcuuucggagcucc

SEQ ID NO: 925056 - RNA, 23 nt, Homo sapiens
ccuuggagcuguaaaccagagag

SEQ ID NO: 925057 - RNA, 22 nt, Homo sapiens
ccuuguccccaacguuccacaa

SEQ ID NO: 925058 - RNA, 21 nt, Homo sapiens
ccuuuggcaauucuucuucuc

SEQ ID NO: 925059 - RNA, 17 nt, Homo sapiens
ccuuuguucacugugag

SEQ ID NO: 925060 - RNA, 11 nt, Homo sapiens
ccuuuugcccg

SEQ ID NO: 925061 - RNA, 19 nt, Homo sapiens
cgacauuuuucaauaaagu

SEQ ID NO: 925062 - RNA, 16 nt, Homo sapiens
cgaggacccaggaaag

SEQ ID NO: 925063 - RNA, 14 nt, Homo sapiens
cgauauuuacguaa

SEQ ID NO: 925064 - RNA, 14 nt, Homo sapiens
cgauuucacugaca

SEQ ID NO: 925065 - RNA, 16 nt, Homo sapiens
cgccacggccuggcug

SEQ ID NO: 925066 - RNA, 18 nt, Homo sapiens
cgcuggcugggggccuca

SEQ ID NO: 925067 - RNA, 23 nt, Homo sapiens
cgcuguccaaguguuucuuguua

SEQ ID NO: 925068 - RNA, 15 nt, Homo sapiens
cggagucucagucug

SEQ ID NO: 925069 - RNA, 12 nt, Homo sapiens
cggauccugcug

SEQ ID NO: 925070 - RNA, 19 nt, Homo sapiens
cggccuaugagaugaaaua

SEQ ID NO: 925071 - RNA, 15 nt, Homo sapiens
cggcuccuucaagcu

SEQ ID NO: 925072 - RNA, 22 nt, Homo sapiens
cggcuguuccccucacccaaaa

SEQ ID NO: 925073 - RNA, 15 nt, Homo sapiens
cggggaagacuugaa

SEQ ID NO: 925074 - RNA, 19 nt, Homo sapiens
cggugauauugugcaugca

SEQ ID NO: 925075 - RNA, 21 nt, Homo sapiens
cgguggugcaugccuguaauc

SEQ ID NO: 925076 - RNA, 21 nt, Homo sapiens
cguauuuuggggaacuguugu

SEQ ID NO: 925077 - RNA, 14 nt, Homo sapiens
cuaaaauacuugag

SEQ ID NO: 925078 - RNA, 23 nt, Homo sapiens
cuaaagaaacucagcagccucag

SEQ ID NO: 925079 - RNA, 13 nt, Homo sapiens
cuaaagcuauauu

SEQ ID NO: 925080 - RNA, 21 nt, Homo sapiens
cuaaauauugauuucugccuu

SEQ ID NO: 925081 - RNA, 11 nt, Homo sapiens
cuaacacuagu

SEQ ID NO: 925082 - RNA, 14 nt, Homo sapiens
cuaaccccuaugaa

SEQ ID NO: 925083 - RNA, 19 nt, Homo sapiens
cuaagaccuuggcauccuu

SEQ ID NO: 925084 - RNA, 22 nt, Homo sapiens
cuaagauuacaggcgugagcca

SEQ ID NO: 925085 - RNA, 15 nt, Homo sapiens
cuaauggauguagcc

SEQ ID NO: 925086 - RNA, 20 nt, Homo sapiens
cuaauuagaaaauauaguuu

SEQ ID NO: 925087 - RNA, 16 nt, Homo sapiens
cuacaaauagugcuaa

SEQ ID NO: 925088 - RNA, 18 nt, Homo sapiens
cuacaccaacugcucuca

SEQ ID NO: 925089 - RNA, 17 nt, Homo sapiens
cuacagagggauuuauu

SEQ ID NO: 925090 - RNA, 14 nt, Homo sapiens
cuacagcccagugg

SEQ ID NO: 925091 - RNA, 15 nt, Homo sapiens
cuacagggugucugu

SEQ ID NO: 925092 - RNA, 17 nt, Homo sapiens
cuacagggugucuguca

SEQ ID NO: 925093 - RNA, 16 nt, Homo sapiens
cuacaguacaaucagc

SEQ ID NO: 925094 - RNA, 11 nt, Homo sapiens
cuacaguauua

SEQ ID NO: 925095 - RNA, 15 nt, Homo sapiens
cuaccuucaaagcug

SEQ ID NO: 925096 - RNA, 15 nt, Homo sapiens
cuagcgucaguauuu

SEQ ID NO: 925097 - RNA, 17 nt, Homo sapiens
cuaggagauaccaccga

SEQ ID NO: 925098 - RNA, 22 nt, Homo sapiens
cuaggcugggugcccacagccc

SEQ ID NO: 925099 - RNA, 20 nt, Homo sapiens
cuaguacuuuauuaguuuaa

SEQ ID NO: 925100 - RNA, 19 nt, Homo sapiens
cuauaccucauucacagcu

SEQ ID NO: 925101 - RNA, 21 nt, Homo sapiens
cuaucggagcaguucaauaac

SEQ ID NO: 925102 - RNA, 13 nt, Homo sapiens
cuaucuguuaaag

SEQ ID NO: 925103 - RNA, 18 nt, Homo sapiens
cuaugaaagcuaugaaug

SEQ ID NO: 925104 - RNA, 16 nt, Homo sapiens
cuaugaacucuugaua

SEQ ID NO: 925105 - RNA, 15 nt, Homo sapiens
cuaugagaugaaaua

SEQ ID NO: 925106 - RNA, 16 nt, Homo sapiens
cuaugagaugaaauau

SEQ ID NO: 925107 - RNA, 21 nt, Homo sapiens
cuauguaaaugugaauggaaa

SEQ ID NO: 925108 - RNA, 13 nt, Homo sapiens
cuauucagcaaaa

SEQ ID NO: 925109 - RNA, 14 nt, Homo sapiens
cuauuuucccaugc

SEQ ID NO: 925110 - RNA, 17 nt, Homo sapiens
cuauuuucccaugccag

SEQ ID NO: 925111 - RNA, 17 nt, Homo sapiens
cuauuuuggacguguga

SEQ ID NO: 925112 - RNA, 18 nt, Homo sapiens
cucaaacuccugaccuca

SEQ ID NO: 925113 - RNA, 21 nt, Homo sapiens
cucaacuucucagacguucca

SEQ ID NO: 925114 - RNA, 22 nt, Homo sapiens
cucaacuuguguuuuguauuua

SEQ ID NO: 925115 - RNA, 16 nt, Homo sapiens
cucaagaacugccaua

SEQ ID NO: 925116 - RNA, 21 nt, Homo sapiens
cucaagcacugacacucauua

SEQ ID NO: 925117 - RNA, 16 nt, Homo sapiens
cucaauccauguucua

SEQ ID NO: 925118 - RNA, 13 nt, Homo sapiens
cucacaccuguaa

SEQ ID NO: 925119 - RNA, 17 nt, Homo sapiens
cucaccuaacaguuacu

SEQ ID NO: 925120 - RNA, 16 nt, Homo sapiens
cucagacguuccauac

SEQ ID NO: 925121 - RNA, 23 nt, Homo sapiens
cucagcaccugggacccaacaga

SEQ ID NO: 925122 - RNA, 20 nt, Homo sapiens
cucaguggcucacaccugua

SEQ ID NO: 925123 - RNA, 16 nt, Homo sapiens
cucaguuucuucaccu

SEQ ID NO: 925124 - RNA, 22 nt, Homo sapiens
cucaucacacgucacaaugucc

SEQ ID NO: 925125 - RNA, 13 nt, Homo sapiens
cucauucuuguga

SEQ ID NO: 925126 - RNA, 12 nt, Homo sapiens
cuccaacaugaa

SEQ ID NO: 925127 - RNA, 15 nt, Homo sapiens
cuccaggaugucaac

SEQ ID NO: 925128 - RNA, 14 nt, Homo sapiens
cucccaaaauacua

SEQ ID NO: 925129 - RNA, 18 nt, Homo sapiens
cucccaaguuuugaaagg

SEQ ID NO: 925130 - RNA, 16 nt, Homo sapiens
cuccccagccaggugc

SEQ ID NO: 925131 - RNA, 20 nt, Homo sapiens
cucccgaguaguugggauua

SEQ ID NO: 925132 - RNA, 14 nt, Homo sapiens
cucccuuccugucc

SEQ ID NO: 925133 - RNA, 24 nt, Homo sapiens
cucccuuuguuuaaaaugucauuu

SEQ ID NO: 925134 - RNA, 19 nt, Homo sapiens
cuccggggcucagcccuga

SEQ ID NO: 925135 - RNA, 13 nt, Homo sapiens
agaaagacacaaa

SEQ ID NO: 925136 - RNA, 19 nt, Homo sapiens
agaaagcagaggcuggccu

SEQ ID NO: 925137 - RNA, 13 nt, Homo sapiens
agaaagcauugcc

SEQ ID NO: 925138 - RNA, 14 nt, Homo sapiens
agaaaucccaguuc

SEQ ID NO: 925139 - RNA, 22 nt, Homo sapiens
agaaaucccaguucauguugcu

SEQ ID NO: 925140 - RNA, 22 nt, Homo sapiens
agaacaaaacuguaacugcauu

SEQ ID NO: 925141 - RNA, 23 nt, Homo sapiens
agaacccauuugccaugcugcua

SEQ ID NO: 925142 - RNA, 20 nt, Homo sapiens
agaaggaaaugugggguaga

SEQ ID NO: 925143 - RNA, 18 nt, Homo sapiens
agaaguaaaaaauguaag

SEQ ID NO: 925144 - RNA, 20 nt, Homo sapiens
agaauauuaaaaauuaauuc

SEQ ID NO: 925145 - RNA, 12 nt, Homo sapiens
agaaucaagucu

SEQ ID NO: 925146 - RNA, 17 nt, Homo sapiens
agaaugaaccaauauga

SEQ ID NO: 925147 - RNA, 20 nt, Homo sapiens
agaaugaaccaauaugaacu

SEQ ID NO: 925148 - RNA, 19 nt, Homo sapiens
agaauucuuaacauagcca

SEQ ID NO: 925149 - RNA, 16 nt, Homo sapiens
agaauuucaauaucaa

SEQ ID NO: 925150 - RNA, 19 nt, Homo sapiens
agaauuucaauaucaagac

SEQ ID NO: 925151 - RNA, 22 nt, Homo sapiens
agacaaaugggacugaugucau

SEQ ID NO: 925152 - RNA, 14 nt, Homo sapiens
agacaguccuuaau

SEQ ID NO: 925153 - RNA, 18 nt, Homo sapiens
agacaucuggacacuggg

SEQ ID NO: 925154 - RNA, 22 nt, Homo sapiens
agacauuccugcgcauggugca

SEQ ID NO: 925155 - RNA, 18 nt, Homo sapiens
agacauuuuaagcauuuu

SEQ ID NO: 925156 - RNA, 19 nt, Homo sapiens
agaccaagccggugcccac

SEQ ID NO: 925157 - RNA, 15 nt, Homo sapiens
agaccuggaaccaga

SEQ ID NO: 925158 - RNA, 20 nt, Homo sapiens
agaccuugucuccacaaaaa

SEQ ID NO: 925159 - RNA, 23 nt, Homo sapiens
cucuguagaauuuagcuuauaca

SEQ ID NO: 925160 - RNA, 18 nt, Homo sapiens
cucugugcugcaucccac

SEQ ID NO: 925161 - RNA, 17 nt, Homo sapiens
cucuucaaucucuggaa

SEQ ID NO: 925162 - RNA, 11 nt, Homo sapiens
cucuuccauau

SEQ ID NO: 925163 - RNA, 21 nt, Homo sapiens
cucuuccuggaaugcauucac

SEQ ID NO: 925164 - RNA, 14 nt, Homo sapiens
cucuugaccaggcu

SEQ ID NO: 925165 - RNA, 13 nt, Homo sapiens
cucuugcagagaa

SEQ ID NO: 925166 - RNA, 11 nt, Homo sapiens
cucuugcuaau

SEQ ID NO: 925167 - RNA, 21 nt, Homo sapiens
cucuuugaacuccgcugccuu

SEQ ID NO: 925168 - RNA, 20 nt, Homo sapiens
cucuuuugagacuuugccca

SEQ ID NO: 925169 - RNA, 16 nt, Homo sapiens
cugaaaccccaucucc

SEQ ID NO: 925170 - RNA, 23 nt, Homo sapiens
cugaaaccccaucuccacuaaaa

SEQ ID NO: 925171 - RNA, 18 nt, Homo sapiens
cugaaauuaucauuggua

SEQ ID NO: 925172 - RNA, 14 nt, Homo sapiens
cugaaauuccucug

SEQ ID NO: 925173 - RNA, 13 nt, Homo sapiens
cugaacacacauu

SEQ ID NO: 925174 - RNA, 19 nt, Homo sapiens
cugaacaguguuggcuuuc

SEQ ID NO: 925175 - RNA, 23 nt, Homo sapiens
cugaagcuccuacacaggucacu

SEQ ID NO: 925176 - RNA, 19 nt, Homo sapiens
cugaaggugccacuccagu

SEQ ID NO: 925177 - RNA, 19 nt, Homo sapiens
cugaauauaugauuugcau

SEQ ID NO: 925178 - RNA, 19 nt, Homo sapiens
cugaauuuguagacauacu

SEQ ID NO: 925179 - RNA, 22 nt, Homo sapiens
cugacacugcgaacucucagga

SEQ ID NO: 925180 - RNA, 19 nt, Homo sapiens
cugaccucaggugauccac

SEQ ID NO: 925181 - RNA, 17 nt, Homo sapiens
cugacuggcaccaacac

SEQ ID NO: 925182 - RNA, 24 nt, Homo sapiens
cugacuugcuaauggauguagcca

SEQ ID NO: 925183 - RNA, 22 nt, Homo sapiens
cugagauuacaggugugagcca

SEQ ID NO: 925184 - RNA, 22 nt, Homo sapiens
cugagcccagccuacuuuucag

SEQ ID NO: 925185 - RNA, 22 nt, Homo sapiens
cugagcuuuggacacacacagc

SEQ ID NO: 925186 - RNA, 18 nt, Homo sapiens
cugagggacuuggcagua

SEQ ID NO: 925187 - RNA, 18 nt, Homo sapiens
cugaguagcugagacuac

SEQ ID NO: 925188 - RNA, 13 nt, Homo sapiens
cugagucacuuga

SEQ ID NO: 925189 - RNA, 17 nt, Homo sapiens
cugagugaagcaaaaac

SEQ ID NO: 925190 - RNA, 17 nt, Homo sapiens
cugagugaauacuuuga

SEQ ID NO: 925191 - RNA, 14 nt, Homo sapiens
cugaguuggcauca

SEQ ID NO: 925192 - RNA, 12 nt, Homo sapiens
cugaguuugugg

SEQ ID NO: 925193 - RNA, 14 nt, Homo sapiens
cugauaaaccaaaa

SEQ ID NO: 925194 - RNA, 13 nt, Homo sapiens
cugauauuggugu

SEQ ID NO: 925195 - RNA, 17 nt, Homo sapiens
cugauuuagaccaaaag

SEQ ID NO: 925196 - RNA, 18 nt, Homo sapiens
cugauuucacauauugca

SEQ ID NO: 925197 - RNA, 17 nt, Homo sapiens
cugauuucuacaacuga

SEQ ID NO: 925198 - RNA, 12 nt, Homo sapiens
cugcacaaugca

SEQ ID NO: 925199 - RNA, 18 nt, Homo sapiens
cugcacaaugcauugaac

SEQ ID NO: 925200 - RNA, 18 nt, Homo sapiens
cugcagcucccagaagcu

SEQ ID NO: 925201 - RNA, 22 nt, Homo sapiens
cugccacuaggcugggugccca

SEQ ID NO: 925202 - RNA, 11 nt, Homo sapiens
cugccacuguu

SEQ ID NO: 925203 - RNA, 23 nt, Homo sapiens
cugccauaaaaucucacgcugcc

SEQ ID NO: 925204 - RNA, 19 nt, Homo sapiens
cugcccagagcugggugag

SEQ ID NO: 925205 - RNA, 13 nt, Homo sapiens
cugcccauucucu

SEQ ID NO: 925206 - RNA, 17 nt, Homo sapiens
cugcccucuauuuauua

SEQ ID NO: 925207 - RNA, 19 nt, Homo sapiens
cugccgcucagaguguaga

SEQ ID NO: 925208 - RNA, 23 nt, Homo sapiens
cugccucccgaguucaagcgauu

SEQ ID NO: 925209 - RNA, 16 nt, Homo sapiens
cugccugccucgggga

SEQ ID NO: 925210 - RNA, 16 nt, Homo sapiens
cugcgagggccggugc

SEQ ID NO: 925211 - RNA, 18 nt, Homo sapiens
cugcgcagggcucuuuga

SEQ ID NO: 925212 - RNA, 15 nt, Homo sapiens
cugcucuaagcacac

SEQ ID NO: 925213 - RNA, 20 nt, Homo sapiens
cugcucuagaggcccaagcu

SEQ ID NO: 925214 - RNA, 18 nt, Homo sapiens
cugcucuccugggagaca

SEQ ID NO: 925215 - RNA, 15 nt, Homo sapiens
cugcugguaccugcc

SEQ ID NO: 925216 - RNA, 21 nt, Homo sapiens
cugcuguccaggaacuuucca

SEQ ID NO: 925217 - RNA, 17 nt, Homo sapiens
cugcuguggcaucagga

SEQ ID NO: 925218 - RNA, 17 nt, Homo sapiens
cuggaacauucugucau

SEQ ID NO: 925219 - RNA, 16 nt, Homo sapiens
cuggaagccugcugau

SEQ ID NO: 925220 - RNA, 16 nt, Homo sapiens
cuggaaucgaggcugu

SEQ ID NO: 925221 - RNA, 13 nt, Homo sapiens
cuggaccaaagcu

SEQ ID NO: 925222 - RNA, 14 nt, Homo sapiens
cuggaccaaagcug

SEQ ID NO: 925223 - RNA, 17 nt, Homo sapiens
cuggagugugugggggu

SEQ ID NO: 925224 - RNA, 20 nt, Homo sapiens
cuggccacauucaccaacca

SEQ ID NO: 925225 - RNA, 19 nt, Homo sapiens
cuggcccuguugugggggu

SEQ ID NO: 925226 - RNA, 23 nt, Homo sapiens
cuggcuuugcccaaccucagcaa

SEQ ID NO: 925227 - RNA, 16 nt, Homo sapiens
cugggauaugacaagc

SEQ ID NO: 925228 - RNA, 14 nt, Homo sapiens
cugggcacuccucc

SEQ ID NO: 925229 - RNA, 12 nt, Homo sapiens
cugggcuuugau

SEQ ID NO: 925230 - RNA, 18 nt, Homo sapiens
cugggugcaggacacugg

SEQ ID NO: 925231 - RNA, 14 nt, Homo sapiens
cugguaagggccaa

SEQ ID NO: 925232 - RNA, 20 nt, Homo sapiens
cugguagguucugucugugc

SEQ ID NO: 925233 - RNA, 15 nt, Homo sapiens
cuggucgagagccaa

SEQ ID NO: 925234 - RNA, 17 nt, Homo sapiens
cuggucuccuaaccaag

SEQ ID NO: 925235 - RNA, 13 nt, Homo sapiens
cuggugcacauga

SEQ ID NO: 925236 - RNA, 14 nt, Homo sapiens
cuguaacugcauua

SEQ ID NO: 925237 - RNA, 20 nt, Homo sapiens
cuguauuuuuuuuuuccauu

SEQ ID NO: 925238 - RNA, 17 nt, Homo sapiens
cugucaauggacugcac

SEQ ID NO: 925239 - RNA, 16 nt, Homo sapiens
cuguccucauucuucu

SEQ ID NO: 925240 - RNA, 14 nt, Homo sapiens
cugugcaucaacca

SEQ ID NO: 925241 - RNA, 13 nt, Homo sapiens
cuguggagccauc

SEQ ID NO: 925242 - RNA, 18 nt, Homo sapiens
cuguugccuugagcucuu

SEQ ID NO: 925243 - RNA, 19 nt, Homo sapiens
cuuaaaauuaauaaaucau

SEQ ID NO: 925244 - RNA, 22 nt, Homo sapiens
cuuaaaguggcuuucaacuuca

SEQ ID NO: 925245 - RNA, 14 nt, Homo sapiens
cuuaacaguuguau

SEQ ID NO: 925246 - RNA, 17 nt, Homo sapiens
cuuaaugcuauuugcca

SEQ ID NO: 925247 - RNA, 22 nt, Homo sapiens
cuuagaacagauggcugugaaa

SEQ ID NO: 925248 - RNA, 17 nt, Homo sapiens
cuuagagucaugaguuu

SEQ ID NO: 925249 - RNA, 22 nt, Homo sapiens
cuuagauuauguucaaugaaua

SEQ ID NO: 925250 - RNA, 12 nt, Homo sapiens
cuuagugacuua

SEQ ID NO: 925251 - RNA, 18 nt, Homo sapiens
cuuauaauuguucucaga

SEQ ID NO: 925252 - RNA, 17 nt, Homo sapiens
cuuauauuaagcaaaca

SEQ ID NO: 925253 - RNA, 16 nt, Homo sapiens
cuuauggauuuggacu

SEQ ID NO: 925254 - RNA, 19 nt, Homo sapiens
cuuauucuacugaaauuau

SEQ ID NO: 925255 - RNA, 14 nt, Homo sapiens
cuuauuuccaugga

SEQ ID NO: 925256 - RNA, 18 nt, Homo sapiens
cuucaauacaaaaagcca

SEQ ID NO: 925257 - RNA, 14 nt, Homo sapiens
aggauaucuucucc

SEQ ID NO: 925258 - RNA, 21 nt, Homo sapiens
aggauucauaaucacaaauau

SEQ ID NO: 925259 - RNA, 16 nt, Homo sapiens
aggauuuucugaccuu

SEQ ID NO: 925260 - RNA, 13 nt, Homo sapiens
aggcaaaguggaa

SEQ ID NO: 925261 - RNA, 15 nt, Homo sapiens
aggcaaaguggaaug

SEQ ID NO: 925262 - RNA, 14 nt, Homo sapiens
aggcaccagcagca

SEQ ID NO: 925263 - RNA, 13 nt, Homo sapiens
aggcaccaggaag

SEQ ID NO: 925264 - RNA, 17 nt, Homo sapiens
aggcccaccuaccuuca

SEQ ID NO: 925265 - RNA, 18 nt, Homo sapiens
aggcccagcagagccguu

SEQ ID NO: 925266 - RNA, 20 nt, Homo sapiens
aggccgggcacgguggcuca

SEQ ID NO: 925267 - RNA, 20 nt, Homo sapiens
aggccgggcucaguggcuca

SEQ ID NO: 925268 - RNA, 23 nt, Homo sapiens
aggccuccagccacuuauuucca

SEQ ID NO: 925269 - RNA, 20 nt, Homo sapiens
aggcuggagugcaguggcac

SEQ ID NO: 925270 - RNA, 13 nt, Homo sapiens
aggcuggggcuau

SEQ ID NO: 925271 - RNA, 15 nt, Homo sapiens
agggaagaaagcaga

SEQ ID NO: 925272 - RNA, 13 nt, Homo sapiens
agggacagcgggu

SEQ ID NO: 925273 - RNA, 14 nt, Homo sapiens
agggacaucuccau

SEQ ID NO: 925274 - RNA, 17 nt, Homo sapiens
agggacauugaaguguu

SEQ ID NO: 925275 - RNA, 13 nt, Homo sapiens
agggaugcagugc

SEQ ID NO: 925276 - RNA, 17 nt, Homo sapiens
agggauguggagcacaa

SEQ ID NO: 925277 - RNA, 21 nt, Homo sapiens
agggcccucuggggcucagcc

SEQ ID NO: 925278 - RNA, 17 nt, Homo sapiens
agggccuagaaacucac

SEQ ID NO: 925279 - RNA, 22 nt, Homo sapiens
agggcuuuucuuuaguggagaa

SEQ ID NO: 925280 - RNA, 22 nt, Homo sapiens
agggucagugccaagucucagg

SEQ ID NO: 925281 - RNA, 19 nt, Homo sapiens
aggguucuccauuacagug

SEQ ID NO: 925282 - RNA, 20 nt, Homo sapiens
aggguuuuaucucugucuac

SEQ ID NO: 925283 - RNA, 23 nt, Homo sapiens
agguaggaugaacacaggcaaug

SEQ ID NO: 925284 - RNA, 16 nt, Homo sapiens
cuuguacugugaccua

SEQ ID NO: 925285 - RNA, 13 nt, Homo sapiens
cuuguccuaauaa

SEQ ID NO: 925286 - RNA, 18 nt, Homo sapiens
cuugugcauuguguguca

SEQ ID NO: 925287 - RNA, 20 nt, Homo sapiens
cuugugcauugugugucaca

SEQ ID NO: 925288 - RNA, 16 nt, Homo sapiens
cuuguucacacuuugc

SEQ ID NO: 925289 - RNA, 18 nt, Homo sapiens
cuuguucuuuucugguag

SEQ ID NO: 925290 - RNA, 18 nt, Homo sapiens
cuuguuuucuacuuugcc

SEQ ID NO: 925291 - RNA, 13 nt, Homo sapiens
cuuuaaaagucau

SEQ ID NO: 925292 - RNA, 13 nt, Homo sapiens
cuuuaauacaaaa

SEQ ID NO: 925293 - RNA, 15 nt, Homo sapiens
cuuuacuagugccaa

SEQ ID NO: 925294 - RNA, 20 nt, Homo sapiens
cuuuaguuaguauccuugga

SEQ ID NO: 925295 - RNA, 15 nt, Homo sapiens
cuuuauaaaugcauu

SEQ ID NO: 925296 - RNA, 12 nt, Homo sapiens
cuuuaucaaaau

SEQ ID NO: 925297 - RNA, 21 nt, Homo sapiens
cuuucaggagggaaaacccac

SEQ ID NO: 925298 - RNA, 12 nt, Homo sapiens
cuuucaguauua

SEQ ID NO: 925299 - RNA, 13 nt, Homo sapiens
cuuucaguauuag

SEQ ID NO: 925300 - RNA, 19 nt, Homo sapiens
cuuucaucuaaauuacuga

SEQ ID NO: 925301 - RNA, 20 nt, Homo sapiens
cuuucaucuaaauuacugau

SEQ ID NO: 925302 - RNA, 18 nt, Homo sapiens
cuuuccacuccaaccaga

SEQ ID NO: 925303 - RNA, 15 nt, Homo sapiens
cuuucugaauggaaa

SEQ ID NO: 925304 - RNA, 13 nt, Homo sapiens
cuuugacauauug

SEQ ID NO: 925305 - RNA, 20 nt, Homo sapiens
cuuugcuccuuuuguaguau

SEQ ID NO: 925306 - RNA, 20 nt, Homo sapiens
cuuuggacacacacagcuuc

SEQ ID NO: 925307 - RNA, 20 nt, Homo sapiens
cuuuggacgcacacagcuuu

SEQ ID NO: 925308 - RNA, 19 nt, Homo sapiens
cuuugguccucugauuuca

SEQ ID NO: 925309 - RNA, 14 nt, Homo sapiens
cuuuuaguggguga

SEQ ID NO: 925310 - RNA, 18 nt, Homo sapiens
cuuuuauggaccaauuag

SEQ ID NO: 925311 - RNA, 16 nt, Homo sapiens
cuuuucauuuggaaug

SEQ ID NO: 925312 - RNA, 10 nt, Homo sapiens
cuuuugccac

SEQ ID NO: 925313 - RNA, 18 nt, Homo sapiens
cuuuuggagcugagauca

SEQ ID NO: 925314 - RNA, 22 nt, Homo sapiens
cuuuuuauggguuuugcuuaaa

SEQ ID NO: 925315 - RNA, 18 nt, Homo sapiens
cuuuuuuuuaagucacaa

SEQ ID NO: 925316 - RNA, 22 nt, Homo sapiens
gaaaaauaaucuuagaacagau

SEQ ID NO: 925317 - RNA, 14 nt, Homo sapiens
gaaaaauccuguca

SEQ ID NO: 925318 - RNA, 14 nt, Homo sapiens
gaaaaaugauuuca

SEQ ID NO: 925319 - RNA, 17 nt, Homo sapiens
gaaaacccacccuacca

SEQ ID NO: 925320 - RNA, 13 nt, Homo sapiens
gaaaacguaucac

SEQ ID NO: 925321 - RNA, 21 nt, Homo sapiens
gaaaacguaucaccuuuccca

SEQ ID NO: 925322 - RNA, 18 nt, Homo sapiens
gaaaauccuaacuuucag

SEQ ID NO: 925323 - RNA, 21 nt, Homo sapiens
gaaagagagaagccagccaca

SEQ ID NO: 925324 - RNA, 13 nt, Homo sapiens
gaaagcauuauuu

SEQ ID NO: 925325 - RNA, 12 nt, Homo sapiens
gaaagcugugaa

SEQ ID NO: 925326 - RNA, 13 nt, Homo sapiens
gaaagcugugaaa

SEQ ID NO: 925327 - RNA, 15 nt, Homo sapiens
gaaaguccaguuuau

SEQ ID NO: 925328 - RNA, 15 nt, Homo sapiens
gaaagugaacaauca

SEQ ID NO: 925329 - RNA, 16 nt, Homo sapiens
gaaaucccaucugcau

SEQ ID NO: 925330 - RNA, 16 nt, Homo sapiens
gaaauggcauaaucuu

SEQ ID NO: 925331 - RNA, 22 nt, Homo sapiens
gaaauuaauaaaacuuaucuga

SEQ ID NO: 925332 - RNA, 18 nt, Homo sapiens
gaaauuaucauugguaaa

SEQ ID NO: 925333 - RNA, 17 nt, Homo sapiens
gaaauuccucuguagaa

SEQ ID NO: 925334 - RNA, 22 nt, Homo sapiens
gaaauuugugggcuuggggaca

SEQ ID NO: 925335 - RNA, 17 nt, Homo sapiens
gaacaagaauugcuaaa

SEQ ID NO: 925336 - RNA, 12 nt, Homo sapiens
gaacaauaucaa

SEQ ID NO: 925337 - RNA, 16 nt, Homo sapiens
gaacagauggcuguga

SEQ ID NO: 925338 - RNA, 20 nt, Homo sapiens
gaacaguuaagcagccgcca

SEQ ID NO: 925339 - RNA, 17 nt, Homo sapiens
gaacaucugccuugcug

SEQ ID NO: 925340 - RNA, 14 nt, Homo sapiens
gaacauucugucau

SEQ ID NO: 925341 - RNA, 23 nt, Homo sapiens
gaacccuaaaaaugaauaagcua

SEQ ID NO: 925342 - RNA, 21 nt, Homo sapiens
gaacuacgggcugcucuacug

SEQ ID NO: 925343 - RNA, 13 nt, Homo sapiens
gaacucauuucaa

SEQ ID NO: 925344 - RNA, 22 nt, Homo sapiens
gaacucuuccuggaaugcauuc

SEQ ID NO: 925345 - RNA, 15 nt, Homo sapiens
gaacuucacagagac

SEQ ID NO: 925346 - RNA, 13 nt, Homo sapiens
gaagaaaaaggau

SEQ ID NO: 925347 - RNA, 15 nt, Homo sapiens
gaagacaucaagaua

SEQ ID NO: 925348 - RNA, 21 nt, Homo sapiens
gaagagcaggcaccagcagca

SEQ ID NO: 925349 - RNA, 19 nt, Homo sapiens
gaagaguaaaauggcuguu

SEQ ID NO: 925350 - RNA, 12 nt, Homo sapiens
gaagagucauuu

SEQ ID NO: 925351 - RNA, 13 nt, Homo sapiens
gaagcaaucauuu

SEQ ID NO: 925352 - RNA, 18 nt, Homo sapiens
gaagcccugggugcagga

SEQ ID NO: 925353 - RNA, 15 nt, Homo sapiens
gaagcugugucuuua

SEQ ID NO: 925354 - RNA, 15 nt, Homo sapiens
gaagcuuucaguauu

SEQ ID NO: 925355 - RNA, 13 nt, Homo sapiens
gaaggaaacauau

SEQ ID NO: 925356 - RNA, 12 nt, Homo sapiens
gaaggagccugc

SEQ ID NO: 925357 - RNA, 17 nt, Homo sapiens
gaaggaggaaguggaag

SEQ ID NO: 925358 - RNA, 18 nt, Homo sapiens
gaaggccaccugcagguc

SEQ ID NO: 925359 - RNA, 19 nt, Homo sapiens
gaaggcucugggaucuccc

SEQ ID NO: 925360 - RNA, 22 nt, Homo sapiens
gaagggccuucuccacagggac

SEQ ID NO: 925361 - RNA, 23 nt, Homo sapiens
gaagggccuucuccacagggaca

SEQ ID NO: 925362 - RNA, 23 nt, Homo sapiens
gaagguaacugauaaaccaaaau

SEQ ID NO: 925363 - RNA, 18 nt, Homo sapiens
gaaggugacucugaccuu

SEQ ID NO: 925364 - RNA, 21 nt, Homo sapiens
gaagguuggaacugcugccau

SEQ ID NO: 925365 - RNA, 21 nt, Homo sapiens
gaagugaauauuugagacaaa

SEQ ID NO: 925366 - RNA, 19 nt, Homo sapiens
gaagugacaccaguucuuu

SEQ ID NO: 925367 - RNA, 10 nt, Homo sapiens
gaaguggaag

SEQ ID NO: 925368 - RNA, 21 nt, Homo sapiens
gaaguuugcagauacucgcca

SEQ ID NO: 925369 - RNA, 20 nt, Homo sapiens
gaauacacaacuccacuguc

SEQ ID NO: 925370 - RNA, 23 nt, Homo sapiens
gaauacuaauaaaauacauacua

SEQ ID NO: 925371 - RNA, 13 nt, Homo sapiens
gaauagcuuguac

SEQ ID NO: 925372 - RNA, 21 nt, Homo sapiens
gaauauauugaauaggcauua

SEQ ID NO: 925373 - RNA, 21 nt, Homo sapiens
gaauauuuuauuuuuuuggca

SEQ ID NO: 925374 - RNA, 21 nt, Homo sapiens
gaaucauagccaaaaacuuuu

SEQ ID NO: 925375 - RNA, 17 nt, Homo sapiens
gaaucuuuuacugugga

SEQ ID NO: 925376 - RNA, 20 nt, Homo sapiens
gaaugccucgcucccuucaa

SEQ ID NO: 925377 - RNA, 23 nt, Homo sapiens
gaauggcucacuauggugccaau

SEQ ID NO: 925378 - RNA, 12 nt, Homo sapiens
gaauuagcucac

SEQ ID NO: 925379 - RNA, 21 nt, Homo sapiens
auauguucacaccuagcguca

SEQ ID NO: 925380 - RNA, 21 nt, Homo sapiens
auauuaagcaaacacuugaag

SEQ ID NO: 925381 - RNA, 22 nt, Homo sapiens
auauuaggcuauaaauguccua

SEQ ID NO: 925382 - RNA, 22 nt, Homo sapiens
auauucccaugguagacuguga

SEQ ID NO: 925383 - RNA, 22 nt, Homo sapiens
auauuuaaaaaaaaacauucaa

SEQ ID NO: 925384 - RNA, 20 nt, Homo sapiens
auauuuaauaccaccaacaa

SEQ ID NO: 925385 - RNA, 21 nt, Homo sapiens
auauuuauaaauaugugauua

SEQ ID NO: 925386 - RNA, 20 nt, Homo sapiens
aucaaaaaacaagucuuuag

SEQ ID NO: 925387 - RNA, 14 nt, Homo sapiens
aucaagucugugaa

SEQ ID NO: 925388 - RNA, 13 nt, Homo sapiens
aucacgaggucag

SEQ ID NO: 925389 - RNA, 14 nt, Homo sapiens
aucacucauuuauu

SEQ ID NO: 925390 - RNA, 14 nt, Homo sapiens
aucauggcucacug

SEQ ID NO: 925391 - RNA, 14 nt, Homo sapiens
aucauuaacacuuu

SEQ ID NO: 925392 - RNA, 15 nt, Homo sapiens
auccacaacuuuuca

SEQ ID NO: 925393 - RNA, 18 nt, Homo sapiens
auccaccuccuucucugu

SEQ ID NO: 925394 - RNA, 22 nt, Homo sapiens
auccacgagaccaugaugcauu

SEQ ID NO: 925395 - RNA, 16 nt, Homo sapiens
auccagccaccaccua

SEQ ID NO: 925396 - RNA, 22 nt, Homo sapiens
aucccaguucauguugcucaga

SEQ ID NO: 925397 - RNA, 14 nt, Homo sapiens
aucccaucugcauu

SEQ ID NO: 925398 - RNA, 13 nt, Homo sapiens
aucccugccaaga

SEQ ID NO: 925399 - RNA, 18 nt, Homo sapiens
auccuaaggggagcuaca

SEQ ID NO: 925400 - RNA, 13 nt, Homo sapiens
auccuacuucucc

SEQ ID NO: 925401 - RNA, 18 nt, Homo sapiens
auccuagcugugugcagu

SEQ ID NO: 925402 - RNA, 13 nt, Homo sapiens
auccucaaggaaa

SEQ ID NO: 925403 - RNA, 16 nt, Homo sapiens
auccucccuacuucca

SEQ ID NO: 925404 - RNA, 20 nt, Homo sapiens
auccuguacaagugcucagu

SEQ ID NO: 925405 - RNA, 19 nt, Homo sapiens
auccuguucucauggauuu

SEQ ID NO: 925406 - RNA, 17 nt, Homo sapiens
aucgacuuugugucucu

SEQ ID NO: 925407 - RNA, 20 nt, Homo sapiens
aucuaccugcccucucucag

SEQ ID NO: 925408 - RNA, 11 nt, Homo sapiens
gacuggcuuug

SEQ ID NO: 925409 - RNA, 15 nt, Homo sapiens
gacuuacagugccaa

SEQ ID NO: 925410 - RNA, 18 nt, Homo sapiens
gacuucugcccauucucu

SEQ ID NO: 925411 - RNA, 14 nt, Homo sapiens
gacuugcuguguau

SEQ ID NO: 925412 - RNA, 23 nt, Homo sapiens
gagaaaacagauaaugauagugu

SEQ ID NO: 925413 - RNA, 16 nt, Homo sapiens
gagaaauuuuaguuua

SEQ ID NO: 925414 - RNA, 22 nt, Homo sapiens
gagaacaaagaccaaugugaag

SEQ ID NO: 925415 - RNA, 16 nt, Homo sapiens
gagaacagggaugcua

SEQ ID NO: 925416 - RNA, 24 nt, Homo sapiens
gagaacgggaguggccaucuggaa

SEQ ID NO: 925417 - RNA, 19 nt, Homo sapiens
gagaagccuggguggcuca

SEQ ID NO: 925418 - RNA, 16 nt, Homo sapiens
gagaaugacccuguca

SEQ ID NO: 925419 - RNA, 13 nt, Homo sapiens
gagacacagggca

SEQ ID NO: 925420 - RNA, 18 nt, Homo sapiens
gagacuccugauugcucu

SEQ ID NO: 925421 - RNA, 14 nt, Homo sapiens
gagaggaagccacg

SEQ ID NO: 925422 - RNA, 19 nt, Homo sapiens
gagaggagagaaugagaga

SEQ ID NO: 925423 - RNA, 21 nt, Homo sapiens
gagaguguggaaaaaaaaaga

SEQ ID NO: 925424 - RNA, 21 nt, Homo sapiens
gagaugaaauaugugauuuuc

SEQ ID NO: 925425 - RNA, 14 nt, Homo sapiens
gagcaaagggccag

SEQ ID NO: 925426 - RNA, 15 nt, Homo sapiens
gagcagagaaggcca

SEQ ID NO: 925427 - RNA, 13 nt, Homo sapiens
gagccauccuccu

SEQ ID NO: 925428 - RNA, 14 nt, Homo sapiens
gagcccggcaaaug

SEQ ID NO: 925429 - RNA, 14 nt, Homo sapiens
gagccugcucuuug

SEQ ID NO: 925430 - RNA, 21 nt, Homo sapiens
gagcugagaucacaccacugu

SEQ ID NO: 925431 - RNA, 14 nt, Homo sapiens
gaggaaauagggcu

SEQ ID NO: 925432 - RNA, 20 nt, Homo sapiens
gaggaaucuaaacaaacagg

SEQ ID NO: 925433 - RNA, 14 nt, Homo sapiens
gaggccaaggcagg

SEQ ID NO: 925434 - RNA, 20 nt, Homo sapiens
gaggccaaggugggcggauc

SEQ ID NO: 925435 - RNA, 13 nt, Homo sapiens
gaggcccuaggcg

SEQ ID NO: 925436 - RNA, 22 nt, Homo sapiens
gaggcuaaaaaacggauuuccu

SEQ ID NO: 925437 - RNA, 13 nt, Homo sapiens
gagggaugcagug

SEQ ID NO: 925438 - RNA, 16 nt, Homo sapiens
gagggaugcagugccu

SEQ ID NO: 925439 - RNA, 18 nt, Homo sapiens
gagggcagaggugaucac

SEQ ID NO: 925440 - RNA, 20 nt, Homo sapiens
gaggggagaggaagcacaag

SEQ ID NO: 925441 - RNA, 22 nt, Homo sapiens
gagguagaggggaaggaaaucu

SEQ ID NO: 925442 - RNA, 20 nt, Homo sapiens
gagguggagguugcagugag

SEQ ID NO: 925443 - RNA, 12 nt, Homo sapiens
gagucacuugaa

SEQ ID NO: 925444 - RNA, 20 nt, Homo sapiens
gagucuugugugcauugcug

SEQ ID NO: 925445 - RNA, 17 nt, Homo sapiens
gagugaucucagcucac

SEQ ID NO: 925446 - RNA, 18 nt, Homo sapiens
gagugaucucagcucacu

SEQ ID NO: 925447 - RNA, 22 nt, Homo sapiens
gagugaucucagcucacugcaa

SEQ ID NO: 925448 - RNA, 22 nt, Homo sapiens
gagugggccccgggcuggagaa

SEQ ID NO: 925449 - RNA, 18 nt, Homo sapiens
gaguucuccugcucccca

SEQ ID NO: 925450 - RNA, 16 nt, Homo sapiens
gauaaaguuugcuaag

SEQ ID NO: 925451 - RNA, 19 nt, Homo sapiens
gauaauuuauuguaccaaa

SEQ ID NO: 925452 - RNA, 19 nt, Homo sapiens
gauacuugugaacaugccu

SEQ ID NO: 925453 - RNA, 15 nt, Homo sapiens
gauagcauauauuca

SEQ ID NO: 925454 - RNA, 19 nt, Homo sapiens
gauaguguuuuguacuugu

SEQ ID NO: 925455 - RNA, 17 nt, Homo sapiens
gauauacugcagcuuua

SEQ ID NO: 925456 - RNA, 20 nt, Homo sapiens
gauauacuugagugugcaag

SEQ ID NO: 925457 - RNA, 20 nt, Homo sapiens
gauauauucuuuccaugcag

SEQ ID NO: 925458 - RNA, 23 nt, Homo sapiens
gauauuaaaaauugaaaacuuug

SEQ ID NO: 925459 - RNA, 20 nt, Homo sapiens
gaucacaucacugcacucca

SEQ ID NO: 925460 - RNA, 16 nt, Homo sapiens
gaucacuugaacccgg

SEQ ID NO: 925461 - RNA, 18 nt, Homo sapiens
gauccaaguuuacucaac

SEQ ID NO: 925462 - RNA, 23 nt, Homo sapiens
gauccaaguuuacucaacccucu

SEQ ID NO: 925463 - RNA, 17 nt, Homo sapiens
gaucccacuccuaggac

SEQ ID NO: 925464 - RNA, 13 nt, Homo sapiens
gaucuuugcaaag

SEQ ID NO: 925465 - RNA, 13 nt, Homo sapiens
gaugauuuuggcc

SEQ ID NO: 925466 - RNA, 23 nt, Homo sapiens
gaugauuuuggccucauuacuuu

SEQ ID NO: 925467 - RNA, 22 nt, Homo sapiens
gaugcuaucucgcuagccauau

SEQ ID NO: 925468 - RNA, 16 nt, Homo sapiens
gaugucuguaaccaau

SEQ ID NO: 925469 - RNA, 21 nt, Homo sapiens
gauguggauggaggugaugaa

SEQ ID NO: 925470 - RNA, 21 nt, Homo sapiens
gauuauguccuacaaugucaa

SEQ ID NO: 925471 - RNA, 13 nt, Homo sapiens
gauuauguucaau

SEQ ID NO: 925472 - RNA, 23 nt, Homo sapiens
gauucaauaaaaugcacugacca

SEQ ID NO: 925473 - RNA, 12 nt, Homo sapiens
gauucugcauuu

SEQ ID NO: 925474 - RNA, 15 nt, Homo sapiens
gauugccauuucuuc

SEQ ID NO: 925475 - RNA, 21 nt, Homo sapiens
gauugccuuuggcaauucuuc

SEQ ID NO: 925476 - RNA, 20 nt, Homo sapiens
gauuuaauuuguuguuaaua

SEQ ID NO: 925477 - RNA, 17 nt, Homo sapiens
gauuuauuuuuauauga

SEQ ID NO: 925478 - RNA, 16 nt, Homo sapiens
gauuucuuaaugcuau

SEQ ID NO: 925479 - RNA, 19 nt, Homo sapiens
gauuuuguauucagggguu

SEQ ID NO: 925480 - RNA, 13 nt, Homo sapiens
gcaaaaaacuaau

SEQ ID NO: 925481 - RNA, 13 nt, Homo sapiens
gcaaaaccaaaga

SEQ ID NO: 925482 - RNA, 20 nt, Homo sapiens
gcaaacacugugauuacucu

SEQ ID NO: 925483 - RNA, 19 nt, Homo sapiens
gcaaaccucuccuuccuca

SEQ ID NO: 925484 - RNA, 17 nt, Homo sapiens
gcaaagcagcaauuaca

SEQ ID NO: 925485 - RNA, 18 nt, Homo sapiens
gcaaagugcuagccacug

SEQ ID NO: 925486 - RNA, 22 nt, Homo sapiens
gcaacgccugccuucugggcaa

SEQ ID NO: 925487 - RNA, 23 nt, Homo sapiens
gcaacgccugccuucugggcaag

SEQ ID NO: 925488 - RNA, 22 nt, Homo sapiens
gcaaggcugccggcugcacccu

SEQ ID NO: 925489 - RNA, 22 nt, Homo sapiens
gcaagggaggaacaaaugaaga

SEQ ID NO: 925490 - RNA, 18 nt, Homo sapiens
gcaagucccaugauuucu

SEQ ID NO: 925491 - RNA, 19 nt, Homo sapiens
gcaagucccaugauuucuu

SEQ ID NO: 925492 - RNA, 21 nt, Homo sapiens
gcaauacggaacacugucaau

SEQ ID NO: 925493 - RNA, 17 nt, Homo sapiens
gcaaugcaauguggaaa

SEQ ID NO: 925494 - RNA, 14 nt, Homo sapiens
gcaauucauucucu

SEQ ID NO: 925495 - RNA, 16 nt, Homo sapiens
gcaauucuucuucuca

SEQ ID NO: 925496 - RNA, 19 nt, Homo sapiens
gcacacggagacgugauga

SEQ ID NO: 925497 - RNA, 20 nt, Homo sapiens
gcacagaacaagccacagga

SEQ ID NO: 925498 - RNA, 22 nt, Homo sapiens
gcaccaaaaaacuaaagcaguu

SEQ ID NO: 925499 - RNA, 22 nt, Homo sapiens
gcaccaacacuuugguauucaa

SEQ ID NO: 925500 - RNA, 20 nt, Homo sapiens
acaggugcugaacugugcau

SEQ ID NO: 925501 - RNA, 16 nt, Homo sapiens
acagguuggaucucac

SEQ ID NO: 925502 - RNA, 23 nt, Homo sapiens
acaguagggaugaguacccaaaa

SEQ ID NO: 925503 - RNA, 10 nt, Homo sapiens
acaguggaau

SEQ ID NO: 925504 - RNA, 18 nt, Homo sapiens
acaguuaaacuugcaaug

SEQ ID NO: 925505 - RNA, 22 nt, Homo sapiens
acaguuuuccaaacugugucac

SEQ ID NO: 925506 - RNA, 19 nt, Homo sapiens
acaguuuuuuacauauuaa

SEQ ID NO: 925507 - RNA, 20 nt, Homo sapiens
acauaaaacaaaaccaagcc

SEQ ID NO: 925508 - RNA, 14 nt, Homo sapiens
acauaacauaagcu

SEQ ID NO: 925509 - RNA, 14 nt, Homo sapiens
acauagauagaaug

SEQ ID NO: 925510 - RNA, 20 nt, Homo sapiens
acauagaugucuguaaccaa

SEQ ID NO: 925511 - RNA, 20 nt, Homo sapiens
acauaggugugcuucccaaa

SEQ ID NO: 925512 - RNA, 17 nt, Homo sapiens
acauaguagauugacau

SEQ ID NO: 925513 - RNA, 17 nt, Homo sapiens
acaucaagauacacuug

SEQ ID NO: 925514 - RNA, 19 nt, Homo sapiens
acaugcuaguucaacagaa

SEQ ID NO: 925515 - RNA, 13 nt, Homo sapiens
acauuaacaagcu

SEQ ID NO: 925516 - RNA, 22 nt, Homo sapiens
acauugacuguggcucuugccu

SEQ ID NO: 925517 - RNA, 13 nt, Homo sapiens
acauuuacagcaa

SEQ ID NO: 925518 - RNA, 22 nt, Homo sapiens
acauuuuucauuauaacuuuaa

SEQ ID NO: 925519 - RNA, 18 nt, Homo sapiens
accaaacggaacucuuca

SEQ ID NO: 925520 - RNA, 12 nt, Homo sapiens
accaaauucuga

SEQ ID NO: 925521 - RNA, 14 nt, Homo sapiens
accaacaaauauag

SEQ ID NO: 925522 - RNA, 13 nt, Homo sapiens
accaaccaaaggg

SEQ ID NO: 925523 - RNA, 15 nt, Homo sapiens
accaagugcugucuu

SEQ ID NO: 925524 - RNA, 20 nt, Homo sapiens
accaaugugaagacacuaca

SEQ ID NO: 925525 - RNA, 17 nt, Homo sapiens
accacacucauggguca

SEQ ID NO: 925526 - RNA, 20 nt, Homo sapiens
gaaaauaauuuuauaaucca

SEQ ID NO: 925527 - RNA, 15 nt, Homo sapiens
gaaaaucaacccaau

SEQ ID NO: 925528 - RNA, 12 nt, Homo sapiens
gaaaaugauuua

SEQ ID NO: 925529 - RNA, 17 nt, Homo sapiens
gaaaauguccaggaaag

SEQ ID NO: 925530 - RNA, 17 nt, Homo sapiens
gaaacauauguucuccc

SEQ ID NO: 925531 - RNA, 15 nt, Homo sapiens
gaaacugaguugaau

SEQ ID NO: 925532 - RNA, 17 nt, Homo sapiens
gaaacugcuaauuacac

SEQ ID NO: 925533 - RNA, 12 nt, Homo sapiens
gaaagacacaaa

SEQ ID NO: 925534 - RNA, 14 nt, Homo sapiens
gaaagcauugccag

SEQ ID NO: 925535 - RNA, 18 nt, Homo sapiens
gaaagucuccuguaucau

SEQ ID NO: 925536 - RNA, 22 nt, Homo sapiens
gaaauggcagucugccugccuc

SEQ ID NO: 925537 - RNA, 19 nt, Homo sapiens
gaaaugggaacaauaucaa

SEQ ID NO: 925538 - RNA, 20 nt, Homo sapiens
gaaauuaauaaaacuuaucu

SEQ ID NO: 925539 - RNA, 16 nt, Homo sapiens
gaaauuccucuguaga

SEQ ID NO: 925540 - RNA, 23 nt, Homo sapiens
gaaauuugugggcuuggggacag

SEQ ID NO: 925541 - RNA, 17 nt, Homo sapiens
gaacagauggcugugaa

SEQ ID NO: 925542 - RNA, 18 nt, Homo sapiens
gaacagauggcugugaaa

SEQ ID NO: 925543 - RNA, 15 nt, Homo sapiens
gaacauacuucaucg

SEQ ID NO: 925544 - RNA, 22 nt, Homo sapiens
gaacauaguagauugacaucua

SEQ ID NO: 925545 - RNA, 19 nt, Homo sapiens
gaacauugauuucauugaa

SEQ ID NO: 925546 - RNA, 23 nt, Homo sapiens
gaaccauauccauguugcugacu

SEQ ID NO: 925547 - RNA, 20 nt, Homo sapiens
gaaccuccuuucucuucucu

SEQ ID NO: 925548 - RNA, 15 nt, Homo sapiens
gaacuacgggcugcu

SEQ ID NO: 925549 - RNA, 22 nt, Homo sapiens
gaacuagugguggcucugagaa

SEQ ID NO: 925550 - RNA, 14 nt, Homo sapiens
gaacucgcuucucu

SEQ ID NO: 925551 - RNA, 22 nt, Homo sapiens
gaacucuucaucuuaaacuaca

SEQ ID NO: 925552 - RNA, 18 nt, Homo sapiens
gaacugaugacacugaga

SEQ ID NO: 925553 - RNA, 20 nt, Homo sapiens
gaacugccauaaaaucucac

SEQ ID NO: 925554 - RNA, 18 nt, Homo sapiens
gaagacgaagaagcaagg

SEQ ID NO: 925555 - RNA, 14 nt, Homo sapiens
gaagaguccaggaa

SEQ ID NO: 925556 - RNA, 22 nt, Homo sapiens
gaagaugauccacaacuugaga

SEQ ID NO: 925557 - RNA, 20 nt, Homo sapiens
gaagcaaaaacuacccagau

SEQ ID NO: 925558 - RNA, 22 nt, Homo sapiens
gaagcucacgccuuaguuugaa

SEQ ID NO: 925559 - RNA, 19 nt, Homo sapiens
gaagcuccgugagccucag

SEQ ID NO: 925560 - RNA, 13 nt, Homo sapiens
gaagcugugucuu

SEQ ID NO: 925561 - RNA, 15 nt, Homo sapiens
gaaggaaaaacaugc

SEQ ID NO: 925562 - RNA, 18 nt, Homo sapiens
gaaggauuuucugaccuu

SEQ ID NO: 925563 - RNA, 19 nt, Homo sapiens
gaagugguuuaaaccaaac

SEQ ID NO: 925564 - RNA, 14 nt, Homo sapiens
gaaguguauuuuau

SEQ ID NO: 925565 - RNA, 19 nt, Homo sapiens
gaagugugacccugugaca

SEQ ID NO: 925566 - RNA, 19 nt, Homo sapiens
gaauaaugacguauuguga

SEQ ID NO: 925567 - RNA, 23 nt, Homo sapiens
gaauaauuagauauauauauuca

SEQ ID NO: 925568 - RNA, 12 nt, Homo sapiens
gaauacuuugau

SEQ ID NO: 925569 - RNA, 15 nt, Homo sapiens
gaauagcaguuucac

SEQ ID NO: 925570 - RNA, 19 nt, Homo sapiens
gaauauguagucuaagcau

SEQ ID NO: 925571 - RNA, 21 nt, Homo sapiens
gaauauuguaaauguucaagu

SEQ ID NO: 925572 - RNA, 16 nt, Homo sapiens
gaaucaagucugugaa

SEQ ID NO: 925573 - RNA, 15 nt, Homo sapiens
gaaucacgauuuucu

SEQ ID NO: 925574 - RNA, 15 nt, Homo sapiens
gaaucauaugggaua

SEQ ID NO: 925575 - RNA, 14 nt, Homo sapiens
gaaucggugcuguc

SEQ ID NO: 925576 - RNA, 14 nt, Homo sapiens
gaaugaccacuuga

SEQ ID NO: 925577 - RNA, 15 nt, Homo sapiens
gaaugcauugcauca

SEQ ID NO: 925578 - RNA, 14 nt, Homo sapiens
gaaugggagccaga

SEQ ID NO: 925579 - RNA, 15 nt, Homo sapiens
gaauuaucaucccaa

SEQ ID NO: 925580 - RNA, 11 nt, Homo sapiens
gaauucagugc

SEQ ID NO: 925581 - RNA, 19 nt, Homo sapiens
gaauucuggacaacccaag

SEQ ID NO: 925582 - RNA, 15 nt, Homo sapiens
gaauuucaauaucaa

SEQ ID NO: 925583 - RNA, 20 nt, Homo sapiens
gacaaaccacuguacauaua

SEQ ID NO: 925584 - RNA, 19 nt, Homo sapiens
gacaaaccucuaacccagg

SEQ ID NO: 925585 - RNA, 14 nt, Homo sapiens
gacaagcacuuugg

SEQ ID NO: 925586 - RNA, 20 nt, Homo sapiens
gacaauuuucuaccacuggu

SEQ ID NO: 925587 - RNA, 20 nt, Homo sapiens
gacacugcgaacucucagga

SEQ ID NO: 925588 - RNA, 21 nt, Homo sapiens
gacaggacagcauggugcaug

SEQ ID NO: 925589 - RNA, 23 nt, Homo sapiens
gacagugguaaauauagaaccau

SEQ ID NO: 925590 - RNA, 20 nt, Homo sapiens
gacaucccccuccuugccgc

SEQ ID NO: 925591 - RNA, 20 nt, Homo sapiens
gacauggauuugaugaaagu

SEQ ID NO: 925592 - RNA, 14 nt, Homo sapiens
gacauguauuccca

SEQ ID NO: 925593 - RNA, 13 nt, Homo sapiens
gaccaaugugaag

SEQ ID NO: 925594 - RNA, 12 nt, Homo sapiens
gacccaggaaag

SEQ ID NO: 925595 - RNA, 23 nt, Homo sapiens
gacccaggaaaggcaggauugaa

SEQ ID NO: 925596 - RNA, 20 nt, Homo sapiens
gaccuggaaccagagccaca

SEQ ID NO: 925597 - RNA, 22 nt, Homo sapiens
gacgcauuccaaaucauacuca

SEQ ID NO: 925598 - RNA, 17 nt, Homo sapiens
gacuaaacuacauuaua

SEQ ID NO: 925599 - RNA, 19 nt, Homo sapiens
gacucuguccuuccaugca

SEQ ID NO: 925600 - RNA, 18 nt, Homo sapiens
gacugacuggcaccaaca

SEQ ID NO: 925601 - RNA, 17 nt, Homo sapiens
gacugaugucaucuuga

SEQ ID NO: 925602 - RNA, 17 nt, Homo sapiens
gacugccccagaauugg

SEQ ID NO: 925603 - RNA, 20 nt, Homo sapiens
gacugcugauuuucuggaau

SEQ ID NO: 925604 - RNA, 15 nt, Homo sapiens
gacugugacacagcu

SEQ ID NO: 925605 - RNA, 17 nt, Homo sapiens
gacuucugcccauucuc

SEQ ID NO: 925606 - RNA, 12 nt, Homo sapiens
gacuuuuagaca

SEQ ID NO: 925607 - RNA, 12 nt, Homo sapiens
gagaacagggau

SEQ ID NO: 925608 - RNA, 12 nt, Homo sapiens
gagaacaucugc

SEQ ID NO: 925609 - RNA, 11 nt, Homo sapiens
gagaagcaauc

SEQ ID NO: 925610 - RNA, 21 nt, Homo sapiens
gagaagggugguuuccugcca

SEQ ID NO: 925611 - RNA, 16 nt, Homo sapiens
gagaccuaacugccgc

SEQ ID NO: 925612 - RNA, 19 nt, Homo sapiens
gagacuaagauguauuaac

SEQ ID NO: 925613 - RNA, 21 nt, Homo sapiens
gagagaacagggaugcuaucu

SEQ ID NO: 925614 - RNA, 23 nt, Homo sapiens
gagaugaaauucaaauaaccuaa

SEQ ID NO: 925615 - RNA, 19 nt, Homo sapiens
gagauguaugcccaaagac

SEQ ID NO: 925616 - RNA, 13 nt, Homo sapiens
gagauuacaggug

SEQ ID NO: 925617 - RNA, 16 nt, Homo sapiens
gagcauaucuguuaua

SEQ ID NO: 925618 - RNA, 14 nt, Homo sapiens
gagcccccuguccu

SEQ ID NO: 925619 - RNA, 19 nt, Homo sapiens
gagcgagauucugccucaa

SEQ ID NO: 925620 - RNA, 13 nt, Homo sapiens
gagcgcaaagugc

SEQ ID NO: 925621 - RNA, 19 nt, Homo sapiens
gagcuaaggcagccuucag

SEQ ID NO: 925622 - RNA, 16 nt, Homo sapiens
gagcuacuugggccau

SEQ ID NO: 925623 - RNA, 22 nt, Homo sapiens
gagcucuggugggaaaaugucc

SEQ ID NO: 925624 - RNA, 14 nt, Homo sapiens
gagcuggccucacc

SEQ ID NO: 925625 - RNA, 22 nt, Homo sapiens
gagcuuguaauugcaccacugc

SEQ ID NO: 925626 - RNA, 19 nt, Homo sapiens
gaggaaucuaaacaaacag

SEQ ID NO: 925627 - RNA, 20 nt, Homo sapiens
gaggagauuaacacacugaa

SEQ ID NO: 925628 - RNA, 18 nt, Homo sapiens
gagggcgcauguguguau

SEQ ID NO: 925629 - RNA, 11 nt, Homo sapiens
gagggggcuca

SEQ ID NO: 925630 - RNA, 12 nt, Homo sapiens
gaggucaugcca

SEQ ID NO: 925631 - RNA, 16 nt, Homo sapiens
gagucacgagcugcug

SEQ ID NO: 925632 - RNA, 15 nt, Homo sapiens
gagucuugugugcau

SEQ ID NO: 925633 - RNA, 18 nt, Homo sapiens
gagugaauacuuugauga

SEQ ID NO: 925634 - RNA, 15 nt, Homo sapiens
gaguucuauccccaa

SEQ ID NO: 925635 - RNA, 12 nt, Homo sapiens
gaguucugaugu

SEQ ID NO: 925636 - RNA, 20 nt, Homo sapiens
gaguuuccagcuaagccuga

SEQ ID NO: 925637 - RNA, 10 nt, Homo sapiens
aagucauuuu

SEQ ID NO: 925638 - RNA, 19 nt, Homo sapiens
aagucucauggcaguccca

SEQ ID NO: 925639 - RNA, 13 nt, Homo sapiens
aagucugaaguca

SEQ ID NO: 925640 - RNA, 19 nt, Homo sapiens
aagucuuccugaccaccuu

SEQ ID NO: 925641 - RNA, 23 nt, Homo sapiens
aagugcugagauuacagguguga

SEQ ID NO: 925642 - RNA, 23 nt, Homo sapiens
aagugcugggauuacagguguga

SEQ ID NO: 925643 - RNA, 19 nt, Homo sapiens
aagugucuaaaauacuuga

SEQ ID NO: 925644 - RNA, 11 nt, Homo sapiens
aaguguguuca

SEQ ID NO: 925645 - RNA, 13 nt, Homo sapiens
aaguucaugucua

SEQ ID NO: 925646 - RNA, 14 nt, Homo sapiens
aaguuuuugccauu

SEQ ID NO: 925647 - RNA, 12 nt, Homo sapiens
aauaaaacaaca

SEQ ID NO: 925648 - RNA, 21 nt, Homo sapiens
aauaaaacccacaagugucua

SEQ ID NO: 925649 - RNA, 15 nt, Homo sapiens
aauaaaauacauacu

SEQ ID NO: 925650 - RNA, 13 nt, Homo sapiens
aauaaacuauacu

SEQ ID NO: 925651 - RNA, 16 nt, Homo sapiens
aauaaagaacauucua

SEQ ID NO: 925652 - RNA, 21 nt, Homo sapiens
aauaaccuaaaaaucaaucac

SEQ ID NO: 925653 - RNA, 19 nt, Homo sapiens
aauaauaccauaauacaug

SEQ ID NO: 925654 - RNA, 20 nt, Homo sapiens
aauaaucuaaacaccaaaaa

SEQ ID NO: 925655 - RNA, 21 nt, Homo sapiens
aauaaugaauggacucaucuu

SEQ ID NO: 925656 - RNA, 15 nt, Homo sapiens
aauacaaaaagcaaa

SEQ ID NO: 925657 - RNA, 16 nt, Homo sapiens
aauacaauauugcauu

SEQ ID NO: 925658 - RNA, 16 nt, Homo sapiens
aauacacauauuugca

SEQ ID NO: 925659 - RNA, 12 nt, Homo sapiens
aauacauggcua

SEQ ID NO: 925660 - RNA, 16 nt, Homo sapiens
aauacauuaacaagcu

SEQ ID NO: 925661 - RNA, 23 nt, Homo sapiens
aauacauuaacaagcucuuacuu

SEQ ID NO: 925662 - RNA, 13 nt, Homo sapiens
aauaccacuacua

SEQ ID NO: 925663 - RNA, 20 nt, Homo sapiens
aauaccuuggacuuuggaca

SEQ ID NO: 925664 - RNA, 22 nt, Homo sapiens
aaaaagaagaaagacacaaaga

SEQ ID NO: 925665 - RNA, 20 nt, Homo sapiens
aaaaaggaugcauucccuac

SEQ ID NO: 925666 - RNA, 15 nt, Homo sapiens
aaaaaguagagacag

SEQ ID NO: 925667 - RNA, 20 nt, Homo sapiens
aaaaauaguguguccaugca

SEQ ID NO: 925668 - RNA, 12 nt, Homo sapiens
aaaaauauguga

SEQ ID NO: 925669 - RNA, 19 nt, Homo sapiens
aaaaauguauaaugacuuu

SEQ ID NO: 925670 - RNA, 11 nt, Homo sapiens
aaaacacuguc

SEQ ID NO: 925671 - RNA, 20 nt, Homo sapiens
aaaacguaucaccuuuccca

SEQ ID NO: 925672 - RNA, 22 nt, Homo sapiens
aaaagaaauucccuggaccaga

SEQ ID NO: 925673 - RNA, 21 nt, Homo sapiens
aaaauaaucuaaacaccaaaa

SEQ ID NO: 925674 - RNA, 18 nt, Homo sapiens
aaaauacagcacuuugac

SEQ ID NO: 925675 - RNA, 14 nt, Homo sapiens
aaaauacauacuau

SEQ ID NO: 925676 - RNA, 12 nt, Homo sapiens
aaaauacuacac

SEQ ID NO: 925677 - RNA, 15 nt, Homo sapiens
aaaauauaguuugau

SEQ ID NO: 925678 - RNA, 23 nt, Homo sapiens
aaaaucaugcuuauaagcaacau

SEQ ID NO: 925679 - RNA, 17 nt, Homo sapiens
aaaaucauuaacacuuu

SEQ ID NO: 925680 - RNA, 15 nt, Homo sapiens
aaaauggaacauuaa

SEQ ID NO: 925681 - RNA, 20 nt, Homo sapiens
aaaauguaaguugaccuucu

SEQ ID NO: 925682 - RNA, 14 nt, Homo sapiens
aaaauucauuccau

SEQ ID NO: 925683 - RNA, 12 nt, Homo sapiens
aaaauugccaaa

SEQ ID NO: 925684 - RNA, 22 nt, Homo sapiens
aaacaaacuuauucuacugaaa

SEQ ID NO: 925685 - RNA, 15 nt, Homo sapiens
aaacaaccaugucau

SEQ ID NO: 925686 - RNA, 19 nt, Homo sapiens
aaacacuugaagugagaag

SEQ ID NO: 925687 - RNA, 23 nt, Homo sapiens
aaacauuuaucuuuguacguucu

SEQ ID NO: 925688 - RNA, 15 nt, Homo sapiens
aaacccuguccuccc

SEQ ID NO: 925689 - RNA, 16 nt, Homo sapiens
aaaccucugacuugcu

SEQ ID NO: 925690 - RNA, 20 nt, Homo sapiens
aaaccugccccuuggcugcu

SEQ ID NO: 925691 - RNA, 20 nt, Homo sapiens
aaacggaacucuucaucuua

SEQ ID NO: 925692 - RNA, 19 nt, Homo sapiens
aaacggccuauuggcuauu

SEQ ID NO: 925693 - RNA, 19 nt, Homo sapiens
aaacgugagcuacaugugu

SEQ ID NO: 925694 - RNA, 20 nt, Homo sapiens
aaacgugcccucuguuugau

SEQ ID NO: 925695 - RNA, 17 nt, Homo sapiens
acgagaccaugaugcau

SEQ ID NO: 925696 - RNA, 19 nt, Homo sapiens
acgagcugcuguccaggaa

SEQ ID NO: 925697 - RNA, 21 nt, Homo sapiens
acgaggcugggccaagccagg

SEQ ID NO: 925698 - RNA, 21 nt, Homo sapiens
acgagggauguggagcacaaa

SEQ ID NO: 925699 - RNA, 20 nt, Homo sapiens
acgauguuaaaacaaauuaa

SEQ ID NO: 925700 - RNA, 15 nt, Homo sapiens
acgauuucacugaca

SEQ ID NO: 925701 - RNA, 18 nt, Homo sapiens
acgauuuugaacauacuu

SEQ ID NO: 925702 - RNA, 22 nt, Homo sapiens
acgcgugauugguaacugccug

SEQ ID NO: 925703 - RNA, 13 nt, Homo sapiens
acgcugccuuaau

SEQ ID NO: 925704 - RNA, 12 nt, Homo sapiens
acggaacacugu

SEQ ID NO: 925705 - RNA, 13 nt, Homo sapiens
acggaauuccaau

SEQ ID NO: 925706 - RNA, 16 nt, Homo sapiens
acggagucucagucug

SEQ ID NO: 925707 - RNA, 20 nt, Homo sapiens
acggagucucagucugucac

SEQ ID NO: 925708 - RNA, 12 nt, Homo sapiens
acggccacugca

SEQ ID NO: 925709 - RNA, 21 nt, Homo sapiens
acgggaguggccaucuggaaa

SEQ ID NO: 925710 - RNA, 20 nt, Homo sapiens
acgguggugcaugccuguaa

SEQ ID NO: 925711 - RNA, 13 nt, Homo sapiens
acguauacaauaa

SEQ ID NO: 925712 - RNA, 23 nt, Homo sapiens
acgugcaauacggaacacuguca

SEQ ID NO: 925713 - RNA, 23 nt, Homo sapiens
acguguaacuugugcuuuugcaa

SEQ ID NO: 925714 - RNA, 12 nt, Homo sapiens
acgugugaggau

SEQ ID NO: 925715 - RNA, 17 nt, Homo sapiens
acuaauaggaccucaaa

SEQ ID NO: 925716 - RNA, 16 nt, Homo sapiens
acuaauuuuaaaguaa

SEQ ID NO: 925717 - RNA, 13 nt, Homo sapiens
acuacacauccaa

SEQ ID NO: 925718 - RNA, 10 nt, Homo sapiens
acuacagggu

SEQ ID NO: 925719 - RNA, 21 nt, Homo sapiens
acuacgggcugcucuacugcu

SEQ ID NO: 925720 - RNA, 14 nt, Homo sapiens
acuacuauuccuuu

SEQ ID NO: 925721 - RNA, 16 nt, Homo sapiens
acuaucaacacugcag

SEQ ID NO: 925722 - RNA, 15 nt, Homo sapiens
acuauucaugagaau

SEQ ID NO: 925723 - RNA, 16 nt, Homo sapiens
acucagcuauaccuca

SEQ ID NO: 925724 - RNA, 14 nt, Homo sapiens
acucauccauuaau

SEQ ID NO: 925725 - RNA, 13 nt, Homo sapiens
acuccaaccagaa

SEQ ID NO: 925726 - RNA, 18 nt, Homo sapiens
acuccaaccagaagugaa

SEQ ID NO: 925727 - RNA, 16 nt, Homo sapiens
acuccaagccaaauac

SEQ ID NO: 925728 - RNA, 21 nt, Homo sapiens
acuccaagccaaauacauucu

SEQ ID NO: 925729 - RNA, 18 nt, Homo sapiens
acucccaaagagcugccu

SEQ ID NO: 925730 - RNA, 13 nt, Homo sapiens
acuccgcaaauau

SEQ ID NO: 925731 - RNA, 17 nt, Homo sapiens
acuccuggagauuucag

SEQ ID NO: 925732 - RNA, 16 nt, Homo sapiens
acuccuuccucuuugc

SEQ ID NO: 925733 - RNA, 12 nt, Homo sapiens
acuccuugccau

SEQ ID NO: 925734 - RNA, 18 nt, Homo sapiens
acucugagugaauacuuu

SEQ ID NO: 925735 - RNA, 14 nt, Homo sapiens
acucuuccuggaau

SEQ ID NO: 925736 - RNA, 19 nt, Homo sapiens
acucuuccuggaaugcauu

SEQ ID NO: 925737 - RNA, 13 nt, Homo sapiens
acucuuuguauga

SEQ ID NO: 925738 - RNA, 19 nt, Homo sapiens
acugaggagcaaagcagca

SEQ ID NO: 925739 - RNA, 17 nt, Homo sapiens
acugauaaaaaugauau

SEQ ID NO: 925740 - RNA, 15 nt, Homo sapiens
acugauaaaccaaaa

SEQ ID NO: 925741 - RNA, 19 nt, Homo sapiens
acugauuauugaguucuga

SEQ ID NO: 925742 - RNA, 13 nt, Homo sapiens
acugcaaccucca

SEQ ID NO: 925743 - RNA, 14 nt, Homo sapiens
acugcaccuuguga

SEQ ID NO: 925744 - RNA, 17 nt, Homo sapiens
acugccuggccuggcac

SEQ ID NO: 925745 - RNA, 18 nt, Homo sapiens
acuggcuuugucccacag

SEQ ID NO: 925746 - RNA, 20 nt, Homo sapiens
acuggcuuugucccacagcu

SEQ ID NO: 925747 - RNA, 22 nt, Homo sapiens
acugguuuguaugauguauuag

SEQ ID NO: 925748 - RNA, 18 nt, Homo sapiens
acuguauuugaaauaaga

SEQ ID NO: 925749 - RNA, 19 nt, Homo sapiens
acugucagaauaaagaaca

SEQ ID NO: 925750 - RNA, 17 nt, Homo sapiens
acugugaccuaagaaca

SEQ ID NO: 925751 - RNA, 20 nt, Homo sapiens
acuguggagguggcugguca

SEQ ID NO: 925752 - RNA, 17 nt, Homo sapiens
acuguggcucuugccuu

SEQ ID NO: 925753 - RNA, 14 nt, Homo sapiens
acuuacagugccaa

SEQ ID NO: 925754 - RNA, 22 nt, Homo sapiens
acuuagugcuguuuuuaaucca

SEQ ID NO: 925755 - RNA, 21 nt, Homo sapiens
acuuauauuaaauaaaugugc

SEQ ID NO: 925756 - RNA, 12 nt, Homo sapiens
acuucacacagc

SEQ ID NO: 925757 - RNA, 16 nt, Homo sapiens
acuucacacagcaccu

SEQ ID NO: 925758 - RNA, 22 nt, Homo sapiens
acuucaguggugagacuguauc

SEQ ID NO: 925759 - RNA, 13 nt, Homo sapiens
acuucauauuaau

SEQ ID NO: 925760 - RNA, 19 nt, Homo sapiens
acuuccaagaccugacuca

SEQ ID NO: 925761 - RNA, 21 nt, Homo sapiens
acuucccccuaaccccuauga

SEQ ID NO: 925762 - RNA, 21 nt, Homo sapiens
acuucugggaaccguaauuga

SEQ ID NO: 925763 - RNA, 15 nt, Homo sapiens
acuugaagugagaag

SEQ ID NO: 925764 - RNA, 21 nt, Homo sapiens
acuugaauacuuugaguaaac

SEQ ID NO: 925765 - RNA, 20 nt, Homo sapiens
acuuggauugggagauuuca

SEQ ID NO: 925766 - RNA, 20 nt, Homo sapiens
acuugugccucuugggagac

SEQ ID NO: 925767 - RNA, 23 nt, Homo sapiens
acuuuagggcuaaccaguucucu

SEQ ID NO: 925768 - RNA, 14 nt, Homo sapiens
acuuuccagcagua

SEQ ID NO: 925769 - RNA, 18 nt, Homo sapiens
acuuuccuuccucauuuc

SEQ ID NO: 925770 - RNA, 18 nt, Homo sapiens
acuuugacacaaggugua

SEQ ID NO: 925771 - RNA, 14 nt, Homo sapiens
acuuuguacauuug

SEQ ID NO: 925772 - RNA, 15 nt, Homo sapiens
acuuuugcuuucuac

SEQ ID NO: 925773 - RNA, 18 nt, Homo sapiens
agaaaaaagacccuauca

SEQ ID NO: 925774 - RNA, 16 nt, Homo sapiens
agaaaaaggaugcauu

SEQ ID NO: 925775 - RNA, 15 nt, Homo sapiens
agaaaacacauuucu

SEQ ID NO: 925776 - RNA, 20 nt, Homo sapiens
agaaaacauugacuguggcu

SEQ ID NO: 925777 - RNA, 16 nt, Homo sapiens
agaaaaugugccauuu

SEQ ID NO: 925778 - RNA, 13 nt, Homo sapiens
agaaaauugccaa

SEQ ID NO: 925779 - RNA, 16 nt, Homo sapiens
agaaaauugccaaaau

SEQ ID NO: 925780 - RNA, 24 nt, Homo sapiens
agaaaccccaagaaauuugcaacu

SEQ ID NO: 925781 - RNA, 18 nt, Homo sapiens
agaaauaauugugucaug

SEQ ID NO: 925782 - RNA, 21 nt, Homo sapiens
agaaauugauugaacguucuc

SEQ ID NO: 925783 - RNA, 12 nt, Homo sapiens
agaaauuugcaa

SEQ ID NO: 925784 - RNA, 14 nt, Homo sapiens
agaacaaaaccucu

SEQ ID NO: 925785 - RNA, 22 nt, Homo sapiens
agaacauguuacgugugcaaca

SEQ ID NO: 925786 - RNA, 12 nt, Homo sapiens
agaaccaugaau

SEQ ID NO: 925787 - RNA, 21 nt, Homo sapiens
agaacugccauaaaaucucac

SEQ ID NO: 925788 - RNA, 15 nt, Homo sapiens
agaacuugaagugaa

SEQ ID NO: 925789 - RNA, 17 nt, Homo sapiens
agaagaaagacacaaag

SEQ ID NO: 925790 - RNA, 21 nt, Homo sapiens
agaagcaguggccuuauugca

SEQ ID NO: 925791 - RNA, 18 nt, Homo sapiens
agaagugggagugggaga

SEQ ID NO: 925792 - RNA, 18 nt, Homo sapiens
agaauacuaauaaaauac

SEQ ID NO: 925793 - RNA, 14 nt, Homo sapiens
agaaucaagucugu

SEQ ID NO: 925794 - RNA, 16 nt, Homo sapiens
agaaugacccugucaa

SEQ ID NO: 925795 - RNA, 15 nt, Homo sapiens
agaaugcauugcauc

SEQ ID NO: 925796 - RNA, 19 nt, Homo sapiens
agaauggagcuauggacgu

SEQ ID NO: 925797 - RNA, 14 nt, Homo sapiens
agaauuucaauauc

SEQ ID NO: 925798 - RNA, 21 nt, Homo sapiens
agaauuuugggacauuugcau

SEQ ID NO: 925799 - RNA, 15 nt, Homo sapiens
agacaguuuuccaaa

SEQ ID NO: 925800 - RNA, 19 nt, Homo sapiens
agacaucuggacacugggc

SEQ ID NO: 925801 - RNA, 12 nt, Homo sapiens
agacccuaucau

SEQ ID NO: 925802 - RNA, 15 nt, Homo sapiens
agaccuugauugcac

SEQ ID NO: 925803 - RNA, 20 nt, Homo sapiens
agacuggcauagcuggacau

SEQ ID NO: 925804 - RNA, 13 nt, Homo sapiens
agacuuugcccag

SEQ ID NO: 925805 - RNA, 21 nt, Homo sapiens
agacuuuugugacccacuaau

SEQ ID NO: 925806 - RNA, 19 nt, Homo sapiens
agagcagccuggcuaacau

SEQ ID NO: 925807 - RNA, 20 nt, Homo sapiens
agagcgagauucugccucaa

SEQ ID NO: 925808 - RNA, 13 nt, Homo sapiens
agaggaagccacg

SEQ ID NO: 925809 - RNA, 13 nt, Homo sapiens
agaggagcagggu

SEQ ID NO: 925810 - RNA, 19 nt, Homo sapiens
agaggauucugucuuccag

SEQ ID NO: 925811 - RNA, 20 nt, Homo sapiens
agaggcagaacccuggugag

SEQ ID NO: 925812 - RNA, 18 nt, Homo sapiens
agagugccccaccugcca

SEQ ID NO: 925813 - RNA, 18 nt, Homo sapiens
agaucagaacauucagcu

SEQ ID NO: 925814 - RNA, 13 nt, Homo sapiens
agauccuacccca

SEQ ID NO: 925815 - RNA, 12 nt, Homo sapiens
agaucuaccccu

SEQ ID NO: 925816 - RNA, 14 nt, Homo sapiens
agaucuccaaagcu

SEQ ID NO: 925817 - RNA, 19 nt, Homo sapiens
agaucugcagucacuucgu

SEQ ID NO: 925818 - RNA, 18 nt, Homo sapiens
uacuuugaguaaacuuac

SEQ ID NO: 925819 - RNA, 18 nt, Homo sapiens
uacuuugguccucugauu

SEQ ID NO: 925820 - RNA, 20 nt, Homo sapiens
uacuuuugcuuucuaccuga

SEQ ID NO: 925821 - RNA, 14 nt, Homo sapiens
uagaaaaaggagcu

SEQ ID NO: 925822 - RNA, 17 nt, Homo sapiens
uagaaaacgauuuugaa

SEQ ID NO: 925823 - RNA, 14 nt, Homo sapiens
uagaaaccaugaaa

SEQ ID NO: 925824 - RNA, 13 nt, Homo sapiens
uagaaccaugaau

SEQ ID NO: 925825 - RNA, 22 nt, Homo sapiens
uagaauacuaauaaaauacaua

SEQ ID NO: 925826 - RNA, 15 nt, Homo sapiens
uagaauuuagcuuau

SEQ ID NO: 925827 - RNA, 20 nt, Homo sapiens
uagacaucccccuccuugcc

SEQ ID NO: 925828 - RNA, 16 nt, Homo sapiens
uagacugaagugccag

SEQ ID NO: 925829 - RNA, 20 nt, Homo sapiens
uagagaaaauggaacauuaa

SEQ ID NO: 925830 - RNA, 22 nt, Homo sapiens
uagagacggggcuucaccaucu

SEQ ID NO: 925831 - RNA, 18 nt, Homo sapiens
uagauauuguuuugugac

SEQ ID NO: 925832 - RNA, 19 nt, Homo sapiens
uagauauuguuuugugacu

SEQ ID NO: 925833 - RNA, 14 nt, Homo sapiens
uagauugacaucua

SEQ ID NO: 925834 - RNA, 17 nt, Homo sapiens
uagcacauagaugucug

SEQ ID NO: 925835 - RNA, 14 nt, Homo sapiens
uagcauuccaucaa

SEQ ID NO: 925836 - RNA, 12 nt, Homo sapiens
uagccacuggaa

SEQ ID NO: 925837 - RNA, 20 nt, Homo sapiens
uagcucgugacuacauugaa

SEQ ID NO: 925838 - RNA, 19 nt, Homo sapiens
uagcugagacuacagguga

SEQ ID NO: 925839 - RNA, 19 nt, Homo sapiens
uagcuuacaggaagcuuuu

SEQ ID NO: 925840 - RNA, 17 nt, Homo sapiens
uagcuuguuccacugca

SEQ ID NO: 925841 - RNA, 23 nt, Homo sapiens
uaggaaacuuuuuccaccuuucu

SEQ ID NO: 925842 - RNA, 19 nt, Homo sapiens
uaggcaccaccucugucac

SEQ ID NO: 925843 - RNA, 16 nt, Homo sapiens
uaggcugggcccagag

SEQ ID NO: 925844 - RNA, 14 nt, Homo sapiens
uagguagacacaaa

SEQ ID NO: 925845 - RNA, 18 nt, Homo sapiens
uaggugcccgaguagcau

SEQ ID NO: 925846 - RNA, 18 nt, Homo sapiens
uagguuaacauuuguaau

SEQ ID NO: 925847 - RNA, 15 nt, Homo sapiens
uaguacccaccugag

SEQ ID NO: 925848 - RNA, 12 nt, Homo sapiens
uauaagcauuua

SEQ ID NO: 925849 - RNA, 22 nt, Homo sapiens
uauaauuaaagaaaauugccaa

SEQ ID NO: 925850 - RNA, 18 nt, Homo sapiens
uauauaauuuuauugcug

SEQ ID NO: 925851 - RNA, 13 nt, Homo sapiens
uauauuaccaaug

SEQ ID NO: 925852 - RNA, 15 nt, Homo sapiens
uauauucauaccugu

SEQ ID NO: 925853 - RNA, 15 nt, Homo sapiens
uaucaaaaugguuua

SEQ ID NO: 925854 - RNA, 14 nt, Homo sapiens
uaucaacacugcag

SEQ ID NO: 925855 - RNA, 19 nt, Homo sapiens
uaucaaggugcuuuuggca

SEQ ID NO: 925856 - RNA, 17 nt, Homo sapiens
uaucaccauuacuuuuu

SEQ ID NO: 925857 - RNA, 17 nt, Homo sapiens
uauccacaacuuuucaa

SEQ ID NO: 925858 - RNA, 13 nt, Homo sapiens
uauccuguucuca

SEQ ID NO: 925859 - RNA, 17 nt, Homo sapiens
uaucugaaccuacugag

SEQ ID NO: 925860 - RNA, 16 nt, Homo sapiens
uaucuguuugcuucua

SEQ ID NO: 925861 - RNA, 21 nt, Homo sapiens
uaugagugcaagcaaagcaga

SEQ ID NO: 925862 - RNA, 22 nt, Homo sapiens
uaugagugcaagcaaagcagaa

SEQ ID NO: 925863 - RNA, 12 nt, Homo sapiens
uaugcacuaauc

SEQ ID NO: 925864 - RNA, 20 nt, Homo sapiens
uaugccuauauuuuuccuca

SEQ ID NO: 925865 - RNA, 14 nt, Homo sapiens
uaugccuuauguaa

SEQ ID NO: 925866 - RNA, 16 nt, Homo sapiens
uaugcggucuagggaa

SEQ ID NO: 925867 - RNA, 23 nt, Homo sapiens
uaugcugugaauuuuacaaaaau

SEQ ID NO: 925868 - RNA, 19 nt, Homo sapiens
uauggaucccaauucauuu

SEQ ID NO: 925869 - RNA, 14 nt, Homo sapiens
uauggauuuggacu

SEQ ID NO: 925870 - RNA, 15 nt, Homo sapiens
uauguagauugccuu

SEQ ID NO: 925871 - RNA, 20 nt, Homo sapiens
uauguggugguuucuauaca

SEQ ID NO: 925872 - RNA, 20 nt, Homo sapiens
uauguucuccccuacauuag

SEQ ID NO: 925873 - RNA, 16 nt, Homo sapiens
uauuaaaccuuuccau

SEQ ID NO: 925874 - RNA, 18 nt, Homo sapiens
uauuaaaccuuuccauuu

SEQ ID NO: 925875 - RNA, 20 nt, Homo sapiens
uauuaaauaaaugugcaugc

SEQ ID NO: 925876 - RNA, 20 nt, Homo sapiens
uauuauuccagaucugcagu

SEQ ID NO: 925877 - RNA, 21 nt, Homo sapiens
uauucaauuugauucuaugac

SEQ ID NO: 925878 - RNA, 16 nt, Homo sapiens
uauucaguaguggaaa

SEQ ID NO: 925879 - RNA, 13 nt, Homo sapiens
uauuccugauaug

SEQ ID NO: 925880 - RNA, 22 nt, Homo sapiens
uauuggcugauuuagaccaaaa

SEQ ID NO: 925881 - RNA, 16 nt, Homo sapiens
uauuuaaaugcaaagu

SEQ ID NO: 925882 - RNA, 20 nt, Homo sapiens
uauuuacuguacuaauuaga

SEQ ID NO: 925883 - RNA, 20 nt, Homo sapiens
uauuugcacaaguacaguaa

SEQ ID NO: 925884 - RNA, 21 nt, Homo sapiens
uauuugccaagaccauuucac

SEQ ID NO: 925885 - RNA, 21 nt, Homo sapiens
uauuugucuccaugauaccac

SEQ ID NO: 925886 - RNA, 19 nt, Homo sapiens
uauuuguguaaaguaugca

SEQ ID NO: 925887 - RNA, 24 nt, Homo sapiens
uauuuuaaaauuucacucuggcau

SEQ ID NO: 925888 - RNA, 13 nt, Homo sapiens
uauuuucccaugc

SEQ ID NO: 925889 - RNA, 15 nt, Homo sapiens
uauuuuuauuugaua

SEQ ID NO: 925890 - RNA, 23 nt, Homo sapiens
ucaaaacagaagggcaaauggaa

SEQ ID NO: 925891 - RNA, 22 nt, Homo sapiens
ucaaaauuuucuaacaacuuua

SEQ ID NO: 925892 - RNA, 18 nt, Homo sapiens
ucaaaucuguaauuacca

SEQ ID NO: 925893 - RNA, 18 nt, Homo sapiens
ucaaauuuuuuguagaca

SEQ ID NO: 925894 - RNA, 18 nt, Homo sapiens
ucaacauggaaaaauccu

SEQ ID NO: 925895 - RNA, 17 nt, Homo sapiens
ucaaccgaugguccuca

SEQ ID NO: 925896 - RNA, 17 nt, Homo sapiens
ucaagaacugccauaaa

SEQ ID NO: 925897 - RNA, 14 nt, Homo sapiens
ucaagauacacuug

SEQ ID NO: 925898 - RNA, 21 nt, Homo sapiens
ucaagcaauccuccugaguga

SEQ ID NO: 925899 - RNA, 20 nt, Homo sapiens
ucaagcuuucaaauccuccc

SEQ ID NO: 925900 - RNA, 22 nt, Homo sapiens
ucaagugcaccuacaccaacug

SEQ ID NO: 925901 - RNA, 19 nt, Homo sapiens
ucaauaaaguacugcaaaa

SEQ ID NO: 925902 - RNA, 17 nt, Homo sapiens
ucaauacaaaaagccaa

SEQ ID NO: 925903 - RNA, 13 nt, Homo sapiens
ucaauaugguguc

SEQ ID NO: 925904 - RNA, 22 nt, Homo sapiens
ucaauuuucuucacacuaucaa

SEQ ID NO: 925905 - RNA, 20 nt, Homo sapiens
ucaauuuuuuuucugaacaa

SEQ ID NO: 925906 - RNA, 12 nt, Homo sapiens
ucacaauuucag

SEQ ID NO: 925907 - RNA, 11 nt, Homo sapiens
ucacacuuugc

SEQ ID NO: 925908 - RNA, 14 nt, Homo sapiens
ucacacuuugccau

SEQ ID NO: 925909 - RNA, 16 nt, Homo sapiens
ucacauccccaaaggu

SEQ ID NO: 925910 - RNA, 18 nt, Homo sapiens
ucacaugcuggacagguc

SEQ ID NO: 925911 - RNA, 21 nt, Homo sapiens
ucaccaaccaaagggggacag

SEQ ID NO: 925912 - RNA, 21 nt, Homo sapiens
ucaccaaggaaauauugagag

SEQ ID NO: 925913 - RNA, 12 nt, Homo sapiens
ucacccaugaaa

SEQ ID NO: 925914 - RNA, 18 nt, Homo sapiens
ucacgaggugucucucac

SEQ ID NO: 925915 - RNA, 13 nt, Homo sapiens
ucacugcacucca

SEQ ID NO: 925916 - RNA, 20 nt, Homo sapiens
ucagaaguuaguuuguauau

SEQ ID NO: 925917 - RNA, 19 nt, Homo sapiens
ucagaauaaagaacauucu

SEQ ID NO: 925918 - RNA, 16 nt, Homo sapiens
ucagacaaauuacuga

SEQ ID NO: 925919 - RNA, 15 nt, Homo sapiens
ucagaccuucuucca

SEQ ID NO: 925920 - RNA, 15 nt, Homo sapiens
ucagcaaaaguuaau

SEQ ID NO: 925921 - RNA, 16 nt, Homo sapiens
ucagcaccaugggccu

SEQ ID NO: 925922 - RNA, 16 nt, Homo sapiens
ucagcacccaacugag

SEQ ID NO: 925923 - RNA, 22 nt, Homo sapiens
ucagcagucuaguucuuuucau

SEQ ID NO: 925924 - RNA, 23 nt, Homo sapiens
ucagccacaugggaaacuuccaa

SEQ ID NO: 925925 - RNA, 15 nt, Homo sapiens
ucagcgagugcuugg

SEQ ID NO: 925926 - RNA, 19 nt, Homo sapiens
ucagcuggcggaaccuggc

SEQ ID NO: 925927 - RNA, 20 nt, Homo sapiens
ucagcuucaaauaaaguaaa

SEQ ID NO: 925928 - RNA, 15 nt, Homo sapiens
ucaggacgccuggag

SEQ ID NO: 925929 - RNA, 19 nt, Homo sapiens
ucaggaggagauuaacaca

SEQ ID NO: 925930 - RNA, 19 nt, Homo sapiens
ucaggaggccguugcagac

SEQ ID NO: 925931 - RNA, 17 nt, Homo sapiens
ucaggauaaaguuugcu

SEQ ID NO: 925932 - RNA, 13 nt, Homo sapiens
ucaggcacaguaa

SEQ ID NO: 925933 - RNA, 17 nt, Homo sapiens
ucaguaaauuuuggaaa

SEQ ID NO: 925934 - RNA, 21 nt, Homo sapiens
ucaguaagaccggaagcuccu

SEQ ID NO: 925935 - RNA, 15 nt, Homo sapiens
ucaguaauagcugaa

SEQ ID NO: 925936 - RNA, 21 nt, Homo sapiens
ucaguaauagcugaaccuguu

SEQ ID NO: 925937 - RNA, 16 nt, Homo sapiens
ucagugacuccugcug

SEQ ID NO: 925938 - RNA, 20 nt, Homo sapiens
ucagugccuucaacaacgug

SEQ ID NO: 925939 - RNA, 21 nt, Homo sapiens
ucaguggcucacaccuguaau

SEQ ID NO: 925940 - RNA, 21 nt, Homo sapiens
uguucugguagcuccacaaga

SEQ ID NO: 925941 - RNA, 12 nt, Homo sapiens
uguugguugaga

SEQ ID NO: 925942 - RNA, 15 nt, Homo sapiens
uguuuaaaaugucau

SEQ ID NO: 925943 - RNA, 17 nt, Homo sapiens
uguuucguagccauauu

SEQ ID NO: 925944 - RNA, 21 nt, Homo sapiens
uguuucuugggaaaauaucac

SEQ ID NO: 925945 - RNA, 17 nt, Homo sapiens
uguuugcuacaaauagu

SEQ ID NO: 925946 - RNA, 23 nt, Homo sapiens
uguuuggugacauaaugccaagg

SEQ ID NO: 925947 - RNA, 20 nt, Homo sapiens
uguuuuacaucuuuugggaa

SEQ ID NO: 925948 - RNA, 16 nt, Homo sapiens
uguuuugugacuuuua

SEQ ID NO: 925949 - RNA, 17 nt, Homo sapiens
uguuuuuacaguggaau

SEQ ID NO: 925950 - RNA, 15 nt, Homo sapiens
uuaaaaugucauuug

SEQ ID NO: 925951 - RNA, 21 nt, Homo sapiens
uuaaaccgugauucuugaaag

SEQ ID NO: 925952 - RNA, 11 nt, Homo sapiens
uuaaagcauuu

SEQ ID NO: 925953 - RNA, 13 nt, Homo sapiens
uuaacaagcucuu

SEQ ID NO: 925954 - RNA, 19 nt, Homo sapiens
uuaacaguuguauuuaaca

SEQ ID NO: 925955 - RNA, 19 nt, Homo sapiens
uuaagaaaaacaugucaug

SEQ ID NO: 925956 - RNA, 19 nt, Homo sapiens
uuaagaaacaaaagugcau

SEQ ID NO: 925957 - RNA, 18 nt, Homo sapiens
uuaagcaauucauucucu

SEQ ID NO: 925958 - RNA, 16 nt, Homo sapiens
uuaaggggguguaaug

SEQ ID NO: 925959 - RNA, 13 nt, Homo sapiens
uuaauccaguuua

SEQ ID NO: 925960 - RNA, 14 nt, Homo sapiens
uuaauuaguaucga

SEQ ID NO: 925961 - RNA, 21 nt, Homo sapiens
uuacaagacggggagugagac

SEQ ID NO: 925962 - RNA, 14 nt, Homo sapiens
uuacaauaggauuu

SEQ ID NO: 925963 - RNA, 15 nt, Homo sapiens
uuacacacgugugau

SEQ ID NO: 925964 - RNA, 20 nt, Homo sapiens
uuacacacgugugauguaug

SEQ ID NO: 925965 - RNA, 18 nt, Homo sapiens
uuacaggugacugccacc

SEQ ID NO: 925966 - RNA, 17 nt, Homo sapiens
uuacauauuaaauaugu

SEQ ID NO: 925967 - RNA, 13 nt, Homo sapiens
uuacccuuaggga

SEQ ID NO: 925968 - RNA, 21 nt, Homo sapiens
uuacccuucugugcccagcuc

SEQ ID NO: 925969 - RNA, 19 nt, Homo sapiens
uuacgcugccuuaauguaa

SEQ ID NO: 925970 - RNA, 13 nt, Homo sapiens
uuacuagugccaa

SEQ ID NO: 925971 - RNA, 17 nt, Homo sapiens
uuagaagacagccuaca

SEQ ID NO: 925972 - RNA, 20 nt, Homo sapiens
uuagauuuuguauucagggg

SEQ ID NO: 925973 - RNA, 12 nt, Homo sapiens
uuagccccauga

SEQ ID NO: 925974 - RNA, 15 nt, Homo sapiens
uuagcuuguuccacu

SEQ ID NO: 925975 - RNA, 15 nt, Homo sapiens
uuaguaauaaaaccc

SEQ ID NO: 925976 - RNA, 17 nt, Homo sapiens
uuaguuuaaaaagaaau

SEQ ID NO: 925977 - RNA, 13 nt, Homo sapiens
uuauaauuaaaga

SEQ ID NO: 925978 - RNA, 20 nt, Homo sapiens
uuauaauuguucucagaauc

SEQ ID NO: 925979 - RNA, 14 nt, Homo sapiens
uuauacauggguag

SEQ ID NO: 925980 - RNA, 17 nt, Homo sapiens
uuauacuagguuaacau

SEQ ID NO: 925981 - RNA, 14 nt, Homo sapiens
uuaucaauaguucc

SEQ ID NO: 925982 - RNA, 17 nt, Homo sapiens
uuaucuuguacagccuu

SEQ ID NO: 925983 - RNA, 13 nt, Homo sapiens
uuaugaacuacag

SEQ ID NO: 925984 - RNA, 15 nt, Homo sapiens
uuauguaacuaucaa

SEQ ID NO: 925985 - RNA, 13 nt, Homo sapiens
uuauguacucuac

SEQ ID NO: 925986 - RNA, 20 nt, Homo sapiens
uuauuaacauauauuguuau

SEQ ID NO: 925987 - RNA, 17 nt, Homo sapiens
uuauucauucagugaga

SEQ ID NO: 925988 - RNA, 14 nt, Homo sapiens
uuauuggacuucca

SEQ ID NO: 925989 - RNA, 13 nt, Homo sapiens
uuauuuccaugga

SEQ ID NO: 925990 - RNA, 15 nt, Homo sapiens
uuauuuccauggauu

SEQ ID NO: 925991 - RNA, 21 nt, Homo sapiens
uuauuucugcugcuuggcaca

SEQ ID NO: 925992 - RNA, 18 nt, Homo sapiens
uuauuugaaaauuugcug

SEQ ID NO: 925993 - RNA, 14 nt, Homo sapiens
uuauuuuggaucua

SEQ ID NO: 925994 - RNA, 22 nt, Homo sapiens
uucaaaguuuaagcaauucauu

SEQ ID NO: 925995 - RNA, 15 nt, Homo sapiens
uucaaauccugccac

SEQ ID NO: 925996 - RNA, 16 nt, Homo sapiens
uucaagaaacaaccuu

SEQ ID NO: 925997 - RNA, 18 nt, Homo sapiens
uucaagaaagcauugcca

SEQ ID NO: 925998 - RNA, 16 nt, Homo sapiens
uucaagauuaaacuga

SEQ ID NO: 925999 - RNA, 18 nt, Homo sapiens
uucaagauuaaacugagu

SEQ ID NO: 926000 - RNA, 18 nt, Homo sapiens
uucaagcuuucaaauccu

SEQ ID NO: 926001 - RNA, 20 nt, Homo sapiens
uucaauaaaguacugcaaaa

SEQ ID NO: 926002 - RNA, 17 nt, Homo sapiens
uucaauaucaagacuga

SEQ ID NO: 926003 - RNA, 22 nt, Homo sapiens
uucaauuuacagguaccaguac

SEQ ID NO: 926004 - RNA, 21 nt, Homo sapiens
uucacaccuagcgucaguauu

SEQ ID NO: 926005 - RNA, 11 nt, Homo sapiens
uucacugugag

SEQ ID NO: 926006 - RNA, 19 nt, Homo sapiens
uucagaauauauugaauag

SEQ ID NO: 926007 - RNA, 23 nt, Homo sapiens
uucagaauauauugaauaggcau

SEQ ID NO: 926008 - RNA, 18 nt, Homo sapiens
uucagacaaauuacugau

SEQ ID NO: 926009 - RNA, 16 nt, Homo sapiens
uucagauacuugugaa

SEQ ID NO: 926010 - RNA, 17 nt, Homo sapiens
uucagauugacaaggua

SEQ ID NO: 926011 - RNA, 22 nt, Homo sapiens
uucaucgcaguggacugugucc

SEQ ID NO: 926012 - RNA, 14 nt, Homo sapiens
uucaucuacuacag

SEQ ID NO: 926013 - RNA, 20 nt, Homo sapiens
uucaugagucuuguaauuaa

SEQ ID NO: 926014 - RNA, 15 nt, Homo sapiens
uucauucccucccca

SEQ ID NO: 926015 - RNA, 15 nt, Homo sapiens
uuccaaacuguguca

SEQ ID NO: 926016 - RNA, 22 nt, Homo sapiens
uuccaaauucaguaaauuuugg

SEQ ID NO: 926017 - RNA, 12 nt, Homo sapiens
uuccacaccccu

SEQ ID NO: 926018 - RNA, 14 nt, Homo sapiens
uuccagguucuggu

SEQ ID NO: 926019 - RNA, 15 nt, Homo sapiens
uuccaguauccugaa

SEQ ID NO: 926020 - RNA, 18 nt, Homo sapiens
uuccauguggcugacuag

SEQ ID NO: 926021 - RNA, 21 nt, Homo sapiens
uucccaaauacauuaacaagc

SEQ ID NO: 926022 - RNA, 21 nt, Homo sapiens
uucccaacacuucagacugca

SEQ ID NO: 926023 - RNA, 23 nt, Homo sapiens
uucccaucaccaucaccaccacc

SEQ ID NO: 926024 - RNA, 12 nt, Homo sapiens
uucccuguuaua

SEQ ID NO: 926025 - RNA, 21 nt, Homo sapiens
uucccuucuccuuccaacugc

SEQ ID NO: 926026 - RNA, 18 nt, Homo sapiens
uuccgcuuugaaagaagc

SEQ ID NO: 926027 - RNA, 18 nt, Homo sapiens
uuccuggggaaaagaagc

SEQ ID NO: 926028 - RNA, 18 nt, Homo sapiens
uuccuuccaagucuuccu

SEQ ID NO: 926029 - RNA, 18 nt, Homo sapiens
uucgcagugcccagugau

SEQ ID NO: 926030 - RNA, 19 nt, Homo sapiens
uucgcagugcccagugaug

SEQ ID NO: 926031 - RNA, 18 nt, Homo sapiens
uucuagugauuucugggg

SEQ ID NO: 926032 - RNA, 16 nt, Homo sapiens
uucuccaggaugucaa

SEQ ID NO: 926033 - RNA, 20 nt, Homo sapiens
uucuccuucgcuuuccugag

SEQ ID NO: 926034 - RNA, 22 nt, Homo sapiens
uucucuagggaaggccaccugc

SEQ ID NO: 926035 - RNA, 13 nt, Homo sapiens
uucugaguagcau

SEQ ID NO: 926036 - RNA, 16 nt, Homo sapiens
uucugauuucucuuca

SEQ ID NO: 926037 - RNA, 16 nt, Homo sapiens
uucugcccauucucuc

SEQ ID NO: 926038 - RNA, 17 nt, Homo sapiens
uucuguauuaacugaau

SEQ ID NO: 926039 - RNA, 23 nt, Homo sapiens
uucuucacacuaucaacacugca

SEQ ID NO: 926040 - RNA, 14 nt, Homo sapiens
uucuucaccuguaa

SEQ ID NO: 926041 - RNA, 19 nt, Homo sapiens
uucuucaggguccugagau

SEQ ID NO: 926042 - RNA, 18 nt, Homo sapiens
uucuucccucauguucuc

SEQ ID NO: 926043 - RNA, 22 nt, Homo sapiens
uucuuccucacaaaaccauauc

SEQ ID NO: 926044 - RNA, 19 nt, Homo sapiens
uucuucucaagcacugaca

SEQ ID NO: 926045 - RNA, 13 nt, Homo sapiens
uucuucuucucaa

SEQ ID NO: 926046 - RNA, 21 nt, Homo sapiens
uucuucuuugacuauaacaaa

SEQ ID NO: 926047 - RNA, 16 nt, Homo sapiens
uucuuguaaaccugga

SEQ ID NO: 926048 - RNA, 15 nt, Homo sapiens
uucuuuccaugcagu

SEQ ID NO: 926049 - RNA, 21 nt, Homo sapiens
uucuuuuggaaaguacuauga

SEQ ID NO: 926050 - RNA, 21 nt, Homo sapiens
uugaaacuugguucccagaaa

SEQ ID NO: 926051 - RNA, 16 nt, Homo sapiens
uugaaauaagaauuca

SEQ ID NO: 926052 - RNA, 13 nt, Homo sapiens
uugaacauuugca

SEQ ID NO: 926053 - RNA, 15 nt, Homo sapiens
uugaacuccuagacu

SEQ ID NO: 926054 - RNA, 17 nt, Homo sapiens
uugaacuccuagacuca

SEQ ID NO: 926055 - RNA, 14 nt, Homo sapiens
uugaauaauguagu

SEQ ID NO: 926056 - RNA, 20 nt, Homo sapiens
uugaauaggcauuaaaugca

SEQ ID NO: 926057 - RNA, 15 nt, Homo sapiens
uugacugugauuuau

SEQ ID NO: 926058 - RNA, 13 nt, Homo sapiens
uugagacagaguc

SEQ ID NO: 926059 - RNA, 11 nt, Homo sapiens
uugagauuacg

SEQ ID NO: 926060 - RNA, 15 nt, Homo sapiens
uugagcgagcccauu

SEQ ID NO: 926061 - RNA, 22 nt, Homo sapiens
uugaugaugaaguauugcuaau

SEQ ID NO: 926062 - RNA, 23 nt, Homo sapiens
aagccucagcaacagccagugga

SEQ ID NO: 926063 - RNA, 12 nt, Homo sapiens
aagccugaugau

SEQ ID NO: 926064 - RNA, 22 nt, Homo sapiens
aagccuuagggcaggaaagaau

SEQ ID NO: 926065 - RNA, 15 nt, Homo sapiens
aagcuguauguacuu

SEQ ID NO: 926066 - RNA, 16 nt, Homo sapiens
aaggaaaucuccucuu

SEQ ID NO: 926067 - RNA, 15 nt, Homo sapiens
aaggacaggacccuc

SEQ ID NO: 926068 - RNA, 21 nt, Homo sapiens
aaggauauggacuauugcaau

SEQ ID NO: 926069 - RNA, 13 nt, Homo sapiens
aaggauucauaau

SEQ ID NO: 926070 - RNA, 15 nt, Homo sapiens
aaggcaaaguggaau

SEQ ID NO: 926071 - RNA, 19 nt, Homo sapiens
aaggcagagcgcaaagugc

SEQ ID NO: 926072 - RNA, 16 nt, Homo sapiens
aaggcagccuucaguc

SEQ ID NO: 926073 - RNA, 15 nt, Homo sapiens
aaggcagcucugucg

SEQ ID NO: 926074 - RNA, 20 nt, Homo sapiens
aaggccagucugaaccugag

SEQ ID NO: 926075 - RNA, 19 nt, Homo sapiens
aaggcuuauauuaagcaaa

SEQ ID NO: 926076 - RNA, 14 nt, Homo sapiens
aaggcuuccugaaa

SEQ ID NO: 926077 - RNA, 21 nt, Homo sapiens
aaggcuucuccacaaccuccu

SEQ ID NO: 926078 - RNA, 18 nt, Homo sapiens
aagggaagaaaaggugaa

SEQ ID NO: 926079 - RNA, 20 nt, Homo sapiens
aagguaccaaaaaaauccau

SEQ ID NO: 926080 - RNA, 16 nt, Homo sapiens
aagguagacauggauu

SEQ ID NO: 926081 - RNA, 18 nt, Homo sapiens
aagguauugcaaggucac

SEQ ID NO: 926082 - RNA, 17 nt, Homo sapiens
aaggucgagacauuccu

SEQ ID NO: 926083 - RNA, 21 nt, Homo sapiens
aagguuaaauaccuguguuca

SEQ ID NO: 926084 - RNA, 20 nt, Homo sapiens
aaguaaaaggcacugcacau

SEQ ID NO: 926085 - RNA, 20 nt, Homo sapiens
aaguaauuuccccacucuga

SEQ ID NO: 926086 - RNA, 15 nt, Homo sapiens
aaguacaagcuguaa

SEQ ID NO: 926087 - RNA, 15 nt, Homo sapiens
aaguacauacauucu

SEQ ID NO: 926088 - RNA, 19 nt, Homo sapiens
aaguaugcacuaaucaaua

SEQ ID NO: 926089 - RNA, 13 nt, Homo sapiens
aaguauugcuaau

SEQ ID NO: 926090 - RNA, 21 nt, Homo sapiens
aagucauucaagagucucauu

SEQ ID NO: 926091 - RNA, 24 nt, Homo sapiens
aagucccaugaauacacaacucca

SEQ ID NO: 926092 - RNA, 21 nt, Homo sapiens
aagugaugauuguaaguccca

SEQ ID NO: 926093 - RNA, 15 nt, Homo sapiens
aagugcaaagcugcu

SEQ ID NO: 926094 - RNA, 15 nt, Homo sapiens
aagugcauaguuuag

SEQ ID NO: 926095 - RNA, 17 nt, Homo sapiens
aagugggagugggagag

SEQ ID NO: 926096 - RNA, 14 nt, Homo sapiens
aagugguacaggaa

SEQ ID NO: 926097 - RNA, 18 nt, Homo sapiens
aagugucuacaugugcca

SEQ ID NO: 926098 - RNA, 15 nt, Homo sapiens
aaguuaaauugcacg

SEQ ID NO: 926099 - RNA, 22 nt, Homo sapiens
aaguugcugugccccaucagca

SEQ ID NO: 926100 - RNA, 14 nt, Homo sapiens
aauaaacuauacuu

SEQ ID NO: 926101 - RNA, 15 nt, Homo sapiens
aauaaguacauauag

SEQ ID NO: 926102 - RNA, 13 nt, Homo sapiens
aauacaaaaagca

SEQ ID NO: 926103 - RNA, 20 nt, Homo sapiens
aauacacaacuccacugucu

SEQ ID NO: 926104 - RNA, 13 nt, Homo sapiens
aauacagcacuuu

SEQ ID NO: 926105 - RNA, 16 nt, Homo sapiens
aauacggaacacuguc

SEQ ID NO: 926106 - RNA, 14 nt, Homo sapiens
aauagcuccucuac

SEQ ID NO: 926107 - RNA, 12 nt, Homo sapiens
aauaggugaaua

SEQ ID NO: 926108 - RNA, 18 nt, Homo sapiens
aauauaaauuuacauaua

SEQ ID NO: 926109 - RNA, 23 nt, Homo sapiens
aauaucuaccugcccucucucag

SEQ ID NO: 926110 - RNA, 15 nt, Homo sapiens
aauauggacaucugg

SEQ ID NO: 926111 - RNA, 20 nt, Homo sapiens
aauauuuuuuuuaacugcau

SEQ ID NO: 926112 - RNA, 23 nt, Homo sapiens
aaucaagaaauaugaagcacuuu

SEQ ID NO: 926113 - RNA, 23 nt, Homo sapiens
aaucaagucugugaaagucuccu

SEQ ID NO: 926114 - RNA, 19 nt, Homo sapiens
aaucaccugugggacuuga

SEQ ID NO: 926115 - RNA, 21 nt, Homo sapiens
aaucacuuuuggacaugcuuu

SEQ ID NO: 926116 - RNA, 15 nt, Homo sapiens
aauccaugugcugcu

SEQ ID NO: 926117 - RNA, 21 nt, Homo sapiens
aauccaugugcugcuguggca

SEQ ID NO: 926118 - RNA, 15 nt, Homo sapiens
aaucccagcuacuug

SEQ ID NO: 926119 - RNA, 14 nt, Homo sapiens
aaucccuacagggu

SEQ ID NO: 926120 - RNA, 23 nt, Homo sapiens
aaucccuacagggugucugucag

SEQ ID NO: 926121 - RNA, 17 nt, Homo sapiens
aauccuggccacauuca

SEQ ID NO: 926122 - RNA, 20 nt, Homo sapiens
aaucuauuuugucugauauu

SEQ ID NO: 926123 - RNA, 22 nt, Homo sapiens
aaucuugcucuuccauaaucuu

SEQ ID NO: 926124 - RNA, 14 nt, Homo sapiens
aaugacccugucaa

SEQ ID NO: 926125 - RNA, 15 nt, Homo sapiens
aaugacccugucaag

SEQ ID NO: 926126 - RNA, 15 nt, Homo sapiens
aaugagagagugugg

SEQ ID NO: 926127 - RNA, 13 nt, Homo sapiens
aaugagaugacca

SEQ ID NO: 926128 - RNA, 20 nt, Homo sapiens
aaugagauuuuagacugcca

SEQ ID NO: 926129 - RNA, 19 nt, Homo sapiens
aaugaguguguuuuguaca

SEQ ID NO: 926130 - RNA, 15 nt, Homo sapiens
aaugauguagacauu

SEQ ID NO: 926131 - RNA, 13 nt, Homo sapiens
aaugcacugacca

SEQ ID NO: 926132 - RNA, 16 nt, Homo sapiens
aaugcaugacuucccu

SEQ ID NO: 926133 - RNA, 20 nt, Homo sapiens
aaugcauuuaaacucauuug

SEQ ID NO: 926134 - RNA, 21 nt, Homo sapiens
aaugcauuuaaacucauuuga

SEQ ID NO: 926135 - RNA, 20 nt, Homo sapiens
aaugcccuuacacuuacugu

SEQ ID NO: 926136 - RNA, 22 nt, Homo sapiens
aaugcccuuacacuuacuguug

SEQ ID NO: 926137 - RNA, 14 nt, Homo sapiens
aaugcucauauuaa

SEQ ID NO: 926138 - RNA, 19 nt, Homo sapiens
aaugcugcacaccaguuac

SEQ ID NO: 926139 - RNA, 20 nt, Homo sapiens
aaugcuguaccuuucugaca

SEQ ID NO: 926140 - RNA, 23 nt, Homo sapiens
aaugcuuugauuguucauaucaa

SEQ ID NO: 926141 - RNA, 15 nt, Homo sapiens
aauggaaacuuggaa

SEQ ID NO: 926142 - RNA, 17 nt, Homo sapiens
aauggcagucugccugc

SEQ ID NO: 926143 - RNA, 14 nt, Homo sapiens
aaugggacugaugu

SEQ ID NO: 926144 - RNA, 18 nt, Homo sapiens
aaugguuuguuuucuaca

SEQ ID NO: 926145 - RNA, 19 nt, Homo sapiens
aauguaaguugaccuucuc

SEQ ID NO: 926146 - RNA, 23 nt, Homo sapiens
aauguaaguugaccuucucuuag

SEQ ID NO: 926147 - RNA, 20 nt, Homo sapiens
aauguauuuuaaaauuucac

SEQ ID NO: 926148 - RNA, 20 nt, Homo sapiens
aauguguguagauacuuccu

SEQ ID NO: 926149 - RNA, 20 nt, Homo sapiens
aauuaaaaaaaaaacuucau

SEQ ID NO: 926150 - RNA, 20 nt, Homo sapiens
aauuaaagaaaauugccaaa

SEQ ID NO: 926151 - RNA, 13 nt, Homo sapiens
aauuacacaugua

SEQ ID NO: 926152 - RNA, 14 nt, Homo sapiens
aauuacacauguag

SEQ ID NO: 926153 - RNA, 22 nt, Homo sapiens
aauuacuuugauuccauuuuaa

SEQ ID NO: 926154 - RNA, 11 nt, Homo sapiens
aauuagcucac

SEQ ID NO: 926155 - RNA, 21 nt, Homo sapiens
aauuauauaacuguauuugaa

SEQ ID NO: 926156 - RNA, 17 nt, Homo sapiens
aauuaucuauccuugau

SEQ ID NO: 926157 - RNA, 17 nt, Homo sapiens
aauuauuaucuucuuaa

SEQ ID NO: 926158 - RNA, 16 nt, Homo sapiens
aauucaaagcauguca

SEQ ID NO: 926159 - RNA, 22 nt, Homo sapiens
aauucagagaauagcaguuuca

SEQ ID NO: 926160 - RNA, 13 nt, Homo sapiens
aauuccaauacau

SEQ ID NO: 926161 - RNA, 21 nt, Homo sapiens
aauuccacaucaaguguucca

SEQ ID NO: 926162 - RNA, 22 nt, Homo sapiens
aauucccuguuauaauuugcac

SEQ ID NO: 926163 - RNA, 17 nt, Homo sapiens
aauucuuaacauagcca

SEQ ID NO: 926164 - RNA, 16 nt, Homo sapiens
aauucuuauaguaccu

SEQ ID NO: 926165 - RNA, 14 nt, Homo sapiens
aauucuucuucuca

SEQ ID NO: 926166 - RNA, 15 nt, Homo sapiens
aauugaaacauuuac

SEQ ID NO: 926167 - RNA, 22 nt, Homo sapiens
aauugguagaaaaauaucuuua

SEQ ID NO: 926168 - RNA, 20 nt, Homo sapiens
aauuggucauugacuggcca

SEQ ID NO: 926169 - RNA, 13 nt, Homo sapiens
aauuguauuccca

SEQ ID NO: 926170 - RNA, 16 nt, Homo sapiens
aauuuaaaauaauuau

SEQ ID NO: 926171 - RNA, 16 nt, Homo sapiens
aauuuggauuuuccac

SEQ ID NO: 926172 - RNA, 19 nt, Homo sapiens
aauuuucuucacacuauca

SEQ ID NO: 926173 - RNA, 21 nt, Homo sapiens
aauuuucuucacacuaucaac

SEQ ID NO: 926174 - RNA, 18 nt, Homo sapiens
acaaaacuguaacugcau

SEQ ID NO: 926175 - RNA, 22 nt, Homo sapiens
acaaaagcagguuuuuauaugu

SEQ ID NO: 926176 - RNA, 13 nt, Homo sapiens
acaaaaugauacu

SEQ ID NO: 926177 - RNA, 13 nt, Homo sapiens
acaaacaccaucu

SEQ ID NO: 926178 - RNA, 14 nt, Homo sapiens
acaaaccacuguac

SEQ ID NO: 926179 - RNA, 17 nt, Homo sapiens
acaaaccacuguacaua

SEQ ID NO: 926180 - RNA, 16 nt, Homo sapiens
acaaaccucuaaccca

SEQ ID NO: 926181 - RNA, 20 nt, Homo sapiens
acaaaggugauuuuccugug

SEQ ID NO: 926182 - RNA, 20 nt, Homo sapiens
acaaaugggacugaugucau

SEQ ID NO: 926183 - RNA, 17 nt, Homo sapiens
gccuaugccaccugcag

SEQ ID NO: 926184 - RNA, 14 nt, Homo sapiens
gccucaaacucaac

SEQ ID NO: 926185 - RNA, 18 nt, Homo sapiens
gccucaaccucccuggcu

SEQ ID NO: 926186 - RNA, 19 nt, Homo sapiens
gccucaguuucuucaccug

SEQ ID NO: 926187 - RNA, 22 nt, Homo sapiens
gccuccccuggggcuggcagcu

SEQ ID NO: 926188 - RNA, 18 nt, Homo sapiens
gccucccuuguggcagca

SEQ ID NO: 926189 - RNA, 18 nt, Homo sapiens
gccucugcucuccuggga

SEQ ID NO: 926190 - RNA, 13 nt, Homo sapiens
gccucuggccaga

SEQ ID NO: 926191 - RNA, 19 nt, Homo sapiens
gccugaccucaagcaacca

SEQ ID NO: 926192 - RNA, 22 nt, Homo sapiens
gccugaguuggcguugugggca

SEQ ID NO: 926193 - RNA, 15 nt, Homo sapiens
gccugaugauggaag

SEQ ID NO: 926194 - RNA, 15 nt, Homo sapiens
gccugccaacaagcu

SEQ ID NO: 926195 - RNA, 16 nt, Homo sapiens
gccugccucggggaca

SEQ ID NO: 926196 - RNA, 16 nt, Homo sapiens
gccuggacaacauagu

SEQ ID NO: 926197 - RNA, 17 nt, Homo sapiens
gccuggaugggggugca

SEQ ID NO: 926198 - RNA, 22 nt, Homo sapiens
gccuguaaucccaacacuuugg

SEQ ID NO: 926199 - RNA, 16 nt, Homo sapiens
gccugugcccuugcug

SEQ ID NO: 926200 - RNA, 18 nt, Homo sapiens
gccugugcuuuuggagcu

SEQ ID NO: 926201 - RNA, 13 nt, Homo sapiens
gccuuggccuccc

SEQ ID NO: 926202 - RNA, 13 nt, Homo sapiens
gccuuuuacuuug

SEQ ID NO: 926203 - RNA, 13 nt, Homo sapiens
gcgaacugugcag

SEQ ID NO: 926204 - RNA, 15 nt, Homo sapiens
gcgaacugugcaguu

SEQ ID NO: 926205 - RNA, 16 nt, Homo sapiens
gcgaacugugcaguua

SEQ ID NO: 926206 - RNA, 15 nt, Homo sapiens
gcgcauggugcagug

SEQ ID NO: 926207 - RNA, 22 nt, Homo sapiens
gcggguaaaaagagaaggcaag

SEQ ID NO: 926208 - RNA, 18 nt, Homo sapiens
gcggugggcagccaugag

SEQ ID NO: 926209 - RNA, 15 nt, Homo sapiens
gcuaaacacuaugua

SEQ ID NO: 926210 - RNA, 23 nt, Homo sapiens
gcuaauucuacucacagugcuuu

SEQ ID NO: 926211 - RNA, 15 nt, Homo sapiens
gcuacagcugugucc

SEQ ID NO: 926212 - RNA, 14 nt, Homo sapiens
gcuauaaagcagua

SEQ ID NO: 926213 - RNA, 20 nt, Homo sapiens
gcuauuaaaaaaaaagaagg

SEQ ID NO: 926214 - RNA, 19 nt, Homo sapiens
gcuauuaagaaaaucacau

SEQ ID NO: 926215 - RNA, 15 nt, Homo sapiens
gcucaaggauucaau

SEQ ID NO: 926216 - RNA, 13 nt, Homo sapiens
gcucagcccugag

SEQ ID NO: 926217 - RNA, 16 nt, Homo sapiens
gcucagcccugagcua

SEQ ID NO: 926218 - RNA, 15 nt, Homo sapiens
gcucaugagcgucug

SEQ ID NO: 926219 - RNA, 18 nt, Homo sapiens
gcucaugagcgucugugg

SEQ ID NO: 926220 - RNA, 23 nt, Homo sapiens
gcuccugggaaggcuacucaccu

SEQ ID NO: 926221 - RNA, 23 nt, Homo sapiens
gcucguucucuucucucuucaau

SEQ ID NO: 926222 - RNA, 23 nt, Homo sapiens
gcucuaugggguucguuaugcca

SEQ ID NO: 926223 - RNA, 21 nt, Homo sapiens
gcucuauuuauuaagaacuau

SEQ ID NO: 926224 - RNA, 16 nt, Homo sapiens
gcucucaaaaugugaa

SEQ ID NO: 926225 - RNA, 14 nt, Homo sapiens
gcucugcacagaca

SEQ ID NO: 926226 - RNA, 23 nt, Homo sapiens
gcucuuugaacuccgcugccuuc

SEQ ID NO: 926227 - RNA, 19 nt, Homo sapiens
gcugaaaccccaucuccac

SEQ ID NO: 926228 - RNA, 20 nt, Homo sapiens
gcugaagacaaaccacugua

SEQ ID NO: 926229 - RNA, 18 nt, Homo sapiens
gcugacuuguaucuucag

SEQ ID NO: 926230 - RNA, 20 nt, Homo sapiens
gcugagaucacaccacugua

SEQ ID NO: 926231 - RNA, 13 nt, Homo sapiens
gcugagauuacag

SEQ ID NO: 926232 - RNA, 11 nt, Homo sapiens
gcugauucaau

SEQ ID NO: 926233 - RNA, 17 nt, Homo sapiens
gcugcaucccaccagcc

SEQ ID NO: 926234 - RNA, 18 nt, Homo sapiens
gcugccggcugcacccug

SEQ ID NO: 926235 - RNA, 15 nt, Homo sapiens
gcugccucccugucc

SEQ ID NO: 926236 - RNA, 17 nt, Homo sapiens
gcugcgccgucugcucg

SEQ ID NO: 926237 - RNA, 20 nt, Homo sapiens
gcugcuucaaacucaaacac

SEQ ID NO: 926238 - RNA, 14 nt, Homo sapiens
gcugcuuggcacau

SEQ ID NO: 926239 - RNA, 19 nt, Homo sapiens
gcuggagugcaguggugcg

SEQ ID NO: 926240 - RNA, 23 nt, Homo sapiens
gcuggcagcuucgugugcagcua

SEQ ID NO: 926241 - RNA, 16 nt, Homo sapiens
gcuggcggaaccuggc

SEQ ID NO: 926242 - RNA, 17 nt, Homo sapiens
gcugggauuacaggugu

SEQ ID NO: 926243 - RNA, 16 nt, Homo sapiens
gcugugucuuuagaca

SEQ ID NO: 926244 - RNA, 10 nt, Homo sapiens
gcuguuaaau

SEQ ID NO: 926245 - RNA, 18 nt, Homo sapiens
gcuuaaaagcuguucuca

SEQ ID NO: 926246 - RNA, 18 nt, Homo sapiens
gcuuaaggggguguaaug

SEQ ID NO: 926247 - RNA, 12 nt, Homo sapiens
gcuuacaggaag

SEQ ID NO: 926248 - RNA, 22 nt, Homo sapiens
gcuucaggaaggacauggacaa

SEQ ID NO: 926249 - RNA, 14 nt, Homo sapiens
gcuugucagaaaca

SEQ ID NO: 926250 - RNA, 21 nt, Homo sapiens
gcuuguuuucuacuuugccac

SEQ ID NO: 926251 - RNA, 13 nt, Homo sapiens
gcuuucaguauua

SEQ ID NO: 926252 - RNA, 16 nt, Homo sapiens
gcuuucccaggcagcu

SEQ ID NO: 926253 - RNA, 15 nt, Homo sapiens
gcuuugaaaaugcag

SEQ ID NO: 926254 - RNA, 18 nt, Homo sapiens
gcuuugaaagaagcaaga

SEQ ID NO: 926255 - RNA, 12 nt, Homo sapiens
ggaaagcauaua

SEQ ID NO: 926256 - RNA, 23 nt, Homo sapiens
ggaaaggagggggcucaggccau

SEQ ID NO: 926257 - RNA, 19 nt, Homo sapiens
ggaaauaugaaauguauuu

SEQ ID NO: 926258 - RNA, 19 nt, Homo sapiens
ggaaauuuggaagaugguu

SEQ ID NO: 926259 - RNA, 13 nt, Homo sapiens
ggaacaauaucaa

SEQ ID NO: 926260 - RNA, 22 nt, Homo sapiens
ggaagaacauugauuucauuga

SEQ ID NO: 926261 - RNA, 21 nt, Homo sapiens
ggaagcccauccugaccagcu

SEQ ID NO: 926262 - RNA, 22 nt, Homo sapiens
ggaagccgccuagugcagagag

SEQ ID NO: 926263 - RNA, 13 nt, Homo sapiens
ggaagcuagcucc

SEQ ID NO: 926264 - RNA, 23 nt, Homo sapiens
ggaauauaagguuaagauaucau

SEQ ID NO: 926265 - RNA, 19 nt, Homo sapiens
ggaauggggaccuggggug

SEQ ID NO: 926266 - RNA, 13 nt, Homo sapiens
ggaauuccaauau

SEQ ID NO: 926267 - RNA, 18 nt, Homo sapiens
ggacaaaggugauuuucc

SEQ ID NO: 926268 - RNA, 16 nt, Homo sapiens
ggacagaaaugccacu

SEQ ID NO: 926269 - RNA, 20 nt, Homo sapiens
ggacauguauucccauugca

SEQ ID NO: 926270 - RNA, 19 nt, Homo sapiens
ggaccaaaccuagccccuu

SEQ ID NO: 926271 - RNA, 16 nt, Homo sapiens
ggacgcacacagcuuu

SEQ ID NO: 926272 - RNA, 20 nt, Homo sapiens
ggacgccugugucacgagcc

SEQ ID NO: 926273 - RNA, 13 nt, Homo sapiens
ggacugaugucau

SEQ ID NO: 926274 - RNA, 13 nt, Homo sapiens
ggacugcaccuug

SEQ ID NO: 926275 - RNA, 13 nt, Homo sapiens
ggacuuccauuug

SEQ ID NO: 926276 - RNA, 22 nt, Homo sapiens
ggagcauuuugugucuuaagaa

SEQ ID NO: 926277 - RNA, 17 nt, Homo sapiens
ggaggccguugcagaca

SEQ ID NO: 926278 - RNA, 12 nt, Homo sapiens
ggaggcugagau

SEQ ID NO: 926279 - RNA, 14 nt, Homo sapiens
ggaugcagugccuu

SEQ ID NO: 926280 - RNA, 20 nt, Homo sapiens
ggcaaggugagggaugccau

SEQ ID NO: 926281 - RNA, 17 nt, Homo sapiens
ggcaggaggguggcacu

SEQ ID NO: 926282 - RNA, 23 nt, Homo sapiens
ggccaaggugccaccacccugcc

SEQ ID NO: 926283 - RNA, 23 nt, Homo sapiens
ggccaaucacugaguuuguggug

SEQ ID NO: 926284 - RNA, 21 nt, Homo sapiens
ggccaccugcaggucacugaa

SEQ ID NO: 926285 - RNA, 20 nt, Homo sapiens
ggccacuaggaggaaugugu

SEQ ID NO: 926286 - RNA, 20 nt, Homo sapiens
ggcccgccacccuugcccac

SEQ ID NO: 926287 - RNA, 16 nt, Homo sapiens
ggccgcuucccuaccc

SEQ ID NO: 926288 - RNA, 19 nt, Homo sapiens
ggccuaaagccagcauuuc

SEQ ID NO: 926289 - RNA, 13 nt, Homo sapiens
ggccucaccuuuc

SEQ ID NO: 926290 - RNA, 23 nt, Homo sapiens
ggccucaugguaagagucacaau

SEQ ID NO: 926291 - RNA, 19 nt, Homo sapiens
ggcggaaccuggcugcgaa

SEQ ID NO: 926292 - RNA, 19 nt, Homo sapiens
ggcggucaauaauugugga

SEQ ID NO: 926293 - RNA, 14 nt, Homo sapiens
ggcguugugggcag

SEQ ID NO: 926294 - RNA, 15 nt, Homo sapiens
ggcuaaagugcucua

SEQ ID NO: 926295 - RNA, 20 nt, Homo sapiens
ggcuaaauugaaaccuggaa

SEQ ID NO: 926296 - RNA, 22 nt, Homo sapiens
ggcuaaggccucuugcuggugc

SEQ ID NO: 926297 - RNA, 23 nt, Homo sapiens
ggcuaauuuuuuguguuuuuaca

SEQ ID NO: 926298 - RNA, 22 nt, Homo sapiens
ggcuauguugagcugagaucac

SEQ ID NO: 926299 - RNA, 17 nt, Homo sapiens
ggcucacgccuguaauc

SEQ ID NO: 926300 - RNA, 15 nt, Homo sapiens
ggcucgggacuucaa

SEQ ID NO: 926301 - RNA, 16 nt, Homo sapiens
ggcucguguauuuauu

SEQ ID NO: 926302 - RNA, 14 nt, Homo sapiens
ggcugcacucaaga

SEQ ID NO: 926303 - RNA, 20 nt, Homo sapiens
ggcuugguuuccucaccuug

SEQ ID NO: 926304 - RNA, 20 nt, Homo sapiens
ggcuuuccucagcaccuggg

SEQ ID NO: 926305 - RNA, 22 nt, Homo sapiens
ucaguggggacaggaaggacca

SEQ ID NO: 926306 - RNA, 16 nt, Homo sapiens
ucaguggugagacugu

SEQ ID NO: 926307 - RNA, 14 nt, Homo sapiens
ucauaaaguugacu

SEQ ID NO: 926308 - RNA, 15 nt, Homo sapiens
ucauaaucacaaaua

SEQ ID NO: 926309 - RNA, 13 nt, Homo sapiens
ucauacugaauga

SEQ ID NO: 926310 - RNA, 22 nt, Homo sapiens
ucauacugaaugaccacuugau

SEQ ID NO: 926311 - RNA, 24 nt, Homo sapiens
ucaucuuuuauagauguaaucuga

SEQ ID NO: 926312 - RNA, 22 nt, Homo sapiens
ucauguugaagucaaauuugga

SEQ ID NO: 926313 - RNA, 20 nt, Homo sapiens
ucauuaauaaaaauucuuau

SEQ ID NO: 926314 - RNA, 22 nt, Homo sapiens
ucauuauuacguggcaaaaucc

SEQ ID NO: 926315 - RNA, 21 nt, Homo sapiens
ucauuuccccucccgucuucc

SEQ ID NO: 926316 - RNA, 16 nt, Homo sapiens
ucauuuucacuuuuaa

SEQ ID NO: 926317 - RNA, 12 nt, Homo sapiens
uccaaagcuuuc

SEQ ID NO: 926318 - RNA, 19 nt, Homo sapiens
uccaacaguuaaacuugca

SEQ ID NO: 926319 - RNA, 19 nt, Homo sapiens
uccaagugaaugaguuucc

SEQ ID NO: 926320 - RNA, 22 nt, Homo sapiens
uccaagugaaugaguuuccagc

SEQ ID NO: 926321 - RNA, 22 nt, Homo sapiens
uccacaaccuccuccuccaguu

SEQ ID NO: 926322 - RNA, 21 nt, Homo sapiens
uccaccauuucuucugcacaa

SEQ ID NO: 926323 - RNA, 22 nt, Homo sapiens
uccaccccuacucuauucugua

SEQ ID NO: 926324 - RNA, 15 nt, Homo sapiens
uccacgcacucagcu

SEQ ID NO: 926325 - RNA, 16 nt, Homo sapiens
uccacuccaaccagaa

SEQ ID NO: 926326 - RNA, 20 nt, Homo sapiens
uccagaagaaauaauugugu

SEQ ID NO: 926327 - RNA, 17 nt, Homo sapiens
uccagccacuuauuucc

SEQ ID NO: 926328 - RNA, 22 nt, Homo sapiens
uccagccacuuauuuccaugga

SEQ ID NO: 926329 - RNA, 18 nt, Homo sapiens
uccaggaacuuuccagca

SEQ ID NO: 926330 - RNA, 15 nt, Homo sapiens
uccaguucugaugag

SEQ ID NO: 926331 - RNA, 15 nt, Homo sapiens
uccaucuguacuuug

SEQ ID NO: 926332 - RNA, 19 nt, Homo sapiens
uccauguagaagagggaga

SEQ ID NO: 926333 - RNA, 10 nt, Homo sapiens
uccauuagua

SEQ ID NO: 926334 - RNA, 13 nt, Homo sapiens
ucccaaaauacua

SEQ ID NO: 926335 - RNA, 16 nt, Homo sapiens
ucccaaagagcugccu

SEQ ID NO: 926336 - RNA, 11 nt, Homo sapiens
ucccaaagugc

SEQ ID NO: 926337 - RNA, 19 nt, Homo sapiens
ucccaaagugcugagauua

SEQ ID NO: 926338 - RNA, 20 nt, Homo sapiens
ucccaaagugcugagauuac

SEQ ID NO: 926339 - RNA, 18 nt, Homo sapiens
ucccacccccaaugcaca

SEQ ID NO: 926340 - RNA, 16 nt, Homo sapiens
ucccaccucaaauggg

SEQ ID NO: 926341 - RNA, 23 nt, Homo sapiens
ucccaccugcagagccagugucc

SEQ ID NO: 926342 - RNA, 15 nt, Homo sapiens
ucccagcuacuuggg

SEQ ID NO: 926343 - RNA, 19 nt, Homo sapiens
ucccaguucauguugcuca

SEQ ID NO: 926344 - RNA, 21 nt, Homo sapiens
ucccaucccacccccaaugca

SEQ ID NO: 926345 - RNA, 16 nt, Homo sapiens
ucccaucugcauuuga

SEQ ID NO: 926346 - RNA, 17 nt, Homo sapiens
ucccaugguagacugug

SEQ ID NO: 926347 - RNA, 17 nt, Homo sapiens
ucccaugugcugagaac

SEQ ID NO: 926348 - RNA, 15 nt, Homo sapiens
uccccaagggcccug

SEQ ID NO: 926349 - RNA, 22 nt, Homo sapiens
uccccagacaucuggacacugg

SEQ ID NO: 926350 - RNA, 22 nt, Homo sapiens
uccccucacuucucccaccugc

SEQ ID NO: 926351 - RNA, 18 nt, Homo sapiens
uccccucguuaacacaug

SEQ ID NO: 926352 - RNA, 11 nt, Homo sapiens
uccccuggcaa

SEQ ID NO: 926353 - RNA, 22 nt, Homo sapiens
ucccggcuggacuuuugcagcu

SEQ ID NO: 926354 - RNA, 13 nt, Homo sapiens
ucccucauguucu

SEQ ID NO: 926355 - RNA, 19 nt, Homo sapiens
ucccucgaacccacacugc

SEQ ID NO: 926356 - RNA, 15 nt, Homo sapiens
ucccugcacacggca

SEQ ID NO: 926357 - RNA, 18 nt, Homo sapiens
ucccuggggcuccugcuu

SEQ ID NO: 926358 - RNA, 14 nt, Homo sapiens
uccgugagccucag

SEQ ID NO: 926359 - RNA, 20 nt, Homo sapiens
uccuaaauuugaaauaguga

SEQ ID NO: 926360 - RNA, 23 nt, Homo sapiens
uccucugccuuuguucacuguga

SEQ ID NO: 926361 - RNA, 13 nt, Homo sapiens
uccucuuugugaa

SEQ ID NO: 926362 - RNA, 19 nt, Homo sapiens
uccugaggcagaaccuggu

SEQ ID NO: 926363 - RNA, 20 nt, Homo sapiens
uccugauggaauuguuauac

SEQ ID NO: 926364 - RNA, 15 nt, Homo sapiens
uccuuagcaacagcc

SEQ ID NO: 926365 - RNA, 13 nt, Homo sapiens
uccuucgcuuucc

SEQ ID NO: 926366 - RNA, 15 nt, Homo sapiens
uccuucuccauaaag

SEQ ID NO: 926367 - RNA, 15 nt, Homo sapiens
ucgacucuuugcaac

SEQ ID NO: 926368 - RNA, 21 nt, Homo sapiens
ucgagagugagaaauggcagu

SEQ ID NO: 926369 - RNA, 14 nt, Homo sapiens
ucgcugagucccag

SEQ ID NO: 926370 - RNA, 16 nt, Homo sapiens
ucguuaacacauggcu

SEQ ID NO: 926371 - RNA, 14 nt, Homo sapiens
ucuaaauuacugau

SEQ ID NO: 926372 - RNA, 15 nt, Homo sapiens
ucuaacccacccuca

SEQ ID NO: 926373 - RNA, 17 nt, Homo sapiens
ucuacaccugucauuga

SEQ ID NO: 926374 - RNA, 13 nt, Homo sapiens
ucuacgcccuucc

SEQ ID NO: 926375 - RNA, 14 nt, Homo sapiens
ucuacuacagggug

SEQ ID NO: 926376 - RNA, 15 nt, Homo sapiens
ucuagaauacuaaua

SEQ ID NO: 926377 - RNA, 24 nt, Homo sapiens
ucuagagcuugaugccaguaggcu

SEQ ID NO: 926378 - RNA, 18 nt, Homo sapiens
ucuaucauguugaaguca

SEQ ID NO: 926379 - RNA, 11 nt, Homo sapiens
ucuaucuucac

SEQ ID NO: 926380 - RNA, 18 nt, Homo sapiens
ucuaugacugaaguacug

SEQ ID NO: 926381 - RNA, 19 nt, Homo sapiens
ucuauggauuuaauaccau

SEQ ID NO: 926382 - RNA, 18 nt, Homo sapiens
ucucaaaaugugaacuga

SEQ ID NO: 926383 - RNA, 14 nt, Homo sapiens
ucucaacauggaaa

SEQ ID NO: 926384 - RNA, 20 nt, Homo sapiens
ucucaacccaggagcaucca

SEQ ID NO: 926385 - RNA, 22 nt, Homo sapiens
ucucaggauaaaguuugcuaag

SEQ ID NO: 926386 - RNA, 22 nt, Homo sapiens
ucucaguuauucagauugacaa

SEQ ID NO: 926387 - RNA, 21 nt, Homo sapiens
ucucauuuuguauguaugugu

SEQ ID NO: 926388 - RNA, 23 nt, Homo sapiens
ucuccaacgaauagcuccucuac

SEQ ID NO: 926389 - RNA, 22 nt, Homo sapiens
ucuccccccaacacaaucuuuc

SEQ ID NO: 926390 - RNA, 21 nt, Homo sapiens
ucuccccucacacuuugccau

SEQ ID NO: 926391 - RNA, 19 nt, Homo sapiens
ucuccucccaaaauacuac

SEQ ID NO: 926392 - RNA, 13 nt, Homo sapiens
ucuccugcaugca

SEQ ID NO: 926393 - RNA, 20 nt, Homo sapiens
ucuccuguguaucuuugaag

SEQ ID NO: 926394 - RNA, 18 nt, Homo sapiens
ucucuccccuugcacugg

SEQ ID NO: 926395 - RNA, 12 nt, Homo sapiens
ucucugugcucu

SEQ ID NO: 926396 - RNA, 14 nt, Homo sapiens
ucucuucaaucucu

SEQ ID NO: 926397 - RNA, 12 nt, Homo sapiens
ucucuugcuaau

SEQ ID NO: 926398 - RNA, 23 nt, Homo sapiens
ucucuuucuuuuucugucucucu

SEQ ID NO: 926399 - RNA, 15 nt, Homo sapiens
ucugaacagcagaaa

SEQ ID NO: 926400 - RNA, 22 nt, Homo sapiens
ucugaagguaaagggacacugg

SEQ ID NO: 926401 - RNA, 17 nt, Homo sapiens
ucugaguagcauauaua

SEQ ID NO: 926402 - RNA, 16 nt, Homo sapiens
ucugcacuauagccau

SEQ ID NO: 926403 - RNA, 12 nt, Homo sapiens
ucugcauuugau

SEQ ID NO: 926404 - RNA, 14 nt, Homo sapiens
ucugcccauucucu

SEQ ID NO: 926405 - RNA, 21 nt, Homo sapiens
ucugccccucccugcuucaau

SEQ ID NO: 926406 - RNA, 18 nt, Homo sapiens
ucugccuuccuugcuaau

SEQ ID NO: 926407 - RNA, 12 nt, Homo sapiens
ucugcuuccaac

SEQ ID NO: 926408 - RNA, 23 nt, Homo sapiens
ucuggaaaaauaaguacauauag

SEQ ID NO: 926409 - RNA, 21 nt, Homo sapiens
ucuggaugggcuuggccaaaa

SEQ ID NO: 926410 - RNA, 23 nt, Homo sapiens
ucuggcacuugcaagucccauga

SEQ ID NO: 926411 - RNA, 20 nt, Homo sapiens
ucugggaacucccaagaaca

SEQ ID NO: 926412 - RNA, 16 nt, Homo sapiens
ucugggcaaauagauu

SEQ ID NO: 926413 - RNA, 20 nt, Homo sapiens
ucugggcacuuuugaacuca

SEQ ID NO: 926414 - RNA, 14 nt, Homo sapiens
ucugggcccagaac

SEQ ID NO: 926415 - RNA, 13 nt, Homo sapiens
ucuggggcucagc

SEQ ID NO: 926416 - RNA, 16 nt, Homo sapiens
ucuggucguuugacca

SEQ ID NO: 926417 - RNA, 16 nt, Homo sapiens
ucugguuuauaaucuc

SEQ ID NO: 926418 - RNA, 21 nt, Homo sapiens
ucuguaucagaaaugaaacag

SEQ ID NO: 926419 - RNA, 22 nt, Homo sapiens
ucugucaucaccccgugaagca

SEQ ID NO: 926420 - RNA, 13 nt, Homo sapiens
ucuguccuuccau

SEQ ID NO: 926421 - RNA, 14 nt, Homo sapiens
ucugugauugccau

SEQ ID NO: 926422 - RNA, 12 nt, Homo sapiens
ucuuaaacuaca

SEQ ID NO: 926423 - RNA, 16 nt, Homo sapiens
ucuuacucuuuguaug

SEQ ID NO: 926424 - RNA, 13 nt, Homo sapiens
ucuucaaggugua

SEQ ID NO: 926425 - RNA, 13 nt, Homo sapiens
ucuucagcuuuga

SEQ ID NO: 926426 - RNA, 15 nt, Homo sapiens
ucuuccuagcuuaaa

SEQ ID NO: 926427 - RNA, 14 nt, Homo sapiens
uugauuuugcaaau

SEQ ID NO: 926428 - RNA, 17 nt, Homo sapiens
uugccaagaccauuuca

SEQ ID NO: 926429 - RNA, 23 nt, Homo sapiens
uugcccagcaaggaccagugaga

SEQ ID NO: 926430 - RNA, 21 nt, Homo sapiens
uugcucuggaagccugcugau

SEQ ID NO: 926431 - RNA, 14 nt, Homo sapiens
uuggccucccaaag

SEQ ID NO: 926432 - RNA, 20 nt, Homo sapiens
uuggccuuauggauuuggac

SEQ ID NO: 926433 - RNA, 14 nt, Homo sapiens
uugggaaaauauca

SEQ ID NO: 926434 - RNA, 18 nt, Homo sapiens
uugggaaaauaucacuuu

SEQ ID NO: 926435 - RNA, 22 nt, Homo sapiens
uugggagauuucauuuucuaca

SEQ ID NO: 926436 - RNA, 14 nt, Homo sapiens
uugggauuacaggu

SEQ ID NO: 926437 - RNA, 23 nt, Homo sapiens
uugggauuacaggugacugccac

SEQ ID NO: 926438 - RNA, 13 nt, Homo sapiens
uugguauucaauu

SEQ ID NO: 926439 - RNA, 21 nt, Homo sapiens
uuggucauauugccaacugga

SEQ ID NO: 926440 - RNA, 22 nt, Homo sapiens
uugguugagauaguugguucuu

SEQ ID NO: 926441 - RNA, 19 nt, Homo sapiens
uuguacaacauuguggaug

SEQ ID NO: 926442 - RNA, 16 nt, Homo sapiens
uuguacacauauacau

SEQ ID NO: 926443 - RNA, 13 nt, Homo sapiens
uuguacuuuucau

SEQ ID NO: 926444 - RNA, 19 nt, Homo sapiens
uugugugcuuuacuacaca

SEQ ID NO: 926445 - RNA, 21 nt, Homo sapiens
uuguuacccauuugaaagaau

SEQ ID NO: 926446 - RNA, 14 nt, Homo sapiens
uuguucacugugag

SEQ ID NO: 926447 - RNA, 14 nt, Homo sapiens
uuguuccacugcaa

SEQ ID NO: 926448 - RNA, 18 nt, Homo sapiens
uuguugcuguuguucaga

SEQ ID NO: 926449 - RNA, 20 nt, Homo sapiens
uuguuuuacaucuuuuggga

SEQ ID NO: 926450 - RNA, 20 nt, Homo sapiens
uuuaaacugaguagcagaaa

SEQ ID NO: 926451 - RNA, 17 nt, Homo sapiens
uuuaaguccucuaaaca

SEQ ID NO: 926452 - RNA, 21 nt, Homo sapiens
uuuaauagaaagauacaaccu

SEQ ID NO: 926453 - RNA, 21 nt, Homo sapiens
uuuaauguagccaugggacca

SEQ ID NO: 926454 - RNA, 22 nt, Homo sapiens
uuuacggugauauugugcaugc

SEQ ID NO: 926455 - RNA, 15 nt, Homo sapiens
uuuacuagugccaaa

SEQ ID NO: 926456 - RNA, 18 nt, Homo sapiens
uuuagaaucaagucugug

SEQ ID NO: 926457 - RNA, 14 nt, Homo sapiens
uuuagugggugaga

SEQ ID NO: 926458 - RNA, 20 nt, Homo sapiens
uuuauauggaguagcaaagg

SEQ ID NO: 926459 - RNA, 12 nt, Homo sapiens
uuuaugugacug

SEQ ID NO: 926460 - RNA, 18 nt, Homo sapiens
uuucaggagguacuguga

SEQ ID NO: 926461 - RNA, 12 nt, Homo sapiens
uuucaguauuag

SEQ ID NO: 926462 - RNA, 17 nt, Homo sapiens
uuuccacuccaaccaga

SEQ ID NO: 926463 - RNA, 17 nt, Homo sapiens
uuuccaucuguacuuug

SEQ ID NO: 926464 - RNA, 16 nt, Homo sapiens
uuucuaccacuggugu

SEQ ID NO: 926465 - RNA, 17 nt, Homo sapiens
uuucuccuuuaauugua

SEQ ID NO: 926466 - RNA, 21 nt, Homo sapiens
uuucuuaaguauaaaccuuau

SEQ ID NO: 926467 - RNA, 17 nt, Homo sapiens
uuucuuaaucaguguag

SEQ ID NO: 926468 - RNA, 19 nt, Homo sapiens
uuucuucaauacaaaaagc

SEQ ID NO: 926469 - RNA, 13 nt, Homo sapiens
uuucuuucaacau

SEQ ID NO: 926470 - RNA, 11 nt, Homo sapiens
uuucuuuccaa

SEQ ID NO: 926471 - RNA, 17 nt, Homo sapiens
uuucuuuuucugucucu

SEQ ID NO: 926472 - RNA, 15 nt, Homo sapiens
uuugaaacagauucu

SEQ ID NO: 926473 - RNA, 22 nt, Homo sapiens
uuugaacaacucgaaucacuca

SEQ ID NO: 926474 - RNA, 21 nt, Homo sapiens
uuugacacaagguguaacuag

SEQ ID NO: 926475 - RNA, 13 nt, Homo sapiens
uuugagcgguuga

SEQ ID NO: 926476 - RNA, 20 nt, Homo sapiens
uuugaguuuucccacauuau

SEQ ID NO: 926477 - RNA, 23 nt, Homo sapiens
uuugcaaacacugugauuacucu

SEQ ID NO: 926478 - RNA, 18 nt, Homo sapiens
uuugcagauacucgccaa

SEQ ID NO: 926479 - RNA, 9 nt, Homo sapiens
uuugccaac

SEQ ID NO: 926480 - RNA, 22 nt, Homo sapiens
uuugcuacaaauagugcuaaua

SEQ ID NO: 926481 - RNA, 18 nt, Homo sapiens
uuugcuccaccccacuca

SEQ ID NO: 926482 - RNA, 18 nt, Homo sapiens
uuuggagaacucauuuca

SEQ ID NO: 926483 - RNA, 19 nt, Homo sapiens
uuuggagaacucauuucaa

SEQ ID NO: 926484 - RNA, 20 nt, Homo sapiens
uuugggacauuugcauucaa

SEQ ID NO: 926485 - RNA, 19 nt, Homo sapiens
uuugugaagauuuaaucuc

SEQ ID NO: 926486 - RNA, 11 nt, Homo sapiens
uuugugacuuu

SEQ ID NO: 926487 - RNA, 14 nt, Homo sapiens
uuugugucugugaa

SEQ ID NO: 926488 - RNA, 18 nt, Homo sapiens
uuuuaagucacaauuuca

SEQ ID NO: 926489 - RNA, 21 nt, Homo sapiens
uuuucaagaaagcauugccag

SEQ ID NO: 926490 - RNA, 22 nt, Homo sapiens
uuuucaauaaaguacugcaaaa

SEQ ID NO: 926491 - RNA, 21 nt, Homo sapiens
uuuuccuuauuuuuacuugua

SEQ ID NO: 926492 - RNA, 16 nt, Homo sapiens
uuuucuacuuugccac

SEQ ID NO: 926493 - RNA, 13 nt, Homo sapiens
uuuugacugugau

SEQ ID NO: 926494 - RNA, 10 nt, Homo sapiens
uuuugccaac

SEQ ID NO: 926495 - RNA, 14 nt, Homo sapiens
uuuuguacugugcu

SEQ ID NO: 926496 - RNA, 22 nt, Homo sapiens
uuuuguauuuaaagcauuuuga

SEQ ID NO: 926497 - RNA, 21 nt, Homo sapiens
uuuugucuuucuauucagcaa

SEQ ID NO: 926498 - RNA, 19 nt, Homo sapiens
uuuuguguacaguaugugu

SEQ ID NO: 926499 - RNA, 19 nt, Homo sapiens
uuuugugucuaccuuguua

SEQ ID NO: 926500 - RNA, 23 nt, Homo sapiens
uuuuuaaauuugcaaaucucagg

SEQ ID NO: 926501 - RNA, 20 nt, Homo sapiens
uuuuucugaacaaaagcagg

SEQ ID NO: 926502 - RNA, 14 nt, Homo sapiens
uuuuuuaacuugaa

SEQ ID NO: 926503 - RNA, 19 nt, Homo sapiens
uaaauauagaaccaugaau

SEQ ID NO: 926504 - RNA, 13 nt, Homo sapiens
uaaauaugaagga

SEQ ID NO: 926505 - RNA, 15 nt, Homo sapiens
uaaauaugugauuau

SEQ ID NO: 926506 - RNA, 21 nt, Homo sapiens
uaaaugaauauacugucgcau

SEQ ID NO: 926507 - RNA, 13 nt, Homo sapiens
uaaaugcaaaaau

SEQ ID NO: 926508 - RNA, 20 nt, Homo sapiens
uaaaugcaauugucuuguac

SEQ ID NO: 926509 - RNA, 16 nt, Homo sapiens
uaaauggugagaauua

SEQ ID NO: 926510 - RNA, 23 nt, Homo sapiens
uaaaugugaauggaaacuuggaa

SEQ ID NO: 926511 - RNA, 13 nt, Homo sapiens
gauaaagcacugu

SEQ ID NO: 926512 - RNA, 15 nt, Homo sapiens
gauauaagaaauaca

SEQ ID NO: 926513 - RNA, 18 nt, Homo sapiens
gaucauugguaucugaua

SEQ ID NO: 926514 - RNA, 23 nt, Homo sapiens
gaucucacaaauaauaaugucag

SEQ ID NO: 926515 - RNA, 20 nt, Homo sapiens
gaucuuggggugcagcacuu

SEQ ID NO: 926516 - RNA, 15 nt, Homo sapiens
gaugaguacccaaaa

SEQ ID NO: 926517 - RNA, 19 nt, Homo sapiens
gaugcgguggcuaaagguc

SEQ ID NO: 926518 - RNA, 13 nt, Homo sapiens
gauggcugugaaa

SEQ ID NO: 926519 - RNA, 20 nt, Homo sapiens
gaugguuuuauucuuugaga

SEQ ID NO: 926520 - RNA, 14 nt, Homo sapiens
gaugugccuacucc

SEQ ID NO: 926521 - RNA, 23 nt, Homo sapiens
gaugugccuacucccaaggacac

SEQ ID NO: 926522 - RNA, 11 nt, Homo sapiens
gguugaagguc

SEQ ID NO: 926523 - RNA, 23 nt, Homo sapiens
gguuguucaaaguuuaagcaauu

SEQ ID NO: 926524 - RNA, 13 nt, Homo sapiens
gguuuccugccac

SEQ ID NO: 926525 - RNA, 19 nt, Homo sapiens
gguuucucugugcucugaa

SEQ ID NO: 926526 - RNA, 23 nt, Homo sapiens
gguuuuucccaccaauccucacc

SEQ ID NO: 926527 - RNA, 12 nt, Homo sapiens
guaaaccuggag

SEQ ID NO: 926528 - RNA, 12 nt, Homo sapiens
guaaacuugaaa

SEQ ID NO: 926529 - RNA, 13 nt, Homo sapiens
guaaagccucagc

SEQ ID NO: 926530 - RNA, 23 nt, Homo sapiens
guaaauacaauucaaacaauuca

SEQ ID NO: 926531 - RNA, 13 nt, Homo sapiens
guaaauguucaag

SEQ ID NO: 926532 - RNA, 18 nt, Homo sapiens
guaacugauaaaccaaaa
